United States Patent 11,369,692 (MATERIALS AND METHODS FOR TREATMENT OF DUCHENNE MUSCULAR DYSTROPHY) - sequence listing, part 38

SEQ ID NO: 1257700 - DNA, 22 bp, Artificial Sequence
  chemically synthesized
gaaatcctgacctcgtgatccg

SEQ ID NO: 1257701 - DNA, 22 bp, Artificial Sequence
  chemically synthesized
gggggccgaggcaggcggatca

SEQ ID NO: 1257702 - DNA, 22 bp, Artificial Sequence
  chemically synthesized
ggggggccgaggcaggcggatc

SEQ ID NO: 1257703 - DNA, 22 bp, Artificial Sequence
  chemically synthesized
tggggggccgaggcaggcggat

SEQ ID NO: 1257704 - DNA, 22 bp, Artificial Sequence
  chemically synthesized
acctcgtgatccgcctgcctcg

SEQ ID NO: 1257705 - DNA, 22 bp, Artificial Sequence
  chemically synthesized
gtgatccgcctgcctcggcccc

SEQ ID NO: 1257706 - DNA, 22 bp, Artificial Sequence
  chemically synthesized
taatcccagcactttggggggc

SEQ ID NO: 1257707 - DNA, 22 bp, Artificial Sequence
  chemically synthesized
ctgtaatcccagcactttgggg

SEQ ID NO: 1257708 - DNA, 22 bp, Artificial Sequence
  chemically synthesized
cctcggccccccaaagtgctgg

SEQ ID NO: 1257709 - DNA, 22 bp, Artificial Sequence
  chemically synthesized
actcctgtaatcccagcacttt

SEQ ID NO: 1257710 - DNA, 22 bp, Artificial Sequence
  chemically synthesized
ggccccccaaagtgctgggatt

SEQ ID NO: 1257711 - DNA, 22 bp, Artificial Sequence
  chemically synthesized
gggcggggcgcggtggctcact

SEQ ID NO: 1257712 - DNA, 22 bp, Artificial Sequence
  chemically synthesized
ggattacaggagtgagccaccg

SEQ ID NO: 1257713 - DNA, 22 bp, Artificial Sequence
  chemically synthesized
tagggcggggcgcggtggctca

SEQ ID NO: 1257714 - DNA, 22 bp, Artificial Sequence
  chemically synthesized
caggagtgagccaccgcgcccc

SEQ ID NO: 1257715 - DNA, 22 bp, Artificial Sequence
  chemically synthesized
agaaagtgtgttctagggcggg

SEQ ID NO: 1257716 - DNA, 22 bp, Artificial Sequence
  chemically synthesized
taagaaagtgtgttctagggcg

SEQ ID NO: 1257717 - DNA, 22 bp, Artificial Sequence
  chemically synthesized
ctaagaaagtgtgttctagggc

SEQ ID NO: 1257718 - DNA, 22 bp, Artificial Sequence
  chemically synthesized
tctaagaaagtgtgttctaggg

SEQ ID NO: 1257719 - DNA, 22 bp, Artificial Sequence
  chemically synthesized
aaactttctaagaaagtgtgtt

SEQ ID NO: 1257720 - DNA, 22 bp, Artificial Sequence
  chemically synthesized
gaaactttctaagaaagtgtgt

SEQ ID NO: 1257721 - DNA, 22 bp, Artificial Sequence
  chemically synthesized
tgaaactttctaagaaagtgtg

SEQ ID NO: 1257722 - DNA, 22 bp, Artificial Sequence
  chemically synthesized
gaacacactttcttagaaagtt

SEQ ID NO: 1257723 - DNA, 22 bp, Artificial Sequence
  chemically synthesized
tcttagaaagtttcaaaatatc

SEQ ID NO: 1257724 - DNA, 22 bp, Artificial Sequence
  chemically synthesized
taacagtaaaaagatattttga

SEQ ID NO: 1257725 - DNA, 22 bp, Artificial Sequence
  chemically synthesized
cttagaaagtttcaaaatatct

SEQ ID NO: 1257726 - DNA, 22 bp, Artificial Sequence
  chemically synthesized
ttagaaagtttcaaaatatctt

SEQ ID NO: 1257727 - DNA, 22 bp, Artificial Sequence
  chemically synthesized
agaaagtttcaaaatatctttt

SEQ ID NO: 1257728 - DNA, 22 bp, Artificial Sequence
  chemically synthesized
gaaagtttcaaaatatcttttt

SEQ ID NO: 1257729 - DNA, 22 bp, Artificial Sequence
  chemically synthesized
aaatactgtaacagtaaaaaga

SEQ ID NO: 1257730 - DNA, 22 bp, Artificial Sequence
  chemically synthesized
ctaaaatactgtaacagtaaaa

SEQ ID NO: 1257731 - DNA, 22 bp, Artificial Sequence
  chemically synthesized
caaaatatctttttactgttac

SEQ ID NO: 1257732 - DNA, 22 bp, Artificial Sequence
  chemically synthesized
aaaatatctttttactgttaca

SEQ ID NO: 1257733 - DNA, 22 bp, Artificial Sequence
  chemically synthesized
agattcctaaaatactgtaaca

SEQ ID NO: 1257734 - DNA, 22 bp, Artificial Sequence
  chemically synthesized
tttactgttacagtattttagg

SEQ ID NO: 1257735 - DNA, 22 bp, Artificial Sequence
  chemically synthesized
ttactgttacagtattttagga

SEQ ID NO: 1257736 - DNA, 22 bp, Artificial Sequence
  chemically synthesized
tactgttacagtattttaggaa

SEQ ID NO: 1257737 - DNA, 22 bp, Artificial Sequence
  chemically synthesized
actgttacagtattttaggaat

SEQ ID NO: 1257738 - DNA, 22 bp, Artificial Sequence
  chemically synthesized
ataagtgttcagattcctaaaa

SEQ ID NO: 1257739 - DNA, 22 bp, Artificial Sequence
  chemically synthesized
ctgttacagtattttaggaatc

SEQ ID NO: 1257740 - DNA, 22 bp, Artificial Sequence
  chemically synthesized
ctaataagtgttcagattccta

SEQ ID NO: 1257741 - DNA, 22 bp, Artificial Sequence
  chemically synthesized
ttacagtattttaggaatctga

SEQ ID NO: 1257742 - DNA, 22 bp, Artificial Sequence
  chemically synthesized
actaataagtgttcagattcct

SEQ ID NO: 1257743 - DNA, 22 bp, Artificial Sequence
  chemically synthesized
tactaataagtgttcagattcc

SEQ ID NO: 1257744 - DNA, 22 bp, Artificial Sequence
  chemically synthesized
ttactaataagtgttcagattc

SEQ ID NO: 1257745 - DNA, 22 bp, Artificial Sequence
  chemically synthesized
cagtattttaggaatctgaaca

SEQ ID NO: 1257746 - DNA, 22 bp, Artificial Sequence
  chemically synthesized
cttttactaataagtgttcaga

SEQ ID NO: 1257747 - DNA, 22 bp, Artificial Sequence
  chemically synthesized
ccttttactaataagtgttcag

SEQ ID NO: 1257748 - DNA, 22 bp, Artificial Sequence
  chemically synthesized
taggaatctgaacacttattag

SEQ ID NO: 1257749 - DNA, 22 bp, Artificial Sequence
  chemically synthesized
aggaatctgaacacttattagt

SEQ ID NO: 1257750 - DNA, 22 bp, Artificial Sequence
  chemically synthesized
atatttccttttactaataagt

SEQ ID NO: 1257751 - DNA, 22 bp, Artificial Sequence
  chemically synthesized
ggaatctgaacacttattagta

SEQ ID NO: 1257752 - DNA, 22 bp, Artificial Sequence
  chemically synthesized
aacacttattagtaaaaggaaa

SEQ ID NO: 1257753 - DNA, 22 bp, Artificial Sequence
  chemically synthesized
agagaaagcaagttcatatttc

SEQ ID NO: 1257754 - DNA, 22 bp, Artificial Sequence
  chemically synthesized
attagtaaaaggaaatatgaac

SEQ ID NO: 1257755 - DNA, 22 bp, Artificial Sequence
  chemically synthesized
gagagaaagcaagttcatattt

SEQ ID NO: 1257756 - DNA, 22 bp, Artificial Sequence
  chemically synthesized
ttagtaaaaggaaatatgaact

SEQ ID NO: 1257757 - DNA, 22 bp, Artificial Sequence
  chemically synthesized
cttgagagaaagcaagttcata

SEQ ID NO: 1257758 - DNA, 22 bp, Artificial Sequence
  chemically synthesized
gtaaaaggaaatatgaacttgc

SEQ ID NO: 1257759 - DNA, 22 bp, Artificial Sequence
  chemically synthesized
tggagaaagaaagatactactt

SEQ ID NO: 1257760 - DNA, 22 bp, Artificial Sequence
  chemically synthesized
gtggagaaagaaagatactact

SEQ ID NO: 1257761 - DNA, 22 bp, Artificial Sequence
  chemically synthesized
gctttctctcaagtagtatctt

SEQ ID NO: 1257762 - DNA, 22 bp, Artificial Sequence
  chemically synthesized
tgtggagaaagaaagatactac

SEQ ID NO: 1257763 - DNA, 22 bp, Artificial Sequence
  chemically synthesized
ctttctctcaagtagtatcttt

SEQ ID NO: 1257764 - DNA, 22 bp, Artificial Sequence
  chemically synthesized
tctctcaagtagtatctttctt

SEQ ID NO: 1257765 - DNA, 22 bp, Artificial Sequence
  chemically synthesized
ctctcaagtagtatctttcttt

SEQ ID NO: 1257766 - DNA, 22 bp, Artificial Sequence
  chemically synthesized
tctcaagtagtatctttctttc

SEQ ID NO: 1257767 - DNA, 22 bp, Artificial Sequence
  chemically synthesized
tcaagtagtatctttctttctc

SEQ ID NO: 1257768 - DNA, 22 bp, Artificial Sequence
  chemically synthesized
aagtagtatctttctttctcca

SEQ ID NO: 1257769 - DNA, 22 bp, Artificial Sequence
  chemically synthesized
agacatggctttgtggagaaag

SEQ ID NO: 1257770 - DNA, 22 bp, Artificial Sequence
  chemically synthesized
taagacatggctttgtggagaa

SEQ ID NO: 1257771 - DNA, 22 bp, Artificial Sequence
  chemically synthesized
tctttctccacaaagccatgtc

SEQ ID NO: 1257772 - DNA, 22 bp, Artificial Sequence
  chemically synthesized
aaagagctctaagacatggctt

SEQ ID NO: 1257773 - DNA, 22 bp, Artificial Sequence
  chemically synthesized
ctttctccacaaagccatgtct

SEQ ID NO: 1257774 - DNA, 22 bp, Artificial Sequence
  chemically synthesized
tttctccacaaagccatgtctt

SEQ ID NO: 1257775 - DNA, 22 bp, Artificial Sequence
  chemically synthesized
tctccacaaagccatgtcttag

SEQ ID NO: 1257776 - DNA, 22 bp, Artificial Sequence
  chemically synthesized
ctccacaaagccatgtcttaga

SEQ ID NO: 1257777 - DNA, 22 bp, Artificial Sequence
  chemically synthesized
tccacaaagccatgtcttagag

SEQ ID NO: 1257778 - DNA, 22 bp, Artificial Sequence
  chemically synthesized
cacaaagccatgtcttagagct

SEQ ID NO: 1257779 - DNA, 22 bp, Artificial Sequence
  chemically synthesized
atacccataattgaaagagctc

SEQ ID NO: 1257780 - DNA, 22 bp, Artificial Sequence
  chemically synthesized
aatacccataattgaaagagct

SEQ ID NO: 1257781 - DNA, 22 bp, Artificial Sequence
  chemically synthesized
gtttaatacccataattgaaag

SEQ ID NO: 1257782 - DNA, 22 bp, Artificial Sequence
  chemically synthesized
agagctctttcaattatgggta

SEQ ID NO: 1257783 - DNA, 22 bp, Artificial Sequence
  chemically synthesized
gagctctttcaattatgggtat

SEQ ID NO: 1257784 - DNA, 22 bp, Artificial Sequence
  chemically synthesized
gtcatactggtttaatacccat

SEQ ID NO: 1257785 - DNA, 22 bp, Artificial Sequence
  chemically synthesized
tggtcatactggtttaataccc

SEQ ID NO: 1257786 - DNA, 22 bp, Artificial Sequence
  chemically synthesized
tttcaattatgggtattaaacc

SEQ ID NO: 1257787 - DNA, 22 bp, Artificial Sequence
  chemically synthesized
tcaattatgggtattaaaccag

SEQ ID NO: 1257788 - DNA, 22 bp, Artificial Sequence
  chemically synthesized
caattatgggtattaaaccagt

SEQ ID NO: 1257789 - DNA, 22 bp, Artificial Sequence
  chemically synthesized
aattatgggtattaaaccagta

SEQ ID NO: 1257790 - DNA, 22 bp, Artificial Sequence
  chemically synthesized
agattctggtcatactggttta

SEQ ID NO: 1257791 - DNA, 22 bp, Artificial Sequence
  chemically synthesized
tctgagattctggtcatactgg

SEQ ID NO: 1257792 - DNA, 22 bp, Artificial Sequence
  chemically synthesized
tgggtattaaaccagtatgacc

SEQ ID NO: 1257793 - DNA, 22 bp, Artificial Sequence
  chemically synthesized
ttgtctgagattctggtcatac

SEQ ID NO: 1257794 - DNA, 22 bp, Artificial Sequence
  chemically synthesized
aaccagtatgaccagaatctca

SEQ ID NO: 1257795 - DNA, 22 bp, Artificial Sequence
  chemically synthesized
tgtggacaggatagtgtctgtt

SEQ ID NO: 1257796 - DNA, 22 bp, Artificial Sequence
  chemically synthesized
tgtgtggacaggatagtgtctg

SEQ ID NO: 1257797 - DNA, 22 bp, Artificial Sequence
  chemically synthesized
gctctgtgtggacaggatagtg

SEQ ID NO: 1257798 - DNA, 22 bp, Artificial Sequence
  chemically synthesized
agacaacagacactatcctgtc

SEQ ID NO: 1257799 - DNA, 22 bp, Artificial Sequence
  chemically synthesized
tcctgtccacacagagctaatg

SEQ ID NO: 1257800 - DNA, 22 bp, Artificial Sequence
  chemically synthesized
cagacagggataaacattagct

SEQ ID NO: 1257801 - DNA, 22 bp, Artificial Sequence
  chemically synthesized
tccacacagagctaatgtttat

SEQ ID NO: 1257802 - DNA, 22 bp, Artificial Sequence
  chemically synthesized
atgaagactgcagacagggata

SEQ ID NO: 1257803 - DNA, 22 bp, Artificial Sequence
  chemically synthesized
ttgatgaagactgcagacaggg

SEQ ID NO: 1257804 - DNA, 22 bp, Artificial Sequence
  chemically synthesized
atgtttatccctgtctgcagtc

SEQ ID NO: 1257805 - DNA, 22 bp, Artificial Sequence
  chemically synthesized
caaactgttgatgaagactgca

SEQ ID NO: 1257806 - DNA, 22 bp, Artificial Sequence
  chemically synthesized
ccaaactgttgatgaagactgc

SEQ ID NO: 1257807 - DNA, 22 bp, Artificial Sequence
  chemically synthesized
tccaaactgttgatgaagactg

SEQ ID NO: 1257808 - DNA, 22 bp, Artificial Sequence
  chemically synthesized
atccctgtctgcagtcttcatc

SEQ ID NO: 1257809 - DNA, 22 bp, Artificial Sequence
  chemically synthesized
tccctgtctgcagtcttcatca

SEQ ID NO: 1257810 - DNA, 22 bp, Artificial Sequence
  chemically synthesized
ctttccaaactgttgatgaaga

SEQ ID NO: 1257811 - DNA, 22 bp, Artificial Sequence
  chemically synthesized
cctttccaaactgttgatgaag

SEQ ID NO: 1257812 - DNA, 22 bp, Artificial Sequence
  chemically synthesized
tcctttccaaactgttgatgaa

SEQ ID NO: 1257813 - DNA, 22 bp, Artificial Sequence
  chemically synthesized
ttcctttccaaactgttgatga

SEQ ID NO: 1257814 - DNA, 22 bp, Artificial Sequence
  chemically synthesized
tctgcagtcttcatcaacagtt

SEQ ID NO: 1257815 - DNA, 22 bp, Artificial Sequence
  chemically synthesized
cagtcttcatcaacagtttgga

SEQ ID NO: 1257816 - DNA, 22 bp, Artificial Sequence
  chemically synthesized
catcaacagtttggaaaggaaa

SEQ ID NO: 1257817 - DNA, 22 bp, Artificial Sequence
  chemically synthesized
atcaacagtttggaaaggaaaa

SEQ ID NO: 1257818 - DNA, 22 bp, Artificial Sequence
  chemically synthesized
aaatagcgagggtgacttttcc

SEQ ID NO: 1257819 - DNA, 22 bp, Artificial Sequence
  chemically synthesized
ggaaaggaaaagtcaccctcgc

SEQ ID NO: 1257820 - DNA, 22 bp, Artificial Sequence
  chemically synthesized
gaaaggaaaagtcaccctcgct

SEQ ID NO: 1257821 - DNA, 22 bp, Artificial Sequence
  chemically synthesized
aaatattgaaatagcgagggtg

SEQ ID NO: 1257822 - DNA, 22 bp, Artificial Sequence
  chemically synthesized
aaaatattgaaatagcgagggt

SEQ ID NO: 1257823 - DNA, 22 bp, Artificial Sequence
  chemically synthesized
gtaaaatgtgtcagcttaaaat

SEQ ID NO: 1257824 - DNA, 22 bp, Artificial Sequence
  chemically synthesized
gctatttcaatattttaagctg

SEQ ID NO: 1257825 - DNA, 22 bp, Artificial Sequence
  chemically synthesized
tttcaatattttaagctgacac

SEQ ID NO: 1257826 - DNA, 22 bp, Artificial Sequence
  chemically synthesized
caatattttaagctgacacatt

SEQ ID NO: 1257827 - DNA, 22 bp, Artificial Sequence
  chemically synthesized
aatattttaagctgacacattt

SEQ ID NO: 1257828 - DNA, 22 bp, Artificial Sequence
  chemically synthesized
taagctgacacattttacgaat

SEQ ID NO: 1257829 - DNA, 22 bp, Artificial Sequence
  chemically synthesized
gagtgtaaaggaattcgtaaaa

SEQ ID NO: 1257830 - DNA, 22 bp, Artificial Sequence
  chemically synthesized
aagctgacacattttacgaatt

SEQ ID NO: 1257831 - DNA, 22 bp, Artificial Sequence
  chemically synthesized
agagtgtaaaggaattcgtaaa

SEQ ID NO: 1257832 - DNA, 22 bp, Artificial Sequence
  chemically synthesized
agctgacacattttacgaattc

SEQ ID NO: 1257833 - DNA, 22 bp, Artificial Sequence
  chemically synthesized
tagagtgtaaaggaattcgtaa

SEQ ID NO: 1257834 - DNA, 22 bp, Artificial Sequence
  chemically synthesized
ttagagtgtaaaggaattcgta

SEQ ID NO: 1257835 - DNA, 22 bp, Artificial Sequence
  chemically synthesized
acacattttacgaattccttta

SEQ ID NO: 1257836 - DNA, 22 bp, Artificial Sequence
  chemically synthesized
tacgaattcctttacactctaa

SEQ ID NO: 1257837 - DNA, 22 bp, Artificial Sequence
  chemically synthesized
acgaattcctttacactctaaa

SEQ ID NO: 1257838 - DNA, 22 bp, Artificial Sequence
  chemically synthesized
cgaattcctttacactctaaaa

SEQ ID NO: 1257839 - DNA, 22 bp, Artificial Sequence
  chemically synthesized
ataaatatatagaccactttta

SEQ ID NO: 1257840 - DNA, 22 bp, Artificial Sequence
  chemically synthesized
ctttacactctaaaagtggtct

SEQ ID NO: 1257841 - DNA, 22 bp, Artificial Sequence
  chemically synthesized
tctaataaatatatagaccact

SEQ ID NO: 1257842 - DNA, 22 bp, Artificial Sequence
  chemically synthesized
tacactctaaaagtggtctata

SEQ ID NO: 1257843 - DNA, 22 bp, Artificial Sequence
  chemically synthesized
acactctaaaagtggtctatat

SEQ ID NO: 1257844 - DNA, 22 bp, Artificial Sequence
  chemically synthesized
cactctaaaagtggtctatata

SEQ ID NO: 1257845 - DNA, 22 bp, Artificial Sequence
  chemically synthesized
taaaagtggtctatatatttat

SEQ ID NO: 1257846 - DNA, 22 bp, Artificial Sequence
  chemically synthesized
aaagtggtctatatatttatta

SEQ ID NO: 1257847 - DNA, 22 bp, Artificial Sequence
  chemically synthesized
agaagtcctatctaataaatat

SEQ ID NO: 1257848 - DNA, 22 bp, Artificial Sequence
  chemically synthesized
gagaagtcctatctaataaata

SEQ ID NO: 1257849 - DNA, 22 bp, Artificial Sequence
  chemically synthesized
tatatttattagataggacttc

SEQ ID NO: 1257850 - DNA, 22 bp, Artificial Sequence
  chemically synthesized
tatcatgccttgagaagtccta

SEQ ID NO: 1257851 - DNA, 22 bp, Artificial Sequence
  chemically synthesized
ggctatatcatgccttgagaag

SEQ ID NO: 1257852 - DNA, 22 bp, Artificial Sequence
  chemically synthesized
attagataggacttctcaaggc

SEQ ID NO: 1257853 - DNA, 22 bp, Artificial Sequence
  chemically synthesized
ttagataggacttctcaaggca

SEQ ID NO: 1257854 - DNA, 22 bp, Artificial Sequence
  chemically synthesized
taggctatatcatgccttgaga

SEQ ID NO: 1257855 - DNA, 22 bp, Artificial Sequence
  chemically synthesized
gataggacttctcaaggcatga

SEQ ID NO: 1257856 - DNA, 22 bp, Artificial Sequence
  chemically synthesized
cagaaaattctaggctatatca

SEQ ID NO: 1257857 - DNA, 22 bp, Artificial Sequence
  chemically synthesized
ctcaaggcatgatatagcctag

SEQ ID NO: 1257858 - DNA, 22 bp, Artificial Sequence
  chemically synthesized
tcaaggcatgatatagcctaga

SEQ ID NO: 1257859 - DNA, 22 bp, Artificial Sequence
  chemically synthesized
aaggcatgatatagcctagaat

SEQ ID NO: 1257860 - DNA, 22 bp, Artificial Sequence
  chemically synthesized
agaggttccagaaaattctagg

SEQ ID NO: 1257861 - DNA, 22 bp, Artificial Sequence
  chemically synthesized
gaattttctggaacctctgaat

SEQ ID NO: 1257862 - DNA, 22 bp, Artificial Sequence
  chemically synthesized
agtgtcaataaaggattcagag

SEQ ID NO: 1257863 - DNA, 22 bp, Artificial Sequence
  chemically synthesized
cagtgtcaataaaggattcaga

SEQ ID NO: 1257864 - DNA, 22 bp, Artificial Sequence
  chemically synthesized
tctggaacctctgaatccttta

SEQ ID NO: 1257865 - DNA, 22 bp, Artificial Sequence
  chemically synthesized
ctggaacctctgaatcctttat

SEQ ID NO: 1257866 - DNA, 22 bp, Artificial Sequence
  chemically synthesized
tggaacctctgaatcctttatt

SEQ ID NO: 1257867 - DNA, 22 bp, Artificial Sequence
  chemically synthesized
gaacctctgaatcctttattga

SEQ ID NO: 1257868 - DNA, 22 bp, Artificial Sequence
  chemically synthesized
tcatggaccttcagtgtcaata

SEQ ID NO: 1257869 - DNA, 22 bp, Artificial Sequence
  chemically synthesized
tgaatcctttattgacactgaa

SEQ ID NO: 1257870 - DNA, 22 bp, Artificial Sequence
  chemically synthesized
aatcctttattgacactgaagg

SEQ ID NO: 1257871 - DNA, 22 bp, Artificial Sequence
  chemically synthesized
caggcactatcatggaccttca

SEQ ID NO: 1257872 - DNA, 22 bp, Artificial Sequence
  chemically synthesized
gcaggcactatcatggaccttc

SEQ ID NO: 1257873 - DNA, 22 bp, Artificial Sequence
  chemically synthesized
tgcaggcactatcatggacctt

SEQ ID NO: 1257874 - DNA, 22 bp, Artificial Sequence
  chemically synthesized
tattgacactgaaggtccatga

SEQ ID NO: 1257875 - DNA, 22 bp, Artificial Sequence
  chemically synthesized
attgacactgaaggtccatgat

SEQ ID NO: 1257876 - DNA, 22 bp, Artificial Sequence
  chemically synthesized
ttgacactgaaggtccatgata

SEQ ID NO: 1257877 - DNA, 22 bp, Artificial Sequence
  chemically synthesized
acactgaaggtccatgatagtg

SEQ ID NO: 1257878 - DNA, 22 bp, Artificial Sequence
  chemically synthesized
aatcattttgcaggcactatca

SEQ ID NO: 1257879 - DNA, 22 bp, Artificial Sequence
  chemically synthesized
ttcaatcattttgcaggcacta

SEQ ID NO: 1257880 - DNA, 22 bp, Artificial Sequence
  chemically synthesized
aaggtccatgatagtgcctgca

SEQ ID NO: 1257881 - DNA, 22 bp, Artificial Sequence
  chemically synthesized
gtattgttcaatcattttgcag

SEQ ID NO: 1257882 - DNA, 22 bp, Artificial Sequence
  chemically synthesized
agtattgttcaatcattttgca

SEQ ID NO: 1257883 - DNA, 22 bp, Artificial Sequence
  chemically synthesized
caagatttagtattgttcaatc

SEQ ID NO: 1257884 - DNA, 22 bp, Artificial Sequence
  chemically synthesized
acaagatttagtattgttcaat

SEQ ID NO: 1257885 - DNA, 22 bp, Artificial Sequence
  chemically synthesized
tttacaagatttagtattgttc

SEQ ID NO: 1257886 - DNA, 22 bp, Artificial Sequence
  chemically synthesized
caaaatgattgaacaatactaa

SEQ ID NO: 1257887 - DNA, 22 bp, Artificial Sequence
  chemically synthesized
aacaatactaaatcttgtaaac

SEQ ID NO: 1257888 - DNA, 22 bp, Artificial Sequence
  chemically synthesized
caaatataatgtgaaattgttt

SEQ ID NO: 1257889 - DNA, 22 bp, Artificial Sequence
  chemically synthesized
aatcttgtaaacaatttcacat

SEQ ID NO: 1257890 - DNA, 22 bp, Artificial Sequence
  chemically synthesized
gtaaacaatttcacattatatt

SEQ ID NO: 1257891 - DNA, 22 bp, Artificial Sequence
  chemically synthesized
tggtacattacaaatataatgt

SEQ ID NO: 1257892 - DNA, 22 bp, Artificial Sequence
  chemically synthesized
taaacaatttcacattatattt

SEQ ID NO: 1257893 - DNA, 22 bp, Artificial Sequence
  chemically synthesized
cacattatatttgtaatgtacc

SEQ ID NO: 1257894 - DNA, 22 bp, Artificial Sequence
  chemically synthesized
acattatatttgtaatgtacca

SEQ ID NO: 1257895 - DNA, 22 bp, Artificial Sequence
  chemically synthesized
ataagatcaatgactgtggtac

SEQ ID NO: 1257896 - DNA, 22 bp, Artificial Sequence
  chemically synthesized
tatttgtaatgtaccacagtca

SEQ ID NO: 1257897 - DNA, 22 bp, Artificial Sequence
  chemically synthesized
gtaatgtaccacagtcattgat

SEQ ID NO: 1257898 - DNA, 22 bp, Artificial Sequence
  chemically synthesized
taatgtaccacagtcattgatc

SEQ ID NO: 1257899 - DNA, 22 bp, Artificial Sequence
  chemically synthesized
accatcattcataagatcaatg

SEQ ID NO: 1257900 - DNA, 22 bp, Artificial Sequence
  chemically synthesized
caccatcattcataagatcaat

SEQ ID NO: 1257901 - DNA, 22 bp, Artificial Sequence
  chemically synthesized
ccaccgccagtttcaccatcat

SEQ ID NO: 1257902 - DNA, 22 bp, Artificial Sequence
  chemically synthesized
cccaccgccagtttcaccatca

SEQ ID NO: 1257903 - DNA, 22 bp, Artificial Sequence
  chemically synthesized
tcccaccgccagtttcaccatc

SEQ ID NO: 1257904 - DNA, 22 bp, Artificial Sequence
  chemically synthesized
atcttatgaatgatggtgaaac

SEQ ID NO: 1257905 - DNA, 22 bp, Artificial Sequence
  chemically synthesized
tttcccaccgccagtttcacca

SEQ ID NO: 1257906 - DNA, 22 bp, Artificial Sequence
  chemically synthesized
tctttcccaccgccagtttcac

SEQ ID NO: 1257907 - DNA, 22 bp, Artificial Sequence
  chemically synthesized
atgaatgatggtgaaactggcg

SEQ ID NO: 1257908 - DNA, 22 bp, Artificial Sequence
  chemically synthesized
tgaatgatggtgaaactggcgg

SEQ ID NO: 1257909 - DNA, 22 bp, Artificial Sequence
  chemically synthesized
cctctctttcccaccgccagtt

SEQ ID NO: 1257910 - DNA, 22 bp, Artificial Sequence
  chemically synthesized
acctctctttcccaccgccagt

SEQ ID NO: 1257911 - DNA, 22 bp, Artificial Sequence
  chemically synthesized
tgtttacctctctttcccaccg

SEQ ID NO: 1257912 - DNA, 22 bp, Artificial Sequence
  chemically synthesized
gtgtttacctctctttcccacc

SEQ ID NO: 1257913 - DNA, 22 bp, Artificial Sequence
  chemically synthesized
tgtgtttacctctctttcccac

SEQ ID NO: 1257914 - DNA, 22 bp, Artificial Sequence
  chemically synthesized
ttgtgtttacctctctttccca

SEQ ID NO: 1257915 - DNA, 22 bp, Artificial Sequence
  chemically synthesized
gcggtgggaaagagaggtaaac

SEQ ID NO: 1257916 - DNA, 22 bp, Artificial Sequence
  chemically synthesized
ggatacacatttttgtgtttac

SEQ ID NO: 1257917 - DNA, 22 bp, Artificial Sequence
  chemically synthesized
gtgttaggatacacatttttgt

SEQ ID NO: 1257918 - DNA, 22 bp, Artificial Sequence
  chemically synthesized
agtgttaggatacacatttttg

SEQ ID NO: 1257919 - DNA, 22 bp, Artificial Sequence
  chemically synthesized
gtttagtgttaggatacacatt

SEQ ID NO: 1257920 - DNA, 22 bp, Artificial Sequence
  chemically synthesized
aaactggtttagtgttaggata

SEQ ID NO: 1257921 - DNA, 22 bp, Artificial Sequence
  chemically synthesized
gaaactggtttagtgttaggat

SEQ ID NO: 1257922 - DNA, 22 bp, Artificial Sequence
  chemically synthesized
tgaaactggtttagtgttagga

SEQ ID NO: 1257923 - DNA, 22 bp, Artificial Sequence
  chemically synthesized
ttgaaactggtttagtgttagg

SEQ ID NO: 1257924 - DNA, 22 bp, Artificial Sequence
  chemically synthesized
ggagcacagccttttgaaactg

SEQ ID NO: 1257925 - DNA, 22 bp, Artificial Sequence
  chemically synthesized
gggagcacagccttttgaaact

SEQ ID NO: 1257926 - DNA, 22 bp, Artificial Sequence
  chemically synthesized
acactaaaccagtttcaaaagg

SEQ ID NO: 1257927 - DNA, 22 bp, Artificial Sequence
  chemically synthesized
aaccagtttcaaaaggctgtgc

SEQ ID NO: 1257928 - DNA, 22 bp, Artificial Sequence
  chemically synthesized
ggataacttgggagcacagcct

SEQ ID NO: 1257929 - DNA, 22 bp, Artificial Sequence
  chemically synthesized
tggctaggataacttgggagca

SEQ ID NO: 1257930 - DNA, 22 bp, Artificial Sequence
  chemically synthesized
caaaaggctgtgctcccaagtt

SEQ ID NO: 1257931 - DNA, 22 bp, Artificial Sequence
  chemically synthesized
aaaaggctgtgctcccaagtta

SEQ ID NO: 1257932 - DNA, 22 bp, Artificial Sequence
  chemically synthesized
tgctcccaagttatcctagcca

SEQ ID NO: 1257933 - DNA, 22 bp, Artificial Sequence
  chemically synthesized
ccaagttatcctagccataaca

SEQ ID NO: 1257934 - DNA, 22 bp, Artificial Sequence
  chemically synthesized
tcctagccataacatgttctga

SEQ ID NO: 1257935 - DNA, 22 bp, Artificial Sequence
  chemically synthesized
atgtgaaagtaagaaatcagaa

SEQ ID NO: 1257936 - DNA, 22 bp, Artificial Sequence
  chemically synthesized
gccataacatgttctgatttct

SEQ ID NO: 1257937 - DNA, 22 bp, Artificial Sequence
  chemically synthesized
aatgtgaaagtaagaaatcaga

SEQ ID NO: 1257938 - DNA, 22 bp, Artificial Sequence
  chemically synthesized
tacagagtttaatgtgaaagta

SEQ ID NO: 1257939 - DNA, 22 bp, Artificial Sequence
  chemically synthesized
tgatttcttactttcacattaa

SEQ ID NO: 1257940 - DNA, 22 bp, Artificial Sequence
  chemically synthesized
atttcttactttcacattaaac

SEQ ID NO: 1257941 - DNA, 22 bp, Artificial Sequence
  chemically synthesized
cttactttcacattaaactctg

SEQ ID NO: 1257942 - DNA, 22 bp, Artificial Sequence
  chemically synthesized
caatatactatacagagtttaa

SEQ ID NO: 1257943 - DNA, 22 bp, Artificial Sequence
  chemically synthesized
ttactttcacattaaactctgt

SEQ ID NO: 1257944 - DNA, 22 bp, Artificial Sequence
  chemically synthesized
tacaatatactatacagagttt

SEQ ID NO: 1257945 - DNA, 22 bp, Artificial Sequence
  chemically synthesized
actttcacattaaactctgtat

SEQ ID NO: 1257946 - DNA, 22 bp, Artificial Sequence
  chemically synthesized
ctttcacattaaactctgtata

SEQ ID NO: 1257947 - DNA, 22 bp, Artificial Sequence
  chemically synthesized
tcacattaaactctgtatagta

SEQ ID NO: 1257948 - DNA, 22 bp, Artificial Sequence
  chemically synthesized
agttctacaatatactatacag

SEQ ID NO: 1257949 - DNA, 22 bp, Artificial Sequence
  chemically synthesized
cacattaaactctgtatagtat

SEQ ID NO: 1257950 - DNA, 22 bp, Artificial Sequence
  chemically synthesized
acattaaactctgtatagtata

SEQ ID NO: 1257951 - DNA, 22 bp, Artificial Sequence
  chemically synthesized
aactctgtatagtatattgtag

SEQ ID NO: 1257952 - DNA, 22 bp, Artificial Sequence
  chemically synthesized
tgtatagtatattgtagaactt

SEQ ID NO: 1257953 - DNA, 22 bp, Artificial Sequence
  chemically synthesized
gcagatatgaattaagttctac

SEQ ID NO: 1257954 - DNA, 22 bp, Artificial Sequence
  chemically synthesized
tatagtatattgtagaacttaa

SEQ ID NO: 1257955 - DNA, 22 bp, Artificial Sequence
  chemically synthesized
agcagatatgaattaagttcta

SEQ ID NO: 1257956 - DNA, 22 bp, Artificial Sequence
  chemically synthesized
atttagcagatatgaattaagt

SEQ ID NO: 1257957 - DNA, 22 bp, Artificial Sequence
  chemically synthesized
aatttagcagatatgaattaag

SEQ ID NO: 1257958 - DNA, 22 bp, Artificial Sequence
  chemically synthesized
atttaatttagcagatatgaat

SEQ ID NO: 1257959 - DNA, 22 bp, Artificial Sequence
  chemically synthesized
tagaacttaattcatatctgct

SEQ ID NO: 1257960 - DNA, 22 bp, Artificial Sequence
  chemically synthesized
actcatttaatttagcagatat

SEQ ID NO: 1257961 - DNA, 22 bp, Artificial Sequence
  chemically synthesized
aattcatatctgctaaattaaa

SEQ ID NO: 1257962 - DNA, 22 bp, Artificial Sequence
  chemically synthesized
tgtattcactcatttaatttag

SEQ ID NO: 1257963 - DNA, 22 bp, Artificial Sequence
  chemically synthesized
attcatatctgctaaattaaat

SEQ ID NO: 1257964 - DNA, 22 bp, Artificial Sequence
  chemically synthesized
atgtattcactcatttaattta

SEQ ID NO: 1257965 - DNA, 22 bp, Artificial Sequence
  chemically synthesized
tatgtattcactcatttaattt

SEQ ID NO: 1257966 - DNA, 22 bp, Artificial Sequence
  chemically synthesized
atatctgctaaattaaatgagt

SEQ ID NO: 1257967 - DNA, 22 bp, Artificial Sequence
  chemically synthesized
cgttttatgtattcactcattt

SEQ ID NO: 1257968 - DNA, 22 bp, Artificial Sequence
  chemically synthesized
ccgttttatgtattcactcatt

SEQ ID NO: 1257969 - DNA, 22 bp, Artificial Sequence
  chemically synthesized
tccgttttatgtattcactcat

SEQ ID NO: 1257970 - DNA, 22 bp, Artificial Sequence
  chemically synthesized
ctaaattaaatgagtgaataca

SEQ ID NO: 1257971 - DNA, 22 bp, Artificial Sequence
  chemically synthesized
agttttccgttttatgtattca

SEQ ID NO: 1257972 - DNA, 22 bp, Artificial Sequence
  chemically synthesized
aattaaatgagtgaatacataa

SEQ ID NO: 1257973 - DNA, 22 bp, Artificial Sequence
  chemically synthesized
cctcagttttccgttttatgta

SEQ ID NO: 1257974 - DNA, 22 bp, Artificial Sequence
  chemically synthesized
acctcagttttccgttttatgt

SEQ ID NO: 1257975 - DNA, 22 bp, Artificial Sequence
  chemically synthesized
aatgagtgaatacataaaacgg

SEQ ID NO: 1257976 - DNA, 22 bp, Artificial Sequence
  chemically synthesized
gtgtaagtagtacacaatttac

SEQ ID NO: 1257977 - DNA, 22 bp, Artificial Sequence
  chemically synthesized
agtgtaagtagtacacaattta

SEQ ID NO: 1257978 - DNA, 22 bp, Artificial Sequence
  chemically synthesized
atttagtgtaagtagtacacaa

SEQ ID NO: 1257979 - DNA, 22 bp, Artificial Sequence
  chemically synthesized
gatttagtgtaagtagtacaca

SEQ ID NO: 1257980 - DNA, 22 bp, Artificial Sequence
  chemically synthesized
tgatttagtgtaagtagtacac

SEQ ID NO: 1257981 - DNA, 22 bp, Artificial Sequence
  chemically synthesized
aggtaaattgtgtactacttac

SEQ ID NO: 1257982 - DNA, 22 bp, Artificial Sequence
  chemically synthesized
tactttgatttagtgtaagtag

SEQ ID NO: 1257983 - DNA, 22 bp, Artificial Sequence
  chemically synthesized
aggctgtactttgatttagtgt

SEQ ID NO: 1257984 - DNA, 22 bp, Artificial Sequence
  chemically synthesized
aaggctgtactttgatttagtg

SEQ ID NO: 1257985 - DNA, 22 bp, Artificial Sequence
  chemically synthesized
tgtactacttacactaaatcaa

SEQ ID NO: 1257986 - DNA, 22 bp, Artificial Sequence
  chemically synthesized
taaggctgtactttgatttagt

SEQ ID NO: 1257987 - DNA, 22 bp, Artificial Sequence
  chemically synthesized
ctttaaggctgtactttgattt

SEQ ID NO: 1257988 - DNA, 22 bp, Artificial Sequence
  chemically synthesized
cttacactaaatcaaagtacag

SEQ ID NO: 1257989 - DNA, 22 bp, Artificial Sequence
  chemically synthesized
acactaaatcaaagtacagcct

SEQ ID NO: 1257990 - DNA, 22 bp, Artificial Sequence
  chemically synthesized
cactaaatcaaagtacagcctt

SEQ ID NO: 1257991 - DNA, 22 bp, Artificial Sequence
  chemically synthesized
aatgtatattcctttaaggctg

SEQ ID NO: 1257992 - DNA, 22 bp, Artificial Sequence
  chemically synthesized
aatcaaagtacagccttaaagg

SEQ ID NO: 1257993 - DNA, 22 bp, Artificial Sequence
  chemically synthesized
ttaaatgtatattcctttaagg

SEQ ID NO: 1257994 - DNA, 22 bp, Artificial Sequence
  chemically synthesized
attattaaatgtatattccttt

SEQ ID NO: 1257995 - DNA, 22 bp, Artificial Sequence
  chemically synthesized
ataaaactcattattaaatgta

SEQ ID NO: 1257996 - DNA, 22 bp, Artificial Sequence
  chemically synthesized
aataaaactcattattaaatgt

SEQ ID NO: 1257997 - DNA, 22 bp, Artificial Sequence
  chemically synthesized
aaaggaatatacatttaataat

SEQ ID NO: 1257998 - DNA, 22 bp, Artificial Sequence
  chemically synthesized
aaggaatatacatttaataatg

SEQ ID NO: 1257999 - DNA, 22 bp, Artificial Sequence
  chemically synthesized
tttaataaaactcattattaaa

SEQ ID NO: 1258000 - DNA, 22 bp, Artificial Sequence
  chemically synthesized
atttaataaaactcattattaa

SEQ ID NO: 1258001 - DNA, 22 bp, Artificial Sequence
  chemically synthesized
tatttaataaaactcattatta

SEQ ID NO: 1258002 - DNA, 22 bp, Artificial Sequence
  chemically synthesized
ttatttaataaaactcattatt

SEQ ID NO: 1258003 - DNA, 22 bp, Artificial Sequence
  chemically synthesized
tttttatttaataaaactcatt

SEQ ID NO: 1258004 - DNA, 22 bp, Artificial Sequence
  chemically synthesized
aataatgagttttattaaataa

SEQ ID NO: 1258005 - DNA, 22 bp, Artificial Sequence
  chemically synthesized
ataatgagttttattaaataaa

SEQ ID NO: 1258006 - DNA, 22 bp, Artificial Sequence
  chemically synthesized
gaatacattatttttatttaat

SEQ ID NO: 1258007 - DNA, 22 bp, Artificial Sequence
  chemically synthesized
agaatacattatttttatttaa

SEQ ID NO: 1258008 - DNA, 22 bp, Artificial Sequence
  chemically synthesized
tttagaatacattatttttatt

SEQ ID NO: 1258009 - DNA, 22 bp, Artificial Sequence
  chemically synthesized
tattaaataaaaataatgtatt

SEQ ID NO: 1258010 - DNA, 22 bp, Artificial Sequence
  chemically synthesized
attaaataaaaataatgtattc

SEQ ID NO: 1258011 - DNA, 22 bp, Artificial Sequence
  chemically synthesized
ttaaataaaaataatgtattct

SEQ ID NO: 1258012 - DNA, 22 bp, Artificial Sequence
  chemically synthesized
aataaaaataatgtattctaaa

SEQ ID NO: 1258013 - DNA, 22 bp, Artificial Sequence
  chemically synthesized
aatgcagacaattgtttagaat

SEQ ID NO: 1258014 - DNA, 22 bp, Artificial Sequence
  chemically synthesized
aaatgcagacaattgtttagaa

SEQ ID NO: 1258015 - DNA, 22 bp, Artificial Sequence
  chemically synthesized
taaatgcagacaattgtttaga

SEQ ID NO: 1258016 - DNA, 22 bp, Artificial Sequence
  chemically synthesized
gcaagttttaaatgcagacaat

SEQ ID NO: 1258017 - DNA, 22 bp, Artificial Sequence
  chemically synthesized
cattggcaagttttaaatgcag

SEQ ID NO: 1258018 - DNA, 22 bp, Artificial Sequence
  chemically synthesized
taaacaattgtctgcatttaaa

SEQ ID NO: 1258019 - DNA, 22 bp, Artificial Sequence
  chemically synthesized
aacaattgtctgcatttaaaac

SEQ ID NO: 1258020 - DNA, 22 bp, Artificial Sequence
  chemically synthesized
atggttccattggcaagtttta

SEQ ID NO: 1258021 - DNA, 22 bp, Artificial Sequence
  chemically synthesized
catggttccattggcaagtttt

SEQ ID NO: 1258022 - DNA, 22 bp, Artificial Sequence
  chemically synthesized
tcatggttccattggcaagttt

SEQ ID NO: 1258023 - DNA, 22 bp, Artificial Sequence
  chemically synthesized
ttcatggttccattggcaagtt

SEQ ID NO: 1258024 - DNA, 22 bp, Artificial Sequence
  chemically synthesized
tctgcatttaaaacttgccaat

SEQ ID NO: 1258025 - DNA, 22 bp, Artificial Sequence
  chemically synthesized
tttcatggttccattggcaagt

SEQ ID NO: 1258026 - DNA, 22 bp, Artificial Sequence
  chemically synthesized
catttaaaacttgccaatggaa

SEQ ID NO: 1258027 - DNA, 22 bp, Artificial Sequence
  chemically synthesized
ggcattttttcatggttccatt

SEQ ID NO: 1258028 - DNA, 22 bp, Artificial Sequence
  chemically synthesized
gggcattttttcatggttccat

SEQ ID NO: 1258029 - DNA, 22 bp, Artificial Sequence
  chemically synthesized
aaaacttgccaatggaaccatg

SEQ ID NO: 1258030 - DNA, 22 bp, Artificial Sequence
  chemically synthesized
aaacttgccaatggaaccatga

SEQ ID NO: 1258031 - DNA, 22 bp, Artificial Sequence
  chemically synthesized
gccaatggaaccatgaaaaaat

SEQ ID NO: 1258032 - DNA, 22 bp, Artificial Sequence
  chemically synthesized
ccaatggaaccatgaaaaaatg

SEQ ID NO: 1258033 - DNA, 22 bp, Artificial Sequence
  chemically synthesized
atgaaaaatgagtttgggcatt

SEQ ID NO: 1258034 - DNA, 22 bp, Artificial Sequence
  chemically synthesized
cattaatgaaaaatgagtttgg

SEQ ID NO: 1258035 - DNA, 22 bp, Artificial Sequence
  chemically synthesized
aattgcattaatgaaaaatgag

SEQ ID NO: 1258036 - DNA, 22 bp, Artificial Sequence
  chemically synthesized
gaattgcattaatgaaaaatga

SEQ ID NO: 1258037 - DNA, 22 bp, Artificial Sequence
  chemically synthesized
tgaattgcattaatgaaaaatg

SEQ ID NO: 1258038 - DNA, 22 bp, Artificial Sequence
  chemically synthesized
ctttgaattgcattaatgaaaa

SEQ ID NO: 1258039 - DNA, 22 bp, Artificial Sequence
  chemically synthesized
actttgaattgcattaatgaaa

SEQ ID NO: 1258040 - DNA, 22 bp, Artificial Sequence
  chemically synthesized
tggatttactttgaattgcatt

SEQ ID NO: 1258041 - DNA, 22 bp, Artificial Sequence
  chemically synthesized
atttttcattaatgcaattcaa

SEQ ID NO: 1258042 - DNA, 22 bp, Artificial Sequence
  chemically synthesized
gctgtggatttactttgaattg

SEQ ID NO: 1258043 - DNA, 22 bp, Artificial Sequence
  chemically synthesized
ttcattaatgcaattcaaagta

SEQ ID NO: 1258044 - DNA, 22 bp, Artificial Sequence
  chemically synthesized
tagctgtggatttactttgaat

SEQ ID NO: 1258045 - DNA, 22 bp, Artificial Sequence
  chemically synthesized
tcattaatgcaattcaaagtaa

SEQ ID NO: 1258046 - DNA, 22 bp, Artificial Sequence
  chemically synthesized
ctagctgtggatttactttgaa

SEQ ID NO: 1258047 - DNA, 22 bp, Artificial Sequence
  chemically synthesized
cattaatgcaattcaaagtaaa

SEQ ID NO: 1258048 - DNA, 22 bp, Artificial Sequence
  chemically synthesized
attaatgcaattcaaagtaaat

SEQ ID NO: 1258049 - DNA, 22 bp, Artificial Sequence
  chemically synthesized
tttctagctgtggatttacttt

SEQ ID NO: 1258050 - DNA, 22 bp, Artificial Sequence
  chemically synthesized
atgcaattcaaagtaaatccac

SEQ ID NO: 1258051 - DNA, 22 bp, Artificial Sequence
  chemically synthesized
aaagtaaatccacagctagaaa

SEQ ID NO: 1258052 - DNA, 22 bp, Artificial Sequence
  chemically synthesized
agtataaaattgtttctagctg

SEQ ID NO: 1258053 - DNA, 22 bp, Artificial Sequence
  chemically synthesized
ttgagtataaaattgtttctag

SEQ ID NO: 1258054 - DNA, 22 bp, Artificial Sequence
  chemically synthesized
tgttgagtataaaattgtttct

SEQ ID NO: 1258055 - DNA, 22 bp, Artificial Sequence
  chemically synthesized
ctctgttgagtataaaattgtt

SEQ ID NO: 1258056 - DNA, 22 bp, Artificial Sequence
  chemically synthesized
gctactctgttgagtataaaat

SEQ ID NO: 1258057 - DNA, 22 bp, Artificial Sequence
  chemically synthesized
ggctactctgttgagtataaaa

SEQ ID NO: 1258058 - DNA, 22 bp, Artificial Sequence
  chemically synthesized
tggctactctgttgagtataaa

SEQ ID NO: 1258059 - DNA, 22 bp, Artificial Sequence
  chemically synthesized
ttggctactctgttgagtataa

SEQ ID NO: 1258060 - DNA, 22 bp, Artificial Sequence
  chemically synthesized
gaaacaattttatactcaacag

SEQ ID NO: 1258061 - DNA, 22 bp, Artificial Sequence
  chemically synthesized
acttttggctactctgttgagt

SEQ ID NO: 1258062 - DNA, 22 bp, Artificial Sequence
  chemically synthesized
aacttttggctactctgttgag

SEQ ID NO: 1258063 - DNA, 22 bp, Artificial Sequence
  chemically synthesized
tatactcaacagagtagccaaa

SEQ ID NO: 1258064 - DNA, 22 bp, Artificial Sequence
  chemically synthesized
atactcaacagagtagccaaaa

SEQ ID NO: 1258065 - DNA, 22 bp, Artificial Sequence
  chemically synthesized
tactcaacagagtagccaaaag

SEQ ID NO: 1258066 - DNA, 22 bp, Artificial Sequence
  chemically synthesized
acaatgtcaaacttaacttttg

SEQ ID NO: 1258067 - DNA, 22 bp, Artificial Sequence
  chemically synthesized
aacagagtagccaaaagttaag

SEQ ID NO: 1258068 - DNA, 22 bp, Artificial Sequence
  chemically synthesized
gacaatgtcaaacttaactttt

SEQ ID NO: 1258069 - DNA, 22 bp, Artificial Sequence
  chemically synthesized
acacttgacaatgtcaaactta

SEQ ID NO: 1258070 - DNA, 22 bp, Artificial Sequence
  chemically synthesized
taacacttgacaatgtcaaact

SEQ ID NO: 1258071 - DNA, 22 bp, Artificial Sequence
  chemically synthesized
ccaaattctaacacttgacaat

SEQ ID NO: 1258072 - DNA, 22 bp, Artificial Sequence
  chemically synthesized
ctcccaaattctaacacttgac

SEQ ID NO: 1258073 - DNA, 22 bp, Artificial Sequence
  chemically synthesized
agtttgacattgtcaagtgtta

SEQ ID NO: 1258074 - DNA, 22 bp, Artificial Sequence
  chemically synthesized
gctcccaaattctaacacttga

SEQ ID NO: 1258075 - DNA, 22 bp, Artificial Sequence
  chemically synthesized
cttgctcccaaattctaacact

SEQ ID NO: 1258076 - DNA, 22 bp, Artificial Sequence
  chemically synthesized
gacattgtcaagtgttagaatt

SEQ ID NO: 1258077 - DNA, 22 bp, Artificial Sequence
  chemically synthesized
tgcttgctcccaaattctaaca

SEQ ID NO: 1258078 - DNA, 22 bp, Artificial Sequence
  chemically synthesized
acattgtcaagtgttagaattt

SEQ ID NO: 1258079 - DNA, 22 bp, Artificial Sequence
  chemically synthesized
tcaagtgttagaatttgggagc

SEQ ID NO: 1258080 - DNA, 22 bp, Artificial Sequence
  chemically synthesized
aaaattctgcttgctcccaaat

SEQ ID NO: 1258081 - DNA, 22 bp, Artificial Sequence
  chemically synthesized
aaaaattctgcttgctcccaaa

SEQ ID NO: 1258082 - DNA, 22 bp, Artificial Sequence
  chemically synthesized
acgaacttaaaaattctgcttg

SEQ ID NO: 1258083 - DNA, 22 bp, Artificial Sequence
  chemically synthesized
gaatttgggagcaagcagaatt

SEQ ID NO: 1258084 - DNA, 22 bp, Artificial Sequence
  chemically synthesized
tcacgaacttaaaaattctgct

SEQ ID NO: 1258085 - DNA, 22 bp, Artificial Sequence
  chemically synthesized
gggagcaagcagaatttttaag

SEQ ID NO: 1258086 - DNA, 22 bp, Artificial Sequence
  chemically synthesized
aattctcacgaacttaaaaatt

SEQ ID NO: 1258087 - DNA, 22 bp, Artificial Sequence
  chemically synthesized
ggagcaagcagaatttttaagt

SEQ ID NO: 1258088 - DNA, 22 bp, Artificial Sequence
  chemically synthesized
aaattctcacgaacttaaaaat

SEQ ID NO: 1258089 - DNA, 22 bp, Artificial Sequence
  chemically synthesized
caccaatttaaattctcacgaa

SEQ ID NO: 1258090 - DNA, 22 bp, Artificial Sequence
  chemically synthesized
gttacaccaatttaaattctca

SEQ ID NO: 1258091 - DNA, 22 bp, Artificial Sequence
  chemically synthesized
ttaagttcgtgagaatttaaat

SEQ ID NO: 1258092 - DNA, 22 bp, Artificial Sequence
  chemically synthesized
taagttcgtgagaatttaaatt

SEQ ID NO: 1258093 - DNA, 22 bp, Artificial Sequence
  chemically synthesized
aagttcgtgagaatttaaattg

SEQ ID NO: 1258094 - DNA, 22 bp, Artificial Sequence
  chemically synthesized
agttcgtgagaatttaaattgg

SEQ ID NO: 1258095 - DNA, 22 bp, Artificial Sequence
  chemically synthesized
aaattggttacaccaatttaaa

SEQ ID NO: 1258096 - DNA, 22 bp, Artificial Sequence
  chemically synthesized
aaaattggttacaccaatttaa

SEQ ID NO: 1258097 - DNA, 22 bp, Artificial Sequence
  chemically synthesized
taaaattggttacaccaattta

SEQ ID NO: 1258098 - DNA, 22 bp, Artificial Sequence
  chemically synthesized
ttaaaattggttacaccaattt

SEQ ID NO: 1258099 - DNA, 22 bp, Artificial Sequence
  chemically synthesized
gtgagaatttaaattggtgtaa

SEQ ID NO: 1258100 - DNA, 22 bp, Artificial Sequence
  chemically synthesized
tttttaaaattggttacaccaa

SEQ ID NO: 1258101 - DNA, 22 bp, Artificial Sequence
  chemically synthesized
aaattggtgtaaccaattttaa

SEQ ID NO: 1258102 - DNA, 22 bp, Artificial Sequence
  chemically synthesized
aattggtgtaaccaattttaaa

SEQ ID NO: 1258103 - DNA, 22 bp, Artificial Sequence
  chemically synthesized
tgccaaattatttttaaaattg

SEQ ID NO: 1258104 - DNA, 22 bp, Artificial Sequence
  chemically synthesized
gtgtaaccaattttaaaaataa

SEQ ID NO: 1258105 - DNA, 22 bp, Artificial Sequence
  chemically synthesized
caagattatgccaaattatttt

SEQ ID NO: 1258106 - DNA, 22 bp, Artificial Sequence
  chemically synthesized
ccaagattatgccaaattattt

SEQ ID NO: 1258107 - DNA, 22 bp, Artificial Sequence
  chemically synthesized
agtttccaagattatgccaaat

SEQ ID NO: 1258108 - DNA, 22 bp, Artificial Sequence
  chemically synthesized
taagtttccaagattatgccaa

SEQ ID NO: 1258109 - DNA, 22 bp, Artificial Sequence
  chemically synthesized
ctaagtttccaagattatgcca

SEQ ID NO: 1258110 - DNA, 22 bp, Artificial Sequence
  chemically synthesized
taaaaataatttggcataatct

SEQ ID NO: 1258111 - DNA, 22 bp, Artificial Sequence
  chemically synthesized
aaaaataatttggcataatctt

SEQ ID NO: 1258112 - DNA, 22 bp, Artificial Sequence
  chemically synthesized
aaaataatttggcataatcttg

SEQ ID NO: 1258113 - DNA, 22 bp, Artificial Sequence
  chemically synthesized
ggcataatcttggaaacttaga

SEQ ID NO: 1258114 - DNA, 22 bp, Artificial Sequence
  chemically synthesized
acatgatgtatttctaagtttc

SEQ ID NO: 1258115 - DNA, 22 bp, Artificial Sequence
  chemically synthesized
gcataatcttggaaacttagaa

SEQ ID NO: 1258116 - DNA, 22 bp, Artificial Sequence
  chemically synthesized
actgacatgatgtatttctaag

SEQ ID NO: 1258117 - DNA, 22 bp, Artificial Sequence
  chemically synthesized
tgactgacatgatgtatttcta

SEQ ID NO: 1258118 - DNA, 22 bp, Artificial Sequence
  chemically synthesized
ggaaacttagaaatacatcatg

SEQ ID NO: 1258119 - DNA, 22 bp, Artificial Sequence
  chemically synthesized
gattctgactgacatgatgtat

SEQ ID NO: 1258120 - DNA, 22 bp, Artificial Sequence
  chemically synthesized
gaaacttagaaatacatcatgt

SEQ ID NO: 1258121 - DNA, 22 bp, Artificial Sequence
  chemically synthesized
agattctgactgacatgatgta

SEQ ID NO: 1258122 - DNA, 22 bp, Artificial Sequence
  chemically synthesized
cttagattctgactgacatgat

SEQ ID NO: 1258123 - DNA, 22 bp, Artificial Sequence
  chemically synthesized
agaaatacatcatgtcagtcag

SEQ ID NO: 1258124 - DNA, 22 bp, Artificial Sequence
  chemically synthesized
gaaatacatcatgtcagtcaga

SEQ ID NO: 1258125 - DNA, 22 bp, Artificial Sequence
  chemically synthesized
tgtctgcttagattctgactga

SEQ ID NO: 1258126 - DNA, 22 bp, Artificial Sequence
  chemically synthesized
gtgtctgcttagattctgactg

SEQ ID NO: 1258127 - DNA, 22 bp, Artificial Sequence
  chemically synthesized
tgtgtctgcttagattctgact

SEQ ID NO: 1258128 - DNA, 22 bp, Artificial Sequence
  chemically synthesized
ttgtgtctgcttagattctgac

SEQ ID NO: 1258129 - DNA, 22 bp, Artificial Sequence
  chemically synthesized
tttgtgtctgcttagattctga

SEQ ID NO: 1258130 - DNA, 22 bp, Artificial Sequence
  chemically synthesized
aatatcaaatgactttttgtgt

SEQ ID NO: 1258131 - DNA, 22 bp, Artificial Sequence
  chemically synthesized
aaatatcaaatgactttttgtg

SEQ ID NO: 1258132 - DNA, 22 bp, Artificial Sequence
  chemically synthesized
atttaaatatcaaatgactttt

SEQ ID NO: 1258133 - DNA, 22 bp, Artificial Sequence
  chemically synthesized
agcagacacaaaaagtcatttg

SEQ ID NO: 1258134 - DNA, 22 bp, Artificial Sequence
  chemically synthesized
tgatttaaatatcaaatgactt

SEQ ID NO: 1258135 - DNA, 22 bp, Artificial Sequence
  chemically synthesized
ctgatttaaatatcaaatgact

SEQ ID NO: 1258136 - DNA, 22 bp, Artificial Sequence
  chemically synthesized
tctgatttaaatatcaaatgac

SEQ ID NO: 1258137 - DNA, 22 bp, Artificial Sequence
  chemically synthesized
agctttctgatttaaatatcaa

SEQ ID NO: 1258138 - DNA, 22 bp, Artificial Sequence
  chemically synthesized
aagctttctgatttaaatatca

SEQ ID NO: 1258139 - DNA, 22 bp, Artificial Sequence
  chemically synthesized
taatttaagctttctgatttaa

SEQ ID NO: 1258140 - DNA, 22 bp, Artificial Sequence
  chemically synthesized
tataatttaagctttctgattt

SEQ ID NO: 1258141 - DNA, 22 bp, Artificial Sequence
  chemically synthesized
gatatttaaatcagaaagctta

SEQ ID NO: 1258142 - DNA, 22 bp, Artificial Sequence
  chemically synthesized
aattctataatttaagctttct

SEQ ID NO: 1258143 - DNA, 22 bp, Artificial Sequence
  chemically synthesized
atatttaaatcagaaagcttaa

SEQ ID NO: 1258144 - DNA, 22 bp, Artificial Sequence
  chemically synthesized
caattctataatttaagctttc

SEQ ID NO: 1258145 - DNA, 22 bp, Artificial Sequence
  chemically synthesized
tttcaattctataatttaagct

SEQ ID NO: 1258146 - DNA, 22 bp, Artificial Sequence
  chemically synthesized
gtttcaattctataatttaagc

SEQ ID NO: 1258147 - DNA, 22 bp, Artificial Sequence
  chemically synthesized
aaatcagaaagcttaaattata

SEQ ID NO: 1258148 - DNA, 22 bp, Artificial Sequence
  chemically synthesized
aatcagaaagcttaaattatag

SEQ ID NO: 1258149 - DNA, 22 bp, Artificial Sequence
  chemically synthesized
atttgtttcaattctataattt

SEQ ID NO: 1258150 - DNA, 22 bp, Artificial Sequence
  chemically synthesized
tcatttgtttcaattctataat

SEQ ID NO: 1258151 - DNA, 22 bp, Artificial Sequence
  chemically synthesized
tctcatttgtttcaattctata

SEQ ID NO: 1258152 - DNA, 22 bp, Artificial Sequence
  chemically synthesized
ctctcatttgtttcaattctat

SEQ ID NO: 1258153 - DNA, 22 bp, Artificial Sequence
  chemically synthesized
ttctctcatttgtttcaattct

SEQ ID NO: 1258154 - DNA, 22 bp, Artificial Sequence
  chemically synthesized
ttcttctctcatttgtttcaat

SEQ ID NO: 1258155 - DNA, 22 bp, Artificial Sequence
  chemically synthesized
aaattatagaattgaaacaaat

SEQ ID NO: 1258156 - DNA, 22 bp, Artificial Sequence
  chemically synthesized
tgttcttctctcatttgtttca

SEQ ID NO: 1258157 - DNA, 22 bp, Artificial Sequence
  chemically synthesized
aattatagaattgaaacaaatg

SEQ ID NO: 1258158 - DNA, 22 bp, Artificial Sequence
  chemically synthesized
tagaattgaaacaaatgagaga

SEQ ID NO: 1258159 - DNA, 22 bp, Artificial Sequence
  chemically synthesized
tcaactctgttcttctctcatt

SEQ ID NO: 1258160 - DNA, 22 bp, Artificial Sequence
  chemically synthesized
gtcaactctgttcttctctcat

SEQ ID NO: 1258161 - DNA, 22 bp, Artificial Sequence
  chemically synthesized
aaacaaatgagagaagaacaga

SEQ ID NO: 1258162 - DNA, 22 bp, Artificial Sequence
  chemically synthesized
cacagcttgtcaactctgttct

SEQ ID NO: 1258163 - DNA, 22 bp, Artificial Sequence
  chemically synthesized
tcctccacagcttgtcaactct

SEQ ID NO: 1258164 - DNA, 22 bp, Artificial Sequence
  chemically synthesized
gtcctccacagcttgtcaactc

SEQ ID NO: 1258165 - DNA, 22 bp, Artificial Sequence
  chemically synthesized
tgtcctccacagcttgtcaact

SEQ ID NO: 1258166 - DNA, 22 bp, Artificial Sequence
  chemically synthesized
agtcactttgtcctccacagct

SEQ ID NO: 1258167 - DNA, 22 bp, Artificial Sequence
  chemically synthesized
tgagtcactttgtcctccacag

SEQ ID NO: 1258168 - DNA, 22 bp, Artificial Sequence
  chemically synthesized
aactctgagtcactttgtcctc

SEQ ID NO: 1258169 - DNA, 22 bp, Artificial Sequence
  chemically synthesized
acaagctgtggaggacaaagtg

SEQ ID NO: 1258170 - DNA, 22 bp, Artificial Sequence
  chemically synthesized
ctaaactctgagtcactttgtc

SEQ ID NO: 1258171 - DNA, 22 bp, Artificial Sequence
  chemically synthesized
tggttgctaaactctgagtcac

SEQ ID NO: 1258172 - DNA, 22 bp, Artificial Sequence
  chemically synthesized
tggaggacaaagtgactcagag

SEQ ID NO: 1258173 - DNA, 22 bp, Artificial Sequence
  chemically synthesized
ctgtggttgctaaactctgagt

SEQ ID NO: 1258174 - DNA, 22 bp, Artificial Sequence
  chemically synthesized
cctgtggttgctaaactctgag

SEQ ID NO: 1258175 - DNA, 22 bp, Artificial Sequence
  chemically synthesized
agagtttagcaaccacaggaag

SEQ ID NO: 1258176 - DNA, 22 bp, Artificial Sequence
  chemically synthesized
agggtaatagtggcttcctgtg

SEQ ID NO: 1258177 - DNA, 22 bp, Artificial Sequence
  chemically synthesized
aagggtaatagtggcttcctgt

SEQ ID NO: 1258178 - DNA, 22 bp, Artificial Sequence
  chemically synthesized
taagggtaatagtggcttcctg

SEQ ID NO: 1258179 - DNA, 22 bp, Artificial Sequence
  chemically synthesized
agcaaccacaggaagccactat

SEQ ID NO: 1258180 - DNA, 22 bp, Artificial Sequence
  chemically synthesized
gcaaccacaggaagccactatt

SEQ ID NO: 1258181 - DNA, 22 bp, Artificial Sequence
  chemically synthesized
tactttaagggtaatagtggct

SEQ ID NO: 1258182 - DNA, 22 bp, Artificial Sequence
  chemically synthesized
cctgtactttaagggtaatagt

SEQ ID NO: 1258183 - DNA, 22 bp, Artificial Sequence
  chemically synthesized
tccctgtactttaagggtaata

SEQ ID NO: 1258184 - DNA, 22 bp, Artificial Sequence
  chemically synthesized
ctctccctgtactttaagggta

SEQ ID NO: 1258185 - DNA, 22 bp, Artificial Sequence
  chemically synthesized
cctctccctgtactttaagggt

SEQ ID NO: 1258186 - DNA, 22 bp, Artificial Sequence
  chemically synthesized
ccttcctctccctgtactttaa

SEQ ID NO: 1258187 - DNA, 22 bp, Artificial Sequence
  chemically synthesized
tcccttcctctccctgtacttt

SEQ ID NO: 1258188 - DNA, 22 bp, Artificial Sequence
  chemically synthesized
ctctcccttcctctccctgtac

SEQ ID NO: 1258189 - DNA, 22 bp, Artificial Sequence
  chemically synthesized
ttacccttaaagtacagggaga

SEQ ID NO: 1258190 - DNA, 22 bp, Artificial Sequence
  chemically synthesized
tcctctcccttcctctccctgt

SEQ ID NO: 1258191 - DNA, 22 bp, Artificial Sequence
  chemically synthesized
cccttaaagtacagggagagga

SEQ ID NO: 1258192 - DNA, 22 bp, Artificial Sequence
  chemically synthesized
tctcctctcccttcctctccct

SEQ ID NO: 1258193 - DNA, 22 bp, Artificial Sequence
  chemically synthesized
ctctcctctcccttcctctccc

SEQ ID NO: 1258194 - DNA, 22 bp, Artificial Sequence
  chemically synthesized
ttctctcctctcccttcctctc

SEQ ID NO: 1258195 - DNA, 22 bp, Artificial Sequence
  chemically synthesized
cttctctcctctcccttcctct

SEQ ID NO: 1258196 - DNA, 22 bp, Artificial Sequence
  chemically synthesized
aaagtacagggagaggaaggga

SEQ ID NO: 1258197 - DNA, 22 bp, Artificial Sequence
  chemically synthesized
aagtacagggagaggaagggag

SEQ ID NO: 1258198 - DNA, 22 bp, Artificial Sequence
  chemically synthesized
ttcttctctcctctcccttcct

SEQ ID NO: 1258199 - DNA, 22 bp, Artificial Sequence
  chemically synthesized
ccactcttcttctctcctctcc

SEQ ID NO: 1258200 - DNA, 22 bp, Artificial Sequence
  chemically synthesized
tcccactcttcttctctcctct

SEQ ID NO: 1258201 - DNA, 22 bp, Artificial Sequence
  chemically synthesized
tctcccactcttcttctctcct

SEQ ID NO: 1258202 - DNA, 22 bp, Artificial Sequence
  chemically synthesized
ctctcccactcttcttctctcc

SEQ ID NO: 1258203 - DNA, 22 bp, Artificial Sequence
  chemically synthesized
cccttctctcccactcttcttc

SEQ ID NO: 1258204 - DNA, 22 bp, Artificial Sequence
  chemically synthesized
tccccttctctcccactcttct

SEQ ID NO: 1258205 - DNA, 22 bp, Artificial Sequence
  chemically synthesized
tctccccttctctcccactctt

SEQ ID NO: 1258206 - DNA, 22 bp, Artificial Sequence
  chemically synthesized
tctctccccttctctcccactc

SEQ ID NO: 1258207 - DNA, 22 bp, Artificial Sequence
  chemically synthesized
tctctctccccttctctcccac

SEQ ID NO: 1258208 - DNA, 22 bp, Artificial Sequence
  chemically synthesized
tctctctctccccttctctccc

SEQ ID NO: 1258209 - DNA, 22 bp, Artificial Sequence
  chemically synthesized
tctctctctctccccttctctc

SEQ ID NO: 1258210 - DNA, 22 bp, Artificial Sequence
  chemically synthesized
tctctctctctctccccttctc

SEQ ID NO: 1258211 - DNA, 22 bp, Artificial Sequence
  chemically synthesized
tctctctctctctctccccttc

SEQ ID NO: 1258212 - DNA, 22 bp, Artificial Sequence
  chemically synthesized
tctctctctctctctctcccct

SEQ ID NO: 1258213 - DNA, 22 bp, Artificial Sequence
  chemically synthesized
tctctctctctctctctctccc

SEQ ID NO: 1258214 - DNA, 22 bp, Artificial Sequence
  chemically synthesized
tctctctctctctctctctctc

SEQ ID NO: 1258215 - DNA, 22 bp, Artificial Sequence
  chemically synthesized
tctctctctctctctctctctc

SEQ ID NO: 1258216 - DNA, 22 bp, Artificial Sequence
  chemically synthesized
tctctctctctctctctctctc

SEQ ID NO: 1258217 - DNA, 22 bp, Artificial Sequence
  chemically synthesized
ctctctctctctctctctctct

SEQ ID NO: 1258218 - DNA, 22 bp, Artificial Sequence
  chemically synthesized
cttctctctctctctctctctc

SEQ ID NO: 1258219 - DNA, 22 bp, Artificial Sequence
  chemically synthesized
ctccttctctctctctctctct

SEQ ID NO: 1258220 - DNA, 22 bp, Artificial Sequence
  chemically synthesized
cccatcctcctccttctctctc

SEQ ID NO: 1258221 - DNA, 22 bp, Artificial Sequence
  chemically synthesized
ctccccatcctcctccttctct

SEQ ID NO: 1258222 - DNA, 22 bp, Artificial Sequence
  chemically synthesized
ctcctccccatcctcctccttc

SEQ ID NO: 1258223 - DNA, 22 bp, Artificial Sequence
  chemically synthesized
cctcctccccatcctcctcctt

SEQ ID NO: 1258224 - DNA, 22 bp, Artificial Sequence
  chemically synthesized
ttcctcctccccatcctcctcc

SEQ ID NO: 1258225 - DNA, 22 bp, Artificial Sequence
  chemically synthesized
ctcttcctcctccccatcctcc

SEQ ID NO: 1258226 - DNA, 22 bp, Artificial Sequence
  chemically synthesized
tcctcttcctcctccccatcct

SEQ ID NO: 1258227 - DNA, 22 bp, Artificial Sequence
  chemically synthesized
ctcctcttcctcctccccatcc

SEQ ID NO: 1258228 - DNA, 22 bp, Artificial Sequence
  chemically synthesized
cttctcctcttcctcctcccca

SEQ ID NO: 1258229 - DNA, 22 bp, Artificial Sequence
  chemically synthesized
cccattccttctcctcttcctc

SEQ ID NO: 1258230 - DNA, 22 bp, Artificial Sequence
  chemically synthesized
ctccccattccttctcctcttc

SEQ ID NO: 1258231 - DNA, 22 bp, Artificial Sequence
  chemically synthesized
ctcctccccattccttctcctc

SEQ ID NO: 1258232 - DNA, 22 bp, Artificial Sequence
  chemically synthesized
ctcctcctccccattccttctc

SEQ ID NO: 1258233 - DNA, 22 bp, Artificial Sequence
  chemically synthesized
cctcctcctccccattccttct

SEQ ID NO: 1258234 - DNA, 22 bp, Artificial Sequence
  chemically synthesized
tcctcctcctccccattccttc

SEQ ID NO: 1258235 - DNA, 22 bp, Artificial Sequence
  chemically synthesized
tttcctcctcctccccattcct

SEQ ID NO: 1258236 - DNA, 22 bp, Artificial Sequence
  chemically synthesized
ctttcctcctcctccccattcc

SEQ ID NO: 1258237 - DNA, 22 bp, Artificial Sequence
  chemically synthesized
ttctttcctcctcctccccatt

SEQ ID NO: 1258238 - DNA, 22 bp, Artificial Sequence
  chemically synthesized
cttctttcctcctcctccccat

SEQ ID NO: 1258239 - DNA, 22 bp, Artificial Sequence
  chemically synthesized
ccttcttctttcctcctcctcc

SEQ ID NO: 1258240 - DNA, 22 bp, Artificial Sequence
  chemically synthesized
atgcaccctgccttcttctttc

SEQ ID NO: 1258241 - DNA, 22 bp, Artificial Sequence
  chemically synthesized
aattcatgcaccctgccttctt

SEQ ID NO: 1258242 - DNA, 22 bp, Artificial Sequence
  chemically synthesized
actgaattcatgcaccctgcct

SEQ ID NO: 1258243 - DNA, 22 bp, Artificial Sequence
  chemically synthesized
attcactgaattcatgcaccct

SEQ ID NO: 1258244 - DNA, 22 bp, Artificial Sequence
  chemically synthesized
ataacctcattcactgaattca

SEQ ID NO: 1258245 - DNA, 22 bp, Artificial Sequence
  chemically synthesized
caatgaatgatctcataacctc

SEQ ID NO: 1258246 - DNA, 22 bp, Artificial Sequence
  chemically synthesized
ccaatgaatgatctcataacct

SEQ ID NO: 1258247 - DNA, 22 bp, Artificial Sequence
  chemically synthesized
agtgaatgaggttatgagatca

SEQ ID NO: 1258248 - DNA, 22 bp, Artificial Sequence
  chemically synthesized
cagcttccaatgaatgatctca

SEQ ID NO: 1258249 - DNA, 22 bp, Artificial Sequence
  chemically synthesized
tagctgcagcttccaatgaatg

SEQ ID NO: 1258250 - DNA, 22 bp, Artificial Sequence
  chemically synthesized
tgagatcattcattggaagctg

SEQ ID NO: 1258251 - DNA, 22 bp, Artificial Sequence
  chemically synthesized
attggaagctgcagctatagtg

SEQ ID NO: 1258252 - DNA, 22 bp, Artificial Sequence
  chemically synthesized
caaccagataggcccactatag

SEQ ID NO: 1258253 - DNA, 22 bp, Artificial Sequence
  chemically synthesized
gaagctgcagctatagtgggcc

SEQ ID NO: 1258254 - DNA, 22 bp, Artificial Sequence
  chemically synthesized
cagctatagtgggcctatctgg

SEQ ID NO: 1258255 - DNA, 22 bp, Artificial Sequence
  chemically synthesized
atgtcccccctccaaccagata

SEQ ID NO: 1258256 - DNA, 22 bp, Artificial Sequence
  chemically synthesized
gatgtcccccctccaaccagat

SEQ ID NO: 1258257 - DNA, 22 bp, Artificial Sequence
  chemically synthesized
tgatgtcccccctccaaccaga

SEQ ID NO: 1258258 - DNA, 22 bp, Artificial Sequence
  chemically synthesized
tagtgggcctatctggttggag

SEQ ID NO: 1258259 - DNA, 22 bp, Artificial Sequence
  chemically synthesized
catatgctttgatgtcccccct

SEQ ID NO: 1258260 - DNA, 22 bp, Artificial Sequence
  chemically synthesized
tctggttggaggggggacatca

SEQ ID NO: 1258261 - DNA, 22 bp, Artificial Sequence
  chemically synthesized
gttggaggggggacatcaaagc

SEQ ID NO: 1258262 - DNA, 22 bp, Artificial Sequence
  chemically synthesized
gcaacagctgcatatgctttga

SEQ ID NO: 1258263 - DNA, 22 bp, Artificial Sequence
  chemically synthesized
gaggggggacatcaaagcatat

SEQ ID NO: 1258264 - DNA, 22 bp, Artificial Sequence
  chemically synthesized
ggcaacagctgcatatgctttg

SEQ ID NO: 1258265 - DNA, 22 bp, Artificial Sequence
  chemically synthesized
tggcaacagctgcatatgcttt

SEQ ID NO: 1258266 - DNA, 22 bp, Artificial Sequence
  chemically synthesized
aggcagtatctttggcaacagc

SEQ ID NO: 1258267 - DNA, 22 bp, Artificial Sequence
  chemically synthesized
caggcagtatctttggcaacag

SEQ ID NO: 1258268 - DNA, 22 bp, Artificial Sequence
  chemically synthesized
tgtttcaggcagtatctttggc

SEQ ID NO: 1258269 - DNA, 22 bp, Artificial Sequence
  chemically synthesized
gtgtttcaggcagtatctttgg

SEQ ID NO: 1258270 - DNA, 22 bp, Artificial Sequence
  chemically synthesized
tgtgtttcaggcagtatctttg

SEQ ID NO: 1258271 - DNA, 22 bp, Artificial Sequence
  chemically synthesized
tttgtgtttcaggcagtatctt

SEQ ID NO: 1258272 - DNA, 22 bp, Artificial Sequence
  chemically synthesized
tctttgtgtttcaggcagtatc

SEQ ID NO: 1258273 - DNA, 22 bp, Artificial Sequence
  chemically synthesized
ctctctttgtgtttcaggcagt

SEQ ID NO: 1258274 - DNA, 22 bp, Artificial Sequence
  chemically synthesized
ttgccaaagatactgcctgaaa

SEQ ID NO: 1258275 - DNA, 22 bp, Artificial Sequence
  chemically synthesized
cctctctttgtgtttcaggcag

SEQ ID NO: 1258276 - DNA, 22 bp, Artificial Sequence
  chemically synthesized
ttcctctctttgtgtttcaggc

SEQ ID NO: 1258277 - DNA, 22 bp, Artificial Sequence
  chemically synthesized
ccaaagatactgcctgaaacac

SEQ ID NO: 1258278 - DNA, 22 bp, Artificial Sequence
  chemically synthesized
tcttcctctctttgtgtttcag

SEQ ID NO: 1258279 - DNA, 22 bp, Artificial Sequence
  chemically synthesized
ctcttcctctctttgtgtttca

SEQ ID NO: 1258280 - DNA, 22 bp, Artificial Sequence
  chemically synthesized
cctgaaacacaaagagaggaag

SEQ ID NO: 1258281 - DNA, 22 bp, Artificial Sequence
  chemically synthesized
aaacacaaagagaggaagagaa

SEQ ID NO: 1258282 - DNA, 22 bp, Artificial Sequence
  chemically synthesized
agggaagacacaagagtgcttc

SEQ ID NO: 1258283 - DNA, 22 bp, Artificial Sequence
  chemically synthesized
gaaactcagggaagacacaaga

SEQ ID NO: 1258284 - DNA, 22 bp, Artificial Sequence
  chemically synthesized
ttgtgtcttccctgagtttcca

SEQ ID NO: 1258285 - DNA, 22 bp, Artificial Sequence
  chemically synthesized
atggtgaaggattggaaactca

SEQ ID NO: 1258286 - DNA, 22 bp, Artificial Sequence
  chemically synthesized
gtgtcttccctgagtttccaat

SEQ ID NO: 1258287 - DNA, 22 bp, Artificial Sequence
  chemically synthesized
tgtcttccctgagtttccaatc

SEQ ID NO: 1258288 - DNA, 22 bp, Artificial Sequence
  chemically synthesized
gctgatggtgaaggattggaaa

SEQ ID NO: 1258289 - DNA, 22 bp, Artificial Sequence
  chemically synthesized
ggctgatggtgaaggattggaa

SEQ ID NO: 1258290 - DNA, 22 bp, Artificial Sequence
  chemically synthesized
tggctgatggtgaaggattgga

SEQ ID NO: 1258291 - DNA, 22 bp, Artificial Sequence
  chemically synthesized
tttggctgatggtgaaggattg

SEQ ID NO: 1258292 - DNA, 22 bp, Artificial Sequence
  chemically synthesized
ccctgagtttccaatccttcac

SEQ ID NO: 1258293 - DNA, 22 bp, Artificial Sequence
  chemically synthesized
cctgagtttccaatccttcacc

SEQ ID NO: 1258294 - DNA, 22 bp, Artificial Sequence
  chemically synthesized
tctttggctgatggtgaaggat

SEQ ID NO: 1258295 - DNA, 22 bp, Artificial Sequence
  chemically synthesized
agtttccaatccttcaccatca

SEQ ID NO: 1258296 - DNA, 22 bp, Artificial Sequence
  chemically synthesized
cagctctctttggctgatggtg

SEQ ID NO: 1258297 - DNA, 22 bp, Artificial Sequence
  chemically synthesized
ccagctctctttggctgatggt

SEQ ID NO: 1258298 - DNA, 22 bp, Artificial Sequence
  chemically synthesized
ccaatccttcaccatcagccaa

SEQ ID NO: 1258299 - DNA, 22 bp, Artificial Sequence
  chemically synthesized
caatccttcaccatcagccaaa

SEQ ID NO: 1258300 - DNA, 22 bp, Artificial Sequence
  chemically synthesized
caggtgacttccagctctcttt

SEQ ID NO: 1258301 - DNA, 22 bp, Artificial Sequence
  chemically synthesized
caccatcagccaaagagagctg

SEQ ID NO: 1258302 - DNA, 22 bp, Artificial Sequence
  chemically synthesized
ccaggtgacttccagctctctt

SEQ ID NO: 1258303 - DNA, 22 bp, Artificial Sequence
  chemically synthesized
accatcagccaaagagagctgg

SEQ ID NO: 1258304 - DNA, 22 bp, Artificial Sequence
  chemically synthesized
catttccaggtgacttccagct

SEQ ID NO: 1258305 - DNA, 22 bp, Artificial Sequence
  chemically synthesized
ccatttccaggtgacttccagc

SEQ ID NO: 1258306 - DNA, 22 bp, Artificial Sequence
  chemically synthesized
tgtgtgccaggcttccatttcc

SEQ ID NO: 1258307 - DNA, 22 bp, Artificial Sequence
  chemically synthesized
gaagtcacctggaaatggaagc

SEQ ID NO: 1258308 - DNA, 22 bp, Artificial Sequence
  chemically synthesized
tagactgtgtgtgccaggcttc

SEQ ID NO: 1258309 - DNA, 22 bp, Artificial Sequence
  chemically synthesized
gtagactgtgtgtgccaggctt

SEQ ID NO: 1258310 - DNA, 22 bp, Artificial Sequence
  chemically synthesized
tgtagactgtgtgtgccaggct

SEQ ID NO: 1258311 - DNA, 22 bp, Artificial Sequence
  chemically synthesized
gaaatggaagcctggcacacac

SEQ ID NO: 1258312 - DNA, 22 bp, Artificial Sequence
  chemically synthesized
acctttgtagactgtgtgtgcc

SEQ ID NO: 1258313 - DNA, 22 bp, Artificial Sequence
  chemically synthesized
ggagactgacctttgtagactg

SEQ ID NO: 1258314 - DNA, 22 bp, Artificial Sequence
  chemically synthesized
gcacacacagtctacaaaggtc

SEQ ID NO: 1258315 - DNA, 22 bp, Artificial Sequence
  chemically synthesized
tgtaccactgggagactgacct

SEQ ID NO: 1258316 - DNA, 22 bp, Artificial Sequence
  chemically synthesized
ctgtgtaccactgggagactga

SEQ ID NO: 1258317 - DNA, 22 bp, Artificial Sequence
  chemically synthesized
tactgtgtaccactgggagact

SEQ ID NO: 1258318 - DNA, 22 bp, Artificial Sequence
  chemically synthesized
ctctactgtgtaccactgggag

SEQ ID NO: 1258319 - DNA, 22 bp, Artificial Sequence
  chemically synthesized
caaaggtcagtctcccagtggt

SEQ ID NO: 1258320 - DNA, 22 bp, Artificial Sequence
  chemically synthesized
cactgctctactgtgtaccact

SEQ ID NO: 1258321 - DNA, 22 bp, Artificial Sequence
  chemically synthesized
acactgctctactgtgtaccac

SEQ ID NO: 1258322 - DNA, 22 bp, Artificial Sequence
  chemically synthesized
tacactgctctactgtgtacca

SEQ ID NO: 1258323 - DNA, 22 bp, Artificial Sequence
  chemically synthesized
ctttacactgctctactgtgta

SEQ ID NO: 1258324 - DNA, 22 bp, Artificial Sequence
  chemically synthesized
gctcctttacactgctctactg

SEQ ID NO: 1258325 - DNA, 22 bp, Artificial Sequence
  chemically synthesized
ccagtggtacacagtagagcag

SEQ ID NO: 1258326 - DNA, 22 bp, Artificial Sequence
  chemically synthesized
ggctcctttacactgctctact

SEQ ID NO: 1258327 - DNA, 22 bp, Artificial Sequence
  chemically synthesized
tggctcctttacactgctctac

SEQ ID NO: 1258328 - DNA, 22 bp, Artificial Sequence
  chemically synthesized
tttggctcctttacactgctct

SEQ ID NO: 1258329 - DNA, 22 bp, Artificial Sequence
  chemically synthesized
gtatactctttggctcctttac

SEQ ID NO: 1258330 - DNA, 22 bp, Artificial Sequence
  chemically synthesized
tggtatactctttggctccttt

SEQ ID NO: 1258331 - DNA, 22 bp, Artificial Sequence
  chemically synthesized
ggtcacagggcccatgtatgtg

SEQ ID NO: 1258332 - DNA, 22 bp, Artificial Sequence
  chemically synthesized
ctgggtcacagggcccatgtat

SEQ ID NO: 1258333 - DNA, 22 bp, Artificial Sequence
  chemically synthesized
tatacatgtaggagtgggattg

SEQ ID NO: 1258334 - DNA, 22 bp, Artificial Sequence
  chemically synthesized
gtatacatgtaggagtgggatt

SEQ ID NO: 1258335 - DNA, 22 bp, Artificial Sequence
  chemically synthesized
tgacccagcaatcccactccta

SEQ ID NO: 1258336 - DNA, 22 bp, Artificial Sequence
  chemically synthesized
cttgtatacatgtaggagtggg

SEQ ID NO: 1258337 - DNA, 22 bp, Artificial Sequence
  chemically synthesized
caaacaaggttccttgtataca

SEQ ID NO: 1258338 - DNA, 22 bp, Artificial Sequence
  chemically synthesized
ttacaaacaaggttccttgtat

SEQ ID NO: 1258339 - DNA, 22 bp, Artificial Sequence
  chemically synthesized
ctattacaaacaaggttccttg

SEQ ID NO: 1258340 - DNA, 22 bp, Artificial Sequence
  chemically synthesized
ctacatgtatacaaggaacctt

SEQ ID NO: 1258341 - DNA, 22 bp, Artificial Sequence
  chemically synthesized
cctattacaaacaaggttcctt

SEQ ID NO: 1258342 - DNA, 22 bp, Artificial Sequence
  chemically synthesized
tcctattacaaacaaggttcct

SEQ ID NO: 1258343 - DNA, 22 bp, Artificial Sequence
  chemically synthesized
ttcctattacaaacaaggttcc

SEQ ID NO: 1258344 - DNA, 22 bp, Artificial Sequence
  chemically synthesized
catgtatacaaggaaccttgtt

SEQ ID NO: 1258345 - DNA, 22 bp, Artificial Sequence
  chemically synthesized
ttttcctattacaaacaaggtt

SEQ ID NO: 1258346 - DNA, 22 bp, Artificial Sequence
  chemically synthesized
attcttttcctattacaaacaa

SEQ ID NO: 1258347 - DNA, 22 bp, Artificial Sequence
  chemically synthesized
aattcttttcctattacaaaca

SEQ ID NO: 1258348 - DNA, 22 bp, Artificial Sequence
  chemically synthesized
taattcttttcctattacaaac

SEQ ID NO: 1258349 - DNA, 22 bp, Artificial Sequence
  chemically synthesized
cagttttaattcttttcctatt

SEQ ID NO: 1258350 - DNA, 22 bp, Artificial Sequence
  chemically synthesized
ccagttttaattcttttcctat

SEQ ID NO: 1258351 - DNA, 22 bp, Artificial Sequence
  chemically synthesized
gtttgtaataggaaaagaatta

SEQ ID NO: 1258352 - DNA, 22 bp, Artificial Sequence
  chemically synthesized
tttgtaataggaaaagaattaa

SEQ ID NO: 1258353 - DNA, 22 bp, Artificial Sequence
  chemically synthesized
gtaataggaaaagaattaaaac

SEQ ID NO: 1258354 - DNA, 22 bp, Artificial Sequence
  chemically synthesized
gggtcgtttccagttttaattc

SEQ ID NO: 1258355 - DNA, 22 bp, Artificial Sequence
  chemically synthesized
taataggaaaagaattaaaact

SEQ ID NO: 1258356 - DNA, 22 bp, Artificial Sequence
  chemically synthesized
atggatactagggtcgtttcca

SEQ ID NO: 1258357 - DNA, 22 bp, Artificial Sequence
  chemically synthesized
ttgatggatactagggtcgttt

SEQ ID NO: 1258358 - DNA, 22 bp, Artificial Sequence
  chemically synthesized
ctgttgatggatactagggtcg

SEQ ID NO: 1258359 - DNA, 22 bp, Artificial Sequence
  chemically synthesized
aaactggaaacgaccctagtat

SEQ ID NO: 1258360 - DNA, 22 bp, Artificial Sequence
  chemically synthesized
gaaacgaccctagtatccatca

SEQ ID NO: 1258361 - DNA, 22 bp, Artificial Sequence
  chemically synthesized
tgcatactactgttgatggata

SEQ ID NO: 1258362 - DNA, 22 bp, Artificial Sequence
  chemically synthesized
atgcatactactgttgatggat

SEQ ID NO: 1258363 - DNA, 22 bp, Artificial Sequence
  chemically synthesized
tttatgcatactactgttgatg

SEQ ID NO: 1258364 - DNA, 22 bp, Artificial Sequence
  chemically synthesized
atttatgcatactactgttgat

SEQ ID NO: 1258365 - DNA, 22 bp, Artificial Sequence
  chemically synthesized
gtatccatcaacagtagtatgc

SEQ ID NO: 1258366 - DNA, 22 bp, Artificial Sequence
  chemically synthesized
cgtcatagaaataacccacaat

SEQ ID NO: 1258367 - DNA, 22 bp, Artificial Sequence
  chemically synthesized
tgtcatattccgtcatagaaat

SEQ ID NO: 1258368 - DNA, 22 bp, Artificial Sequence
  chemically synthesized
tgggttatttctatgacggaat

SEQ ID NO: 1258369 - DNA, 22 bp, Artificial Sequence
  chemically synthesized
cagcattatgtcatattccgtc

SEQ ID NO: 1258370 - DNA, 22 bp, Artificial Sequence
  chemically synthesized
tttctatgacggaatatgacat

SEQ ID NO: 1258371 - DNA, 22 bp, Artificial Sequence
  chemically synthesized
tgactgcagcattatgtcatat

SEQ ID NO: 1258372 - DNA, 22 bp, Artificial Sequence
  chemically synthesized
ctatgacggaatatgacataat

SEQ ID NO: 1258373 - DNA, 22 bp, Artificial Sequence
  chemically synthesized
tatgacggaatatgacataatg

SEQ ID NO: 1258374 - DNA, 22 bp, Artificial Sequence
  chemically synthesized
tgacggaatatgacataatgct

SEQ ID NO: 1258375 - DNA, 22 bp, Artificial Sequence
  chemically synthesized
atccatgtctgtgactgcagca

SEQ ID NO: 1258376 - DNA, 22 bp, Artificial Sequence
  chemically synthesized
agattcatccatgtctgtgact

SEQ ID NO: 1258377 - DNA, 22 bp, Artificial Sequence
  chemically synthesized
ctaagattcatccatgtctgtg

SEQ ID NO: 1258378 - DNA, 22 bp, Artificial Sequence
  chemically synthesized
tgttgctaagattcatccatgt

SEQ ID NO: 1258379 - DNA, 22 bp, Artificial Sequence
  chemically synthesized
cagtcacagacatggatgaatc

SEQ ID NO: 1258380 - DNA, 22 bp, Artificial Sequence
  chemically synthesized
aatcagcattatgttgctaaga

SEQ ID NO: 1258381 - DNA, 22 bp, Artificial Sequence
  chemically synthesized
caatcagcattatgttgctaag

SEQ ID NO: 1258382 - DNA, 22 bp, Artificial Sequence
  chemically synthesized
tcaatcagcattatgttgctaa

SEQ ID NO: 1258383 - DNA, 22 bp, Artificial Sequence
  chemically synthesized
tttcaatcagcattatgttgct

SEQ ID NO: 1258384 - DNA, 22 bp, Artificial Sequence
  chemically synthesized
ctttcaatcagcattatgttgc

SEQ ID NO: 1258385 - DNA, 22 bp, Artificial Sequence
  chemically synthesized
tttctttcaatcagcattatgt

SEQ ID NO: 1258386 - DNA, 22 bp, Artificial Sequence
  chemically synthesized
tgactgtttctttcaatcagca

SEQ ID NO: 1258387 - DNA, 22 bp, Artificial Sequence
  chemically synthesized
agcaacataatgctgattgaaa

SEQ ID NO: 1258388 - DNA, 22 bp, Artificial Sequence
  chemically synthesized
tgtgactgtttctttcaatcag

SEQ ID NO: 1258389 - DNA, 22 bp, Artificial Sequence
  chemically synthesized
gcaacataatgctgattgaaag

SEQ ID NO: 1258390 - DNA, 22 bp, Artificial Sequence
  chemically synthesized
ctgtgactgtttctttcaatca

SEQ ID NO: 1258391 - DNA, 22 bp, Artificial Sequence
  chemically synthesized
ttctgtgactgtttctttcaat

SEQ ID NO: 1258392 - DNA, 22 bp, Artificial Sequence
  chemically synthesized
ttcttctgtgactgtttctttc

SEQ ID NO: 1258393 - DNA, 22 bp, Artificial Sequence
  chemically synthesized
attcttctgtgactgtttcttt

SEQ ID NO: 1258394 - DNA, 22 bp, Artificial Sequence
  chemically synthesized
catttattcttctgtgactgtt

SEQ ID NO: 1258395 - DNA, 22 bp, Artificial Sequence
  chemically synthesized
attgaaagaaacagtcacagaa

SEQ ID NO: 1258396 - DNA, 22 bp, Artificial Sequence
  chemically synthesized
aaagaaacagtcacagaagaat

SEQ ID NO: 1258397 - DNA, 22 bp, Artificial Sequence
  chemically synthesized
gaatcatattgcatttattctt

SEQ ID NO: 1258398 - DNA, 22 bp, Artificial Sequence
  chemically synthesized
gtatagttggaatcatattgca

SEQ ID NO: 1258399 - DNA, 22 bp, Artificial Sequence
  chemically synthesized
cgtatagttggaatcatattgc

SEQ ID NO: 1258400 - DNA, 22 bp, Artificial Sequence
  chemically synthesized
aacttcgtatagttggaatcat

SEQ ID NO: 1258401 - DNA, 22 bp, Artificial Sequence
  chemically synthesized
gaacttcgtatagttggaatca

SEQ ID NO: 1258402 - DNA, 22 bp, Artificial Sequence
  chemically synthesized
tgaacttcgtatagttggaatc

SEQ ID NO: 1258403 - DNA, 22 bp, Artificial Sequence
  chemically synthesized
ttgaacttcgtatagttggaat

SEQ ID NO: 1258404 - DNA, 22 bp, Artificial Sequence
  chemically synthesized
catgcttttgaacttcgtatag

SEQ ID NO: 1258405 - DNA, 22 bp, Artificial Sequence
  chemically synthesized
tgcatgcttttgaacttcgtat

SEQ ID NO: 1258406 - DNA, 22 bp, Artificial Sequence
  chemically synthesized
ctctgcatgcttttgaacttcg

SEQ ID NO: 1258407 - DNA, 22 bp, Artificial Sequence
  chemically synthesized
gctctgcatgcttttgaacttc

SEQ ID NO: 1258408 - DNA, 22 bp, Artificial Sequence
  chemically synthesized
caactatacgaagttcaaaagc

SEQ ID NO: 1258409 - DNA, 22 bp, Artificial Sequence
  chemically synthesized
tacgaagttcaaaagcatgcag

SEQ ID NO: 1258410 - DNA, 22 bp, Artificial Sequence
  chemically synthesized
aaagagaaatagtcttgctctg

SEQ ID NO: 1258411 - DNA, 22 bp, Artificial Sequence
  chemically synthesized
aaaagcatgcagagcaagacta

SEQ ID NO: 1258412 - DNA, 22 bp, Artificial Sequence
  chemically synthesized
ctaaaagagaaatagtcttgct

SEQ ID NO: 1258413 - DNA, 22 bp, Artificial Sequence
  chemically synthesized
catatatatgtattactaaaag

SEQ ID NO: 1258414 - DNA, 22 bp, Artificial Sequence
  chemically synthesized
ctacatatatatgtattactaa

SEQ ID NO: 1258415 - DNA, 22 bp, Artificial Sequence
  chemically synthesized
gctacatatatatgtattacta

SEQ ID NO: 1258416 - DNA, 22 bp, Artificial Sequence
  chemically synthesized
tttctcttttagtaatacatat

SEQ ID NO: 1258417 - DNA, 22 bp, Artificial Sequence
  chemically synthesized
ctcttttagtaatacatatata

SEQ ID NO: 1258418 - DNA, 22 bp, Artificial Sequence
  chemically synthesized
tcttttagtaatacatatatat

SEQ ID NO: 1258419 - DNA, 22 bp, Artificial Sequence
  chemically synthesized
tagtcttgctacatatatatgt

SEQ ID NO: 1258420 - DNA, 22 bp, Artificial Sequence
  chemically synthesized
atagtcttgctacatatatatg

SEQ ID NO: 1258421 - DNA, 22 bp, Artificial Sequence
  chemically synthesized
ttttagtaatacatatatatgt

SEQ ID NO: 1258422 - DNA, 22 bp, Artificial Sequence
  chemically synthesized
tatagtcttgctacatatatat

SEQ ID NO: 1258423 - DNA, 22 bp, Artificial Sequence
  chemically synthesized
ttagtaatacatatatatgtag

SEQ ID NO: 1258424 - DNA, 22 bp, Artificial Sequence
  chemically synthesized
tagtaatacatatatatgtagc

SEQ ID NO: 1258425 - DNA, 22 bp, Artificial Sequence
  chemically synthesized
ttttatagtcttgctacatata

SEQ ID NO: 1258426 - DNA, 22 bp, Artificial Sequence
  chemically synthesized
agtaatacatatatatgtagca

SEQ ID NO: 1258427 - DNA, 22 bp, Artificial Sequence
  chemically synthesized
gttttatagtcttgctacatat

SEQ ID NO: 1258428 - DNA, 22 bp, Artificial Sequence
  chemically synthesized
gtaatacatatatatgtagcaa

SEQ ID NO: 1258429 - DNA, 22 bp, Artificial Sequence
  chemically synthesized
tgttttatagtcttgctacata

SEQ ID NO: 1258430 - DNA, 22 bp, Artificial Sequence
  chemically synthesized
ctttgttttatagtcttgctac

SEQ ID NO: 1258431 - DNA, 22 bp, Artificial Sequence
  chemically synthesized
gctttgttttatagtcttgcta

SEQ ID NO: 1258432 - DNA, 22 bp, Artificial Sequence
  chemically synthesized
taaaacaaagcaaatttcacga

SEQ ID NO: 1258433 - DNA, 22 bp, Artificial Sequence
  chemically synthesized
ccaccagagataacggtggtcg

SEQ ID NO: 1258434 - DNA, 22 bp, Artificial Sequence
  chemically synthesized
cccactaccaccagagataacg

SEQ ID NO: 1258435 - DNA, 22 bp, Artificial Sequence
  chemically synthesized
ccccactaccaccagagataac

SEQ ID NO: 1258436 - DNA, 22 bp, Artificial Sequence
  chemically synthesized
cacgaccaccgttatctctggt

SEQ ID NO: 1258437 - DNA, 22 bp, Artificial Sequence
  chemically synthesized
acgaccaccgttatctctggtg

SEQ ID NO: 1258438 - DNA, 22 bp, Artificial Sequence
  chemically synthesized
catcgcttccccactaccacca

SEQ ID NO: 1258439 - DNA, 22 bp, Artificial Sequence
  chemically synthesized
caattccatcgcttccccacta

SEQ ID NO: 1258440 - DNA, 22 bp, Artificial Sequence
  chemically synthesized
tctctggtggtagtggggaagc

SEQ ID NO: 1258441 - DNA, 22 bp, Artificial Sequence
  chemically synthesized
tggtggtagtggggaagcgatg

SEQ ID NO: 1258442 - DNA, 22 bp, Artificial Sequence
  chemically synthesized
gtggtagtggggaagcgatgga

SEQ ID NO: 1258443 - DNA, 22 bp, Artificial Sequence
  chemically synthesized
tgtacccatctccaattccatc

SEQ ID NO: 1258444 - DNA, 22 bp, Artificial Sequence
  chemically synthesized
aagccatctatgtacccatctc

SEQ ID NO: 1258445 - DNA, 22 bp, Artificial Sequence
  chemically synthesized
gaagccatctatgtacccatct

SEQ ID NO: 1258446 - DNA, 22 bp, Artificial Sequence
  chemically synthesized
gagatgggtacatagatggctt

SEQ ID NO: 1258447 - DNA, 22 bp, Artificial Sequence
  chemically synthesized
cacagtaacttgaagccatcta

SEQ ID NO: 1258448 - DNA, 22 bp, Artificial Sequence
  chemically synthesized
ccacagtaacttgaagccatct

SEQ ID NO: 1258449 - DNA, 22 bp, Artificial Sequence
  chemically synthesized
tccacagtaacttgaagccatc

SEQ ID NO: 1258450 - DNA, 22 bp, Artificial Sequence
  chemically synthesized
gaattttccacagtaacttgaa

SEQ ID NO: 1258451 - DNA, 22 bp, Artificial Sequence
  chemically synthesized
cgaattttccacagtaacttga

SEQ ID NO: 1258452 - DNA, 22 bp, Artificial Sequence
  chemically synthesized
cttcgaattttccacagtaact

SEQ ID NO: 1258453 - DNA, 22 bp, Artificial Sequence
  chemically synthesized
ttacttcgaattttccacagta

SEQ ID NO: 1258454 - DNA, 22 bp, Artificial Sequence
  chemically synthesized
attacttcgaattttccacagt

SEQ ID NO: 1258455 - DNA, 22 bp, Artificial Sequence
  chemically synthesized
caagttactgtggaaaattcga

SEQ ID NO: 1258456 - DNA, 22 bp, Artificial Sequence
  chemically synthesized
aagttactgtggaaaattcgaa

SEQ ID NO: 1258457 - DNA, 22 bp, Artificial Sequence
  chemically synthesized
ctgtggaaaattcgaagtaata

SEQ ID NO: 1258458 - DNA, 22 bp, Artificial Sequence
  chemically synthesized
tggaaaattcgaagtaataaac

SEQ ID NO: 1258459 - DNA, 22 bp, Artificial Sequence
  chemically synthesized
aatcataaccaaatgtgtttat

SEQ ID NO: 1258460 - DNA, 22 bp, Artificial Sequence
  chemically synthesized
caatcataaccaaatgtgttta

SEQ ID NO: 1258461 - DNA, 22 bp, Artificial Sequence
  chemically synthesized
gaagtaataaacacatttggtt

SEQ ID NO: 1258462 - DNA, 22 bp, Artificial Sequence
  chemically synthesized
agacatacagtttcaatcataa

SEQ ID NO: 1258463 - DNA, 22 bp, Artificial Sequence
  chemically synthesized
aagacatacagtttcaatcata

SEQ ID NO: 1258464 - DNA, 22 bp, Artificial Sequence
  chemically synthesized
taagacatacagtttcaatcat

SEQ ID NO: 1258465 - DNA, 22 bp, Artificial Sequence
  chemically synthesized
ggttatgattgaaactgtatgt

SEQ ID NO: 1258466 - DNA, 22 bp, Artificial Sequence
  chemically synthesized
gttatgattgaaactgtatgtc

SEQ ID NO: 1258467 - DNA, 22 bp, Artificial Sequence
  chemically synthesized
tgattgaaactgtatgtcttaa

SEQ ID NO: 1258468 - DNA, 22 bp, Artificial Sequence
  chemically synthesized
cataagaacaaaagattttaag

SEQ ID NO: 1258469 - DNA, 22 bp, Artificial Sequence
  chemically synthesized
aaactgtatgtcttaaaatctt

SEQ ID NO: 1258470 - DNA, 22 bp, Artificial Sequence
  chemically synthesized
ttacataagaacaaaagatttt

SEQ ID NO: 1258471 - DNA, 22 bp, Artificial Sequence
  chemically synthesized
attacataagaacaaaagattt

SEQ ID NO: 1258472 - DNA, 22 bp, Artificial Sequence
  chemically synthesized
tatgtcttaaaatcttttgttc

SEQ ID NO: 1258473 - DNA, 22 bp, Artificial Sequence
  chemically synthesized
aaaatatcttattacataagaa

SEQ ID NO: 1258474 - DNA, 22 bp, Artificial Sequence
  chemically synthesized
aaaatcttttgttcttatgtaa

SEQ ID NO: 1258475 - DNA, 22 bp, Artificial Sequence
  chemically synthesized
aaaaatatcttattacataaga

SEQ ID NO: 1258476 - DNA, 22 bp, Artificial Sequence
  chemically synthesized
aaatcttttgttcttatgtaat

SEQ ID NO: 1258477 - DNA, 22 bp, Artificial Sequence
  chemically synthesized
taaaaatatcttattacataag

SEQ ID NO: 1258478 - DNA, 22 bp, Artificial Sequence
  chemically synthesized
ttaaaaatatcttattacataa

SEQ ID NO: 1258479 - DNA, 22 bp, Artificial Sequence
  chemically synthesized
tcttttaaaaatatcttattac

SEQ ID NO: 1258480 - DNA, 22 bp, Artificial Sequence
  chemically synthesized
ttgttcttatgtaataagatat

SEQ ID NO: 1258481 - DNA, 22 bp, Artificial Sequence
  chemically synthesized
tgttcttatgtaataagatatt

SEQ ID NO: 1258482 - DNA, 22 bp, Artificial Sequence
  chemically synthesized
gttcttatgtaataagatattt

SEQ ID NO: 1258483 - DNA, 22 bp, Artificial Sequence
  chemically synthesized
ttcttatgtaataagatatttt

SEQ ID NO: 1258484 - DNA, 22 bp, Artificial Sequence
  chemically synthesized
ttatgtaataagatatttttaa

SEQ ID NO: 1258485 - DNA, 22 bp, Artificial Sequence
  chemically synthesized
atgtaataagatatttttaaaa

SEQ ID NO: 1258486 - DNA, 22 bp, Artificial Sequence
  chemically synthesized
tgtaataagatatttttaaaag

SEQ ID NO: 1258487 - DNA, 22 bp, Artificial Sequence
  chemically synthesized
aacatgtatctgtcttttaaaa

SEQ ID NO: 1258488 - DNA, 22 bp, Artificial Sequence
  chemically synthesized
ccaatcagttaaacatgtatct

SEQ ID NO: 1258489 - DNA, 22 bp, Artificial Sequence
  chemically synthesized
gccaatcagttaaacatgtatc

SEQ ID NO: 1258490 - DNA, 22 bp, Artificial Sequence
  chemically synthesized
ttaaaagacagatacatgttta

SEQ ID NO: 1258491 - DNA, 22 bp, Artificial Sequence
  chemically synthesized
taaaagacagatacatgtttaa

SEQ ID NO: 1258492 - DNA, 22 bp, Artificial Sequence
  chemically synthesized
aaaagacagatacatgtttaac

SEQ ID NO: 1258493 - DNA, 22 bp, Artificial Sequence
  chemically synthesized
acttgccaatcagttaaacatg

SEQ ID NO: 1258494 - DNA, 22 bp, Artificial Sequence
  chemically synthesized
aaagacagatacatgtttaact

SEQ ID NO: 1258495 - DNA, 22 bp, Artificial Sequence
  chemically synthesized
tactaacttgccaatcagttaa

SEQ ID NO: 1258496 - DNA, 22 bp, Artificial Sequence
  chemically synthesized
ttatactaacttgccaatcagt

SEQ ID NO: 1258497 - DNA, 22 bp, Artificial Sequence
  chemically synthesized
atgttgttatactaacttgcca

SEQ ID NO: 1258498 - DNA, 22 bp, Artificial Sequence
  chemically synthesized
aactgattggcaagttagtata

SEQ ID NO: 1258499 - DNA, 22 bp, Artificial Sequence
  chemically synthesized
ggttgatgttgttatactaact

SEQ ID NO: 1258500 - DNA, 22 bp, Artificial Sequence
  chemically synthesized
actgattggcaagttagtataa

SEQ ID NO: 1258501 - DNA, 22 bp, Artificial Sequence
  chemically synthesized
aggttgatgttgttatactaac

SEQ ID NO: 1258502 - DNA, 22 bp, Artificial Sequence
  chemically synthesized
taggttgatgttgttatactaa

SEQ ID NO: 1258503 - DNA, 22 bp, Artificial Sequence
  chemically synthesized
ttaggttgatgttgttatacta

SEQ ID NO: 1258504 - DNA, 22 bp, Artificial Sequence
  chemically synthesized
attggcaagttagtataacaac

SEQ ID NO: 1258505 - DNA, 22 bp, Artificial Sequence
  chemically synthesized
ttttaggttgatgttgttatac

SEQ ID NO: 1258506 - DNA, 22 bp, Artificial Sequence
  chemically synthesized
cttttaggttgatgttgttata

SEQ ID NO: 1258507 - DNA, 22 bp, Artificial Sequence
  chemically synthesized
gcaagttagtataacaacatca

SEQ ID NO: 1258508 - DNA, 22 bp, Artificial Sequence
  chemically synthesized
atttcttttaggttgatgttgt

SEQ ID NO: 1258509 - DNA, 22 bp, Artificial Sequence
  chemically synthesized
aatttcttttaggttgatgttg

SEQ ID NO: 1258510 - DNA, 22 bp, Artificial Sequence
  chemically synthesized
gtataacaacatcaacctaaaa

SEQ ID NO: 1258511 - DNA, 22 bp, Artificial Sequence
  chemically synthesized
aaagaaattaagtttatttttg

SEQ ID NO: 1258512 - DNA, 22 bp, Artificial Sequence
  chemically synthesized
aaaaacaaaaacaaaaacaaaa

SEQ ID NO: 1258513 - DNA, 22 bp, Artificial Sequence
  chemically synthesized
aaaaaacaaaaacaaaaacaaa

SEQ ID NO: 1258514 - DNA, 22 bp, Artificial Sequence
  chemically synthesized
agtttatttttgtttttgtttt

SEQ ID NO: 1258515 - DNA, 22 bp, Artificial Sequence
  chemically synthesized
agatttaaaaaacaaaaacaaa

SEQ ID NO: 1258516 - DNA, 22 bp, Artificial Sequence
  chemically synthesized
cagatttaaaaaacaaaaacaa

SEQ ID NO: 1258517 - DNA, 22 bp, Artificial Sequence
  chemically synthesized
tcagatttaaaaaacaaaaaca

SEQ ID NO: 1258518 - DNA, 22 bp, Artificial Sequence
  chemically synthesized
atttttgtttttgtttttgttt

SEQ ID NO: 1258519 - DNA, 22 bp, Artificial Sequence
  chemically synthesized
ttcagatttaaaaaacaaaaac

SEQ ID NO: 1258520 - DNA, 22 bp, Artificial Sequence
  chemically synthesized
tttttgtttttgtttttgtttt

SEQ ID NO: 1258521 - DNA, 22 bp, Artificial Sequence
  chemically synthesized
ttgtttttgtttttgtttttta

SEQ ID NO: 1258522 - DNA, 22 bp, Artificial Sequence
  chemically synthesized
tgtttttgtttttgttttttaa

SEQ ID NO: 1258523 - DNA, 22 bp, Artificial Sequence
  chemically synthesized
gtttttgtttttgttttttaaa

SEQ ID NO: 1258524 - DNA, 22 bp, Artificial Sequence
  chemically synthesized
tttttgtttttgttttttaaat

SEQ ID NO: 1258525 - DNA, 22 bp, Artificial Sequence
  chemically synthesized
ttgtttttgttttttaaatctg

SEQ ID NO: 1258526 - DNA, 22 bp, Artificial Sequence
  chemically synthesized
tgtttttgttttttaaatctga

SEQ ID NO: 1258527 - DNA, 22 bp, Artificial Sequence
  chemically synthesized
gtttttgttttttaaatctgaa

SEQ ID NO: 1258528 - DNA, 22 bp, Artificial Sequence
  chemically synthesized
tttttgttttttaaatctgaaa

SEQ ID NO: 1258529 - DNA, 22 bp, Artificial Sequence
  chemically synthesized
aaagggaaatgcttttcagatt

SEQ ID NO: 1258530 - DNA, 22 bp, Artificial Sequence
  chemically synthesized
ttgttttttaaatctgaaaagc

SEQ ID NO: 1258531 - DNA, 22 bp, Artificial Sequence
  chemically synthesized
tgttttttaaatctgaaaagca

SEQ ID NO: 1258532 - DNA, 22 bp, Artificial Sequence
  chemically synthesized
gttttttaaatctgaaaagcat

SEQ ID NO: 1258533 - DNA, 22 bp, Artificial Sequence
  chemically synthesized
ttttttaaatctgaaaagcatt

SEQ ID NO: 1258534 - DNA, 22 bp, Artificial Sequence
  chemically synthesized
tttaaatctgaaaagcatttcc

SEQ ID NO: 1258535 - DNA, 22 bp, Artificial Sequence
  chemically synthesized
ttaaatctgaaaagcatttccc

SEQ ID NO: 1258536 - DNA, 22 bp, Artificial Sequence
  chemically synthesized
taaatctgaaaagcatttccct

SEQ ID NO: 1258537 - DNA, 22 bp, Artificial Sequence
  chemically synthesized
aaatctgaaaagcatttccctt

SEQ ID NO: 1258538 - DNA, 22 bp, Artificial Sequence
  chemically synthesized
aatctgaaaagcatttcccttt

SEQ ID NO: 1258539 - DNA, 22 bp, Artificial Sequence
  chemically synthesized
aaaagcatttccctttcagctt

SEQ ID NO: 1258540 - DNA, 22 bp, Artificial Sequence
  chemically synthesized
gtgcaagaaacccagcaagctg

SEQ ID NO: 1258541 - DNA, 22 bp, Artificial Sequence
  chemically synthesized
agtgcaagaaacccagcaagct

SEQ ID NO: 1258542 - DNA, 22 bp, Artificial Sequence
  chemically synthesized
tagtgcaagaaacccagcaagc

SEQ ID NO: 1258543 - DNA, 22 bp, Artificial Sequence
  chemically synthesized
ttagtgcaagaaacccagcaag

SEQ ID NO: 1258544 - DNA, 22 bp, Artificial Sequence
  chemically synthesized
ccctttcagcttgctgggtttc

SEQ ID NO: 1258545 - DNA, 22 bp, Artificial Sequence
  chemically synthesized
cctttcagcttgctgggtttct

SEQ ID NO: 1258546 - DNA, 22 bp, Artificial Sequence
  chemically synthesized
atcttttagtgcaagaaaccca

SEQ ID NO: 1258547 - DNA, 22 bp, Artificial Sequence
  chemically synthesized
tcagcttgctgggtttcttgca

SEQ ID NO: 1258548 - DNA, 22 bp, Artificial Sequence
  chemically synthesized
cagcttgctgggtttcttgcac

SEQ ID NO: 1258549 - DNA, 22 bp, Artificial Sequence
  chemically synthesized
agcttgctgggtttcttgcact

SEQ ID NO: 1258550 - DNA, 22 bp, Artificial Sequence
  chemically synthesized
aaccctcatcttttagtgcaag

SEQ ID NO: 1258551 - DNA, 22 bp, Artificial Sequence
  chemically synthesized
gctgggtttcttgcactaaaag

SEQ ID NO: 1258552 - DNA, 22 bp, Artificial Sequence
  chemically synthesized
ttaaaccctcatcttttagtgc

SEQ ID NO: 1258553 - DNA, 22 bp, Artificial Sequence
  chemically synthesized
ctgggtttcttgcactaaaaga

SEQ ID NO: 1258554 - DNA, 22 bp, Artificial Sequence
  chemically synthesized
ggtttcttgcactaaaagatga

SEQ ID NO: 1258555 - DNA, 22 bp, Artificial Sequence
  chemically synthesized
tgattattaaaccctcatcttt

SEQ ID NO: 1258556 - DNA, 22 bp, Artificial Sequence
  chemically synthesized
cttgcactaaaagatgagggtt

SEQ ID NO: 1258557 - DNA, 22 bp, Artificial Sequence
  chemically synthesized
ctatgattattaaaccctcatc

SEQ ID NO: 1258558 - DNA, 22 bp, Artificial Sequence
  chemically synthesized
ttgcactaaaagatgagggttt

SEQ ID NO: 1258559 - DNA, 22 bp, Artificial Sequence
  chemically synthesized
gcactaaaagatgagggtttaa

SEQ ID NO: 1258560 - DNA, 22 bp, Artificial Sequence
  chemically synthesized
cactaaaagatgagggtttaat

SEQ ID NO: 1258561 - DNA, 22 bp, Artificial Sequence
  chemically synthesized
atctgctatgattattaaaccc

SEQ ID NO: 1258562 - DNA, 22 bp, Artificial Sequence
  chemically synthesized
tgatctgctatgattattaaac

SEQ ID NO: 1258563 - DNA, 22 bp, Artificial Sequence
  chemically synthesized
aaagatgagggtttaataatca

SEQ ID NO: 1258564 - DNA, 22 bp, Artificial Sequence
  chemically synthesized
aagcctctgatctgctatgatt

SEQ ID NO: 1258565 - DNA, 22 bp, Artificial Sequence
  chemically synthesized
ctgaagcctctgatctgctatg

SEQ ID NO: 1258566 - DNA, 22 bp, Artificial Sequence
  chemically synthesized
cctactgaagcctctgatctgc

SEQ ID NO: 1258567 - DNA, 22 bp, Artificial Sequence
  chemically synthesized
aataatcatagcagatcagagg

SEQ ID NO: 1258568 - DNA, 22 bp, Artificial Sequence
  chemically synthesized
ataatcatagcagatcagaggc

SEQ ID NO: 1258569 - DNA, 22 bp, Artificial Sequence
  chemically synthesized
ctccctactgaagcctctgatc

SEQ ID NO: 1258570 - DNA, 22 bp, Artificial Sequence
  chemically synthesized
tcccatctcctccctactgaag

SEQ ID NO: 1258571 - DNA, 22 bp, Artificial Sequence
  chemically synthesized
acaataagctatcccatctcct

SEQ ID NO: 1258572 - DNA, 22 bp, Artificial Sequence
  chemically synthesized
cacaataagctatcccatctcc

SEQ ID NO: 1258573 - DNA, 22 bp, Artificial Sequence
  chemically synthesized
tcacaataagctatcccatctc

SEQ ID NO: 1258574 - DNA, 22 bp, Artificial Sequence
  chemically synthesized
ttcacaataagctatcccatct

SEQ ID NO: 1258575 - DNA, 22 bp, Artificial Sequence
  chemically synthesized
cagtagggaggagatgggatag

SEQ ID NO: 1258576 - DNA, 22 bp, Artificial Sequence
  chemically synthesized
agtagggaggagatgggatagc

SEQ ID NO: 1258577 - DNA, 22 bp, Artificial Sequence
  chemically synthesized
gggggaaaatcgtttttcacaa

SEQ ID NO: 1258578 - DNA, 22 bp, Artificial Sequence
  chemically synthesized
aactagggggaaaatcgttttt

SEQ ID NO: 1258579 - DNA, 22 bp, Artificial Sequence
  chemically synthesized
aaactagggggaaaatcgtttt

SEQ ID NO: 1258580 - DNA, 22 bp, Artificial Sequence
  chemically synthesized
taaactagggggaaaatcgttt

SEQ ID NO: 1258581 - DNA, 22 bp, Artificial Sequence
  chemically synthesized
ttaaactagggggaaaatcgtt

SEQ ID NO: 1258582 - DNA, 22 bp, Artificial Sequence
  chemically synthesized
attgtgaaaaacgattttcccc

SEQ ID NO: 1258583 - DNA, 22 bp, Artificial Sequence
  chemically synthesized
ttgtgaaaaacgattttccccc

SEQ ID NO: 1258584 - DNA, 22 bp, Artificial Sequence
  chemically synthesized
tgaaaaacgattttccccctag

SEQ ID NO: 1258585 - DNA, 22 bp, Artificial Sequence
  chemically synthesized
ccaggggccacttttaaactag

SEQ ID NO: 1258586 - DNA, 22 bp, Artificial Sequence
  chemically synthesized
tccccctagtttaaaagtggcc

SEQ ID NO: 1258587 - DNA, 22 bp, Artificial Sequence
  chemically synthesized
ccccctagtttaaaagtggccc

SEQ ID NO: 1258588 - DNA, 22 bp, Artificial Sequence
  chemically synthesized
cccctagtttaaaagtggcccc

SEQ ID NO: 1258589 - DNA, 22 bp, Artificial Sequence
  chemically synthesized
aagaaaaatgttaccaggggcc

SEQ ID NO: 1258590 - DNA, 22 bp, Artificial Sequence
  chemically synthesized
caagaaaaatgttaccaggggc

SEQ ID NO: 1258591 - DNA, 22 bp, Artificial Sequence
  chemically synthesized
gtttaaaagtggcccctggtaa

SEQ ID NO: 1258592 - DNA, 22 bp, Artificial Sequence
  chemically synthesized
aaaagtggcccctggtaacatt

SEQ ID NO: 1258593 - DNA, 22 bp, Artificial Sequence
  chemically synthesized
aaagtggcccctggtaacattt

SEQ ID NO: 1258594 - DNA, 22 bp, Artificial Sequence
  chemically synthesized
gaagcttcaagaaaaatgttac

SEQ ID NO: 1258595 - DNA, 22 bp, Artificial Sequence
  chemically synthesized
gtaacatttttcttgaagcttc

SEQ ID NO: 1258596 - DNA, 22 bp, Artificial Sequence
  chemically synthesized
acaacgatatatataactagaa

SEQ ID NO: 1258597 - DNA, 22 bp, Artificial Sequence
  chemically synthesized
ttcttgaagcttctagttatat

SEQ ID NO: 1258598 - DNA, 22 bp, Artificial Sequence
  chemically synthesized
tcttgaagcttctagttatata

SEQ ID NO: 1258599 - DNA, 22 bp, Artificial Sequence
  chemically synthesized
cttgaagcttctagttatatat

SEQ ID NO: 1258600 - DNA, 22 bp, Artificial Sequence
  chemically synthesized
ttgaagcttctagttatatata

SEQ ID NO: 1258601 - DNA, 22 bp, Artificial Sequence
  chemically synthesized
gaagcttctagttatatatatc

SEQ ID NO: 1258602 - DNA, 22 bp, Artificial Sequence
  chemically synthesized
aagcttctagttatatatatcg

SEQ ID NO: 1258603 - DNA, 22 bp, Artificial Sequence
  chemically synthesized
caaagtgactgacaacgatata

SEQ ID NO: 1258604 - DNA, 22 bp, Artificial Sequence
  chemically synthesized
ctagttatatatatcgttgtca

SEQ ID NO: 1258605 - DNA, 22 bp, Artificial Sequence
  chemically synthesized
tagttatatatatcgttgtcag

SEQ ID NO: 1258606 - DNA, 22 bp, Artificial Sequence
  chemically synthesized
gttatatatatcgttgtcagtc

SEQ ID NO: 1258607 - DNA, 22 bp, Artificial Sequence
  chemically synthesized
aaagttgcaaagtgactgacaa

SEQ ID NO: 1258608 - DNA, 22 bp, Artificial Sequence
  chemically synthesized
caaagttgcaaagtgactgaca

SEQ ID NO: 1258609 - DNA, 22 bp, Artificial Sequence
  chemically synthesized
tatatatcgttgtcagtcactt

SEQ ID NO: 1258610 - DNA, 22 bp, Artificial Sequence
  chemically synthesized
ttcaaagttgcaaagtgactga

SEQ ID NO: 1258611 - DNA, 22 bp, Artificial Sequence
  chemically synthesized
cttcaaagttgcaaagtgactg

SEQ ID NO: 1258612 - DNA, 22 bp, Artificial Sequence
  chemically synthesized
tttcttcaaagttgcaaagtga

SEQ ID NO: 1258613 - DNA, 22 bp, Artificial Sequence
  chemically synthesized
tcagtcactttgcaactttgaa

SEQ ID NO: 1258614 - DNA, 22 bp, Artificial Sequence
  chemically synthesized
ggcaggaaaactgtttcttcaa

SEQ ID NO: 1258615 - DNA, 22 bp, Artificial Sequence
  chemically synthesized
cggcaggaaaactgtttcttca

SEQ ID NO: 1258616 - DNA, 22 bp, Artificial Sequence
  chemically synthesized
tgcaactttgaagaaacagttt

SEQ ID NO: 1258617 - DNA, 22 bp, Artificial Sequence
  chemically synthesized
gcaactttgaagaaacagtttt

SEQ ID NO: 1258618 - DNA, 22 bp, Artificial Sequence
  chemically synthesized
caactttgaagaaacagttttc

SEQ ID NO: 1258619 - DNA, 22 bp, Artificial Sequence
  chemically synthesized
tgaagaaacagttttcctgccg

SEQ ID NO: 1258620 - DNA, 22 bp, Artificial Sequence
  chemically synthesized
gaagaaacagttttcctgccga

SEQ ID NO: 1258621 - DNA, 22 bp, Artificial Sequence
  chemically synthesized
taatagagcccttcggcaggaa

SEQ ID NO: 1258622 - DNA, 22 bp, Artificial Sequence
  chemically synthesized
aagaaacagttttcctgccgaa

SEQ ID NO: 1258623 - DNA, 22 bp, Artificial Sequence
  chemically synthesized
actataatagagcccttcggca

SEQ ID NO: 1258624 - DNA, 22 bp, Artificial Sequence
  chemically synthesized
tcctgccgaagggctctattat

SEQ ID NO: 1258625 - DNA, 22 bp, Artificial Sequence
  chemically synthesized
cctgccgaagggctctattata

SEQ ID NO: 1258626 - DNA, 22 bp, Artificial Sequence
  chemically synthesized
ctgccgaagggctctattatag

SEQ ID NO: 1258627 - DNA, 22 bp, Artificial Sequence
  chemically synthesized
ccgaagggctctattatagtta

SEQ ID NO: 1258628 - DNA, 22 bp, Artificial Sequence
  chemically synthesized
tgtagacacatattaactataa

SEQ ID NO: 1258629 - DNA, 22 bp, Artificial Sequence
  chemically synthesized
tattatgtagacacatattaac

SEQ ID NO: 1258630 - DNA, 22 bp, Artificial Sequence
  chemically synthesized
gtattatgtagacacatattaa

SEQ ID NO: 1258631 - DNA, 22 bp, Artificial Sequence
  chemically synthesized
tgtattatgtagacacatatta

SEQ ID NO: 1258632 - DNA, 22 bp, Artificial Sequence
  chemically synthesized
ttgtattatgtagacacatatt

SEQ ID NO: 1258633 - DNA, 22 bp, Artificial Sequence
  chemically synthesized
tttgtattatgtagacacatat

SEQ ID NO: 1258634 - DNA, 22 bp, Artificial Sequence
  chemically synthesized
tattatagttaatatgtgtcta

SEQ ID NO: 1258635 - DNA, 22 bp, Artificial Sequence
  chemically synthesized
ttatagttaatatgtgtctaca

SEQ ID NO: 1258636 - DNA, 22 bp, Artificial Sequence
  chemically synthesized
tagttaatatgtgtctacataa

SEQ ID NO: 1258637 - DNA, 22 bp, Artificial Sequence
  chemically synthesized
aatgactttttgtattatgtag

SEQ ID NO: 1258638 - DNA, 22 bp, Artificial Sequence
  chemically synthesized
aaatgactttttgtattatgta

SEQ ID NO: 1258639 - DNA, 22 bp, Artificial Sequence
  chemically synthesized
taaatgactttttgtattatgt

SEQ ID NO: 1258640 - DNA, 22 bp, Artificial Sequence
  chemically synthesized
ttaaatgactttttgtattatg

SEQ ID NO: 1258641 - DNA, 22 bp, Artificial Sequence
  chemically synthesized
atatgtgtctacataatacaaa

SEQ ID NO: 1258642 - DNA, 22 bp, Artificial Sequence
  chemically synthesized
cataatacaaaaagtcatttaa

SEQ ID NO: 1258643 - DNA, 22 bp, Artificial Sequence
  chemically synthesized
aagcaataatttttaaatgact

SEQ ID NO: 1258644 - DNA, 22 bp, Artificial Sequence
  chemically synthesized
aaagcaataatttttaaatgac

SEQ ID NO: 1258645 - DNA, 22 bp, Artificial Sequence
  chemically synthesized
ttaaagcaataatttttaaatg

SEQ ID NO: 1258646 - DNA, 22 bp, Artificial Sequence
  chemically synthesized
aataaatagttcttaaagcaat

SEQ ID NO: 1258647 - DNA, 22 bp, Artificial Sequence
  chemically synthesized
aaaaattattgctttaagaact

SEQ ID NO: 1258648 - DNA, 22 bp, Artificial Sequence
  chemically synthesized
aaaattattgctttaagaacta

SEQ ID NO: 1258649 - DNA, 22 bp, Artificial Sequence
  chemically synthesized
ggaggcactcaataaatagttc

SEQ ID NO: 1258650 - DNA, 22 bp, Artificial Sequence
  chemically synthesized
aggaggcactcaataaatagtt

SEQ ID NO: 1258651 - DNA, 22 bp, Artificial Sequence
  chemically synthesized
ttgctttaagaactatttattg

SEQ ID NO: 1258652 - DNA, 22 bp, Artificial Sequence
  chemically synthesized
ctttaagaactatttattgagt

SEQ ID NO: 1258653 - DNA, 22 bp, Artificial Sequence
  chemically synthesized
tgtacttaggaggcactcaata

SEQ ID NO: 1258654 - DNA, 22 bp, Artificial Sequence
  chemically synthesized
taagaactatttattgagtgcc

SEQ ID NO: 1258655 - DNA, 22 bp, Artificial Sequence
  chemically synthesized
aagaactatttattgagtgcct

SEQ ID NO: 1258656 - DNA, 22 bp, Artificial Sequence
  chemically synthesized
agaactatttattgagtgcctc

SEQ ID NO: 1258657 - DNA, 22 bp, Artificial Sequence
  chemically synthesized
atgttatgtacttaggaggcac

SEQ ID NO: 1258658 - DNA, 22 bp, Artificial Sequence
  chemically synthesized
gatgttatgtacttaggaggca

SEQ ID NO: 1258659 - DNA, 22 bp, Artificial Sequence
  chemically synthesized
tttattgagtgcctcctaagta

SEQ ID NO: 1258660 - DNA, 22 bp, Artificial Sequence
  chemically synthesized
attgagtgcctcctaagtacat

SEQ ID NO: 1258661 - DNA, 22 bp, Artificial Sequence
  chemically synthesized
ttgagtgcctcctaagtacata

SEQ ID NO: 1258662 - DNA, 22 bp, Artificial Sequence
  chemically synthesized
acagtttgatgttatgtactta

SEQ ID NO: 1258663 - DNA, 22 bp, Artificial Sequence
  chemically synthesized
agtgcctcctaagtacataaca

SEQ ID NO: 1258664 - DNA, 22 bp, Artificial Sequence
  chemically synthesized
aattcacagtttgatgttatgt

SEQ ID NO: 1258665 - DNA, 22 bp, Artificial Sequence
  chemically synthesized
aaattcacagtttgatgttatg

SEQ ID NO: 1258666 - DNA, 22 bp, Artificial Sequence
  chemically synthesized
taaattcacagtttgatgttat

SEQ ID NO: 1258667 - DNA, 22 bp, Artificial Sequence
  chemically synthesized
ctaagtacataacatcaaactg

SEQ ID NO: 1258668 - DNA, 22 bp, Artificial Sequence
  chemically synthesized
agtacataacatcaaactgtga

SEQ ID NO: 1258669 - DNA, 22 bp, Artificial Sequence
  chemically synthesized
tgcaagtccactttaaattcac

SEQ ID NO: 1258670 - DNA, 22 bp, Artificial Sequence
  chemically synthesized
aattatgcaagtccactttaaa

SEQ ID NO: 1258671 - DNA, 22 bp, Artificial Sequence
  chemically synthesized
attaaattatgcaagtccactt

SEQ ID NO: 1258672 - DNA, 22 bp, Artificial Sequence
  chemically synthesized
gattaaattatgcaagtccact

SEQ ID NO: 1258673 - DNA, 22 bp, Artificial Sequence
  chemically synthesized
tgattaaattatgcaagtccac

SEQ ID NO: 1258674 - DNA, 22 bp, Artificial Sequence
  chemically synthesized
tgaatttaaagtggacttgcat

SEQ ID NO: 1258675 - DNA, 22 bp, Artificial Sequence
  chemically synthesized
aaagtggacttgcataatttaa

SEQ ID NO: 1258676 - DNA, 22 bp, Artificial Sequence
  chemically synthesized
aagtggacttgcataatttaat

SEQ ID NO: 1258677 - DNA, 22 bp, Artificial Sequence
  chemically synthesized
gtataaattttgattaaattat

SEQ ID NO: 1258678 - DNA, 22 bp, Artificial Sequence
  chemically synthesized
agtataaattttgattaaatta

SEQ ID NO: 1258679 - DNA, 22 bp, Artificial Sequence
  chemically synthesized
cttagtataaattttgattaaa

SEQ ID NO: 1258680 - DNA, 22 bp, Artificial Sequence
  chemically synthesized
ccttagtataaattttgattaa

SEQ ID NO: 1258681 - DNA, 22 bp, Artificial Sequence
  chemically synthesized
tccttagtataaattttgatta

SEQ ID NO: 1258682 - DNA, 22 bp, Artificial Sequence
  chemically synthesized
ttttccttagtataaattttga

SEQ ID NO: 1258683 - DNA, 22 bp, Artificial Sequence
  chemically synthesized
gcataatttaatcaaaatttat

SEQ ID NO: 1258684 - DNA, 22 bp, Artificial Sequence
  chemically synthesized
cataatttaatcaaaatttata

SEQ ID NO: 1258685 - DNA, 22 bp, Artificial Sequence
  chemically synthesized
tagcctgttttccttagtataa

SEQ ID NO: 1258686 - DNA, 22 bp, Artificial Sequence
  chemically synthesized
aatcaaaatttatactaaggaa

SEQ ID NO: 1258687 - DNA, 22 bp, Artificial Sequence
  chemically synthesized
atcaaaatttatactaaggaaa

SEQ ID NO: 1258688 - DNA, 22 bp, Artificial Sequence
  chemically synthesized
atactaaggaaaacaggctata

SEQ ID NO: 1258689 - DNA, 22 bp, Artificial Sequence
  chemically synthesized
tactaaggaaaacaggctatag

SEQ ID NO: 1258690 - DNA, 22 bp, Artificial Sequence
  chemically synthesized
tagtatcgaaaagccctatagc

SEQ ID NO: 1258691 - DNA, 22 bp, Artificial Sequence
  chemically synthesized
aggaaaacaggctatagggctt

SEQ ID NO: 1258692 - DNA, 22 bp, Artificial Sequence
  chemically synthesized
aggtattgtagtatcgaaaagc

SEQ ID NO: 1258693 - DNA, 22 bp, Artificial Sequence
  chemically synthesized
caggtattgtagtatcgaaaag

SEQ ID NO: 1258694 - DNA, 22 bp, Artificial Sequence
  chemically synthesized
tcaggtattgtagtatcgaaaa

SEQ ID NO: 1258695 - DNA, 22 bp, Artificial Sequence
  chemically synthesized
ttcaggtattgtagtatcgaaa

SEQ ID NO: 1258696 - DNA, 22 bp, Artificial Sequence
  chemically synthesized
atttttcaggtattgtagtatc

SEQ ID NO: 1258697 - DNA, 22 bp, Artificial Sequence
  chemically synthesized
tagggcttttcgatactacaat

SEQ ID NO: 1258698 - DNA, 22 bp, Artificial Sequence
  chemically synthesized
catttttcaggtattgtagtat

SEQ ID NO: 1258699 - DNA, 22 bp, Artificial Sequence
  chemically synthesized
ttcgatactacaatacctgaaa

SEQ ID NO: 1258700 - DNA, 22 bp, Artificial Sequence
  chemically synthesized
tagtatttcatttttcaggtat

SEQ ID NO: 1258701 - DNA, 22 bp, Artificial Sequence
  chemically synthesized
tcgatactacaatacctgaaaa

SEQ ID NO: 1258702 - DNA, 22 bp, Artificial Sequence
  chemically synthesized
cgatactacaatacctgaaaaa

SEQ ID NO: 1258703 - DNA, 22 bp, Artificial Sequence
  chemically synthesized
gatactacaatacctgaaaaat

SEQ ID NO: 1258704 - DNA, 22 bp, Artificial Sequence
  chemically synthesized
taactgtagtatttcatttttc

SEQ ID NO: 1258705 - DNA, 22 bp, Artificial Sequence
  chemically synthesized
caatacctgaaaaatgaaatac

SEQ ID NO: 1258706 - DNA, 22 bp, Artificial Sequence
  chemically synthesized
aaaaatgaaatactacagttat

SEQ ID NO: 1258707 - DNA, 22 bp, Artificial Sequence
  chemically synthesized
gtatcatgtggattataactgt

SEQ ID NO: 1258708 - DNA, 22 bp, Artificial Sequence
  chemically synthesized
atacctggtatcatgtggatta

SEQ ID NO: 1258709 - DNA, 22 bp, Artificial Sequence
  chemically synthesized
catacctggtatcatgtggatt

SEQ ID NO: 1258710 - DNA, 22 bp, Artificial Sequence
  chemically synthesized
cagttataatccacatgatacc

SEQ ID NO: 1258711 - DNA, 22 bp, Artificial Sequence
  chemically synthesized
aatgtttcatacctggtatcat

SEQ ID NO: 1258712 - DNA, 22 bp, Artificial Sequence
  chemically synthesized
ctgaatgtttcatacctggtat

SEQ ID NO: 1258713 - DNA, 22 bp, Artificial Sequence
  chemically synthesized
taatccacatgataccaggtat

SEQ ID NO: 1258714 - DNA, 22 bp, Artificial Sequence
  chemically synthesized
ctactgaatgtttcatacctgg

SEQ ID NO: 1258715 - DNA, 22 bp, Artificial Sequence
  chemically synthesized
gcccactgctactgaatgtttc

SEQ ID NO: 1258716 - DNA, 22 bp, Artificial Sequence
  chemically synthesized
tagcccactgctactgaatgtt

SEQ ID NO: 1258717 - DNA, 22 bp, Artificial Sequence
  chemically synthesized
tagctctagcccactgctactg

SEQ ID NO: 1258718 - DNA, 22 bp, Artificial Sequence
  chemically synthesized
agtagcagtgggctagagctac

SEQ ID NO: 1258719 - DNA, 22 bp, Artificial Sequence
  chemically synthesized
aagaaggtaacctgtagctcta

SEQ ID NO: 1258720 - DNA, 22 bp, Artificial Sequence
  chemically synthesized
acaacgtgtctcaagaaggtaa

SEQ ID NO: 1258721 - DNA, 22 bp, Artificial Sequence
  chemically synthesized
gacaacgtgtctcaagaaggta

SEQ ID NO: 1258722 - DNA, 22 bp, Artificial Sequence
  chemically synthesized
gagctacaggttaccttcttga

SEQ ID NO: 1258723 - DNA, 22 bp, Artificial Sequence
  chemically synthesized
tgacaacgtgtctcaagaaggt

SEQ ID NO: 1258724 - DNA, 22 bp, Artificial Sequence
  chemically synthesized
tttgacaacgtgtctcaagaag

SEQ ID NO: 1258725 - DNA, 22 bp, Artificial Sequence
  chemically synthesized
ctttgacaacgtgtctcaagaa

SEQ ID NO: 1258726 - DNA, 22 bp, Artificial Sequence
  chemically synthesized
caggttaccttcttgagacacg

SEQ ID NO: 1258727 - DNA, 22 bp, Artificial Sequence
  chemically synthesized
tggtcttctttgacaacgtgtc

SEQ ID NO: 1258728 - DNA, 22 bp, Artificial Sequence
  chemically synthesized
ccttcttgagacacgttgtcaa

SEQ ID NO: 1258729 - DNA, 22 bp, Artificial Sequence
  chemically synthesized
gtgctatggtcttctttgacaa

SEQ ID NO: 1258730 - DNA, 22 bp, Artificial Sequence
  chemically synthesized
cttgagacacgttgtcaaagaa

SEQ ID NO: 1258731 - DNA, 22 bp, Artificial Sequence
  chemically synthesized
ttgagacacgttgtcaaagaag

SEQ ID NO: 1258732 - DNA, 22 bp, Artificial Sequence
  chemically synthesized
gagacacgttgtcaaagaagac

SEQ ID NO: 1258733 - DNA, 22 bp, Artificial Sequence
  chemically synthesized
cctagtgctatggtcttctttg

SEQ ID NO: 1258734 - DNA, 22 bp, Artificial Sequence
  chemically synthesized
agacacgttgtcaaagaagacc

SEQ ID NO: 1258735 - DNA, 22 bp, Artificial Sequence
  chemically synthesized
ccaattacctagtgctatggtc

SEQ ID NO: 1258736 - DNA, 22 bp, Artificial Sequence
  chemically synthesized
cccaattacctagtgctatggt

SEQ ID NO: 1258737 - DNA, 22 bp, Artificial Sequence
  chemically synthesized
tcaaagaagaccatagcactag

SEQ ID NO: 1258738 - DNA, 22 bp, Artificial Sequence
  chemically synthesized
gatttcccaattacctagtgct

SEQ ID NO: 1258739 - DNA, 22 bp, Artificial Sequence
  chemically synthesized
caactggatttcccaattacct

SEQ ID NO: 1258740 - DNA, 22 bp, Artificial Sequence
  chemically synthesized
cacagttccaactggatttccc

SEQ ID NO: 1258741 - DNA, 22 bp, Artificial Sequence
  chemically synthesized
ctacacagttccaactggattt

SEQ ID NO: 1258742 - DNA, 22 bp, Artificial Sequence
  chemically synthesized
ggtaattgggaaatccagttgg

SEQ ID NO: 1258743 - DNA, 22 bp, Artificial Sequence
  chemically synthesized
ggaaatccagttggaactgtgt

SEQ ID NO: 1258744 - DNA, 22 bp, Artificial Sequence
  chemically synthesized
gaactgtgtagcagacactgcc

SEQ ID NO: 1258745 - DNA, 22 bp, Artificial Sequence
  chemically synthesized
tgtagcagacactgcccactct

SEQ ID NO: 1258746 - DNA, 22 bp, Artificial Sequence
  chemically synthesized
atcaagccagaggtaaaccaac

SEQ ID NO: 1258747 - DNA, 22 bp, Artificial Sequence
  chemically synthesized
cccactctgttggtttacctct

SEQ ID NO: 1258748 - DNA, 22 bp, Artificial Sequence
  chemically synthesized
cagggctgatcaagccagaggt

SEQ ID NO: 1258749 - DNA, 22 bp, Artificial Sequence
  chemically synthesized
tgttggtttacctctggcttga

SEQ ID NO: 1258750 - DNA, 22 bp, Artificial Sequence
  chemically synthesized
ttggtttacctctggcttgatc

SEQ ID NO: 1258751 - DNA, 22 bp, Artificial Sequence
  chemically synthesized
cattacagggctgatcaagcca

SEQ ID NO: 1258752 - DNA, 22 bp, Artificial Sequence
  chemically synthesized
tccattacagggctgatcaagc

SEQ ID NO: 1258753 - DNA, 22 bp, Artificial Sequence
  chemically synthesized
gtttacctctggcttgatcagc

SEQ ID NO: 1258754 - DNA, 22 bp, Artificial Sequence
  chemically synthesized
acctctggcttgatcagccctg

SEQ ID NO: 1258755 - DNA, 22 bp, Artificial Sequence
  chemically synthesized
cctctggcttgatcagccctgt

SEQ ID NO: 1258756 - DNA, 22 bp, Artificial Sequence
  chemically synthesized
tggcttgatcagccctgtaatg

SEQ ID NO: 1258757 - DNA, 22 bp, Artificial Sequence
  chemically synthesized
gcttgatcagccctgtaatgga

SEQ ID NO: 1258758 - DNA, 22 bp, Artificial Sequence
  chemically synthesized
gcatgcccgagactctccatta

SEQ ID NO: 1258759 - DNA, 22 bp, Artificial Sequence
  chemically synthesized
gatcagccctgtaatggagagt

SEQ ID NO: 1258760 - DNA, 22 bp, Artificial Sequence
  chemically synthesized
atcagccctgtaatggagagtc

SEQ ID NO: 1258761 - DNA, 22 bp, Artificial Sequence
  chemically synthesized
ttagcatgcccgagactctcca

SEQ ID NO: 1258762 - DNA, 22 bp, Artificial Sequence
  chemically synthesized
gtgggctgttagcatgcccgag

SEQ ID NO: 1258763 - DNA, 22 bp, Artificial Sequence
  chemically synthesized
taatggagagtctcgggcatgc

SEQ ID NO: 1258764 - DNA, 22 bp, Artificial Sequence
  chemically synthesized
acctggtgggctgttagcatgc

SEQ ID NO: 1258765 - DNA, 22 bp, Artificial Sequence
  chemically synthesized
gacctggtgggctgttagcatg

SEQ ID NO: 1258766 - DNA, 22 bp, Artificial Sequence
  chemically synthesized
gggcatgctaacagcccaccag

SEQ ID NO: 1258767 - DNA, 22 bp, Artificial Sequence
  chemically synthesized
acagcccaccaggtcaagcacc

SEQ ID NO: 1258768 - DNA, 22 bp, Artificial Sequence
  chemically synthesized
aaacacagagaagcagtgggtg

SEQ ID NO: 1258769 - DNA, 22 bp, Artificial Sequence
  chemically synthesized
gacaaagtcgtgaggctgaaac

SEQ ID NO: 1258770 - DNA, 22 bp, Artificial Sequence
  chemically synthesized
ggacaaagtcgtgaggctgaaa

SEQ ID NO: 1258771 - DNA, 22 bp, Artificial Sequence
  chemically synthesized
tggacaaagtcgtgaggctgaa

SEQ ID NO: 1258772 - DNA, 22 bp, Artificial Sequence
  chemically synthesized
cttctctgtgtttcagcctcac

SEQ ID NO: 1258773 - DNA, 22 bp, Artificial Sequence
  chemically synthesized
ctctgtgtttcagcctcacgac

SEQ ID NO: 1258774 - DNA, 22 bp, Artificial Sequence
  chemically synthesized
tctgtgtttcagcctcacgact

SEQ ID NO: 1258775 - DNA, 22 bp, Artificial Sequence
  chemically synthesized
taactttggacaaagtcgtgag

SEQ ID NO: 1258776 - DNA, 22 bp, Artificial Sequence
  chemically synthesized
tgtgtttcagcctcacgacttt

SEQ ID NO: 1258777 - DNA, 22 bp, Artificial Sequence
  chemically synthesized
tataactttggacaaagtcgtg

SEQ ID NO: 1258778 - DNA, 22 bp, Artificial Sequence
  chemically synthesized
tgtttcagcctcacgactttgt

SEQ ID NO: 1258779 - DNA, 22 bp, Artificial Sequence
  chemically synthesized
ctataactttggacaaagtcgt

SEQ ID NO: 1258780 - DNA, 22 bp, Artificial Sequence
  chemically synthesized
cagcctcacgactttgtccaaa

SEQ ID NO: 1258781 - DNA, 22 bp, Artificial Sequence
  chemically synthesized
agcctcacgactttgtccaaag

SEQ ID NO: 1258782 - DNA, 22 bp, Artificial Sequence
  chemically synthesized
acgactttgtccaaagttatag

SEQ ID NO: 1258783 - DNA, 22 bp, Artificial Sequence
  chemically synthesized
gatgagtgagtttctataactt

SEQ ID NO: 1258784 - DNA, 22 bp, Artificial Sequence
  chemically synthesized
tgtccaaagttatagaaactca

SEQ ID NO: 1258785 - DNA, 22 bp, Artificial Sequence
  chemically synthesized
gtccaaagttatagaaactcac

SEQ ID NO: 1258786 - DNA, 22 bp, Artificial Sequence
  chemically synthesized
tgtgttggatgagtgagtttct

SEQ ID NO: 1258787 - DNA, 22 bp, Artificial Sequence
  chemically synthesized
tccaaagttatagaaactcact

SEQ ID NO: 1258788 - DNA, 22 bp, Artificial Sequence
  chemically synthesized
ctgtgtgttggatgagtgagtt

SEQ ID NO: 1258789 - DNA, 22 bp, Artificial Sequence
  chemically synthesized
tagaaactcactcatccaacac

SEQ ID NO: 1258790 - DNA, 22 bp, Artificial Sequence
  chemically synthesized
actcatccaacacacaggaggg

SEQ ID NO: 1258791 - DNA, 22 bp, Artificial Sequence
  chemically synthesized
agggacatcaggtcccctcctg

SEQ ID NO: 1258792 - DNA, 22 bp, Artificial Sequence
  chemically synthesized
atccaacacacaggaggggacc

SEQ ID NO: 1258793 - DNA, 22 bp, Artificial Sequence
  chemically synthesized
tcagggacatcaggtcccctcc

SEQ ID NO: 1258794 - DNA, 22 bp, Artificial Sequence
  chemically synthesized
ctcagggacatcaggtcccctc

SEQ ID NO: 1258795 - DNA, 22 bp, Artificial Sequence
  chemically synthesized
tttctcagggacatcaggtccc

SEQ ID NO: 1258796 - DNA, 22 bp, Artificial Sequence
  chemically synthesized
attatttctcagggacatcagg

SEQ ID NO: 1258797 - DNA, 22 bp, Artificial Sequence
  chemically synthesized
attaattatttctcagggacat

SEQ ID NO: 1258798 - DNA, 22 bp, Artificial Sequence
  chemically synthesized
tgcctcattaattatttctcag

SEQ ID NO: 1258799 - DNA, 22 bp, Artificial Sequence
  chemically synthesized
ctgtgcctcattaattatttct

SEQ ID NO: 1258800 - DNA, 22 bp, Artificial Sequence
  chemically synthesized
atgtccctgagaaataattaat

SEQ ID NO: 1258801 - DNA, 22 bp, Artificial Sequence
  chemically synthesized
gttcctgtgcctcattaattat

SEQ ID NO: 1258802 - DNA, 22 bp, Artificial Sequence
  chemically synthesized
tggttcctgtgcctcattaatt

SEQ ID NO: 1258803 - DNA, 22 bp, Artificial Sequence
  chemically synthesized
agaaataattaatgaggcacag

SEQ ID NO: 1258804 - DNA, 22 bp, Artificial Sequence
  chemically synthesized
gggaatatgtctctggttcctg

SEQ ID NO: 1258805 - DNA, 22 bp, Artificial Sequence
  chemically synthesized
atgaggcacaggaaccagagac

SEQ ID NO: 1258806 - DNA, 22 bp, Artificial Sequence
  chemically synthesized
aagaataagaggctggggaata

SEQ ID NO: 1258807 - DNA, 22 bp, Artificial Sequence
  chemically synthesized
tgaagaataagaggctggggaa

SEQ ID NO: 1258808 - DNA, 22 bp, Artificial Sequence
  chemically synthesized
tccctctgaagaataagaggct

SEQ ID NO: 1258809 - DNA, 22 bp, Artificial Sequence
  chemically synthesized
ataattgtccctctgaagaata

SEQ ID NO: 1258810 - DNA, 22 bp, Artificial Sequence
  chemically synthesized
cccagcctcttattcttcagag

SEQ ID NO: 1258811 - DNA, 22 bp, Artificial Sequence
  chemically synthesized
ttattcttcagagggacaatta

SEQ ID NO: 1258812 - DNA, 22 bp, Artificial Sequence
  chemically synthesized
tagaatgtactcataattgtcc

SEQ ID NO: 1258813 - DNA, 22 bp, Artificial Sequence
  chemically synthesized
attcttcagagggacaattatg

SEQ ID NO: 1258814 - DNA, 22 bp, Artificial Sequence
  chemically synthesized
ttcttcagagggacaattatga

SEQ ID NO: 1258815 - DNA, 22 bp, Artificial Sequence
  chemically synthesized
ttcagagggacaattatgagta

SEQ ID NO: 1258816 - DNA, 22 bp, Artificial Sequence
  chemically synthesized
cagagggacaattatgagtaca

SEQ ID NO: 1258817 - DNA, 22 bp, Artificial Sequence
  chemically synthesized
agagggacaattatgagtacat

SEQ ID NO: 1258818 - DNA, 22 bp, Artificial Sequence
  chemically synthesized
aggaatgctgtagaatgtactc

SEQ ID NO: 1258819 - DNA, 22 bp, Artificial Sequence
  chemically synthesized
tgaggaatgctgtagaatgtac

SEQ ID NO: 1258820 - DNA, 22 bp, Artificial Sequence
  chemically synthesized
tgagtacattctacagcattcc

SEQ ID NO: 1258821 - DNA, 22 bp, Artificial Sequence
  chemically synthesized
tgaagacccctctgaggaatgc

SEQ ID NO: 1258822 - DNA, 22 bp, Artificial Sequence
  chemically synthesized
aatcctgtgaagacccctctga

SEQ ID NO: 1258823 - DNA, 22 bp, Artificial Sequence
  chemically synthesized
tacagcattcctcagaggggtc

SEQ ID NO: 1258824 - DNA, 22 bp, Artificial Sequence
  chemically synthesized
cagcattcctcagaggggtctt

SEQ ID NO: 1258825 - DNA, 22 bp, Artificial Sequence
  chemically synthesized
ttcaatcctgtgaagacccctc

SEQ ID NO: 1258826 - DNA, 22 bp, Artificial Sequence
  chemically synthesized
ttgttcaatcctgtgaagaccc

SEQ ID NO: 1258827 - DNA, 22 bp, Artificial Sequence
  chemically synthesized
ctcagaggggtcttcacaggat

SEQ ID NO: 1258828 - DNA, 22 bp, Artificial Sequence
  chemically synthesized
agaggggtcttcacaggattga

SEQ ID NO: 1258829 - DNA, 22 bp, Artificial Sequence
  chemically synthesized
cagtgggaaactgttgttcaat

SEQ ID NO: 1258830 - DNA, 22 bp, Artificial Sequence
  chemically synthesized
ctgcagtgggaaactgttgttc

SEQ ID NO: 1258831 - DNA, 22 bp, Artificial Sequence
  chemically synthesized
cacaggattgaacaacagtttc

SEQ ID NO: 1258832 - DNA, 22 bp, Artificial Sequence
  chemically synthesized
acaggattgaacaacagtttcc

SEQ ID NO: 1258833 - DNA, 22 bp, Artificial Sequence
  chemically synthesized
gctactgcagtgggaaactgtt

SEQ ID NO: 1258834 - DNA, 22 bp, Artificial Sequence
  chemically synthesized
agctggctactgcagtgggaaa

SEQ ID NO: 1258835 - DNA, 22 bp, Artificial Sequence
  chemically synthesized
ttcagctggctactgcagtggg

SEQ ID NO: 1258836 - DNA, 22 bp, Artificial Sequence
  chemically synthesized
aacaacagtttcccactgcagt

SEQ ID NO: 1258837 - DNA, 22 bp, Artificial Sequence
  chemically synthesized
cccactgcagtagccagctgaa

SEQ ID NO: 1258838 - DNA, 22 bp, Artificial Sequence
  chemically synthesized
ccactgcagtagccagctgaat

SEQ ID NO: 1258839 - DNA, 22 bp, Artificial Sequence
  chemically synthesized
cagtagccagctgaataataca

SEQ ID NO: 1258840 - DNA, 22 bp, Artificial Sequence
  chemically synthesized
aataatacactcactattgttt

SEQ ID NO: 1258841 - DNA, 22 bp, Artificial Sequence
  chemically synthesized
actattgttttcccccgttttt

SEQ ID NO: 1258842 - DNA, 22 bp, Artificial Sequence
  chemically synthesized
ttgttttcccccgtttttcctt

SEQ ID NO: 1258843 - DNA, 22 bp, Artificial Sequence
  chemically synthesized
ttttcccccgtttttccttact

SEQ ID NO: 1258844 - DNA, 22 bp, Artificial Sequence
  chemically synthesized
tcccccgtttttccttacttcc

SEQ ID NO: 1258845 - DNA, 22 bp, Artificial Sequence
  chemically synthesized
cccccgtttttccttacttccc

SEQ ID NO: 1258846 - DNA, 22 bp, Artificial Sequence
  chemically synthesized
ccccgtttttccttacttcccc

SEQ ID NO: 1258847 - DNA, 22 bp, Artificial Sequence
  chemically synthesized
ttccttacttcccctgcctccc

SEQ ID NO: 1258848 - DNA, 22 bp, Artificial Sequence
  chemically synthesized
tccttacttcccctgcctccca

SEQ ID NO: 1258849 - DNA, 22 bp, Artificial Sequence
  chemically synthesized
ccttacttcccctgcctcccac

SEQ ID NO: 1258850 - DNA, 22 bp, Artificial Sequence
  chemically synthesized
cttacttcccctgcctcccact

SEQ ID NO: 1258851 - DNA, 22 bp, Artificial Sequence
  chemically synthesized
acttcccctgcctcccacttgt

SEQ ID NO: 1258852 - DNA, 22 bp, Artificial Sequence
  chemically synthesized
atcacagggagcacaagtggga

SEQ ID NO: 1258853 - DNA, 22 bp, Artificial Sequence
  chemically synthesized
cttcccctgcctcccacttgtg

SEQ ID NO: 1258854 - DNA, 22 bp, Artificial Sequence
  chemically synthesized
cccctgcctcccacttgtgctc

SEQ ID NO: 1258855 - DNA, 22 bp, Artificial Sequence
  chemically synthesized
ccctgcctcccacttgtgctcc

SEQ ID NO: 1258856 - DNA, 22 bp, Artificial Sequence
  chemically synthesized
gtagctgatcacagggagcaca

SEQ ID NO: 1258857 - DNA, 22 bp, Artificial Sequence
  chemically synthesized
ggtagctgatcacagggagcac

SEQ ID NO: 1258858 - DNA, 22 bp, Artificial Sequence
  chemically synthesized
cctcccacttgtgctccctgtg

SEQ ID NO: 1258859 - DNA, 22 bp, Artificial Sequence
  chemically synthesized
atttggtagctgatcacaggga

SEQ ID NO: 1258860 - DNA, 22 bp, Artificial Sequence
  chemically synthesized
ccacttgtgctccctgtgatca

SEQ ID NO: 1258861 - DNA, 22 bp, Artificial Sequence
  chemically synthesized
gctcatttggtagctgatcaca

SEQ ID NO: 1258862 - DNA, 22 bp, Artificial Sequence
  chemically synthesized
gtgctccctgtgatcagctacc

SEQ ID NO: 1258863 - DNA, 22 bp, Artificial Sequence
  chemically synthesized
tgctccctgtgatcagctacca

SEQ ID NO: 1258864 - DNA, 22 bp, Artificial Sequence
  chemically synthesized
cctgtgatcagctaccaaatga

SEQ ID NO: 1258865 - DNA, 22 bp, Artificial Sequence
  chemically synthesized
gagagcaactagctcatttggt

SEQ ID NO: 1258866 - DNA, 22 bp, Artificial Sequence
  chemically synthesized
tgatcagctaccaaatgagcta

SEQ ID NO: 1258867 - DNA, 22 bp, Artificial Sequence
  chemically synthesized
aggcgaggactagagagcaact

SEQ ID NO: 1258868 - DNA, 22 bp, Artificial Sequence
  chemically synthesized
ccaaatgagctagttgctctct

SEQ ID NO: 1258869 - DNA, 22 bp, Artificial Sequence
  chemically synthesized
agcctgaggcgaggactagaga

SEQ ID NO: 1258870 - DNA, 22 bp, Artificial Sequence
  chemically synthesized
gttgctctctagtcctcgcctc

SEQ ID NO: 1258871 - DNA, 22 bp, Artificial Sequence
  chemically synthesized
aaagctaagcctgaggcgagga

SEQ ID NO: 1258872 - DNA, 22 bp, Artificial Sequence
  chemically synthesized
aaaagctaagcctgaggcgagg

SEQ ID NO: 1258873 - DNA, 22 bp, Artificial Sequence
  chemically synthesized
taaaagctaagcctgaggcgag

SEQ ID NO: 1258874 - DNA, 22 bp, Artificial Sequence
  chemically synthesized
ctctctagtcctcgcctcaggc

SEQ ID NO: 1258875 - DNA, 22 bp, Artificial Sequence
  chemically synthesized
tttaaaagctaagcctgaggcg

SEQ ID NO: 1258876 - DNA, 22 bp, Artificial Sequence
  chemically synthesized
ctttaaaagctaagcctgaggc

SEQ ID NO: 1258877 - DNA, 22 bp, Artificial Sequence
  chemically synthesized
tctagtcctcgcctcaggctta

SEQ ID NO: 1258878 - DNA, 22 bp, Artificial Sequence
  chemically synthesized
tagtcctcgcctcaggcttagc

SEQ ID NO: 1258879 - DNA, 22 bp, Artificial Sequence
  chemically synthesized
gatttctttaaaagctaagcct

SEQ ID NO: 1258880 - DNA, 22 bp, Artificial Sequence
  chemically synthesized
gtcctcgcctcaggcttagctt

SEQ ID NO: 1258881 - DNA, 22 bp, Artificial Sequence
  chemically synthesized
ggatttctttaaaagctaagcc

SEQ ID NO: 1258882 - DNA, 22 bp, Artificial Sequence
  chemically synthesized
gtttggatttctttaaaagcta

SEQ ID NO: 1258883 - DNA, 22 bp, Artificial Sequence
  chemically synthesized
agtttggatttctttaaaagct

SEQ ID NO: 1258884 - DNA, 22 bp, Artificial Sequence
  chemically synthesized
gcctcaggcttagcttttaaag

SEQ ID NO: 1258885 - DNA, 22 bp, Artificial Sequence
  chemically synthesized
tcttagtttggatttctttaaa

SEQ ID NO: 1258886 - DNA, 22 bp, Artificial Sequence
  chemically synthesized
gtcttagtttggatttctttaa

SEQ ID NO: 1258887 - DNA, 22 bp, Artificial Sequence
  chemically synthesized
aggcttagcttttaaagaaatc

SEQ ID NO: 1258888 - DNA, 22 bp, Artificial Sequence
  chemically synthesized
agcttttaaagaaatccaaact

SEQ ID NO: 1258889 - DNA, 22 bp, Artificial Sequence
  chemically synthesized
gcttttaaagaaatccaaacta

SEQ ID NO: 1258890 - DNA, 22 bp, Artificial Sequence
  chemically synthesized
tcacagtttgtcttagtttgga

SEQ ID NO: 1258891 - DNA, 22 bp, Artificial Sequence
  chemically synthesized
gtcacagtttgtcttagtttgg

SEQ ID NO: 1258892 - DNA, 22 bp, Artificial Sequence
  chemically synthesized
ttaaagaaatccaaactaagac

SEQ ID NO: 1258893 - DNA, 22 bp, Artificial Sequence
  chemically synthesized
taaagaaatccaaactaagaca

SEQ ID NO: 1258894 - DNA, 22 bp, Artificial Sequence
  chemically synthesized
aaagaaatccaaactaagacaa

SEQ ID NO: 1258895 - DNA, 22 bp, Artificial Sequence
  chemically synthesized
aagaaatccaaactaagacaaa

SEQ ID NO: 1258896 - DNA, 22 bp, Artificial Sequence
  chemically synthesized
taatttgtcacagtttgtctta

SEQ ID NO: 1258897 - DNA, 22 bp, Artificial Sequence
  chemically synthesized
gattgtaatttgtcacagtttg

SEQ ID NO: 1258898 - DNA, 22 bp, Artificial Sequence
  chemically synthesized
ggattgtaatttgtcacagttt

SEQ ID NO: 1258899 - DNA, 22 bp, Artificial Sequence
  chemically synthesized
gtttggattgtaatttgtcaca

SEQ ID NO: 1258900 - DNA, 22 bp, Artificial Sequence
  chemically synthesized
agacaaactgtgacaaattaca

SEQ ID NO: 1258901 - DNA, 22 bp, Artificial Sequence
  chemically synthesized
tgacaaattacaatccaaacga

SEQ ID NO: 1258902 - DNA, 22 bp, Artificial Sequence
  chemically synthesized
agaggaaagaatctcgtttgga

SEQ ID NO: 1258903 - DNA, 22 bp, Artificial Sequence
  chemically synthesized
caatccaaacgagattctttcc

SEQ ID NO: 1258904 - DNA, 22 bp, Artificial Sequence
  chemically synthesized
agcatccccctgagaggaaaga

SEQ ID NO: 1258905 - DNA, 22 bp, Artificial Sequence
  chemically synthesized
atggggggactaagcatccccc

SEQ ID NO: 1258906 - DNA, 22 bp, Artificial Sequence
  chemically synthesized
gatggggggactaagcatcccc

SEQ ID NO: 1258907 - DNA, 22 bp, Artificial Sequence
  chemically synthesized
tttcctctcagggggatgctta

SEQ ID NO: 1258908 - DNA, 22 bp, Artificial Sequence
  chemically synthesized
tcctctcagggggatgcttagt

SEQ ID NO: 1258909 - DNA, 22 bp, Artificial Sequence
  chemically synthesized
cctctcagggggatgcttagtc

SEQ ID NO: 1258910 - DNA, 22 bp, Artificial Sequence
  chemically synthesized
ctctcagggggatgcttagtcc

SEQ ID NO: 1258911 - DNA, 22 bp, Artificial Sequence
  chemically synthesized
tcagggggatgcttagtccccc

SEQ ID NO: 1258912 - DNA, 22 bp, Artificial Sequence
  chemically synthesized
agggggatgcttagtcccccca

SEQ ID NO: 1258913 - DNA, 22 bp, Artificial Sequence
  chemically synthesized
ataatgatgcttgatgggggga

SEQ ID NO: 1258914 - DNA, 22 bp, Artificial Sequence
  chemically synthesized
gataatgatgcttgatgggggg

SEQ ID NO: 1258915 - DNA, 22 bp, Artificial Sequence
  chemically synthesized
tgataatgatgcttgatggggg

SEQ ID NO: 1258916 - DNA, 22 bp, Artificial Sequence
  chemically synthesized
attttgataatgatgcttgatg

SEQ ID NO: 1258917 - DNA, 22 bp, Artificial Sequence
  chemically synthesized
agtccccccatcaagcatcatt

SEQ ID NO: 1258918 - DNA, 22 bp, Artificial Sequence
  chemically synthesized
gtccccccatcaagcatcatta

SEQ ID NO: 1258919 - DNA, 22 bp, Artificial Sequence
  chemically synthesized
tgttcattttgataatgatgct

SEQ ID NO: 1258920 - DNA, 22 bp, Artificial Sequence
  chemically synthesized
cagtctgtgttcattttgataa

SEQ ID NO: 1258921 - DNA, 22 bp, Artificial Sequence
  chemically synthesized
tgcagtctgtgttcattttgat

SEQ ID NO: 1258922 - DNA, 22 bp, Artificial Sequence
  chemically synthesized
ctctgcagtctgtgttcatttt

SEQ ID NO: 1258923 - DNA, 22 bp, Artificial Sequence
  chemically synthesized
cctctgcagtctgtgttcattt

SEQ ID NO: 1258924 - DNA, 22 bp, Artificial Sequence
  chemically synthesized
ttcctctgcagtctgtgttcat

SEQ ID NO: 1258925 - DNA, 22 bp, Artificial Sequence
  chemically synthesized
cttcctctgcagtctgtgttca

SEQ ID NO: 1258926 - DNA, 22 bp, Artificial Sequence
  chemically synthesized
tcttcctctgcagtctgtgttc

SEQ ID NO: 1258927 - DNA, 22 bp, Artificial Sequence
  chemically synthesized
tcaaaatgaacacagactgcag

SEQ ID NO: 1258928 - DNA, 22 bp, Artificial Sequence
  chemically synthesized
agtgaaggcaaatattttcttc

SEQ ID NO: 1258929 - DNA, 22 bp, Artificial Sequence
  chemically synthesized
ctcagtgaaggcaaatattttc

SEQ ID NO: 1258930 - DNA, 22 bp, Artificial Sequence
  chemically synthesized
gctcagtgaaggcaaatatttt

SEQ ID NO: 1258931 - DNA, 22 bp, Artificial Sequence
  chemically synthesized
tgctcagtgaaggcaaatattt

SEQ ID NO: 1258932 - DNA, 22 bp, Artificial Sequence
  chemically synthesized
cagaggaagaaaatatttgcct

SEQ ID NO: 1258933 - DNA, 22 bp, Artificial Sequence
  chemically synthesized
actttgctcagtgaaggcaaat

SEQ ID NO: 1258934 - DNA, 22 bp, Artificial Sequence
  chemically synthesized
agggtcatgagtctgactttgc

SEQ ID NO: 1258935 - DNA, 22 bp, Artificial Sequence
  chemically synthesized
gccttcactgagcaaagtcaga

SEQ ID NO: 1258936 - DNA, 22 bp, Artificial Sequence
  chemically synthesized
ccttcactgagcaaagtcagac

SEQ ID NO: 1258937 - DNA, 22 bp, Artificial Sequence
  chemically synthesized
acctgagggtcatgagtctgac

SEQ ID NO: 1258938 - DNA, 22 bp, Artificial Sequence
  chemically synthesized
cactgagcaaagtcagactcat

SEQ ID NO: 1258939 - DNA, 22 bp, Artificial Sequence
  chemically synthesized
actgagcaaagtcagactcatg

SEQ ID NO: 1258940 - DNA, 22 bp, Artificial Sequence
  chemically synthesized
taacctgagggtcatgagtctg

SEQ ID NO: 1258941 - DNA, 22 bp, Artificial Sequence
  chemically synthesized
agcaaagtcagactcatgaccc

SEQ ID NO: 1258942 - DNA, 22 bp, Artificial Sequence
  chemically synthesized
tgtctctaacctgagggtcatg

SEQ ID NO: 1258943 - DNA, 22 bp, Artificial Sequence
  chemically synthesized
tgtgtctctaacctgagggtca

SEQ ID NO: 1258944 - DNA, 22 bp, Artificial Sequence
  chemically synthesized
tctgtgtctctaacctgagggt

SEQ ID NO: 1258945 - DNA, 22 bp, Artificial Sequence
  chemically synthesized
ctctgtgtctctaacctgaggg

SEQ ID NO: 1258946 - DNA, 22 bp, Artificial Sequence
  chemically synthesized
catttctctgtgtctctaacct

SEQ ID NO: 1258947 - DNA, 22 bp, Artificial Sequence
  chemically synthesized
atgaccctcaggttagagacac

SEQ ID NO: 1258948 - DNA, 22 bp, Artificial Sequence
  chemically synthesized
gttgcatttctctgtgtctcta

SEQ ID NO: 1258949 - DNA, 22 bp, Artificial Sequence
  chemically synthesized
aggttagagacacagagaaatg

SEQ ID NO: 1258950 - DNA, 22 bp, Artificial Sequence
  chemically synthesized
accccagagttagttgcatttc

SEQ ID NO: 1258951 - DNA, 22 bp, Artificial Sequence
  chemically synthesized
gagacacagagaaatgcaacta

SEQ ID NO: 1258952 - DNA, 22 bp, Artificial Sequence
  chemically synthesized
ttcaccccagagttagttgcat

SEQ ID NO: 1258953 - DNA, 22 bp, Artificial Sequence
  chemically synthesized
tacctattcaccccagagttag

SEQ ID NO: 1258954 - DNA, 22 bp, Artificial Sequence
  chemically synthesized
aatctgtacctattcaccccag

SEQ ID NO: 1258955 - DNA, 22 bp, Artificial Sequence
  chemically synthesized
tgaatctgtacctattcacccc

SEQ ID NO: 1258956 - DNA, 22 bp, Artificial Sequence
  chemically synthesized
cactctgaatctgtacctattc

SEQ ID NO: 1258957 - DNA, 22 bp, Artificial Sequence
  chemically synthesized
ccactctgaatctgtacctatt

SEQ ID NO: 1258958 - DNA, 22 bp, Artificial Sequence
  chemically synthesized
actctggggtgaataggtacag

SEQ ID NO: 1258959 - DNA, 22 bp, Artificial Sequence
  chemically synthesized
tccactctgaatctgtacctat

SEQ ID NO: 1258960 - DNA, 22 bp, Artificial Sequence
  chemically synthesized
tggggtgaataggtacagattc

SEQ ID NO: 1258961 - DNA, 22 bp, Artificial Sequence
  chemically synthesized
gggtgaataggtacagattcag

SEQ ID NO: 1258962 - DNA, 22 bp, Artificial Sequence
  chemically synthesized
aagtctttccactctgaatctg

SEQ ID NO: 1258963 - DNA, 22 bp, Artificial Sequence
  chemically synthesized
aaagtctttccactctgaatct

SEQ ID NO: 1258964 - DNA, 22 bp, Artificial Sequence
  chemically synthesized
taaagtctttccactctgaatc

SEQ ID NO: 1258965 - DNA, 22 bp, Artificial Sequence
  chemically synthesized
ttttaaagtctttccactctga

SEQ ID NO: 1258966 - DNA, 22 bp, Artificial Sequence
  chemically synthesized
ctgttttaaagtctttccactc

SEQ ID NO: 1258967 - DNA, 22 bp, Artificial Sequence
  chemically synthesized
ttgctgttttaaagtctttcca

SEQ ID NO: 1258968 - DNA, 22 bp, Artificial Sequence
  chemically synthesized
attgctgttttaaagtctttcc

SEQ ID NO: 1258969 - DNA, 22 bp, Artificial Sequence
  chemically synthesized
tattgctgttttaaagtctttc

SEQ ID NO: 1258970 - DNA, 22 bp, Artificial Sequence
  chemically synthesized
agagtggaaagactttaaaaca

SEQ ID NO: 1258971 - DNA, 22 bp, Artificial Sequence
  chemically synthesized
ggactttattgctgttttaaag

SEQ ID NO: 1258972 - DNA, 22 bp, Artificial Sequence
  chemically synthesized
taggactttattgctgttttaa

SEQ ID NO: 1258973 - DNA, 22 bp, Artificial Sequence
  chemically synthesized
ctaggactttattgctgtttta

SEQ ID NO: 1258974 - DNA, 22 bp, Artificial Sequence
  chemically synthesized
tttctaggactttattgctgtt

SEQ ID NO: 1258975 - DNA, 22 bp, Artificial Sequence
  chemically synthesized
atttctaggactttattgctgt

SEQ ID NO: 1258976 - DNA, 22 bp, Artificial Sequence
  chemically synthesized
tatttctaggactttattgctg

SEQ ID NO: 1258977 - DNA, 22 bp, Artificial Sequence
  chemically synthesized
ttatttctaggactttattgct

SEQ ID NO: 1258978 - DNA, 22 bp, Artificial Sequence
  chemically synthesized
tttatttctaggactttattgc

SEQ ID NO: 1258979 - DNA, 22 bp, Artificial Sequence
  chemically synthesized
ttttatttctaggactttattg

SEQ ID NO: 1258980 - DNA, 22 bp, Artificial Sequence
  chemically synthesized
tttttatttctaggactttatt

SEQ ID NO: 1258981 - DNA, 22 bp, Artificial Sequence
  chemically synthesized
taaaacagcaataaagtcctag

SEQ ID NO: 1258982 - DNA, 22 bp, Artificial Sequence
  chemically synthesized
aaaacagcaataaagtcctaga

SEQ ID NO: 1258983 - DNA, 22 bp, Artificial Sequence
  chemically synthesized
aaacagcaataaagtcctagaa

SEQ ID NO: 1258984 - DNA, 22 bp, Artificial Sequence
  chemically synthesized
acagctttttttatttctagga

SEQ ID NO: 1258985 - DNA, 22 bp, Artificial Sequence
  chemically synthesized
taccgagctgacagcttttttt

SEQ ID NO: 1258986 - DNA, 22 bp, Artificial Sequence
  chemically synthesized
gtctgtaccgagctgacagctt

SEQ ID NO: 1258987 - DNA, 22 bp, Artificial Sequence
  chemically synthesized
gaaataaaaaaagctgtcagct

SEQ ID NO: 1258988 - DNA, 22 bp, Artificial Sequence
  chemically synthesized
tggtctgtaccgagctgacagc

SEQ ID NO: 1258989 - DNA, 22 bp, Artificial Sequence
  chemically synthesized
aagctctggtctgtaccgagct

SEQ ID NO: 1258990 - DNA, 22 bp, Artificial Sequence
  chemically synthesized
tcaagctctggtctgtaccgag

SEQ ID NO: 1258991 - DNA, 22 bp, Artificial Sequence
  chemically synthesized
ctctcaagctctggtctgtacc

SEQ ID NO: 1258992 - DNA, 22 bp, Artificial Sequence
  chemically synthesized
gctctcaagctctggtctgtac

SEQ ID NO: 1258993 - DNA, 22 bp, Artificial Sequence
  chemically synthesized
ttgctctcaagctctggtctgt

SEQ ID NO: 1258994 - DNA, 22 bp, Artificial Sequence
  chemically synthesized
tcagctcggtacagaccagagc

SEQ ID NO: 1258995 - DNA, 22 bp, Artificial Sequence
  chemically synthesized
gtactcttgctctcaagctctg

SEQ ID NO: 1258996 - DNA, 22 bp, Artificial Sequence
  chemically synthesized
agtactcttgctctcaagctct

SEQ ID NO: 1258997 - DNA, 22 bp, Artificial Sequence
  chemically synthesized
ggtacagaccagagcttgagag

SEQ ID NO: 1258998 - DNA, 22 bp, Artificial Sequence
  chemically synthesized
tgagtcgcttagtactcttgct

SEQ ID NO: 1258999 - DNA, 22 bp, Artificial Sequence
  chemically synthesized
tatgagtcgcttagtactcttg

SEQ ID NO: 1259000 - DNA, 22 bp, Artificial Sequence
  chemically synthesized
ctatgagtcgcttagtactctt

SEQ ID NO: 1259001 - DNA, 22 bp, Artificial Sequence
  chemically synthesized
tctatgagtcgcttagtactct

SEQ ID NO: 1259002 - DNA, 22 bp, Artificial Sequence
  chemically synthesized
ttctatgagtcgcttagtactc

SEQ ID NO: 1259003 - DNA, 22 bp, Artificial Sequence
  chemically synthesized
gagagcaagagtactaagcgac

SEQ ID NO: 1259004 - DNA, 22 bp, Artificial Sequence
  chemically synthesized
agagcaagagtactaagcgact

SEQ ID NO: 1259005 - DNA, 22 bp, Artificial Sequence
  chemically synthesized
aatccttttctatgagtcgctt

SEQ ID NO: 1259006 - DNA, 22 bp, Artificial Sequence
  chemically synthesized
ctgaatccttttctatgagtcg

SEQ ID NO: 1259007 - DNA, 22 bp, Artificial Sequence
  chemically synthesized
gtccctcctgaatccttttcta

SEQ ID NO: 1259008 - DNA, 22 bp, Artificial Sequence
  chemically synthesized
agcgactcatagaaaaggattc

SEQ ID NO: 1259009 - DNA, 22 bp, Artificial Sequence
  chemically synthesized
tgctggtccctcctgaatcctt

SEQ ID NO: 1259010 - DNA, 22 bp, Artificial Sequence
  chemically synthesized
atagaaaaggattcaggaggga

SEQ ID NO: 1259011 - DNA, 22 bp, Artificial Sequence
  chemically synthesized
aagtcgctgtgctggtccctcc

SEQ ID NO: 1259012 - DNA, 22 bp, Artificial Sequence
  chemically synthesized
tgagcctaaagtcgctgtgctg

SEQ ID NO: 1259013 - DNA, 22 bp, Artificial Sequence
  chemically synthesized
aggagggaccagcacagcgact

SEQ ID NO: 1259014 - DNA, 22 bp, Artificial Sequence
  chemically synthesized
ctatgagcctaaagtcgctgtg

SEQ ID NO: 1259015 - DNA, 22 bp, Artificial Sequence
  chemically synthesized
ttactatgagcctaaagtcgct

SEQ ID NO: 1259016 - DNA, 22 bp, Artificial Sequence
  chemically synthesized
gttactatgagcctaaagtcgc

SEQ ID NO: 1259017 - DNA, 22 bp, Artificial Sequence
  chemically synthesized
cttgttactatgagcctaaagt

SEQ ID NO: 1259018 - DNA, 22 bp, Artificial Sequence
  chemically synthesized
ttgcttgttactatgagcctaa

SEQ ID NO: 1259019 - DNA, 22 bp, Artificial Sequence
  chemically synthesized
taggctcatagtaacaagcaac

SEQ ID NO: 1259020 - DNA, 22 bp, Artificial Sequence
  chemically synthesized
aggctcatagtaacaagcaaca

SEQ ID NO: 1259021 - DNA, 22 bp, Artificial Sequence
  chemically synthesized
gccaaagcaaactgttgcttgt

SEQ ID NO: 1259022 - DNA, 22 bp, Artificial Sequence
  chemically synthesized
ggctcatagtaacaagcaacag

SEQ ID NO: 1259023 - DNA, 22 bp, Artificial Sequence
  chemically synthesized
agccaaagcaaactgttgcttg

SEQ ID NO: 1259024 - DNA, 22 bp, Artificial Sequence
  chemically synthesized
tagccaaagcaaactgttgctt

SEQ ID NO: 1259025 - DNA, 22 bp, Artificial Sequence
  chemically synthesized
atagtaacaagcaacagtttgc

SEQ ID NO: 1259026 - DNA, 22 bp, Artificial Sequence
  chemically synthesized
gtaataaactttagccaaagca

SEQ ID NO: 1259027 - DNA, 22 bp, Artificial Sequence
  chemically synthesized
tccacacctagtaataaacttt

SEQ ID NO: 1259028 - DNA, 22 bp, Artificial Sequence
  chemically synthesized
gtccacacctagtaataaactt

SEQ ID NO: 1259029 - DNA, 22 bp, Artificial Sequence
  chemically synthesized
gctttggctaaagtttattact

SEQ ID NO: 1259030 - DNA, 22 bp, Artificial Sequence
  chemically synthesized
ctttggctaaagtttattacta

SEQ ID NO: 1259031 - DNA, 22 bp, Artificial Sequence
  chemically synthesized
cttgtccacacctagtaataaa

SEQ ID NO: 1259032 - DNA, 22 bp, Artificial Sequence
  chemically synthesized
gcttgtccacacctagtaataa

SEQ ID NO: 1259033 - DNA, 22 bp, Artificial Sequence
  chemically synthesized
tggctaaagtttattactaggt

SEQ ID NO: 1259034 - DNA, 22 bp, Artificial Sequence
  chemically synthesized
ttgcttgtccacacctagtaat

SEQ ID NO: 1259035 - DNA, 22 bp, Artificial Sequence
  chemically synthesized
ggctaaagtttattactaggtg

SEQ ID NO: 1259036 - DNA, 22 bp, Artificial Sequence
  chemically synthesized
gctaaagtttattactaggtgt

SEQ ID NO: 1259037 - DNA, 22 bp, Artificial Sequence
  chemically synthesized
tctcttgcttgtccacacctag

SEQ ID NO: 1259038 - DNA, 22 bp, Artificial Sequence
  chemically synthesized
atctcttgcttgtccacaccta

SEQ ID NO: 1259039 - DNA, 22 bp, Artificial Sequence
  chemically synthesized
aagtttattactaggtgtggac

SEQ ID NO: 1259040 - DNA, 22 bp, Artificial Sequence
  chemically synthesized
attactaggtgtggacaagcaa

SEQ ID NO: 1259041 - DNA, 22 bp, Artificial Sequence
  chemically synthesized
ttactaggtgtggacaagcaag

SEQ ID NO: 1259042 - DNA, 22 bp, Artificial Sequence
  chemically synthesized
cgatatttatctcttgcttgtc

SEQ ID NO: 1259043 - DNA, 22 bp, Artificial Sequence
  chemically synthesized
ctaggtgtggacaagcaagaga

SEQ ID NO: 1259044 - DNA, 22 bp, Artificial Sequence
  chemically synthesized
ggtgtggacaagcaagagataa

SEQ ID NO: 1259045 - DNA, 22 bp, Artificial Sequence
  chemically synthesized
tacccacagattccgatattta

SEQ ID NO: 1259046 - DNA, 22 bp, Artificial Sequence
  chemically synthesized
ccatggcatgaaatccaaaggc

SEQ ID NO: 1259047 - DNA, 22 bp, Artificial Sequence
  chemically synthesized
gccatggcatgaaatccaaagg

SEQ ID NO: 1259048 - DNA, 22 bp, Artificial Sequence
  chemically synthesized
tgggtacagcctttggatttca

SEQ ID NO: 1259049 - DNA, 22 bp, Artificial Sequence
  chemically synthesized
ccttgccatggcatgaaatcca

SEQ ID NO: 1259050 - DNA, 22 bp, Artificial Sequence
  chemically synthesized
accttgccatggcatgaaatcc

SEQ ID NO: 1259051 - DNA, 22 bp, Artificial Sequence
  chemically synthesized
taccttgccatggcatgaaatc

SEQ ID NO: 1259052 - DNA, 22 bp, Artificial Sequence
  chemically synthesized
tggatttcatgccatggcaagg

SEQ ID NO: 1259053 - DNA, 22 bp, Artificial Sequence
  chemically synthesized
ggatttcatgccatggcaaggt

SEQ ID NO: 1259054 - DNA, 22 bp, Artificial Sequence
  chemically synthesized
cagatggattttaccttgccat

SEQ ID NO: 1259055 - DNA, 22 bp, Artificial Sequence
  chemically synthesized
gatttcatgccatggcaaggta

SEQ ID NO: 1259056 - DNA, 22 bp, Artificial Sequence
  chemically synthesized
catgccatggcaaggtaaaatc

SEQ ID NO: 1259057 - DNA, 22 bp, Artificial Sequence
  chemically synthesized
atgttgcagatggattttacct

SEQ ID NO: 1259058 - DNA, 22 bp, Artificial Sequence
  chemically synthesized
atgccatggcaaggtaaaatcc

SEQ ID NO: 1259059 - DNA, 22 bp, Artificial Sequence
  chemically synthesized
gatgttgcagatggattttacc

SEQ ID NO: 1259060 - DNA, 22 bp, Artificial Sequence
  chemically synthesized
tgatgttgcagatggattttac

SEQ ID NO: 1259061 - DNA, 22 bp, Artificial Sequence
  chemically synthesized
ttgatgttgcagatggatttta

SEQ ID NO: 1259062 - DNA, 22 bp, Artificial Sequence
  chemically synthesized
tttttgatgttgcagatggatt

SEQ ID NO: 1259063 - DNA, 22 bp, Artificial Sequence
  chemically synthesized
tgtttttgatgttgcagatgga

SEQ ID NO: 1259064 - DNA, 22 bp, Artificial Sequence
  chemically synthesized
tctgtttttgatgttgcagatg

SEQ ID NO: 1259065 - DNA, 22 bp, Artificial Sequence
  chemically synthesized
caaatgcctctctgtttttgat

SEQ ID NO: 1259066 - DNA, 22 bp, Artificial Sequence
  chemically synthesized
gcaaatgcctctctgtttttga

SEQ ID NO: 1259067 - DNA, 22 bp, Artificial Sequence
  chemically synthesized
tgcaaatgcctctctgtttttg

SEQ ID NO: 1259068 - DNA, 22 bp, Artificial Sequence
  chemically synthesized
ttgcaaatgcctctctgttttt

SEQ ID NO: 1259069 - DNA, 22 bp, Artificial Sequence
  chemically synthesized
cttttgcaaatgcctctctgtt

SEQ ID NO: 1259070 - DNA, 22 bp, Artificial Sequence
  chemically synthesized
ccttttgcaaatgcctctctgt

SEQ ID NO: 1259071 - DNA, 22 bp, Artificial Sequence
  chemically synthesized
caacatcaaaaacagagaggca

SEQ ID NO: 1259072 - DNA, 22 bp, Artificial Sequence
  chemically synthesized
atgtttccttttgcaaatgcct

SEQ ID NO: 1259073 - DNA, 22 bp, Artificial Sequence
  chemically synthesized
ctcatgtttccttttgcaaatg

SEQ ID NO: 1259074 - DNA, 22 bp, Artificial Sequence
  chemically synthesized
tcctcatgtttccttttgcaaa

SEQ ID NO: 1259075 - DNA, 22 bp, Artificial Sequence
  chemically synthesized
ggaacattctcctcatgtttcc

SEQ ID NO: 1259076 - DNA, 22 bp, Artificial Sequence
  chemically synthesized
ctaggaacattctcctcatgtt

SEQ ID NO: 1259077 - DNA, 22 bp, Artificial Sequence
  chemically synthesized
gcaaaaggaaacatgaggagaa

SEQ ID NO: 1259078 - DNA, 22 bp, Artificial Sequence
  chemically synthesized
caaaaggaaacatgaggagaat

SEQ ID NO: 1259079 - DNA, 22 bp, Artificial Sequence
  chemically synthesized
ggcagtgctgctaggaacattc

SEQ ID NO: 1259080 - DNA, 22 bp, Artificial Sequence
  chemically synthesized
gggcagtgctgctaggaacatt

SEQ ID NO: 1259081 - DNA, 22 bp, Artificial Sequence
  chemically synthesized
tgggcagtgctgctaggaacat

SEQ ID NO: 1259082 - DNA, 22 bp, Artificial Sequence
  chemically synthesized
ttttgggcagtgctgctaggaa

SEQ ID NO: 1259083 - DNA, 22 bp, Artificial Sequence
  chemically synthesized
tgttattttgggcagtgctgct

SEQ ID NO: 1259084 - DNA, 22 bp, Artificial Sequence
  chemically synthesized
ttgtgttattttgggcagtgct

SEQ ID NO: 1259085 - DNA, 22 bp, Artificial Sequence
  chemically synthesized
attgtgttattttgggcagtgc

SEQ ID NO: 1259086 - DNA, 22 bp, Artificial Sequence
  chemically synthesized
gtttattgtgttattttgggca

SEQ ID NO: 1259087 - DNA, 22 bp, Artificial Sequence
  chemically synthesized
cgtttattgtgttattttgggc

SEQ ID NO: 1259088 - DNA, 22 bp, Artificial Sequence
  chemically synthesized
ctagcagcactgcccaaaataa

SEQ ID NO: 1259089 - DNA, 22 bp, Artificial Sequence
  chemically synthesized
tcgtttattgtgttattttggg

SEQ ID NO: 1259090 - DNA, 22 bp, Artificial Sequence
  chemically synthesized
ttcgtttattgtgttattttgg

SEQ ID NO: 1259091 - DNA, 22 bp, Artificial Sequence
  chemically synthesized
gcagcactgcccaaaataacac

SEQ ID NO: 1259092 - DNA, 22 bp, Artificial Sequence
  chemically synthesized
gaagatttttcgtttattgtgt

SEQ ID NO: 1259093 - DNA, 22 bp, Artificial Sequence
  chemically synthesized
cccaaaataacacaataaacga

SEQ ID NO: 1259094 - DNA, 22 bp, Artificial Sequence
  chemically synthesized
ctcgaagatttttcgtttattg

SEQ ID NO: 1259095 - DNA, 22 bp, Artificial Sequence
  chemically synthesized
ggctgctcgaagatttttcgtt

SEQ ID NO: 1259096 - DNA, 22 bp, Artificial Sequence
  chemically synthesized
gggctgctcgaagatttttcgt

SEQ ID NO: 1259097 - DNA, 22 bp, Artificial Sequence
  chemically synthesized
ccagagggcatttgggctgctc

SEQ ID NO: 1259098 - DNA, 22 bp, Artificial Sequence
  chemically synthesized
ctgccagagggcatttgggctg

SEQ ID NO: 1259099 - DNA, 22 bp, Artificial Sequence
  chemically synthesized
cctgccagagggcatttgggct

SEQ ID NO: 1259100 - DNA, 22 bp, Artificial Sequence
  chemically synthesized
tcctgccagagggcatttgggc

SEQ ID NO: 1259101 - DNA, 22 bp, Artificial Sequence
  chemically synthesized
cgagcagcccaaatgccctctg

SEQ ID NO: 1259102 - DNA, 22 bp, Artificial Sequence
  chemically synthesized
gagcagcccaaatgccctctgg

SEQ ID NO: 1259103 - DNA, 22 bp, Artificial Sequence
  chemically synthesized
tccattttcctgccagagggca

SEQ ID NO: 1259104 - DNA, 22 bp, Artificial Sequence
  chemically synthesized
actgtccattttcctgccagag

SEQ ID NO: 1259105 - DNA, 22 bp, Artificial Sequence
  chemically synthesized
tgtaatcaggttaactgtccat

SEQ ID NO: 1259106 - DNA, 22 bp, Artificial Sequence
  chemically synthesized
tggcaggaaaatggacagttaa

SEQ ID NO: 1259107 - DNA, 22 bp, Artificial Sequence
  chemically synthesized
ctatgtaatcaggttaactgtc

SEQ ID NO: 1259108 - DNA, 22 bp, Artificial Sequence
  chemically synthesized
gcaggaaaatggacagttaacc

SEQ ID NO: 1259109 - DNA, 22 bp, Artificial Sequence
  chemically synthesized
actactatgtaatcaggttaac

SEQ ID NO: 1259110 - DNA, 22 bp, Artificial Sequence
  chemically synthesized
gactactatgtaatcaggttaa

SEQ ID NO: 1259111 - DNA, 22 bp, Artificial Sequence
  chemically synthesized
tgactactatgtaatcaggtta

SEQ ID NO: 1259112 - DNA, 22 bp, Artificial Sequence
  chemically synthesized
tttgactactatgtaatcaggt

SEQ ID NO: 1259113 - DNA, 22 bp, Artificial Sequence
  chemically synthesized
ctttgactactatgtaatcagg

SEQ ID NO: 1259114 - DNA, 22 bp, Artificial Sequence
  chemically synthesized
acctgattacatagtagtcaaa

SEQ ID NO: 1259115 - DNA, 22 bp, Artificial Sequence
  chemically synthesized
tgtagcagtcgtttctttgact

SEQ ID NO: 1259116 - DNA, 22 bp, Artificial Sequence
  chemically synthesized
gtgtagcagtcgtttctttgac

SEQ ID NO: 1259117 - DNA, 22 bp, Artificial Sequence
  chemically synthesized
attacatagtagtcaaagaaac

SEQ ID NO: 1259118 - DNA, 22 bp, Artificial Sequence
  chemically synthesized
tgtgtagcagtcgtttctttga

SEQ ID NO: 1259119 - DNA, 22 bp, Artificial Sequence
  chemically synthesized
ttttgtgtagcagtcgtttctt

SEQ ID NO: 1259120 - DNA, 22 bp, Artificial Sequence
  chemically synthesized
catagtagtcaaagaaacgact

SEQ ID NO: 1259121 - DNA, 22 bp, Artificial Sequence
  chemically synthesized
attgttttgtgtagcagtcgtt

SEQ ID NO: 1259122 - DNA, 22 bp, Artificial Sequence
  chemically synthesized
gattgttttgtgtagcagtcgt

SEQ ID NO: 1259123 - DNA, 22 bp, Artificial Sequence
  chemically synthesized
tcttgattgttttgtgtagcag

SEQ ID NO: 1259124 - DNA, 22 bp, Artificial Sequence
  chemically synthesized
atcttgattgttttgtgtagca

SEQ ID NO: 1259125 - DNA, 22 bp, Artificial Sequence
  chemically synthesized
gaatttatcttgattgttttgt

SEQ ID NO: 1259126 - DNA, 22 bp, Artificial Sequence
  chemically synthesized
ctacacaaaacaatcaagataa

SEQ ID NO: 1259127 - DNA, 22 bp, Artificial Sequence
  chemically synthesized
cacaaaacaatcaagataaatt

SEQ ID NO: 1259128 - DNA, 22 bp, Artificial Sequence
  chemically synthesized
atgcatcatcccatccctagaa

SEQ ID NO: 1259129 - DNA, 22 bp, Artificial Sequence
  chemically synthesized
ctcatgcatcatcccatcccta

SEQ ID NO: 1259130 - DNA, 22 bp, Artificial Sequence
  chemically synthesized
cctcatgcatcatcccatccct

SEQ ID NO: 1259131 - DNA, 22 bp, Artificial Sequence
  chemically synthesized
tcctcatgcatcatcccatccc

SEQ ID NO: 1259132 - DNA, 22 bp, Artificial Sequence
  chemically synthesized
atattttcctcatgcatcatcc

SEQ ID NO: 1259133 - DNA, 22 bp, Artificial Sequence
  chemically synthesized
tagggatgggatgatgcatgag

SEQ ID NO: 1259134 - DNA, 22 bp, Artificial Sequence
  chemically synthesized
gggatgggatgatgcatgagga

SEQ ID NO: 1259135 - DNA, 22 bp, Artificial Sequence
  chemically synthesized
ggactcatattttcctcatgca

SEQ ID NO: 1259136 - DNA, 22 bp, Artificial Sequence
  chemically synthesized
gggactcatattttcctcatgc

SEQ ID NO: 1259137 - DNA, 22 bp, Artificial Sequence
  chemically synthesized
aaaagatatttgggactcatat

SEQ ID NO: 1259138 - DNA, 22 bp, Artificial Sequence
  chemically synthesized
ttaaaaagatatttgggactca

SEQ ID NO: 1259139 - DNA, 22 bp, Artificial Sequence
  chemically synthesized
aatgttattaaaaagatatttg

SEQ ID NO: 1259140 - DNA, 22 bp, Artificial Sequence
  chemically synthesized
aaatgttattaaaaagatattt

SEQ ID NO: 1259141 - DNA, 22 bp, Artificial Sequence
  chemically synthesized
tatttaaatgttattaaaaaga

SEQ ID NO: 1259142 - DNA, 22 bp, Artificial Sequence
  chemically synthesized
atatttaaatgttattaaaaag

SEQ ID NO: 1259143 - DNA, 22 bp, Artificial Sequence
  chemically synthesized
tatatttaaatgttattaaaaa

SEQ ID NO: 1259144 - DNA, 22 bp, Artificial Sequence
  chemically synthesized
ttatatttaaatgttattaaaa

SEQ ID NO: 1259145 - DNA, 22 bp, Artificial Sequence
  chemically synthesized
tttttatatttaaatgttatta

SEQ ID NO: 1259146 - DNA, 22 bp, Artificial Sequence
  chemically synthesized
gtttttatatttaaatgttatt

SEQ ID NO: 1259147 - DNA, 22 bp, Artificial Sequence
  chemically synthesized
gtttgtttttatatttaaatgt

SEQ ID NO: 1259148 - DNA, 22 bp, Artificial Sequence
  chemically synthesized
agtttgtttttatatttaaatg

SEQ ID NO: 1259149 - DNA, 22 bp, Artificial Sequence
  chemically synthesized
tagtttgtttttatatttaaat

SEQ ID NO: 1259150 - DNA, 22 bp, Artificial Sequence
  chemically synthesized
tttaataacatttaaatataaa

SEQ ID NO: 1259151 - DNA, 22 bp, Artificial Sequence
  chemically synthesized
ttaataacatttaaatataaaa

SEQ ID NO: 1259152 - DNA, 22 bp, Artificial Sequence
  chemically synthesized
taataacatttaaatataaaaa

SEQ ID NO: 1259153 - DNA, 22 bp, Artificial Sequence
  chemically synthesized
aataacatttaaatataaaaac

SEQ ID NO: 1259154 - DNA, 22 bp, Artificial Sequence
  chemically synthesized
ataacatttaaatataaaaaca

SEQ ID NO: 1259155 - DNA, 22 bp, Artificial Sequence
  chemically synthesized
aaatataaaaacaaactaaaac

SEQ ID NO: 1259156 - DNA, 22 bp, Artificial Sequence
  chemically synthesized
aatataaaaacaaactaaaaca

SEQ ID NO: 1259157 - DNA, 22 bp, Artificial Sequence
  chemically synthesized
tatgacacaaaatgttttagtt

SEQ ID NO: 1259158 - DNA, 22 bp, Artificial Sequence
  chemically synthesized
ctgtatgacacaaaatgtttta

SEQ ID NO: 1259159 - DNA, 22 bp, Artificial Sequence
  chemically synthesized
actgtatgacacaaaatgtttt

SEQ ID NO: 1259160 - DNA, 22 bp, Artificial Sequence
  chemically synthesized
aaaatatttactgtatgacaca

SEQ ID NO: 1259161 - DNA, 22 bp, Artificial Sequence
  chemically synthesized
aaacattttgtgtcatacagta

SEQ ID NO: 1259162 - DNA, 22 bp, Artificial Sequence
  chemically synthesized
tgtgtcatacagtaaatatttt

SEQ ID NO: 1259163 - DNA, 22 bp, Artificial Sequence
  chemically synthesized
gtgtcatacagtaaatattttt

SEQ ID NO: 1259164 - DNA, 22 bp, Artificial Sequence
  chemically synthesized
tgtcatacagtaaatattttta

SEQ ID NO: 1259165 - DNA, 22 bp, Artificial Sequence
  chemically synthesized
tgaacatatgtgagaacattaa

SEQ ID NO: 1259166 - DNA, 22 bp, Artificial Sequence
  chemically synthesized
ttgtgaacatatgtgagaacat

SEQ ID NO: 1259167 - DNA, 22 bp, Artificial Sequence
  chemically synthesized
ttaatgttctcacatatgttca

SEQ ID NO: 1259168 - DNA, 22 bp, Artificial Sequence
  chemically synthesized
taatgttctcacatatgttcac

SEQ ID NO: 1259169 - DNA, 22 bp, Artificial Sequence
  chemically synthesized
aatgttctcacatatgttcaca

SEQ ID NO: 1259170 - DNA, 22 bp, Artificial Sequence
  chemically synthesized
atgttctcacatatgttcacaa

SEQ ID NO: 1259171 - DNA, 22 bp, Artificial Sequence
  chemically synthesized
tcacatatgttcacaatagccc

SEQ ID NO: 1259172 - DNA, 22 bp, Artificial Sequence
  chemically synthesized
acatatgttcacaatagcccta

SEQ ID NO: 1259173 - DNA, 22 bp, Artificial Sequence
  chemically synthesized
acaatagccctatgacatattt

SEQ ID NO: 1259174 - DNA, 22 bp, Artificial Sequence
  chemically synthesized
tgacatatttactattattgtc

SEQ ID NO: 1259175 - DNA, 22 bp, Artificial Sequence
  chemically synthesized
atccaaaaaaaaaatggggaca

SEQ ID NO: 1259176 - DNA, 22 bp, Artificial Sequence
  chemically synthesized
tcatccaaaaaaaaaatgggga

SEQ ID NO: 1259177 - DNA, 22 bp, Artificial Sequence
  chemically synthesized
ctcatccaaaaaaaaaatgggg

SEQ ID NO: 1259178 - DNA, 22 bp, Artificial Sequence
  chemically synthesized
actattattgtccccatttttt

SEQ ID NO: 1259179 - DNA, 22 bp, Artificial Sequence
  chemically synthesized
tctcatccaaaaaaaaaatggg

SEQ ID NO: 1259180 - DNA, 22 bp, Artificial Sequence
  chemically synthesized
ctattattgtccccattttttt

SEQ ID NO: 1259181 - DNA, 22 bp, Artificial Sequence
  chemically synthesized
ttattgtccccatttttttttt

SEQ ID NO: 1259182 - DNA, 22 bp, Artificial Sequence
  chemically synthesized
agttttctcatccaaaaaaaaa

SEQ ID NO: 1259183 - DNA, 22 bp, Artificial Sequence
  chemically synthesized
ttgtccccattttttttttgga

SEQ ID NO: 1259184 - DNA, 22 bp, Artificial Sequence
  chemically synthesized
tccccattttttttttggatga

SEQ ID NO: 1259185 - DNA, 22 bp, Artificial Sequence
  chemically synthesized
agcctcagttttctcatccaaa

SEQ ID NO: 1259186 - DNA, 22 bp, Artificial Sequence
  chemically synthesized
tgagcctcagttttctcatcca

SEQ ID NO: 1259187 - DNA, 22 bp, Artificial Sequence
  chemically synthesized
tctgagcctcagttttctcatc

SEQ ID NO: 1259188 - DNA, 22 bp, Artificial Sequence
  chemically synthesized
tttttttggatgagaaaactga

SEQ ID NO: 1259189 - DNA, 22 bp, Artificial Sequence
  chemically synthesized
ttttttggatgagaaaactgag

SEQ ID NO: 1259190 - DNA, 22 bp, Artificial Sequence
  chemically synthesized
tttttggatgagaaaactgagg

SEQ ID NO: 1259191 - DNA, 22 bp, Artificial Sequence
  chemically synthesized
aagttctctgagcctcagtttt

SEQ ID NO: 1259192 - DNA, 22 bp, Artificial Sequence
  chemically synthesized
ttttggatgagaaaactgaggc

SEQ ID NO: 1259193 - DNA, 22 bp, Artificial Sequence
  chemically synthesized
tttggatgagaaaactgaggct

SEQ ID NO: 1259194 - DNA, 22 bp, Artificial Sequence
  chemically synthesized
ttggatgagaaaactgaggctc

SEQ ID NO: 1259195 - DNA, 22 bp, Artificial Sequence
  chemically synthesized
ctgaagttctctgagcctcagt

SEQ ID NO: 1259196 - DNA, 22 bp, Artificial Sequence
  chemically synthesized
tggatgagaaaactgaggctca

SEQ ID NO: 1259197 - DNA, 22 bp, Artificial Sequence
  chemically synthesized
ggatgagaaaactgaggctcag

SEQ ID NO: 1259198 - DNA, 22 bp, Artificial Sequence
  chemically synthesized
gatgagaaaactgaggctcaga

SEQ ID NO: 1259199 - DNA, 22 bp, Artificial Sequence
  chemically synthesized
ggaatgttactgaagttctctg

SEQ ID NO: 1259200 - DNA, 22 bp, Artificial Sequence
  chemically synthesized
gggaatgttactgaagttctct

SEQ ID NO: 1259201 - DNA, 22 bp, Artificial Sequence
  chemically synthesized
accttgggaatgttactgaagt

SEQ ID NO: 1259202 - DNA, 22 bp, Artificial Sequence
  chemically synthesized
aggctcagagaacttcagtaac

SEQ ID NO: 1259203 - DNA, 22 bp, Artificial Sequence
  chemically synthesized
agagaacttcagtaacattccc

SEQ ID NO: 1259204 - DNA, 22 bp, Artificial Sequence
  chemically synthesized
gatatctgaccttgggaatgtt

SEQ ID NO: 1259205 - DNA, 22 bp, Artificial Sequence
  chemically synthesized
ctggatatctgaccttgggaat

SEQ ID NO: 1259206 - DNA, 22 bp, Artificial Sequence
  chemically synthesized
attactggatatctgaccttgg

SEQ ID NO: 1259207 - DNA, 22 bp, Artificial Sequence
  chemically synthesized
cagtaacattcccaaggtcaga

SEQ ID NO: 1259208 - DNA, 22 bp, Artificial Sequence
  chemically synthesized
agtaacattcccaaggtcagat

SEQ ID NO: 1259209 - DNA, 22 bp, Artificial Sequence
  chemically synthesized
cactaattactggatatctgac

SEQ ID NO: 1259210 - DNA, 22 bp, Artificial Sequence
  chemically synthesized
tctacactaattactggatatc

SEQ ID NO: 1259211 - DNA, 22 bp, Artificial Sequence
  chemically synthesized
tgtctacactaattactggata

SEQ ID NO: 1259212 - DNA, 22 bp, Artificial Sequence
  chemically synthesized
ccaaggtcagatatccagtaat

SEQ ID NO: 1259213 - DNA, 22 bp, Artificial Sequence
  chemically synthesized
aattctgtctacactaattact

SEQ ID NO: 1259214 - DNA, 22 bp, Artificial Sequence
  chemically synthesized
gaattctgtctacactaattac

SEQ ID NO: 1259215 - DNA, 22 bp, Artificial Sequence
  chemically synthesized
gatttgaattctgtctacacta

SEQ ID NO: 1259216 - DNA, 22 bp, Artificial Sequence
  chemically synthesized
cacctggatttgaattctgtct

SEQ ID NO: 1259217 - DNA, 22 bp, Artificial Sequence
  chemically synthesized
ccacctggatttgaattctgtc

SEQ ID NO: 1259218 - DNA, 22 bp, Artificial Sequence
  chemically synthesized
gtgtagacagaattcaaatcca

SEQ ID NO: 1259219 - DNA, 22 bp, Artificial Sequence
  chemically synthesized
agagcatttccacctggatttg

SEQ ID NO: 1259220 - DNA, 22 bp, Artificial Sequence
  chemically synthesized
cagagcatttccacctggattt

SEQ ID NO: 1259221 - DNA, 22 bp, Artificial Sequence
  chemically synthesized
tgggtttcagagcatttccacc

SEQ ID NO: 1259222 - DNA, 22 bp, Artificial Sequence
  chemically synthesized
aaatccaggtggaaatgctctg

SEQ ID NO: 1259223 - DNA, 22 bp, Artificial Sequence
  chemically synthesized
gtgtagcaggtaagactgtggg

SEQ ID NO: 1259224 - DNA, 22 bp, Artificial Sequence
  chemically synthesized
agtgtagcaggtaagactgtgg

SEQ ID NO: 1259225 - DNA, 22 bp, Artificial Sequence
  chemically synthesized
tgaaacccacagtcttacctgc

SEQ ID NO: 1259226 - DNA, 22 bp, Artificial Sequence
  chemically synthesized
cagtttagtgtagcaggtaaga

SEQ ID NO: 1259227 - DNA, 22 bp, Artificial Sequence
  chemically synthesized
aaacccacagtcttacctgcta

SEQ ID NO: 1259228 - DNA, 22 bp, Artificial Sequence
  chemically synthesized
ttccagtttagtgtagcaggta

SEQ ID NO: 1259229 - DNA, 22 bp, Artificial Sequence
  chemically synthesized
gttccagtttagtgtagcaggt

SEQ ID NO: 1259230 - DNA, 22 bp, Artificial Sequence
  chemically synthesized
aacaatatttgttccagtttag

SEQ ID NO: 1259231 - DNA, 22 bp, Artificial Sequence
  chemically synthesized
caacaatatttgttccagttta

SEQ ID NO: 1259232 - DNA, 22 bp, Artificial Sequence
  chemically synthesized
acctgctacactaaactggaac

SEQ ID NO: 1259233 - DNA, 22 bp, Artificial Sequence
  chemically synthesized
cctgctacactaaactggaaca

SEQ ID NO: 1259234 - DNA, 22 bp, Artificial Sequence
  chemically synthesized
ctacactaaactggaacaaata

SEQ ID NO: 1259235 - DNA, 22 bp, Artificial Sequence
  chemically synthesized
cactaaactggaacaaatattg

SEQ ID NO: 1259236 - DNA, 22 bp, Artificial Sequence
  chemically synthesized
aactggaacaaatattgttgaa

SEQ ID NO: 1259237 - DNA, 22 bp, Artificial Sequence
  chemically synthesized
tcagatacatatgtttcaacaa

SEQ ID NO: 1259238 - DNA, 22 bp, Artificial Sequence
  chemically synthesized
atcagatacatatgtttcaaca

SEQ ID NO: 1259239 - DNA, 22 bp, Artificial Sequence
  chemically synthesized
tatcagatacatatgtttcaac

SEQ ID NO: 1259240 - DNA, 22 bp, Artificial Sequence
  chemically synthesized
gaacaaatattgttgaaacata

SEQ ID NO: 1259241 - DNA, 22 bp, Artificial Sequence
  chemically synthesized
aatgttttatcagatacatatg

SEQ ID NO: 1259242 - DNA, 22 bp, Artificial Sequence
  chemically synthesized
aaatgttttatcagatacatat

SEQ ID NO: 1259243 - DNA, 22 bp, Artificial Sequence
  chemically synthesized
taaatgttttatcagatacata

SEQ ID NO: 1259244 - DNA, 22 bp, Artificial Sequence
  chemically synthesized
ttaaatgttttatcagatacat

SEQ ID NO: 1259245 - DNA, 22 bp, Artificial Sequence
  chemically synthesized
ttgaaacatatgtatctgataa

SEQ ID NO: 1259246 - DNA, 22 bp, Artificial Sequence
  chemically synthesized
aaacatatgtatctgataaaac

SEQ ID NO: 1259247 - DNA, 22 bp, Artificial Sequence
  chemically synthesized
taatatttttaaatgttttatc

SEQ ID NO: 1259248 - DNA, 22 bp, Artificial Sequence
  chemically synthesized
taatcctgtaatatttttaaat

SEQ ID NO: 1259249 - DNA, 22 bp, Artificial Sequence
  chemically synthesized
ataatcctgtaatatttttaaa

SEQ ID NO: 1259250 - DNA, 22 bp, Artificial Sequence
  chemically synthesized
ataaaacatttaaaaatattac

SEQ ID NO: 1259251 - DNA, 22 bp, Artificial Sequence
  chemically synthesized
aatttataatcctgtaatattt

SEQ ID NO: 1259252 - DNA, 22 bp, Artificial Sequence
  chemically synthesized
cctgaatttataatcctgtaat

SEQ ID NO: 1259253 - DNA, 22 bp, Artificial Sequence
  chemically synthesized
aaaaatattacaggattataaa

SEQ ID NO: 1259254 - DNA, 22 bp, Artificial Sequence
  chemically synthesized
aaaatattacaggattataaat

SEQ ID NO: 1259255 - DNA, 22 bp, Artificial Sequence
  chemically synthesized
ggatagtaaacattgcctgaat

SEQ ID NO: 1259256 - DNA, 22 bp, Artificial Sequence
  chemically synthesized
caggattataaattcaggcaat

SEQ ID NO: 1259257 - DNA, 22 bp, Artificial Sequence
  chemically synthesized
gggatagtaaacattgcctgaa

SEQ ID NO: 1259258 - DNA, 22 bp, Artificial Sequence
  chemically synthesized
tgggatagtaaacattgcctga

SEQ ID NO: 1259259 - DNA, 22 bp, Artificial Sequence
  chemically synthesized
taaattcaggcaatgtttacta

SEQ ID NO: 1259260 - DNA, 22 bp, Artificial Sequence
  chemically synthesized
aggcaatgtttactatcccaaa

SEQ ID NO: 1259261 - DNA, 22 bp, Artificial Sequence
  chemically synthesized
ccatgtccccccaactttggga

SEQ ID NO: 1259262 - DNA, 22 bp, Artificial Sequence
  chemically synthesized
cccatgtccccccaactttggg

SEQ ID NO: 1259263 - DNA, 22 bp, Artificial Sequence
  chemically synthesized
actatcccaaagttggggggac

SEQ ID NO: 1259264 - DNA, 22 bp, Artificial Sequence
  chemically synthesized
ctatcccaaagttggggggaca

SEQ ID NO: 1259265 - DNA, 22 bp, Artificial Sequence
  chemically synthesized
atgccatcttcccatgtccccc

SEQ ID NO: 1259266 - DNA, 22 bp, Artificial Sequence
  chemically synthesized
tcccaaagttggggggacatgg

SEQ ID NO: 1259267 - DNA, 22 bp, Artificial Sequence
  chemically synthesized
ctcatgccatcttcccatgtcc

SEQ ID NO: 1259268 - DNA, 22 bp, Artificial Sequence
  chemically synthesized
cctcatgccatcttcccatgtc

SEQ ID NO: 1259269 - DNA, 22 bp, Artificial Sequence
  chemically synthesized
gggggacatgggaagatggcat

SEQ ID NO: 1259270 - DNA, 22 bp, Artificial Sequence
  chemically synthesized
gcaatgacataaagcacagctt

SEQ ID NO: 1259271 - DNA, 22 bp, Artificial Sequence
  chemically synthesized
gaaagttggcaatgacataaag

SEQ ID NO: 1259272 - DNA, 22 bp, Artificial Sequence
  chemically synthesized
aaggactagaaagttggcaatg

SEQ ID NO: 1259273 - DNA, 22 bp, Artificial Sequence
  chemically synthesized
tgctttatgtcattgccaactt

SEQ ID NO: 1259274 - DNA, 22 bp, Artificial Sequence
  chemically synthesized
tatgtcattgccaactttctag

SEQ ID NO: 1259275 - DNA, 22 bp, Artificial Sequence
  chemically synthesized
atgtcattgccaactttctagt

SEQ ID NO: 1259276 - DNA, 22 bp, Artificial Sequence
  chemically synthesized
tgtcattgccaactttctagtc

SEQ ID NO: 1259277 - DNA, 22 bp, Artificial Sequence
  chemically synthesized
accaccaactgaaggactagaa

SEQ ID NO: 1259278 - DNA, 22 bp, Artificial Sequence
  chemically synthesized
aaccaccaactgaaggactaga

SEQ ID NO: 1259279 - DNA, 22 bp, Artificial Sequence
  chemically synthesized
ccaactttctagtccttcagtt

SEQ ID NO: 1259280 - DNA, 22 bp, Artificial Sequence
  chemically synthesized
cacttaaccaccaactgaagga

SEQ ID NO: 1259281 - DNA, 22 bp, Artificial Sequence
  chemically synthesized
tctccacttaaccaccaactga

SEQ ID NO: 1259282 - DNA, 22 bp, Artificial Sequence
  chemically synthesized
atctccacttaaccaccaactg

SEQ ID NO: 1259283 - DNA, 22 bp, Artificial Sequence
  chemically synthesized
tctagtccttcagttggtggtt

SEQ ID NO: 1259284 - DNA, 22 bp, Artificial Sequence
  chemically synthesized
ctagtccttcagttggtggtta

SEQ ID NO: 1259285 - DNA, 22 bp, Artificial Sequence
  chemically synthesized
tagtccttcagttggtggttaa

SEQ ID NO: 1259286 - DNA, 22 bp, Artificial Sequence
  chemically synthesized
gtccttcagttggtggttaagt

SEQ ID NO: 1259287 - DNA, 22 bp, Artificial Sequence
  chemically synthesized
atccttatctccacttaaccac

SEQ ID NO: 1259288 - DNA, 22 bp, Artificial Sequence
  chemically synthesized
gcctcatccttatctccactta

SEQ ID NO: 1259289 - DNA, 22 bp, Artificial Sequence
  chemically synthesized
cagttggtggttaagtggagat

SEQ ID NO: 1259290 - DNA, 22 bp, Artificial Sequence
  chemically synthesized
agttggtggttaagtggagata

SEQ ID NO: 1259291 - DNA, 22 bp, Artificial Sequence
  chemically synthesized
tggcctcatccttatctccact

SEQ ID NO: 1259292 - DNA, 22 bp, Artificial Sequence
  chemically synthesized
tctggcctcatccttatctcca

SEQ ID NO: 1259293 - DNA, 22 bp, Artificial Sequence
  chemically synthesized
gtggttaagtggagataaggat

SEQ ID NO: 1259294 - DNA, 22 bp, Artificial Sequence
  chemically synthesized
atgttctctggcctcatcctta

SEQ ID NO: 1259295 - DNA, 22 bp, Artificial Sequence
  chemically synthesized
agtggagataaggatgaggcca

SEQ ID NO: 1259296 - DNA, 22 bp, Artificial Sequence
  chemically synthesized
gtgccactcatgttctctggcc

SEQ ID NO: 1259297 - DNA, 22 bp, Artificial Sequence
  chemically synthesized
cattcgtgccactcatgttctc

SEQ ID NO: 1259298 - DNA, 22 bp, Artificial Sequence
  chemically synthesized
gcattcgtgccactcatgttct

SEQ ID NO: 1259299 - DNA, 22 bp, Artificial Sequence
  chemically synthesized
agagaatacaagatgtaatctt

SEQ ID NO: 1259300 - DNA, 22 bp, Artificial Sequence
  chemically synthesized
aagagaatacaagatgtaatct

SEQ ID NO: 1259301 - DNA, 22 bp, Artificial Sequence
  chemically synthesized
taagagaatacaagatgtaatc

SEQ ID NO: 1259302 - DNA, 22 bp, Artificial Sequence
  chemically synthesized
aaattttaagagaatacaagat

SEQ ID NO: 1259303 - DNA, 22 bp, Artificial Sequence
  chemically synthesized
catcttgtattctcttaaaatt

SEQ ID NO: 1259304 - DNA, 22 bp, Artificial Sequence
  chemically synthesized
gtattctcttaaaattttaata

SEQ ID NO: 1259305 - DNA, 22 bp, Artificial Sequence
  chemically synthesized
atatgagcaaaatattaaaatt

SEQ ID NO: 1259306 - DNA, 22 bp, Artificial Sequence
  chemically synthesized
tattctcttaaaattttaatat

SEQ ID NO: 1259307 - DNA, 22 bp, Artificial Sequence
  chemically synthesized
tcttaaaattttaatattttgc

SEQ ID NO: 1259308 - DNA, 22 bp, Artificial Sequence
  chemically synthesized
ttaaaattttaatattttgctc

SEQ ID NO: 1259309 - DNA, 22 bp, Artificial Sequence
  chemically synthesized
aaaattttaatattttgctcat

SEQ ID NO: 1259310 - DNA, 22 bp, Artificial Sequence
  chemically synthesized
aaattttaatattttgctcata

SEQ ID NO: 1259311 - DNA, 22 bp, Artificial Sequence
  chemically synthesized
taatattttgctcatatgaatt

SEQ ID NO: 1259312 - DNA, 22 bp, Artificial Sequence
  chemically synthesized
aatattttgctcatatgaatta

SEQ ID NO: 1259313 - DNA, 22 bp, Artificial Sequence
  chemically synthesized
atattttgctcatatgaattat

SEQ ID NO: 1259314 - DNA, 22 bp, Artificial Sequence
  chemically synthesized
aaatcaatgcaaaataattcat

SEQ ID NO: 1259315 - DNA, 22 bp, Artificial Sequence
  chemically synthesized
tgctcatatgaattattttgca

SEQ ID NO: 1259316 - DNA, 22 bp, Artificial Sequence
  chemically synthesized
gctcatatgaattattttgcat

SEQ ID NO: 1259317 - DNA, 22 bp, Artificial Sequence
  chemically synthesized
ctcatatgaattattttgcatt

SEQ ID NO: 1259318 - DNA, 22 bp, Artificial Sequence
  chemically synthesized
acaattaaaatcaatgcaaaat

SEQ ID NO: 1259319 - DNA, 22 bp, Artificial Sequence
  chemically synthesized
aacaattaaaatcaatgcaaaa

SEQ ID NO: 1259320 - DNA, 22 bp, Artificial Sequence
  chemically synthesized
taacaattaaaatcaatgcaaa

SEQ ID NO: 1259321 - DNA, 22 bp, Artificial Sequence
  chemically synthesized
atatgaattattttgcattgat

SEQ ID NO: 1259322 - DNA, 22 bp, Artificial Sequence
  chemically synthesized
attttaacaattaaaatcaatg

SEQ ID NO: 1259323 - DNA, 22 bp, Artificial Sequence
  chemically synthesized
cctcattttaacaattaaaatc

SEQ ID NO: 1259324 - DNA, 22 bp, Artificial Sequence
  chemically synthesized
acctcattttaacaattaaaat

SEQ ID NO: 1259325 - DNA, 22 bp, Artificial Sequence
  chemically synthesized
tacctcattttaacaattaaaa

SEQ ID NO: 1259326 - DNA, 22 bp, Artificial Sequence
  chemically synthesized
ttttgcattgattttaattgtt

SEQ ID NO: 1259327 - DNA, 22 bp, Artificial Sequence
  chemically synthesized
tgcattgattttaattgttaaa

SEQ ID NO: 1259328 - DNA, 22 bp, Artificial Sequence
  chemically synthesized
gcattgattttaattgttaaaa

SEQ ID NO: 1259329 - DNA, 22 bp, Artificial Sequence
  chemically synthesized
tattttacctcattttaacaat

SEQ ID NO: 1259330 - DNA, 22 bp, Artificial Sequence
  chemically synthesized
cattgattttaattgttaaaat

SEQ ID NO: 1259331 - DNA, 22 bp, Artificial Sequence
  chemically synthesized
attttaattgttaaaatgaggt

SEQ ID NO: 1259332 - DNA, 22 bp, Artificial Sequence
  chemically synthesized
taattgttaaaatgaggtaaaa

SEQ ID NO: 1259333 - DNA, 22 bp, Artificial Sequence
  chemically synthesized
aattgttaaaatgaggtaaaat

SEQ ID NO: 1259334 - DNA, 22 bp, Artificial Sequence
  chemically synthesized
attgttaaaatgaggtaaaata

SEQ ID NO: 1259335 - DNA, 22 bp, Artificial Sequence
  chemically synthesized
ttaaaatgaggtaaaatataat

SEQ ID NO: 1259336 - DNA, 22 bp, Artificial Sequence
  chemically synthesized
agaaatcaggataaattatatt

SEQ ID NO: 1259337 - DNA, 22 bp, Artificial Sequence
  chemically synthesized
aaatgaggtaaaatataattta

SEQ ID NO: 1259338 - DNA, 22 bp, Artificial Sequence
  chemically synthesized
aaaattcagaaatcaggataaa

SEQ ID NO: 1259339 - DNA, 22 bp, Artificial Sequence
  chemically synthesized
atcctgatttctgaatttttag

SEQ ID NO: 1259340 - DNA, 22 bp, Artificial Sequence
  chemically synthesized
tcctgatttctgaatttttagg

SEQ ID NO: 1259341 - DNA, 22 bp, Artificial Sequence
  chemically synthesized
atttctgaatttttaggcgacc

SEQ ID NO: 1259342 - DNA, 22 bp, Artificial Sequence
  chemically synthesized
ctgaatttttaggcgaccgctt

SEQ ID NO: 1259343 - DNA, 22 bp, Artificial Sequence
  chemically synthesized
tgaatttttaggcgaccgctta

SEQ ID NO: 1259344 - DNA, 22 bp, Artificial Sequence
  chemically synthesized
aatcacaaaatgtaagcggtcg

SEQ ID NO: 1259345 - DNA, 22 bp, Artificial Sequence
  chemically synthesized
aatttttaggcgaccgcttaca

SEQ ID NO: 1259346 - DNA, 22 bp, Artificial Sequence
  chemically synthesized
tgtctgaatcacaaaatgtaag

SEQ ID NO: 1259347 - DNA, 22 bp, Artificial Sequence
  chemically synthesized
ttaggcgaccgcttacattttg

SEQ ID NO: 1259348 - DNA, 22 bp, Artificial Sequence
  chemically synthesized
taggcgaccgcttacattttgt

SEQ ID NO: 1259349 - DNA, 22 bp, Artificial Sequence
  chemically synthesized
aggcgaccgcttacattttgtg

SEQ ID NO: 1259350 - DNA, 22 bp, Artificial Sequence
  chemically synthesized
ggcgaccgcttacattttgtga

SEQ ID NO: 1259351 - DNA, 22 bp, Artificial Sequence
  chemically synthesized
acattttgtgattcagacatag

SEQ ID NO: 1259352 - DNA, 22 bp, Artificial Sequence
  chemically synthesized
cattttgtgattcagacatagc

SEQ ID NO: 1259353 - DNA, 22 bp, Artificial Sequence
  chemically synthesized
ccagaaaagatggctatgtctg

SEQ ID NO: 1259354 - DNA, 22 bp, Artificial Sequence
  chemically synthesized
tcccagaaaagatggctatgtc

SEQ ID NO: 1259355 - DNA, 22 bp, Artificial Sequence
  chemically synthesized
tgtgattcagacatagccatct

SEQ ID NO: 1259356 - DNA, 22 bp, Artificial Sequence
  chemically synthesized
ctctcccagaaaagatggctat

SEQ ID NO: 1259357 - DNA, 22 bp, Artificial Sequence
  chemically synthesized
gtgattcagacatagccatctt

SEQ ID NO: 1259358 - DNA, 22 bp, Artificial Sequence
  chemically synthesized
cctctcccagaaaagatggcta

SEQ ID NO: 1259359 - DNA, 22 bp, Artificial Sequence
  chemically synthesized
tgattcagacatagccatcttt

SEQ ID NO: 1259360 - DNA, 22 bp, Artificial Sequence
  chemically synthesized
cccttcctctcccagaaaagat

SEQ ID NO: 1259361 - DNA, 22 bp, Artificial Sequence
  chemically synthesized
agacatagccatcttttctggg

SEQ ID NO: 1259362 - DNA, 22 bp, Artificial Sequence
  chemically synthesized
ctccccttcctctcccagaaaa

SEQ ID NO: 1259363 - DNA, 22 bp, Artificial Sequence
  chemically synthesized
tgtgtacctcctccccttcctc

SEQ ID NO: 1259364 - DNA, 22 bp, Artificial Sequence
  chemically synthesized
ttctgggagaggaaggggagga

SEQ ID NO: 1259365 - DNA, 22 bp, Artificial Sequence
  chemically synthesized
tctgggagaggaaggggaggag

SEQ ID NO: 1259366 - DNA, 22 bp, Artificial Sequence
  chemically synthesized
ctgggagaggaaggggaggagg

SEQ ID NO: 1259367 - DNA, 22 bp, Artificial Sequence
  chemically synthesized
tgggagaggaaggggaggaggt

SEQ ID NO: 1259368 - DNA, 22 bp, Artificial Sequence
  chemically synthesized
ggagaggaaggggaggaggtac

SEQ ID NO: 1259369 - DNA, 22 bp, Artificial Sequence
  chemically synthesized
aagacaaatcctgtgtgtacct

SEQ ID NO: 1259370 - DNA, 22 bp, Artificial Sequence
  chemically synthesized
cattcaagacaaatcctgtgtg

SEQ ID NO: 1259371 - DNA, 22 bp, Artificial Sequence
  chemically synthesized
aaaatagggaaacctacattca

SEQ ID NO: 1259372 - DNA, 22 bp, Artificial Sequence
  chemically synthesized
tgaaaatagggaaacctacatt

SEQ ID NO: 1259373 - DNA, 22 bp, Artificial Sequence
  chemically synthesized
gtcttgaatgtaggtttcccta

SEQ ID NO: 1259374 - DNA, 22 bp, Artificial Sequence
  chemically synthesized
tcttgaatgtaggtttccctat

SEQ ID NO: 1259375 - DNA, 22 bp, Artificial Sequence
  chemically synthesized
gaatgtaggtttccctattttc

SEQ ID NO: 1259376 - DNA, 22 bp, Artificial Sequence
  chemically synthesized
aatgtaggtttccctattttca

SEQ ID NO: 1259377 - DNA, 22 bp, Artificial Sequence
  chemically synthesized
ccctattttcagagattgtata

SEQ ID NO: 1259378 - DNA, 22 bp, Artificial Sequence
  chemically synthesized
cctattttcagagattgtatat

SEQ ID NO: 1259379 - DNA, 22 bp, Artificial Sequence
  chemically synthesized
ttttcagagattgtatatttgc

SEQ ID NO: 1259380 - DNA, 22 bp, Artificial Sequence
  chemically synthesized
tcagagattgtatatttgcttc

SEQ ID NO: 1259381 - DNA, 22 bp, Artificial Sequence
  chemically synthesized
cagagattgtatatttgcttcc

SEQ ID NO: 1259382 - DNA, 22 bp, Artificial Sequence
  chemically synthesized
agagattgtatatttgcttcct

SEQ ID NO: 1259383 - DNA, 22 bp, Artificial Sequence
  chemically synthesized
acaccaagccacaggaagcaaa

SEQ ID NO: 1259384 - DNA, 22 bp, Artificial Sequence
  chemically synthesized
tatatttgcttcctgtggcttg

SEQ ID NO: 1259385 - DNA, 22 bp, Artificial Sequence
  chemically synthesized
atcagacctcacaccaagccac

SEQ ID NO: 1259386 - DNA, 22 bp, Artificial Sequence
  chemically synthesized
gcttcctgtggcttggtgtgag

SEQ ID NO: 1259387 - DNA, 22 bp, Artificial Sequence
  chemically synthesized
cttcctgtggcttggtgtgagg

SEQ ID NO: 1259388 - DNA, 22 bp, Artificial Sequence
  chemically synthesized
acattcatcagacctcacacca

SEQ ID NO: 1259389 - DNA, 22 bp, Artificial Sequence
  chemically synthesized
aacattcatcagacctcacacc

SEQ ID NO: 1259390 - DNA, 22 bp, Artificial Sequence
  chemically synthesized
cctgtggcttggtgtgaggtct

SEQ ID NO: 1259391 - DNA, 22 bp, Artificial Sequence
  chemically synthesized
ctgtggcttggtgtgaggtctg

SEQ ID NO: 1259392 - DNA, 22 bp, Artificial Sequence
  chemically synthesized
gcttaacattcatcagacctca

SEQ ID NO: 1259393 - DNA, 22 bp, Artificial Sequence
  chemically synthesized
cgcttaacattcatcagacctc

SEQ ID NO: 1259394 - DNA, 22 bp, Artificial Sequence
  chemically synthesized
tggcttggtgtgaggtctgatg

SEQ ID NO: 1259395 - DNA, 22 bp, Artificial Sequence
  chemically synthesized
gccttcgcttaacattcatcag

SEQ ID NO: 1259396 - DNA, 22 bp, Artificial Sequence
  chemically synthesized
agccttcgcttaacattcatca

SEQ ID NO: 1259397 - DNA, 22 bp, Artificial Sequence
  chemically synthesized
ggtgtgaggtctgatgaatgtt

SEQ ID NO: 1259398 - DNA, 22 bp, Artificial Sequence
  chemically synthesized
gtgtgaggtctgatgaatgtta

SEQ ID NO: 1259399 - DNA, 22 bp, Artificial Sequence
  chemically synthesized
atgaatgttaagcgaaggctaa

SEQ ID NO: 1259400 - DNA, 22 bp, Artificial Sequence
  chemically synthesized
aggagagagggggtgatttagc

SEQ ID NO: 1259401 - DNA, 22 bp, Artificial Sequence
  chemically synthesized
agcgaaggctaaatcaccccct

SEQ ID NO: 1259402 - DNA, 22 bp, Artificial Sequence
  chemically synthesized
agtggtggtactaaggagagag

SEQ ID NO: 1259403 - DNA, 22 bp, Artificial Sequence
  chemically synthesized
cagtggtggtactaaggagaga

SEQ ID NO: 1259404 - DNA, 22 bp, Artificial Sequence
  chemically synthesized
aatcaccccctctctccttagt

SEQ ID NO: 1259405 - DNA, 22 bp, Artificial Sequence
  chemically synthesized
tctccttagtaccaccactgaa

SEQ ID NO: 1259406 - DNA, 22 bp, Artificial Sequence
  chemically synthesized
tccttagtaccaccactgaagt

SEQ ID NO: 1259407 - DNA, 22 bp, Artificial Sequence
  chemically synthesized
cttagtaccaccactgaagtca

SEQ ID NO: 1259408 - DNA, 22 bp, Artificial Sequence
  chemically synthesized
aggccagaaagaagtgacttca

SEQ ID NO: 1259409 - DNA, 22 bp, Artificial Sequence
  chemically synthesized
agtaccaccactgaagtcactt

SEQ ID NO: 1259410 - DNA, 22 bp, Artificial Sequence
  chemically synthesized
aaggccagaaagaagtgacttc

SEQ ID NO: 1259411 - DNA, 22 bp, Artificial Sequence
  chemically synthesized
gtaccaccactgaagtcacttc

SEQ ID NO: 1259412 - DNA, 22 bp, Artificial Sequence
  chemically synthesized
aacttaaggccagaaagaagtg

SEQ ID NO: 1259413 - DNA, 22 bp, Artificial Sequence
  chemically synthesized
gaacttaaggccagaaagaagt

SEQ ID NO: 1259414 - DNA, 22 bp, Artificial Sequence
  chemically synthesized
tgaacttaaggccagaaagaag

SEQ ID NO: 1259415 - DNA, 22 bp, Artificial Sequence
  chemically synthesized
ttgaacttaaggccagaaagaa

SEQ ID NO: 1259416 - DNA, 22 bp, Artificial Sequence
  chemically synthesized
aagtcacttctttctggcctta

SEQ ID NO: 1259417 - DNA, 22 bp, Artificial Sequence
  chemically synthesized
cccttttgaacttaaggccaga

SEQ ID NO: 1259418 - DNA, 22 bp, Artificial Sequence
  chemically synthesized
ccccttttgaacttaaggccag

SEQ ID NO: 1259419 - DNA, 22 bp, Artificial Sequence
  chemically synthesized
agtttccccttttgaacttaag

SEQ ID NO: 1259420 - DNA, 22 bp, Artificial Sequence
  chemically synthesized
ctttctggccttaagttcaaaa

SEQ ID NO: 1259421 - DNA, 22 bp, Artificial Sequence
  chemically synthesized
tttctggccttaagttcaaaag

SEQ ID NO: 1259422 - DNA, 22 bp, Artificial Sequence
  chemically synthesized
tctggccttaagttcaaaaggg

SEQ ID NO: 1259423 - DNA, 22 bp, Artificial Sequence
  chemically synthesized
ctggccttaagttcaaaagggg

SEQ ID NO: 1259424 - DNA, 22 bp, Artificial Sequence
  chemically synthesized
atcattcagtttccccttttga

SEQ ID NO: 1259425 - DNA, 22 bp, Artificial Sequence
  chemically synthesized
tggccttaagttcaaaagggga

SEQ ID NO: 1259426 - DNA, 22 bp, Artificial Sequence
  chemically synthesized
gccttaagttcaaaaggggaaa

SEQ ID NO: 1259427 - DNA, 22 bp, Artificial Sequence
  chemically synthesized
aatactcatcattcagtttccc

SEQ ID NO: 1259428 - DNA, 22 bp, Artificial Sequence
  chemically synthesized
aagttcaaaaggggaaactgaa

SEQ ID NO: 1259429 - DNA, 22 bp, Artificial Sequence
  chemically synthesized
agttcaaaaggggaaactgaat

SEQ ID NO: 1259430 - DNA, 22 bp, Artificial Sequence
  chemically synthesized
aaaaggggaaactgaatgatga

SEQ ID NO: 1259431 - DNA, 22 bp, Artificial Sequence
  chemically synthesized
aatgatgagtattgagcatcta

SEQ ID NO: 1259432 - DNA, 22 bp, Artificial Sequence
  chemically synthesized
atgccatgacacagtgtagatg

SEQ ID NO: 1259433 - DNA, 22 bp, Artificial Sequence
  chemically synthesized
ctaatgccatgacacagtgtag

SEQ ID NO: 1259434 - DNA, 22 bp, Artificial Sequence
  chemically synthesized
agcatctacactgtgtcatggc

SEQ ID NO: 1259435 - DNA, 22 bp, Artificial Sequence
  chemically synthesized
cactgtgtcatggcattagtaa

SEQ ID NO: 1259436 - DNA, 22 bp, Artificial Sequence
  chemically synthesized
tgtcatggcattagtaattgtt

SEQ ID NO: 1259437 - DNA, 22 bp, Artificial Sequence
  chemically synthesized
agggagtcaagtgaggaacaat

SEQ ID NO: 1259438 - DNA, 22 bp, Artificial Sequence
  chemically synthesized
ctgagggagtcaagtgaggaac

SEQ ID NO: 1259439 - DNA, 22 bp, Artificial Sequence
  chemically synthesized
gtaattgttcctcacttgactc

SEQ ID NO: 1259440 - DNA, 22 bp, Artificial Sequence
  chemically synthesized
tgtagctactgagggagtcaag

SEQ ID NO: 1259441 - DNA, 22 bp, Artificial Sequence
  chemically synthesized
atgtagctactgagggagtcaa

SEQ ID NO: 1259442 - DNA, 22 bp, Artificial Sequence
  chemically synthesized
tatgtagctactgagggagtca

SEQ ID NO: 1259443 - DNA, 22 bp, Artificial Sequence
  chemically synthesized
ttcctcacttgactccctcagt

SEQ ID NO: 1259444 - DNA, 22 bp, Artificial Sequence
  chemically synthesized
ctttatgtagctactgagggag

SEQ ID NO: 1259445 - DNA, 22 bp, Artificial Sequence
  chemically synthesized
actttatgtagctactgaggga

SEQ ID NO: 1259446 - DNA, 22 bp, Artificial Sequence
  chemically synthesized
ctcacttgactccctcagtagc

SEQ ID NO: 1259447 - DNA, 22 bp, Artificial Sequence
  chemically synthesized
acttgactccctcagtagctac

SEQ ID NO: 1259448 - DNA, 22 bp, Artificial Sequence
  chemically synthesized
gactccctcagtagctacataa

SEQ ID NO: 1259449 - DNA, 22 bp, Artificial Sequence
  chemically synthesized
actccctcagtagctacataaa

SEQ ID NO: 1259450 - DNA, 22 bp, Artificial Sequence
  chemically synthesized
cctcagtagctacataaagtaa

SEQ ID NO: 1259451 - DNA, 22 bp, Artificial Sequence
  chemically synthesized
agtagctacataaagtaagtct

SEQ ID NO: 1259452 - DNA, 22 bp, Artificial Sequence
  chemically synthesized
catgaaatgagaataagaagac

SEQ ID NO: 1259453 - DNA, 22 bp, Artificial Sequence
  chemically synthesized
cataaagtaagtcttcttattc

SEQ ID NO: 1259454 - DNA, 22 bp, Artificial Sequence
  chemically synthesized
ctccatgaaatgagaataagaa

SEQ ID NO: 1259455 - DNA, 22 bp, Artificial Sequence
  chemically synthesized
actccatgaaatgagaataaga

SEQ ID NO: 1259456 - DNA, 22 bp, Artificial Sequence
  chemically synthesized
cttattctcatttcatggagta

SEQ ID NO: 1259457 - DNA, 22 bp, Artificial Sequence
  chemically synthesized
ttattctcatttcatggagtaa

SEQ ID NO: 1259458 - DNA, 22 bp, Artificial Sequence
  chemically synthesized
attctcatttcatggagtaagt

SEQ ID NO: 1259459 - DNA, 22 bp, Artificial Sequence
  chemically synthesized
ttctcatttcatggagtaagta

SEQ ID NO: 1259460 - DNA, 22 bp, Artificial Sequence
  chemically synthesized
tcatttcatggagtaagtattc

SEQ ID NO: 1259461 - DNA, 22 bp, Artificial Sequence
  chemically synthesized
atttcatggagtaagtattctt

SEQ ID NO: 1259462 - DNA, 22 bp, Artificial Sequence
  chemically synthesized
cacataatgggaataagaatac

SEQ ID NO: 1259463 - DNA, 22 bp, Artificial Sequence
  chemically synthesized
ccacataatgggaataagaata

SEQ ID NO: 1259464 - DNA, 22 bp, Artificial Sequence
  chemically synthesized
catggagtaagtattcttattc

SEQ ID NO: 1259465 - DNA, 22 bp, Artificial Sequence
  chemically synthesized
atggagtaagtattcttattcc

SEQ ID NO: 1259466 - DNA, 22 bp, Artificial Sequence
  chemically synthesized
ttccacataatgggaataagaa

SEQ ID NO: 1259467 - DNA, 22 bp, Artificial Sequence
  chemically synthesized
ttcttccacataatgggaataa

SEQ ID NO: 1259468 - DNA, 22 bp, Artificial Sequence
  chemically synthesized
agtattattcttccacataatg

SEQ ID NO: 1259469 - DNA, 22 bp, Artificial Sequence
  chemically synthesized
aagtattattcttccacataat

SEQ ID NO: 1259470 - DNA, 22 bp, Artificial Sequence
  chemically synthesized
taagtattattcttccacataa

SEQ ID NO: 1259471 - DNA, 22 bp, Artificial Sequence
  chemically synthesized
ttattcccattatgtggaagaa

SEQ ID NO: 1259472 - DNA, 22 bp, Artificial Sequence
  chemically synthesized
attcccattatgtggaagaata

SEQ ID NO: 1259473 - DNA, 22 bp, Artificial Sequence
  chemically synthesized
ttcccattatgtggaagaataa

SEQ ID NO: 1259474 - DNA, 22 bp, Artificial Sequence
  chemically synthesized
ccattatgtggaagaataatac

SEQ ID NO: 1259475 - DNA, 22 bp, Artificial Sequence
  chemically synthesized
tgtggaagaataatacttaaag

SEQ ID NO: 1259476 - DNA, 22 bp, Artificial Sequence
  chemically synthesized
atacatgaataagaatacttta

SEQ ID NO: 1259477 - DNA, 22 bp, Artificial Sequence
  chemically synthesized
aatacatgaataagaatacttt

SEQ ID NO: 1259478 - DNA, 22 bp, Artificial Sequence
  chemically synthesized
taatacatgaataagaatactt

SEQ ID NO: 1259479 - DNA, 22 bp, Artificial Sequence
  chemically synthesized
ttaatacatgaataagaatact

SEQ ID NO: 1259480 - DNA, 22 bp, Artificial Sequence
  chemically synthesized
agtttttaatacatgaataaga

SEQ ID NO: 1259481 - DNA, 22 bp, Artificial Sequence
  chemically synthesized
aaagtattcttattcatgtatt

SEQ ID NO: 1259482 - DNA, 22 bp, Artificial Sequence
  chemically synthesized
aagtattcttattcatgtatta

SEQ ID NO: 1259483 - DNA, 22 bp, Artificial Sequence
  chemically synthesized
agcctcagtttttaatacatga

SEQ ID NO: 1259484 - DNA, 22 bp, Artificial Sequence
  chemically synthesized
tgagcctcagtttttaatacat

SEQ ID NO: 1259485 - DNA, 22 bp, Artificial Sequence
  chemically synthesized
ctgagcctcagtttttaataca

SEQ ID NO: 1259486 - DNA, 22 bp, Artificial Sequence
  chemically synthesized
ttattcatgtattaaaaactga

SEQ ID NO: 1259487 - DNA, 22 bp, Artificial Sequence
  chemically synthesized
gtatttctgagcctcagttttt

SEQ ID NO: 1259488 - DNA, 22 bp, Artificial Sequence
  chemically synthesized
attcatgtattaaaaactgagg

SEQ ID NO: 1259489 - DNA, 22 bp, Artificial Sequence
  chemically synthesized
agtatttctgagcctcagtttt

SEQ ID NO: 1259490 - DNA, 22 bp, Artificial Sequence
  chemically synthesized
ttcatgtattaaaaactgaggc

SEQ ID NO: 1259491 - DNA, 22 bp, Artificial Sequence
  chemically synthesized
ttagtatttctgagcctcagtt

SEQ ID NO: 1259492 - DNA, 22 bp, Artificial Sequence
  chemically synthesized
atgtattaaaaactgaggctca

SEQ ID NO: 1259493 - DNA, 22 bp, Artificial Sequence
  chemically synthesized
aaaactgaggctcagaaatact

SEQ ID NO: 1259494 - DNA, 22 bp, Artificial Sequence
  chemically synthesized
gacaatgttcttagtatttctg

SEQ ID NO: 1259495 - DNA, 22 bp, Artificial Sequence
  chemically synthesized
agacaatgttcttagtatttct

SEQ ID NO: 1259496 - DNA, 22 bp, Artificial Sequence
  chemically synthesized
cccttagacaatgttcttagta

SEQ ID NO: 1259497 - DNA, 22 bp, Artificial Sequence
  chemically synthesized
aggctcagaaatactaagaaca

SEQ ID NO: 1259498 - DNA, 22 bp, Artificial Sequence
  chemically synthesized
gcccttagacaatgttcttagt

SEQ ID NO: 1259499 - DNA, 22 bp, Artificial Sequence
  chemically synthesized
agaaatactaagaacattgtct

SEQ ID NO: 1259500 - DNA, 22 bp, Artificial Sequence
  chemically synthesized
aaatatttgcccttagacaatg

SEQ ID NO: 1259501 - DNA, 22 bp, Artificial Sequence
  chemically synthesized
gaaatatttgcccttagacaat

SEQ ID NO: 1259502 - DNA, 22 bp, Artificial Sequence
  chemically synthesized
agaacattgtctaagggcaaat

SEQ ID NO: 1259503 - DNA, 22 bp, Artificial Sequence
  chemically synthesized
tggcacttgaaatatttgccct

SEQ ID NO: 1259504 - DNA, 22 bp, Artificial Sequence
  chemically synthesized
atggcacttgaaatatttgccc

SEQ ID NO: 1259505 - DNA, 22 bp, Artificial Sequence
  chemically synthesized
tctaagggcaaatatttcaagt

SEQ ID NO: 1259506 - DNA, 22 bp, Artificial Sequence
  chemically synthesized
agaatttatggcacttgaaata

SEQ ID NO: 1259507 - DNA, 22 bp, Artificial Sequence
  chemically synthesized
aagaatttatggcacttgaaat

SEQ ID NO: 1259508 - DNA, 22 bp, Artificial Sequence
  chemically synthesized
agggcaaatatttcaagtgcca

SEQ ID NO: 1259509 - DNA, 22 bp, Artificial Sequence
  chemically synthesized
caagtgccataaattcttaaac

SEQ ID NO: 1259510 - DNA, 22 bp, Artificial Sequence
  chemically synthesized
aagtgccataaattcttaaact

SEQ ID NO: 1259511 - DNA, 22 bp, Artificial Sequence
  chemically synthesized
ttaaacttcatgggtattttgt

SEQ ID NO: 1259512 - DNA, 22 bp, Artificial Sequence
  chemically synthesized
aaacttcatgggtattttgtat

SEQ ID NO: 1259513 - DNA, 22 bp, Artificial Sequence
  chemically synthesized
aaaagaaaaatcatacaaaata

SEQ ID NO: 1259514 - DNA, 22 bp, Artificial Sequence
  chemically synthesized
aacttcatgggtattttgtatg

SEQ ID NO: 1259515 - DNA, 22 bp, Artificial Sequence
  chemically synthesized
catgggtattttgtatgatttt

SEQ ID NO: 1259516 - DNA, 22 bp, Artificial Sequence
  chemically synthesized
atgggtattttgtatgattttt

SEQ ID NO: 1259517 - DNA, 22 bp, Artificial Sequence
  chemically synthesized
tgtatgatttttcttttcaacc

SEQ ID NO: 1259518 - DNA, 22 bp, Artificial Sequence
  chemically synthesized
gtatgatttttcttttcaacct

SEQ ID NO: 1259519 - DNA, 22 bp, Artificial Sequence
  chemically synthesized
tatgatttttcttttcaacctc

SEQ ID NO: 1259520 - DNA, 22 bp, Artificial Sequence
  chemically synthesized
ttcttttcaacctcttttgact

SEQ ID NO: 1259521 - DNA, 22 bp, Artificial Sequence
  chemically synthesized
ccagaatagcccagtcaaaaga

SEQ ID NO: 1259522 - DNA, 22 bp, Artificial Sequence
  chemically synthesized
tcttttcaacctcttttgactg

SEQ ID NO: 1259523 - DNA, 22 bp, Artificial Sequence
  chemically synthesized
cttttcaacctcttttgactgg

SEQ ID NO: 1259524 - DNA, 22 bp, Artificial Sequence
  chemically synthesized
ttttcaacctcttttgactggg

SEQ ID NO: 1259525 - DNA, 22 bp, Artificial Sequence
  chemically synthesized
ttcaacctcttttgactgggct

SEQ ID NO: 1259526 - DNA, 22 bp, Artificial Sequence
  chemically synthesized
tcaacctcttttgactgggcta

SEQ ID NO: 1259527 - DNA, 22 bp, Artificial Sequence
  chemically synthesized
caacctcttttgactgggctat

SEQ ID NO: 1259528 - DNA, 22 bp, Artificial Sequence
  chemically synthesized
aacctcttttgactgggctatt

SEQ ID NO: 1259529 - DNA, 22 bp, Artificial Sequence
  chemically synthesized
tgaccacctcccagaatagccc

SEQ ID NO: 1259530 - DNA, 22 bp, Artificial Sequence
  chemically synthesized
ttttgactgggctattctggga

SEQ ID NO: 1259531 - DNA, 22 bp, Artificial Sequence
  chemically synthesized
ttgactgggctattctgggagg

SEQ ID NO: 1259532 - DNA, 22 bp, Artificial Sequence
  chemically synthesized
tgactgggctattctgggaggt

SEQ ID NO: 1259533 - DNA, 22 bp, Artificial Sequence
  chemically synthesized
atagctgtgaccacctcccaga

SEQ ID NO: 1259534 - DNA, 22 bp, Artificial Sequence
  chemically synthesized
gactgggctattctgggaggtg

SEQ ID NO: 1259535 - DNA, 22 bp, Artificial Sequence
  chemically synthesized
actgggctattctgggaggtgg

SEQ ID NO: 1259536 - DNA, 22 bp, Artificial Sequence
  chemically synthesized
ggctattctgggaggtggtcac

SEQ ID NO: 1259537 - DNA, 22 bp, Artificial Sequence
  chemically synthesized
gccctaatagctgtgaccacct

SEQ ID NO: 1259538 - DNA, 22 bp, Artificial Sequence
  chemically synthesized
ggccctaatagctgtgaccacc

SEQ ID NO: 1259539 - DNA, 22 bp, Artificial Sequence
  chemically synthesized
ttctgggaggtggtcacagcta

SEQ ID NO: 1259540 - DNA, 22 bp, Artificial Sequence
  chemically synthesized
atttggccctaatagctgtgac

SEQ ID NO: 1259541 - DNA, 22 bp, Artificial Sequence
  chemically synthesized
tgggaggtggtcacagctatta

SEQ ID NO: 1259542 - DNA, 22 bp, Artificial Sequence
  chemically synthesized
attcatttggccctaatagctg

SEQ ID NO: 1259543 - DNA, 22 bp, Artificial Sequence
  chemically synthesized
ggaggtggtcacagctattagg

SEQ ID NO: 1259544 - DNA, 22 bp, Artificial Sequence
  chemically synthesized
aattcatttggccctaatagct

SEQ ID NO: 1259545 - DNA, 22 bp, Artificial Sequence
  chemically synthesized
taattcatttggccctaatagc

SEQ ID NO: 1259546 - DNA, 22 bp, Artificial Sequence
  chemically synthesized
atatattttaattcatttggcc

SEQ ID NO: 1259547 - DNA, 22 bp, Artificial Sequence
  chemically synthesized
catatattttaattcatttggc

SEQ ID NO: 1259548 - DNA, 22 bp, Artificial Sequence
  chemically synthesized
tcatatattttaattcatttgg

SEQ ID NO: 1259549 - DNA, 22 bp, Artificial Sequence
  chemically synthesized
ttagggccaaatgaattaaaat

SEQ ID NO: 1259550 - DNA, 22 bp, Artificial Sequence
  chemically synthesized
gggccaaatgaattaaaatata

SEQ ID NO: 1259551 - DNA, 22 bp, Artificial Sequence
  chemically synthesized
atcaatcattttcatatatttt

SEQ ID NO: 1259552 - DNA, 22 bp, Artificial Sequence
  chemically synthesized
cagttcatcaatcattttcata

SEQ ID NO: 1259553 - DNA, 22 bp, Artificial Sequence
  chemically synthesized
acagttcatcaatcattttcat

SEQ ID NO: 1259554 - DNA, 22 bp, Artificial Sequence
  chemically synthesized
aaatatatgaaaatgattgatg

SEQ ID NO: 1259555 - DNA, 22 bp, Artificial Sequence
  chemically synthesized
atatgatgccttacagttcatc

SEQ ID NO: 1259556 - DNA, 22 bp, Artificial Sequence
  chemically synthesized
tgttgatatgatgccttacagt

SEQ ID NO: 1259557 - DNA, 22 bp, Artificial Sequence
  chemically synthesized
atgttgatatgatgccttacag

SEQ ID NO: 1259558 - DNA, 22 bp, Artificial Sequence
  chemically synthesized
tatttatgttgatatgatgcct

SEQ ID NO: 1259559 - DNA, 22 bp, Artificial Sequence
  chemically synthesized
atgaactgtaaggcatcatatc

SEQ ID NO: 1259560 - DNA, 22 bp, Artificial Sequence
  chemically synthesized
tactatatttatgttgatatga

SEQ ID NO: 1259561 - DNA, 22 bp, Artificial Sequence
  chemically synthesized
attatactatatttatgttgat

SEQ ID NO: 1259562 - DNA, 22 bp, Artificial Sequence
  chemically synthesized
taaggcatcatatcaacataaa

SEQ ID NO: 1259563 - DNA, 22 bp, Artificial Sequence
  chemically synthesized
ttaattatactatatttatgtt

SEQ ID NO: 1259564 - DNA, 22 bp, Artificial Sequence
  chemically synthesized
acattattaattatactatatt

SEQ ID NO: 1259565 - DNA, 22 bp, Artificial Sequence
  chemically synthesized
ttgacattattaattatactat

SEQ ID NO: 1259566 - DNA, 22 bp, Artificial Sequence
  chemically synthesized
ttattgacattattaattatac

SEQ ID NO: 1259567 - DNA, 22 bp, Artificial Sequence
  chemically synthesized
attattgacattattaattata

SEQ ID NO: 1259568 - DNA, 22 bp, Artificial Sequence
  chemically synthesized
tattattgacattattaattat

SEQ ID NO: 1259569 - DNA, 22 bp, Artificial Sequence
  chemically synthesized
ataatgtcaataataaaatcat

SEQ ID NO: 1259570 - DNA, 22 bp, Artificial Sequence
  chemically synthesized
gaagtagaagtaaatgatttta

SEQ ID NO: 1259571 - DNA, 22 bp, Artificial Sequence
  chemically synthesized
aatactagaagtagaagtaaat

SEQ ID NO: 1259572 - DNA, 22 bp, Artificial Sequence
  chemically synthesized
tgaatactagaagtagaagtaa

SEQ ID NO: 1259573 - DNA, 22 bp, Artificial Sequence
  chemically synthesized
ctgaatactagaagtagaagta

SEQ ID NO: 1259574 - DNA, 22 bp, Artificial Sequence
  chemically synthesized
ttctgaatactagaagtagaag

SEQ ID NO: 1259575 - DNA, 22 bp, Artificial Sequence
  chemically synthesized
tcttctgaatactagaagtaga

SEQ ID NO: 1259576 - DNA, 22 bp, Artificial Sequence
  chemically synthesized
cctctcttctgaatactagaag

SEQ ID NO: 1259577 - DNA, 22 bp, Artificial Sequence
  chemically synthesized
acctctcttctgaatactagaa

SEQ ID NO: 1259578 - DNA, 22 bp, Artificial Sequence
  chemically synthesized
tacctctcttctgaatactaga

SEQ ID NO: 1259579 - DNA, 22 bp, Artificial Sequence
  chemically synthesized
acttctacttctagtattcaga

SEQ ID NO: 1259580 - DNA, 22 bp, Artificial Sequence
  chemically synthesized
cttctacttctagtattcagaa

SEQ ID NO: 1259581 - DNA, 22 bp, Artificial Sequence
  chemically synthesized
ctacttctagtattcagaagag

SEQ ID NO: 1259582 - DNA, 22 bp, Artificial Sequence
  chemically synthesized
tacttctagtattcagaagaga

SEQ ID NO: 1259583 - DNA, 22 bp, Artificial Sequence
  chemically synthesized
cttctagtattcagaagagagg

SEQ ID NO: 1259584 - DNA, 22 bp, Artificial Sequence
  chemically synthesized
ctagtattcagaagagaggtaa

SEQ ID NO: 1259585 - DNA, 22 bp, Artificial Sequence
  chemically synthesized
tagtattcagaagagaggtaaa

SEQ ID NO: 1259586 - DNA, 22 bp, Artificial Sequence
  chemically synthesized
gtattcagaagagaggtaaagg

SEQ ID NO: 1259587 - DNA, 22 bp, Artificial Sequence
  chemically synthesized
aaataggcaaaatataccttta

SEQ ID NO: 1259588 - DNA, 22 bp, Artificial Sequence
  chemically synthesized
agaagagaggtaaaggtatatt

SEQ ID NO: 1259589 - DNA, 22 bp, Artificial Sequence
  chemically synthesized
taaaataggcaaaatatacctt

SEQ ID NO: 1259590 - DNA, 22 bp, Artificial Sequence
  chemically synthesized
atatggtactctaaaataggca

SEQ ID NO: 1259591 - DNA, 22 bp, Artificial Sequence
  chemically synthesized
catatggtactctaaaataggc

SEQ ID NO: 1259592 - DNA, 22 bp, Artificial Sequence
  chemically synthesized
atttcatatggtactctaaaat

SEQ ID NO: 1259593 - DNA, 22 bp, Artificial Sequence
  chemically synthesized
catttcatatggtactctaaaa

SEQ ID NO: 1259594 - DNA, 22 bp, Artificial Sequence
  chemically synthesized
tttcatttcatatggtactcta

SEQ ID NO: 1259595 - DNA, 22 bp, Artificial Sequence
  chemically synthesized
atttcatttcatatggtactct

SEQ ID NO: 1259596 - DNA, 22 bp, Artificial Sequence
  chemically synthesized
tatttcatttcatatggtactc

SEQ ID NO: 1259597 - DNA, 22 bp, Artificial Sequence
  chemically synthesized
tgcctattttagagtaccatat

SEQ ID NO: 1259598 - DNA, 22 bp, Artificial Sequence
  chemically synthesized
gcctattttagagtaccatatg

SEQ ID NO: 1259599 - DNA, 22 bp, Artificial Sequence
  chemically synthesized
cctattttagagtaccatatga

SEQ ID NO: 1259600 - DNA, 22 bp, Artificial Sequence
  chemically synthesized
ttttagagtaccatatgaaatg

SEQ ID NO: 1259601 - DNA, 22 bp, Artificial Sequence
  chemically synthesized
tagagtaccatatgaaatgaaa

SEQ ID NO: 1259602 - DNA, 22 bp, Artificial Sequence
  chemically synthesized
agagtaccatatgaaatgaaat

SEQ ID NO: 1259603 - DNA, 22 bp, Artificial Sequence
  chemically synthesized
gagtaccatatgaaatgaaata

SEQ ID NO: 1259604 - DNA, 22 bp, Artificial Sequence
  chemically synthesized
ataataatattttatttcattt

SEQ ID NO: 1259605 - DNA, 22 bp, Artificial Sequence
  chemically synthesized
cataataatattttatttcatt

SEQ ID NO: 1259606 - DNA, 22 bp, Artificial Sequence
  chemically synthesized
ttcataataatattttatttca

SEQ ID NO: 1259607 - DNA, 22 bp, Artificial Sequence
  chemically synthesized
cttcataataatattttatttc

SEQ ID NO: 1259608 - DNA, 22 bp, Artificial Sequence
  chemically synthesized
tcttcataataatattttattt

SEQ ID NO: 1259609 - DNA, 22 bp, Artificial Sequence
  chemically synthesized
ttcttcataataatattttatt

SEQ ID NO: 1259610 - DNA, 22 bp, Artificial Sequence
  chemically synthesized
ccaatgtgaaaagagtaaattt

SEQ ID NO: 1259611 - DNA, 22 bp, Artificial Sequence
  chemically synthesized
cccaatgtgaaaagagtaaatt

SEQ ID NO: 1259612 - DNA, 22 bp, Artificial Sequence
  chemically synthesized
ttatgaagaaaaatttactctt

SEQ ID NO: 1259613 - DNA, 22 bp, Artificial Sequence
  chemically synthesized
tgaagaaaaatttactcttttc

SEQ ID NO: 1259614 - DNA, 22 bp, Artificial Sequence
  chemically synthesized
atggatagtttcccaatgtgaa

SEQ ID NO: 1259615 - DNA, 22 bp, Artificial Sequence
  chemically synthesized
tgatggatagtttcccaatgtg

SEQ ID NO: 1259616 - DNA, 22 bp, Artificial Sequence
  chemically synthesized
actcttttcacattgggaaact

SEQ ID NO: 1259617 - DNA, 22 bp, Artificial Sequence
  chemically synthesized
actctgatggatagtttcccaa

SEQ ID NO: 1259618 - DNA, 22 bp, Artificial Sequence
  chemically synthesized
ctcttttcacattgggaaacta

SEQ ID NO: 1259619 - DNA, 22 bp, Artificial Sequence
  chemically synthesized
ttgactctgatggatagtttcc

SEQ ID NO: 1259620 - DNA, 22 bp, Artificial Sequence
  chemically synthesized
ttttcacattgggaaactatcc

SEQ ID NO: 1259621 - DNA, 22 bp, Artificial Sequence
  chemically synthesized
ttcacattgggaaactatccat

SEQ ID NO: 1259622 - DNA, 22 bp, Artificial Sequence
  chemically synthesized
tcacattgggaaactatccatc

SEQ ID NO: 1259623 - DNA, 22 bp, Artificial Sequence
  chemically synthesized
cacattgggaaactatccatca

SEQ ID NO: 1259624 - DNA, 22 bp, Artificial Sequence
  chemically synthesized
acattgggaaactatccatcag

SEQ ID NO: 1259625 - DNA, 22 bp, Artificial Sequence
  chemically synthesized
ggaaactatccatcagagtcaa

SEQ ID NO: 1259626 - DNA, 22 bp, Artificial Sequence
  chemically synthesized
tccatcagagtcaacaatcatt

SEQ ID NO: 1259627 - DNA, 22 bp, Artificial Sequence
  chemically synthesized
gagagaaggaggacaatgattg

SEQ ID NO: 1259628 - DNA, 22 bp, Artificial Sequence
  chemically synthesized
ggagagaaggaggacaatgatt

SEQ ID NO: 1259629 - DNA, 22 bp, Artificial Sequence
  chemically synthesized
tggagagaaggaggacaatgat

SEQ ID NO: 1259630 - DNA, 22 bp, Artificial Sequence
  chemically synthesized
ttttggagagaaggaggacaat

SEQ ID NO: 1259631 - DNA, 22 bp, Artificial Sequence
  chemically synthesized
tattttggagagaaggaggaca

SEQ ID NO: 1259632 - DNA, 22 bp, Artificial Sequence
  chemically synthesized
agcatgttctattttggagaga

SEQ ID NO: 1259633 - DNA, 22 bp, Artificial Sequence
  chemically synthesized
tcctccttctctccaaaataga

SEQ ID NO: 1259634 - DNA, 22 bp, Artificial Sequence
  chemically synthesized
cttctctccaaaatagaacatg

SEQ ID NO: 1259635 - DNA, 22 bp, Artificial Sequence
  chemically synthesized
ctctccaaaatagaacatgctg

SEQ ID NO: 1259636 - DNA, 22 bp, Artificial Sequence
  chemically synthesized
tctccaaaatagaacatgctga

SEQ ID NO: 1259637 - DNA, 22 bp, Artificial Sequence
  chemically synthesized
tccaaaatagaacatgctgagg

SEQ ID NO: 1259638 - DNA, 22 bp, Artificial Sequence
  chemically synthesized
caaaatagaacatgctgaggtt

SEQ ID NO: 1259639 - DNA, 22 bp, Artificial Sequence
  chemically synthesized
aaaaatatagcataaacctcag

SEQ ID NO: 1259640 - DNA, 22 bp, Artificial Sequence
  chemically synthesized
atagaaatagttcaaaaatata

SEQ ID NO: 1259641 - DNA, 22 bp, Artificial Sequence
  chemically synthesized
aggtttatgctatatttttgaa

SEQ ID NO: 1259642 - DNA, 22 bp, Artificial Sequence
  chemically synthesized
tgttaatagaaatagttcaaaa

SEQ ID NO: 1259643 - DNA, 22 bp, Artificial Sequence
  chemically synthesized
atgctatatttttgaactattt

SEQ ID NO: 1259644 - DNA, 22 bp, Artificial Sequence
  chemically synthesized
tgctatatttttgaactatttc

SEQ ID NO: 1259645 - DNA, 22 bp, Artificial Sequence
  chemically synthesized
attgtgttaatagaaatagttc

SEQ ID NO: 1259646 - DNA, 22 bp, Artificial Sequence
  chemically synthesized
aattgtgttaatagaaatagtt

SEQ ID NO: 1259647 - DNA, 22 bp, Artificial Sequence
  chemically synthesized
taattgtgttaatagaaatagt

SEQ ID NO: 1259648 - DNA, 22 bp, Artificial Sequence
  chemically synthesized
tatttttgaactatttctatta

SEQ ID NO: 1259649 - DNA, 22 bp, Artificial Sequence
  chemically synthesized
agcattttaattgtgttaatag

SEQ ID NO: 1259650 - DNA, 22 bp, Artificial Sequence
  chemically synthesized
ttgaactatttctattaacaca

SEQ ID NO: 1259651 - DNA, 22 bp, Artificial Sequence
  chemically synthesized
cagcattttaattgtgttaata

SEQ ID NO: 1259652 - DNA, 22 bp, Artificial Sequence
  chemically synthesized
tgaactatttctattaacacaa

SEQ ID NO: 1259653 - DNA, 22 bp, Artificial Sequence
  chemically synthesized
gaactatttctattaacacaat

SEQ ID NO: 1259654 - DNA, 22 bp, Artificial Sequence
  chemically synthesized
aactatttctattaacacaatt

SEQ ID NO: 1259655 - DNA, 22 bp, Artificial Sequence
  chemically synthesized
atttcagcattttaattgtgtt

SEQ ID NO: 1259656 - DNA, 22 bp, Artificial Sequence
  chemically synthesized
tttctattaacacaattaaaat

SEQ ID NO: 1259657 - DNA, 22 bp, Artificial Sequence
  chemically synthesized
aaattcatttcagcattttaat

SEQ ID NO: 1259658 - DNA, 22 bp, Artificial Sequence
  chemically synthesized
ctattaacacaattaaaatgct

SEQ ID NO: 1259659 - DNA, 22 bp, Artificial Sequence
  chemically synthesized
caaattcatttcagcattttaa

SEQ ID NO: 1259660 - DNA, 22 bp, Artificial Sequence
  chemically synthesized
tattaacacaattaaaatgctg

SEQ ID NO: 1259661 - DNA, 22 bp, Artificial Sequence
  chemically synthesized
tcaaattcatttcagcatttta

SEQ ID NO: 1259662 - DNA, 22 bp, Artificial Sequence
  chemically synthesized
ttcaaattcatttcagcatttt

SEQ ID NO: 1259663 - DNA, 22 bp, Artificial Sequence
  chemically synthesized
ttaacacaattaaaatgctgaa

SEQ ID NO: 1259664 - DNA, 22 bp, Artificial Sequence
  chemically synthesized
acacaattaaaatgctgaaatg

SEQ ID NO: 1259665 - DNA, 22 bp, Artificial Sequence
  chemically synthesized
aaatgctgaaatgaatttgaaa

SEQ ID NO: 1259666 - DNA, 22 bp, Artificial Sequence
  chemically synthesized
gtcagaatataaacatcttttc

SEQ ID NO: 1259667 - DNA, 22 bp, Artificial Sequence
  chemically synthesized
cgtcagaatataaacatctttt

SEQ ID NO: 1259668 - DNA, 22 bp, Artificial Sequence
  chemically synthesized
aaatgaatttgaaaagatgttt

SEQ ID NO: 1259669 - DNA, 22 bp, Artificial Sequence
  chemically synthesized
cccttcgtcagaatataaacat

SEQ ID NO: 1259670 - DNA, 22 bp, Artificial Sequence
  chemically synthesized
gttacccttcgtcagaatataa

SEQ ID NO: 1259671 - DNA, 22 bp, Artificial Sequence
  chemically synthesized
gaaaagatgtttatattctgac

SEQ ID NO: 1259672 - DNA, 22 bp, Artificial Sequence
  chemically synthesized
tagttacccttcgtcagaatat

SEQ ID NO: 1259673 - DNA, 22 bp, Artificial Sequence
  chemically synthesized
aaaagatgtttatattctgacg

SEQ ID NO: 1259674 - DNA, 22 bp, Artificial Sequence
  chemically synthesized
ctagttacccttcgtcagaata

SEQ ID NO: 1259675 - DNA, 22 bp, Artificial Sequence
  chemically synthesized
atattctgacgaagggtaacta

SEQ ID NO: 1259676 - DNA, 22 bp, Artificial Sequence
  chemically synthesized
tattctgacgaagggtaactag

SEQ ID NO: 1259677 - DNA, 22 bp, Artificial Sequence
  chemically synthesized
gagtagaaaatatttctagtta

SEQ ID NO: 1259678 - DNA, 22 bp, Artificial Sequence
  chemically synthesized
agagtagaaaatatttctagtt

SEQ ID NO: 1259679 - DNA, 22 bp, Artificial Sequence
  chemically synthesized
tgacgaagggtaactagaaata

SEQ ID NO: 1259680 - DNA, 22 bp, Artificial Sequence
  chemically synthesized
acgaagggtaactagaaatatt

SEQ ID NO: 1259681 - DNA, 22 bp, Artificial Sequence
  chemically synthesized
aatttagagtagaaaatatttc

SEQ ID NO: 1259682 - DNA, 22 bp, Artificial Sequence
  chemically synthesized
actcaatttagagtagaaaata

SEQ ID NO: 1259683 - DNA, 22 bp, Artificial Sequence
  chemically synthesized
gaaatattttctactctaaatt

SEQ ID NO: 1259684 - DNA, 22 bp, Artificial Sequence
  chemically synthesized
cagtatcacacctgactcaatt

SEQ ID NO: 1259685 - DNA, 22 bp, Artificial Sequence
  chemically synthesized
acagtatcacacctgactcaat

SEQ ID NO: 1259686 - DNA, 22 bp, Artificial Sequence
  chemically synthesized
tctactctaaattgagtcaggt

SEQ ID NO: 1259687 - DNA, 22 bp, Artificial Sequence
  chemically synthesized
ctactctaaattgagtcaggtg

SEQ ID NO: 1259688 - DNA, 22 bp, Artificial Sequence
  chemically synthesized
tttacagtatcacacctgactc

SEQ ID NO: 1259689 - DNA, 22 bp, Artificial Sequence
  chemically synthesized
tactctaaattgagtcaggtgt

SEQ ID NO: 1259690 - DNA, 22 bp, Artificial Sequence
  chemically synthesized
ctctaaattgagtcaggtgtga

SEQ ID NO: 1259691 - DNA, 22 bp, Artificial Sequence
  chemically synthesized
tcctgtttacagtatcacacct

SEQ ID NO: 1259692 - DNA, 22 bp, Artificial Sequence
  chemically synthesized
taaattgagtcaggtgtgatac

SEQ ID NO: 1259693 - DNA, 22 bp, Artificial Sequence
  chemically synthesized
atcctgtttacagtatcacacc

SEQ ID NO: 1259694 - DNA, 22 bp, Artificial Sequence
  chemically synthesized
aattgagtcaggtgtgatactg

SEQ ID NO: 1259695 - DNA, 22 bp, Artificial Sequence
  chemically synthesized
cttatcctgtttacagtatcac

SEQ ID NO: 1259696 - DNA, 22 bp, Artificial Sequence
  chemically synthesized
acttatcctgtttacagtatca

SEQ ID NO: 1259697 - DNA, 22 bp, Artificial Sequence
  chemically synthesized
tacttatcctgtttacagtatc

SEQ ID NO: 1259698 - DNA, 22 bp, Artificial Sequence
  chemically synthesized
ttacttatcctgtttacagtat

SEQ ID NO: 1259699 - DNA, 22 bp, Artificial Sequence
  chemically synthesized
agtcaggtgtgatactgtaaac

SEQ ID NO: 1259700 - DNA, 22 bp, Artificial Sequence
  chemically synthesized
tatttttacttatcctgtttac

SEQ ID NO: 1259701 - DNA, 22 bp, Artificial Sequence
  chemically synthesized
tattatatttttacttatcctg

SEQ ID NO: 1259702 - DNA, 22 bp, Artificial Sequence
  chemically synthesized
atattatatttttacttatcct

SEQ ID NO: 1259703 - DNA, 22 bp, Artificial Sequence
  chemically synthesized
tatattatatttttacttatcc

SEQ ID NO: 1259704 - DNA, 22 bp, Artificial Sequence
  chemically synthesized
taaacaggataagtaaaaatat

SEQ ID NO: 1259705 - DNA, 22 bp, Artificial Sequence
  chemically synthesized
aaattttatattatatttttac

SEQ ID NO: 1259706 - DNA, 22 bp, Artificial Sequence
  chemically synthesized
gaaattttatattatattttta

SEQ ID NO: 1259707 - DNA, 22 bp, Artificial Sequence
  chemically synthesized
tgaaattttatattatattttt

SEQ ID NO: 1259708 - DNA, 22 bp, Artificial Sequence
  chemically synthesized
gaatcaagtagtaaattttgaa

SEQ ID NO: 1259709 - DNA, 22 bp, Artificial Sequence
  chemically synthesized
gacattggaatcaagtagtaaa

SEQ ID NO: 1259710 - DNA, 22 bp, Artificial Sequence
  chemically synthesized
tggacattggaatcaagtagta

SEQ ID NO: 1259711 - DNA, 22 bp, Artificial Sequence
  chemically synthesized
ctggacattggaatcaagtagt

SEQ ID NO: 1259712 - DNA, 22 bp, Artificial Sequence
  chemically synthesized
tctggacattggaatcaagtag

SEQ ID NO: 1259713 - DNA, 22 bp, Artificial Sequence
  chemically synthesized
ttctggacattggaatcaagta

SEQ ID NO: 1259714 - DNA, 22 bp, Artificial Sequence
  chemically synthesized
caaaatttactacttgattcca

SEQ ID NO: 1259715 - DNA, 22 bp, Artificial Sequence
  chemically synthesized
ttttctggacattggaatcaag

SEQ ID NO: 1259716 - DNA, 22 bp, Artificial Sequence
  chemically synthesized
aaaatttactacttgattccaa

SEQ ID NO: 1259717 - DNA, 22 bp, Artificial Sequence
  chemically synthesized
attcttttctggacattggaat

SEQ ID NO: 1259718 - DNA, 22 bp, Artificial Sequence
  chemically synthesized
cattcttttctggacattggaa

SEQ ID NO: 1259719 - DNA, 22 bp, Artificial Sequence
  chemically synthesized
tcattcttttctggacattgga

SEQ ID NO: 1259720 - DNA, 22 bp, Artificial Sequence
  chemically synthesized
actacttgattccaatgtccag

SEQ ID NO: 1259721 - DNA, 22 bp, Artificial Sequence
  chemically synthesized
ctacttgattccaatgtccaga

SEQ ID NO: 1259722 - DNA, 22 bp, Artificial Sequence
  chemically synthesized
tattttcattcttttctggaca

SEQ ID NO: 1259723 - DNA, 22 bp, Artificial Sequence
  chemically synthesized
cttgattccaatgtccagaaaa

SEQ ID NO: 1259724 - DNA, 22 bp, Artificial Sequence
  chemically synthesized
atattttcattcttttctggac

SEQ ID NO: 1259725 - DNA, 22 bp, Artificial Sequence
  chemically synthesized
gattccaatgtccagaaaagaa

SEQ ID NO: 1259726 - DNA, 22 bp, Artificial Sequence
  chemically synthesized
attccaatgtccagaaaagaat

SEQ ID NO: 1259727 - DNA, 22 bp, Artificial Sequence
  chemically synthesized
caatgtccagaaaagaatgaaa

SEQ ID NO: 1259728 - DNA, 22 bp, Artificial Sequence
  chemically synthesized
tatgatttatattttcattctt

SEQ ID NO: 1259729 - DNA, 22 bp, Artificial Sequence
  chemically synthesized
atatgatttatattttcattct

SEQ ID NO: 1259730 - DNA, 22 bp, Artificial Sequence
  chemically synthesized
tatatgatttatattttcattc

SEQ ID NO: 1259731 - DNA, 22 bp, Artificial Sequence
  chemically synthesized
gagttttatatgatttatattt

SEQ ID NO: 1259732 - DNA, 22 bp, Artificial Sequence
  chemically synthesized
gctagagttttatatgatttat

SEQ ID NO: 1259733 - DNA, 22 bp, Artificial Sequence
  chemically synthesized
aattggctagagttttatatga

SEQ ID NO: 1259734 - DNA, 22 bp, Artificial Sequence
  chemically synthesized
aaattggctagagttttatatg

SEQ ID NO: 1259735 - DNA, 22 bp, Artificial Sequence
  chemically synthesized
cttaaattggctagagttttat

SEQ ID NO: 1259736 - DNA, 22 bp, Artificial Sequence
  chemically synthesized
cagttgcttaaattggctagag

SEQ ID NO: 1259737 - DNA, 22 bp, Artificial Sequence
  chemically synthesized
aagggattacagttgcttaaat

SEQ ID NO: 1259738 - DNA, 22 bp, Artificial Sequence
  chemically synthesized
tagccaatttaagcaactgtaa

SEQ ID NO: 1259739 - DNA, 22 bp, Artificial Sequence
  chemically synthesized
gccaatttaagcaactgtaatc

SEQ ID NO: 1259740 - DNA, 22 bp, Artificial Sequence
  chemically synthesized
atgatgtctaaagggattacag

SEQ ID NO: 1259741 - DNA, 22 bp, Artificial Sequence
  chemically synthesized
aatgatgtctaaagggattaca

SEQ ID NO: 1259742 - DNA, 22 bp, Artificial Sequence
  chemically synthesized
aagcaactgtaatccctttaga

SEQ ID NO: 1259743 - DNA, 22 bp, Artificial Sequence
  chemically synthesized
agcaactgtaatccctttagac

SEQ ID NO: 1259744 - DNA, 22 bp, Artificial Sequence
  chemically synthesized
taatccctttagacatcattaa

SEQ ID NO: 1259745 - DNA, 22 bp, Artificial Sequence
  chemically synthesized
tcagaggtaaagtaaatttaat

SEQ ID NO: 1259746 - DNA, 22 bp, Artificial Sequence
  chemically synthesized
ctgtcagaggtaaagtaaattt

SEQ ID NO: 1259747 - DNA, 22 bp, Artificial Sequence
  chemically synthesized
tagacatcattaaatttacttt

SEQ ID NO: 1259748 - DNA, 22 bp, Artificial Sequence
  chemically synthesized
agacatcattaaatttacttta

SEQ ID NO: 1259749 - DNA, 22 bp, Artificial Sequence
  chemically synthesized
gacatcattaaatttactttac

SEQ ID NO: 1259750 - DNA, 22 bp, Artificial Sequence
  chemically synthesized
tggtatcacctactgtcagagg

SEQ ID NO: 1259751 - DNA, 22 bp, Artificial Sequence
  chemically synthesized
aatttactttacctctgacagt

SEQ ID NO: 1259752 - DNA, 22 bp, Artificial Sequence
  chemically synthesized
atggtatcacctactgtcagag

SEQ ID NO: 1259753 - DNA, 22 bp, Artificial Sequence
  chemically synthesized
atttatggtatcacctactgtc

SEQ ID NO: 1259754 - DNA, 22 bp, Artificial Sequence
  chemically synthesized
actttacctctgacagtaggtg

SEQ ID NO: 1259755 - DNA, 22 bp, Artificial Sequence
  chemically synthesized
ctttacctctgacagtaggtga

SEQ ID NO: 1259756 - DNA, 22 bp, Artificial Sequence
  chemically synthesized
ctcatttatggtatcacctact

SEQ ID NO: 1259757 - DNA, 22 bp, Artificial Sequence
  chemically synthesized
actcatttatggtatcacctac

SEQ ID NO: 1259758 - DNA, 22 bp, Artificial Sequence
  chemically synthesized
tacctctgacagtaggtgatac

SEQ ID NO: 1259759 - DNA, 22 bp, Artificial Sequence
  chemically synthesized
acctctgacagtaggtgatacc

SEQ ID NO: 1259760 - DNA, 22 bp, Artificial Sequence
  chemically synthesized
ttactcatttatggtatcacct

SEQ ID NO: 1259761 - DNA, 22 bp, Artificial Sequence
  chemically synthesized
cctctgacagtaggtgatacca

SEQ ID NO: 1259762 - DNA, 22 bp, Artificial Sequence
  chemically synthesized
tgacagtaggtgataccataaa

SEQ ID NO: 1259763 - DNA, 22 bp, Artificial Sequence
  chemically synthesized
acagtaggtgataccataaatg

SEQ ID NO: 1259764 - DNA, 22 bp, Artificial Sequence
  chemically synthesized
aaatatgttcttactcatttat

SEQ ID NO: 1259765 - DNA, 22 bp, Artificial Sequence
  chemically synthesized
aaaatatgttcttactcattta

SEQ ID NO: 1259766 - DNA, 22 bp, Artificial Sequence
  chemically synthesized
acatttaaaatatgttcttact

SEQ ID NO: 1259767 - DNA, 22 bp, Artificial Sequence
  chemically synthesized
tccagagagacaatatattgac

SEQ ID NO: 1259768 - DNA, 22 bp, Artificial Sequence
  chemically synthesized
taaatgtcaatatattgtctct

SEQ ID NO: 1259769 - DNA, 22 bp, Artificial Sequence
  chemically synthesized
aaatgtcaatatattgtctctc

SEQ ID NO: 1259770 - DNA, 22 bp, Artificial Sequence
  chemically synthesized
aatgtcaatatattgtctctct

SEQ ID NO: 1259771 - DNA, 22 bp, Artificial Sequence
  chemically synthesized
tctctctggataatatatttga

SEQ ID NO: 1259772 - DNA, 22 bp, Artificial Sequence
  chemically synthesized
tctggataatatatttgatggt

SEQ ID NO: 1259773 - DNA, 22 bp, Artificial Sequence
  chemically synthesized
tggataatatatttgatggttt

SEQ ID NO: 1259774 - DNA, 22 bp, Artificial Sequence
  chemically synthesized
gtaaggtatataaaaccatcaa

SEQ ID NO: 1259775 - DNA, 22 bp, Artificial Sequence
  chemically synthesized
agtaaggtatataaaaccatca

SEQ ID NO: 1259776 - DNA, 22 bp, Artificial Sequence
  chemically synthesized
gataatatatttgatggtttta

SEQ ID NO: 1259777 - DNA, 22 bp, Artificial Sequence
  chemically synthesized
tagtaaggtatataaaaccatc

SEQ ID NO: 1259778 - DNA, 22 bp, Artificial Sequence
  chemically synthesized
tgggttttagtaaggtatataa

SEQ ID NO: 1259779 - DNA, 22 bp, Artificial Sequence
  chemically synthesized
tatgggttttagtaaggtatat

SEQ ID NO: 1259780 - DNA, 22 bp, Artificial Sequence
  chemically synthesized
ctatgggttttagtaaggtata

SEQ ID NO: 1259781 - DNA, 22 bp, Artificial Sequence
  chemically synthesized
gatggttttatataccttacta

SEQ ID NO: 1259782 - DNA, 22 bp, Artificial Sequence
  chemically synthesized
atggttttatataccttactaa

SEQ ID NO: 1259783 - DNA, 22 bp, Artificial Sequence
  chemically synthesized
aaaagtttctatgggttttagt

SEQ ID NO: 1259784 - DNA, 22 bp, Artificial Sequence
  chemically synthesized
aaaaagtttctatgggttttag

SEQ ID NO: 1259785 - DNA, 22 bp, Artificial Sequence
  chemically synthesized
tatataccttactaaaacccat

SEQ ID NO: 1259786 - DNA, 22 bp, Artificial Sequence
  chemically synthesized
taaaaagtttctatgggtttta

SEQ ID NO: 1259787 - DNA, 22 bp, Artificial Sequence
  chemically synthesized
atataccttactaaaacccata

SEQ ID NO: 1259788 - DNA, 22 bp, Artificial Sequence
  chemically synthesized
tataccttactaaaacccatag

SEQ ID NO: 1259789 - DNA, 22 bp, Artificial Sequence
  chemically synthesized
actaaaacccatagaaactttt

SEQ ID NO: 1259790 - DNA, 22 bp, Artificial Sequence
  chemically synthesized
ctaaaacccatagaaacttttt

SEQ ID NO: 1259791 - DNA, 22 bp, Artificial Sequence
  chemically synthesized
atatcacatctttaaaaagttt

SEQ ID NO: 1259792 - DNA, 22 bp, Artificial Sequence
  chemically synthesized
aaacccatagaaactttttaaa

SEQ ID NO: 1259793 - DNA, 22 bp, Artificial Sequence
  chemically synthesized
aatagatatcaacactaatatc

SEQ ID NO: 1259794 - DNA, 22 bp, Artificial Sequence
  chemically synthesized
tttaaagatgtgatattagtgt

SEQ ID NO: 1259795 - DNA, 22 bp, Artificial Sequence
  chemically synthesized
caatagatatcaacactaatat

SEQ ID NO: 1259796 - DNA, 22 bp, Artificial Sequence
  chemically synthesized
ttaaagatgtgatattagtgtt

SEQ ID NO: 1259797 - DNA, 22 bp, Artificial Sequence
  chemically synthesized
taaagatgtgatattagtgttg

SEQ ID NO: 1259798 - DNA, 22 bp, Artificial Sequence
  chemically synthesized
aaagatgtgatattagtgttga

SEQ ID NO: 1259799 - DNA, 22 bp, Artificial Sequence
  chemically synthesized
aagatgtgatattagtgttgat

SEQ ID NO: 1259800 - DNA, 22 bp, Artificial Sequence
  chemically synthesized
tatcttcaatagatatcaacac

SEQ ID NO: 1259801 - DNA, 22 bp, Artificial Sequence
  chemically synthesized
gccaattatatcttcaatagat

SEQ ID NO: 1259802 - DNA, 22 bp, Artificial Sequence
  chemically synthesized
agccaattatatcttcaataga

SEQ ID NO: 1259803 - DNA, 22 bp, Artificial Sequence
  chemically synthesized
tagccaattatatcttcaatag

SEQ ID NO: 1259804 - DNA, 22 bp, Artificial Sequence
  chemically synthesized
gtgttgatatctattgaagata

SEQ ID NO: 1259805 - DNA, 22 bp, Artificial Sequence
  chemically synthesized
aactttagccaattatatcttc

SEQ ID NO: 1259806 - DNA, 22 bp, Artificial Sequence
  chemically synthesized
aaactttagccaattatatctt

SEQ ID NO: 1259807 - DNA, 22 bp, Artificial Sequence
  chemically synthesized
taaactttagccaattatatct

SEQ ID NO: 1259808 - DNA, 22 bp, Artificial Sequence
  chemically synthesized
atatctattgaagatataattg

SEQ ID NO: 1259809 - DNA, 22 bp, Artificial Sequence
  chemically synthesized
ttaaactttagccaattatatc

SEQ ID NO: 1259810 - DNA, 22 bp, Artificial Sequence
  chemically synthesized
tttaaactttagccaattatat

SEQ ID NO: 1259811 - DNA, 22 bp, Artificial Sequence
  chemically synthesized
ttttaaactttagccaattata

SEQ ID NO: 1259812 - DNA, 22 bp, Artificial Sequence
  chemically synthesized
ttttttaaactttagccaatta

SEQ ID NO: 1259813 - DNA, 22 bp, Artificial Sequence
  chemically synthesized
ttgaagatataattggctaaag

SEQ ID NO: 1259814 - DNA, 22 bp, Artificial Sequence
  chemically synthesized
ctcttttttaaactttagccaa

SEQ ID NO: 1259815 - DNA, 22 bp, Artificial Sequence
  chemically synthesized
actcttttttaaactttagcca

SEQ ID NO: 1259816 - DNA, 22 bp, Artificial Sequence
  chemically synthesized
tactcttttttaaactttagcc

SEQ ID NO: 1259817 - DNA, 22 bp, Artificial Sequence
  chemically synthesized
aagatataattggctaaagttt

SEQ ID NO: 1259818 - DNA, 22 bp, Artificial Sequence
  chemically synthesized
gctaaagtttaaaaaagagtaa

SEQ ID NO: 1259819 - DNA, 22 bp, Artificial Sequence
  chemically synthesized
gaaaaaaatattttactctttt

SEQ ID NO: 1259820 - DNA, 22 bp, Artificial Sequence
  chemically synthesized
ggaaaaaaatattttactcttt

SEQ ID NO: 1259821 - DNA, 22 bp, Artificial Sequence
  chemically synthesized
aagtttaaaaaagagtaaaata

SEQ ID NO: 1259822 - DNA, 22 bp, Artificial Sequence
  chemically synthesized
tgcttggaaaaaaatattttac

SEQ ID NO: 1259823 - DNA, 22 bp, Artificial Sequence
  chemically synthesized
aaaaaagagtaaaatatttttt

SEQ ID NO: 1259824 - DNA, 22 bp, Artificial Sequence
  chemically synthesized
aaaaagagtaaaatattttttt

SEQ ID NO: 1259825 - DNA, 22 bp, Artificial Sequence
  chemically synthesized
ggctgtgcttggaaaaaaatat

SEQ ID NO: 1259826 - DNA, 22 bp, Artificial Sequence
  chemically synthesized
ctgggctgtgcttggaaaaaaa

SEQ ID NO: 1259827 - DNA, 22 bp, Artificial Sequence
  chemically synthesized
ttttccaagcacagcccagtaa

SEQ ID NO: 1259828 - DNA, 22 bp, Artificial Sequence
  chemically synthesized
tttccaagcacagcccagtaat

SEQ ID NO: 1259829 - DNA, 22 bp, Artificial Sequence
  chemically synthesized
ttccaagcacagcccagtaata

SEQ ID NO: 1259830 - DNA, 22 bp, Artificial Sequence
  chemically synthesized
tccaagcacagcccagtaatat

SEQ ID NO: 1259831 - DNA, 22 bp, Artificial Sequence
  chemically synthesized
ccaagcacagcccagtaatatt

SEQ ID NO: 1259832 - DNA, 22 bp, Artificial Sequence
  chemically synthesized
caagcacagcccagtaatattg

SEQ ID NO: 1259833 - DNA, 22 bp, Artificial Sequence
  chemically synthesized
tgacaacagtaaaaaacaaaga

SEQ ID NO: 1259834 - DNA, 22 bp, Artificial Sequence
  chemically synthesized
atgacaacagtaaaaaacaaag

SEQ ID NO: 1259835 - DNA, 22 bp, Artificial Sequence
  chemically synthesized
gacatgtgatctttgtttttta

SEQ ID NO: 1259836 - DNA, 22 bp, Artificial Sequence
  chemically synthesized
tatgcttatgacaacagtaaaa

SEQ ID NO: 1259837 - DNA, 22 bp, Artificial Sequence
  chemically synthesized
tatatgcttatgacaacagtaa

SEQ ID NO: 1259838 - DNA, 22 bp, Artificial Sequence
  chemically synthesized
ctatatgcttatgacaacagta

SEQ ID NO: 1259839 - DNA, 22 bp, Artificial Sequence
  chemically synthesized
tctatatgcttatgacaacagt

SEQ ID NO: 1259840 - DNA, 22 bp, Artificial Sequence
  chemically synthesized
tgttttttactgttgtcataag

SEQ ID NO: 1259841 - DNA, 22 bp, Artificial Sequence
  chemically synthesized
tctttctatatgcttatgacaa

SEQ ID NO: 1259842 - DNA, 22 bp, Artificial Sequence
  chemically synthesized
gttttttactgttgtcataagc

SEQ ID NO: 1259843 - DNA, 22 bp, Artificial Sequence
  chemically synthesized
ttttttactgttgtcataagca

SEQ ID NO: 1259844 - DNA, 22 bp, Artificial Sequence
  chemically synthesized
tttactgttgtcataagcatat

SEQ ID NO: 1259845 - DNA, 22 bp, Artificial Sequence
  chemically synthesized
aattgtctttctatatgcttat

SEQ ID NO: 1259846 - DNA, 22 bp, Artificial Sequence
  chemically synthesized
ttactgttgtcataagcatata

SEQ ID NO: 1259847 - DNA, 22 bp, Artificial Sequence
  chemically synthesized
tactgttgtcataagcatatag

SEQ ID NO: 1259848 - DNA, 22 bp, Artificial Sequence
  chemically synthesized
actgttgtcataagcatataga

SEQ ID NO: 1259849 - DNA, 22 bp, Artificial Sequence
  chemically synthesized
ctaaattgtctttctatatgct

SEQ ID NO: 1259850 - DNA, 22 bp, Artificial Sequence
  chemically synthesized
ctgttgtcataagcatatagaa

SEQ ID NO: 1259851 - DNA, 22 bp, Artificial Sequence
  chemically synthesized
gctaaattgtctttctatatgc

SEQ ID NO: 1259852 - DNA, 22 bp, Artificial Sequence
  chemically synthesized
ttgtcataagcatatagaaaga

SEQ ID NO: 1259853 - DNA, 22 bp, Artificial Sequence
  chemically synthesized
tcataagcatatagaaagacaa

SEQ ID NO: 1259854 - DNA, 22 bp, Artificial Sequence
  chemically synthesized
atcagaacacttgctaaattgt

SEQ ID NO: 1259855 - DNA, 22 bp, Artificial Sequence
  chemically synthesized
aacctcatcagaacacttgcta

SEQ ID NO: 1259856 - DNA, 22 bp, Artificial Sequence
  chemically synthesized
aaacctcatcagaacacttgct

SEQ ID NO: 1259857 - DNA, 22 bp, Artificial Sequence
  chemically synthesized
taaacctcatcagaacacttgc

SEQ ID NO: 1259858 - DNA, 22 bp, Artificial Sequence
  chemically synthesized
tttaaacctcatcagaacactt

SEQ ID NO: 1259859 - DNA, 22 bp, Artificial Sequence
  chemically synthesized
agcaagtgttctgatgaggttt

SEQ ID NO: 1259860 - DNA, 22 bp, Artificial Sequence
  chemically synthesized
gcaagtgttctgatgaggttta

SEQ ID NO: 1259861 - DNA, 22 bp, Artificial Sequence
  chemically synthesized
gaaaaaatgctctttaaacctc

SEQ ID NO: 1259862 - DNA, 22 bp, Artificial Sequence
  chemically synthesized
tgatgaggtttaaagagcattt

SEQ ID NO: 1259863 - DNA, 22 bp, Artificial Sequence
  chemically synthesized
atgaggtttaaagagcattttt

SEQ ID NO: 1259864 - DNA, 22 bp, Artificial Sequence
  chemically synthesized
ccatatactagaaaaaatgctc

SEQ ID NO: 1259865 - DNA, 22 bp, Artificial Sequence
  chemically synthesized
tactaccatatactagaaaaaa

SEQ ID NO: 1259866 - DNA, 22 bp, Artificial Sequence
  chemically synthesized
ttatactaccatatactagaaa

SEQ ID NO: 1259867 - DNA, 22 bp, Artificial Sequence
  chemically synthesized
aaagagcattttttctagtata

SEQ ID NO: 1259868 - DNA, 22 bp, Artificial Sequence
  chemically synthesized
attatactaccatatactagaa

SEQ ID NO: 1259869 - DNA, 22 bp, Artificial Sequence
  chemically synthesized
aagagcattttttctagtatat

SEQ ID NO: 1259870 - DNA, 22 bp, Artificial Sequence
  chemically synthesized
tttattatactaccatatacta

SEQ ID NO: 1259871 - DNA, 22 bp, Artificial Sequence
  chemically synthesized
ttgtttattatactaccatata

SEQ ID NO: 1259872 - DNA, 22 bp, Artificial Sequence
  chemically synthesized
tttctagtatatggtagtataa

SEQ ID NO: 1259873 - DNA, 22 bp, Artificial Sequence
  chemically synthesized
ttctagtatatggtagtataat

SEQ ID NO: 1259874 - DNA, 22 bp, Artificial Sequence
  chemically synthesized
tctagtatatggtagtataata

SEQ ID NO: 1259875 - DNA, 22 bp, Artificial Sequence
  chemically synthesized
ctagtatatggtagtataataa

SEQ ID NO: 1259876 - DNA, 22 bp, Artificial Sequence
  chemically synthesized
tagtatatggtagtataataaa

SEQ ID NO: 1259877 - DNA, 22 bp, Artificial Sequence
  chemically synthesized
gtatatggtagtataataaaca

SEQ ID NO: 1259878 - DNA, 22 bp, Artificial Sequence
  chemically synthesized
aaatatacaatgaattattgtt

SEQ ID NO: 1259879 - DNA, 22 bp, Artificial Sequence
  chemically synthesized
gaaatatacaatgaattattgt

SEQ ID NO: 1259880 - DNA, 22 bp, Artificial Sequence
  chemically synthesized
tgaaatatacaatgaattattg

SEQ ID NO: 1259881 - DNA, 22 bp, Artificial Sequence
  chemically synthesized
ttttgaaatatacaatgaatta

SEQ ID NO: 1259882 - DNA, 22 bp, Artificial Sequence
  chemically synthesized
gctattttgaaatatacaatga

SEQ ID NO: 1259883 - DNA, 22 bp, Artificial Sequence
  chemically synthesized
tagctattttgaaatatacaat

SEQ ID NO: 1259884 - DNA, 22 bp, Artificial Sequence
  chemically synthesized
ctagctattttgaaatatacaa

SEQ ID NO: 1259885 - DNA, 22 bp, Artificial Sequence
  chemically synthesized
ttctagctattttgaaatatac

SEQ ID NO: 1259886 - DNA, 22 bp, Artificial Sequence
  chemically synthesized
tcttctagctattttgaaatat

SEQ ID NO: 1259887 - DNA, 22 bp, Artificial Sequence
  chemically synthesized
ttctcttctagctattttgaaa

SEQ ID NO: 1259888 - DNA, 22 bp, Artificial Sequence
  chemically synthesized
attgtatatttcaaaatagcta

SEQ ID NO: 1259889 - DNA, 22 bp, Artificial Sequence
  chemically synthesized
taattattctcttctagctatt

SEQ ID NO: 1259890 - DNA, 22 bp, Artificial Sequence
  chemically synthesized
tatatttcaaaatagctagaag

SEQ ID NO: 1259891 - DNA, 22 bp, Artificial Sequence
  chemically synthesized
caaaatagctagaagagaataa

SEQ ID NO: 1259892 - DNA, 22 bp, Artificial Sequence
  chemically synthesized
aaaatagctagaagagaataat

SEQ ID NO: 1259893 - DNA, 22 bp, Artificial Sequence
  chemically synthesized
tgatgggatcattataattatt

SEQ ID NO: 1259894 - DNA, 22 bp, Artificial Sequence
  chemically synthesized
gtgatgggatcattataattat

SEQ ID NO: 1259895 - DNA, 22 bp, Artificial Sequence
  chemically synthesized
tgtgatgggatcattataatta

SEQ ID NO: 1259896 - DNA, 22 bp, Artificial Sequence
  chemically synthesized
tttgtgatgggatcattataat

SEQ ID NO: 1259897 - DNA, 22 bp, Artificial Sequence
  chemically synthesized
ctttgtgatgggatcattataa

SEQ ID NO: 1259898 - DNA, 22 bp, Artificial Sequence
  chemically synthesized
gaagagaataattataatgatc

SEQ ID NO: 1259899 - DNA, 22 bp, Artificial Sequence
  chemically synthesized
tctttgtgatgggatcattata

SEQ ID NO: 1259900 - DNA, 22 bp, Artificial Sequence
  chemically synthesized
ctttctttgtgatgggatcatt

SEQ ID NO: 1259901 - DNA, 22 bp, Artificial Sequence
  chemically synthesized
cctttctttgtgatgggatcat

SEQ ID NO: 1259902 - DNA, 22 bp, Artificial Sequence
  chemically synthesized
aatccttcctttctttgtgatg

SEQ ID NO: 1259903 - DNA, 22 bp, Artificial Sequence
  chemically synthesized
taatgatcccatcacaaagaaa

SEQ ID NO: 1259904 - DNA, 22 bp, Artificial Sequence
  chemically synthesized
ggatatccatcatctcaatcct

SEQ ID NO: 1259905 - DNA, 22 bp, Artificial Sequence
  chemically synthesized
agatgatggatatcccaattac

SEQ ID NO: 1259906 - DNA, 22 bp, Artificial Sequence
  chemically synthesized
tataaatgatcaaatcagagta

SEQ ID NO: 1259907 - DNA, 22 bp, Artificial Sequence
  chemically synthesized
ctctgatttgatcatttataca

SEQ ID NO: 1259908 - DNA, 22 bp, Artificial Sequence
  chemically synthesized
atcatgtatatactgtataaat

SEQ ID NO: 1259909 - DNA, 22 bp, Artificial Sequence
  chemically synthesized
aatcatgtatatactgtataaa

SEQ ID NO: 1259910 - DNA, 22 bp, Artificial Sequence
  chemically synthesized
tgatttgatcatttatacagta

SEQ ID NO: 1259911 - DNA, 22 bp, Artificial Sequence
  chemically synthesized
taatcatgtatatactgtataa

SEQ ID NO: 1259912 - DNA, 22 bp, Artificial Sequence
  chemically synthesized
atttgatcatttatacagtata

SEQ ID NO: 1259913 - DNA, 22 bp, Artificial Sequence
  chemically synthesized
gatcatttatacagtatataca

SEQ ID NO: 1259914 - DNA, 22 bp, Artificial Sequence
  chemically synthesized
atcatttatacagtatatacat

SEQ ID NO: 1259915 - DNA, 22 bp, Artificial Sequence
  chemically synthesized
atacagtatatacatgattaaa

SEQ ID NO: 1259916 - DNA, 22 bp, Artificial Sequence
  chemically synthesized
tacagtatatacatgattaaaa

SEQ ID NO: 1259917 - DNA, 22 bp, Artificial Sequence
  chemically synthesized
aaatattacatgtgatatactt

SEQ ID NO: 1259918 - DNA, 22 bp, Artificial Sequence
  chemically synthesized
ggtggggacacagagccaaagt

SEQ ID NO: 1259919 - DNA, 22 bp, Artificial Sequence
  chemically synthesized
gggtggggacacagagccaaag

SEQ ID NO: 1259920 - DNA, 22 bp, Artificial Sequence
  chemically synthesized
catgtgatatactttggctctg

SEQ ID NO: 1259921 - DNA, 22 bp, Artificial Sequence
  chemically synthesized
gatttgggtggggacacagagc

SEQ ID NO: 1259922 - DNA, 22 bp, Artificial Sequence
  chemically synthesized
gcattagatttgggtggggaca

SEQ ID NO: 1259923 - DNA, 22 bp, Artificial Sequence
  chemically synthesized
ggcattagatttgggtggggac

SEQ ID NO: 1259924 - DNA, 22 bp, Artificial Sequence
  chemically synthesized
tggctctgtgtccccacccaaa

SEQ ID NO: 1259925 - DNA, 22 bp, Artificial Sequence
  chemically synthesized
tttggcattagatttgggtggg

SEQ ID NO: 1259926 - DNA, 22 bp, Artificial Sequence
  chemically synthesized
ggctctgtgtccccacccaaat

SEQ ID NO: 1259927 - DNA, 22 bp, Artificial Sequence
  chemically synthesized
gctctgtgtccccacccaaatc

SEQ ID NO: 1259928 - DNA, 22 bp, Artificial Sequence
  chemically synthesized
ctatttggcattagatttgggt

SEQ ID NO: 1259929 - DNA, 22 bp, Artificial Sequence
  chemically synthesized
tgtgtccccacccaaatctaat

SEQ ID NO: 1259930 - DNA, 22 bp, Artificial Sequence
  chemically synthesized
tgtccccacccaaatctaatgc

SEQ ID NO: 1259931 - DNA, 22 bp, Artificial Sequence
  chemically synthesized
acacaaggagattactatttgg

SEQ ID NO: 1259932 - DNA, 22 bp, Artificial Sequence
  chemically synthesized
ccctgacacaaggagattacta

SEQ ID NO: 1259933 - DNA, 22 bp, Artificial Sequence
  chemically synthesized
atgccaaatagtaatctccttg

SEQ ID NO: 1259934 - DNA, 22 bp, Artificial Sequence
  chemically synthesized
ccaccaggtccctcccctgaca

SEQ ID NO: 1259935 - DNA, 22 bp, Artificial Sequence
  chemically synthesized
cttgtgtcaggggagggacctg

SEQ ID NO: 1259936 - DNA, 22 bp, Artificial Sequence
  chemically synthesized
gtgtcaggggagggacctggtg

SEQ ID NO: 1259937 - DNA, 22 bp, Artificial Sequence
  chemically synthesized
tgtcaggggagggacctggtgg

SEQ ID NO: 1259938 - DNA, 22 bp, Artificial Sequence
  chemically synthesized
ccatgatccagtcatctcccac

SEQ ID NO: 1259939 - DNA, 22 bp, Artificial Sequence
  chemically synthesized
ctcccatgatccagtcatctcc

SEQ ID NO: 1259940 - DNA, 22 bp, Artificial Sequence
  chemically synthesized
gtgggagatgactggatcatgg

SEQ ID NO: 1259941 - DNA, 22 bp, Artificial Sequence
  chemically synthesized
agggaaatctgctcccatgatc

SEQ ID NO: 1259942 - DNA, 22 bp, Artificial Sequence
  chemically synthesized
gatcatgggagcagatttccct

SEQ ID NO: 1259943 - DNA, 22 bp, Artificial Sequence
  chemically synthesized
tcacaagaaaagtctgagggaa

SEQ ID NO: 1259944 - DNA, 22 bp, Artificial Sequence
  chemically synthesized
actatcacaagaaaagtctgag

SEQ ID NO: 1259945 - DNA, 22 bp, Artificial Sequence
  chemically synthesized
actcactatcacaagaaaagtc

SEQ ID NO: 1259946 - DNA, 22 bp, Artificial Sequence
  chemically synthesized
ccctcagacttttcttgtgata

SEQ ID NO: 1259947 - DNA, 22 bp, Artificial Sequence
  chemically synthesized
cctcagacttttcttgtgatag

SEQ ID NO: 1259948 - DNA, 22 bp, Artificial Sequence
  chemically synthesized
gtgagaactcactcactatcac

SEQ ID NO: 1259949 - DNA, 22 bp, Artificial Sequence
  chemically synthesized
agacttttcttgtgatagtgag

SEQ ID NO: 1259950 - DNA, 22 bp, Artificial Sequence
  chemically synthesized
ttcttgtgatagtgagtgagtt

SEQ ID NO: 1259951 - DNA, 22 bp, Artificial Sequence
  chemically synthesized
tcttgtgatagtgagtgagttc

SEQ ID NO: 1259952 - DNA, 22 bp, Artificial Sequence
  chemically synthesized
cttgtgatagtgagtgagttct

SEQ ID NO: 1259953 - DNA, 22 bp, Artificial Sequence
  chemically synthesized
ttgtgatagtgagtgagttctc

SEQ ID NO: 1259954 - DNA, 22 bp, Artificial Sequence
  chemically synthesized
gtgatagtgagtgagttctcac

SEQ ID NO: 1259955 - DNA, 22 bp, Artificial Sequence
  chemically synthesized
tgatagtgagtgagttctcacg

SEQ ID NO: 1259956 - DNA, 22 bp, Artificial Sequence
  chemically synthesized
aaccatcagatctcgtgagaac

SEQ ID NO: 1259957 - DNA, 22 bp, Artificial Sequence
  chemically synthesized
aaaccatcagatctcgtgagaa

SEQ ID NO: 1259958 - DNA, 22 bp, Artificial Sequence
  chemically synthesized
taaaccatcagatctcgtgaga

SEQ ID NO: 1259959 - DNA, 22 bp, Artificial Sequence
  chemically synthesized
ttaaaccatcagatctcgtgag

SEQ ID NO: 1259960 - DNA, 22 bp, Artificial Sequence
  chemically synthesized
tcacgagatctgatggtttaaa

SEQ ID NO: 1259961 - DNA, 22 bp, Artificial Sequence
  chemically synthesized
acgagatctgatggtttaaaag

SEQ ID NO: 1259962 - DNA, 22 bp, Artificial Sequence
  chemically synthesized
atggtttaaaagtgtggcactt

SEQ ID NO: 1259963 - DNA, 22 bp, Artificial Sequence
  chemically synthesized
aaaagtgtggcacttccccccc

SEQ ID NO: 1259964 - DNA, 22 bp, Artificial Sequence
  chemically synthesized
ggggatgtgggggggggggaag

SEQ ID NO: 1259965 - DNA, 22 bp, Artificial Sequence
  chemically synthesized
aaagtgtggcacttcccccccc

SEQ ID NO: 1259966 - DNA, 22 bp, Artificial Sequence
  chemically synthesized
cccccccccccacatcccccag

SEQ ID NO: 1259967 - DNA, 22 bp, Artificial Sequence
  chemically synthesized
ccccccccccacatcccccagc

SEQ ID NO: 1259968 - DNA, 22 bp, Artificial Sequence
  chemically synthesized
catggtggcaggagctggggga

SEQ ID NO: 1259969 - DNA, 22 bp, Artificial Sequence
  chemically synthesized
acatggtggcaggagctggggg

SEQ ID NO: 1259970 - DNA, 22 bp, Artificial Sequence
  chemically synthesized
ctgccaccatgtaagatgtgcc

SEQ ID NO: 1259971 - DNA, 22 bp, Artificial Sequence
  chemically synthesized
ccaccatgtaagatgtgccttg

SEQ ID NO: 1259972 - DNA, 22 bp, Artificial Sequence
  chemically synthesized
gcagaaggtgaaggggaggcaa

SEQ ID NO: 1259973 - DNA, 22 bp, Artificial Sequence
  chemically synthesized
ggcagaaggtgaaggggaggca

SEQ ID NO: 1259974 - DNA, 22 bp, Artificial Sequence
  chemically synthesized
acaatcttggcagaaggtgaag

SEQ ID NO: 1259975 - DNA, 22 bp, Artificial Sequence
  chemically synthesized
gcctccccttcaccttctgcca

SEQ ID NO: 1259976 - DNA, 22 bp, Artificial Sequence
  chemically synthesized
cctccccttcaccttctgccaa

SEQ ID NO: 1259977 - DNA, 22 bp, Artificial Sequence
  chemically synthesized
aggacgctgacaatcttggcag

SEQ ID NO: 1259978 - DNA, 22 bp, Artificial Sequence
  chemically synthesized
cccttcaccttctgccaagatt

SEQ ID NO: 1259979 - DNA, 22 bp, Artificial Sequence
  chemically synthesized
caccttctgccaagattgtcag

SEQ ID NO: 1259980 - DNA, 22 bp, Artificial Sequence
  chemically synthesized
accttctgccaagattgtcagc

SEQ ID NO: 1259981 - DNA, 22 bp, Artificial Sequence
  chemically synthesized
gggaggcctcaggacgctgaca

SEQ ID NO: 1259982 - DNA, 22 bp, Artificial Sequence
  chemically synthesized
ctgccaagattgtcagcgtcct

SEQ ID NO: 1259983 - DNA, 22 bp, Artificial Sequence
  chemically synthesized
tgccaagattgtcagcgtcctg

SEQ ID NO: 1259984 - DNA, 22 bp, Artificial Sequence
  chemically synthesized
ccaagattgtcagcgtcctgag

SEQ ID NO: 1259985 - DNA, 22 bp, Artificial Sequence
  chemically synthesized
cacatgactggggaggcctcag

SEQ ID NO: 1259986 - DNA, 22 bp, Artificial Sequence
  chemically synthesized
tcagcgtcctgaggcctcccca

SEQ ID NO: 1259987 - DNA, 22 bp, Artificial Sequence
  chemically synthesized
aaagttccacatgactggggag

SEQ ID NO: 1259988 - DNA, 22 bp, Artificial Sequence
  chemically synthesized
actcaaagttccacatgactgg

SEQ ID NO: 1259989 - DNA, 22 bp, Artificial Sequence
  chemically synthesized
aggcctccccagtcatgtggaa

SEQ ID NO: 1259990 - DNA, 22 bp, Artificial Sequence
  chemically synthesized
attgactcaaagttccacatga

SEQ ID NO: 1259991 - DNA, 22 bp, Artificial Sequence
  chemically synthesized
aattgactcaaagttccacatg

SEQ ID NO: 1259992 - DNA, 22 bp, Artificial Sequence
  chemically synthesized
cccagtcatgtggaactttgag

SEQ ID NO: 1259993 - DNA, 22 bp, Artificial Sequence
  chemically synthesized
taaagaaaagaggtttaattga

SEQ ID NO: 1259994 - DNA, 22 bp, Artificial Sequence
  chemically synthesized
ataaagaaaagaggtttaattg

SEQ ID NO: 1259995 - DNA, 22 bp, Artificial Sequence
  chemically synthesized
tgagtcaattaaacctcttttc

SEQ ID NO: 1259996 - DNA, 22 bp, Artificial Sequence
  chemically synthesized
gagtcaattaaacctcttttct

SEQ ID NO: 1259997 - DNA, 22 bp, Artificial Sequence
  chemically synthesized
ggtgatttataaagaaaagagg

SEQ ID NO: 1259998 - DNA, 22 bp, Artificial Sequence
  chemically synthesized
agtcaattaaacctcttttctt

SEQ ID NO: 1259999 - DNA, 22 bp, Artificial Sequence
  chemically synthesized
agactgggtgatttataaagaa

SEQ ID NO: 1260000 - DNA, 22 bp, Artificial Sequence
  chemically synthesized
aacctcttttctttataaatca

SEQ ID NO: 1260001 - DNA, 22 bp, Artificial Sequence
  chemically synthesized
cctgagactgggtgatttataa

SEQ ID NO: 1260002 - DNA, 22 bp, Artificial Sequence
  chemically synthesized
ttttctttataaatcacccagt

SEQ ID NO: 1260003 - DNA, 22 bp, Artificial Sequence
  chemically synthesized
ttctttataaatcacccagtct

SEQ ID NO: 1260004 - DNA, 22 bp, Artificial Sequence
  chemically synthesized
tctttataaatcacccagtctc

SEQ ID NO: 1260005 - DNA, 22 bp, Artificial Sequence
  chemically synthesized
ctttataaatcacccagtctca

SEQ ID NO: 1260006 - DNA, 22 bp, Artificial Sequence
  chemically synthesized
taaagaactacctgagactggg

SEQ ID NO: 1260007 - DNA, 22 bp, Artificial Sequence
  chemically synthesized
tttataaatcacccagtctcag

SEQ ID NO: 1260008 - DNA, 22 bp, Artificial Sequence
  chemically synthesized
tataaatcacccagtctcaggt

SEQ ID NO: 1260009 - DNA, 22 bp, Artificial Sequence
  chemically synthesized
ataaatcacccagtctcaggta

SEQ ID NO: 1260010 - DNA, 22 bp, Artificial Sequence
  chemically synthesized
taaatcacccagtctcaggtag

SEQ ID NO: 1260011 - DNA, 22 bp, Artificial Sequence
  chemically synthesized
cacagctataaagaactacctg

SEQ ID NO: 1260012 - DNA, 22 bp, Artificial Sequence
  chemically synthesized
acacagctataaagaactacct

SEQ ID NO: 1260013 - DNA, 22 bp, Artificial Sequence
  chemically synthesized
tacacagctataaagaactacc

SEQ ID NO: 1260014 - DNA, 22 bp, Artificial Sequence
  chemically synthesized
ttacacagctataaagaactac

SEQ ID NO: 1260015 - DNA, 22 bp, Artificial Sequence
  chemically synthesized
atttttacacagctataaagaa

SEQ ID NO: 1260016 - DNA, 22 bp, Artificial Sequence
  chemically synthesized
gttcatttttacacagctataa

SEQ ID NO: 1260017 - DNA, 22 bp, Artificial Sequence
  chemically synthesized
aggtagttctttatagctgtgt

SEQ ID NO: 1260018 - DNA, 22 bp, Artificial Sequence
  chemically synthesized
tattagttcatttttacacagc

SEQ ID NO: 1260019 - DNA, 22 bp, Artificial Sequence
  chemically synthesized
tttatagctgtgtaaaaatgaa

SEQ ID NO: 1260020 - DNA, 22 bp, Artificial Sequence
  chemically synthesized
catgttgtattagttcattttt

SEQ ID NO: 1260021 - DNA, 22 bp, Artificial Sequence
  chemically synthesized
tatagctgtgtaaaaatgaact

SEQ ID NO: 1260022 - DNA, 22 bp, Artificial Sequence
  chemically synthesized
atagctgtgtaaaaatgaacta

SEQ ID NO: 1260023 - DNA, 22 bp, Artificial Sequence
  chemically synthesized
tagctgtgtaaaaatgaactaa

SEQ ID NO: 1260024 - DNA, 22 bp, Artificial Sequence
  chemically synthesized
gtgttacatgttgtattagttc

SEQ ID NO: 1260025 - DNA, 22 bp, Artificial Sequence
  chemically synthesized
cgtgttacatgttgtattagtt

SEQ ID NO: 1260026 - DNA, 22 bp, Artificial Sequence
  chemically synthesized
tcgtgttacatgttgtattagt

SEQ ID NO: 1260027 - DNA, 22 bp, Artificial Sequence
  chemically synthesized
tgtaaaaatgaactaatacaac

SEQ ID NO: 1260028 - DNA, 22 bp, Artificial Sequence
  chemically synthesized
tacatattttcgtgttacatgt

SEQ ID NO: 1260029 - DNA, 22 bp, Artificial Sequence
  chemically synthesized
atacaacatgtaacacgaaaat

SEQ ID NO: 1260030 - DNA, 22 bp, Artificial Sequence
  chemically synthesized
atatatcatagttgtacatatt

SEQ ID NO: 1260031 - DNA, 22 bp, Artificial Sequence
  chemically synthesized
gatatatcatagttgtacatat

SEQ ID NO: 1260032 - DNA, 22 bp, Artificial Sequence
  chemically synthesized
tgatatatcatagttgtacata

SEQ ID NO: 1260033 - DNA, 22 bp, Artificial Sequence
  chemically synthesized
ttgatatatcatagttgtacat

SEQ ID NO: 1260034 - DNA, 22 bp, Artificial Sequence
  chemically synthesized
tagcttttgatatatcatagtt

SEQ ID NO: 1260035 - DNA, 22 bp, Artificial Sequence
  chemically synthesized
gtagcttttgatatatcatagt

SEQ ID NO: 1260036 - DNA, 22 bp, Artificial Sequence
  chemically synthesized
tgatatatcaaaagctacaaac

SEQ ID NO: 1260037 - DNA, 22 bp, Artificial Sequence
  chemically synthesized
caaactatttttgtttgctcat

SEQ ID NO: 1260038 - DNA, 22 bp, Artificial Sequence
  chemically synthesized
agatatatagtaaatgagcaaa

SEQ ID NO: 1260039 - DNA, 22 bp, Artificial Sequence
  chemically synthesized
tttttgtttgctcatttactat

SEQ ID NO: 1260040 - DNA, 22 bp, Artificial Sequence
  chemically synthesized
ttgtttgctcatttactatata

SEQ ID NO: 1260041 - DNA, 22 bp, Artificial Sequence
  chemically synthesized
tgtttgctcatttactatatat

SEQ ID NO: 1260042 - DNA, 22 bp, Artificial Sequence
  chemically synthesized
gtttgctcatttactatatatc

SEQ ID NO: 1260043 - DNA, 22 bp, Artificial Sequence
  chemically synthesized
caaaatatctaagatatatagt

SEQ ID NO: 1260044 - DNA, 22 bp, Artificial Sequence
  chemically synthesized
tttgctcatttactatatatct

SEQ ID NO: 1260045 - DNA, 22 bp, Artificial Sequence
  chemically synthesized
gctcatttactatatatcttag

SEQ ID NO: 1260046 - DNA, 22 bp, Artificial Sequence
  chemically synthesized
ctcatttactatatatcttaga

SEQ ID NO: 1260047 - DNA, 22 bp, Artificial Sequence
  chemically synthesized
atttactatatatcttagatat

SEQ ID NO: 1260048 - DNA, 22 bp, Artificial Sequence
  chemically synthesized
actatatatcttagatattttg

SEQ ID NO: 1260049 - DNA, 22 bp, Artificial Sequence
  chemically synthesized
ctatatatcttagatattttgg

SEQ ID NO: 1260050 - DNA, 22 bp, Artificial Sequence
  chemically synthesized
tatatcttagatattttggaac

SEQ ID NO: 1260051 - DNA, 22 bp, Artificial Sequence
  chemically synthesized
agatattttggaaccaccacca

SEQ ID NO: 1260052 - DNA, 22 bp, Artificial Sequence
  chemically synthesized
gatattttggaaccaccaccac

SEQ ID NO: 1260053 - DNA, 22 bp, Artificial Sequence
  chemically synthesized
tgtgtgatgtgtggtggtggtg

SEQ ID NO: 1260054 - DNA, 22 bp, Artificial Sequence
  chemically synthesized
gtgtgtgatgtgtggtggtggt

SEQ ID NO: 1260055 - DNA, 22 bp, Artificial Sequence
  chemically synthesized
tggaaccaccaccaccacacat

SEQ ID NO: 1260056 - DNA, 22 bp, Artificial Sequence
  chemically synthesized
ggaaccaccaccaccacacatc

SEQ ID NO: 1260057 - DNA, 22 bp, Artificial Sequence
  chemically synthesized
gaaccaccaccaccacacatca

SEQ ID NO: 1260058 - DNA, 22 bp, Artificial Sequence
  chemically synthesized
tgaatttgtgtgtgatgtgtgg

SEQ ID NO: 1260059 - DNA, 22 bp, Artificial Sequence
  chemically synthesized
gtgaatttgtgtgtgatgtgtg

SEQ ID NO: 1260060 - DNA, 22 bp, Artificial Sequence
  chemically synthesized
tgtttgtgaatttgtgtgtgat

SEQ ID NO: 1260061 - DNA, 22 bp, Artificial Sequence
  chemically synthesized
taacatgttatgtttgtgaatt

SEQ ID NO: 1260062 - DNA, 22 bp, Artificial Sequence
  chemically synthesized
ataacatgttatgtttgtgaat

SEQ ID NO: 1260063 - DNA, 22 bp, Artificial Sequence
  chemically synthesized
tataacatgttatgtttgtgaa

SEQ ID NO: 1260064 - DNA, 22 bp, Artificial Sequence
  chemically synthesized
tgttttataacatgttatgttt

SEQ ID NO: 1260065 - DNA, 22 bp, Artificial Sequence
  chemically synthesized
ctatgttttataacatgttatg

SEQ ID NO: 1260066 - DNA, 22 bp, Artificial Sequence
  chemically synthesized
cctatgttttataacatgttat

SEQ ID NO: 1260067 - DNA, 22 bp, Artificial Sequence
  chemically synthesized
atttcctatgttttataacatg

SEQ ID NO: 1260068 - DNA, 22 bp, Artificial Sequence
  chemically synthesized
gatttcctatgttttataacat

SEQ ID NO: 1260069 - DNA, 22 bp, Artificial Sequence
  chemically synthesized
acaaacataacatgttataaaa

SEQ ID NO: 1260070 - DNA, 22 bp, Artificial Sequence
  chemically synthesized
atttgatttcctatgttttata

SEQ ID NO: 1260071 - DNA, 22 bp, Artificial Sequence
  chemically synthesized
tcatttgatttcctatgtttta

SEQ ID NO: 1260072 - DNA, 22 bp, Artificial Sequence
  chemically synthesized
ggaaatgttctcatttgatttc

SEQ ID NO: 1260073 - DNA, 22 bp, Artificial Sequence
  chemically synthesized
aggaaatgttctcatttgattt

SEQ ID NO: 1260074 - DNA, 22 bp, Artificial Sequence
  chemically synthesized
taaaacataggaaatcaaatga

SEQ ID NO: 1260075 - DNA, 22 bp, Artificial Sequence
  chemically synthesized
aaaaagcatagccttaggaaat

SEQ ID NO: 1260076 - DNA, 22 bp, Artificial Sequence
  chemically synthesized
ccagttgaaaaagcatagcctt

SEQ ID NO: 1260077 - DNA, 22 bp, Artificial Sequence
  chemically synthesized
cccaactaccagttgaaaaagc

SEQ ID NO: 1260078 - DNA, 22 bp, Artificial Sequence
  chemically synthesized
cctaaggctatgctttttcaac

SEQ ID NO: 1260079 - DNA, 22 bp, Artificial Sequence
  chemically synthesized
ctaaggctatgctttttcaact

SEQ ID NO: 1260080 - DNA, 22 bp, Artificial Sequence
  chemically synthesized
ctccccaactaccagttgaaaa

SEQ ID NO: 1260081 - DNA, 22 bp, Artificial Sequence
  chemically synthesized
cctccccaactaccagttgaaa

SEQ ID NO: 1260082 - DNA, 22 bp, Artificial Sequence
  chemically synthesized
aggctatgctttttcaactggt

SEQ ID NO: 1260083 - DNA, 22 bp, Artificial Sequence
  chemically synthesized
agtttcctccccaactaccagt

SEQ ID NO: 1260084 - DNA, 22 bp, Artificial Sequence
  chemically synthesized
tgctttttcaactggtagttgg

SEQ ID NO: 1260085 - DNA, 22 bp, Artificial Sequence
  chemically synthesized
aaattcagtttcctccccaact

SEQ ID NO: 1260086 - DNA, 22 bp, Artificial Sequence
  chemically synthesized
tttcaactggtagttggggagg

SEQ ID NO: 1260087 - DNA, 22 bp, Artificial Sequence
  chemically synthesized
gaaattcagtttcctccccaac

SEQ ID NO: 1260088 - DNA, 22 bp, Artificial Sequence
  chemically synthesized
ttcaactggtagttggggagga

SEQ ID NO: 1260089 - DNA, 22 bp, Artificial Sequence
  chemically synthesized
tgaaattcagtttcctccccaa

SEQ ID NO: 1260090 - DNA, 22 bp, Artificial Sequence
  chemically synthesized
tcaactggtagttggggaggaa

SEQ ID NO: 1260091 - DNA, 22 bp, Artificial Sequence
  chemically synthesized
caactggtagttggggaggaaa

SEQ ID NO: 1260092 - DNA, 22 bp, Artificial Sequence
  chemically synthesized
aactggtagttggggaggaaac

SEQ ID NO: 1260093 - DNA, 22 bp, Artificial Sequence
  chemically synthesized
gtagttggggaggaaactgaat

SEQ ID NO: 1260094 - DNA, 22 bp, Artificial Sequence
  chemically synthesized
tagagcggagattttgaaattc

SEQ ID NO: 1260095 - DNA, 22 bp, Artificial Sequence
  chemically synthesized
gggaggaaactgaatttcaaaa

SEQ ID NO: 1260096 - DNA, 22 bp, Artificial Sequence
  chemically synthesized
gagagaaattatagagcggaga

SEQ ID NO: 1260097 - DNA, 22 bp, Artificial Sequence
  chemically synthesized
aatttcaaaatctccgctctat

SEQ ID NO: 1260098 - DNA, 22 bp, Artificial Sequence
  chemically synthesized
caaaatctccgctctataattt

SEQ ID NO: 1260099 - DNA, 22 bp, Artificial Sequence
  chemically synthesized
aaaatctccgctctataatttc

SEQ ID NO: 1260100 - DNA, 22 bp, Artificial Sequence
  chemically synthesized
cgctctataatttctctctaac

SEQ ID NO: 1260101 - DNA, 22 bp, Artificial Sequence
  chemically synthesized
tataatttctctctaactctat

SEQ ID NO: 1260102 - DNA, 22 bp, Artificial Sequence
  chemically synthesized
taatttctctctaactctatat

SEQ ID NO: 1260103 - DNA, 22 bp, Artificial Sequence
  chemically synthesized
cccagaagtgacaatatagagt

SEQ ID NO: 1260104 - DNA, 22 bp, Artificial Sequence
  chemically synthesized
ccccagaagtgacaatatagag

SEQ ID NO: 1260105 - DNA, 22 bp, Artificial Sequence
  chemically synthesized
tccccagaagtgacaatataga

SEQ ID NO: 1260106 - DNA, 22 bp, Artificial Sequence
  chemically synthesized
ttccccagaagtgacaatatag

SEQ ID NO: 1260107 - DNA, 22 bp, Artificial Sequence
  chemically synthesized
tttccccagaagtgacaatata

SEQ ID NO: 1260108 - DNA, 22 bp, Artificial Sequence
  chemically synthesized
ctctctaactctatattgtcac

SEQ ID NO: 1260109 - DNA, 22 bp, Artificial Sequence
  chemically synthesized
ttttccccagaagtgacaatat

SEQ ID NO: 1260110 - DNA, 22 bp, Artificial Sequence
  chemically synthesized
tctctaactctatattgtcact

SEQ ID NO: 1260111 - DNA, 22 bp, Artificial Sequence
  chemically synthesized
tttttccccagaagtgacaata

SEQ ID NO: 1260112 - DNA, 22 bp, Artificial Sequence
  chemically synthesized
tctaactctatattgtcacttc

SEQ ID NO: 1260113 - DNA, 22 bp, Artificial Sequence
  chemically synthesized
tttttttccccagaagtgacaa

SEQ ID NO: 1260114 - DNA, 22 bp, Artificial Sequence
  chemically synthesized
taactctatattgtcacttctg

SEQ ID NO: 1260115 - DNA, 22 bp, Artificial Sequence
  chemically synthesized
tctttttttccccagaagtgac

SEQ ID NO: 1260116 - DNA, 22 bp, Artificial Sequence
  chemically synthesized
ctctttttttccccagaagtga

SEQ ID NO: 1260117 - DNA, 22 bp, Artificial Sequence
  chemically synthesized
actctatattgtcacttctggg

SEQ ID NO: 1260118 - DNA, 22 bp, Artificial Sequence
  chemically synthesized
ttctctttttttccccagaagt

SEQ ID NO: 1260119 - DNA, 22 bp, Artificial Sequence
  chemically synthesized
cttctctttttttccccagaag

SEQ ID NO: 1260120 - DNA, 22 bp, Artificial Sequence
  chemically synthesized
tatattgtcacttctggggaaa

SEQ ID NO: 1260121 - DNA, 22 bp, Artificial Sequence
  chemically synthesized
tattgtcacttctggggaaaaa

SEQ ID NO: 1260122 - DNA, 22 bp, Artificial Sequence
  chemically synthesized
ccttcttctctttttttcccca

SEQ ID NO: 1260123 - DNA, 22 bp, Artificial Sequence
  chemically synthesized
accttcttctctttttttcccc

SEQ ID NO: 1260124 - DNA, 22 bp, Artificial Sequence
  chemically synthesized
tcacttctggggaaaaaaagag

SEQ ID NO: 1260125 - DNA, 22 bp, Artificial Sequence
  chemically synthesized
ctggggaaaaaaagagaagaag

SEQ ID NO: 1260126 - DNA, 22 bp, Artificial Sequence
  chemically synthesized
tggggaaaaaaagagaagaagg

SEQ ID NO: 1260127 - DNA, 22 bp, Artificial Sequence
  chemically synthesized
gggaaaaaaagagaagaaggta

SEQ ID NO: 1260128 - DNA, 22 bp, Artificial Sequence
  chemically synthesized
aatagagccagaagatgcaatt

SEQ ID NO: 1260129 - DNA, 22 bp, Artificial Sequence
  chemically synthesized
tgaatagagccagaagatgcaa

SEQ ID NO: 1260130 - DNA, 22 bp, Artificial Sequence
  chemically synthesized
ctgaatagagccagaagatgca

SEQ ID NO: 1260131 - DNA, 22 bp, Artificial Sequence
  chemically synthesized
ttctgaatagagccagaagatg

SEQ ID NO: 1260132 - DNA, 22 bp, Artificial Sequence
  chemically synthesized
cttctgaatagagccagaagat

SEQ ID NO: 1260133 - DNA, 22 bp, Artificial Sequence
  chemically synthesized
ttcttctgaatagagccagaag

SEQ ID NO: 1260134 - DNA, 22 bp, Artificial Sequence
  chemically synthesized
cttcttctgaatagagccagaa

SEQ ID NO: 1260135 - DNA, 22 bp, Artificial Sequence
  chemically synthesized
tcttcttctgaatagagccaga

SEQ ID NO: 1260136 - DNA, 22 bp, Artificial Sequence
  chemically synthesized
ttcttcttctgaatagagccag

SEQ ID NO: 1260137 - DNA, 22 bp, Artificial Sequence
  chemically synthesized
tttcttcttctgaatagagcca

SEQ ID NO: 1260138 - DNA, 22 bp, Artificial Sequence
  chemically synthesized
catcttctggctctattcagaa

SEQ ID NO: 1260139 - DNA, 22 bp, Artificial Sequence
  chemically synthesized
ctggctctattcagaagaagaa

SEQ ID NO: 1260140 - DNA, 22 bp, Artificial Sequence
  chemically synthesized
tggctctattcagaagaagaaa

SEQ ID NO: 1260141 - DNA, 22 bp, Artificial Sequence
  chemically synthesized
gctctattcagaagaagaaaaa

SEQ ID NO: 1260142 - DNA, 22 bp, Artificial Sequence
  chemically synthesized
tattcagaagaagaaaaaatgg

SEQ ID NO: 1260143 - DNA, 22 bp, Artificial Sequence
  chemically synthesized
ttcagaagaagaaaaaatggtt

SEQ ID NO: 1260144 - DNA, 22 bp, Artificial Sequence
  chemically synthesized
agaagaagaaaaaatggttggt

SEQ ID NO: 1260145 - DNA, 22 bp, Artificial Sequence
  chemically synthesized
gtgatctttgttgtatggattt

SEQ ID NO: 1260146 - DNA, 22 bp, Artificial Sequence
  chemically synthesized
ggagacccatcagataaaatcc

SEQ ID NO: 1260147 - DNA, 22 bp, Artificial Sequence
  chemically synthesized
tgttgtatggattttatctgat

SEQ ID NO: 1260148 - DNA, 22 bp, Artificial Sequence
  chemically synthesized
gttgtatggattttatctgatg

SEQ ID NO: 1260149 - DNA, 22 bp, Artificial Sequence
  chemically synthesized
ttgtatggattttatctgatgg

SEQ ID NO: 1260150 - DNA, 22 bp, Artificial Sequence
  chemically synthesized
tatggattttatctgatgggtc

SEQ ID NO: 1260151 - DNA, 22 bp, Artificial Sequence
  chemically synthesized
agtgtaaactaggagacccatc

SEQ ID NO: 1260152 - DNA, 22 bp, Artificial Sequence
  chemically synthesized
tatctgatgggtctcctagttt

SEQ ID NO: 1260153 - DNA, 22 bp, Artificial Sequence
  chemically synthesized
atctgatgggtctcctagttta

SEQ ID NO: 1260154 - DNA, 22 bp, Artificial Sequence
  chemically synthesized
tctgatgggtctcctagtttac

SEQ ID NO: 1260155 - DNA, 22 bp, Artificial Sequence
  chemically synthesized
agcaaatctaagtgtaaactag

SEQ ID NO: 1260156 - DNA, 22 bp, Artificial Sequence
  chemically synthesized
atgggtctcctagtttacactt

SEQ ID NO: 1260157 - DNA, 22 bp, Artificial Sequence
  chemically synthesized
ttcagcaaatctaagtgtaaac

SEQ ID NO: 1260158 - DNA, 22 bp, Artificial Sequence
  chemically synthesized
attcagcaaatctaagtgtaaa

SEQ ID NO: 1260159 - DNA, 22 bp, Artificial Sequence
  chemically synthesized
ctagtttacacttagatttgct

SEQ ID NO: 1260160 - DNA, 22 bp, Artificial Sequence
  chemically synthesized
gtttacacttagatttgctgaa

SEQ ID NO: 1260161 - DNA, 22 bp, Artificial Sequence
  chemically synthesized
acacttagatttgctgaataaa

SEQ ID NO: 1260162 - DNA, 22 bp, Artificial Sequence
  chemically synthesized
cacttagatttgctgaataaat

SEQ ID NO: 1260163 - DNA, 22 bp, Artificial Sequence
  chemically synthesized
gaaatgaggaggatttattcag

SEQ ID NO: 1260164 - DNA, 22 bp, Artificial Sequence
  chemically synthesized
tggaaatgaggaggatttattc

SEQ ID NO: 1260165 - DNA, 22 bp, Artificial Sequence
  chemically synthesized
ctggaaatgaggaggatttatt

SEQ ID NO: 1260166 - DNA, 22 bp, Artificial Sequence
  chemically synthesized
tctggaaatgaggaggatttat

SEQ ID NO: 1260167 - DNA, 22 bp, Artificial Sequence
  chemically synthesized
agatttgctgaataaatcctcc

SEQ ID NO: 1260168 - DNA, 22 bp, Artificial Sequence
  chemically synthesized
gatttgctgaataaatcctcct

SEQ ID NO: 1260169 - DNA, 22 bp, Artificial Sequence
  chemically synthesized
tctttctggaaatgaggaggat

SEQ ID NO: 1260170 - DNA, 22 bp, Artificial Sequence
  chemically synthesized
gctgaataaatcctcctcattt

SEQ ID NO: 1260171 - DNA, 22 bp, Artificial Sequence
  chemically synthesized
ctgaataaatcctcctcatttc

SEQ ID NO: 1260172 - DNA, 22 bp, Artificial Sequence
  chemically synthesized
aataaatcctcctcatttccag

SEQ ID NO: 1260173 - DNA, 22 bp, Artificial Sequence
  chemically synthesized
ccacaaagccatattgtctttc

SEQ ID NO: 1260174 - DNA, 22 bp, Artificial Sequence
  chemically synthesized
ctcatttccagaaagacaatat

SEQ ID NO: 1260175 - DNA, 22 bp, Artificial Sequence
  chemically synthesized
atttccagaaagacaatatggc

SEQ ID NO: 1260176 - DNA, 22 bp, Artificial Sequence
  chemically synthesized
agcactcccacaaagccatatt

SEQ ID NO: 1260177 - DNA, 22 bp, Artificial Sequence
  chemically synthesized
cagcactcccacaaagccatat

SEQ ID NO: 1260178 - DNA, 22 bp, Artificial Sequence
  chemically synthesized
ccagaaagacaatatggctttg

SEQ ID NO: 1260179 - DNA, 22 bp, Artificial Sequence
  chemically synthesized
cagaaagacaatatggctttgt

SEQ ID NO: 1260180 - DNA, 22 bp, Artificial Sequence
  chemically synthesized
acaaagatgtgccttcagcact

SEQ ID NO: 1260181 - DNA, 22 bp, Artificial Sequence
  chemically synthesized
tgtgggagtgctgaaggcacat

SEQ ID NO: 1260182 - DNA, 22 bp, Artificial Sequence
  chemically synthesized
gtgggagtgctgaaggcacatc

SEQ ID NO: 1260183 - DNA, 22 bp, Artificial Sequence
  chemically synthesized
tgggagtgctgaaggcacatct

SEQ ID NO: 1260184 - DNA, 22 bp, Artificial Sequence
  chemically synthesized
cgatagtgggaactgacaaaga

SEQ ID NO: 1260185 - DNA, 22 bp, Artificial Sequence
  chemically synthesized
aaggcacatctttgtcagttcc

SEQ ID NO: 1260186 - DNA, 22 bp, Artificial Sequence
  chemically synthesized
ggagtctccgatagtgggaact

SEQ ID NO: 1260187 - DNA, 22 bp, Artificial Sequence
  chemically synthesized
tgtcagttcccactatcggaga

SEQ ID NO: 1260188 - DNA, 22 bp, Artificial Sequence
  chemically synthesized
gtcagttcccactatcggagac

SEQ ID NO: 1260189 - DNA, 22 bp, Artificial Sequence
  chemically synthesized
tcagttcccactatcggagact

SEQ ID NO: 1260190 - DNA, 22 bp, Artificial Sequence
  chemically synthesized
ccactatcggagactcccagta

SEQ ID NO: 1260191 - DNA, 22 bp, Artificial Sequence
  chemically synthesized
gcatgacaggatgtactgggag

SEQ ID NO: 1260192 - DNA, 22 bp, Artificial Sequence
  chemically synthesized
tcggagactcccagtacatcct

SEQ ID NO: 1260193 - DNA, 22 bp, Artificial Sequence
  chemically synthesized
ccagtacatcctgtcatgccag

SEQ ID NO: 1260194 - DNA, 22 bp, Artificial Sequence
  chemically synthesized
tcaggcagagcaaatcctggca

SEQ ID NO: 1260195 - DNA, 22 bp, Artificial Sequence
  chemically synthesized
gtcaggcagagcaaatcctggc

SEQ ID NO: 1260196 - DNA, 22 bp, Artificial Sequence
  chemically synthesized
ttgtcaggcagagcaaatcctg

SEQ ID NO: 1260197 - DNA, 22 bp, Artificial Sequence
  chemically synthesized
cttgtcaggcagagcaaatcct

SEQ ID NO: 1260198 - DNA, 22 bp, Artificial Sequence
  chemically synthesized
cttcttgtcaggcagagcaaat

SEQ ID NO: 1260199 - DNA, 22 bp, Artificial Sequence
  chemically synthesized
ccttcttgtcaggcagagcaaa

SEQ ID NO: 1260200 - DNA, 22 bp, Artificial Sequence
  chemically synthesized
tcatgccaggatttgctctgcc

SEQ ID NO: 1260201 - DNA, 22 bp, Artificial Sequence
  chemically synthesized
ttccttcttgtcaggcagagca

SEQ ID NO: 1260202 - DNA, 22 bp, Artificial Sequence
  chemically synthesized
cttccttcttgtcaggcagagc

SEQ ID NO: 1260203 - DNA, 22 bp, Artificial Sequence
  chemically synthesized
tcataagcttcttccttcttgt

SEQ ID NO: 1260204 - DNA, 22 bp, Artificial Sequence
  chemically synthesized
gctctgcctgacaagaaggaag

SEQ ID NO: 1260205 - DNA, 22 bp, Artificial Sequence
  chemically synthesized
ctctgcctgacaagaaggaaga

SEQ ID NO: 1260206 - DNA, 22 bp, Artificial Sequence
  chemically synthesized
tgcctgacaagaaggaagaagc

SEQ ID NO: 1260207 - DNA, 22 bp, Artificial Sequence
  chemically synthesized
cctgacaagaaggaagaagctt

SEQ ID NO: 1260208 - DNA, 22 bp, Artificial Sequence
  chemically synthesized
agaaagctatcataagcttctt

SEQ ID NO: 1260209 - DNA, 22 bp, Artificial Sequence
  chemically synthesized
acaagaaggaagaagcttatga

SEQ ID NO: 1260210 - DNA, 22 bp, Artificial Sequence
  chemically synthesized
agagtcattcagaaagctatca

SEQ ID NO: 1260211 - DNA, 22 bp, Artificial Sequence
  chemically synthesized
cagagtcattcagaaagctatc

SEQ ID NO: 1260212 - DNA, 22 bp, Artificial Sequence
  chemically synthesized
tcagagtcattcagaaagctat

SEQ ID NO: 1260213 - DNA, 22 bp, Artificial Sequence
  chemically synthesized
ttcagagtcattcagaaagcta

SEQ ID NO: 1260214 - DNA, 22 bp, Artificial Sequence
  chemically synthesized
atttttcagagtcattcagaaa

SEQ ID NO: 1260215 - DNA, 22 bp, Artificial Sequence
  chemically synthesized
catttttcagagtcattcagaa

SEQ ID NO: 1260216 - DNA, 22 bp, Artificial Sequence
  chemically synthesized
atgatagctttctgaatgactc

SEQ ID NO: 1260217 - DNA, 22 bp, Artificial Sequence
  chemically synthesized
tgatagctttctgaatgactct

SEQ ID NO: 1260218 - DNA, 22 bp, Artificial Sequence
  chemically synthesized
cagagcagcttcatttttcaga

SEQ ID NO: 1260219 - DNA, 22 bp, Artificial Sequence
  chemically synthesized
tctgaatgactctgaaaaatga

SEQ ID NO: 1260220 - DNA, 22 bp, Artificial Sequence
  chemically synthesized
ctgaatgactctgaaaaatgaa

SEQ ID NO: 1260221 - DNA, 22 bp, Artificial Sequence
  chemically synthesized
tgaatgactctgaaaaatgaag

SEQ ID NO: 1260222 - DNA, 22 bp, Artificial Sequence
  chemically synthesized
aatgactctgaaaaatgaagct

SEQ ID NO: 1260223 - DNA, 22 bp, Artificial Sequence
  chemically synthesized
gtgatgatacctgcagagcagc

SEQ ID NO: 1260224 - DNA, 22 bp, Artificial Sequence
  chemically synthesized
tgaaaaatgaagctgctctgca

SEQ ID NO: 1260225 - DNA, 22 bp, Artificial Sequence
  chemically synthesized
aaaaatgaagctgctctgcagg

SEQ ID NO: 1260226 - DNA, 22 bp, Artificial Sequence
  chemically synthesized
tggtctagtgatgatacctgca

SEQ ID NO: 1260227 - DNA, 22 bp, Artificial Sequence
  chemically synthesized
tctgtggtctagtgatgatacc

SEQ ID NO: 1260228 - DNA, 22 bp, Artificial Sequence
  chemically synthesized
atctgtggtctagtgatgatac

SEQ ID NO: 1260229 - DNA, 22 bp, Artificial Sequence
  chemically synthesized
ctctgcaggtatcatcactaga

SEQ ID NO: 1260230 - DNA, 22 bp, Artificial Sequence
  chemically synthesized
agtttatctgtggtctagtgat

SEQ ID NO: 1260231 - DNA, 22 bp, Artificial Sequence
  chemically synthesized
tgcaggtatcatcactagacca

SEQ ID NO: 1260232 - DNA, 22 bp, Artificial Sequence
  chemically synthesized
ttgagtttatctgtggtctagt

SEQ ID NO: 1260233 - DNA, 22 bp, Artificial Sequence
  chemically synthesized
caggtatcatcactagaccaca

SEQ ID NO: 1260234 - DNA, 22 bp, Artificial Sequence
  chemically synthesized
gcagatgaatgttattgagttt

SEQ ID NO: 1260235 - DNA, 22 bp, Artificial Sequence
  chemically synthesized
gaccacagataaactcaataac

SEQ ID NO: 1260236 - DNA, 22 bp, Artificial Sequence
  chemically synthesized
tagcagatgaatgttattgagt

SEQ ID NO: 1260237 - DNA, 22 bp, Artificial Sequence
  chemically synthesized
ctagcagatgaatgttattgag

SEQ ID NO: 1260238 - DNA, 22 bp, Artificial Sequence
  chemically synthesized
tctagcagatgaatgttattga

SEQ ID NO: 1260239 - DNA, 22 bp, Artificial Sequence
  chemically synthesized
ttctagcagatgaatgttattg

SEQ ID NO: 1260240 - DNA, 22 bp, Artificial Sequence
  chemically synthesized
tttctagcagatgaatgttatt

SEQ ID NO: 1260241 - DNA, 22 bp, Artificial Sequence
  chemically synthesized
ttttctagcagatgaatgttat

SEQ ID NO: 1260242 - DNA, 22 bp, Artificial Sequence
  chemically synthesized
tttttctagcagatgaatgtta

SEQ ID NO: 1260243 - DNA, 22 bp, Artificial Sequence
  chemically synthesized
ttttttctagcagatgaatgtt

SEQ ID NO: 1260244 - DNA, 22 bp, Artificial Sequence
  chemically synthesized
tttttttctagcagatgaatgt

SEQ ID NO: 1260245 - DNA, 22 bp, Artificial Sequence
  chemically synthesized
ttttttttctagcagatgaatg

SEQ ID NO: 1260246 - DNA, 22 bp, Artificial Sequence
  chemically synthesized
tttttttttctagcagatgaat

SEQ ID NO: 1260247 - DNA, 22 bp, Artificial Sequence
  chemically synthesized
ttttttttttctagcagatgaa

SEQ ID NO: 1260248 - DNA, 22 bp, Artificial Sequence
  chemically synthesized
tttttttttttctagcagatga

SEQ ID NO: 1260249 - DNA, 22 bp, Artificial Sequence
  chemically synthesized
ttttttttttttctagcagatg

SEQ ID NO: 1260250 - DNA, 22 bp, Artificial Sequence
  chemically synthesized
tttttttttttttctagcagat

SEQ ID NO: 1260251 - DNA, 22 bp, Artificial Sequence
  chemically synthesized
aataacattcatctgctagaaa

SEQ ID NO: 1260252 - DNA, 22 bp, Artificial Sequence
  chemically synthesized
tttttttttttttttctagcag

SEQ ID NO: 1260253 - DNA, 22 bp, Artificial Sequence
  chemically synthesized
ctttttttttttttttctagca

SEQ ID NO: 1260254 - DNA, 22 bp, Artificial Sequence
  chemically synthesized
tctttttttttttttttctagc

SEQ ID NO: 1260255 - DNA, 22 bp, Artificial Sequence
  chemically synthesized
tttctttttttttttttttcta

SEQ ID NO: 1260256 - DNA, 22 bp, Artificial Sequence
  chemically synthesized
ctttctttttttttttttttct

SEQ ID NO: 1260257 - DNA, 22 bp, Artificial Sequence
  chemically synthesized
tctttctttttttttttttttc

SEQ ID NO: 1260258 - DNA, 22 bp, Artificial Sequence
  chemically synthesized
ttctttcttttttttttttttt

SEQ ID NO: 1260259 - DNA, 22 bp, Artificial Sequence
  chemically synthesized
atctgctagaaaaaaaaaaaaa

SEQ ID NO: 1260260 - DNA, 22 bp, Artificial Sequence
  chemically synthesized
ctagaaaaaaaaaaaaaaagaa

SEQ ID NO: 1260261 - DNA, 22 bp, Artificial Sequence
  chemically synthesized
gaaaaaaaaaaaaaaagaaaga

SEQ ID NO: 1260262 - DNA, 22 bp, Artificial Sequence
  chemically synthesized
gaagtgaacccttttctttctt

SEQ ID NO: 1260263 - DNA, 22 bp, Artificial Sequence
  chemically synthesized
atctggaagtgaacccttttct

SEQ ID NO: 1260264 - DNA, 22 bp, Artificial Sequence
  chemically synthesized
ccaaaggctgatctggaagtga

SEQ ID NO: 1260265 - DNA, 22 bp, Artificial Sequence
  chemically synthesized
taccaaaggctgatctggaagt

SEQ ID NO: 1260266 - DNA, 22 bp, Artificial Sequence
  chemically synthesized
tctctaccaaaggctgatctgg

SEQ ID NO: 1260267 - DNA, 22 bp, Artificial Sequence
  chemically synthesized
cctatctctaccaaaggctgat

SEQ ID NO: 1260268 - DNA, 22 bp, Artificial Sequence
  chemically synthesized
ctgcctatctctaccaaaggct

SEQ ID NO: 1260269 - DNA, 22 bp, Artificial Sequence
  chemically synthesized
acttccagatcagcctttggta

SEQ ID NO: 1260270 - DNA, 22 bp, Artificial Sequence
  chemically synthesized
ccagatcagcctttggtagaga

SEQ ID NO: 1260271 - DNA, 22 bp, Artificial Sequence
  chemically synthesized
cagatcagcctttggtagagat

SEQ ID NO: 1260272 - DNA, 22 bp, Artificial Sequence
  chemically synthesized
ccaagtccctactgcctatctc

SEQ ID NO: 1260273 - DNA, 22 bp, Artificial Sequence
  chemically synthesized
tggtagagataggcagtaggga

SEQ ID NO: 1260274 - DNA, 22 bp, Artificial Sequence
  chemically synthesized
gggactgccaagtccctactgc

SEQ ID NO: 1260275 - DNA, 22 bp, Artificial Sequence
  chemically synthesized
ggtagagataggcagtagggac

SEQ ID NO: 1260276 - DNA, 22 bp, Artificial Sequence
  chemically synthesized
gtagagataggcagtagggact

SEQ ID NO: 1260277 - DNA, 22 bp, Artificial Sequence
  chemically synthesized
aatgtgactagggactgccaag

SEQ ID NO: 1260278 - DNA, 22 bp, Artificial Sequence
  chemically synthesized
gaatgtgactagggactgccaa

SEQ ID NO: 1260279 - DNA, 22 bp, Artificial Sequence
  chemically synthesized
atttgaatgtgactagggactg

SEQ ID NO: 1260280 - DNA, 22 bp, Artificial Sequence
  chemically synthesized
catttgaatgtgactagggact

SEQ ID NO: 1260281 - DNA, 22 bp, Artificial Sequence
  chemically synthesized
ggcagtccctagtcacattcaa

SEQ ID NO: 1260282 - DNA, 22 bp, Artificial Sequence
  chemically synthesized
gcagtccctagtcacattcaaa

SEQ ID NO: 1260283 - DNA, 22 bp, Artificial Sequence
  chemically synthesized
gtcacattcaaatgaaggttcg

SEQ ID NO: 1260284 - DNA, 22 bp, Artificial Sequence
  chemically synthesized
agcacaataggtcgaaccttca

SEQ ID NO: 1260285 - DNA, 22 bp, Artificial Sequence
  chemically synthesized
cagcacaataggtcgaaccttc

SEQ ID NO: 1260286 - DNA, 22 bp, Artificial Sequence
  chemically synthesized
gacttcagcacaataggtcgaa

SEQ ID NO: 1260287 - DNA, 22 bp, Artificial Sequence
  chemically synthesized
agacttcagcacaataggtcga

SEQ ID NO: 1260288 - DNA, 22 bp, Artificial Sequence
  chemically synthesized
aaatgaaggttcgacctattgt

SEQ ID NO: 1260289 - DNA, 22 bp, Artificial Sequence
  chemically synthesized
tcttagacttcagcacaatagg

SEQ ID NO: 1260290 - DNA, 22 bp, Artificial Sequence
  chemically synthesized
gtcttagacttcagcacaatag

SEQ ID NO: 1260291 - DNA, 22 bp, Artificial Sequence
  chemically synthesized
tgtcttagacttcagcacaata

SEQ ID NO: 1260292 - DNA, 22 bp, Artificial Sequence
  chemically synthesized
gacctattgtgctgaagtctaa

SEQ ID NO: 1260293 - DNA, 22 bp, Artificial Sequence
  chemically synthesized
aataagcacctttgtcttagac

SEQ ID NO: 1260294 - DNA, 22 bp, Artificial Sequence
  chemically synthesized
ttgtgctgaagtctaagacaaa

SEQ ID NO: 1260295 - DNA, 22 bp, Artificial Sequence
  chemically synthesized
tgctgaagtctaagacaaaggt

SEQ ID NO: 1260296 - DNA, 22 bp, Artificial Sequence
  chemically synthesized
aagtctaagacaaaggtgctta

SEQ ID NO: 1260297 - DNA, 22 bp, Artificial Sequence
  chemically synthesized
agacaaaggtgcttatttagat

SEQ ID NO: 1260298 - DNA, 22 bp, Artificial Sequence
  chemically synthesized
gccataaaataggaaatctaaa

SEQ ID NO: 1260299 - DNA, 22 bp, Artificial Sequence
  chemically synthesized
agccataaaataggaaatctaa

SEQ ID NO: 1260300 - DNA, 22 bp, Artificial Sequence
  chemically synthesized
tagccataaaataggaaatcta

SEQ ID NO: 1260301 - DNA, 22 bp, Artificial Sequence
  chemically synthesized
atttagatttcctattttatgg

SEQ ID NO: 1260302 - DNA, 22 bp, Artificial Sequence
  chemically synthesized
tttagatttcctattttatggc

SEQ ID NO: 1260303 - DNA, 22 bp, Artificial Sequence
  chemically synthesized
agatttcctattttatggctaa

SEQ ID NO: 1260304 - DNA, 22 bp, Artificial Sequence
  chemically synthesized
gatttcctattttatggctaaa

SEQ ID NO: 1260305 - DNA, 22 bp, Artificial Sequence
  chemically synthesized
cagtcacatatattttagccat

SEQ ID NO: 1260306 - DNA, 22 bp, Artificial Sequence
  chemically synthesized
ctacagtcacatatattttagc

SEQ ID NO: 1260307 - DNA, 22 bp, Artificial Sequence
  chemically synthesized
cctattttatggctaaaatata

SEQ ID NO: 1260308 - DNA, 22 bp, Artificial Sequence
  chemically synthesized
ctattttatggctaaaatatat

SEQ ID NO: 1260309 - DNA, 22 bp, Artificial Sequence
  chemically synthesized
ttttatggctaaaatatatgtg

SEQ ID NO: 1260310 - DNA, 22 bp, Artificial Sequence
  chemically synthesized
tatggctaaaatatatgtgact

SEQ ID NO: 1260311 - DNA, 22 bp, Artificial Sequence
  chemically synthesized
atggctaaaatatatgtgactg

SEQ ID NO: 1260312 - DNA, 22 bp, Artificial Sequence
  chemically synthesized
tggctaaaatatatgtgactgt

SEQ ID NO: 1260313 - DNA, 22 bp, Artificial Sequence
  chemically synthesized
aaatatatgtgactgtaggaat

SEQ ID NO: 1260314 - DNA, 22 bp, Artificial Sequence
  chemically synthesized
gtgtgtatgcgtatgtccaaca

SEQ ID NO: 1260315 - DNA, 22 bp, Artificial Sequence
  chemically synthesized
taggaatcctctgttggacata

SEQ ID NO: 1260316 - DNA, 22 bp, Artificial Sequence
  chemically synthesized
tgttggacatacgcatacacac

SEQ ID NO: 1260317 - DNA, 22 bp, Artificial Sequence
  chemically synthesized
ttggacatacgcatacacacca

SEQ ID NO: 1260318 - DNA, 22 bp, Artificial Sequence
  chemically synthesized
caatagataagttggtgtgtat

SEQ ID NO: 1260319 - DNA, 22 bp, Artificial Sequence
  chemically synthesized
gcaatagataagttggtgtgta

SEQ ID NO: 1260320 - DNA, 22 bp, Artificial Sequence
  chemically synthesized
gacatacgcatacacaccaact

SEQ ID NO: 1260321 - DNA, 22 bp, Artificial Sequence
  chemically synthesized
ataatatagacccttgcaatag

SEQ ID NO: 1260322 - DNA, 22 bp, Artificial Sequence
  chemically synthesized
atctattgcaagggtctatatt

SEQ ID NO: 1260323 - DNA, 22 bp, Artificial Sequence
  chemically synthesized
tctattgcaagggtctatatta

SEQ ID NO: 1260324 - DNA, 22 bp, Artificial Sequence
  chemically synthesized
ttgcaagggtctatattattag

SEQ ID NO: 1260325 - DNA, 22 bp, Artificial Sequence
  chemically synthesized
atatacagtcatactaataata

SEQ ID NO: 1260326 - DNA, 22 bp, Artificial Sequence
  chemically synthesized
aatatacagtcatactaataat

SEQ ID NO: 1260327 - DNA, 22 bp, Artificial Sequence
  chemically synthesized
caagggtctatattattagtat

SEQ ID NO: 1260328 - DNA, 22 bp, Artificial Sequence
  chemically synthesized
tttaatatacagtcatactaat

SEQ ID NO: 1260329 - DNA, 22 bp, Artificial Sequence
  chemically synthesized
tattattagtatgactgtatat

SEQ ID NO: 1260330 - DNA, 22 bp, Artificial Sequence
  chemically synthesized
ttagtatgactgtatattaaat

SEQ ID NO: 1260331 - DNA, 22 bp, Artificial Sequence
  chemically synthesized
agataataaaattatttaatat

SEQ ID NO: 1260332 - DNA, 22 bp, Artificial Sequence
  chemically synthesized
cagataataaaattatttaata

SEQ ID NO: 1260333 - DNA, 22 bp, Artificial Sequence
  chemically synthesized
gtatgactgtatattaaataat

SEQ ID NO: 1260334 - DNA, 22 bp, Artificial Sequence
  chemically synthesized
tcagataataaaattatttaat

SEQ ID NO: 1260335 - DNA, 22 bp, Artificial Sequence
  chemically synthesized
ttcagataataaaattatttaa

SEQ ID NO: 1260336 - DNA, 22 bp, Artificial Sequence
  chemically synthesized
aaatttttcagataataaaatt

SEQ ID NO: 1260337 - DNA, 22 bp, Artificial Sequence
  chemically synthesized
tatattaaataattttattatc

SEQ ID NO: 1260338 - DNA, 22 bp, Artificial Sequence
  chemically synthesized
aataattttattatctgaaaaa

SEQ ID NO: 1260339 - DNA, 22 bp, Artificial Sequence
  chemically synthesized
aatgcactcaaatttttcagat

SEQ ID NO: 1260340 - DNA, 22 bp, Artificial Sequence
  chemically synthesized
caatgcactcaaatttttcaga

SEQ ID NO: 1260341 - DNA, 22 bp, Artificial Sequence
  chemically synthesized
tcttcaatgcactcaaattttt

SEQ ID NO: 1260342 - DNA, 22 bp, Artificial Sequence
  chemically synthesized
atcttcaatgcactcaaatttt

SEQ ID NO: 1260343 - DNA, 22 bp, Artificial Sequence
  chemically synthesized
tatcttcaatgcactcaaattt

SEQ ID NO: 1260344 - DNA, 22 bp, Artificial Sequence
  chemically synthesized
tattatctgaaaaatttgagtg

SEQ ID NO: 1260345 - DNA, 22 bp, Artificial Sequence
  chemically synthesized
attatctgaaaaatttgagtgc

SEQ ID NO: 1260346 - DNA, 22 bp, Artificial Sequence
  chemically synthesized
ttatctgaaaaatttgagtgca

SEQ ID NO: 1260347 - DNA, 22 bp, Artificial Sequence
  chemically synthesized
tctgaaaaatttgagtgcattg

SEQ ID NO: 1260348 - DNA, 22 bp, Artificial Sequence
  chemically synthesized
aaaaatttgagtgcattgaaga

SEQ ID NO: 1260349 - DNA, 22 bp, Artificial Sequence
  chemically synthesized
aggagtcagttttatcttcaat

SEQ ID NO: 1260350 - DNA, 22 bp, Artificial Sequence
  chemically synthesized
caggagtcagttttatcttcaa

SEQ ID NO: 1260351 - DNA, 22 bp, Artificial Sequence
  chemically synthesized
gagtgcattgaagataaaactg

SEQ ID NO: 1260352 - DNA, 22 bp, Artificial Sequence
  chemically synthesized
gatttcaggagtcagttttatc

SEQ ID NO: 1260353 - DNA, 22 bp, Artificial Sequence
  chemically synthesized
agtgcattgaagataaaactga

SEQ ID NO: 1260354 - DNA, 22 bp, Artificial Sequence
  chemically synthesized
agatttcaggagtcagttttat

SEQ ID NO: 1260355 - DNA, 22 bp, Artificial Sequence
  chemically synthesized
aagataaaactgactcctgaaa

SEQ ID NO: 1260356 - DNA, 22 bp, Artificial Sequence
  chemically synthesized
aataggacttagatttcaggag

SEQ ID NO: 1260357 - DNA, 22 bp, Artificial Sequence
  chemically synthesized
attaaataggacttagatttca

SEQ ID NO: 1260358 - DNA, 22 bp, Artificial Sequence
  chemically synthesized
gattaaataggacttagatttc

SEQ ID NO: 1260359 - DNA, 22 bp, Artificial Sequence
  chemically synthesized
tgattaaataggacttagattt

SEQ ID NO: 1260360 - DNA, 22 bp, Artificial Sequence
  chemically synthesized
actcctgaaatctaagtcctat

SEQ ID NO: 1260361 - DNA, 22 bp, Artificial Sequence
  chemically synthesized
ctgaaatctaagtcctatttaa

SEQ ID NO: 1260362 - DNA, 22 bp, Artificial Sequence
  chemically synthesized
aagcaagttttgattaaatagg

SEQ ID NO: 1260363 - DNA, 22 bp, Artificial Sequence
  chemically synthesized
gaagcaagttttgattaaatag

SEQ ID NO: 1260364 - DNA, 22 bp, Artificial Sequence
  chemically synthesized
aaatctaagtcctatttaatca

SEQ ID NO: 1260365 - DNA, 22 bp, Artificial Sequence
  chemically synthesized
tgaagcaagttttgattaaata

SEQ ID NO: 1260366 - DNA, 22 bp, Artificial Sequence
  chemically synthesized
agtcctatttaatcaaaacttg

SEQ ID NO: 1260367 - DNA, 22 bp, Artificial Sequence
  chemically synthesized
ggaaggttttgaagcaagtttt

SEQ ID NO: 1260368 - DNA, 22 bp, Artificial Sequence
  chemically synthesized
gggaaggttttgaagcaagttt

SEQ ID NO: 1260369 - DNA, 22 bp, Artificial Sequence
  chemically synthesized
tgggaaggttttgaagcaagtt

SEQ ID NO: 1260370 - DNA, 22 bp, Artificial Sequence
  chemically synthesized
tttaatcaaaacttgcttcaaa

SEQ ID NO: 1260371 - DNA, 22 bp, Artificial Sequence
  chemically synthesized
aatcaaaacttgcttcaaaacc

SEQ ID NO: 1260372 - DNA, 22 bp, Artificial Sequence
  chemically synthesized
aaactttgggaaggttttgaag

SEQ ID NO: 1260373 - DNA, 22 bp, Artificial Sequence
  chemically synthesized
atcaaaacttgcttcaaaacct

SEQ ID NO: 1260374 - DNA, 22 bp, Artificial Sequence
  chemically synthesized
gcttcaaaaccttcccaaagtt

SEQ ID NO: 1260375 - DNA, 22 bp, Artificial Sequence
  chemically synthesized
cttcaaaaccttcccaaagttt

SEQ ID NO: 1260376 - DNA, 22 bp, Artificial Sequence
  chemically synthesized
caaaaccttcccaaagtttcaa

SEQ ID NO: 1260377 - DNA, 22 bp, Artificial Sequence
  chemically synthesized
aaaaccttcccaaagtttcaac

SEQ ID NO: 1260378 - DNA, 22 bp, Artificial Sequence
  chemically synthesized
cccaaagtttcaacatgtatta

SEQ ID NO: 1260379 - DNA, 22 bp, Artificial Sequence
  chemically synthesized
ccaaagtttcaacatgtattat

SEQ ID NO: 1260380 - DNA, 22 bp, Artificial Sequence
  chemically synthesized
tcacacacacgaaaaaataata

SEQ ID NO: 1260381 - DNA, 22 bp, Artificial Sequence
  chemically synthesized
gtcacacacacgaaaaaataat

SEQ ID NO: 1260382 - DNA, 22 bp, Artificial Sequence
  chemically synthesized
caacatgtattattttttcgtg

SEQ ID NO: 1260383 - DNA, 22 bp, Artificial Sequence
  chemically synthesized
aacatgtattattttttcgtgt

SEQ ID NO: 1260384 - DNA, 22 bp, Artificial Sequence
  chemically synthesized
ttttttcgtgtgtgtgacaagg

SEQ ID NO: 1260385 - DNA, 22 bp, Artificial Sequence
  chemically synthesized
tttcgtgtgtgtgacaaggtcg

SEQ ID NO: 1260386 - DNA, 22 bp, Artificial Sequence
  chemically synthesized
ggcgacagagtgcgaccttgtc

SEQ ID NO: 1260387 - DNA, 22 bp, Artificial Sequence
  chemically synthesized
ttcgtgtgtgtgacaaggtcgc

SEQ ID NO: 1260388 - DNA, 22 bp, Artificial Sequence
  chemically synthesized
tcgtgtgtgtgacaaggtcgca

SEQ ID NO: 1260389 - DNA, 22 bp, Artificial Sequence
  chemically synthesized
cgtgtgtgtgacaaggtcgcac

SEQ ID NO: 1260390 - DNA, 22 bp, Artificial Sequence
  chemically synthesized
gtgtgtgtgacaaggtcgcact

SEQ ID NO: 1260391 - DNA, 22 bp, Artificial Sequence
  chemically synthesized
caccatctgggcgacagagtgc

SEQ ID NO: 1260392 - DNA, 22 bp, Artificial Sequence
  chemically synthesized
agatcacaccactgcaccatct

SEQ ID NO: 1260393 - DNA, 22 bp, Artificial Sequence
  chemically synthesized
tgtcgcccagatggtgcagtgg

SEQ ID NO: 1260394 - DNA, 22 bp, Artificial Sequence
  chemically synthesized
tcgcccagatggtgcagtggtg

SEQ ID NO: 1260395 - DNA, 22 bp, Artificial Sequence
  chemically synthesized
cagtgaactgagatcacaccac

SEQ ID NO: 1260396 - DNA, 22 bp, Artificial Sequence
  chemically synthesized
aggcgggaggcagaggttgcag

SEQ ID NO: 1260397 - DNA, 22 bp, Artificial Sequence
  chemically synthesized
gaggcgggaggcagaggttgca

SEQ ID NO: 1260398 - DNA, 22 bp, Artificial Sequence
  chemically synthesized
acttgaggcgggaggcagaggt

SEQ ID NO: 1260399 - DNA, 22 bp, Artificial Sequence
  chemically synthesized
agttcactgcaacctctgcctc

SEQ ID NO: 1260400 - DNA, 22 bp, Artificial Sequence
  chemically synthesized
cacttgaggcgggaggcagagg

SEQ ID NO: 1260401 - DNA, 22 bp, Artificial Sequence
  chemically synthesized
actgcaacctctgcctcccgcc

SEQ ID NO: 1260402 - DNA, 22 bp, Artificial Sequence
  chemically synthesized
caacctctgcctcccgcctcaa

SEQ ID NO: 1260403 - DNA, 22 bp, Artificial Sequence
  chemically synthesized
aggtgggaggtttcacttgagg

SEQ ID NO: 1260404 - DNA, 22 bp, Artificial Sequence
  chemically synthesized
tgcctcccgcctcaagtgaaac

SEQ ID NO: 1260405 - DNA, 22 bp, Artificial Sequence
  chemically synthesized
cctcccgcctcaagtgaaacct

SEQ ID NO: 1260406 - DNA, 22 bp, Artificial Sequence
  chemically synthesized
ggaggctgaggtgggaggtttc

SEQ ID NO: 1260407 - DNA, 22 bp, Artificial Sequence
  chemically synthesized
ccgcctcaagtgaaacctccca

SEQ ID NO: 1260408 - DNA, 22 bp, Artificial Sequence
  chemically synthesized
gggaggctgaggtgggaggttt

SEQ ID NO: 1260409 - DNA, 22 bp, Artificial Sequence
  chemically synthesized
cttgggaggctgaggtgggagg

SEQ ID NO: 1260410 - DNA, 22 bp, Artificial Sequence
  chemically synthesized
aagtgaaacctcccacctcagc

SEQ ID NO: 1260411 - DNA, 22 bp, Artificial Sequence
  chemically synthesized
cagctacttgggaggctgaggt

SEQ ID NO: 1260412 - DNA, 22 bp, Artificial Sequence
  chemically synthesized
taattccagctacttgggaggc

SEQ ID NO: 1260413 - DNA, 22 bp, Artificial Sequence
  chemically synthesized
ccacctcagcctcccaagtagc

SEQ ID NO: 1260414 - DNA, 22 bp, Artificial Sequence
  chemically synthesized
agcctcccaagtagctggaatt

SEQ ID NO: 1260415 - DNA, 22 bp, Artificial Sequence
  chemically synthesized
ccaagtagctggaattacaggt

SEQ ID NO: 1260416 - DNA, 22 bp, Artificial Sequence
  chemically synthesized
tgtgtggtggtgggcacctgta

SEQ ID NO: 1260417 - DNA, 22 bp, Artificial Sequence
  chemically synthesized
gctgtgtgtggtggtgggcacc

SEQ ID NO: 1260418 - DNA, 22 bp, Artificial Sequence
  chemically synthesized
gaattacaggtgcccaccacca

SEQ ID NO: 1260419 - DNA, 22 bp, Artificial Sequence
  chemically synthesized
caggtgcccaccaccacacaca

SEQ ID NO: 1260420 - DNA, 22 bp, Artificial Sequence
  chemically synthesized
caaaacccacaaaaattagctg

SEQ ID NO: 1260421 - DNA, 22 bp, Artificial Sequence
  chemically synthesized
tgcaaaacccacaaaaattagc

SEQ ID NO: 1260422 - DNA, 22 bp, Artificial Sequence
  chemically synthesized
atctctgcaaaacccacaaaaa

SEQ ID NO: 1260423 - DNA, 22 bp, Artificial Sequence
  chemically synthesized
atttttgtgggttttgcagaga

SEQ ID NO: 1260424 - DNA, 22 bp, Artificial Sequence
  chemically synthesized
ttgtgggttttgcagagatgag

SEQ ID NO: 1260425 - DNA, 22 bp, Artificial Sequence
  chemically synthesized
tgtgggttttgcagagatgagg

SEQ ID NO: 1260426 - DNA, 22 bp, Artificial Sequence
  chemically synthesized
gtgggttttgcagagatgaggt

SEQ ID NO: 1260427 - DNA, 22 bp, Artificial Sequence
  chemically synthesized
tgggttttgcagagatgaggtt

SEQ ID NO: 1260428 - DNA, 22 bp, Artificial Sequence
  chemically synthesized
gacaacatggtgaaacctcatc

SEQ ID NO: 1260429 - DNA, 22 bp, Artificial Sequence
  chemically synthesized
tgcagagatgaggtttcaccat

SEQ ID NO: 1260430 - DNA, 22 bp, Artificial Sequence
  chemically synthesized
gcagagatgaggtttcaccatg

SEQ ID NO: 1260431 - DNA, 22 bp, Artificial Sequence
  chemically synthesized
cagagatgaggtttcaccatgt

SEQ ID NO: 1260432 - DNA, 22 bp, Artificial Sequence
  chemically synthesized
gagaccagcctggacaacatgg

SEQ ID NO: 1260433 - DNA, 22 bp, Artificial Sequence
  chemically synthesized
caccatgttgtccaggctggtc

SEQ ID NO: 1260434 - DNA, 22 bp, Artificial Sequence
  chemically synthesized
accatgttgtccaggctggtct

SEQ ID NO: 1260435 - DNA, 22 bp, Artificial Sequence
  chemically synthesized
agcccaggagttcgagaccagc

SEQ ID NO: 1260436 - DNA, 22 bp, Artificial Sequence
  chemically synthesized
gagcccaggagttcgagaccag

SEQ ID NO: 1260437 - DNA, 22 bp, Artificial Sequence
  chemically synthesized
tccaggctggtctcgaactcct

SEQ ID NO: 1260438 - DNA, 22 bp, Artificial Sequence
  chemically synthesized
gtctcgaactcctgggctcaag

SEQ ID NO: 1260439 - DNA, 22 bp, Artificial Sequence
  chemically synthesized
gaactcctgggctcaagcgatc

SEQ ID NO: 1260440 - DNA, 22 bp, Artificial Sequence
  chemically synthesized
ggaggccaaggcaggcagatcg

SEQ ID NO: 1260441 - DNA, 22 bp, Artificial Sequence
  chemically synthesized
ctgggctcaagcgatctgcctg

SEQ ID NO: 1260442 - DNA, 22 bp, Artificial Sequence
  chemically synthesized
gggaggccaaggcaggcagatc

SEQ ID NO: 1260443 - DNA, 22 bp, Artificial Sequence
  chemically synthesized
tgggaggccaaggcaggcagat

SEQ ID NO: 1260444 - DNA, 22 bp, Artificial Sequence
  chemically synthesized
ggctcaagcgatctgcctgcct

SEQ ID NO: 1260445 - DNA, 22 bp, Artificial Sequence
  chemically synthesized
aagcgatctgcctgccttggcc

SEQ ID NO: 1260446 - DNA, 22 bp, Artificial Sequence
  chemically synthesized
taatgccagcactttgggaggc

SEQ ID NO: 1260447 - DNA, 22 bp, Artificial Sequence
  chemically synthesized
cctgccttggcctcccaaagtg

SEQ ID NO: 1260448 - DNA, 22 bp, Artificial Sequence
  chemically synthesized
ccttggcctcccaaagtgctgg

SEQ ID NO: 1260449 - DNA, 22 bp, Artificial Sequence
  chemically synthesized
atgcctgtaatgccagcacttt

SEQ ID NO: 1260450 - DNA, 22 bp, Artificial Sequence
  chemically synthesized
ggcctcccaaagtgctggcatt

SEQ ID NO: 1260451 - DNA, 22 bp, Artificial Sequence
  chemically synthesized
gcctcccaaagtgctggcatta

SEQ ID NO: 1260452 - DNA, 22 bp, Artificial Sequence
  chemically synthesized
ccaaagtgctggcattacaggc

SEQ ID NO: 1260453 - DNA, 22 bp, Artificial Sequence
  chemically synthesized
accgggtgcagtggctcatgcc

SEQ ID NO: 1260454 - DNA, 22 bp, Artificial Sequence
  chemically synthesized
gcattacaggcatgagccactg

SEQ ID NO: 1260455 - DNA, 22 bp, Artificial Sequence
  chemically synthesized
caggcatgagccactgcacccg

SEQ ID NO: 1260456 - DNA, 22 bp, Artificial Sequence
  chemically synthesized
agaatacatgttgaccgggtgc

SEQ ID NO: 1260457 - DNA, 22 bp, Artificial Sequence
  chemically synthesized
aagaatacatgttgaccgggtg

SEQ ID NO: 1260458 - DNA, 22 bp, Artificial Sequence
  chemically synthesized
tttaagaatacatgttgaccgg

SEQ ID NO: 1260459 - DNA, 22 bp, Artificial Sequence
  chemically synthesized
aatctgtttaagaatacatgtt

SEQ ID NO: 1260460 - DNA, 22 bp, Artificial Sequence
  chemically synthesized
aaatctgtttaagaatacatgt

SEQ ID NO: 1260461 - DNA, 22 bp, Artificial Sequence
  chemically synthesized
taaatctgtttaagaatacatg

SEQ ID NO: 1260462 - DNA, 22 bp, Artificial Sequence
  chemically synthesized
cacccggtcaacatgtattctt

SEQ ID NO: 1260463 - DNA, 22 bp, Artificial Sequence
  chemically synthesized
tgaagaaagcattttaaatctg

SEQ ID NO: 1260464 - DNA, 22 bp, Artificial Sequence
  chemically synthesized
atgctatgaagaaagcatttta

SEQ ID NO: 1260465 - DNA, 22 bp, Artificial Sequence
  chemically synthesized
ttaaacagatttaaaatgcttt

SEQ ID NO: 1260466 - DNA, 22 bp, Artificial Sequence
  chemically synthesized
aatgctatgaagaaagcatttt

SEQ ID NO: 1260467 - DNA, 22 bp, Artificial Sequence
  chemically synthesized
taatgctatgaagaaagcattt

SEQ ID NO: 1260468 - DNA, 22 bp, Artificial Sequence
  chemically synthesized
aaacagatttaaaatgctttct

SEQ ID NO: 1260469 - DNA, 22 bp, Artificial Sequence
  chemically synthesized
ttaatgctatgaagaaagcatt

SEQ ID NO: 1260470 - DNA, 22 bp, Artificial Sequence
  chemically synthesized
aacagatttaaaatgctttctt

SEQ ID NO: 1260471 - DNA, 22 bp, Artificial Sequence
  chemically synthesized
aaaatgctttcttcatagcatt

SEQ ID NO: 1260472 - DNA, 22 bp, Artificial Sequence
  chemically synthesized
tgaaacatttttaatgctatga

SEQ ID NO: 1260473 - DNA, 22 bp, Artificial Sequence
  chemically synthesized
aaatgctttcttcatagcatta

SEQ ID NO: 1260474 - DNA, 22 bp, Artificial Sequence
  chemically synthesized
ttgtgaaacatttttaatgcta

SEQ ID NO: 1260475 - DNA, 22 bp, Artificial Sequence
  chemically synthesized
tcttcatagcattaaaaatgtt

SEQ ID NO: 1260476 - DNA, 22 bp, Artificial Sequence
  chemically synthesized
cttcatagcattaaaaatgttt

SEQ ID NO: 1260477 - DNA, 22 bp, Artificial Sequence
  chemically synthesized
ttcatagcattaaaaatgtttc

SEQ ID NO: 1260478 - DNA, 22 bp, Artificial Sequence
  chemically synthesized
catagcattaaaaatgtttcac

SEQ ID NO: 1260479 - DNA, 22 bp, Artificial Sequence
  chemically synthesized
atgtaaattattgtgaaacatt

SEQ ID NO: 1260480 - DNA, 22 bp, Artificial Sequence
  chemically synthesized
atagcattaaaaatgtttcaca

SEQ ID NO: 1260481 - DNA, 22 bp, Artificial Sequence
  chemically synthesized
tcatgtaaattattgtgaaaca

SEQ ID NO: 1260482 - DNA, 22 bp, Artificial Sequence
  chemically synthesized
aaaatgtttcacaataatttac

SEQ ID NO: 1260483 - DNA, 22 bp, Artificial Sequence
  chemically synthesized
catagagttctcatgtaaatta

SEQ ID NO: 1260484 - DNA, 22 bp, Artificial Sequence
  chemically synthesized
ccatagagttctcatgtaaatt

SEQ ID NO: 1260485 - DNA, 22 bp, Artificial Sequence
  chemically synthesized
agcttccatagagttctcatgt

SEQ ID NO: 1260486 - DNA, 22 bp, Artificial Sequence
  chemically synthesized
cacaataatttacatgagaact

SEQ ID NO: 1260487 - DNA, 22 bp, Artificial Sequence
  chemically synthesized
acaataatttacatgagaactc

SEQ ID NO: 1260488 - DNA, 22 bp, Artificial Sequence
  chemically synthesized
gaaatatattaagcttccatag

SEQ ID NO: 1260489 - DNA, 22 bp, Artificial Sequence
  chemically synthesized
acatgagaactctatggaagct

SEQ ID NO: 1260490 - DNA, 22 bp, Artificial Sequence
  chemically synthesized
catgagaactctatggaagctt

SEQ ID NO: 1260491 - DNA, 22 bp, Artificial Sequence
  chemically synthesized
tgctggaaatatattaagcttc

SEQ ID NO: 1260492 - DNA, 22 bp, Artificial Sequence
  chemically synthesized
tatggaagcttaatatatttcc

SEQ ID NO: 1260493 - DNA, 22 bp, Artificial Sequence
  chemically synthesized
tggaagcttaatatatttccag

SEQ ID NO: 1260494 - DNA, 22 bp, Artificial Sequence
  chemically synthesized
tgtgtatcctatgctggaaata

SEQ ID NO: 1260495 - DNA, 22 bp, Artificial Sequence
  chemically synthesized
aatatatttccagcataggata

SEQ ID NO: 1260496 - DNA, 22 bp, Artificial Sequence
  chemically synthesized
aatcattgtgtgtatcctatgc

SEQ ID NO: 1260497 - DNA, 22 bp, Artificial Sequence
  chemically synthesized
atatatttccagcataggatac

SEQ ID NO: 1260498 - DNA, 22 bp, Artificial Sequence
  chemically synthesized
ccagcataggatacacacaatg

SEQ ID NO: 1260499 - DNA, 22 bp, Artificial Sequence
  chemically synthesized
cagcataggatacacacaatga

SEQ ID NO: 1260500 - DNA, 22 bp, Artificial Sequence
  chemically synthesized
aagggccaggacattgaatcat

SEQ ID NO: 1260501 - DNA, 22 bp, Artificial Sequence
  chemically synthesized
caagggccaggacattgaatca

SEQ ID NO: 1260502 - DNA, 22 bp, Artificial Sequence
  chemically synthesized
tgtgtacttcaagggccaggac

SEQ ID NO: 1260503 - DNA, 22 bp, Artificial Sequence
  chemically synthesized
caattatgtgtacttcaagggc

SEQ ID NO: 1260504 - DNA, 22 bp, Artificial Sequence
  chemically synthesized
aatgtcctggcccttgaagtac

SEQ ID NO: 1260505 - DNA, 22 bp, Artificial Sequence
  chemically synthesized
attccaattatgtgtacttcaa

SEQ ID NO: 1260506 - DNA, 22 bp, Artificial Sequence
  chemically synthesized
ctcattccaattatgtgtactt

SEQ ID NO: 1260507 - DNA, 22 bp, Artificial Sequence
  chemically synthesized
tcctcattccaattatgtgtac

SEQ ID NO: 1260508 - DNA, 22 bp, Artificial Sequence
  chemically synthesized
ctcctcattccaattatgtgta

SEQ ID NO: 1260509 - DNA, 22 bp, Artificial Sequence
  chemically synthesized
gcccttgaagtacacataattg

SEQ ID NO: 1260510 - DNA, 22 bp, Artificial Sequence
  chemically synthesized
gaagtacacataattggaatga

SEQ ID NO: 1260511 - DNA, 22 bp, Artificial Sequence
  chemically synthesized
aagtacacataattggaatgag

SEQ ID NO: 1260512 - DNA, 22 bp, Artificial Sequence
  chemically synthesized
caaatgtccttctcctcattcc

SEQ ID NO: 1260513 - DNA, 22 bp, Artificial Sequence
  chemically synthesized
ccaaatgtccttctcctcattc

SEQ ID NO: 1260514 - DNA, 22 bp, Artificial Sequence
  chemically synthesized
tccaaatgtccttctcctcatt

SEQ ID NO: 1260515 - DNA, 22 bp, Artificial Sequence
  chemically synthesized
ttttccaaatgtccttctcctc

SEQ ID NO: 1260516 - DNA, 22 bp, Artificial Sequence
  chemically synthesized
gaatgaggagaaggacatttgg

SEQ ID NO: 1260517 - DNA, 22 bp, Artificial Sequence
  chemically synthesized
catggtaattattttccaaatg

SEQ ID NO: 1260518 - DNA, 22 bp, Artificial Sequence
  chemically synthesized
ggaaaataattaccatgcaata

SEQ ID NO: 1260519 - DNA, 22 bp, Artificial Sequence
  chemically synthesized
gaaaataattaccatgcaatat

SEQ ID NO: 1260520 - DNA, 22 bp, Artificial Sequence
  chemically synthesized
tacaatagcaggtatcatattg

SEQ ID NO: 1260521 - DNA, 22 bp, Artificial Sequence
  chemically synthesized
ccatgcaatatgatacctgcta

SEQ ID NO: 1260522 - DNA, 22 bp, Artificial Sequence
  chemically synthesized
taagaacctgtacaatagcagg

SEQ ID NO: 1260523 - DNA, 22 bp, Artificial Sequence
  chemically synthesized
tagcacctgtaagaacctgtac

SEQ ID NO: 1260524 - DNA, 22 bp, Artificial Sequence
  chemically synthesized
tgtagcacctgtaagaacctgt

SEQ ID NO: 1260525 - DNA, 22 bp, Artificial Sequence
  chemically synthesized
ctgtagcacctgtaagaacctg

SEQ ID NO: 1260526 - DNA, 22 bp, Artificial Sequence
  chemically synthesized
ttctgtagcacctgtaagaacc

SEQ ID NO: 1260527 - DNA, 22 bp, Artificial Sequence
  chemically synthesized
ctattgtacaggttcttacagg

SEQ ID NO: 1260528 - DNA, 22 bp, Artificial Sequence
  chemically synthesized
attcttctgtagcacctgtaag

SEQ ID NO: 1260529 - DNA, 22 bp, Artificial Sequence
  chemically synthesized
ttgtacaggttcttacaggtgc

SEQ ID NO: 1260530 - DNA, 22 bp, Artificial Sequence
  chemically synthesized
gattcttctgtagcacctgtaa

SEQ ID NO: 1260531 - DNA, 22 bp, Artificial Sequence
  chemically synthesized
tgattcttctgtagcacctgta

SEQ ID NO: 1260532 - DNA, 22 bp, Artificial Sequence
  chemically synthesized
tacaggttcttacaggtgctac

SEQ ID NO: 1260533 - DNA, 22 bp, Artificial Sequence
  chemically synthesized
ctttgattcttctgtagcacct

SEQ ID NO: 1260534 - DNA, 22 bp, Artificial Sequence
  chemically synthesized
cctttgattcttctgtagcacc

SEQ ID NO: 1260535 - DNA, 22 bp, Artificial Sequence
  chemically synthesized
tcctttgattcttctgtagcac

SEQ ID NO: 1260536 - DNA, 22 bp, Artificial Sequence
  chemically synthesized
cctttcctttgattcttctgta

SEQ ID NO: 1260537 - DNA, 22 bp, Artificial Sequence
  chemically synthesized
ttacaggtgctacagaagaatc

SEQ ID NO: 1260538 - DNA, 22 bp, Artificial Sequence
  chemically synthesized
acaggtgctacagaagaatcaa

SEQ ID NO: 1260539 - DNA, 22 bp, Artificial Sequence
  chemically synthesized
caggtgctacagaagaatcaaa

SEQ ID NO: 1260540 - DNA, 22 bp, Artificial Sequence
  chemically synthesized
gtctccctttcctttgattctt

SEQ ID NO: 1260541 - DNA, 22 bp, Artificial Sequence
  chemically synthesized
cagaagaatcaaaggaaaggga

SEQ ID NO: 1260542 - DNA, 22 bp, Artificial Sequence
  chemically synthesized
aggtggaattagtctccctttc

SEQ ID NO: 1260543 - DNA, 22 bp, Artificial Sequence
  chemically synthesized
tgaggtggaattagtctccctt

SEQ ID NO: 1260544 - DNA, 22 bp, Artificial Sequence
  chemically synthesized
tctgaggtggaattagtctccc

SEQ ID NO: 1260545 - DNA, 22 bp, Artificial Sequence
  chemically synthesized
attctctgaggtggaattagtc

SEQ ID NO: 1260546 - DNA, 22 bp, Artificial Sequence
  chemically synthesized
attaattctctgaggtggaatt

SEQ ID NO: 1260547 - DNA, 22 bp, Artificial Sequence
  chemically synthesized
cattaattctctgaggtggaat

SEQ ID NO: 1260548 - DNA, 22 bp, Artificial Sequence
  chemically synthesized
attccacctcagagaattaatg

SEQ ID NO: 1260549 - DNA, 22 bp, Artificial Sequence
  chemically synthesized
ccgtgatacatttcattaattc

SEQ ID NO: 1260550 - DNA, 22 bp, Artificial Sequence
  chemically synthesized
gccgtgatacatttcattaatt

SEQ ID NO: 1260551 - DNA, 22 bp, Artificial Sequence
  chemically synthesized
tgccgtgatacatttcattaat

SEQ ID NO: 1260552 - DNA, 22 bp, Artificial Sequence
  chemically synthesized
cacctcagagaattaatgaaat

SEQ ID NO: 1260553 - DNA, 22 bp, Artificial Sequence
  chemically synthesized
atctttgccgtgatacatttca

SEQ ID NO: 1260554 - DNA, 22 bp, Artificial Sequence
  chemically synthesized
agagaattaatgaaatgtatca

SEQ ID NO: 1260555 - DNA, 22 bp, Artificial Sequence
  chemically synthesized
atgaaatgtatcacggcaaaga

SEQ ID NO: 1260556 - DNA, 22 bp, Artificial Sequence
  chemically synthesized
ggacccagacaaaatctgatct

SEQ ID NO: 1260557 - DNA, 22 bp, Artificial Sequence
  chemically synthesized
gggacccagacaaaatctgatc

SEQ ID NO: 1260558 - DNA, 22 bp, Artificial Sequence
  chemically synthesized
tgggacccagacaaaatctgat

SEQ ID NO: 1260559 - DNA, 22 bp, Artificial Sequence
  chemically synthesized
aacgtcctttgggacccagaca

SEQ ID NO: 1260560 - DNA, 22 bp, Artificial Sequence
  chemically synthesized
gaacgtcctttgggacccagac

SEQ ID NO: 1260561 - DNA, 22 bp, Artificial Sequence
  chemically synthesized
tgaacgtcctttgggacccaga

SEQ ID NO: 1260562 - DNA, 22 bp, Artificial Sequence
  chemically synthesized
ttgaacgtcctttgggacccag

SEQ ID NO: 1260563 - DNA, 22 bp, Artificial Sequence
  chemically synthesized
ccaagcttttgaacgtcctttg

SEQ ID NO: 1260564 - DNA, 22 bp, Artificial Sequence
  chemically synthesized
tgtctgggtcccaaaggacgtt

SEQ ID NO: 1260565 - DNA, 22 bp, Artificial Sequence
  chemically synthesized
gtctgggtcccaaaggacgttc

SEQ ID NO: 1260566 - DNA, 22 bp, Artificial Sequence
  chemically synthesized
tctgggtcccaaaggacgttca

SEQ ID NO: 1260567 - DNA, 22 bp, Artificial Sequence
  chemically synthesized
aacctaccaagcttttgaacgt

SEQ ID NO: 1260568 - DNA, 22 bp, Artificial Sequence
  chemically synthesized
ggtcccaaaggacgttcaaaag

SEQ ID NO: 1260569 - DNA, 22 bp, Artificial Sequence
  chemically synthesized
tcaacctaccaagcttttgaac

SEQ ID NO: 1260570 - DNA, 22 bp, Artificial Sequence
  chemically synthesized
ctcaacctaccaagcttttgaa

SEQ ID NO: 1260571 - DNA, 22 bp, Artificial Sequence
  chemically synthesized
tctcaacctaccaagcttttga

SEQ ID NO: 1260572 - DNA, 22 bp, Artificial Sequence
  chemically synthesized
ccactttctcaacctaccaagc

SEQ ID NO: 1260573 - DNA, 22 bp, Artificial Sequence
  chemically synthesized
cccactttctcaacctaccaag

SEQ ID NO: 1260574 - DNA, 22 bp, Artificial Sequence
  chemically synthesized
tttcccactttctcaacctacc

SEQ ID NO: 1260575 - DNA, 22 bp, Artificial Sequence
  chemically synthesized
aaaagcttggtaggttgagaaa

SEQ ID NO: 1260576 - DNA, 22 bp, Artificial Sequence
  chemically synthesized
gaatgctgtttcccactttctc

SEQ ID NO: 1260577 - DNA, 22 bp, Artificial Sequence
  chemically synthesized
ggtaggttgagaaagtgggaaa

SEQ ID NO: 1260578 - DNA, 22 bp, Artificial Sequence
  chemically synthesized
gtaggttgagaaagtgggaaac

SEQ ID NO: 1260579 - DNA, 22 bp, Artificial Sequence
  chemically synthesized
gacctggaatgctgtttcccac

SEQ ID NO: 1260580 - DNA, 22 bp, Artificial Sequence
  chemically synthesized
agacctggaatgctgtttccca

SEQ ID NO: 1260581 - DNA, 22 bp, Artificial Sequence
  chemically synthesized
cttagacctggaatgctgtttc

SEQ ID NO: 1260582 - DNA, 22 bp, Artificial Sequence
  chemically synthesized
agaaagtgggaaacagcattcc

SEQ ID NO: 1260583 - DNA, 22 bp, Artificial Sequence
  chemically synthesized
aggcagtctccttagacctgga

SEQ ID NO: 1260584 - DNA, 22 bp, Artificial Sequence
  chemically synthesized
aaggcagtctccttagacctgg

SEQ ID NO: 1260585 - DNA, 22 bp, Artificial Sequence
  chemically synthesized
taaggcagtctccttagacctg

SEQ ID NO: 1260586 - DNA, 22 bp, Artificial Sequence
  chemically synthesized
aactttaaggcagtctccttag

SEQ ID NO: 1260587 - DNA, 22 bp, Artificial Sequence
  chemically synthesized
aaactttaaggcagtctcctta

SEQ ID NO: 1260588 - DNA, 22 bp, Artificial Sequence
  chemically synthesized
cttaaactttaaggcagtctcc

SEQ ID NO: 1260589 - DNA, 22 bp, Artificial Sequence
  chemically synthesized
caggtctaaggagactgcctta

SEQ ID NO: 1260590 - DNA, 22 bp, Artificial Sequence
  chemically synthesized
tcctacttaaactttaaggcag

SEQ ID NO: 1260591 - DNA, 22 bp, Artificial Sequence
  chemically synthesized
actgtcctacttaaactttaag

SEQ ID NO: 1260592 - DNA, 22 bp, Artificial Sequence
  chemically synthesized
gactgtcctacttaaactttaa

SEQ ID NO: 1260593 - DNA, 22 bp, Artificial Sequence
  chemically synthesized
aggagactgccttaaagtttaa

SEQ ID NO: 1260594 - DNA, 22 bp, Artificial Sequence
  chemically synthesized
tgactgtcctacttaaacttta

SEQ ID NO: 1260595 - DNA, 22 bp, Artificial Sequence
  chemically synthesized
tttgactgtcctacttaaactt

SEQ ID NO: 1260596 - DNA, 22 bp, Artificial Sequence
  chemically synthesized
cactctttgactgtcctactta

SEQ ID NO: 1260597 - DNA, 22 bp, Artificial Sequence
  chemically synthesized
ccttaaagtttaagtaggacag

SEQ ID NO: 1260598 - DNA, 22 bp, Artificial Sequence
  chemically synthesized
ctccactctttgactgtcctac

SEQ ID NO: 1260599 - DNA, 22 bp, Artificial Sequence
  chemically synthesized
cctccactctttgactgtccta

SEQ ID NO: 1260600 - DNA, 22 bp, Artificial Sequence
  chemically synthesized
aaagtttaagtaggacagtcaa

SEQ ID NO: 1260601 - DNA, 22 bp, Artificial Sequence
  chemically synthesized
aagtttaagtaggacagtcaaa

SEQ ID NO: 1260602 - DNA, 22 bp, Artificial Sequence
  chemically synthesized
tttcctccactctttgactgtc

SEQ ID NO: 1260603 - DNA, 22 bp, Artificial Sequence
  chemically synthesized
atttcctccactctttgactgt

SEQ ID NO: 1260604 - DNA, 22 bp, Artificial Sequence
  chemically synthesized
acttatttcctccactctttga

SEQ ID NO: 1260605 - DNA, 22 bp, Artificial Sequence
  chemically synthesized
aagtaggacagtcaaagagtgg

SEQ ID NO: 1260606 - DNA, 22 bp, Artificial Sequence
  chemically synthesized
gacttatttcctccactctttg

SEQ ID NO: 1260607 - DNA, 22 bp, Artificial Sequence
  chemically synthesized
agtaggacagtcaaagagtgga

SEQ ID NO: 1260608 - DNA, 22 bp, Artificial Sequence
  chemically synthesized
tgacttatttcctccactcttt

SEQ ID NO: 1260609 - DNA, 22 bp, Artificial Sequence
  chemically synthesized
ttttgacttatttcctccactc

SEQ ID NO: 1260610 - DNA, 22 bp, Artificial Sequence
  chemically synthesized
ctattttgacttatttcctcca

SEQ ID NO: 1260611 - DNA, 22 bp, Artificial Sequence
  chemically synthesized
cctattttgacttatttcctcc

SEQ ID NO: 1260612 - DNA, 22 bp, Artificial Sequence
  chemically synthesized
tcctattttgacttatttcctc

SEQ ID NO: 1260613 - DNA, 22 bp, Artificial Sequence
  chemically synthesized
tcattttcctattttgacttat

SEQ ID NO: 1260614 - DNA, 22 bp, Artificial Sequence
  chemically synthesized
gtcattttcctattttgactta

SEQ ID NO: 1260615 - DNA, 22 bp, Artificial Sequence
  chemically synthesized
tgtcattttcctattttgactt

SEQ ID NO: 1260616 - DNA, 22 bp, Artificial Sequence
  chemically synthesized
ttgtcattttcctattttgact

SEQ ID NO: 1260617 - DNA, 22 bp, Artificial Sequence
  chemically synthesized
tttgtcattttcctattttgac

SEQ ID NO: 1260618 - DNA, 22 bp, Artificial Sequence
  chemically synthesized
ttttttgtcattttcctatttt

SEQ ID NO: 1260619 - DNA, 22 bp, Artificial Sequence
  chemically synthesized
tattttttgtcattttcctatt

SEQ ID NO: 1260620 - DNA, 22 bp, Artificial Sequence
  chemically synthesized
tctattttttgtcattttccta

SEQ ID NO: 1260621 - DNA, 22 bp, Artificial Sequence
  chemically synthesized
caaggttctctattttttgtca

SEQ ID NO: 1260622 - DNA, 22 bp, Artificial Sequence
  chemically synthesized
gcctacaaggttctctattttt

SEQ ID NO: 1260623 - DNA, 22 bp, Artificial Sequence
  chemically synthesized
agcctggcctacaaggttctct

SEQ ID NO: 1260624 - DNA, 22 bp, Artificial Sequence
  chemically synthesized
gaagtcctaagcctggcctaca

SEQ ID NO: 1260625 - DNA, 22 bp, Artificial Sequence
  chemically synthesized
agttagaagtcctaagcctggc

SEQ ID NO: 1260626 - DNA, 22 bp, Artificial Sequence
  chemically synthesized
aagttagaagtcctaagcctgg

SEQ ID NO: 1260627 - DNA, 22 bp, Artificial Sequence
  chemically synthesized
tcttaagttagaagtcctaagc

SEQ ID NO: 1260628 - DNA, 22 bp, Artificial Sequence
  chemically synthesized
gtaggccaggcttaggacttct

SEQ ID NO: 1260629 - DNA, 22 bp, Artificial Sequence
  chemically synthesized
taggccaggcttaggacttcta

SEQ ID NO: 1260630 - DNA, 22 bp, Artificial Sequence
  chemically synthesized
cattgtcttaagttagaagtcc

SEQ ID NO: 1260631 - DNA, 22 bp, Artificial Sequence
  chemically synthesized
atgatctccattgtcttaagtt

SEQ ID NO: 1260632 - DNA, 22 bp, Artificial Sequence
  chemically synthesized
gatgatctccattgtcttaagt

SEQ ID NO: 1260633 - DNA, 22 bp, Artificial Sequence
  chemically synthesized
tgatgatctccattgtcttaag

SEQ ID NO: 1260634 - DNA, 22 bp, Artificial Sequence
  chemically synthesized
aggacttctaacttaagacaat

SEQ ID NO: 1260635 - DNA, 22 bp, Artificial Sequence
  chemically synthesized
ggacttctaacttaagacaatg

SEQ ID NO: 1260636 - DNA, 22 bp, Artificial Sequence
  chemically synthesized
ctaacttaagacaatggagatc

SEQ ID NO: 1260637 - DNA, 22 bp, Artificial Sequence
  chemically synthesized
taacttaagacaatggagatca

SEQ ID NO: 1260638 - DNA, 22 bp, Artificial Sequence
  chemically synthesized
aagggtctttgatgatctccat

SEQ ID NO: 1260639 - DNA, 22 bp, Artificial Sequence
  chemically synthesized
acttaagacaatggagatcatc

SEQ ID NO: 1260640 - DNA, 22 bp, Artificial Sequence
  chemically synthesized
aagacaatggagatcatcaaag

SEQ ID NO: 1260641 - DNA, 22 bp, Artificial Sequence
  chemically synthesized
agacaatggagatcatcaaaga

SEQ ID NO: 1260642 - DNA, 22 bp, Artificial Sequence
  chemically synthesized
gtcatctaaagggtctttgatg

SEQ ID NO: 1260643 - DNA, 22 bp, Artificial Sequence
  chemically synthesized
agtcatctaaagggtctttgat

SEQ ID NO: 1260644 - DNA, 22 bp, Artificial Sequence
  chemically synthesized
agacttagtcatctaaagggtc

SEQ ID NO: 1260645 - DNA, 22 bp, Artificial Sequence
  chemically synthesized
tcagacttagtcatctaaaggg

SEQ ID NO: 1260646 - DNA, 22 bp, Artificial Sequence
  chemically synthesized
ctctcagacttagtcatctaaa

SEQ ID NO: 1260647 - DNA, 22 bp, Artificial Sequence
  chemically synthesized
cacactgctctcagacttagtc

SEQ ID NO: 1260648 - DNA, 22 bp, Artificial Sequence
  chemically synthesized
acacactgctctcagacttagt

SEQ ID NO: 1260649 - DNA, 22 bp, Artificial Sequence
  chemically synthesized
tacacactgctctcagacttag

SEQ ID NO: 1260650 - DNA, 22 bp, Artificial Sequence
  chemically synthesized
ttacacactgctctcagactta

SEQ ID NO: 1260651 - DNA, 22 bp, Artificial Sequence
  chemically synthesized
tagatgactaagtctgagagca

SEQ ID NO: 1260652 - DNA, 22 bp, Artificial Sequence
  chemically synthesized
agatgactaagtctgagagcag

SEQ ID NO: 1260653 - DNA, 22 bp, Artificial Sequence
  chemically synthesized
gatgactaagtctgagagcagt

SEQ ID NO: 1260654 - DNA, 22 bp, Artificial Sequence
  chemically synthesized
aagccaatccttttacacactg

SEQ ID NO: 1260655 - DNA, 22 bp, Artificial Sequence
  chemically synthesized
caagccaatccttttacacact

SEQ ID NO: 1260656 - DNA, 22 bp, Artificial Sequence
  chemically synthesized
agtctgagagcagtgtgtaaaa

SEQ ID NO: 1260657 - DNA, 22 bp, Artificial Sequence
  chemically synthesized
tcaagccaatccttttacacac

SEQ ID NO: 1260658 - DNA, 22 bp, Artificial Sequence
  chemically synthesized
ttcaagccaatccttttacaca

SEQ ID NO: 1260659 - DNA, 22 bp, Artificial Sequence
  chemically synthesized
agagcagtgtgtaaaaggattg

SEQ ID NO: 1260660 - DNA, 22 bp, Artificial Sequence
  chemically synthesized
atcttttcaagccaatcctttt

SEQ ID NO: 1260661 - DNA, 22 bp, Artificial Sequence
  chemically synthesized
gatcttttcaagccaatccttt

SEQ ID NO: 1260662 - DNA, 22 bp, Artificial Sequence
  chemically synthesized
tgatcttttcaagccaatcctt

SEQ ID NO: 1260663 - DNA, 22 bp, Artificial Sequence
  chemically synthesized
attttgatcttttcaagccaat

SEQ ID NO: 1260664 - DNA, 22 bp, Artificial Sequence
  chemically synthesized
ctgattttgatcttttcaagcc

SEQ ID NO: 1260665 - DNA, 22 bp, Artificial Sequence
  chemically synthesized
cctgattttgatcttttcaagc

SEQ ID NO: 1260666 - DNA, 22 bp, Artificial Sequence
  chemically synthesized
gacttcctgattttgatctttt

SEQ ID NO: 1260667 - DNA, 22 bp, Artificial Sequence
  chemically synthesized
tctggacttcctgattttgatc

SEQ ID NO: 1260668 - DNA, 22 bp, Artificial Sequence
  chemically synthesized
tatctggacttcctgattttga

SEQ ID NO: 1260669 - DNA, 22 bp, Artificial Sequence
  chemically synthesized
gcttgaaaagatcaaaatcagg

SEQ ID NO: 1260670 - DNA, 22 bp, Artificial Sequence
  chemically synthesized
gaaaagatcaaaatcaggaagt

SEQ ID NO: 1260671 - DNA, 22 bp, Artificial Sequence
  chemically synthesized
aattctatctggacttcctgat

SEQ ID NO: 1260672 - DNA, 22 bp, Artificial Sequence
  chemically synthesized
aaaagatcaaaatcaggaagtc

SEQ ID NO: 1260673 - DNA, 22 bp, Artificial Sequence
  chemically synthesized
tcaattctatctggacttcctg

SEQ ID NO: 1260674 - DNA, 22 bp, Artificial Sequence
  chemically synthesized
ctcaattctatctggacttcct

SEQ ID NO: 1260675 - DNA, 22 bp, Artificial Sequence
  chemically synthesized
ccatagtcttctcaattctatc

SEQ ID NO: 1260676 - DNA, 22 bp, Artificial Sequence
  chemically synthesized
gccatagtcttctcaattctat

SEQ ID NO: 1260677 - DNA, 22 bp, Artificial Sequence
  chemically synthesized
tttgccatagtcttctcaattc

SEQ ID NO: 1260678 - DNA, 22 bp, Artificial Sequence
  chemically synthesized
atcaaccaacactatttgccat

SEQ ID NO: 1260679 - DNA, 22 bp, Artificial Sequence
  chemically synthesized
catcaaccaacactatttgcca

SEQ ID NO: 1260680 - DNA, 22 bp, Artificial Sequence
  chemically synthesized
tcatcaaccaacactatttgcc

SEQ ID NO: 1260681 - DNA, 22 bp, Artificial Sequence
  chemically synthesized
ttcatcaaccaacactatttgc

SEQ ID NO: 1260682 - DNA, 22 bp, Artificial Sequence
  chemically synthesized
agaagactatggcaaatagtgt

SEQ ID NO: 1260683 - DNA, 22 bp, Artificial Sequence
  chemically synthesized
tggcaaatagtgttggttgatg

SEQ ID NO: 1260684 - DNA, 22 bp, Artificial Sequence
  chemically synthesized
ataccaacaatgccttttcatc

SEQ ID NO: 1260685 - DNA, 22 bp, Artificial Sequence
  chemically synthesized
ccattaataccaacaatgcctt

SEQ ID NO: 1260686 - DNA, 22 bp, Artificial Sequence
  chemically synthesized
gttgatgaaaaggcattgttgg

SEQ ID NO: 1260687 - DNA, 22 bp, Artificial Sequence
  chemically synthesized
atgaaaaggcattgttggtatt

SEQ ID NO: 1260688 - DNA, 22 bp, Artificial Sequence
  chemically synthesized
gaatctcccattaataccaaca

SEQ ID NO: 1260689 - DNA, 22 bp, Artificial Sequence
  chemically synthesized
tggaatctcccattaataccaa

SEQ ID NO: 1260690 - DNA, 22 bp, Artificial Sequence
  chemically synthesized
gatagtatctctggaatctccc

SEQ ID NO: 1260691 - DNA, 22 bp, Artificial Sequence
  chemically synthesized
ttggtattaatgggagattcca

SEQ ID NO: 1260692 - DNA, 22 bp, Artificial Sequence
  chemically synthesized
gtattaatgggagattccagag

SEQ ID NO: 1260693 - DNA, 22 bp, Artificial Sequence
  chemically synthesized
atgggagattccagagatacta

SEQ ID NO: 1260694 - DNA, 22 bp, Artificial Sequence
  chemically synthesized
cagagatactatccaacctgtt

SEQ ID NO: 1260695 - DNA, 22 bp, Artificial Sequence
  chemically synthesized
atcaaaaaagtataaaacaggt

SEQ ID NO: 1260696 - DNA, 22 bp, Artificial Sequence
  chemically synthesized
tccaacctgttttatacttttt

SEQ ID NO: 1260697 - DNA, 22 bp, Artificial Sequence
  chemically synthesized
gacatgcaacctgatcaaaaaa

SEQ ID NO: 1260698 - DNA, 22 bp, Artificial Sequence
  chemically synthesized
agacatgcaacctgatcaaaaa

SEQ ID NO: 1260699 - DNA, 22 bp, Artificial Sequence
  chemically synthesized
ttagacatgcaacctgatcaaa

SEQ ID NO: 1260700 - DNA, 22 bp, Artificial Sequence
  chemically synthesized
ttttatacttttttgatcaggt

SEQ ID NO: 1260701 - DNA, 22 bp, Artificial Sequence
  chemically synthesized
tatacttttttgatcaggttgc

SEQ ID NO: 1260702 - DNA, 22 bp, Artificial Sequence
  chemically synthesized
atacttttttgatcaggttgca

SEQ ID NO: 1260703 - DNA, 22 bp, Artificial Sequence
  chemically synthesized
tacttttttgatcaggttgcat

SEQ ID NO: 1260704 - DNA, 22 bp, Artificial Sequence
  chemically synthesized
gggatgttcttagacatgcaac

SEQ ID NO: 1260705 - DNA, 22 bp, Artificial Sequence
  chemically synthesized
ttttgatcaggttgcatgtcta

SEQ ID NO: 1260706 - DNA, 22 bp, Artificial Sequence
  chemically synthesized
tttgatcaggttgcatgtctaa

SEQ ID NO: 1260707 - DNA, 22 bp, Artificial Sequence
  chemically synthesized
ctagggatgttcttagacatgc

SEQ ID NO: 1260708 - DNA, 22 bp, Artificial Sequence
  chemically synthesized
ttgatcaggttgcatgtctaag

SEQ ID NO: 1260709 - DNA, 22 bp, Artificial Sequence
  chemically synthesized
cctagggatgttcttagacatg

SEQ ID NO: 1260710 - DNA, 22 bp, Artificial Sequence
  chemically synthesized
tgatcaggttgcatgtctaaga

SEQ ID NO: 1260711 - DNA, 22 bp, Artificial Sequence
  chemically synthesized
gatcaggttgcatgtctaagaa

SEQ ID NO: 1260712 - DNA, 22 bp, Artificial Sequence
  chemically synthesized
atcaggttgcatgtctaagaac

SEQ ID NO: 1260713 - DNA, 22 bp, Artificial Sequence
  chemically synthesized
catgtctaagaacatccctagg

SEQ ID NO: 1260714 - DNA, 22 bp, Artificial Sequence
  chemically synthesized
agaacatccctaggaagtatta

SEQ ID NO: 1260715 - DNA, 22 bp, Artificial Sequence
  chemically synthesized
ggaagtattacttttcactgca

SEQ ID NO: 1260716 - DNA, 22 bp, Artificial Sequence
  chemically synthesized
aatagtaaaaaataatgcagtg

SEQ ID NO: 1260717 - DNA, 22 bp, Artificial Sequence
  chemically synthesized
tagttgaatagtaaaaaataat

SEQ ID NO: 1260718 - DNA, 22 bp, Artificial Sequence
  chemically synthesized
cttttcactgcattatttttta

SEQ ID NO: 1260719 - DNA, 22 bp, Artificial Sequence
  chemically synthesized
atagttgaatagtaaaaaataa

SEQ ID NO: 1260720 - DNA, 22 bp, Artificial Sequence
  chemically synthesized
tatagttgaatagtaaaaaata

SEQ ID NO: 1260721 - DNA, 22 bp, Artificial Sequence
  chemically synthesized
ttcactgcattattttttacta

SEQ ID NO: 1260722 - DNA, 22 bp, Artificial Sequence
  chemically synthesized
tcactgcattattttttactat

SEQ ID NO: 1260723 - DNA, 22 bp, Artificial Sequence
  chemically synthesized
ctttatagttgaatagtaaaaa

SEQ ID NO: 1260724 - DNA, 22 bp, Artificial Sequence
  chemically synthesized
cactgcattattttttactatt

SEQ ID NO: 1260725 - DNA, 22 bp, Artificial Sequence
  chemically synthesized
actttatagttgaatagtaaaa

SEQ ID NO: 1260726 - DNA, 22 bp, Artificial Sequence
  chemically synthesized
actgcattattttttactattc

SEQ ID NO: 1260727 - DNA, 22 bp, Artificial Sequence
  chemically synthesized
cattattttttactattcaact

SEQ ID NO: 1260728 - DNA, 22 bp, Artificial Sequence
  chemically synthesized
ttttttactattcaactataaa

SEQ ID NO: 1260729 - DNA, 22 bp, Artificial Sequence
  chemically synthesized
tttactattcaactataaagta

SEQ ID NO: 1260730 - DNA, 22 bp, Artificial Sequence
  chemically synthesized
catgcatccatttactttatag

SEQ ID NO: 1260731 - DNA, 22 bp, Artificial Sequence
  chemically synthesized
ttactattcaactataaagtaa

SEQ ID NO: 1260732 - DNA, 22 bp, Artificial Sequence
  chemically synthesized
tactattcaactataaagtaaa

SEQ ID NO: 1260733 - DNA, 22 bp, Artificial Sequence
  chemically synthesized
actattcaactataaagtaaat

SEQ ID NO: 1260734 - DNA, 22 bp, Artificial Sequence
  chemically synthesized
ctattcaactataaagtaaatg

SEQ ID NO: 1260735 - DNA, 22 bp, Artificial Sequence
  chemically synthesized
ttcaactataaagtaaatggat

SEQ ID NO: 1260736 - DNA, 22 bp, Artificial Sequence
  chemically synthesized
aacagttacatgcatccattta

SEQ ID NO: 1260737 - DNA, 22 bp, Artificial Sequence
  chemically synthesized
aactataaagtaaatggatgca

SEQ ID NO: 1260738 - DNA, 22 bp, Artificial Sequence
  chemically synthesized
taaagtaaatggatgcatgtaa

SEQ ID NO: 1260739 - DNA, 22 bp, Artificial Sequence
  chemically synthesized
tggcatgagtgcaaggaaaggc

SEQ ID NO: 1260740 - DNA, 22 bp, Artificial Sequence
  chemically synthesized
atggcatgagtgcaaggaaagg

SEQ ID NO: 1260741 - DNA, 22 bp, Artificial Sequence
  chemically synthesized
catttatggcatgagtgcaagg

SEQ ID NO: 1260742 - DNA, 22 bp, Artificial Sequence
  chemically synthesized
acatttatggcatgagtgcaag

SEQ ID NO: 1260743 - DNA, 22 bp, Artificial Sequence
  chemically synthesized
ttgagcctttccttgcactcat

SEQ ID NO: 1260744 - DNA, 22 bp, Artificial Sequence
  chemically synthesized
ttacatttatggcatgagtgca

SEQ ID NO: 1260745 - DNA, 22 bp, Artificial Sequence
  chemically synthesized
agcctttccttgcactcatgcc

SEQ ID NO: 1260746 - DNA, 22 bp, Artificial Sequence
  chemically synthesized
tgttcttacatttatggcatga

SEQ ID NO: 1260747 - DNA, 22 bp, Artificial Sequence
  chemically synthesized
atgttcttacatttatggcatg

SEQ ID NO: 1260748 - DNA, 22 bp, Artificial Sequence
  chemically synthesized
tatgttcttacatttatggcat

SEQ ID NO: 1260749 - DNA, 22 bp, Artificial Sequence
  chemically synthesized
tccttgcactcatgccataaat

SEQ ID NO: 1260750 - DNA, 22 bp, Artificial Sequence
  chemically synthesized
ccttgcactcatgccataaatg

SEQ ID NO: 1260751 - DNA, 22 bp, Artificial Sequence
  chemically synthesized
cttgcactcatgccataaatgt

SEQ ID NO: 1260752 - DNA, 22 bp, Artificial Sequence
  chemically synthesized
gcactcatgccataaatgtaag

SEQ ID NO: 1260753 - DNA, 22 bp, Artificial Sequence
  chemically synthesized
cactcatgccataaatgtaaga

SEQ ID NO: 1260754 - DNA, 22 bp, Artificial Sequence
  chemically synthesized
aggtgtagctttatgttcttac

SEQ ID NO: 1260755 - DNA, 22 bp, Artificial Sequence
  chemically synthesized
atgccataaatgtaagaacata

SEQ ID NO: 1260756 - DNA, 22 bp, Artificial Sequence
  chemically synthesized
aaggtgtagctttatgttctta

SEQ ID NO: 1260757 - DNA, 22 bp, Artificial Sequence
  chemically synthesized
taaggtgtagctttatgttctt

SEQ ID NO: 1260758 - DNA, 22 bp, Artificial Sequence
  chemically synthesized
aaaggtaactttaaggtgtagc

SEQ ID NO: 1260759 - DNA, 22 bp, Artificial Sequence
  chemically synthesized
caccttaaagttaccttttagc

SEQ ID NO: 1260760 - DNA, 22 bp, Artificial Sequence
  chemically synthesized
aaagttaccttttagctctttt

SEQ ID NO: 1260761 - DNA, 22 bp, Artificial Sequence
  chemically synthesized
aagttaccttttagctctttta

SEQ ID NO: 1260762 - DNA, 22 bp, Artificial Sequence
  chemically synthesized
aaacataaaaaataaaagagct

SEQ ID NO: 1260763 - DNA, 22 bp, Artificial Sequence
  chemically synthesized
ctaaaacataaaaaataaaaga

SEQ ID NO: 1260764 - DNA, 22 bp, Artificial Sequence
  chemically synthesized
ccttttagctcttttatttttt

SEQ ID NO: 1260765 - DNA, 22 bp, Artificial Sequence
  chemically synthesized
ttagctcttttattttttatgt

SEQ ID NO: 1260766 - DNA, 22 bp, Artificial Sequence
  chemically synthesized
aatactactaaaacataaaaaa

SEQ ID NO: 1260767 - DNA, 22 bp, Artificial Sequence
  chemically synthesized
tagctcttttattttttatgtt

SEQ ID NO: 1260768 - DNA, 22 bp, Artificial Sequence
  chemically synthesized
agctcttttattttttatgttt

SEQ ID NO: 1260769 - DNA, 22 bp, Artificial Sequence
  chemically synthesized
gctcttttattttttatgtttt

SEQ ID NO: 1260770 - DNA, 22 bp, Artificial Sequence
  chemically synthesized
ttttattttttatgttttagta

SEQ ID NO: 1260771 - DNA, 22 bp, Artificial Sequence
  chemically synthesized
ttattttttatgttttagtagt

SEQ ID NO: 1260772 - DNA, 22 bp, Artificial Sequence
  chemically synthesized
tattttttatgttttagtagta

SEQ ID NO: 1260773 - DNA, 22 bp, Artificial Sequence
  chemically synthesized
attttttatgttttagtagtat

SEQ ID NO: 1260774 - DNA, 22 bp, Artificial Sequence
  chemically synthesized
ttttttatgttttagtagtatt

SEQ ID NO: 1260775 - DNA, 22 bp, Artificial Sequence
  chemically synthesized
agtagaatagactgaatactac

SEQ ID NO: 1260776 - DNA, 22 bp, Artificial Sequence
  chemically synthesized
tttatgttttagtagtattcag

SEQ ID NO: 1260777 - DNA, 22 bp, Artificial Sequence
  chemically synthesized
ttatgttttagtagtattcagt

SEQ ID NO: 1260778 - DNA, 22 bp, Artificial Sequence
  chemically synthesized
tatgttttagtagtattcagtc

SEQ ID NO: 1260779 - DNA, 22 bp, Artificial Sequence
  chemically synthesized
atgttttagtagtattcagtct

SEQ ID NO: 1260780 - DNA, 22 bp, Artificial Sequence
  chemically synthesized
tgttttagtagtattcagtcta

SEQ ID NO: 1260781 - DNA, 22 bp, Artificial Sequence
  chemically synthesized
aattcagtagaatagactgaat

SEQ ID NO: 1260782 - DNA, 22 bp, Artificial Sequence
  chemically synthesized
tagtagtattcagtctattcta

SEQ ID NO: 1260783 - DNA, 22 bp, Artificial Sequence
  chemically synthesized
agtagtattcagtctattctac

SEQ ID NO: 1260784 - DNA, 22 bp, Artificial Sequence
  chemically synthesized
gtagtattcagtctattctact

SEQ ID NO: 1260785 - DNA, 22 bp, Artificial Sequence
  chemically synthesized
agtctattctactgaattcagt

SEQ ID NO: 1260786 - DNA, 22 bp, Artificial Sequence
  chemically synthesized
ttctactgaattcagtcccgat

SEQ ID NO: 1260787 - DNA, 22 bp, Artificial Sequence
  chemically synthesized
tactgaattcagtcccgatttg

SEQ ID NO: 1260788 - DNA, 22 bp, Artificial Sequence
  chemically synthesized
ctgaattcagtcccgatttgtt

SEQ ID NO: 1260789 - DNA, 22 bp, Artificial Sequence
  chemically synthesized
aattcagtcccgatttgttata

SEQ ID NO: 1260790 - DNA, 22 bp, Artificial Sequence
  chemically synthesized
aagagtaaataaaatataacaa

SEQ ID NO: 1260791 - DNA, 22 bp, Artificial Sequence
  chemically synthesized
gaagagtaaataaaatataaca

SEQ ID NO: 1260792 - DNA, 22 bp, Artificial Sequence
  chemically synthesized
tgaagagtaaataaaatataac

SEQ ID NO: 1260793 - DNA, 22 bp, Artificial Sequence
  chemically synthesized
agtcccgatttgttatatttta

SEQ ID NO: 1260794 - DNA, 22 bp, Artificial Sequence
  chemically synthesized
tttgaagagtaaataaaatata

SEQ ID NO: 1260795 - DNA, 22 bp, Artificial Sequence
  chemically synthesized
ctttgaagagtaaataaaatat

SEQ ID NO: 1260796 - DNA, 22 bp, Artificial Sequence
  chemically synthesized
tctttgaagagtaaataaaata

SEQ ID NO: 1260797 - DNA, 22 bp, Artificial Sequence
  chemically synthesized
gttatattttatttactcttca

SEQ ID NO: 1260798 - DNA, 22 bp, Artificial Sequence
  chemically synthesized
aaaaactttctttgaagagtaa

SEQ ID NO: 1260799 - DNA, 22 bp, Artificial Sequence
  chemically synthesized
ttatattttatttactcttcaa

SEQ ID NO: 1260800 - DNA, 22 bp, Artificial Sequence
  chemically synthesized
gaaaaactttctttgaagagta

SEQ ID NO: 1260801 - DNA, 22 bp, Artificial Sequence
  chemically synthesized
tattttatttactcttcaaaga

SEQ ID NO: 1260802 - DNA, 22 bp, Artificial Sequence
  chemically synthesized
tcatttgaaaaactttctttga

SEQ ID NO: 1260803 - DNA, 22 bp, Artificial Sequence
  chemically synthesized
tatttactcttcaaagaaagtt

SEQ ID NO: 1260804 - DNA, 22 bp, Artificial Sequence
  chemically synthesized
atttactcttcaaagaaagttt

SEQ ID NO: 1260805 - DNA, 22 bp, Artificial Sequence
  chemically synthesized
tttactcttcaaagaaagtttt

SEQ ID NO: 1260806 - DNA, 22 bp, Artificial Sequence
  chemically synthesized
aattgtcatttgaaaaactttc

SEQ ID NO: 1260807 - DNA, 22 bp, Artificial Sequence
  chemically synthesized
caattgtcatttgaaaaacttt

SEQ ID NO: 1260808 - DNA, 22 bp, Artificial Sequence
  chemically synthesized
actcttcaaagaaagtttttca

SEQ ID NO: 1260809 - DNA, 22 bp, Artificial Sequence
  chemically synthesized
ctcttcaaagaaagtttttcaa

SEQ ID NO: 1260810 - DNA, 22 bp, Artificial Sequence
  chemically synthesized
tttcaattgtcatttgaaaaac

SEQ ID NO: 1260811 - DNA, 22 bp, Artificial Sequence
  chemically synthesized
atttcaattgtcatttgaaaaa

SEQ ID NO: 1260812 - DNA, 22 bp, Artificial Sequence
  chemically synthesized
ttcaaagaaagtttttcaaatg

SEQ ID NO: 1260813 - DNA, 22 bp, Artificial Sequence
  chemically synthesized
tatttcaattgtcatttgaaaa

SEQ ID NO: 1260814 - DNA, 22 bp, Artificial Sequence
  chemically synthesized
ttatttcaattgtcatttgaaa

SEQ ID NO: 1260815 - DNA, 22 bp, Artificial Sequence
  chemically synthesized
caaagaaagtttttcaaatgac

SEQ ID NO: 1260816 - DNA, 22 bp, Artificial Sequence
  chemically synthesized
aaagaaagtttttcaaatgaca

SEQ ID NO: 1260817 - DNA, 22 bp, Artificial Sequence
  chemically synthesized
ttttatttcaattgtcatttga

SEQ ID NO: 1260818 - DNA, 22 bp, Artificial Sequence
  chemically synthesized
cttttatttcaattgtcatttg

SEQ ID NO: 1260819 - DNA, 22 bp, Artificial Sequence
  chemically synthesized
ttcaaatgacaattgaaataaa

SEQ ID NO: 1260820 - DNA, 22 bp, Artificial Sequence
  chemically synthesized
tcaaatgacaattgaaataaaa

SEQ ID NO: 1260821 - DNA, 22 bp, Artificial Sequence
  chemically synthesized
caaatgacaattgaaataaaag

SEQ ID NO: 1260822 - DNA, 22 bp, Artificial Sequence
  chemically synthesized
aaatgacaattgaaataaaaga

SEQ ID NO: 1260823 - DNA, 22 bp, Artificial Sequence
  chemically synthesized
cagaacaaatggtatcttcttt

SEQ ID NO: 1260824 - DNA, 22 bp, Artificial Sequence
  chemically synthesized
aaataaaagaagataccatttg

SEQ ID NO: 1260825 - DNA, 22 bp, Artificial Sequence
  chemically synthesized
gaatgtagataatctacagaac

SEQ ID NO: 1260826 - DNA, 22 bp, Artificial Sequence
  chemically synthesized
gttctgtagattatctacattc

SEQ ID NO: 1260827 - DNA, 22 bp, Artificial Sequence
  chemically synthesized
ttctgtagattatctacattcc

SEQ ID NO: 1260828 - DNA, 22 bp, Artificial Sequence
  chemically synthesized
ggaaataggaattggaatgtag

SEQ ID NO: 1260829 - DNA, 22 bp, Artificial Sequence
  chemically synthesized
tgtagattatctacattccaat

SEQ ID NO: 1260830 - DNA, 22 bp, Artificial Sequence
  chemically synthesized
tagattatctacattccaattc

SEQ ID NO: 1260831 - DNA, 22 bp, Artificial Sequence
  chemically synthesized
tctacattccaattcctatttc

SEQ ID NO: 1260832 - DNA, 22 bp, Artificial Sequence
  chemically synthesized
gaatagggaacctaggaaatag

SEQ ID NO: 1260833 - DNA, 22 bp, Artificial Sequence
  chemically synthesized
cattccaattcctatttcctag

SEQ ID NO: 1260834 - DNA, 22 bp, Artificial Sequence
  chemically synthesized
caattcctatttcctaggttcc

SEQ ID NO: 1260835 - DNA, 22 bp, Artificial Sequence
  chemically synthesized
ctatttcctaggttccctattc

SEQ ID NO: 1260836 - DNA, 22 bp, Artificial Sequence
  chemically synthesized
tttcctaggttccctattctaa

SEQ ID NO: 1260837 - DNA, 22 bp, Artificial Sequence
  chemically synthesized
cctaggttccctattctaatca

SEQ ID NO: 1260838 - DNA, 22 bp, Artificial Sequence
  chemically synthesized
ctaggttccctattctaatcat

SEQ ID NO: 1260839 - DNA, 22 bp, Artificial Sequence
  chemically synthesized
ggttccctattctaatcatcta

SEQ ID NO: 1260840 - DNA, 22 bp, Artificial Sequence
  chemically synthesized
cctattctaatcatctactttt

SEQ ID NO: 1260841 - DNA, 22 bp, Artificial Sequence
  chemically synthesized
ttctaatcatctacttttctat

SEQ ID NO: 1260842 - DNA, 22 bp, Artificial Sequence
  chemically synthesized
gtgatgaagaaaatatagaaaa

SEQ ID NO: 1260843 - DNA, 22 bp, Artificial Sequence
  chemically synthesized
taatcatctacttttctatatt

SEQ ID NO: 1260844 - DNA, 22 bp, Artificial Sequence
  chemically synthesized
ggtgatgaagaaaatatagaaa

SEQ ID NO: 1260845 - DNA, 22 bp, Artificial Sequence
  chemically synthesized
atcatctacttttctatatttt

SEQ ID NO: 1260846 - DNA, 22 bp, Artificial Sequence
  chemically synthesized
tatttggtgatgaagaaaatat

SEQ ID NO: 1260847 - DNA, 22 bp, Artificial Sequence
  chemically synthesized
cctgtatttggtgatgaagaaa

SEQ ID NO: 1260848 - DNA, 22 bp, Artificial Sequence
  chemically synthesized
cttttctatattttcttcatca

SEQ ID NO: 1260849 - DNA, 22 bp, Artificial Sequence
  chemically synthesized
ttctatattttcttcatcacca

SEQ ID NO: 1260850 - DNA, 22 bp, Artificial Sequence
  chemically synthesized
tctatattttcttcatcaccaa

SEQ ID NO: 1260851 - DNA, 22 bp, Artificial Sequence
  chemically synthesized
ctatattttcttcatcaccaaa

SEQ ID NO: 1260852 - DNA, 22 bp, Artificial Sequence
  chemically synthesized
tgactgcctgtatttggtgatg

SEQ ID NO: 1260853 - DNA, 22 bp, Artificial Sequence
  chemically synthesized
tatattttcttcatcaccaaat

SEQ ID NO: 1260854 - DNA, 22 bp, Artificial Sequence
  chemically synthesized
tattttcttcatcaccaaatac

SEQ ID NO: 1260855 - DNA, 22 bp, Artificial Sequence
  chemically synthesized
cctgtgactgcctgtatttggt

SEQ ID NO: 1260856 - DNA, 22 bp, Artificial Sequence
  chemically synthesized
gcctgtgactgcctgtatttgg

SEQ ID NO: 1260857 - DNA, 22 bp, Artificial Sequence
  chemically synthesized
tcttcatcaccaaatacaggca

SEQ ID NO: 1260858 - DNA, 22 bp, Artificial Sequence
  chemically synthesized
cttcatcaccaaatacaggcag

SEQ ID NO: 1260859 - DNA, 22 bp, Artificial Sequence
  chemically synthesized
ttcatcaccaaatacaggcagt

SEQ ID NO: 1260860 - DNA, 22 bp, Artificial Sequence
  chemically synthesized
cacttgcctgtgactgcctgta

SEQ ID NO: 1260861 - DNA, 22 bp, Artificial Sequence
  chemically synthesized
catcaccaaatacaggcagtca

SEQ ID NO: 1260862 - DNA, 22 bp, Artificial Sequence
  chemically synthesized
atcaccaaatacaggcagtcac

SEQ ID NO: 1260863 - DNA, 22 bp, Artificial Sequence
  chemically synthesized
ctgcacttgcctgtgactgcct

SEQ ID NO: 1260864 - DNA, 22 bp, Artificial Sequence
  chemically synthesized
actcctgcacttgcctgtgact

SEQ ID NO: 1260865 - DNA, 22 bp, Artificial Sequence
  chemically synthesized
ttaactcctgcacttgcctgtg

SEQ ID NO: 1260866 - DNA, 22 bp, Artificial Sequence
  chemically synthesized
tcaatgattattaactcctgca

SEQ ID NO: 1260867 - DNA, 22 bp, Artificial Sequence
  chemically synthesized
atcaatgattattaactcctgc

SEQ ID NO: 1260868 - DNA, 22 bp, Artificial Sequence
  chemically synthesized
tataacatgtaatttatcaatg

SEQ ID NO: 1260869 - DNA, 22 bp, Artificial Sequence
  chemically synthesized
ataatcattgataaattacatg

SEQ ID NO: 1260870 - DNA, 22 bp, Artificial Sequence
  chemically synthesized
aatatcaaagtctatataacat

SEQ ID NO: 1260871 - DNA, 22 bp, Artificial Sequence
  chemically synthesized
ataaattacatgttatatagac

SEQ ID NO: 1260872 - DNA, 22 bp, Artificial Sequence
  chemically synthesized
catgttatatagactttgatat

SEQ ID NO: 1260873 - DNA, 22 bp, Artificial Sequence
  chemically synthesized
cagagaaattgaatatcaaagt

SEQ ID NO: 1260874 - DNA, 22 bp, Artificial Sequence
  chemically synthesized
tatagactttgatattcaattt

SEQ ID NO: 1260875 - DNA, 22 bp, Artificial Sequence
  chemically synthesized
tatatctccagagaaattgaat

SEQ ID NO: 1260876 - DNA, 22 bp, Artificial Sequence
  chemically synthesized
tgatattcaatttctctggaga

SEQ ID NO: 1260877 - DNA, 22 bp, Artificial Sequence
  chemically synthesized
gatattcaatttctctggagat

SEQ ID NO: 1260878 - DNA, 22 bp, Artificial Sequence
  chemically synthesized
atattcaatttctctggagata

SEQ ID NO: 1260879 - DNA, 22 bp, Artificial Sequence
  chemically synthesized
aatttctctggagatatataac

SEQ ID NO: 1260880 - DNA, 22 bp, Artificial Sequence
  chemically synthesized
ctctggagatatataactatat

SEQ ID NO: 1260881 - DNA, 22 bp, Artificial Sequence
  chemically synthesized
tctggagatatataactatata

SEQ ID NO: 1260882 - DNA, 22 bp, Artificial Sequence
  chemically synthesized
tggagatatataactatatata

SEQ ID NO: 1260883 - DNA, 22 bp, Artificial Sequence
  chemically synthesized
agggaaagaagggtatatatag

SEQ ID NO: 1260884 - DNA, 22 bp, Artificial Sequence
  chemically synthesized
gagatatataactatatatacc

SEQ ID NO: 1260885 - DNA, 22 bp, Artificial Sequence
  chemically synthesized
tgagggaaagaagggtatatat

SEQ ID NO: 1260886 - DNA, 22 bp, Artificial Sequence
  chemically synthesized
aagccctctgagggaaagaagg

SEQ ID NO: 1260887 - DNA, 22 bp, Artificial Sequence
  chemically synthesized
aaagccctctgagggaaagaag

SEQ ID NO: 1260888 - DNA, 22 bp, Artificial Sequence
  chemically synthesized
cttaaagccctctgagggaaag

SEQ ID NO: 1260889 - DNA, 22 bp, Artificial Sequence
  chemically synthesized
tatatacccttctttccctcag

SEQ ID NO: 1260890 - DNA, 22 bp, Artificial Sequence
  chemically synthesized
ccttaaagccctctgagggaaa

SEQ ID NO: 1260891 - DNA, 22 bp, Artificial Sequence
  chemically synthesized
gtttccttaaagccctctgagg

SEQ ID NO: 1260892 - DNA, 22 bp, Artificial Sequence
  chemically synthesized
agtttccttaaagccctctgag

SEQ ID NO: 1260893 - DNA, 22 bp, Artificial Sequence
  chemically synthesized
ctttccctcagagggctttaag

SEQ ID NO: 1260894 - DNA, 22 bp, Artificial Sequence
  chemically synthesized
tttccctcagagggctttaagg

SEQ ID NO: 1260895 - DNA, 22 bp, Artificial Sequence
  chemically synthesized
gggatttagtttccttaaagcc

SEQ ID NO: 1260896 - DNA, 22 bp, Artificial Sequence
  chemically synthesized
ggggatttagtttccttaaagc

SEQ ID NO: 1260897 - DNA, 22 bp, Artificial Sequence
  chemically synthesized
tccctcagagggctttaaggaa

SEQ ID NO: 1260898 - DNA, 22 bp, Artificial Sequence
  chemically synthesized
tggggatttagtttccttaaag

SEQ ID NO: 1260899 - DNA, 22 bp, Artificial Sequence
  chemically synthesized
ccctcagagggctttaaggaaa

SEQ ID NO: 1260900 - DNA, 22 bp, Artificial Sequence
  chemically synthesized
cctcagagggctttaaggaaac

SEQ ID NO: 1260901 - DNA, 22 bp, Artificial Sequence
  chemically synthesized
gttttggggatttagtttcctt

SEQ ID NO: 1260902 - DNA, 22 bp, Artificial Sequence
  chemically synthesized
agttttggggatttagtttcct

SEQ ID NO: 1260903 - DNA, 22 bp, Artificial Sequence
  chemically synthesized
agagggctttaaggaaactaaa

SEQ ID NO: 1260904 - DNA, 22 bp, Artificial Sequence
  chemically synthesized
tagttttggggatttagtttcc

SEQ ID NO: 1260905 - DNA, 22 bp, Artificial Sequence
  chemically synthesized
ttagttttggggatttagtttc

SEQ ID NO: 1260906 - DNA, 22 bp, Artificial Sequence
  chemically synthesized
taaggaaactaaatccccaaaa

SEQ ID NO: 1260907 - DNA, 22 bp, Artificial Sequence
  chemically synthesized
aaggaaactaaatccccaaaac

SEQ ID NO: 1260908 - DNA, 22 bp, Artificial Sequence
  chemically synthesized
aggaaactaaatccccaaaact

SEQ ID NO: 1260909 - DNA, 22 bp, Artificial Sequence
  chemically synthesized
aaccatgagtcagtgcttttag

SEQ ID NO: 1260910 - DNA, 22 bp, Artificial Sequence
  chemically synthesized
aatccccaaaactaaaagcact

SEQ ID NO: 1260911 - DNA, 22 bp, Artificial Sequence
  chemically synthesized
aaaccatgagtcagtgctttta

SEQ ID NO: 1260912 - DNA, 22 bp, Artificial Sequence
  chemically synthesized
taaaccatgagtcagtgctttt

SEQ ID NO: 1260913 - DNA, 22 bp, Artificial Sequence
  chemically synthesized
ccctttaaaccatgagtcagtg

SEQ ID NO: 1260914 - DNA, 22 bp, Artificial Sequence
  chemically synthesized
accctttaaaccatgagtcagt

SEQ ID NO: 1260915 - DNA, 22 bp, Artificial Sequence
  chemically synthesized
acttaccctttaaaccatgagt

SEQ ID NO: 1260916 - DNA, 22 bp, Artificial Sequence
  chemically synthesized
aacttaccctttaaaccatgag

SEQ ID NO: 1260917 - DNA, 22 bp, Artificial Sequence
  chemically synthesized
aaagcactgactcatggtttaa

SEQ ID NO: 1260918 - DNA, 22 bp, Artificial Sequence
  chemically synthesized
actcatggtttaaagggtaagt

SEQ ID NO: 1260919 - DNA, 22 bp, Artificial Sequence
  chemically synthesized
cagagagatttaacttaccctt

SEQ ID NO: 1260920 - DNA, 22 bp, Artificial Sequence
  chemically synthesized
acagagagatttaacttaccct

SEQ ID NO: 1260921 - DNA, 22 bp, Artificial Sequence
  chemically synthesized
tacagagagatttaacttaccc

SEQ ID NO: 1260922 - DNA, 22 bp, Artificial Sequence
  chemically synthesized
atggtttaaagggtaagttaaa

SEQ ID NO: 1260923 - DNA, 22 bp, Artificial Sequence
  chemically synthesized
ctttacagagagatttaactta

SEQ ID NO: 1260924 - DNA, 22 bp, Artificial Sequence
  chemically synthesized
cctttacagagagatttaactt

SEQ ID NO: 1260925 - DNA, 22 bp, Artificial Sequence
  chemically synthesized
tcctttacagagagatttaact

SEQ ID NO: 1260926 - DNA, 22 bp, Artificial Sequence
  chemically synthesized
aaagggtaagttaaatctctct

SEQ ID NO: 1260927 - DNA, 22 bp, Artificial Sequence
  chemically synthesized
aagggtaagttaaatctctctg

SEQ ID NO: 1260928 - DNA, 22 bp, Artificial Sequence
  chemically synthesized
ggctttcctttacagagagatt

SEQ ID NO: 1260929 - DNA, 22 bp, Artificial Sequence
  chemically synthesized
aggctttcctttacagagagat

SEQ ID NO: 1260930 - DNA, 22 bp, Artificial Sequence
  chemically synthesized
aatctctctgtaaaggaaagcc

SEQ ID NO: 1260931 - DNA, 22 bp, Artificial Sequence
  chemically synthesized
caaagatcacatttaggctttc

SEQ ID NO: 1260932 - DNA, 22 bp, Artificial Sequence
  chemically synthesized
gcaaagatcacatttaggcttt

SEQ ID NO: 1260933 - DNA, 22 bp, Artificial Sequence
  chemically synthesized
tctgtaaaggaaagcctaaatg

SEQ ID NO: 1260934 - DNA, 22 bp, Artificial Sequence
  chemically synthesized
tgtaaaggaaagcctaaatgtg

SEQ ID NO: 1260935 - DNA, 22 bp, Artificial Sequence
  chemically synthesized
tgtttgcaaagatcacatttag

SEQ ID NO: 1260936 - DNA, 22 bp, Artificial Sequence
  chemically synthesized
taaaggaaagcctaaatgtgat

SEQ ID NO: 1260937 - DNA, 22 bp, Artificial Sequence
  chemically synthesized
atcaccagttatgtttgcaaag

SEQ ID NO: 1260938 - DNA, 22 bp, Artificial Sequence
  chemically synthesized
ttgatcaccagttatgtttgca

SEQ ID NO: 1260939 - DNA, 22 bp, Artificial Sequence
  chemically synthesized
aatgtgatctttgcaaacataa

SEQ ID NO: 1260940 - DNA, 22 bp, Artificial Sequence
  chemically synthesized
ggctattgatcaccagttatgt

SEQ ID NO: 1260941 - DNA, 22 bp, Artificial Sequence
  chemically synthesized
cggctattgatcaccagttatg

SEQ ID NO: 1260942 - DNA, 22 bp, Artificial Sequence
  chemically synthesized
tcggctattgatcaccagttat

SEQ ID NO: 1260943 - DNA, 22 bp, Artificial Sequence
  chemically synthesized
tgcaaacataactggtgatcaa

SEQ ID NO: 1260944 - DNA, 22 bp, Artificial Sequence
  chemically synthesized
atctttcggctattgatcacca

SEQ ID NO: 1260945 - DNA, 22 bp, Artificial Sequence
  chemically synthesized
gcaaacataactggtgatcaat

SEQ ID NO: 1260946 - DNA, 22 bp, Artificial Sequence
  chemically synthesized
aatctttcggctattgatcacc

SEQ ID NO: 1260947 - DNA, 22 bp, Artificial Sequence
  chemically synthesized
caaacataactggtgatcaata

SEQ ID NO: 1260948 - DNA, 22 bp, Artificial Sequence
  chemically synthesized
taatctttcggctattgatcac

SEQ ID NO: 1260949 - DNA, 22 bp, Artificial Sequence
  chemically synthesized
ctttaatctttcggctattgat

SEQ ID NO: 1260950 - DNA, 22 bp, Artificial Sequence
  chemically synthesized
gtgatcaatagccgaaagatta

SEQ ID NO: 1260951 - DNA, 22 bp, Artificial Sequence
  chemically synthesized
catatgtactgctttaatcttt

SEQ ID NO: 1260952 - DNA, 22 bp, Artificial Sequence
  chemically synthesized
gcatatgtactgctttaatctt

SEQ ID NO: 1260953 - DNA, 22 bp, Artificial Sequence
  chemically synthesized
tgcatatgtactgctttaatct

SEQ ID NO: 1260954 - DNA, 22 bp, Artificial Sequence
  chemically synthesized
ttgcatatgtactgctttaatc

SEQ ID NO: 1260955 - DNA, 22 bp, Artificial Sequence
  chemically synthesized
tttgcatatgtactgctttaat

SEQ ID NO: 1260956 - DNA, 22 bp, Artificial Sequence
  chemically synthesized
ctttttgcatatgtactgcttt

SEQ ID NO: 1260957 - DNA, 22 bp, Artificial Sequence
  chemically synthesized
cctttttgcatatgtactgctt

SEQ ID NO: 1260958 - DNA, 22 bp, Artificial Sequence
  chemically synthesized
aatcttcctttttgcatatgta

SEQ ID NO: 1260959 - DNA, 22 bp, Artificial Sequence
  chemically synthesized
caatcttcctttttgcatatgt

SEQ ID NO: 1260960 - DNA, 22 bp, Artificial Sequence
  chemically synthesized
aagcagtacatatgcaaaaagg

SEQ ID NO: 1260961 - DNA, 22 bp, Artificial Sequence
  chemically synthesized
agtttcaatcttcctttttgca

SEQ ID NO: 1260962 - DNA, 22 bp, Artificial Sequence
  chemically synthesized
agaatgacatcaataaacaaaa

SEQ ID NO: 1260963 - DNA, 22 bp, Artificial Sequence
  chemically synthesized
aaacttaacattttgtttattg

SEQ ID NO: 1260964 - DNA, 22 bp, Artificial Sequence
  chemically synthesized
agatctaagaatgacatcaata

SEQ ID NO: 1260965 - DNA, 22 bp, Artificial Sequence
  chemically synthesized
aacattttgtttattgatgtca

SEQ ID NO: 1260966 - DNA, 22 bp, Artificial Sequence
  chemically synthesized
acattttgtttattgatgtcat

SEQ ID NO: 1260967 - DNA, 22 bp, Artificial Sequence
  chemically synthesized
attgagatctaagaatgacatc

SEQ ID NO: 1260968 - DNA, 22 bp, Artificial Sequence
  chemically synthesized
tgtttattgatgtcattcttag

SEQ ID NO: 1260969 - DNA, 22 bp, Artificial Sequence
  chemically synthesized
gtttattgatgtcattcttaga

SEQ ID NO: 1260970 - DNA, 22 bp, Artificial Sequence
  chemically synthesized
aattaattgagatctaagaatg

SEQ ID NO: 1260971 - DNA, 22 bp, Artificial Sequence
  chemically synthesized
tttattgatgtcattcttagat

SEQ ID NO: 1260972 - DNA, 22 bp, Artificial Sequence
  chemically synthesized
attgatgtcattcttagatctc

SEQ ID NO: 1260973 - DNA, 22 bp, Artificial Sequence
  chemically synthesized
ttgatgtcattcttagatctca

SEQ ID NO: 1260974 - DNA, 22 bp, Artificial Sequence
  chemically synthesized
atgtcattcttagatctcaatt

SEQ ID NO: 1260975 - DNA, 22 bp, Artificial Sequence
  chemically synthesized
atgtatcaaattaaattaattg

SEQ ID NO: 1260976 - DNA, 22 bp, Artificial Sequence
  chemically synthesized
ttagatctcaattaatttaatt

SEQ ID NO: 1260977 - DNA, 22 bp, Artificial Sequence
  chemically synthesized
agatctcaattaatttaatttg

SEQ ID NO: 1260978 - DNA, 22 bp, Artificial Sequence
  chemically synthesized
gatctcaattaatttaatttga

SEQ ID NO: 1260979 - DNA, 22 bp, Artificial Sequence
  chemically synthesized
aattaatttaatttgatacatc

SEQ ID NO: 1260980 - DNA, 22 bp, Artificial Sequence
  chemically synthesized
aggacggaggttgatgtatcaa

SEQ ID NO: 1260981 - DNA, 22 bp, Artificial Sequence
  chemically synthesized
attgaggacggaggttgatgta

SEQ ID NO: 1260982 - DNA, 22 bp, Artificial Sequence
  chemically synthesized
atttaatttgatacatcaacct

SEQ ID NO: 1260983 - DNA, 22 bp, Artificial Sequence
  chemically synthesized
gattgaggacggaggttgatgt

SEQ ID NO: 1260984 - DNA, 22 bp, Artificial Sequence
  chemically synthesized
aatttgatacatcaacctccgt

SEQ ID NO: 1260985 - DNA, 22 bp, Artificial Sequence
  chemically synthesized
atttgatacatcaacctccgtc

SEQ ID NO: 1260986 - DNA, 22 bp, Artificial Sequence
  chemically synthesized
gtgtttgattgaggacggaggt

SEQ ID NO: 1260987 - DNA, 22 bp, Artificial Sequence
  chemically synthesized
gatacatcaacctccgtcctca

SEQ ID NO: 1260988 - DNA, 22 bp, Artificial Sequence
  chemically synthesized
atacatcaacctccgtcctcaa

SEQ ID NO: 1260989 - DNA, 22 bp, Artificial Sequence
  chemically synthesized
tccatctagtgtttgattgagg

SEQ ID NO: 1260990 - DNA, 22 bp, Artificial Sequence
  chemically synthesized
atccatctagtgtttgattgag

SEQ ID NO: 1260991 - DNA, 22 bp, Artificial Sequence
  chemically synthesized
tatccatctagtgtttgattga

SEQ ID NO: 1260992 - DNA, 22 bp, Artificial Sequence
  chemically synthesized
tctttatccatctagtgtttga

SEQ ID NO: 1260993 - DNA, 22 bp, Artificial Sequence
  chemically synthesized
cgtcctcaatcaaacactagat

SEQ ID NO: 1260994 - DNA, 22 bp, Artificial Sequence
  chemically synthesized
aatcaaacactagatggataaa

SEQ ID NO: 1260995 - DNA, 22 bp, Artificial Sequence
  chemically synthesized
cataatagtgattatctttatc

SEQ ID NO: 1260996 - DNA, 22 bp, Artificial Sequence
  chemically synthesized
ttacataatagtgattatcttt

SEQ ID NO: 1260997 - DNA, 22 bp, Artificial Sequence
  chemically synthesized
actattacataatagtgattat

SEQ ID NO: 1260998 - DNA, 22 bp, Artificial Sequence
  chemically synthesized
gatggataaagataatcactat

SEQ ID NO: 1260999 - DNA, 22 bp, Artificial Sequence
  chemically synthesized
ggcgtattgactattacataat

SEQ ID NO: 1261000 - DNA, 22 bp, Artificial Sequence
  chemically synthesized
ttatgtaatagtcaatacgccc

SEQ ID NO: 1261001 - DNA, 22 bp, Artificial Sequence
  chemically synthesized
tgtaatagtcaatacgcccagg

SEQ ID NO: 1261002 - DNA, 22 bp, Artificial Sequence
  chemically synthesized
aatagatcatatatgccaggag

SEQ ID NO: 1261003 - DNA, 22 bp, Artificial Sequence
  chemically synthesized
caatagatcatatatgccagga

SEQ ID NO: 1261004 - DNA, 22 bp, Artificial Sequence
  chemically synthesized
ctggcatatatgatctattgaa

SEQ ID NO: 1261005 - DNA, 22 bp, Artificial Sequence
  chemically synthesized
gcatatatgatctattgaaata

SEQ ID NO: 1261006 - DNA, 22 bp, Artificial Sequence
  chemically synthesized
aaatataataatatatgtattt

SEQ ID NO: 1261007 - DNA, 22 bp, Artificial Sequence
  chemically synthesized
gttaaaatataataatatatgt

SEQ ID NO: 1261008 - DNA, 22 bp, Artificial Sequence
  chemically synthesized
agttaaaatataataatatatg

SEQ ID NO: 1261009 - DNA, 22 bp, Artificial Sequence
  chemically synthesized
ttagttaaaatataataatata

SEQ ID NO: 1261010 - DNA, 22 bp, Artificial Sequence
  chemically synthesized
cttagttaaaatataataatat

SEQ ID NO: 1261011 - DNA, 22 bp, Artificial Sequence
  chemically synthesized
ttgaaatacatatattattata

SEQ ID NO: 1261012 - DNA, 22 bp, Artificial Sequence
  chemically synthesized
aaatacatatattattatattt

SEQ ID NO: 1261013 - DNA, 22 bp, Artificial Sequence
  chemically synthesized
tgtttcttagttaaaatataat

SEQ ID NO: 1261014 - DNA, 22 bp, Artificial Sequence
  chemically synthesized
gatactgtgtttcttagttaaa

SEQ ID NO: 1261015 - DNA, 22 bp, Artificial Sequence
  chemically synthesized
ggttagatactgtgtttcttag

SEQ ID NO: 1261016 - DNA, 22 bp, Artificial Sequence
  chemically synthesized
ttatattttaactaagaaacac

SEQ ID NO: 1261017 - DNA, 22 bp, Artificial Sequence
  chemically synthesized
gggttagatactgtgtttctta

SEQ ID NO: 1261018 - DNA, 22 bp, Artificial Sequence
  chemically synthesized
tattttaactaagaaacacagt

SEQ ID NO: 1261019 - DNA, 22 bp, Artificial Sequence
  chemically synthesized
taactaagaaacacagtatcta

SEQ ID NO: 1261020 - DNA, 22 bp, Artificial Sequence
  chemically synthesized
aactaagaaacacagtatctaa

SEQ ID NO: 1261021 - DNA, 22 bp, Artificial Sequence
  chemically synthesized
actaagaaacacagtatctaac

SEQ ID NO: 1261022 - DNA, 22 bp, Artificial Sequence
  chemically synthesized
agaaacacagtatctaacccaa

SEQ ID NO: 1261023 - DNA, 22 bp, Artificial Sequence
  chemically synthesized
aaaaatgtacataatacttggg

SEQ ID NO: 1261024 - DNA, 22 bp, Artificial Sequence
  chemically synthesized
aaaaaatgtacataatacttgg

SEQ ID NO: 1261025 - DNA, 22 bp, Artificial Sequence
  chemically synthesized
tttaaaaaatgtacataatact

SEQ ID NO: 1261026 - DNA, 22 bp, Artificial Sequence
  chemically synthesized
acccaagtattatgtacatttt

SEQ ID NO: 1261027 - DNA, 22 bp, Artificial Sequence
  chemically synthesized
aaggaagtgaattgtttaaaaa

SEQ ID NO: 1261028 - DNA, 22 bp, Artificial Sequence
  chemically synthesized
caaggaagtgaattgtttaaaa

SEQ ID NO: 1261029 - DNA, 22 bp, Artificial Sequence
  chemically synthesized
tcaaggaagtgaattgtttaaa

SEQ ID NO: 1261030 - DNA, 22 bp, Artificial Sequence
  chemically synthesized
tgtacattttttaaacaattca

SEQ ID NO: 1261031 - DNA, 22 bp, Artificial Sequence
  chemically synthesized
ataactttcaaggaagtgaatt

SEQ ID NO: 1261032 - DNA, 22 bp, Artificial Sequence
  chemically synthesized
tttaaacaattcacttccttga

SEQ ID NO: 1261033 - DNA, 22 bp, Artificial Sequence
  chemically synthesized
ttaaacaattcacttccttgaa

SEQ ID NO: 1261034 - DNA, 22 bp, Artificial Sequence
  chemically synthesized
taaacaattcacttccttgaaa

SEQ ID NO: 1261035 - DNA, 22 bp, Artificial Sequence
  chemically synthesized
gtaactcataactttcaaggaa

SEQ ID NO: 1261036 - DNA, 22 bp, Artificial Sequence
  chemically synthesized
aaacaattcacttccttgaaag

SEQ ID NO: 1261037 - DNA, 22 bp, Artificial Sequence
  chemically synthesized
aacaattcacttccttgaaagt

SEQ ID NO: 1261038 - DNA, 22 bp, Artificial Sequence
  chemically synthesized
acttccttgaaagttatgagtt

SEQ ID NO: 1261039 - DNA, 22 bp, Artificial Sequence
  chemically synthesized
aaaatgattggtaactcataac

SEQ ID NO: 1261040 - DNA, 22 bp, Artificial Sequence
  chemically synthesized
ttaaaaatgattggtaactcat

SEQ ID NO: 1261041 - DNA, 22 bp, Artificial Sequence
  chemically synthesized
ccttgaaagttatgagttacca

SEQ ID NO: 1261042 - DNA, 22 bp, Artificial Sequence
  chemically synthesized
attaaaaatgattggtaactca

SEQ ID NO: 1261043 - DNA, 22 bp, Artificial Sequence
  chemically synthesized
cttgaaagttatgagttaccaa

SEQ ID NO: 1261044 - DNA, 22 bp, Artificial Sequence
  chemically synthesized
gaaagttatgagttaccaatca

SEQ ID NO: 1261045 - DNA, 22 bp, Artificial Sequence
  chemically synthesized
aaagttatgagttaccaatcat

SEQ ID NO: 1261046 - DNA, 22 bp, Artificial Sequence
  chemically synthesized
ggagaaatttattaaaaatgat

SEQ ID NO: 1261047 - DNA, 22 bp, Artificial Sequence
  chemically synthesized
tgagttaccaatcatttttaat

SEQ ID NO: 1261048 - DNA, 22 bp, Artificial Sequence
  chemically synthesized
ccaatcatttttaataaatttc

SEQ ID NO: 1261049 - DNA, 22 bp, Artificial Sequence
  chemically synthesized
ttaataaatttctcccagcttt

SEQ ID NO: 1261050 - DNA, 22 bp, Artificial Sequence
  chemically synthesized
atagataaatgtaaagctggga

SEQ ID NO: 1261051 - DNA, 22 bp, Artificial Sequence
  chemically synthesized
taataaatttctcccagcttta

SEQ ID NO: 1261052 - DNA, 22 bp, Artificial Sequence
  chemically synthesized
aataaatttctcccagctttac

SEQ ID NO: 1261053 - DNA, 22 bp, Artificial Sequence
  chemically synthesized
ataaatttctcccagctttaca

SEQ ID NO: 1261054 - DNA, 22 bp, Artificial Sequence
  chemically synthesized
ctcccagctttacatttatcta

SEQ ID NO: 1261055 - DNA, 22 bp, Artificial Sequence
  chemically synthesized
agatataattgatagataaatg

SEQ ID NO: 1261056 - DNA, 22 bp, Artificial Sequence
  chemically synthesized
tcccagctttacatttatctat

SEQ ID NO: 1261057 - DNA, 22 bp, Artificial Sequence
  chemically synthesized
ccagctttacatttatctatca

SEQ ID NO: 1261058 - DNA, 22 bp, Artificial Sequence
  chemically synthesized
aagttcagatataattgataga

SEQ ID NO: 1261059 - DNA, 22 bp, Artificial Sequence
  chemically synthesized
gaagttcagatataattgatag

SEQ ID NO: 1261060 - DNA, 22 bp, Artificial Sequence
  chemically synthesized
tacatttatctatcaattatat

SEQ ID NO: 1261061 - DNA, 22 bp, Artificial Sequence
  chemically synthesized
acatttatctatcaattatatc

SEQ ID NO: 1261062 - DNA, 22 bp, Artificial Sequence
  chemically synthesized
catttatctatcaattatatct

SEQ ID NO: 1261063 - DNA, 22 bp, Artificial Sequence
  chemically synthesized
atctatcaattatatctgaact

SEQ ID NO: 1261064 - DNA, 22 bp, Artificial Sequence
  chemically synthesized
tctatcaattatatctgaactt

SEQ ID NO: 1261065 - DNA, 22 bp, Artificial Sequence
  chemically synthesized
tcaattatatctgaacttcaaa

SEQ ID NO: 1261066 - DNA, 22 bp, Artificial Sequence
  chemically synthesized
tatctgaacttcaaatacactc

SEQ ID NO: 1261067 - DNA, 22 bp, Artificial Sequence
  chemically synthesized
agacaaatgcatccagagtgta

SEQ ID NO: 1261068 - DNA, 22 bp, Artificial Sequence
  chemically synthesized
tgagacaaatgcatccagagtg

SEQ ID NO: 1261069 - DNA, 22 bp, Artificial Sequence
  chemically synthesized
aacttcaaatacactctggatg

SEQ ID NO: 1261070 - DNA, 22 bp, Artificial Sequence
  chemically synthesized
ctctgagacaaatgcatccaga

SEQ ID NO: 1261071 - DNA, 22 bp, Artificial Sequence
  chemically synthesized
caaatacactctggatgcattt

SEQ ID NO: 1261072 - DNA, 22 bp, Artificial Sequence
  chemically synthesized
aaatacactctggatgcatttg

SEQ ID NO: 1261073 - DNA, 22 bp, Artificial Sequence
  chemically synthesized
gacaccatcattgctctgagac

SEQ ID NO: 1261074 - DNA, 22 bp, Artificial Sequence
  chemically synthesized
tggatgcatttgtctcagagca

SEQ ID NO: 1261075 - DNA, 22 bp, Artificial Sequence
  chemically synthesized
agacaccatcattgctctgaga

SEQ ID NO: 1261076 - DNA, 22 bp, Artificial Sequence
  chemically synthesized
gatgcatttgtctcagagcaat

SEQ ID NO: 1261077 - DNA, 22 bp, Artificial Sequence
  chemically synthesized
caagcttagacaccatcattgc

SEQ ID NO: 1261078 - DNA, 22 bp, Artificial Sequence
  chemically synthesized
gtctcagagcaatgatggtgtc

SEQ ID NO: 1261079 - DNA, 22 bp, Artificial Sequence
  chemically synthesized
tctcagagcaatgatggtgtct

SEQ ID NO: 1261080 - DNA, 22 bp, Artificial Sequence
  chemically synthesized
agagcaatgatggtgtctaagc

SEQ ID NO: 1261081 - DNA, 22 bp, Artificial Sequence
  chemically synthesized
acagacacagaaactgcaagct

SEQ ID NO: 1261082 - DNA, 22 bp, Artificial Sequence
  chemically synthesized
cacagacacagaaactgcaagc

SEQ ID NO: 1261083 - DNA, 22 bp, Artificial Sequence
  chemically synthesized
agcttgcagtttctgtgtctgt

SEQ ID NO: 1261084 - DNA, 22 bp, Artificial Sequence
  chemically synthesized
caaatgaatttcacagacacag

SEQ ID NO: 1261085 - DNA, 22 bp, Artificial Sequence
  chemically synthesized
ctgcaaatgaatttcacagaca

SEQ ID NO: 1261086 - DNA, 22 bp, Artificial Sequence
  chemically synthesized
actgcaaatgaatttcacagac

SEQ ID NO: 1261087 - DNA, 22 bp, Artificial Sequence
  chemically synthesized
gcagtttctgtgtctgtgaaat

SEQ ID NO: 1261088 - DNA, 22 bp, Artificial Sequence
  chemically synthesized
cagtttctgtgtctgtgaaatt

SEQ ID NO: 1261089 - DNA, 22 bp, Artificial Sequence
  chemically synthesized
acaatttactgcaaatgaattt

SEQ ID NO: 1261090 - DNA, 22 bp, Artificial Sequence
  chemically synthesized
ctgtgtctgtgaaattcatttg

SEQ ID NO: 1261091 - DNA, 22 bp, Artificial Sequence
  chemically synthesized
tgtgtctgtgaaattcatttgc

SEQ ID NO: 1261092 - DNA, 22 bp, Artificial Sequence
  chemically synthesized
ttcacaatttactgcaaatgaa

SEQ ID NO: 1261093 - DNA, 22 bp, Artificial Sequence
  chemically synthesized
tgtctgtgaaattcatttgcag

SEQ ID NO: 1261094 - DNA, 22 bp, Artificial Sequence
  chemically synthesized
attcacaatttactgcaaatga

SEQ ID NO: 1261095 - DNA, 22 bp, Artificial Sequence
  chemically synthesized
tttattcacaatttactgcaaa

SEQ ID NO: 1261096 - DNA, 22 bp, Artificial Sequence
  chemically synthesized
atttattcacaatttactgcaa

SEQ ID NO: 1261097 - DNA, 22 bp, Artificial Sequence
  chemically synthesized
tgaaattcatttgcagtaaatt

SEQ ID NO: 1261098 - DNA, 22 bp, Artificial Sequence
  chemically synthesized
catttatttattcacaatttac

SEQ ID NO: 1261099 - DNA, 22 bp, Artificial Sequence
  chemically synthesized
ctgcatttatttattcacaatt

SEQ ID NO: 1261100 - DNA, 22 bp, Artificial Sequence
  chemically synthesized
actgcatttatttattcacaat

SEQ ID NO: 1261101 - DNA, 22 bp, Artificial Sequence
  chemically synthesized
atttgcagtaaattgtgaataa

SEQ ID NO: 1261102 - DNA, 22 bp, Artificial Sequence
  chemically synthesized
tactgcatttatttattcacaa

SEQ ID NO: 1261103 - DNA, 22 bp, Artificial Sequence
  chemically synthesized
ttactgcatttatttattcaca

SEQ ID NO: 1261104 - DNA, 22 bp, Artificial Sequence
  chemically synthesized
tttactgcatttatttattcac

SEQ ID NO: 1261105 - DNA, 22 bp, Artificial Sequence
  chemically synthesized
gcagtaaattgtgaataaataa

SEQ ID NO: 1261106 - DNA, 22 bp, Artificial Sequence
  chemically synthesized
cagtaaattgtgaataaataaa

SEQ ID NO: 1261107 - DNA, 22 bp, Artificial Sequence
  chemically synthesized
ggctttttactgcatttattta

SEQ ID NO: 1261108 - DNA, 22 bp, Artificial Sequence
  chemically synthesized
tgaataaataaatgcagtaaaa

SEQ ID NO: 1261109 - DNA, 22 bp, Artificial Sequence
  chemically synthesized
caaggagcctaggctttttact

SEQ ID NO: 1261110 - DNA, 22 bp, Artificial Sequence
  chemically synthesized
tccaaggagcctaggcttttta

SEQ ID NO: 1261111 - DNA, 22 bp, Artificial Sequence
  chemically synthesized
ggctccttggagagtctacatt

SEQ ID NO: 1261112 - DNA, 22 bp, Artificial Sequence
  chemically synthesized
cttggagagtctacattctcct

SEQ ID NO: 1261113 - DNA, 22 bp, Artificial Sequence
  chemically synthesized
ggagagtctacattctcctccc

SEQ ID NO: 1261114 - DNA, 22 bp, Artificial Sequence
  chemically synthesized
gagagtctacattctcctccct

SEQ ID NO: 1261115 - DNA, 22 bp, Artificial Sequence
  chemically synthesized
cattctcctccctcccatctct

SEQ ID NO: 1261116 - DNA, 22 bp, Artificial Sequence
  chemically synthesized
tcctccctcccatctctttctc

SEQ ID NO: 1261117 - DNA, 22 bp, Artificial Sequence
  chemically synthesized
ctccctcccatctctttctctc

SEQ ID NO: 1261118 - DNA, 22 bp, Artificial Sequence
  chemically synthesized
cctcccatctctttctctcttc

SEQ ID NO: 1261119 - DNA, 22 bp, Artificial Sequence
  chemically synthesized
ccatctctttctctcttcttct

SEQ ID NO: 1261120 - DNA, 22 bp, Artificial Sequence
  chemically synthesized
tttctctcttcttctctcctac

SEQ ID NO: 1261121 - DNA, 22 bp, Artificial Sequence
  chemically synthesized
tctctcttcttctctcctaccc

SEQ ID NO: 1261122 - DNA, 22 bp, Artificial Sequence
  chemically synthesized
ctctcttcttctctcctaccct

SEQ ID NO: 1261123 - DNA, 22 bp, Artificial Sequence
  chemically synthesized
tctcttcttctctcctaccctc

SEQ ID NO: 1261124 - DNA, 22 bp, Artificial Sequence
  chemically synthesized
tcttcttctctcctaccctctc

SEQ ID NO: 1261125 - DNA, 22 bp, Artificial Sequence
  chemically synthesized
ttcttctctcctaccctctcat

SEQ ID NO: 1261126 - DNA, 22 bp, Artificial Sequence
  chemically synthesized
cttctctcctaccctctcatcc

SEQ ID NO: 1261127 - DNA, 22 bp, Artificial Sequence
  chemically synthesized
ttctctcctaccctctcatcct

SEQ ID NO: 1261128 - DNA, 22 bp, Artificial Sequence
  chemically synthesized
ctctcctaccctctcatcctcc

SEQ ID NO: 1261129 - DNA, 22 bp, Artificial Sequence
  chemically synthesized
tctcctaccctctcatcctcca

SEQ ID NO: 1261130 - DNA, 22 bp, Artificial Sequence
  chemically synthesized
tcctaccctctcatcctccatc

SEQ ID NO: 1261131 - DNA, 22 bp, Artificial Sequence
  chemically synthesized
ctaccctctcatcctccatctg

SEQ ID NO: 1261132 - DNA, 22 bp, Artificial Sequence
  chemically synthesized
ccctctcatcctccatctgtcc

SEQ ID NO: 1261133 - DNA, 22 bp, Artificial Sequence
  chemically synthesized
tcatcctccatctgtccctttc

SEQ ID NO: 1261134 - DNA, 22 bp, Artificial Sequence
  chemically synthesized
atcctccatctgtccctttccc

SEQ ID NO: 1261135 - DNA, 22 bp, Artificial Sequence
  chemically synthesized
catctgtccctttccctatcct

SEQ ID NO: 1261136 - DNA, 22 bp, Artificial Sequence
  chemically synthesized
ccatgtgtgataagaaggatag

SEQ ID NO: 1261137 - DNA, 22 bp, Artificial Sequence
  chemically synthesized
cccatgtgtgataagaaggata

SEQ ID NO: 1261138 - DNA, 22 bp, Artificial Sequence
  chemically synthesized
tcccatgtgtgataagaaggat

SEQ ID NO: 1261139 - DNA, 22 bp, Artificial Sequence
  chemically synthesized
tccctttccctatccttcttat

SEQ ID NO: 1261140 - DNA, 22 bp, Artificial Sequence
  chemically synthesized
ttcccatgtgtgataagaagga

SEQ ID NO: 1261141 - DNA, 22 bp, Artificial Sequence
  chemically synthesized
agtttttcccatgtgtgataag

SEQ ID NO: 1261142 - DNA, 22 bp, Artificial Sequence
  chemically synthesized
tccctatccttcttatcacaca

SEQ ID NO: 1261143 - DNA, 22 bp, Artificial Sequence
  chemically synthesized
ccctatccttcttatcacacat

SEQ ID NO: 1261144 - DNA, 22 bp, Artificial Sequence
  chemically synthesized
cctatccttcttatcacacatg

SEQ ID NO: 1261145 - DNA, 22 bp, Artificial Sequence
  chemically synthesized
aattgagtttttcccatgtgtg

SEQ ID NO: 1261146 - DNA, 22 bp, Artificial Sequence
  chemically synthesized
tccttcttatcacacatgggaa

SEQ ID NO: 1261147 - DNA, 22 bp, Artificial Sequence
  chemically synthesized
attcaattgagtttttcccatg

SEQ ID NO: 1261148 - DNA, 22 bp, Artificial Sequence
  chemically synthesized
aattcaattgagtttttcccat

SEQ ID NO: 1261149 - DNA, 22 bp, Artificial Sequence
  chemically synthesized
cttatcacacatgggaaaaact

SEQ ID NO: 1261150 - DNA, 22 bp, Artificial Sequence
  chemically synthesized
ttatcacacatgggaaaaactc

SEQ ID NO: 1261151 - DNA, 22 bp, Artificial Sequence
  chemically synthesized
atcacacatgggaaaaactcaa

SEQ ID NO: 1261152 - DNA, 22 bp, Artificial Sequence
  chemically synthesized
aatttaattcaattgagttttt

SEQ ID NO: 1261153 - DNA, 22 bp, Artificial Sequence
  chemically synthesized
tcacacatgggaaaaactcaat

SEQ ID NO: 1261154 - DNA, 22 bp, Artificial Sequence
  chemically synthesized
gtagactgaatttaattcaatt

SEQ ID NO: 1261155 - DNA, 22 bp, Artificial Sequence
  chemically synthesized
tggtagactgaatttaattcaa

SEQ ID NO: 1261156 - DNA, 22 bp, Artificial Sequence
  chemically synthesized
ctggtagactgaatttaattca

SEQ ID NO: 1261157 - DNA, 22 bp, Artificial Sequence
  chemically synthesized
tatacttctggtagactgaatt

SEQ ID NO: 1261158 - DNA, 22 bp, Artificial Sequence
  chemically synthesized
aattgaattaaattcagtctac

SEQ ID NO: 1261159 - DNA, 22 bp, Artificial Sequence
  chemically synthesized
aattgtatacttctggtagact

SEQ ID NO: 1261160 - DNA, 22 bp, Artificial Sequence
  chemically synthesized
aattaaattcagtctaccagaa

SEQ ID NO: 1261161 - DNA, 22 bp, Artificial Sequence
  chemically synthesized
aattcagtctaccagaagtata

SEQ ID NO: 1261162 - DNA, 22 bp, Artificial Sequence
  chemically synthesized
tcaaaaattcaattgtatactt

SEQ ID NO: 1261163 - DNA, 22 bp, Artificial Sequence
  chemically synthesized
atcaaaaattcaattgtatact

SEQ ID NO: 1261164 - DNA, 22 bp, Artificial Sequence
  chemically synthesized
agtctaccagaagtatacaatt

SEQ ID NO: 1261165 - DNA, 22 bp, Artificial Sequence
  chemically synthesized
ccagaagtatacaattgaattt

SEQ ID NO: 1261166 - DNA, 22 bp, Artificial Sequence
  chemically synthesized
gtgtgtttatcaaaaattcaat

SEQ ID NO: 1261167 - DNA, 22 bp, Artificial Sequence
  chemically synthesized
tggtgtgtttatcaaaaattca

SEQ ID NO: 1261168 - DNA, 22 bp, Artificial Sequence
  chemically synthesized
ctggtgtgtttatcaaaaattc

SEQ ID NO: 1261169 - DNA, 22 bp, Artificial Sequence
  chemically synthesized
atttctggtgtgtttatcaaaa

SEQ ID NO: 1261170 - DNA, 22 bp, Artificial Sequence
  chemically synthesized
aatttttgataaacacaccaga

SEQ ID NO: 1261171 - DNA, 22 bp, Artificial Sequence
  chemically synthesized
ttgataaacacaccagaaatta

SEQ ID NO: 1261172 - DNA, 22 bp, Artificial Sequence
  chemically synthesized
tgataaacacaccagaaattag

SEQ ID NO: 1261173 - DNA, 22 bp, Artificial Sequence
  chemically synthesized
gataaacacaccagaaattaga

SEQ ID NO: 1261174 - DNA, 22 bp, Artificial Sequence
  chemically synthesized
ataaacacaccagaaattagat

SEQ ID NO: 1261175 - DNA, 22 bp, Artificial Sequence
  chemically synthesized
gatgtgtatgttcatttattcc

SEQ ID NO: 1261176 - DNA, 22 bp, Artificial Sequence
  chemically synthesized
aacaaatatgtgcggaaggaat

SEQ ID NO: 1261177 - DNA, 22 bp, Artificial Sequence
  chemically synthesized
atttattccttccgcacatatt

SEQ ID NO: 1261178 - DNA, 22 bp, Artificial Sequence
  chemically synthesized
attccttccgcacatatttgtt

SEQ ID NO: 1261179 - DNA, 22 bp, Artificial Sequence
  chemically synthesized
ttccttccgcacatatttgttg

SEQ ID NO: 1261180 - DNA, 22 bp, Artificial Sequence
  chemically synthesized
cttccgcacatatttgttgaat

SEQ ID NO: 1261181 - DNA, 22 bp, Artificial Sequence
  chemically synthesized
ccgcacatatttgttgaatgtt

SEQ ID NO: 1261182 - DNA, 22 bp, Artificial Sequence
  chemically synthesized
cgcacatatttgttgaatgttt

SEQ ID NO: 1261183 - DNA, 22 bp, Artificial Sequence
  chemically synthesized
atccatagtgtggcatgaagta

SEQ ID NO: 1261184 - DNA, 22 bp, Artificial Sequence
  chemically synthesized
gatccatagtgtggcatgaagt

SEQ ID NO: 1261185 - DNA, 22 bp, Artificial Sequence
  chemically synthesized
gttgaatgtttacttcatgcca

SEQ ID NO: 1261186 - DNA, 22 bp, Artificial Sequence
  chemically synthesized
ttgaatgtttacttcatgccac

SEQ ID NO: 1261187 - DNA, 22 bp, Artificial Sequence
  chemically synthesized
cttgatccatagtgtggcatga

SEQ ID NO: 1261188 - DNA, 22 bp, Artificial Sequence
  chemically synthesized
aatgtttacttcatgccacact

SEQ ID NO: 1261189 - DNA, 22 bp, Artificial Sequence
  chemically synthesized
actgcttgatccatagtgtggc

SEQ ID NO: 1261190 - DNA, 22 bp, Artificial Sequence
  chemically synthesized
cactgcttgatccatagtgtgg

SEQ ID NO: 1261191 - DNA, 22 bp, Artificial Sequence
  chemically synthesized
acttcatgccacactatggatc

SEQ ID NO: 1261192 - DNA, 22 bp, Artificial Sequence
  chemically synthesized
tcttcactgcttgatccatagt

SEQ ID NO: 1261193 - DNA, 22 bp, Artificial Sequence
  chemically synthesized
cttcatgccacactatggatca

SEQ ID NO: 1261194 - DNA, 22 bp, Artificial Sequence
  chemically synthesized
atcttcactgcttgatccatag

SEQ ID NO: 1261195 - DNA, 22 bp, Artificial Sequence
  chemically synthesized
tatcttcactgcttgatccata

SEQ ID NO: 1261196 - DNA, 22 bp, Artificial Sequence
  chemically synthesized
catgccacactatggatcaagc

SEQ ID NO: 1261197 - DNA, 22 bp, Artificial Sequence
  chemically synthesized
atgccacactatggatcaagca

SEQ ID NO: 1261198 - DNA, 22 bp, Artificial Sequence
  chemically synthesized
ttttatcttcactgcttgatcc

SEQ ID NO: 1261199 - DNA, 22 bp, Artificial Sequence
  chemically synthesized
ctgttttatcttcactgcttga

SEQ ID NO: 1261200 - DNA, 22 bp, Artificial Sequence
  chemically synthesized
actgttttatcttcactgcttg

SEQ ID NO: 1261201 - DNA, 22 bp, Artificial Sequence
  chemically synthesized
tttactgttttatcttcactgc

SEQ ID NO: 1261202 - DNA, 22 bp, Artificial Sequence
  chemically synthesized
gtttactgttttatcttcactg

SEQ ID NO: 1261203 - DNA, 22 bp, Artificial Sequence
  chemically synthesized
tggatcaagcagtgaagataaa

SEQ ID NO: 1261204 - DNA, 22 bp, Artificial Sequence
  chemically synthesized
catgtcttgtttactgttttat

SEQ ID NO: 1261205 - DNA, 22 bp, Artificial Sequence
  chemically synthesized
gcatgtcttgtttactgtttta

SEQ ID NO: 1261206 - DNA, 22 bp, Artificial Sequence
  chemically synthesized
cttgcatgtcttgtttactgtt

SEQ ID NO: 1261207 - DNA, 22 bp, Artificial Sequence
  chemically synthesized
ccttgcatgtcttgtttactgt

SEQ ID NO: 1261208 - DNA, 22 bp, Artificial Sequence
  chemically synthesized
catgagagtagtttccttgcat

SEQ ID NO: 1261209 - DNA, 22 bp, Artificial Sequence
  chemically synthesized
gaagttccatgagagtagtttc

SEQ ID NO: 1261210 - DNA, 22 bp, Artificial Sequence
  chemically synthesized
caatagattggaagttccatga

SEQ ID NO: 1261211 - DNA, 22 bp, Artificial Sequence
  chemically synthesized
cctacaatagattggaagttcc

SEQ ID NO: 1261212 - DNA, 22 bp, Artificial Sequence
  chemically synthesized
ttccctacaatagattggaagt

SEQ ID NO: 1261213 - DNA, 22 bp, Artificial Sequence
  chemically synthesized
ctctcatggaacttccaatcta

SEQ ID NO: 1261214 - DNA, 22 bp, Artificial Sequence
  chemically synthesized
ctattccctacaatagattgga

SEQ ID NO: 1261215 - DNA, 22 bp, Artificial Sequence
  chemically synthesized
gctattccctacaatagattgg

SEQ ID NO: 1261216 - DNA, 22 bp, Artificial Sequence
  chemically synthesized
tcatggaacttccaatctattg

SEQ ID NO: 1261217 - DNA, 22 bp, Artificial Sequence
  chemically synthesized
atggaacttccaatctattgta

SEQ ID NO: 1261218 - DNA, 22 bp, Artificial Sequence
  chemically synthesized
tttgctattccctacaatagat

SEQ ID NO: 1261219 - DNA, 22 bp, Artificial Sequence
  chemically synthesized
atttgctattccctacaataga

SEQ ID NO: 1261220 - DNA, 22 bp, Artificial Sequence
  chemically synthesized
tcatttatttgctattccctac

SEQ ID NO: 1261221 - DNA, 22 bp, Artificial Sequence
  chemically synthesized
gtcatttatttgctattcccta

SEQ ID NO: 1261222 - DNA, 22 bp, Artificial Sequence
  chemically synthesized
ccaatctattgtagggaatagc

SEQ ID NO: 1261223 - DNA, 22 bp, Artificial Sequence
  chemically synthesized
tgtcatttatttgctattccct

SEQ ID NO: 1261224 - DNA, 22 bp, Artificial Sequence
  chemically synthesized
caatctattgtagggaatagca

SEQ ID NO: 1261225 - DNA, 22 bp, Artificial Sequence
  chemically synthesized
ttttgtcatttatttgctattc

SEQ ID NO: 1261226 - DNA, 22 bp, Artificial Sequence
  chemically synthesized
ttgtagggaatagcaaataaat

SEQ ID NO: 1261227 - DNA, 22 bp, Artificial Sequence
  chemically synthesized
tgttattttgtcatttatttgc

SEQ ID NO: 1261228 - DNA, 22 bp, Artificial Sequence
  chemically synthesized
tagggaatagcaaataaatgac

SEQ ID NO: 1261229 - DNA, 22 bp, Artificial Sequence
  chemically synthesized
ggtgattatgttattttgtcat

SEQ ID NO: 1261230 - DNA, 22 bp, Artificial Sequence
  chemically synthesized
tattgggtgattatgttatttt

SEQ ID NO: 1261231 - DNA, 22 bp, Artificial Sequence
  chemically synthesized
ttatattgggtgattatgttat

SEQ ID NO: 1261232 - DNA, 22 bp, Artificial Sequence
  chemically synthesized
attatattgggtgattatgtta

SEQ ID NO: 1261233 - DNA, 22 bp, Artificial Sequence
  chemically synthesized
aataacacttattatattgggt

SEQ ID NO: 1261234 - DNA, 22 bp, Artificial Sequence
  chemically synthesized
caataacacttattatattggg

SEQ ID NO: 1261235 - DNA, 22 bp, Artificial Sequence
  chemically synthesized
ttcaataacacttattatattg

SEQ ID NO: 1261236 - DNA, 22 bp, Artificial Sequence
  chemically synthesized
cttcaataacacttattatatt

SEQ ID NO: 1261237 - DNA, 22 bp, Artificial Sequence
  chemically synthesized
tttcttcaataacacttattat

SEQ ID NO: 1261238 - DNA, 22 bp, Artificial Sequence
  chemically synthesized
atttcttcaataacacttatta

SEQ ID NO: 1261239 - DNA, 22 bp, Artificial Sequence
  chemically synthesized
tttatttcttcaataacactta

SEQ ID NO: 1261240 - DNA, 22 bp, Artificial Sequence
  chemically synthesized
gtttatttcttcaataacactt

SEQ ID NO: 1261241 - DNA, 22 bp, Artificial Sequence
  chemically synthesized
aacatcttgtttatttcttcaa

SEQ ID NO: 1261242 - DNA, 22 bp, Artificial Sequence
  chemically synthesized
tctgaacatcttgtttatttct

SEQ ID NO: 1261243 - DNA, 22 bp, Artificial Sequence
  chemically synthesized
tatctgaacatcttgtttattt

SEQ ID NO: 1261244 - DNA, 22 bp, Artificial Sequence
  chemically synthesized
ctatctgaacatcttgtttatt

SEQ ID NO: 1261245 - DNA, 22 bp, Artificial Sequence
  chemically synthesized
tctatctgaacatcttgtttat

SEQ ID NO: 1261246 - DNA, 22 bp, Artificial Sequence
  chemically synthesized
ttgaagaaataaacaagatgtt

SEQ ID NO: 1261247 - DNA, 22 bp, Artificial Sequence
  chemically synthesized
aagaaataaacaagatgttcag

SEQ ID NO: 1261248 - DNA, 22 bp, Artificial Sequence
  chemically synthesized
ggtactttctatctgaacatct

SEQ ID NO: 1261249 - DNA, 22 bp, Artificial Sequence
  chemically synthesized
aggtactttctatctgaacatc

SEQ ID NO: 1261250 - DNA, 22 bp, Artificial Sequence
  chemically synthesized
taggtactttctatctgaacat

SEQ ID NO: 1261251 - DNA, 22 bp, Artificial Sequence
  chemically synthesized
ttttaggtactttctatctgaa

SEQ ID NO: 1261252 - DNA, 22 bp, Artificial Sequence
  chemically synthesized
tattttaggtactttctatctg

SEQ ID NO: 1261253 - DNA, 22 bp, Artificial Sequence
  chemically synthesized
tctattttaggtactttctatc

SEQ ID NO: 1261254 - DNA, 22 bp, Artificial Sequence
  chemically synthesized
gactctctattttaggtacttt

SEQ ID NO: 1261255 - DNA, 22 bp, Artificial Sequence
  chemically synthesized
cctggactctctattttaggta

SEQ ID NO: 1261256 - DNA, 22 bp, Artificial Sequence
  chemically synthesized
ccctggactctctattttaggt

SEQ ID NO: 1261257 - DNA, 22 bp, Artificial Sequence
  chemically synthesized
agatagaaagtacctaaaatag

SEQ ID NO: 1261258 - DNA, 22 bp, Artificial Sequence
  chemically synthesized
cttccctggactctctatttta

SEQ ID NO: 1261259 - DNA, 22 bp, Artificial Sequence
  chemically synthesized
tccttccctggactctctattt

SEQ ID NO: 1261260 - DNA, 22 bp, Artificial Sequence
  chemically synthesized
tctccttccctggactctctat

SEQ ID NO: 1261261 - DNA, 22 bp, Artificial Sequence
  chemically synthesized
tctctccttccctggactctct

SEQ ID NO: 1261262 - DNA, 22 bp, Artificial Sequence
  chemically synthesized
gttctctctccttccctggact

SEQ ID NO: 1261263 - DNA, 22 bp, Artificial Sequence
  chemically synthesized
aaatagagagtccagggaagga

SEQ ID NO: 1261264 - DNA, 22 bp, Artificial Sequence
  chemically synthesized
tgaaatccagactagttctctc

SEQ ID NO: 1261265 - DNA, 22 bp, Artificial Sequence
  chemically synthesized
actatgaaatccagactagttc

SEQ ID NO: 1261266 - DNA, 22 bp, Artificial Sequence
  chemically synthesized
gactatgaaatccagactagtt

SEQ ID NO: 1261267 - DNA, 22 bp, Artificial Sequence
  chemically synthesized
tgactatgaaatccagactagt

SEQ ID NO: 1261268 - DNA, 22 bp, Artificial Sequence
  chemically synthesized
tttgactatgaaatccagacta

SEQ ID NO: 1261269 - DNA, 22 bp, Artificial Sequence
  chemically synthesized
ctttgactatgaaatccagact

SEQ ID NO: 1261270 - DNA, 22 bp, Artificial Sequence
  chemically synthesized
gtctggatttcatagtcaaaga

SEQ ID NO: 1261271 - DNA, 22 bp, Artificial Sequence
  chemically synthesized
gatttcatagtcaaagaaggtg

SEQ ID NO: 1261272 - DNA, 22 bp, Artificial Sequence
  chemically synthesized
cacatccaaaaaaacaccttct

SEQ ID NO: 1261273 - DNA, 22 bp, Artificial Sequence
  chemically synthesized
catagtcaaagaaggtgttttt

SEQ ID NO: 1261274 - DNA, 22 bp, Artificial Sequence
  chemically synthesized
atagtcaaagaaggtgtttttt

SEQ ID NO: 1261275 - DNA, 22 bp, Artificial Sequence
  chemically synthesized
attgcacatccaaaaaaacacc

SEQ ID NO: 1261276 - DNA, 22 bp, Artificial Sequence
  chemically synthesized
aattgcacatccaaaaaaacac

SEQ ID NO: 1261277 - DNA, 22 bp, Artificial Sequence
  chemically synthesized
tttaattgcacatccaaaaaaa

SEQ ID NO: 1261278 - DNA, 22 bp, Artificial Sequence
  chemically synthesized
aaatctgtttaattgcacatcc

SEQ ID NO: 1261279 - DNA, 22 bp, Artificial Sequence
  chemically synthesized
caaatctgtttaattgcacatc

SEQ ID NO: 1261280 - DNA, 22 bp, Artificial Sequence
  chemically synthesized
atccttcaaatctgtttaattg

SEQ ID NO: 1261281 - DNA, 22 bp, Artificial Sequence
  chemically synthesized
ttttggatgtgcaattaaacag

SEQ ID NO: 1261282 - DNA, 22 bp, Artificial Sequence
  chemically synthesized
catccttcaaatctgtttaatt

SEQ ID NO: 1261283 - DNA, 22 bp, Artificial Sequence
  chemically synthesized
tttggatgtgcaattaaacaga

SEQ ID NO: 1261284 - DNA, 22 bp, Artificial Sequence
  chemically synthesized
tcatccttcaaatctgtttaat

SEQ ID NO: 1261285 - DNA, 22 bp, Artificial Sequence
  chemically synthesized
ttggatgtgcaattaaacagat

SEQ ID NO: 1261286 - DNA, 22 bp, Artificial Sequence
  chemically synthesized
tggatgtgcaattaaacagatt

SEQ ID NO: 1261287 - DNA, 22 bp, Artificial Sequence
  chemically synthesized
ggatgtgcaattaaacagattt

SEQ ID NO: 1261288 - DNA, 22 bp, Artificial Sequence
  chemically synthesized
gatgtgcaattaaacagatttg

SEQ ID NO: 1261289 - DNA, 22 bp, Artificial Sequence
  chemically synthesized
aacagatttgaaggatgaaaat

SEQ ID NO: 1261290 - DNA, 22 bp, Artificial Sequence
  chemically synthesized
catgatggaataattttcatcc

SEQ ID NO: 1261291 - DNA, 22 bp, Artificial Sequence
  chemically synthesized
gcatgatggaataattttcatc

SEQ ID NO: 1261292 - DNA, 22 bp, Artificial Sequence
  chemically synthesized
tgcatgatggaataattttcat

SEQ ID NO: 1261293 - DNA, 22 bp, Artificial Sequence
  chemically synthesized
ttttgcatgatggaataatttt

SEQ ID NO: 1261294 - DNA, 22 bp, Artificial Sequence
  chemically synthesized
ttattttgcatgatggaataat

SEQ ID NO: 1261295 - DNA, 22 bp, Artificial Sequence
  chemically synthesized
gaaggatgaaaattattccatc

SEQ ID NO: 1261296 - DNA, 22 bp, Artificial Sequence
  chemically synthesized
aaggatgaaaattattccatca

SEQ ID NO: 1261297 - DNA, 22 bp, Artificial Sequence
  chemically synthesized
tgctattattttgcatgatgga

SEQ ID NO: 1261298 - DNA, 22 bp, Artificial Sequence
  chemically synthesized
gtgctattattttgcatgatgg

SEQ ID NO: 1261299 - DNA, 22 bp, Artificial Sequence
  chemically synthesized
gacaaacttgtgctattatttt

SEQ ID NO: 1261300 - DNA, 22 bp, Artificial Sequence
  chemically synthesized
ttccatcatgcaaaataatagc

SEQ ID NO: 1261301 - DNA, 22 bp, Artificial Sequence
  chemically synthesized
ctggacaaacttgtgctattat

SEQ ID NO: 1261302 - DNA, 22 bp, Artificial Sequence
  chemically synthesized
catcatgcaaaataatagcaca

SEQ ID NO: 1261303 - DNA, 22 bp, Artificial Sequence
  chemically synthesized
cctggacaaacttgtgctatta

SEQ ID NO: 1261304 - DNA, 22 bp, Artificial Sequence
  chemically synthesized
tcctggacaaacttgtgctatt

SEQ ID NO: 1261305 - DNA, 22 bp, Artificial Sequence
  chemically synthesized
tttcctggacaaacttgtgcta

SEQ ID NO: 1261306 - DNA, 22 bp, Artificial Sequence
  chemically synthesized
caaaggctctttcctggacaaa

SEQ ID NO: 1261307 - DNA, 22 bp, Artificial Sequence
  chemically synthesized
gcaaaggctctttcctggacaa

SEQ ID NO: 1261308 - DNA, 22 bp, Artificial Sequence
  chemically synthesized
gtccaggaaagagcctttgcaa

SEQ ID NO: 1261309 - DNA, 22 bp, Artificial Sequence
  chemically synthesized
tccaggaaagagcctttgcaaa

SEQ ID NO: 1261310 - DNA, 22 bp, Artificial Sequence
  chemically synthesized
catcccagggaatttgcaaagg

SEQ ID NO: 1261311 - DNA, 22 bp, Artificial Sequence
  chemically synthesized
ttccatcccagggaatttgcaa

SEQ ID NO: 1261312 - DNA, 22 bp, Artificial Sequence
  chemically synthesized
tattccatcccagggaatttgc

SEQ ID NO: 1261313 - DNA, 22 bp, Artificial Sequence
  chemically synthesized
tgcaaattccctgggatggaat

SEQ ID NO: 1261314 - DNA, 22 bp, Artificial Sequence
  chemically synthesized
gcaaattccctgggatggaata

SEQ ID NO: 1261315 - DNA, 22 bp, Artificial Sequence
  chemically synthesized
caaattccctgggatggaatag

SEQ ID NO: 1261316 - DNA, 22 bp, Artificial Sequence
  chemically synthesized
cctgggatggaatagaggcctt

SEQ ID NO: 1261317 - DNA, 22 bp, Artificial Sequence
  chemically synthesized
caaacagtaatgaaggcctcta

SEQ ID NO: 1261318 - DNA, 22 bp, Artificial Sequence
  chemically synthesized
ggatggaatagaggccttcatt

SEQ ID NO: 1261319 - DNA, 22 bp, Artificial Sequence
  chemically synthesized
aagagagaagttccaaacagta

SEQ ID NO: 1261320 - DNA, 22 bp, Artificial Sequence
  chemically synthesized
cattactgtttggaacttctct

SEQ ID NO: 1261321 - DNA, 22 bp, Artificial Sequence
  chemically synthesized
attactgtttggaacttctctc

SEQ ID NO: 1261322 - DNA, 22 bp, Artificial Sequence
  chemically synthesized
caaaggtagattgaagagagaa

SEQ ID NO: 1261323 - DNA, 22 bp, Artificial Sequence
  chemically synthesized
ctgtttggaacttctctcttca

SEQ ID NO: 1261324 - DNA, 22 bp, Artificial Sequence
  chemically synthesized
tttggaacttctctcttcaatc

SEQ ID NO: 1261325 - DNA, 22 bp, Artificial Sequence
  chemically synthesized
ggctacaaaggtagattgaaga

SEQ ID NO: 1261326 - DNA, 22 bp, Artificial Sequence
  chemically synthesized
aggctacaaaggtagattgaag

SEQ ID NO: 1261327 - DNA, 22 bp, Artificial Sequence
  chemically synthesized
ggaacttctctcttcaatctac

SEQ ID NO: 1261328 - DNA, 22 bp, Artificial Sequence
  chemically synthesized
taggctacaaaggtagattgaa

SEQ ID NO: 1261329 - DNA, 22 bp, Artificial Sequence
  chemically synthesized
gaacttctctcttcaatctacc

SEQ ID NO: 1261330 - DNA, 22 bp, Artificial Sequence
  chemically synthesized
ttaggctacaaaggtagattga

SEQ ID NO: 1261331 - DNA, 22 bp, Artificial Sequence
  chemically synthesized
ctctcttcaatctacctttgta

SEQ ID NO: 1261332 - DNA, 22 bp, Artificial Sequence
  chemically synthesized
tctcttcaatctacctttgtag

SEQ ID NO: 1261333 - DNA, 22 bp, Artificial Sequence
  chemically synthesized
tcttcaatctacctttgtagcc

SEQ ID NO: 1261334 - DNA, 22 bp, Artificial Sequence
  chemically synthesized
aaaatgccttttaggctacaaa

SEQ ID NO: 1261335 - DNA, 22 bp, Artificial Sequence
  chemically synthesized
ttcaatctacctttgtagccta

SEQ ID NO: 1261336 - DNA, 22 bp, Artificial Sequence
  chemically synthesized
aaaaatgccttttaggctacaa

SEQ ID NO: 1261337 - DNA, 22 bp, Artificial Sequence
  chemically synthesized
caatctacctttgtagcctaaa

SEQ ID NO: 1261338 - DNA, 22 bp, Artificial Sequence
  chemically synthesized
aatctacctttgtagcctaaaa

SEQ ID NO: 1261339 - DNA, 22 bp, Artificial Sequence
  chemically synthesized
cctttgtagcctaaaaggcatt

SEQ ID NO: 1261340 - DNA, 22 bp, Artificial Sequence
  chemically synthesized
accatatttaaaaatgcctttt

SEQ ID NO: 1261341 - DNA, 22 bp, Artificial Sequence
  chemically synthesized
gaccatatttaaaaatgccttt

SEQ ID NO: 1261342 - DNA, 22 bp, Artificial Sequence
  chemically synthesized
ttgaccatatttaaaaatgcct

SEQ ID NO: 1261343 - DNA, 22 bp, Artificial Sequence
  chemically synthesized
tgtagcctaaaaggcattttta

SEQ ID NO: 1261344 - DNA, 22 bp, Artificial Sequence
  chemically synthesized
gtagcctaaaaggcatttttaa

SEQ ID NO: 1261345 - DNA, 22 bp, Artificial Sequence
  chemically synthesized
tagcctaaaaggcatttttaaa

SEQ ID NO: 1261346 - DNA, 22 bp, Artificial Sequence
  chemically synthesized
aacattcttgaccatatttaaa

SEQ ID NO: 1261347 - DNA, 22 bp, Artificial Sequence
  chemically synthesized
caacattcttgaccatatttaa

SEQ ID NO: 1261348 - DNA, 22 bp, Artificial Sequence
  chemically synthesized
aaaggcatttttaaatatggtc

SEQ ID NO: 1261349 - DNA, 22 bp, Artificial Sequence
  chemically synthesized
ttaaatatggtcaagaatgttg

SEQ ID NO: 1261350 - DNA, 22 bp, Artificial Sequence
  chemically synthesized
taaatatggtcaagaatgttga

SEQ ID NO: 1261351 - DNA, 22 bp, Artificial Sequence
  chemically synthesized
aaatatggtcaagaatgttgaa

SEQ ID NO: 1261352 - DNA, 22 bp, Artificial Sequence
  chemically synthesized
aatatggtcaagaatgttgaaa

SEQ ID NO: 1261353 - DNA, 22 bp, Artificial Sequence
  chemically synthesized
tcaagaaaaacagtttcaacat

SEQ ID NO: 1261354 - DNA, 22 bp, Artificial Sequence
  chemically synthesized
cactatcaagaaaaacagtttc

SEQ ID NO: 1261355 - DNA, 22 bp, Artificial Sequence
  chemically synthesized
acactatcaagaaaaacagttt

SEQ ID NO: 1261356 - DNA, 22 bp, Artificial Sequence
  chemically synthesized
tttacactatcaagaaaaacag

SEQ ID NO: 1261357 - DNA, 22 bp, Artificial Sequence
  chemically synthesized
atttacactatcaagaaaaaca

SEQ ID NO: 1261358 - DNA, 22 bp, Artificial Sequence
  chemically synthesized
aaactgtttttcttgatagtgt

SEQ ID NO: 1261359 - DNA, 22 bp, Artificial Sequence
  chemically synthesized
atacatttatttacactatcaa

SEQ ID NO: 1261360 - DNA, 22 bp, Artificial Sequence
  chemically synthesized
tttttcttgatagtgtaaataa

SEQ ID NO: 1261361 - DNA, 22 bp, Artificial Sequence
  chemically synthesized
agtagttcatacatttatttac

SEQ ID NO: 1261362 - DNA, 22 bp, Artificial Sequence
  chemically synthesized
ttcttgatagtgtaaataaatg

SEQ ID NO: 1261363 - DNA, 22 bp, Artificial Sequence
  chemically synthesized
gagtagttcatacatttattta

SEQ ID NO: 1261364 - DNA, 22 bp, Artificial Sequence
  chemically synthesized
tcttgatagtgtaaataaatgt

SEQ ID NO: 1261365 - DNA, 22 bp, Artificial Sequence
  chemically synthesized
cttgatagtgtaaataaatgta

SEQ ID NO: 1261366 - DNA, 22 bp, Artificial Sequence
  chemically synthesized
ttgatagtgtaaataaatgtat

SEQ ID NO: 1261367 - DNA, 22 bp, Artificial Sequence
  chemically synthesized
tttgagtagttcatacatttat

SEQ ID NO: 1261368 - DNA, 22 bp, Artificial Sequence
  chemically synthesized
gatagtgtaaataaatgtatga

SEQ ID NO: 1261369 - DNA, 22 bp, Artificial Sequence
  chemically synthesized
atagtgtaaataaatgtatgaa

SEQ ID NO: 1261370 - DNA, 22 bp, Artificial Sequence
  chemically synthesized
attgtttgagtagttcatacat

SEQ ID NO: 1261371 - DNA, 22 bp, Artificial Sequence
  chemically synthesized
tagctaattgtttgagtagttc

SEQ ID NO: 1261372 - DNA, 22 bp, Artificial Sequence
  chemically synthesized
tcactatagctaattgtttgag

SEQ ID NO: 1261373 - DNA, 22 bp, Artificial Sequence
  chemically synthesized
atcactatagctaattgtttga

SEQ ID NO: 1261374 - DNA, 22 bp, Artificial Sequence
  chemically synthesized
gatttatcactatagctaattg

SEQ ID NO: 1261375 - DNA, 22 bp, Artificial Sequence
  chemically synthesized
ttcgatttatcactatagctaa

SEQ ID NO: 1261376 - DNA, 22 bp, Artificial Sequence
  chemically synthesized
attcgatttatcactatagcta

SEQ ID NO: 1261377 - DNA, 22 bp, Artificial Sequence
  chemically synthesized
ctcaaacaattagctatagtga

SEQ ID NO: 1261378 - DNA, 22 bp, Artificial Sequence
  chemically synthesized
aaacaattagctatagtgataa

SEQ ID NO: 1261379 - DNA, 22 bp, Artificial Sequence
  chemically synthesized
ccaacttattcgatttatcact

SEQ ID NO: 1261380 - DNA, 22 bp, Artificial Sequence
  chemically synthesized
gctatagtgataaatcgaataa

SEQ ID NO: 1261381 - DNA, 22 bp, Artificial Sequence
  chemically synthesized
aaacctaccaacttattcgatt

SEQ ID NO: 1261382 - DNA, 22 bp, Artificial Sequence
  chemically synthesized
tagtgataaatcgaataagttg

SEQ ID NO: 1261383 - DNA, 22 bp, Artificial Sequence
  chemically synthesized
tccagcatattcaaacctacca

SEQ ID NO: 1261384 - DNA, 22 bp, Artificial Sequence
  chemically synthesized
gtaggtttgaatatgctggata

SEQ ID NO: 1261385 - DNA, 22 bp, Artificial Sequence
  chemically synthesized
gaatatgctggataacactgtt

SEQ ID NO: 1261386 - DNA, 22 bp, Artificial Sequence
  chemically synthesized
ggtggtatcagaaacagtgtta

SEQ ID NO: 1261387 - DNA, 22 bp, Artificial Sequence
  chemically synthesized
aatatgctggataacactgttt

SEQ ID NO: 1261388 - DNA, 22 bp, Artificial Sequence
  chemically synthesized
taggtggtatcagaaacagtgt

SEQ ID NO: 1261389 - DNA, 22 bp, Artificial Sequence
  chemically synthesized
gataacactgtttctgatacca

SEQ ID NO: 1261390 - DNA, 22 bp, Artificial Sequence
  chemically synthesized
tttctgataccacctagagact

SEQ ID NO: 1261391 - DNA, 22 bp, Artificial Sequence
  chemically synthesized
acagatgggaaccagtctctag

SEQ ID NO: 1261392 - DNA, 22 bp, Artificial Sequence
  chemically synthesized
ctgataccacctagagactggt

SEQ ID NO: 1261393 - DNA, 22 bp, Artificial Sequence
  chemically synthesized
tgataccacctagagactggtt

SEQ ID NO: 1261394 - DNA, 22 bp, Artificial Sequence
  chemically synthesized
ataccacctagagactggttcc

SEQ ID NO: 1261395 - DNA, 22 bp, Artificial Sequence
  chemically synthesized
taaccagttgacagatgggaac

SEQ ID NO: 1261396 - DNA, 22 bp, Artificial Sequence
  chemically synthesized
ataaccagttgacagatgggaa

SEQ ID NO: 1261397 - DNA, 22 bp, Artificial Sequence
  chemically synthesized
tataaccagttgacagatggga

SEQ ID NO: 1261398 - DNA, 22 bp, Artificial Sequence
  chemically synthesized
gagactggttcccatctgtcaa

SEQ ID NO: 1261399 - DNA, 22 bp, Artificial Sequence
  chemically synthesized
ttttataaccagttgacagatg

SEQ ID NO: 1261400 - DNA, 22 bp, Artificial Sequence
  chemically synthesized
gttcccatctgtcaactggtta

SEQ ID NO: 1261401 - DNA, 22 bp, Artificial Sequence
  chemically synthesized
caaaattgttttataaccagtt

SEQ ID NO: 1261402 - DNA, 22 bp, Artificial Sequence
  chemically synthesized
ccaaaattgttttataaccagt

SEQ ID NO: 1261403 - DNA, 22 bp, Artificial Sequence
  chemically synthesized
ccatctgtcaactggttataaa

SEQ ID NO: 1261404 - DNA, 22 bp, Artificial Sequence
  chemically synthesized
cttccaaaattgttttataacc

SEQ ID NO: 1261405 - DNA, 22 bp, Artificial Sequence
  chemically synthesized
tcaactggttataaaacaattt

SEQ ID NO: 1261406 - DNA, 22 bp, Artificial Sequence
  chemically synthesized
taatattccttccaaaattgtt

SEQ ID NO: 1261407 - DNA, 22 bp, Artificial Sequence
  chemically synthesized
gttataaaacaattttggaagg

SEQ ID NO: 1261408 - DNA, 22 bp, Artificial Sequence
  chemically synthesized
caagttataatattccttccaa

SEQ ID NO: 1261409 - DNA, 22 bp, Artificial Sequence
  chemically synthesized
gcaagttataatattccttcca

SEQ ID NO: 1261410 - DNA, 22 bp, Artificial Sequence
  chemically synthesized
taaaacaattttggaaggaata

SEQ ID NO: 1261411 - DNA, 22 bp, Artificial Sequence
  chemically synthesized
tgcaagttataatattccttcc

SEQ ID NO: 1261412 - DNA, 22 bp, Artificial Sequence
  chemically synthesized
tttgcaagttataatattcctt

SEQ ID NO: 1261413 - DNA, 22 bp, Artificial Sequence
  chemically synthesized
ctttgcaagttataatattcct

SEQ ID NO: 1261414 - DNA, 22 bp, Artificial Sequence
  chemically synthesized
tctttgcaagttataatattcc

SEQ ID NO: 1261415 - DNA, 22 bp, Artificial Sequence
  chemically synthesized
gttttctttgcaagttataata

SEQ ID NO: 1261416 - DNA, 22 bp, Artificial Sequence
  chemically synthesized
tggaaggaatattataacttgc

SEQ ID NO: 1261417 - DNA, 22 bp, Artificial Sequence
  chemically synthesized
ttcgttttctttgcaagttata

SEQ ID NO: 1261418 - DNA, 22 bp, Artificial Sequence
  chemically synthesized
ggaaggaatattataacttgca

SEQ ID NO: 1261419 - DNA, 22 bp, Artificial Sequence
  chemically synthesized
gaaggaatattataacttgcaa

SEQ ID NO: 1261420 - DNA, 22 bp, Artificial Sequence
  chemically synthesized
tgttcgttttctttgcaagtta

SEQ ID NO: 1261421 - DNA, 22 bp, Artificial Sequence
  chemically synthesized
aattctgttcgttttctttgca

SEQ ID NO: 1261422 - DNA, 22 bp, Artificial Sequence
  chemically synthesized
tgaattctgttcgttttctttg

SEQ ID NO: 1261423 - DNA, 22 bp, Artificial Sequence
  chemically synthesized
tctgaattctgttcgttttctt

SEQ ID NO: 1261424 - DNA, 22 bp, Artificial Sequence
  chemically synthesized
ctctgaattctgttcgttttct

SEQ ID NO: 1261425 - DNA, 22 bp, Artificial Sequence
  chemically synthesized
tctctgaattctgttcgttttc

SEQ ID NO: 1261426 - DNA, 22 bp, Artificial Sequence
  chemically synthesized
taacttgcaaagaaaacgaaca

SEQ ID NO: 1261427 - DNA, 22 bp, Artificial Sequence
  chemically synthesized
ttctctgaattctgttcgtttt

SEQ ID NO: 1261428 - DNA, 22 bp, Artificial Sequence
  chemically synthesized
tttctctgaattctgttcgttt

SEQ ID NO: 1261429 - DNA, 22 bp, Artificial Sequence
  chemically synthesized
ctttttctctgaattctgttcg

SEQ ID NO: 1261430 - DNA, 22 bp, Artificial Sequence
  chemically synthesized
gcaaagaaaacgaacagaattc

SEQ ID NO: 1261431 - DNA, 22 bp, Artificial Sequence
  chemically synthesized
caaagaaaacgaacagaattca

SEQ ID NO: 1261432 - DNA, 22 bp, Artificial Sequence
  chemically synthesized
ttactttttctctgaattctgt

SEQ ID NO: 1261433 - DNA, 22 bp, Artificial Sequence
  chemically synthesized
gttactttttctctgaattctg

SEQ ID NO: 1261434 - DNA, 22 bp, Artificial Sequence
  chemically synthesized
tgttactttttctctgaattct

SEQ ID NO: 1261435 - DNA, 22 bp, Artificial Sequence
  chemically synthesized
ttgttactttttctctgaattc

SEQ ID NO: 1261436 - DNA, 22 bp, Artificial Sequence
  chemically synthesized
agagcaatttttgttacttttt

SEQ ID NO: 1261437 - DNA, 22 bp, Artificial Sequence
  chemically synthesized
aagagcaatttttgttactttt

SEQ ID NO: 1261438 - DNA, 22 bp, Artificial Sequence
  chemically synthesized
agagaaaaagtaacaaaaattg

SEQ ID NO: 1261439 - DNA, 22 bp, Artificial Sequence
  chemically synthesized
aaatatttaagagcaatttttg

SEQ ID NO: 1261440 - DNA, 22 bp, Artificial Sequence
  chemically synthesized
caaatatttaagagcaattttt

SEQ ID NO: 1261441 - DNA, 22 bp, Artificial Sequence
  chemically synthesized
tcaaatatttaagagcaatttt

SEQ ID NO: 1261442 - DNA, 22 bp, Artificial Sequence
  chemically synthesized
ctcttaaatatttgaaaatatg

SEQ ID NO: 1261443 - DNA, 22 bp, Artificial Sequence
  chemically synthesized
ttaaatatttgaaaatatgttc

SEQ ID NO: 1261444 - DNA, 22 bp, Artificial Sequence
  chemically synthesized
aggaatgaggatgaacatattt

SEQ ID NO: 1261445 - DNA, 22 bp, Artificial Sequence
  chemically synthesized
aaatatttgaaaatatgttcat

SEQ ID NO: 1261446 - DNA, 22 bp, Artificial Sequence
  chemically synthesized
aatatttgaaaatatgttcatc

SEQ ID NO: 1261447 - DNA, 22 bp, Artificial Sequence
  chemically synthesized
ctcaggaatgaggatgaacata

SEQ ID NO: 1261448 - DNA, 22 bp, Artificial Sequence
  chemically synthesized
tctactcaggaatgaggatgaa

SEQ ID NO: 1261449 - DNA, 22 bp, Artificial Sequence
  chemically synthesized
atctactcaggaatgaggatga

SEQ ID NO: 1261450 - DNA, 22 bp, Artificial Sequence
  chemically synthesized
gaaaatatgttcatcctcattc

SEQ ID NO: 1261451 - DNA, 22 bp, Artificial Sequence
  chemically synthesized
aaaatatgttcatcctcattcc

SEQ ID NO: 1261452 - DNA, 22 bp, Artificial Sequence
  chemically synthesized
cacttatctactcaggaatgag

SEQ ID NO: 1261453 - DNA, 22 bp, Artificial Sequence
  chemically synthesized
gcacttatctactcaggaatga

SEQ ID NO: 1261454 - DNA, 22 bp, Artificial Sequence
  chemically synthesized
gtttgcacttatctactcagga

SEQ ID NO: 1261455 - DNA, 22 bp, Artificial Sequence
  chemically synthesized
agtttgcacttatctactcagg

SEQ ID NO: 1261456 - DNA, 22 bp, Artificial Sequence
  chemically synthesized
tagtttgcacttatctactcag

SEQ ID NO: 1261457 - DNA, 22 bp, Artificial Sequence
  chemically synthesized
ttagtttgcacttatctactca

SEQ ID NO: 1261458 - DNA, 22 bp, Artificial Sequence
  chemically synthesized
atcctcattcctgagtagataa

SEQ ID NO: 1261459 - DNA, 22 bp, Artificial Sequence
  chemically synthesized
tgtcttttagtttgcacttatc

SEQ ID NO: 1261460 - DNA, 22 bp, Artificial Sequence
  chemically synthesized
attcctgagtagataagtgcaa

SEQ ID NO: 1261461 - DNA, 22 bp, Artificial Sequence
  chemically synthesized
ctgagtagataagtgcaaacta

SEQ ID NO: 1261462 - DNA, 22 bp, Artificial Sequence
  chemically synthesized
agtagataagtgcaaactaaaa

SEQ ID NO: 1261463 - DNA, 22 bp, Artificial Sequence
  chemically synthesized
tgaaactatgtcttttagtttg

SEQ ID NO: 1261464 - DNA, 22 bp, Artificial Sequence
  chemically synthesized
gtgaaaaactatgaaactatgt

SEQ ID NO: 1261465 - DNA, 22 bp, Artificial Sequence
  chemically synthesized
aaagacatagtttcatagtttt

SEQ ID NO: 1261466 - DNA, 22 bp, Artificial Sequence
  chemically synthesized
ccaatatgattggtgaaaaact

SEQ ID NO: 1261467 - DNA, 22 bp, Artificial Sequence
  chemically synthesized
gccaatatgattggtgaaaaac

SEQ ID NO: 1261468 - DNA, 22 bp, Artificial Sequence
  chemically synthesized
tgccaatatgattggtgaaaaa

SEQ ID NO: 1261469 - DNA, 22 bp, Artificial Sequence
  chemically synthesized
atctttgccaatatgattggtg

SEQ ID NO: 1261470 - DNA, 22 bp, Artificial Sequence
  chemically synthesized
gatctttgccaatatgattggt

SEQ ID NO: 1261471 - DNA, 22 bp, Artificial Sequence
  chemically synthesized
catagtttttcaccaatcatat

SEQ ID NO: 1261472 - DNA, 22 bp, Artificial Sequence
  chemically synthesized
tgatctttgccaatatgattgg

SEQ ID NO: 1261473 - DNA, 22 bp, Artificial Sequence
  chemically synthesized
atagtttttcaccaatcatatt

SEQ ID NO: 1261474 - DNA, 22 bp, Artificial Sequence
  chemically synthesized
ttgatctttgccaatatgattg

SEQ ID NO: 1261475 - DNA, 22 bp, Artificial Sequence
  chemically synthesized
ttcaccaatcatattggcaaag

SEQ ID NO: 1261476 - DNA, 22 bp, Artificial Sequence
  chemically synthesized
tcaccaatcatattggcaaaga

SEQ ID NO: 1261477 - DNA, 22 bp, Artificial Sequence
  chemically synthesized
ccaaacttttgatctttgccaa

SEQ ID NO: 1261478 - DNA, 22 bp, Artificial Sequence
  chemically synthesized
caccaatcatattggcaaagat

SEQ ID NO: 1261479 - DNA, 22 bp, Artificial Sequence
  chemically synthesized
accaatcatattggcaaagatc

SEQ ID NO: 1261480 - DNA, 22 bp, Artificial Sequence
  chemically synthesized
gcaaagatcaaaagtttggtag

SEQ ID NO: 1261481 - DNA, 22 bp, Artificial Sequence
  chemically synthesized
ataccataaaaaacgcagtata

SEQ ID NO: 1261482 - DNA, 22 bp, Artificial Sequence
  chemically synthesized
ctcataccataaaaaacgcagt

SEQ ID NO: 1261483 - DNA, 22 bp, Artificial Sequence
  chemically synthesized
cctcataccataaaaaacgcag

SEQ ID NO: 1261484 - DNA, 22 bp, Artificial Sequence
  chemically synthesized
ggtagtatactgcgttttttat

SEQ ID NO: 1261485 - DNA, 22 bp, Artificial Sequence
  chemically synthesized
gtagtatactgcgttttttatg

SEQ ID NO: 1261486 - DNA, 22 bp, Artificial Sequence
  chemically synthesized
cgttttttatggtatgaggaaa

SEQ ID NO: 1261487 - DNA, 22 bp, Artificial Sequence
  chemically synthesized
tttatggtatgaggaaattgat

SEQ ID NO: 1261488 - DNA, 22 bp, Artificial Sequence
  chemically synthesized
ttatggtatgaggaaattgatg

SEQ ID NO: 1261489 - DNA, 22 bp, Artificial Sequence
  chemically synthesized
tatggtatgaggaaattgatgt

SEQ ID NO: 1261490 - DNA, 22 bp, Artificial Sequence
  chemically synthesized
atggtatgaggaaattgatgtt

SEQ ID NO: 1261491 - DNA, 22 bp, Artificial Sequence
  chemically synthesized
tggtatgaggaaattgatgttc

SEQ ID NO: 1261492 - DNA, 22 bp, Artificial Sequence
  chemically synthesized
tcaggaaggtatgagaacatca

SEQ ID NO: 1261493 - DNA, 22 bp, Artificial Sequence
  chemically synthesized
aaatctgtcaggaaggtatgag

SEQ ID NO: 1261494 - DNA, 22 bp, Artificial Sequence
  chemically synthesized
atgttctcataccttcctgaca

SEQ ID NO: 1261495 - DNA, 22 bp, Artificial Sequence
  chemically synthesized
tcataccttcctgacagatttg

SEQ ID NO: 1261496 - DNA, 22 bp, Artificial Sequence
  chemically synthesized
ataccttcctgacagatttgaa

SEQ ID NO: 1261497 - DNA, 22 bp, Artificial Sequence
  chemically synthesized
cctgacagatttgaactgatat

SEQ ID NO: 1261498 - DNA, 22 bp, Artificial Sequence
  chemically synthesized
ctgacagatttgaactgatata

SEQ ID NO: 1261499 - DNA, 22 bp, Artificial Sequence
  chemically synthesized
acagatttgaactgatatacgt

SEQ ID NO: 1261500 - DNA, 22 bp, Artificial Sequence
  chemically synthesized
gaactgatatacgtggccatgt

SEQ ID NO: 1261501 - DNA, 22 bp, Artificial Sequence
  chemically synthesized
aactgatatacgtggccatgtg

SEQ ID NO: 1261502 - DNA, 22 bp, Artificial Sequence
  chemically synthesized
atatacgtggccatgtgtatga

SEQ ID NO: 1261503 - DNA, 22 bp, Artificial Sequence
  chemically synthesized
tacatacatgcgcatagtcata

SEQ ID NO: 1261504 - DNA, 22 bp, Artificial Sequence
  chemically synthesized
ctgtacatacatgcgcatagtc

SEQ ID NO: 1261505 - DNA, 22 bp, Artificial Sequence
  chemically synthesized
agatatctgctgtacatacatg

SEQ ID NO: 1261506 - DNA, 22 bp, Artificial Sequence
  chemically synthesized
cagatatctgctgtacatacat

SEQ ID NO: 1261507 - DNA, 22 bp, Artificial Sequence
  chemically synthesized
tcagatatctgctgtacataca

SEQ ID NO: 1261508 - DNA, 22 bp, Artificial Sequence
  chemically synthesized
tttcagatatctgctgtacata

SEQ ID NO: 1261509 - DNA, 22 bp, Artificial Sequence
  chemically synthesized
tgcgcatgtatgtacagcagat

SEQ ID NO: 1261510 - DNA, 22 bp, Artificial Sequence
  chemically synthesized
tgtattctttcagatatctgct

SEQ ID NO: 1261511 - DNA, 22 bp, Artificial Sequence
  chemically synthesized
tgtgtattctttcagatatctg

SEQ ID NO: 1261512 - DNA, 22 bp, Artificial Sequence
  chemically synthesized
ctgtgtattctttcagatatct

SEQ ID NO: 1261513 - DNA, 22 bp, Artificial Sequence
  chemically synthesized
tctgtgtattctttcagatatc

SEQ ID NO: 1261514 - DNA, 22 bp, Artificial Sequence
  chemically synthesized
cggttttctgtgtattctttca

SEQ ID NO: 1261515 - DNA, 22 bp, Artificial Sequence
  chemically synthesized
gcattgcggttttctgtgtatt

SEQ ID NO: 1261516 - DNA, 22 bp, Artificial Sequence
  chemically synthesized
aaagaatacacagaaaaccgca

SEQ ID NO: 1261517 - DNA, 22 bp, Artificial Sequence
  chemically synthesized
ggggtgctggcattgcggtttt

SEQ ID NO: 1261518 - DNA, 22 bp, Artificial Sequence
  chemically synthesized
ctgggggtgctggcattgcggt

SEQ ID NO: 1261519 - DNA, 22 bp, Artificial Sequence
  chemically synthesized
actgggggtgctggcattgcgg

SEQ ID NO: 1261520 - DNA, 22 bp, Artificial Sequence
  chemically synthesized
ttactgggggtgctggcattgc

SEQ ID NO: 1261521 - DNA, 22 bp, Artificial Sequence
  chemically synthesized
tcttactgggggtgctggcatt

SEQ ID NO: 1261522 - DNA, 22 bp, Artificial Sequence
  chemically synthesized
tctcttactgggggtgctggca

SEQ ID NO: 1261523 - DNA, 22 bp, Artificial Sequence
  chemically synthesized
ctctcttactgggggtgctggc

SEQ ID NO: 1261524 - DNA, 22 bp, Artificial Sequence
  chemically synthesized
cttctctcttactgggggtgct

SEQ ID NO: 1261525 - DNA, 22 bp, Artificial Sequence
  chemically synthesized
tcctccttctctcttactgggg

SEQ ID NO: 1261526 - DNA, 22 bp, Artificial Sequence
  chemically synthesized
gttatcctccttctctcttact

SEQ ID NO: 1261527 - DNA, 22 bp, Artificial Sequence
  chemically synthesized
ctagttatcctccttctctctt

SEQ ID NO: 1261528 - DNA, 22 bp, Artificial Sequence
  chemically synthesized
gcctcctagttatcctccttct

SEQ ID NO: 1261529 - DNA, 22 bp, Artificial Sequence
  chemically synthesized
gctagcctcctagttatcctcc

SEQ ID NO: 1261530 - DNA, 22 bp, Artificial Sequence
  chemically synthesized
tgttagctagcctcctagttat

SEQ ID NO: 1261531 - DNA, 22 bp, Artificial Sequence
  chemically synthesized
ttatgttagctagcctcctagt

SEQ ID NO: 1261532 - DNA, 22 bp, Artificial Sequence
  chemically synthesized
ctattatgttagctagcctcct

SEQ ID NO: 1261533 - DNA, 22 bp, Artificial Sequence
  chemically synthesized
tcctattatgttagctagcctc

SEQ ID NO: 1261534 - DNA, 22 bp, Artificial Sequence
  chemically synthesized
ctcctattatgttagctagcct

SEQ ID NO: 1261535 - DNA, 22 bp, Artificial Sequence
  chemically synthesized
tttctcctattatgttagctag

SEQ ID NO: 1261536 - DNA, 22 bp, Artificial Sequence
  chemically synthesized
ggaggctagctaacataatagg

SEQ ID NO: 1261537 - DNA, 22 bp, Artificial Sequence
  chemically synthesized
gctaacataataggagaaacaa

SEQ ID NO: 1261538 - DNA, 22 bp, Artificial Sequence
  chemically synthesized
acataataggagaaacaatttt

SEQ ID NO: 1261539 - DNA, 22 bp, Artificial Sequence
  chemically synthesized
atagaggtaaacaaaaaagaac

SEQ ID NO: 1261540 - DNA, 22 bp, Artificial Sequence
  chemically synthesized
tctttatgcgttcttttttgtt

SEQ ID NO: 1261541 - DNA, 22 bp, Artificial Sequence
  chemically synthesized
ctttatgcgttcttttttgttt

SEQ ID NO: 1261542 - DNA, 22 bp, Artificial Sequence
  chemically synthesized
tttatgcgttcttttttgttta

SEQ ID NO: 1261543 - DNA, 22 bp, Artificial Sequence
  chemically synthesized
tatgcgttcttttttgtttacc

SEQ ID NO: 1261544 - DNA, 22 bp, Artificial Sequence
  chemically synthesized
atgcgttcttttttgtttacct

SEQ ID NO: 1261545 - DNA, 22 bp, Artificial Sequence
  chemically synthesized
tgcgttcttttttgtttacctc

SEQ ID NO: 1261546 - DNA, 22 bp, Artificial Sequence
  chemically synthesized
ttttttgtttacctctatgaat

SEQ ID NO: 1261547 - DNA, 22 bp, Artificial Sequence
  chemically synthesized
cacatagtacaaaattcataga

SEQ ID NO: 1261548 - DNA, 22 bp, Artificial Sequence
  chemically synthesized
ttttgtttacctctatgaattt

SEQ ID NO: 1261549 - DNA, 22 bp, Artificial Sequence
  chemically synthesized
tttgtttacctctatgaatttt

SEQ ID NO: 1261550 - DNA, 22 bp, Artificial Sequence
  chemically synthesized
ttgtttacctctatgaattttg

SEQ ID NO: 1261551 - DNA, 22 bp, Artificial Sequence
  chemically synthesized
tgtttacctctatgaattttgt

SEQ ID NO: 1261552 - DNA, 22 bp, Artificial Sequence
  chemically synthesized
attgcacatagtacaaaattca

SEQ ID NO: 1261553 - DNA, 22 bp, Artificial Sequence
  chemically synthesized
gtttacctctatgaattttgta

SEQ ID NO: 1261554 - DNA, 22 bp, Artificial Sequence
  chemically synthesized
tttacctctatgaattttgtac

SEQ ID NO: 1261555 - DNA, 22 bp, Artificial Sequence
  chemically synthesized
gttaattgcacatagtacaaaa

SEQ ID NO: 1261556 - DNA, 22 bp, Artificial Sequence
  chemically synthesized
acctctatgaattttgtactat

SEQ ID NO: 1261557 - DNA, 22 bp, Artificial Sequence
  chemically synthesized
cctctatgaattttgtactatg

SEQ ID NO: 1261558 - DNA, 22 bp, Artificial Sequence
  chemically synthesized
cctagttaattgcacatagtac

SEQ ID NO: 1261559 - DNA, 22 bp, Artificial Sequence
  chemically synthesized
tatgaattttgtactatgtgca

SEQ ID NO: 1261560 - DNA, 22 bp, Artificial Sequence
  chemically synthesized
tgaattttgtactatgtgcaat

SEQ ID NO: 1261561 - DNA, 22 bp, Artificial Sequence
  chemically synthesized
caattacctagttaattgcaca

SEQ ID NO: 1261562 - DNA, 22 bp, Artificial Sequence
  chemically synthesized
tgtactatgtgcaattaactag

SEQ ID NO: 1261563 - DNA, 22 bp, Artificial Sequence
  chemically synthesized
gtactatgtgcaattaactagg

SEQ ID NO: 1261564 - DNA, 22 bp, Artificial Sequence
  chemically synthesized
aagctccaattacctagttaat

SEQ ID NO: 1261565 - DNA, 22 bp, Artificial Sequence
  chemically synthesized
tactatgtgcaattaactaggt

SEQ ID NO: 1261566 - DNA, 22 bp, Artificial Sequence
  chemically synthesized
aaagctccaattacctagttaa

SEQ ID NO: 1261567 - DNA, 22 bp, Artificial Sequence
  chemically synthesized
ttaaagctccaattacctagtt

SEQ ID NO: 1261568 - DNA, 22 bp, Artificial Sequence
  chemically synthesized
tgtgcaattaactaggtaattg

SEQ ID NO: 1261569 - DNA, 22 bp, Artificial Sequence
  chemically synthesized
actaggtaattggagctttaag

SEQ ID NO: 1261570 - DNA, 22 bp, Artificial Sequence
  chemically synthesized
ggtaattggagctttaagagca

SEQ ID NO: 1261571 - DNA, 22 bp, Artificial Sequence
  chemically synthesized
atgacccccaaagtgctcttaa

SEQ ID NO: 1261572 - DNA, 22 bp, Artificial Sequence
  chemically synthesized
gtgttaatgacccccaaagtgc

SEQ ID NO: 1261573 - DNA, 22 bp, Artificial Sequence
  chemically synthesized
gagctttaagagcactttgggg

SEQ ID NO: 1261574 - DNA, 22 bp, Artificial Sequence
  chemically synthesized
agtgttaatgacccccaaagtg

SEQ ID NO: 1261575 - DNA, 22 bp, Artificial Sequence
  chemically synthesized
tagtgttaatgacccccaaagt

SEQ ID NO: 1261576 - DNA, 22 bp, Artificial Sequence
  chemically synthesized
ttagtgttaatgacccccaaag

SEQ ID NO: 1261577 - DNA, 22 bp, Artificial Sequence
  chemically synthesized
taagagcactttgggggtcatt

SEQ ID NO: 1261578 - DNA, 22 bp, Artificial Sequence
  chemically synthesized
aagagcactttgggggtcatta

SEQ ID NO: 1261579 - DNA, 22 bp, Artificial Sequence
  chemically synthesized
agagcactttgggggtcattaa

SEQ ID NO: 1261580 - DNA, 22 bp, Artificial Sequence
  chemically synthesized
tgtaaaatatttttagtgttaa

SEQ ID NO: 1261581 - DNA, 22 bp, Artificial Sequence
  chemically synthesized
tatgtaaaatatttttagtgtt

SEQ ID NO: 1261582 - DNA, 22 bp, Artificial Sequence
  chemically synthesized
tgggggtcattaacactaaaaa

SEQ ID NO: 1261583 - DNA, 22 bp, Artificial Sequence
  chemically synthesized
ctatgtaaaatatttttagtgt

SEQ ID NO: 1261584 - DNA, 22 bp, Artificial Sequence
  chemically synthesized
gggggtcattaacactaaaaat

SEQ ID NO: 1261585 - DNA, 22 bp, Artificial Sequence
  chemically synthesized
ggggtcattaacactaaaaata

SEQ ID NO: 1261586 - DNA, 22 bp, Artificial Sequence
  chemically synthesized
tttctatgtaaaatatttttag

SEQ ID NO: 1261587 - DNA, 22 bp, Artificial Sequence
  chemically synthesized
taattatttctatgtaaaatat

SEQ ID NO: 1261588 - DNA, 22 bp, Artificial Sequence
  chemically synthesized
ataattatttctatgtaaaata

SEQ ID NO: 1261589 - DNA, 22 bp, Artificial Sequence
  chemically synthesized
acactaaaaatattttacatag

SEQ ID NO: 1261590 - DNA, 22 bp, Artificial Sequence
  chemically synthesized
aaaatattttacatagaaataa

SEQ ID NO: 1261591 - DNA, 22 bp, Artificial Sequence
  chemically synthesized
gatgaatatgcttataattatt

SEQ ID NO: 1261592 - DNA, 22 bp, Artificial Sequence
  chemically synthesized
tacatagaaataattataagca

SEQ ID NO: 1261593 - DNA, 22 bp, Artificial Sequence
  chemically synthesized
acatagaaataattataagcat

SEQ ID NO: 1261594 - DNA, 22 bp, Artificial Sequence
  chemically synthesized
catagaaataattataagcata

SEQ ID NO: 1261595 - DNA, 22 bp, Artificial Sequence
  chemically synthesized
taagcatattcatccaaccatt

SEQ ID NO: 1261596 - DNA, 22 bp, Artificial Sequence
  chemically synthesized
atccaaccatttatttatttat

SEQ ID NO: 1261597 - DNA, 22 bp, Artificial Sequence
  chemically synthesized
atttatttatccatgcacccat

SEQ ID NO: 1261598 - DNA, 22 bp, Artificial Sequence
  chemically synthesized
tttatttatccatgcacccatc

SEQ ID NO: 1261599 - DNA, 22 bp, Artificial Sequence
  chemically synthesized
atttatccatgcacccatccat

SEQ ID NO: 1261600 - DNA, 22 bp, Artificial Sequence
  chemically synthesized
tttatccatgcacccatccatc

SEQ ID NO: 1261601 - DNA, 22 bp, Artificial Sequence
  chemically synthesized
atccatgcacccatccatccat

SEQ ID NO: 1261602 - DNA, 22 bp, Artificial Sequence
  chemically synthesized
tccatgcacccatccatccatt

SEQ ID NO: 1261603 - DNA, 22 bp, Artificial Sequence
  chemically synthesized
atccatccatccgtttatctct

SEQ ID NO: 1261604 - DNA, 22 bp, Artificial Sequence
  chemically synthesized
aacatgagatggatgaagagat

SEQ ID NO: 1261605 - DNA, 22 bp, Artificial Sequence
  chemically synthesized
tacaaattaaacatgagatgga

SEQ ID NO: 1261606 - DNA, 22 bp, Artificial Sequence
  chemically synthesized
atacaaattaaacatgagatgg

SEQ ID NO: 1261607 - DNA, 22 bp, Artificial Sequence
  chemically synthesized
atctcttcatccatctcatgtt

SEQ ID NO: 1261608 - DNA, 22 bp, Artificial Sequence
  chemically synthesized
tctcttcatccatctcatgttt

SEQ ID NO: 1261609 - DNA, 22 bp, Artificial Sequence
  chemically synthesized
ttcatccatctcatgtttaatt

SEQ ID NO: 1261610 - DNA, 22 bp, Artificial Sequence
  chemically synthesized
catccatctcatgtttaatttg

SEQ ID NO: 1261611 - DNA, 22 bp, Artificial Sequence
  chemically synthesized
atccatctcatgtttaatttgt

SEQ ID NO: 1261612 - DNA, 22 bp, Artificial Sequence
  chemically synthesized
tgggataaataaacgtttatac

SEQ ID NO: 1261613 - DNA, 22 bp, Artificial Sequence
  chemically synthesized
atgtttaatttgtataaacgtt

SEQ ID NO: 1261614 - DNA, 22 bp, Artificial Sequence
  chemically synthesized
aatttgtataaacgtttattta

SEQ ID NO: 1261615 - DNA, 22 bp, Artificial Sequence
  chemically synthesized
atttgtataaacgtttatttat

SEQ ID NO: 1261616 - DNA, 22 bp, Artificial Sequence
  chemically synthesized
gtataaacgtttatttatccca

SEQ ID NO: 1261617 - DNA, 22 bp, Artificial Sequence
  chemically synthesized
tataaacgtttatttatcccat

SEQ ID NO: 1261618 - DNA, 22 bp, Artificial Sequence
  chemically synthesized
atttatcccatagactctatgt

SEQ ID NO: 1261619 - DNA, 22 bp, Artificial Sequence
  chemically synthesized
tttatcccatagactctatgta

SEQ ID NO: 1261620 - DNA, 22 bp, Artificial Sequence
  chemically synthesized
catgtaccatacatacatagag

SEQ ID NO: 1261621 - DNA, 22 bp, Artificial Sequence
  chemically synthesized
acatgtaccatacatacataga

SEQ ID NO: 1261622 - DNA, 22 bp, Artificial Sequence
  chemically synthesized
atcccatagactctatgtatgt

SEQ ID NO: 1261623 - DNA, 22 bp, Artificial Sequence
  chemically synthesized
tcccatagactctatgtatgta

SEQ ID NO: 1261624 - DNA, 22 bp, Artificial Sequence
  chemically synthesized
tataaccttacatgtaccatac

SEQ ID NO: 1261625 - DNA, 22 bp, Artificial Sequence
  chemically synthesized
atataaccttacatgtaccata

SEQ ID NO: 1261626 - DNA, 22 bp, Artificial Sequence
  chemically synthesized
ttatataaccttacatgtacca

SEQ ID NO: 1261627 - DNA, 22 bp, Artificial Sequence
  chemically synthesized
tatgtatgtatggtacatgtaa

SEQ ID NO: 1261628 - DNA, 22 bp, Artificial Sequence
  chemically synthesized
tgtatgtatggtacatgtaagg

SEQ ID NO: 1261629 - DNA, 22 bp, Artificial Sequence
  chemically synthesized
tatctcttatataaccttacat

SEQ ID NO: 1261630 - DNA, 22 bp, Artificial Sequence
  chemically synthesized
acattgtatctcttatataacc

SEQ ID NO: 1261631 - DNA, 22 bp, Artificial Sequence
  chemically synthesized
aacattgtatctcttatataac

SEQ ID NO: 1261632 - DNA, 22 bp, Artificial Sequence
  chemically synthesized
tttaacattgtatctcttatat

SEQ ID NO: 1261633 - DNA, 22 bp, Artificial Sequence
  chemically synthesized
atttaacattgtatctcttata

SEQ ID NO: 1261634 - DNA, 22 bp, Artificial Sequence
  chemically synthesized
ccttatttaacattgtatctct

SEQ ID NO: 1261635 - DNA, 22 bp, Artificial Sequence
  chemically synthesized
tataagagatacaatgttaaat

SEQ ID NO: 1261636 - DNA, 22 bp, Artificial Sequence
  chemically synthesized
gggatagtagaaactgccttat

SEQ ID NO: 1261637 - DNA, 22 bp, Artificial Sequence
  chemically synthesized
agggatagtagaaactgcctta

SEQ ID NO: 1261638 - DNA, 22 bp, Artificial Sequence
  chemically synthesized
taaatttagggatagtagaaac

SEQ ID NO: 1261639 - DNA, 22 bp, Artificial Sequence
  chemically synthesized
aataaggcagtttctactatcc

SEQ ID NO: 1261640 - DNA, 22 bp, Artificial Sequence
  chemically synthesized
attgtaaatttagggatagtag

SEQ ID NO: 1261641 - DNA, 22 bp, Artificial Sequence
  chemically synthesized
cattgtaaatttagggatagta

SEQ ID NO: 1261642 - DNA, 22 bp, Artificial Sequence
  chemically synthesized
cttcattgtaaatttagggata

SEQ ID NO: 1261643 - DNA, 22 bp, Artificial Sequence
  chemically synthesized
tccttcattgtaaatttaggga

SEQ ID NO: 1261644 - DNA, 22 bp, Artificial Sequence
  chemically synthesized
ctccttcattgtaaatttaggg

SEQ ID NO: 1261645 - DNA, 22 bp, Artificial Sequence
  chemically synthesized
tctccttcattgtaaatttagg

SEQ ID NO: 1261646 - DNA, 22 bp, Artificial Sequence
  chemically synthesized
ttctccttcattgtaaatttag

SEQ ID NO: 1261647 - DNA, 22 bp, Artificial Sequence
  chemically synthesized
ctactatccctaaatttacaat

SEQ ID NO: 1261648 - DNA, 22 bp, Artificial Sequence
  chemically synthesized
tactatccctaaatttacaatg

SEQ ID NO: 1261649 - DNA, 22 bp, Artificial Sequence
  chemically synthesized
ctatccctaaatttacaatgaa

SEQ ID NO: 1261650 - DNA, 22 bp, Artificial Sequence
  chemically synthesized
tccctaaatttacaatgaagga

SEQ ID NO: 1261651 - DNA, 22 bp, Artificial Sequence
  chemically synthesized
aatttacaatgaaggagaaaag

SEQ ID NO: 1261652 - DNA, 22 bp, Artificial Sequence
  chemically synthesized
taatcatgaggtagcttttctc

SEQ ID NO: 1261653 - DNA, 22 bp, Artificial Sequence
  chemically synthesized
acaatgaaggagaaaagctacc

SEQ ID NO: 1261654 - DNA, 22 bp, Artificial Sequence
  chemically synthesized
caatgaaggagaaaagctacct

SEQ ID NO: 1261655 - DNA, 22 bp, Artificial Sequence
  chemically synthesized
atatctgtaatcatgaggtagc

SEQ ID NO: 1261656 - DNA, 22 bp, Artificial Sequence
  chemically synthesized
catatctgtaatcatgaggtag

SEQ ID NO: 1261657 - DNA, 22 bp, Artificial Sequence
  chemically synthesized
ccaaacccttcatatctgtaat

SEQ ID NO: 1261658 - DNA, 22 bp, Artificial Sequence
  chemically synthesized
accaaacccttcatatctgtaa

SEQ ID NO: 1261659 - DNA, 22 bp, Artificial Sequence
  chemically synthesized
cctcatgattacagatatgaag

SEQ ID NO: 1261660 - DNA, 22 bp, Artificial Sequence
  chemically synthesized
atgattacagatatgaagggtt

SEQ ID NO: 1261661 - DNA, 22 bp, Artificial Sequence
  chemically synthesized
gtgatgcatttaccaaaccctt

SEQ ID NO: 1261662 - DNA, 22 bp, Artificial Sequence
  chemically synthesized
ggtgatgcatttaccaaaccct

SEQ ID NO: 1261663 - DNA, 22 bp, Artificial Sequence
  chemically synthesized
cagatatgaagggtttggtaaa

SEQ ID NO: 1261664 - DNA, 22 bp, Artificial Sequence
  chemically synthesized
tgtgtaagccttggtgatgcat

SEQ ID NO: 1261665 - DNA, 22 bp, Artificial Sequence
  chemically synthesized
atgtgtaagccttggtgatgca

SEQ ID NO: 1261666 - DNA, 22 bp, Artificial Sequence
  chemically synthesized
cttatgtgtaagccttggtgat

SEQ ID NO: 1261667 - DNA, 22 bp, Artificial Sequence
  chemically synthesized
tgcttatgtgtaagccttggtg

SEQ ID NO: 1261668 - DNA, 22 bp, Artificial Sequence
  chemically synthesized
ggtaaatgcatcaccaaggctt

SEQ ID NO: 1261669 - DNA, 22 bp, Artificial Sequence
  chemically synthesized
ctgcttatgtgtaagccttggt

SEQ ID NO: 1261670 - DNA, 22 bp, Artificial Sequence
  chemically synthesized
gtaaatgcatcaccaaggctta

SEQ ID NO: 1261671 - DNA, 22 bp, Artificial Sequence
  chemically synthesized
cttctgcttatgtgtaagcctt

SEQ ID NO: 1261672 - DNA, 22 bp, Artificial Sequence
  chemically synthesized
tccttctgcttatgtgtaagcc

SEQ ID NO: 1261673 - DNA, 22 bp, Artificial Sequence
  chemically synthesized
caccctctccttctgcttatgt

SEQ ID NO: 1261674 - DNA, 22 bp, Artificial Sequence
  chemically synthesized
tgcaccctctccttctgcttat

SEQ ID NO: 1261675 - DNA, 22 bp, Artificial Sequence
  chemically synthesized
tctgcaccctctccttctgctt

SEQ ID NO: 1261676 - DNA, 22 bp, Artificial Sequence
  chemically synthesized
gctctctgcaccctctccttct

SEQ ID NO: 1261677 - DNA, 22 bp, Artificial Sequence
  chemically synthesized
agctctctgcaccctctccttc

SEQ ID NO: 1261678 - DNA, 22 bp, Artificial Sequence
  chemically synthesized
acacataagcagaaggagaggg

SEQ ID NO: 1261679 - DNA, 22 bp, Artificial Sequence
  chemically synthesized
tagctctctgcaccctctcctt

SEQ ID NO: 1261680 - DNA, 22 bp, Artificial Sequence
  chemically synthesized
cacataagcagaaggagagggt

SEQ ID NO: 1261681 - DNA, 22 bp, Artificial Sequence
  chemically synthesized
ttagctctctgcaccctctcct

SEQ ID NO: 1261682 - DNA, 22 bp, Artificial Sequence
  chemically synthesized
ggggagccttttagctctctgc

SEQ ID NO: 1261683 - DNA, 22 bp, Artificial Sequence
  chemically synthesized
gggggagccttttagctctctg

SEQ ID NO: 1261684 - DNA, 22 bp, Artificial Sequence
  chemically synthesized
tgggggagccttttagctctct

SEQ ID NO: 1261685 - DNA, 22 bp, Artificial Sequence
  chemically synthesized
agtcctttgggggagcctttta

SEQ ID NO: 1261686 - DNA, 22 bp, Artificial Sequence
  chemically synthesized
cagtcctttgggggagcctttt

SEQ ID NO: 1261687 - DNA, 22 bp, Artificial Sequence
  chemically synthesized
aagtttcagtcctttgggggag

SEQ ID NO: 1261688 - DNA, 22 bp, Artificial Sequence
  chemically synthesized
caagtttcagtcctttggggga

SEQ ID NO: 1261689 - DNA, 22 bp, Artificial Sequence
  chemically synthesized
tcaagtttcagtcctttggggg

SEQ ID NO: 1261690 - DNA, 22 bp, Artificial Sequence
  chemically synthesized
ctttcaagtttcagtcctttgg

SEQ ID NO: 1261691 - DNA, 22 bp, Artificial Sequence
  chemically synthesized
aaaggctcccccaaaggactga

SEQ ID NO: 1261692 - DNA, 22 bp, Artificial Sequence
  chemically synthesized
cagaattcctttcaagtttcag

SEQ ID NO: 1261693 - DNA, 22 bp, Artificial Sequence
  chemically synthesized
ccccaaaggactgaaacttgaa

SEQ ID NO: 1261694 - DNA, 22 bp, Artificial Sequence
  chemically synthesized
tctgcagaattcctttcaagtt

SEQ ID NO: 1261695 - DNA, 22 bp, Artificial Sequence
  chemically synthesized
aaacctatctgcagaattcctt

SEQ ID NO: 1261696 - DNA, 22 bp, Artificial Sequence
  chemically synthesized
caaacctatctgcagaattcct

SEQ ID NO: 1261697 - DNA, 22 bp, Artificial Sequence
  chemically synthesized
tcaaacctatctgcagaattcc

SEQ ID NO: 1261698 - DNA, 22 bp, Artificial Sequence
  chemically synthesized
aaacttgaaaggaattctgcag

SEQ ID NO: 1261699 - DNA, 22 bp, Artificial Sequence
  chemically synthesized
gaaaggaattctgcagataggt

SEQ ID NO: 1261700 - DNA, 22 bp, Artificial Sequence
  chemically synthesized
aaaggaattctgcagataggtt

SEQ ID NO: 1261701 - DNA, 22 bp, Artificial Sequence
  chemically synthesized
tgcagataggtttgaaagccct

SEQ ID NO: 1261702 - DNA, 22 bp, Artificial Sequence
  chemically synthesized
cagataggtttgaaagccctga

SEQ ID NO: 1261703 - DNA, 22 bp, Artificial Sequence
  chemically synthesized
gaaagccctgacatgatttttt

SEQ ID NO: 1261704 - DNA, 22 bp, Artificial Sequence
  chemically synthesized
aaagccctgacatgattttttt

SEQ ID NO: 1261705 - DNA, 22 bp, Artificial Sequence
  chemically synthesized
acatgattttttttttttttta

SEQ ID NO: 1261706 - DNA, 22 bp, Artificial Sequence
  chemically synthesized
ttttttttttttactgtttcct

SEQ ID NO: 1261707 - DNA, 22 bp, Artificial Sequence
  chemically synthesized
tttttttttttactgtttccta

SEQ ID NO: 1261708 - DNA, 22 bp, Artificial Sequence
  chemically synthesized
ttttttttttactgtttcctat

SEQ ID NO: 1261709 - DNA, 22 bp, Artificial Sequence
  chemically synthesized
tttttttttactgtttcctatt

SEQ ID NO: 1261710 - DNA, 22 bp, Artificial Sequence
  chemically synthesized
ttttttttactgtttcctattg

SEQ ID NO: 1261711 - DNA, 22 bp, Artificial Sequence
  chemically synthesized
tttttttactgtttcctattgc

SEQ ID NO: 1261712 - DNA, 22 bp, Artificial Sequence
  chemically synthesized
ttttttactgtttcctattgca

SEQ ID NO: 1261713 - DNA, 22 bp, Artificial Sequence
  chemically synthesized
tttttactgtttcctattgcat

SEQ ID NO: 1261714 - DNA, 22 bp, Artificial Sequence
  chemically synthesized
ttttactgtttcctattgcata

SEQ ID NO: 1261715 - DNA, 22 bp, Artificial Sequence
  chemically synthesized
tttactgtttcctattgcatat

SEQ ID NO: 1261716 - DNA, 22 bp, Artificial Sequence
  chemically synthesized
ttactgtttcctattgcatatt

SEQ ID NO: 1261717 - DNA, 22 bp, Artificial Sequence
  chemically synthesized
tactgtttcctattgcatattc

SEQ ID NO: 1261718 - DNA, 22 bp, Artificial Sequence
  chemically synthesized
aaagggacaaaagaatatgcaa

SEQ ID NO: 1261719 - DNA, 22 bp, Artificial Sequence
  chemically synthesized
actgtttcctattgcatattct

SEQ ID NO: 1261720 - DNA, 22 bp, Artificial Sequence
  chemically synthesized
gaaagggacaaaagaatatgca

SEQ ID NO: 1261721 - DNA, 22 bp, Artificial Sequence
  chemically synthesized
ctgtttcctattgcatattctt

SEQ ID NO: 1261722 - DNA, 22 bp, Artificial Sequence
  chemically synthesized
tttcctattgcatattcttttg

SEQ ID NO: 1261723 - DNA, 22 bp, Artificial Sequence
  chemically synthesized
atacttgaaagggacaaaagaa

SEQ ID NO: 1261724 - DNA, 22 bp, Artificial Sequence
  chemically synthesized
cctattgcatattcttttgtcc

SEQ ID NO: 1261725 - DNA, 22 bp, Artificial Sequence
  chemically synthesized
catacttgaaagggacaaaaga

SEQ ID NO: 1261726 - DNA, 22 bp, Artificial Sequence
  chemically synthesized
ctattgcatattcttttgtccc

SEQ ID NO: 1261727 - DNA, 22 bp, Artificial Sequence
  chemically synthesized
tcatacttgaaagggacaaaag

SEQ ID NO: 1261728 - DNA, 22 bp, Artificial Sequence
  chemically synthesized
ttgcatattcttttgtcccttt

SEQ ID NO: 1261729 - DNA, 22 bp, Artificial Sequence
  chemically synthesized
catattcttttgtccctttcaa

SEQ ID NO: 1261730 - DNA, 22 bp, Artificial Sequence
  chemically synthesized
taagaattttcatacttgaaag

SEQ ID NO: 1261731 - DNA, 22 bp, Artificial Sequence
  chemically synthesized
ttttgtccctttcaagtatgaa

SEQ ID NO: 1261732 - DNA, 22 bp, Artificial Sequence
  chemically synthesized
ttgtccctttcaagtatgaaaa

SEQ ID NO: 1261733 - DNA, 22 bp, Artificial Sequence
  chemically synthesized
tgtccctttcaagtatgaaaat

SEQ ID NO: 1261734 - DNA, 22 bp, Artificial Sequence
  chemically synthesized
gtccctttcaagtatgaaaatt

SEQ ID NO: 1261735 - DNA, 22 bp, Artificial Sequence
  chemically synthesized
tccctttcaagtatgaaaattc

SEQ ID NO: 1261736 - DNA, 22 bp, Artificial Sequence
  chemically synthesized
aaggaaattataagaattttca

SEQ ID NO: 1261737 - DNA, 22 bp, Artificial Sequence
  chemically synthesized
tcaagtatgaaaattcttataa

SEQ ID NO: 1261738 - DNA, 22 bp, Artificial Sequence
  chemically synthesized
caagtatgaaaattcttataat

SEQ ID NO: 1261739 - DNA, 22 bp, Artificial Sequence
  chemically synthesized
aagtatgaaaattcttataatt

SEQ ID NO: 1261740 - DNA, 22 bp, Artificial Sequence
  chemically synthesized
gagagtatacattgaaggaaat

SEQ ID NO: 1261741 - DNA, 22 bp, Artificial Sequence
  chemically synthesized
agagagtatacattgaaggaaa

SEQ ID NO: 1261742 - DNA, 22 bp, Artificial Sequence
  chemically synthesized
cttagagagtatacattgaagg

SEQ ID NO: 1261743 - DNA, 22 bp, Artificial Sequence
  chemically synthesized
ttataatttccttcaatgtata

SEQ ID NO: 1261744 - DNA, 22 bp, Artificial Sequence
  chemically synthesized
ttacttagagagtatacattga

SEQ ID NO: 1261745 - DNA, 22 bp, Artificial Sequence
  chemically synthesized
attacttagagagtatacattg

SEQ ID NO: 1261746 - DNA, 22 bp, Artificial Sequence
  chemically synthesized
ataatttccttcaatgtatact

SEQ ID NO: 1261747 - DNA, 22 bp, Artificial Sequence
  chemically synthesized
tattacttagagagtatacatt

SEQ ID NO: 1261748 - DNA, 22 bp, Artificial Sequence
  chemically synthesized
taatttccttcaatgtatactc

SEQ ID NO: 1261749 - DNA, 22 bp, Artificial Sequence
  chemically synthesized
ttattacttagagagtatacat

SEQ ID NO: 1261750 - DNA, 22 bp, Artificial Sequence
  chemically synthesized
tttttattacttagagagtata

SEQ ID NO: 1261751 - DNA, 22 bp, Artificial Sequence
  chemically synthesized
ccttcaatgtatactctctaag

SEQ ID NO: 1261752 - DNA, 22 bp, Artificial Sequence
  chemically synthesized
cttcaatgtatactctctaagt

SEQ ID NO: 1261753 - DNA, 22 bp, Artificial Sequence
  chemically synthesized
caatgtatactctctaagtaat

SEQ ID NO: 1261754 - DNA, 22 bp, Artificial Sequence
  chemically synthesized
aatgtatactctctaagtaata

SEQ ID NO: 1261755 - DNA, 22 bp, Artificial Sequence
  chemically synthesized
agaatacaattgtttttattac

SEQ ID NO: 1261756 - DNA, 22 bp, Artificial Sequence
  chemically synthesized
gagaatacaattgtttttatta

SEQ ID NO: 1261757 - DNA, 22 bp, Artificial Sequence
  chemically synthesized
tgagaatacaattgtttttatt

SEQ ID NO: 1261758 - DNA, 22 bp, Artificial Sequence
  chemically synthesized
ttgagaatacaattgtttttat

SEQ ID NO: 1261759 - DNA, 22 bp, Artificial Sequence
  chemically synthesized
tctaagtaataaaaacaattgt

SEQ ID NO: 1261760 - DNA, 22 bp, Artificial Sequence
  chemically synthesized
gcttttgagaatacaattgttt

SEQ ID NO: 1261761 - DNA, 22 bp, Artificial Sequence
  chemically synthesized
taagtaataaaaacaattgtat

SEQ ID NO: 1261762 - DNA, 22 bp, Artificial Sequence
  chemically synthesized
ttagcttttgagaatacaattg

SEQ ID NO: 1261763 - DNA, 22 bp, Artificial Sequence
  chemically synthesized
agtaataaaaacaattgtattc

SEQ ID NO: 1261764 - DNA, 22 bp, Artificial Sequence
  chemically synthesized
gttagcttttgagaatacaatt

SEQ ID NO: 1261765 - DNA, 22 bp, Artificial Sequence
  chemically synthesized
tttgttagcttttgagaataca

SEQ ID NO: 1261766 - DNA, 22 bp, Artificial Sequence
  chemically synthesized
gtttgttagcttttgagaatac

SEQ ID NO: 1261767 - DNA, 22 bp, Artificial Sequence
  chemically synthesized
ttgtttgttagcttttgagaat

SEQ ID NO: 1261768 - DNA, 22 bp, Artificial Sequence
  chemically synthesized
cttgtttgttagcttttgagaa

SEQ ID NO: 1261769 - DNA, 22 bp, Artificial Sequence
  chemically synthesized
tcttgtttgttagcttttgaga

SEQ ID NO: 1261770 - DNA, 22 bp, Artificial Sequence
  chemically synthesized
ctttcttgtttgttagcttttg

SEQ ID NO: 1261771 - DNA, 22 bp, Artificial Sequence
  chemically synthesized
gctttcttgtttgttagctttt

SEQ ID NO: 1261772 - DNA, 22 bp, Artificial Sequence
  chemically synthesized
cttgctttcttgtttgttagct

SEQ ID NO: 1261773 - DNA, 22 bp, Artificial Sequence
  chemically synthesized
gcttgctttcttgtttgttagc

SEQ ID NO: 1261774 - DNA, 22 bp, Artificial Sequence
  chemically synthesized
tattctcaaaagctaacaaaca

SEQ ID NO: 1261775 - DNA, 22 bp, Artificial Sequence
  chemically synthesized
tttgcttgctttcttgtttgtt

SEQ ID NO: 1261776 - DNA, 22 bp, Artificial Sequence
  chemically synthesized
gtttgcttgctttcttgtttgt

SEQ ID NO: 1261777 - DNA, 22 bp, Artificial Sequence
  chemically synthesized
tgtttgcttgctttcttgtttg

SEQ ID NO: 1261778 - DNA, 22 bp, Artificial Sequence
  chemically synthesized
tcaaaagctaacaaacaagaaa

SEQ ID NO: 1261779 - DNA, 22 bp, Artificial Sequence
  chemically synthesized
ttgtttgcttgctttcttgttt

SEQ ID NO: 1261780 - DNA, 22 bp, Artificial Sequence
  chemically synthesized
aaaagctaacaaacaagaaagc

SEQ ID NO: 1261781 - DNA, 22 bp, Artificial Sequence
  chemically synthesized
aacttttgtttgcttgctttct

SEQ ID NO: 1261782 - DNA, 22 bp, Artificial Sequence
  chemically synthesized
acaaacaagaaagcaagcaaac

SEQ ID NO: 1261783 - DNA, 22 bp, Artificial Sequence
  chemically synthesized
caaatgtgatacctgaactttt

SEQ ID NO: 1261784 - DNA, 22 bp, Artificial Sequence
  chemically synthesized
ctgcaaatgtgatacctgaact

SEQ ID NO: 1261785 - DNA, 22 bp, Artificial Sequence
  chemically synthesized
tatattactgcaaatgtgatac

SEQ ID NO: 1261786 - DNA, 22 bp, Artificial Sequence
  chemically synthesized
gtatattactgcaaatgtgata

SEQ ID NO: 1261787 - DNA, 22 bp, Artificial Sequence
  chemically synthesized
aggtatcacatttgcagtaata

SEQ ID NO: 1261788 - DNA, 22 bp, Artificial Sequence
  chemically synthesized
atgaaagcacttgtatattact

SEQ ID NO: 1261789 - DNA, 22 bp, Artificial Sequence
  chemically synthesized
aatgaaagcacttgtatattac

SEQ ID NO: 1261790 - DNA, 22 bp, Artificial Sequence
  chemically synthesized
taatgaaagcacttgtatatta

SEQ ID NO: 1261791 - DNA, 22 bp, Artificial Sequence
  chemically synthesized
gcagtaatatacaagtgctttc

SEQ ID NO: 1261792 - DNA, 22 bp, Artificial Sequence
  chemically synthesized
cagtaatatacaagtgctttca

SEQ ID NO: 1261793 - DNA, 22 bp, Artificial Sequence
  chemically synthesized
agtaaacacataaaagcataat

SEQ ID NO: 1261794 - DNA, 22 bp, Artificial Sequence
  chemically synthesized
taagtaaacacataaaagcata

SEQ ID NO: 1261795 - DNA, 22 bp, Artificial Sequence
  chemically synthesized
tcattaaaattatgcttttatg

SEQ ID NO: 1261796 - DNA, 22 bp, Artificial Sequence
  chemically synthesized
cattaaaattatgcttttatgt

SEQ ID NO: 1261797 - DNA, 22 bp, Artificial Sequence
  chemically synthesized
ctctaagtaaacacataaaagc

SEQ ID NO: 1261798 - DNA, 22 bp, Artificial Sequence
  chemically synthesized
attaaaattatgcttttatgtg

SEQ ID NO: 1261799 - DNA, 22 bp, Artificial Sequence
  chemically synthesized
aaattatgcttttatgtgttta

SEQ ID NO: 1261800 - DNA, 22 bp, Artificial Sequence
  chemically synthesized
aagactcctctaagtaaacaca

SEQ ID NO: 1261801 - DNA, 22 bp, Artificial Sequence
  chemically synthesized
tcaagactcctctaagtaaaca

SEQ ID NO: 1261802 - DNA, 22 bp, Artificial Sequence
  chemically synthesized
ctcaagactcctctaagtaaac

SEQ ID NO: 1261803 - DNA, 22 bp, Artificial Sequence
  chemically synthesized
tgcttttatgtgtttacttaga

SEQ ID NO: 1261804 - DNA, 22 bp, Artificial Sequence
  chemically synthesized
tctcaagactcctctaagtaaa

SEQ ID NO: 1261805 - DNA, 22 bp, Artificial Sequence
  chemically synthesized
ttatgtgtttacttagaggagt

SEQ ID NO: 1261806 - DNA, 22 bp, Artificial Sequence
  chemically synthesized
tatgtgtttacttagaggagtc

SEQ ID NO: 1261807 - DNA, 22 bp, Artificial Sequence
  chemically synthesized
atgtgtttacttagaggagtct

SEQ ID NO: 1261808 - DNA, 22 bp, Artificial Sequence
  chemically synthesized
aatattttctcaagactcctct

SEQ ID NO: 1261809 - DNA, 22 bp, Artificial Sequence
  chemically synthesized
tgtgtttacttagaggagtctt

SEQ ID NO: 1261810 - DNA, 22 bp, Artificial Sequence
  chemically synthesized
acttagaggagtcttgagaaaa

SEQ ID NO: 1261811 - DNA, 22 bp, Artificial Sequence
  chemically synthesized
cttagaggagtcttgagaaaat

SEQ ID NO: 1261812 - DNA, 22 bp, Artificial Sequence
  chemically synthesized
agaggagtcttgagaaaatatt

SEQ ID NO: 1261813 - DNA, 22 bp, Artificial Sequence
  chemically synthesized
gaggagtcttgagaaaatattt

SEQ ID NO: 1261814 - DNA, 22 bp, Artificial Sequence
  chemically synthesized
gggggtaggtctaaatattttc

SEQ ID NO: 1261815 - DNA, 22 bp, Artificial Sequence
  chemically synthesized
agggggtaggtctaaatatttt

SEQ ID NO: 1261816 - DNA, 22 bp, Artificial Sequence
  chemically synthesized
aagcttagggggtaggtctaaa

SEQ ID NO: 1261817 - DNA, 22 bp, Artificial Sequence
  chemically synthesized
gagaaaatatttagacctaccc

SEQ ID NO: 1261818 - DNA, 22 bp, Artificial Sequence
  chemically synthesized
agaaaatatttagacctacccc

SEQ ID NO: 1261819 - DNA, 22 bp, Artificial Sequence
  chemically synthesized
cctaaagcttagggggtaggtc

SEQ ID NO: 1261820 - DNA, 22 bp, Artificial Sequence
  chemically synthesized
ccctaaagcttagggggtaggt

SEQ ID NO: 1261821 - DNA, 22 bp, Artificial Sequence
  chemically synthesized
agacctaccccctaagctttag

SEQ ID NO: 1261822 - DNA, 22 bp, Artificial Sequence
  chemically synthesized
gggaccacttccctaaagctta

SEQ ID NO: 1261823 - DNA, 22 bp, Artificial Sequence
  chemically synthesized
gacctaccccctaagctttagg

SEQ ID NO: 1261824 - DNA, 22 bp, Artificial Sequence
  chemically synthesized
ccccctaagctttagggaagtg

SEQ ID NO: 1261825 - DNA, 22 bp, Artificial Sequence
  chemically synthesized
aaaaggttggggaccacttccc

SEQ ID NO: 1261826 - DNA, 22 bp, Artificial Sequence
  chemically synthesized
agctttagggaagtggtcccca

SEQ ID NO: 1261827 - DNA, 22 bp, Artificial Sequence
  chemically synthesized
gtgctaaaaaggttggggacca

SEQ ID NO: 1261828 - DNA, 22 bp, Artificial Sequence
  chemically synthesized
tagggaagtggtccccaacctt

SEQ ID NO: 1261829 - DNA, 22 bp, Artificial Sequence
  chemically synthesized
agggaagtggtccccaaccttt

SEQ ID NO: 1261830 - DNA, 22 bp, Artificial Sequence
  chemically synthesized
gggaagtggtccccaacctttt

SEQ ID NO: 1261831 - DNA, 22 bp, Artificial Sequence
  chemically synthesized
cacgaaaccagtccctggtgct

SEQ ID NO: 1261832 - DNA, 22 bp, Artificial Sequence
  chemically synthesized
ccacgaaaccagtccctggtgc

SEQ ID NO: 1261833 - DNA, 22 bp, Artificial Sequence
  chemically synthesized
tcttccacgaaaccagtccctg

SEQ ID NO: 1261834 - DNA, 22 bp, Artificial Sequence
  chemically synthesized
tttagcaccagggactggtttc

SEQ ID NO: 1261835 - DNA, 22 bp, Artificial Sequence
  chemically synthesized
ttagcaccagggactggtttcg

SEQ ID NO: 1261836 - DNA, 22 bp, Artificial Sequence
  chemically synthesized
tagcaccagggactggtttcgt

SEQ ID NO: 1261837 - DNA, 22 bp, Artificial Sequence
  chemically synthesized
agcaccagggactggtttcgtg

SEQ ID NO: 1261838 - DNA, 22 bp, Artificial Sequence
  chemically synthesized
gcaccagggactggtttcgtgg

SEQ ID NO: 1261839 - DNA, 22 bp, Artificial Sequence
  chemically synthesized
tgaaaaaattgtcttccacgaa

SEQ ID NO: 1261840 - DNA, 22 bp, Artificial Sequence
  chemically synthesized
gtttcgtggaagacaatttttt

SEQ ID NO: 1261841 - DNA, 22 bp, Artificial Sequence
  chemically synthesized
cgtggaagacaattttttcaca

SEQ ID NO: 1261842 - DNA, 22 bp, Artificial Sequence
  chemically synthesized
gtggaagacaattttttcacag

SEQ ID NO: 1261843 - DNA, 22 bp, Artificial Sequence
  chemically synthesized
cccagcccaagtctgtgaaaaa

SEQ ID NO: 1261844 - DNA, 22 bp, Artificial Sequence
  chemically synthesized
ccaaaccatctccccagcccaa

SEQ ID NO: 1261845 - DNA, 22 bp, Artificial Sequence
  chemically synthesized
tttcacagacttgggctgggga

SEQ ID NO: 1261846 - DNA, 22 bp, Artificial Sequence
  chemically synthesized
ttcacagacttgggctggggag

SEQ ID NO: 1261847 - DNA, 22 bp, Artificial Sequence
  chemically synthesized
tcacagacttgggctggggaga

SEQ ID NO: 1261848 - DNA, 22 bp, Artificial Sequence
  chemically synthesized
cacagacttgggctggggagat

SEQ ID NO: 1261849 - DNA, 22 bp, Artificial Sequence
  chemically synthesized
acagacttgggctggggagatg

SEQ ID NO: 1261850 - DNA, 22 bp, Artificial Sequence
  chemically synthesized
aatcattcccaaaccatctccc

SEQ ID NO: 1261851 - DNA, 22 bp, Artificial Sequence
  chemically synthesized
gaatcattcccaaaccatctcc

SEQ ID NO: 1261852 - DNA, 22 bp, Artificial Sequence
  chemically synthesized
gggctggggagatggtttggga

SEQ ID NO: 1261853 - DNA, 22 bp, Artificial Sequence
  chemically synthesized
ggctggggagatggtttgggaa

SEQ ID NO: 1261854 - DNA, 22 bp, Artificial Sequence
  chemically synthesized
taatgtgcttgaatcattccca

SEQ ID NO: 1261855 - DNA, 22 bp, Artificial Sequence
  chemically synthesized
gggagatggtttgggaatgatt

SEQ ID NO: 1261856 - DNA, 22 bp, Artificial Sequence
  chemically synthesized
gggaatgattcaagcacattac

SEQ ID NO: 1261857 - DNA, 22 bp, Artificial Sequence
  chemically synthesized
atgataaatgttgtaatgtgct

SEQ ID NO: 1261858 - DNA, 22 bp, Artificial Sequence
  chemically synthesized
ggaatgattcaagcacattaca

SEQ ID NO: 1261859 - DNA, 22 bp, Artificial Sequence
  chemically synthesized
aatgataaatgttgtaatgtgc

SEQ ID NO: 1261860 - DNA, 22 bp, Artificial Sequence
  chemically synthesized
tgagaatttaatgataaatgtt

SEQ ID NO: 1261861 - DNA, 22 bp, Artificial Sequence
  chemically synthesized
aagcacattacaacatttatca

SEQ ID NO: 1261862 - DNA, 22 bp, Artificial Sequence
  chemically synthesized
atgagaatttaatgataaatgt

SEQ ID NO: 1261863 - DNA, 22 bp, Artificial Sequence
  chemically synthesized
cttatgagaatttaatgataaa

SEQ ID NO: 1261864 - DNA, 22 bp, Artificial Sequence
  chemically synthesized
caacatttatcattaaattctc

SEQ ID NO: 1261865 - DNA, 22 bp, Artificial Sequence
  chemically synthesized
tgtgctccttatgagaatttaa

SEQ ID NO: 1261866 - DNA, 22 bp, Artificial Sequence
  chemically synthesized
ggttgtgtgctccttatgagaa

SEQ ID NO: 1261867 - DNA, 22 bp, Artificial Sequence
  chemically synthesized
atcattaaattctcataaggag

SEQ ID NO: 1261868 - DNA, 22 bp, Artificial Sequence
  chemically synthesized
tcattaaattctcataaggagc

SEQ ID NO: 1261869 - DNA, 22 bp, Artificial Sequence
  chemically synthesized
aattctcataaggagcacacaa

SEQ ID NO: 1261870 - DNA, 22 bp, Artificial Sequence
  chemically synthesized
tcataaggagcacacaacctag

SEQ ID NO: 1261871 - DNA, 22 bp, Artificial Sequence
  chemically synthesized
ataaggagcacacaacctagat

SEQ ID NO: 1261872 - DNA, 22 bp, Artificial Sequence
  chemically synthesized
cgcatgcgagggatctaggttg

SEQ ID NO: 1261873 - DNA, 22 bp, Artificial Sequence
  chemically synthesized
tgacctgcgcatgcgagggatc

SEQ ID NO: 1261874 - DNA, 22 bp, Artificial Sequence
  chemically synthesized
ttgtgacctgcgcatgcgaggg

SEQ ID NO: 1261875 - DNA, 22 bp, Artificial Sequence
  chemically synthesized
gatccctcgcatgcgcaggtca

SEQ ID NO: 1261876 - DNA, 22 bp, Artificial Sequence
  chemically synthesized
gcatgcgcaggtcacaataggg

SEQ ID NO: 1261877 - DNA, 22 bp, Artificial Sequence
  chemically synthesized
ataggagcgagaaccctattgt

SEQ ID NO: 1261878 - DNA, 22 bp, Artificial Sequence
  chemically synthesized
tcataggagcgagaaccctatt

SEQ ID NO: 1261879 - DNA, 22 bp, Artificial Sequence
  chemically synthesized
cattctcataggagcgagaacc

SEQ ID NO: 1261880 - DNA, 22 bp, Artificial Sequence
  chemically synthesized
tcgctcctatgagaatgtaatg

SEQ ID NO: 1261881 - DNA, 22 bp, Artificial Sequence
  chemically synthesized
gctcctatgagaatgtaatgct

SEQ ID NO: 1261882 - DNA, 22 bp, Artificial Sequence
  chemically synthesized
tcagataagcagcagcattaca

SEQ ID NO: 1261883 - DNA, 22 bp, Artificial Sequence
  chemically synthesized
ctatgagaatgtaatgctgctg

SEQ ID NO: 1261884 - DNA, 22 bp, Artificial Sequence
  chemically synthesized
ctgtcagataagcagcagcatt

SEQ ID NO: 1261885 - DNA, 22 bp, Artificial Sequence
  chemically synthesized
tgagaatgtaatgctgctgctt

SEQ ID NO: 1261886 - DNA, 22 bp, Artificial Sequence
  chemically synthesized
cctcctgtcagataagcagcag

SEQ ID NO: 1261887 - DNA, 22 bp, Artificial Sequence
  chemically synthesized
tgcctcctgtcagataagcagc

SEQ ID NO: 1261888 - DNA, 22 bp, Artificial Sequence
  chemically synthesized
agctctgcctcctgtcagataa

SEQ ID NO: 1261889 - DNA, 22 bp, Artificial Sequence
  chemically synthesized
ctgcttatctgacaggaggcag

SEQ ID NO: 1261890 - DNA, 22 bp, Artificial Sequence
  chemically synthesized
cttatctgacaggaggcagagc

SEQ ID NO: 1261891 - DNA, 22 bp, Artificial Sequence
  chemically synthesized
atctgacaggaggcagagctca

SEQ ID NO: 1261892 - DNA, 22 bp, Artificial Sequence
  chemically synthesized
tctgacaggaggcagagctcag

SEQ ID NO: 1261893 - DNA, 22 bp, Artificial Sequence
  chemically synthesized
acaggaggcagagctcaggctt

SEQ ID NO: 1261894 - DNA, 22 bp, Artificial Sequence
  chemically synthesized
aggcttgcccggggctcacttc

SEQ ID NO: 1261895 - DNA, 22 bp, Artificial Sequence
  chemically synthesized
gcccggggctcacttcctgctg

SEQ ID NO: 1261896 - DNA, 22 bp, Artificial Sequence
  chemically synthesized
cccggggctcacttcctgctgt

SEQ ID NO: 1261897 - DNA, 22 bp, Artificial Sequence
  chemically synthesized
gaaaccagggggaacagcagga

SEQ ID NO: 1261898 - DNA, 22 bp, Artificial Sequence
  chemically synthesized
ttagaaaccagggggaacagca

SEQ ID NO: 1261899 - DNA, 22 bp, Artificial Sequence
  chemically synthesized
acttcctgctgttccccctggt

SEQ ID NO: 1261900 - DNA, 22 bp, Artificial Sequence
  chemically synthesized
cctgctgttccccctggtttct

SEQ ID NO: 1261901 - DNA, 22 bp, Artificial Sequence
  chemically synthesized
ctgctgttccccctggtttcta

SEQ ID NO: 1261902 - DNA, 22 bp, Artificial Sequence
  chemically synthesized
ctgttccccctggtttctaaca

SEQ ID NO: 1261903 - DNA, 22 bp, Artificial Sequence
  chemically synthesized
ttccccctggtttctaacaggt

SEQ ID NO: 1261904 - DNA, 22 bp, Artificial Sequence
  chemically synthesized
cccctggtttctaacaggtcac

SEQ ID NO: 1261905 - DNA, 22 bp, Artificial Sequence
  chemically synthesized
gtttctaacaggtcacggaccg

SEQ ID NO: 1261906 - DNA, 22 bp, Artificial Sequence
  chemically synthesized
ggccccagaccaatcggtccgt

SEQ ID NO: 1261907 - DNA, 22 bp, Artificial Sequence
  chemically synthesized
ctaacaggtcacggaccgattg

SEQ ID NO: 1261908 - DNA, 22 bp, Artificial Sequence
  chemically synthesized
taacaggtcacggaccgattgg

SEQ ID NO: 1261909 - DNA, 22 bp, Artificial Sequence
  chemically synthesized
acaggtcacggaccgattggtc

SEQ ID NO: 1261910 - DNA, 22 bp, Artificial Sequence
  chemically synthesized
gtctggggcccagggtttgggg

SEQ ID NO: 1261911 - DNA, 22 bp, Artificial Sequence
  chemically synthesized
gggcccagggtttggggacccc

SEQ ID NO: 1261912 - DNA, 22 bp, Artificial Sequence
  chemically synthesized
cccaaagcaggggtccccaaag

SEQ ID NO: 1261913 - DNA, 22 bp, Artificial Sequence
  chemically synthesized
ggggacccctgctttggggacc

SEQ ID NO: 1261914 - DNA, 22 bp, Artificial Sequence
  chemically synthesized
gggacccctgctttggggaccc

SEQ ID NO: 1261915 - DNA, 22 bp, Artificial Sequence
  chemically synthesized
tccccaaagcaggggtccccaa

SEQ ID NO: 1261916 - DNA, 22 bp, Artificial Sequence
  chemically synthesized
ttctccccaaagcaggggtccc

SEQ ID NO: 1261917 - DNA, 22 bp, Artificial Sequence
  chemically synthesized
tgctgttctccccaaagcaggg

SEQ ID NO: 1261918 - DNA, 22 bp, Artificial Sequence
  chemically synthesized
atgctgttctccccaaagcagg

SEQ ID NO: 1261919 - DNA, 22 bp, Artificial Sequence
  chemically synthesized
ctttggggacccctgctttggg

SEQ ID NO: 1261920 - DNA, 22 bp, Artificial Sequence
  chemically synthesized
tatgctgttctccccaaagcag

SEQ ID NO: 1261921 - DNA, 22 bp, Artificial Sequence
  chemically synthesized
ttatgctgttctccccaaagca

SEQ ID NO: 1261922 - DNA, 22 bp, Artificial Sequence
  chemically synthesized
tttatgctgttctccccaaagc

SEQ ID NO: 1261923 - DNA, 22 bp, Artificial Sequence
  chemically synthesized
tggggacccctgctttggggag

SEQ ID NO: 1261924 - DNA, 22 bp, Artificial Sequence
  chemically synthesized
ggggacccctgctttggggaga

SEQ ID NO: 1261925 - DNA, 22 bp, Artificial Sequence
  chemically synthesized
gggacccctgctttggggagaa

SEQ ID NO: 1261926 - DNA, 22 bp, Artificial Sequence
  chemically synthesized
cctttttatgctgttctcccca

SEQ ID NO: 1261927 - DNA, 22 bp, Artificial Sequence
  chemically synthesized
ctttggggagaacagcataaaa

SEQ ID NO: 1261928 - DNA, 22 bp, Artificial Sequence
  chemically synthesized
agaaatgctgcctttttatgct

SEQ ID NO: 1261929 - DNA, 22 bp, Artificial Sequence
  chemically synthesized
cagaaatgctgcctttttatgc

SEQ ID NO: 1261930 - DNA, 22 bp, Artificial Sequence
  chemically synthesized
tggggagaacagcataaaaagg

SEQ ID NO: 1261931 - DNA, 22 bp, Artificial Sequence
  chemically synthesized
ggggagaacagcataaaaaggc

SEQ ID NO: 1261932 - DNA, 22 bp, Artificial Sequence
  chemically synthesized
gggagaacagcataaaaaggca

SEQ ID NO: 1261933 - DNA, 22 bp, Artificial Sequence
  chemically synthesized
gaacagtttcagaaatgctgcc

SEQ ID NO: 1261934 - DNA, 22 bp, Artificial Sequence
  chemically synthesized
acagaaaaataaaaatctagaa

SEQ ID NO: 1261935 - DNA, 22 bp, Artificial Sequence
  chemically synthesized
ctgaaactgttctagattttta

SEQ ID NO: 1261936 - DNA, 22 bp, Artificial Sequence
  chemically synthesized
ctgacagaaaaataaaaatcta

SEQ ID NO: 1261937 - DNA, 22 bp, Artificial Sequence
  chemically synthesized
tgaaactgttctagatttttat

SEQ ID NO: 1261938 - DNA, 22 bp, Artificial Sequence
  chemically synthesized
actgacagaaaaataaaaatct

SEQ ID NO: 1261939 - DNA, 22 bp, Artificial Sequence
  chemically synthesized
tactgacagaaaaataaaaatc

SEQ ID NO: 1261940 - DNA, 22 bp, Artificial Sequence
  chemically synthesized
aaactgttctagatttttattt

SEQ ID NO: 1261941 - DNA, 22 bp, Artificial Sequence
  chemically synthesized
ttctagatttttatttttctgt

SEQ ID NO: 1261942 - DNA, 22 bp, Artificial Sequence
  chemically synthesized
caaccattttactgacagaaaa

SEQ ID NO: 1261943 - DNA, 22 bp, Artificial Sequence
  chemically synthesized
tagatttttatttttctgtcag

SEQ ID NO: 1261944 - DNA, 22 bp, Artificial Sequence
  chemically synthesized
gatttttatttttctgtcagta

SEQ ID NO: 1261945 - DNA, 22 bp, Artificial Sequence
  chemically synthesized
ttatttttctgtcagtaaaatg

SEQ ID NO: 1261946 - DNA, 22 bp, Artificial Sequence
  chemically synthesized
tatttttctgtcagtaaaatgg

SEQ ID NO: 1261947 - DNA, 22 bp, Artificial Sequence
  chemically synthesized
atttttctgtcagtaaaatggt

SEQ ID NO: 1261948 - DNA, 22 bp, Artificial Sequence
  chemically synthesized
tttttctgtcagtaaaatggtt

SEQ ID NO: 1261949 - DNA, 22 bp, Artificial Sequence
  chemically synthesized
tataccaatactacaaccattt

SEQ ID NO: 1261950 - DNA, 22 bp, Artificial Sequence
  chemically synthesized
ttctgtcagtaaaatggttgta

SEQ ID NO: 1261951 - DNA, 22 bp, Artificial Sequence
  chemically synthesized
atataccaatactacaaccatt

SEQ ID NO: 1261952 - DNA, 22 bp, Artificial Sequence
  chemically synthesized
tctgtcagtaaaatggttgtag

SEQ ID NO: 1261953 - DNA, 22 bp, Artificial Sequence
  chemically synthesized
ctgtcagtaaaatggttgtagt

SEQ ID NO: 1261954 - DNA, 22 bp, Artificial Sequence
  chemically synthesized
tgtcagtaaaatggttgtagta

SEQ ID NO: 1261955 - DNA, 22 bp, Artificial Sequence
  chemically synthesized
tcagtaaaatggttgtagtatt

SEQ ID NO: 1261956 - DNA, 22 bp, Artificial Sequence
  chemically synthesized
caatacagtgtaagatttatat

SEQ ID NO: 1261957 - DNA, 22 bp, Artificial Sequence
  chemically synthesized
tagtattggtatataaatctta

SEQ ID NO: 1261958 - DNA, 22 bp, Artificial Sequence
  chemically synthesized
tacaatacagtgtaagatttat

SEQ ID NO: 1261959 - DNA, 22 bp, Artificial Sequence
  chemically synthesized
agactctacaatacagtgtaag

SEQ ID NO: 1261960 - DNA, 22 bp, Artificial Sequence
  chemically synthesized
gtatataaatcttacactgtat

SEQ ID NO: 1261961 - DNA, 22 bp, Artificial Sequence
  chemically synthesized
ttgagactctacaatacagtgt

SEQ ID NO: 1261962 - DNA, 22 bp, Artificial Sequence
  chemically synthesized
attgagactctacaatacagtg

SEQ ID NO: 1261963 - DNA, 22 bp, Artificial Sequence
  chemically synthesized
tattgagactctacaatacagt

SEQ ID NO: 1261964 - DNA, 22 bp, Artificial Sequence
  chemically synthesized
acactgtattgtagagtctcaa

SEQ ID NO: 1261965 - DNA, 22 bp, Artificial Sequence
  chemically synthesized
cactgtattgtagagtctcaat

SEQ ID NO: 1261966 - DNA, 22 bp, Artificial Sequence
  chemically synthesized
agtgagtaactttattgagact

SEQ ID NO: 1261967 - DNA, 22 bp, Artificial Sequence
  chemically synthesized
tattgtagagtctcaataaagt

SEQ ID NO: 1261968 - DNA, 22 bp, Artificial Sequence
  chemically synthesized
attcagtgagtaactttattga

SEQ ID NO: 1261969 - DNA, 22 bp, Artificial Sequence
  chemically synthesized
tagagtctcaataaagttactc

SEQ ID NO: 1261970 - DNA, 22 bp, Artificial Sequence
  chemically synthesized
aaatattcattcagtgagtaac

SEQ ID NO: 1261971 - DNA, 22 bp, Artificial Sequence
  chemically synthesized
aaaatattcattcagtgagtaa

SEQ ID NO: 1261972 - DNA, 22 bp, Artificial Sequence
  chemically synthesized
taaaatattcattcagtgagta

SEQ ID NO: 1261973 - DNA, 22 bp, Artificial Sequence
  chemically synthesized
ttaaaatattcattcagtgagt

SEQ ID NO: 1261974 - DNA, 22 bp, Artificial Sequence
  chemically synthesized
tttaaaatattcattcagtgag

SEQ ID NO: 1261975 - DNA, 22 bp, Artificial Sequence
  chemically synthesized
aataaagttactcactgaatga

SEQ ID NO: 1261976 - DNA, 22 bp, Artificial Sequence
  chemically synthesized
ctcactgaatgaatattttaaa

SEQ ID NO: 1261977 - DNA, 22 bp, Artificial Sequence
  chemically synthesized
ataagggaaaactttttaaaat

SEQ ID NO: 1261978 - DNA, 22 bp, Artificial Sequence
  chemically synthesized
actgaatgaatattttaaaaag

SEQ ID NO: 1261979 - DNA, 22 bp, Artificial Sequence
  chemically synthesized
aataagggaaaactttttaaaa

SEQ ID NO: 1261980 - DNA, 22 bp, Artificial Sequence
  chemically synthesized
aatgaatattttaaaaagtttt

SEQ ID NO: 1261981 - DNA, 22 bp, Artificial Sequence
  chemically synthesized
taatttaataagggaaaacttt

SEQ ID NO: 1261982 - DNA, 22 bp, Artificial Sequence
  chemically synthesized
gtaatttaataagggaaaactt

SEQ ID NO: 1261983 - DNA, 22 bp, Artificial Sequence
  chemically synthesized
tgtaatttaataagggaaaact

SEQ ID NO: 1261984 - DNA, 22 bp, Artificial Sequence
  chemically synthesized
ttgtaatttaataagggaaaac

SEQ ID NO: 1261985 - DNA, 22 bp, Artificial Sequence
  chemically synthesized
cttttgtaatttaataagggaa

SEQ ID NO: 1261986 - DNA, 22 bp, Artificial Sequence
  chemically synthesized
acttttgtaatttaataaggga

SEQ ID NO: 1261987 - DNA, 22 bp, Artificial Sequence
  chemically synthesized
tacttttgtaatttaataaggg

SEQ ID NO: 1261988 - DNA, 22 bp, Artificial Sequence
  chemically synthesized
taaaaagttttcccttattaaa

SEQ ID NO: 1261989 - DNA, 22 bp, Artificial Sequence
  chemically synthesized
aaaaagttttcccttattaaat

SEQ ID NO: 1261990 - DNA, 22 bp, Artificial Sequence
  chemically synthesized
aaaagttttcccttattaaatt

SEQ ID NO: 1261991 - DNA, 22 bp, Artificial Sequence
  chemically synthesized
ttttacttttgtaatttaataa

SEQ ID NO: 1261992 - DNA, 22 bp, Artificial Sequence
  chemically synthesized
ctattttacttttgtaatttaa

SEQ ID NO: 1261993 - DNA, 22 bp, Artificial Sequence
  chemically synthesized
tcccttattaaattacaaaagt

SEQ ID NO: 1261994 - DNA, 22 bp, Artificial Sequence
  chemically synthesized
cccttattaaattacaaaagta

SEQ ID NO: 1261995 - DNA, 22 bp, Artificial Sequence
  chemically synthesized
ccttattaaattacaaaagtaa

SEQ ID NO: 1261996 - DNA, 22 bp, Artificial Sequence
  chemically synthesized
tagtactcctattttacttttg

SEQ ID NO: 1261997 - DNA, 22 bp, Artificial Sequence
  chemically synthesized
attaaattacaaaagtaaaata

SEQ ID NO: 1261998 - DNA, 22 bp, Artificial Sequence
  chemically synthesized
ttaaattacaaaagtaaaatag

SEQ ID NO: 1261999 - DNA, 22 bp, Artificial Sequence
  chemically synthesized
tgttatagtactcctattttac

SEQ ID NO: 1262000 - DNA, 22 bp, Artificial Sequence
  chemically synthesized
aattacaaaagtaaaataggag

SEQ ID NO: 1262001 - DNA, 22 bp, Artificial Sequence
  chemically synthesized
caaaagtaaaataggagtacta

SEQ ID NO: 1262002 - DNA, 22 bp, Artificial Sequence
  chemically synthesized
tgtagattatgttatagtactc

SEQ ID NO: 1262003 - DNA, 22 bp, Artificial Sequence
  chemically synthesized
atgtagattatgttatagtact

SEQ ID NO: 1262004 - DNA, 22 bp, Artificial Sequence
  chemically synthesized
gtatttatgtagattatgttat

SEQ ID NO: 1262005 - DNA, 22 bp, Artificial Sequence
  chemically synthesized
ggtatttatgtagattatgtta

SEQ ID NO: 1262006 - DNA, 22 bp, Artificial Sequence
  chemically synthesized
atatttggtatttatgtagatt

SEQ ID NO: 1262007 - DNA, 22 bp, Artificial Sequence
  chemically synthesized
taacataatctacataaatacc

SEQ ID NO: 1262008 - DNA, 22 bp, Artificial Sequence
  chemically synthesized
cataaataccaaatatgaattg

SEQ ID NO: 1262009 - DNA, 22 bp, Artificial Sequence
  chemically synthesized
aaatataggaaaaatatatcaa

SEQ ID NO: 1262010 - DNA, 22 bp, Artificial Sequence
  chemically synthesized
ttaaaatataggaaaaatatat

SEQ ID NO: 1262011 - DNA, 22 bp, Artificial Sequence
  chemically synthesized
tgttaaaatataggaaaaatat

SEQ ID NO: 1262012 - DNA, 22 bp, Artificial Sequence
  chemically synthesized
ctgttaaaatataggaaaaata

SEQ ID NO: 1262013 - DNA, 22 bp, Artificial Sequence
  chemically synthesized
atatatttttcctatattttaa

SEQ ID NO: 1262014 - DNA, 22 bp, Artificial Sequence
  chemically synthesized
aagaagaatttctgttaaaata

SEQ ID NO: 1262015 - DNA, 22 bp, Artificial Sequence
  chemically synthesized
tcaagaagaatttctgttaaaa

SEQ ID NO: 1262016 - DNA, 22 bp, Artificial Sequence
  chemically synthesized
tctcaagaagaatttctgttaa

SEQ ID NO: 1262017 - DNA, 22 bp, Artificial Sequence
  chemically synthesized
ctctcaagaagaatttctgtta

SEQ ID NO: 1262018 - DNA, 22 bp, Artificial Sequence
  chemically synthesized
ttcctatattttaacagaaatt

SEQ ID NO: 1262019 - DNA, 22 bp, Artificial Sequence
  chemically synthesized
tcctatattttaacagaaattc

SEQ ID NO: 1262020 - DNA, 22 bp, Artificial Sequence
  chemically synthesized
cctatattttaacagaaattct

SEQ ID NO: 1262021 - DNA, 22 bp, Artificial Sequence
  chemically synthesized
ctatattttaacagaaattctt

SEQ ID NO: 1262022 - DNA, 22 bp, Artificial Sequence
  chemically synthesized
tgtttctctcaagaagaatttc

SEQ ID NO: 1262023 - DNA, 22 bp, Artificial Sequence
  chemically synthesized
tattttaacagaaattcttctt

SEQ ID NO: 1262024 - DNA, 22 bp, Artificial Sequence
  chemically synthesized
tatgtttctctcaagaagaatt

SEQ ID NO: 1262025 - DNA, 22 bp, Artificial Sequence
  chemically synthesized
taacagaaattcttcttgagag

SEQ ID NO: 1262026 - DNA, 22 bp, Artificial Sequence
  chemically synthesized
aacagaaattcttcttgagaga

SEQ ID NO: 1262027 - DNA, 22 bp, Artificial Sequence
  chemically synthesized
acagaaattcttcttgagagaa

SEQ ID NO: 1262028 - DNA, 22 bp, Artificial Sequence
  chemically synthesized
ttcttgagagaaacatagaatt

SEQ ID NO: 1262029 - DNA, 22 bp, Artificial Sequence
  chemically synthesized
cttgagagaaacatagaattct

SEQ ID NO: 1262030 - DNA, 22 bp, Artificial Sequence
  chemically synthesized
ttgagagaaacatagaattcta

SEQ ID NO: 1262031 - DNA, 22 bp, Artificial Sequence
  chemically synthesized
taaataggagacatagaattct

SEQ ID NO: 1262032 - DNA, 22 bp, Artificial Sequence
  chemically synthesized
gagagaaacatagaattctatg

SEQ ID NO: 1262033 - DNA, 22 bp, Artificial Sequence
  chemically synthesized
agagaaacatagaattctatgt

SEQ ID NO: 1262034 - DNA, 22 bp, Artificial Sequence
  chemically synthesized
atgtctataaataggagacata

SEQ ID NO: 1262035 - DNA, 22 bp, Artificial Sequence
  chemically synthesized
tatgtctcctatttatagacat

SEQ ID NO: 1262036 - DNA, 22 bp, Artificial Sequence
  chemically synthesized
tgtctcctatttatagacatta

SEQ ID NO: 1262037 - DNA, 22 bp, Artificial Sequence
  chemically synthesized
tgcaaaatgtagcagttaatgt

SEQ ID NO: 1262038 - DNA, 22 bp, Artificial Sequence
  chemically synthesized
ctatttatagacattaactgct

SEQ ID NO: 1262039 - DNA, 22 bp, Artificial Sequence
  chemically synthesized
tttatagacattaactgctaca

SEQ ID NO: 1262040 - DNA, 22 bp, Artificial Sequence
  chemically synthesized
atagacattaactgctacattt

SEQ ID NO: 1262041 - DNA, 22 bp, Artificial Sequence
  chemically synthesized
tagacattaactgctacatttt

SEQ ID NO: 1262042 - DNA, 22 bp, Artificial Sequence
  chemically synthesized
acggtaaaagtggttgtgcaaa

SEQ ID NO: 1262043 - DNA, 22 bp, Artificial Sequence
  chemically synthesized
actgctacattttgcacaacca

SEQ ID NO: 1262044 - DNA, 22 bp, Artificial Sequence
  chemically synthesized
taacggtaaaagtggttgtgca

SEQ ID NO: 1262045 - DNA, 22 bp, Artificial Sequence
  chemically synthesized
ctaacggtaaaagtggttgtgc

SEQ ID NO: 1262046 - DNA, 22 bp, Artificial Sequence
  chemically synthesized
tctaacggtaaaagtggttgtg

SEQ ID NO: 1262047 - DNA, 22 bp, Artificial Sequence
  chemically synthesized
ctacattttgcacaaccacttt

SEQ ID NO: 1262048 - DNA, 22 bp, Artificial Sequence
  chemically synthesized
tttctaacggtaaaagtggttg

SEQ ID NO: 1262049 - DNA, 22 bp, Artificial Sequence
  chemically synthesized
tctttctaacggtaaaagtggt

SEQ ID NO: 1262050 - DNA, 22 bp, Artificial Sequence
  chemically synthesized
cattttgcacaaccacttttac

SEQ ID NO: 1262051 - DNA, 22 bp, Artificial Sequence
  chemically synthesized
tgcacaaccacttttaccgtta

SEQ ID NO: 1262052 - DNA, 22 bp, Artificial Sequence
  chemically synthesized
gcacaaccacttttaccgttag

SEQ ID NO: 1262053 - DNA, 22 bp, Artificial Sequence
  chemically synthesized
cacaaccacttttaccgttaga

SEQ ID NO: 1262054 - DNA, 22 bp, Artificial Sequence
  chemically synthesized
ttaccgttagaaagagaactgt

SEQ ID NO: 1262055 - DNA, 22 bp, Artificial Sequence
  chemically synthesized
taccgttagaaagagaactgta

SEQ ID NO: 1262056 - DNA, 22 bp, Artificial Sequence
  chemically synthesized
accgttagaaagagaactgtac

SEQ ID NO: 1262057 - DNA, 22 bp, Artificial Sequence
  chemically synthesized
ccgttagaaagagaactgtact

SEQ ID NO: 1262058 - DNA, 22 bp, Artificial Sequence
  chemically synthesized
tgtaaccatcaaagtacagttc

SEQ ID NO: 1262059 - DNA, 22 bp, Artificial Sequence
  chemically synthesized
gaaagagaactgtactttgatg

SEQ ID NO: 1262060 - DNA, 22 bp, Artificial Sequence
  chemically synthesized
tactttgatggttacatagcac

SEQ ID NO: 1262061 - DNA, 22 bp, Artificial Sequence
  chemically synthesized
tacatgaggaaaaggtgctatg

SEQ ID NO: 1262062 - DNA, 22 bp, Artificial Sequence
  chemically synthesized
gtacatgaggaaaaggtgctat

SEQ ID NO: 1262063 - DNA, 22 bp, Artificial Sequence
  chemically synthesized
tgtacatgaggaaaaggtgcta

SEQ ID NO: 1262064 - DNA, 22 bp, Artificial Sequence
  chemically synthesized
tgatggttacatagcacctttt

SEQ ID NO: 1262065 - DNA, 22 bp, Artificial Sequence
  chemically synthesized
gatggttacatagcaccttttc

SEQ ID NO: 1262066 - DNA, 22 bp, Artificial Sequence
  chemically synthesized
atggttacatagcaccttttcc

SEQ ID NO: 1262067 - DNA, 22 bp, Artificial Sequence
  chemically synthesized
gtattttgtacatgaggaaaag

SEQ ID NO: 1262068 - DNA, 22 bp, Artificial Sequence
  chemically synthesized
catagcaccttttcctcatgta

SEQ ID NO: 1262069 - DNA, 22 bp, Artificial Sequence
  chemically synthesized
gtagcattagtattttgtacat

SEQ ID NO: 1262070 - DNA, 22 bp, Artificial Sequence
  chemically synthesized
ttagtagcattagtattttgta

SEQ ID NO: 1262071 - DNA, 22 bp, Artificial Sequence
  chemically synthesized
gttagtagcattagtattttgt

SEQ ID NO: 1262072 - DNA, 22 bp, Artificial Sequence
  chemically synthesized
tgttagtagcattagtattttg

SEQ ID NO: 1262073 - DNA, 22 bp, Artificial Sequence
  chemically synthesized
ttcctcatgtacaaaatactaa

SEQ ID NO: 1262074 - DNA, 22 bp, Artificial Sequence
  chemically synthesized
ttgttagtagcattagtatttt

SEQ ID NO: 1262075 - DNA, 22 bp, Artificial Sequence
  chemically synthesized
tcctcatgtacaaaatactaat

SEQ ID NO: 1262076 - DNA, 22 bp, Artificial Sequence
  chemically synthesized
cctcatgtacaaaatactaatg

SEQ ID NO: 1262077 - DNA, 22 bp, Artificial Sequence
  chemically synthesized
ctcatgtacaaaatactaatgc

SEQ ID NO: 1262078 - DNA, 22 bp, Artificial Sequence
  chemically synthesized
tttttgttagtagcattagtat

SEQ ID NO: 1262079 - DNA, 22 bp, Artificial Sequence
  chemically synthesized
atgtacaaaatactaatgctac

SEQ ID NO: 1262080 - DNA, 22 bp, Artificial Sequence
  chemically synthesized
aaattatttttgttagtagcat

SEQ ID NO: 1262081 - DNA, 22 bp, Artificial Sequence
  chemically synthesized
aaaattatttttgttagtagca

SEQ ID NO: 1262082 - DNA, 22 bp, Artificial Sequence
  chemically synthesized
atcacttaaaattatttttgtt

SEQ ID NO: 1262083 - DNA, 22 bp, Artificial Sequence
  chemically synthesized
gatcacttaaaattatttttgt

SEQ ID NO: 1262084 - DNA, 22 bp, Artificial Sequence
  chemically synthesized
tgatcacttaaaattatttttg

SEQ ID NO: 1262085 - DNA, 22 bp, Artificial Sequence
  chemically synthesized
atgctactaacaaaaataattt

SEQ ID NO: 1262086 - DNA, 22 bp, Artificial Sequence
  chemically synthesized
atattttgatcacttaaaatta

SEQ ID NO: 1262087 - DNA, 22 bp, Artificial Sequence
  chemically synthesized
catattttgatcacttaaaatt

SEQ ID NO: 1262088 - DNA, 22 bp, Artificial Sequence
  chemically synthesized
ctaacaaaaataattttaagtg

SEQ ID NO: 1262089 - DNA, 22 bp, Artificial Sequence
  chemically synthesized
acaaaaataattttaagtgatc

SEQ ID NO: 1262090 - DNA, 22 bp, Artificial Sequence
  chemically synthesized
catttcatattttgatcactta

SEQ ID NO: 1262091 - DNA, 22 bp, Artificial Sequence
  chemically synthesized
ataattacatttcatattttga

SEQ ID NO: 1262092 - DNA, 22 bp, Artificial Sequence
  chemically synthesized
gataattacatttcatattttg

SEQ ID NO: 1262093 - DNA, 22 bp, Artificial Sequence
  chemically synthesized
taagtgatcaaaatatgaaatg

SEQ ID NO: 1262094 - DNA, 22 bp, Artificial Sequence
  chemically synthesized
aagtgatcaaaatatgaaatgt

SEQ ID NO: 1262095 - DNA, 22 bp, Artificial Sequence
  chemically synthesized
agtgatcaaaatatgaaatgta

SEQ ID NO: 1262096 - DNA, 22 bp, Artificial Sequence
  chemically synthesized
ataatggggtttgataattaca

SEQ ID NO: 1262097 - DNA, 22 bp, Artificial Sequence
  chemically synthesized
atcctcataatggggtttgata

SEQ ID NO: 1262098 - DNA, 22 bp, Artificial Sequence
  chemically synthesized
acctcatcctcataatggggtt

SEQ ID NO: 1262099 - DNA, 22 bp, Artificial Sequence
  chemically synthesized
aacctcatcctcataatggggt

SEQ ID NO: 1262100 - DNA, 22 bp, Artificial Sequence
  chemically synthesized
tcttaacctcatcctcataatg

SEQ ID NO: 1262101 - DNA, 22 bp, Artificial Sequence
  chemically synthesized
atcttaacctcatcctcataat

SEQ ID NO: 1262102 - DNA, 22 bp, Artificial Sequence
  chemically synthesized
tatcttaacctcatcctcataa

SEQ ID NO: 1262103 - DNA, 22 bp, Artificial Sequence
  chemically synthesized
tcaaaccccattatgaggatga

SEQ ID NO: 1262104 - DNA, 22 bp, Artificial Sequence
  chemically synthesized
ctttatcttaacctcatcctca

SEQ ID NO: 1262105 - DNA, 22 bp, Artificial Sequence
  chemically synthesized
actttatcttaacctcatcctc

SEQ ID NO: 1262106 - DNA, 22 bp, Artificial Sequence
  chemically synthesized
tactttatcttaacctcatcct

SEQ ID NO: 1262107 - DNA, 22 bp, Artificial Sequence
  chemically synthesized
tgaggatgaggttaagataaag

SEQ ID NO: 1262108 - DNA, 22 bp, Artificial Sequence
  chemically synthesized
acaaagatgattttactttatc

SEQ ID NO: 1262109 - DNA, 22 bp, Artificial Sequence
  chemically synthesized
agataaagtaaaatcatctttg

SEQ ID NO: 1262110 - DNA, 22 bp, Artificial Sequence
  chemically synthesized
cgccccaccctgacaaagatga

SEQ ID NO: 1262111 - DNA, 22 bp, Artificial Sequence
  chemically synthesized
caggtgtgagccactgcgcccc

SEQ ID NO: 1262112 - DNA, 22 bp, Artificial Sequence
  chemically synthesized
tgtcagggtggggcgcagtggc

SEQ ID NO: 1262113 - DNA, 22 bp, Artificial Sequence
  chemically synthesized
gtcagggtggggcgcagtggct

SEQ ID NO: 1262114 - DNA, 22 bp, Artificial Sequence
  chemically synthesized
tcagggtggggcgcagtggctc

SEQ ID NO: 1262115 - DNA, 22 bp, Artificial Sequence
  chemically synthesized
agattacaggtgtgagccactg

SEQ ID NO: 1262116 - DNA, 22 bp, Artificial Sequence
  chemically synthesized
ccaaagtattgagattacaggt

SEQ ID NO: 1262117 - DNA, 22 bp, Artificial Sequence
  chemically synthesized
gcctcccaaagtattgagatta

SEQ ID NO: 1262118 - DNA, 22 bp, Artificial Sequence
  chemically synthesized
ggcctcccaaagtattgagatt

SEQ ID NO: 1262119 - DNA, 22 bp, Artificial Sequence
  chemically synthesized
acacctgtaatctcaatacttt

SEQ ID NO: 1262120 - DNA, 22 bp, Artificial Sequence
  chemically synthesized
ccttggcctcccaaagtattga

SEQ ID NO: 1262121 - DNA, 22 bp, Artificial Sequence
  chemically synthesized
taatctcaatactttgggaggc

SEQ ID NO: 1262122 - DNA, 22 bp, Artificial Sequence
  chemically synthesized
aatactttgggaggccaaggca

SEQ ID NO: 1262123 - DNA, 22 bp, Artificial Sequence
  chemically synthesized
aagtgatccccctgccttggcc

SEQ ID NO: 1262124 - DNA, 22 bp, Artificial Sequence
  chemically synthesized
gcctcaagtgatccccctgcct

SEQ ID NO: 1262125 - DNA, 22 bp, Artificial Sequence
  chemically synthesized
tgggaggccaaggcagggggat

SEQ ID NO: 1262126 - DNA, 22 bp, Artificial Sequence
  chemically synthesized
gggaggccaaggcagggggatc

SEQ ID NO: 1262127 - DNA, 22 bp, Artificial Sequence
  chemically synthesized
ctggcctcaagtgatccccctg

SEQ ID NO: 1262128 - DNA, 22 bp, Artificial Sequence
  chemically synthesized
ggaggccaaggcagggggatca

SEQ ID NO: 1262129 - DNA, 22 bp, Artificial Sequence
  chemically synthesized
gaactcctggcctcaagtgatc

SEQ ID NO: 1262130 - DNA, 22 bp, Artificial Sequence
  chemically synthesized
gtctcgaactcctggcctcaag

SEQ ID NO: 1262131 - DNA, 22 bp, Artificial Sequence
  chemically synthesized
taatggccaggctggtctcgaa

SEQ ID NO: 1262132 - DNA, 22 bp, Artificial Sequence
  chemically synthesized
gaggccaggagttcgagaccag

SEQ ID NO: 1262133 - DNA, 22 bp, Artificial Sequence
  chemically synthesized
aggccaggagttcgagaccagc

SEQ ID NO: 1262134 - DNA, 22 bp, Artificial Sequence
  chemically synthesized
gctataatggccaggctggtct

SEQ ID NO: 1262135 - DNA, 22 bp, Artificial Sequence
  chemically synthesized
cgctataatggccaggctggtc

SEQ ID NO: 1262136 - DNA, 22 bp, Artificial Sequence
  chemically synthesized
gagaccagcctggccattatag

SEQ ID NO: 1262137 - DNA, 22 bp, Artificial Sequence
  chemically synthesized
gtagagatggggtttcgctata

SEQ ID NO: 1262138 - DNA, 22 bp, Artificial Sequence
  chemically synthesized
agtagagatggggtttcgctat

SEQ ID NO: 1262139 - DNA, 22 bp, Artificial Sequence
  chemically synthesized
tagtagagatggggtttcgcta

SEQ ID NO: 1262140 - DNA, 22 bp, Artificial Sequence
  chemically synthesized
ttagtagagatggggtttcgct

SEQ ID NO: 1262141 - DNA, 22 bp, Artificial Sequence
  chemically synthesized
gccattatagcgaaaccccatc

SEQ ID NO: 1262142 - DNA, 22 bp, Artificial Sequence
  chemically synthesized
tatttttagtagagatggggtt

SEQ ID NO: 1262143 - DNA, 22 bp, Artificial Sequence
  chemically synthesized
gtatttttagtagagatggggt

SEQ ID NO: 1262144 - DNA, 22 bp, Artificial Sequence
  chemically synthesized
tgtatttttagtagagatgggg

SEQ ID NO: 1262145 - DNA, 22 bp, Artificial Sequence
  chemically synthesized
ttgtatttttagtagagatggg

SEQ ID NO: 1262146 - DNA, 22 bp, Artificial Sequence
  chemically synthesized
tagcgaaaccccatctctacta

SEQ ID NO: 1262147 - DNA, 22 bp, Artificial Sequence
  chemically synthesized
atttttgtatttttagtagaga

SEQ ID NO: 1262148 - DNA, 22 bp, Artificial Sequence
  chemically synthesized
tactaaaaatacaaaaattaga

SEQ ID NO: 1262149 - DNA, 22 bp, Artificial Sequence
  chemically synthesized
ctaaaaatacaaaaattagatg

SEQ ID NO: 1262150 - DNA, 22 bp, Artificial Sequence
  chemically synthesized
aaaatacaaaaattagatgggt

SEQ ID NO: 1262151 - DNA, 22 bp, Artificial Sequence
  chemically synthesized
caggggtgtgccaccacaccca

SEQ ID NO: 1262152 - DNA, 22 bp, Artificial Sequence
  chemically synthesized
ggattacaggggtgtgccacca

SEQ ID NO: 1262153 - DNA, 22 bp, Artificial Sequence
  chemically synthesized
gatgggtgtggtggcacacccc

SEQ ID NO: 1262154 - DNA, 22 bp, Artificial Sequence
  chemically synthesized
ccgagtagctgggattacaggg

SEQ ID NO: 1262155 - DNA, 22 bp, Artificial Sequence
  chemically synthesized
agcctaccgagtagctgggatt

SEQ ID NO: 1262156 - DNA, 22 bp, Artificial Sequence
  chemically synthesized
ccacctcagcctaccgagtagc

SEQ ID NO: 1262157 - DNA, 22 bp, Artificial Sequence
  chemically synthesized
tcccacctcagcctaccgagta

SEQ ID NO: 1262158 - DNA, 22 bp, Artificial Sequence
  chemically synthesized
taatcccagctactcggtaggc

SEQ ID NO: 1262159 - DNA, 22 bp, Artificial Sequence
  chemically synthesized
agcgattctcccacctcagcct

SEQ ID NO: 1262160 - DNA, 22 bp, Artificial Sequence
  chemically synthesized
ctcggtaggctgaggtgggaga

SEQ ID NO: 1262161 - DNA, 22 bp, Artificial Sequence
  chemically synthesized
ggtaggctgaggtgggagaatc

SEQ ID NO: 1262162 - DNA, 22 bp, Artificial Sequence
  chemically synthesized
ccggggttaagcgattctccca

SEQ ID NO: 1262163 - DNA, 22 bp, Artificial Sequence
  chemically synthesized
gctcccggggttaagcgattct

SEQ ID NO: 1262164 - DNA, 22 bp, Artificial Sequence
  chemically synthesized
tggctcccggggttaagcgatt

SEQ ID NO: 1262165 - DNA, 22 bp, Artificial Sequence
  chemically synthesized
aggtgggagaatcgcttaaccc

SEQ ID NO: 1262166 - DNA, 22 bp, Artificial Sequence
  chemically synthesized
caacctctggctcccggggtta

SEQ ID NO: 1262167 - DNA, 22 bp, Artificial Sequence
  chemically synthesized
actgcaacctctggctcccggg

SEQ ID NO: 1262168 - DNA, 22 bp, Artificial Sequence
  chemically synthesized
gctcactgcaacctctggctcc

SEQ ID NO: 1262169 - DNA, 22 bp, Artificial Sequence
  chemically synthesized
ggctcactgcaacctctggctc

SEQ ID NO: 1262170 - DNA, 22 bp, Artificial Sequence
  chemically synthesized
aaccccgggagccagaggttgc

SEQ ID NO: 1262171 - DNA, 22 bp, Artificial Sequence
  chemically synthesized
accccgggagccagaggttgca

SEQ ID NO: 1262172 - DNA, 22 bp, Artificial Sequence
  chemically synthesized
gagtgaagtggtgcgatcttgg

SEQ ID NO: 1262173 - DNA, 22 bp, Artificial Sequence
  chemically synthesized
cagtgagccaagatcgcaccac

SEQ ID NO: 1262174 - DNA, 22 bp, Artificial Sequence
  chemically synthesized
cccaggctggagtgaagtggtg

SEQ ID NO: 1262175 - DNA, 22 bp, Artificial Sequence
  chemically synthesized
ttgcccaggctggagtgaagtg

SEQ ID NO: 1262176 - DNA, 22 bp, Artificial Sequence
  chemically synthesized
tgttgcccaggctggagtgaag

SEQ ID NO: 1262177 - DNA, 22 bp, Artificial Sequence
  chemically synthesized
ctgttgcccaggctggagtgaa

SEQ ID NO: 1262178 - DNA, 22 bp, Artificial Sequence
  chemically synthesized
acttctgttgcccaggctggag

SEQ ID NO: 1262179 - DNA, 22 bp, Artificial Sequence
  chemically synthesized
agatctcacttctgttgcccag

SEQ ID NO: 1262180 - DNA, 22 bp, Artificial Sequence
  chemically synthesized
aagatctcacttctgttgccca

SEQ ID NO: 1262181 - DNA, 22 bp, Artificial Sequence
  chemically synthesized
taagatctcacttctgttgccc

SEQ ID NO: 1262182 - DNA, 22 bp, Artificial Sequence
  chemically synthesized
cactccagcctgggcaacagaa

SEQ ID NO: 1262183 - DNA, 22 bp, Artificial Sequence
  chemically synthesized
ttaagatctcacttctgttgcc

SEQ ID NO: 1262184 - DNA, 22 bp, Artificial Sequence
  chemically synthesized
actccagcctgggcaacagaag

SEQ ID NO: 1262185 - DNA, 22 bp, Artificial Sequence
  chemically synthesized
tttaagatctcacttctgttgc

SEQ ID NO: 1262186 - DNA, 22 bp, Artificial Sequence
  chemically synthesized
ttttaagatctcacttctgttg

SEQ ID NO: 1262187 - DNA, 22 bp, Artificial Sequence
  chemically synthesized
tttttaagatctcacttctgtt

SEQ ID NO: 1262188 - DNA, 22 bp, Artificial Sequence
  chemically synthesized
ttttttaagatctcacttctgt

SEQ ID NO: 1262189 - DNA, 22 bp, Artificial Sequence
  chemically synthesized
cagcctgggcaacagaagtgag

SEQ ID NO: 1262190 - DNA, 22 bp, Artificial Sequence
  chemically synthesized
tttttttaagatctcacttctg

SEQ ID NO: 1262191 - DNA, 22 bp, Artificial Sequence
  chemically synthesized
ttttttttttaagatctcactt

SEQ ID NO: 1262192 - DNA, 22 bp, Artificial Sequence
  chemically synthesized
gttttttttttaagatctcact

SEQ ID NO: 1262193 - DNA, 22 bp, Artificial Sequence
  chemically synthesized
tgttttttttttaagatctcac

SEQ ID NO: 1262194 - DNA, 22 bp, Artificial Sequence
  chemically synthesized
ttgttttttttttaagatctca

SEQ ID NO: 1262195 - DNA, 22 bp, Artificial Sequence
  chemically synthesized
ggcaacagaagtgagatcttaa

SEQ ID NO: 1262196 - DNA, 22 bp, Artificial Sequence
  chemically synthesized
tttttgttttttttttaagatc

SEQ ID NO: 1262197 - DNA, 22 bp, Artificial Sequence
  chemically synthesized
gtttttgttttttttttaagat

SEQ ID NO: 1262198 - DNA, 22 bp, Artificial Sequence
  chemically synthesized
tgtttttgttttttttttaaga

SEQ ID NO: 1262199 - DNA, 22 bp, Artificial Sequence
  chemically synthesized
ttgtttttgttttttttttaag

SEQ ID NO: 1262200 - DNA, 22 bp, Artificial Sequence
  chemically synthesized
tttttgtttttgtttttttttt

SEQ ID NO: 1262201 - DNA, 22 bp, Artificial Sequence
  chemically synthesized
gtttttgtttttgttttttttt

SEQ ID NO: 1262202 - DNA, 22 bp, Artificial Sequence
  chemically synthesized
tgtttttgtttttgtttttttt

SEQ ID NO: 1262203 - DNA, 22 bp, Artificial Sequence
  chemically synthesized
ttgtttttgtttttgttttttt

SEQ ID NO: 1262204 - DNA, 22 bp, Artificial Sequence
  chemically synthesized
tttgtttttgtttttgtttttt

SEQ ID NO: 1262205 - DNA, 22 bp, Artificial Sequence
  chemically synthesized
attttttgtttttgtttttgtt

SEQ ID NO: 1262206 - DNA, 22 bp, Artificial Sequence
  chemically synthesized
aaaaaaaaaacaaaaacaaaaa

SEQ ID NO: 1262207 - DNA, 22 bp, Artificial Sequence
  chemically synthesized
aaaaaaaaacaaaaacaaaaac

SEQ ID NO: 1262208 - DNA, 22 bp, Artificial Sequence
  chemically synthesized
tagcaaagcatagataaagttg

SEQ ID NO: 1262209 - DNA, 22 bp, Artificial Sequence
  chemically synthesized
acacctatagcaaagcatagat

SEQ ID NO: 1262210 - DNA, 22 bp, Artificial Sequence
  chemically synthesized
tcgttaacacctatagcaaagc

SEQ ID NO: 1262211 - DNA, 22 bp, Artificial Sequence
  chemically synthesized
tatctatgctttgctataggtg

SEQ ID NO: 1262212 - DNA, 22 bp, Artificial Sequence
  chemically synthesized
atctatgctttgctataggtgt

SEQ ID NO: 1262213 - DNA, 22 bp, Artificial Sequence
  chemically synthesized
tctatgctttgctataggtgtt

SEQ ID NO: 1262214 - DNA, 22 bp, Artificial Sequence
  chemically synthesized
tgctttgctataggtgttaacg

SEQ ID NO: 1262215 - DNA, 22 bp, Artificial Sequence
  chemically synthesized
tgctataggtgttaacgataat

SEQ ID NO: 1262216 - DNA, 22 bp, Artificial Sequence
  chemically synthesized
gctataggtgttaacgataatt

SEQ ID NO: 1262217 - DNA, 22 bp, Artificial Sequence
  chemically synthesized
ctataggtgttaacgataattg

SEQ ID NO: 1262218 - DNA, 22 bp, Artificial Sequence
  chemically synthesized
taggtgttaacgataattgcct

SEQ ID NO: 1262219 - DNA, 22 bp, Artificial Sequence
  chemically synthesized
acgataattgcctattgtccta

SEQ ID NO: 1262220 - DNA, 22 bp, Artificial Sequence
  chemically synthesized
ataaaatcatccatgtaggaca

SEQ ID NO: 1262221 - DNA, 22 bp, Artificial Sequence
  chemically synthesized
ttaataaaatcatccatgtagg

SEQ ID NO: 1262222 - DNA, 22 bp, Artificial Sequence
  chemically synthesized
cctattgtcctacatggatgat

SEQ ID NO: 1262223 - DNA, 22 bp, Artificial Sequence
  chemically synthesized
ttgtcctacatggatgatttta

SEQ ID NO: 1262224 - DNA, 22 bp, Artificial Sequence
  chemically synthesized
tcctacatggatgattttatta

SEQ ID NO: 1262225 - DNA, 22 bp, Artificial Sequence
  chemically synthesized
tgtaatcactattaataaaatc

SEQ ID NO: 1262226 - DNA, 22 bp, Artificial Sequence
  chemically synthesized
atgtaatcactattaataaaat

SEQ ID NO: 1262227 - DNA, 22 bp, Artificial Sequence
  chemically synthesized
tatgtaatcactattaataaaa

SEQ ID NO: 1262228 - DNA, 22 bp, Artificial Sequence
  chemically synthesized
ttatgtaatcactattaataaa

SEQ ID NO: 1262229 - DNA, 22 bp, Artificial Sequence
  chemically synthesized
tttatgtaatcactattaataa

SEQ ID NO: 1262230 - DNA, 22 bp, Artificial Sequence
  chemically synthesized
catggatgattttattaatagt

SEQ ID NO: 1262231 - DNA, 22 bp, Artificial Sequence
  chemically synthesized
ttttatgtaatcactattaata

SEQ ID NO: 1262232 - DNA, 22 bp, Artificial Sequence
  chemically synthesized
atttttttatgtaatcactatt

SEQ ID NO: 1262233 - DNA, 22 bp, Artificial Sequence
  chemically synthesized
catttttttatgtaatcactat

SEQ ID NO: 1262234 - DNA, 22 bp, Artificial Sequence
  chemically synthesized
tcatttttttatgtaatcacta

SEQ ID NO: 1262235 - DNA, 22 bp, Artificial Sequence
  chemically synthesized
ttcatttttttatgtaatcact

SEQ ID NO: 1262236 - DNA, 22 bp, Artificial Sequence
  chemically synthesized
tattaatagtgattacataaaa

SEQ ID NO: 1262237 - DNA, 22 bp, Artificial Sequence
  chemically synthesized
attaatagtgattacataaaaa

SEQ ID NO: 1262238 - DNA, 22 bp, Artificial Sequence
  chemically synthesized
ttaatagtgattacataaaaaa

SEQ ID NO: 1262239 - DNA, 22 bp, Artificial Sequence
  chemically synthesized
atagtgattacataaaaaaatg

SEQ ID NO: 1262240 - DNA, 22 bp, Artificial Sequence
  chemically synthesized
cacagaaagtttttcatttttt

SEQ ID NO: 1262241 - DNA, 22 bp, Artificial Sequence
  chemically synthesized
cataaaaaaatgaaaaactttc

SEQ ID NO: 1262242 - DNA, 22 bp, Artificial Sequence
  chemically synthesized
catcaccactacacagaaagtt

SEQ ID NO: 1262243 - DNA, 22 bp, Artificial Sequence
  chemically synthesized
acatcaccactacacagaaagt

SEQ ID NO: 1262244 - DNA, 22 bp, Artificial Sequence
  chemically synthesized
tacatcaccactacacagaaag

SEQ ID NO: 1262245 - DNA, 22 bp, Artificial Sequence
  chemically synthesized
ttacatcaccactacacagaaa

SEQ ID NO: 1262246 - DNA, 22 bp, Artificial Sequence
  chemically synthesized
tttacatcaccactacacagaa

SEQ ID NO: 1262247 - DNA, 22 bp, Artificial Sequence
  chemically synthesized
tctttttacatcaccactacac

SEQ ID NO: 1262248 - DNA, 22 bp, Artificial Sequence
  chemically synthesized
tctgtgtagtggtgatgtaaaa

SEQ ID NO: 1262249 - DNA, 22 bp, Artificial Sequence
  chemically synthesized
ctgtgtagtggtgatgtaaaaa

SEQ ID NO: 1262250 - DNA, 22 bp, Artificial Sequence
  chemically synthesized
tgtgtagtggtgatgtaaaaag

SEQ ID NO: 1262251 - DNA, 22 bp, Artificial Sequence
  chemically synthesized
tgtagtggtgatgtaaaaagat

SEQ ID NO: 1262252 - DNA, 22 bp, Artificial Sequence
  chemically synthesized
aaaatataacaaatccatgtga

SEQ ID NO: 1262253 - DNA, 22 bp, Artificial Sequence
  chemically synthesized
aaaaatataacaaatccatgtg

SEQ ID NO: 1262254 - DNA, 22 bp, Artificial Sequence
  chemically synthesized
taaaaatataacaaatccatgt

SEQ ID NO: 1262255 - DNA, 22 bp, Artificial Sequence
  chemically synthesized
ttaaaaatataacaaatccatg

SEQ ID NO: 1262256 - DNA, 22 bp, Artificial Sequence
  chemically synthesized
tttaaaaatataacaaatccat

SEQ ID NO: 1262257 - DNA, 22 bp, Artificial Sequence
  chemically synthesized
tctttttaaaaatataacaaat

SEQ ID NO: 1262258 - DNA, 22 bp, Artificial Sequence
  chemically synthesized
tcatcacatggatttgttatat

SEQ ID NO: 1262259 - DNA, 22 bp, Artificial Sequence
  chemically synthesized
catcacatggatttgttatatt

SEQ ID NO: 1262260 - DNA, 22 bp, Artificial Sequence
  chemically synthesized
atcacatggatttgttatattt

SEQ ID NO: 1262261 - DNA, 22 bp, Artificial Sequence
  chemically synthesized
tgaagaattatctttttaaaaa

SEQ ID NO: 1262262 - DNA, 22 bp, Artificial Sequence
  chemically synthesized
gttatatttttaaaaagataat

SEQ ID NO: 1262263 - DNA, 22 bp, Artificial Sequence
  chemically synthesized
ttatatttttaaaaagataatt

SEQ ID NO: 1262264 - DNA, 22 bp, Artificial Sequence
  chemically synthesized
aaaaacctatgaagaattatct

SEQ ID NO: 1262265 - DNA, 22 bp, Artificial Sequence
  chemically synthesized
tatttttaaaaagataattctt

SEQ ID NO: 1262266 - DNA, 22 bp, Artificial Sequence
  chemically synthesized
ttaaaaagataattcttcatag

SEQ ID NO: 1262267 - DNA, 22 bp, Artificial Sequence
  chemically synthesized
taaaaagataattcttcatagg

SEQ ID NO: 1262268 - DNA, 22 bp, Artificial Sequence
  chemically synthesized
aaaaagataattcttcataggt

SEQ ID NO: 1262269 - DNA, 22 bp, Artificial Sequence
  chemically synthesized
aaaagataattcttcataggtt

SEQ ID NO: 1262270 - DNA, 22 bp, Artificial Sequence
  chemically synthesized
ttcataggtttttcagggattg

SEQ ID NO: 1262271 - DNA, 22 bp, Artificial Sequence
  chemically synthesized
cataggtttttcagggattgtc

SEQ ID NO: 1262272 - DNA, 22 bp, Artificial Sequence
  chemically synthesized
ataggtttttcagggattgtct

SEQ ID NO: 1262273 - DNA, 22 bp, Artificial Sequence
  chemically synthesized
aacaaataaaaccagacaatcc

SEQ ID NO: 1262274 - DNA, 22 bp, Artificial Sequence
  chemically synthesized
attaaacaaataaaaccagaca

SEQ ID NO: 1262275 - DNA, 22 bp, Artificial Sequence
  chemically synthesized
cattaaacaaataaaaccagac

SEQ ID NO: 1262276 - DNA, 22 bp, Artificial Sequence
  chemically synthesized
tcattaaacaaataaaaccaga

SEQ ID NO: 1262277 - DNA, 22 bp, Artificial Sequence
  chemically synthesized
ttcagggattgtctggttttat

SEQ ID NO: 1262278 - DNA, 22 bp, Artificial Sequence
  chemically synthesized
ttcattaaacaaataaaaccag

SEQ ID NO: 1262279 - DNA, 22 bp, Artificial Sequence
  chemically synthesized
tcagggattgtctggttttatt

SEQ ID NO: 1262280 - DNA, 22 bp, Artificial Sequence
  chemically synthesized
cagggattgtctggttttattt

SEQ ID NO: 1262281 - DNA, 22 bp, Artificial Sequence
  chemically synthesized
agggattgtctggttttatttg

SEQ ID NO: 1262282 - DNA, 22 bp, Artificial Sequence
  chemically synthesized
tttttcattaaacaaataaaac

SEQ ID NO: 1262283 - DNA, 22 bp, Artificial Sequence
  chemically synthesized
atttttcattaaacaaataaaa

SEQ ID NO: 1262284 - DNA, 22 bp, Artificial Sequence
  chemically synthesized
atttatttttcattaaacaaat

SEQ ID NO: 1262285 - DNA, 22 bp, Artificial Sequence
  chemically synthesized
tctggttttatttgtttaatga

SEQ ID NO: 1262286 - DNA, 22 bp, Artificial Sequence
  chemically synthesized
cctcatttatttttcattaaac

SEQ ID NO: 1262287 - DNA, 22 bp, Artificial Sequence
  chemically synthesized
gttttatttgtttaatgaaaaa

SEQ ID NO: 1262288 - DNA, 22 bp, Artificial Sequence
  chemically synthesized
tatttgtttaatgaaaaataaa

SEQ ID NO: 1262289 - DNA, 22 bp, Artificial Sequence
  chemically synthesized
atttgtttaatgaaaaataaat

SEQ ID NO: 1262290 - DNA, 22 bp, Artificial Sequence
  chemically synthesized
tttgtttaatgaaaaataaatg

SEQ ID NO: 1262291 - DNA, 22 bp, Artificial Sequence
  chemically synthesized
gtttaatgaaaaataaatgagg

SEQ ID NO: 1262292 - DNA, 22 bp, Artificial Sequence
  chemically synthesized
tttaatgaaaaataaatgaggt

SEQ ID NO: 1262293 - DNA, 22 bp, Artificial Sequence
  chemically synthesized
caatgagacgttacctcattta

SEQ ID NO: 1262294 - DNA, 22 bp, Artificial Sequence
  chemically synthesized
acaatgagacgttacctcattt

SEQ ID NO: 1262295 - DNA, 22 bp, Artificial Sequence
  chemically synthesized
tacaatgagacgttacctcatt

SEQ ID NO: 1262296 - DNA, 22 bp, Artificial Sequence
  chemically synthesized
aatgaaaaataaatgaggtaac

SEQ ID NO: 1262297 - DNA, 22 bp, Artificial Sequence
  chemically synthesized
atgaaaaataaatgaggtaacg

SEQ ID NO: 1262298 - DNA, 22 bp, Artificial Sequence
  chemically synthesized
ttttacaatgagacgttacctc

SEQ ID NO: 1262299 - DNA, 22 bp, Artificial Sequence
  chemically synthesized
attttacaatgagacgttacct

SEQ ID NO: 1262300 - DNA, 22 bp, Artificial Sequence
  chemically synthesized
ttattttacaatgagacgttac

SEQ ID NO: 1262301 - DNA, 22 bp, Artificial Sequence
  chemically synthesized
aactcttattttacaatgagac

SEQ ID NO: 1262302 - DNA, 22 bp, Artificial Sequence
  chemically synthesized
aaactcttattttacaatgaga

SEQ ID NO: 1262303 - DNA, 22 bp, Artificial Sequence
  chemically synthesized
aaatttaaactcttattttaca

SEQ ID NO: 1262304 - DNA, 22 bp, Artificial Sequence
  chemically synthesized
attaaaatttaaactcttattt

SEQ ID NO: 1262305 - DNA, 22 bp, Artificial Sequence
  chemically synthesized
ctaattaaaatttaaactctta

SEQ ID NO: 1262306 - DNA, 22 bp, Artificial Sequence
  chemically synthesized
cctaattaaaatttaaactctt

SEQ ID NO: 1262307 - DNA, 22 bp, Artificial Sequence
  chemically synthesized
tcctaattaaaatttaaactct

SEQ ID NO: 1262308 - DNA, 22 bp, Artificial Sequence
  chemically synthesized
attgtaaaataagagtttaaat

SEQ ID NO: 1262309 - DNA, 22 bp, Artificial Sequence
  chemically synthesized
ttcctaattaaaatttaaactc

SEQ ID NO: 1262310 - DNA, 22 bp, Artificial Sequence
  chemically synthesized
taaaataagagtttaaatttta

SEQ ID NO: 1262311 - DNA, 22 bp, Artificial Sequence
  chemically synthesized
ggtatcttttcctaattaaaat

SEQ ID NO: 1262312 - DNA, 22 bp, Artificial Sequence
  chemically synthesized
gggtatcttttcctaattaaaa

SEQ ID NO: 1262313 - DNA, 22 bp, Artificial Sequence
  chemically synthesized
tcttgggtatcttttcctaatt

SEQ ID NO: 1262314 - DNA, 22 bp, Artificial Sequence
  chemically synthesized
tgtcttgggtatcttttcctaa

SEQ ID NO: 1262315 - DNA, 22 bp, Artificial Sequence
  chemically synthesized
ctgtcttgggtatcttttccta

SEQ ID NO: 1262316 - DNA, 22 bp, Artificial Sequence
  chemically synthesized
aaattttaattaggaaaagata

SEQ ID NO: 1262317 - DNA, 22 bp, Artificial Sequence
  chemically synthesized
aattttaattaggaaaagatac

SEQ ID NO: 1262318 - DNA, 22 bp, Artificial Sequence
  chemically synthesized
taattaggaaaagatacccaag

SEQ ID NO: 1262319 - DNA, 22 bp, Artificial Sequence
  chemically synthesized
aattaggaaaagatacccaaga

SEQ ID NO: 1262320 - DNA, 22 bp, Artificial Sequence
  chemically synthesized
aatgtatttctgtcttgggtat

SEQ ID NO: 1262321 - DNA, 22 bp, Artificial Sequence
  chemically synthesized
attaggaaaagatacccaagac

SEQ ID NO: 1262322 - DNA, 22 bp, Artificial Sequence
  chemically synthesized
aaatgtatttctgtcttgggta

SEQ ID NO: 1262323 - DNA, 22 bp, Artificial Sequence
  chemically synthesized
taaatgtatttctgtcttgggt

SEQ ID NO: 1262324 - DNA, 22 bp, Artificial Sequence
  chemically synthesized
ggaaaagatacccaagacagaa

SEQ ID NO: 1262325 - DNA, 22 bp, Artificial Sequence
  chemically synthesized
ttttaaatgtatttctgtcttg

SEQ ID NO: 1262326 - DNA, 22 bp, Artificial Sequence
  chemically synthesized
attttaaatgtatttctgtctt

SEQ ID NO: 1262327 - DNA, 22 bp, Artificial Sequence
  chemically synthesized
tcttattttaaatgtatttctg

SEQ ID NO: 1262328 - DNA, 22 bp, Artificial Sequence
  chemically synthesized
aaagtgataatctatcttattt

SEQ ID NO: 1262329 - DNA, 22 bp, Artificial Sequence
  chemically synthesized
taattaaaagtgataatctatc

SEQ ID NO: 1262330 - DNA, 22 bp, Artificial Sequence
  chemically synthesized
tataattaaaagtgataatcta

SEQ ID NO: 1262331 - DNA, 22 bp, Artificial Sequence
  chemically synthesized
ctataattaaaagtgataatct

SEQ ID NO: 1262332 - DNA, 22 bp, Artificial Sequence
  chemically synthesized
tctataattaaaagtgataatc

SEQ ID NO: 1262333 - DNA, 22 bp, Artificial Sequence
  chemically synthesized
aaaataagatagattatcactt

SEQ ID NO: 1262334 - DNA, 22 bp, Artificial Sequence
  chemically synthesized
aaataagatagattatcacttt

SEQ ID NO: 1262335 - DNA, 22 bp, Artificial Sequence
  chemically synthesized
attttctataattaaaagtgat

SEQ ID NO: 1262336 - DNA, 22 bp, Artificial Sequence
  chemically synthesized
cattttctataattaaaagtga

SEQ ID NO: 1262337 - DNA, 22 bp, Artificial Sequence
  chemically synthesized
gaaagcttcattttctataatt

SEQ ID NO: 1262338 - DNA, 22 bp, Artificial Sequence
  chemically synthesized
tggaaagcttcattttctataa

SEQ ID NO: 1262339 - DNA, 22 bp, Artificial Sequence
  chemically synthesized
tcacttttaattatagaaaatg

SEQ ID NO: 1262340 - DNA, 22 bp, Artificial Sequence
  chemically synthesized
ttaattatagaaaatgaagctt

SEQ ID NO: 1262341 - DNA, 22 bp, Artificial Sequence
  chemically synthesized
taattatagaaaatgaagcttt

SEQ ID NO: 1262342 - DNA, 22 bp, Artificial Sequence
  chemically synthesized
aattatagaaaatgaagctttc

SEQ ID NO: 1262343 - DNA, 22 bp, Artificial Sequence
  chemically synthesized
aacataattctggaaagcttca

SEQ ID NO: 1262344 - DNA, 22 bp, Artificial Sequence
  chemically synthesized
attatagaaaatgaagctttcc

SEQ ID NO: 1262345 - DNA, 22 bp, Artificial Sequence
  chemically synthesized
aaacataattctggaaagcttc

SEQ ID NO: 1262346 - DNA, 22 bp, Artificial Sequence
  chemically synthesized
tagaaaatgaagctttccagaa

SEQ ID NO: 1262347 - DNA, 22 bp, Artificial Sequence
  chemically synthesized
taaatttaaacataattctgga

SEQ ID NO: 1262348 - DNA, 22 bp, Artificial Sequence
  chemically synthesized
atgcatctataaatttaaacat

SEQ ID NO: 1262349 - DNA, 22 bp, Artificial Sequence
  chemically synthesized
aatgcatctataaatttaaaca

SEQ ID NO: 1262350 - DNA, 22 bp, Artificial Sequence
  chemically synthesized
taatgcatctataaatttaaac

SEQ ID NO: 1262351 - DNA, 22 bp, Artificial Sequence
  chemically synthesized
tccagaattatgtttaaattta

SEQ ID NO: 1262352 - DNA, 22 bp, Artificial Sequence
  chemically synthesized
ttaatgcatctataaatttaaa

SEQ ID NO: 1262353 - DNA, 22 bp, Artificial Sequence
  chemically synthesized
ccagaattatgtttaaatttat

SEQ ID NO: 1262354 - DNA, 22 bp, Artificial Sequence
  chemically synthesized
cagaattatgtttaaatttata

SEQ ID NO: 1262355 - DNA, 22 bp, Artificial Sequence
  chemically synthesized
atagtttttaatgcatctataa

SEQ ID NO: 1262356 - DNA, 22 bp, Artificial Sequence
  chemically synthesized
gatagtttttaatgcatctata

SEQ ID NO: 1262357 - DNA, 22 bp, Artificial Sequence
  chemically synthesized
tgtttaaatttatagatgcatt

SEQ ID NO: 1262358 - DNA, 22 bp, Artificial Sequence
  chemically synthesized
aacttgatagtttttaatgcat

SEQ ID NO: 1262359 - DNA, 22 bp, Artificial Sequence
  chemically synthesized
aaacttgatagtttttaatgca

SEQ ID NO: 1262360 - DNA, 22 bp, Artificial Sequence
  chemically synthesized
aaatttatagatgcattaaaaa

SEQ ID NO: 1262361 - DNA, 22 bp, Artificial Sequence
  chemically synthesized
aatttatagatgcattaaaaac

SEQ ID NO: 1262362 - DNA, 22 bp, Artificial Sequence
  chemically synthesized
atagatgcattaaaaactatca

SEQ ID NO: 1262363 - DNA, 22 bp, Artificial Sequence
  chemically synthesized
aatgtttaaacttgatagtttt

SEQ ID NO: 1262364 - DNA, 22 bp, Artificial Sequence
  chemically synthesized
tagatgcattaaaaactatcaa

SEQ ID NO: 1262365 - DNA, 22 bp, Artificial Sequence
  chemically synthesized
aaatgtttaaacttgatagttt

SEQ ID NO: 1262366 - DNA, 22 bp, Artificial Sequence
  chemically synthesized
aggtacttaaatgtttaaactt

SEQ ID NO: 1262367 - DNA, 22 bp, Artificial Sequence
  chemically synthesized
aaaactatcaagtttaaacatt

SEQ ID NO: 1262368 - DNA, 22 bp, Artificial Sequence
  chemically synthesized
ttcaggtacttaaatgtttaaa

SEQ ID NO: 1262369 - DNA, 22 bp, Artificial Sequence
  chemically synthesized
tcaagtttaaacatttaagtac

SEQ ID NO: 1262370 - DNA, 22 bp, Artificial Sequence
  chemically synthesized
aacattattcaggtacttaaat

SEQ ID NO: 1262371 - DNA, 22 bp, Artificial Sequence
  chemically synthesized
ctcaacattattcaggtactta

SEQ ID NO: 1262372 - DNA, 22 bp, Artificial Sequence
  chemically synthesized
gctcaacattattcaggtactt

SEQ ID NO: 1262373 - DNA, 22 bp, Artificial Sequence
  chemically synthesized
tttgctcaacattattcaggta

SEQ ID NO: 1262374 - DNA, 22 bp, Artificial Sequence
  chemically synthesized
aaacatttaagtacctgaataa

SEQ ID NO: 1262375 - DNA, 22 bp, Artificial Sequence
  chemically synthesized
aacatttaagtacctgaataat

SEQ ID NO: 1262376 - DNA, 22 bp, Artificial Sequence
  chemically synthesized
ctatttgctcaacattattcag

SEQ ID NO: 1262377 - DNA, 22 bp, Artificial Sequence
  chemically synthesized
aagtacctgaataatgttgagc

SEQ ID NO: 1262378 - DNA, 22 bp, Artificial Sequence
  chemically synthesized
agtacctgaataatgttgagca

SEQ ID NO: 1262379 - DNA, 22 bp, Artificial Sequence
  chemically synthesized
aataatgttgagcaaatagcaa

SEQ ID NO: 1262380 - DNA, 22 bp, Artificial Sequence
  chemically synthesized
atgccagcatagtccaaagttg

SEQ ID NO: 1262381 - DNA, 22 bp, Artificial Sequence
  chemically synthesized
agcaaatagcaactttggacta

SEQ ID NO: 1262382 - DNA, 22 bp, Artificial Sequence
  chemically synthesized
ctcatgccagcatagtccaaag

SEQ ID NO: 1262383 - DNA, 22 bp, Artificial Sequence
  chemically synthesized
tcctcatgccagcatagtccaa

SEQ ID NO: 1262384 - DNA, 22 bp, Artificial Sequence
  chemically synthesized
actctcctcatgccagcatagt

SEQ ID NO: 1262385 - DNA, 22 bp, Artificial Sequence
  chemically synthesized
ctcactctcctcatgccagcat

SEQ ID NO: 1262386 - DNA, 22 bp, Artificial Sequence
  chemically synthesized
cctcactctcctcatgccagca

SEQ ID NO: 1262387 - DNA, 22 bp, Artificial Sequence
  chemically synthesized
tggactatgctggcatgaggag

SEQ ID NO: 1262388 - DNA, 22 bp, Artificial Sequence
  chemically synthesized
ggactatgctggcatgaggaga

SEQ ID NO: 1262389 - DNA, 22 bp, Artificial Sequence
  chemically synthesized
gactatgctggcatgaggagag

SEQ ID NO: 1262390 - DNA, 22 bp, Artificial Sequence
  chemically synthesized
tcgtggcatttcctcactctcc

SEQ ID NO: 1262391 - DNA, 22 bp, Artificial Sequence
  chemically synthesized
tgctggcatgaggagagtgagg

SEQ ID NO: 1262392 - DNA, 22 bp, Artificial Sequence
  chemically synthesized
atcgtggcatttcctcactctc

SEQ ID NO: 1262393 - DNA, 22 bp, Artificial Sequence
  chemically synthesized
tatcgtggcatttcctcactct

SEQ ID NO: 1262394 - DNA, 22 bp, Artificial Sequence
  chemically synthesized
ttatcgtggcatttcctcactc

SEQ ID NO: 1262395 - DNA, 22 bp, Artificial Sequence
  chemically synthesized
gcatgaggagagtgaggaaatg

SEQ ID NO: 1262396 - DNA, 22 bp, Artificial Sequence
  chemically synthesized
atttttatcgtggcatttcctc

SEQ ID NO: 1262397 - DNA, 22 bp, Artificial Sequence
  chemically synthesized
tgatttttatcgtggcatttcc

SEQ ID NO: 1262398 - DNA, 22 bp, Artificial Sequence
  chemically synthesized
ctgatttttatcgtggcatttc

SEQ ID NO: 1262399 - DNA, 22 bp, Artificial Sequence
  chemically synthesized
ataatttctgatttttatcgtg

SEQ ID NO: 1262400 - DNA, 22 bp, Artificial Sequence
  chemically synthesized
aataatttctgatttttatcgt

SEQ ID NO: 1262401 - DNA, 22 bp, Artificial Sequence
  chemically synthesized
taataatttctgatttttatcg

SEQ ID NO: 1262402 - DNA, 22 bp, Artificial Sequence
  chemically synthesized
tttaataatttctgatttttat

SEQ ID NO: 1262403 - DNA, 22 bp, Artificial Sequence
  chemically synthesized
ctttaataatttctgattttta

SEQ ID NO: 1262404 - DNA, 22 bp, Artificial Sequence
  chemically synthesized
taagcaaaagaaagcaaggact

SEQ ID NO: 1262405 - DNA, 22 bp, Artificial Sequence
  chemically synthesized
gtaagcaaaagaaagcaaggac

SEQ ID NO: 1262406 - DNA, 22 bp, Artificial Sequence
  chemically synthesized
tgtaagcaaaagaaagcaagga

SEQ ID NO: 1262407 - DNA, 22 bp, Artificial Sequence
  chemically synthesized
ttgtaagcaaaagaaagcaagg

SEQ ID NO: 1262408 - DNA, 22 bp, Artificial Sequence
  chemically synthesized
ttaaagaagtccttgctttctt

SEQ ID NO: 1262409 - DNA, 22 bp, Artificial Sequence
  chemically synthesized
aagaagtccttgctttcttttg

SEQ ID NO: 1262410 - DNA, 22 bp, Artificial Sequence
  chemically synthesized
gctttcttttgcttacaaaaga

SEQ ID NO: 1262411 - DNA, 22 bp, Artificial Sequence
  chemically synthesized
ctttcttttgcttacaaaagat

SEQ ID NO: 1262412 - DNA, 22 bp, Artificial Sequence
  chemically synthesized
aatatcaatagaatcttttgta

SEQ ID NO: 1262413 - DNA, 22 bp, Artificial Sequence
  chemically synthesized
caatatcaatagaatcttttgt

SEQ ID NO: 1262414 - DNA, 22 bp, Artificial Sequence
  chemically synthesized
tcaatatcaatagaatcttttg

SEQ ID NO: 1262415 - DNA, 22 bp, Artificial Sequence
  chemically synthesized
tcttttgcttacaaaagattct

SEQ ID NO: 1262416 - DNA, 22 bp, Artificial Sequence
  chemically synthesized
ttcaatatcaatagaatctttt

SEQ ID NO: 1262417 - DNA, 22 bp, Artificial Sequence
  chemically synthesized
cttttgcttacaaaagattcta

SEQ ID NO: 1262418 - DNA, 22 bp, Artificial Sequence
  chemically synthesized
ttttgcttacaaaagattctat

SEQ ID NO: 1262419 - DNA, 22 bp, Artificial Sequence
  chemically synthesized
tttttcaatatcaatagaatct

SEQ ID NO: 1262420 - DNA, 22 bp, Artificial Sequence
  chemically synthesized
ttgcttacaaaagattctattg

SEQ ID NO: 1262421 - DNA, 22 bp, Artificial Sequence
  chemically synthesized
gtttttcaatatcaatagaatc

SEQ ID NO: 1262422 - DNA, 22 bp, Artificial Sequence
  chemically synthesized
tgcttacaaaagattctattga

SEQ ID NO: 1262423 - DNA, 22 bp, Artificial Sequence
  chemically synthesized
gcttacaaaagattctattgat

SEQ ID NO: 1262424 - DNA, 22 bp, Artificial Sequence
  chemically synthesized
cttacaaaagattctattgata

SEQ ID NO: 1262425 - DNA, 22 bp, Artificial Sequence
  chemically synthesized
gtttgtttttcaatatcaatag

SEQ ID NO: 1262426 - DNA, 22 bp, Artificial Sequence
  chemically synthesized
ggtttgtttttcaatatcaata

SEQ ID NO: 1262427 - DNA, 22 bp, Artificial Sequence
  chemically synthesized
acaaaagattctattgatattg

SEQ ID NO: 1262428 - DNA, 22 bp, Artificial Sequence
  chemically synthesized
tggtttgtttttcaatatcaat

SEQ ID NO: 1262429 - DNA, 22 bp, Artificial Sequence
  chemically synthesized
caaaagattctattgatattga

SEQ ID NO: 1262430 - DNA, 22 bp, Artificial Sequence
  chemically synthesized
ttttggtttgtttttcaatatc

SEQ ID NO: 1262431 - DNA, 22 bp, Artificial Sequence
  chemically synthesized
gttttggtttgtttttcaatat

SEQ ID NO: 1262432 - DNA, 22 bp, Artificial Sequence
  chemically synthesized
tttgttttggtttgtttttcaa

SEQ ID NO: 1262433 - DNA, 22 bp, Artificial Sequence
  chemically synthesized
gtttgttttggtttgtttttca

SEQ ID NO: 1262434 - DNA, 22 bp, Artificial Sequence
  chemically synthesized
tgtttgttttggtttgtttttc

SEQ ID NO: 1262435 - DNA, 22 bp, Artificial Sequence
  chemically synthesized
ttgtttgttttggtttgttttt

SEQ ID NO: 1262436 - DNA, 22 bp, Artificial Sequence
  chemically synthesized
tattgatattgaaaaacaaacc

SEQ ID NO: 1262437 - DNA, 22 bp, Artificial Sequence
  chemically synthesized
tttgtttgttttggtttgtttt

SEQ ID NO: 1262438 - DNA, 22 bp, Artificial Sequence
  chemically synthesized
ttttgtttgttttggtttgttt

SEQ ID NO: 1262439 - DNA, 22 bp, Artificial Sequence
  chemically synthesized
ttgatattgaaaaacaaaccaa

SEQ ID NO: 1262440 - DNA, 22 bp, Artificial Sequence
  chemically synthesized
atattgaaaaacaaaccaaaac

SEQ ID NO: 1262441 - DNA, 22 bp, Artificial Sequence
  chemically synthesized
aaaaacaaaccaaaacaaacaa

SEQ ID NO: 1262442 - DNA, 22 bp, Artificial Sequence
  chemically synthesized
aatccagatgccgtagccattt

SEQ ID NO: 1262443 - DNA, 22 bp, Artificial Sequence
  chemically synthesized
gaatccagatgccgtagccatt

SEQ ID NO: 1262444 - DNA, 22 bp, Artificial Sequence
  chemically synthesized
tgaatccagatgccgtagccat

SEQ ID NO: 1262445 - DNA, 22 bp, Artificial Sequence
  chemically synthesized
tggaaacattttgaatccagat

SEQ ID NO: 1262446 - DNA, 22 bp, Artificial Sequence
  chemically synthesized
atggaaacattttgaatccaga

SEQ ID NO: 1262447 - DNA, 22 bp, Artificial Sequence
  chemically synthesized
cggcatctggattcaaaatgtt

SEQ ID NO: 1262448 - DNA, 22 bp, Artificial Sequence
  chemically synthesized
catccatagacttatggaaaca

SEQ ID NO: 1262449 - DNA, 22 bp, Artificial Sequence
  chemically synthesized
gcatccatagacttatggaaac

SEQ ID NO: 1262450 - DNA, 22 bp, Artificial Sequence
  chemically synthesized
tgcatccatagacttatggaaa

SEQ ID NO: 1262451 - DNA, 22 bp, Artificial Sequence
  chemically synthesized
gattcaaaatgtttccataagt

SEQ ID NO: 1262452 - DNA, 22 bp, Artificial Sequence
  chemically synthesized
actttgcatccatagacttatg

SEQ ID NO: 1262453 - DNA, 22 bp, Artificial Sequence
  chemically synthesized
aaaatgtttccataagtctatg

SEQ ID NO: 1262454 - DNA, 22 bp, Artificial Sequence
  chemically synthesized
agactcactttgcatccataga

SEQ ID NO: 1262455 - DNA, 22 bp, Artificial Sequence
  chemically synthesized
ccataagtctatggatgcaaag

SEQ ID NO: 1262456 - DNA, 22 bp, Artificial Sequence
  chemically synthesized
cataagtctatggatgcaaagt

SEQ ID NO: 1262457 - DNA, 22 bp, Artificial Sequence
  chemically synthesized
ataaaattgagactcactttgc

SEQ ID NO: 1262458 - DNA, 22 bp, Artificial Sequence
  chemically synthesized
cataaaattgagactcactttg

SEQ ID NO: 1262459 - DNA, 22 bp, Artificial Sequence
  chemically synthesized
tttcataaaattgagactcact

SEQ ID NO: 1262460 - DNA, 22 bp, Artificial Sequence
  chemically synthesized
atttcataaaattgagactcac

SEQ ID NO: 1262461 - DNA, 22 bp, Artificial Sequence
  chemically synthesized
tggatgcaaagtgagtctcaat

SEQ ID NO: 1262462 - DNA, 22 bp, Artificial Sequence
  chemically synthesized
ttatttcataaaattgagactc

SEQ ID NO: 1262463 - DNA, 22 bp, Artificial Sequence
  chemically synthesized
cttatttcataaaattgagact

SEQ ID NO: 1262464 - DNA, 22 bp, Artificial Sequence
  chemically synthesized
tcttatttcataaaattgagac

SEQ ID NO: 1262465 - DNA, 22 bp, Artificial Sequence
  chemically synthesized
ttcttatttcataaaattgaga

SEQ ID NO: 1262466 - DNA, 22 bp, Artificial Sequence
  chemically synthesized
tttcttatttcataaaattgag

SEQ ID NO: 1262467 - DNA, 22 bp, Artificial Sequence
  chemically synthesized
ttttcttatttcataaaattga

SEQ ID NO: 1262468 - DNA, 22 bp, Artificial Sequence
  chemically synthesized
ttttttcttatttcataaaatt

SEQ ID NO: 1262469 - DNA, 22 bp, Artificial Sequence
  chemically synthesized
cttttttcttatttcataaaat

SEQ ID NO: 1262470 - DNA, 22 bp, Artificial Sequence
  chemically synthesized
tcttttttcttatttcataaaa

SEQ ID NO: 1262471 - DNA, 22 bp, Artificial Sequence
  chemically synthesized
ttcttttttcttatttcataaa

SEQ ID NO: 1262472 - DNA, 22 bp, Artificial Sequence
  chemically synthesized
acatttttcttttttcttattt

SEQ ID NO: 1262473 - DNA, 22 bp, Artificial Sequence
  chemically synthesized
aattttatgaaataagaaaaaa

SEQ ID NO: 1262474 - DNA, 22 bp, Artificial Sequence
  chemically synthesized
gctaacatttttcttttttctt

SEQ ID NO: 1262475 - DNA, 22 bp, Artificial Sequence
  chemically synthesized
tatgaaataagaaaaaagaaaa

SEQ ID NO: 1262476 - DNA, 22 bp, Artificial Sequence
  chemically synthesized
atgaaataagaaaaaagaaaaa

SEQ ID NO: 1262477 - DNA, 22 bp, Artificial Sequence
  chemically synthesized
gtctagctaacatttttctttt

SEQ ID NO: 1262478 - DNA, 22 bp, Artificial Sequence
  chemically synthesized
tgaaataagaaaaaagaaaaat

SEQ ID NO: 1262479 - DNA, 22 bp, Artificial Sequence
  chemically synthesized
caagtgtgatccatcatgcctg

SEQ ID NO: 1262480 - DNA, 22 bp, Artificial Sequence
  chemically synthesized
gctagaccaggcatgatggatc

SEQ ID NO: 1262481 - DNA, 22 bp, Artificial Sequence
  chemically synthesized
ggattacaagtgtgatccatca

SEQ ID NO: 1262482 - DNA, 22 bp, Artificial Sequence
  chemically synthesized
gaccaggcatgatggatcacac

SEQ ID NO: 1262483 - DNA, 22 bp, Artificial Sequence
  chemically synthesized
ccaaagtgctgggattacaagt

SEQ ID NO: 1262484 - DNA, 22 bp, Artificial Sequence
  chemically synthesized
agcctcccaaagtgctgggatt

SEQ ID NO: 1262485 - DNA, 22 bp, Artificial Sequence
  chemically synthesized
ccgcctcagcctcccaaagtgc

SEQ ID NO: 1262486 - DNA, 22 bp, Artificial Sequence
  chemically synthesized
gtaatcccagcactttgggagg

SEQ ID NO: 1262487 - DNA, 22 bp, Artificial Sequence
  chemically synthesized
taatcccagcactttgggaggc

SEQ ID NO: 1262488 - DNA, 22 bp, Artificial Sequence
  chemically synthesized
aagcaatcctcccgcctcagcc

SEQ ID NO: 1262489 - DNA, 22 bp, Artificial Sequence
  chemically synthesized
gcctcaagcaatcctcccgcct

SEQ ID NO: 1262490 - DNA, 22 bp, Artificial Sequence
  chemically synthesized
tgggaggctgaggcgggaggat

SEQ ID NO: 1262491 - DNA, 22 bp, Artificial Sequence
  chemically synthesized
gggaggctgaggcgggaggatt

SEQ ID NO: 1262492 - DNA, 22 bp, Artificial Sequence
  chemically synthesized
ctggcctcaagcaatcctcccg

SEQ ID NO: 1262493 - DNA, 22 bp, Artificial Sequence
  chemically synthesized
ggaggctgaggcgggaggattg

SEQ ID NO: 1262494 - DNA, 22 bp, Artificial Sequence
  chemically synthesized
gaactcctggcctcaagcaatc

SEQ ID NO: 1262495 - DNA, 22 bp, Artificial Sequence
  chemically synthesized
aggcgggaggattgcttgaggc

SEQ ID NO: 1262496 - DNA, 22 bp, Artificial Sequence
  chemically synthesized
gtctagaactcctggcctcaag

SEQ ID NO: 1262497 - DNA, 22 bp, Artificial Sequence
  chemically synthesized
ccaagctggtctagaactcctg

SEQ ID NO: 1262498 - DNA, 22 bp, Artificial Sequence
  chemically synthesized
cccaagctggtctagaactcct

SEQ ID NO: 1262499 - DNA, 22 bp, Artificial Sequence
  chemically synthesized
cttgaggccaggagttctagac

SEQ ID NO: 1262500 - DNA, 22 bp, Artificial Sequence
  chemically synthesized
tgtttcccaagctggtctagaa

SEQ ID NO: 1262501 - DNA, 22 bp, Artificial Sequence
  chemically synthesized
gaggccaggagttctagaccag

SEQ ID NO: 1262502 - DNA, 22 bp, Artificial Sequence
  chemically synthesized
aggccaggagttctagaccagc

SEQ ID NO: 1262503 - DNA, 22 bp, Artificial Sequence
  chemically synthesized
ctatgtttcccaagctggtcta

SEQ ID NO: 1262504 - DNA, 22 bp, Artificial Sequence
  chemically synthesized
gctatgtttcccaagctggtct

SEQ ID NO: 1262505 - DNA, 22 bp, Artificial Sequence
  chemically synthesized
tagaccagcttgggaaacatag

SEQ ID NO: 1262506 - DNA, 22 bp, Artificial Sequence
  chemically synthesized
gaccagcttgggaaacatagca

SEQ ID NO: 1262507 - DNA, 22 bp, Artificial Sequence
  chemically synthesized
gtggagacagggtcttgctatg

SEQ ID NO: 1262508 - DNA, 22 bp, Artificial Sequence
  chemically synthesized
cgtggagacagggtcttgctat

SEQ ID NO: 1262509 - DNA, 22 bp, Artificial Sequence
  chemically synthesized
tcgtggagacagggtcttgcta

SEQ ID NO: 1262510 - DNA, 22 bp, Artificial Sequence
  chemically synthesized
ttcgtggagacagggtcttgct

SEQ ID NO: 1262511 - DNA, 22 bp, Artificial Sequence
  chemically synthesized
gggaaacatagcaagaccctgt

SEQ ID NO: 1262512 - DNA, 22 bp, Artificial Sequence
  chemically synthesized
tttttcgtggagacagggtctt

SEQ ID NO: 1262513 - DNA, 22 bp, Artificial Sequence
  chemically synthesized
ggaaacatagcaagaccctgtc

SEQ ID NO: 1262514 - DNA, 22 bp, Artificial Sequence
  chemically synthesized
atttttcgtggagacagggtct

SEQ ID NO: 1262515 - DNA, 22 bp, Artificial Sequence
  chemically synthesized
tatttttcgtggagacagggtc

SEQ ID NO: 1262516 - DNA, 22 bp, Artificial Sequence
  chemically synthesized
ttatttttcgtggagacagggt

SEQ ID NO: 1262517 - DNA, 22 bp, Artificial Sequence
  chemically synthesized
tttatttttcgtggagacaggg

SEQ ID NO: 1262518 - DNA, 22 bp, Artificial Sequence
  chemically synthesized
tttttatttttcgtggagacag

SEQ ID NO: 1262519 - DNA, 22 bp, Artificial Sequence
  chemically synthesized
ctttttatttttcgtggagaca

SEQ ID NO: 1262520 - DNA, 22 bp, Artificial Sequence
  chemically synthesized
tctttttatttttcgtggagac

SEQ ID NO: 1262521 - DNA, 22 bp, Artificial Sequence
  chemically synthesized
attttctttttatttttcgtgg

SEQ ID NO: 1262522 - DNA, 22 bp, Artificial Sequence
  chemically synthesized
ctaattttctttttatttttcg

SEQ ID NO: 1262523 - DNA, 22 bp, Artificial Sequence
  chemically synthesized
tctccacgaaaaataaaaagaa

SEQ ID NO: 1262524 - DNA, 22 bp, Artificial Sequence
  chemically synthesized
cacgaaaaataaaaagaaaatt

SEQ ID NO: 1262525 - DNA, 22 bp, Artificial Sequence
  chemically synthesized
ggacaagtgcacaccacgccct

SEQ ID NO: 1262526 - DNA, 22 bp, Artificial Sequence
  chemically synthesized
agtagctgggacaagtgcacac

SEQ ID NO: 1262527 - DNA, 22 bp, Artificial Sequence
  chemically synthesized
gcagggcgtggtgtgcacttgt

SEQ ID NO: 1262528 - DNA, 22 bp, Artificial Sequence
  chemically synthesized
ctgagtagctgggacaagtgca

SEQ ID NO: 1262529 - DNA, 22 bp, Artificial Sequence
  chemically synthesized
cacctcctgagtagctgggaca

SEQ ID NO: 1262530 - DNA, 22 bp, Artificial Sequence
  chemically synthesized
ccacctgcacctcctgagtagc

SEQ ID NO: 1262531 - DNA, 22 bp, Artificial Sequence
  chemically synthesized
tcccacctgcacctcctgagta

SEQ ID NO: 1262532 - DNA, 22 bp, Artificial Sequence
  chemically synthesized
gtcccagctactcaggaggtgc

SEQ ID NO: 1262533 - DNA, 22 bp, Artificial Sequence
  chemically synthesized
tcccagctactcaggaggtgca

SEQ ID NO: 1262534 - DNA, 22 bp, Artificial Sequence
  chemically synthesized
agatgattctcccacctgcacc

SEQ ID NO: 1262535 - DNA, 22 bp, Artificial Sequence
  chemically synthesized
ctcaggaggtgcaggtgggaga

SEQ ID NO: 1262536 - DNA, 22 bp, Artificial Sequence
  chemically synthesized
ggctcagatgattctcccacct

SEQ ID NO: 1262537 - DNA, 22 bp, Artificial Sequence
  chemically synthesized
aggaggtgcaggtgggagaatc

SEQ ID NO: 1262538 - DNA, 22 bp, Artificial Sequence
  chemically synthesized
ctgggctcagatgattctccca

SEQ ID NO: 1262539 - DNA, 22 bp, Artificial Sequence
  chemically synthesized
aattcctgggctcagatgattc

SEQ ID NO: 1262540 - DNA, 22 bp, Artificial Sequence
  chemically synthesized
gaattcctgggctcagatgatt

SEQ ID NO: 1262541 - DNA, 22 bp, Artificial Sequence
  chemically synthesized
accttgaattcctgggctcaga

SEQ ID NO: 1262542 - DNA, 22 bp, Artificial Sequence
  chemically synthesized
taaccttgaattcctgggctca

SEQ ID NO: 1262543 - DNA, 22 bp, Artificial Sequence
  chemically synthesized
actctaaccttgaattcctggg

SEQ ID NO: 1262544 - DNA, 22 bp, Artificial Sequence
  chemically synthesized
agcccaggaattcaaggttaga

SEQ ID NO: 1262545 - DNA, 22 bp, Artificial Sequence
  chemically synthesized
aaggttagagtgagctatgatc

SEQ ID NO: 1262546 - DNA, 22 bp, Artificial Sequence
  chemically synthesized
aagtgcagtggcatgatcatag

SEQ ID NO: 1262547 - DNA, 22 bp, Artificial Sequence
  chemically synthesized
gagtgagctatgatcatgccac

SEQ ID NO: 1262548 - DNA, 22 bp, Artificial Sequence
  chemically synthesized
gcacccaggctgaagtgcagtg

SEQ ID NO: 1262549 - DNA, 22 bp, Artificial Sequence
  chemically synthesized
tggcacccaggctgaagtgcag

SEQ ID NO: 1262550 - DNA, 22 bp, Artificial Sequence
  chemically synthesized
tgatcatgccactgcacttcag

SEQ ID NO: 1262551 - DNA, 22 bp, Artificial Sequence
  chemically synthesized
tctggcacccaggctgaagtgc

SEQ ID NO: 1262552 - DNA, 22 bp, Artificial Sequence
  chemically synthesized
tctctggcacccaggctgaagt

SEQ ID NO: 1262553 - DNA, 22 bp, Artificial Sequence
  chemically synthesized
cacttcagcctgggtgccagag

SEQ ID NO: 1262554 - DNA, 22 bp, Artificial Sequence
  chemically synthesized
agggacaagatctctctctggc

SEQ ID NO: 1262555 - DNA, 22 bp, Artificial Sequence
  chemically synthesized
aagggacaagatctctctctgg

SEQ ID NO: 1262556 - DNA, 22 bp, Artificial Sequence
  chemically synthesized
cagcctgggtgccagagagaga

SEQ ID NO: 1262557 - DNA, 22 bp, Artificial Sequence
  chemically synthesized
taagggacaagatctctctctg

SEQ ID NO: 1262558 - DNA, 22 bp, Artificial Sequence
  chemically synthesized
agcctgggtgccagagagagat

SEQ ID NO: 1262559 - DNA, 22 bp, Artificial Sequence
  chemically synthesized
tctttaagggacaagatctctc

SEQ ID NO: 1262560 - DNA, 22 bp, Artificial Sequence
  chemically synthesized
atctttaagggacaagatctct

SEQ ID NO: 1262561 - DNA, 22 bp, Artificial Sequence
  chemically synthesized
tatctttaagggacaagatctc

SEQ ID NO: 1262562 - DNA, 22 bp, Artificial Sequence
  chemically synthesized
ggtgccagagagagatcttgtc

SEQ ID NO: 1262563 - DNA, 22 bp, Artificial Sequence
  chemically synthesized
ttatctttaagggacaagatct

SEQ ID NO: 1262564 - DNA, 22 bp, Artificial Sequence
  chemically synthesized
tttttatctttaagggacaaga

SEQ ID NO: 1262565 - DNA, 22 bp, Artificial Sequence
  chemically synthesized
atttttatctttaagggacaag

SEQ ID NO: 1262566 - DNA, 22 bp, Artificial Sequence
  chemically synthesized
tatttttatctttaagggacaa

SEQ ID NO: 1262567 - DNA, 22 bp, Artificial Sequence
  chemically synthesized
ttatttttatctttaagggaca

SEQ ID NO: 1262568 - DNA, 22 bp, Artificial Sequence
  chemically synthesized
tttatttttatctttaagggac

SEQ ID NO: 1262569 - DNA, 22 bp, Artificial Sequence
  chemically synthesized
ttttttatttttatctttaagg

SEQ ID NO: 1262570 - DNA, 22 bp, Artificial Sequence
  chemically synthesized
attttttatttttatctttaag

SEQ ID NO: 1262571 - DNA, 22 bp, Artificial Sequence
  chemically synthesized
atatttattttttatttttatc

SEQ ID NO: 1262572 - DNA, 22 bp, Artificial Sequence
  chemically synthesized
gtcccttaaagataaaaataaa

SEQ ID NO: 1262573 - DNA, 22 bp, Artificial Sequence
  chemically synthesized
tcccttaaagataaaaataaaa

SEQ ID NO: 1262574 - DNA, 22 bp, Artificial Sequence
  chemically synthesized
gctaatatttattttttatttt

SEQ ID NO: 1262575 - DNA, 22 bp, Artificial Sequence
  chemically synthesized
aaagataaaaataaaaaataaa

SEQ ID NO: 1262576 - DNA, 22 bp, Artificial Sequence
  chemically synthesized
aagataaaaataaaaaataaat

SEQ ID NO: 1262577 - DNA, 22 bp, Artificial Sequence
  chemically synthesized
gtaggttagctaatatttattt

SEQ ID NO: 1262578 - DNA, 22 bp, Artificial Sequence
  chemically synthesized
aggtaaaactagtaggttagct

SEQ ID NO: 1262579 - DNA, 22 bp, Artificial Sequence
  chemically synthesized
aaggaactcaggtaaaactagt

SEQ ID NO: 1262580 - DNA, 22 bp, Artificial Sequence
  chemically synthesized
gctaacctactagttttacctg

SEQ ID NO: 1262581 - DNA, 22 bp, Artificial Sequence
  chemically synthesized
acctactagttttacctgagtt

SEQ ID NO: 1262582 - DNA, 22 bp, Artificial Sequence
  chemically synthesized
taatccactgaaggaactcagg

SEQ ID NO: 1262583 - DNA, 22 bp, Artificial Sequence
  chemically synthesized
ctagttttacctgagttccttc

SEQ ID NO: 1262584 - DNA, 22 bp, Artificial Sequence
  chemically synthesized
gttttacctgagttccttcagt

SEQ ID NO: 1262585 - DNA, 22 bp, Artificial Sequence
  chemically synthesized
tacctgagttccttcagtggat

SEQ ID NO: 1262586 - DNA, 22 bp, Artificial Sequence
  chemically synthesized
aaatatgttgtaatccactgaa

SEQ ID NO: 1262587 - DNA, 22 bp, Artificial Sequence
  chemically synthesized
acctgagttccttcagtggatt

SEQ ID NO: 1262588 - DNA, 22 bp, Artificial Sequence
  chemically synthesized
gaaatatgttgtaatccactga

SEQ ID NO: 1262589 - DNA, 22 bp, Artificial Sequence
  chemically synthesized
cctgagttccttcagtggatta

SEQ ID NO: 1262590 - DNA, 22 bp, Artificial Sequence
  chemically synthesized
agttccttcagtggattacaac

SEQ ID NO: 1262591 - DNA, 22 bp, Artificial Sequence
  chemically synthesized
tggtttgaaatatgttgtaatc

SEQ ID NO: 1262592 - DNA, 22 bp, Artificial Sequence
  chemically synthesized
cttcagtggattacaacatatt

SEQ ID NO: 1262593 - DNA, 22 bp, Artificial Sequence
  chemically synthesized
cagtggattacaacatatttca

SEQ ID NO: 1262594 - DNA, 22 bp, Artificial Sequence
  chemically synthesized
agtggattacaacatatttcaa

SEQ ID NO: 1262595 - DNA, 22 bp, Artificial Sequence
  chemically synthesized
aatagggctgtggtttgaaata

SEQ ID NO: 1262596 - DNA, 22 bp, Artificial Sequence
  chemically synthesized
caatagggctgtggtttgaaat

SEQ ID NO: 1262597 - DNA, 22 bp, Artificial Sequence
  chemically synthesized
acttcaatagggctgtggtttg

SEQ ID NO: 1262598 - DNA, 22 bp, Artificial Sequence
  chemically synthesized
caacatatttcaaaccacagcc

SEQ ID NO: 1262599 - DNA, 22 bp, Artificial Sequence
  chemically synthesized
caaaccacagccctattgaagt

SEQ ID NO: 1262600 - DNA, 22 bp, Artificial Sequence
  chemically synthesized
aaaccacagccctattgaagtt

SEQ ID NO: 1262601 - DNA, 22 bp, Artificial Sequence
  chemically synthesized
catcacacagaaattaacttca

SEQ ID NO: 1262602 - DNA, 22 bp, Artificial Sequence
  chemically synthesized
ataaattccatcacacagaaat

SEQ ID NO: 1262603 - DNA, 22 bp, Artificial Sequence
  chemically synthesized
ttgaagttaatttctgtgtgat

SEQ ID NO: 1262604 - DNA, 22 bp, Artificial Sequence
  chemically synthesized
aagttaatttctgtgtgatgga

SEQ ID NO: 1262605 - DNA, 22 bp, Artificial Sequence
  chemically synthesized
atttctgtgtgatggaatttat

SEQ ID NO: 1262606 - DNA, 22 bp, Artificial Sequence
  chemically synthesized
aaacataaagctaataaattcc

SEQ ID NO: 1262607 - DNA, 22 bp, Artificial Sequence
  chemically synthesized
aaaacataaagctaataaattc

SEQ ID NO: 1262608 - DNA, 22 bp, Artificial Sequence
  chemically synthesized
taaaacataaagctaataaatt

SEQ ID NO: 1262609 - DNA, 22 bp, Artificial Sequence
  chemically synthesized
ctgtgtgatggaatttattagc

SEQ ID NO: 1262610 - DNA, 22 bp, Artificial Sequence
  chemically synthesized
tgtgtgatggaatttattagct

SEQ ID NO: 1262611 - DNA, 22 bp, Artificial Sequence
  chemically synthesized
tgtgatggaatttattagcttt

SEQ ID NO: 1262612 - DNA, 22 bp, Artificial Sequence
  chemically synthesized
attagctttatgttttaaaata

SEQ ID NO: 1262613 - DNA, 22 bp, Artificial Sequence
  chemically synthesized
ttagctttatgttttaaaatac

SEQ ID NO: 1262614 - DNA, 22 bp, Artificial Sequence
  chemically synthesized
gctttatgttttaaaatacact

SEQ ID NO: 1262615 - DNA, 22 bp, Artificial Sequence
  chemically synthesized
agaggagaaaatcagtgtattt

SEQ ID NO: 1262616 - DNA, 22 bp, Artificial Sequence
  chemically synthesized
cagaggagaaaatcagtgtatt

SEQ ID NO: 1262617 - DNA, 22 bp, Artificial Sequence
  chemically synthesized
tcagaggagaaaatcagtgtat

SEQ ID NO: 1262618 - DNA, 22 bp, Artificial Sequence
  chemically synthesized
tatgttttaaaatacactgatt

SEQ ID NO: 1262619 - DNA, 22 bp, Artificial Sequence
  chemically synthesized
atgttttaaaatacactgattt

SEQ ID NO: 1262620 - DNA, 22 bp, Artificial Sequence
  chemically synthesized
tttcagaggagaaaatcagtgt

SEQ ID NO: 1262621 - DNA, 22 bp, Artificial Sequence
  chemically synthesized
tgttttaaaatacactgatttt

SEQ ID NO: 1262622 - DNA, 22 bp, Artificial Sequence
  chemically synthesized
actctttcagaggagaaaatca

SEQ ID NO: 1262623 - DNA, 22 bp, Artificial Sequence
  chemically synthesized
taaaatacactgattttctcct

SEQ ID NO: 1262624 - DNA, 22 bp, Artificial Sequence
  chemically synthesized
tcactctttcagaggagaaaat

SEQ ID NO: 1262625 - DNA, 22 bp, Artificial Sequence
  chemically synthesized
aaaatacactgattttctcctc

SEQ ID NO: 1262626 - DNA, 22 bp, Artificial Sequence
  chemically synthesized
ctcactctttcagaggagaaaa

SEQ ID NO: 1262627 - DNA, 22 bp, Artificial Sequence
  chemically synthesized
aaatacactgattttctcctct

SEQ ID NO: 1262628 - DNA, 22 bp, Artificial Sequence
  chemically synthesized
tctcactctttcagaggagaaa

SEQ ID NO: 1262629 - DNA, 22 bp, Artificial Sequence
  chemically synthesized
attttctcctctgaaagagtga

SEQ ID NO: 1262630 - DNA, 22 bp, Artificial Sequence
  chemically synthesized
aagaatattttctcactctttc

SEQ ID NO: 1262631 - DNA, 22 bp, Artificial Sequence
  chemically synthesized
taaagaatattttctcactctt

SEQ ID NO: 1262632 - DNA, 22 bp, Artificial Sequence
  chemically synthesized
ctaaagaatattttctcactct

SEQ ID NO: 1262633 - DNA, 22 bp, Artificial Sequence
  chemically synthesized
tctcctctgaaagagtgagaaa

SEQ ID NO: 1262634 - DNA, 22 bp, Artificial Sequence
  chemically synthesized
ctcctctgaaagagtgagaaaa

SEQ ID NO: 1262635 - DNA, 22 bp, Artificial Sequence
  chemically synthesized
tcctctgaaagagtgagaaaat

SEQ ID NO: 1262636 - DNA, 22 bp, Artificial Sequence
  chemically synthesized
tttctaaagaatattttctcac

SEQ ID NO: 1262637 - DNA, 22 bp, Artificial Sequence
  chemically synthesized
ctctgaaagagtgagaaaatat

SEQ ID NO: 1262638 - DNA, 22 bp, Artificial Sequence
  chemically synthesized
tgaaagagtgagaaaatattct

SEQ ID NO: 1262639 - DNA, 22 bp, Artificial Sequence
  chemically synthesized
aaagagtgagaaaatattcttt

SEQ ID NO: 1262640 - DNA, 22 bp, Artificial Sequence
  chemically synthesized
taatgtaaactgtttctaaaga

SEQ ID NO: 1262641 - DNA, 22 bp, Artificial Sequence
  chemically synthesized
gtaatgtaaactgtttctaaag

SEQ ID NO: 1262642 - DNA, 22 bp, Artificial Sequence
  chemically synthesized
atcagagtttgtaatgtaaact

SEQ ID NO: 1262643 - DNA, 22 bp, Artificial Sequence
  chemically synthesized
tttagaaacagtttacattaca

SEQ ID NO: 1262644 - DNA, 22 bp, Artificial Sequence
  chemically synthesized
tagaaacagtttacattacaaa

SEQ ID NO: 1262645 - DNA, 22 bp, Artificial Sequence
  chemically synthesized
agaaacagtttacattacaaac

SEQ ID NO: 1262646 - DNA, 22 bp, Artificial Sequence
  chemically synthesized
gaaacagtttacattacaaact

SEQ ID NO: 1262647 - DNA, 22 bp, Artificial Sequence
  chemically synthesized
atatccactcatcagagtttgt

SEQ ID NO: 1262648 - DNA, 22 bp, Artificial Sequence
  chemically synthesized
acattacaaactctgatgagtg

SEQ ID NO: 1262649 - DNA, 22 bp, Artificial Sequence
  chemically synthesized
cattacaaactctgatgagtgg

SEQ ID NO: 1262650 - DNA, 22 bp, Artificial Sequence
  chemically synthesized
gcaaagtattcatatccactca

SEQ ID NO: 1262651 - DNA, 22 bp, Artificial Sequence
  chemically synthesized
caaactctgatgagtggatatg

SEQ ID NO: 1262652 - DNA, 22 bp, Artificial Sequence
  chemically synthesized
attggcaaagtattcatatcca

SEQ ID NO: 1262653 - DNA, 22 bp, Artificial Sequence
  chemically synthesized
cattggcaaagtattcatatcc

SEQ ID NO: 1262654 - DNA, 22 bp, Artificial Sequence
  chemically synthesized
tgatgagtggatatgaatactt

SEQ ID NO: 1262655 - DNA, 22 bp, Artificial Sequence
  chemically synthesized
atgagtggatatgaatactttg

SEQ ID NO: 1262656 - DNA, 22 bp, Artificial Sequence
  chemically synthesized
caagtatccacacacatttcat

SEQ ID NO: 1262657 - DNA, 22 bp, Artificial Sequence
  chemically synthesized
ccaagtatccacacacatttca

SEQ ID NO: 1262658 - DNA, 22 bp, Artificial Sequence
  chemically synthesized
tgccaatgaaatgtgtgtggat

SEQ ID NO: 1262659 - DNA, 22 bp, Artificial Sequence
  chemically synthesized
gccaatgaaatgtgtgtggata

SEQ ID NO: 1262660 - DNA, 22 bp, Artificial Sequence
  chemically synthesized
ccaatgaaatgtgtgtggatac

SEQ ID NO: 1262661 - DNA, 22 bp, Artificial Sequence
  chemically synthesized
atgtcccagccaatttccaagt

SEQ ID NO: 1262662 - DNA, 22 bp, Artificial Sequence
  chemically synthesized
ttcatgtcccagccaatttcca

SEQ ID NO: 1262663 - DNA, 22 bp, Artificial Sequence
  chemically synthesized
attcatgtcccagccaatttcc

SEQ ID NO: 1262664 - DNA, 22 bp, Artificial Sequence
  chemically synthesized
agcaatttattcatgtcccagc

SEQ ID NO: 1262665 - DNA, 22 bp, Artificial Sequence
  chemically synthesized
ggaaattggctgggacatgaat

SEQ ID NO: 1262666 - DNA, 22 bp, Artificial Sequence
  chemically synthesized
gaaattggctgggacatgaata

SEQ ID NO: 1262667 - DNA, 22 bp, Artificial Sequence
  chemically synthesized
gctgggacatgaataaattgct

SEQ ID NO: 1262668 - DNA, 22 bp, Artificial Sequence
  chemically synthesized
ggacatgaataaattgctcaac

SEQ ID NO: 1262669 - DNA, 22 bp, Artificial Sequence
  chemically synthesized
agtgtgtacagtaatagggttg

SEQ ID NO: 1262670 - DNA, 22 bp, Artificial Sequence
  chemically synthesized
cagtgtgtacagtaatagggtt

SEQ ID NO: 1262671 - DNA, 22 bp, Artificial Sequence
  chemically synthesized
ctcaaccctattactgtacaca

SEQ ID NO: 1262672 - DNA, 22 bp, Artificial Sequence
  chemically synthesized
aaccctattactgtacacactg

SEQ ID NO: 1262673 - DNA, 22 bp, Artificial Sequence
  chemically synthesized
aaaaatagtacttcagtgtgta

SEQ ID NO: 1262674 - DNA, 22 bp, Artificial Sequence
  chemically synthesized
ttactgtacacactgaagtact

SEQ ID NO: 1262675 - DNA, 22 bp, Artificial Sequence
  chemically synthesized
aagtactaaaaaatagtacttc

SEQ ID NO: 1262676 - DNA, 22 bp, Artificial Sequence
  chemically synthesized
ctgtacacactgaagtactatt

SEQ ID NO: 1262677 - DNA, 22 bp, Artificial Sequence
  chemically synthesized
ctgaagtactaaaaaatagtac

SEQ ID NO: 1262678 - DNA, 22 bp, Artificial Sequence
  chemically synthesized
tacacactgaagtactattttt

SEQ ID NO: 1262679 - DNA, 22 bp, Artificial Sequence
  chemically synthesized
ctgctgaagtactaaaaaatag

SEQ ID NO: 1262680 - DNA, 22 bp, Artificial Sequence
  chemically synthesized
acctactgctgaagtactaaaa

SEQ ID NO: 1262681 - DNA, 22 bp, Artificial Sequence
  chemically synthesized
aagtactattttttagtacttc

SEQ ID NO: 1262682 - DNA, 22 bp, Artificial Sequence
  chemically synthesized
ctgacctactgctgaagtacta

SEQ ID NO: 1262683 - DNA, 22 bp, Artificial Sequence
  chemically synthesized
ctgctgacctactgctgaagta

SEQ ID NO: 1262684 - DNA, 22 bp, Artificial Sequence
  chemically synthesized
tactgctgacctactgctgaag

SEQ ID NO: 1262685 - DNA, 22 bp, Artificial Sequence
  chemically synthesized
ttttttagtacttcagcagtag

SEQ ID NO: 1262686 - DNA, 22 bp, Artificial Sequence
  chemically synthesized
tttagtacttcagcagtaggtc

SEQ ID NO: 1262687 - DNA, 22 bp, Artificial Sequence
  chemically synthesized
ttagtacttcagcagtaggtca

SEQ ID NO: 1262688 - DNA, 22 bp, Artificial Sequence
  chemically synthesized
tagtacttcagcagtaggtcag

SEQ ID NO: 1262689 - DNA, 22 bp, Artificial Sequence
  chemically synthesized
agtacttcagcagtaggtcagc

SEQ ID NO: 1262690 - DNA, 22 bp, Artificial Sequence
  chemically synthesized
gtacttcagcagtaggtcagca

SEQ ID NO: 1262691 - DNA, 22 bp, Artificial Sequence
  chemically synthesized
cagcagtaggtcagcagtagaa

SEQ ID NO: 1262692 - DNA, 22 bp, Artificial Sequence
  chemically synthesized
gggatatgaggattctactgct

SEQ ID NO: 1262693 - DNA, 22 bp, Artificial Sequence
  chemically synthesized
agcagtaggtcagcagtagaat

SEQ ID NO: 1262694 - DNA, 22 bp, Artificial Sequence
  chemically synthesized
ggggatatgaggattctactgc

SEQ ID NO: 1262695 - DNA, 22 bp, Artificial Sequence
  chemically synthesized
tggggatatgaggattctactg

SEQ ID NO: 1262696 - DNA, 22 bp, Artificial Sequence
  chemically synthesized
tttggggatatgaggattctac

SEQ ID NO: 1262697 - DNA, 22 bp, Artificial Sequence
  chemically synthesized
ctttggggatatgaggattcta

SEQ ID NO: 1262698 - DNA, 22 bp, Artificial Sequence
  chemically synthesized
tctttggggatatgaggattct

SEQ ID NO: 1262699 - DNA, 22 bp, Artificial Sequence
  chemically synthesized
tttctttggggatatgaggatt

SEQ ID NO: 1262700 - DNA, 22 bp, Artificial Sequence
  chemically synthesized
taatgttctttctttggggata

SEQ ID NO: 1262701 - DNA, 22 bp, Artificial Sequence
  chemically synthesized
ataatgttctttctttggggat

SEQ ID NO: 1262702 - DNA, 22 bp, Artificial Sequence
  chemically synthesized
atatccccaaagaaagaacatt

SEQ ID NO: 1262703 - DNA, 22 bp, Artificial Sequence
  chemically synthesized
cacatatatttataatgttctt

SEQ ID NO: 1262704 - DNA, 22 bp, Artificial Sequence
  chemically synthesized
acacatatatttataatgttct

SEQ ID NO: 1262705 - DNA, 22 bp, Artificial Sequence
  chemically synthesized
aaaatttacacatatatttata

SEQ ID NO: 1262706 - DNA, 22 bp, Artificial Sequence
  chemically synthesized
tgctaaaaatttacacatatat

SEQ ID NO: 1262707 - DNA, 22 bp, Artificial Sequence
  chemically synthesized
atgctaaaaatttacacatata

SEQ ID NO: 1262708 - DNA, 22 bp, Artificial Sequence
  chemically synthesized
tatgctaaaaatttacacatat

SEQ ID NO: 1262709 - DNA, 22 bp, Artificial Sequence
  chemically synthesized
taaatatatgtgtaaattttta

SEQ ID NO: 1262710 - DNA, 22 bp, Artificial Sequence
  chemically synthesized
aacacgttttatgctaaaaatt

SEQ ID NO: 1262711 - DNA, 22 bp, Artificial Sequence
  chemically synthesized
aaacacgttttatgctaaaaat

SEQ ID NO: 1262712 - DNA, 22 bp, Artificial Sequence
  chemically synthesized
taaacacgttttatgctaaaaa

SEQ ID NO: 1262713 - DNA, 22 bp, Artificial Sequence
  chemically synthesized
ttttaaacacgttttatgctaa

SEQ ID NO: 1262714 - DNA, 22 bp, Artificial Sequence
  chemically synthesized
attttaaacacgttttatgcta

SEQ ID NO: 1262715 - DNA, 22 bp, Artificial Sequence
  chemically synthesized
tattttaaacacgttttatgct

SEQ ID NO: 1262716 - DNA, 22 bp, Artificial Sequence
  chemically synthesized
atattttattttaaacacgttt

SEQ ID NO: 1262717 - DNA, 22 bp, Artificial Sequence
  chemically synthesized
aatattttattttaaacacgtt

SEQ ID NO: 1262718 - DNA, 22 bp, Artificial Sequence
  chemically synthesized
ttagcataaaacgtgtttaaaa

SEQ ID NO: 1262719 - DNA, 22 bp, Artificial Sequence
  chemically synthesized
tagcataaaacgtgtttaaaat

SEQ ID NO: 1262720 - DNA, 22 bp, Artificial Sequence
  chemically synthesized
agcataaaacgtgtttaaaata

SEQ ID NO: 1262721 - DNA, 22 bp, Artificial Sequence
  chemically synthesized
gcataaaacgtgtttaaaataa

SEQ ID NO: 1262722 - DNA, 22 bp, Artificial Sequence
  chemically synthesized
catcttaatattttattttaaa

SEQ ID NO: 1262723 - DNA, 22 bp, Artificial Sequence
  chemically synthesized
atattccatcttaatattttat

SEQ ID NO: 1262724 - DNA, 22 bp, Artificial Sequence
  chemically synthesized
aatattccatcttaatatttta

SEQ ID NO: 1262725 - DNA, 22 bp, Artificial Sequence
  chemically synthesized
tacttaatattccatcttaata

SEQ ID NO: 1262726 - DNA, 22 bp, Artificial Sequence
  chemically synthesized
aaaataaaatattaagatggaa

SEQ ID NO: 1262727 - DNA, 22 bp, Artificial Sequence
  chemically synthesized
aaataaaatattaagatggaat

SEQ ID NO: 1262728 - DNA, 22 bp, Artificial Sequence
  chemically synthesized
aggttatacttaatattccatc

SEQ ID NO: 1262729 - DNA, 22 bp, Artificial Sequence
  chemically synthesized
atattcaggttatacttaatat

SEQ ID NO: 1262730 - DNA, 22 bp, Artificial Sequence
  chemically synthesized
aatattcaggttatacttaata

SEQ ID NO: 1262731 - DNA, 22 bp, Artificial Sequence
  chemically synthesized
ttaatattcaggttatacttaa

SEQ ID NO: 1262732 - DNA, 22 bp, Artificial Sequence
  chemically synthesized
agatggaatattaagtataacc

SEQ ID NO: 1262733 - DNA, 22 bp, Artificial Sequence
  chemically synthesized
ttcttaatattcaggttatact

SEQ ID NO: 1262734 - DNA, 22 bp, Artificial Sequence
  chemically synthesized
agtataacctgaatattaagaa

SEQ ID NO: 1262735 - DNA, 22 bp, Artificial Sequence
  chemically synthesized
cgagtgtatctgttcttaatat

SEQ ID NO: 1262736 - DNA, 22 bp, Artificial Sequence
  chemically synthesized
attccgagtgtatctgttctta

SEQ ID NO: 1262737 - DNA, 22 bp, Artificial Sequence
  chemically synthesized
aatattaagaacagatacactc

SEQ ID NO: 1262738 - DNA, 22 bp, Artificial Sequence
  chemically synthesized
cccaaccccactaattccgagt

SEQ ID NO: 1262739 - DNA, 22 bp, Artificial Sequence
  chemically synthesized
agaacagatacactcggaatta

SEQ ID NO: 1262740 - DNA, 22 bp, Artificial Sequence
  chemically synthesized
ccccaaccccactaattccgag

SEQ ID NO: 1262741 - DNA, 22 bp, Artificial Sequence
  chemically synthesized
tccccaaccccactaattccga

SEQ ID NO: 1262742 - DNA, 22 bp, Artificial Sequence
  chemically synthesized
ttccccaaccccactaattccg

SEQ ID NO: 1262743 - DNA, 22 bp, Artificial Sequence
  chemically synthesized
tttccccaaccccactaattcc

SEQ ID NO: 1262744 - DNA, 22 bp, Artificial Sequence
  chemically synthesized
ctttttccccaaccccactaat

SEQ ID NO: 1262745 - DNA, 22 bp, Artificial Sequence
  chemically synthesized
tactttttccccaaccccacta

SEQ ID NO: 1262746 - DNA, 22 bp, Artificial Sequence
  chemically synthesized
ctactttttccccaaccccact

SEQ ID NO: 1262747 - DNA, 22 bp, Artificial Sequence
  chemically synthesized
tcttctactttttccccaaccc

SEQ ID NO: 1262748 - DNA, 22 bp, Artificial Sequence
  chemically synthesized
ggaattagtggggttggggaaa

SEQ ID NO: 1262749 - DNA, 22 bp, Artificial Sequence
  chemically synthesized
gtggggttggggaaaaagtaga

SEQ ID NO: 1262750 - DNA, 22 bp, Artificial Sequence
  chemically synthesized
gggaaaaagtagaagacagctc

SEQ ID NO: 1262751 - DNA, 22 bp, Artificial Sequence
  chemically synthesized
ccaaaaccatcggccacagagc

SEQ ID NO: 1262752 - DNA, 22 bp, Artificial Sequence
  chemically synthesized
ttaccaaaaccatcggccacag

SEQ ID NO: 1262753 - DNA, 22 bp, Artificial Sequence
  chemically synthesized
aacattattaccaaaaccatcg

SEQ ID NO: 1262754 - DNA, 22 bp, Artificial Sequence
  chemically synthesized
tgtggccgatggttttggtaat

SEQ ID NO: 1262755 - DNA, 22 bp, Artificial Sequence
  chemically synthesized
tggccgatggttttggtaataa

SEQ ID NO: 1262756 - DNA, 22 bp, Artificial Sequence
  chemically synthesized
gaatccctaaacattattacca

SEQ ID NO: 1262757 - DNA, 22 bp, Artificial Sequence
  chemically synthesized
ctggaatccctaaacattatta

SEQ ID NO: 1262758 - DNA, 22 bp, Artificial Sequence
  chemically synthesized
tggtaataatgtttagggattc

SEQ ID NO: 1262759 - DNA, 22 bp, Artificial Sequence
  chemically synthesized
ggtaataatgtttagggattcc

SEQ ID NO: 1262760 - DNA, 22 bp, Artificial Sequence
  chemically synthesized
gtaataatgtttagggattcca

SEQ ID NO: 1262761 - DNA, 22 bp, Artificial Sequence
  chemically synthesized
aaaatcatattcctggaatccc

SEQ ID NO: 1262762 - DNA, 22 bp, Artificial Sequence
  chemically synthesized
tgacattgaaaatcatattcct

SEQ ID NO: 1262763 - DNA, 22 bp, Artificial Sequence
  chemically synthesized
agggattccaggaatatgattt

SEQ ID NO: 1262764 - DNA, 22 bp, Artificial Sequence
  chemically synthesized
gggattccaggaatatgatttt

SEQ ID NO: 1262765 - DNA, 22 bp, Artificial Sequence
  chemically synthesized
caggaatatgattttcaatgtc

SEQ ID NO: 1262766 - DNA, 22 bp, Artificial Sequence
  chemically synthesized
gaaaaatactatgacattgaaa

SEQ ID NO: 1262767 - DNA, 22 bp, Artificial Sequence
  chemically synthesized
ggaaaaatactatgacattgaa

SEQ ID NO: 1262768 - DNA, 22 bp, Artificial Sequence
  chemically synthesized
gtcatttggaaaaatactatga

SEQ ID NO: 1262769 - DNA, 22 bp, Artificial Sequence
  chemically synthesized
agtcatttggaaaaatactatg

SEQ ID NO: 1262770 - DNA, 22 bp, Artificial Sequence
  chemically synthesized
cttagtcatttggaaaaatact

SEQ ID NO: 1262771 - DNA, 22 bp, Artificial Sequence
  chemically synthesized
tcaatgtcatagtatttttcca

SEQ ID NO: 1262772 - DNA, 22 bp, Artificial Sequence
  chemically synthesized
caatgtcatagtatttttccaa

SEQ ID NO: 1262773 - DNA, 22 bp, Artificial Sequence
  chemically synthesized
aatgtcatagtatttttccaaa

SEQ ID NO: 1262774 - DNA, 22 bp, Artificial Sequence
  chemically synthesized
aaaaacctacttagtcatttgg

SEQ ID NO: 1262775 - DNA, 22 bp, Artificial Sequence
  chemically synthesized
gaaaaacctacttagtcatttg

SEQ ID NO: 1262776 - DNA, 22 bp, Artificial Sequence
  chemically synthesized
tgaaaaacctacttagtcattt

SEQ ID NO: 1262777 - DNA, 22 bp, Artificial Sequence
  chemically synthesized
ttgaaaaacctacttagtcatt

SEQ ID NO: 1262778 - DNA, 22 bp, Artificial Sequence
  chemically synthesized
ttccaaatgactaagtaggttt

SEQ ID NO: 1262779 - DNA, 22 bp, Artificial Sequence
  chemically synthesized
tccaaatgactaagtaggtttt

SEQ ID NO: 1262780 - DNA, 22 bp, Artificial Sequence
  chemically synthesized
ccaaatgactaagtaggttttt

SEQ ID NO: 1262781 - DNA, 22 bp, Artificial Sequence
  chemically synthesized
caaatgactaagtaggtttttc

SEQ ID NO: 1262782 - DNA, 22 bp, Artificial Sequence
  chemically synthesized
agtaggtttttcaaaaactctg

SEQ ID NO: 1262783 - DNA, 22 bp, Artificial Sequence
  chemically synthesized
ttcaaaaactctgggttttttt

SEQ ID NO: 1262784 - DNA, 22 bp, Artificial Sequence
  chemically synthesized
tcaaaaactctgggtttttttt

SEQ ID NO: 1262785 - DNA, 22 bp, Artificial Sequence
  chemically synthesized
caaaaactctgggttttttttt

SEQ ID NO: 1262786 - DNA, 22 bp, Artificial Sequence
  chemically synthesized
aaaaactctgggtttttttttt

SEQ ID NO: 1262787 - DNA, 22 bp, Artificial Sequence
  chemically synthesized
aaaaaaaaaaaaaaaaaaaaaa

SEQ ID NO: 1262788 - DNA, 22 bp, Artificial Sequence
  chemically synthesized
tgggtttttttttttttttttt

SEQ ID NO: 1262789 - DNA, 22 bp, Artificial Sequence
  chemically synthesized
taaaaaaaaaaaaaaaaaaaaa

SEQ ID NO: 1262790 - DNA, 22 bp, Artificial Sequence
  chemically synthesized
ctaaaaaaaaaaaaaaaaaaaa

SEQ ID NO: 1262791 - DNA, 22 bp, Artificial Sequence
  chemically synthesized
ggtttttttttttttttttttt

SEQ ID NO: 1262792 - DNA, 22 bp, Artificial Sequence
  chemically synthesized
tctaaaaaaaaaaaaaaaaaaa

SEQ ID NO: 1262793 - DNA, 22 bp, Artificial Sequence
  chemically synthesized
ttctaaaaaaaaaaaaaaaaaa

SEQ ID NO: 1262794 - DNA, 22 bp, Artificial Sequence
  chemically synthesized
tttttctaaaaaaaaaaaaaaa

SEQ ID NO: 1262795 - DNA, 22 bp, Artificial Sequence
  chemically synthesized
tttttttttttttttttttttt

SEQ ID NO: 1262796 - DNA, 22 bp, Artificial Sequence
  chemically synthesized
tttttttttttttttttttttt

SEQ ID NO: 1262797 - DNA, 22 bp, Artificial Sequence
  chemically synthesized
tttttttttttttttttttttt

SEQ ID NO: 1262798 - DNA, 22 bp, Artificial Sequence
  chemically synthesized
tttttttttttttttttttttt

SEQ ID NO: 1262799 - DNA, 22 bp, Artificial Sequence
  chemically synthesized
tttttttttttttttttttttt

SEQ ID NO: 1262800 - DNA, 22 bp, Artificial Sequence
  chemically synthesized
ttttttttttttttttttttta

SEQ ID NO: 1262801 - DNA, 22 bp, Artificial Sequence
  chemically synthesized
ttttttttttttttttttttag

SEQ ID NO: 1262802 - DNA, 22 bp, Artificial Sequence
  chemically synthesized
tttttttttttttttttttaga

SEQ ID NO: 1262803 - DNA, 22 bp, Artificial Sequence
  chemically synthesized
ttttttttttttttttttagaa

SEQ ID NO: 1262804 - DNA, 22 bp, Artificial Sequence
  chemically synthesized
tttttttttttttttttagaaa

SEQ ID NO: 1262805 - DNA, 22 bp, Artificial Sequence
  chemically synthesized
ttttttttttttttttagaaaa

SEQ ID NO: 1262806 - DNA, 22 bp, Artificial Sequence
  chemically synthesized
tttttttttttttttagaaaaa

SEQ ID NO: 1262807 - DNA, 22 bp, Artificial Sequence
  chemically synthesized
ttttttttttttttagaaaaat

SEQ ID NO: 1262808 - DNA, 22 bp, Artificial Sequence
  chemically synthesized
agtccatcaattatttttctaa

SEQ ID NO: 1262809 - DNA, 22 bp, Artificial Sequence
  chemically synthesized
tttttttttttttagaaaaata

SEQ ID NO: 1262810 - DNA, 22 bp, Artificial Sequence
  chemically synthesized
ttttttttttttagaaaaataa

SEQ ID NO: 1262811 - DNA, 22 bp, Artificial Sequence
  chemically synthesized
tttttttttttagaaaaataat

SEQ ID NO: 1262812 - DNA, 22 bp, Artificial Sequence
  chemically synthesized
ttttttttttagaaaaataatt

SEQ ID NO: 1262813 - DNA, 22 bp, Artificial Sequence
  chemically synthesized
tttttttttagaaaaataattg

SEQ ID NO: 1262814 - DNA, 22 bp, Artificial Sequence
  chemically synthesized
ttttttttagaaaaataattga

SEQ ID NO: 1262815 - DNA, 22 bp, Artificial Sequence
  chemically synthesized
agattgagtccatcaattattt

SEQ ID NO: 1262816 - DNA, 22 bp, Artificial Sequence
  chemically synthesized
tttttttagaaaaataattgat

SEQ ID NO: 1262817 - DNA, 22 bp, Artificial Sequence
  chemically synthesized
cagattgagtccatcaattatt

SEQ ID NO: 1262818 - DNA, 22 bp, Artificial Sequence
  chemically synthesized
ttttttagaaaaataattgatg

SEQ ID NO: 1262819 - DNA, 22 bp, Artificial Sequence
  chemically synthesized
tcagattgagtccatcaattat

SEQ ID NO: 1262820 - DNA, 22 bp, Artificial Sequence
  chemically synthesized
tttttagaaaaataattgatgg

SEQ ID NO: 1262821 - DNA, 22 bp, Artificial Sequence
  chemically synthesized
ttttagaaaaataattgatgga

SEQ ID NO: 1262822 - DNA, 22 bp, Artificial Sequence
  chemically synthesized
tttagaaaaataattgatggac

SEQ ID NO: 1262823 - DNA, 22 bp, Artificial Sequence
  chemically synthesized
ttagaaaaataattgatggact

SEQ ID NO: 1262824 - DNA, 22 bp, Artificial Sequence
  chemically synthesized
tagaaaaataattgatggactc

SEQ ID NO: 1262825 - DNA, 22 bp, Artificial Sequence
  chemically synthesized
agaaaaataattgatggactca

SEQ ID NO: 1262826 - DNA, 22 bp, Artificial Sequence
  chemically synthesized
gaaaaataattgatggactcaa

SEQ ID NO: 1262827 - DNA, 22 bp, Artificial Sequence
  chemically synthesized
atggactcaatctgaaagttat

SEQ ID NO: 1262828 - DNA, 22 bp, Artificial Sequence
  chemically synthesized
tatggtaggccaaaataacttt

SEQ ID NO: 1262829 - DNA, 22 bp, Artificial Sequence
  chemically synthesized
gtatggtaggccaaaataactt

SEQ ID NO: 1262830 - DNA, 22 bp, Artificial Sequence
  chemically synthesized
tgtatggtaggccaaaataact

SEQ ID NO: 1262831 - DNA, 22 bp, Artificial Sequence
  chemically synthesized
aatctgaaagttattttggcct

SEQ ID NO: 1262832 - DNA, 22 bp, Artificial Sequence
  chemically synthesized
cataggctttgtatggtaggcc

SEQ ID NO: 1262833 - DNA, 22 bp, Artificial Sequence
  chemically synthesized
aaagttattttggcctaccata

SEQ ID NO: 1262834 - DNA, 22 bp, Artificial Sequence
  chemically synthesized
agaactgcataggctttgtatg

SEQ ID NO: 1262835 - DNA, 22 bp, Artificial Sequence
  chemically synthesized
ttttggcctaccatacaaagcc

SEQ ID NO: 1262836 - DNA, 22 bp, Artificial Sequence
  chemically synthesized
tggcctaccatacaaagcctat

SEQ ID NO: 1262837 - DNA, 22 bp, Artificial Sequence
  chemically synthesized
ggcctaccatacaaagcctatg

SEQ ID NO: 1262838 - DNA, 22 bp, Artificial Sequence
  chemically synthesized
gcctaccatacaaagcctatgc

SEQ ID NO: 1262839 - DNA, 22 bp, Artificial Sequence
  chemically synthesized
ccatacaaagcctatgcagttc

SEQ ID NO: 1262840 - DNA, 22 bp, Artificial Sequence
  chemically synthesized
cagcaggtcacatactgagaac

SEQ ID NO: 1262841 - DNA, 22 bp, Artificial Sequence
  chemically synthesized
attccagcaggtcacatactga

SEQ ID NO: 1262842 - DNA, 22 bp, Artificial Sequence
  chemically synthesized
tgcagttctcagtatgtgacct

SEQ ID NO: 1262843 - DNA, 22 bp, Artificial Sequence
  chemically synthesized
tcagtatgtgacctgctggaat

SEQ ID NO: 1262844 - DNA, 22 bp, Artificial Sequence
  chemically synthesized
agtatgtgacctgctggaatga

SEQ ID NO: 1262845 - DNA, 22 bp, Artificial Sequence
  chemically synthesized
aggtggtcacactcattccagc

SEQ ID NO: 1262846 - DNA, 22 bp, Artificial Sequence
  chemically synthesized
ctgaggtggtcacactcattcc

SEQ ID NO: 1262847 - DNA, 22 bp, Artificial Sequence
  chemically synthesized
gtatctactgaggtggtcacac

SEQ ID NO: 1262848 - DNA, 22 bp, Artificial Sequence
  chemically synthesized
ctggaatgagtgtgaccacctc

SEQ ID NO: 1262849 - DNA, 22 bp, Artificial Sequence
  chemically synthesized
gaatgagtgtgaccacctcagt

SEQ ID NO: 1262850 - DNA, 22 bp, Artificial Sequence
  chemically synthesized
ccagtacaacgttagtatctac

SEQ ID NO: 1262851 - DNA, 22 bp, Artificial Sequence
  chemically synthesized
aaagtattgccagtacaacgtt

SEQ ID NO: 1262852 - DNA, 22 bp, Artificial Sequence
  chemically synthesized
aaaagtattgccagtacaacgt

SEQ ID NO: 1262853 - DNA, 22 bp, Artificial Sequence
  chemically synthesized
agtagatactaacgttgtactg

SEQ ID NO: 1262854 - DNA, 22 bp, Artificial Sequence
  chemically synthesized
aacttaaaagtattgccagtac

SEQ ID NO: 1262855 - DNA, 22 bp, Artificial Sequence
  chemically synthesized
aaacttaaaagtattgccagta

SEQ ID NO: 1262856 - DNA, 22 bp, Artificial Sequence
  chemically synthesized
taaacttaaaagtattgccagt

SEQ ID NO: 1262857 - DNA, 22 bp, Artificial Sequence
  chemically synthesized
acgttgtactggcaatactttt

SEQ ID NO: 1262858 - DNA, 22 bp, Artificial Sequence
  chemically synthesized
tggttttaaacttaaaagtatt

SEQ ID NO: 1262859 - DNA, 22 bp, Artificial Sequence
  chemically synthesized
tactggcaatacttttaagttt

SEQ ID NO: 1262860 - DNA, 22 bp, Artificial Sequence
  chemically synthesized
gcaatacttttaagtttaaaac

SEQ ID NO: 1262861 - DNA, 22 bp, Artificial Sequence
  chemically synthesized
cggaatacaatgttgtggtttt

SEQ ID NO: 1262862 - DNA, 22 bp, Artificial Sequence
  chemically synthesized
ccggaatacaatgttgtggttt

SEQ ID NO: 1262863 - DNA, 22 bp, Artificial Sequence
  chemically synthesized
ttaagtttaaaaccacaacatt

SEQ ID NO: 1262864 - DNA, 22 bp, Artificial Sequence
  chemically synthesized
taagtttaaaaccacaacattg

SEQ ID NO: 1262865 - DNA, 22 bp, Artificial Sequence
  chemically synthesized
aagtttaaaaccacaacattgt

SEQ ID NO: 1262866 - DNA, 22 bp, Artificial Sequence
  chemically synthesized
agtttaaaaccacaacattgta

SEQ ID NO: 1262867 - DNA, 22 bp, Artificial Sequence
  chemically synthesized
aaaaccacaacattgtattccg

SEQ ID NO: 1262868 - DNA, 22 bp, Artificial Sequence
  chemically synthesized
aaaccacaacattgtattccgg

SEQ ID NO: 1262869 - DNA, 22 bp, Artificial Sequence
  chemically synthesized
aaaatagaagtcttccggaata

SEQ ID NO: 1262870 - DNA, 22 bp, Artificial Sequence
  chemically synthesized
tattccggaagacttctatttt

SEQ ID NO: 1262871 - DNA, 22 bp, Artificial Sequence
  chemically synthesized
cggaagacttctattttgagtc

SEQ ID NO: 1262872 - DNA, 22 bp, Artificial Sequence
  chemically synthesized
tcagaatgaaaagactcaaaat

SEQ ID NO: 1262873 - DNA, 22 bp, Artificial Sequence
  chemically synthesized
ctattttgagtcttttcattct

SEQ ID NO: 1262874 - DNA, 22 bp, Artificial Sequence
  chemically synthesized
gaggatactatcagaatgaaaa

SEQ ID NO: 1262875 - DNA, 22 bp, Artificial Sequence
  chemically synthesized
tattttgagtcttttcattctg

SEQ ID NO: 1262876 - DNA, 22 bp, Artificial Sequence
  chemically synthesized
ggaggatactatcagaatgaaa

SEQ ID NO: 1262877 - DNA, 22 bp, Artificial Sequence
  chemically synthesized
ttttgagtcttttcattctgat

SEQ ID NO: 1262878 - DNA, 22 bp, Artificial Sequence
  chemically synthesized
cttggaggatactatcagaatg

SEQ ID NO: 1262879 - DNA, 22 bp, Artificial Sequence
  chemically synthesized
tgagtcttttcattctgatagt

SEQ ID NO: 1262880 - DNA, 22 bp, Artificial Sequence
  chemically synthesized
gagtcttttcattctgatagta

SEQ ID NO: 1262881 - DNA, 22 bp, Artificial Sequence
  chemically synthesized
agtcttttcattctgatagtat

SEQ ID NO: 1262882 - DNA, 22 bp, Artificial Sequence
  chemically synthesized
aagttccttggaggatactatc

SEQ ID NO: 1262883 - DNA, 22 bp, Artificial Sequence
  chemically synthesized
aaagttccttggaggatactat

SEQ ID NO: 1262884 - DNA, 22 bp, Artificial Sequence
  chemically synthesized
taaagttccttggaggatacta

SEQ ID NO: 1262885 - DNA, 22 bp, Artificial Sequence
  chemically synthesized
ttcattctgatagtatcctcca

SEQ ID NO: 1262886 - DNA, 22 bp, Artificial Sequence
  chemically synthesized
tttaaagttccttggaggatac

SEQ ID NO: 1262887 - DNA, 22 bp, Artificial Sequence
  chemically synthesized
tcattctgatagtatcctccaa

SEQ ID NO: 1262888 - DNA, 22 bp, Artificial Sequence
  chemically synthesized
cattctgatagtatcctccaag

SEQ ID NO: 1262889 - DNA, 22 bp, Artificial Sequence
  chemically synthesized
attctgatagtatcctccaagg

SEQ ID NO: 1262890 - DNA, 22 bp, Artificial Sequence
  chemically synthesized
ttctttaaagttccttggagga

SEQ ID NO: 1262891 - DNA, 22 bp, Artificial Sequence
  chemically synthesized
tattctttaaagttccttggag

SEQ ID NO: 1262892 - DNA, 22 bp, Artificial Sequence
  chemically synthesized
tgatagtatcctccaaggaact

SEQ ID NO: 1262893 - DNA, 22 bp, Artificial Sequence
  chemically synthesized
atagtatcctccaaggaacttt

SEQ ID NO: 1262894 - DNA, 22 bp, Artificial Sequence
  chemically synthesized
aatcaggggttctattctttaa

SEQ ID NO: 1262895 - DNA, 22 bp, Artificial Sequence
  chemically synthesized
caaggaactttaaagaatagaa

SEQ ID NO: 1262896 - DNA, 22 bp, Artificial Sequence
  chemically synthesized
cctgaatcaggggttctattct

SEQ ID NO: 1262897 - DNA, 22 bp, Artificial Sequence
  chemically synthesized
ttacctgaatcaggggttctat

SEQ ID NO: 1262898 - DNA, 22 bp, Artificial Sequence
  chemically synthesized
gttacctgaatcaggggttcta

SEQ ID NO: 1262899 - DNA, 22 bp, Artificial Sequence
  chemically synthesized
taaagaatagaacccctgattc

SEQ ID NO: 1262900 - DNA, 22 bp, Artificial Sequence
  chemically synthesized
aaagaatagaacccctgattca

SEQ ID NO: 1262901 - DNA, 22 bp, Artificial Sequence
  chemically synthesized
aagaatagaacccctgattcag

SEQ ID NO: 1262902 - DNA, 22 bp, Artificial Sequence
  chemically synthesized
agatcttgttacctgaatcagg

SEQ ID NO: 1262903 - DNA, 22 bp, Artificial Sequence
  chemically synthesized
attcaggtaacaagatctgaat

SEQ ID NO: 1262904 - DNA, 22 bp, Artificial Sequence
  chemically synthesized
atgcatcccaaacattcagatc

SEQ ID NO: 1262905 - DNA, 22 bp, Artificial Sequence
  chemically synthesized
aggtaacaagatctgaatgttt

SEQ ID NO: 1262906 - DNA, 22 bp, Artificial Sequence
  chemically synthesized
actgatgcatcccaaacattca

SEQ ID NO: 1262907 - DNA, 22 bp, Artificial Sequence
  chemically synthesized
ctcactgatgcatcccaaacat

SEQ ID NO: 1262908 - DNA, 22 bp, Artificial Sequence
  chemically synthesized
tactcactgatgcatcccaaac

SEQ ID NO: 1262909 - DNA, 22 bp, Artificial Sequence
  chemically synthesized
ctactcactgatgcatcccaaa

SEQ ID NO: 1262910 - DNA, 22 bp, Artificial Sequence
  chemically synthesized
cttctactcactgatgcatccc

SEQ ID NO: 1262911 - DNA, 22 bp, Artificial Sequence
  chemically synthesized
aatgtttgggatgcatcagtga

SEQ ID NO: 1262912 - DNA, 22 bp, Artificial Sequence
  chemically synthesized
gggatgcatcagtgagtagaag

SEQ ID NO: 1262913 - DNA, 22 bp, Artificial Sequence
  chemically synthesized
ggatgcatcagtgagtagaagc

SEQ ID NO: 1262914 - DNA, 22 bp, Artificial Sequence
  chemically synthesized
aaagtgcgtgaattgcttctac

SEQ ID NO: 1262915 - DNA, 22 bp, Artificial Sequence
  chemically synthesized
tgaaagtgcgtgaattgcttct

SEQ ID NO: 1262916 - DNA, 22 bp, Artificial Sequence
  chemically synthesized
ctgaaagtgcgtgaattgcttc

SEQ ID NO: 1262917 - DNA, 22 bp, Artificial Sequence
  chemically synthesized
aggacttctgaaagtgcgtgaa

SEQ ID NO: 1262918 - DNA, 22 bp, Artificial Sequence
  chemically synthesized
acgcactttcagaagtccttaa

SEQ ID NO: 1262919 - DNA, 22 bp, Artificial Sequence
  chemically synthesized
aggggcccaaaagttaaggact

SEQ ID NO: 1262920 - DNA, 22 bp, Artificial Sequence
  chemically synthesized
gaggggcccaaaagttaaggac

SEQ ID NO: 1262921 - DNA, 22 bp, Artificial Sequence
  chemically synthesized
cttgaggggcccaaaagttaag

SEQ ID NO: 1262922 - DNA, 22 bp, Artificial Sequence
  chemically synthesized
tcagaagtccttaacttttggg

SEQ ID NO: 1262923 - DNA, 22 bp, Artificial Sequence
  chemically synthesized
cagaagtccttaacttttgggc

SEQ ID NO: 1262924 - DNA, 22 bp, Artificial Sequence
  chemically synthesized
agaagtccttaacttttgggcc

SEQ ID NO: 1262925 - DNA, 22 bp, Artificial Sequence
  chemically synthesized
cagtccagttacttgaggggcc

SEQ ID NO: 1262926 - DNA, 22 bp, Artificial Sequence
  chemically synthesized
aacttttgggcccctcaagtaa

SEQ ID NO: 1262927 - DNA, 22 bp, Artificial Sequence
  chemically synthesized
acttttgggcccctcaagtaac

SEQ ID NO: 1262928 - DNA, 22 bp, Artificial Sequence
  chemically synthesized
aagttacagtccagttacttga

SEQ ID NO: 1262929 - DNA, 22 bp, Artificial Sequence
  chemically synthesized
ttgggcccctcaagtaactgga

SEQ ID NO: 1262930 - DNA, 22 bp, Artificial Sequence
  chemically synthesized
tgggcccctcaagtaactggac

SEQ ID NO: 1262931 - DNA, 22 bp, Artificial Sequence
  chemically synthesized
gggcccctcaagtaactggact

SEQ ID NO: 1262932 - DNA, 22 bp, Artificial Sequence
  chemically synthesized
gattcaagttacagtccagtta

SEQ ID NO: 1262933 - DNA, 22 bp, Artificial Sequence
  chemically synthesized
ggcccctcaagtaactggactg

SEQ ID NO: 1262934 - DNA, 22 bp, Artificial Sequence
  chemically synthesized
ctggattcaagttacagtccag

SEQ ID NO: 1262935 - DNA, 22 bp, Artificial Sequence
  chemically synthesized
actggattcaagttacagtcca

SEQ ID NO: 1262936 - DNA, 22 bp, Artificial Sequence
  chemically synthesized
atttactggattcaagttacag

SEQ ID NO: 1262937 - DNA, 22 bp, Artificial Sequence
  chemically synthesized
aagtaactggactgtaacttga

SEQ ID NO: 1262938 - DNA, 22 bp, Artificial Sequence
  chemically synthesized
atgtagttcatttactggattc

SEQ ID NO: 1262939 - DNA, 22 bp, Artificial Sequence
  chemically synthesized
gactgtaacttgaatccagtaa

SEQ ID NO: 1262940 - DNA, 22 bp, Artificial Sequence
  chemically synthesized
catgtagttcatttactggatt

SEQ ID NO: 1262941 - DNA, 22 bp, Artificial Sequence
  chemically synthesized
taacttgaatccagtaaatgaa

SEQ ID NO: 1262942 - DNA, 22 bp, Artificial Sequence
  chemically synthesized
gtgacagtttcatgtagttcat

SEQ ID NO: 1262943 - DNA, 22 bp, Artificial Sequence
  chemically synthesized
gaatccagtaaatgaactacat

SEQ ID NO: 1262944 - DNA, 22 bp, Artificial Sequence
  chemically synthesized
ggtgacagtttcatgtagttca

SEQ ID NO: 1262945 - DNA, 22 bp, Artificial Sequence
  chemically synthesized
aatccagtaaatgaactacatg

SEQ ID NO: 1262946 - DNA, 22 bp, Artificial Sequence
  chemically synthesized
gtttggtgacagtttcatgtag

SEQ ID NO: 1262947 - DNA, 22 bp, Artificial Sequence
  chemically synthesized
agtttggtgacagtttcatgta

SEQ ID NO: 1262948 - DNA, 22 bp, Artificial Sequence
  chemically synthesized
tagtttggtgacagtttcatgt

SEQ ID NO: 1262949 - DNA, 22 bp, Artificial Sequence
  chemically synthesized
ctttagtttggtgacagtttca

SEQ ID NO: 1262950 - DNA, 22 bp, Artificial Sequence
  chemically synthesized
atcaattgctttagtttggtga

SEQ ID NO: 1262951 - DNA, 22 bp, Artificial Sequence
  chemically synthesized
catcaattgctttagtttggtg

SEQ ID NO: 1262952 - DNA, 22 bp, Artificial Sequence
  chemically synthesized
catgaaactgtcaccaaactaa

SEQ ID NO: 1262953 - DNA, 22 bp, Artificial Sequence
  chemically synthesized
tttcatcaattgctttagtttg

SEQ ID NO: 1262954 - DNA, 22 bp, Artificial Sequence
  chemically synthesized
ctgtttcatcaattgctttagt

SEQ ID NO: 1262955 - DNA, 22 bp, Artificial Sequence
  chemically synthesized
tcaccaaactaaagcaattgat

SEQ ID NO: 1262956 - DNA, 22 bp, Artificial Sequence
  chemically synthesized
gtgttactgtttcatcaattgc

SEQ ID NO: 1262957 - DNA, 22 bp, Artificial Sequence
  chemically synthesized
ttcgtgttactgtttcatcaat

SEQ ID NO: 1262958 - DNA, 22 bp, Artificial Sequence
  chemically synthesized
attcgtgttactgtttcatcaa

SEQ ID NO: 1262959 - DNA, 22 bp, Artificial Sequence
  chemically synthesized
tatttattcgtgttactgtttc

SEQ ID NO: 1262960 - DNA, 22 bp, Artificial Sequence
  chemically synthesized
aagcaattgatgaaacagtaac

SEQ ID NO: 1262961 - DNA, 22 bp, Artificial Sequence
  chemically synthesized
atatttattcgtgttactgttt

SEQ ID NO: 1262962 - DNA, 22 bp, Artificial Sequence
  chemically synthesized
tatatttattcgtgttactgtt

SEQ ID NO: 1262963 - DNA, 22 bp, Artificial Sequence
  chemically synthesized
ttatatttattcgtgttactgt

SEQ ID NO: 1262964 - DNA, 22 bp, Artificial Sequence
  chemically synthesized
atgaaacagtaacacgaataaa

SEQ ID NO: 1262965 - DNA, 22 bp, Artificial Sequence
  chemically synthesized
gcagtgccttttatatttattc

SEQ ID NO: 1262966 - DNA, 22 bp, Artificial Sequence
  chemically synthesized
agcagtgccttttatatttatt

SEQ ID NO: 1262967 - DNA, 22 bp, Artificial Sequence
  chemically synthesized
tagcagtgccttttatatttat

SEQ ID NO: 1262968 - DNA, 22 bp, Artificial Sequence
  chemically synthesized
ttagcagtgccttttatattta

SEQ ID NO: 1262969 - DNA, 22 bp, Artificial Sequence
  chemically synthesized
tttagcagtgccttttatattt

SEQ ID NO: 1262970 - DNA, 22 bp, Artificial Sequence
  chemically synthesized
aagcctttttagcagtgccttt

SEQ ID NO: 1262971 - DNA, 22 bp, Artificial Sequence
  chemically synthesized
aaagcctttttagcagtgcctt

SEQ ID NO: 1262972 - DNA, 22 bp, Artificial Sequence
  chemically synthesized
ttaaagcctttttagcagtgcc

SEQ ID NO: 1262973 - DNA, 22 bp, Artificial Sequence
  chemically synthesized
cttaaagcctttttagcagtgc

SEQ ID NO: 1262974 - DNA, 22 bp, Artificial Sequence
  chemically synthesized
tcttaaagcctttttagcagtg

SEQ ID NO: 1262975 - DNA, 22 bp, Artificial Sequence
  chemically synthesized
aaaagcctttcttaaagccttt

SEQ ID NO: 1262976 - DNA, 22 bp, Artificial Sequence
  chemically synthesized
ctaaaaaggctttaagaaaggc

SEQ ID NO: 1262977 - DNA, 22 bp, Artificial Sequence
  chemically synthesized
aaaaatgttaaaaagcctttct

SEQ ID NO: 1262978 - DNA, 22 bp, Artificial Sequence
  chemically synthesized
aaaaggctttaagaaaggcttt

SEQ ID NO: 1262979 - DNA, 22 bp, Artificial Sequence
  chemically synthesized
cctcaaaaatgttaaaaagcct

SEQ ID NO: 1262980 - DNA, 22 bp, Artificial Sequence
  chemically synthesized
ccctcaaaaatgttaaaaagcc

SEQ ID NO: 1262981 - DNA, 22 bp, Artificial Sequence
  chemically synthesized
tttccctcaaaaatgttaaaaa

SEQ ID NO: 1262982 - DNA, 22 bp, Artificial Sequence
  chemically synthesized
taagaaaggctttttaacattt

SEQ ID NO: 1262983 - DNA, 22 bp, Artificial Sequence
  chemically synthesized
aagaaaggctttttaacatttt

SEQ ID NO: 1262984 - DNA, 22 bp, Artificial Sequence
  chemically synthesized
agaaaggctttttaacattttt

SEQ ID NO: 1262985 - DNA, 22 bp, Artificial Sequence
  chemically synthesized
catactatttccctcaaaaatg

SEQ ID NO: 1262986 - DNA, 22 bp, Artificial Sequence
  chemically synthesized
acatactatttccctcaaaaat

SEQ ID NO: 1262987 - DNA, 22 bp, Artificial Sequence
  chemically synthesized
tacatactatttccctcaaaaa

SEQ ID NO: 1262988 - DNA, 22 bp, Artificial Sequence
  chemically synthesized
ttacatactatttccctcaaaa

SEQ ID NO: 1262989 - DNA, 22 bp, Artificial Sequence
  chemically synthesized
tttaacatttttgagggaaata

SEQ ID NO: 1262990 - DNA, 22 bp, Artificial Sequence
  chemically synthesized
ttaacatttttgagggaaatag

SEQ ID NO: 1262991 - DNA, 22 bp, Artificial Sequence
  chemically synthesized
cacttttacatactatttccct

SEQ ID NO: 1262992 - DNA, 22 bp, Artificial Sequence
  chemically synthesized
taacatttttgagggaaatagt

SEQ ID NO: 1262993 - DNA, 22 bp, Artificial Sequence
  chemically synthesized
aacatttttgagggaaatagta

SEQ ID NO: 1262994 - DNA, 22 bp, Artificial Sequence
  chemically synthesized
acatttttgagggaaatagtat

SEQ ID NO: 1262995 - DNA, 22 bp, Artificial Sequence
  chemically synthesized
ttgagggaaatagtatgtaaaa

SEQ ID NO: 1262996 - DNA, 22 bp, Artificial Sequence
  chemically synthesized
tgagggaaatagtatgtaaaag

SEQ ID NO: 1262997 - DNA, 22 bp, Artificial Sequence
  chemically synthesized
tcatgtactacacttttacata

SEQ ID NO: 1262998 - DNA, 22 bp, Artificial Sequence
  chemically synthesized
gagggaaatagtatgtaaaagt

SEQ ID NO: 1262999 - DNA, 22 bp, Artificial Sequence
  chemically synthesized
agggaaatagtatgtaaaagtg

SEQ ID NO: 1263000 - DNA, 22 bp, Artificial Sequence
  chemically synthesized
gttatcatgtactacactttta

SEQ ID NO: 1263001 - DNA, 22 bp, Artificial Sequence
  chemically synthesized
agttatcatgtactacactttt

SEQ ID NO: 1263002 - DNA, 22 bp, Artificial Sequence
  chemically synthesized
tagttatcatgtactacacttt

SEQ ID NO: 1263003 - DNA, 22 bp, Artificial Sequence
  chemically synthesized
attttagttatcatgtactaca

SEQ ID NO: 1263004 - DNA, 22 bp, Artificial Sequence
  chemically synthesized
actaattttagttatcatgtac

SEQ ID NO: 1263005 - DNA, 22 bp, Artificial Sequence
  chemically synthesized
aactaattttagttatcatgta

SEQ ID NO: 1263006 - DNA, 22 bp, Artificial Sequence
  chemically synthesized
atttaactaattttagttatca

SEQ ID NO: 1263007 - DNA, 22 bp, Artificial Sequence
  chemically synthesized
caattaatttaactaattttag

SEQ ID NO: 1263008 - DNA, 22 bp, Artificial Sequence
  chemically synthesized
ctgcaattaatttaactaattt

SEQ ID NO: 1263009 - DNA, 22 bp, Artificial Sequence
  chemically synthesized
aagtaactcctgcaattaattt

SEQ ID NO: 1263010 - DNA, 22 bp, Artificial Sequence
  chemically synthesized
aaattagttaaattaattgcag

SEQ ID NO: 1263011 - DNA, 22 bp, Artificial Sequence
  chemically synthesized
gttaaattaattgcaggagtta

SEQ ID NO: 1263012 - DNA, 22 bp, Artificial Sequence
  chemically synthesized
aattaattgcaggagttacttt

SEQ ID NO: 1263013 - DNA, 22 bp, Artificial Sequence
  chemically synthesized
attgcaggagttactttaatca

SEQ ID NO: 1263014 - DNA, 22 bp, Artificial Sequence
  chemically synthesized
tgtagacatgtggtgattaaag

SEQ ID NO: 1263015 - DNA, 22 bp, Artificial Sequence
  chemically synthesized
caggagttactttaatcaccac

SEQ ID NO: 1263016 - DNA, 22 bp, Artificial Sequence
  chemically synthesized
ttatgtagacatgtggtgatta

SEQ ID NO: 1263017 - DNA, 22 bp, Artificial Sequence
  chemically synthesized
gattgttatgtagacatgtggt

SEQ ID NO: 1263018 - DNA, 22 bp, Artificial Sequence
  chemically synthesized
agattgttatgtagacatgtgg

SEQ ID NO: 1263019 - DNA, 22 bp, Artificial Sequence
  chemically synthesized
ctttaatcaccacatgtctaca

SEQ ID NO: 1263020 - DNA, 22 bp, Artificial Sequence
  chemically synthesized
taatcaccacatgtctacataa

SEQ ID NO: 1263021 - DNA, 22 bp, Artificial Sequence
  chemically synthesized
aatcaccacatgtctacataac

SEQ ID NO: 1263022 - DNA, 22 bp, Artificial Sequence
  chemically synthesized
gtagtttagattgttatgtaga

SEQ ID NO: 1263023 - DNA, 22 bp, Artificial Sequence
  chemically synthesized
atcaccacatgtctacataaca

SEQ ID NO: 1263024 - DNA, 22 bp, Artificial Sequence
  chemically synthesized
agtagtttagattgttatgtag

SEQ ID NO: 1263025 - DNA, 22 bp, Artificial Sequence
  chemically synthesized
taacgtttagtagtttagattg

SEQ ID NO: 1263026 - DNA, 22 bp, Artificial Sequence
  chemically synthesized
cataacaatctaaactactaaa

SEQ ID NO: 1263027 - DNA, 22 bp, Artificial Sequence
  chemically synthesized
aagattataacgtttagtagtt

SEQ ID NO: 1263028 - DNA, 22 bp, Artificial Sequence
  chemically synthesized
gaagattataacgtttagtagt

SEQ ID NO: 1263029 - DNA, 22 bp, Artificial Sequence
  chemically synthesized
ttgaagattataacgtttagta

SEQ ID NO: 1263030 - DNA, 22 bp, Artificial Sequence
  chemically synthesized
cttgaagattataacgtttagt

SEQ ID NO: 1263031 - DNA, 22 bp, Artificial Sequence
  chemically synthesized
tcttgaagattataacgtttag

SEQ ID NO: 1263032 - DNA, 22 bp, Artificial Sequence
  chemically synthesized
ttcttgaagattataacgttta

SEQ ID NO: 1263033 - DNA, 22 bp, Artificial Sequence
  chemically synthesized
aactactaaacgttataatctt

SEQ ID NO: 1263034 - DNA, 22 bp, Artificial Sequence
  chemically synthesized
tagccttttcttgaagattata

SEQ ID NO: 1263035 - DNA, 22 bp, Artificial Sequence
  chemically synthesized
ctaaacgttataatcttcaaga

SEQ ID NO: 1263036 - DNA, 22 bp, Artificial Sequence
  chemically synthesized
aacgttataatcttcaagaaaa

SEQ ID NO: 1263037 - DNA, 22 bp, Artificial Sequence
  chemically synthesized
atagttgtagccttttcttgaa

SEQ ID NO: 1263038 - DNA, 22 bp, Artificial Sequence
  chemically synthesized
catagttgtagccttttcttga

SEQ ID NO: 1263039 - DNA, 22 bp, Artificial Sequence
  chemically synthesized
tcatagttgtagccttttcttg

SEQ ID NO: 1263040 - DNA, 22 bp, Artificial Sequence
  chemically synthesized
ttcatagttgtagccttttctt

SEQ ID NO: 1263041 - DNA, 22 bp, Artificial Sequence
  chemically synthesized
tttcatagttgtagccttttct

SEQ ID NO: 1263042 - DNA, 22 bp, Artificial Sequence
  chemically synthesized
tttttcatagttgtagcctttt

SEQ ID NO: 1263043 - DNA, 22 bp, Artificial Sequence
  chemically synthesized
taatcttcaagaaaaggctaca

SEQ ID NO: 1263044 - DNA, 22 bp, Artificial Sequence
  chemically synthesized
caagaaaaggctacaactatga

SEQ ID NO: 1263045 - DNA, 22 bp, Artificial Sequence
  chemically synthesized
aagaaaaggctacaactatgaa

SEQ ID NO: 1263046 - DNA, 22 bp, Artificial Sequence
  chemically synthesized
accaatgctctttttcatagtt

SEQ ID NO: 1263047 - DNA, 22 bp, Artificial Sequence
  chemically synthesized
atacattcaccaatgctctttt

SEQ ID NO: 1263048 - DNA, 22 bp, Artificial Sequence
  chemically synthesized
aatacattcaccaatgctcttt

SEQ ID NO: 1263049 - DNA, 22 bp, Artificial Sequence
  chemically synthesized
caactatgaaaaagagcattgg

SEQ ID NO: 1263050 - DNA, 22 bp, Artificial Sequence
  chemically synthesized
tgaaaaagagcattggtgaatg

SEQ ID NO: 1263051 - DNA, 22 bp, Artificial Sequence
  chemically synthesized
tcaaacttaatacattcaccaa

SEQ ID NO: 1263052 - DNA, 22 bp, Artificial Sequence
  chemically synthesized
ctatcaaacttaatacattcac

SEQ ID NO: 1263053 - DNA, 22 bp, Artificial Sequence
  chemically synthesized
actatcaaacttaatacattca

SEQ ID NO: 1263054 - DNA, 22 bp, Artificial Sequence
  chemically synthesized
tactatcaaacttaatacattc

SEQ ID NO: 1263055 - DNA, 22 bp, Artificial Sequence
  chemically synthesized
ttactatcaaacttaatacatt

SEQ ID NO: 1263056 - DNA, 22 bp, Artificial Sequence
  chemically synthesized
tttttactatcaaacttaatac

SEQ ID NO: 1263057 - DNA, 22 bp, Artificial Sequence
  chemically synthesized
gtttttactatcaaacttaata

SEQ ID NO: 1263058 - DNA, 22 bp, Artificial Sequence
  chemically synthesized
tgtttttactatcaaacttaat

SEQ ID NO: 1263059 - DNA, 22 bp, Artificial Sequence
  chemically synthesized
ttttgtttttactatcaaactt

SEQ ID NO: 1263060 - DNA, 22 bp, Artificial Sequence
  chemically synthesized
gtgaatgtattaagtttgatag

SEQ ID NO: 1263061 - DNA, 22 bp, Artificial Sequence
  chemically synthesized
tctgttttgtttttactatcaa

SEQ ID NO: 1263062 - DNA, 22 bp, Artificial Sequence
  chemically synthesized
gtctgttttgtttttactatca

SEQ ID NO: 1263063 - DNA, 22 bp, Artificial Sequence
  chemically synthesized
atttgtctgttttgtttttact

SEQ ID NO: 1263064 - DNA, 22 bp, Artificial Sequence
  chemically synthesized
aatttgtctgttttgtttttac

SEQ ID NO: 1263065 - DNA, 22 bp, Artificial Sequence
  chemically synthesized
agtttgatagtaaaaacaaaac

SEQ ID NO: 1263066 - DNA, 22 bp, Artificial Sequence
  chemically synthesized
gatagtaaaaacaaaacagaca

SEQ ID NO: 1263067 - DNA, 22 bp, Artificial Sequence
  chemically synthesized
atagtaaaaacaaaacagacaa

SEQ ID NO: 1263068 - DNA, 22 bp, Artificial Sequence
  chemically synthesized
atcaatggccaaatcagcttaa

SEQ ID NO: 1263069 - DNA, 22 bp, Artificial Sequence
  chemically synthesized
agctgatttggccattgattaa

SEQ ID NO: 1263070 - DNA, 22 bp, Artificial Sequence
  chemically synthesized
atttggccattgattaactttt

SEQ ID NO: 1263071 - DNA, 22 bp, Artificial Sequence
  chemically synthesized
tgtcccccaatatccaaaagtt

SEQ ID NO: 1263072 - DNA, 22 bp, Artificial Sequence
  chemically synthesized
ggccattgattaacttttggat

SEQ ID NO: 1263073 - DNA, 22 bp, Artificial Sequence
  chemically synthesized
atgtcccccaatatccaaaagt

SEQ ID NO: 1263074 - DNA, 22 bp, Artificial Sequence
  chemically synthesized
gccattgattaacttttggata

SEQ ID NO: 1263075 - DNA, 22 bp, Artificial Sequence
  chemically synthesized
attaacttttggatattggggg

SEQ ID NO: 1263076 - DNA, 22 bp, Artificial Sequence
  chemically synthesized
acttttggatattgggggacat

SEQ ID NO: 1263077 - DNA, 22 bp, Artificial Sequence
  chemically synthesized
ttggatattgggggacataaat

SEQ ID NO: 1263078 - DNA, 22 bp, Artificial Sequence
  chemically synthesized
tggatattgggggacataaata

SEQ ID NO: 1263079 - DNA, 22 bp, Artificial Sequence
  chemically synthesized
ggatattgggggacataaatat

SEQ ID NO: 1263080 - DNA, 22 bp, Artificial Sequence
  chemically synthesized
gatattgggggacataaatatt

SEQ ID NO: 1263081 - DNA, 22 bp, Artificial Sequence
  chemically synthesized
ggggacataaatatttatggct

SEQ ID NO: 1263082 - DNA, 22 bp, Artificial Sequence
  chemically synthesized
aagatatagaaaacaagccata

SEQ ID NO: 1263083 - DNA, 22 bp, Artificial Sequence
  chemically synthesized
aaagatatagaaaacaagccat

SEQ ID NO: 1263084 - DNA, 22 bp, Artificial Sequence
  chemically synthesized
aatttaaagatatagaaaacaa

SEQ ID NO: 1263085 - DNA, 22 bp, Artificial Sequence
  chemically synthesized
atggcttgttttctatatcttt

SEQ ID NO: 1263086 - DNA, 22 bp, Artificial Sequence
  chemically synthesized
tggcttgttttctatatcttta

SEQ ID NO: 1263087 - DNA, 22 bp, Artificial Sequence
  chemically synthesized
gatccatactcaatttaaagat

SEQ ID NO: 1263088 - DNA, 22 bp, Artificial Sequence
  chemically synthesized
gttttctatatctttaaattga

SEQ ID NO: 1263089 - DNA, 22 bp, Artificial Sequence
  chemically synthesized
ctggatccatactcaatttaaa

SEQ ID NO: 1263090 - DNA, 22 bp, Artificial Sequence
  chemically synthesized
ttttctatatctttaaattgag

SEQ ID NO: 1263091 - DNA, 22 bp, Artificial Sequence
  chemically synthesized
tctatatctttaaattgagtat

SEQ ID NO: 1263092 - DNA, 22 bp, Artificial Sequence
  chemically synthesized
ctatatctttaaattgagtatg

SEQ ID NO: 1263093 - DNA, 22 bp, Artificial Sequence
  chemically synthesized
tatatctttaaattgagtatgg

SEQ ID NO: 1263094 - DNA, 22 bp, Artificial Sequence
  chemically synthesized
tatctttaaattgagtatggat

SEQ ID NO: 1263095 - DNA, 22 bp, Artificial Sequence
  chemically synthesized
agtaatgggattgctggatcca

SEQ ID NO: 1263096 - DNA, 22 bp, Artificial Sequence
  chemically synthesized
taaattgagtatggatccagca

SEQ ID NO: 1263097 - DNA, 22 bp, Artificial Sequence
  chemically synthesized
aaattgagtatggatccagcaa

SEQ ID NO: 1263098 - DNA, 22 bp, Artificial Sequence
  chemically synthesized
aattgagtatggatccagcaat

SEQ ID NO: 1263099 - DNA, 22 bp, Artificial Sequence
  chemically synthesized
agtatggatccagcaatcccat

SEQ ID NO: 1263100 - DNA, 22 bp, Artificial Sequence
  chemically synthesized
ggatacatactcagtaatggga

SEQ ID NO: 1263101 - DNA, 22 bp, Artificial Sequence
  chemically synthesized
gggatacatactcagtaatggg

SEQ ID NO: 1263102 - DNA, 22 bp, Artificial Sequence
  chemically synthesized
tgggatacatactcagtaatgg

SEQ ID NO: 1263103 - DNA, 22 bp, Artificial Sequence
  chemically synthesized
tttgggatacatactcagtaat

SEQ ID NO: 1263104 - DNA, 22 bp, Artificial Sequence
  chemically synthesized
ctttgggatacatactcagtaa

SEQ ID NO: 1263105 - DNA, 22 bp, Artificial Sequence
  chemically synthesized
atttctttgggatacatactca

SEQ ID NO: 1263106 - DNA, 22 bp, Artificial Sequence
  chemically synthesized
catttctttgggatacatactc

SEQ ID NO: 1263107 - DNA, 22 bp, Artificial Sequence
  chemically synthesized
ctgagtatgtatcccaaagaaa

SEQ ID NO: 1263108 - DNA, 22 bp, Artificial Sequence
  chemically synthesized
agtatgtatcccaaagaaatga

SEQ ID NO: 1263109 - DNA, 22 bp, Artificial Sequence
  chemically synthesized
aatataatgatttcatttcttt

SEQ ID NO: 1263110 - DNA, 22 bp, Artificial Sequence
  chemically synthesized
caatataatgatttcatttctt

SEQ ID NO: 1263111 - DNA, 22 bp, Artificial Sequence
  chemically synthesized
tcaatataatgatttcatttct

SEQ ID NO: 1263112 - DNA, 22 bp, Artificial Sequence
  chemically synthesized
ttcaatataatgatttcatttc

SEQ ID NO: 1263113 - DNA, 22 bp, Artificial Sequence
  chemically synthesized
tattgaaaagatatgtgcactc

SEQ ID NO: 1263114 - DNA, 22 bp, Artificial Sequence
  chemically synthesized
caatgaacacgggagtgcacat

SEQ ID NO: 1263115 - DNA, 22 bp, Artificial Sequence
  chemically synthesized
aaaagatatgtgcactcccgtg

SEQ ID NO: 1263116 - DNA, 22 bp, Artificial Sequence
  chemically synthesized
tgaacaatgctgcaatgaacac

SEQ ID NO: 1263117 - DNA, 22 bp, Artificial Sequence
  chemically synthesized
ttgtgaacaatgctgcaatgaa

SEQ ID NO: 1263118 - DNA, 22 bp, Artificial Sequence
  chemically synthesized
gctattgtgaacaatgctgcaa

SEQ ID NO: 1263119 - DNA, 22 bp, Artificial Sequence
  chemically synthesized
ggctattgtgaacaatgctgca

SEQ ID NO: 1263120 - DNA, 22 bp, Artificial Sequence
  chemically synthesized
ccgtgttcattgcagcattgtt

SEQ ID NO: 1263121 - DNA, 22 bp, Artificial Sequence
  chemically synthesized
attgcagcattgttcacaatag

SEQ ID NO: 1263122 - DNA, 22 bp, Artificial Sequence
  chemically synthesized
aatccataccttggctattgtg

SEQ ID NO: 1263123 - DNA, 22 bp, Artificial Sequence
  chemically synthesized
cagcattgttcacaatagccaa

SEQ ID NO: 1263124 - DNA, 22 bp, Artificial Sequence
  chemically synthesized
ggttgaatccataccttggcta

SEQ ID NO: 1263125 - DNA, 22 bp, Artificial Sequence
  chemically synthesized
aggttgaatccataccttggct

SEQ ID NO: 1263126 - DNA, 22 bp, Artificial Sequence
  chemically synthesized
ttcacaatagccaaggtatgga

SEQ ID NO: 1263127 - DNA, 22 bp, Artificial Sequence
  chemically synthesized
acaatagccaaggtatggattc

SEQ ID NO: 1263128 - DNA, 22 bp, Artificial Sequence
  chemically synthesized
atggacatttaggttgaatcca

SEQ ID NO: 1263129 - DNA, 22 bp, Artificial Sequence
  chemically synthesized
ttgatggacatttaggttgaat

SEQ ID NO: 1263130 - DNA, 22 bp, Artificial Sequence
  chemically synthesized
gttgatggacatttaggttgaa

SEQ ID NO: 1263131 - DNA, 22 bp, Artificial Sequence
  chemically synthesized
atttgttgatggacatttaggt

SEQ ID NO: 1263132 - DNA, 22 bp, Artificial Sequence
  chemically synthesized
tccattcatttgttgatggaca

SEQ ID NO: 1263133 - DNA, 22 bp, Artificial Sequence
  chemically synthesized
aacctaaatgtccatcaacaaa

SEQ ID NO: 1263134 - DNA, 22 bp, Artificial Sequence
  chemically synthesized
attatccattcatttgttgatg

SEQ ID NO: 1263135 - DNA, 22 bp, Artificial Sequence
  chemically synthesized
cattatccattcatttgttgat

SEQ ID NO: 1263136 - DNA, 22 bp, Artificial Sequence
  chemically synthesized
tcattatccattcatttgttga

SEQ ID NO: 1263137 - DNA, 22 bp, Artificial Sequence
  chemically synthesized
aatgtccatcaacaaatgaatg

SEQ ID NO: 1263138 - DNA, 22 bp, Artificial Sequence
  chemically synthesized
tgtgtgtgtgtgaccacatttt

SEQ ID NO: 1263139 - DNA, 22 bp, Artificial Sequence
  chemically synthesized
cattgtgtgtgtgtgtgaccac

SEQ ID NO: 1263140 - DNA, 22 bp, Artificial Sequence
  chemically synthesized
tattccattgtgtgtgtgtgtg

SEQ ID NO: 1263141 - DNA, 22 bp, Artificial Sequence
  chemically synthesized
aattatattccattgtgtgtgt

SEQ ID NO: 1263142 - DNA, 22 bp, Artificial Sequence
  chemically synthesized
atgtctgaattatattccattg

SEQ ID NO: 1263143 - DNA, 22 bp, Artificial Sequence
  chemically synthesized
catgtctgaattatattccatt

SEQ ID NO: 1263144 - DNA, 22 bp, Artificial Sequence
  chemically synthesized
tcatgtctgaattatattccat

SEQ ID NO: 1263145 - DNA, 22 bp, Artificial Sequence
  chemically synthesized
tttcatgtctgaattatattcc

SEQ ID NO: 1263146 - DNA, 22 bp, Artificial Sequence
  chemically synthesized
ctttcatgtctgaattatattc

SEQ ID NO: 1263147 - DNA, 22 bp, Artificial Sequence
  chemically synthesized
ttctttcatgtctgaattatat

SEQ ID NO: 1263148 - DNA, 22 bp, Artificial Sequence
  chemically synthesized
cttctttcatgtctgaattata

SEQ ID NO: 1263149 - DNA, 22 bp, Artificial Sequence
  chemically synthesized
tcttctttcatgtctgaattat

SEQ ID NO: 1263150 - DNA, 22 bp, Artificial Sequence
  chemically synthesized
tcacaaatggtagattttcttc

SEQ ID NO: 1263151 - DNA, 22 bp, Artificial Sequence
  chemically synthesized
agacatgaaagaagaaaatcta

SEQ ID NO: 1263152 - DNA, 22 bp, Artificial Sequence
  chemically synthesized
tccatgttgtcacaaatggtag

SEQ ID NO: 1263153 - DNA, 22 bp, Artificial Sequence
  chemically synthesized
caggattatccatgttgtcaca

SEQ ID NO: 1263154 - DNA, 22 bp, Artificial Sequence
  chemically synthesized
ctccaggattatccatgttgtc

SEQ ID NO: 1263155 - DNA, 22 bp, Artificial Sequence
  chemically synthesized
cctccaggattatccatgttgt

SEQ ID NO: 1263156 - DNA, 22 bp, Artificial Sequence
  chemically synthesized
ccatttgtgacaacatggataa

SEQ ID NO: 1263157 - DNA, 22 bp, Artificial Sequence
  chemically synthesized
gtgacaacatggataatcctgg

SEQ ID NO: 1263158 - DNA, 22 bp, Artificial Sequence
  chemically synthesized
gcaaaacttcctccaggattat

SEQ ID NO: 1263159 - DNA, 22 bp, Artificial Sequence
  chemically synthesized
tgacaacatggataatcctgga

SEQ ID NO: 1263160 - DNA, 22 bp, Artificial Sequence
  chemically synthesized
agcaaaacttcctccaggatta

SEQ ID NO: 1263161 - DNA, 22 bp, Artificial Sequence
  chemically synthesized
cacttagcaaaacttcctccag

SEQ ID NO: 1263162 - DNA, 22 bp, Artificial Sequence
  chemically synthesized
ttgcacttagcaaaacttcctc

SEQ ID NO: 1263163 - DNA, 22 bp, Artificial Sequence
  chemically synthesized
attgcacttagcaaaacttcct

SEQ ID NO: 1263164 - DNA, 22 bp, Artificial Sequence
  chemically synthesized
gcttattgcacttagcaaaact

SEQ ID NO: 1263165 - DNA, 22 bp, Artificial Sequence
  chemically synthesized
tgcctggcttattgcacttagc

SEQ ID NO: 1263166 - DNA, 22 bp, Artificial Sequence
  chemically synthesized
gaggaagttttgctaagtgcaa

SEQ ID NO: 1263167 - DNA, 22 bp, Artificial Sequence
  chemically synthesized
tgtgcctggcttattgcactta

SEQ ID NO: 1263168 - DNA, 22 bp, Artificial Sequence
  chemically synthesized
ctgtgcctggcttattgcactt

SEQ ID NO: 1263169 - DNA, 22 bp, Artificial Sequence
  chemically synthesized
tctgtgcctggcttattgcact

SEQ ID NO: 1263170 - DNA, 22 bp, Artificial Sequence
  chemically synthesized
gctttctgtgcctggcttattg

SEQ ID NO: 1263171 - DNA, 22 bp, Artificial Sequence
  chemically synthesized
ggctttctgtgcctggcttatt

SEQ ID NO: 1263172 - DNA, 22 bp, Artificial Sequence
  chemically synthesized
tgctaagtgcaataagccaggc

SEQ ID NO: 1263173 - DNA, 22 bp, Artificial Sequence
  chemically synthesized
gctaagtgcaataagccaggca

SEQ ID NO: 1263174 - DNA, 22 bp, Artificial Sequence
  chemically synthesized
tttggctttctgtgcctggctt

SEQ ID NO: 1263175 - DNA, 22 bp, Artificial Sequence
  chemically synthesized
ctaagtgcaataagccaggcac

SEQ ID NO: 1263176 - DNA, 22 bp, Artificial Sequence
  chemically synthesized
agtgcaataagccaggcacaga

SEQ ID NO: 1263177 - DNA, 22 bp, Artificial Sequence
  chemically synthesized
taataagcgagatcatatgtta

SEQ ID NO: 1263178 - DNA, 22 bp, Artificial Sequence
  chemically synthesized
gataccacctataataagcgag

SEQ ID NO: 1263179 - DNA, 22 bp, Artificial Sequence
  chemically synthesized
agataccacctataataagcga

SEQ ID NO: 1263180 - DNA, 22 bp, Artificial Sequence
  chemically synthesized
tagataccacctataataagcg

SEQ ID NO: 1263181 - DNA, 22 bp, Artificial Sequence
  chemically synthesized
ttagataccacctataataagc

SEQ ID NO: 1263182 - DNA, 22 bp, Artificial Sequence
  chemically synthesized
tttagataccacctataataag

SEQ ID NO: 1263183 - DNA, 22 bp, Artificial Sequence
  chemically synthesized
gcttattataggtggtatctaa

SEQ ID NO: 1263184 - DNA, 22 bp, Artificial Sequence
  chemically synthesized
tgagcccaactttttagatacc

SEQ ID NO: 1263185 - DNA, 22 bp, Artificial Sequence
  chemically synthesized
tatgagcccaactttttagata

SEQ ID NO: 1263186 - DNA, 22 bp, Artificial Sequence
  chemically synthesized
attataggtggtatctaaaaag

SEQ ID NO: 1263187 - DNA, 22 bp, Artificial Sequence
  chemically synthesized
ctatgagcccaactttttagat

SEQ ID NO: 1263188 - DNA, 22 bp, Artificial Sequence
  chemically synthesized
ttataggtggtatctaaaaagt

SEQ ID NO: 1263189 - DNA, 22 bp, Artificial Sequence
  chemically synthesized
cttctatgagcccaacttttta

SEQ ID NO: 1263190 - DNA, 22 bp, Artificial Sequence
  chemically synthesized
taggtggtatctaaaaagttgg

SEQ ID NO: 1263191 - DNA, 22 bp, Artificial Sequence
  chemically synthesized
tacttctatgagcccaactttt

SEQ ID NO: 1263192 - DNA, 22 bp, Artificial Sequence
  chemically synthesized
tctacttctatgagcccaactt

SEQ ID NO: 1263193 - DNA, 22 bp, Artificial Sequence
  chemically synthesized
ctctctacttctatgagcccaa

SEQ ID NO: 1263194 - DNA, 22 bp, Artificial Sequence
  chemically synthesized
tactctctacttctatgagccc

SEQ ID NO: 1263195 - DNA, 22 bp, Artificial Sequence
  chemically synthesized
ttctactctctacttctatgag

SEQ ID NO: 1263196 - DNA, 22 bp, Artificial Sequence
  chemically synthesized
aaaagttgggctcatagaagta

SEQ ID NO: 1263197 - DNA, 22 bp, Artificial Sequence
  chemically synthesized
ggctcatagaagtagagagtag

SEQ ID NO: 1263198 - DNA, 22 bp, Artificial Sequence
  chemically synthesized
gtaaccactattctactctcta

SEQ ID NO: 1263199 - DNA, 22 bp, Artificial Sequence
  chemically synthesized
tggtaaccactattctactctc

SEQ ID NO: 1263200 - DNA, 22 bp, Artificial Sequence
  chemically synthesized
atagaagtagagagtagaatag

SEQ ID NO: 1263201 - DNA, 22 bp, Artificial Sequence
  chemically synthesized
ccagtctctggtaaccactatt

SEQ ID NO: 1263202 - DNA, 22 bp, Artificial Sequence
  chemically synthesized
ctcccagtctctggtaaccact

SEQ ID NO: 1263203 - DNA, 22 bp, Artificial Sequence
  chemically synthesized
acaccctcctcccagtctctgg

SEQ ID NO: 1263204 - DNA, 22 bp, Artificial Sequence
  chemically synthesized
caagcctcacaccctcctccca

SEQ ID NO: 1263205 - DNA, 22 bp, Artificial Sequence
  chemically synthesized
tgcaagcctcacaccctcctcc

SEQ ID NO: 1263206 - DNA, 22 bp, Artificial Sequence
  chemically synthesized
ccagagactgggaggagggtgt

SEQ ID NO: 1263207 - DNA, 22 bp, Artificial Sequence
  chemically synthesized
atcaatatctctgcaagcctca

SEQ ID NO: 1263208 - DNA, 22 bp, Artificial Sequence
  chemically synthesized
ggaggagggtgtgaggcttgca

SEQ ID NO: 1263209 - DNA, 22 bp, Artificial Sequence
  chemically synthesized
gatcaatatctctgcaagcctc

SEQ ID NO: 1263210 - DNA, 22 bp, Artificial Sequence
  chemically synthesized
tgatcaatatctctgcaagcct

SEQ ID NO: 1263211 - DNA, 22 bp, Artificial Sequence
  chemically synthesized
tttgatcaatatctctgcaagc

SEQ ID NO: 1263212 - DNA, 22 bp, Artificial Sequence
  chemically synthesized
tattctttgatcaatatctctg

SEQ ID NO: 1263213 - DNA, 22 bp, Artificial Sequence
  chemically synthesized
gtattctttgatcaatatctct

SEQ ID NO: 1263214 - DNA, 22 bp, Artificial Sequence
  chemically synthesized
tgtattctttgatcaatatctc

SEQ ID NO: 1263215 - DNA, 22 bp, Artificial Sequence
  chemically synthesized
gcagagatattgatcaaagaat

SEQ ID NO: 1263216 - DNA, 22 bp, Artificial Sequence
  chemically synthesized
cagagatattgatcaaagaata

SEQ ID NO: 1263217 - DNA, 22 bp, Artificial Sequence
  chemically synthesized
aatgaaattttgtattctttga

SEQ ID NO: 1263218 - DNA, 22 bp, Artificial Sequence
  chemically synthesized
tctaaatgaaattttgtattct

SEQ ID NO: 1263219 - DNA, 22 bp, Artificial Sequence
  chemically synthesized
ctgtctaaatgaaattttgtat

SEQ ID NO: 1263220 - DNA, 22 bp, Artificial Sequence
  chemically synthesized
tcctgtctaaatgaaattttgt

SEQ ID NO: 1263221 - DNA, 22 bp, Artificial Sequence
  chemically synthesized
ctcctgtctaaatgaaattttg

SEQ ID NO: 1263222 - DNA, 22 bp, Artificial Sequence
  chemically synthesized
atcaaagaatacaaaatttcat

SEQ ID NO: 1263223 - DNA, 22 bp, Artificial Sequence
  chemically synthesized
tttctcctgtctaaatgaaatt

SEQ ID NO: 1263224 - DNA, 22 bp, Artificial Sequence
  chemically synthesized
atttctcctgtctaaatgaaat

SEQ ID NO: 1263225 - DNA, 22 bp, Artificial Sequence
  chemically synthesized
gaacttatttctcctgtctaaa

SEQ ID NO: 1263226 - DNA, 22 bp, Artificial Sequence
  chemically synthesized
tcgaacttatttctcctgtcta

SEQ ID NO: 1263227 - DNA, 22 bp, Artificial Sequence
  chemically synthesized
catttagacaggagaaataagt

SEQ ID NO: 1263228 - DNA, 22 bp, Artificial Sequence
  chemically synthesized
atttagacaggagaaataagtt

SEQ ID NO: 1263229 - DNA, 22 bp, Artificial Sequence
  chemically synthesized
agacaggagaaataagttcgag

SEQ ID NO: 1263230 - DNA, 22 bp, Artificial Sequence
  chemically synthesized
gacaggagaaataagttcgaga

SEQ ID NO: 1263231 - DNA, 22 bp, Artificial Sequence
  chemically synthesized
tagaatcaacatgtacaataga

SEQ ID NO: 1263232 - DNA, 22 bp, Artificial Sequence
  chemically synthesized
gagagatctattgtacatgttg

SEQ ID NO: 1263233 - DNA, 22 bp, Artificial Sequence
  chemically synthesized
tgaaccacctgtagaatcaaca

SEQ ID NO: 1263234 - DNA, 22 bp, Artificial Sequence
  chemically synthesized
ttatgaaccacctgtagaatca

SEQ ID NO: 1263235 - DNA, 22 bp, Artificial Sequence
  chemically synthesized
ttgtacatgttgattctacagg

SEQ ID NO: 1263236 - DNA, 22 bp, Artificial Sequence
  chemically synthesized
tacatgttgattctacaggtgg

SEQ ID NO: 1263237 - DNA, 22 bp, Artificial Sequence
  chemically synthesized
attctacaggtggttcataaca

SEQ ID NO: 1263238 - DNA, 22 bp, Artificial Sequence
  chemically synthesized
aagagtataatacattgttatg

SEQ ID NO: 1263239 - DNA, 22 bp, Artificial Sequence
  chemically synthesized
tacaggtggttcataacaatgt

SEQ ID NO: 1263240 - DNA, 22 bp, Artificial Sequence
  chemically synthesized
caagagtataatacattgttat

SEQ ID NO: 1263241 - DNA, 22 bp, Artificial Sequence
  chemically synthesized
tcaagagtataatacattgtta

SEQ ID NO: 1263242 - DNA, 22 bp, Artificial Sequence
  chemically synthesized
caggtggttcataacaatgtat

SEQ ID NO: 1263243 - DNA, 22 bp, Artificial Sequence
  chemically synthesized
gcaattttcaagagtataatac

SEQ ID NO: 1263244 - DNA, 22 bp, Artificial Sequence
  chemically synthesized
agcaattttcaagagtataata

SEQ ID NO: 1263245 - DNA, 22 bp, Artificial Sequence
  chemically synthesized
ttagcaattttcaagagtataa

SEQ ID NO: 1263246 - DNA, 22 bp, Artificial Sequence
  chemically synthesized
ataacaatgtattatactcttg

SEQ ID NO: 1263247 - DNA, 22 bp, Artificial Sequence
  chemically synthesized
tcttagcaattttcaagagtat

SEQ ID NO: 1263248 - DNA, 22 bp, Artificial Sequence
  chemically synthesized
ctctcttagcaattttcaagag

SEQ ID NO: 1263249 - DNA, 22 bp, Artificial Sequence
  chemically synthesized
aaatctactctcttagcaattt

SEQ ID NO: 1263250 - DNA, 22 bp, Artificial Sequence
  chemically synthesized
aaaatctactctcttagcaatt

SEQ ID NO: 1263251 - DNA, 22 bp, Artificial Sequence
  chemically synthesized
tactcttgaaaattgctaagag

SEQ ID NO: 1263252 - DNA, 22 bp, Artificial Sequence
  chemically synthesized
ttgaaaattgctaagagagtag

SEQ ID NO: 1263253 - DNA, 22 bp, Artificial Sequence
  chemically synthesized
gaaaattgctaagagagtagat

SEQ ID NO: 1263254 - DNA, 22 bp, Artificial Sequence
  chemically synthesized
aaaattgctaagagagtagatt

SEQ ID NO: 1263255 - DNA, 22 bp, Artificial Sequence
  chemically synthesized
ctaagagagtagattttaagtg

SEQ ID NO: 1263256 - DNA, 22 bp, Artificial Sequence
  chemically synthesized
agagagtagattttaagtgttt

SEQ ID NO: 1263257 - DNA, 22 bp, Artificial Sequence
  chemically synthesized
cacccagccaagtgaaaaacac

SEQ ID NO: 1263258 - DNA, 22 bp, Artificial Sequence
  chemically synthesized
taagtgtttttcacttggctgg

SEQ ID NO: 1263259 - DNA, 22 bp, Artificial Sequence
  chemically synthesized
aagtgtttttcacttggctggg

SEQ ID NO: 1263260 - DNA, 22 bp, Artificial Sequence
  chemically synthesized
agtgtttttcacttggctgggt

SEQ ID NO: 1263261 - DNA, 22 bp, Artificial Sequence
  chemically synthesized
caggcgtgagccactgcaccca

SEQ ID NO: 1263262 - DNA, 22 bp, Artificial Sequence
  chemically synthesized
ttcacttggctgggtgcagtgg

SEQ ID NO: 1263263 - DNA, 22 bp, Artificial Sequence
  chemically synthesized
tcacttggctgggtgcagtggc

SEQ ID NO: 1263264 - DNA, 22 bp, Artificial Sequence
  chemically synthesized
cacttggctgggtgcagtggct

SEQ ID NO: 1263265 - DNA, 22 bp, Artificial Sequence
  chemically synthesized
acttggctgggtgcagtggctc

SEQ ID NO: 1263266 - DNA, 22 bp, Artificial Sequence
  chemically synthesized
ggattacaggcgtgagccactg

SEQ ID NO: 1263267 - DNA, 22 bp, Artificial Sequence
  chemically synthesized
ggctgggtgcagtggctcacgc

SEQ ID NO: 1263268 - DNA, 22 bp, Artificial Sequence
  chemically synthesized
gctgggtgcagtggctcacgcc

SEQ ID NO: 1263269 - DNA, 22 bp, Artificial Sequence
  chemically synthesized
ggtgcagtggctcacgcctgta

SEQ ID NO: 1263270 - DNA, 22 bp, Artificial Sequence
  chemically synthesized
ccaaagtactgggattacaggc

SEQ ID NO: 1263271 - DNA, 22 bp, Artificial Sequence
  chemically synthesized
cgcctcccaaagtactgggatt

SEQ ID NO: 1263272 - DNA, 22 bp, Artificial Sequence
  chemically synthesized
ccgcctcccaaagtactgggat

SEQ ID NO: 1263273 - DNA, 22 bp, Artificial Sequence
  chemically synthesized
acgcctgtaatcccagtacttt

SEQ ID NO: 1263274 - DNA, 22 bp, Artificial Sequence
  chemically synthesized
taatcccagtactttgggaggc

SEQ ID NO: 1263275 - DNA, 22 bp, Artificial Sequence
  chemically synthesized
aggcaatccgcccgcttccgcc

SEQ ID NO: 1263276 - DNA, 22 bp, Artificial Sequence
  chemically synthesized
agctcaggcaatccgcccgctt

SEQ ID NO: 1263277 - DNA, 22 bp, Artificial Sequence
  chemically synthesized
tgggaggcggaagcgggcggat

SEQ ID NO: 1263278 - DNA, 22 bp, Artificial Sequence
  chemically synthesized
gggaggcggaagcgggcggatt

SEQ ID NO: 1263279 - DNA, 22 bp, Artificial Sequence
  chemically synthesized
ctgagctcaggcaatccgcccg

SEQ ID NO: 1263280 - DNA, 22 bp, Artificial Sequence
  chemically synthesized
ggaggcggaagcgggcggattg

SEQ ID NO: 1263281 - DNA, 22 bp, Artificial Sequence
  chemically synthesized
gtcaggaactcctgagctcagg

SEQ ID NO: 1263282 - DNA, 22 bp, Artificial Sequence
  chemically synthesized
cccaggctggtcaggaactcct

SEQ ID NO: 1263283 - DNA, 22 bp, Artificial Sequence
  chemically synthesized
cctgagctcaggagttcctgac

SEQ ID NO: 1263284 - DNA, 22 bp, Artificial Sequence
  chemically synthesized
tgttgcccaggctggtcaggaa

SEQ ID NO: 1263285 - DNA, 22 bp, Artificial Sequence
  chemically synthesized
agctcaggagttcctgaccagc

SEQ ID NO: 1263286 - DNA, 22 bp, Artificial Sequence
  chemically synthesized
actatgttgcccaggctggtca

SEQ ID NO: 1263287 - DNA, 22 bp, Artificial Sequence
  chemically synthesized
cactatgttgcccaggctggtc

SEQ ID NO: 1263288 - DNA, 22 bp, Artificial Sequence
  chemically synthesized
aggagttcctgaccagcctggg

SEQ ID NO: 1263289 - DNA, 22 bp, Artificial Sequence
  chemically synthesized
ctgaccagcctgggcaacatag

SEQ ID NO: 1263290 - DNA, 22 bp, Artificial Sequence
  chemically synthesized
accagcctgggcaacatagtga

SEQ ID NO: 1263291 - DNA, 22 bp, Artificial Sequence
  chemically synthesized
gtagagacggggtttcactatg

SEQ ID NO: 1263292 - DNA, 22 bp, Artificial Sequence
  chemically synthesized
agtagagacggggtttcactat

SEQ ID NO: 1263293 - DNA, 22 bp, Artificial Sequence
  chemically synthesized
tagtagagacggggtttcacta

SEQ ID NO: 1263294 - DNA, 22 bp, Artificial Sequence
  chemically synthesized
ggcaacatagtgaaaccccgtc

SEQ ID NO: 1263295 - DNA, 22 bp, Artificial Sequence
  chemically synthesized
tgtgttttagtagagacggggt

SEQ ID NO: 1263296 - DNA, 22 bp, Artificial Sequence
  chemically synthesized
gtgtgttttagtagagacgggg

SEQ ID NO: 1263297 - DNA, 22 bp, Artificial Sequence
  chemically synthesized
tgtgtgttttagtagagacggg

SEQ ID NO: 1263298 - DNA, 22 bp, Artificial Sequence
  chemically synthesized
ttgtgtgttttagtagagacgg

SEQ ID NO: 1263299 - DNA, 22 bp, Artificial Sequence
  chemically synthesized
tttgtgtgttttagtagagacg

SEQ ID NO: 1263300 - DNA, 22 bp, Artificial Sequence
  chemically synthesized
attttttgtgtgttttagtaga

SEQ ID NO: 1263301 - DNA, 22 bp, Artificial Sequence
  chemically synthesized
ctaattttttgtgtgttttagt

SEQ ID NO: 1263302 - DNA, 22 bp, Artificial Sequence
  chemically synthesized
tactaaaacacacaaaaaatta

SEQ ID NO: 1263303 - DNA, 22 bp, Artificial Sequence
  chemically synthesized
ctaaaacacacaaaaaattagc

SEQ ID NO: 1263304 - DNA, 22 bp, Artificial Sequence
  chemically synthesized
aaacacacaaaaaattagcagg

SEQ ID NO: 1263305 - DNA, 22 bp, Artificial Sequence
  chemically synthesized
acgccgccacatcctgctaatt

SEQ ID NO: 1263306 - DNA, 22 bp, Artificial Sequence
  chemically synthesized
cagcctcacgccgccacatcct

SEQ ID NO: 1263307 - DNA, 22 bp, Artificial Sequence
  chemically synthesized
ggactacagcctcacgccgcca

SEQ ID NO: 1263308 - DNA, 22 bp, Artificial Sequence
  chemically synthesized
gcaggatgtggcggcgtgaggc

SEQ ID NO: 1263309 - DNA, 22 bp, Artificial Sequence
  chemically synthesized
agtagctgggactacagcctca

SEQ ID NO: 1263310 - DNA, 22 bp, Artificial Sequence
  chemically synthesized
ctgagtagctgggactacagcc

SEQ ID NO: 1263311 - DNA, 22 bp, Artificial Sequence
  chemically synthesized
agcctcctgagtagctgggact

SEQ ID NO: 1263312 - DNA, 22 bp, Artificial Sequence
  chemically synthesized
cctcagcctcctgagtagctgg

SEQ ID NO: 1263313 - DNA, 22 bp, Artificial Sequence
  chemically synthesized
ctgcctcagcctcctgagtagc

SEQ ID NO: 1263314 - DNA, 22 bp, Artificial Sequence
  chemically synthesized
tcctgcctcagcctcctgagta

SEQ ID NO: 1263315 - DNA, 22 bp, Artificial Sequence
  chemically synthesized
tagtcccagctactcaggaggc

SEQ ID NO: 1263316 - DNA, 22 bp, Artificial Sequence
  chemically synthesized
aagcgattctcctgcctcagcc

SEQ ID NO: 1263317 - DNA, 22 bp, Artificial Sequence
  chemically synthesized
ctcaggaggctgaggcaggaga

SEQ ID NO: 1263318 - DNA, 22 bp, Artificial Sequence
  chemically synthesized
aggaggctgaggcaggagaatc

SEQ ID NO: 1263319 - DNA, 22 bp, Artificial Sequence
  chemically synthesized
acaggttcaagcgattctcctg

SEQ ID NO: 1263320 - DNA, 22 bp, Artificial Sequence
  chemically synthesized
cctcacaggttcaagcgattct

SEQ ID NO: 1263321 - DNA, 22 bp, Artificial Sequence
  chemically synthesized
tgcctcacaggttcaagcgatt

SEQ ID NO: 1263322 - DNA, 22 bp, Artificial Sequence
  chemically synthesized
ctgcctcacaggttcaagcgat

SEQ ID NO: 1263323 - DNA, 22 bp, Artificial Sequence
  chemically synthesized
aggcaggagaatcgcttgaacc

SEQ ID NO: 1263324 - DNA, 22 bp, Artificial Sequence
  chemically synthesized
caacttctgcctcacaggttca

SEQ ID NO: 1263325 - DNA, 22 bp, Artificial Sequence
  chemically synthesized
actgcaacttctgcctcacagg

SEQ ID NO: 1263326 - DNA, 22 bp, Artificial Sequence
  chemically synthesized
ggttcactgcaacttctgcctc

SEQ ID NO: 1263327 - DNA, 22 bp, Artificial Sequence
  chemically synthesized
gaacctgtgaggcagaagttgc

SEQ ID NO: 1263328 - DNA, 22 bp, Artificial Sequence
  chemically synthesized
aacctgtgaggcagaagttgca

SEQ ID NO: 1263329 - DNA, 22 bp, Artificial Sequence
  chemically synthesized
atctcggttcactgcaacttct

SEQ ID NO: 1263330 - DNA, 22 bp, Artificial Sequence
  chemically synthesized
gatctcggttcactgcaacttc

SEQ ID NO: 1263331 - DNA, 22 bp, Artificial Sequence
  chemically synthesized
tgaggcagaagttgcagtgaac

SEQ ID NO: 1263332 - DNA, 22 bp, Artificial Sequence
  chemically synthesized
cagtgaaccgagatcaagccac

SEQ ID NO: 1263333 - DNA, 22 bp, Artificial Sequence
  chemically synthesized
ccaggcaggagtgcagtggctt

SEQ ID NO: 1263334 - DNA, 22 bp, Artificial Sequence
  chemically synthesized
cgtctcccaggcaggagtgcag

SEQ ID NO: 1263335 - DNA, 22 bp, Artificial Sequence
  chemically synthesized
ctccgtctcccaggcaggagtg

SEQ ID NO: 1263336 - DNA, 22 bp, Artificial Sequence
  chemically synthesized
gctccgtctcccaggcaggagt

SEQ ID NO: 1263337 - DNA, 22 bp, Artificial Sequence
  chemically synthesized
cactcctgcctgggagacggag

SEQ ID NO: 1263338 - DNA, 22 bp, Artificial Sequence
  chemically synthesized
gagatggagtcttgctccgtct

SEQ ID NO: 1263339 - DNA, 22 bp, Artificial Sequence
  chemically synthesized
ggagatggagtcttgctccgtc

SEQ ID NO: 1263340 - DNA, 22 bp, Artificial Sequence
  chemically synthesized
tggagatggagtcttgctccgt

SEQ ID NO: 1263341 - DNA, 22 bp, Artificial Sequence
  chemically synthesized
ctgcctgggagacggagcaaga

SEQ ID NO: 1263342 - DNA, 22 bp, Artificial Sequence
  chemically synthesized
ttggagatggagtcttgctccg

SEQ ID NO: 1263343 - DNA, 22 bp, Artificial Sequence
  chemically synthesized
tttggagatggagtcttgctcc

SEQ ID NO: 1263344 - DNA, 22 bp, Artificial Sequence
  chemically synthesized
ttttggagatggagtcttgctc

SEQ ID NO: 1263345 - DNA, 22 bp, Artificial Sequence
  chemically synthesized
cctgggagacggagcaagactc

SEQ ID NO: 1263346 - DNA, 22 bp, Artificial Sequence
  chemically synthesized
tttttggagatggagtcttgct

SEQ ID NO: 1263347 - DNA, 22 bp, Artificial Sequence
  chemically synthesized
ttttttggagatggagtcttgc

SEQ ID NO: 1263348 - DNA, 22 bp, Artificial Sequence
  chemically synthesized
tttttttggagatggagtcttg

SEQ ID NO: 1263349 - DNA, 22 bp, Artificial Sequence
  chemically synthesized
ttttttttggagatggagtctt

SEQ ID NO: 1263350 - DNA, 22 bp, Artificial Sequence
  chemically synthesized
ggagacggagcaagactccatc

SEQ ID NO: 1263351 - DNA, 22 bp, Artificial Sequence
  chemically synthesized
tttttttttggagatggagtct

SEQ ID NO: 1263352 - DNA, 22 bp, Artificial Sequence
  chemically synthesized
ttttttttttggagatggagtc

SEQ ID NO: 1263353 - DNA, 22 bp, Artificial Sequence
  chemically synthesized
tttttttttttggagatggagt

SEQ ID NO: 1263354 - DNA, 22 bp, Artificial Sequence
  chemically synthesized
ttttttttttttggagatggag

SEQ ID NO: 1263355 - DNA, 22 bp, Artificial Sequence
  chemically synthesized
tttttttttttttggagatgga

SEQ ID NO: 1263356 - DNA, 22 bp, Artificial Sequence
  chemically synthesized
ttttttttttttttggagatgg

SEQ ID NO: 1263357 - DNA, 22 bp, Artificial Sequence
  chemically synthesized
tttttttttttttttggagatg

SEQ ID NO: 1263358 - DNA, 22 bp, Artificial Sequence
  chemically synthesized
catctccaaaaaaaaaaaaaaa

SEQ ID NO: 1263359 - DNA, 22 bp, Artificial Sequence
  chemically synthesized
taggaagaacactttttttttt

SEQ ID NO: 1263360 - DNA, 22 bp, Artificial Sequence
  chemically synthesized
gtaggaagaacacttttttttt

SEQ ID NO: 1263361 - DNA, 22 bp, Artificial Sequence
  chemically synthesized
tgtaggaagaacactttttttt

SEQ ID NO: 1263362 - DNA, 22 bp, Artificial Sequence
  chemically synthesized
ttgtaggaagaacacttttttt

SEQ ID NO: 1263363 - DNA, 22 bp, Artificial Sequence
  chemically synthesized
caaaaaaaaaaaaaaaaagtgt

SEQ ID NO: 1263364 - DNA, 22 bp, Artificial Sequence
  chemically synthesized
tttgtaggaagaacactttttt

SEQ ID NO: 1263365 - DNA, 22 bp, Artificial Sequence
  chemically synthesized
ttttgtaggaagaacacttttt

SEQ ID NO: 1263366 - DNA, 22 bp, Artificial Sequence
  chemically synthesized
tttttttgtaggaagaacactt

SEQ ID NO: 1263367 - DNA, 22 bp, Artificial Sequence
  chemically synthesized
atttttttgtaggaagaacact

SEQ ID NO: 1263368 - DNA, 22 bp, Artificial Sequence
  chemically synthesized
acatgcttatttttttgtagga

SEQ ID NO: 1263369 - DNA, 22 bp, Artificial Sequence
  chemically synthesized
cctcacatgcttatttttttgt

SEQ ID NO: 1263370 - DNA, 22 bp, Artificial Sequence
  chemically synthesized
ttacctcacatgcttatttttt

SEQ ID NO: 1263371 - DNA, 22 bp, Artificial Sequence
  chemically synthesized
attacctcacatgcttattttt

SEQ ID NO: 1263372 - DNA, 22 bp, Artificial Sequence
  chemically synthesized
ttcctacaaaaaaataagcatg

SEQ ID NO: 1263373 - DNA, 22 bp, Artificial Sequence
  chemically synthesized
cctacaaaaaaataagcatgtg

SEQ ID NO: 1263374 - DNA, 22 bp, Artificial Sequence
  chemically synthesized
ctacaaaaaaataagcatgtga

SEQ ID NO: 1263375 - DNA, 22 bp, Artificial Sequence
  chemically synthesized
acatatttattacctcacatgc

SEQ ID NO: 1263376 - DNA, 22 bp, Artificial Sequence
  chemically synthesized
caaaaaaataagcatgtgaggt

SEQ ID NO: 1263377 - DNA, 22 bp, Artificial Sequence
  chemically synthesized
attaacatatttattacctcac

SEQ ID NO: 1263378 - DNA, 22 bp, Artificial Sequence
  chemically synthesized
agtcaagctaattaacatattt

SEQ ID NO: 1263379 - DNA, 22 bp, Artificial Sequence
  chemically synthesized
attagcttgactgagccattca

SEQ ID NO: 1263380 - DNA, 22 bp, Artificial Sequence
  chemically synthesized
aatatatatatatgaatggctc

SEQ ID NO: 1263381 - DNA, 22 bp, Artificial Sequence
  chemically synthesized
gaatatatatatatgaatggct

SEQ ID NO: 1263382 - DNA, 22 bp, Artificial Sequence
  chemically synthesized
tgaatatatatatatgaatggc

SEQ ID NO: 1263383 - DNA, 22 bp, Artificial Sequence
  chemically synthesized
gcttgactgagccattcatata

SEQ ID NO: 1263384 - DNA, 22 bp, Artificial Sequence
  chemically synthesized
ttttgaatatatatatatgaat

SEQ ID NO: 1263385 - DNA, 22 bp, Artificial Sequence
  chemically synthesized
gactgagccattcatatatata

SEQ ID NO: 1263386 - DNA, 22 bp, Artificial Sequence
  chemically synthesized
actgagccattcatatatatat

SEQ ID NO: 1263387 - DNA, 22 bp, Artificial Sequence
  chemically synthesized
agccattcatatatatatattc

SEQ ID NO: 1263388 - DNA, 22 bp, Artificial Sequence
  chemically synthesized
aacatgttgttttgaatatata

SEQ ID NO: 1263389 - DNA, 22 bp, Artificial Sequence
  chemically synthesized
attcaacatgttgttttgaata

SEQ ID NO: 1263390 - DNA, 22 bp, Artificial Sequence
  chemically synthesized
cattcaacatgttgttttgaat

SEQ ID NO: 1263391 - DNA, 22 bp, Artificial Sequence
  chemically synthesized
atatatatatattcaaaacaac

SEQ ID NO: 1263392 - DNA, 22 bp, Artificial Sequence
  chemically synthesized
tttcattcaacatgttgttttg

SEQ ID NO: 1263393 - DNA, 22 bp, Artificial Sequence
  chemically synthesized
atttcattcaacatgttgtttt

SEQ ID NO: 1263394 - DNA, 22 bp, Artificial Sequence
  chemically synthesized
tatttcattcaacatgttgttt

SEQ ID NO: 1263395 - DNA, 22 bp, Artificial Sequence
  chemically synthesized
tctttatttcattcaacatgtt

SEQ ID NO: 1263396 - DNA, 22 bp, Artificial Sequence
  chemically synthesized
atctttatttcattcaacatgt

SEQ ID NO: 1263397 - DNA, 22 bp, Artificial Sequence
  chemically synthesized
tttatctttatttcattcaaca

SEQ ID NO: 1263398 - DNA, 22 bp, Artificial Sequence
  chemically synthesized
aaaacaacatgttgaatgaaat

SEQ ID NO: 1263399 - DNA, 22 bp, Artificial Sequence
  chemically synthesized
aatgaaataaagataaacaatt

SEQ ID NO: 1263400 - DNA, 22 bp, Artificial Sequence
  chemically synthesized
atggatagaaaaaattgtttat

SEQ ID NO: 1263401 - DNA, 22 bp, Artificial Sequence
  chemically synthesized
aatggatagaaaaaattgttta

SEQ ID NO: 1263402 - DNA, 22 bp, Artificial Sequence
  chemically synthesized
taatggatagaaaaaattgttt

SEQ ID NO: 1263403 - DNA, 22 bp, Artificial Sequence
  chemically synthesized
attttaatggatagaaaaaatt

SEQ ID NO: 1263404 - DNA, 22 bp, Artificial Sequence
  chemically synthesized
aatagttaattttaatggatag

SEQ ID NO: 1263405 - DNA, 22 bp, Artificial Sequence
  chemically synthesized
aattaaatagttaattttaatg

SEQ ID NO: 1263406 - DNA, 22 bp, Artificial Sequence
  chemically synthesized
aaattaaatagttaattttaat

SEQ ID NO: 1263407 - DNA, 22 bp, Artificial Sequence
  chemically synthesized
tttctatccattaaaattaact

SEQ ID NO: 1263408 - DNA, 22 bp, Artificial Sequence
  chemically synthesized
tttaaattaaatagttaatttt

SEQ ID NO: 1263409 - DNA, 22 bp, Artificial Sequence
  chemically synthesized
ttctatccattaaaattaacta

SEQ ID NO: 1263410 - DNA, 22 bp, Artificial Sequence
  chemically synthesized
atttaaattaaatagttaattt

SEQ ID NO: 1263411 - DNA, 22 bp, Artificial Sequence
  chemically synthesized
tctatccattaaaattaactat

SEQ ID NO: 1263412 - DNA, 22 bp, Artificial Sequence
  chemically synthesized
tatttaaattaaatagttaatt

SEQ ID NO: 1263413 - DNA, 22 bp, Artificial Sequence
  chemically synthesized
ctatccattaaaattaactatt

SEQ ID NO: 1263414 - DNA, 22 bp, Artificial Sequence
  chemically synthesized
tatccattaaaattaactattt

SEQ ID NO: 1263415 - DNA, 22 bp, Artificial Sequence
  chemically synthesized
ttttatttaaattaaatagtta

SEQ ID NO: 1263416 - DNA, 22 bp, Artificial Sequence
  chemically synthesized
tccattaaaattaactatttaa

SEQ ID NO: 1263417 - DNA, 22 bp, Artificial Sequence
  chemically synthesized
attttatttaaattaaatagtt

SEQ ID NO: 1263418 - DNA, 22 bp, Artificial Sequence
  chemically synthesized
tattttatttaaattaaatagt

SEQ ID NO: 1263419 - DNA, 22 bp, Artificial Sequence
  chemically synthesized
aaattaactatttaatttaaat

SEQ ID NO: 1263420 - DNA, 22 bp, Artificial Sequence
  chemically synthesized
actatttaatttaaataaaata

SEQ ID NO: 1263421 - DNA, 22 bp, Artificial Sequence
  chemically synthesized
tttaatttaaataaaataaaat

SEQ ID NO: 1263422 - DNA, 22 bp, Artificial Sequence
  chemically synthesized
ggatgatcaaatccattttatt

SEQ ID NO: 1263423 - DNA, 22 bp, Artificial Sequence
  chemically synthesized
aatttaaataaaataaaatgga

SEQ ID NO: 1263424 - DNA, 22 bp, Artificial Sequence
  chemically synthesized
atttaaataaaataaaatggat

SEQ ID NO: 1263425 - DNA, 22 bp, Artificial Sequence
  chemically synthesized
aaataaaataaaatggatttga

SEQ ID NO: 1263426 - DNA, 22 bp, Artificial Sequence
  chemically synthesized
aataaaataaaatggatttgat

SEQ ID NO: 1263427 - DNA, 22 bp, Artificial Sequence
  chemically synthesized
gtaaatgtgttaggatgatcaa

SEQ ID NO: 1263428 - DNA, 22 bp, Artificial Sequence
  chemically synthesized
taacaacctagtaaatgtgtta

SEQ ID NO: 1263429 - DNA, 22 bp, Artificial Sequence
  chemically synthesized
ataacaacctagtaaatgtgtt

SEQ ID NO: 1263430 - DNA, 22 bp, Artificial Sequence
  chemically synthesized
gatcatcctaacacatttacta

SEQ ID NO: 1263431 - DNA, 22 bp, Artificial Sequence
  chemically synthesized
atcatcctaacacatttactag

SEQ ID NO: 1263432 - DNA, 22 bp, Artificial Sequence
  chemically synthesized
gatcttataacaacctagtaaa

SEQ ID NO: 1263433 - DNA, 22 bp, Artificial Sequence
  chemically synthesized
agatcttataacaacctagtaa

SEQ ID NO: 1263434 - DNA, 22 bp, Artificial Sequence
  chemically synthesized
acacatttactaggttgttata

SEQ ID NO: 1263435 - DNA, 22 bp, Artificial Sequence
  chemically synthesized
actaggttgttataagatctaa

SEQ ID NO: 1263436 - DNA, 22 bp, Artificial Sequence
  chemically synthesized
ctaggttgttataagatctaaa

SEQ ID NO: 1263437 - DNA, 22 bp, Artificial Sequence
  chemically synthesized
cagatgatgccatgtttagatc

SEQ ID NO: 1263438 - DNA, 22 bp, Artificial Sequence
  chemically synthesized
ggttgttataagatctaaacat

SEQ ID NO: 1263439 - DNA, 22 bp, Artificial Sequence
  chemically synthesized
tgcagatgatgccatgtttaga

SEQ ID NO: 1263440 - DNA, 22 bp, Artificial Sequence
  chemically synthesized
ttataagatctaaacatggcat

SEQ ID NO: 1263441 - DNA, 22 bp, Artificial Sequence
  chemically synthesized
taagatctaaacatggcatcat

SEQ ID NO: 1263442 - DNA, 22 bp, Artificial Sequence
  chemically synthesized
agccaagacctctgcagatgat

SEQ ID NO: 1263443 - DNA, 22 bp, Artificial Sequence
  chemically synthesized
aacatggcatcatctgcagagg

SEQ ID NO: 1263444 - DNA, 22 bp, Artificial Sequence
  chemically synthesized
atatatgtcagacattaagcca

SEQ ID NO: 1263445 - DNA, 22 bp, Artificial Sequence
  chemically synthesized
cagaggtcttggcttaatgtct

SEQ ID NO: 1263446 - DNA, 22 bp, Artificial Sequence
  chemically synthesized
agcaattaatatatgtcagaca

SEQ ID NO: 1263447 - DNA, 22 bp, Artificial Sequence
  chemically synthesized
ctaagcaattaatatatgtcag

SEQ ID NO: 1263448 - DNA, 22 bp, Artificial Sequence
  chemically synthesized
gctaagcaattaatatatgtca

SEQ ID NO: 1263449 - DNA, 22 bp, Artificial Sequence
  chemically synthesized
ggcttaatgtctgacatatatt

SEQ ID NO: 1263450 - DNA, 22 bp, Artificial Sequence
  chemically synthesized
gcttaatgtctgacatatatta

SEQ ID NO: 1263451 - DNA, 22 bp, Artificial Sequence
  chemically synthesized
aatgtctgacatatattaattg

SEQ ID NO: 1263452 - DNA, 22 bp, Artificial Sequence
  chemically synthesized
cgatttgctaagcaattaatat

SEQ ID NO: 1263453 - DNA, 22 bp, Artificial Sequence
  chemically synthesized
atgtctgacatatattaattgc

SEQ ID NO: 1263454 - DNA, 22 bp, Artificial Sequence
  chemically synthesized
cagctacgatttgctaagcaat

SEQ ID NO: 1263455 - DNA, 22 bp, Artificial Sequence
  chemically synthesized
acatatattaattgcttagcaa

SEQ ID NO: 1263456 - DNA, 22 bp, Artificial Sequence
  chemically synthesized
gtgattacagctacgatttgct

SEQ ID NO: 1263457 - DNA, 22 bp, Artificial Sequence
  chemically synthesized
agtgattacagctacgatttgc

SEQ ID NO: 1263458 - DNA, 22 bp, Artificial Sequence
  chemically synthesized
tttagtgattacagctacgatt

SEQ ID NO: 1263459 - DNA, 22 bp, Artificial Sequence
  chemically synthesized
attgcttagcaaatcgtagctg

SEQ ID NO: 1263460 - DNA, 22 bp, Artificial Sequence
  chemically synthesized
atttagtgattacagctacgat

SEQ ID NO: 1263461 - DNA, 22 bp, Artificial Sequence
  chemically synthesized
tttatttagtgattacagctac

SEQ ID NO: 1263462 - DNA, 22 bp, Artificial Sequence
  chemically synthesized
cttagcaaatcgtagctgtaat

SEQ ID NO: 1263463 - DNA, 22 bp, Artificial Sequence
  chemically synthesized
atttatttagtgattacagcta

SEQ ID NO: 1263464 - DNA, 22 bp, Artificial Sequence
  chemically synthesized
agcaaatcgtagctgtaatcac

SEQ ID NO: 1263465 - DNA, 22 bp, Artificial Sequence
  chemically synthesized
gcaaatcgtagctgtaatcact

SEQ ID NO: 1263466 - DNA, 22 bp, Artificial Sequence
  chemically synthesized
taatcactaaataaataaattt

SEQ ID NO: 1263467 - DNA, 22 bp, Artificial Sequence
  chemically synthesized
tggaataaaaaagtcaataaat

SEQ ID NO: 1263468 - DNA, 22 bp, Artificial Sequence
  chemically synthesized
aataaataaatttattgacttt

SEQ ID NO: 1263469 - DNA, 22 bp, Artificial Sequence
  chemically synthesized
attgacttttttattccatagt

SEQ ID NO: 1263470 - DNA, 22 bp, Artificial Sequence
  chemically synthesized
ttgacttttttattccatagta

SEQ ID NO: 1263471 - DNA, 22 bp, Artificial Sequence
  chemically synthesized
acttttttattccatagtaccc

SEQ ID NO: 1263472 - DNA, 22 bp, Artificial Sequence
  chemically synthesized
ttttattccatagtacccttcg

SEQ ID NO: 1263473 - DNA, 22 bp, Artificial Sequence
  chemically synthesized
tttattccatagtacccttcgc

SEQ ID NO: 1263474 - DNA, 22 bp, Artificial Sequence
  chemically synthesized
ttattccatagtacccttcgct

SEQ ID NO: 1263475 - DNA, 22 bp, Artificial Sequence
  chemically synthesized
tattccatagtacccttcgcta

SEQ ID NO: 1263476 - DNA, 22 bp, Artificial Sequence
  chemically synthesized
attccatagtacccttcgctac

SEQ ID NO: 1263477 - DNA, 22 bp, Artificial Sequence
  chemically synthesized
ttccatagtacccttcgctaca

SEQ ID NO: 1263478 - DNA, 22 bp, Artificial Sequence
  chemically synthesized
catagtacccttcgctacatta

SEQ ID NO: 1263479 - DNA, 22 bp, Artificial Sequence
  chemically synthesized
cgctacattatttgtatctcta

SEQ ID NO: 1263480 - DNA, 22 bp, Artificial Sequence
  chemically synthesized
gctacattatttgtatctctac

SEQ ID NO: 1263481 - DNA, 22 bp, Artificial Sequence
  chemically synthesized
ccagtagacgaagtagagatac

SEQ ID NO: 1263482 - DNA, 22 bp, Artificial Sequence
  chemically synthesized
cccagtagacgaagtagagata

SEQ ID NO: 1263483 - DNA, 22 bp, Artificial Sequence
  chemically synthesized
cattatttgtatctctacttcg

SEQ ID NO: 1263484 - DNA, 22 bp, Artificial Sequence
  chemically synthesized
tttgtatctctacttcgtctac

SEQ ID NO: 1263485 - DNA, 22 bp, Artificial Sequence
  chemically synthesized
gtatctctacttcgtctactgg

SEQ ID NO: 1263486 - DNA, 22 bp, Artificial Sequence
  chemically synthesized
tatctctacttcgtctactggg

SEQ ID NO: 1263487 - DNA, 22 bp, Artificial Sequence
  chemically synthesized
ccacaggcataccttcccagta

SEQ ID NO: 1263488 - DNA, 22 bp, Artificial Sequence
  chemically synthesized
tgccacaggcataccttcccag

SEQ ID NO: 1263489 - DNA, 22 bp, Artificial Sequence
  chemically synthesized
tacttcgtctactgggaaggta

SEQ ID NO: 1263490 - DNA, 22 bp, Artificial Sequence
  chemically synthesized
ctgccacaggcataccttccca

SEQ ID NO: 1263491 - DNA, 22 bp, Artificial Sequence
  chemically synthesized
tctgccacaggcataccttccc

SEQ ID NO: 1263492 - DNA, 22 bp, Artificial Sequence
  chemically synthesized
cttcgtctactgggaaggtatg

SEQ ID NO: 1263493 - DNA, 22 bp, Artificial Sequence
  chemically synthesized
ttctgccacaggcataccttcc

SEQ ID NO: 1263494 - DNA, 22 bp, Artificial Sequence
  chemically synthesized
cgtctactgggaaggtatgcct

SEQ ID NO: 1263495 - DNA, 22 bp, Artificial Sequence
  chemically synthesized
gtctactgggaaggtatgcctg

SEQ ID NO: 1263496 - DNA, 22 bp, Artificial Sequence
  chemically synthesized
ctgggaaggtatgcctgtggca

SEQ ID NO: 1263497 - DNA, 22 bp, Artificial Sequence
  chemically synthesized
ggaaggtatgcctgtggcagaa

SEQ ID NO: 1263498 - DNA, 22 bp, Artificial Sequence
  chemically synthesized
gataagatggaaacttttctgc

SEQ ID NO: 1263499 - DNA, 22 bp, Artificial Sequence
  chemically synthesized
tggcagaaaagtttccatctta

SEQ ID NO: 1263500 - DNA, 22 bp, Artificial Sequence
  chemically synthesized
ccatcttatctagcctttctca

SEQ ID NO: 1263501 - DNA, 22 bp, Artificial Sequence
  chemically synthesized
catcttatctagcctttctcac

SEQ ID NO: 1263502 - DNA, 22 bp, Artificial Sequence
  chemically synthesized
gacagaagggaatgtgagaaag

SEQ ID NO: 1263503 - DNA, 22 bp, Artificial Sequence
  chemically synthesized
ggacagaagggaatgtgagaaa

SEQ ID NO: 1263504 - DNA, 22 bp, Artificial Sequence
  chemically synthesized
atctagcctttctcacattccc

SEQ ID NO: 1263505 - DNA, 22 bp, Artificial Sequence
  chemically synthesized
tctagcctttctcacattccct

SEQ ID NO: 1263506 - DNA, 22 bp, Artificial Sequence
  chemically synthesized
gcctttctcacattcccttctg

SEQ ID NO: 1263507 - DNA, 22 bp, Artificial Sequence
  chemically synthesized
gaatgatttggacagaagggaa

SEQ ID NO: 1263508 - DNA, 22 bp, Artificial Sequence
  chemically synthesized
tctcacattcccttctgtccaa

SEQ ID NO: 1263509 - DNA, 22 bp, Artificial Sequence
  chemically synthesized
ctcacattcccttctgtccaaa

SEQ ID NO: 1263510 - DNA, 22 bp, Artificial Sequence
  chemically synthesized
tcacattcccttctgtccaaat

SEQ ID NO: 1263511 - DNA, 22 bp, Artificial Sequence
  chemically synthesized
acattcccttctgtccaaatca

SEQ ID NO: 1263512 - DNA, 22 bp, Artificial Sequence
  chemically synthesized
agagtgggctggaatgatttgg

SEQ ID NO: 1263513 - DNA, 22 bp, Artificial Sequence
  chemically synthesized
ccttctgtccaaatcattccag

SEQ ID NO: 1263514 - DNA, 22 bp, Artificial Sequence
  chemically synthesized
gattcagagtgggctggaatga

SEQ ID NO: 1263515 - DNA, 22 bp, Artificial Sequence
  chemically synthesized
ctgtccaaatcattccagccca

SEQ ID NO: 1263516 - DNA, 22 bp, Artificial Sequence
  chemically synthesized
tgtccaaatcattccagcccac

SEQ ID NO: 1263517 - DNA, 22 bp, Artificial Sequence
  chemically synthesized
tccaaatcattccagcccactc

SEQ ID NO: 1263518 - DNA, 22 bp, Artificial Sequence
  chemically synthesized
tcaaaacaagttagattcagag

SEQ ID NO: 1263519 - DNA, 22 bp, Artificial Sequence
  chemically synthesized
tgtcaaaacaagttagattcag

SEQ ID NO: 1263520 - DNA, 22 bp, Artificial Sequence
  chemically synthesized
cagcccactctgaatctaactt

SEQ ID NO: 1263521 - DNA, 22 bp, Artificial Sequence
  chemically synthesized
tgaatctaacttgttttgacag

SEQ ID NO: 1263522 - DNA, 22 bp, Artificial Sequence
  chemically synthesized
aatctaacttgttttgacagag

SEQ ID NO: 1263523 - DNA, 22 bp, Artificial Sequence
  chemically synthesized
acttgttttgacagagtactta

SEQ ID NO: 1263524 - DNA, 22 bp, Artificial Sequence
  chemically synthesized
gttttgacagagtacttattta

SEQ ID NO: 1263525 - DNA, 22 bp, Artificial Sequence
  chemically synthesized
tcatgtgccaagtaaataagta

SEQ ID NO: 1263526 - DNA, 22 bp, Artificial Sequence
  chemically synthesized
ttttgacagagtacttatttac

SEQ ID NO: 1263527 - DNA, 22 bp, Artificial Sequence
  chemically synthesized
tgacagagtacttatttacttg

SEQ ID NO: 1263528 - DNA, 22 bp, Artificial Sequence
  chemically synthesized
gacagagtacttatttacttgg

SEQ ID NO: 1263529 - DNA, 22 bp, Artificial Sequence
  chemically synthesized
acagagtacttatttacttggc

SEQ ID NO: 1263530 - DNA, 22 bp, Artificial Sequence
  chemically synthesized
agaacctatcatgtgccaagta

SEQ ID NO: 1263531 - DNA, 22 bp, Artificial Sequence
  chemically synthesized
ttaagaacctatcatgtgccaa

SEQ ID NO: 1263532 - DNA, 22 bp, Artificial Sequence
  chemically synthesized
attaagaacctatcatgtgcca

SEQ ID NO: 1263533 - DNA, 22 bp, Artificial Sequence
  chemically synthesized
atttacttggcacatgataggt

SEQ ID NO: 1263534 - DNA, 22 bp, Artificial Sequence
  chemically synthesized
tttacttggcacatgataggtt

SEQ ID NO: 1263535 - DNA, 22 bp, Artificial Sequence
  chemically synthesized
acttggcacatgataggttctt

SEQ ID NO: 1263536 - DNA, 22 bp, Artificial Sequence
  chemically synthesized
cttggcacatgataggttctta

SEQ ID NO: 1263537 - DNA, 22 bp, Artificial Sequence
  chemically synthesized
ggcacatgataggttcttaata

SEQ ID NO: 1263538 - DNA, 22 bp, Artificial Sequence
  chemically synthesized
gcacatgataggttcttaataa

SEQ ID NO: 1263539 - DNA, 22 bp, Artificial Sequence
  chemically synthesized
taaggcaataaacaaatattta

SEQ ID NO: 1263540 - DNA, 22 bp, Artificial Sequence
  chemically synthesized
ctataaggcaataaacaaatat

SEQ ID NO: 1263541 - DNA, 22 bp, Artificial Sequence
  chemically synthesized
cctataaggcaataaacaaata

SEQ ID NO: 1263542 - DNA, 22 bp, Artificial Sequence
  chemically synthesized
ttcctataaggcaataaacaaa

SEQ ID NO: 1263543 - DNA, 22 bp, Artificial Sequence
  chemically synthesized
cttcctataaggcaataaacaa

SEQ ID NO: 1263544 - DNA, 22 bp, Artificial Sequence
  chemically synthesized
ttaataaatatttgtttattgc

SEQ ID NO: 1263545 - DNA, 22 bp, Artificial Sequence
  chemically synthesized
tcttcctataaggcaataaaca

SEQ ID NO: 1263546 - DNA, 22 bp, Artificial Sequence
  chemically synthesized
aataaatatttgtttattgcct

SEQ ID NO: 1263547 - DNA, 22 bp, Artificial Sequence
  chemically synthesized
ataaatatttgtttattgcctt

SEQ ID NO: 1263548 - DNA, 22 bp, Artificial Sequence
  chemically synthesized
ataactttcttcctataaggca

SEQ ID NO: 1263549 - DNA, 22 bp, Artificial Sequence
  chemically synthesized
cataactttcttcctataaggc

SEQ ID NO: 1263550 - DNA, 22 bp, Artificial Sequence
  chemically synthesized
cttcataactttcttcctataa

SEQ ID NO: 1263551 - DNA, 22 bp, Artificial Sequence
  chemically synthesized
ccttcataactttcttcctata

SEQ ID NO: 1263552 - DNA, 22 bp, Artificial Sequence
  chemically synthesized
gtttattgccttataggaagaa

SEQ ID NO: 1263553 - DNA, 22 bp, Artificial Sequence
  chemically synthesized
tttattgccttataggaagaaa

SEQ ID NO: 1263554 - DNA, 22 bp, Artificial Sequence
  chemically synthesized
attgccttataggaagaaagtt

SEQ ID NO: 1263555 - DNA, 22 bp, Artificial Sequence
  chemically synthesized
tatttccttcataactttcttc

SEQ ID NO: 1263556 - DNA, 22 bp, Artificial Sequence
  chemically synthesized
ttgccttataggaagaaagtta

SEQ ID NO: 1263557 - DNA, 22 bp, Artificial Sequence
  chemically synthesized
ccttataggaagaaagttatga

SEQ ID NO: 1263558 - DNA, 22 bp, Artificial Sequence
  chemically synthesized
ataggaagaaagttatgaagga

SEQ ID NO: 1263559 - DNA, 22 bp, Artificial Sequence
  chemically synthesized
taggaagaaagttatgaaggaa

SEQ ID NO: 1263560 - DNA, 22 bp, Artificial Sequence
  chemically synthesized
agtaaacaagttatatttcctt

SEQ ID NO: 1263561 - DNA, 22 bp, Artificial Sequence
  chemically synthesized
cccctcagtaaacaagttatat

SEQ ID NO: 1263562 - DNA, 22 bp, Artificial Sequence
  chemically synthesized
ctacccctcagtaaacaagtta

SEQ ID NO: 1263563 - DNA, 22 bp, Artificial Sequence
  chemically synthesized
tgaaggaaatataacttgttta

SEQ ID NO: 1263564 - DNA, 22 bp, Artificial Sequence
  chemically synthesized
gctacccctcagtaaacaagtt

SEQ ID NO: 1263565 - DNA, 22 bp, Artificial Sequence
  chemically synthesized
gtttactgaggggtagcaagtt

SEQ ID NO: 1263566 - DNA, 22 bp, Artificial Sequence
  chemically synthesized
tttactgaggggtagcaagttt

SEQ ID NO: 1263567 - DNA, 22 bp, Artificial Sequence
  chemically synthesized
actgaggggtagcaagtttcct

SEQ ID NO: 1263568 - DNA, 22 bp, Artificial Sequence
  chemically synthesized
ctgaggggtagcaagtttcctt

SEQ ID NO: 1263569 - DNA, 22 bp, Artificial Sequence
  chemically synthesized
aggggtagcaagtttccttctt

SEQ ID NO: 1263570 - DNA, 22 bp, Artificial Sequence
  chemically synthesized
ccttctttctttcttttttttt

SEQ ID NO: 1263571 - DNA, 22 bp, Artificial Sequence
  chemically synthesized
cttctttctttctttttttttt

SEQ ID NO: 1263572 - DNA, 22 bp, Artificial Sequence
  chemically synthesized
ctttctttcttttttttttttt

SEQ ID NO: 1263573 - DNA, 22 bp, Artificial Sequence
  chemically synthesized
tttctttctttttttttttttt

SEQ ID NO: 1263574 - DNA, 22 bp, Artificial Sequence
  chemically synthesized
tctttctttttttttttttttt

SEQ ID NO: 1263575 - DNA, 22 bp, Artificial Sequence
  chemically synthesized
catcaaaaaaaaaaaaaaaaaa

SEQ ID NO: 1263576 - DNA, 22 bp, Artificial Sequence
  chemically synthesized
ctttcttttttttttttttttt

SEQ ID NO: 1263577 - DNA, 22 bp, Artificial Sequence
  chemically synthesized
tttctttttttttttttttttt

SEQ ID NO: 1263578 - DNA, 22 bp, Artificial Sequence
  chemically synthesized
tctttttttttttttttttttt

SEQ ID NO: 1263579 - DNA, 22 bp, Artificial Sequence
  chemically synthesized
cttttttttttttttttttttt

SEQ ID NO: 1263580 - DNA, 22 bp, Artificial Sequence
  chemically synthesized
tttttttttttttttttttttt

SEQ ID NO: 1263581 - DNA, 22 bp, Artificial Sequence
  chemically synthesized
tttttttttttttttttttttt

SEQ ID NO: 1263582 - DNA, 22 bp, Artificial Sequence
  chemically synthesized
tttttttttttttttttttttg

SEQ ID NO: 1263583 - DNA, 22 bp, Artificial Sequence
  chemically synthesized
ttttttttttttttttttttga

SEQ ID NO: 1263584 - DNA, 22 bp, Artificial Sequence
  chemically synthesized
tttttttttttttttttttgat

SEQ ID NO: 1263585 - DNA, 22 bp, Artificial Sequence
  chemically synthesized
ttttttttttttttttttgatg

SEQ ID NO: 1263586 - DNA, 22 bp, Artificial Sequence
  chemically synthesized
tttttttttttttttttgatgg

SEQ ID NO: 1263587 - DNA, 22 bp, Artificial Sequence
  chemically synthesized
ttttttttttttttttgatgga

SEQ ID NO: 1263588 - DNA, 22 bp, Artificial Sequence
  chemically synthesized
tttttttttttttttgatggaa

SEQ ID NO: 1263589 - DNA, 22 bp, Artificial Sequence
  chemically synthesized
ttttttttttttttgatggaat

SEQ ID NO: 1263590 - DNA, 22 bp, Artificial Sequence
  chemically synthesized
tttttttttttttgatggaatt

SEQ ID NO: 1263591 - DNA, 22 bp, Artificial Sequence
  chemically synthesized
ttttttttttttgatggaattt

SEQ ID NO: 1263592 - DNA, 22 bp, Artificial Sequence
  chemically synthesized
tttttttttttgatggaatttc

SEQ ID NO: 1263593 - DNA, 22 bp, Artificial Sequence
  chemically synthesized
ggcaacaagagtgaaattccat

SEQ ID NO: 1263594 - DNA, 22 bp, Artificial Sequence
  chemically synthesized
ttttttttttgatggaatttca

SEQ ID NO: 1263595 - DNA, 22 bp, Artificial Sequence
  chemically synthesized
tttttttttgatggaatttcac

SEQ ID NO: 1263596 - DNA, 22 bp, Artificial Sequence
  chemically synthesized
ttttttttgatggaatttcact

SEQ ID NO: 1263597 - DNA, 22 bp, Artificial Sequence
  chemically synthesized
tttttttgatggaatttcactc

SEQ ID NO: 1263598 - DNA, 22 bp, Artificial Sequence
  chemically synthesized
ttttttgatggaatttcactct

SEQ ID NO: 1263599 - DNA, 22 bp, Artificial Sequence
  chemically synthesized
tttttgatggaatttcactctt

SEQ ID NO: 1263600 - DNA, 22 bp, Artificial Sequence
  chemically synthesized
ttttgatggaatttcactcttg

SEQ ID NO: 1263601 - DNA, 22 bp, Artificial Sequence
  chemically synthesized
cagcctgggcaacaagagtgaa

SEQ ID NO: 1263602 - DNA, 22 bp, Artificial Sequence
  chemically synthesized
tttgatggaatttcactcttgt

SEQ ID NO: 1263603 - DNA, 22 bp, Artificial Sequence
  chemically synthesized
ttgatggaatttcactcttgtt

SEQ ID NO: 1263604 - DNA, 22 bp, Artificial Sequence
  chemically synthesized
tgatggaatttcactcttgttg

SEQ ID NO: 1263605 - DNA, 22 bp, Artificial Sequence
  chemically synthesized
gatggaatttcactcttgttgc

SEQ ID NO: 1263606 - DNA, 22 bp, Artificial Sequence
  chemically synthesized
atggaatttcactcttgttgcc

SEQ ID NO: 1263607 - DNA, 22 bp, Artificial Sequence
  chemically synthesized
gccatcatactccagcctgggc

SEQ ID NO: 1263608 - DNA, 22 bp, Artificial Sequence
  chemically synthesized
cactcttgttgcccaggctgga

SEQ ID NO: 1263609 - DNA, 22 bp, Artificial Sequence
  chemically synthesized
actcttgttgcccaggctggag

SEQ ID NO: 1263610 - DNA, 22 bp, Artificial Sequence
  chemically synthesized
ttgttgcccaggctggagtatg

SEQ ID NO: 1263611 - DNA, 22 bp, Artificial Sequence
  chemically synthesized
agatctggccatcatactccag

SEQ ID NO: 1263612 - DNA, 22 bp, Artificial Sequence
  chemically synthesized
gttgcccaggctggagtatgat

SEQ ID NO: 1263613 - DNA, 22 bp, Artificial Sequence
  chemically synthesized
ttgcccaggctggagtatgatg

SEQ ID NO: 1263614 - DNA, 22 bp, Artificial Sequence
  chemically synthesized
cccaggctggagtatgatggcc

SEQ ID NO: 1263615 - DNA, 22 bp, Artificial Sequence
  chemically synthesized
tggtgagctgagatctggccat

SEQ ID NO: 1263616 - DNA, 22 bp, Artificial Sequence
  chemically synthesized
gagtatgatggccagatctcag

SEQ ID NO: 1263617 - DNA, 22 bp, Artificial Sequence
  chemically synthesized
aaaggcggaggttgtggtgagc

SEQ ID NO: 1263618 - DNA, 22 bp, Artificial Sequence
  chemically synthesized
cactaaaaggcggaggttgtgg

SEQ ID NO: 1263619 - DNA, 22 bp, Artificial Sequence
  chemically synthesized
agctcaccacaacctccgcctt

SEQ ID NO: 1263620 - DNA, 22 bp, Artificial Sequence
  chemically synthesized
accacaacctccgccttttagt

SEQ ID NO: 1263621 - DNA, 22 bp, Artificial Sequence
  chemically synthesized
cgccttttagtggagatgatgt

SEQ ID NO: 1263622 - DNA, 22 bp, Artificial Sequence
  chemically synthesized
accaacatggagaaacatcatc

SEQ ID NO: 1263623 - DNA, 22 bp, Artificial Sequence
  chemically synthesized
ttagtggagatgatgtttctcc

SEQ ID NO: 1263624 - DNA, 22 bp, Artificial Sequence
  chemically synthesized
tagtggagatgatgtttctcca

SEQ ID NO: 1263625 - DNA, 22 bp, Artificial Sequence
  chemically synthesized
agtggagatgatgtttctccat

SEQ ID NO: 1263626 - DNA, 22 bp, Artificial Sequence
  chemically synthesized
gtggagatgatgtttctccatg

SEQ ID NO: 1263627 - DNA, 22 bp, Artificial Sequence
  chemically synthesized
aagaccagcctgaccaacatgg

SEQ ID NO: 1263628 - DNA, 22 bp, Artificial Sequence
  chemically synthesized
ctccatgttggtcaggctggtc

SEQ ID NO: 1263629 - DNA, 22 bp, Artificial Sequence
  chemically synthesized
tccatgttggtcaggctggtct

SEQ ID NO: 1263630 - DNA, 22 bp, Artificial Sequence
  chemically synthesized
catgttggtcaggctggtcttg

SEQ ID NO: 1263631 - DNA, 22 bp, Artificial Sequence
  chemically synthesized
aggccgggagttcaagaccagc

SEQ ID NO: 1263632 - DNA, 22 bp, Artificial Sequence
  chemically synthesized
gtcaggctggtcttgaactccc

SEQ ID NO: 1263633 - DNA, 22 bp, Artificial Sequence
  chemically synthesized
gtcttgaactcccggcctcagg

SEQ ID NO: 1263634 - DNA, 22 bp, Artificial Sequence
  chemically synthesized
gaactcccggcctcaggtgacc

SEQ ID NO: 1263635 - DNA, 22 bp, Artificial Sequence
  chemically synthesized
aactcccggcctcaggtgaccc

SEQ ID NO: 1263636 - DNA, 22 bp, Artificial Sequence
  chemically synthesized
ccggcctcaggtgacccgctgc

SEQ ID NO: 1263637 - DNA, 22 bp, Artificial Sequence
  chemically synthesized
cggccgggcgtccgaggcagcg

SEQ ID NO: 1263638 - DNA, 22 bp, Artificial Sequence
  chemically synthesized
gcggccgggcgtccgaggcagc

SEQ ID NO: 1263639 - DNA, 22 bp, Artificial Sequence
  chemically synthesized
aggtgacccgctgcctcggacg

SEQ ID NO: 1263640 - DNA, 22 bp, Artificial Sequence
  chemically synthesized
cctcggacgcccggccgcaagt

SEQ ID NO: 1263641 - DNA, 22 bp, Artificial Sequence
  chemically synthesized
ggacgcccggccgcaagtcttt

SEQ ID NO: 1263642 - DNA, 22 bp, Artificial Sequence
  chemically synthesized
gtaagataaaagaaagacttgc

SEQ ID NO: 1263643 - DNA, 22 bp, Artificial Sequence
  chemically synthesized
agtaagataaaagaaagacttg

SEQ ID NO: 1263644 - DNA, 22 bp, Artificial Sequence
  chemically synthesized
tgtttagtaagataaaagaaag

SEQ ID NO: 1263645 - DNA, 22 bp, Artificial Sequence
  chemically synthesized
tctgtgtttagtaagataaaag

SEQ ID NO: 1263646 - DNA, 22 bp, Artificial Sequence
  chemically synthesized
gtctgtgtttagtaagataaaa

SEQ ID NO: 1263647 - DNA, 22 bp, Artificial Sequence
  chemically synthesized
catcatttgtctgtgtttagta

SEQ ID NO: 1263648 - DNA, 22 bp, Artificial Sequence
  chemically synthesized
tcttttatcttactaaacacag

SEQ ID NO: 1263649 - DNA, 22 bp, Artificial Sequence
  chemically synthesized
tccatcatttgtctgtgtttag

SEQ ID NO: 1263650 - DNA, 22 bp, Artificial Sequence
  chemically synthesized
cttttatcttactaaacacaga

SEQ ID NO: 1263651 - DNA, 22 bp, Artificial Sequence
  chemically synthesized
ctccatcatttgtctgtgttta

SEQ ID NO: 1263652 - DNA, 22 bp, Artificial Sequence
  chemically synthesized
ttttatcttactaaacacagac

SEQ ID NO: 1263653 - DNA, 22 bp, Artificial Sequence
  chemically synthesized
tctccatcatttgtctgtgttt

SEQ ID NO: 1263654 - DNA, 22 bp, Artificial Sequence
  chemically synthesized
ttctccatcatttgtctgtgtt

SEQ ID NO: 1263655 - DNA, 22 bp, Artificial Sequence
  chemically synthesized
ttatcttactaaacacagacaa

SEQ ID NO: 1263656 - DNA, 22 bp, Artificial Sequence
  chemically synthesized
tttctccatcatttgtctgtgt

SEQ ID NO: 1263657 - DNA, 22 bp, Artificial Sequence
  chemically synthesized
tatcttactaaacacagacaaa

SEQ ID NO: 1263658 - DNA, 22 bp, Artificial Sequence
  chemically synthesized
atcttactaaacacagacaaat

SEQ ID NO: 1263659 - DNA, 22 bp, Artificial Sequence
  chemically synthesized
tcttactaaacacagacaaatg

SEQ ID NO: 1263660 - DNA, 22 bp, Artificial Sequence
  chemically synthesized
actaaacacagacaaatgatgg

SEQ ID NO: 1263661 - DNA, 22 bp, Artificial Sequence
  chemically synthesized
ctaaacacagacaaatgatgga

SEQ ID NO: 1263662 - DNA, 22 bp, Artificial Sequence
  chemically synthesized
acagactttttctccatcattt

SEQ ID NO: 1263663 - DNA, 22 bp, Artificial Sequence
  chemically synthesized
aacagactttttctccatcatt

SEQ ID NO: 1263664 - DNA, 22 bp, Artificial Sequence
  chemically synthesized
aacacagacaaatgatggagaa

SEQ ID NO: 1263665 - DNA, 22 bp, Artificial Sequence
  chemically synthesized
cttaacagactttttctccatc

SEQ ID NO: 1263666 - DNA, 22 bp, Artificial Sequence
  chemically synthesized
gcttaacagactttttctccat

SEQ ID NO: 1263667 - DNA, 22 bp, Artificial Sequence
  chemically synthesized
aataatccaagacagtatgcat

SEQ ID NO: 1263668 - DNA, 22 bp, Artificial Sequence
  chemically synthesized
aaataatccaagacagtatgca

SEQ ID NO: 1263669 - DNA, 22 bp, Artificial Sequence
  chemically synthesized
ttaagcaaatgcatactgtctt

SEQ ID NO: 1263670 - DNA, 22 bp, Artificial Sequence
  chemically synthesized
agcaaatgcatactgtcttgga

SEQ ID NO: 1263671 - DNA, 22 bp, Artificial Sequence
  chemically synthesized
aatacccgaaaacttaaataat

SEQ ID NO: 1263672 - DNA, 22 bp, Artificial Sequence
  chemically synthesized
tcttggattatttaagttttcg

SEQ ID NO: 1263673 - DNA, 22 bp, Artificial Sequence
  chemically synthesized
ggattatttaagttttcgggta

SEQ ID NO: 1263674 - DNA, 22 bp, Artificial Sequence
  chemically synthesized
gattatttaagttttcgggtat

SEQ ID NO: 1263675 - DNA, 22 bp, Artificial Sequence
  chemically synthesized
ggaaatcaacctaaatacccga

SEQ ID NO: 1263676 - DNA, 22 bp, Artificial Sequence
  chemically synthesized
tttaagttttcgggtatttagg

SEQ ID NO: 1263677 - DNA, 22 bp, Artificial Sequence
  chemically synthesized
gttgggaaatcaacctaaatac

SEQ ID NO: 1263678 - DNA, 22 bp, Artificial Sequence
  chemically synthesized
aagttttcgggtatttaggttg

SEQ ID NO: 1263679 - DNA, 22 bp, Artificial Sequence
  chemically synthesized
agttttcgggtatttaggttga

SEQ ID NO: 1263680 - DNA, 22 bp, Artificial Sequence
  chemically synthesized
tcgggtatttaggttgatttcc

SEQ ID NO: 1263681 - DNA, 22 bp, Artificial Sequence
  chemically synthesized
cgggtatttaggttgatttccc

SEQ ID NO: 1263682 - DNA, 22 bp, Artificial Sequence
  chemically synthesized
gggtatttaggttgatttccca

SEQ ID NO: 1263683 - DNA, 22 bp, Artificial Sequence
  chemically synthesized
caggatatcctagttgggaaat

SEQ ID NO: 1263684 - DNA, 22 bp, Artificial Sequence
  chemically synthesized
ccaggatatcctagttgggaaa

SEQ ID NO: 1263685 - DNA, 22 bp, Artificial Sequence
  chemically synthesized
tttccaggatatcctagttggg

SEQ ID NO: 1263686 - DNA, 22 bp, Artificial Sequence
  chemically synthesized
aggttgatttcccaactaggat

SEQ ID NO: 1263687 - DNA, 22 bp, Artificial Sequence
  chemically synthesized
ggttgatttcccaactaggata

SEQ ID NO: 1263688 - DNA, 22 bp, Artificial Sequence
  chemically synthesized
aatctgtttccaggatatccta

SEQ ID NO: 1263689 - DNA, 22 bp, Artificial Sequence
  chemically synthesized
atttcccaactaggatatcctg

SEQ ID NO: 1263690 - DNA, 22 bp, Artificial Sequence
  chemically synthesized
cattaaatctgtttccaggata

SEQ ID NO: 1263691 - DNA, 22 bp, Artificial Sequence
  chemically synthesized
cccaactaggatatcctggaaa

SEQ ID NO: 1263692 - DNA, 22 bp, Artificial Sequence
  chemically synthesized
acattaaatctgtttccaggat

SEQ ID NO: 1263693 - DNA, 22 bp, Artificial Sequence
  chemically synthesized
ccaactaggatatcctggaaac

SEQ ID NO: 1263694 - DNA, 22 bp, Artificial Sequence
  chemically synthesized
ggatatcctggaaacagattta

SEQ ID NO: 1263695 - DNA, 22 bp, Artificial Sequence
  chemically synthesized
aagggataagatgatttacatt

SEQ ID NO: 1263696 - DNA, 22 bp, Artificial Sequence
  chemically synthesized
gaaacagatttaatgtaaatca

SEQ ID NO: 1263697 - DNA, 22 bp, Artificial Sequence
  chemically synthesized
aagattgaagggataagatgat

SEQ ID NO: 1263698 - DNA, 22 bp, Artificial Sequence
  chemically synthesized
aatgtaaatcatcttatccctt

SEQ ID NO: 1263699 - DNA, 22 bp, Artificial Sequence
  chemically synthesized
atgtaaatcatcttatcccttc

SEQ ID NO: 1263700 - DNA, 22 bp, Artificial Sequence
  chemically synthesized
atacagaatctaaagattgaag

SEQ ID NO: 1263701 - DNA, 22 bp, Artificial Sequence
  chemically synthesized
atcccttcaatctttagattct

SEQ ID NO: 1263702 - DNA, 22 bp, Artificial Sequence
  chemically synthesized
tcccttcaatctttagattctg

SEQ ID NO: 1263703 - DNA, 22 bp, Artificial Sequence
  chemically synthesized
gaaagattaatacagaatctaa

SEQ ID NO: 1263704 - DNA, 22 bp, Artificial Sequence
  chemically synthesized
agaaagattaatacagaatcta

SEQ ID NO: 1263705 - DNA, 22 bp, Artificial Sequence
  chemically synthesized
tagaaagattaatacagaatct

SEQ ID NO: 1263706 - DNA, 22 bp, Artificial Sequence
  chemically synthesized
ttagaaagattaatacagaatc

SEQ ID NO: 1263707 - DNA, 22 bp, Artificial Sequence
  chemically synthesized
caatctttagattctgtattaa

SEQ ID NO: 1263708 - DNA, 22 bp, Artificial Sequence
  chemically synthesized
aatctttagattctgtattaat

SEQ ID NO: 1263709 - DNA, 22 bp, Artificial Sequence
  chemically synthesized
tagattctgtattaatctttct

SEQ ID NO: 1263710 - DNA, 22 bp, Artificial Sequence
  chemically synthesized
agattctgtattaatctttcta

SEQ ID NO: 1263711 - DNA, 22 bp, Artificial Sequence
  chemically synthesized
gattctgtattaatctttctaa

SEQ ID NO: 1263712 - DNA, 22 bp, Artificial Sequence
  chemically synthesized
tgtattaatctttctaaaaatt

SEQ ID NO: 1263713 - DNA, 22 bp, Artificial Sequence
  chemically synthesized
tattaatctttctaaaaatttg

SEQ ID NO: 1263714 - DNA, 22 bp, Artificial Sequence
  chemically synthesized
cagaagaacataagagcaaatt

SEQ ID NO: 1263715 - DNA, 22 bp, Artificial Sequence
  chemically synthesized
atctttctaaaaatttgctctt

SEQ ID NO: 1263716 - DNA, 22 bp, Artificial Sequence
  chemically synthesized
tctaaaaatttgctcttatgtt

SEQ ID NO: 1263717 - DNA, 22 bp, Artificial Sequence
  chemically synthesized
ctaaaaatttgctcttatgttc

SEQ ID NO: 1263718 - DNA, 22 bp, Artificial Sequence
  chemically synthesized
taaaaatttgctcttatgttct

SEQ ID NO: 1263719 - DNA, 22 bp, Artificial Sequence
  chemically synthesized
aaaatttgctcttatgttcttc

SEQ ID NO: 1263720 - DNA, 22 bp, Artificial Sequence
  chemically synthesized
gggatataaatgttccagaaga

SEQ ID NO: 1263721 - DNA, 22 bp, Artificial Sequence
  chemically synthesized
gctcttatgttcttctggaaca

SEQ ID NO: 1263722 - DNA, 22 bp, Artificial Sequence
  chemically synthesized
ctcttatgttcttctggaacat

SEQ ID NO: 1263723 - DNA, 22 bp, Artificial Sequence
  chemically synthesized
ttagggatataaatgttccaga

SEQ ID NO: 1263724 - DNA, 22 bp, Artificial Sequence
  chemically synthesized
ttatgttcttctggaacattta

SEQ ID NO: 1263725 - DNA, 22 bp, Artificial Sequence
  chemically synthesized
atgttcttctggaacatttata

SEQ ID NO: 1263726 - DNA, 22 bp, Artificial Sequence
  chemically synthesized
tgttcttctggaacatttatat

SEQ ID NO: 1263727 - DNA, 22 bp, Artificial Sequence
  chemically synthesized
ccatccctattagggatataaa

SEQ ID NO: 1263728 - DNA, 22 bp, Artificial Sequence
  chemically synthesized
accatccctattagggatataa

SEQ ID NO: 1263729 - DNA, 22 bp, Artificial Sequence
  chemically synthesized
ttctggaacatttatatcccta

SEQ ID NO: 1263730 - DNA, 22 bp, Artificial Sequence
  chemically synthesized
ctggaacatttatatccctaat

SEQ ID NO: 1263731 - DNA, 22 bp, Artificial Sequence
  chemically synthesized
tggaacatttatatccctaata

SEQ ID NO: 1263732 - DNA, 22 bp, Artificial Sequence
  chemically synthesized
gaacatttatatccctaatagg

SEQ ID NO: 1263733 - DNA, 22 bp, Artificial Sequence
  chemically synthesized
tcagatttaccatccctattag

SEQ ID NO: 1263734 - DNA, 22 bp, Artificial Sequence
  chemically synthesized
atatccctaatagggatggtaa

SEQ ID NO: 1263735 - DNA, 22 bp, Artificial Sequence
  chemically synthesized
tatccctaatagggatggtaaa

SEQ ID NO: 1263736 - DNA, 22 bp, Artificial Sequence
  chemically synthesized
aatatcagattatcagatttac

SEQ ID NO: 1263737 - DNA, 22 bp, Artificial Sequence
  chemically synthesized
gaatatcagattatcagattta

SEQ ID NO: 1263738 - DNA, 22 bp, Artificial Sequence
  chemically synthesized
atagggatggtaaatctgataa

SEQ ID NO: 1263739 - DNA, 22 bp, Artificial Sequence
  chemically synthesized
ccttgaatatcagattatcaga

SEQ ID NO: 1263740 - DNA, 22 bp, Artificial Sequence
  chemically synthesized
ataatctgatattcaaggtagc

SEQ ID NO: 1263741 - DNA, 22 bp, Artificial Sequence
  chemically synthesized
atattcaaggtagcatggtgca

SEQ ID NO: 1263742 - DNA, 22 bp, Artificial Sequence
  chemically synthesized
aaggtagcatggtgcacacacg

SEQ ID NO: 1263743 - DNA, 22 bp, Artificial Sequence
  chemically synthesized
aatcaaataatccgtgtgtgca

SEQ ID NO: 1263744 - DNA, 22 bp, Artificial Sequence
  chemically synthesized
taaatcaaataatccgtgtgtg

SEQ ID NO: 1263745 - DNA, 22 bp, Artificial Sequence
  chemically synthesized
ctaaatcaaataatccgtgtgt

SEQ ID NO: 1263746 - DNA, 22 bp, Artificial Sequence
  chemically synthesized
tctaaatcaaataatccgtgtg

SEQ ID NO: 1263747 - DNA, 22 bp, Artificial Sequence
  chemically synthesized
ttctaaatcaaataatccgtgt

SEQ ID NO: 1263748 - DNA, 22 bp, Artificial Sequence
  chemically synthesized
tttctaaatcaaataatccgtg

SEQ ID NO: 1263749 - DNA, 22 bp, Artificial Sequence
  chemically synthesized
ttttctaaatcaaataatccgt

SEQ ID NO: 1263750 - DNA, 22 bp, Artificial Sequence
  chemically synthesized
tttttctaaatcaaataatccg

SEQ ID NO: 1263751 - DNA, 22 bp, Artificial Sequence
  chemically synthesized
ttttttttctaaatcaaataat

SEQ ID NO: 1263752 - DNA, 22 bp, Artificial Sequence
  chemically synthesized
tttgatttagaaaaaaaataga

SEQ ID NO: 1263753 - DNA, 22 bp, Artificial Sequence
  chemically synthesized
gggaaacacatgtctatttttt

SEQ ID NO: 1263754 - DNA, 22 bp, Artificial Sequence
  chemically synthesized
gatttagaaaaaaaatagacat

SEQ ID NO: 1263755 - DNA, 22 bp, Artificial Sequence
  chemically synthesized
atttagaaaaaaaatagacatg

SEQ ID NO: 1263756 - DNA, 22 bp, Artificial Sequence
  chemically synthesized
agaaaaaaaatagacatgtgtt

SEQ ID NO: 1263757 - DNA, 22 bp, Artificial Sequence
  chemically synthesized
gaaaaaaaatagacatgtgttt

SEQ ID NO: 1263758 - DNA, 22 bp, Artificial Sequence
  chemically synthesized
caagcggttagggaaacacatg

SEQ ID NO: 1263759 - DNA, 22 bp, Artificial Sequence
  chemically synthesized
acaagcggttagggaaacacat

SEQ ID NO: 1263760 - DNA, 22 bp, Artificial Sequence
  chemically synthesized
tacaagcggttagggaaacaca

SEQ ID NO: 1263761 - DNA, 22 bp, Artificial Sequence
  chemically synthesized
cattttacaagcggttagggaa

SEQ ID NO: 1263762 - DNA, 22 bp, Artificial Sequence
  chemically synthesized
tatacatgctgcattttacaag

SEQ ID NO: 1263763 - DNA, 22 bp, Artificial Sequence
  chemically synthesized
atatacatgctgcattttacaa

SEQ ID NO: 1263764 - DNA, 22 bp, Artificial Sequence
  chemically synthesized
ccctaaccgcttgtaaaatgca

SEQ ID NO: 1263765 - DNA, 22 bp, Artificial Sequence
  chemically synthesized
cctaaccgcttgtaaaatgcag

SEQ ID NO: 1263766 - DNA, 22 bp, Artificial Sequence
  chemically synthesized
accgcttgtaaaatgcagcatg

SEQ ID NO: 1263767 - DNA, 22 bp, Artificial Sequence
  chemically synthesized
gtaaaatgcagcatgtatataa

SEQ ID NO: 1263768 - DNA, 22 bp, Artificial Sequence
  chemically synthesized
taaaatgcagcatgtatataaa

SEQ ID NO: 1263769 - DNA, 22 bp, Artificial Sequence
  chemically synthesized
atacatgagatgatttatatac

SEQ ID NO: 1263770 - DNA, 22 bp, Artificial Sequence
  chemically synthesized
cctaatacatgagatgatttat

SEQ ID NO: 1263771 - DNA, 22 bp, Artificial Sequence
  chemically synthesized
ggaaaatggaaactgcctaata

SEQ ID NO: 1263772 - DNA, 22 bp, Artificial Sequence
  chemically synthesized
gggaaaatggaaactgcctaat

SEQ ID NO: 1263773 - DNA, 22 bp, Artificial Sequence
  chemically synthesized
tgggaaaatggaaactgcctaa

SEQ ID NO: 1263774 - DNA, 22 bp, Artificial Sequence
  chemically synthesized
ttgggaaaatggaaactgccta

SEQ ID NO: 1263775 - DNA, 22 bp, Artificial Sequence
  chemically synthesized
ttttgggaaaatggaaactgcc

SEQ ID NO: 1263776 - DNA, 22 bp, Artificial Sequence
  chemically synthesized
cttttgggaaaatggaaactgc

SEQ ID NO: 1263777 - DNA, 22 bp, Artificial Sequence
  chemically synthesized
tcttttgggaaaatggaaactg

SEQ ID NO: 1263778 - DNA, 22 bp, Artificial Sequence
  chemically synthesized
atgtattaggcagtttccattt

SEQ ID NO: 1263779 - DNA, 22 bp, Artificial Sequence
  chemically synthesized
ggcagtttccattttcccaaaa

SEQ ID NO: 1263780 - DNA, 22 bp, Artificial Sequence
  chemically synthesized
acaggcatattttcttttggga

SEQ ID NO: 1263781 - DNA, 22 bp, Artificial Sequence
  chemically synthesized
ccattttcccaaaagaaaatat

SEQ ID NO: 1263782 - DNA, 22 bp, Artificial Sequence
  chemically synthesized
cattttcccaaaagaaaatatg

SEQ ID NO: 1263783 - DNA, 22 bp, Artificial Sequence
  chemically synthesized
agggctcacaggcatattttct

SEQ ID NO: 1263784 - DNA, 22 bp, Artificial Sequence
  chemically synthesized
gagggctcacaggcatattttc

SEQ ID NO: 1263785 - DNA, 22 bp, Artificial Sequence
  chemically synthesized
tgagggctcacaggcatatttt

SEQ ID NO: 1263786 - DNA, 22 bp, Artificial Sequence
  chemically synthesized
ttgagggctcacaggcatattt

SEQ ID NO: 1263787 - DNA, 22 bp, Artificial Sequence
  chemically synthesized
tcccaaaagaaaatatgcctgt

SEQ ID NO: 1263788 - DNA, 22 bp, Artificial Sequence
  chemically synthesized
cccaaaagaaaatatgcctgtg

SEQ ID NO: 1263789 - DNA, 22 bp, Artificial Sequence
  chemically synthesized
ccaaaagaaaatatgcctgtga

SEQ ID NO: 1263790 - DNA, 22 bp, Artificial Sequence
  chemically synthesized
aaatatttttgagggctcacag

SEQ ID NO: 1263791 - DNA, 22 bp, Artificial Sequence
  chemically synthesized
gcctaaaatatttttgagggct

SEQ ID NO: 1263792 - DNA, 22 bp, Artificial Sequence
  chemically synthesized
tgagccctcaaaaatattttag

SEQ ID NO: 1263793 - DNA, 22 bp, Artificial Sequence
  chemically synthesized
tgtatacatgttggcctaaaat

SEQ ID NO: 1263794 - DNA, 22 bp, Artificial Sequence
  chemically synthesized
gtgtatacatgttggcctaaaa

SEQ ID NO: 1263795 - DNA, 22 bp, Artificial Sequence
  chemically synthesized
tgtgtatacatgttggcctaaa

SEQ ID NO: 1263796 - DNA, 22 bp, Artificial Sequence
  chemically synthesized
aaaaatattttaggccaacatg

SEQ ID NO: 1263797 - DNA, 22 bp, Artificial Sequence
  chemically synthesized
aaattttgtgtatacatgttgg

SEQ ID NO: 1263798 - DNA, 22 bp, Artificial Sequence
  chemically synthesized
taggccaacatgtatacacaaa

SEQ ID NO: 1263799 - DNA, 22 bp, Artificial Sequence
  chemically synthesized
aagtcctaaaattttgtgtata

SEQ ID NO: 1263800 - DNA, 22 bp, Artificial Sequence
  chemically synthesized
aggccaacatgtatacacaaaa

SEQ ID NO: 1263801 - DNA, 22 bp, Artificial Sequence
  chemically synthesized
ggccaacatgtatacacaaaat

SEQ ID NO: 1263802 - DNA, 22 bp, Artificial Sequence
  chemically synthesized
ctaaagtcctaaaattttgtgt

SEQ ID NO: 1263803 - DNA, 22 bp, Artificial Sequence
  chemically synthesized
gctaaagtcctaaaattttgtg

SEQ ID NO: 1263804 - DNA, 22 bp, Artificial Sequence
  chemically synthesized
tatatatttgctaaagtcctaa

SEQ ID NO: 1263805 - DNA, 22 bp, Artificial Sequence
  chemically synthesized
attatatatatttgctaaagtc

SEQ ID NO: 1263806 - DNA, 22 bp, Artificial Sequence
  chemically synthesized
taggactttagcaaatatatat

SEQ ID NO: 1263807 - DNA, 22 bp, Artificial Sequence
  chemically synthesized
aggactttagcaaatatatata

SEQ ID NO: 1263808 - DNA, 22 bp, Artificial Sequence
  chemically synthesized
ggactttagcaaatatatataa

SEQ ID NO: 1263809 - DNA, 22 bp, Artificial Sequence
  chemically synthesized
tagcaaatatatataatcaatt

SEQ ID NO: 1263810 - DNA, 22 bp, Artificial Sequence
  chemically synthesized
agcaaatatatataatcaattg

SEQ ID NO: 1263811 - DNA, 22 bp, Artificial Sequence
  chemically synthesized
gcaaatatatataatcaattgt

SEQ ID NO: 1263812 - DNA, 22 bp, Artificial Sequence
  chemically synthesized
tcaaaatcatgcatacaattga

SEQ ID NO: 1263813 - DNA, 22 bp, Artificial Sequence
  chemically synthesized
atcaaaatcatgcatacaattg

SEQ ID NO: 1263814 - DNA, 22 bp, Artificial Sequence
  chemically synthesized
ttatcaaaatcatgcatacaat

SEQ ID NO: 1263815 - DNA, 22 bp, Artificial Sequence
  chemically synthesized
cttatcaaaatcatgcatacaa

SEQ ID NO: 1263816 - DNA, 22 bp, Artificial Sequence
  chemically synthesized
atggcatcaatttcttatcaaa

SEQ ID NO: 1263817 - DNA, 22 bp, Artificial Sequence
  chemically synthesized
tatgcatgattttgataagaaa

SEQ ID NO: 1263818 - DNA, 22 bp, Artificial Sequence
  chemically synthesized
tcatagaaaattaatggcatca

SEQ ID NO: 1263819 - DNA, 22 bp, Artificial Sequence
  chemically synthesized
tgataagaaattgatgccatta

SEQ ID NO: 1263820 - DNA, 22 bp, Artificial Sequence
  chemically synthesized
atcatagaaaattaatggcatc

SEQ ID NO: 1263821 - DNA, 22 bp, Artificial Sequence
  chemically synthesized
gataagaaattgatgccattaa

SEQ ID NO: 1263822 - DNA, 22 bp, Artificial Sequence
  chemically synthesized
tatcatagaaaattaatggcat

SEQ ID NO: 1263823 - DNA, 22 bp, Artificial Sequence
  chemically synthesized
ataagaaattgatgccattaat

SEQ ID NO: 1263824 - DNA, 22 bp, Artificial Sequence
  chemically synthesized
ttatcatagaaaattaatggca

SEQ ID NO: 1263825 - DNA, 22 bp, Artificial Sequence
  chemically synthesized
atatttttatcatagaaaatta

SEQ ID NO: 1263826 - DNA, 22 bp, Artificial Sequence
  chemically synthesized
aatatttttatcatagaaaatt

SEQ ID NO: 1263827 - DNA, 22 bp, Artificial Sequence
  chemically synthesized
atgccattaattttctatgata

SEQ ID NO: 1263828 - DNA, 22 bp, Artificial Sequence
  chemically synthesized
attttctatgataaaaatatta

SEQ ID NO: 1263829 - DNA, 22 bp, Artificial Sequence
  chemically synthesized
tctatgataaaaatattaaata

SEQ ID NO: 1263830 - DNA, 22 bp, Artificial Sequence
  chemically synthesized
ctatgataaaaatattaaatat

SEQ ID NO: 1263831 - DNA, 22 bp, Artificial Sequence
  chemically synthesized
tatgataaaaatattaaatatt

SEQ ID NO: 1263832 - DNA, 22 bp, Artificial Sequence
  chemically synthesized
tgataaaaatattaaatatttt

SEQ ID NO: 1263833 - DNA, 22 bp, Artificial Sequence
  chemically synthesized
tatgatataaatatgaaatata

SEQ ID NO: 1263834 - DNA, 22 bp, Artificial Sequence
  chemically synthesized
atatgatataaatatgaaatat

SEQ ID NO: 1263835 - DNA, 22 bp, Artificial Sequence
  chemically synthesized
tatatgatataaatatgaaata

SEQ ID NO: 1263836 - DNA, 22 bp, Artificial Sequence
  chemically synthesized
aatatttttatatttcatattt

SEQ ID NO: 1263837 - DNA, 22 bp, Artificial Sequence
  chemically synthesized
atgttttatatgatataaatat

SEQ ID NO: 1263838 - DNA, 22 bp, Artificial Sequence
  chemically synthesized
taatgttttatatgatataaat

SEQ ID NO: 1263839 - DNA, 22 bp, Artificial Sequence
  chemically synthesized
ttatatttcatatttatatcat

SEQ ID NO: 1263840 - DNA, 22 bp, Artificial Sequence
  chemically synthesized
ctaatgttttatatgatataaa

SEQ ID NO: 1263841 - DNA, 22 bp, Artificial Sequence
  chemically synthesized
tatatttcatatttatatcata

SEQ ID NO: 1263842 - DNA, 22 bp, Artificial Sequence
  chemically synthesized
atatttcatatttatatcatat

SEQ ID NO: 1263843 - DNA, 22 bp, Artificial Sequence
  chemically synthesized
tatttcatatttatatcatata

SEQ ID NO: 1263844 - DNA, 22 bp, Artificial Sequence
  chemically synthesized
atatttctaatgttttatatga

SEQ ID NO: 1263845 - DNA, 22 bp, Artificial Sequence
  chemically synthesized
catatttatatcatataaaaca

SEQ ID NO: 1263846 - DNA, 22 bp, Artificial Sequence
  chemically synthesized
taatatttctaatgttttatat

SEQ ID NO: 1263847 - DNA, 22 bp, Artificial Sequence
  chemically synthesized
atatttatatcatataaaacat

SEQ ID NO: 1263848 - DNA, 22 bp, Artificial Sequence
  chemically synthesized
ctaatatttctaatgttttata

SEQ ID NO: 1263849 - DNA, 22 bp, Artificial Sequence
  chemically synthesized
atatcatataaaacattagaaa

SEQ ID NO: 1263850 - DNA, 22 bp, Artificial Sequence
  chemically synthesized
tatcatataaaacattagaaat

SEQ ID NO: 1263851 - DNA, 22 bp, Artificial Sequence
  chemically synthesized
aaaaacatgccagcatttctaa

SEQ ID NO: 1263852 - DNA, 22 bp, Artificial Sequence
  chemically synthesized
gaaatattagaaatgctggcat

SEQ ID NO: 1263853 - DNA, 22 bp, Artificial Sequence
  chemically synthesized
gaaatgctggcatgttttttag

SEQ ID NO: 1263854 - DNA, 22 bp, Artificial Sequence
  chemically synthesized
atgaaatgcgagactaaaaaac

SEQ ID NO: 1263855 - DNA, 22 bp, Artificial Sequence
  chemically synthesized
catgaaatgcgagactaaaaaa

SEQ ID NO: 1263856 - DNA, 22 bp, Artificial Sequence
  chemically synthesized
gcatgttttttagtctcgcatt

SEQ ID NO: 1263857 - DNA, 22 bp, Artificial Sequence
  chemically synthesized
tttagtctcgcatttcatgaaa

SEQ ID NO: 1263858 - DNA, 22 bp, Artificial Sequence
  chemically synthesized
ttagtctcgcatttcatgaaat

SEQ ID NO: 1263859 - DNA, 22 bp, Artificial Sequence
  chemically synthesized
tagtctcgcatttcatgaaatg

SEQ ID NO: 1263860 - DNA, 22 bp, Artificial Sequence
  chemically synthesized
agtctcgcatttcatgaaatga

SEQ ID NO: 1263861 - DNA, 22 bp, Artificial Sequence
  chemically synthesized
gtctcgcatttcatgaaatgac

SEQ ID NO: 1263862 - DNA, 22 bp, Artificial Sequence
  chemically synthesized
aaagagatcgaataaagtcatt

SEQ ID NO: 1263863 - DNA, 22 bp, Artificial Sequence
  chemically synthesized
gcatttcatgaaatgactttat

SEQ ID NO: 1263864 - DNA, 22 bp, Artificial Sequence
  chemically synthesized
caaagagatcgaataaagtcat

SEQ ID NO: 1263865 - DNA, 22 bp, Artificial Sequence
  chemically synthesized
tcaaagagatcgaataaagtca

SEQ ID NO: 1263866 - DNA, 22 bp, Artificial Sequence
  chemically synthesized
catgaaatgactttattcgatc

SEQ ID NO: 1263867 - DNA, 22 bp, Artificial Sequence
  chemically synthesized
atgaaatgactttattcgatct

SEQ ID NO: 1263868 - DNA, 22 bp, Artificial Sequence
  chemically synthesized
aaagtagctttcaaagagatcg

SEQ ID NO: 1263869 - DNA, 22 bp, Artificial Sequence
  chemically synthesized
cctcaaagtagctttcaaagag

SEQ ID NO: 1263870 - DNA, 22 bp, Artificial Sequence
  chemically synthesized
tattcgatctctttgaaagcta

SEQ ID NO: 1263871 - DNA, 22 bp, Artificial Sequence
  chemically synthesized
attcgatctctttgaaagctac

SEQ ID NO: 1263872 - DNA, 22 bp, Artificial Sequence
  chemically synthesized
ttcgatctctttgaaagctact

SEQ ID NO: 1263873 - DNA, 22 bp, Artificial Sequence
  chemically synthesized
gatctctttgaaagctactttg

SEQ ID NO: 1263874 - DNA, 22 bp, Artificial Sequence
  chemically synthesized
tttgaaagctactttgaggtaa

SEQ ID NO: 1263875 - DNA, 22 bp, Artificial Sequence
  chemically synthesized
tgaaagctactttgaggtaatt

SEQ ID NO: 1263876 - DNA, 22 bp, Artificial Sequence
  chemically synthesized
gaaagctactttgaggtaattt

SEQ ID NO: 1263877 - DNA, 22 bp, Artificial Sequence
  chemically synthesized
tgacaaagaaaaaaattacctc

SEQ ID NO: 1263878 - DNA, 22 bp, Artificial Sequence
  chemically synthesized
aaagctactttgaggtaatttt

SEQ ID NO: 1263879 - DNA, 22 bp, Artificial Sequence
  chemically synthesized
atgacaaagaaaaaaattacct

SEQ ID NO: 1263880 - DNA, 22 bp, Artificial Sequence
  chemically synthesized
ttatgacaaagaaaaaaattac

SEQ ID NO: 1263881 - DNA, 22 bp, Artificial Sequence
  chemically synthesized
ctttgaggtaatttttttcttt

SEQ ID NO: 1263882 - DNA, 22 bp, Artificial Sequence
  chemically synthesized
tgaggtaatttttttctttgtc

SEQ ID NO: 1263883 - DNA, 22 bp, Artificial Sequence
  chemically synthesized
gaggtaatttttttctttgtca

SEQ ID NO: 1263884 - DNA, 22 bp, Artificial Sequence
  chemically synthesized
aggtaatttttttctttgtcat

SEQ ID NO: 1263885 - DNA, 22 bp, Artificial Sequence
  chemically synthesized
aaaaaaggggttcttatgacaa

SEQ ID NO: 1263886 - DNA, 22 bp, Artificial Sequence
  chemically synthesized
ttttctttgtcataagaacccc

SEQ ID NO: 1263887 - DNA, 22 bp, Artificial Sequence
  chemically synthesized
tttctttgtcataagaacccct

SEQ ID NO: 1263888 - DNA, 22 bp, Artificial Sequence
  chemically synthesized
ttctttgtcataagaacccctt

SEQ ID NO: 1263889 - DNA, 22 bp, Artificial Sequence
  chemically synthesized
tctttgtcataagaaccccttt

SEQ ID NO: 1263890 - DNA, 22 bp, Artificial Sequence
  chemically synthesized
ctttgtcataagaacccctttt

SEQ ID NO: 1263891 - DNA, 22 bp, Artificial Sequence
  chemically synthesized
gatgacattaaaaaaaggggtt

SEQ ID NO: 1263892 - DNA, 22 bp, Artificial Sequence
  chemically synthesized
tttgtcataagaaccccttttt

SEQ ID NO: 1263893 - DNA, 22 bp, Artificial Sequence
  chemically synthesized
tagatgacattaaaaaaagggg

SEQ ID NO: 1263894 - DNA, 22 bp, Artificial Sequence
  chemically synthesized
tgtcataagaaccccttttttt

SEQ ID NO: 1263895 - DNA, 22 bp, Artificial Sequence
  chemically synthesized
ctagatgacattaaaaaaaggg

SEQ ID NO: 1263896 - DNA, 22 bp, Artificial Sequence
  chemically synthesized
gtcataagaaccccttttttta

SEQ ID NO: 1263897 - DNA, 22 bp, Artificial Sequence
  chemically synthesized
tcataagaacccctttttttaa

SEQ ID NO: 1263898 - DNA, 22 bp, Artificial Sequence
  chemically synthesized
aaaaaagcttctagatgacatt

SEQ ID NO: 1263899 - DNA, 22 bp, Artificial Sequence
  chemically synthesized
tgaaaaaagcttctagatgaca

SEQ ID NO: 1263900 - DNA, 22 bp, Artificial Sequence
  chemically synthesized
tttttaatgtcatctagaagct

SEQ ID NO: 1263901 - DNA, 22 bp, Artificial Sequence
  chemically synthesized
ttttaatgtcatctagaagctt

SEQ ID NO: 1263902 - DNA, 22 bp, Artificial Sequence
  chemically synthesized
tttaatgtcatctagaagcttt

SEQ ID NO: 1263903 - DNA, 22 bp, Artificial Sequence
  chemically synthesized
ttaatgtcatctagaagctttt

SEQ ID NO: 1263904 - DNA, 22 bp, Artificial Sequence
  chemically synthesized
atgggttctgaaaaaagcttct

SEQ ID NO: 1263905 - DNA, 22 bp, Artificial Sequence
  chemically synthesized
taatgtcatctagaagcttttt

SEQ ID NO: 1263906 - DNA, 22 bp, Artificial Sequence
  chemically synthesized
aatgtcatctagaagctttttt

SEQ ID NO: 1263907 - DNA, 22 bp, Artificial Sequence
  chemically synthesized
atgtcatctagaagcttttttc

SEQ ID NO: 1263908 - DNA, 22 bp, Artificial Sequence
  chemically synthesized
gaaatggagttgatgggttctg

SEQ ID NO: 1263909 - DNA, 22 bp, Artificial Sequence
  chemically synthesized
gaagcttttttcagaacccatc

SEQ ID NO: 1263910 - DNA, 22 bp, Artificial Sequence
  chemically synthesized
ttttcagaacccatcaactcca

SEQ ID NO: 1263911 - DNA, 22 bp, Artificial Sequence
  chemically synthesized
tgtagctggaaatggagttgat

SEQ ID NO: 1263912 - DNA, 22 bp, Artificial Sequence
  chemically synthesized
tttcagaacccatcaactccat

SEQ ID NO: 1263913 - DNA, 22 bp, Artificial Sequence
  chemically synthesized
atgtagctggaaatggagttga

SEQ ID NO: 1263914 - DNA, 22 bp, Artificial Sequence
  chemically synthesized
ttcagaacccatcaactccatt

SEQ ID NO: 1263915 - DNA, 22 bp, Artificial Sequence
  chemically synthesized
tcagaacccatcaactccattt

SEQ ID NO: 1263916 - DNA, 22 bp, Artificial Sequence
  chemically synthesized
cagaacccatcaactccatttc

SEQ ID NO: 1263917 - DNA, 22 bp, Artificial Sequence
  chemically synthesized
agaacccatcaactccatttcc

SEQ ID NO: 1263918 - DNA, 22 bp, Artificial Sequence
  chemically synthesized
aacttatgtagctggaaatgga

SEQ ID NO: 1263919 - DNA, 22 bp, Artificial Sequence
  chemically synthesized
tctcaacttatgtagctggaaa

SEQ ID NO: 1263920 - DNA, 22 bp, Artificial Sequence
  chemically synthesized
atctcaacttatgtagctggaa

SEQ ID NO: 1263921 - DNA, 22 bp, Artificial Sequence
  chemically synthesized
catttccagctacataagttga

SEQ ID NO: 1263922 - DNA, 22 bp, Artificial Sequence
  chemically synthesized
acaaagtaatttatctcaactt

SEQ ID NO: 1263923 - DNA, 22 bp, Artificial Sequence
  chemically synthesized
ccagctacataagttgagataa

SEQ ID NO: 1263924 - DNA, 22 bp, Artificial Sequence
  chemically synthesized
cagctacataagttgagataaa

SEQ ID NO: 1263925 - DNA, 22 bp, Artificial Sequence
  chemically synthesized
cataagttgagataaattactt

SEQ ID NO: 1263926 - DNA, 22 bp, Artificial Sequence
  chemically synthesized
agataaattactttgtgaatat

SEQ ID NO: 1263927 - DNA, 22 bp, Artificial Sequence
  chemically synthesized
tgacgaagagcatacatattca

SEQ ID NO: 1263928 - DNA, 22 bp, Artificial Sequence
  chemically synthesized
atgacgaagagcatacatattc

SEQ ID NO: 1263929 - DNA, 22 bp, Artificial Sequence
  chemically synthesized
tatgacgaagagcatacatatt

SEQ ID NO: 1263930 - DNA, 22 bp, Artificial Sequence
  chemically synthesized
ttatgacgaagagcatacatat

SEQ ID NO: 1263931 - DNA, 22 bp, Artificial Sequence
  chemically synthesized
ctttgtgaatatgtatgctctt

SEQ ID NO: 1263932 - DNA, 22 bp, Artificial Sequence
  chemically synthesized
tgtgaatatgtatgctcttcgt

SEQ ID NO: 1263933 - DNA, 22 bp, Artificial Sequence
  chemically synthesized
gtgaatatgtatgctcttcgtc

SEQ ID NO: 1263934 - DNA, 22 bp, Artificial Sequence
  chemically synthesized
tgaatatgtatgctcttcgtca

SEQ ID NO: 1263935 - DNA, 22 bp, Artificial Sequence
  chemically synthesized
ttcgtcataaaaatttgacctc

SEQ ID NO: 1263936 - DNA, 22 bp, Artificial Sequence
  chemically synthesized
cgtcataaaaatttgacctcac

SEQ ID NO: 1263937 - DNA, 22 bp, Artificial Sequence
  chemically synthesized
gtcataaaaatttgacctcacg

SEQ ID NO: 1263938 - DNA, 22 bp, Artificial Sequence
  chemically synthesized
gcaagcagagtgtggcgtgagg

SEQ ID NO: 1263939 - DNA, 22 bp, Artificial Sequence
  chemically synthesized
ctagcaagcagagtgtggcgtg

SEQ ID NO: 1263940 - DNA, 22 bp, Artificial Sequence
  chemically synthesized
actagcaagcagagtgtggcgt

SEQ ID NO: 1263941 - DNA, 22 bp, Artificial Sequence
  chemically synthesized
ttactagcaagcagagtgtggc

SEQ ID NO: 1263942 - DNA, 22 bp, Artificial Sequence
  chemically synthesized
cttactagcaagcagagtgtgg

SEQ ID NO: 1263943 - DNA, 22 bp, Artificial Sequence
  chemically synthesized
tcttactagcaagcagagtgtg

SEQ ID NO: 1263944 - DNA, 22 bp, Artificial Sequence
  chemically synthesized
gacctcacgccacactctgctt

SEQ ID NO: 1263945 - DNA, 22 bp, Artificial Sequence
  chemically synthesized
acctcacgccacactctgcttg

SEQ ID NO: 1263946 - DNA, 22 bp, Artificial Sequence
  chemically synthesized
acgccacactctgcttgctagt

SEQ ID NO: 1263947 - DNA, 22 bp, Artificial Sequence
  chemically synthesized
tgcttgctagtaagaaagctgt

SEQ ID NO: 1263948 - DNA, 22 bp, Artificial Sequence
  chemically synthesized
cttgctagtaagaaagctgttg

SEQ ID NO: 1263949 - DNA, 22 bp, Artificial Sequence
  chemically synthesized
gctagtaagaaagctgttgttt

SEQ ID NO: 1263950 - DNA, 22 bp, Artificial Sequence
  chemically synthesized
ctagtaagaaagctgttgttta

SEQ ID NO: 1263951 - DNA, 22 bp, Artificial Sequence
  chemically synthesized
gtaagaaagctgttgtttatat

SEQ ID NO: 1263952 - DNA, 22 bp, Artificial Sequence
  chemically synthesized
ttgtttatatttttccccttgt

SEQ ID NO: 1263953 - DNA, 22 bp, Artificial Sequence
  chemically synthesized
tttatatttttccccttgtctt

SEQ ID NO: 1263954 - DNA, 22 bp, Artificial Sequence
  chemically synthesized
atatttttccccttgtcttttg

SEQ ID NO: 1263955 - DNA, 22 bp, Artificial Sequence
  chemically synthesized
acaaatatacaccaaaagacaa

SEQ ID NO: 1263956 - DNA, 22 bp, Artificial Sequence
  chemically synthesized
tatttttccccttgtcttttgg

SEQ ID NO: 1263957 - DNA, 22 bp, Artificial Sequence
  chemically synthesized
aattcacaaatatacaccaaaa

SEQ ID NO: 1263958 - DNA, 22 bp, Artificial Sequence
  chemically synthesized
ttccccttgtcttttggtgtat

SEQ ID NO: 1263959 - DNA, 22 bp, Artificial Sequence
  chemically synthesized
tccccttgtcttttggtgtata

SEQ ID NO: 1263960 - DNA, 22 bp, Artificial Sequence
  chemically synthesized
ccccttgtcttttggtgtatat

SEQ ID NO: 1263961 - DNA, 22 bp, Artificial Sequence
  chemically synthesized
ttgaattcacaaatatacacca

SEQ ID NO: 1263962 - DNA, 22 bp, Artificial Sequence
  chemically synthesized
cccttgtcttttggtgtatatt

SEQ ID NO: 1263963 - DNA, 22 bp, Artificial Sequence
  chemically synthesized
gtcttttggtgtatatttgtga

SEQ ID NO: 1263964 - DNA, 22 bp, Artificial Sequence
  chemically synthesized
tcttttggtgtatatttgtgaa

SEQ ID NO: 1263965 - DNA, 22 bp, Artificial Sequence
  chemically synthesized
ttggtgtatatttgtgaattca

SEQ ID NO: 1263966 - DNA, 22 bp, Artificial Sequence
  chemically synthesized
tggtgtatatttgtgaattcaa

SEQ ID NO: 1263967 - DNA, 22 bp, Artificial Sequence
  chemically synthesized
ggtgtatatttgtgaattcaat

SEQ ID NO: 1263968 - DNA, 22 bp, Artificial Sequence
  chemically synthesized
gtgtatatttgtgaattcaata

SEQ ID NO: 1263969 - DNA, 22 bp, Artificial Sequence
  chemically synthesized
gtgaattcaatagcatgactgc

SEQ ID NO: 1263970 - DNA, 22 bp, Artificial Sequence
  chemically synthesized
tgaattcaatagcatgactgct

SEQ ID NO: 1263971 - DNA, 22 bp, Artificial Sequence
  chemically synthesized
aatagcatgactgcttactgtt

SEQ ID NO: 1263972 - DNA, 22 bp, Artificial Sequence
  chemically synthesized
cgtatccacatatacaaaacag

SEQ ID NO: 1263973 - DNA, 22 bp, Artificial Sequence
  chemically synthesized
cttactgttttgtatatgtgga

SEQ ID NO: 1263974 - DNA, 22 bp, Artificial Sequence
  chemically synthesized
actgttttgtatatgtggatac

SEQ ID NO: 1263975 - DNA, 22 bp, Artificial Sequence
  chemically synthesized
ctgttttgtatatgtggatacg

SEQ ID NO: 1263976 - DNA, 22 bp, Artificial Sequence
  chemically synthesized
ttttgtatatgtggatacgtag

SEQ ID NO: 1263977 - DNA, 22 bp, Artificial Sequence
  chemically synthesized
tgtatatgtggatacgtaggta

SEQ ID NO: 1263978 - DNA, 22 bp, Artificial Sequence
  chemically synthesized
aaaaatcacacatacctacgta

SEQ ID NO: 1263979 - DNA, 22 bp, Artificial Sequence
  chemically synthesized
gtatatgtggatacgtaggtat

SEQ ID NO: 1263980 - DNA, 22 bp, Artificial Sequence
  chemically synthesized
aaaaaatcacacatacctacgt

SEQ ID NO: 1263981 - DNA, 22 bp, Artificial Sequence
  chemically synthesized
tatatgtggatacgtaggtatg

SEQ ID NO: 1263982 - DNA, 22 bp, Artificial Sequence
  chemically synthesized
atgataatttaaaaaatcacac

SEQ ID NO: 1263983 - DNA, 22 bp, Artificial Sequence
  chemically synthesized
ttaatgataatttaaaaaatca

SEQ ID NO: 1263984 - DNA, 22 bp, Artificial Sequence
  chemically synthesized
ggtgtcattgttaatgataatt

SEQ ID NO: 1263985 - DNA, 22 bp, Artificial Sequence
  chemically synthesized
ctaggtgtcattgttaatgata

SEQ ID NO: 1263986 - DNA, 22 bp, Artificial Sequence
  chemically synthesized
gctaggtgtcattgttaatgat

SEQ ID NO: 1263987 - DNA, 22 bp, Artificial Sequence
  chemically synthesized
cttgctaggtgtcattgttaat

SEQ ID NO: 1263988 - DNA, 22 bp, Artificial Sequence
  chemically synthesized
tttaaattatcattaacaatga

SEQ ID NO: 1263989 - DNA, 22 bp, Artificial Sequence
  chemically synthesized
acttgctaggtgtcattgttaa

SEQ ID NO: 1263990 - DNA, 22 bp, Artificial Sequence
  chemically synthesized
ttaaattatcattaacaatgac

SEQ ID NO: 1263991 - DNA, 22 bp, Artificial Sequence
  chemically synthesized
taaattatcattaacaatgaca

SEQ ID NO: 1263992 - DNA, 22 bp, Artificial Sequence
  chemically synthesized
ttacttgctaggtgtcattgtt

SEQ ID NO: 1263993 - DNA, 22 bp, Artificial Sequence
  chemically synthesized
aaattatcattaacaatgacac

SEQ ID NO: 1263994 - DNA, 22 bp, Artificial Sequence
  chemically synthesized
cttacttgctaggtgtcattgt

SEQ ID NO: 1263995 - DNA, 22 bp, Artificial Sequence
  chemically synthesized
aattatcattaacaatgacacc

SEQ ID NO: 1263996 - DNA, 22 bp, Artificial Sequence
  chemically synthesized
atcttcttacttgctaggtgtc

SEQ ID NO: 1263997 - DNA, 22 bp, Artificial Sequence
  chemically synthesized
tcattaacaatgacacctagca

SEQ ID NO: 1263998 - DNA, 22 bp, Artificial Sequence
  chemically synthesized
catcttcttacttgctaggtgt

SEQ ID NO: 1263999 - DNA, 22 bp, Artificial Sequence
  chemically synthesized
acttcatcttcttacttgctag

SEQ ID NO: 1264000 - DNA, 22 bp, Artificial Sequence
  chemically synthesized
acaatgacacctagcaagtaag

SEQ ID NO: 1264001 - DNA, 22 bp, Artificial Sequence
  chemically synthesized
ccaggtatctgacttcatcttc

SEQ ID NO: 1264002 - DNA, 22 bp, Artificial Sequence
  chemically synthesized
ttcccaggtatctgacttcatc

SEQ ID NO: 1264003 - DNA, 22 bp, Artificial Sequence
  chemically synthesized
gcaagtaagaagatgaagtcag

SEQ ID NO: 1264004 - DNA, 22 bp, Artificial Sequence
  chemically synthesized
gattattcccaggtatctgact

SEQ ID NO: 1264005 - DNA, 22 bp, Artificial Sequence
  chemically synthesized
aatgttagattattcccaggta

SEQ ID NO: 1264006 - DNA, 22 bp, Artificial Sequence
  chemically synthesized
aaggcaaatattgaatgttaga

SEQ ID NO: 1264007 - DNA, 22 bp, Artificial Sequence
  chemically synthesized
ggaataatctaacattcaatat

SEQ ID NO: 1264008 - DNA, 22 bp, Artificial Sequence
  chemically synthesized
aaaaactgaaggcaaatattga

SEQ ID NO: 1264009 - DNA, 22 bp, Artificial Sequence
  chemically synthesized
acattcaatatttgccttcagt

SEQ ID NO: 1264010 - DNA, 22 bp, Artificial Sequence
  chemically synthesized
atgaaacggattgaaaaactga

SEQ ID NO: 1264011 - DNA, 22 bp, Artificial Sequence
  chemically synthesized
aatatttgccttcagtttttca

SEQ ID NO: 1264012 - DNA, 22 bp, Artificial Sequence
  chemically synthesized
cctgatgaaacggattgaaaaa

SEQ ID NO: 1264013 - DNA, 22 bp, Artificial Sequence
  chemically synthesized
gccttcagtttttcaatccgtt

SEQ ID NO: 1264014 - DNA, 22 bp, Artificial Sequence
  chemically synthesized
ccttcagtttttcaatccgttt

SEQ ID NO: 1264015 - DNA, 22 bp, Artificial Sequence
  chemically synthesized
cagtttttcaatccgtttcatc

SEQ ID NO: 1264016 - DNA, 22 bp, Artificial Sequence
  chemically synthesized
agtttttcaatccgtttcatca

SEQ ID NO: 1264017 - DNA, 22 bp, Artificial Sequence
  chemically synthesized
taagtaggttacctgatgaaac

SEQ ID NO: 1264018 - DNA, 22 bp, Artificial Sequence
  chemically synthesized
ttcaatccgtttcatcaggtaa

SEQ ID NO: 1264019 - DNA, 22 bp, Artificial Sequence
  chemically synthesized
tcaatccgtttcatcaggtaac

SEQ ID NO: 1264020 - DNA, 22 bp, Artificial Sequence
  chemically synthesized
caatccgtttcatcaggtaacc

SEQ ID NO: 1264021 - DNA, 22 bp, Artificial Sequence
  chemically synthesized
catctgtaagtaggttacctga

SEQ ID NO: 1264022 - DNA, 22 bp, Artificial Sequence
  chemically synthesized
aatccgtttcatcaggtaacct

SEQ ID NO: 1264023 - DNA, 22 bp, Artificial Sequence
  chemically synthesized
acatctgtaagtaggttacctg

SEQ ID NO: 1264024 - DNA, 22 bp, Artificial Sequence
  chemically synthesized
tacatctgtaagtaggttacct

SEQ ID NO: 1264025 - DNA, 22 bp, Artificial Sequence
  chemically synthesized
caagttttacatctgtaagtag

SEQ ID NO: 1264026 - DNA, 22 bp, Artificial Sequence
  chemically synthesized
catcaggtaacctacttacaga

SEQ ID NO: 1264027 - DNA, 22 bp, Artificial Sequence
  chemically synthesized
atcaggtaacctacttacagat

SEQ ID NO: 1264028 - DNA, 22 bp, Artificial Sequence
  chemically synthesized
cttacagatgtaaaacttgcaa

SEQ ID NO: 1264029 - DNA, 22 bp, Artificial Sequence
  chemically synthesized
gaagacaaatcattgcaagttt

SEQ ID NO: 1264030 - DNA, 22 bp, Artificial Sequence
  chemically synthesized
agaagacaaatcattgcaagtt

SEQ ID NO: 1264031 - DNA, 22 bp, Artificial Sequence
  chemically synthesized
acagatgtaaaacttgcaatga

SEQ ID NO: 1264032 - DNA, 22 bp, Artificial Sequence
  chemically synthesized
cagatgtaaaacttgcaatgat

SEQ ID NO: 1264033 - DNA, 22 bp, Artificial Sequence
  chemically synthesized
tttagaagacaaatcattgcaa

SEQ ID NO: 1264034 - DNA, 22 bp, Artificial Sequence
  chemically synthesized
gcaatgatttgtcttctaaaca

SEQ ID NO: 1264035 - DNA, 22 bp, Artificial Sequence
  chemically synthesized
caatgatttgtcttctaaacag

SEQ ID NO: 1264036 - DNA, 22 bp, Artificial Sequence
  chemically synthesized
aataagataatactgtttagaa

SEQ ID NO: 1264037 - DNA, 22 bp, Artificial Sequence
  chemically synthesized
tgaataagataatactgtttag

SEQ ID NO: 1264038 - DNA, 22 bp, Artificial Sequence
  chemically synthesized
ctctgaataagataatactgtt

SEQ ID NO: 1264039 - DNA, 22 bp, Artificial Sequence
  chemically synthesized
actctgaataagataatactgt

SEQ ID NO: 1264040 - DNA, 22 bp, Artificial Sequence
  chemically synthesized
tactctgaataagataatactg

SEQ ID NO: 1264041 - DNA, 22 bp, Artificial Sequence
  chemically synthesized
gtcttctaaacagtattatctt

SEQ ID NO: 1264042 - DNA, 22 bp, Artificial Sequence
  chemically synthesized
tcttctaaacagtattatctta

SEQ ID NO: 1264043 - DNA, 22 bp, Artificial Sequence
  chemically synthesized
ctttactctgaataagataata

SEQ ID NO: 1264044 - DNA, 22 bp, Artificial Sequence
  chemically synthesized
ctaaacagtattatcttattca

SEQ ID NO: 1264045 - DNA, 22 bp, Artificial Sequence
  chemically synthesized
taaacagtattatcttattcag

SEQ ID NO: 1264046 - DNA, 22 bp, Artificial Sequence
  chemically synthesized
aattgctttactctgaataaga

SEQ ID NO: 1264047 - DNA, 22 bp, Artificial Sequence
  chemically synthesized
aacagtattatcttattcagag

SEQ ID NO: 1264048 - DNA, 22 bp, Artificial Sequence
  chemically synthesized
tcaattgctttactctgaataa

SEQ ID NO: 1264049 - DNA, 22 bp, Artificial Sequence
  chemically synthesized
tcttattcagagtaaagcaatt

SEQ ID NO: 1264050 - DNA, 22 bp, Artificial Sequence
  chemically synthesized
gaaagaactctcaattgcttta

SEQ ID NO: 1264051 - DNA, 22 bp, Artificial Sequence
  chemically synthesized
agaaagaactctcaattgcttt

SEQ ID NO: 1264052 - DNA, 22 bp, Artificial Sequence
  chemically synthesized
tagaaagaactctcaattgctt

SEQ ID NO: 1264053 - DNA, 22 bp, Artificial Sequence
  chemically synthesized
attcagagtaaagcaattgaga

SEQ ID NO: 1264054 - DNA, 22 bp, Artificial Sequence
  chemically synthesized
ttcagagtaaagcaattgagag

SEQ ID NO: 1264055 - DNA, 22 bp, Artificial Sequence
  chemically synthesized
ttttagaaagaactctcaattg

SEQ ID NO: 1264056 - DNA, 22 bp, Artificial Sequence
  chemically synthesized
attttagaaagaactctcaatt

SEQ ID NO: 1264057 - DNA, 22 bp, Artificial Sequence
  chemically synthesized
agagtaaagcaattgagagttc

SEQ ID NO: 1264058 - DNA, 22 bp, Artificial Sequence
  chemically synthesized
ttattttagaaagaactctcaa

SEQ ID NO: 1264059 - DNA, 22 bp, Artificial Sequence
  chemically synthesized
aaaatctcttattttagaaaga

SEQ ID NO: 1264060 - DNA, 22 bp, Artificial Sequence
  chemically synthesized
aaaaatctcttattttagaaag

SEQ ID NO: 1264061 - DNA, 22 bp, Artificial Sequence
  chemically synthesized
taaaaatctcttattttagaaa

SEQ ID NO: 1264062 - DNA, 22 bp, Artificial Sequence
  chemically synthesized
agagttctttctaaaataagag

SEQ ID NO: 1264063 - DNA, 22 bp, Artificial Sequence
  chemically synthesized
tattttaaaaatctcttatttt

SEQ ID NO: 1264064 - DNA, 22 bp, Artificial Sequence
  chemically synthesized
attatattttaaaaatctctta

SEQ ID NO: 1264065 - DNA, 22 bp, Artificial Sequence
  chemically synthesized
aattatattttaaaaatctctt

SEQ ID NO: 1264066 - DNA, 22 bp, Artificial Sequence
  chemically synthesized
tttctaaaataagagattttta

SEQ ID NO: 1264067 - DNA, 22 bp, Artificial Sequence
  chemically synthesized
cttaattatattttaaaaatct

SEQ ID NO: 1264068 - DNA, 22 bp, Artificial Sequence
  chemically synthesized
tctaaaataagagatttttaaa

SEQ ID NO: 1264069 - DNA, 22 bp, Artificial Sequence
  chemically synthesized
ctaaaataagagatttttaaaa

SEQ ID NO: 1264070 - DNA, 22 bp, Artificial Sequence
  chemically synthesized
taaaataagagatttttaaaat

SEQ ID NO: 1264071 - DNA, 22 bp, Artificial Sequence
  chemically synthesized
aaataagagatttttaaaatat

SEQ ID NO: 1264072 - DNA, 22 bp, Artificial Sequence
  chemically synthesized
aaagttgcttaattatatttta

SEQ ID NO: 1264073 - DNA, 22 bp, Artificial Sequence
  chemically synthesized
ttcaaagttgcttaattatatt

SEQ ID NO: 1264074 - DNA, 22 bp, Artificial Sequence
  chemically synthesized
gttcaaagttgcttaattatat

SEQ ID NO: 1264075 - DNA, 22 bp, Artificial Sequence
  chemically synthesized
ttaaaatataattaagcaactt

SEQ ID NO: 1264076 - DNA, 22 bp, Artificial Sequence
  chemically synthesized
taaaatataattaagcaacttt

SEQ ID NO: 1264077 - DNA, 22 bp, Artificial Sequence
  chemically synthesized
aaaatataattaagcaactttg

SEQ ID NO: 1264078 - DNA, 22 bp, Artificial Sequence
  chemically synthesized
aaatataattaagcaactttga

SEQ ID NO: 1264079 - DNA, 22 bp, Artificial Sequence
  chemically synthesized
taggtgaatttgttcaaagttg

SEQ ID NO: 1264080 - DNA, 22 bp, Artificial Sequence
  chemically synthesized
ataggtgaatttgttcaaagtt

SEQ ID NO: 1264081 - DNA, 22 bp, Artificial Sequence
  chemically synthesized
cttataggtgaatttgttcaaa

SEQ ID NO: 1264082 - DNA, 22 bp, Artificial Sequence
  chemically synthesized
agcaactttgaacaaattcacc

SEQ ID NO: 1264083 - DNA, 22 bp, Artificial Sequence
  chemically synthesized
gtacgtctccttataggtgaat

SEQ ID NO: 1264084 - DNA, 22 bp, Artificial Sequence
  chemically synthesized
tgaacaaattcacctataagga

SEQ ID NO: 1264085 - DNA, 22 bp, Artificial Sequence
  chemically synthesized
gaacaaattcacctataaggag

SEQ ID NO: 1264086 - DNA, 22 bp, Artificial Sequence
  chemically synthesized
taactggtacgtctccttatag

SEQ ID NO: 1264087 - DNA, 22 bp, Artificial Sequence
  chemically synthesized
aacaaattcacctataaggaga

SEQ ID NO: 1264088 - DNA, 22 bp, Artificial Sequence
  chemically synthesized
acagtgttataactggtacgtc

SEQ ID NO: 1264089 - DNA, 22 bp, Artificial Sequence
  chemically synthesized
acctataaggagacgtaccagt

SEQ ID NO: 1264090 - DNA, 22 bp, Artificial Sequence
  chemically synthesized
taaggagacgtaccagttataa

SEQ ID NO: 1264091 - DNA, 22 bp, Artificial Sequence
  chemically synthesized
ccccaaccccatgtaagttaac

SEQ ID NO: 1264092 - DNA, 22 bp, Artificial Sequence
  chemically synthesized
taacactgttaacttacatggg

SEQ ID NO: 1264093 - DNA, 22 bp, Artificial Sequence
  chemically synthesized
taagcaattaccccaaccccat

SEQ ID NO: 1264094 - DNA, 22 bp, Artificial Sequence
  chemically synthesized
ttaacttacatggggttggggt

SEQ ID NO: 1264095 - DNA, 22 bp, Artificial Sequence
  chemically synthesized
attgtaagcaattaccccaacc

SEQ ID NO: 1264096 - DNA, 22 bp, Artificial Sequence
  chemically synthesized
acttacatggggttggggtaat

SEQ ID NO: 1264097 - DNA, 22 bp, Artificial Sequence
  chemically synthesized
acatggggttggggtaattgct

SEQ ID NO: 1264098 - DNA, 22 bp, Artificial Sequence
  chemically synthesized
catggggttggggtaattgctt

SEQ ID NO: 1264099 - DNA, 22 bp, Artificial Sequence
  chemically synthesized
agaatatctgattgtaagcaat

SEQ ID NO: 1264100 - DNA, 22 bp, Artificial Sequence
  chemically synthesized
gggtaattgcttacaatcagat

SEQ ID NO: 1264101 - DNA, 22 bp, Artificial Sequence
  chemically synthesized
taatgtctgagaatatctgatt

SEQ ID NO: 1264102 - DNA, 22 bp, Artificial Sequence
  chemically synthesized
gtaatgtctgagaatatctgat

SEQ ID NO: 1264103 - DNA, 22 bp, Artificial Sequence
  chemically synthesized
cttacaatcagatattctcaga

SEQ ID NO: 1264104 - DNA, 22 bp, Artificial Sequence
  chemically synthesized
aagtttgtaatgtctgagaata

SEQ ID NO: 1264105 - DNA, 22 bp, Artificial Sequence
  chemically synthesized
acaatcagatattctcagacat

SEQ ID NO: 1264106 - DNA, 22 bp, Artificial Sequence
  chemically synthesized
caatcagatattctcagacatt

SEQ ID NO: 1264107 - DNA, 22 bp, Artificial Sequence
  chemically synthesized
caacctaaagtttgtaatgtct

SEQ ID NO: 1264108 - DNA, 22 bp, Artificial Sequence
  chemically synthesized
tagtactgcaacctaaagtttg

SEQ ID NO: 1264109 - DNA, 22 bp, Artificial Sequence
  chemically synthesized
gtagtactgcaacctaaagttt

SEQ ID NO: 1264110 - DNA, 22 bp, Artificial Sequence
  chemically synthesized
tcagacattacaaactttaggt

SEQ ID NO: 1264111 - DNA, 22 bp, Artificial Sequence
  chemically synthesized
agacattacaaactttaggttg

SEQ ID NO: 1264112 - DNA, 22 bp, Artificial Sequence
  chemically synthesized
tttgtagtactgcaacctaaag

SEQ ID NO: 1264113 - DNA, 22 bp, Artificial Sequence
  chemically synthesized
gtttgtagtactgcaacctaaa

SEQ ID NO: 1264114 - DNA, 22 bp, Artificial Sequence
  chemically synthesized
tatttgtttgtagtactgcaac

SEQ ID NO: 1264115 - DNA, 22 bp, Artificial Sequence
  chemically synthesized
caaactttaggttgcagtacta

SEQ ID NO: 1264116 - DNA, 22 bp, Artificial Sequence
  chemically synthesized
attatatttgtttgtagtactg

SEQ ID NO: 1264117 - DNA, 22 bp, Artificial Sequence
  chemically synthesized
cattatatttgtttgtagtact

SEQ ID NO: 1264118 - DNA, 22 bp, Artificial Sequence
  chemically synthesized
tcattatatttgtttgtagtac

SEQ ID NO: 1264119 - DNA, 22 bp, Artificial Sequence
  chemically synthesized
taggttgcagtactacaaacaa

SEQ ID NO: 1264120 - DNA, 22 bp, Artificial Sequence
  chemically synthesized
aggttgcagtactacaaacaaa

SEQ ID NO: 1264121 - DNA, 22 bp, Artificial Sequence
  chemically synthesized
ggttgcagtactacaaacaaat

SEQ ID NO: 1264122 - DNA, 22 bp, Artificial Sequence
  chemically synthesized
accgttttcattatatttgttt

SEQ ID NO: 1264123 - DNA, 22 bp, Artificial Sequence
  chemically synthesized
cagtactacaaacaaatataat

SEQ ID NO: 1264124 - DNA, 22 bp, Artificial Sequence
  chemically synthesized
ttcaccgttttcattatatttg

SEQ ID NO: 1264125 - DNA, 22 bp, Artificial Sequence
  chemically synthesized
attcaccgttttcattatattt

SEQ ID NO: 1264126 - DNA, 22 bp, Artificial Sequence
  chemically synthesized
caaacaaatataatgaaaacgg

SEQ ID NO: 1264127 - DNA, 22 bp, Artificial Sequence
  chemically synthesized
gtgaacaaaagaataaagccat

SEQ ID NO: 1264128 - DNA, 22 bp, Artificial Sequence
  chemically synthesized
gtttatgcatggctttattctt

SEQ ID NO: 1264129 - DNA, 22 bp, Artificial Sequence
  chemically synthesized
tttatgcatggctttattcttt

SEQ ID NO: 1264130 - DNA, 22 bp, Artificial Sequence
  chemically synthesized
atgcatggctttattcttttgt

SEQ ID NO: 1264131 - DNA, 22 bp, Artificial Sequence
  chemically synthesized
tgcatggctttattcttttgtt

SEQ ID NO: 1264132 - DNA, 22 bp, Artificial Sequence
  chemically synthesized
aacagaacaaggaattggtgaa

SEQ ID NO: 1264133 - DNA, 22 bp, Artificial Sequence
  chemically synthesized
aaacagaacaaggaattggtga

SEQ ID NO: 1264134 - DNA, 22 bp, Artificial Sequence
  chemically synthesized
tattcttttgttcaccaattcc

SEQ ID NO: 1264135 - DNA, 22 bp, Artificial Sequence
  chemically synthesized
attcttttgttcaccaattcct

SEQ ID NO: 1264136 - DNA, 22 bp, Artificial Sequence
  chemically synthesized
ttcttttgttcaccaattcctt

SEQ ID NO: 1264137 - DNA, 22 bp, Artificial Sequence
  chemically synthesized
ttttgttcaccaattccttgtt

SEQ ID NO: 1264138 - DNA, 22 bp, Artificial Sequence
  chemically synthesized
ttgttcaccaattccttgttct

SEQ ID NO: 1264139 - DNA, 22 bp, Artificial Sequence
  chemically synthesized
tgttcaccaattccttgttctg

SEQ ID NO: 1264140 - DNA, 22 bp, Artificial Sequence
  chemically synthesized
gttcaccaattccttgttctgt

SEQ ID NO: 1264141 - DNA, 22 bp, Artificial Sequence
  chemically synthesized
gaatgtgtttaaacagaacaag

SEQ ID NO: 1264142 - DNA, 22 bp, Artificial Sequence
  chemically synthesized
ttcaccaattccttgttctgtt

SEQ ID NO: 1264143 - DNA, 22 bp, Artificial Sequence
  chemically synthesized
ggaatgtgtttaaacagaacaa

SEQ ID NO: 1264144 - DNA, 22 bp, Artificial Sequence
  chemically synthesized
tggaatgtgtttaaacagaaca

SEQ ID NO: 1264145 - DNA, 22 bp, Artificial Sequence
  chemically synthesized
ttggaatgtgtttaaacagaac

SEQ ID NO: 1264146 - DNA, 22 bp, Artificial Sequence
  chemically synthesized
accaattccttgttctgtttaa

SEQ ID NO: 1264147 - DNA, 22 bp, Artificial Sequence
  chemically synthesized
cttgttctgtttaaacacattc

SEQ ID NO: 1264148 - DNA, 22 bp, Artificial Sequence
  chemically synthesized
gttctgtttaaacacattccaa

SEQ ID NO: 1264149 - DNA, 22 bp, Artificial Sequence
  chemically synthesized
ttctgtttaaacacattccaaa

SEQ ID NO: 1264150 - DNA, 22 bp, Artificial Sequence
  chemically synthesized
tgggtaaatgtttttggaatgt

SEQ ID NO: 1264151 - DNA, 22 bp, Artificial Sequence
  chemically synthesized
tgtttaaacacattccaaaaac

SEQ ID NO: 1264152 - DNA, 22 bp, Artificial Sequence
  chemically synthesized
tttaaacacattccaaaaacat

SEQ ID NO: 1264153 - DNA, 22 bp, Artificial Sequence
  chemically synthesized
cgttatgggtaaatgtttttgg

SEQ ID NO: 1264154 - DNA, 22 bp, Artificial Sequence
  chemically synthesized
acgttatgggtaaatgtttttg

SEQ ID NO: 1264155 - DNA, 22 bp, Artificial Sequence
  chemically synthesized
tacgttatgggtaaatgttttt

SEQ ID NO: 1264156 - DNA, 22 bp, Artificial Sequence
  chemically synthesized
aaacacattccaaaaacattta

SEQ ID NO: 1264157 - DNA, 22 bp, Artificial Sequence
  chemically synthesized
aacacattccaaaaacatttac

SEQ ID NO: 1264158 - DNA, 22 bp, Artificial Sequence
  chemically synthesized
ctttacgttatgggtaaatgtt

SEQ ID NO: 1264159 - DNA, 22 bp, Artificial Sequence
  chemically synthesized
cctttacgttatgggtaaatgt

SEQ ID NO: 1264160 - DNA, 22 bp, Artificial Sequence
  chemically synthesized
caaaaacatttacccataacgt

SEQ ID NO: 1264161 - DNA, 22 bp, Artificial Sequence
  chemically synthesized
tgcataccttcctttacgttat

SEQ ID NO: 1264162 - DNA, 22 bp, Artificial Sequence
  chemically synthesized
tatctatgcataccttccttta

SEQ ID NO: 1264163 - DNA, 22 bp, Artificial Sequence
  chemically synthesized
acccataacgtaaaggaaggta

SEQ ID NO: 1264164 - DNA, 22 bp, Artificial Sequence
  chemically synthesized
cccataacgtaaaggaaggtat

SEQ ID NO: 1264165 - DNA, 22 bp, Artificial Sequence
  chemically synthesized
aaattatatctatgcatacctt

SEQ ID NO: 1264166 - DNA, 22 bp, Artificial Sequence
  chemically synthesized
gaaattatatctatgcatacct

SEQ ID NO: 1264167 - DNA, 22 bp, Artificial Sequence
  chemically synthesized
atgtttgaaattatatctatgc

SEQ ID NO: 1264168 - DNA, 22 bp, Artificial Sequence
  chemically synthesized
actaatgtttgaaattatatct

SEQ ID NO: 1264169 - DNA, 22 bp, Artificial Sequence
  chemically synthesized
ttgactaatgtttgaaattata

SEQ ID NO: 1264170 - DNA, 22 bp, Artificial Sequence
  chemically synthesized
aatgctattgactaatgtttga

SEQ ID NO: 1264171 - DNA, 22 bp, Artificial Sequence
  chemically synthesized
agtcactgaatgctattgacta

SEQ ID NO: 1264172 - DNA, 22 bp, Artificial Sequence
  chemically synthesized
caaacattagtcaatagcattc

SEQ ID NO: 1264173 - DNA, 22 bp, Artificial Sequence
  chemically synthesized
aaacattagtcaatagcattca

SEQ ID NO: 1264174 - DNA, 22 bp, Artificial Sequence
  chemically synthesized
gtcaatagcattcagtgactga

SEQ ID NO: 1264175 - DNA, 22 bp, Artificial Sequence
  chemically synthesized
catcccgaaatccattcagtca

SEQ ID NO: 1264176 - DNA, 22 bp, Artificial Sequence
  chemically synthesized
tccatcccgaaatccattcagt

SEQ ID NO: 1264177 - DNA, 22 bp, Artificial Sequence
  chemically synthesized
ctccatcccgaaatccattcag

SEQ ID NO: 1264178 - DNA, 22 bp, Artificial Sequence
  chemically synthesized
tctccatcccgaaatccattca

SEQ ID NO: 1264179 - DNA, 22 bp, Artificial Sequence
  chemically synthesized
ctttctccatcccgaaatccat

SEQ ID NO: 1264180 - DNA, 22 bp, Artificial Sequence
  chemically synthesized
agtgactgaatggatttcggga

SEQ ID NO: 1264181 - DNA, 22 bp, Artificial Sequence
  chemically synthesized
tattcctttctccatcccgaaa

SEQ ID NO: 1264182 - DNA, 22 bp, Artificial Sequence
  chemically synthesized
gtattcctttctccatcccgaa

SEQ ID NO: 1264183 - DNA, 22 bp, Artificial Sequence
  chemically synthesized
tgtattcctttctccatcccga

SEQ ID NO: 1264184 - DNA, 22 bp, Artificial Sequence
  chemically synthesized
ttgtattcctttctccatcccg

SEQ ID NO: 1264185 - DNA, 22 bp, Artificial Sequence
  chemically synthesized
aatggatttcgggatggagaaa

SEQ ID NO: 1264186 - DNA, 22 bp, Artificial Sequence
  chemically synthesized
tttttgtattcctttctccatc

SEQ ID NO: 1264187 - DNA, 22 bp, Artificial Sequence
  chemically synthesized
atttttgtattcctttctccat

SEQ ID NO: 1264188 - DNA, 22 bp, Artificial Sequence
  chemically synthesized
cgggatggagaaaggaatacaa

SEQ ID NO: 1264189 - DNA, 22 bp, Artificial Sequence
  chemically synthesized
gggatggagaaaggaatacaaa

SEQ ID NO: 1264190 - DNA, 22 bp, Artificial Sequence
  chemically synthesized
aagtcgcttatttttgtattcc

SEQ ID NO: 1264191 - DNA, 22 bp, Artificial Sequence
  chemically synthesized
aaatccctgaagtcgcttattt

SEQ ID NO: 1264192 - DNA, 22 bp, Artificial Sequence
  chemically synthesized
tatctgaaatccctgaagtcgc

SEQ ID NO: 1264193 - DNA, 22 bp, Artificial Sequence
  chemically synthesized
ctatatctgaaatccctgaagt

SEQ ID NO: 1264194 - DNA, 22 bp, Artificial Sequence
  chemically synthesized
caggctcctatatctgaaatcc

SEQ ID NO: 1264195 - DNA, 22 bp, Artificial Sequence
  chemically synthesized
ccaggctcctatatctgaaatc

SEQ ID NO: 1264196 - DNA, 22 bp, Artificial Sequence
  chemically synthesized
cttccaggctcctatatctgaa

SEQ ID NO: 1264197 - DNA, 22 bp, Artificial Sequence
  chemically synthesized
cagggatttcagatataggagc

SEQ ID NO: 1264198 - DNA, 22 bp, Artificial Sequence
  chemically synthesized
agggatttcagatataggagcc

SEQ ID NO: 1264199 - DNA, 22 bp, Artificial Sequence
  chemically synthesized
agcaccactgcttccaggctcc

SEQ ID NO: 1264200 - DNA, 22 bp, Artificial Sequence
  chemically synthesized
ttaagcaccactgcttccaggc

SEQ ID NO: 1264201 - DNA, 22 bp, Artificial Sequence
  chemically synthesized
cagatataggagcctggaagca

SEQ ID NO: 1264202 - DNA, 22 bp, Artificial Sequence
  chemically synthesized
agatataggagcctggaagcag

SEQ ID NO: 1264203 - DNA, 22 bp, Artificial Sequence
  chemically synthesized
tattaagcaccactgcttccag

SEQ ID NO: 1264204 - DNA, 22 bp, Artificial Sequence
  chemically synthesized
ctattaagcaccactgcttcca

SEQ ID NO: 1264205 - DNA, 22 bp, Artificial Sequence
  chemically synthesized
tctattaagcaccactgcttcc

SEQ ID NO: 1264206 - DNA, 22 bp, Artificial Sequence
  chemically synthesized
ccctttctattaagcaccactg

SEQ ID NO: 1264207 - DNA, 22 bp, Artificial Sequence
  chemically synthesized
cccctttctattaagcaccact

SEQ ID NO: 1264208 - DNA, 22 bp, Artificial Sequence
  chemically synthesized
tcccctttctattaagcaccac

SEQ ID NO: 1264209 - DNA, 22 bp, Artificial Sequence
  chemically synthesized
tttcccctttctattaagcacc

SEQ ID NO: 1264210 - DNA, 22 bp, Artificial Sequence
  chemically synthesized
gaagcagtggtgcttaatagaa

SEQ ID NO: 1264211 - DNA, 22 bp, Artificial Sequence
  chemically synthesized
atgactctttcccctttctatt

SEQ ID NO: 1264212 - DNA, 22 bp, Artificial Sequence
  chemically synthesized
catgactctttcccctttctat

SEQ ID NO: 1264213 - DNA, 22 bp, Artificial Sequence
  chemically synthesized
ttcatgactctttcccctttct

SEQ ID NO: 1264214 - DNA, 22 bp, Artificial Sequence
  chemically synthesized
aatagaaaggggaaagagtcat

SEQ ID NO: 1264215 - DNA, 22 bp, Artificial Sequence
  chemically synthesized
atagaaaggggaaagagtcatg

SEQ ID NO: 1264216 - DNA, 22 bp, Artificial Sequence
  chemically synthesized
ccacataaaccagctcttcatg

SEQ ID NO: 1264217 - DNA, 22 bp, Artificial Sequence
  chemically synthesized
ctcccacataaaccagctcttc

SEQ ID NO: 1264218 - DNA, 22 bp, Artificial Sequence
  chemically synthesized
tctactcccacataaaccagct

SEQ ID NO: 1264219 - DNA, 22 bp, Artificial Sequence
  chemically synthesized
attatctactcccacataaacc

SEQ ID NO: 1264220 - DNA, 22 bp, Artificial Sequence
  chemically synthesized
gtttatgtgggagtagataatg

SEQ ID NO: 1264221 - DNA, 22 bp, Artificial Sequence
  chemically synthesized
atgtgggagtagataatgagtt

SEQ ID NO: 1264222 - DNA, 22 bp, Artificial Sequence
  chemically synthesized
tgtgggagtagataatgagttc

SEQ ID NO: 1264223 - DNA, 22 bp, Artificial Sequence
  chemically synthesized
aatataccaaatggaactcatt

SEQ ID NO: 1264224 - DNA, 22 bp, Artificial Sequence
  chemically synthesized
aaaattaaatataccaaatgga

SEQ ID NO: 1264225 - DNA, 22 bp, Artificial Sequence
  chemically synthesized
catttggtatatttaattttga

SEQ ID NO: 1264226 - DNA, 22 bp, Artificial Sequence
  chemically synthesized
ggtatatttaattttgagactg

SEQ ID NO: 1264227 - DNA, 22 bp, Artificial Sequence
  chemically synthesized
gtatatttaattttgagactga

SEQ ID NO: 1264228 - DNA, 22 bp, Artificial Sequence
  chemically synthesized
agtgtccccccatcagtctcaa

SEQ ID NO: 1264229 - DNA, 22 bp, Artificial Sequence
  chemically synthesized
caattaagtgtccccccatcag

SEQ ID NO: 1264230 - DNA, 22 bp, Artificial Sequence
  chemically synthesized
aattttgagactgatgggggga

SEQ ID NO: 1264231 - DNA, 22 bp, Artificial Sequence
  chemically synthesized
attttgagactgatggggggac

SEQ ID NO: 1264232 - DNA, 22 bp, Artificial Sequence
  chemically synthesized
tgagactgatggggggacactt

SEQ ID NO: 1264233 - DNA, 22 bp, Artificial Sequence
  chemically synthesized
gagactgatggggggacactta

SEQ ID NO: 1264234 - DNA, 22 bp, Artificial Sequence
  chemically synthesized
agactgatggggggacacttaa

SEQ ID NO: 1264235 - DNA, 22 bp, Artificial Sequence
  chemically synthesized
cagaacgtctccaattaagtgt

SEQ ID NO: 1264236 - DNA, 22 bp, Artificial Sequence
  chemically synthesized
atggggggacacttaattggag

SEQ ID NO: 1264237 - DNA, 22 bp, Artificial Sequence
  chemically synthesized
cacctacagaacgtctccaatt

SEQ ID NO: 1264238 - DNA, 22 bp, Artificial Sequence
  chemically synthesized
atataattacacctacagaacg

SEQ ID NO: 1264239 - DNA, 22 bp, Artificial Sequence
  chemically synthesized
aatataattacacctacagaac

SEQ ID NO: 1264240 - DNA, 22 bp, Artificial Sequence
  chemically synthesized
aattggagacgttctgtaggtg

SEQ ID NO: 1264241 - DNA, 22 bp, Artificial Sequence
  chemically synthesized
ttaatataattacacctacaga

SEQ ID NO: 1264242 - DNA, 22 bp, Artificial Sequence
  chemically synthesized
attggagacgttctgtaggtgt

SEQ ID NO: 1264243 - DNA, 22 bp, Artificial Sequence
  chemically synthesized
cttaatataattacacctacag

SEQ ID NO: 1264244 - DNA, 22 bp, Artificial Sequence
  chemically synthesized
gagacgttctgtaggtgtaatt

SEQ ID NO: 1264245 - DNA, 22 bp, Artificial Sequence
  chemically synthesized
cccttcttaatataattacacc

SEQ ID NO: 1264246 - DNA, 22 bp, Artificial Sequence
  chemically synthesized
ccccttcttaatataattacac

SEQ ID NO: 1264247 - DNA, 22 bp, Artificial Sequence
  chemically synthesized
tccccttcttaatataattaca

SEQ ID NO: 1264248 - DNA, 22 bp, Artificial Sequence
  chemically synthesized
ttccccttcttaatataattac

SEQ ID NO: 1264249 - DNA, 22 bp, Artificial Sequence
  chemically synthesized
tgtaggtgtaattatattaaga

SEQ ID NO: 1264250 - DNA, 22 bp, Artificial Sequence
  chemically synthesized
aatttttccccttcttaatata

SEQ ID NO: 1264251 - DNA, 22 bp, Artificial Sequence
  chemically synthesized
taggtgtaattatattaagaag

SEQ ID NO: 1264252 - DNA, 22 bp, Artificial Sequence
  chemically synthesized
attgaatttttccccttcttaa

SEQ ID NO: 1264253 - DNA, 22 bp, Artificial Sequence
  chemically synthesized
taattgaatttttccccttctt

SEQ ID NO: 1264254 - DNA, 22 bp, Artificial Sequence
  chemically synthesized
tattaagaaggggaaaaattca

SEQ ID NO: 1264255 - DNA, 22 bp, Artificial Sequence
  chemically synthesized
gtggagctctaattgaattttt

SEQ ID NO: 1264256 - DNA, 22 bp, Artificial Sequence
  chemically synthesized
ggtggagctctaattgaatttt

SEQ ID NO: 1264257 - DNA, 22 bp, Artificial Sequence
  chemically synthesized
agaaggggaaaaattcaattag

SEQ ID NO: 1264258 - DNA, 22 bp, Artificial Sequence
  chemically synthesized
atataatttggtggagctctaa

SEQ ID NO: 1264259 - DNA, 22 bp, Artificial Sequence
  chemically synthesized
aattagagctccaccaaattat

SEQ ID NO: 1264260 - DNA, 22 bp, Artificial Sequence
  chemically synthesized
gacacagctgatataatttggt

SEQ ID NO: 1264261 - DNA, 22 bp, Artificial Sequence
  chemically synthesized
ggacacagctgatataatttgg

SEQ ID NO: 1264262 - DNA, 22 bp, Artificial Sequence
  chemically synthesized
gagctccaccaaattatatcag

SEQ ID NO: 1264263 - DNA, 22 bp, Artificial Sequence
  chemically synthesized
caccaaattatatcagctgtgt

SEQ ID NO: 1264264 - DNA, 22 bp, Artificial Sequence
  chemically synthesized
tatcagctgtgtccaaaccata

SEQ ID NO: 1264265 - DNA, 22 bp, Artificial Sequence
  chemically synthesized
tacacacaggcaatcaatatgg

SEQ ID NO: 1264266 - DNA, 22 bp, Artificial Sequence
  chemically synthesized
tgtccaaaccatattgattgcc

SEQ ID NO: 1264267 - DNA, 22 bp, Artificial Sequence
  chemically synthesized
cacaccagctatacacacaggc

SEQ ID NO: 1264268 - DNA, 22 bp, Artificial Sequence
  chemically synthesized
cactgcacaccagctatacaca

SEQ ID NO: 1264269 - DNA, 22 bp, Artificial Sequence
  chemically synthesized
ctacactgcacaccagctatac

SEQ ID NO: 1264270 - DNA, 22 bp, Artificial Sequence
  chemically synthesized
attgcctgtgtgtatagctggt

SEQ ID NO: 1264271 - DNA, 22 bp, Artificial Sequence
  chemically synthesized
tgctacactgcacaccagctat

SEQ ID NO: 1264272 - DNA, 22 bp, Artificial Sequence
  chemically synthesized
cctgtgtgtatagctggtgtgc

SEQ ID NO: 1264273 - DNA, 22 bp, Artificial Sequence
  chemically synthesized
agctctgctacactgcacacca

SEQ ID NO: 1264274 - DNA, 22 bp, Artificial Sequence
  chemically synthesized
tgtgtatagctggtgtgcagtg

SEQ ID NO: 1264275 - DNA, 22 bp, Artificial Sequence
  chemically synthesized
gtagcattcagctctgctacac

SEQ ID NO: 1264276 - DNA, 22 bp, Artificial Sequence
  chemically synthesized
agtagcattcagctctgctaca

SEQ ID NO: 1264277 - DNA, 22 bp, Artificial Sequence
  chemically synthesized
gtgtgcagtgtagcagagctga

SEQ ID NO: 1264278 - DNA, 22 bp, Artificial Sequence
  chemically synthesized
aatgctactaagctcccttccg

SEQ ID NO: 1264279 - DNA, 22 bp, Artificial Sequence
  chemically synthesized
aaatcaaaaaacgtagaacgga

SEQ ID NO: 1264280 - DNA, 22 bp, Artificial Sequence
  chemically synthesized
ctaagctcccttccgttctacg

SEQ ID NO: 1264281 - DNA, 22 bp, Artificial Sequence
  chemically synthesized
caaatcaaaaaacgtagaacgg

SEQ ID NO: 1264282 - DNA, 22 bp, Artificial Sequence
  chemically synthesized
ttcaaatcaaaaaacgtagaac

SEQ ID NO: 1264283 - DNA, 22 bp, Artificial Sequence
  chemically synthesized
agctcccttccgttctacgttt

SEQ ID NO: 1264284 - DNA, 22 bp, Artificial Sequence
  chemically synthesized
cttcaaatcaaaaaacgtagaa

SEQ ID NO: 1264285 - DNA, 22 bp, Artificial Sequence
  chemically synthesized
ttcttcaaatcaaaaaacgtag

SEQ ID NO: 1264286 - DNA, 22 bp, Artificial Sequence
  chemically synthesized
ccttccgttctacgttttttga

SEQ ID NO: 1264287 - DNA, 22 bp, Artificial Sequence
  chemically synthesized
ccgttctacgttttttgatttg

SEQ ID NO: 1264288 - DNA, 22 bp, Artificial Sequence
  chemically synthesized
catattcttcttcaaatcaaaa

SEQ ID NO: 1264289 - DNA, 22 bp, Artificial Sequence
  chemically synthesized
cgttctacgttttttgatttga

SEQ ID NO: 1264290 - DNA, 22 bp, Artificial Sequence
  chemically synthesized
tacgttttttgatttgaagaag

SEQ ID NO: 1264291 - DNA, 22 bp, Artificial Sequence
  chemically synthesized
cgttttttgatttgaagaagaa

SEQ ID NO: 1264292 - DNA, 22 bp, Artificial Sequence
  chemically synthesized
tttgatttgaagaagaatatgg

SEQ ID NO: 1264293 - DNA, 22 bp, Artificial Sequence
  chemically synthesized
ttgatttgaagaagaatatgga

SEQ ID NO: 1264294 - DNA, 22 bp, Artificial Sequence
  chemically synthesized
tgatttgaagaagaatatggag

SEQ ID NO: 1264295 - DNA, 22 bp, Artificial Sequence
  chemically synthesized
cagcatgtcaccctccatattc

SEQ ID NO: 1264296 - DNA, 22 bp, Artificial Sequence
  chemically synthesized
gatttgaagaagaatatggagg

SEQ ID NO: 1264297 - DNA, 22 bp, Artificial Sequence
  chemically synthesized
ccagcatgtcaccctccatatt

SEQ ID NO: 1264298 - DNA, 22 bp, Artificial Sequence
  chemically synthesized
atttgaagaagaatatggaggg

SEQ ID NO: 1264299 - DNA, 22 bp, Artificial Sequence
  chemically synthesized
tccagcatgtcaccctccatat

SEQ ID NO: 1264300 - DNA, 22 bp, Artificial Sequence
  chemically synthesized
tttccagcatgtcaccctccat

SEQ ID NO: 1264301 - DNA, 22 bp, Artificial Sequence
  chemically synthesized
gaagaagaatatggagggtgac

SEQ ID NO: 1264302 - DNA, 22 bp, Artificial Sequence
  chemically synthesized
aagaagaatatggagggtgaca

SEQ ID NO: 1264303 - DNA, 22 bp, Artificial Sequence
  chemically synthesized
gtcatgtcctctttccagcatg

SEQ ID NO: 1264304 - DNA, 22 bp, Artificial Sequence
  chemically synthesized
ctggtcatgtcctctttccagc

SEQ ID NO: 1264305 - DNA, 22 bp, Artificial Sequence
  chemically synthesized
gaaagaggacatgaccagcagc

SEQ ID NO: 1264306 - DNA, 22 bp, Artificial Sequence
  chemically synthesized
tctctctctctctctctctcac

SEQ ID NO: 1264307 - DNA, 22 bp, Artificial Sequence
  chemically synthesized
ctctctctctctctctctcact

SEQ ID NO: 1264308 - DNA, 22 bp, Artificial Sequence
  chemically synthesized
tctctctctctctctctcactg

SEQ ID NO: 1264309 - DNA, 22 bp, Artificial Sequence
  chemically synthesized
tctctctctctctctcactgtt

SEQ ID NO: 1264310 - DNA, 22 bp, Artificial Sequence
  chemically synthesized
tctctctctctctcactgttcc

SEQ ID NO: 1264311 - DNA, 22 bp, Artificial Sequence
  chemically synthesized
tctctctctctcactgttcctc

SEQ ID NO: 1264312 - DNA, 22 bp, Artificial Sequence
  chemically synthesized
tctctctctcactgttcctctg

SEQ ID NO: 1264313 - DNA, 22 bp, Artificial Sequence
  chemically synthesized
tctctctcactgttcctctggt

SEQ ID NO: 1264314 - DNA, 22 bp, Artificial Sequence
  chemically synthesized
tctctcactgttcctctggttt

SEQ ID NO: 1264315 - DNA, 22 bp, Artificial Sequence
  chemically synthesized
tctcactgttcctctggtttct

SEQ ID NO: 1264316 - DNA, 22 bp, Artificial Sequence
  chemically synthesized
tcactgttcctctggtttctcc

SEQ ID NO: 1264317 - DNA, 22 bp, Artificial Sequence
  chemically synthesized
actgttcctctggtttctcctt

SEQ ID NO: 1264318 - DNA, 22 bp, Artificial Sequence
  chemically synthesized
cagtagaggaaacaaaggagaa

SEQ ID NO: 1264319 - DNA, 22 bp, Artificial Sequence
  chemically synthesized
gcagtagaggaaacaaaggaga

SEQ ID NO: 1264320 - DNA, 22 bp, Artificial Sequence
  chemically synthesized
ttcctctggtttctcctttgtt

SEQ ID NO: 1264321 - DNA, 22 bp, Artificial Sequence
  chemically synthesized
ctctggtttctcctttgtttcc

SEQ ID NO: 1264322 - DNA, 22 bp, Artificial Sequence
  chemically synthesized
tggtttctcctttgtttcctct

SEQ ID NO: 1264323 - DNA, 22 bp, Artificial Sequence
  chemically synthesized
tccatttgcagtagaggaaaca

SEQ ID NO: 1264324 - DNA, 22 bp, Artificial Sequence
  chemically synthesized
gtttctcctttgtttcctctac

SEQ ID NO: 1264325 - DNA, 22 bp, Artificial Sequence
  chemically synthesized
ctcctttgtttcctctactgca

SEQ ID NO: 1264326 - DNA, 22 bp, Artificial Sequence
  chemically synthesized
tcctttgtttcctctactgcaa

SEQ ID NO: 1264327 - DNA, 22 bp, Artificial Sequence
  chemically synthesized
ctttgtttcctctactgcaaat

SEQ ID NO: 1264328 - DNA, 22 bp, Artificial Sequence
  chemically synthesized
tgtttcctctactgcaaatgga

SEQ ID NO: 1264329 - DNA, 22 bp, Artificial Sequence
  chemically synthesized
gtttcctctactgcaaatggat

SEQ ID NO: 1264330 - DNA, 22 bp, Artificial Sequence
  chemically synthesized
tttcctctactgcaaatggata

SEQ ID NO: 1264331 - DNA, 22 bp, Artificial Sequence
  chemically synthesized
cctctactgcaaatggataata

SEQ ID NO: 1264332 - DNA, 22 bp, Artificial Sequence
  chemically synthesized
aacatggcacagtattatccat

SEQ ID NO: 1264333 - DNA, 22 bp, Artificial Sequence
  chemically synthesized
ctctactgcaaatggataatac

SEQ ID NO: 1264334 - DNA, 22 bp, Artificial Sequence
  chemically synthesized
tactgcaaatggataatactgt

SEQ ID NO: 1264335 - DNA, 22 bp, Artificial Sequence
  chemically synthesized
gttgaacatggcacagtattat

SEQ ID NO: 1264336 - DNA, 22 bp, Artificial Sequence
  chemically synthesized
ctgcaaatggataatactgtgc

SEQ ID NO: 1264337 - DNA, 22 bp, Artificial Sequence
  chemically synthesized
caaatggataatactgtgccat

SEQ ID NO: 1264338 - DNA, 22 bp, Artificial Sequence
  chemically synthesized
tggccaattagttgaacatggc

SEQ ID NO: 1264339 - DNA, 22 bp, Artificial Sequence
  chemically synthesized
agtaactatggccaattagttg

SEQ ID NO: 1264340 - DNA, 22 bp, Artificial Sequence
  chemically synthesized
tgccatgttcaactaattggcc

SEQ ID NO: 1264341 - DNA, 22 bp, Artificial Sequence
  chemically synthesized
atatcctcagtaactatggcca

SEQ ID NO: 1264342 - DNA, 22 bp, Artificial Sequence
  chemically synthesized
gatatcctcagtaactatggcc

SEQ ID NO: 1264343 - DNA, 22 bp, Artificial Sequence
  chemically synthesized
tgatatcctcagtaactatggc

SEQ ID NO: 1264344 - DNA, 22 bp, Artificial Sequence
  chemically synthesized
aactaattggccatagttactg

SEQ ID NO: 1264345 - DNA, 22 bp, Artificial Sequence
  chemically synthesized
attggccatagttactgaggat

SEQ ID NO: 1264346 - DNA, 22 bp, Artificial Sequence
  chemically synthesized
atgggttttgatatcctcagta

SEQ ID NO: 1264347 - DNA, 22 bp, Artificial Sequence
  chemically synthesized
gatgggttttgatatcctcagt

SEQ ID NO: 1264348 - DNA, 22 bp, Artificial Sequence
  chemically synthesized
gccatagttactgaggatatca

SEQ ID NO: 1264349 - DNA, 22 bp, Artificial Sequence
  chemically synthesized
tgcttgatgggttttgatatcc

SEQ ID NO: 1264350 - DNA, 22 bp, Artificial Sequence
  chemically synthesized
ctgaggatatcaaaacccatca

SEQ ID NO: 1264351 - DNA, 22 bp, Artificial Sequence
  chemically synthesized
aggatatcaaaacccatcaagc

SEQ ID NO: 1264352 - DNA, 22 bp, Artificial Sequence
  chemically synthesized
aaatataataataatataaaag

SEQ ID NO: 1264353 - DNA, 22 bp, Artificial Sequence
  chemically synthesized
aaaatataataataatataaaa

SEQ ID NO: 1264354 - DNA, 22 bp, Artificial Sequence
  chemically synthesized
ttcttttatattattattatat

SEQ ID NO: 1264355 - DNA, 22 bp, Artificial Sequence
  chemically synthesized
tcttttatattattattatatt

SEQ ID NO: 1264356 - DNA, 22 bp, Artificial Sequence
  chemically synthesized
cttttatattattattatattt

SEQ ID NO: 1264357 - DNA, 22 bp, Artificial Sequence
  chemically synthesized
ttttatattattattatatttt

SEQ ID NO: 1264358 - DNA, 22 bp, Artificial Sequence
  chemically synthesized
ttatattattattatattttaa

SEQ ID NO: 1264359 - DNA, 22 bp, Artificial Sequence
  chemically synthesized
tatattattattatattttaag

SEQ ID NO: 1264360 - DNA, 22 bp, Artificial Sequence
  chemically synthesized
atattattattatattttaagt

SEQ ID NO: 1264361 - DNA, 22 bp, Artificial Sequence
  chemically synthesized
tattattattatattttaagtt

SEQ ID NO: 1264362 - DNA, 22 bp, Artificial Sequence
  chemically synthesized
cacatgtatcccagaacttaaa

SEQ ID NO: 1264363 - DNA, 22 bp, Artificial Sequence
  chemically synthesized
tgcacatgtatcccagaactta

SEQ ID NO: 1264364 - DNA, 22 bp, Artificial Sequence
  chemically synthesized
ttattatattttaagttctggg

SEQ ID NO: 1264365 - DNA, 22 bp, Artificial Sequence
  chemically synthesized
ttatattttaagttctgggata

SEQ ID NO: 1264366 - DNA, 22 bp, Artificial Sequence
  chemically synthesized
tattttaagttctgggatacat

SEQ ID NO: 1264367 - DNA, 22 bp, Artificial Sequence
  chemically synthesized
cacgttctgcacatgtatccca

SEQ ID NO: 1264368 - DNA, 22 bp, Artificial Sequence
  chemically synthesized
taagttctgggatacatgtgca

SEQ ID NO: 1264369 - DNA, 22 bp, Artificial Sequence
  chemically synthesized
aagttctgggatacatgtgcag

SEQ ID NO: 1264370 - DNA, 22 bp, Artificial Sequence
  chemically synthesized
agttctgggatacatgtgcaga

SEQ ID NO: 1264371 - DNA, 22 bp, Artificial Sequence
  chemically synthesized
tgggatacatgtgcagaacgtg

SEQ ID NO: 1264372 - DNA, 22 bp, Artificial Sequence
  chemically synthesized
tgtaacaaacctgcacgttctg

SEQ ID NO: 1264373 - DNA, 22 bp, Artificial Sequence
  chemically synthesized
ggatacatgtgcagaacgtgca

SEQ ID NO: 1264374 - DNA, 22 bp, Artificial Sequence
  chemically synthesized
gttacataggtatgcacgtgct

SEQ ID NO: 1264375 - DNA, 22 bp, Artificial Sequence
  chemically synthesized
ttacataggtatgcacgtgcta

SEQ ID NO: 1264376 - DNA, 22 bp, Artificial Sequence
  chemically synthesized
cataggtatgcacgtgctatgg

SEQ ID NO: 1264377 - DNA, 22 bp, Artificial Sequence
  chemically synthesized
atgggtgcagcagtccaccata

SEQ ID NO: 1264378 - DNA, 22 bp, Artificial Sequence
  chemically synthesized
tggtggactgctgcacccatca

SEQ ID NO: 1264379 - DNA, 22 bp, Artificial Sequence
  chemically synthesized
atgtagatgacgggttgatggg

SEQ ID NO: 1264380 - DNA, 22 bp, Artificial Sequence
  chemically synthesized
ctgcacccatcaacccgtcatc

SEQ ID NO: 1264381 - DNA, 22 bp, Artificial Sequence
  chemically synthesized
cacccatcaacccgtcatctac

SEQ ID NO: 1264382 - DNA, 22 bp, Artificial Sequence
  chemically synthesized
ggagaaatacctaatgtagatg

SEQ ID NO: 1264383 - DNA, 22 bp, Artificial Sequence
  chemically synthesized
cattaggtatttctcctaatgc

SEQ ID NO: 1264384 - DNA, 22 bp, Artificial Sequence
  chemically synthesized
ggtatttctcctaatgctatcc

SEQ ID NO: 1264385 - DNA, 22 bp, Artificial Sequence
  chemically synthesized
ctcctaatgctatccctccctt

SEQ ID NO: 1264386 - DNA, 22 bp, Artificial Sequence
  chemically synthesized
tcctaatgctatccctcccttt

SEQ ID NO: 1264387 - DNA, 22 bp, Artificial Sequence
  chemically synthesized
ctaatgctatccctccctttgc

SEQ ID NO: 1264388 - DNA, 22 bp, Artificial Sequence
  chemically synthesized
tcagggggtggggggcaaaggg

SEQ ID NO: 1264389 - DNA, 22 bp, Artificial Sequence
  chemically synthesized
atgctatccctccctttgcccc

SEQ ID NO: 1264390 - DNA, 22 bp, Artificial Sequence
  chemically synthesized
ggcctgtcagggggtggggggc

SEQ ID NO: 1264391 - DNA, 22 bp, Artificial Sequence
  chemically synthesized
tccctccctttgccccccaccc

SEQ ID NO: 1264392 - DNA, 22 bp, Artificial Sequence
  chemically synthesized
cctttgccccccaccccctgac

SEQ ID NO: 1264393 - DNA, 22 bp, Artificial Sequence
  chemically synthesized
tgccccccaccccctgacaggc

SEQ ID NO: 1264394 - DNA, 22 bp, Artificial Sequence
  chemically synthesized
gccccccaccccctgacaggcc

SEQ ID NO: 1264395 - DNA, 22 bp, Artificial Sequence
  chemically synthesized
ccccccaccccctgacaggccc

SEQ ID NO: 1264396 - DNA, 22 bp, Artificial Sequence
  chemically synthesized
acaggcccaggtgtgtgatgtt

SEQ ID NO: 1264397 - DNA, 22 bp, Artificial Sequence
  chemically synthesized
aacaacaagaacacatggacac

SEQ ID NO: 1264398 - DNA, 22 bp, Artificial Sequence
  chemically synthesized
ccttccctgtgtccatgtgttc

SEQ ID NO: 1264399 - DNA, 22 bp, Artificial Sequence
  chemically synthesized
ccctgtgtccatgtgttcttgt

SEQ ID NO: 1264400 - DNA, 22 bp, Artificial Sequence
  chemically synthesized
cctgtgtccatgtgttcttgtt

SEQ ID NO: 1264401 - DNA, 22 bp, Artificial Sequence
  chemically synthesized
tgtccatgtgttcttgttgttc

SEQ ID NO: 1264402 - DNA, 22 bp, Artificial Sequence
  chemically synthesized
taagtgggagttgaacaacaag

SEQ ID NO: 1264403 - DNA, 22 bp, Artificial Sequence
  chemically synthesized
ataagtgggagttgaacaacaa

SEQ ID NO: 1264404 - DNA, 22 bp, Artificial Sequence
  chemically synthesized
tcttataagtgggagttgaaca

SEQ ID NO: 1264405 - DNA, 22 bp, Artificial Sequence
  chemically synthesized
tgtcttataagtgggagttgaa

SEQ ID NO: 1264406 - DNA, 22 bp, Artificial Sequence
  chemically synthesized
ttgttgttcaactcccacttat

SEQ ID NO: 1264407 - DNA, 22 bp, Artificial Sequence
  chemically synthesized
gttgttcaactcccacttataa

SEQ ID NO: 1264408 - DNA, 22 bp, Artificial Sequence
  chemically synthesized
ttgttcaactcccacttataag

SEQ ID NO: 1264409 - DNA, 22 bp, Artificial Sequence
  chemically synthesized
ttcaactcccacttataagaca

SEQ ID NO: 1264410 - DNA, 22 bp, Artificial Sequence
  chemically synthesized
aactcccacttataagacagaa

SEQ ID NO: 1264411 - DNA, 22 bp, Artificial Sequence
  chemically synthesized
ccacttataagacagaacatgt

SEQ ID NO: 1264412 - DNA, 22 bp, Artificial Sequence
  chemically synthesized
ataagacagaacatgtggtatt

SEQ ID NO: 1264413 - DNA, 22 bp, Artificial Sequence
  chemically synthesized
taagacagaacatgtggtattt

SEQ ID NO: 1264414 - DNA, 22 bp, Artificial Sequence
  chemically synthesized
aaacaggaacagaaaaccaaat

SEQ ID NO: 1264415 - DNA, 22 bp, Artificial Sequence
  chemically synthesized
agcaaactaaaacaggaacaga

SEQ ID NO: 1264416 - DNA, 22 bp, Artificial Sequence
  chemically synthesized
tcagcaaactaaaacaggaaca

SEQ ID NO: 1264417 - DNA, 22 bp, Artificial Sequence
  chemically synthesized
ggttttctgttcctgttttagt

SEQ ID NO: 1264418 - DNA, 22 bp, Artificial Sequence
  chemically synthesized
gttttctgttcctgttttagtt

SEQ ID NO: 1264419 - DNA, 22 bp, Artificial Sequence
  chemically synthesized
tctgttcctgttttagtttgct

SEQ ID NO: 1264420 - DNA, 22 bp, Artificial Sequence
  chemically synthesized
ctgttcctgttttagtttgctg

SEQ ID NO: 1264421 - DNA, 22 bp, Artificial Sequence
  chemically synthesized
tgttcctgttttagtttgctga

SEQ ID NO: 1264422 - DNA, 22 bp, Artificial Sequence
  chemically synthesized
gaaaccatcattctcagcaaac

SEQ ID NO: 1264423 - DNA, 22 bp, Artificial Sequence
  chemically synthesized
ttcctgttttagtttgctgaga

SEQ ID NO: 1264424 - DNA, 22 bp, Artificial Sequence
  chemically synthesized
ctgttttagtttgctgagaatg

SEQ ID NO: 1264425 - DNA, 22 bp, Artificial Sequence
  chemically synthesized
ttttagtttgctgagaatgatg

SEQ ID NO: 1264426 - DNA, 22 bp, Artificial Sequence
  chemically synthesized
tagtttgctgagaatgatggtt

SEQ ID NO: 1264427 - DNA, 22 bp, Artificial Sequence
  chemically synthesized
agtttgctgagaatgatggttt

SEQ ID NO: 1264428 - DNA, 22 bp, Artificial Sequence
  chemically synthesized
gtttgctgagaatgatggtttc

SEQ ID NO: 1264429 - DNA, 22 bp, Artificial Sequence
  chemically synthesized
gctgagaatgatggtttccagc

SEQ ID NO: 1264430 - DNA, 22 bp, Artificial Sequence
  chemically synthesized
ctgagaatgatggtttccagct

SEQ ID NO: 1264431 - DNA, 22 bp, Artificial Sequence
  chemically synthesized
agaatgatggtttccagcttca

SEQ ID NO: 1264432 - DNA, 22 bp, Artificial Sequence
  chemically synthesized
cagggacatggatgaagctgga

SEQ ID NO: 1264433 - DNA, 22 bp, Artificial Sequence
  chemically synthesized
gcagggacatggatgaagctgg

SEQ ID NO: 1264434 - DNA, 22 bp, Artificial Sequence
  chemically synthesized
tgcagggacatggatgaagctg

SEQ ID NO: 1264435 - DNA, 22 bp, Artificial Sequence
  chemically synthesized
tgtcctttgcagggacatggat

SEQ ID NO: 1264436 - DNA, 22 bp, Artificial Sequence
  chemically synthesized
atgtcctttgcagggacatgga

SEQ ID NO: 1264437 - DNA, 22 bp, Artificial Sequence
  chemically synthesized
ccagcttcatccatgtccctgc

SEQ ID NO: 1264438 - DNA, 22 bp, Artificial Sequence
  chemically synthesized
cagcttcatccatgtccctgca

SEQ ID NO: 1264439 - DNA, 22 bp, Artificial Sequence
  chemically synthesized
tgagtttatgtcctttgcaggg

SEQ ID NO: 1264440 - DNA, 22 bp, Artificial Sequence
  chemically synthesized
catccatgtccctgcaaaggac

SEQ ID NO: 1264441 - DNA, 22 bp, Artificial Sequence
  chemically synthesized
atccatgtccctgcaaaggaca

SEQ ID NO: 1264442 - DNA, 22 bp, Artificial Sequence
  chemically synthesized
caaaggacataaactcataatt

SEQ ID NO: 1264443 - DNA, 22 bp, Artificial Sequence
  chemically synthesized
tgcagccataaaaaattatgag

SEQ ID NO: 1264444 - DNA, 22 bp, Artificial Sequence
  chemically synthesized
ataattttttatggctgcacag

SEQ ID NO: 1264445 - DNA, 22 bp, Artificial Sequence
  chemically synthesized
tttatggctgcacagtattcca

SEQ ID NO: 1264446 - DNA, 22 bp, Artificial Sequence
  chemically synthesized
ttatggctgcacagtattccat

SEQ ID NO: 1264447 - DNA, 22 bp, Artificial Sequence
  chemically synthesized
tatggctgcacagtattccatg

SEQ ID NO: 1264448 - DNA, 22 bp, Artificial Sequence
  chemically synthesized
atggctgcacagtattccatgg

SEQ ID NO: 1264449 - DNA, 22 bp, Artificial Sequence
  chemically synthesized
tggctgcacagtattccatggt

SEQ ID NO: 1264450 - DNA, 22 bp, Artificial Sequence
  chemically synthesized
cacagtattccatggtgtatat

SEQ ID NO: 1264451 - DNA, 22 bp, Artificial Sequence
  chemically synthesized
gataaagaaaatgtggcacata

SEQ ID NO: 1264452 - DNA, 22 bp, Artificial Sequence
  chemically synthesized
catggtgtatatgtgccacatt

SEQ ID NO: 1264453 - DNA, 22 bp, Artificial Sequence
  chemically synthesized
aaatgcccatcaaagatagact

SEQ ID NO: 1264454 - DNA, 22 bp, Artificial Sequence
  chemically synthesized
tctttatccagtctatctttga

SEQ ID NO: 1264455 - DNA, 22 bp, Artificial Sequence
  chemically synthesized
ctttatccagtctatctttgat

SEQ ID NO: 1264456 - DNA, 22 bp, Artificial Sequence
  chemically synthesized
tttatccagtctatctttgatg

SEQ ID NO: 1264457 - DNA, 22 bp, Artificial Sequence
  chemically synthesized
tatccagtctatctttgatggg

SEQ ID NO: 1264458 - DNA, 22 bp, Artificial Sequence
  chemically synthesized
taagttgaaatgcccatcaaag

SEQ ID NO: 1264459 - DNA, 22 bp, Artificial Sequence
  chemically synthesized
atccagtctatctttgatgggc

SEQ ID NO: 1264460 - DNA, 22 bp, Artificial Sequence
  chemically synthesized
tccagtctatctttgatgggca

SEQ ID NO: 1264461 - DNA, 22 bp, Artificial Sequence
  chemically synthesized
attgtaagttgaaatgcccatc

SEQ ID NO: 1264462 - DNA, 22 bp, Artificial Sequence
  chemically synthesized
cattgtaagttgaaatgcccat

SEQ ID NO: 1264463 - DNA, 22 bp, Artificial Sequence
  chemically synthesized
tctttgatgggcatttcaactt

SEQ ID NO: 1264464 - DNA, 22 bp, Artificial Sequence
  chemically synthesized
tgatgggcatttcaacttacaa

SEQ ID NO: 1264465 - DNA, 22 bp, Artificial Sequence
  chemically synthesized
gatgggcatttcaacttacaat

SEQ ID NO: 1264466 - DNA, 22 bp, Artificial Sequence
  chemically synthesized
atgggcatttcaacttacaatg

SEQ ID NO: 1264467 - DNA, 22 bp, Artificial Sequence
  chemically synthesized
caacttacaatgaagttacatg

SEQ ID NO: 1264468 - DNA, 22 bp, Artificial Sequence
  chemically synthesized
aacttacaatgaagttacatgc

SEQ ID NO: 1264469 - DNA, 22 bp, Artificial Sequence
  chemically synthesized
tgatgggtatatcagcatgtaa

SEQ ID NO: 1264470 - DNA, 22 bp, Artificial Sequence
  chemically synthesized
acaatgaagttacatgctgata

SEQ ID NO: 1264471 - DNA, 22 bp, Artificial Sequence
  chemically synthesized
caatgaagttacatgctgatat

SEQ ID NO: 1264472 - DNA, 22 bp, Artificial Sequence
  chemically synthesized
caaactatgatgggtatatcag

SEQ ID NO: 1264473 - DNA, 22 bp, Artificial Sequence
  chemically synthesized
ccaaactatgatgggtatatca

SEQ ID NO: 1264474 - DNA, 22 bp, Artificial Sequence
  chemically synthesized
catgctgatatacccatcatag

SEQ ID NO: 1264475 - DNA, 22 bp, Artificial Sequence
  chemically synthesized
aaaatttccaaactatgatggg

SEQ ID NO: 1264476 - DNA, 22 bp, Artificial Sequence
  chemically synthesized
caaaatttccaaactatgatgg

SEQ ID NO: 1264477 - DNA, 22 bp, Artificial Sequence
  chemically synthesized
atatacccatcatagtttggaa

SEQ ID NO: 1264478 - DNA, 22 bp, Artificial Sequence
  chemically synthesized
aagtttcaaaatttccaaacta

SEQ ID NO: 1264479 - DNA, 22 bp, Artificial Sequence
  chemically synthesized
caagtttcaaaatttccaaact

SEQ ID NO: 1264480 - DNA, 22 bp, Artificial Sequence
  chemically synthesized
tcaagtttcaaaatttccaaac

SEQ ID NO: 1264481 - DNA, 22 bp, Artificial Sequence
  chemically synthesized
ggaaattttgaaacttgaaaat

SEQ ID NO: 1264482 - DNA, 22 bp, Artificial Sequence
  chemically synthesized
gaaattttgaaacttgaaaatg

SEQ ID NO: 1264483 - DNA, 22 bp, Artificial Sequence
  chemically synthesized
ggtgtatcaaatgcattttcaa

SEQ ID NO: 1264484 - DNA, 22 bp, Artificial Sequence
  chemically synthesized
ttaggtgtatcaaatgcatttt

SEQ ID NO: 1264485 - DNA, 22 bp, Artificial Sequence
  chemically synthesized
tgaaacttgaaaatgcatttga

SEQ ID NO: 1264486 - DNA, 22 bp, Artificial Sequence
  chemically synthesized
gaaacttgaaaatgcatttgat

SEQ ID NO: 1264487 - DNA, 22 bp, Artificial Sequence
  chemically synthesized
aaacttgaaaatgcatttgata

SEQ ID NO: 1264488 - DNA, 22 bp, Artificial Sequence
  chemically synthesized
gaaaatgcatttgatacaccta

SEQ ID NO: 1264489 - DNA, 22 bp, Artificial Sequence
  chemically synthesized
aaaatgcatttgatacacctaa

SEQ ID NO: 1264490 - DNA, 22 bp, Artificial Sequence
  chemically synthesized
tgatgtacagtctgttaggtgt

SEQ ID NO: 1264491 - DNA, 22 bp, Artificial Sequence
  chemically synthesized
acctatgatgtacagtctgtta

SEQ ID NO: 1264492 - DNA, 22 bp, Artificial Sequence
  chemically synthesized
gatacacctaacagactgtaca

SEQ ID NO: 1264493 - DNA, 22 bp, Artificial Sequence
  chemically synthesized
atacacctaacagactgtacat

SEQ ID NO: 1264494 - DNA, 22 bp, Artificial Sequence
  chemically synthesized
ggctaacctatgatgtacagtc

SEQ ID NO: 1264495 - DNA, 22 bp, Artificial Sequence
  chemically synthesized
acagactgtacatcataggtta

SEQ ID NO: 1264496 - DNA, 22 bp, Artificial Sequence
  chemically synthesized
agataggctaggctaacctatg

SEQ ID NO: 1264497 - DNA, 22 bp, Artificial Sequence
  chemically synthesized
aagataggctaggctaacctat

SEQ ID NO: 1264498 - DNA, 22 bp, Artificial Sequence
  chemically synthesized
tacatcataggttagcctagcc

SEQ ID NO: 1264499 - DNA, 22 bp, Artificial Sequence
  chemically synthesized
agcatgtttaagataggctagg

SEQ ID NO: 1264500 - DNA, 22 bp, Artificial Sequence
  chemically synthesized
taagcatgtttaagataggcta

SEQ ID NO: 1264501 - DNA, 22 bp, Artificial Sequence
  chemically synthesized
gcctagcctatcttaaacatgc

SEQ ID NO: 1264502 - DNA, 22 bp, Artificial Sequence
  chemically synthesized
acgtaagtgttctaagcatgtt

SEQ ID NO: 1264503 - DNA, 22 bp, Artificial Sequence
  chemically synthesized
gcctatcttaaacatgcttaga

SEQ ID NO: 1264504 - DNA, 22 bp, Artificial Sequence
  chemically synthesized
tcttaaacatgcttagaacact

SEQ ID NO: 1264505 - DNA, 22 bp, Artificial Sequence
  chemically synthesized
taggctaacgtaagtgttctaa

SEQ ID NO: 1264506 - DNA, 22 bp, Artificial Sequence
  chemically synthesized
aaacatgcttagaacacttacg

SEQ ID NO: 1264507 - DNA, 22 bp, Artificial Sequence
  chemically synthesized
aacatgcttagaacacttacgt

SEQ ID NO: 1264508 - DNA, 22 bp, Artificial Sequence
  chemically synthesized
ccaactgtaggctaacgtaagt

SEQ ID NO: 1264509 - DNA, 22 bp, Artificial Sequence
  chemically synthesized
cccaactgtaggctaacgtaag

SEQ ID NO: 1264510 - DNA, 22 bp, Artificial Sequence
  chemically synthesized
tcccaactgtaggctaacgtaa

SEQ ID NO: 1264511 - DNA, 22 bp, Artificial Sequence
  chemically synthesized
ttcccaactgtaggctaacgta

SEQ ID NO: 1264512 - DNA, 22 bp, Artificial Sequence
  chemically synthesized
tttcccaactgtaggctaacgt

SEQ ID NO: 1264513 - DNA, 22 bp, Artificial Sequence
  chemically synthesized
ttttcccaactgtaggctaacg

SEQ ID NO: 1264514 - DNA, 22 bp, Artificial Sequence
  chemically synthesized
agaacacttacgttagcctaca

SEQ ID NO: 1264515 - DNA, 22 bp, Artificial Sequence
  chemically synthesized
gaacacttacgttagcctacag

SEQ ID NO: 1264516 - DNA, 22 bp, Artificial Sequence
  chemically synthesized
tgatttttttcccaactgtagg

SEQ ID NO: 1264517 - DNA, 22 bp, Artificial Sequence
  chemically synthesized
atgatttttttcccaactgtag

SEQ ID NO: 1264518 - DNA, 22 bp, Artificial Sequence
  chemically synthesized
tatgatttttttcccaactgta

SEQ ID NO: 1264519 - DNA, 22 bp, Artificial Sequence
  chemically synthesized
acgttagcctacagttgggaaa

SEQ ID NO: 1264520 - DNA, 22 bp, Artificial Sequence
  chemically synthesized
cgttagcctacagttgggaaaa

SEQ ID NO: 1264521 - DNA, 22 bp, Artificial Sequence
  chemically synthesized
tgttttatgatttttttcccaa

SEQ ID NO: 1264522 - DNA, 22 bp, Artificial Sequence
  chemically synthesized
gtgttttatgatttttttccca

SEQ ID NO: 1264523 - DNA, 22 bp, Artificial Sequence
  chemically synthesized
tgtgttttatgatttttttccc

SEQ ID NO: 1264524 - DNA, 22 bp, Artificial Sequence
  chemically synthesized
gcctacagttgggaaaaaaatc

SEQ ID NO: 1264525 - DNA, 22 bp, Artificial Sequence
  chemically synthesized
cagttgggaaaaaaatcataaa

SEQ ID NO: 1264526 - DNA, 22 bp, Artificial Sequence
  chemically synthesized
taaaataggctttgtgttttat

SEQ ID NO: 1264527 - DNA, 22 bp, Artificial Sequence
  chemically synthesized
ggaaaaaaatcataaaacacaa

SEQ ID NO: 1264528 - DNA, 22 bp, Artificial Sequence
  chemically synthesized
ttataaaataggctttgtgttt

SEQ ID NO: 1264529 - DNA, 22 bp, Artificial Sequence
  chemically synthesized
attataaaataggctttgtgtt

SEQ ID NO: 1264530 - DNA, 22 bp, Artificial Sequence
  chemically synthesized
tattataaaataggctttgtgt

SEQ ID NO: 1264531 - DNA, 22 bp, Artificial Sequence
  chemically synthesized
aacattttattataaaataggc

SEQ ID NO: 1264532 - DNA, 22 bp, Artificial Sequence
  chemically synthesized
catgaaatattcaacattttat

SEQ ID NO: 1264533 - DNA, 22 bp, Artificial Sequence
  chemically synthesized
ttttataataaaatgttgaata

SEQ ID NO: 1264534 - DNA, 22 bp, Artificial Sequence
  chemically synthesized
tataataaaatgttgaatattt

SEQ ID NO: 1264535 - DNA, 22 bp, Artificial Sequence
  chemically synthesized
ataaattacatgaaatattcaa

SEQ ID NO: 1264536 - DNA, 22 bp, Artificial Sequence
  chemically synthesized
ataataaaatgttgaatatttc

SEQ ID NO: 1264537 - DNA, 22 bp, Artificial Sequence
  chemically synthesized
aataaattacatgaaatattca

SEQ ID NO: 1264538 - DNA, 22 bp, Artificial Sequence
  chemically synthesized
taataaaatgttgaatatttca

SEQ ID NO: 1264539 - DNA, 22 bp, Artificial Sequence
  chemically synthesized
agtatagtatttaataaattac

SEQ ID NO: 1264540 - DNA, 22 bp, Artificial Sequence
  chemically synthesized
cagtatagtatttaataaatta

SEQ ID NO: 1264541 - DNA, 22 bp, Artificial Sequence
  chemically synthesized
aatatttcatgtaatttattaa

SEQ ID NO: 1264542 - DNA, 22 bp, Artificial Sequence
  chemically synthesized
tcagtatagtatttaataaatt

SEQ ID NO: 1264543 - DNA, 22 bp, Artificial Sequence
  chemically synthesized
actttcagtatagtatttaata

SEQ ID NO: 1264544 - DNA, 22 bp, Artificial Sequence
  chemically synthesized
gactttcagtatagtatttaat

SEQ ID NO: 1264545 - DNA, 22 bp, Artificial Sequence
  chemically synthesized
tgactttcagtatagtatttaa

SEQ ID NO: 1264546 - DNA, 22 bp, Artificial Sequence
  chemically synthesized
catgtaatttattaaatactat

SEQ ID NO: 1264547 - DNA, 22 bp, Artificial Sequence
  chemically synthesized
atgtaatttattaaatactata

SEQ ID NO: 1264548 - DNA, 22 bp, Artificial Sequence
  chemically synthesized
gttttgactttcagtatagtat

SEQ ID NO: 1264549 - DNA, 22 bp, Artificial Sequence
  chemically synthesized
tggttttgactttcagtatagt

SEQ ID NO: 1264550 - DNA, 22 bp, Artificial Sequence
  chemically synthesized
ttctggttttgactttcagtat

SEQ ID NO: 1264551 - DNA, 22 bp, Artificial Sequence
  chemically synthesized
attaaatactatactgaaagtc

SEQ ID NO: 1264552 - DNA, 22 bp, Artificial Sequence
  chemically synthesized
ttaaatactatactgaaagtca

SEQ ID NO: 1264553 - DNA, 22 bp, Artificial Sequence
  chemically synthesized
aatactatactgaaagtcaaaa

SEQ ID NO: 1264554 - DNA, 22 bp, Artificial Sequence
  chemically synthesized
tacaactattctggttttgact

SEQ ID NO: 1264555 - DNA, 22 bp, Artificial Sequence
  chemically synthesized
tactgaaagtcaaaaccagaat

SEQ ID NO: 1264556 - DNA, 22 bp, Artificial Sequence
  chemically synthesized
aggacctatacaactattctgg

SEQ ID NO: 1264557 - DNA, 22 bp, Artificial Sequence
  chemically synthesized
gaggacctatacaactattctg

SEQ ID NO: 1264558 - DNA, 22 bp, Artificial Sequence
  chemically synthesized
aaagtcaaaaccagaatagttg

SEQ ID NO: 1264559 - DNA, 22 bp, Artificial Sequence
  chemically synthesized
tgaggacctatacaactattct

SEQ ID NO: 1264560 - DNA, 22 bp, Artificial Sequence
  chemically synthesized
tggaaaccatactttgaggacc

SEQ ID NO: 1264561 - DNA, 22 bp, Artificial Sequence
  chemically synthesized
atgctgtggaaaccatactttg

SEQ ID NO: 1264562 - DNA, 22 bp, Artificial Sequence
  chemically synthesized
tataggtcctcaaagtatggtt

SEQ ID NO: 1264563 - DNA, 22 bp, Artificial Sequence
  chemically synthesized
aaagtatggtttccacagcatg

SEQ ID NO: 1264564 - DNA, 22 bp, Artificial Sequence
  chemically synthesized
ggatggtgcgaaagtgatactc

SEQ ID NO: 1264565 - DNA, 22 bp, Artificial Sequence
  chemically synthesized
aggatggtgcgaaagtgatact

SEQ ID NO: 1264566 - DNA, 22 bp, Artificial Sequence
  chemically synthesized
taggatggtgcgaaagtgatac

SEQ ID NO: 1264567 - DNA, 22 bp, Artificial Sequence
  chemically synthesized
ccacagcatgagtatcactttc

SEQ ID NO: 1264568 - DNA, 22 bp, Artificial Sequence
  chemically synthesized
cacagcatgagtatcactttcg

SEQ ID NO: 1264569 - DNA, 22 bp, Artificial Sequence
  chemically synthesized
gactttaggatggtgcgaaagt

SEQ ID NO: 1264570 - DNA, 22 bp, Artificial Sequence
  chemically synthesized
cgactttaggatggtgcgaaag

SEQ ID NO: 1264571 - DNA, 22 bp, Artificial Sequence
  chemically synthesized
tcgactttaggatggtgcgaaa

SEQ ID NO: 1264572 - DNA, 22 bp, Artificial Sequence
  chemically synthesized
ttcgactttaggatggtgcgaa

SEQ ID NO: 1264573 - DNA, 22 bp, Artificial Sequence
  chemically synthesized
acaatttttcgactttaggatg

SEQ ID NO: 1264574 - DNA, 22 bp, Artificial Sequence
  chemically synthesized
aacaatttttcgactttaggat

SEQ ID NO: 1264575 - DNA, 22 bp, Artificial Sequence
  chemically synthesized
tcgcaccatcctaaagtcgaaa

SEQ ID NO: 1264576 - DNA, 22 bp, Artificial Sequence
  chemically synthesized
aacttaacaatttttcgacttt

SEQ ID NO: 1264577 - DNA, 22 bp, Artificial Sequence
  chemically synthesized
cgcaccatcctaaagtcgaaaa

SEQ ID NO: 1264578 - DNA, 22 bp, Artificial Sequence
  chemically synthesized
gcaccatcctaaagtcgaaaaa

SEQ ID NO: 1264579 - DNA, 22 bp, Artificial Sequence
  chemically synthesized
aagtcgaaaaattgttaagttg

SEQ ID NO: 1264580 - DNA, 22 bp, Artificial Sequence
  chemically synthesized
ttaagttgaactactgtatgtc

SEQ ID NO: 1264581 - DNA, 22 bp, Artificial Sequence
  chemically synthesized
agttgaactactgtatgtcggg

SEQ ID NO: 1264582 - DNA, 22 bp, Artificial Sequence
  chemically synthesized
aagtacagagatggtccccgac

SEQ ID NO: 1264583 - DNA, 22 bp, Artificial Sequence
  chemically synthesized
aactactgtatgtcggggacca

SEQ ID NO: 1264584 - DNA, 22 bp, Artificial Sequence
  chemically synthesized
caagtacagagatggtccccga

SEQ ID NO: 1264585 - DNA, 22 bp, Artificial Sequence
  chemically synthesized
tcaagtacagagatggtccccg

SEQ ID NO: 1264586 - DNA, 22 bp, Artificial Sequence
  chemically synthesized
ctttcaagtacagagatggtcc

SEQ ID NO: 1264587 - DNA, 22 bp, Artificial Sequence
  chemically synthesized
ctgtatgtcggggaccatctct

SEQ ID NO: 1264588 - DNA, 22 bp, Artificial Sequence
  chemically synthesized
tatgtcggggaccatctctgta

SEQ ID NO: 1264589 - DNA, 22 bp, Artificial Sequence
  chemically synthesized
actactttcaagtacagagatg

SEQ ID NO: 1264590 - DNA, 22 bp, Artificial Sequence
  chemically synthesized
tgactactttcaagtacagaga

SEQ ID NO: 1264591 - DNA, 22 bp, Artificial Sequence
  chemically synthesized
ctgactactttcaagtacagag

SEQ ID NO: 1264592 - DNA, 22 bp, Artificial Sequence
  chemically synthesized
tctgactactttcaagtacaga

SEQ ID NO: 1264593 - DNA, 22 bp, Artificial Sequence
  chemically synthesized
gttttctgactactttcaagta

SEQ ID NO: 1264594 - DNA, 22 bp, Artificial Sequence
  chemically synthesized
ggttttctgactactttcaagt

SEQ ID NO: 1264595 - DNA, 22 bp, Artificial Sequence
  chemically synthesized
tggttttctgactactttcaag

SEQ ID NO: 1264596 - DNA, 22 bp, Artificial Sequence
  chemically synthesized
ttggttttctgactactttcaa

SEQ ID NO: 1264597 - DNA, 22 bp, Artificial Sequence
  chemically synthesized
tttggttttctgactactttca

SEQ ID NO: 1264598 - DNA, 22 bp, Artificial Sequence
  chemically synthesized
ttttggttttctgactactttc

SEQ ID NO: 1264599 - DNA, 22 bp, Artificial Sequence
  chemically synthesized
cttttttggttttctgactact

SEQ ID NO: 1264600 - DNA, 22 bp, Artificial Sequence
  chemically synthesized
tgtacttgaaagtagtcagaaa

SEQ ID NO: 1264601 - DNA, 22 bp, Artificial Sequence
  chemically synthesized
ttacttttttggttttctgact

SEQ ID NO: 1264602 - DNA, 22 bp, Artificial Sequence
  chemically synthesized
tacttgaaagtagtcagaaaac

SEQ ID NO: 1264603 - DNA, 22 bp, Artificial Sequence
  chemically synthesized
attacttttttggttttctgac

SEQ ID NO: 1264604 - DNA, 22 bp, Artificial Sequence
  chemically synthesized
tattacttttttggttttctga

SEQ ID NO: 1264605 - DNA, 22 bp, Artificial Sequence
  chemically synthesized
ttattacttttttggttttctg

SEQ ID NO: 1264606 - DNA, 22 bp, Artificial Sequence
  chemically synthesized
gaaagtagtcagaaaaccaaaa

SEQ ID NO: 1264607 - DNA, 22 bp, Artificial Sequence
  chemically synthesized
aaagtagtcagaaaaccaaaaa

SEQ ID NO: 1264608 - DNA, 22 bp, Artificial Sequence
  chemically synthesized
ataataataataataataccgt

SEQ ID NO: 1264609 - DNA, 22 bp, Artificial Sequence
  chemically synthesized
gacctaataataataataataa

SEQ ID NO: 1264610 - DNA, 22 bp, Artificial Sequence
  chemically synthesized
agtagaatactagacctaataa

SEQ ID NO: 1264611 - DNA, 22 bp, Artificial Sequence
  chemically synthesized
taagtagaatactagacctaat

SEQ ID NO: 1264612 - DNA, 22 bp, Artificial Sequence
  chemically synthesized
ttattattattattaggtctag

SEQ ID NO: 1264613 - DNA, 22 bp, Artificial Sequence
  chemically synthesized
tctaagtagaatactagaccta

SEQ ID NO: 1264614 - DNA, 22 bp, Artificial Sequence
  chemically synthesized
ctctaagtagaatactagacct

SEQ ID NO: 1264615 - DNA, 22 bp, Artificial Sequence
  chemically synthesized
ttattattattaggtctagtat

SEQ ID NO: 1264616 - DNA, 22 bp, Artificial Sequence
  chemically synthesized
tctctaagtagaatactagacc

SEQ ID NO: 1264617 - DNA, 22 bp, Artificial Sequence
  chemically synthesized
tttctctaagtagaatactaga

SEQ ID NO: 1264618 - DNA, 22 bp, Artificial Sequence
  chemically synthesized
ttattattaggtctagtattct

SEQ ID NO: 1264619 - DNA, 22 bp, Artificial Sequence
  chemically synthesized
ctctttctctaagtagaatact

SEQ ID NO: 1264620 - DNA, 22 bp, Artificial Sequence
  chemically synthesized
ttattaggtctagtattctact

SEQ ID NO: 1264621 - DNA, 22 bp, Artificial Sequence
  chemically synthesized
ttaggtctagtattctacttag

SEQ ID NO: 1264622 - DNA, 22 bp, Artificial Sequence
  chemically synthesized
ggtctagtattctacttagaga

SEQ ID NO: 1264623 - DNA, 22 bp, Artificial Sequence
  chemically synthesized
gtggaagttcctctttctctaa

SEQ ID NO: 1264624 - DNA, 22 bp, Artificial Sequence
  chemically synthesized
agtggaagttcctctttctcta

SEQ ID NO: 1264625 - DNA, 22 bp, Artificial Sequence
  chemically synthesized
gtattctacttagagaaagagg

SEQ ID NO: 1264626 - DNA, 22 bp, Artificial Sequence
  chemically synthesized
tacttagagaaagaggaacttc

SEQ ID NO: 1264627 - DNA, 22 bp, Artificial Sequence
  chemically synthesized
cttagagaaagaggaacttcca

SEQ ID NO: 1264628 - DNA, 22 bp, Artificial Sequence
  chemically synthesized
atccagatacttagtggaagtt

SEQ ID NO: 1264629 - DNA, 22 bp, Artificial Sequence
  chemically synthesized
agagaaagaggaacttccacta

SEQ ID NO: 1264630 - DNA, 22 bp, Artificial Sequence
  chemically synthesized
aatccagatacttagtggaagt

SEQ ID NO: 1264631 - DNA, 22 bp, Artificial Sequence
  chemically synthesized
gagaaagaggaacttccactaa

SEQ ID NO: 1264632 - DNA, 22 bp, Artificial Sequence
  chemically synthesized
taatccagatacttagtggaag

SEQ ID NO: 1264633 - DNA, 22 bp, Artificial Sequence
  chemically synthesized
ttaatccagatacttagtggaa

SEQ ID NO: 1264634 - DNA, 22 bp, Artificial Sequence
  chemically synthesized
ttttaatccagatacttagtgg

SEQ ID NO: 1264635 - DNA, 22 bp, Artificial Sequence
  chemically synthesized
cttttaatccagatacttagtg

SEQ ID NO: 1264636 - DNA, 22 bp, Artificial Sequence
  chemically synthesized
ccactaagtatctggattaaaa

SEQ ID NO: 1264637 - DNA, 22 bp, Artificial Sequence
  chemically synthesized
cactaagtatctggattaaaag

SEQ ID NO: 1264638 - DNA, 22 bp, Artificial Sequence
  chemically synthesized
agtatctggattaaaagaagct

SEQ ID NO: 1264639 - DNA, 22 bp, Artificial Sequence
  chemically synthesized
tataaataacaaaagcttcttt

SEQ ID NO: 1264640 - DNA, 22 bp, Artificial Sequence
  chemically synthesized
gttgtataaataacaaaagctt

SEQ ID NO: 1264641 - DNA, 22 bp, Artificial Sequence
  chemically synthesized
agttgtataaataacaaaagct

SEQ ID NO: 1264642 - DNA, 22 bp, Artificial Sequence
  chemically synthesized
tagttgtataaataacaaaagc

SEQ ID NO: 1264643 - DNA, 22 bp, Artificial Sequence
  chemically synthesized
gattaaaagaagcttttgttat

SEQ ID NO: 1264644 - DNA, 22 bp, Artificial Sequence
  chemically synthesized
aaagaagcttttgttatttata

SEQ ID NO: 1264645 - DNA, 22 bp, Artificial Sequence
  chemically synthesized
caacgttttagttgtataaata

SEQ ID NO: 1264646 - DNA, 22 bp, Artificial Sequence
  chemically synthesized
tacaacgttttagttgtataaa

SEQ ID NO: 1264647 - DNA, 22 bp, Artificial Sequence
  chemically synthesized
ctacaacgttttagttgtataa

SEQ ID NO: 1264648 - DNA, 22 bp, Artificial Sequence
  chemically synthesized
ttgttatttatacaactaaaac

SEQ ID NO: 1264649 - DNA, 22 bp, Artificial Sequence
  chemically synthesized
tgttatttatacaactaaaacg

SEQ ID NO: 1264650 - DNA, 22 bp, Artificial Sequence
  chemically synthesized
gttatttatacaactaaaacgt

SEQ ID NO: 1264651 - DNA, 22 bp, Artificial Sequence
  chemically synthesized
ttatttatacaactaaaacgtt

SEQ ID NO: 1264652 - DNA, 22 bp, Artificial Sequence
  chemically synthesized
tttatacaactaaaacgttgta

SEQ ID NO: 1264653 - DNA, 22 bp, Artificial Sequence
  chemically synthesized
ggaaataatttctacaacgttt

SEQ ID NO: 1264654 - DNA, 22 bp, Artificial Sequence
  chemically synthesized
atacaactaaaacgttgtagaa

SEQ ID NO: 1264655 - DNA, 22 bp, Artificial Sequence
  chemically synthesized
tacaactaaaacgttgtagaaa

SEQ ID NO: 1264656 - DNA, 22 bp, Artificial Sequence
  chemically synthesized
gttgggaaataatttctacaac

SEQ ID NO: 1264657 - DNA, 22 bp, Artificial Sequence
  chemically synthesized
attagttgggaaataatttcta

SEQ ID NO: 1264658 - DNA, 22 bp, Artificial Sequence
  chemically synthesized
gattagttgggaaataatttct

SEQ ID NO: 1264659 - DNA, 22 bp, Artificial Sequence
  chemically synthesized
aaacgttgtagaaattatttcc

SEQ ID NO: 1264660 - DNA, 22 bp, Artificial Sequence
  chemically synthesized
aaagcgtcttgattagttggga

SEQ ID NO: 1264661 - DNA, 22 bp, Artificial Sequence
  chemically synthesized
tagaaattatttcccaactaat

SEQ ID NO: 1264662 - DNA, 22 bp, Artificial Sequence
  chemically synthesized
aaaagcgtcttgattagttggg

SEQ ID NO: 1264663 - DNA, 22 bp, Artificial Sequence
  chemically synthesized
tttcccaactaatcaagacgct

SEQ ID NO: 1264664 - DNA, 22 bp, Artificial Sequence
  chemically synthesized
tgaaggcatttaaaagcgtctt

SEQ ID NO: 1264665 - DNA, 22 bp, Artificial Sequence
  chemically synthesized
cccaactaatcaagacgctttt

SEQ ID NO: 1264666 - DNA, 22 bp, Artificial Sequence
  chemically synthesized
ccaactaatcaagacgctttta

SEQ ID NO: 1264667 - DNA, 22 bp, Artificial Sequence
  chemically synthesized
gattgtgaaggcatttaaaagc

SEQ ID NO: 1264668 - DNA, 22 bp, Artificial Sequence
  chemically synthesized
atcaagacgcttttaaatgcct

SEQ ID NO: 1264669 - DNA, 22 bp, Artificial Sequence
  chemically synthesized
tgattagattgtgaaggcattt

SEQ ID NO: 1264670 - DNA, 22 bp, Artificial Sequence
  chemically synthesized
ttaaatgccttcacaatctaat

SEQ ID NO: 1264671 - DNA, 22 bp, Artificial Sequence
  chemically synthesized
taaatgccttcacaatctaatc

SEQ ID NO: 1264672 - DNA, 22 bp, Artificial Sequence
  chemically synthesized
aaatgccttcacaatctaatca

SEQ ID NO: 1264673 - DNA, 22 bp, Artificial Sequence
  chemically synthesized
aatgccttcacaatctaatcat

SEQ ID NO: 1264674 - DNA, 22 bp, Artificial Sequence
  chemically synthesized
gaaaagcaggttatgattagat

SEQ ID NO: 1264675 - DNA, 22 bp, Artificial Sequence
  chemically synthesized
cacaatctaatcataacctgct

SEQ ID NO: 1264676 - DNA, 22 bp, Artificial Sequence
  chemically synthesized
acaatctaatcataacctgctt

SEQ ID NO: 1264677 - DNA, 22 bp, Artificial Sequence
  chemically synthesized
atcataacctgcttttctagcc

SEQ ID NO: 1264678 - DNA, 22 bp, Artificial Sequence
  chemically synthesized
ggtgaaataccaaaaatagggc

SEQ ID NO: 1264679 - DNA, 22 bp, Artificial Sequence
  chemically synthesized
gggtgaaataccaaaaataggg

SEQ ID NO: 1264680 - DNA, 22 bp, Artificial Sequence
  chemically synthesized
cttttctagccctatttttggt

SEQ ID NO: 1264681 - DNA, 22 bp, Artificial Sequence
  chemically synthesized
ttctagccctatttttggtatt

SEQ ID NO: 1264682 - DNA, 22 bp, Artificial Sequence
  chemically synthesized
tctagccctatttttggtattt

SEQ ID NO: 1264683 - DNA, 22 bp, Artificial Sequence
  chemically synthesized
aatgcttgggtgaaataccaaa

SEQ ID NO: 1264684 - DNA, 22 bp, Artificial Sequence
  chemically synthesized
ctagccctatttttggtatttc

SEQ ID NO: 1264685 - DNA, 22 bp, Artificial Sequence
  chemically synthesized
gaatgcttgggtgaaataccaa

SEQ ID NO: 1264686 - DNA, 22 bp, Artificial Sequence
  chemically synthesized
tagccctatttttggtatttca

SEQ ID NO: 1264687 - DNA, 22 bp, Artificial Sequence
  chemically synthesized
gccctatttttggtatttcacc

SEQ ID NO: 1264688 - DNA, 22 bp, Artificial Sequence
  chemically synthesized
aaatcttgaatgcttgggtgaa

SEQ ID NO: 1264689 - DNA, 22 bp, Artificial Sequence
  chemically synthesized
tttttggtatttcacccaagca

SEQ ID NO: 1264690 - DNA, 22 bp, Artificial Sequence
  chemically synthesized
tgaaatcttgaatgcttgggtg

SEQ ID NO: 1264691 - DNA, 22 bp, Artificial Sequence
  chemically synthesized
ctgaaatcttgaatgcttgggt

SEQ ID NO: 1264692 - DNA, 22 bp, Artificial Sequence
  chemically synthesized
ttggtatttcacccaagcattc

SEQ ID NO: 1264693 - DNA, 22 bp, Artificial Sequence
  chemically synthesized
tggtatttcacccaagcattca

SEQ ID NO: 1264694 - DNA, 22 bp, Artificial Sequence
  chemically synthesized
ggtatttcacccaagcattcaa

SEQ ID NO: 1264695 - DNA, 22 bp, Artificial Sequence
  chemically synthesized
gtatttcacccaagcattcaag

SEQ ID NO: 1264696 - DNA, 22 bp, Artificial Sequence
  chemically synthesized
tatgtttctgaaatcttgaatg

SEQ ID NO: 1264697 - DNA, 22 bp, Artificial Sequence
  chemically synthesized
cacccaagcattcaagatttca

SEQ ID NO: 1264698 - DNA, 22 bp, Artificial Sequence
  chemically synthesized
acccaagcattcaagatttcag

SEQ ID NO: 1264699 - DNA, 22 bp, Artificial Sequence
  chemically synthesized
aagatttcagaaacatatagct

SEQ ID NO: 1264700 - DNA, 22 bp, Artificial Sequence
  chemically synthesized
ggaaggacaatgggtagctata

SEQ ID NO: 1264701 - DNA, 22 bp, Artificial Sequence
  chemically synthesized
cagaaacatatagctacccatt

SEQ ID NO: 1264702 - DNA, 22 bp, Artificial Sequence
  chemically synthesized
agaaacatatagctacccattg

SEQ ID NO: 1264703 - DNA, 22 bp, Artificial Sequence
  chemically synthesized
atagtatctgggaaggacaatg

SEQ ID NO: 1264704 - DNA, 22 bp, Artificial Sequence
  chemically synthesized
catagtatctgggaaggacaat

SEQ ID NO: 1264705 - DNA, 22 bp, Artificial Sequence
  chemically synthesized
cccattgtccttcccagatact

SEQ ID NO: 1264706 - DNA, 22 bp, Artificial Sequence
  chemically synthesized
aaggaatgtaatttcatagtat

SEQ ID NO: 1264707 - DNA, 22 bp, Artificial Sequence
  chemically synthesized
aaaggaatgtaatttcatagta

SEQ ID NO: 1264708 - DNA, 22 bp, Artificial Sequence
  chemically synthesized
tccttcccagatactatgaaat

SEQ ID NO: 1264709 - DNA, 22 bp, Artificial Sequence
  chemically synthesized
cccagatactatgaaattacat

SEQ ID NO: 1264710 - DNA, 22 bp, Artificial Sequence
  chemically synthesized
ccagatactatgaaattacatt

SEQ ID NO: 1264711 - DNA, 22 bp, Artificial Sequence
  chemically synthesized
tgaaattacattcctttaagct

SEQ ID NO: 1264712 - DNA, 22 bp, Artificial Sequence
  chemically synthesized
cattcctttaagcttttgtaca

SEQ ID NO: 1264713 - DNA, 22 bp, Artificial Sequence
  chemically synthesized
ctttaagcttttgtacatgttg

SEQ ID NO: 1264714 - DNA, 22 bp, Artificial Sequence
  chemically synthesized
caggagggagggaccaacatgt

SEQ ID NO: 1264715 - DNA, 22 bp, Artificial Sequence
  chemically synthesized
taagcttttgtacatgttggtc

SEQ ID NO: 1264716 - DNA, 22 bp, Artificial Sequence
  chemically synthesized
aagcttttgtacatgttggtcc

SEQ ID NO: 1264717 - DNA, 22 bp, Artificial Sequence
  chemically synthesized
agcttttgtacatgttggtccc

SEQ ID NO: 1264718 - DNA, 22 bp, Artificial Sequence
  chemically synthesized
cattccaggagggagggaccaa

SEQ ID NO: 1264719 - DNA, 22 bp, Artificial Sequence
  chemically synthesized
ttgtacatgttggtccctccct

SEQ ID NO: 1264720 - DNA, 22 bp, Artificial Sequence
  chemically synthesized
tgtacatgttggtccctccctc

SEQ ID NO: 1264721 - DNA, 22 bp, Artificial Sequence
  chemically synthesized
gtacatgttggtccctccctcc

SEQ ID NO: 1264722 - DNA, 22 bp, Artificial Sequence
  chemically synthesized
tacatgttggtccctccctcct

SEQ ID NO: 1264723 - DNA, 22 bp, Artificial Sequence
  chemically synthesized
gtccctccctcctggaatgcaa

SEQ ID NO: 1264724 - DNA, 22 bp, Artificial Sequence
  chemically synthesized
tggaggagtaggggttgcattc

SEQ ID NO: 1264725 - DNA, 22 bp, Artificial Sequence
  chemically synthesized
cctcctggaatgcaacccctac

SEQ ID NO: 1264726 - DNA, 22 bp, Artificial Sequence
  chemically synthesized
gggttatggaggagtaggggtt

SEQ ID NO: 1264727 - DNA, 22 bp, Artificial Sequence
  chemically synthesized
ctggaatgcaacccctactcct

SEQ ID NO: 1264728 - DNA, 22 bp, Artificial Sequence
  chemically synthesized
gaatgcaacccctactcctcca

SEQ ID NO: 1264729 - DNA, 22 bp, Artificial Sequence
  chemically synthesized
tcaaatgaagaattggggttat

SEQ ID NO: 1264730 - DNA, 22 bp, Artificial Sequence
  chemically synthesized
atcaaatgaagaattggggtta

SEQ ID NO: 1264731 - DNA, 22 bp, Artificial Sequence
  chemically synthesized
ctcctccataaccccaattctt

SEQ ID NO: 1264732 - DNA, 22 bp, Artificial Sequence
  chemically synthesized
ctccataaccccaattcttcat

SEQ ID NO: 1264733 - DNA, 22 bp, Artificial Sequence
  chemically synthesized
cataaccccaattcttcatttg

SEQ ID NO: 1264734 - DNA, 22 bp, Artificial Sequence
  chemically synthesized
aaagcatgtaaagatttatcaa

SEQ ID NO: 1264735 - DNA, 22 bp, Artificial Sequence
  chemically synthesized
ttcatttgataaatctttacat

SEQ ID NO: 1264736 - DNA, 22 bp, Artificial Sequence
  chemically synthesized
catttgataaatctttacatgc

SEQ ID NO: 1264737 - DNA, 22 bp, Artificial Sequence
  chemically synthesized
atttgataaatctttacatgct

SEQ ID NO: 1264738 - DNA, 22 bp, Artificial Sequence
  chemically synthesized
agataaatctcaaagcatgtaa

SEQ ID NO: 1264739 - DNA, 22 bp, Artificial Sequence
  chemically synthesized
gagataaatctcaaagcatgta

SEQ ID NO: 1264740 - DNA, 22 bp, Artificial Sequence
  chemically synthesized
gataaatctttacatgctttga

SEQ ID NO: 1264741 - DNA, 22 bp, Artificial Sequence
  chemically synthesized
ataaatctttacatgctttgag

SEQ ID NO: 1264742 - DNA, 22 bp, Artificial Sequence
  chemically synthesized
tacatgctttgagatttatctc

SEQ ID NO: 1264743 - DNA, 22 bp, Artificial Sequence
  chemically synthesized
acatgctttgagatttatctca

SEQ ID NO: 1264744 - DNA, 22 bp, Artificial Sequence
  chemically synthesized
catgctttgagatttatctcaa

SEQ ID NO: 1264745 - DNA, 22 bp, Artificial Sequence
  chemically synthesized
tgagatttatctcaaatattac

SEQ ID NO: 1264746 - DNA, 22 bp, Artificial Sequence
  chemically synthesized
gagatttatctcaaatattacc

SEQ ID NO: 1264747 - DNA, 22 bp, Artificial Sequence
  chemically synthesized
agatttatctcaaatattaccc

SEQ ID NO: 1264748 - DNA, 22 bp, Artificial Sequence
  chemically synthesized
gggtaggaggaatggggtaata

SEQ ID NO: 1264749 - DNA, 22 bp, Artificial Sequence
  chemically synthesized
agggtaggaggaatggggtaat

SEQ ID NO: 1264750 - DNA, 22 bp, Artificial Sequence
  chemically synthesized
atctcaaatattaccccattcc

SEQ ID NO: 1264751 - DNA, 22 bp, Artificial Sequence
  chemically synthesized
cttagggtaggaggaatggggt

SEQ ID NO: 1264752 - DNA, 22 bp, Artificial Sequence
  chemically synthesized
tctcaaatattaccccattcct

SEQ ID NO: 1264753 - DNA, 22 bp, Artificial Sequence
  chemically synthesized
gcttagggtaggaggaatgggg

SEQ ID NO: 1264754 - DNA, 22 bp, Artificial Sequence
  chemically synthesized
tgcttagggtaggaggaatggg

SEQ ID NO: 1264755 - DNA, 22 bp, Artificial Sequence
  chemically synthesized
aaatattaccccattcctccta

SEQ ID NO: 1264756 - DNA, 22 bp, Artificial Sequence
  chemically synthesized
ccccattcctcctaccctaagc

SEQ ID NO: 1264757 - DNA, 22 bp, Artificial Sequence
  chemically synthesized
ctcctaccctaagcaaaaccat

SEQ ID NO: 1264758 - DNA, 22 bp, Artificial Sequence
  chemically synthesized
ctaccctaagcaaaaccattca

SEQ ID NO: 1264759 - DNA, 22 bp, Artificial Sequence
  chemically synthesized
ccctaagcaaaaccattcattt

SEQ ID NO: 1264760 - DNA, 22 bp, Artificial Sequence
  chemically synthesized
agcaaaaccattcatttctttt

SEQ ID NO: 1264761 - DNA, 22 bp, Artificial Sequence
  chemically synthesized
atttcttttgcattatatatat

SEQ ID NO: 1264762 - DNA, 22 bp, Artificial Sequence
  chemically synthesized
tgtatgcaatagtaaatatata

SEQ ID NO: 1264763 - DNA, 22 bp, Artificial Sequence
  chemically synthesized
cttttgcattatatatatttac

SEQ ID NO: 1264764 - DNA, 22 bp, Artificial Sequence
  chemically synthesized
gtgtatgcaatagtaaatatat

SEQ ID NO: 1264765 - DNA, 22 bp, Artificial Sequence
  chemically synthesized
ttttgcattatatatatttact

SEQ ID NO: 1264766 - DNA, 22 bp, Artificial Sequence
  chemically synthesized
tgtgtatgcaatagtaaatata

SEQ ID NO: 1264767 - DNA, 22 bp, Artificial Sequence
  chemically synthesized
ttgcattatatatatttactat

SEQ ID NO: 1264768 - DNA, 22 bp, Artificial Sequence
  chemically synthesized
tgcattatatatatttactatt

SEQ ID NO: 1264769 - DNA, 22 bp, Artificial Sequence
  chemically synthesized
gcattatatatatttactattg

SEQ ID NO: 1264770 - DNA, 22 bp, Artificial Sequence
  chemically synthesized
cattatatatatttactattgc

SEQ ID NO: 1264771 - DNA, 22 bp, Artificial Sequence
  chemically synthesized
tatatatttactattgcataca

SEQ ID NO: 1264772 - DNA, 22 bp, Artificial Sequence
  chemically synthesized
actattgcatacacaaaatgct

SEQ ID NO: 1264773 - DNA, 22 bp, Artificial Sequence
  chemically synthesized
ctattgcatacacaaaatgcta

SEQ ID NO: 1264774 - DNA, 22 bp, Artificial Sequence
  chemically synthesized
ttgcatacacaaaatgctacat

SEQ ID NO: 1264775 - DNA, 22 bp, Artificial Sequence
  chemically synthesized
catacacaaaatgctacattct

SEQ ID NO: 1264776 - DNA, 22 bp, Artificial Sequence
  chemically synthesized
gtatagtgtgtcatagagaatg

SEQ ID NO: 1264777 - DNA, 22 bp, Artificial Sequence
  chemically synthesized
acaacctagtatagtgtgtcat

SEQ ID NO: 1264778 - DNA, 22 bp, Artificial Sequence
  chemically synthesized
cattctctatgacacactatac

SEQ ID NO: 1264779 - DNA, 22 bp, Artificial Sequence
  chemically synthesized
atgagttcacaacctagtatag

SEQ ID NO: 1264780 - DNA, 22 bp, Artificial Sequence
  chemically synthesized
tctatgacacactatactaggt

SEQ ID NO: 1264781 - DNA, 22 bp, Artificial Sequence
  chemically synthesized
gatgagttcacaacctagtata

SEQ ID NO: 1264782 - DNA, 22 bp, Artificial Sequence
  chemically synthesized
tatgacacactatactaggttg

SEQ ID NO: 1264783 - DNA, 22 bp, Artificial Sequence
  chemically synthesized
tgacacactatactaggttgtg

SEQ ID NO: 1264784 - DNA, 22 bp, Artificial Sequence
  chemically synthesized
tactaggttgtgaactcatcaa

SEQ ID NO: 1264785 - DNA, 22 bp, Artificial Sequence
  chemically synthesized
aaaaatagtgcacttgatgagt

SEQ ID NO: 1264786 - DNA, 22 bp, Artificial Sequence
  chemically synthesized
ggttgtgaactcatcaagtgca

SEQ ID NO: 1264787 - DNA, 22 bp, Artificial Sequence
  chemically synthesized
tgaactcatcaagtgcactatt

SEQ ID NO: 1264788 - DNA, 22 bp, Artificial Sequence
  chemically synthesized
atcaagtgcactattttttaat

SEQ ID NO: 1264789 - DNA, 22 bp, Artificial Sequence
  chemically synthesized
ggtgtaaagaatggaaaaatta

SEQ ID NO: 1264790 - DNA, 22 bp, Artificial Sequence
  chemically synthesized
agttaggtgtaaagaatggaaa

SEQ ID NO: 1264791 - DNA, 22 bp, Artificial Sequence
  chemically synthesized
gagttaggtgtaaagaatggaa

SEQ ID NO: 1264792 - DNA, 22 bp, Artificial Sequence
  chemically synthesized
ttttttaatttttccattcttt

SEQ ID NO: 1264793 - DNA, 22 bp, Artificial Sequence
  chemically synthesized
tttaatttttccattctttaca

SEQ ID NO: 1264794 - DNA, 22 bp, Artificial Sequence
  chemically synthesized
ttaatttttccattctttacac

SEQ ID NO: 1264795 - DNA, 22 bp, Artificial Sequence
  chemically synthesized
taatttttccattctttacacc

SEQ ID NO: 1264796 - DNA, 22 bp, Artificial Sequence
  chemically synthesized
aatttttccattctttacacct

SEQ ID NO: 1264797 - DNA, 22 bp, Artificial Sequence
  chemically synthesized
atttttccattctttacaccta

SEQ ID NO: 1264798 - DNA, 22 bp, Artificial Sequence
  chemically synthesized
ttccattctttacacctaactc

SEQ ID NO: 1264799 - DNA, 22 bp, Artificial Sequence
  chemically synthesized
tccattctttacacctaactca

SEQ ID NO: 1264800 - DNA, 22 bp, Artificial Sequence
  chemically synthesized
ccattctttacacctaactcaa

SEQ ID NO: 1264801 - DNA, 22 bp, Artificial Sequence
  chemically synthesized
cattctttacacctaactcaag

SEQ ID NO: 1264802 - DNA, 22 bp, Artificial Sequence
  chemically synthesized
tttacacctaactcaagtctat

SEQ ID NO: 1264803 - DNA, 22 bp, Artificial Sequence
  chemically synthesized
tacacctaactcaagtctatgc

SEQ ID NO: 1264804 - DNA, 22 bp, Artificial Sequence
  chemically synthesized
acacctaactcaagtctatgca

SEQ ID NO: 1264805 - DNA, 22 bp, Artificial Sequence
  chemically synthesized
cacctaactcaagtctatgcat

SEQ ID NO: 1264806 - DNA, 22 bp, Artificial Sequence
  chemically synthesized
actcaagtctatgcatatattt

SEQ ID NO: 1264807 - DNA, 22 bp, Artificial Sequence
  chemically synthesized
aagtctatgcatatatttttct

SEQ ID NO: 1264808 - DNA, 22 bp, Artificial Sequence
  chemically synthesized
tgcatatatttttctattatat

SEQ ID NO: 1264809 - DNA, 22 bp, Artificial Sequence
  chemically synthesized
ttctattatatgattcatatat

SEQ ID NO: 1264810 - DNA, 22 bp, Artificial Sequence
  chemically synthesized
tctattatatgattcatatatt

SEQ ID NO: 1264811 - DNA, 22 bp, Artificial Sequence
  chemically synthesized
ctattatatgattcatatatta

SEQ ID NO: 1264812 - DNA, 22 bp, Artificial Sequence
  chemically synthesized
tattatatgattcatatattat

SEQ ID NO: 1264813 - DNA, 22 bp, Artificial Sequence
  chemically synthesized
ttatatgattcatatattatat

SEQ ID NO: 1264814 - DNA, 22 bp, Artificial Sequence
  chemically synthesized
tatgattcatatattatatatt

SEQ ID NO: 1264815 - DNA, 22 bp, Artificial Sequence
  chemically synthesized
atatattatatattatacattt

SEQ ID NO: 1264816 - DNA, 22 bp, Artificial Sequence
  chemically synthesized
tatattatacatttattatata

SEQ ID NO: 1264817 - DNA, 22 bp, Artificial Sequence
  chemically synthesized
atatagtataaaataatatata

SEQ ID NO: 1264818 - DNA, 22 bp, Artificial Sequence
  chemically synthesized
tacatttattatatatattatt

SEQ ID NO: 1264819 - DNA, 22 bp, Artificial Sequence
  chemically synthesized
attatatatattattttatact

SEQ ID NO: 1264820 - DNA, 22 bp, Artificial Sequence
  chemically synthesized
ttatatatattattttatacta

SEQ ID NO: 1264821 - DNA, 22 bp, Artificial Sequence
  chemically synthesized
atatgtattaatatagtataaa

SEQ ID NO: 1264822 - DNA, 22 bp, Artificial Sequence
  chemically synthesized
tatatattattttatactatat

SEQ ID NO: 1264823 - DNA, 22 bp, Artificial Sequence
  chemically synthesized
ttaatatgtattaatatagtat

SEQ ID NO: 1264824 - DNA, 22 bp, Artificial Sequence
  chemically synthesized
attgttaatatgtattaatata

SEQ ID NO: 1264825 - DNA, 22 bp, Artificial Sequence
  chemically synthesized
ttttatactatattaatacata

SEQ ID NO: 1264826 - DNA, 22 bp, Artificial Sequence
  chemically synthesized
tatactatattaatacatatta

SEQ ID NO: 1264827 - DNA, 22 bp, Artificial Sequence
  chemically synthesized
atactatattaatacatattaa

SEQ ID NO: 1264828 - DNA, 22 bp, Artificial Sequence
  chemically synthesized
tactatattaatacatattaac

SEQ ID NO: 1264829 - DNA, 22 bp, Artificial Sequence
  chemically synthesized
tattaatacatattaacaatta

SEQ ID NO: 1264830 - DNA, 22 bp, Artificial Sequence
  chemically synthesized
atacatattaacaattaatact

SEQ ID NO: 1264831 - DNA, 22 bp, Artificial Sequence
  chemically synthesized
acatatatgaaatatatatagt

SEQ ID NO: 1264832 - DNA, 22 bp, Artificial Sequence
  chemically synthesized
aacatatatgaaatatatatag

SEQ ID NO: 1264833 - DNA, 22 bp, Artificial Sequence
  chemically synthesized
acaattaatactatatatattt

SEQ ID NO: 1264834 - DNA, 22 bp, Artificial Sequence
  chemically synthesized
atactatatatatttcatatat

SEQ ID NO: 1264835 - DNA, 22 bp, Artificial Sequence
  chemically synthesized
tatatatttcatatatgttaaa

SEQ ID NO: 1264836 - DNA, 22 bp, Artificial Sequence
  chemically synthesized
catatatgttaaattatgcatt

SEQ ID NO: 1264837 - DNA, 22 bp, Artificial Sequence
  chemically synthesized
atatatgttaaattatgcattt

SEQ ID NO: 1264838 - DNA, 22 bp, Artificial Sequence
  chemically synthesized
aattatgcattttatcttatta

SEQ ID NO: 1264839 - DNA, 22 bp, Artificial Sequence
  chemically synthesized
tgcattttatcttattacatat

SEQ ID NO: 1264840 - DNA, 22 bp, Artificial Sequence
  chemically synthesized
tatcttattacatattatatat

SEQ ID NO: 1264841 - DNA, 22 bp, Artificial Sequence
  chemically synthesized
atcttattacatattatatata

SEQ ID NO: 1264842 - DNA, 22 bp, Artificial Sequence
  chemically synthesized
tcttattacatattatatatat

SEQ ID NO: 1264843 - DNA, 22 bp, Artificial Sequence
  chemically synthesized
attacatattatatatattcat

SEQ ID NO: 1264844 - DNA, 22 bp, Artificial Sequence
  chemically synthesized
ttacatattatatatattcata

SEQ ID NO: 1264845 - DNA, 22 bp, Artificial Sequence
  chemically synthesized
catattatatatattcatatga

SEQ ID NO: 1264846 - DNA, 22 bp, Artificial Sequence
  chemically synthesized
tatatattcatatgattcatat

SEQ ID NO: 1264847 - DNA, 22 bp, Artificial Sequence
  chemically synthesized
tatgaatccatataatatatga

SEQ ID NO: 1264848 - DNA, 22 bp, Artificial Sequence
  chemically synthesized
atatgattcatatattatatgg

SEQ ID NO: 1264849 - DNA, 22 bp, Artificial Sequence
  chemically synthesized
acaaacctatatgaatccatat

SEQ ID NO: 1264850 - DNA, 22 bp, Artificial Sequence
  chemically synthesized
aacaaacctatatgaatccata

SEQ ID NO: 1264851 - DNA, 22 bp, Artificial Sequence
  chemically synthesized
atatattatatggattcatata

SEQ ID NO: 1264852 - DNA, 22 bp, Artificial Sequence
  chemically synthesized
atttaacaaacctatatgaatc

SEQ ID NO: 1264853 - DNA, 22 bp, Artificial Sequence
  chemically synthesized
ttaatttaacaaacctatatga

SEQ ID NO: 1264854 - DNA, 22 bp, Artificial Sequence
  chemically synthesized
actgttaatttaacaaacctat

SEQ ID NO: 1264855 - DNA, 22 bp, Artificial Sequence
  chemically synthesized
tatggattcatataggtttgtt

SEQ ID NO: 1264856 - DNA, 22 bp, Artificial Sequence
  chemically synthesized
cactgttaatttaacaaaccta

SEQ ID NO: 1264857 - DNA, 22 bp, Artificial Sequence
  chemically synthesized
tcactgttaatttaacaaacct

SEQ ID NO: 1264858 - DNA, 22 bp, Artificial Sequence
  chemically synthesized
gggctttcactgttaatttaac

SEQ ID NO: 1264859 - DNA, 22 bp, Artificial Sequence
  chemically synthesized
atataggtttgttaaattaaca

SEQ ID NO: 1264860 - DNA, 22 bp, Artificial Sequence
  chemically synthesized
aaaaactggggctttcactgtt

SEQ ID NO: 1264861 - DNA, 22 bp, Artificial Sequence
  chemically synthesized
ctcaaaaactggggctttcact

SEQ ID NO: 1264862 - DNA, 22 bp, Artificial Sequence
  chemically synthesized
gttaaattaacagtgaaagccc

SEQ ID NO: 1264863 - DNA, 22 bp, Artificial Sequence
  chemically synthesized
cctcaaaaactggggctttcac

SEQ ID NO: 1264864 - DNA, 22 bp, Artificial Sequence
  chemically synthesized
ttaaattaacagtgaaagcccc

SEQ ID NO: 1264865 - DNA, 22 bp, Artificial Sequence
  chemically synthesized
aattaacagtgaaagccccagt

SEQ ID NO: 1264866 - DNA, 22 bp, Artificial Sequence
  chemically synthesized
acagtgaaagccccagtttttg

SEQ ID NO: 1264867 - DNA, 22 bp, Artificial Sequence
  chemically synthesized
ccaagatataggcaatacatac

SEQ ID NO: 1264868 - DNA, 22 bp, Artificial Sequence
  chemically synthesized
ttgaggaaattgtatgtattgc

SEQ ID NO: 1264869 - DNA, 22 bp, Artificial Sequence
  chemically synthesized
tgaggaaattgtatgtattgcc

SEQ ID NO: 1264870 - DNA, 22 bp, Artificial Sequence
  chemically synthesized
gaggaaattgtatgtattgcct

SEQ ID NO: 1264871 - DNA, 22 bp, Artificial Sequence
  chemically synthesized
aggaaattgtatgtattgccta

SEQ ID NO: 1264872 - DNA, 22 bp, Artificial Sequence
  chemically synthesized
actgccaagatataggcaatac

SEQ ID NO: 1264873 - DNA, 22 bp, Artificial Sequence
  chemically synthesized
tatgtattgcctatatcttggc

SEQ ID NO: 1264874 - DNA, 22 bp, Artificial Sequence
  chemically synthesized
gtaaagttgactgccaagatat

SEQ ID NO: 1264875 - DNA, 22 bp, Artificial Sequence
  chemically synthesized
ttagtaaagttgactgccaaga

SEQ ID NO: 1264876 - DNA, 22 bp, Artificial Sequence
  chemically synthesized
attagtaaagttgactgccaag

SEQ ID NO: 1264877 - DNA, 22 bp, Artificial Sequence
  chemically synthesized
cctatatcttggcagtcaactt

SEQ ID NO: 1264878 - DNA, 22 bp, Artificial Sequence
  chemically synthesized
tatcttggcagtcaactttact

SEQ ID NO: 1264879 - DNA, 22 bp, Artificial Sequence
  chemically synthesized
tagcagcttattagtaaagttg

SEQ ID NO: 1264880 - DNA, 22 bp, Artificial Sequence
  chemically synthesized
atagcagcttattagtaaagtt

SEQ ID NO: 1264881 - DNA, 22 bp, Artificial Sequence
  chemically synthesized
tatagcagcttattagtaaagt

SEQ ID NO: 1264882 - DNA, 22 bp, Artificial Sequence
  chemically synthesized
ttttatagcagcttattagtaa

SEQ ID NO: 1264883 - DNA, 22 bp, Artificial Sequence
  chemically synthesized
ggcagtcaactttactaataag

SEQ ID NO: 1264884 - DNA, 22 bp, Artificial Sequence
  chemically synthesized
attttatagcagcttattagta

SEQ ID NO: 1264885 - DNA, 22 bp, Artificial Sequence
  chemically synthesized
gcagtcaactttactaataagc

SEQ ID NO: 1264886 - DNA, 22 bp, Artificial Sequence
  chemically synthesized
tactaataagctgctataaaat

SEQ ID NO: 1264887 - DNA, 22 bp, Artificial Sequence
  chemically synthesized
actaataagctgctataaaata

SEQ ID NO: 1264888 - DNA, 22 bp, Artificial Sequence
  chemically synthesized
atgaatcatatttattttatag

SEQ ID NO: 1264889 - DNA, 22 bp, Artificial Sequence
  chemically synthesized
ctaataagctgctataaaataa

SEQ ID NO: 1264890 - DNA, 22 bp, Artificial Sequence
  chemically synthesized
aatgaatcatatttattttata

SEQ ID NO: 1264891 - DNA, 22 bp, Artificial Sequence
  chemically synthesized
ttaatgaatcatatttatttta

SEQ ID NO: 1264892 - DNA, 22 bp, Artificial Sequence
  chemically synthesized
ataagctgctataaaataaata

SEQ ID NO: 1264893 - DNA, 22 bp, Artificial Sequence
  chemically synthesized
cactcttaatgaatcatattta

SEQ ID NO: 1264894 - DNA, 22 bp, Artificial Sequence
  chemically synthesized
acactcttaatgaatcatattt

SEQ ID NO: 1264895 - DNA, 22 bp, Artificial Sequence
  chemically synthesized
ctataaaataaatatgattcat

SEQ ID NO: 1264896 - DNA, 22 bp, Artificial Sequence
  chemically synthesized
catttacactcttaatgaatca

SEQ ID NO: 1264897 - DNA, 22 bp, Artificial Sequence
  chemically synthesized
taaaataaatatgattcattaa

SEQ ID NO: 1264898 - DNA, 22 bp, Artificial Sequence
  chemically synthesized
ggattccatttacactcttaat

SEQ ID NO: 1264899 - DNA, 22 bp, Artificial Sequence
  chemically synthesized
ttaggattccatttacactctt

SEQ ID NO: 1264900 - DNA, 22 bp, Artificial Sequence
  chemically synthesized
attaggattccatttacactct

SEQ ID NO: 1264901 - DNA, 22 bp, Artificial Sequence
  chemically synthesized
cttattaggattccatttacac

SEQ ID NO: 1264902 - DNA, 22 bp, Artificial Sequence
  chemically synthesized
tctccttattaggattccattt

SEQ ID NO: 1264903 - DNA, 22 bp, Artificial Sequence
  chemically synthesized
attaagagtgtaaatggaatcc

SEQ ID NO: 1264904 - DNA, 22 bp, Artificial Sequence
  chemically synthesized
agagtgtaaatggaatcctaat

SEQ ID NO: 1264905 - DNA, 22 bp, Artificial Sequence
  chemically synthesized
gggttatctccttattaggatt

SEQ ID NO: 1264906 - DNA, 22 bp, Artificial Sequence
  chemically synthesized
agggttatctccttattaggat

SEQ ID NO: 1264907 - DNA, 22 bp, Artificial Sequence
  chemically synthesized
tcgtaaatttagggttatctcc

SEQ ID NO: 1264908 - DNA, 22 bp, Artificial Sequence
  chemically synthesized
actatcgtaaatttagggttat

SEQ ID NO: 1264909 - DNA, 22 bp, Artificial Sequence
  chemically synthesized
ataaggagataaccctaaattt

SEQ ID NO: 1264910 - DNA, 22 bp, Artificial Sequence
  chemically synthesized
cacaacatgcctgactatcgta

SEQ ID NO: 1264911 - DNA, 22 bp, Artificial Sequence
  chemically synthesized
ttgcacaacatgcctgactatc

SEQ ID NO: 1264912 - DNA, 22 bp, Artificial Sequence
  chemically synthesized
tgttgcacaacatgcctgacta

SEQ ID NO: 1264913 - DNA, 22 bp, Artificial Sequence
  chemically synthesized
tctgttgcacaacatgcctgac

SEQ ID NO: 1264914 - DNA, 22 bp, Artificial Sequence
  chemically synthesized
aatttacgatagtcaggcatgt

SEQ ID NO: 1264915 - DNA, 22 bp, Artificial Sequence
  chemically synthesized
ctctgttgcacaacatgcctga

SEQ ID NO: 1264916 - DNA, 22 bp, Artificial Sequence
  chemically synthesized
acgatagtcaggcatgttgtgc

SEQ ID NO: 1264917 - DNA, 22 bp, Artificial Sequence
  chemically synthesized
cgatagtcaggcatgttgtgca

SEQ ID NO: 1264918 - DNA, 22 bp, Artificial Sequence
  chemically synthesized
cagaatacagtttctctgttgc

SEQ ID NO: 1264919 - DNA, 22 bp, Artificial Sequence
  chemically synthesized
gcaattacagaatacagtttct

SEQ ID NO: 1264920 - DNA, 22 bp, Artificial Sequence
  chemically synthesized
tgcaacagagaaactgtattct

SEQ ID NO: 1264921 - DNA, 22 bp, Artificial Sequence
  chemically synthesized
cccctagcaattacagaataca

SEQ ID NO: 1264922 - DNA, 22 bp, Artificial Sequence
  chemically synthesized
tccccctagcaattacagaata

SEQ ID NO: 1264923 - DNA, 22 bp, Artificial Sequence
  chemically synthesized
tattctgtaattgctaggggga

SEQ ID NO: 1264924 - DNA, 22 bp, Artificial Sequence
  chemically synthesized
tgtaattgctagggggagagtg

SEQ ID NO: 1264925 - DNA, 22 bp, Artificial Sequence
  chemically synthesized
taattgctagggggagagtgcg

SEQ ID NO: 1264926 - DNA, 22 bp, Artificial Sequence
  chemically synthesized
tcgacagtaaccacgcactctc

SEQ ID NO: 1264927 - DNA, 22 bp, Artificial Sequence
  chemically synthesized
ctagggggagagtgcgtggtta

SEQ ID NO: 1264928 - DNA, 22 bp, Artificial Sequence
  chemically synthesized
gggggagagtgcgtggttactg

SEQ ID NO: 1264929 - DNA, 22 bp, Artificial Sequence
  chemically synthesized
aataacgcaactatcgacagta

SEQ ID NO: 1264930 - DNA, 22 bp, Artificial Sequence
  chemically synthesized
ctgtcgatagttgcgttattta

SEQ ID NO: 1264931 - DNA, 22 bp, Artificial Sequence
  chemically synthesized
tcgatagttgcgttatttagat

SEQ ID NO: 1264932 - DNA, 22 bp, Artificial Sequence
  chemically synthesized
tgcaatgtaatgatctaaataa

SEQ ID NO: 1264933 - DNA, 22 bp, Artificial Sequence
  chemically synthesized
atgcaatgtaatgatctaaata

SEQ ID NO: 1264934 - DNA, 22 bp, Artificial Sequence
  chemically synthesized
cttatgcaatgtaatgatctaa

SEQ ID NO: 1264935 - DNA, 22 bp, Artificial Sequence
  chemically synthesized
cgttatttagatcattacattg

SEQ ID NO: 1264936 - DNA, 22 bp, Artificial Sequence
  chemically synthesized
tttagatcattacattgcataa

SEQ ID NO: 1264937 - DNA, 22 bp, Artificial Sequence
  chemically synthesized
agatcattacattgcataagta

SEQ ID NO: 1264938 - DNA, 22 bp, Artificial Sequence
  chemically synthesized
gatcattacattgcataagtaa

SEQ ID NO: 1264939 - DNA, 22 bp, Artificial Sequence
  chemically synthesized
catcaatatgggcatacattac

SEQ ID NO: 1264940 - DNA, 22 bp, Artificial Sequence
  chemically synthesized
acatcaatatgggcatacatta

SEQ ID NO: 1264941 - DNA, 22 bp, Artificial Sequence
  chemically synthesized
cattgcataagtaatgtatgcc

SEQ ID NO: 1264942 - DNA, 22 bp, Artificial Sequence
  chemically synthesized
cataagtaatgtatgcccatat

SEQ ID NO: 1264943 - DNA, 22 bp, Artificial Sequence
  chemically synthesized
cataacgtttacatcaatatgg

SEQ ID NO: 1264944 - DNA, 22 bp, Artificial Sequence
  chemically synthesized
cctgcataacgtttacatcaat

SEQ ID NO: 1264945 - DNA, 22 bp, Artificial Sequence
  chemically synthesized
atgtaaacgttatgcaggtaat

SEQ ID NO: 1264946 - DNA, 22 bp, Artificial Sequence
  chemically synthesized
taataaatatgcattacctgca

SEQ ID NO: 1264947 - DNA, 22 bp, Artificial Sequence
  chemically synthesized
gtaataaatatgcattacctgc

SEQ ID NO: 1264948 - DNA, 22 bp, Artificial Sequence
  chemically synthesized
tttgtaataaatatgcattacc

SEQ ID NO: 1264949 - DNA, 22 bp, Artificial Sequence
  chemically synthesized
atttgtaataaatatgcattac

SEQ ID NO: 1264950 - DNA, 22 bp, Artificial Sequence
  chemically synthesized
atttatttgtaataaatatgca

SEQ ID NO: 1264951 - DNA, 22 bp, Artificial Sequence
  chemically synthesized
taatttatttgtaataaatatg

SEQ ID NO: 1264952 - DNA, 22 bp, Artificial Sequence
  chemically synthesized
tgcaggtaatgcatatttatta

SEQ ID NO: 1264953 - DNA, 22 bp, Artificial Sequence
  chemically synthesized
ctaatttatttgtaataaatat

SEQ ID NO: 1264954 - DNA, 22 bp, Artificial Sequence
  chemically synthesized
tctaatttatttgtaataaata

SEQ ID NO: 1264955 - DNA, 22 bp, Artificial Sequence
  chemically synthesized
ttttctaatttatttgtaataa

SEQ ID NO: 1264956 - DNA, 22 bp, Artificial Sequence
  chemically synthesized
tattttctaatttatttgtaat

SEQ ID NO: 1264957 - DNA, 22 bp, Artificial Sequence
  chemically synthesized
ctctattttctaatttatttgt

SEQ ID NO: 1264958 - DNA, 22 bp, Artificial Sequence
  chemically synthesized
attacaaataaattagaaaata

SEQ ID NO: 1264959 - DNA, 22 bp, Artificial Sequence
  chemically synthesized
ttacaaataaattagaaaatag

SEQ ID NO: 1264960 - DNA, 22 bp, Artificial Sequence
  chemically synthesized
caaataaattagaaaatagagt

SEQ ID NO: 1264961 - DNA, 22 bp, Artificial Sequence
  chemically synthesized
agcaaatcagaataacacagtt

SEQ ID NO: 1264962 - DNA, 22 bp, Artificial Sequence
  chemically synthesized
gaaaatagagtaactgtgttat

SEQ ID NO: 1264963 - DNA, 22 bp, Artificial Sequence
  chemically synthesized
tgttattctgatttgctgaatc

SEQ ID NO: 1264964 - DNA, 22 bp, Artificial Sequence
  chemically synthesized
catgtgaacaaaagattcagca

SEQ ID NO: 1264965 - DNA, 22 bp, Artificial Sequence
  chemically synthesized
ttctgatttgctgaatcttttg

SEQ ID NO: 1264966 - DNA, 22 bp, Artificial Sequence
  chemically synthesized
agcctacatgtgaacaaaagat

SEQ ID NO: 1264967 - DNA, 22 bp, Artificial Sequence
  chemically synthesized
tgatttgctgaatcttttgttc

SEQ ID NO: 1264968 - DNA, 22 bp, Artificial Sequence
  chemically synthesized
atttgctgaatcttttgttcac

SEQ ID NO: 1264969 - DNA, 22 bp, Artificial Sequence
  chemically synthesized
tacctcagcctacatgtgaaca

SEQ ID NO: 1264970 - DNA, 22 bp, Artificial Sequence
  chemically synthesized
gctgaatcttttgttcacatgt

SEQ ID NO: 1264971 - DNA, 22 bp, Artificial Sequence
  chemically synthesized
atacctcagcctacatgtgaac

SEQ ID NO: 1264972 - DNA, 22 bp, Artificial Sequence
  chemically synthesized
ctgaatcttttgttcacatgta

SEQ ID NO: 1264973 - DNA, 22 bp, Artificial Sequence
  chemically synthesized
aatcttttgttcacatgtaggc

SEQ ID NO: 1264974 - DNA, 22 bp, Artificial Sequence
  chemically synthesized
atttatacctcagcctacatgt

SEQ ID NO: 1264975 - DNA, 22 bp, Artificial Sequence
  chemically synthesized
ttgatttatacctcagcctaca

SEQ ID NO: 1264976 - DNA, 22 bp, Artificial Sequence
  chemically synthesized
tgttgatttatacctcagccta

SEQ ID NO: 1264977 - DNA, 22 bp, Artificial Sequence
  chemically synthesized
ttgttcacatgtaggctgaggt

SEQ ID NO: 1264978 - DNA, 22 bp, Artificial Sequence
  chemically synthesized
tgttcacatgtaggctgaggta

SEQ ID NO: 1264979 - DNA, 22 bp, Artificial Sequence
  chemically synthesized
gttcacatgtaggctgaggtat

SEQ ID NO: 1264980 - DNA, 22 bp, Artificial Sequence
  chemically synthesized
ttctgttgatttatacctcagc

SEQ ID NO: 1264981 - DNA, 22 bp, Artificial Sequence
  chemically synthesized
ttcacatgtaggctgaggtata

SEQ ID NO: 1264982 - DNA, 22 bp, Artificial Sequence
  chemically synthesized
attctgttgatttatacctcag

SEQ ID NO: 1264983 - DNA, 22 bp, Artificial Sequence
  chemically synthesized
tattctgttgatttatacctca

SEQ ID NO: 1264984 - DNA, 22 bp, Artificial Sequence
  chemically synthesized
ttattctgttgatttatacctc

SEQ ID NO: 1264985 - DNA, 22 bp, Artificial Sequence
  chemically synthesized
acatgtaggctgaggtataaat

SEQ ID NO: 1264986 - DNA, 22 bp, Artificial Sequence
  chemically synthesized
aggtataaatcaacagaataaa

SEQ ID NO: 1264987 - DNA, 22 bp, Artificial Sequence
  chemically synthesized
gccataaaaacacttttattct

SEQ ID NO: 1264988 - DNA, 22 bp, Artificial Sequence
  chemically synthesized
agccataaaaacacttttattc

SEQ ID NO: 1264989 - DNA, 22 bp, Artificial Sequence
  chemically synthesized
accttagccataaaaacacttt

SEQ ID NO: 1264990 - DNA, 22 bp, Artificial Sequence
  chemically synthesized
actgaccttagccataaaaaca

SEQ ID NO: 1264991 - DNA, 22 bp, Artificial Sequence
  chemically synthesized
tcactgaccttagccataaaaa

SEQ ID NO: 1264992 - DNA, 22 bp, Artificial Sequence
  chemically synthesized
aatctctcactgaccttagcca

SEQ ID NO: 1264993 - DNA, 22 bp, Artificial Sequence
  chemically synthesized
gaatctctcactgaccttagcc

SEQ ID NO: 1264994 - DNA, 22 bp, Artificial Sequence
  chemically synthesized
tttgaatctctcactgacctta

SEQ ID NO: 1264995 - DNA, 22 bp, Artificial Sequence
  chemically synthesized
gtttgaatctctcactgacctt

SEQ ID NO: 1264996 - DNA, 22 bp, Artificial Sequence
  chemically synthesized
ttatggctaaggtcagtgagag

SEQ ID NO: 1264997 - DNA, 22 bp, Artificial Sequence
  chemically synthesized
tatggctaaggtcagtgagaga

SEQ ID NO: 1264998 - DNA, 22 bp, Artificial Sequence
  chemically synthesized
atggctaaggtcagtgagagat

SEQ ID NO: 1264999 - DNA, 22 bp, Artificial Sequence
  chemically synthesized
tggctaaggtcagtgagagatt

SEQ ID NO: 1265000 - DNA, 22 bp, Artificial Sequence
  chemically synthesized
tacgtttgtttgaatctctcac

SEQ ID NO: 1265001 - DNA, 22 bp, Artificial Sequence
  chemically synthesized
atacgtttgtttgaatctctca

SEQ ID NO: 1265002 - DNA, 22 bp, Artificial Sequence
  chemically synthesized
aggtcagtgagagattcaaaca

SEQ ID NO: 1265003 - DNA, 22 bp, Artificial Sequence
  chemically synthesized
tatgcttatacgtttgtttgaa

SEQ ID NO: 1265004 - DNA, 22 bp, Artificial Sequence
  chemically synthesized
atatgcttatacgtttgtttga

SEQ ID NO: 1265005 - DNA, 22 bp, Artificial Sequence
  chemically synthesized
tataagcacacttatatgctta

SEQ ID NO: 1265006 - DNA, 22 bp, Artificial Sequence
  chemically synthesized
aaacaaacgtataagcatataa

SEQ ID NO: 1265007 - DNA, 22 bp, Artificial Sequence
  chemically synthesized
atataagcacacttatatgctt

SEQ ID NO: 1265008 - DNA, 22 bp, Artificial Sequence
  chemically synthesized
tgaatacatacttatataagca

SEQ ID NO: 1265009 - DNA, 22 bp, Artificial Sequence
  chemically synthesized
atataagtatgtattcatagtc

SEQ ID NO: 1265010 - DNA, 22 bp, Artificial Sequence
  chemically synthesized
tataagtatgtattcatagtca

SEQ ID NO: 1265011 - DNA, 22 bp, Artificial Sequence
  chemically synthesized
gcatgtgagtatatgtgtgtga

SEQ ID NO: 1265012 - DNA, 22 bp, Artificial Sequence
  chemically synthesized
atagtcacacacatatactcac

SEQ ID NO: 1265013 - DNA, 22 bp, Artificial Sequence
  chemically synthesized
atacgttagcatgtgagtatat

SEQ ID NO: 1265014 - DNA, 22 bp, Artificial Sequence
  chemically synthesized
aatcaattgatacgttagcatg

SEQ ID NO: 1265015 - DNA, 22 bp, Artificial Sequence
  chemically synthesized
aaatcaattgatacgttagcat

SEQ ID NO: 1265016 - DNA, 22 bp, Artificial Sequence
  chemically synthesized
taaatcaattgatacgttagca

SEQ ID NO: 1265017 - DNA, 22 bp, Artificial Sequence
  chemically synthesized
actttaaatcaattgatacgtt

SEQ ID NO: 1265018 - DNA, 22 bp, Artificial Sequence
  chemically synthesized
acatgctaacgtatcaattgat

SEQ ID NO: 1265019 - DNA, 22 bp, Artificial Sequence
  chemically synthesized
taaaattaactttaaatcaatt

SEQ ID NO: 1265020 - DNA, 22 bp, Artificial Sequence
  chemically synthesized
acgtatcaattgatttaaagtt

SEQ ID NO: 1265021 - DNA, 22 bp, Artificial Sequence
  chemically synthesized
atttaaagttaattttataggg

SEQ ID NO: 1265022 - DNA, 22 bp, Artificial Sequence
  chemically synthesized
aaagttaattttatagggggtt

SEQ ID NO: 1265023 - DNA, 22 bp, Artificial Sequence
  chemically synthesized
aagttaattttatagggggttg

SEQ ID NO: 1265024 - DNA, 22 bp, Artificial Sequence
  chemically synthesized
ataatgtgacaaatcaaccccc

SEQ ID NO: 1265025 - DNA, 22 bp, Artificial Sequence
  chemically synthesized
gataatgtgacaaatcaacccc

SEQ ID NO: 1265026 - DNA, 22 bp, Artificial Sequence
  chemically synthesized
attttatagggggttgatttgt

SEQ ID NO: 1265027 - DNA, 22 bp, Artificial Sequence
  chemically synthesized
gtgtttgataatgtgacaaatc

SEQ ID NO: 1265028 - DNA, 22 bp, Artificial Sequence
  chemically synthesized
tatagggggttgatttgtcaca

SEQ ID NO: 1265029 - DNA, 22 bp, Artificial Sequence
  chemically synthesized
agtgtttgataatgtgacaaat

SEQ ID NO: 1265030 - DNA, 22 bp, Artificial Sequence
  chemically synthesized
atagggggttgatttgtcacat

SEQ ID NO: 1265031 - DNA, 22 bp, Artificial Sequence
  chemically synthesized
tagtgtttgataatgtgacaaa

SEQ ID NO: 1265032 - DNA, 22 bp, Artificial Sequence
  chemically synthesized
tagggggttgatttgtcacatt

SEQ ID NO: 1265033 - DNA, 22 bp, Artificial Sequence
  chemically synthesized
tttagtgtttgataatgtgaca

SEQ ID NO: 1265034 - DNA, 22 bp, Artificial Sequence
  chemically synthesized
atacattctttagtgtttgata

SEQ ID NO: 1265035 - DNA, 22 bp, Artificial Sequence
  chemically synthesized
atttgtcacattatcaaacact

SEQ ID NO: 1265036 - DNA, 22 bp, Artificial Sequence
  chemically synthesized
gtcacattatcaaacactaaag

SEQ ID NO: 1265037 - DNA, 22 bp, Artificial Sequence
  chemically synthesized
tcacattatcaaacactaaaga

SEQ ID NO: 1265038 - DNA, 22 bp, Artificial Sequence
  chemically synthesized
aaaactcatacattctttagtg

SEQ ID NO: 1265039 - DNA, 22 bp, Artificial Sequence
  chemically synthesized
aaaaactcatacattctttagt

SEQ ID NO: 1265040 - DNA, 22 bp, Artificial Sequence
  chemically synthesized
taaaaactcatacattctttag

SEQ ID NO: 1265041 - DNA, 22 bp, Artificial Sequence
  chemically synthesized
tcaaacactaaagaatgtatga

SEQ ID NO: 1265042 - DNA, 22 bp, Artificial Sequence
  chemically synthesized
atggacattttaaaaactcata

SEQ ID NO: 1265043 - DNA, 22 bp, Artificial Sequence
  chemically synthesized
actcatggacattttaaaaact

SEQ ID NO: 1265044 - DNA, 22 bp, Artificial Sequence
  chemically synthesized
aagaatgtatgagtttttaaaa

SEQ ID NO: 1265045 - DNA, 22 bp, Artificial Sequence
  chemically synthesized
cactcatggacattttaaaaac

SEQ ID NO: 1265046 - DNA, 22 bp, Artificial Sequence
  chemically synthesized
gtcttcactcatggacatttta

SEQ ID NO: 1265047 - DNA, 22 bp, Artificial Sequence
  chemically synthesized
ggtcttcactcatggacatttt

SEQ ID NO: 1265048 - DNA, 22 bp, Artificial Sequence
  chemically synthesized
gcatttggtcttcactcatgga

SEQ ID NO: 1265049 - DNA, 22 bp, Artificial Sequence
  chemically synthesized
ttaaaatgtccatgagtgaaga

SEQ ID NO: 1265050 - DNA, 22 bp, Artificial Sequence
  chemically synthesized
gctggcatttggtcttcactca

SEQ ID NO: 1265051 - DNA, 22 bp, Artificial Sequence
  chemically synthesized
taaaatgtccatgagtgaagac

SEQ ID NO: 1265052 - DNA, 22 bp, Artificial Sequence
  chemically synthesized
aaaatgtccatgagtgaagacc

SEQ ID NO: 1265053 - DNA, 22 bp, Artificial Sequence
  chemically synthesized
aaatgtccatgagtgaagacca

SEQ ID NO: 1265054 - DNA, 22 bp, Artificial Sequence
  chemically synthesized
agttagctggcatttggtcttc

SEQ ID NO: 1265055 - DNA, 22 bp, Artificial Sequence
  chemically synthesized
cactcagttagctggcatttgg

SEQ ID NO: 1265056 - DNA, 22 bp, Artificial Sequence
  chemically synthesized
tgttacactcagttagctggca

SEQ ID NO: 1265057 - DNA, 22 bp, Artificial Sequence
  chemically synthesized
tatgttacactcagttagctgg

SEQ ID NO: 1265058 - DNA, 22 bp, Artificial Sequence
  chemically synthesized
tattctatgttacactcagtta

SEQ ID NO: 1265059 - DNA, 22 bp, Artificial Sequence
  chemically synthesized
aatatacctatattctatgtta

SEQ ID NO: 1265060 - DNA, 22 bp, Artificial Sequence
  chemically synthesized
caatatacctatattctatgtt

SEQ ID NO: 1265061 - DNA, 22 bp, Artificial Sequence
  chemically synthesized
tcaatatacctatattctatgt

SEQ ID NO: 1265062 - DNA, 22 bp, Artificial Sequence
  chemically synthesized
actgagtgtaacatagaatata

SEQ ID NO: 1265063 - DNA, 22 bp, Artificial Sequence
  chemically synthesized
agtgtaacatagaatataggta

SEQ ID NO: 1265064 - DNA, 22 bp, Artificial Sequence
  chemically synthesized
atatgaatactttcaatatacc

SEQ ID NO: 1265065 - DNA, 22 bp, Artificial Sequence
  chemically synthesized
tgatgaaatataagttgatatg

SEQ ID NO: 1265066 - DNA, 22 bp, Artificial Sequence
  chemically synthesized
atgatgaaatataagttgatat

SEQ ID NO: 1265067 - DNA, 22 bp, Artificial Sequence
  chemically synthesized
tatgatgaaatataagttgata

SEQ ID NO: 1265068 - DNA, 22 bp, Artificial Sequence
  chemically synthesized
aaagtattcatatcaacttata

SEQ ID NO: 1265069 - DNA, 22 bp, Artificial Sequence
  chemically synthesized
atatcaacttatatttcatcat

SEQ ID NO: 1265070 - DNA, 22 bp, Artificial Sequence
  chemically synthesized
aaatgaaatacagctttatgat

SEQ ID NO: 1265071 - DNA, 22 bp, Artificial Sequence
  chemically synthesized
aaaatgaaatacagctttatga

SEQ ID NO: 1265072 - DNA, 22 bp, Artificial Sequence
  chemically synthesized
atatttcatcataaagctgtat

SEQ ID NO: 1265073 - DNA, 22 bp, Artificial Sequence
  chemically synthesized
tatttcatcataaagctgtatt

SEQ ID NO: 1265074 - DNA, 22 bp, Artificial Sequence
  chemically synthesized
aaaccttaaaatgaaatacagc

SEQ ID NO: 1265075 - DNA, 22 bp, Artificial Sequence
  chemically synthesized
caaaccttaaaatgaaatacag

SEQ ID NO: 1265076 - DNA, 22 bp, Artificial Sequence
  chemically synthesized
catcataaagctgtatttcatt

SEQ ID NO: 1265077 - DNA, 22 bp, Artificial Sequence
  chemically synthesized
atcataaagctgtatttcattt

SEQ ID NO: 1265078 - DNA, 22 bp, Artificial Sequence
  chemically synthesized
gagtttcaaaccttaaaatgaa

SEQ ID NO: 1265079 - DNA, 22 bp, Artificial Sequence
  chemically synthesized
tatttcattttaaggtttgaaa

SEQ ID NO: 1265080 - DNA, 22 bp, Artificial Sequence
  chemically synthesized
cattttaaggtttgaaactcca

SEQ ID NO: 1265081 - DNA, 22 bp, Artificial Sequence
  chemically synthesized
attttaaggtttgaaactccaa

SEQ ID NO: 1265082 - DNA, 22 bp, Artificial Sequence
  chemically synthesized
acacagtagatattggagtttc

SEQ ID NO: 1265083 - DNA, 22 bp, Artificial Sequence
  chemically synthesized
gacacagtagatattggagttt

SEQ ID NO: 1265084 - DNA, 22 bp, Artificial Sequence
  chemically synthesized
tgacacagtagatattggagtt

SEQ ID NO: 1265085 - DNA, 22 bp, Artificial Sequence
  chemically synthesized
taaggtttgaaactccaatatc

SEQ ID NO: 1265086 - DNA, 22 bp, Artificial Sequence
  chemically synthesized
aaggtttgaaactccaatatct

SEQ ID NO: 1265087 - DNA, 22 bp, Artificial Sequence
  chemically synthesized
ctttgacacagtagatattgga

SEQ ID NO: 1265088 - DNA, 22 bp, Artificial Sequence
  chemically synthesized
aggtttgaaactccaatatcta

SEQ ID NO: 1265089 - DNA, 22 bp, Artificial Sequence
  chemically synthesized
aatctgctttgacacagtagat

SEQ ID NO: 1265090 - DNA, 22 bp, Artificial Sequence
  chemically synthesized
gaaactccaatatctactgtgt

SEQ ID NO: 1265091 - DNA, 22 bp, Artificial Sequence
  chemically synthesized
aaactccaatatctactgtgtc

SEQ ID NO: 1265092 - DNA, 22 bp, Artificial Sequence
  chemically synthesized
tatactcaatctgctttgacac

SEQ ID NO: 1265093 - DNA, 22 bp, Artificial Sequence
  chemically synthesized
caatatctactgtgtcaaagca

SEQ ID NO: 1265094 - DNA, 22 bp, Artificial Sequence
  chemically synthesized
atatactcaatctgctttgaca

SEQ ID NO: 1265095 - DNA, 22 bp, Artificial Sequence
  chemically synthesized
tatatactcaatctgctttgac

SEQ ID NO: 1265096 - DNA, 22 bp, Artificial Sequence
  chemically synthesized
ctttatatactcaatctgcttt

SEQ ID NO: 1265097 - DNA, 22 bp, Artificial Sequence
  chemically synthesized
cctttatatactcaatctgctt

SEQ ID NO: 1265098 - DNA, 22 bp, Artificial Sequence
  chemically synthesized
ctgtgtcaaagcagattgagta

SEQ ID NO: 1265099 - DNA, 22 bp, Artificial Sequence
  chemically synthesized
tgtcaaagcagattgagtatat

SEQ ID NO: 1265100 - DNA, 22 bp, Artificial Sequence
  chemically synthesized
aacccatttcctttatatactc

SEQ ID NO: 1265101 - DNA, 22 bp, Artificial Sequence
  chemically synthesized
ccactgaacccatttcctttat

SEQ ID NO: 1265102 - DNA, 22 bp, Artificial Sequence
  chemically synthesized
agtatataaaggaaatgggttc

SEQ ID NO: 1265103 - DNA, 22 bp, Artificial Sequence
  chemically synthesized
tcatagctaccactgaacccat

SEQ ID NO: 1265104 - DNA, 22 bp, Artificial Sequence
  chemically synthesized
gtcatagctaccactgaaccca

SEQ ID NO: 1265105 - DNA, 22 bp, Artificial Sequence
  chemically synthesized
atttgtcatagctaccactgaa

SEQ ID NO: 1265106 - DNA, 22 bp, Artificial Sequence
  chemically synthesized
aatttgtcatagctaccactga

SEQ ID NO: 1265107 - DNA, 22 bp, Artificial Sequence
  chemically synthesized
agtggtagctatgacaaattaa

SEQ ID NO: 1265108 - DNA, 22 bp, Artificial Sequence
  chemically synthesized
cagaagcaggcaaaatttaatt

SEQ ID NO: 1265109 - DNA, 22 bp, Artificial Sequence
  chemically synthesized
acagaagcaggcaaaatttaat

SEQ ID NO: 1265110 - DNA, 22 bp, Artificial Sequence
  chemically synthesized
tacagaagcaggcaaaatttaa

SEQ ID NO: 1265111 - DNA, 22 bp, Artificial Sequence
  chemically synthesized
tgacaaattaaattttgcctgc

SEQ ID NO: 1265112 - DNA, 22 bp, Artificial Sequence
  chemically synthesized
cactttacagaagcaggcaaaa

SEQ ID NO: 1265113 - DNA, 22 bp, Artificial Sequence
  chemically synthesized
ccactttacagaagcaggcaaa

SEQ ID NO: 1265114 - DNA, 22 bp, Artificial Sequence
  chemically synthesized
tccactttacagaagcaggcaa

SEQ ID NO: 1265115 - DNA, 22 bp, Artificial Sequence
  chemically synthesized
aattttgcctgcttctgtaaag

SEQ ID NO: 1265116 - DNA, 22 bp, Artificial Sequence
  chemically synthesized
aatagggactttccactttaca

SEQ ID NO: 1265117 - DNA, 22 bp, Artificial Sequence
  chemically synthesized
tgcctgcttctgtaaagtggaa

SEQ ID NO: 1265118 - DNA, 22 bp, Artificial Sequence
  chemically synthesized
tgaatagggactttccacttta

SEQ ID NO: 1265119 - DNA, 22 bp, Artificial Sequence
  chemically synthesized
gcctgcttctgtaaagtggaaa

SEQ ID NO: 1265120 - DNA, 22 bp, Artificial Sequence
  chemically synthesized
cctgcttctgtaaagtggaaag

SEQ ID NO: 1265121 - DNA, 22 bp, Artificial Sequence
  chemically synthesized
gttctgaatagggactttccac

SEQ ID NO: 1265122 - DNA, 22 bp, Artificial Sequence
  chemically synthesized
cttctgtaaagtggaaagtccc

SEQ ID NO: 1265123 - DNA, 22 bp, Artificial Sequence
  chemically synthesized
tctggttctgaatagggacttt

SEQ ID NO: 1265124 - DNA, 22 bp, Artificial Sequence
  chemically synthesized
ctgtaaagtggaaagtccctat

SEQ ID NO: 1265125 - DNA, 22 bp, Artificial Sequence
  chemically synthesized
tgtaaagtggaaagtccctatt

SEQ ID NO: 1265126 - DNA, 22 bp, Artificial Sequence
  chemically synthesized
taaagtggaaagtccctattca

SEQ ID NO: 1265127 - DNA, 22 bp, Artificial Sequence
  chemically synthesized
gtaacaattgtctggttctgaa

SEQ ID NO: 1265128 - DNA, 22 bp, Artificial Sequence
  chemically synthesized
tagtaacaattgtctggttctg

SEQ ID NO: 1265129 - DNA, 22 bp, Artificial Sequence
  chemically synthesized
gttctagtaacaattgtctggt

SEQ ID NO: 1265130 - DNA, 22 bp, Artificial Sequence
  chemically synthesized
agttctagtaacaattgtctgg

SEQ ID NO: 1265131 - DNA, 22 bp, Artificial Sequence
  chemically synthesized
tagttctagtaacaattgtctg

SEQ ID NO: 1265132 - DNA, 22 bp, Artificial Sequence
  chemically synthesized
ttcagaaccagacaattgttac

SEQ ID NO: 1265133 - DNA, 22 bp, Artificial Sequence
  chemically synthesized
attttagttctagtaacaattg

SEQ ID NO: 1265134 - DNA, 22 bp, Artificial Sequence
  chemically synthesized
agaaccagacaattgttactag

SEQ ID NO: 1265135 - DNA, 22 bp, Artificial Sequence
  chemically synthesized
gaccctcattttagttctagta

SEQ ID NO: 1265136 - DNA, 22 bp, Artificial Sequence
  chemically synthesized
tagaccctcattttagttctag

SEQ ID NO: 1265137 - DNA, 22 bp, Artificial Sequence
  chemically synthesized
ctagaccctcattttagttcta

SEQ ID NO: 1265138 - DNA, 22 bp, Artificial Sequence
  chemically synthesized
tctagaccctcattttagttct

SEQ ID NO: 1265139 - DNA, 22 bp, Artificial Sequence
  chemically synthesized
ttactagaactaaaatgagggt

SEQ ID NO: 1265140 - DNA, 22 bp, Artificial Sequence
  chemically synthesized
aatagattttctagaccctcat

SEQ ID NO: 1265141 - DNA, 22 bp, Artificial Sequence
  chemically synthesized
ctagaactaaaatgagggtcta

SEQ ID NO: 1265142 - DNA, 22 bp, Artificial Sequence
  chemically synthesized
gaatagattttctagaccctca

SEQ ID NO: 1265143 - DNA, 22 bp, Artificial Sequence
  chemically synthesized
gaactaaaatgagggtctagaa

SEQ ID NO: 1265144 - DNA, 22 bp, Artificial Sequence
  chemically synthesized
aaatgagggtctagaaaatcta

SEQ ID NO: 1265145 - DNA, 22 bp, Artificial Sequence
  chemically synthesized
gaaaatctattcaaatatacac

SEQ ID NO: 1265146 - DNA, 22 bp, Artificial Sequence
  chemically synthesized
gcataatgcgtgtgtgtatatt

SEQ ID NO: 1265147 - DNA, 22 bp, Artificial Sequence
  chemically synthesized
agcataatgcgtgtgtgtatat

SEQ ID NO: 1265148 - DNA, 22 bp, Artificial Sequence
  chemically synthesized
tgtttagcataatgcgtgtgtg

SEQ ID NO: 1265149 - DNA, 22 bp, Artificial Sequence
  chemically synthesized
gtgtttagcataatgcgtgtgt

SEQ ID NO: 1265150 - DNA, 22 bp, Artificial Sequence
  chemically synthesized
ttcaaatatacacacacgcatt

SEQ ID NO: 1265151 - DNA, 22 bp, Artificial Sequence
  chemically synthesized
aaatatacacacacgcattatg

SEQ ID NO: 1265152 - DNA, 22 bp, Artificial Sequence
  chemically synthesized
ataaggacagatacgtttgtgt

SEQ ID NO: 1265153 - DNA, 22 bp, Artificial Sequence
  chemically synthesized
gataaggacagatacgtttgtg

SEQ ID NO: 1265154 - DNA, 22 bp, Artificial Sequence
  chemically synthesized
cttgataaggacagatacgttt

SEQ ID NO: 1265155 - DNA, 22 bp, Artificial Sequence
  chemically synthesized
acttgataaggacagatacgtt

SEQ ID NO: 1265156 - DNA, 22 bp, Artificial Sequence
  chemically synthesized
tgctaaacacaaacgtatctgt

SEQ ID NO: 1265157 - DNA, 22 bp, Artificial Sequence
  chemically synthesized
tacttgataaggacagatacgt

SEQ ID NO: 1265158 - DNA, 22 bp, Artificial Sequence
  chemically synthesized
ttacttgataaggacagatacg

SEQ ID NO: 1265159 - DNA, 22 bp, Artificial Sequence
  chemically synthesized
tttttacttgataaggacagat

SEQ ID NO: 1265160 - DNA, 22 bp, Artificial Sequence
  chemically synthesized
aacacaaacgtatctgtcctta

SEQ ID NO: 1265161 - DNA, 22 bp, Artificial Sequence
  chemically synthesized
attatttttacttgataaggac

SEQ ID NO: 1265162 - DNA, 22 bp, Artificial Sequence
  chemically synthesized
ctcattatttttacttgataag

SEQ ID NO: 1265163 - DNA, 22 bp, Artificial Sequence
  chemically synthesized
gctcattatttttacttgataa

SEQ ID NO: 1265164 - DNA, 22 bp, Artificial Sequence
  chemically synthesized
tccttatcaagtaaaaataatg

SEQ ID NO: 1265165 - DNA, 22 bp, Artificial Sequence
  chemically synthesized
atcaagtaaaaataatgagcaa

SEQ ID NO: 1265166 - DNA, 22 bp, Artificial Sequence
  chemically synthesized
atgcacagatgtttgctcatta

SEQ ID NO: 1265167 - DNA, 22 bp, Artificial Sequence
  chemically synthesized
tcaagtaaaaataatgagcaaa

SEQ ID NO: 1265168 - DNA, 22 bp, Artificial Sequence
  chemically synthesized
cattcatgcacagatgtttgct

SEQ ID NO: 1265169 - DNA, 22 bp, Artificial Sequence
  chemically synthesized
acattcatgcacagatgtttgc

SEQ ID NO: 1265170 - DNA, 22 bp, Artificial Sequence
  chemically synthesized
agcttacattcatgcacagatg

SEQ ID NO: 1265171 - DNA, 22 bp, Artificial Sequence
  chemically synthesized
ataaagtagactgagcttacat

SEQ ID NO: 1265172 - DNA, 22 bp, Artificial Sequence
  chemically synthesized
tgcatgaatgtaagctcagtct

SEQ ID NO: 1265173 - DNA, 22 bp, Artificial Sequence
  chemically synthesized
agtctactttatcagggctatt

SEQ ID NO: 1265174 - DNA, 22 bp, Artificial Sequence
  chemically synthesized
tcagccaaaatcggaaatagcc

SEQ ID NO: 1265175 - DNA, 22 bp, Artificial Sequence
  chemically synthesized
ctttatcagggctatttccgat

SEQ ID NO: 1265176 - DNA, 22 bp, Artificial Sequence
  chemically synthesized
atctatcagccaaaatcggaaa

SEQ ID NO: 1265177 - DNA, 22 bp, Artificial Sequence
  chemically synthesized
tatcagggctatttccgatttt

SEQ ID NO: 1265178 - DNA, 22 bp, Artificial Sequence
  chemically synthesized
atcagggctatttccgattttg

SEQ ID NO: 1265179 - DNA, 22 bp, Artificial Sequence
  chemically synthesized
tcagggctatttccgattttgg

SEQ ID NO: 1265180 - DNA, 22 bp, Artificial Sequence
  chemically synthesized
tttccgattttggctgatagat

SEQ ID NO: 1265181 - DNA, 22 bp, Artificial Sequence
  chemically synthesized
ccgattttggctgatagatcag

SEQ ID NO: 1265182 - DNA, 22 bp, Artificial Sequence
  chemically synthesized
cgattttggctgatagatcagt

SEQ ID NO: 1265183 - DNA, 22 bp, Artificial Sequence
  chemically synthesized
tggctgatagatcagtttcctt

SEQ ID NO: 1265184 - DNA, 22 bp, Artificial Sequence
  chemically synthesized
ggctgatagatcagtttcctta

SEQ ID NO: 1265185 - DNA, 22 bp, Artificial Sequence
  chemically synthesized
tagccatatcaataaggaaact

SEQ ID NO: 1265186 - DNA, 22 bp, Artificial Sequence
  chemically synthesized
gctgatagatcagtttccttat

SEQ ID NO: 1265187 - DNA, 22 bp, Artificial Sequence
  chemically synthesized
ttgtagccatatcaataaggaa

SEQ ID NO: 1265188 - DNA, 22 bp, Artificial Sequence
  chemically synthesized
atagatcagtttccttattgat

SEQ ID NO: 1265189 - DNA, 22 bp, Artificial Sequence
  chemically synthesized
tattgtagccatatcaataagg

SEQ ID NO: 1265190 - DNA, 22 bp, Artificial Sequence
  chemically synthesized
aaatggattctattgtagccat

SEQ ID NO: 1265191 - DNA, 22 bp, Artificial Sequence
  chemically synthesized
ccttattgatatggctacaata

SEQ ID NO: 1265192 - DNA, 22 bp, Artificial Sequence
  chemically synthesized
cttattgatatggctacaatag

SEQ ID NO: 1265193 - DNA, 22 bp, Artificial Sequence
  chemically synthesized
attcaaatggattctattgtag

SEQ ID NO: 1265194 - DNA, 22 bp, Artificial Sequence
  chemically synthesized
attgatatggctacaatagaat

SEQ ID NO: 1265195 - DNA, 22 bp, Artificial Sequence
  chemically synthesized
ttgatatggctacaatagaatc

SEQ ID NO: 1265196 - DNA, 22 bp, Artificial Sequence
  chemically synthesized
atatggctacaatagaatccat

SEQ ID NO: 1265197 - DNA, 22 bp, Artificial Sequence
  chemically synthesized
caaaatctcattcaaatggatt

SEQ ID NO: 1265198 - DNA, 22 bp, Artificial Sequence
  chemically synthesized
caatagaatccatttgaatgag

SEQ ID NO: 1265199 - DNA, 22 bp, Artificial Sequence
  chemically synthesized
tggttacaaaatctcattcaaa

SEQ ID NO: 1265200 - DNA, 22 bp, Artificial Sequence
  chemically synthesized
atggttacaaaatctcattcaa

SEQ ID NO: 1265201 - DNA, 22 bp, Artificial Sequence
  chemically synthesized
cttatggttacaaaatctcatt

SEQ ID NO: 1265202 - DNA, 22 bp, Artificial Sequence
  chemically synthesized
gaatgagattttgtaaccataa

SEQ ID NO: 1265203 - DNA, 22 bp, Artificial Sequence
  chemically synthesized
aatgagattttgtaaccataag

SEQ ID NO: 1265204 - DNA, 22 bp, Artificial Sequence
  chemically synthesized
caaaatacaattccttatggtt

SEQ ID NO: 1265205 - DNA, 22 bp, Artificial Sequence
  chemically synthesized
acaaaatacaattccttatggt

SEQ ID NO: 1265206 - DNA, 22 bp, Artificial Sequence
  chemically synthesized
tgtaaccataaggaattgtatt

SEQ ID NO: 1265207 - DNA, 22 bp, Artificial Sequence
  chemically synthesized
gtaaccataaggaattgtattt

SEQ ID NO: 1265208 - DNA, 22 bp, Artificial Sequence
  chemically synthesized
taaccataaggaattgtatttt

SEQ ID NO: 1265209 - DNA, 22 bp, Artificial Sequence
  chemically synthesized
tgaccccaccttacaaaataca

SEQ ID NO: 1265210 - DNA, 22 bp, Artificial Sequence
  chemically synthesized
gtgaccccaccttacaaaatac

SEQ ID NO: 1265211 - DNA, 22 bp, Artificial Sequence
  chemically synthesized
tattttgtaaggtggggtcaca

SEQ ID NO: 1265212 - DNA, 22 bp, Artificial Sequence
  chemically synthesized
aaacaggaaaggatttgtgacc

SEQ ID NO: 1265213 - DNA, 22 bp, Artificial Sequence
  chemically synthesized
gaaacaggaaaggatttgtgac

SEQ ID NO: 1265214 - DNA, 22 bp, Artificial Sequence
  chemically synthesized
tgtaaggtggggtcacaaatcc

SEQ ID NO: 1265215 - DNA, 22 bp, Artificial Sequence
  chemically synthesized
gtaaggtggggtcacaaatcct

SEQ ID NO: 1265216 - DNA, 22 bp, Artificial Sequence
  chemically synthesized
taaggtggggtcacaaatcctt

SEQ ID NO: 1265217 - DNA, 22 bp, Artificial Sequence
  chemically synthesized
atcagtttgaaacaggaaagga

SEQ ID NO: 1265218 - DNA, 22 bp, Artificial Sequence
  chemically synthesized
tcctgtttcaaactgattaaca

SEQ ID NO: 1265219 - DNA, 22 bp, Artificial Sequence
  chemically synthesized
cctgtttcaaactgattaacac

SEQ ID NO: 1265220 - DNA, 22 bp, Artificial Sequence
  chemically synthesized
ctgtttcaaactgattaacact

SEQ ID NO: 1265221 - DNA, 22 bp, Artificial Sequence
  chemically synthesized
tttcaaactgattaacactgat

SEQ ID NO: 1265222 - DNA, 22 bp, Artificial Sequence
  chemically synthesized
acaaaagagcagtatcagtgtt

SEQ ID NO: 1265223 - DNA, 22 bp, Artificial Sequence
  chemically synthesized
cacaaaagagcagtatcagtgt

SEQ ID NO: 1265224 - DNA, 22 bp, Artificial Sequence
  chemically synthesized
caaactgattaacactgatact

SEQ ID NO: 1265225 - DNA, 22 bp, Artificial Sequence
  chemically synthesized
tcacaaaagagcagtatcagtg

SEQ ID NO: 1265226 - DNA, 22 bp, Artificial Sequence
  chemically synthesized
aaactgattaacactgatactg

SEQ ID NO: 1265227 - DNA, 22 bp, Artificial Sequence
  chemically synthesized
attaacactgatactgctcttt

SEQ ID NO: 1265228 - DNA, 22 bp, Artificial Sequence
  chemically synthesized
acactgatactgctcttttgtg

SEQ ID NO: 1265229 - DNA, 22 bp, Artificial Sequence
  chemically synthesized
cacacaggcaattttcacaaaa

SEQ ID NO: 1265230 - DNA, 22 bp, Artificial Sequence
  chemically synthesized
atactgctcttttgtgaaaatt

SEQ ID NO: 1265231 - DNA, 22 bp, Artificial Sequence
  chemically synthesized
ctcttttgtgaaaattgcctgt

SEQ ID NO: 1265232 - DNA, 22 bp, Artificial Sequence
  chemically synthesized
ttttgtgaaaattgcctgtgtg

SEQ ID NO: 1265233 - DNA, 22 bp, Artificial Sequence
  chemically synthesized
aaatatggtcctgcacacaggc

SEQ ID NO: 1265234 - DNA, 22 bp, Artificial Sequence
  chemically synthesized
ttgtgaaaattgcctgtgtgca

SEQ ID NO: 1265235 - DNA, 22 bp, Artificial Sequence
  chemically synthesized
caaatatggtcctgcacacagg

SEQ ID NO: 1265236 - DNA, 22 bp, Artificial Sequence
  chemically synthesized
tgtgaaaattgcctgtgtgcag

SEQ ID NO: 1265237 - DNA, 22 bp, Artificial Sequence
  chemically synthesized
tcaaatatggtcctgcacacag

SEQ ID NO: 1265238 - DNA, 22 bp, Artificial Sequence
  chemically synthesized
gtgaaaattgcctgtgtgcagg

SEQ ID NO: 1265239 - DNA, 22 bp, Artificial Sequence
  chemically synthesized
tgaaaattgcctgtgtgcagga

SEQ ID NO: 1265240 - DNA, 22 bp, Artificial Sequence
  chemically synthesized
aaattttcaaatatggtcctgc

SEQ ID NO: 1265241 - DNA, 22 bp, Artificial Sequence
  chemically synthesized
ttcaaattttcaaatatggtcc

SEQ ID NO: 1265242 - DNA, 22 bp, Artificial Sequence
  chemically synthesized
cctgtgtgcaggaccatatttg

SEQ ID NO: 1265243 - DNA, 22 bp, Artificial Sequence
  chemically synthesized
ttgttcaaattttcaaatatgg

SEQ ID NO: 1265244 - DNA, 22 bp, Artificial Sequence
  chemically synthesized
attgttcaaattttcaaatatg

SEQ ID NO: 1265245 - DNA, 22 bp, Artificial Sequence
  chemically synthesized
tgtgcaggaccatatttgaaaa

SEQ ID NO: 1265246 - DNA, 22 bp, Artificial Sequence
  chemically synthesized
tttattgttcaaattttcaaat

SEQ ID NO: 1265247 - DNA, 22 bp, Artificial Sequence
  chemically synthesized
ttatttattgttcaaattttca

SEQ ID NO: 1265248 - DNA, 22 bp, Artificial Sequence
  chemically synthesized
attatttattgttcaaattttc

SEQ ID NO: 1265249 - DNA, 22 bp, Artificial Sequence
  chemically synthesized
catatgcttattatttattgtt

SEQ ID NO: 1265250 - DNA, 22 bp, Artificial Sequence
  chemically synthesized
gaaaatttgaacaataaataat

SEQ ID NO: 1265251 - DNA, 22 bp, Artificial Sequence
  chemically synthesized
ttacatatgcttattatttatt

SEQ ID NO: 1265252 - DNA, 22 bp, Artificial Sequence
  chemically synthesized
aaaatttgaacaataaataata

SEQ ID NO: 1265253 - DNA, 22 bp, Artificial Sequence
  chemically synthesized
attacatatgcttattatttat

SEQ ID NO: 1265254 - DNA, 22 bp, Artificial Sequence
  chemically synthesized
tattacatatgcttattattta

SEQ ID NO: 1265255 - DNA, 22 bp, Artificial Sequence
  chemically synthesized
ttattacatatgcttattattt

SEQ ID NO: 1265256 - DNA, 22 bp, Artificial Sequence
  chemically synthesized
cttttattacatatgcttatta

SEQ ID NO: 1265257 - DNA, 22 bp, Artificial Sequence
  chemically synthesized
gaacaataaataataagcatat

SEQ ID NO: 1265258 - DNA, 22 bp, Artificial Sequence
  chemically synthesized
aacaataaataataagcatatg

SEQ ID NO: 1265259 - DNA, 22 bp, Artificial Sequence
  chemically synthesized
ttacttttattacatatgctta

SEQ ID NO: 1265260 - DNA, 22 bp, Artificial Sequence
  chemically synthesized
tatataatatgacacacatcgc

SEQ ID NO: 1265261 - DNA, 22 bp, Artificial Sequence
  chemically synthesized
ggggagtacggaaactatatat

SEQ ID NO: 1265262 - DNA, 22 bp, Artificial Sequence
  chemically synthesized
tatatagtttccgtactcccct

SEQ ID NO: 1265263 - DNA, 22 bp, Artificial Sequence
  chemically synthesized
ccgtactcccctagtggggtgg

SEQ ID NO: 1265264 - DNA, 22 bp, Artificial Sequence
  chemically synthesized
cgtactcccctagtggggtggg

SEQ ID NO: 1265265 - DNA, 22 bp, Artificial Sequence
  chemically synthesized
aaaataaaatccacccacccca

SEQ ID NO: 1265266 - DNA, 22 bp, Artificial Sequence
  chemically synthesized
ccctgaaaataaaatccaccca

SEQ ID NO: 1265267 - DNA, 22 bp, Artificial Sequence
  chemically synthesized
ccctagtggggtgggtggattt

SEQ ID NO: 1265268 - DNA, 22 bp, Artificial Sequence
  chemically synthesized
gtggggtgggtggattttattt

SEQ ID NO: 1265269 - DNA, 22 bp, Artificial Sequence
  chemically synthesized
gaagttcccctgaaaataaaat

SEQ ID NO: 1265270 - DNA, 22 bp, Artificial Sequence
  chemically synthesized
taaggttggaagttcccctgaa

SEQ ID NO: 1265271 - DNA, 22 bp, Artificial Sequence
  chemically synthesized
ataaggttggaagttcccctga

SEQ ID NO: 1265272 - DNA, 22 bp, Artificial Sequence
  chemically synthesized
tttataaggttggaagttcccc

SEQ ID NO: 1265273 - DNA, 22 bp, Artificial Sequence
  chemically synthesized
tattttcaggggaacttccaac

SEQ ID NO: 1265274 - DNA, 22 bp, Artificial Sequence
  chemically synthesized
attttcaggggaacttccaacc

SEQ ID NO: 1265275 - DNA, 22 bp, Artificial Sequence
  chemically synthesized
ttttcaggggaacttccaacct

SEQ ID NO: 1265276 - DNA, 22 bp, Artificial Sequence
  chemically synthesized
gtgaattgtttataaggttgga

SEQ ID NO: 1265277 - DNA, 22 bp, Artificial Sequence
  chemically synthesized
tcaggggaacttccaaccttat

SEQ ID NO: 1265278 - DNA, 22 bp, Artificial Sequence
  chemically synthesized
caggggaacttccaaccttata

SEQ ID NO: 1265279 - DNA, 22 bp, Artificial Sequence
  chemically synthesized
aggggaacttccaaccttataa

SEQ ID NO: 1265280 - DNA, 22 bp, Artificial Sequence
  chemically synthesized
ccaaccttataaacaattcacc

SEQ ID NO: 1265281 - DNA, 22 bp, Artificial Sequence
  chemically synthesized
caaccttataaacaattcacca

SEQ ID NO: 1265282 - DNA, 22 bp, Artificial Sequence
  chemically synthesized
ataaacaattcaccaatacatt

SEQ ID NO: 1265283 - DNA, 22 bp, Artificial Sequence
  chemically synthesized
taaacaattcaccaatacattt

SEQ ID NO: 1265284 - DNA, 22 bp, Artificial Sequence
  chemically synthesized
ccccatagatggaaaatgtatt

SEQ ID NO: 1265285 - DNA, 22 bp, Artificial Sequence
  chemically synthesized
accccatagatggaaaatgtat

SEQ ID NO: 1265286 - DNA, 22 bp, Artificial Sequence
  chemically synthesized
taccccatagatggaaaatgta

SEQ ID NO: 1265287 - DNA, 22 bp, Artificial Sequence
  chemically synthesized
ttaccccatagatggaaaatgt

SEQ ID NO: 1265288 - DNA, 22 bp, Artificial Sequence
  chemically synthesized
catttttaccccatagatggaa

SEQ ID NO: 1265289 - DNA, 22 bp, Artificial Sequence
  chemically synthesized
accaatacattttccatctatg

SEQ ID NO: 1265290 - DNA, 22 bp, Artificial Sequence
  chemically synthesized
ttgcatttttaccccatagatg

SEQ ID NO: 1265291 - DNA, 22 bp, Artificial Sequence
  chemically synthesized
taacctattgcatttttacccc

SEQ ID NO: 1265292 - DNA, 22 bp, Artificial Sequence
  chemically synthesized
tccatctatggggtaaaaatgc

SEQ ID NO: 1265293 - DNA, 22 bp, Artificial Sequence
  chemically synthesized
ccatctatggggtaaaaatgca

SEQ ID NO: 1265294 - DNA, 22 bp, Artificial Sequence
  chemically synthesized
catctatggggtaaaaatgcaa

SEQ ID NO: 1265295 - DNA, 22 bp, Artificial Sequence
  chemically synthesized
tatggctataacctattgcatt

SEQ ID NO: 1265296 - DNA, 22 bp, Artificial Sequence
  chemically synthesized
tggggtaaaaatgcaataggtt

SEQ ID NO: 1265297 - DNA, 22 bp, Artificial Sequence
  chemically synthesized
gcgtaaactatatggctataac

SEQ ID NO: 1265298 - DNA, 22 bp, Artificial Sequence
  chemically synthesized
gaggtctggcgtaaactatatg

SEQ ID NO: 1265299 - DNA, 22 bp, Artificial Sequence
  chemically synthesized
agaggtctggcgtaaactatat

SEQ ID NO: 1265300 - DNA, 22 bp, Artificial Sequence
  chemically synthesized
tagccatatagtttacgccaga

SEQ ID NO: 1265301 - DNA, 22 bp, Artificial Sequence
  chemically synthesized
caaatgccttagaggtctggcg

SEQ ID NO: 1265302 - DNA, 22 bp, Artificial Sequence
  chemically synthesized
ttccaaatgccttagaggtctg

SEQ ID NO: 1265303 - DNA, 22 bp, Artificial Sequence
  chemically synthesized
attccaaatgccttagaggtct

SEQ ID NO: 1265304 - DNA, 22 bp, Artificial Sequence
  chemically synthesized
tattccaaatgccttagaggtc

SEQ ID NO: 1265305 - DNA, 22 bp, Artificial Sequence
  chemically synthesized
cctttattccaaatgccttaga

SEQ ID NO: 1265306 - DNA, 22 bp, Artificial Sequence
  chemically synthesized
acgccagacctctaaggcattt

SEQ ID NO: 1265307 - DNA, 22 bp, Artificial Sequence
  chemically synthesized
tacctttattccaaatgcctta

SEQ ID NO: 1265308 - DNA, 22 bp, Artificial Sequence
  chemically synthesized
cgccagacctctaaggcatttg

SEQ ID NO: 1265309 - DNA, 22 bp, Artificial Sequence
  chemically synthesized
ctacctttattccaaatgcctt

SEQ ID NO: 1265310 - DNA, 22 bp, Artificial Sequence
  chemically synthesized
tctacctttattccaaatgcct

SEQ ID NO: 1265311 - DNA, 22 bp, Artificial Sequence
  chemically synthesized
ttctacctttattccaaatgcc

SEQ ID NO: 1265312 - DNA, 22 bp, Artificial Sequence
  chemically synthesized
tttctacctttattccaaatgc

SEQ ID NO: 1265313 - DNA, 22 bp, Artificial Sequence
  chemically synthesized
ttttctacctttattccaaatg

SEQ ID NO: 1265314 - DNA, 22 bp, Artificial Sequence
  chemically synthesized
tttttctacctttattccaaat

SEQ ID NO: 1265315 - DNA, 22 bp, Artificial Sequence
  chemically synthesized
ccctttttttctacctttattc

SEQ ID NO: 1265316 - DNA, 22 bp, Artificial Sequence
  chemically synthesized
taaggcatttggaataaaggta

SEQ ID NO: 1265317 - DNA, 22 bp, Artificial Sequence
  chemically synthesized
aggcatttggaataaaggtaga

SEQ ID NO: 1265318 - DNA, 22 bp, Artificial Sequence
  chemically synthesized
aatgttgccctttttttctacc

SEQ ID NO: 1265319 - DNA, 22 bp, Artificial Sequence
  chemically synthesized
ggaataaaggtagaaaaaaagg

SEQ ID NO: 1265320 - DNA, 22 bp, Artificial Sequence
  chemically synthesized
gaataaaggtagaaaaaaaggg

SEQ ID NO: 1265321 - DNA, 22 bp, Artificial Sequence
  chemically synthesized
aaatattaaatgttgccctttt

SEQ ID NO: 1265322 - DNA, 22 bp, Artificial Sequence
  chemically synthesized
ttcaaatattaaatgttgccct

SEQ ID NO: 1265323 - DNA, 22 bp, Artificial Sequence
  chemically synthesized
attcaaatattaaatgttgccc

SEQ ID NO: 1265324 - DNA, 22 bp, Artificial Sequence
  chemically synthesized
tgatatttattcaaatattaaa

SEQ ID NO: 1265325 - DNA, 22 bp, Artificial Sequence
  chemically synthesized
atgatatttattcaaatattaa

SEQ ID NO: 1265326 - DNA, 22 bp, Artificial Sequence
  chemically synthesized
acccttatgatatttattcaaa

SEQ ID NO: 1265327 - DNA, 22 bp, Artificial Sequence
  chemically synthesized
cacccttatgatatttattcaa

SEQ ID NO: 1265328 - DNA, 22 bp, Artificial Sequence
  chemically synthesized
ttcacccttatgatatttattc

SEQ ID NO: 1265329 - DNA, 22 bp, Artificial Sequence
  chemically synthesized
cttcacccttatgatatttatt

SEQ ID NO: 1265330 - DNA, 22 bp, Artificial Sequence
  chemically synthesized
tcttcacccttatgatatttat

SEQ ID NO: 1265331 - DNA, 22 bp, Artificial Sequence
  chemically synthesized
aatatttgaataaatatcataa

SEQ ID NO: 1265332 - DNA, 22 bp, Artificial Sequence
  chemically synthesized
ctttcttcacccttatgatatt

SEQ ID NO: 1265333 - DNA, 22 bp, Artificial Sequence
  chemically synthesized
atatttgaataaatatcataag

SEQ ID NO: 1265334 - DNA, 22 bp, Artificial Sequence
  chemically synthesized
tcctttcttcacccttatgata

SEQ ID NO: 1265335 - DNA, 22 bp, Artificial Sequence
  chemically synthesized
gaataaatatcataagggtgaa

SEQ ID NO: 1265336 - DNA, 22 bp, Artificial Sequence
  chemically synthesized
aataaatatcataagggtgaag

SEQ ID NO: 1265337 - DNA, 22 bp, Artificial Sequence
  chemically synthesized
aatatgtacccacgactctcct

SEQ ID NO: 1265338 - DNA, 22 bp, Artificial Sequence
  chemically synthesized
tcaatatgtacccacgactctc

SEQ ID NO: 1265339 - DNA, 22 bp, Artificial Sequence
  chemically synthesized
tctcaatatgtacccacgactc

SEQ ID NO: 1265340 - DNA, 22 bp, Artificial Sequence
  chemically synthesized
ctctcaatatgtacccacgact

SEQ ID NO: 1265341 - DNA, 22 bp, Artificial Sequence
  chemically synthesized
tctctcaatatgtacccacgac

SEQ ID NO: 1265342 - DNA, 22 bp, Artificial Sequence
  chemically synthesized
ttctctcaatatgtacccacga

SEQ ID NO: 1265343 - DNA, 22 bp, Artificial Sequence
  chemically synthesized
cttttctctcaatatgtaccca

SEQ ID NO: 1265344 - DNA, 22 bp, Artificial Sequence
  chemically synthesized
taattacttttctctcaatatg

SEQ ID NO: 1265345 - DNA, 22 bp, Artificial Sequence
  chemically synthesized
ataattacttttctctcaatat

SEQ ID NO: 1265346 - DNA, 22 bp, Artificial Sequence
  chemically synthesized
gtcataccaatttataattact

SEQ ID NO: 1265347 - DNA, 22 bp, Artificial Sequence
  chemically synthesized
tagtcataccaatttataatta

SEQ ID NO: 1265348 - DNA, 22 bp, Artificial Sequence
  chemically synthesized
ctagtcataccaatttataatt

SEQ ID NO: 1265349 - DNA, 22 bp, Artificial Sequence
  chemically synthesized
agagaaaagtaattataaattg

SEQ ID NO: 1265350 - DNA, 22 bp, Artificial Sequence
  chemically synthesized
ttctagtcataccaatttataa

SEQ ID NO: 1265351 - DNA, 22 bp, Artificial Sequence
  chemically synthesized
tcttctagtcataccaatttat

SEQ ID NO: 1265352 - DNA, 22 bp, Artificial Sequence
  chemically synthesized
ccattctcttctagtcatacca

SEQ ID NO: 1265353 - DNA, 22 bp, Artificial Sequence
  chemically synthesized
attgccattctcttctagtcat

SEQ ID NO: 1265354 - DNA, 22 bp, Artificial Sequence
  chemically synthesized
taaattggtatgactagaagag

SEQ ID NO: 1265355 - DNA, 22 bp, Artificial Sequence
  chemically synthesized
ccaaagctcattgccattctct

SEQ ID NO: 1265356 - DNA, 22 bp, Artificial Sequence
  chemically synthesized
gtatgactagaagagaatggca

SEQ ID NO: 1265357 - DNA, 22 bp, Artificial Sequence
  chemically synthesized
gccaaagctcattgccattctc

SEQ ID NO: 1265358 - DNA, 22 bp, Artificial Sequence
  chemically synthesized
gaagagaatggcaatgagcttt

SEQ ID NO: 1265359 - DNA, 22 bp, Artificial Sequence
  chemically synthesized
taatggggatcatttgccaaag

SEQ ID NO: 1265360 - DNA, 22 bp, Artificial Sequence
  chemically synthesized
cactataatggggatcatttgc

SEQ ID NO: 1265361 - DNA, 22 bp, Artificial Sequence
  chemically synthesized
aactacactataatggggatca

SEQ ID NO: 1265362 - DNA, 22 bp, Artificial Sequence
  chemically synthesized
aaactacactataatggggatc

SEQ ID NO: 1265363 - DNA, 22 bp, Artificial Sequence
  chemically synthesized
tggcaaatgatccccattatag

SEQ ID NO: 1265364 - DNA, 22 bp, Artificial Sequence
  chemically synthesized
ggcaaatgatccccattatagt

SEQ ID NO: 1265365 - DNA, 22 bp, Artificial Sequence
  chemically synthesized
gcaaatgatccccattatagtg

SEQ ID NO: 1265366 - DNA, 22 bp, Artificial Sequence
  chemically synthesized
tacatcaatcgtttaaactaca

SEQ ID NO: 1265367 - DNA, 22 bp, Artificial Sequence
  chemically synthesized
gtacatcaatcgtttaaactac

SEQ ID NO: 1265368 - DNA, 22 bp, Artificial Sequence
  chemically synthesized
gggcttgtacatcaatcgttta

SEQ ID NO: 1265369 - DNA, 22 bp, Artificial Sequence
  chemically synthesized
cgggcttgtacatcaatcgttt

SEQ ID NO: 1265370 - DNA, 22 bp, Artificial Sequence
  chemically synthesized
tagtgtagtttaaacgattgat

SEQ ID NO: 1265371 - DNA, 22 bp, Artificial Sequence
  chemically synthesized
tcgggcttgtacatcaatcgtt

SEQ ID NO: 1265372 - DNA, 22 bp, Artificial Sequence
  chemically synthesized
ttcgggcttgtacatcaatcgt

SEQ ID NO: 1265373 - DNA, 22 bp, Artificial Sequence
  chemically synthesized
cagccttttcgggcttgtacat

SEQ ID NO: 1265374 - DNA, 22 bp, Artificial Sequence
  chemically synthesized
tccagccttttcgggcttgtac

SEQ ID NO: 1265375 - DNA, 22 bp, Artificial Sequence
  chemically synthesized
aaacgattgatgtacaagcccg

SEQ ID NO: 1265376 - DNA, 22 bp, Artificial Sequence
  chemically synthesized
aacgattgatgtacaagcccga

SEQ ID NO: 1265377 - DNA, 22 bp, Artificial Sequence
  chemically synthesized
atattctccagccttttcgggc

SEQ ID NO: 1265378 - DNA, 22 bp, Artificial Sequence
  chemically synthesized
atgtacaagcccgaaaaggctg

SEQ ID NO: 1265379 - DNA, 22 bp, Artificial Sequence
  chemically synthesized
taaccagcagatctgatattct

SEQ ID NO: 1265380 - DNA, 22 bp, Artificial Sequence
  chemically synthesized
gagaatatcagatctgctggtt

SEQ ID NO: 1265381 - DNA, 22 bp, Artificial Sequence
  chemically synthesized
gtagtcagatacaccctgtaac

SEQ ID NO: 1265382 - DNA, 22 bp, Artificial Sequence
  chemically synthesized
aaactggtagtcagatacaccc

SEQ ID NO: 1265383 - DNA, 22 bp, Artificial Sequence
  chemically synthesized
ctggttacagggtgtatctgac

SEQ ID NO: 1265384 - DNA, 22 bp, Artificial Sequence
  chemically synthesized
gttacagggtgtatctgactac

SEQ ID NO: 1265385 - DNA, 22 bp, Artificial Sequence
  chemically synthesized
taccctgaaactggtagtcaga

SEQ ID NO: 1265386 - DNA, 22 bp, Artificial Sequence
  chemically synthesized
cagggtgtatctgactaccagt

SEQ ID NO: 1265387 - DNA, 22 bp, Artificial Sequence
  chemically synthesized
agctgtaccctgaaactggtag

SEQ ID NO: 1265388 - DNA, 22 bp, Artificial Sequence
  chemically synthesized
cagctgtaccctgaaactggta

SEQ ID NO: 1265389 - DNA, 22 bp, Artificial Sequence
  chemically synthesized
tttcagctgtaccctgaaactg

SEQ ID NO: 1265390 - DNA, 22 bp, Artificial Sequence
  chemically synthesized
atttcagctgtaccctgaaact

SEQ ID NO: 1265391 - DNA, 22 bp, Artificial Sequence
  chemically synthesized
atttatttcagctgtaccctga

SEQ ID NO: 1265392 - DNA, 22 bp, Artificial Sequence
  chemically synthesized
actaccagtttcagggtacagc

SEQ ID NO: 1265393 - DNA, 22 bp, Artificial Sequence
  chemically synthesized
ccagtttcagggtacagctgaa

SEQ ID NO: 1265394 - DNA, 22 bp, Artificial Sequence
  chemically synthesized
ggatcactgatttatttcagct

SEQ ID NO: 1265395 - DNA, 22 bp, Artificial Sequence
  chemically synthesized
tgggatcactgatttatttcag

SEQ ID NO: 1265396 - DNA, 22 bp, Artificial Sequence
  chemically synthesized
ctgggatcactgatttatttca

SEQ ID NO: 1265397 - DNA, 22 bp, Artificial Sequence
  chemically synthesized
cagggtacagctgaaataaatc

SEQ ID NO: 1265398 - DNA, 22 bp, Artificial Sequence
  chemically synthesized
tctgggatcactgatttatttc

SEQ ID NO: 1265399 - DNA, 22 bp, Artificial Sequence
  chemically synthesized
agggtacagctgaaataaatca

SEQ ID NO: 1265400 - DNA, 22 bp, Artificial Sequence
  chemically synthesized
ttctgggatcactgatttattt

SEQ ID NO: 1265401 - DNA, 22 bp, Artificial Sequence
  chemically synthesized
ttttctgggatcactgatttat

SEQ ID NO: 1265402 - DNA, 22 bp, Artificial Sequence
  chemically synthesized
cttttctgggatcactgattta

SEQ ID NO: 1265403 - DNA, 22 bp, Artificial Sequence
  chemically synthesized
aaataaatcagtgatcccagaa

SEQ ID NO: 1265404 - DNA, 22 bp, Artificial Sequence
  chemically synthesized
cacgtaaaaagaaacttctttt

SEQ ID NO: 1265405 - DNA, 22 bp, Artificial Sequence
  chemically synthesized
gcacgtaaaaagaaacttcttt

SEQ ID NO: 1265406 - DNA, 22 bp, Artificial Sequence
  chemically synthesized
tgcacgtaaaaagaaacttctt

SEQ ID NO: 1265407 - DNA, 22 bp, Artificial Sequence
  chemically synthesized
agaagttttgcacgtaaaaaga

SEQ ID NO: 1265408 - DNA, 22 bp, Artificial Sequence
  chemically synthesized
ctcagaagttttgcacgtaaaa

SEQ ID NO: 1265409 - DNA, 22 bp, Artificial Sequence
  chemically synthesized
gctcagaagttttgcacgtaaa

SEQ ID NO: 1265410 - DNA, 22 bp, Artificial Sequence
  chemically synthesized
tgctcagaagttttgcacgtaa

SEQ ID NO: 1265411 - DNA, 22 bp, Artificial Sequence
  chemically synthesized
ctttttacgtgcaaaacttctg

SEQ ID NO: 1265412 - DNA, 22 bp, Artificial Sequence
  chemically synthesized
tttttacgtgcaaaacttctga

SEQ ID NO: 1265413 - DNA, 22 bp, Artificial Sequence
  chemically synthesized
tttacgtgcaaaacttctgagc

SEQ ID NO: 1265414 - DNA, 22 bp, Artificial Sequence
  chemically synthesized
ttacgtgcaaaacttctgagca

SEQ ID NO: 1265415 - DNA, 22 bp, Artificial Sequence
  chemically synthesized
tacgtgcaaaacttctgagcaa

SEQ ID NO: 1265416 - DNA, 22 bp, Artificial Sequence
  chemically synthesized
gcagagatcactttgctcagaa

SEQ ID NO: 1265417 - DNA, 22 bp, Artificial Sequence
  chemically synthesized
acgtgcaaaacttctgagcaaa

SEQ ID NO: 1265418 - DNA, 22 bp, Artificial Sequence
  chemically synthesized
cgtgcaaaacttctgagcaaag

SEQ ID NO: 1265419 - DNA, 22 bp, Artificial Sequence
  chemically synthesized
cagctggcagagatcactttgc

SEQ ID NO: 1265420 - DNA, 22 bp, Artificial Sequence
  chemically synthesized
ctgagcaaagtgatctctgcca

SEQ ID NO: 1265421 - DNA, 22 bp, Artificial Sequence
  chemically synthesized
tgagcaaagtgatctctgccag

SEQ ID NO: 1265422 - DNA, 22 bp, Artificial Sequence
  chemically synthesized
agcaaagtgatctctgccagct

SEQ ID NO: 1265423 - DNA, 22 bp, Artificial Sequence
  chemically synthesized
tgaatccccagctccagctggc

SEQ ID NO: 1265424 - DNA, 22 bp, Artificial Sequence
  chemically synthesized
tgccagctggagctggggattc

SEQ ID NO: 1265425 - DNA, 22 bp, Artificial Sequence
  chemically synthesized
ccagctggagctggggattcac

SEQ ID NO: 1265426 - DNA, 22 bp, Artificial Sequence
  chemically synthesized
atggaaaaatagaggctgtgaa

SEQ ID NO: 1265427 - DNA, 22 bp, Artificial Sequence
  chemically synthesized
gatggaaaaatagaggctgtga

SEQ ID NO: 1265428 - DNA, 22 bp, Artificial Sequence
  chemically synthesized
gagctggggattcacagcctct

SEQ ID NO: 1265429 - DNA, 22 bp, Artificial Sequence
  chemically synthesized
tgatggaaaaatagaggctgtg

SEQ ID NO: 1265430 - DNA, 22 bp, Artificial Sequence
  chemically synthesized
ttgatggaaaaatagaggctgt

SEQ ID NO: 1265431 - DNA, 22 bp, Artificial Sequence
  chemically synthesized
ttttgatggaaaaatagaggct

SEQ ID NO: 1265432 - DNA, 22 bp, Artificial Sequence
  chemically synthesized
gggattcacagcctctattttt

SEQ ID NO: 1265433 - DNA, 22 bp, Artificial Sequence
  chemically synthesized
attcttttgatggaaaaataga

SEQ ID NO: 1265434 - DNA, 22 bp, Artificial Sequence
  chemically synthesized
aattcttttgatggaaaaatag

SEQ ID NO: 1265435 - DNA, 22 bp, Artificial Sequence
  chemically synthesized
acagcctctatttttccatcaa

SEQ ID NO: 1265436 - DNA, 22 bp, Artificial Sequence
  chemically synthesized
ggagtcaacttaattcttttga

SEQ ID NO: 1265437 - DNA, 22 bp, Artificial Sequence
  chemically synthesized
tatttttccatcaaaagaatta

SEQ ID NO: 1265438 - DNA, 22 bp, Artificial Sequence
  chemically synthesized
tttttccatcaaaagaattaag

SEQ ID NO: 1265439 - DNA, 22 bp, Artificial Sequence
  chemically synthesized
tctgggagtcaacttaattctt

SEQ ID NO: 1265440 - DNA, 22 bp, Artificial Sequence
  chemically synthesized
tatctgggagtcaacttaattc

SEQ ID NO: 1265441 - DNA, 22 bp, Artificial Sequence
  chemically synthesized
ttccatcaaaagaattaagttg

SEQ ID NO: 1265442 - DNA, 22 bp, Artificial Sequence
  chemically synthesized
tccatcaaaagaattaagttga

SEQ ID NO: 1265443 - DNA, 22 bp, Artificial Sequence
  chemically synthesized
tctatctgggagtcaacttaat

SEQ ID NO: 1265444 - DNA, 22 bp, Artificial Sequence
  chemically synthesized
ccatcaaaagaattaagttgac

SEQ ID NO: 1265445 - DNA, 22 bp, Artificial Sequence
  chemically synthesized
catcaaaagaattaagttgact

SEQ ID NO: 1265446 - DNA, 22 bp, Artificial Sequence
  chemically synthesized
ttctctatctgggagtcaactt

SEQ ID NO: 1265447 - DNA, 22 bp, Artificial Sequence
  chemically synthesized
agttgactcccagatagagaat

SEQ ID NO: 1265448 - DNA, 22 bp, Artificial Sequence
  chemically synthesized
actcccagatagagaataacta

SEQ ID NO: 1265449 - DNA, 22 bp, Artificial Sequence
  chemically synthesized
aaaaaaaatatatagttattct

SEQ ID NO: 1265450 - DNA, 22 bp, Artificial Sequence
  chemically synthesized
ccagatagagaataactatata

SEQ ID NO: 1265451 - DNA, 22 bp, Artificial Sequence
  chemically synthesized
catctgaaaaaaaatatatagt

SEQ ID NO: 1265452 - DNA, 22 bp, Artificial Sequence
  chemically synthesized
aggaggctacatctgaaaaaaa

SEQ ID NO: 1265453 - DNA, 22 bp, Artificial Sequence
  chemically synthesized
tatattttttttcagatgtagc

SEQ ID NO: 1265454 - DNA, 22 bp, Artificial Sequence
  chemically synthesized
agtactcaggaggctacatctg

SEQ ID NO: 1265455 - DNA, 22 bp, Artificial Sequence
  chemically synthesized
gagtactcaggaggctacatct

SEQ ID NO: 1265456 - DNA, 22 bp, Artificial Sequence
  chemically synthesized
tgagtactcaggaggctacatc

SEQ ID NO: 1265457 - DNA, 22 bp, Artificial Sequence
  chemically synthesized
tttttcagatgtagcctcctga

SEQ ID NO: 1265458 - DNA, 22 bp, Artificial Sequence
  chemically synthesized
ttttcagatgtagcctcctgag

SEQ ID NO: 1265459 - DNA, 22 bp, Artificial Sequence
  chemically synthesized
tttcagatgtagcctcctgagt

SEQ ID NO: 1265460 - DNA, 22 bp, Artificial Sequence
  chemically synthesized
ttcagatgtagcctcctgagta

SEQ ID NO: 1265461 - DNA, 22 bp, Artificial Sequence
  chemically synthesized
tcagatgtagcctcctgagtac

SEQ ID NO: 1265462 - DNA, 22 bp, Artificial Sequence
  chemically synthesized
cagatgtagcctcctgagtact

SEQ ID NO: 1265463 - DNA, 22 bp, Artificial Sequence
  chemically synthesized
gagatggttttgagtactcagg

SEQ ID NO: 1265464 - DNA, 22 bp, Artificial Sequence
  chemically synthesized
agatgtagcctcctgagtactc

SEQ ID NO: 1265465 - DNA, 22 bp, Artificial Sequence
  chemically synthesized
catatcctggagatggttttga

SEQ ID NO: 1265466 - DNA, 22 bp, Artificial Sequence
  chemically synthesized
ccatatcctggagatggttttg

SEQ ID NO: 1265467 - DNA, 22 bp, Artificial Sequence
  chemically synthesized
tccatatcctggagatggtttt

SEQ ID NO: 1265468 - DNA, 22 bp, Artificial Sequence
  chemically synthesized
ctgagtactcaaaaccatctcc

SEQ ID NO: 1265469 - DNA, 22 bp, Artificial Sequence
  chemically synthesized
agtactcaaaaccatctccagg

SEQ ID NO: 1265470 - DNA, 22 bp, Artificial Sequence
  chemically synthesized
aaaaccatctccaggatatgga

SEQ ID NO: 1265471 - DNA, 22 bp, Artificial Sequence
  chemically synthesized
gataaggtgaattttccatatc

SEQ ID NO: 1265472 - DNA, 22 bp, Artificial Sequence
  chemically synthesized
ggataaggtgaattttccatat

SEQ ID NO: 1265473 - DNA, 22 bp, Artificial Sequence
  chemically synthesized
caggatatggaaaattcacctt

SEQ ID NO: 1265474 - DNA, 22 bp, Artificial Sequence
  chemically synthesized
gccatatacgtttggataaggt

SEQ ID NO: 1265475 - DNA, 22 bp, Artificial Sequence
  chemically synthesized
agccatatacgtttggataagg

SEQ ID NO: 1265476 - DNA, 22 bp, Artificial Sequence
  chemically synthesized
tagccatatacgtttggataag

SEQ ID NO: 1265477 - DNA, 22 bp, Artificial Sequence
  chemically synthesized
accttatccaaacgtatatggc

SEQ ID NO: 1265478 - DNA, 22 bp, Artificial Sequence
  chemically synthesized
caaaggaattttagccatatac

SEQ ID NO: 1265479 - DNA, 22 bp, Artificial Sequence
  chemically synthesized
acaaaggaattttagccatata

SEQ ID NO: 1265480 - DNA, 22 bp, Artificial Sequence
  chemically synthesized
atccaaacgtatatggctaaaa

SEQ ID NO: 1265481 - DNA, 22 bp, Artificial Sequence
  chemically synthesized
tccaaacgtatatggctaaaat

SEQ ID NO: 1265482 - DNA, 22 bp, Artificial Sequence
  chemically synthesized
aaattcctttgtaaggcactac

SEQ ID NO: 1265483 - DNA, 22 bp, Artificial Sequence
  chemically synthesized
ctttgtaaggcactacctattt

SEQ ID NO: 1265484 - DNA, 22 bp, Artificial Sequence
  chemically synthesized
tgtaaggcactacctatttccc

SEQ ID NO: 1265485 - DNA, 22 bp, Artificial Sequence
  chemically synthesized
gtaaggcactacctatttccct

SEQ ID NO: 1265486 - DNA, 22 bp, Artificial Sequence
  chemically synthesized
taaggcactacctatttccctg

SEQ ID NO: 1265487 - DNA, 22 bp, Artificial Sequence
  chemically synthesized
atcaaatacaagaaacagggaa

SEQ ID NO: 1265488 - DNA, 22 bp, Artificial Sequence
  chemically synthesized
taatcaaatacaagaaacaggg

SEQ ID NO: 1265489 - DNA, 22 bp, Artificial Sequence
  chemically synthesized
tctctaatcaaatacaagaaac

SEQ ID NO: 1265490 - DNA, 22 bp, Artificial Sequence
  chemically synthesized
cctatttccctgtttcttgtat

SEQ ID NO: 1265491 - DNA, 22 bp, Artificial Sequence
  chemically synthesized
tttccctgtttcttgtatttga

SEQ ID NO: 1265492 - DNA, 22 bp, Artificial Sequence
  chemically synthesized
ccctgtttcttgtatttgatta

SEQ ID NO: 1265493 - DNA, 22 bp, Artificial Sequence
  chemically synthesized
aatagttatctctaatcaaata

SEQ ID NO: 1265494 - DNA, 22 bp, Artificial Sequence
  chemically synthesized
cctgtttcttgtatttgattag

SEQ ID NO: 1265495 - DNA, 22 bp, Artificial Sequence
  chemically synthesized
tcaatagttatctctaatcaaa

SEQ ID NO: 1265496 - DNA, 22 bp, Artificial Sequence
  chemically synthesized
ctcaatagttatctctaatcaa

SEQ ID NO: 1265497 - DNA, 22 bp, Artificial Sequence
  chemically synthesized
tctcaatagttatctctaatca

SEQ ID NO: 1265498 - DNA, 22 bp, Artificial Sequence
  chemically synthesized
tttcttgtatttgattagagat

SEQ ID NO: 1265499 - DNA, 22 bp, Artificial Sequence
  chemically synthesized
cttgtatttgattagagataac

SEQ ID NO: 1265500 - DNA, 22 bp, Artificial Sequence
  chemically synthesized
ttgtatttgattagagataact

SEQ ID NO: 1265501 - DNA, 22 bp, Artificial Sequence
  chemically synthesized
gtatttgattagagataactat

SEQ ID NO: 1265502 - DNA, 22 bp, Artificial Sequence
  chemically synthesized
tatttgattagagataactatt

SEQ ID NO: 1265503 - DNA, 22 bp, Artificial Sequence
  chemically synthesized
gattagagataactattgagaa

SEQ ID NO: 1265504 - DNA, 22 bp, Artificial Sequence
  chemically synthesized
ataaaccatgttttctcaatag

SEQ ID NO: 1265505 - DNA, 22 bp, Artificial Sequence
  chemically synthesized
attagagataactattgagaaa

SEQ ID NO: 1265506 - DNA, 22 bp, Artificial Sequence
  chemically synthesized
cataaaccatgttttctcaata

SEQ ID NO: 1265507 - DNA, 22 bp, Artificial Sequence
  chemically synthesized
tcataaaccatgttttctcaat

SEQ ID NO: 1265508 - DNA, 22 bp, Artificial Sequence
  chemically synthesized
tttcataaaccatgttttctca

SEQ ID NO: 1265509 - DNA, 22 bp, Artificial Sequence
  chemically synthesized
gagataactattgagaaaacat

SEQ ID NO: 1265510 - DNA, 22 bp, Artificial Sequence
  chemically synthesized
ctttcataaaccatgttttctc

SEQ ID NO: 1265511 - DNA, 22 bp, Artificial Sequence
  chemically synthesized
ccatttctttcataaaccatgt

SEQ ID NO: 1265512 - DNA, 22 bp, Artificial Sequence
  chemically synthesized
cccatttctttcataaaccatg

SEQ ID NO: 1265513 - DNA, 22 bp, Artificial Sequence
  chemically synthesized
tcccatttctttcataaaccat

SEQ ID NO: 1265514 - DNA, 22 bp, Artificial Sequence
  chemically synthesized
ttgagaaaacatggtttatgaa

SEQ ID NO: 1265515 - DNA, 22 bp, Artificial Sequence
  chemically synthesized
agaaaacatggtttatgaaaga

SEQ ID NO: 1265516 - DNA, 22 bp, Artificial Sequence
  chemically synthesized
atgaaagaaatgggaaaatatt

SEQ ID NO: 1265517 - DNA, 22 bp, Artificial Sequence
  chemically synthesized
tcaaaacgggaaaatattttcc

SEQ ID NO: 1265518 - DNA, 22 bp, Artificial Sequence
  chemically synthesized
tgaaagaaatgggaaaatattt

SEQ ID NO: 1265519 - DNA, 22 bp, Artificial Sequence
  chemically synthesized
atcaaaacgggaaaatattttc

SEQ ID NO: 1265520 - DNA, 22 bp, Artificial Sequence
  chemically synthesized
ttatcaaaacgggaaaatattt

SEQ ID NO: 1265521 - DNA, 22 bp, Artificial Sequence
  chemically synthesized
aaaatacattcttatcaaaacg

SEQ ID NO: 1265522 - DNA, 22 bp, Artificial Sequence
  chemically synthesized
aaaaatacattcttatcaaaac

SEQ ID NO: 1265523 - DNA, 22 bp, Artificial Sequence
  chemically synthesized
taaaaatacattcttatcaaaa

SEQ ID NO: 1265524 - DNA, 22 bp, Artificial Sequence
  chemically synthesized
ttaaaaatacattcttatcaaa

SEQ ID NO: 1265525 - DNA, 22 bp, Artificial Sequence
  chemically synthesized
tttaaaaatacattcttatcaa

SEQ ID NO: 1265526 - DNA, 22 bp, Artificial Sequence
  chemically synthesized
ttttttaaaaatacattcttat

SEQ ID NO: 1265527 - DNA, 22 bp, Artificial Sequence
  chemically synthesized
gttttttaaaaatacattctta

SEQ ID NO: 1265528 - DNA, 22 bp, Artificial Sequence
  chemically synthesized
tcccgttttgataagaatgtat

SEQ ID NO: 1265529 - DNA, 22 bp, Artificial Sequence
  chemically synthesized
cccgttttgataagaatgtatt

SEQ ID NO: 1265530 - DNA, 22 bp, Artificial Sequence
  chemically synthesized
ccgttttgataagaatgtattt

SEQ ID NO: 1265531 - DNA, 22 bp, Artificial Sequence
  chemically synthesized
catttgttttttaaaaatacat

SEQ ID NO: 1265532 - DNA, 22 bp, Artificial Sequence
  chemically synthesized
ccatttgttttttaaaaataca

SEQ ID NO: 1265533 - DNA, 22 bp, Artificial Sequence
  chemically synthesized
tgataagaatgtatttttaaaa

SEQ ID NO: 1265534 - DNA, 22 bp, Artificial Sequence
  chemically synthesized
gataagaatgtatttttaaaaa

SEQ ID NO: 1265535 - DNA, 22 bp, Artificial Sequence
  chemically synthesized
ataagaatgtatttttaaaaaa

SEQ ID NO: 1265536 - DNA, 22 bp, Artificial Sequence
  chemically synthesized
ggtttccatttgttttttaaaa

SEQ ID NO: 1265537 - DNA, 22 bp, Artificial Sequence
  chemically synthesized
aggtttccatttgttttttaaa

SEQ ID NO: 1265538 - DNA, 22 bp, Artificial Sequence
  chemically synthesized
taggtttccatttgttttttaa

SEQ ID NO: 1265539 - DNA, 22 bp, Artificial Sequence
  chemically synthesized
tgtctttaggtttccatttgtt

SEQ ID NO: 1265540 - DNA, 22 bp, Artificial Sequence
  chemically synthesized
gtgtctttaggtttccatttgt

SEQ ID NO: 1265541 - DNA, 22 bp, Artificial Sequence
  chemically synthesized
tgtgtctttaggtttccatttg

SEQ ID NO: 1265542 - DNA, 22 bp, Artificial Sequence
  chemically synthesized
ttgtgtctttaggtttccattt

SEQ ID NO: 1265543 - DNA, 22 bp, Artificial Sequence
  chemically synthesized
tttgtgtctttaggtttccatt

SEQ ID NO: 1265544 - DNA, 22 bp, Artificial Sequence
  chemically synthesized
ttttgtgtctttaggtttccat

SEQ ID NO: 1265545 - DNA, 22 bp, Artificial Sequence
  chemically synthesized
ttaaaaaacaaatggaaaccta

SEQ ID NO: 1265546 - DNA, 22 bp, Artificial Sequence
  chemically synthesized
taaaaaacaaatggaaacctaa

SEQ ID NO: 1265547 - DNA, 22 bp, Artificial Sequence
  chemically synthesized
aaaaaacaaatggaaacctaaa

SEQ ID NO: 1265548 - DNA, 22 bp, Artificial Sequence
  chemically synthesized
aaaaacaaatggaaacctaaag

SEQ ID NO: 1265549 - DNA, 22 bp, Artificial Sequence
  chemically synthesized
caaatatttttttgtgtcttta

SEQ ID NO: 1265550 - DNA, 22 bp, Artificial Sequence
  chemically synthesized
acaaatatttttttgtgtcttt

SEQ ID NO: 1265551 - DNA, 22 bp, Artificial Sequence
  chemically synthesized
tacaaatatttttttgtgtctt

SEQ ID NO: 1265552 - DNA, 22 bp, Artificial Sequence
  chemically synthesized
tcccctttacaaatattttttt

SEQ ID NO: 1265553 - DNA, 22 bp, Artificial Sequence
  chemically synthesized
aagacacaaaaaaatatttgta

SEQ ID NO: 1265554 - DNA, 22 bp, Artificial Sequence
  chemically synthesized
agggtattatcccctttacaaa

SEQ ID NO: 1265555 - DNA, 22 bp, Artificial Sequence
  chemically synthesized
cctcagggtattatccccttta

SEQ ID NO: 1265556 - DNA, 22 bp, Artificial Sequence
  chemically synthesized
ccctcagggtattatccccttt

SEQ ID NO: 1265557 - DNA, 22 bp, Artificial Sequence
  chemically synthesized
ccttccctcagggtattatccc

SEQ ID NO: 1265558 - DNA, 22 bp, Artificial Sequence
  chemically synthesized
gctcccttccctcagggtatta

SEQ ID NO: 1265559 - DNA, 22 bp, Artificial Sequence
  chemically synthesized
gtaaaggggataataccctgag

SEQ ID NO: 1265560 - DNA, 22 bp, Artificial Sequence
  chemically synthesized
tggctcccttccctcagggtat

SEQ ID NO: 1265561 - DNA, 22 bp, Artificial Sequence
  chemically synthesized
taaaggggataataccctgagg

SEQ ID NO: 1265562 - DNA, 22 bp, Artificial Sequence
  chemically synthesized
ctggctcccttccctcagggta

SEQ ID NO: 1265563 - DNA, 22 bp, Artificial Sequence
  chemically synthesized
cttctggctcccttccctcagg

SEQ ID NO: 1265564 - DNA, 22 bp, Artificial Sequence
  chemically synthesized
tacttctggctcccttccctca

SEQ ID NO: 1265565 - DNA, 22 bp, Artificial Sequence
  chemically synthesized
gtctctacttctggctcccttc

SEQ ID NO: 1265566 - DNA, 22 bp, Artificial Sequence
  chemically synthesized
tagtctctacttctggctccct

SEQ ID NO: 1265567 - DNA, 22 bp, Artificial Sequence
  chemically synthesized
agggaagggagccagaagtaga

SEQ ID NO: 1265568 - DNA, 22 bp, Artificial Sequence
  chemically synthesized
atatctctagtctctacttctg

SEQ ID NO: 1265569 - DNA, 22 bp, Artificial Sequence
  chemically synthesized
aatatctctagtctctacttct

SEQ ID NO: 1265570 - DNA, 22 bp, Artificial Sequence
  chemically synthesized
ttaatatctctagtctctactt

SEQ ID NO: 1265571 - DNA, 22 bp, Artificial Sequence
  chemically synthesized
cttaatatctctagtctctact

SEQ ID NO: 1265572 - DNA, 22 bp, Artificial Sequence
  chemically synthesized
tcttaatatctctagtctctac

SEQ ID NO: 1265573 - DNA, 22 bp, Artificial Sequence
  chemically synthesized
ttcttaatatctctagtctcta

SEQ ID NO: 1265574 - DNA, 22 bp, Artificial Sequence
  chemically synthesized
aagtttttcttaatatctctag

SEQ ID NO: 1265575 - DNA, 22 bp, Artificial Sequence
  chemically synthesized
attaaagtttttcttaatatct

SEQ ID NO: 1265576 - DNA, 22 bp, Artificial Sequence
  chemically synthesized
gagatattaagaaaaactttaa

SEQ ID NO: 1265577 - DNA, 22 bp, Artificial Sequence
  chemically synthesized
agccaaaatataaattcattaa

SEQ ID NO: 1265578 - DNA, 22 bp, Artificial Sequence
  chemically synthesized
tgagccaaaatataaattcatt

SEQ ID NO: 1265579 - DNA, 22 bp, Artificial Sequence
  chemically synthesized
agaaaaactttaatgaatttat

SEQ ID NO: 1265580 - DNA, 22 bp, Artificial Sequence
  chemically synthesized
taatgaatttatattttggctc

SEQ ID NO: 1265581 - DNA, 22 bp, Artificial Sequence
  chemically synthesized
aatgaatttatattttggctca

SEQ ID NO: 1265582 - DNA, 22 bp, Artificial Sequence
  chemically synthesized
gtaggtgagctctgagccaaaa

SEQ ID NO: 1265583 - DNA, 22 bp, Artificial Sequence
  chemically synthesized
atgaatttatattttggctcag

SEQ ID NO: 1265584 - DNA, 22 bp, Artificial Sequence
  chemically synthesized
agtaggtgagctctgagccaaa

SEQ ID NO: 1265585 - DNA, 22 bp, Artificial Sequence
  chemically synthesized
ccttagtaggtgagctctgagc

SEQ ID NO: 1265586 - DNA, 22 bp, Artificial Sequence
  chemically synthesized
ctcccttagtaggtgagctctg

SEQ ID NO: 1265587 - DNA, 22 bp, Artificial Sequence
  chemically synthesized
atattttggctcagagctcacc

SEQ ID NO: 1265588 - DNA, 22 bp, Artificial Sequence
  chemically synthesized
actcccttagtaggtgagctct

SEQ ID NO: 1265589 - DNA, 22 bp, Artificial Sequence
  chemically synthesized
tattttggctcagagctcacct

SEQ ID NO: 1265590 - DNA, 22 bp, Artificial Sequence
  chemically synthesized
tttactcccttagtaggtgagc

SEQ ID NO: 1265591 - DNA, 22 bp, Artificial Sequence
  chemically synthesized
tggctcagagctcacctactaa

SEQ ID NO: 1265592 - DNA, 22 bp, Artificial Sequence
  chemically synthesized
ggctcagagctcacctactaag

SEQ ID NO: 1265593 - DNA, 22 bp, Artificial Sequence
  chemically synthesized
cctgtttactcccttagtaggt

SEQ ID NO: 1265594 - DNA, 22 bp, Artificial Sequence
  chemically synthesized
gctcagagctcacctactaagg

SEQ ID NO: 1265595 - DNA, 22 bp, Artificial Sequence
  chemically synthesized
gcctgtttactcccttagtagg

SEQ ID NO: 1265596 - DNA, 22 bp, Artificial Sequence
  chemically synthesized
tgcctgtttactcccttagtag

SEQ ID NO: 1265597 - DNA, 22 bp, Artificial Sequence
  chemically synthesized
agagctcacctactaagggagt

SEQ ID NO: 1265598 - DNA, 22 bp, Artificial Sequence
  chemically synthesized
tgactttgcctgtttactccct

SEQ ID NO: 1265599 - DNA, 22 bp, Artificial Sequence
  chemically synthesized
gtgactttgcctgtttactccc

SEQ ID NO: 1265600 - DNA, 22 bp, Artificial Sequence
  chemically synthesized
tgtgactttgcctgtttactcc

SEQ ID NO: 1265601 - DNA, 22 bp, Artificial Sequence
  chemically synthesized
acctactaagggagtaaacagg

SEQ ID NO: 1265602 - DNA, 22 bp, Artificial Sequence
  chemically synthesized
ctaagggagtaaacaggcaaag

SEQ ID NO: 1265603 - DNA, 22 bp, Artificial Sequence
  chemically synthesized
taaacctttgtgactttgcctg

SEQ ID NO: 1265604 - DNA, 22 bp, Artificial Sequence
  chemically synthesized
agggagtaaacaggcaaagtca

SEQ ID NO: 1265605 - DNA, 22 bp, Artificial Sequence
  chemically synthesized
ccccgaccaatggcaagtgtaa

SEQ ID NO: 1265606 - DNA, 22 bp, Artificial Sequence
  chemically synthesized
ataatccttacacttgccattg

SEQ ID NO: 1265607 - DNA, 22 bp, Artificial Sequence
  chemically synthesized
taatccttacacttgccattgg

SEQ ID NO: 1265608 - DNA, 22 bp, Artificial Sequence
  chemically synthesized
atcacctaccccgaccaatggc

SEQ ID NO: 1265609 - DNA, 22 bp, Artificial Sequence
  chemically synthesized
acacttgccattggtcggggta

SEQ ID NO: 1265610 - DNA, 22 bp, Artificial Sequence
  chemically synthesized
cacttgccattggtcggggtag

SEQ ID NO: 1265611 - DNA, 22 bp, Artificial Sequence
  chemically synthesized
acatctaatcacctaccccgac

SEQ ID NO: 1265612 - DNA, 22 bp, Artificial Sequence
  chemically synthesized
cacatctaatcacctaccccga

SEQ ID NO: 1265613 - DNA, 22 bp, Artificial Sequence
  chemically synthesized
tcacatctaatcacctaccccg

SEQ ID NO: 1265614 - DNA, 22 bp, Artificial Sequence
  chemically synthesized
ttcacatctaatcacctacccc

SEQ ID NO: 1265615 - DNA, 22 bp, Artificial Sequence
  chemically synthesized
tttcacatctaatcacctaccc

SEQ ID NO: 1265616 - DNA, 22 bp, Artificial Sequence
  chemically synthesized
gccattggtcggggtaggtgat

SEQ ID NO: 1265617 - DNA, 22 bp, Artificial Sequence
  chemically synthesized
ttttcacatctaatcacctacc

SEQ ID NO: 1265618 - DNA, 22 bp, Artificial Sequence
  chemically synthesized
ccattggtcggggtaggtgatt

SEQ ID NO: 1265619 - DNA, 22 bp, Artificial Sequence
  chemically synthesized
tttttcacatctaatcacctac

SEQ ID NO: 1265620 - DNA, 22 bp, Artificial Sequence
  chemically synthesized
gtcggggtaggtgattagatgt

SEQ ID NO: 1265621 - DNA, 22 bp, Artificial Sequence
  chemically synthesized
gatgtgaaaaaaaatgatgctt

SEQ ID NO: 1265622 - DNA, 22 bp, Artificial Sequence
  chemically synthesized
atatgcccagaataaataaagc

SEQ ID NO: 1265623 - DNA, 22 bp, Artificial Sequence
  chemically synthesized
aatatgcccagaataaataaag

SEQ ID NO: 1265624 - DNA, 22 bp, Artificial Sequence
  chemically synthesized
agtttaatatgcccagaataaa

SEQ ID NO: 1265625 - DNA, 22 bp, Artificial Sequence
  chemically synthesized
tatttattctgggcatattaaa

SEQ ID NO: 1265626 - DNA, 22 bp, Artificial Sequence
  chemically synthesized
atttattctgggcatattaaac

SEQ ID NO: 1265627 - DNA, 22 bp, Artificial Sequence
  chemically synthesized
tttattctgggcatattaaact

SEQ ID NO: 1265628 - DNA, 22 bp, Artificial Sequence
  chemically synthesized
aatcacccagttcagtttaata

SEQ ID NO: 1265629 - DNA, 22 bp, Artificial Sequence
  chemically synthesized
aaatcacccagttcagtttaat

SEQ ID NO: 1265630 - DNA, 22 bp, Artificial Sequence
  chemically synthesized
attctgggcatattaaactgaa

SEQ ID NO: 1265631 - DNA, 22 bp, Artificial Sequence
  chemically synthesized
ttctgggcatattaaactgaac

SEQ ID NO: 1265632 - DNA, 22 bp, Artificial Sequence
  chemically synthesized
atttaaatcacccagttcagtt

SEQ ID NO: 1265633 - DNA, 22 bp, Artificial Sequence
  chemically synthesized
tgggcatattaaactgaactgg

SEQ ID NO: 1265634 - DNA, 22 bp, Artificial Sequence
  chemically synthesized
ggcatattaaactgaactgggt

SEQ ID NO: 1265635 - DNA, 22 bp, Artificial Sequence
  chemically synthesized
cagttcatttaaatcacccagt

SEQ ID NO: 1265636 - DNA, 22 bp, Artificial Sequence
  chemically synthesized
ctacagttcatttaaatcaccc

SEQ ID NO: 1265637 - DNA, 22 bp, Artificial Sequence
  chemically synthesized
cctacagttcatttaaatcacc

SEQ ID NO: 1265638 - DNA, 22 bp, Artificial Sequence
  chemically synthesized
aactgaactgggtgatttaaat

SEQ ID NO: 1265639 - DNA, 22 bp, Artificial Sequence
  chemically synthesized
aatttcctacagttcatttaaa

SEQ ID NO: 1265640 - DNA, 22 bp, Artificial Sequence
  chemically synthesized
aactgggtgatttaaatgaact

SEQ ID NO: 1265641 - DNA, 22 bp, Artificial Sequence
  chemically synthesized
cattgaatttcctacagttcat

SEQ ID NO: 1265642 - DNA, 22 bp, Artificial Sequence
  chemically synthesized
ggtgatttaaatgaactgtagg

SEQ ID NO: 1265643 - DNA, 22 bp, Artificial Sequence
  chemically synthesized
ttgcattgaatttcctacagtt

SEQ ID NO: 1265644 - DNA, 22 bp, Artificial Sequence
  chemically synthesized
gctgttgcattgaatttcctac

SEQ ID NO: 1265645 - DNA, 22 bp, Artificial Sequence
  chemically synthesized
agctgttgcattgaatttccta

SEQ ID NO: 1265646 - DNA, 22 bp, Artificial Sequence
  chemically synthesized
tagctgttgcattgaatttcct

SEQ ID NO: 1265647 - DNA, 22 bp, Artificial Sequence
  chemically synthesized
aaatgaactgtaggaaattcaa

SEQ ID NO: 1265648 - DNA, 22 bp, Artificial Sequence
  chemically synthesized
aatgaactgtaggaaattcaat

SEQ ID NO: 1265649 - DNA, 22 bp, Artificial Sequence
  chemically synthesized
attttagctgttgcattgaatt

SEQ ID NO: 1265650 - DNA, 22 bp, Artificial Sequence
  chemically synthesized
taggaaattcaatgcaacagct

SEQ ID NO: 1265651 - DNA, 22 bp, Artificial Sequence
  chemically synthesized
gtcattcattttagctgttgca

SEQ ID NO: 1265652 - DNA, 22 bp, Artificial Sequence
  chemically synthesized
agtcattcattttagctgttgc

SEQ ID NO: 1265653 - DNA, 22 bp, Artificial Sequence
  chemically synthesized
cttagtcattcattttagctgt

SEQ ID NO: 1265654 - DNA, 22 bp, Artificial Sequence
  chemically synthesized
gctccttagtcattcattttag

SEQ ID NO: 1265655 - DNA, 22 bp, Artificial Sequence
  chemically synthesized
aatgcaacagctaaaatgaatg

SEQ ID NO: 1265656 - DNA, 22 bp, Artificial Sequence
  chemically synthesized
tagctccttagtcattcatttt

SEQ ID NO: 1265657 - DNA, 22 bp, Artificial Sequence
  chemically synthesized
ctagctccttagtcattcattt

SEQ ID NO: 1265658 - DNA, 22 bp, Artificial Sequence
  chemically synthesized
agatcttctagctccttagtca

SEQ ID NO: 1265659 - DNA, 22 bp, Artificial Sequence
  chemically synthesized
aaatgaatgactaaggagctag

SEQ ID NO: 1265660 - DNA, 22 bp, Artificial Sequence
  chemically synthesized
tacagattaagatcttctagct

SEQ ID NO: 1265661 - DNA, 22 bp, Artificial Sequence
  chemically synthesized
atacagattaagatcttctagc

SEQ ID NO: 1265662 - DNA, 22 bp, Artificial Sequence
  chemically synthesized
tatacagattaagatcttctag

SEQ ID NO: 1265663 - DNA, 22 bp, Artificial Sequence
  chemically synthesized
agctttatacagattaagatct

SEQ ID NO: 1265664 - DNA, 22 bp, Artificial Sequence
  chemically synthesized
cagctttatacagattaagatc

SEQ ID NO: 1265665 - DNA, 22 bp, Artificial Sequence
  chemically synthesized
aggagctagaagatcttaatct

SEQ ID NO: 1265666 - DNA, 22 bp, Artificial Sequence
  chemically synthesized
tcagctttatacagattaagat

SEQ ID NO: 1265667 - DNA, 22 bp, Artificial Sequence
  chemically synthesized
tttcagctttatacagattaag

SEQ ID NO: 1265668 - DNA, 22 bp, Artificial Sequence
  chemically synthesized
ttctttcagctttatacagatt

SEQ ID NO: 1265669 - DNA, 22 bp, Artificial Sequence
  chemically synthesized
gttctttcagctttatacagat

SEQ ID NO: 1265670 - DNA, 22 bp, Artificial Sequence
  chemically synthesized
tgttctttcagctttatacaga

SEQ ID NO: 1265671 - DNA, 22 bp, Artificial Sequence
  chemically synthesized
gaagatcttaatctgtataaag

SEQ ID NO: 1265672 - DNA, 22 bp, Artificial Sequence
  chemically synthesized
tgcatattttgttctttcagct

SEQ ID NO: 1265673 - DNA, 22 bp, Artificial Sequence
  chemically synthesized
aatctgtataaagctgaaagaa

SEQ ID NO: 1265674 - DNA, 22 bp, Artificial Sequence
  chemically synthesized
atctgtataaagctgaaagaac

SEQ ID NO: 1265675 - DNA, 22 bp, Artificial Sequence
  chemically synthesized
aattgtgcatattttgttcttt

SEQ ID NO: 1265676 - DNA, 22 bp, Artificial Sequence
  chemically synthesized
tataaagctgaaagaacaaaat

SEQ ID NO: 1265677 - DNA, 22 bp, Artificial Sequence
  chemically synthesized
gcacagagctaaattgtgcata

SEQ ID NO: 1265678 - DNA, 22 bp, Artificial Sequence
  chemically synthesized
aaagaacaaaatatgcacaatt

SEQ ID NO: 1265679 - DNA, 22 bp, Artificial Sequence
  chemically synthesized
attagcacagagctaaattgtg

SEQ ID NO: 1265680 - DNA, 22 bp, Artificial Sequence
  chemically synthesized
cattagcacagagctaaattgt

SEQ ID NO: 1265681 - DNA, 22 bp, Artificial Sequence
  chemically synthesized
tcattagcacagagctaaattg

SEQ ID NO: 1265682 - DNA, 22 bp, Artificial Sequence
  chemically synthesized
ctttcattagcacagagctaaa

SEQ ID NO: 1265683 - DNA, 22 bp, Artificial Sequence
  chemically synthesized
cctttcattagcacagagctaa

SEQ ID NO: 1265684 - DNA, 22 bp, Artificial Sequence
  chemically synthesized
tcctttcattagcacagagcta

SEQ ID NO: 1265685 - DNA, 22 bp, Artificial Sequence
  chemically synthesized
tttcctttcattagcacagagc

SEQ ID NO: 1265686 - DNA, 22 bp, Artificial Sequence
  chemically synthesized
tctctttcctttcattagcaca

SEQ ID NO: 1265687 - DNA, 22 bp, Artificial Sequence
  chemically synthesized
gtgttatctctttcctttcatt

SEQ ID NO: 1265688 - DNA, 22 bp, Artificial Sequence
  chemically synthesized
agctctgtgctaatgaaaggaa

SEQ ID NO: 1265689 - DNA, 22 bp, Artificial Sequence
  chemically synthesized
agtgttatctctttcctttcat

SEQ ID NO: 1265690 - DNA, 22 bp, Artificial Sequence
  chemically synthesized
gctctgtgctaatgaaaggaaa

SEQ ID NO: 1265691 - DNA, 22 bp, Artificial Sequence
  chemically synthesized
tagtgttatctctttcctttca

SEQ ID NO: 1265692 - DNA, 22 bp, Artificial Sequence
  chemically synthesized
ttagtgttatctctttcctttc

SEQ ID NO: 1265693 - DNA, 22 bp, Artificial Sequence
  chemically synthesized
tgtgctaatgaaaggaaagaga

SEQ ID NO: 1265694 - DNA, 22 bp, Artificial Sequence
  chemically synthesized
tttttagtgttatctctttcct

SEQ ID NO: 1265695 - DNA, 22 bp, Artificial Sequence
  chemically synthesized
tgctaatgaaaggaaagagata

SEQ ID NO: 1265696 - DNA, 22 bp, Artificial Sequence
  chemically synthesized
agttatttttagtgttatctct

SEQ ID NO: 1265697 - DNA, 22 bp, Artificial Sequence
  chemically synthesized
atgaaaggaaagagataacact

SEQ ID NO: 1265698 - DNA, 22 bp, Artificial Sequence
  chemically synthesized
caccattcagttatttttagtg

SEQ ID NO: 1265699 - DNA, 22 bp, Artificial Sequence
  chemically synthesized
aagcctgcaccattcagttatt

SEQ ID NO: 1265700 - DNA, 22 bp, Artificial Sequence
  chemically synthesized
gaagcctgcaccattcagttat

SEQ ID NO: 1265701 - DNA, 22 bp, Artificial Sequence
  chemically synthesized
ccttgaagcctgcaccattcag

SEQ ID NO: 1265702 - DNA, 22 bp, Artificial Sequence
  chemically synthesized
ctgccttgaagcctgcaccatt

SEQ ID NO: 1265703 - DNA, 22 bp, Artificial Sequence
  chemically synthesized
aaaataactgaatggtgcaggc

SEQ ID NO: 1265704 - DNA, 22 bp, Artificial Sequence
  chemically synthesized
tgctgccttgaagcctgcacca

SEQ ID NO: 1265705 - DNA, 22 bp, Artificial Sequence
  chemically synthesized
ctgctgccttgaagcctgcacc

SEQ ID NO: 1265706 - DNA, 22 bp, Artificial Sequence
  chemically synthesized
ttctgctgccttgaagcctgca

SEQ ID NO: 1265707 - DNA, 22 bp, Artificial Sequence
  chemically synthesized
aatggtgcaggcttcaaggcag

SEQ ID NO: 1265708 - DNA, 22 bp, Artificial Sequence
  chemically synthesized
tgccagaactcttctgctgcct

SEQ ID NO: 1265709 - DNA, 22 bp, Artificial Sequence
  chemically synthesized
gtgccagaactcttctgctgcc

SEQ ID NO: 1265710 - DNA, 22 bp, Artificial Sequence
  chemically synthesized
caaggcagcagaagagttctgg

SEQ ID NO: 1265711 - DNA, 22 bp, Artificial Sequence
  chemically synthesized
aaggcagcagaagagttctggc

SEQ ID NO: 1265712 - DNA, 22 bp, Artificial Sequence
  chemically synthesized
gatagatccatttgtgccagaa

SEQ ID NO: 1265713 - DNA, 22 bp, Artificial Sequence
  chemically synthesized
tggatagatccatttgtgccag

SEQ ID NO: 1265714 - DNA, 22 bp, Artificial Sequence
  chemically synthesized
ctggatagatccatttgtgcca

SEQ ID NO: 1265715 - DNA, 22 bp, Artificial Sequence
  chemically synthesized
tctggatagatccatttgtgcc

SEQ ID NO: 1265716 - DNA, 22 bp, Artificial Sequence
  chemically synthesized
ttctggatagatccatttgtgc

SEQ ID NO: 1265717 - DNA, 22 bp, Artificial Sequence
  chemically synthesized
tttctggatagatccatttgtg

SEQ ID NO: 1265718 - DNA, 22 bp, Artificial Sequence
  chemically synthesized
ttttctggatagatccatttgt

SEQ ID NO: 1265719 - DNA, 22 bp, Artificial Sequence
  chemically synthesized
atttttttctggatagatccat

SEQ ID NO: 1265720 - DNA, 22 bp, Artificial Sequence
  chemically synthesized
tggcacaaatggatctatccag

SEQ ID NO: 1265721 - DNA, 22 bp, Artificial Sequence
  chemically synthesized
gcacaaatggatctatccagaa

SEQ ID NO: 1265722 - DNA, 22 bp, Artificial Sequence
  chemically synthesized
agtctcatttttttctggatag

SEQ ID NO: 1265723 - DNA, 22 bp, Artificial Sequence
  chemically synthesized
tgtaattaagtctcattttttt

SEQ ID NO: 1265724 - DNA, 22 bp, Artificial Sequence
  chemically synthesized
gtgtaattaagtctcatttttt

SEQ ID NO: 1265725 - DNA, 22 bp, Artificial Sequence
  chemically synthesized
tgtgtaattaagtctcattttt

SEQ ID NO: 1265726 - DNA, 22 bp, Artificial Sequence
  chemically synthesized
ctttgtgtaattaagtctcatt

SEQ ID NO: 1265727 - DNA, 22 bp, Artificial Sequence
  chemically synthesized
cctttgtgtaattaagtctcat

SEQ ID NO: 1265728 - DNA, 22 bp, Artificial Sequence
  chemically synthesized
tccagaaaaaaatgagacttaa

SEQ ID NO: 1265729 - DNA, 22 bp, Artificial Sequence
  chemically synthesized
tcctttgtgtaattaagtctca

SEQ ID NO: 1265730 - DNA, 22 bp, Artificial Sequence
  chemically synthesized
ttcctttgtgtaattaagtctc

SEQ ID NO: 1265731 - DNA, 22 bp, Artificial Sequence
  chemically synthesized
acagtcaacagtttttcctttg

SEQ ID NO: 1265732 - DNA, 22 bp, Artificial Sequence
  chemically synthesized
ctcacagtcaacagtttttcct

SEQ ID NO: 1265733 - DNA, 22 bp, Artificial Sequence
  chemically synthesized
cctcacagtcaacagtttttcc

SEQ ID NO: 1265734 - DNA, 22 bp, Artificial Sequence
  chemically synthesized
aattacacaaaggaaaaactgt

SEQ ID NO: 1265735 - DNA, 22 bp, Artificial Sequence
  chemically synthesized
tcctcacagtcaacagtttttc

SEQ ID NO: 1265736 - DNA, 22 bp, Artificial Sequence
  chemically synthesized
attacacaaaggaaaaactgtt

SEQ ID NO: 1265737 - DNA, 22 bp, Artificial Sequence
  chemically synthesized
ttcctcacagtcaacagttttt

SEQ ID NO: 1265738 - DNA, 22 bp, Artificial Sequence
  chemically synthesized
cacaaaggaaaaactgttgact

SEQ ID NO: 1265739 - DNA, 22 bp, Artificial Sequence
  chemically synthesized
ggacacttttcctcacagtcaa

SEQ ID NO: 1265740 - DNA, 22 bp, Artificial Sequence
  chemically synthesized
gggacacttttcctcacagtca

SEQ ID NO: 1265741 - DNA, 22 bp, Artificial Sequence
  chemically synthesized
atcttgggacacttttcctcac

SEQ ID NO: 1265742 - DNA, 22 bp, Artificial Sequence
  chemically synthesized
catcttgggacacttttcctca

SEQ ID NO: 1265743 - DNA, 22 bp, Artificial Sequence
  chemically synthesized
ttgactgtgaggaaaagtgtcc

SEQ ID NO: 1265744 - DNA, 22 bp, Artificial Sequence
  chemically synthesized
actgtgaggaaaagtgtcccaa

SEQ ID NO: 1265745 - DNA, 22 bp, Artificial Sequence
  chemically synthesized
tgaggaaaagtgtcccaagatg

SEQ ID NO: 1265746 - DNA, 22 bp, Artificial Sequence
  chemically synthesized
aacagcagtcatttcatcttgg

SEQ ID NO: 1265747 - DNA, 22 bp, Artificial Sequence
  chemically synthesized
ccattcaacagcagtcatttca

SEQ ID NO: 1265748 - DNA, 22 bp, Artificial Sequence
  chemically synthesized
cccattcaacagcagtcatttc

SEQ ID NO: 1265749 - DNA, 22 bp, Artificial Sequence
  chemically synthesized
atggtttcccattcaacagcag

SEQ ID NO: 1265750 - DNA, 22 bp, Artificial Sequence
  chemically synthesized
tgatggtttcccattcaacagc

SEQ ID NO: 1265751 - DNA, 22 bp, Artificial Sequence
  chemically synthesized
tctgatggtttcccattcaaca

SEQ ID NO: 1265752 - DNA, 22 bp, Artificial Sequence
  chemically synthesized
cctctctgatggtttcccattc

SEQ ID NO: 1265753 - DNA, 22 bp, Artificial Sequence
  chemically synthesized
ctgttgaatgggaaaccatcag

SEQ ID NO: 1265754 - DNA, 22 bp, Artificial Sequence
  chemically synthesized
gtcactgcctctctgatggttt

SEQ ID NO: 1265755 - DNA, 22 bp, Artificial Sequence
  chemically synthesized
tcgtcactgcctctctgatggt

SEQ ID NO: 1265756 - DNA, 22 bp, Artificial Sequence
  chemically synthesized
ttgaatgggaaaccatcagaga

SEQ ID NO: 1265757 - DNA, 22 bp, Artificial Sequence
  chemically synthesized
aatgggaaaccatcagagaggc

SEQ ID NO: 1265758 - DNA, 22 bp, Artificial Sequence
  chemically synthesized
tcgagataacactctcgtcact

SEQ ID NO: 1265759 - DNA, 22 bp, Artificial Sequence
  chemically synthesized
agttgtcgagataacactctcg

SEQ ID NO: 1265760 - DNA, 22 bp, Artificial Sequence
  chemically synthesized
cagttgtcgagataacactctc

SEQ ID NO: 1265761 - DNA, 22 bp, Artificial Sequence
  chemically synthesized
cttcagttgtcgagataacact

SEQ ID NO: 1265762 - DNA, 22 bp, Artificial Sequence
  chemically synthesized
agctgcttcagttgtcgagata

SEQ ID NO: 1265763 - DNA, 22 bp, Artificial Sequence
  chemically synthesized
cagctgcttcagttgtcgagat

SEQ ID NO: 1265764 - DNA, 22 bp, Artificial Sequence
  chemically synthesized
atttcagctgcttcagttgtcg

SEQ ID NO: 1265765 - DNA, 22 bp, Artificial Sequence
  chemically synthesized
tctcgacaactgaagcagctga

SEQ ID NO: 1265766 - DNA, 22 bp, Artificial Sequence
  chemically synthesized
gacaactgaagcagctgaaatg

SEQ ID NO: 1265767 - DNA, 22 bp, Artificial Sequence
  chemically synthesized
cggcaacgtgtctcatttcagc

SEQ ID NO: 1265768 - DNA, 22 bp, Artificial Sequence
  chemically synthesized
ccggcaacgtgtctcatttcag

SEQ ID NO: 1265769 - DNA, 22 bp, Artificial Sequence
  chemically synthesized
tccggcaacgtgtctcatttca

SEQ ID NO: 1265770 - DNA, 22 bp, Artificial Sequence
  chemically synthesized
ttccggcaacgtgtctcatttc

SEQ ID NO: 1265771 - DNA, 22 bp, Artificial Sequence
  chemically synthesized
aagcagctgaaatgagacacgt

SEQ ID NO: 1265772 - DNA, 22 bp, Artificial Sequence
  chemically synthesized
taatggcttttccggcaacgtg

SEQ ID NO: 1265773 - DNA, 22 bp, Artificial Sequence
  chemically synthesized
aaatgagacacgttgccggaaa

SEQ ID NO: 1265774 - DNA, 22 bp, Artificial Sequence
  chemically synthesized
gtctgtaatggcttttccggca

SEQ ID NO: 1265775 - DNA, 22 bp, Artificial Sequence
  chemically synthesized
agtctgtaatggcttttccggc

SEQ ID NO: 1265776 - DNA, 22 bp, Artificial Sequence
  chemically synthesized
ccggaaaagccattacagacta

SEQ ID NO: 1265777 - DNA, 22 bp, Artificial Sequence
  chemically synthesized
ggaccagggggtatttagtctg

SEQ ID NO: 1265778 - DNA, 22 bp, Artificial Sequence
  chemically synthesized
aggaccagggggtatttagtct

SEQ ID NO: 1265779 - DNA, 22 bp, Artificial Sequence
  chemically synthesized
taggaccagggggtatttagtc

SEQ ID NO: 1265780 - DNA, 22 bp, Artificial Sequence
  chemically synthesized
tttaggaccagggggtatttag

SEQ ID NO: 1265781 - DNA, 22 bp, Artificial Sequence
  chemically synthesized
tctctttaggaccagggggtat

SEQ ID NO: 1265782 - DNA, 22 bp, Artificial Sequence
  chemically synthesized
cagactaaataccccctggtcc

SEQ ID NO: 1265783 - DNA, 22 bp, Artificial Sequence
  chemically synthesized
aataccccctggtcctaaagag

SEQ ID NO: 1265784 - DNA, 22 bp, Artificial Sequence
  chemically synthesized
atgtgcatctatctctttagga

SEQ ID NO: 1265785 - DNA, 22 bp, Artificial Sequence
  chemically synthesized
agttgatgtgcatctatctctt

SEQ ID NO: 1265786 - DNA, 22 bp, Artificial Sequence
  chemically synthesized
aagttgatgtgcatctatctct

SEQ ID NO: 1265787 - DNA, 22 bp, Artificial Sequence
  chemically synthesized
cttaagttgatgtgcatctatc

SEQ ID NO: 1265788 - DNA, 22 bp, Artificial Sequence
  chemically synthesized
gtcctaaagagatagatgcaca

SEQ ID NO: 1265789 - DNA, 22 bp, Artificial Sequence
  chemically synthesized
tccttaagttgatgtgcatcta

SEQ ID NO: 1265790 - DNA, 22 bp, Artificial Sequence
  chemically synthesized
aagagatagatgcacatcaact

SEQ ID NO: 1265791 - DNA, 22 bp, Artificial Sequence
  chemically synthesized
caattctccttaagttgatgtg

SEQ ID NO: 1265792 - DNA, 22 bp, Artificial Sequence
  chemically synthesized
tgcaattctccttaagttgatg

SEQ ID NO: 1265793 - DNA, 22 bp, Artificial Sequence
  chemically synthesized
ctctgcaattctccttaagttg

SEQ ID NO: 1265794 - DNA, 22 bp, Artificial Sequence
  chemically synthesized
gtggtgtgcctgctctgcaatt

SEQ ID NO: 1265795 - DNA, 22 bp, Artificial Sequence
  chemically synthesized
tagtggtgtgcctgctctgcaa

SEQ ID NO: 1265796 - DNA, 22 bp, Artificial Sequence
  chemically synthesized
aaggagaattgcagagcaggca

SEQ ID NO: 1265797 - DNA, 22 bp, Artificial Sequence
  chemically synthesized
aggagaattgcagagcaggcac

SEQ ID NO: 1265798 - DNA, 22 bp, Artificial Sequence
  chemically synthesized
ccccgtgttctagtggtgtgcc

SEQ ID NO: 1265799 - DNA, 22 bp, Artificial Sequence
  chemically synthesized
actgccccgtgttctagtggtg

SEQ ID NO: 1265800 - DNA, 22 bp, Artificial Sequence
  chemically synthesized
cagagcaggcacaccactagaa

SEQ ID NO: 1265801 - DNA, 22 bp, Artificial Sequence
  chemically synthesized
actcactgccccgtgttctagt

SEQ ID NO: 1265802 - DNA, 22 bp, Artificial Sequence
  chemically synthesized
ctgactcactgccccgtgttct

SEQ ID NO: 1265803 - DNA, 22 bp, Artificial Sequence
  chemically synthesized
ctcctgactcactgccccgtgt

SEQ ID NO: 1265804 - DNA, 22 bp, Artificial Sequence
  chemically synthesized
gaacacggggcagtgagtcagg

SEQ ID NO: 1265805 - DNA, 22 bp, Artificial Sequence
  chemically synthesized
agataaagaccctactcctgac

SEQ ID NO: 1265806 - DNA, 22 bp, Artificial Sequence
  chemically synthesized
atggcattgagataaagaccct

SEQ ID NO: 1265807 - DNA, 22 bp, Artificial Sequence
  chemically synthesized
cacctaatggcattgagataaa

SEQ ID NO: 1265808 - DNA, 22 bp, Artificial Sequence
  chemically synthesized
agcaagactacacctaatggca

SEQ ID NO: 1265809 - DNA, 22 bp, Artificial Sequence
  chemically synthesized
tatctcaatgccattaggtgta

SEQ ID NO: 1265810 - DNA, 22 bp, Artificial Sequence
  chemically synthesized
atctcaatgccattaggtgtag

SEQ ID NO: 1265811 - DNA, 22 bp, Artificial Sequence
  chemically synthesized
ggttgagcaagactacacctaa

SEQ ID NO: 1265812 - DNA, 22 bp, Artificial Sequence
  chemically synthesized
tctcaatgccattaggtgtagt

SEQ ID NO: 1265813 - DNA, 22 bp, Artificial Sequence
  chemically synthesized
aatgccattaggtgtagtcttg

SEQ ID NO: 1265814 - DNA, 22 bp, Artificial Sequence
  chemically synthesized
ggtgtagtcttgctcaacctaa

SEQ ID NO: 1265815 - DNA, 22 bp, Artificial Sequence
  chemically synthesized
gctcaacctaatttatttctgc

SEQ ID NO: 1265816 - DNA, 22 bp, Artificial Sequence
  chemically synthesized
ctcaacctaatttatttctgcg

SEQ ID NO: 1265817 - DNA, 22 bp, Artificial Sequence
  chemically synthesized
aacctaatttatttctgcggct

SEQ ID NO: 1265818 - DNA, 22 bp, Artificial Sequence
  chemically synthesized
atttatttctgcggcttggatt

SEQ ID NO: 1265819 - DNA, 22 bp, Artificial Sequence
  chemically synthesized
atttctgcggcttggattgctt

SEQ ID NO: 1265820 - DNA, 22 bp, Artificial Sequence
  chemically synthesized
tttctgcggcttggattgcttt

SEQ ID NO: 1265821 - DNA, 22 bp, Artificial Sequence
  chemically synthesized
ctgcggcttggattgctttctg

SEQ ID NO: 1265822 - DNA, 22 bp, Artificial Sequence
  chemically synthesized
aagcagaatagtcagaaagcaa

SEQ ID NO: 1265823 - DNA, 22 bp, Artificial Sequence
  chemically synthesized
tgcggcttggattgctttctga

SEQ ID NO: 1265824 - DNA, 22 bp, Artificial Sequence
  chemically synthesized
cggcttggattgctttctgact

SEQ ID NO: 1265825 - DNA, 22 bp, Artificial Sequence
  chemically synthesized
cactgaagcagaatagtcagaa

SEQ ID NO: 1265826 - DNA, 22 bp, Artificial Sequence
  chemically synthesized
ggattgctttctgactattctg

SEQ ID NO: 1265827 - DNA, 22 bp, Artificial Sequence
  chemically synthesized
gattgctttctgactattctgc

SEQ ID NO: 1265828 - DNA, 22 bp, Artificial Sequence
  chemically synthesized
ctttctgactattctgcttcag

SEQ ID NO: 1265829 - DNA, 22 bp, Artificial Sequence
  chemically synthesized
tctgactattctgcttcagtgg

SEQ ID NO: 1265830 - DNA, 22 bp, Artificial Sequence
  chemically synthesized
ctgactattctgcttcagtgga

SEQ ID NO: 1265831 - DNA, 22 bp, Artificial Sequence
  chemically synthesized
tgactattctgcttcagtggaa

SEQ ID NO: 1265832 - DNA, 22 bp, Artificial Sequence
  chemically synthesized
gtcacaacgacattccactgaa

SEQ ID NO: 1265833 - DNA, 22 bp, Artificial Sequence
  chemically synthesized
actattctgcttcagtggaatg

SEQ ID NO: 1265834 - DNA, 22 bp, Artificial Sequence
  chemically synthesized
ttctgcttcagtggaatgtcgt

SEQ ID NO: 1265835 - DNA, 22 bp, Artificial Sequence
  chemically synthesized
tgcttcagtggaatgtcgttgt

SEQ ID NO: 1265836 - DNA, 22 bp, Artificial Sequence
  chemically synthesized
cttcagtggaatgtcgttgtga

SEQ ID NO: 1265837 - DNA, 22 bp, Artificial Sequence
  chemically synthesized
cagtggaatgtcgttgtgacca

SEQ ID NO: 1265838 - DNA, 22 bp, Artificial Sequence
  chemically synthesized
agtggaatgtcgttgtgaccaa

SEQ ID NO: 1265839 - DNA, 22 bp, Artificial Sequence
  chemically synthesized
gtagcaacaaaattggtcacaa

SEQ ID NO: 1265840 - DNA, 22 bp, Artificial Sequence
  chemically synthesized
agtagcaacaaaattggtcaca

SEQ ID NO: 1265841 - DNA, 22 bp, Artificial Sequence
  chemically synthesized
tagtagcaacaaaattggtcac

SEQ ID NO: 1265842 - DNA, 22 bp, Artificial Sequence
  chemically synthesized
agtattttagtagcaacaaaat

SEQ ID NO: 1265843 - DNA, 22 bp, Artificial Sequence
  chemically synthesized
aagtattttagtagcaacaaaa

SEQ ID NO: 1265844 - DNA, 22 bp, Artificial Sequence
  chemically synthesized
cttaagtattttagtagcaaca

SEQ ID NO: 1265845 - DNA, 22 bp, Artificial Sequence
  chemically synthesized
tgaccaattttgttgctactaa

SEQ ID NO: 1265846 - DNA, 22 bp, Artificial Sequence
  chemically synthesized
ttacttaagtattttagtagca

SEQ ID NO: 1265847 - DNA, 22 bp, Artificial Sequence
  chemically synthesized
gttacttaagtattttagtagc

SEQ ID NO: 1265848 - DNA, 22 bp, Artificial Sequence
  chemically synthesized
tgttacttaagtattttagtag

SEQ ID NO: 1265849 - DNA, 22 bp, Artificial Sequence
  chemically synthesized
tgttgctactaaaatacttaag

SEQ ID NO: 1265850 - DNA, 22 bp, Artificial Sequence
  chemically synthesized
gttgctactaaaatacttaagt

SEQ ID NO: 1265851 - DNA, 22 bp, Artificial Sequence
  chemically synthesized
ttgctactaaaatacttaagta

SEQ ID NO: 1265852 - DNA, 22 bp, Artificial Sequence
  chemically synthesized
ctactaaaatacttaagtaaca

SEQ ID NO: 1265853 - DNA, 22 bp, Artificial Sequence
  chemically synthesized
ctaaaatacttaagtaacaaaa

SEQ ID NO: 1265854 - DNA, 22 bp, Artificial Sequence
  chemically synthesized
tcaagaagtggattttgttact

SEQ ID NO: 1265855 - DNA, 22 bp, Artificial Sequence
  chemically synthesized
atcaagaagtggattttgttac

SEQ ID NO: 1265856 - DNA, 22 bp, Artificial Sequence
  chemically synthesized
tatcaagaagtggattttgtta

SEQ ID NO: 1265857 - DNA, 22 bp, Artificial Sequence
  chemically synthesized
aaatacttaagtaacaaaatcc

SEQ ID NO: 1265858 - DNA, 22 bp, Artificial Sequence
  chemically synthesized
aatctttatcaagaagtggatt

SEQ ID NO: 1265859 - DNA, 22 bp, Artificial Sequence
  chemically synthesized
aagtaacaaaatccacttcttg

SEQ ID NO: 1265860 - DNA, 22 bp, Artificial Sequence
  chemically synthesized
agtaacaaaatccacttcttga

SEQ ID NO: 1265861 - DNA, 22 bp, Artificial Sequence
  chemically synthesized
gatgacattaaatctttatcaa

SEQ ID NO: 1265862 - DNA, 22 bp, Artificial Sequence
  chemically synthesized
gggattagatgacattaaatct

SEQ ID NO: 1265863 - DNA, 22 bp, Artificial Sequence
  chemically synthesized
agggattagatgacattaaatc

SEQ ID NO: 1265864 - DNA, 22 bp, Artificial Sequence
  chemically synthesized
ttagggattagatgacattaaa

SEQ ID NO: 1265865 - DNA, 22 bp, Artificial Sequence
  chemically synthesized
cttgataaagatttaatgtcat

SEQ ID NO: 1265866 - DNA, 22 bp, Artificial Sequence
  chemically synthesized
ttgataaagatttaatgtcatc

SEQ ID NO: 1265867 - DNA, 22 bp, Artificial Sequence
  chemically synthesized
gataaagatttaatgtcatcta

SEQ ID NO: 1265868 - DNA, 22 bp, Artificial Sequence
  chemically synthesized
actcttagggattagatgacat

SEQ ID NO: 1265869 - DNA, 22 bp, Artificial Sequence
  chemically synthesized
ataaagatttaatgtcatctaa

SEQ ID NO: 1265870 - DNA, 22 bp, Artificial Sequence
  chemically synthesized
aactcttagggattagatgaca

SEQ ID NO: 1265871 - DNA, 22 bp, Artificial Sequence
  chemically synthesized
aatgtcatctaatccctaagag

SEQ ID NO: 1265872 - DNA, 22 bp, Artificial Sequence
  chemically synthesized
taatgtccttaactcttaggga

SEQ ID NO: 1265873 - DNA, 22 bp, Artificial Sequence
  chemically synthesized
atgtcatctaatccctaagagt

SEQ ID NO: 1265874 - DNA, 22 bp, Artificial Sequence
  chemically synthesized
gtaatgtccttaactcttaggg

SEQ ID NO: 1265875 - DNA, 22 bp, Artificial Sequence
  chemically synthesized
tgtaatgtccttaactcttagg

SEQ ID NO: 1265876 - DNA, 22 bp, Artificial Sequence
  chemically synthesized
ataatctttgtaatgtccttaa

SEQ ID NO: 1265877 - DNA, 22 bp, Artificial Sequence
  chemically synthesized
atccctaagagttaaggacatt

SEQ ID NO: 1265878 - DNA, 22 bp, Artificial Sequence
  chemically synthesized
actgataatctttgtaatgtcc

SEQ ID NO: 1265879 - DNA, 22 bp, Artificial Sequence
  chemically synthesized
agagttaaggacattacaaaga

SEQ ID NO: 1265880 - DNA, 22 bp, Artificial Sequence
  chemically synthesized
attcactgataatctttgtaat

SEQ ID NO: 1265881 - DNA, 22 bp, Artificial Sequence
  chemically synthesized
attgattcactgataatctttg

SEQ ID NO: 1265882 - DNA, 22 bp, Artificial Sequence
  chemically synthesized
aggacattacaaagattatcag

SEQ ID NO: 1265883 - DNA, 22 bp, Artificial Sequence
  chemically synthesized
ccaatattcattgattcactga

SEQ ID NO: 1265884 - DNA, 22 bp, Artificial Sequence
  chemically synthesized
caaagattatcagtgaatcaat

SEQ ID NO: 1265885 - DNA, 22 bp, Artificial Sequence
  chemically synthesized
atgatgactaccaatattcatt

SEQ ID NO: 1265886 - DNA, 22 bp, Artificial Sequence
  chemically synthesized
gatgatgactaccaatattcat

SEQ ID NO: 1265887 - DNA, 22 bp, Artificial Sequence
  chemically synthesized
tcagtgaatcaatgaatattgg

SEQ ID NO: 1265888 - DNA, 22 bp, Artificial Sequence
  chemically synthesized
tgatgatgactaccaatattca

SEQ ID NO: 1265889 - DNA, 22 bp, Artificial Sequence
  chemically synthesized
ttgatgatgactaccaatattc

SEQ ID NO: 1265890 - DNA, 22 bp, Artificial Sequence
  chemically synthesized
tttgatgatgactaccaatatt

SEQ ID NO: 1265891 - DNA, 22 bp, Artificial Sequence
  chemically synthesized
ttttttgatgatgactaccaat

SEQ ID NO: 1265892 - DNA, 22 bp, Artificial Sequence
  chemically synthesized
ttgttttttgatgatgactacc

SEQ ID NO: 1265893 - DNA, 22 bp, Artificial Sequence
  chemically synthesized
aacctattgttttttgatgatg

SEQ ID NO: 1265894 - DNA, 22 bp, Artificial Sequence
  chemically synthesized
tcaacctattgttttttgatga

SEQ ID NO: 1265895 - DNA, 22 bp, Artificial Sequence
  chemically synthesized
gtagtcatcatcaaaaaacaat

SEQ ID NO: 1265896 - DNA, 22 bp, Artificial Sequence
  chemically synthesized
aaactctcaacctattgttttt

SEQ ID NO: 1265897 - DNA, 22 bp, Artificial Sequence
  chemically synthesized
ctgaaactctcaacctattgtt

SEQ ID NO: 1265898 - DNA, 22 bp, Artificial Sequence
  chemically synthesized
actgaaactctcaacctattgt

SEQ ID NO: 1265899 - DNA, 22 bp, Artificial Sequence
  chemically synthesized
tactgaaactctcaacctattg

SEQ ID NO: 1265900 - DNA, 22 bp, Artificial Sequence
  chemically synthesized
gttttactgaaactctcaacct

SEQ ID NO: 1265901 - DNA, 22 bp, Artificial Sequence
  chemically synthesized
attagttttactgaaactctca

SEQ ID NO: 1265902 - DNA, 22 bp, Artificial Sequence
  chemically synthesized
cattagttttactgaaactctc

SEQ ID NO: 1265903 - DNA, 22 bp, Artificial Sequence
  chemically synthesized
tcattagttttactgaaactct

SEQ ID NO: 1265904 - DNA, 22 bp, Artificial Sequence
  chemically synthesized
tatatggttttcattagtttta

SEQ ID NO: 1265905 - DNA, 22 bp, Artificial Sequence
  chemically synthesized
atatatggttttcattagtttt

SEQ ID NO: 1265906 - DNA, 22 bp, Artificial Sequence
  chemically synthesized
agagtttcagtaaaactaatga

SEQ ID NO: 1265907 - DNA, 22 bp, Artificial Sequence
  chemically synthesized
ttatatatggttttcattagtt

SEQ ID NO: 1265908 - DNA, 22 bp, Artificial Sequence
  chemically synthesized
cagtaaaactaatgaaaaccat

SEQ ID NO: 1265909 - DNA, 22 bp, Artificial Sequence
  chemically synthesized
agtaaaactaatgaaaaccata

SEQ ID NO: 1265910 - DNA, 22 bp, Artificial Sequence
  chemically synthesized
taatgttcttatatatggtttt

SEQ ID NO: 1265911 - DNA, 22 bp, Artificial Sequence
  chemically synthesized
ataatgttcttatatatggttt

SEQ ID NO: 1265912 - DNA, 22 bp, Artificial Sequence
  chemically synthesized
atgaaaaccatatataagaaca

SEQ ID NO: 1265913 - DNA, 22 bp, Artificial Sequence
  chemically synthesized
taatcatatttataatgttctt

SEQ ID NO: 1265914 - DNA, 22 bp, Artificial Sequence
  chemically synthesized
ttgtaatcatatttataatgtt

SEQ ID NO: 1265915 - DNA, 22 bp, Artificial Sequence
  chemically synthesized
aaagagatgcatctattgtaat

SEQ ID NO: 1265916 - DNA, 22 bp, Artificial Sequence
  chemically synthesized
taaaagagatgcatctattgta

SEQ ID NO: 1265917 - DNA, 22 bp, Artificial Sequence
  chemically synthesized
ctaaaagagatgcatctattgt

SEQ ID NO: 1265918 - DNA, 22 bp, Artificial Sequence
  chemically synthesized
taaatatgattacaatagatgc

SEQ ID NO: 1265919 - DNA, 22 bp, Artificial Sequence
  chemically synthesized
tttctaaaagagatgcatctat

SEQ ID NO: 1265920 - DNA, 22 bp, Artificial Sequence
  chemically synthesized
gtttctaaaagagatgcatcta

SEQ ID NO: 1265921 - DNA, 22 bp, Artificial Sequence
  chemically synthesized
ccttgtttctaaaagagatgca

SEQ ID NO: 1265922 - DNA, 22 bp, Artificial Sequence
  chemically synthesized
ttaccttgtttctaaaagagat

SEQ ID NO: 1265923 - DNA, 22 bp, Artificial Sequence
  chemically synthesized
attaccttgtttctaaaagaga

SEQ ID NO: 1265924 - DNA, 22 bp, Artificial Sequence
  chemically synthesized
caatagatgcatctcttttaga

SEQ ID NO: 1265925 - DNA, 22 bp, Artificial Sequence
  chemically synthesized
gaagcacagtgtttattacctt

SEQ ID NO: 1265926 - DNA, 22 bp, Artificial Sequence
  chemically synthesized
ggaagcacagtgtttattacct

SEQ ID NO: 1265927 - DNA, 22 bp, Artificial Sequence
  chemically synthesized
ttttagaaacaaggtaataaac

SEQ ID NO: 1265928 - DNA, 22 bp, Artificial Sequence
  chemically synthesized
ttagaaacaaggtaataaacac

SEQ ID NO: 1265929 - DNA, 22 bp, Artificial Sequence
  chemically synthesized
tagaaacaaggtaataaacact

SEQ ID NO: 1265930 - DNA, 22 bp, Artificial Sequence
  chemically synthesized
agaaacaaggtaataaacactg

SEQ ID NO: 1265931 - DNA, 22 bp, Artificial Sequence
  chemically synthesized
gaaacaaggtaataaacactgt

SEQ ID NO: 1265932 - DNA, 22 bp, Artificial Sequence
  chemically synthesized
aatacatcttggaagcacagtg

SEQ ID NO: 1265933 - DNA, 22 bp, Artificial Sequence
  chemically synthesized
aaatacatcttggaagcacagt

SEQ ID NO: 1265934 - DNA, 22 bp, Artificial Sequence
  chemically synthesized
ttaaatacatcttggaagcaca

SEQ ID NO: 1265935 - DNA, 22 bp, Artificial Sequence
  chemically synthesized
aacattcttaaatacatcttgg

SEQ ID NO: 1265936 - DNA, 22 bp, Artificial Sequence
  chemically synthesized
caacattcttaaatacatcttg

SEQ ID NO: 1265937 - DNA, 22 bp, Artificial Sequence
  chemically synthesized
cttcaacattcttaaatacatc

SEQ ID NO: 1265938 - DNA, 22 bp, Artificial Sequence
  chemically synthesized
ccttcaacattcttaaatacat

SEQ ID NO: 1265939 - DNA, 22 bp, Artificial Sequence
  chemically synthesized
tgcttccaagatgtatttaaga

SEQ ID NO: 1265940 - DNA, 22 bp, Artificial Sequence
  chemically synthesized
acttccttcaacattcttaaat

SEQ ID NO: 1265941 - DNA, 22 bp, Artificial Sequence
  chemically synthesized
ccaagatgtatttaagaatgtt

SEQ ID NO: 1265942 - DNA, 22 bp, Artificial Sequence
  chemically synthesized
caagatgtatttaagaatgttg

SEQ ID NO: 1265943 - DNA, 22 bp, Artificial Sequence
  chemically synthesized
aagaatgttgaaggaagtgagg

SEQ ID NO: 1265944 - DNA, 22 bp, Artificial Sequence
  chemically synthesized
agaatgttgaaggaagtgaggc

SEQ ID NO: 1265945 - DNA, 22 bp, Artificial Sequence
  chemically synthesized
taggcacaagtcagtgtgcctc

SEQ ID NO: 1265946 - DNA, 22 bp, Artificial Sequence
  chemically synthesized
aaggaagtgaggcacactgact

SEQ ID NO: 1265947 - DNA, 22 bp, Artificial Sequence
  chemically synthesized
ccagggggattataggcacaag

SEQ ID NO: 1265948 - DNA, 22 bp, Artificial Sequence
  chemically synthesized
agcctcccagggggattatagg

SEQ ID NO: 1265949 - DNA, 22 bp, Artificial Sequence
  chemically synthesized
acttgtgcctataatccccctg

SEQ ID NO: 1265950 - DNA, 22 bp, Artificial Sequence
  chemically synthesized
ccacctcagcctcccaggggga

SEQ ID NO: 1265951 - DNA, 22 bp, Artificial Sequence
  chemically synthesized
gtgcctataatccccctgggag

SEQ ID NO: 1265952 - DNA, 22 bp, Artificial Sequence
  chemically synthesized
tgcctataatccccctgggagg

SEQ ID NO: 1265953 - DNA, 22 bp, Artificial Sequence
  chemically synthesized
taatccccctgggaggctgagg

SEQ ID NO: 1265954 - DNA, 22 bp, Artificial Sequence
  chemically synthesized
aggtaaccctcccacctcagcc

SEQ ID NO: 1265955 - DNA, 22 bp, Artificial Sequence
  chemically synthesized
gcctcaggtaaccctcccacct

SEQ ID NO: 1265956 - DNA, 22 bp, Artificial Sequence
  chemically synthesized
ctggcctcaggtaaccctccca

SEQ ID NO: 1265957 - DNA, 22 bp, Artificial Sequence
  chemically synthesized
ggaggctgaggtgggagggtta

SEQ ID NO: 1265958 - DNA, 22 bp, Artificial Sequence
  chemically synthesized
actcctggcctcaggtaaccct

SEQ ID NO: 1265959 - DNA, 22 bp, Artificial Sequence
  chemically synthesized
taactcctggcctcaggtaacc

SEQ ID NO: 1265960 - DNA, 22 bp, Artificial Sequence
  chemically synthesized
aggtgggagggttacctgaggc

SEQ ID NO: 1265961 - DNA, 22 bp, Artificial Sequence
  chemically synthesized
atctctaactcctggcctcagg

SEQ ID NO: 1265962 - DNA, 22 bp, Artificial Sequence
  chemically synthesized
cccaggctgatctctaactcct

SEQ ID NO: 1265963 - DNA, 22 bp, Artificial Sequence
  chemically synthesized
cctgaggccaggagttagagat

SEQ ID NO: 1265964 - DNA, 22 bp, Artificial Sequence
  chemically synthesized
ttgcccaggctgatctctaact

SEQ ID NO: 1265965 - DNA, 22 bp, Artificial Sequence
  chemically synthesized
gttgcccaggctgatctctaac

SEQ ID NO: 1265966 - DNA, 22 bp, Artificial Sequence
  chemically synthesized
tgttgcccaggctgatctctaa

SEQ ID NO: 1265967 - DNA, 22 bp, Artificial Sequence
  chemically synthesized
aggccaggagttagagatcagc

SEQ ID NO: 1265968 - DNA, 22 bp, Artificial Sequence
  chemically synthesized
tttgttgcccaggctgatctct

SEQ ID NO: 1265969 - DNA, 22 bp, Artificial Sequence
  chemically synthesized
tctttgttgcccaggctgatct

SEQ ID NO: 1265970 - DNA, 22 bp, Artificial Sequence
  chemically synthesized
gagatcagcctgggcaacaaag

SEQ ID NO: 1265971 - DNA, 22 bp, Artificial Sequence
  chemically synthesized
aagatatggtctctctttgttg

SEQ ID NO: 1265972 - DNA, 22 bp, Artificial Sequence
  chemically synthesized
aaagatatggtctctctttgtt

SEQ ID NO: 1265973 - DNA, 22 bp, Artificial Sequence
  chemically synthesized
taaagatatggtctctctttgt

SEQ ID NO: 1265974 - DNA, 22 bp, Artificial Sequence
  chemically synthesized
ttaaagatatggtctctctttg

SEQ ID NO: 1265975 - DNA, 22 bp, Artificial Sequence
  chemically synthesized
ttttaaagatatggtctctctt

SEQ ID NO: 1265976 - DNA, 22 bp, Artificial Sequence
  chemically synthesized
ggcaacaaagagagaccatatc

SEQ ID NO: 1265977 - DNA, 22 bp, Artificial Sequence
  chemically synthesized
aaacaaaattcttttaaagata

SEQ ID NO: 1265978 - DNA, 22 bp, Artificial Sequence
  chemically synthesized
actaaaacaaaattcttttaaa

SEQ ID NO: 1265979 - DNA, 22 bp, Artificial Sequence
  chemically synthesized
gctaactaaaacaaaattcttt

SEQ ID NO: 1265980 - DNA, 22 bp, Artificial Sequence
  chemically synthesized
acctggctaactaaaacaaaat

SEQ ID NO: 1265981 - DNA, 22 bp, Artificial Sequence
  chemically synthesized
cacctggctaactaaaacaaaa

SEQ ID NO: 1265982 - DNA, 22 bp, Artificial Sequence
  chemically synthesized
taaaagaattttgttttagtta

SEQ ID NO: 1265983 - DNA, 22 bp, Artificial Sequence
  chemically synthesized
aaaagaattttgttttagttag

SEQ ID NO: 1265984 - DNA, 22 bp, Artificial Sequence
  chemically synthesized
aaagaattttgttttagttagc

SEQ ID NO: 1265985 - DNA, 22 bp, Artificial Sequence
  chemically synthesized
tgttttagttagccaggtgaag

SEQ ID NO: 1265986 - DNA, 22 bp, Artificial Sequence
  chemically synthesized
gttttagttagccaggtgaagt

SEQ ID NO: 1265987 - DNA, 22 bp, Artificial Sequence
  chemically synthesized
caggtgggtgccacttcacctg

SEQ ID NO: 1265988 - DNA, 22 bp, Artificial Sequence
  chemically synthesized
ttttagttagccaggtgaagtg

SEQ ID NO: 1265989 - DNA, 22 bp, Artificial Sequence
  chemically synthesized
tagttagccaggtgaagtggca

SEQ ID NO: 1265990 - DNA, 22 bp, Artificial Sequence
  chemically synthesized
agttagccaggtgaagtggcac

SEQ ID NO: 1265991 - DNA, 22 bp, Artificial Sequence
  chemically synthesized
gttagccaggtgaagtggcacc

SEQ ID NO: 1265992 - DNA, 22 bp, Artificial Sequence
  chemically synthesized
ggattacaggtgggtgccactt

SEQ ID NO: 1265993 - DNA, 22 bp, Artificial Sequence
  chemically synthesized
gccaggtgaagtggcacccacc

SEQ ID NO: 1265994 - DNA, 22 bp, Artificial Sequence
  chemically synthesized
aatagctgggattacaggtggg

SEQ ID NO: 1265995 - DNA, 22 bp, Artificial Sequence
  chemically synthesized
ctgaatagctgggattacaggt

SEQ ID NO: 1265996 - DNA, 22 bp, Artificial Sequence
  chemically synthesized
aagcaatcctcctgaatagctg

SEQ ID NO: 1265997 - DNA, 22 bp, Artificial Sequence
  chemically synthesized
ggttcaagcaatcctcctgaat

SEQ ID NO: 1265998 - DNA, 22 bp, Artificial Sequence
  chemically synthesized
taatcccagctattcaggagga

SEQ ID NO: 1265999 - DNA, 22 bp, Artificial Sequence
  chemically synthesized
aacccctaggttcaagcaatcc

SEQ ID NO: 1266000 - DNA, 22 bp, Artificial Sequence
  chemically synthesized
gaacccctaggttcaagcaatc

SEQ ID NO: 1266001 - DNA, 22 bp, Artificial Sequence
  chemically synthesized
ttcaggaggattgcttgaacct

SEQ ID NO: 1266002 - DNA, 22 bp, Artificial Sequence
  chemically synthesized
aggaggattgcttgaacctagg

SEQ ID NO: 1266003 - DNA, 22 bp, Artificial Sequence
  chemically synthesized
tcacccaggcttgaacccctag

SEQ ID NO: 1266004 - DNA, 22 bp, Artificial Sequence
  chemically synthesized
tgtcacccaggcttgaacccct

SEQ ID NO: 1266005 - DNA, 22 bp, Artificial Sequence
  chemically synthesized
tctgtcacccaggcttgaaccc

SEQ ID NO: 1266006 - DNA, 22 bp, Artificial Sequence
  chemically synthesized
cttgaacctaggggttcaagcc

SEQ ID NO: 1266007 - DNA, 22 bp, Artificial Sequence
  chemically synthesized
ctctgtcacccaggcttgaacc

SEQ ID NO: 1266008 - DNA, 22 bp, Artificial Sequence
  chemically synthesized
gaacctaggggttcaagcctgg

SEQ ID NO: 1266009 - DNA, 22 bp, Artificial Sequence
  chemically synthesized
aacctaggggttcaagcctggg

SEQ ID NO: 1266010 - DNA, 22 bp, Artificial Sequence
  chemically synthesized
ggggttcaagcctgggtgacag

SEQ ID NO: 1266011 - DNA, 22 bp, Artificial Sequence
  chemically synthesized
gagatgcggtatttctctgtca

SEQ ID NO: 1266012 - DNA, 22 bp, Artificial Sequence
  chemically synthesized
agagatgcggtatttctctgtc

SEQ ID NO: 1266013 - DNA, 22 bp, Artificial Sequence
  chemically synthesized
tagagatgcggtatttctctgt

SEQ ID NO: 1266014 - DNA, 22 bp, Artificial Sequence
  chemically synthesized
aagcctgggtgacagagaaata

SEQ ID NO: 1266015 - DNA, 22 bp, Artificial Sequence
  chemically synthesized
ttagagatgcggtatttctctg

SEQ ID NO: 1266016 - DNA, 22 bp, Artificial Sequence
  chemically synthesized
tttttagagatgcggtatttct

SEQ ID NO: 1266017 - DNA, 22 bp, Artificial Sequence
  chemically synthesized
ggtgacagagaaataccgcatc

SEQ ID NO: 1266018 - DNA, 22 bp, Artificial Sequence
  chemically synthesized
aaattgtttttagagatgcggt

SEQ ID NO: 1266019 - DNA, 22 bp, Artificial Sequence
  chemically synthesized
aaaattgtttttagagatgcgg

SEQ ID NO: 1266020 - DNA, 22 bp, Artificial Sequence
  chemically synthesized
aatttaaaattgtttttagaga

SEQ ID NO: 1266021 - DNA, 22 bp, Artificial Sequence
  chemically synthesized
aaatttaaaattgtttttagag

SEQ ID NO: 1266022 - DNA, 22 bp, Artificial Sequence
  chemically synthesized
taaatttaaaattgtttttaga

SEQ ID NO: 1266023 - DNA, 22 bp, Artificial Sequence
  chemically synthesized
ttaaatttaaaattgtttttag

SEQ ID NO: 1266024 - DNA, 22 bp, Artificial Sequence
  chemically synthesized
tttttaaatttaaaattgtttt

SEQ ID NO: 1266025 - DNA, 22 bp, Artificial Sequence
  chemically synthesized
tatttttaaatttaaaattgtt

SEQ ID NO: 1266026 - DNA, 22 bp, Artificial Sequence
  chemically synthesized
ctatttttaaatttaaaattgt

SEQ ID NO: 1266027 - DNA, 22 bp, Artificial Sequence
  chemically synthesized
tctatttttaaatttaaaattg

SEQ ID NO: 1266028 - DNA, 22 bp, Artificial Sequence
  chemically synthesized
ttctatttttaaatttaaaatt

SEQ ID NO: 1266029 - DNA, 22 bp, Artificial Sequence
  chemically synthesized
tttctatttttaaatttaaaat

SEQ ID NO: 1266030 - DNA, 22 bp, Artificial Sequence
  chemically synthesized
ttttctatttttaaatttaaaa

SEQ ID NO: 1266031 - DNA, 22 bp, Artificial Sequence
  chemically synthesized
taaaaacaattttaaatttaaa

SEQ ID NO: 1266032 - DNA, 22 bp, Artificial Sequence
  chemically synthesized
aaaacaattttaaatttaaaaa

SEQ ID NO: 1266033 - DNA, 22 bp, Artificial Sequence
  chemically synthesized
taaatttaaaaatagaaaaaag

SEQ ID NO: 1266034 - DNA, 22 bp, Artificial Sequence
  chemically synthesized
aaatttaaaaatagaaaaaagc

SEQ ID NO: 1266035 - DNA, 22 bp, Artificial Sequence
  chemically synthesized
aatttaaaaatagaaaaaagca

SEQ ID NO: 1266036 - DNA, 22 bp, Artificial Sequence
  chemically synthesized
gggcccagtgtagcatgctttt

SEQ ID NO: 1266037 - DNA, 22 bp, Artificial Sequence
  chemically synthesized
ggggcccagtgtagcatgcttt

SEQ ID NO: 1266038 - DNA, 22 bp, Artificial Sequence
  chemically synthesized
aaaaatagaaaaaagcatgcta

SEQ ID NO: 1266039 - DNA, 22 bp, Artificial Sequence
  chemically synthesized
aaaatagaaaaaagcatgctac

SEQ ID NO: 1266040 - DNA, 22 bp, Artificial Sequence
  chemically synthesized
gaggcaagcatagatcttgggg

SEQ ID NO: 1266041 - DNA, 22 bp, Artificial Sequence
  chemically synthesized
cactgggccccaagatctatgc

SEQ ID NO: 1266042 - DNA, 22 bp, Artificial Sequence
  chemically synthesized
ggccccaagatctatgcttgcc

SEQ ID NO: 1266043 - DNA, 22 bp, Artificial Sequence
  chemically synthesized
gggaaaaattggaggcaagcat

SEQ ID NO: 1266044 - DNA, 22 bp, Artificial Sequence
  chemically synthesized
tgcttgcctccaatttttcccc

SEQ ID NO: 1266045 - DNA, 22 bp, Artificial Sequence
  chemically synthesized
gcctccaatttttccccaattt

SEQ ID NO: 1266046 - DNA, 22 bp, Artificial Sequence
  chemically synthesized
cctccaatttttccccaatttt

SEQ ID NO: 1266047 - DNA, 22 bp, Artificial Sequence
  chemically synthesized
caatttttccccaatttttatg

SEQ ID NO: 1266048 - DNA, 22 bp, Artificial Sequence
  chemically synthesized
cacaaagggaaatcataaaaat

SEQ ID NO: 1266049 - DNA, 22 bp, Artificial Sequence
  chemically synthesized
ttccccaatttttatgatttcc

SEQ ID NO: 1266050 - DNA, 22 bp, Artificial Sequence
  chemically synthesized
tccccaatttttatgatttccc

SEQ ID NO: 1266051 - DNA, 22 bp, Artificial Sequence
  chemically synthesized
ccccaatttttatgatttccct

SEQ ID NO: 1266052 - DNA, 22 bp, Artificial Sequence
  chemically synthesized
cccaatttttatgatttccctt

SEQ ID NO: 1266053 - DNA, 22 bp, Artificial Sequence
  chemically synthesized
ttatgatttccctttgtgtaat

SEQ ID NO: 1266054 - DNA, 22 bp, Artificial Sequence
  chemically synthesized
tatgatttccctttgtgtaatg

SEQ ID NO: 1266055 - DNA, 22 bp, Artificial Sequence
  chemically synthesized
atgatttccctttgtgtaatgt

SEQ ID NO: 1266056 - DNA, 22 bp, Artificial Sequence
  chemically synthesized
tgatttccctttgtgtaatgtg

SEQ ID NO: 1266057 - DNA, 22 bp, Artificial Sequence
  chemically synthesized
tgcatcaaatatcacattacac

SEQ ID NO: 1266058 - DNA, 22 bp, Artificial Sequence
  chemically synthesized
atgcatcaaatatcacattaca

SEQ ID NO: 1266059 - DNA, 22 bp, Artificial Sequence
  chemically synthesized
tatgcatcaaatatcacattac

SEQ ID NO: 1266060 - DNA, 22 bp, Artificial Sequence
  chemically synthesized
ttatgcatcaaatatcacatta

SEQ ID NO: 1266061 - DNA, 22 bp, Artificial Sequence
  chemically synthesized
ttttatgcatcaaatatcacat

SEQ ID NO: 1266062 - DNA, 22 bp, Artificial Sequence
  chemically synthesized
ccctttgtgtaatgtgatattt

SEQ ID NO: 1266063 - DNA, 22 bp, Artificial Sequence
  chemically synthesized
cctttgtgtaatgtgatatttg

SEQ ID NO: 1266064 - DNA, 22 bp, Artificial Sequence
  chemically synthesized
tgtgtaatgtgatatttgatgc

SEQ ID NO: 1266065 - DNA, 22 bp, Artificial Sequence
  chemically synthesized
gtgtaatgtgatatttgatgca

SEQ ID NO: 1266066 - DNA, 22 bp, Artificial Sequence
  chemically synthesized
tgtaatgtgatatttgatgcat

SEQ ID NO: 1266067 - DNA, 22 bp, Artificial Sequence
  chemically synthesized
catatattcttttatgcatcaa

SEQ ID NO: 1266068 - DNA, 22 bp, Artificial Sequence
  chemically synthesized
catatccattacatatattctt

SEQ ID NO: 1266069 - DNA, 22 bp, Artificial Sequence
  chemically synthesized
acatatccattacatatattct

SEQ ID NO: 1266070 - DNA, 22 bp, Artificial Sequence
  chemically synthesized
gatgcataaaagaatatatgta

SEQ ID NO: 1266071 - DNA, 22 bp, Artificial Sequence
  chemically synthesized
atgcataaaagaatatatgtaa

SEQ ID NO: 1266072 - DNA, 22 bp, Artificial Sequence
  chemically synthesized
taatttacatatccattacata

SEQ ID NO: 1266073 - DNA, 22 bp, Artificial Sequence
  chemically synthesized
gtaatttacatatccattacat

SEQ ID NO: 1266074 - DNA, 22 bp, Artificial Sequence
  chemically synthesized
tgtaatttacatatccattaca

SEQ ID NO: 1266075 - DNA, 22 bp, Artificial Sequence
  chemically synthesized
agctttgtaatttacatatcca

SEQ ID NO: 1266076 - DNA, 22 bp, Artificial Sequence
  chemically synthesized
ttgagctttgtaatttacatat

SEQ ID NO: 1266077 - DNA, 22 bp, Artificial Sequence
  chemically synthesized
ttattgagctttgtaatttaca

SEQ ID NO: 1266078 - DNA, 22 bp, Artificial Sequence
  chemically synthesized
attattgagctttgtaatttac

SEQ ID NO: 1266079 - DNA, 22 bp, Artificial Sequence
  chemically synthesized
tattattgagctttgtaattta

SEQ ID NO: 1266080 - DNA, 22 bp, Artificial Sequence
  chemically synthesized
ttttattattgagctttgtaat

SEQ ID NO: 1266081 - DNA, 22 bp, Artificial Sequence
  chemically synthesized
gttttattattgagctttgtaa

SEQ ID NO: 1266082 - DNA, 22 bp, Artificial Sequence
  chemically synthesized
caaagctcaataataaaacaaa

SEQ ID NO: 1266083 - DNA, 22 bp, Artificial Sequence
  chemically synthesized
ggatggacatatgtttgtttta

SEQ ID NO: 1266084 - DNA, 22 bp, Artificial Sequence
  chemically synthesized
ttgggatggacatatgtttgtt

SEQ ID NO: 1266085 - DNA, 22 bp, Artificial Sequence
  chemically synthesized
aataataaaacaaacatatgtc

SEQ ID NO: 1266086 - DNA, 22 bp, Artificial Sequence
  chemically synthesized
agttattgggatggacatatgt

SEQ ID NO: 1266087 - DNA, 22 bp, Artificial Sequence
  chemically synthesized
cagttattgggatggacatatg

SEQ ID NO: 1266088 - DNA, 22 bp, Artificial Sequence
  chemically synthesized
atatttcagttattgggatgga

SEQ ID NO: 1266089 - DNA, 22 bp, Artificial Sequence
  chemically synthesized
ctaatatttcagttattgggat

SEQ ID NO: 1266090 - DNA, 22 bp, Artificial Sequence
  chemically synthesized
ttgctaatatttcagttattgg

SEQ ID NO: 1266091 - DNA, 22 bp, Artificial Sequence
  chemically synthesized
aggtgtgagttgttgctaatat

SEQ ID NO: 1266092 - DNA, 22 bp, Artificial Sequence
  chemically synthesized
aaatattagcaacaactcacac

SEQ ID NO: 1266093 - DNA, 22 bp, Artificial Sequence
  chemically synthesized
gcaacaactcacacctgaacct

SEQ ID NO: 1266094 - DNA, 22 bp, Artificial Sequence
  chemically synthesized
gtgtaggagcacataggttcag

SEQ ID NO: 1266095 - DNA, 22 bp, Artificial Sequence
  chemically synthesized
acacctgaacctatgtgctcct

SEQ ID NO: 1266096 - DNA, 22 bp, Artificial Sequence
  chemically synthesized
aacctatgtgctcctacactag

SEQ ID NO: 1266097 - DNA, 22 bp, Artificial Sequence
  chemically synthesized
tgtgctcctacactagttcttc

SEQ ID NO: 1266098 - DNA, 22 bp, Artificial Sequence
  chemically synthesized
ctacactagttcttcactcttt

SEQ ID NO: 1266099 - DNA, 22 bp, Artificial Sequence
  chemically synthesized
cactagttcttcactcttttgt

SEQ ID NO: 1266100 - DNA, 22 bp, Artificial Sequence
  chemically synthesized
gttcttcactcttttgtacccc

SEQ ID NO: 1266101 - DNA, 22 bp, Artificial Sequence
  chemically synthesized
ggtaaatggagggaggggtaca

SEQ ID NO: 1266102 - DNA, 22 bp, Artificial Sequence
  chemically synthesized
ttcactcttttgtacccctccc

SEQ ID NO: 1266103 - DNA, 22 bp, Artificial Sequence
  chemically synthesized
cactcttttgtacccctccctc

SEQ ID NO: 1266104 - DNA, 22 bp, Artificial Sequence
  chemically synthesized
actcttttgtacccctccctcc

SEQ ID NO: 1266105 - DNA, 22 bp, Artificial Sequence
  chemically synthesized
atcctgggtaaatggagggagg

SEQ ID NO: 1266106 - DNA, 22 bp, Artificial Sequence
  chemically synthesized
ttttgtacccctccctccattt

SEQ ID NO: 1266107 - DNA, 22 bp, Artificial Sequence
  chemically synthesized
ttgtacccctccctccatttac

SEQ ID NO: 1266108 - DNA, 22 bp, Artificial Sequence
  chemically synthesized
tgtacccctccctccatttacc

SEQ ID NO: 1266109 - DNA, 22 bp, Artificial Sequence
  chemically synthesized
gtacccctccctccatttaccc

SEQ ID NO: 1266110 - DNA, 22 bp, Artificial Sequence
  chemically synthesized
tacccctccctccatttaccca

SEQ ID NO: 1266111 - DNA, 22 bp, Artificial Sequence
  chemically synthesized
gatggtagttaatcctgggtaa

SEQ ID NO: 1266112 - DNA, 22 bp, Artificial Sequence
  chemically synthesized
tggatggtagttaatcctgggt

SEQ ID NO: 1266113 - DNA, 22 bp, Artificial Sequence
  chemically synthesized
cctccatttacccaggattaac

SEQ ID NO: 1266114 - DNA, 22 bp, Artificial Sequence
  chemically synthesized
catttacccaggattaactacc

SEQ ID NO: 1266115 - DNA, 22 bp, Artificial Sequence
  chemically synthesized
acccaggattaactaccatcca

SEQ ID NO: 1266116 - DNA, 22 bp, Artificial Sequence
  chemically synthesized
cccaggattaactaccatccag

SEQ ID NO: 1266117 - DNA, 22 bp, Artificial Sequence
  chemically synthesized
actaccatccagaatctgggga

SEQ ID NO: 1266118 - DNA, 22 bp, Artificial Sequence
  chemically synthesized
ccatccagaatctggggattgt

SEQ ID NO: 1266119 - DNA, 22 bp, Artificial Sequence
  chemically synthesized
gggattgtcatatcattgcctt

SEQ ID NO: 1266120 - DNA, 22 bp, Artificial Sequence
  chemically synthesized
tcatatcattgcctttgatttc

SEQ ID NO: 1266121 - DNA, 22 bp, Artificial Sequence
  chemically synthesized
cctttgatttcttttgtttgct

SEQ ID NO: 1266122 - DNA, 22 bp, Artificial Sequence
  chemically synthesized
tgatttcttttgtttgctcatt

SEQ ID NO: 1266123 - DNA, 22 bp, Artificial Sequence
  chemically synthesized
gatttcttttgtttgctcattt

SEQ ID NO: 1266124 - DNA, 22 bp, Artificial Sequence
  chemically synthesized
atttcttttgtttgctcatttg

SEQ ID NO: 1266125 - DNA, 22 bp, Artificial Sequence
  chemically synthesized
cttttgtttgctcatttgtttt

SEQ ID NO: 1266126 - DNA, 22 bp, Artificial Sequence
  chemically synthesized
ttttgtttgctcatttgttttg

SEQ ID NO: 1266127 - DNA, 22 bp, Artificial Sequence
  chemically synthesized
ttgtttgctcatttgttttgtg

SEQ ID NO: 1266128 - DNA, 22 bp, Artificial Sequence
  chemically synthesized
tgtttgctcatttgttttgtgt

SEQ ID NO: 1266129 - DNA, 22 bp, Artificial Sequence
  chemically synthesized
gtttgctcatttgttttgtgtt

SEQ ID NO: 1266130 - DNA, 22 bp, Artificial Sequence
  chemically synthesized
tttgctcatttgttttgtgttg

SEQ ID NO: 1266131 - DNA, 22 bp, Artificial Sequence
  chemically synthesized
gctcatttgttttgtgttggtt

SEQ ID NO: 1266132 - DNA, 22 bp, Artificial Sequence
  chemically synthesized
ctcatttgttttgtgttggttt

SEQ ID NO: 1266133 - DNA, 22 bp, Artificial Sequence
  chemically synthesized
atttgttttgtgttggtttttt

SEQ ID NO: 1266134 - DNA, 22 bp, Artificial Sequence
  chemically synthesized
gttttgtgttggttttttcgat

SEQ ID NO: 1266135 - DNA, 22 bp, Artificial Sequence
  chemically synthesized
ttttgtgttggttttttcgatt

SEQ ID NO: 1266136 - DNA, 22 bp, Artificial Sequence
  chemically synthesized
tgtgttggttttttcgatttat

SEQ ID NO: 1266137 - DNA, 22 bp, Artificial Sequence
  chemically synthesized
gtgttggttttttcgatttatc

SEQ ID NO: 1266138 - DNA, 22 bp, Artificial Sequence
  chemically synthesized
tgttggttttttcgatttatca

SEQ ID NO: 1266139 - DNA, 22 bp, Artificial Sequence
  chemically synthesized
gcatacatgcatgtgtgataaa

SEQ ID NO: 1266140 - DNA, 22 bp, Artificial Sequence
  chemically synthesized
ggcatacatgcatgtgtgataa

SEQ ID NO: 1266141 - DNA, 22 bp, Artificial Sequence
  chemically synthesized
gttttttcgatttatcacacat

SEQ ID NO: 1266142 - DNA, 22 bp, Artificial Sequence
  chemically synthesized
tggcatacatgcatgtgtgata

SEQ ID NO: 1266143 - DNA, 22 bp, Artificial Sequence
  chemically synthesized
ttttggcatacatgcatgtgtg

SEQ ID NO: 1266144 - DNA, 22 bp, Artificial Sequence
  chemically synthesized
tttcgatttatcacacatgcat

SEQ ID NO: 1266145 - DNA, 22 bp, Artificial Sequence
  chemically synthesized
ttcgatttatcacacatgcatg

SEQ ID NO: 1266146 - DNA, 22 bp, Artificial Sequence
  chemically synthesized
tcgatttatcacacatgcatgt

SEQ ID NO: 1266147 - DNA, 22 bp, Artificial Sequence
  chemically synthesized
cgatttatcacacatgcatgta

SEQ ID NO: 1266148 - DNA, 22 bp, Artificial Sequence
  chemically synthesized
gatttatcacacatgcatgtat

SEQ ID NO: 1266149 - DNA, 22 bp, Artificial Sequence
  chemically synthesized
atcacacatgcatgtatgccaa

SEQ ID NO: 1266150 - DNA, 22 bp, Artificial Sequence
  chemically synthesized
tcacacatgcatgtatgccaaa

SEQ ID NO: 1266151 - DNA, 22 bp, Artificial Sequence
  chemically synthesized
atgaaaatattgttttggcata

SEQ ID NO: 1266152 - DNA, 22 bp, Artificial Sequence
  chemically synthesized
aagcataggaacacctaatgaa

SEQ ID NO: 1266153 - DNA, 22 bp, Artificial Sequence
  chemically synthesized
cagaaagctcaagcataggaac

SEQ ID NO: 1266154 - DNA, 22 bp, Artificial Sequence
  chemically synthesized
tcattaggtgttcctatgcttg

SEQ ID NO: 1266155 - DNA, 22 bp, Artificial Sequence
  chemically synthesized
cattaggtgttcctatgcttga

SEQ ID NO: 1266156 - DNA, 22 bp, Artificial Sequence
  chemically synthesized
attaggtgttcctatgcttgag

SEQ ID NO: 1266157 - DNA, 22 bp, Artificial Sequence
  chemically synthesized
ggtgttcctatgcttgagcttt

SEQ ID NO: 1266158 - DNA, 22 bp, Artificial Sequence
  chemically synthesized
gacaacactccagaaagctcaa

SEQ ID NO: 1266159 - DNA, 22 bp, Artificial Sequence
  chemically synthesized
tattagacaacactccagaaag

SEQ ID NO: 1266160 - DNA, 22 bp, Artificial Sequence
  chemically synthesized
ctatgcttgagctttctggagt

SEQ ID NO: 1266161 - DNA, 22 bp, Artificial Sequence
  chemically synthesized
gtattagacaacactccagaaa

SEQ ID NO: 1266162 - DNA, 22 bp, Artificial Sequence
  chemically synthesized
tgcttgagctttctggagtgtt

SEQ ID NO: 1266163 - DNA, 22 bp, Artificial Sequence
  chemically synthesized
acccttgtattagacaacactc

SEQ ID NO: 1266164 - DNA, 22 bp, Artificial Sequence
  chemically synthesized
gagctttctggagtgttgtcta

SEQ ID NO: 1266165 - DNA, 22 bp, Artificial Sequence
  chemically synthesized
agctttctggagtgttgtctaa

SEQ ID NO: 1266166 - DNA, 22 bp, Artificial Sequence
  chemically synthesized
tctggagtgttgtctaatacaa

SEQ ID NO: 1266167 - DNA, 22 bp, Artificial Sequence
  chemically synthesized
ctggagtgttgtctaatacaag

SEQ ID NO: 1266168 - DNA, 22 bp, Artificial Sequence
  chemically synthesized
tggagtgttgtctaatacaagg

SEQ ID NO: 1266169 - DNA, 22 bp, Artificial Sequence
  chemically synthesized
gagtgttgtctaatacaagggt

SEQ ID NO: 1266170 - DNA, 22 bp, Artificial Sequence
  chemically synthesized
tctaatacaagggtcagcacac

SEQ ID NO: 1266171 - DNA, 22 bp, Artificial Sequence
  chemically synthesized
atacaagggtcagcacactacc

SEQ ID NO: 1266172 - DNA, 22 bp, Artificial Sequence
  chemically synthesized
cagagccggggagcccatgggc

SEQ ID NO: 1266173 - DNA, 22 bp, Artificial Sequence
  chemically synthesized
actccagagccggggagcccat

SEQ ID NO: 1266174 - DNA, 22 bp, Artificial Sequence
  chemically synthesized
ccgcccatgggctccccggctc

SEQ ID NO: 1266175 - DNA, 22 bp, Artificial Sequence
  chemically synthesized
gggaagtgcactcactccagag

SEQ ID NO: 1266176 - DNA, 22 bp, Artificial Sequence
  chemically synthesized
cccggctctggagtgagtgcac

SEQ ID NO: 1266177 - DNA, 22 bp, Artificial Sequence
  chemically synthesized
cagcctggggaagtgcactcac

SEQ ID NO: 1266178 - DNA, 22 bp, Artificial Sequence
  chemically synthesized
cgctccagcctggggaagtgca

SEQ ID NO: 1266179 - DNA, 22 bp, Artificial Sequence
  chemically synthesized
tggagtgagtgcacttccccag

SEQ ID NO: 1266180 - DNA, 22 bp, Artificial Sequence
  chemically synthesized
gagtgagtgcacttccccaggc

SEQ ID NO: 1266181 - DNA, 22 bp, Artificial Sequence
  chemically synthesized
ccccaggctggagcgcagtggc

SEQ ID NO: 1266182 - DNA, 22 bp, Artificial Sequence
  chemically synthesized
cccaggctggagcgcagtggcg

SEQ ID NO: 1266183 - DNA, 22 bp, Artificial Sequence
  chemically synthesized
cagtgagccgagatcgcgccac

SEQ ID NO: 1266184 - DNA, 22 bp, Artificial Sequence
  chemically synthesized
gcagtgagccgagatcgcgcca

SEQ ID NO: 1266185 - DNA, 22 bp, Artificial Sequence
  chemically synthesized
gagcgcagtggcgcgatctcgg

SEQ ID NO: 1266186 - DNA, 22 bp, Artificial Sequence
  chemically synthesized
ggctcactgcaagctccgcctc

SEQ ID NO: 1266187 - DNA, 22 bp, Artificial Sequence
  chemically synthesized
actgcaagctccgcctcccggg

SEQ ID NO: 1266188 - DNA, 22 bp, Artificial Sequence
  chemically synthesized
caagctccgcctcccgggttca

SEQ ID NO: 1266189 - DNA, 22 bp, Artificial Sequence
  chemically synthesized
aggcaggagaatggcgtgaacc

SEQ ID NO: 1266190 - DNA, 22 bp, Artificial Sequence
  chemically synthesized
cgcctcccgggttcacgccatt

SEQ ID NO: 1266191 - DNA, 22 bp, Artificial Sequence
  chemically synthesized
ccgggttcacgccattctcctg

SEQ ID NO: 1266192 - DNA, 22 bp, Artificial Sequence
  chemically synthesized
gggaggctgaggcaggagaatg

SEQ ID NO: 1266193 - DNA, 22 bp, Artificial Sequence
  chemically synthesized
ctcgggaggctgaggcaggaga

SEQ ID NO: 1266194 - DNA, 22 bp, Artificial Sequence
  chemically synthesized
acgccattctcctgcctcagcc

SEQ ID NO: 1266195 - DNA, 22 bp, Artificial Sequence
  chemically synthesized
tagtcccagctactcgggaggc

SEQ ID NO: 1266196 - DNA, 22 bp, Artificial Sequence
  chemically synthesized
tcctgcctcagcctcccgagta

SEQ ID NO: 1266197 - DNA, 22 bp, Artificial Sequence
  chemically synthesized
ctgcctcagcctcccgagtagc

SEQ ID NO: 1266198 - DNA, 22 bp, Artificial Sequence
  chemically synthesized
cctcagcctcccgagtagctgg

SEQ ID NO: 1266199 - DNA, 22 bp, Artificial Sequence
  chemically synthesized
agcctcccgagtagctgggact

SEQ ID NO: 1266200 - DNA, 22 bp, Artificial Sequence
  chemically synthesized
ccgagtagctgggactacaggc

SEQ ID NO: 1266201 - DNA, 22 bp, Artificial Sequence
  chemically synthesized
gcggggcgtggtggcgggcgcc

SEQ ID NO: 1266202 - DNA, 22 bp, Artificial Sequence
  chemically synthesized
ggactacaggcgcccgccacca

SEQ ID NO: 1266203 - DNA, 22 bp, Artificial Sequence
  chemically synthesized
caggcgcccgccaccacgcccc

SEQ ID NO: 1266204 - DNA, 22 bp, Artificial Sequence
  chemically synthesized
aaaatacaagaaattagcgggg

SEQ ID NO: 1266205 - DNA, 22 bp, Artificial Sequence
  chemically synthesized
ctaaaaatacaagaaattagcg

SEQ ID NO: 1266206 - DNA, 22 bp, Artificial Sequence
  chemically synthesized
tactaaaaatacaagaaattag

SEQ ID NO: 1266207 - DNA, 22 bp, Artificial Sequence
  chemically synthesized
atttcttgtatttttagtagag

SEQ ID NO: 1266208 - DNA, 22 bp, Artificial Sequence
  chemically synthesized
cttgtatttttagtagagacgg

SEQ ID NO: 1266209 - DNA, 22 bp, Artificial Sequence
  chemically synthesized
ttgtatttttagtagagacggg

SEQ ID NO: 1266210 - DNA, 22 bp, Artificial Sequence
  chemically synthesized
acacggtgaaaccccgtctcta

SEQ ID NO: 1266211 - DNA, 22 bp, Artificial Sequence
  chemically synthesized
gtatttttagtagagacggggt

SEQ ID NO: 1266212 - DNA, 22 bp, Artificial Sequence
  chemically synthesized
tatttttagtagagacggggtt

SEQ ID NO: 1266213 - DNA, 22 bp, Artificial Sequence
  chemically synthesized
gctaacacggtgaaaccccgtc

SEQ ID NO: 1266214 - DNA, 22 bp, Artificial Sequence
  chemically synthesized
ttagtagagacggggtttcacc

SEQ ID NO: 1266215 - DNA, 22 bp, Artificial Sequence
  chemically synthesized
tagtagagacggggtttcaccg

SEQ ID NO: 1266216 - DNA, 22 bp, Artificial Sequence
  chemically synthesized
agtagagacggggtttcaccgt

SEQ ID NO: 1266217 - DNA, 22 bp, Artificial Sequence
  chemically synthesized
gtagagacggggtttcaccgtg

SEQ ID NO: 1266218 - DNA, 22 bp, Artificial Sequence
  chemically synthesized
caccgtgttagccaggatggtc

SEQ ID NO: 1266219 - DNA, 22 bp, Artificial Sequence
  chemically synthesized
accgtgttagccaggatggtct

SEQ ID NO: 1266220 - DNA, 22 bp, Artificial Sequence
  chemically synthesized
gccaggatggtctcgatctgct

SEQ ID NO: 1266221 - DNA, 22 bp, Artificial Sequence
  chemically synthesized
gatctgctgacctcatgatccg

SEQ ID NO: 1266222 - DNA, 22 bp, Artificial Sequence
  chemically synthesized
ggaggccgagatgggcggatca

SEQ ID NO: 1266223 - DNA, 22 bp, Artificial Sequence
  chemically synthesized
gggaggccgagatgggcggatc

SEQ ID NO: 1266224 - DNA, 22 bp, Artificial Sequence
  chemically synthesized
tgggaggccgagatgggcggat

SEQ ID NO: 1266225 - DNA, 22 bp, Artificial Sequence
  chemically synthesized
ctgacctcatgatccgcccatc

SEQ ID NO: 1266226 - DNA, 22 bp, Artificial Sequence
  chemically synthesized
acctcatgatccgcccatctcg

SEQ ID NO: 1266227 - DNA, 22 bp, Artificial Sequence
  chemically synthesized
atgatccgcccatctcggcctc

SEQ ID NO: 1266228 - DNA, 22 bp, Artificial Sequence
  chemically synthesized
taatcccagcactttgggaggc

SEQ ID NO: 1266229 - DNA, 22 bp, Artificial Sequence
  chemically synthesized
acgcctgtaatcccagcacttt

SEQ ID NO: 1266230 - DNA, 22 bp, Artificial Sequence
  chemically synthesized
ggcctcccaaagtgctgggatt

SEQ ID NO: 1266231 - DNA, 22 bp, Artificial Sequence
  chemically synthesized
ccaaagtgctgggattacaggc

SEQ ID NO: 1266232 - DNA, 22 bp, Artificial Sequence
  chemically synthesized
ggattacaggcgtgagccaccg

SEQ ID NO: 1266233 - DNA, 22 bp, Artificial Sequence
  chemically synthesized
tcagggaggccgggcgcggtgg

SEQ ID NO: 1266234 - DNA, 22 bp, Artificial Sequence
  chemically synthesized
caggcgtgagccaccgcgcccg

SEQ ID NO: 1266235 - DNA, 22 bp, Artificial Sequence
  chemically synthesized
aaaactgtcagggaggccgggc

SEQ ID NO: 1266236 - DNA, 22 bp, Artificial Sequence
  chemically synthesized
aaaaactgtcagggaggccggg

SEQ ID NO: 1266237 - DNA, 22 bp, Artificial Sequence
  chemically synthesized
taaaaactgtcagggaggccgg

SEQ ID NO: 1266238 - DNA, 22 bp, Artificial Sequence
  chemically synthesized
ttaaaaactgtcagggaggccg

SEQ ID NO: 1266239 - DNA, 22 bp, Artificial Sequence
  chemically synthesized
atttttaaaaactgtcagggag

SEQ ID NO: 1266240 - DNA, 22 bp, Artificial Sequence
  chemically synthesized
catttttaaaaactgtcaggga

SEQ ID NO: 1266241 - DNA, 22 bp, Artificial Sequence
  chemically synthesized
ataaaacttcatttttaaaaac

SEQ ID NO: 1266242 - DNA, 22 bp, Artificial Sequence
  chemically synthesized
cctgacagtttttaaaaatgaa

SEQ ID NO: 1266243 - DNA, 22 bp, Artificial Sequence
  chemically synthesized
acagtttttaaaaatgaagttt

SEQ ID NO: 1266244 - DNA, 22 bp, Artificial Sequence
  chemically synthesized
ttaaaaatgaagttttattaga

SEQ ID NO: 1266245 - DNA, 22 bp, Artificial Sequence
  chemically synthesized
taaaaatgaagttttattagac

SEQ ID NO: 1266246 - DNA, 22 bp, Artificial Sequence
  chemically synthesized
aaaaatgaagttttattagact

SEQ ID NO: 1266247 - DNA, 22 bp, Artificial Sequence
  chemically synthesized
aaaatgaagttttattagactc

SEQ ID NO: 1266248 - DNA, 22 bp, Artificial Sequence
  chemically synthesized
tatgagtgaataggtgtgagtg

SEQ ID NO: 1266249 - DNA, 22 bp, Artificial Sequence
  chemically synthesized
tattagactcactcacacctat

SEQ ID NO: 1266250 - DNA, 22 bp, Artificial Sequence
  chemically synthesized
ttatatgagtgaataggtgtga

SEQ ID NO: 1266251 - DNA, 22 bp, Artificial Sequence
  chemically synthesized
attagactcactcacacctatt

SEQ ID NO: 1266252 - DNA, 22 bp, Artificial Sequence
  chemically synthesized
ttagactcactcacacctattc

SEQ ID NO: 1266253 - DNA, 22 bp, Artificial Sequence
  chemically synthesized
gactcactcacacctattcact

SEQ ID NO: 1266254 - DNA, 22 bp, Artificial Sequence
  chemically synthesized
actcacacctattcactcatat

SEQ ID NO: 1266255 - DNA, 22 bp, Artificial Sequence
  chemically synthesized
acacctattcactcatataata

SEQ ID NO: 1266256 - DNA, 22 bp, Artificial Sequence
  chemically synthesized
ttcactcatataataactatgg

SEQ ID NO: 1266257 - DNA, 22 bp, Artificial Sequence
  chemically synthesized
tggcatcaaagcagccatagtt

SEQ ID NO: 1266258 - DNA, 22 bp, Artificial Sequence
  chemically synthesized
actcatataataactatggctg

SEQ ID NO: 1266259 - DNA, 22 bp, Artificial Sequence
  chemically synthesized
ttgtggcatcaaagcagccata

SEQ ID NO: 1266260 - DNA, 22 bp, Artificial Sequence
  chemically synthesized
atataataactatggctgcttt

SEQ ID NO: 1266261 - DNA, 22 bp, Artificial Sequence
  chemically synthesized
tgttgttgtggcatcaaagcag

SEQ ID NO: 1266262 - DNA, 22 bp, Artificial Sequence
  chemically synthesized
actatgttgttgtggcatcaaa

SEQ ID NO: 1266263 - DNA, 22 bp, Artificial Sequence
  chemically synthesized
tggctgctttgatgccacaaca

SEQ ID NO: 1266264 - DNA, 22 bp, Artificial Sequence
  chemically synthesized
caaatacctaactatgttgttg

SEQ ID NO: 1266265 - DNA, 22 bp, Artificial Sequence
  chemically synthesized
ctttgatgccacaacaacatag

SEQ ID NO: 1266266 - DNA, 22 bp, Artificial Sequence
  chemically synthesized
tgatgccacaacaacatagtta

SEQ ID NO: 1266267 - DNA, 22 bp, Artificial Sequence
  chemically synthesized
gatgccacaacaacatagttag

SEQ ID NO: 1266268 - DNA, 22 bp, Artificial Sequence
  chemically synthesized
atgccacaacaacatagttagg

SEQ ID NO: 1266269 - DNA, 22 bp, Artificial Sequence
  chemically synthesized
ggtcatattgcaaatacctaac

SEQ ID NO: 1266270 - DNA, 22 bp, Artificial Sequence
  chemically synthesized
taggtcatattgcaaataccta

SEQ ID NO: 1266271 - DNA, 22 bp, Artificial Sequence
  chemically synthesized
ctaggtcatattgcaaatacct

SEQ ID NO: 1266272 - DNA, 22 bp, Artificial Sequence
  chemically synthesized
aggcttctaggtcatattgcaa

SEQ ID NO: 1266273 - DNA, 22 bp, Artificial Sequence
  chemically synthesized
caggcttctaggtcatattgca

SEQ ID NO: 1266274 - DNA, 22 bp, Artificial Sequence
  chemically synthesized
ggtatttgcaatatgacctaga

SEQ ID NO: 1266275 - DNA, 22 bp, Artificial Sequence
  chemically synthesized
gcaatatgacctagaagcctga

SEQ ID NO: 1266276 - DNA, 22 bp, Artificial Sequence
  chemically synthesized
caatatgacctagaagcctgaa

SEQ ID NO: 1266277 - DNA, 22 bp, Artificial Sequence
  chemically synthesized
aagggccagatagtacatattt

SEQ ID NO: 1266278 - DNA, 22 bp, Artificial Sequence
  chemically synthesized
aaagggccagatagtacatatt

SEQ ID NO: 1266279 - DNA, 22 bp, Artificial Sequence
  chemically synthesized
ttaaagggccagatagtacata

SEQ ID NO: 1266280 - DNA, 22 bp, Artificial Sequence
  chemically synthesized
gaagcctgaaatatgtactatc

SEQ ID NO: 1266281 - DNA, 22 bp, Artificial Sequence
  chemically synthesized
cttaaagggccagatagtacat

SEQ ID NO: 1266282 - DNA, 22 bp, Artificial Sequence
  chemically synthesized
tcttaaagggccagatagtaca

SEQ ID NO: 1266283 - DNA, 22 bp, Artificial Sequence
  chemically synthesized
aaatatgtactatctggccctt

SEQ ID NO: 1266284 - DNA, 22 bp, Artificial Sequence
  chemically synthesized
tctggccctttaagaaaatgtt

SEQ ID NO: 1266285 - DNA, 22 bp, Artificial Sequence
  chemically synthesized
gccctttaagaaaatgtttgtg

SEQ ID NO: 1266286 - DNA, 22 bp, Artificial Sequence
  chemically synthesized
taagaaaatgtttgtggacctc

SEQ ID NO: 1266287 - DNA, 22 bp, Artificial Sequence
  chemically synthesized
aagaaaatgtttgtggacctct

SEQ ID NO: 1266288 - DNA, 22 bp, Artificial Sequence
  chemically synthesized
agaaaatgtttgtggacctcta

SEQ ID NO: 1266289 - DNA, 22 bp, Artificial Sequence
  chemically synthesized
gtggacctctacattatgtttt

SEQ ID NO: 1266290 - DNA, 22 bp, Artificial Sequence
  chemically synthesized
tggacctctacattatgttttt

SEQ ID NO: 1266291 - DNA, 22 bp, Artificial Sequence
  chemically synthesized
tacattatgtttttatgatttt

SEQ ID NO: 1266292 - DNA, 22 bp, Artificial Sequence
  chemically synthesized
cattatgtttttatgattttct

SEQ ID NO: 1266293 - DNA, 22 bp, Artificial Sequence
  chemically synthesized
tgtttttatgattttctcatat

SEQ ID NO: 1266294 - DNA, 22 bp, Artificial Sequence
  chemically synthesized
tgatcacatgtaagaatatgag

SEQ ID NO: 1266295 - DNA, 22 bp, Artificial Sequence
  chemically synthesized
ttatgattttctcatattctta

SEQ ID NO: 1266296 - DNA, 22 bp, Artificial Sequence
  chemically synthesized
tatgattttctcatattcttac

SEQ ID NO: 1266297 - DNA, 22 bp, Artificial Sequence
  chemically synthesized
atgattttctcatattcttaca

SEQ ID NO: 1266298 - DNA, 22 bp, Artificial Sequence
  chemically synthesized
actatgatcacatgtaagaata

SEQ ID NO: 1266299 - DNA, 22 bp, Artificial Sequence
  chemically synthesized
tgattttctcatattcttacat

SEQ ID NO: 1266300 - DNA, 22 bp, Artificial Sequence
  chemically synthesized
tctcatattcttacatgtgatc

SEQ ID NO: 1266301 - DNA, 22 bp, Artificial Sequence
  chemically synthesized
ctcatattcttacatgtgatca

SEQ ID NO: 1266302 - DNA, 22 bp, Artificial Sequence
  chemically synthesized
tcatattcttacatgtgatcat

SEQ ID NO: 1266303 - DNA, 22 bp, Artificial Sequence
  chemically synthesized
atattcttacatgtgatcatag

SEQ ID NO: 1266304 - DNA, 22 bp, Artificial Sequence
  chemically synthesized
ttacatgtgatcatagttaatt

SEQ ID NO: 1266305 - DNA, 22 bp, Artificial Sequence
  chemically synthesized
acatgtgatcatagttaattat

SEQ ID NO: 1266306 - DNA, 22 bp, Artificial Sequence
  chemically synthesized
catgtgatcatagttaattatt

SEQ ID NO: 1266307 - DNA, 22 bp, Artificial Sequence
  chemically synthesized
tatagcagtataaataattaac

SEQ ID NO: 1266308 - DNA, 22 bp, Artificial Sequence
  chemically synthesized
attatttatactgctatataat

SEQ ID NO: 1266309 - DNA, 22 bp, Artificial Sequence
  chemically synthesized
tttatactgctatataatattc

SEQ ID NO: 1266310 - DNA, 22 bp, Artificial Sequence
  chemically synthesized
tggtcataccatggaatattat

SEQ ID NO: 1266311 - DNA, 22 bp, Artificial Sequence
  chemically synthesized
atactgctatataatattccat

SEQ ID NO: 1266312 - DNA, 22 bp, Artificial Sequence
  chemically synthesized
tactgctatataatattccatg

SEQ ID NO: 1266313 - DNA, 22 bp, Artificial Sequence
  chemically synthesized
tattatggtcataccatggaat

SEQ ID NO: 1266314 - DNA, 22 bp, Artificial Sequence
  chemically synthesized
ctatataatattccatggtatg

SEQ ID NO: 1266315 - DNA, 22 bp, Artificial Sequence
  chemically synthesized
tataatattccatggtatgacc

SEQ ID NO: 1266316 - DNA, 22 bp, Artificial Sequence
  chemically synthesized
catggtatgaccataatacaat

SEQ ID NO: 1266317 - DNA, 22 bp, Artificial Sequence
  chemically synthesized
ataatagcaaataattgtatta

SEQ ID NO: 1266318 - DNA, 22 bp, Artificial Sequence
  chemically synthesized
cagtgttcataatagcaaataa

SEQ ID NO: 1266319 - DNA, 22 bp, Artificial Sequence
  chemically synthesized
gtagctacagtgttcataatag

SEQ ID NO: 1266320 - DNA, 22 bp, Artificial Sequence
  chemically synthesized
tttgctattatgaacactgtag

SEQ ID NO: 1266321 - DNA, 22 bp, Artificial Sequence
  chemically synthesized
gctattatgaacactgtagcta

SEQ ID NO: 1266322 - DNA, 22 bp, Artificial Sequence
  chemically synthesized
ctattatgaacactgtagctac

SEQ ID NO: 1266323 - DNA, 22 bp, Artificial Sequence
  chemically synthesized
ttatgaacactgtagctacgaa

SEQ ID NO: 1266324 - DNA, 22 bp, Artificial Sequence
  chemically synthesized
tgaacactgtagctacgaatgt

SEQ ID NO: 1266325 - DNA, 22 bp, Artificial Sequence
  chemically synthesized
tagctacgaatgtccttccctc

SEQ ID NO: 1266326 - DNA, 22 bp, Artificial Sequence
  chemically synthesized
cagtgccagagagggagggaag

SEQ ID NO: 1266327 - DNA, 22 bp, Artificial Sequence
  chemically synthesized
cgaatgtccttccctccctctc

SEQ ID NO: 1266328 - DNA, 22 bp, Artificial Sequence
  chemically synthesized
agtgtctccagtgccagagagg

SEQ ID NO: 1266329 - DNA, 22 bp, Artificial Sequence
  chemically synthesized
cactgagtgtctccagtgccag

SEQ ID NO: 1266330 - DNA, 22 bp, Artificial Sequence
  chemically synthesized
acactgagtgtctccagtgcca

SEQ ID NO: 1266331 - DNA, 22 bp, Artificial Sequence
  chemically synthesized
ccctccctctctggcactggag

SEQ ID NO: 1266332 - DNA, 22 bp, Artificial Sequence
  chemically synthesized
cctccctctctggcactggaga

SEQ ID NO: 1266333 - DNA, 22 bp, Artificial Sequence
  chemically synthesized
cctctctggcactggagacact

SEQ ID NO: 1266334 - DNA, 22 bp, Artificial Sequence
  chemically synthesized
tctggcactggagacactcagt

SEQ ID NO: 1266335 - DNA, 22 bp, Artificial Sequence
  chemically synthesized
tggcactggagacactcagtgt

SEQ ID NO: 1266336 - DNA, 22 bp, Artificial Sequence
  chemically synthesized
ggaaatcaatttacactgagtg

SEQ ID NO: 1266337 - DNA, 22 bp, Artificial Sequence
  chemically synthesized
aggaaatcaatttacactgagt

SEQ ID NO: 1266338 - DNA, 22 bp, Artificial Sequence
  chemically synthesized
gcactggagacactcagtgtaa

SEQ ID NO: 1266339 - DNA, 22 bp, Artificial Sequence
  chemically synthesized
atttaggaaatcaatttacact

SEQ ID NO: 1266340 - DNA, 22 bp, Artificial Sequence
  chemically synthesized
gagacactcagtgtaaattgat

SEQ ID NO: 1266341 - DNA, 22 bp, Artificial Sequence
  chemically synthesized
aagaattaatttaggaaatcaa

SEQ ID NO: 1266342 - DNA, 22 bp, Artificial Sequence
  chemically synthesized
agtgtaaattgatttcctaaat

SEQ ID NO: 1266343 - DNA, 22 bp, Artificial Sequence
  chemically synthesized
atttcctaaattaattctttaa

SEQ ID NO: 1266344 - DNA, 22 bp, Artificial Sequence
  chemically synthesized
agcgcaaaaaggattaaagaat

SEQ ID NO: 1266345 - DNA, 22 bp, Artificial Sequence
  chemically synthesized
cctaaattaattctttaatcct

SEQ ID NO: 1266346 - DNA, 22 bp, Artificial Sequence
  chemically synthesized
ctaaattaattctttaatcctt

SEQ ID NO: 1266347 - DNA, 22 bp, Artificial Sequence
  chemically synthesized
tattcagcgcaaaaaggattaa

SEQ ID NO: 1266348 - DNA, 22 bp, Artificial Sequence
  chemically synthesized
aattaattctttaatccttttt

SEQ ID NO: 1266349 - DNA, 22 bp, Artificial Sequence
  chemically synthesized
tatattcagcgcaaaaaggatt

SEQ ID NO: 1266350 - DNA, 22 bp, Artificial Sequence
  chemically synthesized
ctatattcagcgcaaaaaggat

SEQ ID NO: 1266351 - DNA, 22 bp, Artificial Sequence
  chemically synthesized
attctttaatcctttttgcgct

SEQ ID NO: 1266352 - DNA, 22 bp, Artificial Sequence
  chemically synthesized
tgacttctatattcagcgcaaa

SEQ ID NO: 1266353 - DNA, 22 bp, Artificial Sequence
  chemically synthesized
gtgacttctatattcagcgcaa

SEQ ID NO: 1266354 - DNA, 22 bp, Artificial Sequence
  chemically synthesized
tttaatcctttttgcgctgaat

SEQ ID NO: 1266355 - DNA, 22 bp, Artificial Sequence
  chemically synthesized
tgtgacttctatattcagcgca

SEQ ID NO: 1266356 - DNA, 22 bp, Artificial Sequence
  chemically synthesized
taatcctttttgcgctgaatat

SEQ ID NO: 1266357 - DNA, 22 bp, Artificial Sequence
  chemically synthesized
aatcctttttgcgctgaatata

SEQ ID NO: 1266358 - DNA, 22 bp, Artificial Sequence
  chemically synthesized
atcctttttgcgctgaatatag

SEQ ID NO: 1266359 - DNA, 22 bp, Artificial Sequence
  chemically synthesized
tgtgactttgtgacttctatat

SEQ ID NO: 1266360 - DNA, 22 bp, Artificial Sequence
  chemically synthesized
gtgtgactttgtgacttctata

SEQ ID NO: 1266361 - DNA, 22 bp, Artificial Sequence
  chemically synthesized
tttgcgctgaatatagaagtca

SEQ ID NO: 1266362 - DNA, 22 bp, Artificial Sequence
  chemically synthesized
ttgcgctgaatatagaagtcac

SEQ ID NO: 1266363 - DNA, 22 bp, Artificial Sequence
  chemically synthesized
tgcgctgaatatagaagtcaca

SEQ ID NO: 1266364 - DNA, 22 bp, Artificial Sequence
  chemically synthesized
gcgctgaatatagaagtcacaa

SEQ ID NO: 1266365 - DNA, 22 bp, Artificial Sequence
  chemically synthesized
cgctgaatatagaagtcacaaa

SEQ ID NO: 1266366 - DNA, 22 bp, Artificial Sequence
  chemically synthesized
atgtttgtgtgactttgtgact

SEQ ID NO: 1266367 - DNA, 22 bp, Artificial Sequence
  chemically synthesized
aatgtttgtgtgactttgtgac

SEQ ID NO: 1266368 - DNA, 22 bp, Artificial Sequence
  chemically synthesized
taatgtttgtgtgactttgtga

SEQ ID NO: 1266369 - DNA, 22 bp, Artificial Sequence
  chemically synthesized
aatatagaagtcacaaagtcac

SEQ ID NO: 1266370 - DNA, 22 bp, Artificial Sequence
  chemically synthesized
tttaatgtttgtgtgactttgt

SEQ ID NO: 1266371 - DNA, 22 bp, Artificial Sequence
  chemically synthesized
caaatattctttaatgtttgtg

SEQ ID NO: 1266372 - DNA, 22 bp, Artificial Sequence
  chemically synthesized
ccaaatattctttaatgtttgt

SEQ ID NO: 1266373 - DNA, 22 bp, Artificial Sequence
  chemically synthesized
tttccaaatattctttaatgtt

SEQ ID NO: 1266374 - DNA, 22 bp, Artificial Sequence
  chemically synthesized
atttccaaatattctttaatgt

SEQ ID NO: 1266375 - DNA, 22 bp, Artificial Sequence
  chemically synthesized
ttatttccaaatattctttaat

SEQ ID NO: 1266376 - DNA, 22 bp, Artificial Sequence
  chemically synthesized
ctcttatttccaaatattcttt

SEQ ID NO: 1266377 - DNA, 22 bp, Artificial Sequence
  chemically synthesized
tactcttatttccaaatattct

SEQ ID NO: 1266378 - DNA, 22 bp, Artificial Sequence
  chemically synthesized
tactctactcttatttccaaat

SEQ ID NO: 1266379 - DNA, 22 bp, Artificial Sequence
  chemically synthesized
tgtactctactcttatttccaa

SEQ ID NO: 1266380 - DNA, 22 bp, Artificial Sequence
  chemically synthesized
ctgtactctactcttatttcca

SEQ ID NO: 1266381 - DNA, 22 bp, Artificial Sequence
  chemically synthesized
tctgtactctactcttatttcc

SEQ ID NO: 1266382 - DNA, 22 bp, Artificial Sequence
  chemically synthesized
aagaatatttggaaataagagt

SEQ ID NO: 1266383 - DNA, 22 bp, Artificial Sequence
  chemically synthesized
cattttctgtactctactctta

SEQ ID NO: 1266384 - DNA, 22 bp, Artificial Sequence
  chemically synthesized
gcattttctgtactctactctt

SEQ ID NO: 1266385 - DNA, 22 bp, Artificial Sequence
  chemically synthesized
cttgcattttctgtactctact

SEQ ID NO: 1266386 - DNA, 22 bp, Artificial Sequence
  chemically synthesized
ccttgcattttctgtactctac

SEQ ID NO: 1266387 - DNA, 22 bp, Artificial Sequence
  chemically synthesized
tccttgcattttctgtactcta

SEQ ID NO: 1266388 - DNA, 22 bp, Artificial Sequence
  chemically synthesized
ggaaataagagtagagtacaga

SEQ ID NO: 1266389 - DNA, 22 bp, Artificial Sequence
  chemically synthesized
ttccttgcattttctgtactct

SEQ ID NO: 1266390 - DNA, 22 bp, Artificial Sequence
  chemically synthesized
gaaataagagtagagtacagaa

SEQ ID NO: 1266391 - DNA, 22 bp, Artificial Sequence
  chemically synthesized
tttccttgcattttctgtactc

SEQ ID NO: 1266392 - DNA, 22 bp, Artificial Sequence
  chemically synthesized
ttttccttgcattttctgtact

SEQ ID NO: 1266393 - DNA, 22 bp, Artificial Sequence
  chemically synthesized
tttttccttgcattttctgtac

SEQ ID NO: 1266394 - DNA, 22 bp, Artificial Sequence
  chemically synthesized
ttttttccttgcattttctgta

SEQ ID NO: 1266395 - DNA, 22 bp, Artificial Sequence
  chemically synthesized
tttttttttccttgcattttct

SEQ ID NO: 1266396 - DNA, 22 bp, Artificial Sequence
  chemically synthesized
agggggagagatagaattgttt

SEQ ID NO: 1266397 - DNA, 22 bp, Artificial Sequence
  chemically synthesized
tctaagggggagagatagaatt

SEQ ID NO: 1266398 - DNA, 22 bp, Artificial Sequence
  chemically synthesized
ccggttgtctaagggggagaga

SEQ ID NO: 1266399 - DNA, 22 bp, Artificial Sequence
  chemically synthesized
gtattaccggttgtctaagggg

SEQ ID NO: 1266400 - DNA, 22 bp, Artificial Sequence
  chemically synthesized
tatctctcccccttagacaacc

SEQ ID NO: 1266401 - DNA, 22 bp, Artificial Sequence
  chemically synthesized
tctctcccccttagacaaccgg

SEQ ID NO: 1266402 - DNA, 22 bp, Artificial Sequence
  chemically synthesized
tcccccttagacaaccggtaat

SEQ ID NO: 1266403 - DNA, 22 bp, Artificial Sequence
  chemically synthesized
ccccttagacaaccggtaatac

SEQ ID NO: 1266404 - DNA, 22 bp, Artificial Sequence
  chemically synthesized
agacaaccggtaatactaatgt

SEQ ID NO: 1266405 - DNA, 22 bp, Artificial Sequence
  chemically synthesized
gacaaccggtaatactaatgtt

SEQ ID NO: 1266406 - DNA, 22 bp, Artificial Sequence
  chemically synthesized
acagcaagaggaaaaaggcata

SEQ ID NO: 1266407 - DNA, 22 bp, Artificial Sequence
  chemically synthesized
cacagcaagaggaaaaaggcat

SEQ ID NO: 1266408 - DNA, 22 bp, Artificial Sequence
  chemically synthesized
atgttatgcctttttcctcttg

SEQ ID NO: 1266409 - DNA, 22 bp, Artificial Sequence
  chemically synthesized
tgcctttttcctcttgctgtga

SEQ ID NO: 1266410 - DNA, 22 bp, Artificial Sequence
  chemically synthesized
atggataaggagtttcacagca

SEQ ID NO: 1266411 - DNA, 22 bp, Artificial Sequence
  chemically synthesized
ttaatggataaggagtttcaca

SEQ ID NO: 1266412 - DNA, 22 bp, Artificial Sequence
  chemically synthesized
tttcctcttgctgtgaaactcc

SEQ ID NO: 1266413 - DNA, 22 bp, Artificial Sequence
  chemically synthesized
ttcctcttgctgtgaaactcct

SEQ ID NO: 1266414 - DNA, 22 bp, Artificial Sequence
  chemically synthesized
tcctcttgctgtgaaactcctt

SEQ ID NO: 1266415 - DNA, 22 bp, Artificial Sequence
  chemically synthesized
cctcttgctgtgaaactcctta

SEQ ID NO: 1266416 - DNA, 22 bp, Artificial Sequence
  chemically synthesized
gctgttaatggataaggagttt

SEQ ID NO: 1266417 - DNA, 22 bp, Artificial Sequence
  chemically synthesized
ctcttgctgtgaaactccttat

SEQ ID NO: 1266418 - DNA, 22 bp, Artificial Sequence
  chemically synthesized
agctgttaatggataaggagtt

SEQ ID NO: 1266419 - DNA, 22 bp, Artificial Sequence
  chemically synthesized
ttgctgtgaaactccttatcca

SEQ ID NO: 1266420 - DNA, 22 bp, Artificial Sequence
  chemically synthesized
cttagctgttaatggataagga

SEQ ID NO: 1266421 - DNA, 22 bp, Artificial Sequence
  chemically synthesized
ccttagctgttaatggataagg

SEQ ID NO: 1266422 - DNA, 22 bp, Artificial Sequence
  chemically synthesized
gctgtgaaactccttatccatt

SEQ ID NO: 1266423 - DNA, 22 bp, Artificial Sequence
  chemically synthesized
ctgtgaaactccttatccatta

SEQ ID NO: 1266424 - DNA, 22 bp, Artificial Sequence
  chemically synthesized
tgaaactccttatccattaaca

SEQ ID NO: 1266425 - DNA, 22 bp, Artificial Sequence
  chemically synthesized
cttatccattaacagctaagga

SEQ ID NO: 1266426 - DNA, 22 bp, Artificial Sequence
  chemically synthesized
atccattaacagctaaggaagg

SEQ ID NO: 1266427 - DNA, 22 bp, Artificial Sequence
  chemically synthesized
tccattaacagctaaggaagga

SEQ ID NO: 1266428 - DNA, 22 bp, Artificial Sequence
  chemically synthesized
acagctaaggaaggatcactgt

SEQ ID NO: 1266429 - DNA, 22 bp, Artificial Sequence
  chemically synthesized
aggaaggatcactgtcgcctca

SEQ ID NO: 1266430 - DNA, 22 bp, Artificial Sequence
  chemically synthesized
tcgcctcaccttcctttttcat

SEQ ID NO: 1266431 - DNA, 22 bp, Artificial Sequence
  chemically synthesized
ataataggcaggatgaaaaagg

SEQ ID NO: 1266432 - DNA, 22 bp, Artificial Sequence
  chemically synthesized
ttcataataggcaggatgaaaa

SEQ ID NO: 1266433 - DNA, 22 bp, Artificial Sequence
  chemically synthesized
accttcctttttcatcctgcct

SEQ ID NO: 1266434 - DNA, 22 bp, Artificial Sequence
  chemically synthesized
tggattattcataataggcagg

SEQ ID NO: 1266435 - DNA, 22 bp, Artificial Sequence
  chemically synthesized
atggattattcataataggcag

SEQ ID NO: 1266436 - DNA, 22 bp, Artificial Sequence
  chemically synthesized
cctttttcatcctgcctattat

SEQ ID NO: 1266437 - DNA, 22 bp, Artificial Sequence
  chemically synthesized
ctttttcatcctgcctattatg

SEQ ID NO: 1266438 - DNA, 22 bp, Artificial Sequence
  chemically synthesized
tttcatcctgcctattatgaat

SEQ ID NO: 1266439 - DNA, 22 bp, Artificial Sequence
  chemically synthesized
ttcatcctgcctattatgaata

SEQ ID NO: 1266440 - DNA, 22 bp, Artificial Sequence
  chemically synthesized
tcatcctgcctattatgaataa

SEQ ID NO: 1266441 - DNA, 22 bp, Artificial Sequence
  chemically synthesized
catcctgcctattatgaataat

SEQ ID NO: 1266442 - DNA, 22 bp, Artificial Sequence
  chemically synthesized
atcctgcctattatgaataatc

SEQ ID NO: 1266443 - DNA, 22 bp, Artificial Sequence
  chemically synthesized
aaatgagatttatggattattc

SEQ ID NO: 1266444 - DNA, 22 bp, Artificial Sequence
  chemically synthesized
cctattatgaataatccataaa

SEQ ID NO: 1266445 - DNA, 22 bp, Artificial Sequence
  chemically synthesized
ttatgaataatccataaatctc

SEQ ID NO: 1266446 - DNA, 22 bp, Artificial Sequence
  chemically synthesized
tgaataatccataaatctcatt

SEQ ID NO: 1266447 - DNA, 22 bp, Artificial Sequence
  chemically synthesized
gtgaaatcattaaaatgagatt

SEQ ID NO: 1266448 - DNA, 22 bp, Artificial Sequence
  chemically synthesized
tagtgaaatcattaaaatgaga

SEQ ID NO: 1266449 - DNA, 22 bp, Artificial Sequence
  chemically synthesized
ctagtgaaatcattaaaatgag

SEQ ID NO: 1266450 - DNA, 22 bp, Artificial Sequence
  chemically synthesized
tctagtgaaatcattaaaatga

SEQ ID NO: 1266451 - DNA, 22 bp, Artificial Sequence
  chemically synthesized
atgctttctagtgaaatcatta

SEQ ID NO: 1266452 - DNA, 22 bp, Artificial Sequence
  chemically synthesized
aatgctttctagtgaaatcatt

SEQ ID NO: 1266453 - DNA, 22 bp, Artificial Sequence
  chemically synthesized
catttaatgctttctagtgaaa

SEQ ID NO: 1266454 - DNA, 22 bp, Artificial Sequence
  chemically synthesized
acatttaatgctttctagtgaa

SEQ ID NO: 1266455 - DNA, 22 bp, Artificial Sequence
  chemically synthesized
attttaatgatttcactagaaa

SEQ ID NO: 1266456 - DNA, 22 bp, Artificial Sequence
  chemically synthesized
tttacatttaatgctttctagt

SEQ ID NO: 1266457 - DNA, 22 bp, Artificial Sequence
  chemically synthesized
taatgatttcactagaaagcat

SEQ ID NO: 1266458 - DNA, 22 bp, Artificial Sequence
  chemically synthesized
aatgatttcactagaaagcatt

SEQ ID NO: 1266459 - DNA, 22 bp, Artificial Sequence
  chemically synthesized
atgatttcactagaaagcatta

SEQ ID NO: 1266460 - DNA, 22 bp, Artificial Sequence
  chemically synthesized
cactagaaagcattaaatgtaa

SEQ ID NO: 1266461 - DNA, 22 bp, Artificial Sequence
  chemically synthesized
actagaaagcattaaatgtaaa

SEQ ID NO: 1266462 - DNA, 22 bp, Artificial Sequence
  chemically synthesized
gaaagcattaaatgtaaataat

SEQ ID NO: 1266463 - DNA, 22 bp, Artificial Sequence
  chemically synthesized
tgtccacccccacggattattt

SEQ ID NO: 1266464 - DNA, 22 bp, Artificial Sequence
  chemically synthesized
ctatgtccacccccacggatta

SEQ ID NO: 1266465 - DNA, 22 bp, Artificial Sequence
  chemically synthesized
aatgtaaataatccgtgggggt

SEQ ID NO: 1266466 - DNA, 22 bp, Artificial Sequence
  chemically synthesized
cctcctatgtccacccccacgg

SEQ ID NO: 1266467 - DNA, 22 bp, Artificial Sequence
  chemically synthesized
atattacctcctatgtccaccc

SEQ ID NO: 1266468 - DNA, 22 bp, Artificial Sequence
  chemically synthesized
gtctaatattacctcctatgtc

SEQ ID NO: 1266469 - DNA, 22 bp, Artificial Sequence
  chemically synthesized
ctcgtctaatattacctcctat

SEQ ID NO: 1266470 - DNA, 22 bp, Artificial Sequence
  chemically synthesized
gctcgtctaatattacctccta

SEQ ID NO: 1266471 - DNA, 22 bp, Artificial Sequence
  chemically synthesized
tgctcgtctaatattacctcct

SEQ ID NO: 1266472 - DNA, 22 bp, Artificial Sequence
  chemically synthesized
ttgctcgtctaatattacctcc

SEQ ID NO: 1266473 - DNA, 22 bp, Artificial Sequence
  chemically synthesized
cttttgctcgtctaatattacc

SEQ ID NO: 1266474 - DNA, 22 bp, Artificial Sequence
  chemically synthesized
ccttttgctcgtctaatattac

SEQ ID NO: 1266475 - DNA, 22 bp, Artificial Sequence
  chemically synthesized
ttccttttgctcgtctaatatt

SEQ ID NO: 1266476 - DNA, 22 bp, Artificial Sequence
  chemically synthesized
cctcttccttttgctcgtctaa

SEQ ID NO: 1266477 - DNA, 22 bp, Artificial Sequence
  chemically synthesized
gcctcttccttttgctcgtcta

SEQ ID NO: 1266478 - DNA, 22 bp, Artificial Sequence
  chemically synthesized
aatcttgcctcttccttttgct

SEQ ID NO: 1266479 - DNA, 22 bp, Artificial Sequence
  chemically synthesized
aaatcttgcctcttccttttgc

SEQ ID NO: 1266480 - DNA, 22 bp, Artificial Sequence
  chemically synthesized
taaatcttgcctcttccttttg

SEQ ID NO: 1266481 - DNA, 22 bp, Artificial Sequence
  chemically synthesized
ttaaatcttgcctcttcctttt

SEQ ID NO: 1266482 - DNA, 22 bp, Artificial Sequence
  chemically synthesized
gacgagcaaaaggaagaggcaa

SEQ ID NO: 1266483 - DNA, 22 bp, Artificial Sequence
  chemically synthesized
ataaggtcttttaaatcttgcc

SEQ ID NO: 1266484 - DNA, 22 bp, Artificial Sequence
  chemically synthesized
aataaggtcttttaaatcttgc

SEQ ID NO: 1266485 - DNA, 22 bp, Artificial Sequence
  chemically synthesized
aaagcttaataaggtcttttaa

SEQ ID NO: 1266486 - DNA, 22 bp, Artificial Sequence
  chemically synthesized
aaaagcttaataaggtctttta

SEQ ID NO: 1266487 - DNA, 22 bp, Artificial Sequence
  chemically synthesized
taaaagcttaataaggtctttt

SEQ ID NO: 1266488 - DNA, 22 bp, Artificial Sequence
  chemically synthesized
aaacattttaaaagcttaataa

SEQ ID NO: 1266489 - DNA, 22 bp, Artificial Sequence
  chemically synthesized
aaaagaccttattaagctttta

SEQ ID NO: 1266490 - DNA, 22 bp, Artificial Sequence
  chemically synthesized
aaagaccttattaagcttttaa

SEQ ID NO: 1266491 - DNA, 22 bp, Artificial Sequence
  chemically synthesized
attaagcttttaaaatgtttta

SEQ ID NO: 1266492 - DNA, 22 bp, Artificial Sequence
  chemically synthesized
ttaagcttttaaaatgttttag

SEQ ID NO: 1266493 - DNA, 22 bp, Artificial Sequence
  chemically synthesized
agcttttaaaatgttttagcac

SEQ ID NO: 1266494 - DNA, 22 bp, Artificial Sequence
  chemically synthesized
agaacagaatacatgtgctaaa

SEQ ID NO: 1266495 - DNA, 22 bp, Artificial Sequence
  chemically synthesized
ttaaaatgttttagcacatgta

SEQ ID NO: 1266496 - DNA, 22 bp, Artificial Sequence
  chemically synthesized
taaaatgttttagcacatgtat

SEQ ID NO: 1266497 - DNA, 22 bp, Artificial Sequence
  chemically synthesized
aaaatgttttagcacatgtatt

SEQ ID NO: 1266498 - DNA, 22 bp, Artificial Sequence
  chemically synthesized
aaatgttttagcacatgtattc

SEQ ID NO: 1266499 - DNA, 22 bp, Artificial Sequence
  chemically synthesized
tagcacatgtattctgttctta

SEQ ID NO: 1266500 - DNA, 22 bp, Artificial Sequence
  chemically synthesized
agcacatgtattctgttcttaa

SEQ ID NO: 1266501 - DNA, 22 bp, Artificial Sequence
  chemically synthesized
gcacatgtattctgttcttaat

SEQ ID NO: 1266502 - DNA, 22 bp, Artificial Sequence
  chemically synthesized
tgtgtgtgaaatattaagaaca

SEQ ID NO: 1266503 - DNA, 22 bp, Artificial Sequence
  chemically synthesized
gtgtgtgtgaaatattaagaac

SEQ ID NO: 1266504 - DNA, 22 bp, Artificial Sequence
  chemically synthesized
tgtgtgtgtgaaatattaagaa

SEQ ID NO: 1266505 - DNA, 22 bp, Artificial Sequence
  chemically synthesized
ttgtgtgtgtgaaatattaaga

SEQ ID NO: 1266506 - DNA, 22 bp, Artificial Sequence
  chemically synthesized
tttgtgtgtgtgaaatattaag

SEQ ID NO: 1266507 - DNA, 22 bp, Artificial Sequence
  chemically synthesized
ttttgtgtgtgtgaaatattaa

SEQ ID NO: 1266508 - DNA, 22 bp, Artificial Sequence
  chemically synthesized
tttttgtgtgtgtgaaatatta

SEQ ID NO: 1266509 - DNA, 22 bp, Artificial Sequence
  chemically synthesized
tgttcttaatatttcacacaca

SEQ ID NO: 1266510 - DNA, 22 bp, Artificial Sequence
  chemically synthesized
ttcttaatatttcacacacaca

SEQ ID NO: 1266511 - DNA, 22 bp, Artificial Sequence
  chemically synthesized
gacagttttttttgtgtgtgtg

SEQ ID NO: 1266512 - DNA, 22 bp, Artificial Sequence
  chemically synthesized
tagacagttttttttgtgtgtg

SEQ ID NO: 1266513 - DNA, 22 bp, Artificial Sequence
  chemically synthesized
ttaatatttcacacacacaaaa

SEQ ID NO: 1266514 - DNA, 22 bp, Artificial Sequence
  chemically synthesized
ctagacagttttttttgtgtgt

SEQ ID NO: 1266515 - DNA, 22 bp, Artificial Sequence
  chemically synthesized
aatatttcacacacacaaaaaa

SEQ ID NO: 1266516 - DNA, 22 bp, Artificial Sequence
  chemically synthesized
atatttcacacacacaaaaaaa

SEQ ID NO: 1266517 - DNA, 22 bp, Artificial Sequence
  chemically synthesized
tggtttctagacagtttttttt

SEQ ID NO: 1266518 - DNA, 22 bp, Artificial Sequence
  chemically synthesized
cacacacacaaaaaaaactgtc

SEQ ID NO: 1266519 - DNA, 22 bp, Artificial Sequence
  chemically synthesized
acacacacaaaaaaaactgtct

SEQ ID NO: 1266520 - DNA, 22 bp, Artificial Sequence
  chemically synthesized
tgaaatcacctgtggtttctag

SEQ ID NO: 1266521 - DNA, 22 bp, Artificial Sequence
  chemically synthesized
tctagaaaccacaggtgatttc

SEQ ID NO: 1266522 - DNA, 22 bp, Artificial Sequence
  chemically synthesized
gaaaccacaggtgatttcataa

SEQ ID NO: 1266523 - DNA, 22 bp, Artificial Sequence
  chemically synthesized
cataactttacttgtatctctt

SEQ ID NO: 1266524 - DNA, 22 bp, Artificial Sequence
  chemically synthesized
ataactttacttgtatctcttt

SEQ ID NO: 1266525 - DNA, 22 bp, Artificial Sequence
  chemically synthesized
cagaaaaaaaaaaaagagatac

SEQ ID NO: 1266526 - DNA, 22 bp, Artificial Sequence
  chemically synthesized
cgtctccagaaaaaaaaaaaag

SEQ ID NO: 1266527 - DNA, 22 bp, Artificial Sequence
  chemically synthesized
tacttgtatctctttttttttt

SEQ ID NO: 1266528 - DNA, 22 bp, Artificial Sequence
  chemically synthesized
acttgtatctcttttttttttt

SEQ ID NO: 1266529 - DNA, 22 bp, Artificial Sequence
  chemically synthesized
cttgtatctctttttttttttt

SEQ ID NO: 1266530 - DNA, 22 bp, Artificial Sequence
  chemically synthesized
gtatctcttttttttttttctg

SEQ ID NO: 1266531 - DNA, 22 bp, Artificial Sequence
  chemically synthesized
tatctcttttttttttttctgg

SEQ ID NO: 1266532 - DNA, 22 bp, Artificial Sequence
  chemically synthesized
ttttttttttttctggagacgg

SEQ ID NO: 1266533 - DNA, 22 bp, Artificial Sequence
  chemically synthesized
ttttttttttctggagacggag

SEQ ID NO: 1266534 - DNA, 22 bp, Artificial Sequence
  chemically synthesized
tttttttttctggagacggagt

SEQ ID NO: 1266535 - DNA, 22 bp, Artificial Sequence
  chemically synthesized
ttttttttctggagacggagtt

SEQ ID NO: 1266536 - DNA, 22 bp, Artificial Sequence
  chemically synthesized
tttttttctggagacggagttt

SEQ ID NO: 1266537 - DNA, 22 bp, Artificial Sequence
  chemically synthesized
ttttttctggagacggagtttt

SEQ ID NO: 1266538 - DNA, 22 bp, Artificial Sequence
  chemically synthesized
ggcaacaagagcaaaactccgt

SEQ ID NO: 1266539 - DNA, 22 bp, Artificial Sequence
  chemically synthesized
tttttctggagacggagttttg

SEQ ID NO: 1266540 - DNA, 22 bp, Artificial Sequence
  chemically synthesized
ttttctggagacggagttttgc

SEQ ID NO: 1266541 - DNA, 22 bp, Artificial Sequence
  chemically synthesized
tttctggagacggagttttgct

SEQ ID NO: 1266542 - DNA, 22 bp, Artificial Sequence
  chemically synthesized
ttctggagacggagttttgctc

SEQ ID NO: 1266543 - DNA, 22 bp, Artificial Sequence
  chemically synthesized
tctggagacggagttttgctct

SEQ ID NO: 1266544 - DNA, 22 bp, Artificial Sequence
  chemically synthesized
ctggagacggagttttgctctt

SEQ ID NO: 1266545 - DNA, 22 bp, Artificial Sequence
  chemically synthesized
tggagacggagttttgctcttg

SEQ ID NO: 1266546 - DNA, 22 bp, Artificial Sequence
  chemically synthesized
cagcctgggcaacaagagcaaa

SEQ ID NO: 1266547 - DNA, 22 bp, Artificial Sequence
  chemically synthesized
gagacggagttttgctcttgtt

SEQ ID NO: 1266548 - DNA, 22 bp, Artificial Sequence
  chemically synthesized
cactccagcctgggcaacaaga

SEQ ID NO: 1266549 - DNA, 22 bp, Artificial Sequence
  chemically synthesized
tgctcttgttgcccaggctgga

SEQ ID NO: 1266550 - DNA, 22 bp, Artificial Sequence
  chemically synthesized
gctcttgttgcccaggctggag

SEQ ID NO: 1266551 - DNA, 22 bp, Artificial Sequence
  chemically synthesized
ctcttgttgcccaggctggagt

SEQ ID NO: 1266552 - DNA, 22 bp, Artificial Sequence
  chemically synthesized
ttgttgcccaggctggagtgca

SEQ ID NO: 1266553 - DNA, 22 bp, Artificial Sequence
  chemically synthesized
agatggcgccattgcactccag

SEQ ID NO: 1266554 - DNA, 22 bp, Artificial Sequence
  chemically synthesized
gttgcccaggctggagtgcaat

SEQ ID NO: 1266555 - DNA, 22 bp, Artificial Sequence
  chemically synthesized
ttgcccaggctggagtgcaatg

SEQ ID NO: 1266556 - DNA, 22 bp, Artificial Sequence
  chemically synthesized
cccaggctggagtgcaatggcg

SEQ ID NO: 1266557 - DNA, 22 bp, Artificial Sequence
  chemically synthesized
tggtgagctgagatggcgccat

SEQ ID NO: 1266558 - DNA, 22 bp, Artificial Sequence
  chemically synthesized
gagtgcaatggcgccatctcag

SEQ ID NO: 1266559 - DNA, 22 bp, Artificial Sequence
  chemically synthesized
aacccaggaggcggaggttgtg

SEQ ID NO: 1266560 - DNA, 22 bp, Artificial Sequence
  chemically synthesized
gaacccaggaggcggaggttgt

SEQ ID NO: 1266561 - DNA, 22 bp, Artificial Sequence
  chemically synthesized
ttgaacccaggaggcggaggtt

SEQ ID NO: 1266562 - DNA, 22 bp, Artificial Sequence
  chemically synthesized
agctcaccacaacctccgcctc

SEQ ID NO: 1266563 - DNA, 22 bp, Artificial Sequence
  chemically synthesized
accacaacctccgcctcctggg

SEQ ID NO: 1266564 - DNA, 22 bp, Artificial Sequence
  chemically synthesized
aggcaggagaatctcttgaacc

SEQ ID NO: 1266565 - DNA, 22 bp, Artificial Sequence
  chemically synthesized
cgcctcctgggttcaagagatt

SEQ ID NO: 1266566 - DNA, 22 bp, Artificial Sequence
  chemically synthesized
ctgggttcaagagattctcctg

SEQ ID NO: 1266567 - DNA, 22 bp, Artificial Sequence
  chemically synthesized
cggagtctgaggcaggagaatc

SEQ ID NO: 1266568 - DNA, 22 bp, Artificial Sequence
  chemically synthesized
ggttcaagagattctcctgcct

SEQ ID NO: 1266569 - DNA, 22 bp, Artificial Sequence
  chemically synthesized
ctccggagtctgaggcaggaga

SEQ ID NO: 1266570 - DNA, 22 bp, Artificial Sequence
  chemically synthesized
aagagattctcctgcctcagac

SEQ ID NO: 1266571 - DNA, 22 bp, Artificial Sequence
  chemically synthesized
taaccccagctactccggagtc

SEQ ID NO: 1266572 - DNA, 22 bp, Artificial Sequence
  chemically synthesized
tcctgcctcagactccggagta

SEQ ID NO: 1266573 - DNA, 22 bp, Artificial Sequence
  chemically synthesized
ctgcctcagactccggagtagc

SEQ ID NO: 1266574 - DNA, 22 bp, Artificial Sequence
  chemically synthesized
cctcagactccggagtagctgg

SEQ ID NO: 1266575 - DNA, 22 bp, Artificial Sequence
  chemically synthesized
agactccggagtagctggggtt

SEQ ID NO: 1266576 - DNA, 22 bp, Artificial Sequence
  chemically synthesized
cggagtagctggggttacaggc

SEQ ID NO: 1266577 - DNA, 22 bp, Artificial Sequence
  chemically synthesized
gccaggcgtggtggtgcatgcc

SEQ ID NO: 1266578 - DNA, 22 bp, Artificial Sequence
  chemically synthesized
gggttacaggcatgcaccacca

SEQ ID NO: 1266579 - DNA, 22 bp, Artificial Sequence
  chemically synthesized
caggcatgcaccaccacgcctg

SEQ ID NO: 1266580 - DNA, 22 bp, Artificial Sequence
  chemically synthesized
aaaatacaaaattagccaggcg

SEQ ID NO: 1266581 - DNA, 22 bp, Artificial Sequence
  chemically synthesized
ctaaaaatacaaaattagccag

SEQ ID NO: 1266582 - DNA, 22 bp, Artificial Sequence
  chemically synthesized
tactaaaaatacaaaattagcc

SEQ ID NO: 1266583 - DNA, 22 bp, Artificial Sequence
  chemically synthesized
gctaattttgtatttttagtag

SEQ ID NO: 1266584 - DNA, 22 bp, Artificial Sequence
  chemically synthesized
attttgtatttttagtagagat

SEQ ID NO: 1266585 - DNA, 22 bp, Artificial Sequence
  chemically synthesized
tgtatttttagtagagatgggc

SEQ ID NO: 1266586 - DNA, 22 bp, Artificial Sequence
  chemically synthesized
gtatttttagtagagatgggct

SEQ ID NO: 1266587 - DNA, 22 bp, Artificial Sequence
  chemically synthesized
tatttttagtagagatgggctt

SEQ ID NO: 1266588 - DNA, 22 bp, Artificial Sequence
  chemically synthesized
accaaagtggaaaaagcccatc

SEQ ID NO: 1266589 - DNA, 22 bp, Artificial Sequence
  chemically synthesized
ttagtagagatgggctttttcc

SEQ ID NO: 1266590 - DNA, 22 bp, Artificial Sequence
  chemically synthesized
tagtagagatgggctttttcca

SEQ ID NO: 1266591 - DNA, 22 bp, Artificial Sequence
  chemically synthesized
agtagagatgggctttttccac

SEQ ID NO: 1266592 - DNA, 22 bp, Artificial Sequence
  chemically synthesized
gtagagatgggctttttccact

SEQ ID NO: 1266593 - DNA, 22 bp, Artificial Sequence
  chemically synthesized
gagaccagcctgaccaaagtgg

SEQ ID NO: 1266594 - DNA, 22 bp, Artificial Sequence
  chemically synthesized
tttccactttggtcaggctggt

SEQ ID NO: 1266595 - DNA, 22 bp, Artificial Sequence
  chemically synthesized
ttccactttggtcaggctggtc

SEQ ID NO: 1266596 - DNA, 22 bp, Artificial Sequence
  chemically synthesized
tccactttggtcaggctggtct

SEQ ID NO: 1266597 - DNA, 22 bp, Artificial Sequence
  chemically synthesized
ccactttggtcaggctggtctc

SEQ ID NO: 1266598 - DNA, 22 bp, Artificial Sequence
  chemically synthesized
cactttggtcaggctggtctcg

SEQ ID NO: 1266599 - DNA, 22 bp, Artificial Sequence
  chemically synthesized
aggtcaggagttcgagaccagc

SEQ ID NO: 1266600 - DNA, 22 bp, Artificial Sequence
  chemically synthesized
tggtcaggctggtctcgaactc

SEQ ID NO: 1266601 - DNA, 22 bp, Artificial Sequence
  chemically synthesized
ggtcaggctggtctcgaactcc

SEQ ID NO: 1266602 - DNA, 22 bp, Artificial Sequence
  chemically synthesized
gtcaggctggtctcgaactcct

SEQ ID NO: 1266603 - DNA, 22 bp, Artificial Sequence
  chemically synthesized
gtctcgaactcctgacctcagg

SEQ ID NO: 1266604 - DNA, 22 bp, Artificial Sequence
  chemically synthesized
gaactcctgacctcaggtgatc

SEQ ID NO: 1266605 - DNA, 22 bp, Artificial Sequence
  chemically synthesized
ggaggccgaggcaggcagatca

SEQ ID NO: 1266606 - DNA, 22 bp, Artificial Sequence
  chemically synthesized
ctgacctcaggtgatctgcctg

SEQ ID NO: 1266607 - DNA, 22 bp, Artificial Sequence
  chemically synthesized
gggaggccgaggcaggcagatc

SEQ ID NO: 1266608 - DNA, 22 bp, Artificial Sequence
  chemically synthesized
tgggaggccgaggcaggcagat

SEQ ID NO: 1266609 - DNA, 22 bp, Artificial Sequence
  chemically synthesized
acctcaggtgatctgcctgcct

SEQ ID NO: 1266610 - DNA, 22 bp, Artificial Sequence
  chemically synthesized
aggtgatctgcctgcctcggcc

SEQ ID NO: 1266611 - DNA, 22 bp, Artificial Sequence
  chemically synthesized
taaatcccaacactttgggagg

SEQ ID NO: 1266612 - DNA, 22 bp, Artificial Sequence
  chemically synthesized
cctgcctcggcctcccaaagtg

SEQ ID NO: 1266613 - DNA, 22 bp, Artificial Sequence
  chemically synthesized
cctcggcctcccaaagtgttgg

SEQ ID NO: 1266614 - DNA, 22 bp, Artificial Sequence
  chemically synthesized
acgcctgtaaatcccaacactt

SEQ ID NO: 1266615 - DNA, 22 bp, Artificial Sequence
  chemically synthesized
ggcctcccaaagtgttgggatt

SEQ ID NO: 1266616 - DNA, 22 bp, Artificial Sequence
  chemically synthesized
ccaaagtgttgggatttacagg

SEQ ID NO: 1266617 - DNA, 22 bp, Artificial Sequence
  chemically synthesized
ggcgcggtggctcacgcctgta

SEQ ID NO: 1266618 - DNA, 22 bp, Artificial Sequence
  chemically synthesized
ggatttacaggcgtgagccacc

SEQ ID NO: 1266619 - DNA, 22 bp, Artificial Sequence
  chemically synthesized
acaggcgtgagccaccgcgccc

SEQ ID NO: 1266620 - DNA, 22 bp, Artificial Sequence
  chemically synthesized
caggcgtgagccaccgcgccca

SEQ ID NO: 1266621 - DNA, 22 bp, Artificial Sequence
  chemically synthesized
agagatacaagtaagctgggcg

SEQ ID NO: 1266622 - DNA, 22 bp, Artificial Sequence
  chemically synthesized
tgatgggattaagagatacaag

SEQ ID NO: 1266623 - DNA, 22 bp, Artificial Sequence
  chemically synthesized
atgatgggattaagagatacaa

SEQ ID NO: 1266624 - DNA, 22 bp, Artificial Sequence
  chemically synthesized
tatgatgggattaagagataca

SEQ ID NO: 1266625 - DNA, 22 bp, Artificial Sequence
  chemically synthesized
acttgtatctcttaatcccatc

SEQ ID NO: 1266626 - DNA, 22 bp, Artificial Sequence
  chemically synthesized
cttgtatctcttaatcccatca

SEQ ID NO: 1266627 - DNA, 22 bp, Artificial Sequence
  chemically synthesized
gtatctcttaatcccatcataa

SEQ ID NO: 1266628 - DNA, 22 bp, Artificial Sequence
  chemically synthesized
tatctcttaatcccatcataaa

SEQ ID NO: 1266629 - DNA, 22 bp, Artificial Sequence
  chemically synthesized
ttaatcccatcataaaggggca

SEQ ID NO: 1266630 - DNA, 22 bp, Artificial Sequence
  chemically synthesized
aagtaataggatatgccccttt

SEQ ID NO: 1266631 - DNA, 22 bp, Artificial Sequence
  chemically synthesized
aatcccatcataaaggggcata

SEQ ID NO: 1266632 - DNA, 22 bp, Artificial Sequence
  chemically synthesized
aaagtaataggatatgcccctt

SEQ ID NO: 1266633 - DNA, 22 bp, Artificial Sequence
  chemically synthesized
atcccatcataaaggggcatat

SEQ ID NO: 1266634 - DNA, 22 bp, Artificial Sequence
  chemically synthesized
taaagtaataggatatgcccct

SEQ ID NO: 1266635 - DNA, 22 bp, Artificial Sequence
  chemically synthesized
ttaaagtaataggatatgcccc

SEQ ID NO: 1266636 - DNA, 22 bp, Artificial Sequence
  chemically synthesized
gcttttaaagtaataggatatg

SEQ ID NO: 1266637 - DNA, 22 bp, Artificial Sequence
  chemically synthesized
ttggcttttaaagtaataggat

SEQ ID NO: 1266638 - DNA, 22 bp, Artificial Sequence
  chemically synthesized
ttactttaaaagccaacaattc

SEQ ID NO: 1266639 - DNA, 22 bp, Artificial Sequence
  chemically synthesized
ctttaaaagccaacaattccct

SEQ ID NO: 1266640 - DNA, 22 bp, Artificial Sequence
  chemically synthesized
taaaagccaacaattccctctc

SEQ ID NO: 1266641 - DNA, 22 bp, Artificial Sequence
  chemically synthesized
aaaagccaacaattccctctca

SEQ ID NO: 1266642 - DNA, 22 bp, Artificial Sequence
  chemically synthesized
aaagccaacaattccctctcat

SEQ ID NO: 1266643 - DNA, 22 bp, Artificial Sequence
  chemically synthesized
atggtgaatgaaaatgagaggg

SEQ ID NO: 1266644 - DNA, 22 bp, Artificial Sequence
  chemically synthesized
cctctcattttcattcaccatg

SEQ ID NO: 1266645 - DNA, 22 bp, Artificial Sequence
  chemically synthesized
tcattttcattcaccatgagtt

SEQ ID NO: 1266646 - DNA, 22 bp, Artificial Sequence
  chemically synthesized
aggagtagtagtaactcatggt

SEQ ID NO: 1266647 - DNA, 22 bp, Artificial Sequence
  chemically synthesized
caggagtagtagtaactcatgg

SEQ ID NO: 1266648 - DNA, 22 bp, Artificial Sequence
  chemically synthesized
attttcattcaccatgagttac

SEQ ID NO: 1266649 - DNA, 22 bp, Artificial Sequence
  chemically synthesized
tcattcaccatgagttactact

SEQ ID NO: 1266650 - DNA, 22 bp, Artificial Sequence
  chemically synthesized
cattcaccatgagttactacta

SEQ ID NO: 1266651 - DNA, 22 bp, Artificial Sequence
  chemically synthesized
attcaccatgagttactactac

SEQ ID NO: 1266652 - DNA, 22 bp, Artificial Sequence
  chemically synthesized
tgaaggtttcaggagtagtagt

SEQ ID NO: 1266653 - DNA, 22 bp, Artificial Sequence
  chemically synthesized
gtgaaggtttcaggagtagtag

SEQ ID NO: 1266654 - DNA, 22 bp, Artificial Sequence
  chemically synthesized
accatgagttactactactcct

SEQ ID NO: 1266655 - DNA, 22 bp, Artificial Sequence
  chemically synthesized
tgtgaaggtttcaggagtagta

SEQ ID NO: 1266656 - DNA, 22 bp, Artificial Sequence
  chemically synthesized
ggaaactttgtgaaggtttcag

SEQ ID NO: 1266657 - DNA, 22 bp, Artificial Sequence
  chemically synthesized
tgggaaactttgtgaaggtttc

SEQ ID NO: 1266658 - DNA, 22 bp, Artificial Sequence
  chemically synthesized
ctactactcctgaaaccttcac

SEQ ID NO: 1266659 - DNA, 22 bp, Artificial Sequence
  chemically synthesized
ctgggaaactttgtgaaggttt

SEQ ID NO: 1266660 - DNA, 22 bp, Artificial Sequence
  chemically synthesized
ctactcctgaaaccttcacaaa

SEQ ID NO: 1266661 - DNA, 22 bp, Artificial Sequence
  chemically synthesized
tttctgggaaactttgtgaagg

SEQ ID NO: 1266662 - DNA, 22 bp, Artificial Sequence
  chemically synthesized
ctcctgaaaccttcacaaagtt

SEQ ID NO: 1266663 - DNA, 22 bp, Artificial Sequence
  chemically synthesized
tcctgtttctgggaaactttgt

SEQ ID NO: 1266664 - DNA, 22 bp, Artificial Sequence
  chemically synthesized
ctgaaaccttcacaaagtttcc

SEQ ID NO: 1266665 - DNA, 22 bp, Artificial Sequence
  chemically synthesized
aaaccttcacaaagtttcccag

SEQ ID NO: 1266666 - DNA, 22 bp, Artificial Sequence
  chemically synthesized
cacaaagtttcccagaaacagg

SEQ ID NO: 1266667 - DNA, 22 bp, Artificial Sequence
  chemically synthesized
ggagtgggctgtcctgtttctg

SEQ ID NO: 1266668 - DNA, 22 bp, Artificial Sequence
  chemically synthesized
acaaagtttcccagaaacagga

SEQ ID NO: 1266669 - DNA, 22 bp, Artificial Sequence
  chemically synthesized
cccagaaacaggacagcccact

SEQ ID NO: 1266670 - DNA, 22 bp, Artificial Sequence
  chemically synthesized
ccagaaacaggacagcccactc

SEQ ID NO: 1266671 - DNA, 22 bp, Artificial Sequence
  chemically synthesized
ctagcccatgggcctcttccct

SEQ ID NO: 1266672 - DNA, 22 bp, Artificial Sequence
  chemically synthesized
gcccatgggcctcttcccttcc

SEQ ID NO: 1266673 - DNA, 22 bp, Artificial Sequence
  chemically synthesized
ttcccttcctcatttcttaccc

SEQ ID NO: 1266674 - DNA, 22 bp, Artificial Sequence
  chemically synthesized
cccttcctcatttcttaccctt

SEQ ID NO: 1266675 - DNA, 22 bp, Artificial Sequence
  chemically synthesized
ccttcctcatttcttacccttt

SEQ ID NO: 1266676 - DNA, 22 bp, Artificial Sequence
  chemically synthesized
cctcatttcttacccttttctt

SEQ ID NO: 1266677 - DNA, 22 bp, Artificial Sequence
  chemically synthesized
ctcatttcttacccttttcttc

SEQ ID NO: 1266678 - DNA, 22 bp, Artificial Sequence
  chemically synthesized
atttcttacccttttcttcctc

SEQ ID NO: 1266679 - DNA, 22 bp, Artificial Sequence
  chemically synthesized
aagaaaaaaagcagggaggaag

SEQ ID NO: 1266680 - DNA, 22 bp, Artificial Sequence
  chemically synthesized
cttacccttttcttcctccctg

SEQ ID NO: 1266681 - DNA, 22 bp, Artificial Sequence
  chemically synthesized
caagaaaaaaagcagggaggaa

SEQ ID NO: 1266682 - DNA, 22 bp, Artificial Sequence
  chemically synthesized
ttacccttttcttcctccctgc

SEQ ID NO: 1266683 - DNA, 22 bp, Artificial Sequence
  chemically synthesized
acccttttcttcctccctgctt

SEQ ID NO: 1266684 - DNA, 22 bp, Artificial Sequence
  chemically synthesized
tttcaagaaaaaaagcagggag

SEQ ID NO: 1266685 - DNA, 22 bp, Artificial Sequence
  chemically synthesized
cccttttcttcctccctgcttt

SEQ ID NO: 1266686 - DNA, 22 bp, Artificial Sequence
  chemically synthesized
atttcaagaaaaaaagcaggga

SEQ ID NO: 1266687 - DNA, 22 bp, Artificial Sequence
  chemically synthesized
tatttcaagaaaaaaagcaggg

SEQ ID NO: 1266688 - DNA, 22 bp, Artificial Sequence
  chemically synthesized
ttcttcctccctgctttttttc

SEQ ID NO: 1266689 - DNA, 22 bp, Artificial Sequence
  chemically synthesized
tcttcctccctgctttttttct

SEQ ID NO: 1266690 - DNA, 22 bp, Artificial Sequence
  chemically synthesized
cttcctccctgctttttttctt

SEQ ID NO: 1266691 - DNA, 22 bp, Artificial Sequence
  chemically synthesized
ttcctccctgctttttttcttg

SEQ ID NO: 1266692 - DNA, 22 bp, Artificial Sequence
  chemically synthesized
cctccctgctttttttcttgaa

SEQ ID NO: 1266693 - DNA, 22 bp, Artificial Sequence
  chemically synthesized
gggaaattttatttcaagaaaa

SEQ ID NO: 1266694 - DNA, 22 bp, Artificial Sequence
  chemically synthesized
ctccctgctttttttcttgaaa

SEQ ID NO: 1266695 - DNA, 22 bp, Artificial Sequence
  chemically synthesized
ggggaaattttatttcaagaaa

SEQ ID NO: 1266696 - DNA, 22 bp, Artificial Sequence
  chemically synthesized
tggggaaattttatttcaagaa

SEQ ID NO: 1266697 - DNA, 22 bp, Artificial Sequence
  chemically synthesized
ttggggaaattttatttcaaga

SEQ ID NO: 1266698 - DNA, 22 bp, Artificial Sequence
  chemically synthesized
cctgctttttttcttgaaataa

SEQ ID NO: 1266699 - DNA, 22 bp, Artificial Sequence
  chemically synthesized
gcttttggggaaattttatttc

SEQ ID NO: 1266700 - DNA, 22 bp, Artificial Sequence
  chemically synthesized
ctttttttcttgaaataaaatt

SEQ ID NO: 1266701 - DNA, 22 bp, Artificial Sequence
  chemically synthesized
tttttcttgaaataaaatttcc

SEQ ID NO: 1266702 - DNA, 22 bp, Artificial Sequence
  chemically synthesized
ttttcttgaaataaaatttccc

SEQ ID NO: 1266703 - DNA, 22 bp, Artificial Sequence
  chemically synthesized
tttcttgaaataaaatttcccc

SEQ ID NO: 1266704 - DNA, 22 bp, Artificial Sequence
  chemically synthesized
ttcttgaaataaaatttcccca

SEQ ID NO: 1266705 - DNA, 22 bp, Artificial Sequence
  chemically synthesized
tcttgaaataaaatttccccaa

SEQ ID NO: 1266706 - DNA, 22 bp, Artificial Sequence
  chemically synthesized
cttgaaataaaatttccccaaa

SEQ ID NO: 1266707 - DNA, 22 bp, Artificial Sequence
  chemically synthesized
ttgaaataaaatttccccaaaa

SEQ ID NO: 1266708 - DNA, 22 bp, Artificial Sequence
  chemically synthesized
gaaataaaatttccccaaaagc

SEQ ID NO: 1266709 - DNA, 22 bp, Artificial Sequence
  chemically synthesized
aaataaaatttccccaaaagct

SEQ ID NO: 1266710 - DNA, 22 bp, Artificial Sequence
  chemically synthesized
cagtggcagactagcttttggg

SEQ ID NO: 1266711 - DNA, 22 bp, Artificial Sequence
  chemically synthesized
gcagtggcagactagcttttgg

SEQ ID NO: 1266712 - DNA, 22 bp, Artificial Sequence
  chemically synthesized
ccccaaaagctagtctgccact

SEQ ID NO: 1266713 - DNA, 22 bp, Artificial Sequence
  chemically synthesized
cccaaaagctagtctgccactg

SEQ ID NO: 1266714 - DNA, 22 bp, Artificial Sequence
  chemically synthesized
aggatgtgcttgcagtggcaga

SEQ ID NO: 1266715 - DNA, 22 bp, Artificial Sequence
  chemically synthesized
tctgaggatgtgcttgcagtgg

SEQ ID NO: 1266716 - DNA, 22 bp, Artificial Sequence
  chemically synthesized
gtctgccactgcaagcacatcc

SEQ ID NO: 1266717 - DNA, 22 bp, Artificial Sequence
  chemically synthesized
tccagttatctgaggatgtgct

SEQ ID NO: 1266718 - DNA, 22 bp, Artificial Sequence
  chemically synthesized
atccagttatctgaggatgtgc

SEQ ID NO: 1266719 - DNA, 22 bp, Artificial Sequence
  chemically synthesized
tatccagttatctgaggatgtg

SEQ ID NO: 1266720 - DNA, 22 bp, Artificial Sequence
  chemically synthesized
ccactgcaagcacatcctcaga

SEQ ID NO: 1266721 - DNA, 22 bp, Artificial Sequence
  chemically synthesized
ctttatccagttatctgaggat

SEQ ID NO: 1266722 - DNA, 22 bp, Artificial Sequence
  chemically synthesized
cctttatccagttatctgagga

SEQ ID NO: 1266723 - DNA, 22 bp, Artificial Sequence
  chemically synthesized
caagcacatcctcagataactg

SEQ ID NO: 1266724 - DNA, 22 bp, Artificial Sequence
  chemically synthesized
tcttcctttatccagttatctg

SEQ ID NO: 1266725 - DNA, 22 bp, Artificial Sequence
  chemically synthesized
tgccacattatcttcctttatc

SEQ ID NO: 1266726 - DNA, 22 bp, Artificial Sequence
  chemically synthesized
tgtgccacattatcttccttta

SEQ ID NO: 1266727 - DNA, 22 bp, Artificial Sequence
  chemically synthesized
agataactggataaaggaagat

SEQ ID NO: 1266728 - DNA, 22 bp, Artificial Sequence
  chemically synthesized
ctctgtgccacattatcttcct

SEQ ID NO: 1266729 - DNA, 22 bp, Artificial Sequence
  chemically synthesized
gataaaggaagataatgtggca

SEQ ID NO: 1266730 - DNA, 22 bp, Artificial Sequence
  chemically synthesized
gaagtatccccagactcctctg

SEQ ID NO: 1266731 - DNA, 22 bp, Artificial Sequence
  chemically synthesized
gctagaagtatccccagactcc

SEQ ID NO: 1266732 - DNA, 22 bp, Artificial Sequence
  chemically synthesized
ggctagaagtatccccagactc

SEQ ID NO: 1266733 - DNA, 22 bp, Artificial Sequence
  chemically synthesized
tttggctagaagtatccccaga

SEQ ID NO: 1266734 - DNA, 22 bp, Artificial Sequence
  chemically synthesized
tggcacaaaaactatttggcta

SEQ ID NO: 1266735 - DNA, 22 bp, Artificial Sequence
  chemically synthesized
gggatacttctagccaaatagt

SEQ ID NO: 1266736 - DNA, 22 bp, Artificial Sequence
  chemically synthesized
ttatggcacaaaaactatttgg

SEQ ID NO: 1266737 - DNA, 22 bp, Artificial Sequence
  chemically synthesized
ctagccaaatagtttttgtgcc

SEQ ID NO: 1266738 - DNA, 22 bp, Artificial Sequence
  chemically synthesized
tagccaaatagtttttgtgcca

SEQ ID NO: 1266739 - DNA, 22 bp, Artificial Sequence
  chemically synthesized
gccaaatagtttttgtgccata

SEQ ID NO: 1266740 - DNA, 22 bp, Artificial Sequence
  chemically synthesized
tcataaagattattatggcaca

SEQ ID NO: 1266741 - DNA, 22 bp, Artificial Sequence
  chemically synthesized
ctgtcataaagattattatggc

SEQ ID NO: 1266742 - DNA, 22 bp, Artificial Sequence
  chemically synthesized
ttgtgccataataatctttatg

SEQ ID NO: 1266743 - DNA, 22 bp, Artificial Sequence
  chemically synthesized
tgtgccataataatctttatga

SEQ ID NO: 1266744 - DNA, 22 bp, Artificial Sequence
  chemically synthesized
aggatcctactgtcataaagat

SEQ ID NO: 1266745 - DNA, 22 bp, Artificial Sequence
  chemically synthesized
gtgccataataatctttatgac

SEQ ID NO: 1266746 - DNA, 22 bp, Artificial Sequence
  chemically synthesized
caggatcctactgtcataaaga

SEQ ID NO: 1266747 - DNA, 22 bp, Artificial Sequence
  chemically synthesized
tgccataataatctttatgaca

SEQ ID NO: 1266748 - DNA, 22 bp, Artificial Sequence
  chemically synthesized
ggtaacatttcaggatcctact

SEQ ID NO: 1266749 - DNA, 22 bp, Artificial Sequence
  chemically synthesized
taggtaacatttcaggatccta

SEQ ID NO: 1266750 - DNA, 22 bp, Artificial Sequence
  chemically synthesized
tatgacagtaggatcctgaaat

SEQ ID NO: 1266751 - DNA, 22 bp, Artificial Sequence
  chemically synthesized
atgacagtaggatcctgaaatg

SEQ ID NO: 1266752 - DNA, 22 bp, Artificial Sequence
  chemically synthesized
tgacagtaggatcctgaaatgt

SEQ ID NO: 1266753 - DNA, 22 bp, Artificial Sequence
  chemically synthesized
ggcacaagtgttctaggtaaca

SEQ ID NO: 1266754 - DNA, 22 bp, Artificial Sequence
  chemically synthesized
ggactaggcacaagtgttctag

SEQ ID NO: 1266755 - DNA, 22 bp, Artificial Sequence
  chemically synthesized
aaatgttacctagaacacttgt

SEQ ID NO: 1266756 - DNA, 22 bp, Artificial Sequence
  chemically synthesized
cctagaacacttgtgcctagtc

SEQ ID NO: 1266757 - DNA, 22 bp, Artificial Sequence
  chemically synthesized
gaacacttgtgcctagtcccaa

SEQ ID NO: 1266758 - DNA, 22 bp, Artificial Sequence
  chemically synthesized
tcccaccagaaattgggactag

SEQ ID NO: 1266759 - DNA, 22 bp, Artificial Sequence
  chemically synthesized
atcccaccagaaattgggacta

SEQ ID NO: 1266760 - DNA, 22 bp, Artificial Sequence
  chemically synthesized
tatcccaccagaaattgggact

SEQ ID NO: 1266761 - DNA, 22 bp, Artificial Sequence
  chemically synthesized
gtgcctagtcccaatttctggt

SEQ ID NO: 1266762 - DNA, 22 bp, Artificial Sequence
  chemically synthesized
tgcctagtcccaatttctggtg

SEQ ID NO: 1266763 - DNA, 22 bp, Artificial Sequence
  chemically synthesized
tatacagttttatcccaccaga

SEQ ID NO: 1266764 - DNA, 22 bp, Artificial Sequence
  chemically synthesized
atatacagttttatcccaccag

SEQ ID NO: 1266765 - DNA, 22 bp, Artificial Sequence
  chemically synthesized
gtcccaatttctggtgggataa

SEQ ID NO: 1266766 - DNA, 22 bp, Artificial Sequence
  chemically synthesized
ccttatatacagttttatccca

SEQ ID NO: 1266767 - DNA, 22 bp, Artificial Sequence
  chemically synthesized
ctggtgggataaaactgtatat

SEQ ID NO: 1266768 - DNA, 22 bp, Artificial Sequence
  chemically synthesized
tggtgggataaaactgtatata

SEQ ID NO: 1266769 - DNA, 22 bp, Artificial Sequence
  chemically synthesized
taatgattcccttatatacagt

SEQ ID NO: 1266770 - DNA, 22 bp, Artificial Sequence
  chemically synthesized
gtgggataaaactgtatataag

SEQ ID NO: 1266771 - DNA, 22 bp, Artificial Sequence
  chemically synthesized
agacgcaagcacctgtaatgat

SEQ ID NO: 1266772 - DNA, 22 bp, Artificial Sequence
  chemically synthesized
tatataagggaatcattacagg

SEQ ID NO: 1266773 - DNA, 22 bp, Artificial Sequence
  chemically synthesized
caggtgcttgcgtctgagacac

SEQ ID NO: 1266774 - DNA, 22 bp, Artificial Sequence
  chemically synthesized
aatcatagccagaagtgtctca

SEQ ID NO: 1266775 - DNA, 22 bp, Artificial Sequence
  chemically synthesized
gcgtctgagacacttctggcta

SEQ ID NO: 1266776 - DNA, 22 bp, Artificial Sequence
  chemically synthesized
cgtctgagacacttctggctat

SEQ ID NO: 1266777 - DNA, 22 bp, Artificial Sequence
  chemically synthesized
agacacttctggctatgattga

SEQ ID NO: 1266778 - DNA, 22 bp, Artificial Sequence
  chemically synthesized
ataatgtgtaggagactcaatc

SEQ ID NO: 1266779 - DNA, 22 bp, Artificial Sequence
  chemically synthesized
gataatgtgtaggagactcaat

SEQ ID NO: 1266780 - DNA, 22 bp, Artificial Sequence
  chemically synthesized
tgataatgtgtaggagactcaa

SEQ ID NO: 1266781 - DNA, 22 bp, Artificial Sequence
  chemically synthesized
ttgataatgtgtaggagactca

SEQ ID NO: 1266782 - DNA, 22 bp, Artificial Sequence
  chemically synthesized
ctggctatgattgagtctccta

SEQ ID NO: 1266783 - DNA, 22 bp, Artificial Sequence
  chemically synthesized
tttgataatgtgtaggagactc

SEQ ID NO: 1266784 - DNA, 22 bp, Artificial Sequence
  chemically synthesized
tggctatgattgagtctcctac

SEQ ID NO: 1266785 - DNA, 22 bp, Artificial Sequence
  chemically synthesized
gctatgattgagtctcctacac

SEQ ID NO: 1266786 - DNA, 22 bp, Artificial Sequence
  chemically synthesized
tgattgagtctcctacacatta

SEQ ID NO: 1266787 - DNA, 22 bp, Artificial Sequence
  chemically synthesized
cacgttttttgataatgtgtag

SEQ ID NO: 1266788 - DNA, 22 bp, Artificial Sequence
  chemically synthesized
agtctcctacacattatcaaaa

SEQ ID NO: 1266789 - DNA, 22 bp, Artificial Sequence
  chemically synthesized
aagcattacacgttttttgata

SEQ ID NO: 1266790 - DNA, 22 bp, Artificial Sequence
  chemically synthesized
ttaaagcattacacgttttttg

SEQ ID NO: 1266791 - DNA, 22 bp, Artificial Sequence
  chemically synthesized
ctacacattatcaaaaaacgtg

SEQ ID NO: 1266792 - DNA, 22 bp, Artificial Sequence
  chemically synthesized
ttattaaagcattacacgtttt

SEQ ID NO: 1266793 - DNA, 22 bp, Artificial Sequence
  chemically synthesized
cacattatcaaaaaacgtgtaa

SEQ ID NO: 1266794 - DNA, 22 bp, Artificial Sequence
  chemically synthesized
gttattaaagcattacacgttt

SEQ ID NO: 1266795 - DNA, 22 bp, Artificial Sequence
  chemically synthesized
tgttattaaagcattacacgtt

SEQ ID NO: 1266796 - DNA, 22 bp, Artificial Sequence
  chemically synthesized
ttgttattaaagcattacacgt

SEQ ID NO: 1266797 - DNA, 22 bp, Artificial Sequence
  chemically synthesized
cttttgttattaaagcattaca

SEQ ID NO: 1266798 - DNA, 22 bp, Artificial Sequence
  chemically synthesized
acttttgttattaaagcattac

SEQ ID NO: 1266799 - DNA, 22 bp, Artificial Sequence
  chemically synthesized
tcaaaaaacgtgtaatgcttta

SEQ ID NO: 1266800 - DNA, 22 bp, Artificial Sequence
  chemically synthesized
atttacttttgttattaaagca

SEQ ID NO: 1266801 - DNA, 22 bp, Artificial Sequence
  chemically synthesized
catttacttttgttattaaagc

SEQ ID NO: 1266802 - DNA, 22 bp, Artificial Sequence
  chemically synthesized
tcatttacttttgttattaaag

SEQ ID NO: 1266803 - DNA, 22 bp, Artificial Sequence
  chemically synthesized
aggattttcatttacttttgtt

SEQ ID NO: 1266804 - DNA, 22 bp, Artificial Sequence
  chemically synthesized
gaggattttcatttacttttgt

SEQ ID NO: 1266805 - DNA, 22 bp, Artificial Sequence
  chemically synthesized
tgaggattttcatttacttttg

SEQ ID NO: 1266806 - DNA, 22 bp, Artificial Sequence
  chemically synthesized
ctttgaggattttcatttactt

SEQ ID NO: 1266807 - DNA, 22 bp, Artificial Sequence
  chemically synthesized
taataacaaaagtaaatgaaaa

SEQ ID NO: 1266808 - DNA, 22 bp, Artificial Sequence
  chemically synthesized
aataacaaaagtaaatgaaaat

SEQ ID NO: 1266809 - DNA, 22 bp, Artificial Sequence
  chemically synthesized
actcctttgaggattttcattt

SEQ ID NO: 1266810 - DNA, 22 bp, Artificial Sequence
  chemically synthesized
ataacaaaagtaaatgaaaatc

SEQ ID NO: 1266811 - DNA, 22 bp, Artificial Sequence
  chemically synthesized
gcatattaactcctttgaggat

SEQ ID NO: 1266812 - DNA, 22 bp, Artificial Sequence
  chemically synthesized
tgtacattagcatattaactcc

SEQ ID NO: 1266813 - DNA, 22 bp, Artificial Sequence
  chemically synthesized
aaaggagttaatatgctaatgt

SEQ ID NO: 1266814 - DNA, 22 bp, Artificial Sequence
  chemically synthesized
taaagtgactatgtacattagc

SEQ ID NO: 1266815 - DNA, 22 bp, Artificial Sequence
  chemically synthesized
ataaagtgactatgtacattag

SEQ ID NO: 1266816 - DNA, 22 bp, Artificial Sequence
  chemically synthesized
ttataaagtgactatgtacatt

SEQ ID NO: 1266817 - DNA, 22 bp, Artificial Sequence
  chemically synthesized
atatgctaatgtacatagtcac

SEQ ID NO: 1266818 - DNA, 22 bp, Artificial Sequence
  chemically synthesized
ccctcttataaagtgactatgt

SEQ ID NO: 1266819 - DNA, 22 bp, Artificial Sequence
  chemically synthesized
cactaccctcttataaagtgac

SEQ ID NO: 1266820 - DNA, 22 bp, Artificial Sequence
  chemically synthesized
acactaccctcttataaagtga

SEQ ID NO: 1266821 - DNA, 22 bp, Artificial Sequence
  chemically synthesized
atgtacatagtcactttataag

SEQ ID NO: 1266822 - DNA, 22 bp, Artificial Sequence
  chemically synthesized
cttacactaccctcttataaag

SEQ ID NO: 1266823 - DNA, 22 bp, Artificial Sequence
  chemically synthesized
gcttacactaccctcttataaa

SEQ ID NO: 1266824 - DNA, 22 bp, Artificial Sequence
  chemically synthesized
tataagagggtagtgtaagcaa

SEQ ID NO: 1266825 - DNA, 22 bp, Artificial Sequence
  chemically synthesized
atgtgggataatttgcttacac

SEQ ID NO: 1266826 - DNA, 22 bp, Artificial Sequence
  chemically synthesized
ataagagggtagtgtaagcaaa

SEQ ID NO: 1266827 - DNA, 22 bp, Artificial Sequence
  chemically synthesized
taagagggtagtgtaagcaaat

SEQ ID NO: 1266828 - DNA, 22 bp, Artificial Sequence
  chemically synthesized
agttaatgtgggataatttgct

SEQ ID NO: 1266829 - DNA, 22 bp, Artificial Sequence
  chemically synthesized
attgagttaatgtgggataatt

SEQ ID NO: 1266830 - DNA, 22 bp, Artificial Sequence
  chemically synthesized
tgattgagttaatgtgggataa

SEQ ID NO: 1266831 - DNA, 22 bp, Artificial Sequence
  chemically synthesized
ccgggactctgattgagttaat

SEQ ID NO: 1266832 - DNA, 22 bp, Artificial Sequence
  chemically synthesized
taccgggactctgattgagtta

SEQ ID NO: 1266833 - DNA, 22 bp, Artificial Sequence
  chemically synthesized
ctaccgggactctgattgagtt

SEQ ID NO: 1266834 - DNA, 22 bp, Artificial Sequence
  chemically synthesized
tcccacattaactcaatcagag

SEQ ID NO: 1266835 - DNA, 22 bp, Artificial Sequence
  chemically synthesized
cagtttctaccgggactctgat

SEQ ID NO: 1266836 - DNA, 22 bp, Artificial Sequence
  chemically synthesized
actcaatcagagtcccggtaga

SEQ ID NO: 1266837 - DNA, 22 bp, Artificial Sequence
  chemically synthesized
aatcagagtcccggtagaaact

SEQ ID NO: 1266838 - DNA, 22 bp, Artificial Sequence
  chemically synthesized
agaaatcaatcctccagtttct

SEQ ID NO: 1266839 - DNA, 22 bp, Artificial Sequence
  chemically synthesized
acataccccgagattgagaaat

SEQ ID NO: 1266840 - DNA, 22 bp, Artificial Sequence
  chemically synthesized
gaggattgatttctcaatctcg

SEQ ID NO: 1266841 - DNA, 22 bp, Artificial Sequence
  chemically synthesized
gcctcacataccccgagattga

SEQ ID NO: 1266842 - DNA, 22 bp, Artificial Sequence
  chemically synthesized
atttctcaatctcggggtatgt

SEQ ID NO: 1266843 - DNA, 22 bp, Artificial Sequence
  chemically synthesized
gcaaactggcctcacatacccc

SEQ ID NO: 1266844 - DNA, 22 bp, Artificial Sequence
  chemically synthesized
agcaaactggcctcacataccc

SEQ ID NO: 1266845 - DNA, 22 bp, Artificial Sequence
  chemically synthesized
tagcaaactggcctcacatacc

SEQ ID NO: 1266846 - DNA, 22 bp, Artificial Sequence
  chemically synthesized
ctcaatctcggggtatgtgagg

SEQ ID NO: 1266847 - DNA, 22 bp, Artificial Sequence
  chemically synthesized
tcaatctcggggtatgtgaggc

SEQ ID NO: 1266848 - DNA, 22 bp, Artificial Sequence
  chemically synthesized
aatctcggggtatgtgaggcca

SEQ ID NO: 1266849 - DNA, 22 bp, Artificial Sequence
  chemically synthesized
ggggtatgtgaggccagtttgc

SEQ ID NO: 1266850 - DNA, 22 bp, Artificial Sequence
  chemically synthesized
ataacccctttagcaaactggc

SEQ ID NO: 1266851 - DNA, 22 bp, Artificial Sequence
  chemically synthesized
ttgataacccctttagcaaact

SEQ ID NO: 1266852 - DNA, 22 bp, Artificial Sequence
  chemically synthesized
tgttgataacccctttagcaaa

SEQ ID NO: 1266853 - DNA, 22 bp, Artificial Sequence
  chemically synthesized
agcatatctctgttgataaccc

SEQ ID NO: 1266854 - DNA, 22 bp, Artificial Sequence
  chemically synthesized
gctaaaggggttatcaacagag

SEQ ID NO: 1266855 - DNA, 22 bp, Artificial Sequence
  chemically synthesized
ctaaaggggttatcaacagaga

SEQ ID NO: 1266856 - DNA, 22 bp, Artificial Sequence
  chemically synthesized
acactgagcatatctctgttga

SEQ ID NO: 1266857 - DNA, 22 bp, Artificial Sequence
  chemically synthesized
aaggggttatcaacagagatat

SEQ ID NO: 1266858 - DNA, 22 bp, Artificial Sequence
  chemically synthesized
ctaacactgagcatatctctgt

SEQ ID NO: 1266859 - DNA, 22 bp, Artificial Sequence
  chemically synthesized
cctaacactgagcatatctctg

SEQ ID NO: 1266860 - DNA, 22 bp, Artificial Sequence
  chemically synthesized
aatttcctaacactgagcatat

SEQ ID NO: 1266861 - DNA, 22 bp, Artificial Sequence
  chemically synthesized
gaatttcctaacactgagcata

SEQ ID NO: 1266862 - DNA, 22 bp, Artificial Sequence
  chemically synthesized
tcaacagagatatgctcagtgt

SEQ ID NO: 1266863 - DNA, 22 bp, Artificial Sequence
  chemically synthesized
ttgaatttcctaacactgagca

SEQ ID NO: 1266864 - DNA, 22 bp, Artificial Sequence
  chemically synthesized
cttgaatttcctaacactgagc

SEQ ID NO: 1266865 - DNA, 22 bp, Artificial Sequence
  chemically synthesized
cgtcatcccttcttgaatttcc

SEQ ID NO: 1266866 - DNA, 22 bp, Artificial Sequence
  chemically synthesized
tccgtcatcccttcttgaattt

SEQ ID NO: 1266867 - DNA, 22 bp, Artificial Sequence
  chemically synthesized
agtgttaggaaattcaagaagg

SEQ ID NO: 1266868 - DNA, 22 bp, Artificial Sequence
  chemically synthesized
actctccgtcatcccttcttga

SEQ ID NO: 1266869 - DNA, 22 bp, Artificial Sequence
  chemically synthesized
ggaaattcaagaagggatgacg

SEQ ID NO: 1266870 - DNA, 22 bp, Artificial Sequence
  chemically synthesized
cagttaactctccgtcatccct

SEQ ID NO: 1266871 - DNA, 22 bp, Artificial Sequence
  chemically synthesized
aggtctacagttaactctccgt

SEQ ID NO: 1266872 - DNA, 22 bp, Artificial Sequence
  chemically synthesized
aagaagggatgacggagagtta

SEQ ID NO: 1266873 - DNA, 22 bp, Artificial Sequence
  chemically synthesized
gaggtctacagttaactctccg

SEQ ID NO: 1266874 - DNA, 22 bp, Artificial Sequence
  chemically synthesized
acccttgaggtctacagttaac

SEQ ID NO: 1266875 - DNA, 22 bp, Artificial Sequence
  chemically synthesized
aacccttgaggtctacagttaa

SEQ ID NO: 1266876 - DNA, 22 bp, Artificial Sequence
  chemically synthesized
ttaacccttgaggtctacagtt

SEQ ID NO: 1266877 - DNA, 22 bp, Artificial Sequence
  chemically synthesized
ctcttaacccttgaggtctaca

SEQ ID NO: 1266878 - DNA, 22 bp, Artificial Sequence
  chemically synthesized
cctcttaacccttgaggtctac

SEQ ID NO: 1266879 - DNA, 22 bp, Artificial Sequence
  chemically synthesized
actgtagacctcaagggttaag

SEQ ID NO: 1266880 - DNA, 22 bp, Artificial Sequence
  chemically synthesized
tagacctcaagggttaagagga

SEQ ID NO: 1266881 - DNA, 22 bp, Artificial Sequence
  chemically synthesized
aggaaacgtccttcctcttaac

SEQ ID NO: 1266882 - DNA, 22 bp, Artificial Sequence
  chemically synthesized
gttcaggaaacgtccttcctct

SEQ ID NO: 1266883 - DNA, 22 bp, Artificial Sequence
  chemically synthesized
tagttcaggaaacgtccttcct

SEQ ID NO: 1266884 - DNA, 22 bp, Artificial Sequence
  chemically synthesized
aagggttaagaggaaggacgtt

SEQ ID NO: 1266885 - DNA, 22 bp, Artificial Sequence
  chemically synthesized
tctagttcaggaaacgtccttc

SEQ ID NO: 1266886 - DNA, 22 bp, Artificial Sequence
  chemically synthesized
gctctctagttcaggaaacgtc

SEQ ID NO: 1266887 - DNA, 22 bp, Artificial Sequence
  chemically synthesized
agaggaaggacgtttcctgaac

SEQ ID NO: 1266888 - DNA, 22 bp, Artificial Sequence
  chemically synthesized
ggtctggctctctagttcagga

SEQ ID NO: 1266889 - DNA, 22 bp, Artificial Sequence
  chemically synthesized
ttgggtctggctctctagttca

SEQ ID NO: 1266890 - DNA, 22 bp, Artificial Sequence
  chemically synthesized
tattgggtctggctctctagtt

SEQ ID NO: 1266891 - DNA, 22 bp, Artificial Sequence
  chemically synthesized
ctattgggtctggctctctagt

SEQ ID NO: 1266892 - DNA, 22 bp, Artificial Sequence
  chemically synthesized
catttctattgggtctggctct

SEQ ID NO: 1266893 - DNA, 22 bp, Artificial Sequence
  chemically synthesized
gcatttctattgggtctggctc

SEQ ID NO: 1266894 - DNA, 22 bp, Artificial Sequence
  chemically synthesized
cctgaactagagagccagaccc

SEQ ID NO: 1266895 - DNA, 22 bp, Artificial Sequence
  chemically synthesized
ctgaactagagagccagaccca

SEQ ID NO: 1266896 - DNA, 22 bp, Artificial Sequence
  chemically synthesized
ttgcatttctattgggtctggc

SEQ ID NO: 1266897 - DNA, 22 bp, Artificial Sequence
  chemically synthesized
tcttgcatttctattgggtctg

SEQ ID NO: 1266898 - DNA, 22 bp, Artificial Sequence
  chemically synthesized
aactagagagccagacccaata

SEQ ID NO: 1266899 - DNA, 22 bp, Artificial Sequence
  chemically synthesized
tctcttgcatttctattgggtc

SEQ ID NO: 1266900 - DNA, 22 bp, Artificial Sequence
  chemically synthesized
gagagccagacccaatagaaat

SEQ ID NO: 1266901 - DNA, 22 bp, Artificial Sequence
  chemically synthesized
gacagttctctcttgcatttct

SEQ ID NO: 1266902 - DNA, 22 bp, Artificial Sequence
  chemically synthesized
ctggacagttctctcttgcatt

SEQ ID NO: 1266903 - DNA, 22 bp, Artificial Sequence
  chemically synthesized
tgctggacagttctctcttgca

SEQ ID NO: 1266904 - DNA, 22 bp, Artificial Sequence
  chemically synthesized
ctgctggacagttctctcttgc

SEQ ID NO: 1266905 - DNA, 22 bp, Artificial Sequence
  chemically synthesized
gaccagagcttctgctggacag

SEQ ID NO: 1266906 - DNA, 22 bp, Artificial Sequence
  chemically synthesized
acattagaccagagcttctgct

SEQ ID NO: 1266907 - DNA, 22 bp, Artificial Sequence
  chemically synthesized
aacagctaacattagaccagag

SEQ ID NO: 1266908 - DNA, 22 bp, Artificial Sequence
  chemically synthesized
tccagcagaagctctggtctaa

SEQ ID NO: 1266909 - DNA, 22 bp, Artificial Sequence
  chemically synthesized
tgaacagctaacattagaccag

SEQ ID NO: 1266910 - DNA, 22 bp, Artificial Sequence
  chemically synthesized
gctctgaacagctaacattaga

SEQ ID NO: 1266911 - DNA, 22 bp, Artificial Sequence
  chemically synthesized
tggtctaatgttagctgttcag

SEQ ID NO: 1266912 - DNA, 22 bp, Artificial Sequence
  chemically synthesized
cacaggttagctctgaacagct

SEQ ID NO: 1266913 - DNA, 22 bp, Artificial Sequence
  chemically synthesized
ccacaggttagctctgaacagc

SEQ ID NO: 1266914 - DNA, 22 bp, Artificial Sequence
  chemically synthesized
gtctaatgttagctgttcagag

SEQ ID NO: 1266915 - DNA, 22 bp, Artificial Sequence
  chemically synthesized
atgttagctgttcagagctaac

SEQ ID NO: 1266916 - DNA, 22 bp, Artificial Sequence
  chemically synthesized
gctgttcagagctaacctgtgg

SEQ ID NO: 1266917 - DNA, 22 bp, Artificial Sequence
  chemically synthesized
ttcagagctaacctgtggaaat

SEQ ID NO: 1266918 - DNA, 22 bp, Artificial Sequence
  chemically synthesized
agagctaacctgtggaaatccc

SEQ ID NO: 1266919 - DNA, 22 bp, Artificial Sequence
  chemically synthesized
atgtggccccatgggatttcca

SEQ ID NO: 1266920 - DNA, 22 bp, Artificial Sequence
  chemically synthesized
catgtggccccatgggatttcc

SEQ ID NO: 1266921 - DNA, 22 bp, Artificial Sequence
  chemically synthesized
tcatgtggccccatgggatttc

SEQ ID NO: 1266922 - DNA, 22 bp, Artificial Sequence
  chemically synthesized
ttttcatgtggccccatgggat

SEQ ID NO: 1266923 - DNA, 22 bp, Artificial Sequence
  chemically synthesized
attttcatgtggccccatggga

SEQ ID NO: 1266924 - DNA, 22 bp, Artificial Sequence
  chemically synthesized
acctgtggaaatcccatggggc

SEQ ID NO: 1266925 - DNA, 22 bp, Artificial Sequence
  chemically synthesized
tggaaatcccatggggccacat

SEQ ID NO: 1266926 - DNA, 22 bp, Artificial Sequence
  chemically synthesized
cacccttttcttatccactgta

SEQ ID NO: 1266927 - DNA, 22 bp, Artificial Sequence
  chemically synthesized
cagcaggaggagtacagtggat

SEQ ID NO: 1266928 - DNA, 22 bp, Artificial Sequence
  chemically synthesized
ttcttatccactgtactcctcc

SEQ ID NO: 1266929 - DNA, 22 bp, Artificial Sequence
  chemically synthesized
tcttatccactgtactcctcct

SEQ ID NO: 1266930 - DNA, 22 bp, Artificial Sequence
  chemically synthesized
cttatccactgtactcctcctg

SEQ ID NO: 1266931 - DNA, 22 bp, Artificial Sequence
  chemically synthesized
ttatccactgtactcctcctgc

SEQ ID NO: 1266932 - DNA, 22 bp, Artificial Sequence
  chemically synthesized
agacaggctgcagcaggaggag

SEQ ID NO: 1266933 - DNA, 22 bp, Artificial Sequence
  chemically synthesized
atccactgtactcctcctgctg

SEQ ID NO: 1266934 - DNA, 22 bp, Artificial Sequence
  chemically synthesized
tccactgtactcctcctgctgc

SEQ ID NO: 1266935 - DNA, 22 bp, Artificial Sequence
  chemically synthesized
cagttgagacaggctgcagcag

SEQ ID NO: 1266936 - DNA, 22 bp, Artificial Sequence
  chemically synthesized
ccagttgagacaggctgcagca

SEQ ID NO: 1266937 - DNA, 22 bp, Artificial Sequence
  chemically synthesized
tactcctcctgctgcagcctgt

SEQ ID NO: 1266938 - DNA, 22 bp, Artificial Sequence
  chemically synthesized
cagtttccagttgagacaggct

SEQ ID NO: 1266939 - DNA, 22 bp, Artificial Sequence
  chemically synthesized
ctcctgctgcagcctgtctcaa

SEQ ID NO: 1266940 - DNA, 22 bp, Artificial Sequence
  chemically synthesized
ctgctgcagcctgtctcaactg

SEQ ID NO: 1266941 - DNA, 22 bp, Artificial Sequence
  chemically synthesized
ccctacagtttccagttgagac

SEQ ID NO: 1266942 - DNA, 22 bp, Artificial Sequence
  chemically synthesized
gccctacagtttccagttgaga

SEQ ID NO: 1266943 - DNA, 22 bp, Artificial Sequence
  chemically synthesized
tgccctacagtttccagttgag

SEQ ID NO: 1266944 - DNA, 22 bp, Artificial Sequence
  chemically synthesized
ctgcagcctgtctcaactggaa

SEQ ID NO: 1266945 - DNA, 22 bp, Artificial Sequence
  chemically synthesized
ctttgccctacagtttccagtt

SEQ ID NO: 1266946 - DNA, 22 bp, Artificial Sequence
  chemically synthesized
cagcctgtctcaactggaaact

SEQ ID NO: 1266947 - DNA, 22 bp, Artificial Sequence
  chemically synthesized
tctcaactggaaactgtagggc

SEQ ID NO: 1266948 - DNA, 22 bp, Artificial Sequence
  chemically synthesized
aactggaaactgtagggcaaag

SEQ ID NO: 1266949 - DNA, 22 bp, Artificial Sequence
  chemically synthesized
gaaactgtagggcaaaggaact

SEQ ID NO: 1266950 - DNA, 22 bp, Artificial Sequence
  chemically synthesized
ggaatggcatcagagttccttt

SEQ ID NO: 1266951 - DNA, 22 bp, Artificial Sequence
  chemically synthesized
aggaatggcatcagagttcctt

SEQ ID NO: 1266952 - DNA, 22 bp, Artificial Sequence
  chemically synthesized
taggaatggcatcagagttcct

SEQ ID NO: 1266953 - DNA, 22 bp, Artificial Sequence
  chemically synthesized
tagggcaaaggaactctgatgc

SEQ ID NO: 1266954 - DNA, 22 bp, Artificial Sequence
  chemically synthesized
ccctttaggaatggcatcagag

SEQ ID NO: 1266955 - DNA, 22 bp, Artificial Sequence
  chemically synthesized
gggactgccctttaggaatggc

SEQ ID NO: 1266956 - DNA, 22 bp, Artificial Sequence
  chemically synthesized
tgtcctggggactgccctttag

SEQ ID NO: 1266957 - DNA, 22 bp, Artificial Sequence
  chemically synthesized
tgatgccattcctaaagggcag

SEQ ID NO: 1266958 - DNA, 22 bp, Artificial Sequence
  chemically synthesized
gtgtcctggggactgcccttta

SEQ ID NO: 1266959 - DNA, 22 bp, Artificial Sequence
  chemically synthesized
tgtgtcctggggactgcccttt

SEQ ID NO: 1266960 - DNA, 22 bp, Artificial Sequence
  chemically synthesized
atgccattcctaaagggcagtc

SEQ ID NO: 1266961 - DNA, 22 bp, Artificial Sequence
  chemically synthesized
tgctttgtgtcctggggactgc

SEQ ID NO: 1266962 - DNA, 22 bp, Artificial Sequence
  chemically synthesized
ctaaagggcagtccccaggaca

SEQ ID NO: 1266963 - DNA, 22 bp, Artificial Sequence
  chemically synthesized
ccactgtgctttgtgtcctggg

SEQ ID NO: 1266964 - DNA, 22 bp, Artificial Sequence
  chemically synthesized
accactgtgctttgtgtcctgg

SEQ ID NO: 1266965 - DNA, 22 bp, Artificial Sequence
  chemically synthesized
aagggcagtccccaggacacaa

SEQ ID NO: 1266966 - DNA, 22 bp, Artificial Sequence
  chemically synthesized
taccactgtgctttgtgtcctg

SEQ ID NO: 1266967 - DNA, 22 bp, Artificial Sequence
  chemically synthesized
tttaccactgtgctttgtgtcc

SEQ ID NO: 1266968 - DNA, 22 bp, Artificial Sequence
  chemically synthesized
attctttaccactgtgctttgt

SEQ ID NO: 1266969 - DNA, 22 bp, Artificial Sequence
  chemically synthesized
cattctttaccactgtgctttg

SEQ ID NO: 1266970 - DNA, 22 bp, Artificial Sequence
  chemically synthesized
tcattctttaccactgtgcttt

SEQ ID NO: 1266971 - DNA, 22 bp, Artificial Sequence
  chemically synthesized
ttcattctttaccactgtgctt

SEQ ID NO: 1266972 - DNA, 22 bp, Artificial Sequence
  chemically synthesized
aaatccatttttcattctttac

SEQ ID NO: 1266973 - DNA, 22 bp, Artificial Sequence
  chemically synthesized
caaatccatttttcattcttta

SEQ ID NO: 1266974 - DNA, 22 bp, Artificial Sequence
  chemically synthesized
tcaaatccatttttcattcttt

SEQ ID NO: 1266975 - DNA, 22 bp, Artificial Sequence
  chemically synthesized
tcctttcaaatccatttttcat

SEQ ID NO: 1266976 - DNA, 22 bp, Artificial Sequence
  chemically synthesized
gtcctttcaaatccatttttca

SEQ ID NO: 1266977 - DNA, 22 bp, Artificial Sequence
  chemically synthesized
ttgtcctttcaaatccattttt

SEQ ID NO: 1266978 - DNA, 22 bp, Artificial Sequence
  chemically synthesized
cctcttgtcctttcaaatccat

SEQ ID NO: 1266979 - DNA, 22 bp, Artificial Sequence
  chemically synthesized
ccctcttgtcctttcaaatcca

SEQ ID NO: 1266980 - DNA, 22 bp, Artificial Sequence
  chemically synthesized
tccctcttgtcctttcaaatcc

SEQ ID NO: 1266981 - DNA, 22 bp, Artificial Sequence
  chemically synthesized
tttccctcttgtcctttcaaat

SEQ ID NO: 1266982 - DNA, 22 bp, Artificial Sequence
  chemically synthesized
gtgcataaattctttccctctt

SEQ ID NO: 1266983 - DNA, 22 bp, Artificial Sequence
  chemically synthesized
agtgcataaattctttccctct

SEQ ID NO: 1266984 - DNA, 22 bp, Artificial Sequence
  chemically synthesized
gaaaggacaagagggaaagaat

SEQ ID NO: 1266985 - DNA, 22 bp, Artificial Sequence
  chemically synthesized
aaaggacaagagggaaagaatt

SEQ ID NO: 1266986 - DNA, 22 bp, Artificial Sequence
  chemically synthesized
tgcttagtgcataaattctttc

SEQ ID NO: 1266987 - DNA, 22 bp, Artificial Sequence
  chemically synthesized
aaagggaaaagttatgcttagt

SEQ ID NO: 1266988 - DNA, 22 bp, Artificial Sequence
  chemically synthesized
gaaagggaaaagttatgcttag

SEQ ID NO: 1266989 - DNA, 22 bp, Artificial Sequence
  chemically synthesized
acttgaaagggaaaagttatgc

SEQ ID NO: 1266990 - DNA, 22 bp, Artificial Sequence
  chemically synthesized
atgcactaagcataacttttcc

SEQ ID NO: 1266991 - DNA, 22 bp, Artificial Sequence
  chemically synthesized
tgcactaagcataacttttccc

SEQ ID NO: 1266992 - DNA, 22 bp, Artificial Sequence
  chemically synthesized
gattaacttgaaagggaaaagt

SEQ ID NO: 1266993 - DNA, 22 bp, Artificial Sequence
  chemically synthesized
agcataacttttccctttcaag

SEQ ID NO: 1266994 - DNA, 22 bp, Artificial Sequence
  chemically synthesized
aacatactagattaacttgaaa

SEQ ID NO: 1266995 - DNA, 22 bp, Artificial Sequence
  chemically synthesized
ttccctttcaagttaatctagt

SEQ ID NO: 1266996 - DNA, 22 bp, Artificial Sequence
  chemically synthesized
tccctttcaagttaatctagta

SEQ ID NO: 1266997 - DNA, 22 bp, Artificial Sequence
  chemically synthesized
ccctttcaagttaatctagtat

SEQ ID NO: 1266998 - DNA, 22 bp, Artificial Sequence
  chemically synthesized
cctttcaagttaatctagtatg

SEQ ID NO: 1266999 - DNA, 22 bp, Artificial Sequence
  chemically synthesized
tcaagttaatctagtatgttga

SEQ ID NO: 1267000 - DNA, 22 bp, Artificial Sequence
  chemically synthesized
caagttaatctagtatgttgag

SEQ ID NO: 1267001 - DNA, 22 bp, Artificial Sequence
  chemically synthesized
aagttaatctagtatgttgagt

SEQ ID NO: 1267002 - DNA, 22 bp, Artificial Sequence
  chemically synthesized
aagagcaaaccaactcaacata

SEQ ID NO: 1267003 - DNA, 22 bp, Artificial Sequence
  chemically synthesized
gttaaagagcaaaccaactcaa

SEQ ID NO: 1267004 - DNA, 22 bp, Artificial Sequence
  chemically synthesized
agttaaagagcaaaccaactca

SEQ ID NO: 1267005 - DNA, 22 bp, Artificial Sequence
  chemically synthesized
atctagtatgttgagttggttt

SEQ ID NO: 1267006 - DNA, 22 bp, Artificial Sequence
  chemically synthesized
gtatgttgagttggtttgctct

SEQ ID NO: 1267007 - DNA, 22 bp, Artificial Sequence
  chemically synthesized
agttggtttgctctttaactaa

SEQ ID NO: 1267008 - DNA, 22 bp, Artificial Sequence
  chemically synthesized
gaaacaggggggtttagttaaa

SEQ ID NO: 1267009 - DNA, 22 bp, Artificial Sequence
  chemically synthesized
ggaaacaggggggtttagttaa

SEQ ID NO: 1267010 - DNA, 22 bp, Artificial Sequence
  chemically synthesized
tggaaacaggggggtttagtta

SEQ ID NO: 1267011 - DNA, 22 bp, Artificial Sequence
  chemically synthesized
gtttgctctttaactaaacccc

SEQ ID NO: 1267012 - DNA, 22 bp, Artificial Sequence
  chemically synthesized
gctctttaactaaacccccctg

SEQ ID NO: 1267013 - DNA, 22 bp, Artificial Sequence
  chemically synthesized
aggctttggaaacaggggggtt

SEQ ID NO: 1267014 - DNA, 22 bp, Artificial Sequence
  chemically synthesized
ctctttaactaaacccccctgt

SEQ ID NO: 1267015 - DNA, 22 bp, Artificial Sequence
  chemically synthesized
tttaactaaacccccctgtttc

SEQ ID NO: 1267016 - DNA, 22 bp, Artificial Sequence
  chemically synthesized
tcctcaggctttggaaacaggg

SEQ ID NO: 1267017 - DNA, 22 bp, Artificial Sequence
  chemically synthesized
taactaaacccccctgtttcca

SEQ ID NO: 1267018 - DNA, 22 bp, Artificial Sequence
  chemically synthesized
aactaaacccccctgtttccaa

SEQ ID NO: 1267019 - DNA, 22 bp, Artificial Sequence
  chemically synthesized
actaaacccccctgtttccaaa

SEQ ID NO: 1267020 - DNA, 22 bp, Artificial Sequence
  chemically synthesized
aacccccctgtttccaaagcct

SEQ ID NO: 1267021 - DNA, 22 bp, Artificial Sequence
  chemically synthesized
agtaggtagtatgttatcctca

SEQ ID NO: 1267022 - DNA, 22 bp, Artificial Sequence
  chemically synthesized
tttccaaagcctgaggataaca

SEQ ID NO: 1267023 - DNA, 22 bp, Artificial Sequence
  chemically synthesized
ccaaagcctgaggataacatac

SEQ ID NO: 1267024 - DNA, 22 bp, Artificial Sequence
  chemically synthesized
caaagcctgaggataacatact

SEQ ID NO: 1267025 - DNA, 22 bp, Artificial Sequence
  chemically synthesized
ccaactcagtaggtagtatgtt

SEQ ID NO: 1267026 - DNA, 22 bp, Artificial Sequence
  chemically synthesized
accaactcagtaggtagtatgt

SEQ ID NO: 1267027 - DNA, 22 bp, Artificial Sequence
  chemically synthesized
tttaccaactcagtaggtagta

SEQ ID NO: 1267028 - DNA, 22 bp, Artificial Sequence
  chemically synthesized
aggataacatactacctactga

SEQ ID NO: 1267029 - DNA, 22 bp, Artificial Sequence
  chemically synthesized
aggttgtttaccaactcagtag

SEQ ID NO: 1267030 - DNA, 22 bp, Artificial Sequence
  chemically synthesized
aaggttgtttaccaactcagta

SEQ ID NO: 1267031 - DNA, 22 bp, Artificial Sequence
  chemically synthesized
ccttaaggttgtttaccaactc

SEQ ID NO: 1267032 - DNA, 22 bp, Artificial Sequence
  chemically synthesized
ctgccttaaggttgtttaccaa

SEQ ID NO: 1267033 - DNA, 22 bp, Artificial Sequence
  chemically synthesized
cctactgagttggtaaacaacc

SEQ ID NO: 1267034 - DNA, 22 bp, Artificial Sequence
  chemically synthesized
ctgagttggtaaacaaccttaa

SEQ ID NO: 1267035 - DNA, 22 bp, Artificial Sequence
  chemically synthesized
caggactgctgccttaaggttg

SEQ ID NO: 1267036 - DNA, 22 bp, Artificial Sequence
  chemically synthesized
agttggtaaacaaccttaaggc

SEQ ID NO: 1267037 - DNA, 22 bp, Artificial Sequence
  chemically synthesized
ggctccaggactgctgccttaa

SEQ ID NO: 1267038 - DNA, 22 bp, Artificial Sequence
  chemically synthesized
gtaaacaaccttaaggcagcag

SEQ ID NO: 1267039 - DNA, 22 bp, Artificial Sequence
  chemically synthesized
tctaggctccaggactgctgcc

SEQ ID NO: 1267040 - DNA, 22 bp, Artificial Sequence
  chemically synthesized
tgtctaggctccaggactgctg

SEQ ID NO: 1267041 - DNA, 22 bp, Artificial Sequence
  chemically synthesized
aaggcagcagtcctggagccta

SEQ ID NO: 1267042 - DNA, 22 bp, Artificial Sequence
  chemically synthesized
aggcagcagtcctggagcctag

SEQ ID NO: 1267043 - DNA, 22 bp, Artificial Sequence
  chemically synthesized
atccaatgtctctgtctaggct

SEQ ID NO: 1267044 - DNA, 22 bp, Artificial Sequence
  chemically synthesized
ctcatccaatgtctctgtctag

SEQ ID NO: 1267045 - DNA, 22 bp, Artificial Sequence
  chemically synthesized
gtctactcatccaatgtctctg

SEQ ID NO: 1267046 - DNA, 22 bp, Artificial Sequence
  chemically synthesized
gagcctagacagagacattgga

SEQ ID NO: 1267047 - DNA, 22 bp, Artificial Sequence
  chemically synthesized
cattcgtctactcatccaatgt

SEQ ID NO: 1267048 - DNA, 22 bp, Artificial Sequence
  chemically synthesized
gacagagacattggatgagtag

SEQ ID NO: 1267049 - DNA, 22 bp, Artificial Sequence
  chemically synthesized
gtgtacctccattcgtctactc

SEQ ID NO: 1267050 - DNA, 22 bp, Artificial Sequence
  chemically synthesized
gatgagtagacgaatggaggta

SEQ ID NO: 1267051 - DNA, 22 bp, Artificial Sequence
  chemically synthesized
tccatccatgcatccatccatg

SEQ ID NO: 1267052 - DNA, 22 bp, Artificial Sequence
  chemically synthesized
acctatccatccatgcatccat

SEQ ID NO: 1267053 - DNA, 22 bp, Artificial Sequence
  chemically synthesized
atccatccattcacctatccat

SEQ ID NO: 1267054 - DNA, 22 bp, Artificial Sequence
  chemically synthesized
catccatccattcacctatcca

SEQ ID NO: 1267055 - DNA, 22 bp, Artificial Sequence
  chemically synthesized
acttcatccatccattcaccta

SEQ ID NO: 1267056 - DNA, 22 bp, Artificial Sequence
  chemically synthesized
atgtgattgacttcatccatcc

SEQ ID NO: 1267057 - DNA, 22 bp, Artificial Sequence
  chemically synthesized
taaaatactaatgtgattgact

SEQ ID NO: 1267058 - DNA, 22 bp, Artificial Sequence
  chemically synthesized
tgtaacgtgtgtctgtaaaata

SEQ ID NO: 1267059 - DNA, 22 bp, Artificial Sequence
  chemically synthesized
gtattttacagacacacgttac

SEQ ID NO: 1267060 - DNA, 22 bp, Artificial Sequence
  chemically synthesized
agatacaggttgtgtaacgtgt

SEQ ID NO: 1267061 - DNA, 22 bp, Artificial Sequence
  chemically synthesized
tacagacacacgttacacaacc

SEQ ID NO: 1267062 - DNA, 22 bp, Artificial Sequence
  chemically synthesized
acagacacacgttacacaacct

SEQ ID NO: 1267063 - DNA, 22 bp, Artificial Sequence
  chemically synthesized
cagacacacgttacacaacctg

SEQ ID NO: 1267064 - DNA, 22 bp, Artificial Sequence
  chemically synthesized
atcgtgttcagatacaggttgt

SEQ ID NO: 1267065 - DNA, 22 bp, Artificial Sequence
  chemically synthesized
cacaacctgtatctgaacacga

SEQ ID NO: 1267066 - DNA, 22 bp, Artificial Sequence
  chemically synthesized
tatctgaacacgatgagtctct

SEQ ID NO: 1267067 - DNA, 22 bp, Artificial Sequence
  chemically synthesized
aacacgatgagtctctcttcct

SEQ ID NO: 1267068 - DNA, 22 bp, Artificial Sequence
  chemically synthesized
cataatcaaaggaggaagagag

SEQ ID NO: 1267069 - DNA, 22 bp, Artificial Sequence
  chemically synthesized
ccataatcaaaggaggaagaga

SEQ ID NO: 1267070 - DNA, 22 bp, Artificial Sequence
  chemically synthesized
acttccataatcaaaggaggaa

SEQ ID NO: 1267071 - DNA, 22 bp, Artificial Sequence
  chemically synthesized
aacttccataatcaaaggagga

SEQ ID NO: 1267072 - DNA, 22 bp, Artificial Sequence
  chemically synthesized
ttaacttccataatcaaaggag

SEQ ID NO: 1267073 - DNA, 22 bp, Artificial Sequence
  chemically synthesized
ctcttaacttccataatcaaag

SEQ ID NO: 1267074 - DNA, 22 bp, Artificial Sequence
  chemically synthesized
gctcttaacttccataatcaaa

SEQ ID NO: 1267075 - DNA, 22 bp, Artificial Sequence
  chemically synthesized
tcttcctcctttgattatggaa

SEQ ID NO: 1267076 - DNA, 22 bp, Artificial Sequence
  chemically synthesized
ttcctcctttgattatggaagt

SEQ ID NO: 1267077 - DNA, 22 bp, Artificial Sequence
  chemically synthesized
cctcctttgattatggaagtta

SEQ ID NO: 1267078 - DNA, 22 bp, Artificial Sequence
  chemically synthesized
agtgcttgctcttaacttccat

SEQ ID NO: 1267079 - DNA, 22 bp, Artificial Sequence
  chemically synthesized
ctcctttgattatggaagttaa

SEQ ID NO: 1267080 - DNA, 22 bp, Artificial Sequence
  chemically synthesized
ctttgattatggaagttaagag

SEQ ID NO: 1267081 - DNA, 22 bp, Artificial Sequence
  chemically synthesized
cctcagtgcttgctcttaactt

SEQ ID NO: 1267082 - DNA, 22 bp, Artificial Sequence
  chemically synthesized
tgattatggaagttaagagcaa

SEQ ID NO: 1267083 - DNA, 22 bp, Artificial Sequence
  chemically synthesized
gattatggaagttaagagcaag

SEQ ID NO: 1267084 - DNA, 22 bp, Artificial Sequence
  chemically synthesized
gttacctcagtgcttgctctta

SEQ ID NO: 1267085 - DNA, 22 bp, Artificial Sequence
  chemically synthesized
attatggaagttaagagcaagc

SEQ ID NO: 1267086 - DNA, 22 bp, Artificial Sequence
  chemically synthesized
tggaagttaagagcaagcactg

SEQ ID NO: 1267087 - DNA, 22 bp, Artificial Sequence
  chemically synthesized
tataatattggttacctcagtg

SEQ ID NO: 1267088 - DNA, 22 bp, Artificial Sequence
  chemically synthesized
agagcaagcactgaggtaacca

SEQ ID NO: 1267089 - DNA, 22 bp, Artificial Sequence
  chemically synthesized
cagaaatctatataatattggt

SEQ ID NO: 1267090 - DNA, 22 bp, Artificial Sequence
  chemically synthesized
ctccagaaatctatataatatt

SEQ ID NO: 1267091 - DNA, 22 bp, Artificial Sequence
  chemically synthesized
actccagaaatctatataatat

SEQ ID NO: 1267092 - DNA, 22 bp, Artificial Sequence
  chemically synthesized
tactccagaaatctatataata

SEQ ID NO: 1267093 - DNA, 22 bp, Artificial Sequence
  chemically synthesized
aggtaaccaatattatatagat

SEQ ID NO: 1267094 - DNA, 22 bp, Artificial Sequence
  chemically synthesized
ttttactccagaaatctatata

SEQ ID NO: 1267095 - DNA, 22 bp, Artificial Sequence
  chemically synthesized
tatagatttctggagtaaaaca

SEQ ID NO: 1267096 - DNA, 22 bp, Artificial Sequence
  chemically synthesized
atagtcatgatgagtacctgtt

SEQ ID NO: 1267097 - DNA, 22 bp, Artificial Sequence
  chemically synthesized
ctggagtaaaacaggtactcat

SEQ ID NO: 1267098 - DNA, 22 bp, Artificial Sequence
  chemically synthesized
tggagtaaaacaggtactcatc

SEQ ID NO: 1267099 - DNA, 22 bp, Artificial Sequence
  chemically synthesized
gagtaaaacaggtactcatcat

SEQ ID NO: 1267100 - DNA, 22 bp, Artificial Sequence
  chemically synthesized
aaatcgttgatagtcatgatga

SEQ ID NO: 1267101 - DNA, 22 bp, Artificial Sequence
  chemically synthesized
atcatgactatcaacgatttga

SEQ ID NO: 1267102 - DNA, 22 bp, Artificial Sequence
  chemically synthesized
acatcatccccaaattcaaatc

SEQ ID NO: 1267103 - DNA, 22 bp, Artificial Sequence
  chemically synthesized
tcaacgatttgaatttggggat

SEQ ID NO: 1267104 - DNA, 22 bp, Artificial Sequence
  chemically synthesized
aataattgacatcatccccaaa

SEQ ID NO: 1267105 - DNA, 22 bp, Artificial Sequence
  chemically synthesized
gaataattgacatcatccccaa

SEQ ID NO: 1267106 - DNA, 22 bp, Artificial Sequence
  chemically synthesized
tgaataattgacatcatcccca

SEQ ID NO: 1267107 - DNA, 22 bp, Artificial Sequence
  chemically synthesized
tttgaataattgacatcatccc

SEQ ID NO: 1267108 - DNA, 22 bp, Artificial Sequence
  chemically synthesized
gaatttggggatgatgtcaatt

SEQ ID NO: 1267109 - DNA, 22 bp, Artificial Sequence
  chemically synthesized
aatttggggatgatgtcaatta

SEQ ID NO: 1267110 - DNA, 22 bp, Artificial Sequence
  chemically synthesized
aggttctttgaataattgacat

SEQ ID NO: 1267111 - DNA, 22 bp, Artificial Sequence
  chemically synthesized
caggttctttgaataattgaca

SEQ ID NO: 1267112 - DNA, 22 bp, Artificial Sequence
  chemically synthesized
tcaggttctttgaataattgac

SEQ ID NO: 1267113 - DNA, 22 bp, Artificial Sequence
  chemically synthesized
ttcaggttctttgaataattga

SEQ ID NO: 1267114 - DNA, 22 bp, Artificial Sequence
  chemically synthesized
tttcaggttctttgaataattg

SEQ ID NO: 1267115 - DNA, 22 bp, Artificial Sequence
  chemically synthesized
ggggatgatgtcaattattcaa

SEQ ID NO: 1267116 - DNA, 22 bp, Artificial Sequence
  chemically synthesized
ttttcaggttctttgaataatt

SEQ ID NO: 1267117 - DNA, 22 bp, Artificial Sequence
  chemically synthesized
gggatgatgtcaattattcaaa

SEQ ID NO: 1267118 - DNA, 22 bp, Artificial Sequence
  chemically synthesized
cttttttcaggttctttgaata

SEQ ID NO: 1267119 - DNA, 22 bp, Artificial Sequence
  chemically synthesized
actacttttttcaggttctttg

SEQ ID NO: 1267120 - DNA, 22 bp, Artificial Sequence
  chemically synthesized
cactacttttttcaggttcttt

SEQ ID NO: 1267121 - DNA, 22 bp, Artificial Sequence
  chemically synthesized
ttcaaagaacctgaaaaaagta

SEQ ID NO: 1267122 - DNA, 22 bp, Artificial Sequence
  chemically synthesized
aaagaacctgaaaaaagtagtg

SEQ ID NO: 1267123 - DNA, 22 bp, Artificial Sequence
  chemically synthesized
agataagcaacttcactacttt

SEQ ID NO: 1267124 - DNA, 22 bp, Artificial Sequence
  chemically synthesized
gggcctcagataagcaacttca

SEQ ID NO: 1267125 - DNA, 22 bp, Artificial Sequence
  chemically synthesized
aaaaaagtagtgaagttgctta

SEQ ID NO: 1267126 - DNA, 22 bp, Artificial Sequence
  chemically synthesized
tggggcctcagataagcaactt

SEQ ID NO: 1267127 - DNA, 22 bp, Artificial Sequence
  chemically synthesized
cttatctgaggccccagaactt

SEQ ID NO: 1267128 - DNA, 22 bp, Artificial Sequence
  chemically synthesized
atctgaggccccagaacttcct

SEQ ID NO: 1267129 - DNA, 22 bp, Artificial Sequence
  chemically synthesized
tctgaggccccagaacttcctt

SEQ ID NO: 1267130 - DNA, 22 bp, Artificial Sequence
  chemically synthesized
aggccccagaacttccttcatt

SEQ ID NO: 1267131 - DNA, 22 bp, Artificial Sequence
  chemically synthesized
aaagccagagtaaaatgaagga

SEQ ID NO: 1267132 - DNA, 22 bp, Artificial Sequence
  chemically synthesized
ccttcattttactctggctttc

SEQ ID NO: 1267133 - DNA, 22 bp, Artificial Sequence
  chemically synthesized
cttcattttactctggctttca

SEQ ID NO: 1267134 - DNA, 22 bp, Artificial Sequence
  chemically synthesized
cattttactctggctttcaacg

SEQ ID NO: 1267135 - DNA, 22 bp, Artificial Sequence
  chemically synthesized
atgtgtatccaacgttgaaagc

SEQ ID NO: 1267136 - DNA, 22 bp, Artificial Sequence
  chemically synthesized
attttactctggctttcaacgt

SEQ ID NO: 1267137 - DNA, 22 bp, Artificial Sequence
  chemically synthesized
aatgtgtatccaacgttgaaag

SEQ ID NO: 1267138 - DNA, 22 bp, Artificial Sequence
  chemically synthesized
taatgtgtatccaacgttgaaa

SEQ ID NO: 1267139 - DNA, 22 bp, Artificial Sequence
  chemically synthesized
tactctggctttcaacgttgga

SEQ ID NO: 1267140 - DNA, 22 bp, Artificial Sequence
  chemically synthesized
actctggctttcaacgttggat

SEQ ID NO: 1267141 - DNA, 22 bp, Artificial Sequence
  chemically synthesized
ctctggctttcaacgttggata

SEQ ID NO: 1267142 - DNA, 22 bp, Artificial Sequence
  chemically synthesized
tggctttcaacgttggatacac

SEQ ID NO: 1267143 - DNA, 22 bp, Artificial Sequence
  chemically synthesized
gataattttaatgtgtatccaa

SEQ ID NO: 1267144 - DNA, 22 bp, Artificial Sequence
  chemically synthesized
gctttcaacgttggatacacat

SEQ ID NO: 1267145 - DNA, 22 bp, Artificial Sequence
  chemically synthesized
ctagataattttaatgtgtatc

SEQ ID NO: 1267146 - DNA, 22 bp, Artificial Sequence
  chemically synthesized
cctagataattttaatgtgtat

SEQ ID NO: 1267147 - DNA, 22 bp, Artificial Sequence
  chemically synthesized
tcaacgttggatacacattaaa

SEQ ID NO: 1267148 - DNA, 22 bp, Artificial Sequence
  chemically synthesized
caacgttggatacacattaaaa

SEQ ID NO: 1267149 - DNA, 22 bp, Artificial Sequence
  chemically synthesized
aacgttggatacacattaaaat

SEQ ID NO: 1267150 - DNA, 22 bp, Artificial Sequence
  chemically synthesized
aaaagtttcctagataatttta

SEQ ID NO: 1267151 - DNA, 22 bp, Artificial Sequence
  chemically synthesized
gaaaagtttcctagataatttt

SEQ ID NO: 1267152 - DNA, 22 bp, Artificial Sequence
  chemically synthesized
gatacacattaaaattatctag

SEQ ID NO: 1267153 - DNA, 22 bp, Artificial Sequence
  chemically synthesized
agtttgaaaagtttcctagata

SEQ ID NO: 1267154 - DNA, 22 bp, Artificial Sequence
  chemically synthesized
aaattatctaggaaacttttca

SEQ ID NO: 1267155 - DNA, 22 bp, Artificial Sequence
  chemically synthesized
tctaggaaacttttcaaactga

SEQ ID NO: 1267156 - DNA, 22 bp, Artificial Sequence
  chemically synthesized
taatccgagcatctcagtttga

SEQ ID NO: 1267157 - DNA, 22 bp, Artificial Sequence
  chemically synthesized
ggaaacttttcaaactgagatg

SEQ ID NO: 1267158 - DNA, 22 bp, Artificial Sequence
  chemically synthesized
agtggtctgtaatccgagcatc

SEQ ID NO: 1267159 - DNA, 22 bp, Artificial Sequence
  chemically synthesized
aagtggtctgtaatccgagcat

SEQ ID NO: 1267160 - DNA, 22 bp, Artificial Sequence
  chemically synthesized
ttcaaactgagatgctcggatt

SEQ ID NO: 1267161 - DNA, 22 bp, Artificial Sequence
  chemically synthesized
tcaaactgagatgctcggatta

SEQ ID NO: 1267162 - DNA, 22 bp, Artificial Sequence
  chemically synthesized
caaactgagatgctcggattac

SEQ ID NO: 1267163 - DNA, 22 bp, Artificial Sequence
  chemically synthesized
aaactgagatgctcggattaca

SEQ ID NO: 1267164 - DNA, 22 bp, Artificial Sequence
  chemically synthesized
acttaagtggtctgtaatccga

SEQ ID NO: 1267165 - DNA, 22 bp, Artificial Sequence
  chemically synthesized
agatgctcggattacagaccac

SEQ ID NO: 1267166 - DNA, 22 bp, Artificial Sequence
  chemically synthesized
cacagagtctgacttaagtggt

SEQ ID NO: 1267167 - DNA, 22 bp, Artificial Sequence
  chemically synthesized
ccacagagtctgacttaagtgg

SEQ ID NO: 1267168 - DNA, 22 bp, Artificial Sequence
  chemically synthesized
ggattacagaccacttaagtca

SEQ ID NO: 1267169 - DNA, 22 bp, Artificial Sequence
  chemically synthesized
tttccacagagtctgacttaag

SEQ ID NO: 1267170 - DNA, 22 bp, Artificial Sequence
  chemically synthesized
tatttccacagagtctgactta

SEQ ID NO: 1267171 - DNA, 22 bp, Artificial Sequence
  chemically synthesized
cagaccacttaagtcagactct

SEQ ID NO: 1267172 - DNA, 22 bp, Artificial Sequence
  chemically synthesized
cgttctatttccacagagtctg

SEQ ID NO: 1267173 - DNA, 22 bp, Artificial Sequence
  chemically synthesized
aagtcagactctgtggaaatag

SEQ ID NO: 1267174 - DNA, 22 bp, Artificial Sequence
  chemically synthesized
agtcagactctgtggaaataga

SEQ ID NO: 1267175 - DNA, 22 bp, Artificial Sequence
  chemically synthesized
caaacagtgatatctgcgttct

SEQ ID NO: 1267176 - DNA, 22 bp, Artificial Sequence
  chemically synthesized
acaaacagtgatatctgcgttc

SEQ ID NO: 1267177 - DNA, 22 bp, Artificial Sequence
  chemically synthesized
tgtggaaatagaacgcagatat

SEQ ID NO: 1267178 - DNA, 22 bp, Artificial Sequence
  chemically synthesized
tggaaatagaacgcagatatca

SEQ ID NO: 1267179 - DNA, 22 bp, Artificial Sequence
  chemically synthesized
gtggagtgtttacaaacagtga

SEQ ID NO: 1267180 - DNA, 22 bp, Artificial Sequence
  chemically synthesized
cacattggtggagtgtttacaa

SEQ ID NO: 1267181 - DNA, 22 bp, Artificial Sequence
  chemically synthesized
ctacacattggtggagtgttta

SEQ ID NO: 1267182 - DNA, 22 bp, Artificial Sequence
  chemically synthesized
gctacacattggtggagtgttt

SEQ ID NO: 1267183 - DNA, 22 bp, Artificial Sequence
  chemically synthesized
tgctacacattggtggagtgtt

SEQ ID NO: 1267184 - DNA, 22 bp, Artificial Sequence
  chemically synthesized
tttgtaaacactccaccaatgt

SEQ ID NO: 1267185 - DNA, 22 bp, Artificial Sequence
  chemically synthesized
gcattttgctacacattggtgg

SEQ ID NO: 1267186 - DNA, 22 bp, Artificial Sequence
  chemically synthesized
cgcattttgctacacattggtg

SEQ ID NO: 1267187 - DNA, 22 bp, Artificial Sequence
  chemically synthesized
tcgcattttgctacacattggt

SEQ ID NO: 1267188 - DNA, 22 bp, Artificial Sequence
  chemically synthesized
gtaaacactccaccaatgtgta

SEQ ID NO: 1267189 - DNA, 22 bp, Artificial Sequence
  chemically synthesized
taaacactccaccaatgtgtag

SEQ ID NO: 1267190 - DNA, 22 bp, Artificial Sequence
  chemically synthesized
caccaatgtgtagcaaaatgcg

SEQ ID NO: 1267191 - DNA, 22 bp, Artificial Sequence
  chemically synthesized
aagagagtggaaagatcagtag

SEQ ID NO: 1267192 - DNA, 22 bp, Artificial Sequence
  chemically synthesized
aaagagagtggaaagatcagta

SEQ ID NO: 1267193 - DNA, 22 bp, Artificial Sequence
  chemically synthesized
ctgatctttccactctctttaa

SEQ ID NO: 1267194 - DNA, 22 bp, Artificial Sequence
  chemically synthesized
ataatggtagatcttaaagaga

SEQ ID NO: 1267195 - DNA, 22 bp, Artificial Sequence
  chemically synthesized
atctttccactctctttaagat

SEQ ID NO: 1267196 - DNA, 22 bp, Artificial Sequence
  chemically synthesized
gggctcataatggtagatctta

SEQ ID NO: 1267197 - DNA, 22 bp, Artificial Sequence
  chemically synthesized
tccactctctttaagatctacc

SEQ ID NO: 1267198 - DNA, 22 bp, Artificial Sequence
  chemically synthesized
ggggctcataatggtagatctt

SEQ ID NO: 1267199 - DNA, 22 bp, Artificial Sequence
  chemically synthesized
ccactctctttaagatctacca

SEQ ID NO: 1267200 - DNA, 22 bp, Artificial Sequence
  chemically synthesized
tggggctcataatggtagatct

SEQ ID NO: 1267201 - DNA, 22 bp, Artificial Sequence
  chemically synthesized
cactctctttaagatctaccat

SEQ ID NO: 1267202 - DNA, 22 bp, Artificial Sequence
  chemically synthesized
tctttaagatctaccattatga

SEQ ID NO: 1267203 - DNA, 22 bp, Artificial Sequence
  chemically synthesized
tttaagatctaccattatgagc

SEQ ID NO: 1267204 - DNA, 22 bp, Artificial Sequence
  chemically synthesized
taagatctaccattatgagccc

SEQ ID NO: 1267205 - DNA, 22 bp, Artificial Sequence
  chemically synthesized
aagatctaccattatgagcccc

SEQ ID NO: 1267206 - DNA, 22 bp, Artificial Sequence
  chemically synthesized
agatctaccattatgagcccca

SEQ ID NO: 1267207 - DNA, 22 bp, Artificial Sequence
  chemically synthesized
ccattatgagccccaaaatcat

SEQ ID NO: 1267208 - DNA, 22 bp, Artificial Sequence
  chemically synthesized
ccaagagaaccagaatgatttt

SEQ ID NO: 1267209 - DNA, 22 bp, Artificial Sequence
  chemically synthesized
tgagccccaaaatcattctggt

SEQ ID NO: 1267210 - DNA, 22 bp, Artificial Sequence
  chemically synthesized
aaaaatgtaaattaccaagaga

SEQ ID NO: 1267211 - DNA, 22 bp, Artificial Sequence
  chemically synthesized
aaaaaatgtaaattaccaagag

SEQ ID NO: 1267212 - DNA, 22 bp, Artificial Sequence
  chemically synthesized
taaaaaatgtaaattaccaaga

SEQ ID NO: 1267213 - DNA, 22 bp, Artificial Sequence
  chemically synthesized
ctttaaaaaatgtaaattacca

SEQ ID NO: 1267214 - DNA, 22 bp, Artificial Sequence
  chemically synthesized
cctttaaaaaatgtaaattacc

SEQ ID NO: 1267215 - DNA, 22 bp, Artificial Sequence
  chemically synthesized
tggttctcttggtaatttacat

SEQ ID NO: 1267216 - DNA, 22 bp, Artificial Sequence
  chemically synthesized
gttctcttggtaatttacattt

SEQ ID NO: 1267217 - DNA, 22 bp, Artificial Sequence
  chemically synthesized
gagtttcctttaaaaaatgtaa

SEQ ID NO: 1267218 - DNA, 22 bp, Artificial Sequence
  chemically synthesized
agagtttcctttaaaaaatgta

SEQ ID NO: 1267219 - DNA, 22 bp, Artificial Sequence
  chemically synthesized
tcttggtaatttacatttttta

SEQ ID NO: 1267220 - DNA, 22 bp, Artificial Sequence
  chemically synthesized
ttggtaatttacattttttaaa

SEQ ID NO: 1267221 - DNA, 22 bp, Artificial Sequence
  chemically synthesized
ggtaatttacattttttaaagg

SEQ ID NO: 1267222 - DNA, 22 bp, Artificial Sequence
  chemically synthesized
gtaatttacattttttaaagga

SEQ ID NO: 1267223 - DNA, 22 bp, Artificial Sequence
  chemically synthesized
acattttttaaaggaaactcta

SEQ ID NO: 1267224 - DNA, 22 bp, Artificial Sequence
  chemically synthesized
cattttttaaaggaaactctaa

SEQ ID NO: 1267225 - DNA, 22 bp, Artificial Sequence
  chemically synthesized
tcagcaaggcatcttagagttt

SEQ ID NO: 1267226 - DNA, 22 bp, Artificial Sequence
  chemically synthesized
tttaaaggaaactctaagatgc

SEQ ID NO: 1267227 - DNA, 22 bp, Artificial Sequence
  chemically synthesized
ttaaaggaaactctaagatgcc

SEQ ID NO: 1267228 - DNA, 22 bp, Artificial Sequence
  chemically synthesized
taaaggaaactctaagatgcct

SEQ ID NO: 1267229 - DNA, 22 bp, Artificial Sequence
  chemically synthesized
aaaggaaactctaagatgcctt

SEQ ID NO: 1267230 - DNA, 22 bp, Artificial Sequence
  chemically synthesized
aaggaaactctaagatgccttg

SEQ ID NO: 1267231 - DNA, 22 bp, Artificial Sequence
  chemically synthesized
atatataatattatcagcaagg

SEQ ID NO: 1267232 - DNA, 22 bp, Artificial Sequence
  chemically synthesized
catatataatattatcagcaag

SEQ ID NO: 1267233 - DNA, 22 bp, Artificial Sequence
  chemically synthesized
tcatatataatattatcagcaa

SEQ ID NO: 1267234 - DNA, 22 bp, Artificial Sequence
  chemically synthesized
ttcatatataatattatcagca

SEQ ID NO: 1267235 - DNA, 22 bp, Artificial Sequence
  chemically synthesized
taagatgccttgctgataatat

SEQ ID NO: 1267236 - DNA, 22 bp, Artificial Sequence
  chemically synthesized
agatgccttgctgataatatta

SEQ ID NO: 1267237 - DNA, 22 bp, Artificial Sequence
  chemically synthesized
gataacccttttcatatataat

SEQ ID NO: 1267238 - DNA, 22 bp, Artificial Sequence
  chemically synthesized
gctgataatattatatatgaaa

SEQ ID NO: 1267239 - DNA, 22 bp, Artificial Sequence
  chemically synthesized
ctgataatattatatatgaaaa

SEQ ID NO: 1267240 - DNA, 22 bp, Artificial Sequence
  chemically synthesized
ataatattatatatgaaaaggg

SEQ ID NO: 1267241 - DNA, 22 bp, Artificial Sequence
  chemically synthesized
tatatgaaaagggttatcgaat

SEQ ID NO: 1267242 - DNA, 22 bp, Artificial Sequence
  chemically synthesized
ccccaaccccaaacccgataaa

SEQ ID NO: 1267243 - DNA, 22 bp, Artificial Sequence
  chemically synthesized
cccccaaccccaaacccgataa

SEQ ID NO: 1267244 - DNA, 22 bp, Artificial Sequence
  chemically synthesized
tttcccccaaccccaaacccga

SEQ ID NO: 1267245 - DNA, 22 bp, Artificial Sequence
  chemically synthesized
tcgaatttatcgggtttggggt

SEQ ID NO: 1267246 - DNA, 22 bp, Artificial Sequence
  chemically synthesized
ataagtattatttcccccaacc

SEQ ID NO: 1267247 - DNA, 22 bp, Artificial Sequence
  chemically synthesized
atcgggtttggggttgggggaa

SEQ ID NO: 1267248 - DNA, 22 bp, Artificial Sequence
  chemically synthesized
gataagtattatttcccccaac

SEQ ID NO: 1267249 - DNA, 22 bp, Artificial Sequence
  chemically synthesized
tcgggtttggggttgggggaaa

SEQ ID NO: 1267250 - DNA, 22 bp, Artificial Sequence
  chemically synthesized
tgataagtattatttcccccaa

SEQ ID NO: 1267251 - DNA, 22 bp, Artificial Sequence
  chemically synthesized
ctttgataagtattatttcccc

SEQ ID NO: 1267252 - DNA, 22 bp, Artificial Sequence
  chemically synthesized
ctcctttgataagtattatttc

SEQ ID NO: 1267253 - DNA, 22 bp, Artificial Sequence
  chemically synthesized
actcctttgataagtattattt

SEQ ID NO: 1267254 - DNA, 22 bp, Artificial Sequence
  chemically synthesized
ggggttgggggaaataatactt

SEQ ID NO: 1267255 - DNA, 22 bp, Artificial Sequence
  chemically synthesized
tactcctttgataagtattatt

SEQ ID NO: 1267256 - DNA, 22 bp, Artificial Sequence
  chemically synthesized
gggttgggggaaataatactta

SEQ ID NO: 1267257 - DNA, 22 bp, Artificial Sequence
  chemically synthesized
ttactcctttgataagtattat

SEQ ID NO: 1267258 - DNA, 22 bp, Artificial Sequence
  chemically synthesized
ggggaaataatacttatcaaag

SEQ ID NO: 1267259 - DNA, 22 bp, Artificial Sequence
  chemically synthesized
atatttttactcctttgataag

SEQ ID NO: 1267260 - DNA, 22 bp, Artificial Sequence
  chemically synthesized
ctcatatttttactcctttgat

SEQ ID NO: 1267261 - DNA, 22 bp, Artificial Sequence
  chemically synthesized
tgaactgctcatatttttactc

SEQ ID NO: 1267262 - DNA, 22 bp, Artificial Sequence
  chemically synthesized
atgaactgctcatatttttact

SEQ ID NO: 1267263 - DNA, 22 bp, Artificial Sequence
  chemically synthesized
tatgaactgctcatatttttac

SEQ ID NO: 1267264 - DNA, 22 bp, Artificial Sequence
  chemically synthesized
atcaaaggagtaaaaatatgag

SEQ ID NO: 1267265 - DNA, 22 bp, Artificial Sequence
  chemically synthesized
ttttatgaactgctcatatttt

SEQ ID NO: 1267266 - DNA, 22 bp, Artificial Sequence
  chemically synthesized
tcaaaggagtaaaaatatgagc

SEQ ID NO: 1267267 - DNA, 22 bp, Artificial Sequence
  chemically synthesized
tcacaggttattttatgaactg

SEQ ID NO: 1267268 - DNA, 22 bp, Artificial Sequence
  chemically synthesized
gactatcacaggttattttatg

SEQ ID NO: 1267269 - DNA, 22 bp, Artificial Sequence
  chemically synthesized
ataaaataacctgtgatagtcc

SEQ ID NO: 1267270 - DNA, 22 bp, Artificial Sequence
  chemically synthesized
tgatagtccagattacttgcat

SEQ ID NO: 1267271 - DNA, 22 bp, Artificial Sequence
  chemically synthesized
aaatgcaagggaaaatatgcaa

SEQ ID NO: 1267272 - DNA, 22 bp, Artificial Sequence
  chemically synthesized
tgaaatgcaagggaaaatatgc

SEQ ID NO: 1267273 - DNA, 22 bp, Artificial Sequence
  chemically synthesized
cttgcatattttcccttgcatt

SEQ ID NO: 1267274 - DNA, 22 bp, Artificial Sequence
  chemically synthesized
ataaggactctgaaatgcaagg

SEQ ID NO: 1267275 - DNA, 22 bp, Artificial Sequence
  chemically synthesized
gcatattttcccttgcatttca

SEQ ID NO: 1267276 - DNA, 22 bp, Artificial Sequence
  chemically synthesized
catattttcccttgcatttcag

SEQ ID NO: 1267277 - DNA, 22 bp, Artificial Sequence
  chemically synthesized
aatactgataaggactctgaaa

SEQ ID NO: 1267278 - DNA, 22 bp, Artificial Sequence
  chemically synthesized
gaatactgataaggactctgaa

SEQ ID NO: 1267279 - DNA, 22 bp, Artificial Sequence
  chemically synthesized
tgaatactgataaggactctga

SEQ ID NO: 1267280 - DNA, 22 bp, Artificial Sequence
  chemically synthesized
tcccttgcatttcagagtcctt

SEQ ID NO: 1267281 - DNA, 22 bp, Artificial Sequence
  chemically synthesized
cccttgcatttcagagtcctta

SEQ ID NO: 1267282 - DNA, 22 bp, Artificial Sequence
  chemically synthesized
ccttgcatttcagagtccttat

SEQ ID NO: 1267283 - DNA, 22 bp, Artificial Sequence
  chemically synthesized
gcatttcagagtccttatcagt

SEQ ID NO: 1267284 - DNA, 22 bp, Artificial Sequence
  chemically synthesized
catttcagagtccttatcagta

SEQ ID NO: 1267285 - DNA, 22 bp, Artificial Sequence
  chemically synthesized
cagtcctttgaatactgataag

SEQ ID NO: 1267286 - DNA, 22 bp, Artificial Sequence
  chemically synthesized
tacagtcctttgaatactgata

SEQ ID NO: 1267287 - DNA, 22 bp, Artificial Sequence
  chemically synthesized
cagagtccttatcagtattcaa

SEQ ID NO: 1267288 - DNA, 22 bp, Artificial Sequence
  chemically synthesized
agagtccttatcagtattcaaa

SEQ ID NO: 1267289 - DNA, 22 bp, Artificial Sequence
  chemically synthesized
aaagctctacagtcctttgaat

SEQ ID NO: 1267290 - DNA, 22 bp, Artificial Sequence
  chemically synthesized
taaaagctctacagtcctttga

SEQ ID NO: 1267291 - DNA, 22 bp, Artificial Sequence
  chemically synthesized
ctaaaagctctacagtcctttg

SEQ ID NO: 1267292 - DNA, 22 bp, Artificial Sequence
  chemically synthesized
atcagtattcaaaggactgtag

SEQ ID NO: 1267293 - DNA, 22 bp, Artificial Sequence
  chemically synthesized
tcagtattcaaaggactgtaga

SEQ ID NO: 1267294 - DNA, 22 bp, Artificial Sequence
  chemically synthesized
aagcatttctaaaagctctaca

SEQ ID NO: 1267295 - DNA, 22 bp, Artificial Sequence
  chemically synthesized
actgaagcatttctaaaagctc

SEQ ID NO: 1267296 - DNA, 22 bp, Artificial Sequence
  chemically synthesized
aaaggactgtagagcttttaga

SEQ ID NO: 1267297 - DNA, 22 bp, Artificial Sequence
  chemically synthesized
ctcactgaagcatttctaaaag

SEQ ID NO: 1267298 - DNA, 22 bp, Artificial Sequence
  chemically synthesized
tagagcttttagaaatgcttca

SEQ ID NO: 1267299 - DNA, 22 bp, Artificial Sequence
  chemically synthesized
ttagaaatgcttcagtgaggaa

SEQ ID NO: 1267300 - DNA, 22 bp, Artificial Sequence
  chemically synthesized
tagaaatgcttcagtgaggaac

SEQ ID NO: 1267301 - DNA, 22 bp, Artificial Sequence
  chemically synthesized
agaaatgcttcagtgaggaaca

SEQ ID NO: 1267302 - DNA, 22 bp, Artificial Sequence
  chemically synthesized
gaaatgcttcagtgaggaacac

SEQ ID NO: 1267303 - DNA, 22 bp, Artificial Sequence
  chemically synthesized
tcagggacagagtataaagtgt

SEQ ID NO: 1267304 - DNA, 22 bp, Artificial Sequence
  chemically synthesized
atcagggacagagtataaagtg

SEQ ID NO: 1267305 - DNA, 22 bp, Artificial Sequence
  chemically synthesized
cagtgaggaacactttatactc

SEQ ID NO: 1267306 - DNA, 22 bp, Artificial Sequence
  chemically synthesized
agtgaggaacactttatactct

SEQ ID NO: 1267307 - DNA, 22 bp, Artificial Sequence
  chemically synthesized
atttatcagggacagagtataa

SEQ ID NO: 1267308 - DNA, 22 bp, Artificial Sequence
  chemically synthesized
catttatcagggacagagtata

SEQ ID NO: 1267309 - DNA, 22 bp, Artificial Sequence
  chemically synthesized
tcatttatcagggacagagtat

SEQ ID NO: 1267310 - DNA, 22 bp, Artificial Sequence
  chemically synthesized
tatactctgtccctgataaatg

SEQ ID NO: 1267311 - DNA, 22 bp, Artificial Sequence
  chemically synthesized
atactctgtccctgataaatga

SEQ ID NO: 1267312 - DNA, 22 bp, Artificial Sequence
  chemically synthesized
tactctgtccctgataaatgaa

SEQ ID NO: 1267313 - DNA, 22 bp, Artificial Sequence
  chemically synthesized
agaggaaataaacactttcatt

SEQ ID NO: 1267314 - DNA, 22 bp, Artificial Sequence
  chemically synthesized
tgtccctgataaatgaaagtgt

SEQ ID NO: 1267315 - DNA, 22 bp, Artificial Sequence
  chemically synthesized
tccctgataaatgaaagtgttt

SEQ ID NO: 1267316 - DNA, 22 bp, Artificial Sequence
  chemically synthesized
tctgagaggaaataaacacttt

SEQ ID NO: 1267317 - DNA, 22 bp, Artificial Sequence
  chemically synthesized
atctgagaggaaataaacactt

SEQ ID NO: 1267318 - DNA, 22 bp, Artificial Sequence
  chemically synthesized
ataaatgaaagtgtttatttcc

SEQ ID NO: 1267319 - DNA, 22 bp, Artificial Sequence
  chemically synthesized
acttatctgagaggaaataaac

SEQ ID NO: 1267320 - DNA, 22 bp, Artificial Sequence
  chemically synthesized
ctgacttatctgagaggaaata

SEQ ID NO: 1267321 - DNA, 22 bp, Artificial Sequence
  chemically synthesized
ttactgacttatctgagaggaa

SEQ ID NO: 1267322 - DNA, 22 bp, Artificial Sequence
  chemically synthesized
gttactgacttatctgagagga

SEQ ID NO: 1267323 - DNA, 22 bp, Artificial Sequence
  chemically synthesized
cttgttactgacttatctgaga

SEQ ID NO: 1267324 - DNA, 22 bp, Artificial Sequence
  chemically synthesized
gcttgttactgacttatctgag

SEQ ID NO: 1267325 - DNA, 22 bp, Artificial Sequence
  chemically synthesized
atttcctctcagataagtcagt

SEQ ID NO: 1267326 - DNA, 22 bp, Artificial Sequence
  chemically synthesized
tttcctctcagataagtcagta

SEQ ID NO: 1267327 - DNA, 22 bp, Artificial Sequence
  chemically synthesized
cctctcagataagtcagtaaca

SEQ ID NO: 1267328 - DNA, 22 bp, Artificial Sequence
  chemically synthesized
ctctcagataagtcagtaacaa

SEQ ID NO: 1267329 - DNA, 22 bp, Artificial Sequence
  chemically synthesized
gaaaatacttgcttgttactga

SEQ ID NO: 1267330 - DNA, 22 bp, Artificial Sequence
  chemically synthesized
tcagataagtcagtaacaagca

SEQ ID NO: 1267331 - DNA, 22 bp, Artificial Sequence
  chemically synthesized
ctagaaaatacttgcttgttac

SEQ ID NO: 1267332 - DNA, 22 bp, Artificial Sequence
  chemically synthesized
agataagtcagtaacaagcaag

SEQ ID NO: 1267333 - DNA, 22 bp, Artificial Sequence
  chemically synthesized
tctagcaactggactataccca

SEQ ID NO: 1267334 - DNA, 22 bp, Artificial Sequence
  chemically synthesized
ctagcaactggactatacccac

SEQ ID NO: 1267335 - DNA, 22 bp, Artificial Sequence
  chemically synthesized
ggaaatgaataggtgggtatag

SEQ ID NO: 1267336 - DNA, 22 bp, Artificial Sequence
  chemically synthesized
tagcaactggactatacccacc

SEQ ID NO: 1267337 - DNA, 22 bp, Artificial Sequence
  chemically synthesized
gggaaatgaataggtgggtata

SEQ ID NO: 1267338 - DNA, 22 bp, Artificial Sequence
  chemically synthesized
gcaactggactatacccaccta

SEQ ID NO: 1267339 - DNA, 22 bp, Artificial Sequence
  chemically synthesized
gactatacccacctattcattt

SEQ ID NO: 1267340 - DNA, 22 bp, Artificial Sequence
  chemically synthesized
tacccacctattcatttcccaa

SEQ ID NO: 1267341 - DNA, 22 bp, Artificial Sequence
  chemically synthesized
gtgatgcccaatgagccttggg

SEQ ID NO: 1267342 - DNA, 22 bp, Artificial Sequence
  chemically synthesized
ctagtgatgcccaatgagcctt

SEQ ID NO: 1267343 - DNA, 22 bp, Artificial Sequence
  chemically synthesized
ttcatttcccaaggctcattgg

SEQ ID NO: 1267344 - DNA, 22 bp, Artificial Sequence
  chemically synthesized
atttcccaaggctcattgggca

SEQ ID NO: 1267345 - DNA, 22 bp, Artificial Sequence
  chemically synthesized
tattcctagtgatgcccaatga

SEQ ID NO: 1267346 - DNA, 22 bp, Artificial Sequence
  chemically synthesized
ttgtattcctagtgatgcccaa

SEQ ID NO: 1267347 - DNA, 22 bp, Artificial Sequence
  chemically synthesized
cccaaggctcattgggcatcac

SEQ ID NO: 1267348 - DNA, 22 bp, Artificial Sequence
  chemically synthesized
ccaaggctcattgggcatcact

SEQ ID NO: 1267349 - DNA, 22 bp, Artificial Sequence
  chemically synthesized
aaacctgttgtattcctagtga

SEQ ID NO: 1267350 - DNA, 22 bp, Artificial Sequence
  chemically synthesized
attgggcatcactaggaataca

SEQ ID NO: 1267351 - DNA, 22 bp, Artificial Sequence
  chemically synthesized
ggcatcactaggaatacaacag

SEQ ID NO: 1267352 - DNA, 22 bp, Artificial Sequence
  chemically synthesized
gtagtaactaaaacctgttgta

SEQ ID NO: 1267353 - DNA, 22 bp, Artificial Sequence
  chemically synthesized
gggttggtagtaactaaaacct

SEQ ID NO: 1267354 - DNA, 22 bp, Artificial Sequence
  chemically synthesized
ggaatacaacaggttttagtta

SEQ ID NO: 1267355 - DNA, 22 bp, Artificial Sequence
  chemically synthesized
cagtaactggggttggtagtaa

SEQ ID NO: 1267356 - DNA, 22 bp, Artificial Sequence
  chemically synthesized
tacagtaactggggttggtagt

SEQ ID NO: 1267357 - DNA, 22 bp, Artificial Sequence
  chemically synthesized
attctacagtaactggggttgg

SEQ ID NO: 1267358 - DNA, 22 bp, Artificial Sequence
  chemically synthesized
tagttactaccaaccccagtta

SEQ ID NO: 1267359 - DNA, 22 bp, Artificial Sequence
  chemically synthesized
agttactaccaaccccagttac

SEQ ID NO: 1267360 - DNA, 22 bp, Artificial Sequence
  chemically synthesized
cctaattctacagtaactgggg

SEQ ID NO: 1267361 - DNA, 22 bp, Artificial Sequence
  chemically synthesized
gttactaccaaccccagttact

SEQ ID NO: 1267362 - DNA, 22 bp, Artificial Sequence
  chemically synthesized
ctaccaaccccagttactgtag

SEQ ID NO: 1267363 - DNA, 22 bp, Artificial Sequence
  chemically synthesized
ccaaccccagttactgtagaat

SEQ ID NO: 1267364 - DNA, 22 bp, Artificial Sequence
  chemically synthesized
tataattgcctaattctacagt

SEQ ID NO: 1267365 - DNA, 22 bp, Artificial Sequence
  chemically synthesized
atataattgcctaattctacag

SEQ ID NO: 1267366 - DNA, 22 bp, Artificial Sequence
  chemically synthesized
ttatataattgcctaattctac

SEQ ID NO: 1267367 - DNA, 22 bp, Artificial Sequence
  chemically synthesized
aactcttatataattgcctaat

SEQ ID NO: 1267368 - DNA, 22 bp, Artificial Sequence
  chemically synthesized
aaactcttatataattgcctaa

SEQ ID NO: 1267369 - DNA, 22 bp, Artificial Sequence
  chemically synthesized
taaactcttatataattgccta

SEQ ID NO: 1267370 - DNA, 22 bp, Artificial Sequence
  chemically synthesized
ttaaactcttatataattgcct

SEQ ID NO: 1267371 - DNA, 22 bp, Artificial Sequence
  chemically synthesized
tttaaactcttatataattgcc

SEQ ID NO: 1267372 - DNA, 22 bp, Artificial Sequence
  chemically synthesized
ctgtagaattaggcaattatat

SEQ ID NO: 1267373 - DNA, 22 bp, Artificial Sequence
  chemically synthesized
tagaattaggcaattatataag

SEQ ID NO: 1267374 - DNA, 22 bp, Artificial Sequence
  chemically synthesized
attttttaaactcttatataat

SEQ ID NO: 1267375 - DNA, 22 bp, Artificial Sequence
  chemically synthesized
ctgattttttaaactcttatat

SEQ ID NO: 1267376 - DNA, 22 bp, Artificial Sequence
  chemically synthesized
actgattttttaaactcttata

SEQ ID NO: 1267377 - DNA, 22 bp, Artificial Sequence
  chemically synthesized
ggcaattatataagagtttaaa

SEQ ID NO: 1267378 - DNA, 22 bp, Artificial Sequence
  chemically synthesized
tataagagtttaaaaaatcagt

SEQ ID NO: 1267379 - DNA, 22 bp, Artificial Sequence
  chemically synthesized
aaataaaaacatccttactgat

SEQ ID NO: 1267380 - DNA, 22 bp, Artificial Sequence
  chemically synthesized
aaaataaaaacatccttactga

SEQ ID NO: 1267381 - DNA, 22 bp, Artificial Sequence
  chemically synthesized
aaaaaatcagtaaggatgtttt

SEQ ID NO: 1267382 - DNA, 22 bp, Artificial Sequence
  chemically synthesized
aaaaatcagtaaggatgttttt

SEQ ID NO: 1267383 - DNA, 22 bp, Artificial Sequence
  chemically synthesized
tccaagtagtttaaaataaaaa

SEQ ID NO: 1267384 - DNA, 22 bp, Artificial Sequence
  chemically synthesized
aattatccaagtagtttaaaat

SEQ ID NO: 1267385 - DNA, 22 bp, Artificial Sequence
  chemically synthesized
caattatccaagtagtttaaaa

SEQ ID NO: 1267386 - DNA, 22 bp, Artificial Sequence
  chemically synthesized
tcaattatccaagtagtttaaa

SEQ ID NO: 1267387 - DNA, 22 bp, Artificial Sequence
  chemically synthesized
ttcaattatccaagtagtttaa

SEQ ID NO: 1267388 - DNA, 22 bp, Artificial Sequence
  chemically synthesized
cttttcaattatccaagtagtt

SEQ ID NO: 1267389 - DNA, 22 bp, Artificial Sequence
  chemically synthesized
ttattttaaactacttggataa

SEQ ID NO: 1267390 - DNA, 22 bp, Artificial Sequence
  chemically synthesized
cctacttttcaattatccaagt

SEQ ID NO: 1267391 - DNA, 22 bp, Artificial Sequence
  chemically synthesized
tattttaaactacttggataat

SEQ ID NO: 1267392 - DNA, 22 bp, Artificial Sequence
  chemically synthesized
attttaaactacttggataatt

SEQ ID NO: 1267393 - DNA, 22 bp, Artificial Sequence
  chemically synthesized
ttttaaactacttggataattg

SEQ ID NO: 1267394 - DNA, 22 bp, Artificial Sequence
  chemically synthesized
tctacctacttttcaattatcc

SEQ ID NO: 1267395 - DNA, 22 bp, Artificial Sequence
  chemically synthesized
taaactacttggataattgaaa

SEQ ID NO: 1267396 - DNA, 22 bp, Artificial Sequence
  chemically synthesized
aaactacttggataattgaaaa

SEQ ID NO: 1267397 - DNA, 22 bp, Artificial Sequence
  chemically synthesized
aactacttggataattgaaaag

SEQ ID NO: 1267398 - DNA, 22 bp, Artificial Sequence
  chemically synthesized
cttggataattgaaaagtaggt

SEQ ID NO: 1267399 - DNA, 22 bp, Artificial Sequence
  chemically synthesized
ggataattgaaaagtaggtaga

SEQ ID NO: 1267400 - DNA, 22 bp, Artificial Sequence
  chemically synthesized
gataattgaaaagtaggtagac

SEQ ID NO: 1267401 - DNA, 22 bp, Artificial Sequence
  chemically synthesized
aaaagtaggtagacaacattta

SEQ ID NO: 1267402 - DNA, 22 bp, Artificial Sequence
  chemically synthesized
gcaaataaagacaaaaaataaa

SEQ ID NO: 1267403 - DNA, 22 bp, Artificial Sequence
  chemically synthesized
ggcaaataaagacaaaaaataa

SEQ ID NO: 1267404 - DNA, 22 bp, Artificial Sequence
  chemically synthesized
atacagtcgtttggcaaataaa

SEQ ID NO: 1267405 - DNA, 22 bp, Artificial Sequence
  chemically synthesized
attttttgtctttatttgccaa

SEQ ID NO: 1267406 - DNA, 22 bp, Artificial Sequence
  chemically synthesized
ttttttgtctttatttgccaaa

SEQ ID NO: 1267407 - DNA, 22 bp, Artificial Sequence
  chemically synthesized
tttgtctttatttgccaaacga

SEQ ID NO: 1267408 - DNA, 22 bp, Artificial Sequence
  chemically synthesized
aatctaatacagtcgtttggca

SEQ ID NO: 1267409 - DNA, 22 bp, Artificial Sequence
  chemically synthesized
ttgtctttatttgccaaacgac

SEQ ID NO: 1267410 - DNA, 22 bp, Artificial Sequence
  chemically synthesized
aaatctaatacagtcgtttggc

SEQ ID NO: 1267411 - DNA, 22 bp, Artificial Sequence
  chemically synthesized
tgtctttatttgccaaacgact

SEQ ID NO: 1267412 - DNA, 22 bp, Artificial Sequence
  chemically synthesized
taaatctaatacagtcgtttgg

SEQ ID NO: 1267413 - DNA, 22 bp, Artificial Sequence
  chemically synthesized
gtctttatttgccaaacgactg

SEQ ID NO: 1267414 - DNA, 22 bp, Artificial Sequence
  chemically synthesized
tctttatttgccaaacgactgt

SEQ ID NO: 1267415 - DNA, 22 bp, Artificial Sequence
  chemically synthesized
gttttaaatctaatacagtcgt

SEQ ID NO: 1267416 - DNA, 22 bp, Artificial Sequence
  chemically synthesized
tatttgccaaacgactgtatta

SEQ ID NO: 1267417 - DNA, 22 bp, Artificial Sequence
  chemically synthesized
tggttttaaatctaatacagtc

SEQ ID NO: 1267418 - DNA, 22 bp, Artificial Sequence
  chemically synthesized
atttgccaaacgactgtattag

SEQ ID NO: 1267419 - DNA, 22 bp, Artificial Sequence
  chemically synthesized
ctggttttaaatctaatacagt

SEQ ID NO: 1267420 - DNA, 22 bp, Artificial Sequence
  chemically synthesized
tttgccaaacgactgtattaga

SEQ ID NO: 1267421 - DNA, 22 bp, Artificial Sequence
  chemically synthesized
tctggttttaaatctaatacag

SEQ ID NO: 1267422 - DNA, 22 bp, Artificial Sequence
  chemically synthesized
gccaaacgactgtattagattt

SEQ ID NO: 1267423 - DNA, 22 bp, Artificial Sequence
  chemically synthesized
ttttctggttttaaatctaata

SEQ ID NO: 1267424 - DNA, 22 bp, Artificial Sequence
  chemically synthesized
ccaaacgactgtattagattta

SEQ ID NO: 1267425 - DNA, 22 bp, Artificial Sequence
  chemically synthesized
gttttctggttttaaatctaat

SEQ ID NO: 1267426 - DNA, 22 bp, Artificial Sequence
  chemically synthesized
tattagatttaaaaccagaaaa

SEQ ID NO: 1267427 - DNA, 22 bp, Artificial Sequence
  chemically synthesized
cataggggcttgttttctggtt

SEQ ID NO: 1267428 - DNA, 22 bp, Artificial Sequence
  chemically synthesized
tacataggggcttgttttctgg

SEQ ID NO: 1267429 - DNA, 22 bp, Artificial Sequence
  chemically synthesized
gatttaaaaccagaaaacaagc

SEQ ID NO: 1267430 - DNA, 22 bp, Artificial Sequence
  chemically synthesized
tattctacataggggcttgttt

SEQ ID NO: 1267431 - DNA, 22 bp, Artificial Sequence
  chemically synthesized
aaaaccagaaaacaagccccta

SEQ ID NO: 1267432 - DNA, 22 bp, Artificial Sequence
  chemically synthesized
aaaccagaaaacaagcccctat

SEQ ID NO: 1267433 - DNA, 22 bp, Artificial Sequence
  chemically synthesized
gtgagaatctatattctacata

SEQ ID NO: 1267434 - DNA, 22 bp, Artificial Sequence
  chemically synthesized
tgaactggtgagaatctatatt

SEQ ID NO: 1267435 - DNA, 22 bp, Artificial Sequence
  chemically synthesized
atctatgaactggtgagaatct

SEQ ID NO: 1267436 - DNA, 22 bp, Artificial Sequence
  chemically synthesized
gatctatgaactggtgagaatc

SEQ ID NO: 1267437 - DNA, 22 bp, Artificial Sequence
  chemically synthesized
tgtagaatatagattctcacca

SEQ ID NO: 1267438 - DNA, 22 bp, Artificial Sequence
  chemically synthesized
cttgatctatgaactggtgaga

SEQ ID NO: 1267439 - DNA, 22 bp, Artificial Sequence
  chemically synthesized
ttacttgatctatgaactggtg

SEQ ID NO: 1267440 - DNA, 22 bp, Artificial Sequence
  chemically synthesized
attacttgatctatgaactggt

SEQ ID NO: 1267441 - DNA, 22 bp, Artificial Sequence
  chemically synthesized
tcaccagttcatagatcaagta

SEQ ID NO: 1267442 - DNA, 22 bp, Artificial Sequence
  chemically synthesized
ggaaatgtcttattacttgatc

SEQ ID NO: 1267443 - DNA, 22 bp, Artificial Sequence
  chemically synthesized
accagttcatagatcaagtaat

SEQ ID NO: 1267444 - DNA, 22 bp, Artificial Sequence
  chemically synthesized
atagatcaagtaataagacatt

SEQ ID NO: 1267445 - DNA, 22 bp, Artificial Sequence
  chemically synthesized
aacaccctaggaaatgtcttat

SEQ ID NO: 1267446 - DNA, 22 bp, Artificial Sequence
  chemically synthesized
gtatcaaacaattaaacaccct

SEQ ID NO: 1267447 - DNA, 22 bp, Artificial Sequence
  chemically synthesized
agtatcaaacaattaaacaccc

SEQ ID NO: 1267448 - DNA, 22 bp, Artificial Sequence
  chemically synthesized
ttagtatcaaacaattaaacac

SEQ ID NO: 1267449 - DNA, 22 bp, Artificial Sequence
  chemically synthesized
ctcttagtatcaaacaattaaa

SEQ ID NO: 1267450 - DNA, 22 bp, Artificial Sequence
  chemically synthesized
cctagggtgtttaattgtttga

SEQ ID NO: 1267451 - DNA, 22 bp, Artificial Sequence
  chemically synthesized
ttgctcttagtatcaaacaatt

SEQ ID NO: 1267452 - DNA, 22 bp, Artificial Sequence
  chemically synthesized
ctagggtgtttaattgtttgat

SEQ ID NO: 1267453 - DNA, 22 bp, Artificial Sequence
  chemically synthesized
attgctcttagtatcaaacaat

SEQ ID NO: 1267454 - DNA, 22 bp, Artificial Sequence
  chemically synthesized
gggtgtttaattgtttgatact

SEQ ID NO: 1267455 - DNA, 22 bp, Artificial Sequence
  chemically synthesized
taatttattgctcttagtatca

SEQ ID NO: 1267456 - DNA, 22 bp, Artificial Sequence
  chemically synthesized
ctataatttattgctcttagta

SEQ ID NO: 1267457 - DNA, 22 bp, Artificial Sequence
  chemically synthesized
cctataatttattgctcttagt

SEQ ID NO: 1267458 - DNA, 22 bp, Artificial Sequence
  chemically synthesized
aattgtttgatactaagagcaa

SEQ ID NO: 1267459 - DNA, 22 bp, Artificial Sequence
  chemically synthesized
tcctataatttattgctcttag

SEQ ID NO: 1267460 - DNA, 22 bp, Artificial Sequence
  chemically synthesized
attgtttgatactaagagcaat

SEQ ID NO: 1267461 - DNA, 22 bp, Artificial Sequence
  chemically synthesized
ttttcctataatttattgctct

SEQ ID NO: 1267462 - DNA, 22 bp, Artificial Sequence
  chemically synthesized
tttgatactaagagcaataaat

SEQ ID NO: 1267463 - DNA, 22 bp, Artificial Sequence
  chemically synthesized
gatactaagagcaataaattat

SEQ ID NO: 1267464 - DNA, 22 bp, Artificial Sequence
  chemically synthesized
atactaagagcaataaattata

SEQ ID NO: 1267465 - DNA, 22 bp, Artificial Sequence
  chemically synthesized
caaattattttcctataattta

SEQ ID NO: 1267466 - DNA, 22 bp, Artificial Sequence
  chemically synthesized
ttacaaattattttcctataat

SEQ ID NO: 1267467 - DNA, 22 bp, Artificial Sequence
  chemically synthesized
agagcaataaattataggaaaa

SEQ ID NO: 1267468 - DNA, 22 bp, Artificial Sequence
  chemically synthesized
accaattattacaaattatttt

SEQ ID NO: 1267469 - DNA, 22 bp, Artificial Sequence
  chemically synthesized
aaccaattattacaaattattt

SEQ ID NO: 1267470 - DNA, 22 bp, Artificial Sequence
  chemically synthesized
cttaaccaattattacaaatta

SEQ ID NO: 1267471 - DNA, 22 bp, Artificial Sequence
  chemically synthesized
taggaaaataatttgtaataat

SEQ ID NO: 1267472 - DNA, 22 bp, Artificial Sequence
  chemically synthesized
attacttaaccaattattacaa

SEQ ID NO: 1267473 - DNA, 22 bp, Artificial Sequence
  chemically synthesized
tggttaattacttaaccaatta

SEQ ID NO: 1267474 - DNA, 22 bp, Artificial Sequence
  chemically synthesized
attgtggttaattacttaacca

SEQ ID NO: 1267475 - DNA, 22 bp, Artificial Sequence
  chemically synthesized
aattgtggttaattacttaacc

SEQ ID NO: 1267476 - DNA, 22 bp, Artificial Sequence
  chemically synthesized
ttaattgtggttaattacttaa

SEQ ID NO: 1267477 - DNA, 22 bp, Artificial Sequence
  chemically synthesized
gtaataattggttaagtaatta

SEQ ID NO: 1267478 - DNA, 22 bp, Artificial Sequence
  chemically synthesized
cttaattgtggttaattactta

SEQ ID NO: 1267479 - DNA, 22 bp, Artificial Sequence
  chemically synthesized
taataattggttaagtaattaa

SEQ ID NO: 1267480 - DNA, 22 bp, Artificial Sequence
  chemically synthesized
tcttaattgtggttaattactt

SEQ ID NO: 1267481 - DNA, 22 bp, Artificial Sequence
  chemically synthesized
ttcttaattgtggttaattact

SEQ ID NO: 1267482 - DNA, 22 bp, Artificial Sequence
  chemically synthesized
gttaagtaattaaccacaatta

SEQ ID NO: 1267483 - DNA, 22 bp, Artificial Sequence
  chemically synthesized
catcatcttttcttaattgtgg

SEQ ID NO: 1267484 - DNA, 22 bp, Artificial Sequence
  chemically synthesized
agtaattaaccacaattaagaa

SEQ ID NO: 1267485 - DNA, 22 bp, Artificial Sequence
  chemically synthesized
agggattccatcatcttttctt

SEQ ID NO: 1267486 - DNA, 22 bp, Artificial Sequence
  chemically synthesized
accacaattaagaaaagatgat

SEQ ID NO: 1267487 - DNA, 22 bp, Artificial Sequence
  chemically synthesized
tcggatatcctcagggattcca

SEQ ID NO: 1267488 - DNA, 22 bp, Artificial Sequence
  chemically synthesized
agaaaagatgatggaatccctg

SEQ ID NO: 1267489 - DNA, 22 bp, Artificial Sequence
  chemically synthesized
tcagtattgtcggatatcctca

SEQ ID NO: 1267490 - DNA, 22 bp, Artificial Sequence
  chemically synthesized
taatgttgtcagtattgtcgga

SEQ ID NO: 1267491 - DNA, 22 bp, Artificial Sequence
  chemically synthesized
ataatgttgtcagtattgtcgg

SEQ ID NO: 1267492 - DNA, 22 bp, Artificial Sequence
  chemically synthesized
aggatatccgacaatactgaca

SEQ ID NO: 1267493 - DNA, 22 bp, Artificial Sequence
  chemically synthesized
aagtttataatgttgtcagtat

SEQ ID NO: 1267494 - DNA, 22 bp, Artificial Sequence
  chemically synthesized
aaagtttataatgttgtcagta

SEQ ID NO: 1267495 - DNA, 22 bp, Artificial Sequence
  chemically synthesized
ttaaagtttataatgttgtcag

SEQ ID NO: 1267496 - DNA, 22 bp, Artificial Sequence
  chemically synthesized
tcttaaagtttataatgttgtc

SEQ ID NO: 1267497 - DNA, 22 bp, Artificial Sequence
  chemically synthesized
ctcttaaagtttataatgttgt

SEQ ID NO: 1267498 - DNA, 22 bp, Artificial Sequence
  chemically synthesized
tctcttaaagtttataatgttg

SEQ ID NO: 1267499 - DNA, 22 bp, Artificial Sequence
  chemically synthesized
ttctcttaaagtttataatgtt

SEQ ID NO: 1267500 - DNA, 22 bp, Artificial Sequence
  chemically synthesized
tttctcttaaagtttataatgt

SEQ ID NO: 1267501 - DNA, 22 bp, Artificial Sequence
  chemically synthesized
ttttctcttaaagtttataatg

SEQ ID NO: 1267502 - DNA, 22 bp, Artificial Sequence
  chemically synthesized
tttttctcttaaagtttataat

SEQ ID NO: 1267503 - DNA, 22 bp, Artificial Sequence
  chemically synthesized
ttttttttctcttaaagtttat

SEQ ID NO: 1267504 - DNA, 22 bp, Artificial Sequence
  chemically synthesized
acaacattataaactttaagag

SEQ ID NO: 1267505 - DNA, 22 bp, Artificial Sequence
  chemically synthesized
caacaactattttttttctctt

SEQ ID NO: 1267506 - DNA, 22 bp, Artificial Sequence
  chemically synthesized
tgcaacaactattttttttctc

SEQ ID NO: 1267507 - DNA, 22 bp, Artificial Sequence
  chemically synthesized
taaactttaagagaaaaaaaat

SEQ ID NO: 1267508 - DNA, 22 bp, Artificial Sequence
  chemically synthesized
ctctgcaacaactatttttttt

SEQ ID NO: 1267509 - DNA, 22 bp, Artificial Sequence
  chemically synthesized
gctctgcaacaactattttttt

SEQ ID NO: 1267510 - DNA, 22 bp, Artificial Sequence
  chemically synthesized
ttgctctgcaacaactattttt

SEQ ID NO: 1267511 - DNA, 22 bp, Artificial Sequence
  chemically synthesized
cttgctctgcaacaactatttt

SEQ ID NO: 1267512 - DNA, 22 bp, Artificial Sequence
  chemically synthesized
tcttgctctgcaacaactattt

SEQ ID NO: 1267513 - DNA, 22 bp, Artificial Sequence
  chemically synthesized
taagagaaaaaaaatagttgtt

SEQ ID NO: 1267514 - DNA, 22 bp, Artificial Sequence
  chemically synthesized
ttcttgctctgcaacaactatt

SEQ ID NO: 1267515 - DNA, 22 bp, Artificial Sequence
  chemically synthesized
aagagaaaaaaaatagttgttg

SEQ ID NO: 1267516 - DNA, 22 bp, Artificial Sequence
  chemically synthesized
agagaaaaaaaatagttgttgc

SEQ ID NO: 1267517 - DNA, 22 bp, Artificial Sequence
  chemically synthesized
ggcacatgatgacttttcttgc

SEQ ID NO: 1267518 - DNA, 22 bp, Artificial Sequence
  chemically synthesized
ttgcagagcaagaaaagtcatc

SEQ ID NO: 1267519 - DNA, 22 bp, Artificial Sequence
  chemically synthesized
tgctaggcacatgatgactttt

SEQ ID NO: 1267520 - DNA, 22 bp, Artificial Sequence
  chemically synthesized
gtgctaggcacatgatgacttt

SEQ ID NO: 1267521 - DNA, 22 bp, Artificial Sequence
  chemically synthesized
cagagcaagaaaagtcatcatg

SEQ ID NO: 1267522 - DNA, 22 bp, Artificial Sequence
  chemically synthesized
tttgtgctaggcacatgatgac

SEQ ID NO: 1267523 - DNA, 22 bp, Artificial Sequence
  chemically synthesized
tatttgtgctaggcacatgatg

SEQ ID NO: 1267524 - DNA, 22 bp, Artificial Sequence
  chemically synthesized
gacctctatttgtgctaggcac

SEQ ID NO: 1267525 - DNA, 22 bp, Artificial Sequence
  chemically synthesized
taattagacctctatttgtgct

SEQ ID NO: 1267526 - DNA, 22 bp, Artificial Sequence
  chemically synthesized
gcacaaatagaggtctaattat

SEQ ID NO: 1267527 - DNA, 22 bp, Artificial Sequence
  chemically synthesized
tgaaaaacgtaaaatcccctat

SEQ ID NO: 1267528 - DNA, 22 bp, Artificial Sequence
  chemically synthesized
attataggggattttacgtttt

SEQ ID NO: 1267529 - DNA, 22 bp, Artificial Sequence
  chemically synthesized
tagacattatgaaaaacgtaaa

SEQ ID NO: 1267530 - DNA, 22 bp, Artificial Sequence
  chemically synthesized
taggggattttacgtttttcat

SEQ ID NO: 1267531 - DNA, 22 bp, Artificial Sequence
  chemically synthesized
attgtagacattatgaaaaacg

SEQ ID NO: 1267532 - DNA, 22 bp, Artificial Sequence
  chemically synthesized
tacgtttttcataatgtctaca

SEQ ID NO: 1267533 - DNA, 22 bp, Artificial Sequence
  chemically synthesized
acgtttttcataatgtctacaa

SEQ ID NO: 1267534 - DNA, 22 bp, Artificial Sequence
  chemically synthesized
cgtttttcataatgtctacaat

SEQ ID NO: 1267535 - DNA, 22 bp, Artificial Sequence
  chemically synthesized
ttcataatgtctacaatgagca

SEQ ID NO: 1267536 - DNA, 22 bp, Artificial Sequence
  chemically synthesized
tcataatgtctacaatgagcat

SEQ ID NO: 1267537 - DNA, 22 bp, Artificial Sequence
  chemically synthesized
taaatgtagtatatgctcattg

SEQ ID NO: 1267538 - DNA, 22 bp, Artificial Sequence
  chemically synthesized
cataatgtctacaatgagcata

SEQ ID NO: 1267539 - DNA, 22 bp, Artificial Sequence
  chemically synthesized
ataatgtctacaatgagcatat

SEQ ID NO: 1267540 - DNA, 22 bp, Artificial Sequence
  chemically synthesized
gtgattataaatgtagtatatg

SEQ ID NO: 1267541 - DNA, 22 bp, Artificial Sequence
  chemically synthesized
ttcgtgattataaatgtagtat

SEQ ID NO: 1267542 - DNA, 22 bp, Artificial Sequence
  chemically synthesized
caatgagcatatactacattta

SEQ ID NO: 1267543 - DNA, 22 bp, Artificial Sequence
  chemically synthesized
atggactgttcgtgattataaa

SEQ ID NO: 1267544 - DNA, 22 bp, Artificial Sequence
  chemically synthesized
ctaatggactgttcgtgattat

SEQ ID NO: 1267545 - DNA, 22 bp, Artificial Sequence
  chemically synthesized
catttataatcacgaacagtcc

SEQ ID NO: 1267546 - DNA, 22 bp, Artificial Sequence
  chemically synthesized
ataatcacgaacagtccattag

SEQ ID NO: 1267547 - DNA, 22 bp, Artificial Sequence
  chemically synthesized
taatcacgaacagtccattagc

SEQ ID NO: 1267548 - DNA, 22 bp, Artificial Sequence
  chemically synthesized
agatatatgatacctgctaatg

SEQ ID NO: 1267549 - DNA, 22 bp, Artificial Sequence
  chemically synthesized
ccaactcagatatatgatacct

SEQ ID NO: 1267550 - DNA, 22 bp, Artificial Sequence
  chemically synthesized
cccaactcagatatatgatacc

SEQ ID NO: 1267551 - DNA, 22 bp, Artificial Sequence
  chemically synthesized
gcaggtatcatatatctgagtt

SEQ ID NO: 1267552 - DNA, 22 bp, Artificial Sequence
  chemically synthesized
gcgaagtgacagggtatttccc

SEQ ID NO: 1267553 - DNA, 22 bp, Artificial Sequence
  chemically synthesized
agttgggaaataccctgtcact

SEQ ID NO: 1267554 - DNA, 22 bp, Artificial Sequence
  chemically synthesized
ggaaataccctgtcacttcgct

SEQ ID NO: 1267555 - DNA, 22 bp, Artificial Sequence
  chemically synthesized
gaacaaaaagaaagaagtatta

SEQ ID NO: 1267556 - DNA, 22 bp, Artificial Sequence
  chemically synthesized
tcacttcgctaatacttctttc

SEQ ID NO: 1267557 - DNA, 22 bp, Artificial Sequence
  chemically synthesized
ttagaacaaaaagaaagaagta

SEQ ID NO: 1267558 - DNA, 22 bp, Artificial Sequence
  chemically synthesized
cgctaatacttctttctttttg

SEQ ID NO: 1267559 - DNA, 22 bp, Artificial Sequence
  chemically synthesized
gctaatacttctttctttttgt

SEQ ID NO: 1267560 - DNA, 22 bp, Artificial Sequence
  chemically synthesized
atacttctttctttttgttcta

SEQ ID NO: 1267561 - DNA, 22 bp, Artificial Sequence
  chemically synthesized
gtgaatacactattagaacaaa

SEQ ID NO: 1267562 - DNA, 22 bp, Artificial Sequence
  chemically synthesized
ggtgaatacactattagaacaa

SEQ ID NO: 1267563 - DNA, 22 bp, Artificial Sequence
  chemically synthesized
tttggtgaatacactattagaa

SEQ ID NO: 1267564 - DNA, 22 bp, Artificial Sequence
  chemically synthesized
ctttctttttgttctaatagtg

SEQ ID NO: 1267565 - DNA, 22 bp, Artificial Sequence
  chemically synthesized
tttctttttgttctaatagtgt

SEQ ID NO: 1267566 - DNA, 22 bp, Artificial Sequence
  chemically synthesized
tctttttgttctaatagtgtat

SEQ ID NO: 1267567 - DNA, 22 bp, Artificial Sequence
  chemically synthesized
ctttttgttctaatagtgtatt

SEQ ID NO: 1267568 - DNA, 22 bp, Artificial Sequence
  chemically synthesized
tttttgttctaatagtgtattc

SEQ ID NO: 1267569 - DNA, 22 bp, Artificial Sequence
  chemically synthesized
tttgttctaatagtgtattcac

SEQ ID NO: 1267570 - DNA, 22 bp, Artificial Sequence
  chemically synthesized
gaagattatttggtgaatacac

SEQ ID NO: 1267571 - DNA, 22 bp, Artificial Sequence
  chemically synthesized
ttgttctaatagtgtattcacc

SEQ ID NO: 1267572 - DNA, 22 bp, Artificial Sequence
  chemically synthesized
agaagattatttggtgaataca

SEQ ID NO: 1267573 - DNA, 22 bp, Artificial Sequence
  chemically synthesized
tgttctaatagtgtattcacca

SEQ ID NO: 1267574 - DNA, 22 bp, Artificial Sequence
  chemically synthesized
gttctaatagtgtattcaccaa

SEQ ID NO: 1267575 - DNA, 22 bp, Artificial Sequence
  chemically synthesized
ttctaatagtgtattcaccaaa

SEQ ID NO: 1267576 - DNA, 22 bp, Artificial Sequence
  chemically synthesized
taatagtgtattcaccaaataa

SEQ ID NO: 1267577 - DNA, 22 bp, Artificial Sequence
  chemically synthesized
atagtgtattcaccaaataatc

SEQ ID NO: 1267578 - DNA, 22 bp, Artificial Sequence
  chemically synthesized
accaaataatcttctaaatata

SEQ ID NO: 1267579 - DNA, 22 bp, Artificial Sequence
  chemically synthesized
aaatatatatatatacacatat

SEQ ID NO: 1267580 - DNA, 22 bp, Artificial Sequence
  chemically synthesized
ctaaatatatatgtgtatatat

SEQ ID NO: 1267581 - DNA, 22 bp, Artificial Sequence
  chemically synthesized
taaatatatatgtgtatatata

SEQ ID NO: 1267582 - DNA, 22 bp, Artificial Sequence
  chemically synthesized
aatatatatgtgtatatatata

SEQ ID NO: 1267583 - DNA, 22 bp, Artificial Sequence
  chemically synthesized
aaatatatatacatatatatct

SEQ ID NO: 1267584 - DNA, 22 bp, Artificial Sequence
  chemically synthesized
gagatatatatgtatatatatt

SEQ ID NO: 1267585 - DNA, 22 bp, Artificial Sequence
  chemically synthesized
agatatatatgtatatatattt

SEQ ID NO: 1267586 - DNA, 22 bp, Artificial Sequence
  chemically synthesized
gagatatatatgtatatatatg

SEQ ID NO: 1267587 - DNA, 22 bp, Artificial Sequence
  chemically synthesized
agatatatatgtatatatatgt

SEQ ID NO: 1267588 - DNA, 22 bp, Artificial Sequence
  chemically synthesized
aaatatatatatacacgtatat

SEQ ID NO: 1267589 - DNA, 22 bp, Artificial Sequence
  chemically synthesized
catatatatatctcaaatatat

SEQ ID NO: 1267590 - DNA, 22 bp, Artificial Sequence
  chemically synthesized
ctgcatatatatatctcaaata

SEQ ID NO: 1267591 - DNA, 22 bp, Artificial Sequence
  chemically synthesized
cctgcatatatatatctcaaat

SEQ ID NO: 1267592 - DNA, 22 bp, Artificial Sequence
  chemically synthesized
ttcctgcatatatatatctcaa

SEQ ID NO: 1267593 - DNA, 22 bp, Artificial Sequence
  chemically synthesized
cttcctgcatatatatatctca

SEQ ID NO: 1267594 - DNA, 22 bp, Artificial Sequence
  chemically synthesized
acttcttcctgcatatatatat

SEQ ID NO: 1267595 - DNA, 22 bp, Artificial Sequence
  chemically synthesized
gagatatatatatgcaggaaga

SEQ ID NO: 1267596 - DNA, 22 bp, Artificial Sequence
  chemically synthesized
agatatatatatgcaggaagaa

SEQ ID NO: 1267597 - DNA, 22 bp, Artificial Sequence
  chemically synthesized
gaatgtcactcacttcttcctg

SEQ ID NO: 1267598 - DNA, 22 bp, Artificial Sequence
  chemically synthesized
agaatgtcactcacttcttcct

SEQ ID NO: 1267599 - DNA, 22 bp, Artificial Sequence
  chemically synthesized
ttagaatgtcactcacttcttc

SEQ ID NO: 1267600 - DNA, 22 bp, Artificial Sequence
  chemically synthesized
cttagaatgtcactcacttctt

SEQ ID NO: 1267601 - DNA, 22 bp, Artificial Sequence
  chemically synthesized
gtgtttcttagaatgtcactca

SEQ ID NO: 1267602 - DNA, 22 bp, Artificial Sequence
  chemically synthesized
gtcattagtgtttcttagaatg

SEQ ID NO: 1267603 - DNA, 22 bp, Artificial Sequence
  chemically synthesized
ggtcattagtgtttcttagaat

SEQ ID NO: 1267604 - DNA, 22 bp, Artificial Sequence
  chemically synthesized
tggtcattagtgtttcttagaa

SEQ ID NO: 1267605 - DNA, 22 bp, Artificial Sequence
  chemically synthesized
ttggtcattagtgtttcttaga

SEQ ID NO: 1267606 - DNA, 22 bp, Artificial Sequence
  chemically synthesized
tttggtcattagtgtttcttag

SEQ ID NO: 1267607 - DNA, 22 bp, Artificial Sequence
  chemically synthesized
tgtggttttttggtcattagtg

SEQ ID NO: 1267608 - DNA, 22 bp, Artificial Sequence
  chemically synthesized
taagaaacactaatgaccaaaa

SEQ ID NO: 1267609 - DNA, 22 bp, Artificial Sequence
  chemically synthesized
agaaacactaatgaccaaaaaa

SEQ ID NO: 1267610 - DNA, 22 bp, Artificial Sequence
  chemically synthesized
agaaaagatattatgtggtttt

SEQ ID NO: 1267611 - DNA, 22 bp, Artificial Sequence
  chemically synthesized
atgaccaaaaaaccacataata

SEQ ID NO: 1267612 - DNA, 22 bp, Artificial Sequence
  chemically synthesized
gccaatataaggaaggaacacc

SEQ ID NO: 1267613 - DNA, 22 bp, Artificial Sequence
  chemically synthesized
ttcttagtggtgttccttcctt

SEQ ID NO: 1267614 - DNA, 22 bp, Artificial Sequence
  chemically synthesized
tcttagtggtgttccttcctta

SEQ ID NO: 1267615 - DNA, 22 bp, Artificial Sequence
  chemically synthesized
cttagtggtgttccttccttat

SEQ ID NO: 1267616 - DNA, 22 bp, Artificial Sequence
  chemically synthesized
ttagtggtgttccttccttata

SEQ ID NO: 1267617 - DNA, 22 bp, Artificial Sequence
  chemically synthesized
agtggtgttccttccttatatt

SEQ ID NO: 1267618 - DNA, 22 bp, Artificial Sequence
  chemically synthesized
gtggtgttccttccttatattg

SEQ ID NO: 1267619 - DNA, 22 bp, Artificial Sequence
  chemically synthesized
caaggtggttggccaatataag

SEQ ID NO: 1267620 - DNA, 22 bp, Artificial Sequence
  chemically synthesized
ttgcaaggtggttggccaatat

SEQ ID NO: 1267621 - DNA, 22 bp, Artificial Sequence
  chemically synthesized
attgcaaggtggttggccaata

SEQ ID NO: 1267622 - DNA, 22 bp, Artificial Sequence
  chemically synthesized
tattgcaaggtggttggccaat

SEQ ID NO: 1267623 - DNA, 22 bp, Artificial Sequence
  chemically synthesized
ttattgcaaggtggttggccaa

SEQ ID NO: 1267624 - DNA, 22 bp, Artificial Sequence
  chemically synthesized
tttattgcaaggtggttggcca

SEQ ID NO: 1267625 - DNA, 22 bp, Artificial Sequence
  chemically synthesized
cttccttatattggccaaccac

SEQ ID NO: 1267626 - DNA, 22 bp, Artificial Sequence
  chemically synthesized
ccttatattggccaaccacctt

SEQ ID NO: 1267627 - DNA, 22 bp, Artificial Sequence
  chemically synthesized
cttatattggccaaccaccttg

SEQ ID NO: 1267628 - DNA, 22 bp, Artificial Sequence
  chemically synthesized
atattggccaaccaccttgcaa

SEQ ID NO: 1267629 - DNA, 22 bp, Artificial Sequence
  chemically synthesized
tattggccaaccaccttgcaat

SEQ ID NO: 1267630 - DNA, 22 bp, Artificial Sequence
  chemically synthesized
catcatcattttttattgcaag

SEQ ID NO: 1267631 - DNA, 22 bp, Artificial Sequence
  chemically synthesized
gccaaccaccttgcaataaaaa

SEQ ID NO: 1267632 - DNA, 22 bp, Artificial Sequence
  chemically synthesized
tctacatcatcattttttattg

SEQ ID NO: 1267633 - DNA, 22 bp, Artificial Sequence
  chemically synthesized
tgtctacatcatcattttttat

SEQ ID NO: 1267634 - DNA, 22 bp, Artificial Sequence
  chemically synthesized
ctgtctacatcatcatttttta

SEQ ID NO: 1267635 - DNA, 22 bp, Artificial Sequence
  chemically synthesized
tctgtctacatcatcatttttt

SEQ ID NO: 1267636 - DNA, 22 bp, Artificial Sequence
  chemically synthesized
ctttctgtctacatcatcattt

SEQ ID NO: 1267637 - DNA, 22 bp, Artificial Sequence
  chemically synthesized
cctttctgtctacatcatcatt

SEQ ID NO: 1267638 - DNA, 22 bp, Artificial Sequence
  chemically synthesized
tcctttctgtctacatcatcat

SEQ ID NO: 1267639 - DNA, 22 bp, Artificial Sequence
  chemically synthesized
ttcctttctgtctacatcatca

SEQ ID NO: 1267640 - DNA, 22 bp, Artificial Sequence
  chemically synthesized
gcaataaaaaatgatgatgtag

SEQ ID NO: 1267641 - DNA, 22 bp, Artificial Sequence
  chemically synthesized
caataaaaaatgatgatgtaga

SEQ ID NO: 1267642 - DNA, 22 bp, Artificial Sequence
  chemically synthesized
acttttcctttctgtctacatc

SEQ ID NO: 1267643 - DNA, 22 bp, Artificial Sequence
  chemically synthesized
taacttttcctttctgtctaca

SEQ ID NO: 1267644 - DNA, 22 bp, Artificial Sequence
  chemically synthesized
aaaggaaaggaaaaagaatagg

SEQ ID NO: 1267645 - DNA, 22 bp, Artificial Sequence
  chemically synthesized
gagctacctattctttttcctt

SEQ ID NO: 1267646 - DNA, 22 bp, Artificial Sequence
  chemically synthesized
cctattctttttcctttccttt

SEQ ID NO: 1267647 - DNA, 22 bp, Artificial Sequence
  chemically synthesized
ttctttttcctttccttttagt

SEQ ID NO: 1267648 - DNA, 22 bp, Artificial Sequence
  chemically synthesized
acgtgtaaggagggactaaaag

SEQ ID NO: 1267649 - DNA, 22 bp, Artificial Sequence
  chemically synthesized
tttttcctttccttttagtccc

SEQ ID NO: 1267650 - DNA, 22 bp, Artificial Sequence
  chemically synthesized
tttcctttccttttagtccctc

SEQ ID NO: 1267651 - DNA, 22 bp, Artificial Sequence
  chemically synthesized
ctgacgtgtaaggagggactaa

SEQ ID NO: 1267652 - DNA, 22 bp, Artificial Sequence
  chemically synthesized
ttcctttccttttagtccctcc

SEQ ID NO: 1267653 - DNA, 22 bp, Artificial Sequence
  chemically synthesized
actgacgtgtaaggagggacta

SEQ ID NO: 1267654 - DNA, 22 bp, Artificial Sequence
  chemically synthesized
tcctttccttttagtccctcct

SEQ ID NO: 1267655 - DNA, 22 bp, Artificial Sequence
  chemically synthesized
cctttccttttagtccctcctt

SEQ ID NO: 1267656 - DNA, 22 bp, Artificial Sequence
  chemically synthesized
ctttccttttagtccctcctta

SEQ ID NO: 1267657 - DNA, 22 bp, Artificial Sequence
  chemically synthesized
gcttactgacgtgtaaggaggg

SEQ ID NO: 1267658 - DNA, 22 bp, Artificial Sequence
  chemically synthesized
ggcttactgacgtgtaaggagg

SEQ ID NO: 1267659 - DNA, 22 bp, Artificial Sequence
  chemically synthesized
tccttttagtccctccttacac

SEQ ID NO: 1267660 - DNA, 22 bp, Artificial Sequence
  chemically synthesized
tggcttactgacgtgtaaggag

SEQ ID NO: 1267661 - DNA, 22 bp, Artificial Sequence
  chemically synthesized
ccttttagtccctccttacacg

SEQ ID NO: 1267662 - DNA, 22 bp, Artificial Sequence
  chemically synthesized
cttttagtccctccttacacgt

SEQ ID NO: 1267663 - DNA, 22 bp, Artificial Sequence
  chemically synthesized
ttagtccctccttacacgtcag

SEQ ID NO: 1267664 - DNA, 22 bp, Artificial Sequence
  chemically synthesized
tagtccctccttacacgtcagt

SEQ ID NO: 1267665 - DNA, 22 bp, Artificial Sequence
  chemically synthesized
agtccctccttacacgtcagta

SEQ ID NO: 1267666 - DNA, 22 bp, Artificial Sequence
  chemically synthesized
gtccctccttacacgtcagtaa

SEQ ID NO: 1267667 - DNA, 22 bp, Artificial Sequence
  chemically synthesized
cttacacgtcagtaagccaaag

SEQ ID NO: 1267668 - DNA, 22 bp, Artificial Sequence
  chemically synthesized
tcaagaagatgccctttggctt

SEQ ID NO: 1267669 - DNA, 22 bp, Artificial Sequence
  chemically synthesized
atcaagaagatgccctttggct

SEQ ID NO: 1267670 - DNA, 22 bp, Artificial Sequence
  chemically synthesized
acacgtcagtaagccaaagggc

SEQ ID NO: 1267671 - DNA, 22 bp, Artificial Sequence
  chemically synthesized
cacgtcagtaagccaaagggca

SEQ ID NO: 1267672 - DNA, 22 bp, Artificial Sequence
  chemically synthesized
ataaatgtacagtttatcaaga

SEQ ID NO: 1267673 - DNA, 22 bp, Artificial Sequence
  chemically synthesized
cataaatgtacagtttatcaag

SEQ ID NO: 1267674 - DNA, 22 bp, Artificial Sequence
  chemically synthesized
ttcataaatgtacagtttatca

SEQ ID NO: 1267675 - DNA, 22 bp, Artificial Sequence
  chemically synthesized
cttcataaatgtacagtttatc

SEQ ID NO: 1267676 - DNA, 22 bp, Artificial Sequence
  chemically synthesized
tcttcataaatgtacagtttat

SEQ ID NO: 1267677 - DNA, 22 bp, Artificial Sequence
  chemically synthesized
ctttcttcataaatgtacagtt

SEQ ID NO: 1267678 - DNA, 22 bp, Artificial Sequence
  chemically synthesized
cctttcttcataaatgtacagt

SEQ ID NO: 1267679 - DNA, 22 bp, Artificial Sequence
  chemically synthesized
tttcctttcttcataaatgtac

SEQ ID NO: 1267680 - DNA, 22 bp, Artificial Sequence
  chemically synthesized
cttgataaactgtacatttatg

SEQ ID NO: 1267681 - DNA, 22 bp, Artificial Sequence
  chemically synthesized
atttcctttcttcataaatgta

SEQ ID NO: 1267682 - DNA, 22 bp, Artificial Sequence
  chemically synthesized
ttgataaactgtacatttatga

SEQ ID NO: 1267683 - DNA, 22 bp, Artificial Sequence
  chemically synthesized
tatttcctttcttcataaatgt

SEQ ID NO: 1267684 - DNA, 22 bp, Artificial Sequence
  chemically synthesized
ttatttcctttcttcataaatg

SEQ ID NO: 1267685 - DNA, 22 bp, Artificial Sequence
  chemically synthesized
gataaactgtacatttatgaag

SEQ ID NO: 1267686 - DNA, 22 bp, Artificial Sequence
  chemically synthesized
ataaactgtacatttatgaaga

SEQ ID NO: 1267687 - DNA, 22 bp, Artificial Sequence
  chemically synthesized
atggtttttatttcctttcttc

SEQ ID NO: 1267688 - DNA, 22 bp, Artificial Sequence
  chemically synthesized
aatggtttttatttcctttctt

SEQ ID NO: 1267689 - DNA, 22 bp, Artificial Sequence
  chemically synthesized
tacatttatgaagaaaggaaat

SEQ ID NO: 1267690 - DNA, 22 bp, Artificial Sequence
  chemically synthesized
atgaagaaaggaaataaaaacc

SEQ ID NO: 1267691 - DNA, 22 bp, Artificial Sequence
  chemically synthesized
tgaagaaaggaaataaaaacca

SEQ ID NO: 1267692 - DNA, 22 bp, Artificial Sequence
  chemically synthesized
cataaaatgaacttaatggttt

SEQ ID NO: 1267693 - DNA, 22 bp, Artificial Sequence
  chemically synthesized
ccagaatagtggaaatgctgca

SEQ ID NO: 1267694 - DNA, 22 bp, Artificial Sequence
  chemically synthesized
agttcattttatgcagcatttc

SEQ ID NO: 1267695 - DNA, 22 bp, Artificial Sequence
  chemically synthesized
accagaatagtggaaatgctgc

SEQ ID NO: 1267696 - DNA, 22 bp, Artificial Sequence
  chemically synthesized
cttaccagaatagtggaaatgc

SEQ ID NO: 1267697 - DNA, 22 bp, Artificial Sequence
  chemically synthesized
acttaccagaatagtggaaatg

SEQ ID NO: 1267698 - DNA, 22 bp, Artificial Sequence
  chemically synthesized
attttatgcagcatttccacta

SEQ ID NO: 1267699 - DNA, 22 bp, Artificial Sequence
  chemically synthesized
tacttaccagaatagtggaaat

SEQ ID NO: 1267700 - DNA, 22 bp, Artificial Sequence
  chemically synthesized
tttacttaccagaatagtggaa

SEQ ID NO: 1267701 - DNA, 22 bp, Artificial Sequence
  chemically synthesized
ctttacttaccagaatagtgga

SEQ ID NO: 1267702 - DNA, 22 bp, Artificial Sequence
  chemically synthesized
tatgcagcatttccactattct

SEQ ID NO: 1267703 - DNA, 22 bp, Artificial Sequence
  chemically synthesized
tctttacttaccagaatagtgg

SEQ ID NO: 1267704 - DNA, 22 bp, Artificial Sequence
  chemically synthesized
atgcagcatttccactattctg

SEQ ID NO: 1267705 - DNA, 22 bp, Artificial Sequence
  chemically synthesized
tgcagcatttccactattctgg

SEQ ID NO: 1267706 - DNA, 22 bp, Artificial Sequence
  chemically synthesized
ccactattctggtaagtaaaga

SEQ ID NO: 1267707 - DNA, 22 bp, Artificial Sequence
  chemically synthesized
cactattctggtaagtaaagaa

SEQ ID NO: 1267708 - DNA, 22 bp, Artificial Sequence
  chemically synthesized
ttctggtaagtaaagaaagcat

SEQ ID NO: 1267709 - DNA, 22 bp, Artificial Sequence
  chemically synthesized
tggtaagtaaagaaagcatgtg

SEQ ID NO: 1267710 - DNA, 22 bp, Artificial Sequence
  chemically synthesized
gtaagtaaagaaagcatgtgtg

SEQ ID NO: 1267711 - DNA, 22 bp, Artificial Sequence
  chemically synthesized
atacatcatccacacacatgct

SEQ ID NO: 1267712 - DNA, 22 bp, Artificial Sequence
  chemically synthesized
catacatcatccacacacatgc

SEQ ID NO: 1267713 - DNA, 22 bp, Artificial Sequence
  chemically synthesized
tatttcatacatcatccacaca

SEQ ID NO: 1267714 - DNA, 22 bp, Artificial Sequence
  chemically synthesized
gtatttcatacatcatccacac

SEQ ID NO: 1267715 - DNA, 22 bp, Artificial Sequence
  chemically synthesized
cacaatttgtatttcatacatc

SEQ ID NO: 1267716 - DNA, 22 bp, Artificial Sequence
  chemically synthesized
tatggagagtcatagaaattac

SEQ ID NO: 1267717 - DNA, 22 bp, Artificial Sequence
  chemically synthesized
atatggagagtcatagaaatta

SEQ ID NO: 1267718 - DNA, 22 bp, Artificial Sequence
  chemically synthesized
acttatatggagagtcatagaa

SEQ ID NO: 1267719 - DNA, 22 bp, Artificial Sequence
  chemically synthesized
aacttatatggagagtcataga

SEQ ID NO: 1267720 - DNA, 22 bp, Artificial Sequence
  chemically synthesized
tgtaatttctatgactctccat

SEQ ID NO: 1267721 - DNA, 22 bp, Artificial Sequence
  chemically synthesized
ctatgactctccatataagtta

SEQ ID NO: 1267722 - DNA, 22 bp, Artificial Sequence
  chemically synthesized
tatgactctccatataagttaa

SEQ ID NO: 1267723 - DNA, 22 bp, Artificial Sequence
  chemically synthesized
tgactctccatataagttaaat

SEQ ID NO: 1267724 - DNA, 22 bp, Artificial Sequence
  chemically synthesized
gatggatatatgagaatattta

SEQ ID NO: 1267725 - DNA, 22 bp, Artificial Sequence
  chemically synthesized
tccatataagttaaatattctc

SEQ ID NO: 1267726 - DNA, 22 bp, Artificial Sequence
  chemically synthesized
agatggatatatgagaatattt

SEQ ID NO: 1267727 - DNA, 22 bp, Artificial Sequence
  chemically synthesized
tagatggatatatgagaatatt

SEQ ID NO: 1267728 - DNA, 22 bp, Artificial Sequence
  chemically synthesized
catataagttaaatattctcat

SEQ ID NO: 1267729 - DNA, 22 bp, Artificial Sequence
  chemically synthesized
ttagatggatatatgagaatat

SEQ ID NO: 1267730 - DNA, 22 bp, Artificial Sequence
  chemically synthesized
tttttagatggatatatgagaa

SEQ ID NO: 1267731 - DNA, 22 bp, Artificial Sequence
  chemically synthesized
aatattctcatatatccatcta

SEQ ID NO: 1267732 - DNA, 22 bp, Artificial Sequence
  chemically synthesized
aagtcagtgctatttttagatg

SEQ ID NO: 1267733 - DNA, 22 bp, Artificial Sequence
  chemically synthesized
tcatatatccatctaaaaatag

SEQ ID NO: 1267734 - DNA, 22 bp, Artificial Sequence
  chemically synthesized
ctgaagtcagtgctatttttag

SEQ ID NO: 1267735 - DNA, 22 bp, Artificial Sequence
  chemically synthesized
actgaagtcagtgctattttta

SEQ ID NO: 1267736 - DNA, 22 bp, Artificial Sequence
  chemically synthesized
atatatccatctaaaaatagca

SEQ ID NO: 1267737 - DNA, 22 bp, Artificial Sequence
  chemically synthesized
tactgaagtcagtgctattttt

SEQ ID NO: 1267738 - DNA, 22 bp, Artificial Sequence
  chemically synthesized
aaactttactgaagtcagtgct

SEQ ID NO: 1267739 - DNA, 22 bp, Artificial Sequence
  chemically synthesized
ctgaaactttactgaagtcagt

SEQ ID NO: 1267740 - DNA, 22 bp, Artificial Sequence
  chemically synthesized
cctgaaactttactgaagtcag

SEQ ID NO: 1267741 - DNA, 22 bp, Artificial Sequence
  chemically synthesized
aaaatagcactgacttcagtaa

SEQ ID NO: 1267742 - DNA, 22 bp, Artificial Sequence
  chemically synthesized
tttcctgaaactttactgaagt

SEQ ID NO: 1267743 - DNA, 22 bp, Artificial Sequence
  chemically synthesized
gtttcctgaaactttactgaag

SEQ ID NO: 1267744 - DNA, 22 bp, Artificial Sequence
  chemically synthesized
tgtttcctgaaactttactgaa

SEQ ID NO: 1267745 - DNA, 22 bp, Artificial Sequence
  chemically synthesized
attttgtttcctgaaactttac

SEQ ID NO: 1267746 - DNA, 22 bp, Artificial Sequence
  chemically synthesized
acttcagtaaagtttcaggaaa

SEQ ID NO: 1267747 - DNA, 22 bp, Artificial Sequence
  chemically synthesized
tatattgattttgtttcctgaa

SEQ ID NO: 1267748 - DNA, 22 bp, Artificial Sequence
  chemically synthesized
gtatattgattttgtttcctga

SEQ ID NO: 1267749 - DNA, 22 bp, Artificial Sequence
  chemically synthesized
tgtatattgattttgtttcctg

SEQ ID NO: 1267750 - DNA, 22 bp, Artificial Sequence
  chemically synthesized
cagtaaagtttcaggaaacaaa

SEQ ID NO: 1267751 - DNA, 22 bp, Artificial Sequence
  chemically synthesized
ttgtatattgattttgtttcct

SEQ ID NO: 1267752 - DNA, 22 bp, Artificial Sequence
  chemically synthesized
agtaaagtttcaggaaacaaaa

SEQ ID NO: 1267753 - DNA, 22 bp, Artificial Sequence
  chemically synthesized
atttttgtatattgattttgtt

SEQ ID NO: 1267754 - DNA, 22 bp, Artificial Sequence
  chemically synthesized
ctgatttttgtatattgatttt

SEQ ID NO: 1267755 - DNA, 22 bp, Artificial Sequence
  chemically synthesized
caggaaacaaaatcaatataca

SEQ ID NO: 1267756 - DNA, 22 bp, Artificial Sequence
  chemically synthesized
aggaaacaaaatcaatatacaa

SEQ ID NO: 1267757 - DNA, 22 bp, Artificial Sequence
  chemically synthesized
gtatgtagaaatgttactgatt

SEQ ID NO: 1267758 - DNA, 22 bp, Artificial Sequence
  chemically synthesized
ctggtatgtagaaatgttactg

SEQ ID NO: 1267759 - DNA, 22 bp, Artificial Sequence
  chemically synthesized
aaaattactggtatgtagaaat

SEQ ID NO: 1267760 - DNA, 22 bp, Artificial Sequence
  chemically synthesized
gaaaattactggtatgtagaaa

SEQ ID NO: 1267761 - DNA, 22 bp, Artificial Sequence
  chemically synthesized
gcttgaaaattactggtatgta

SEQ ID NO: 1267762 - DNA, 22 bp, Artificial Sequence
  chemically synthesized
agcttgaaaattactggtatgt

SEQ ID NO: 1267763 - DNA, 22 bp, Artificial Sequence
  chemically synthesized
gtgcttagcttgaaaattactg

SEQ ID NO: 1267764 - DNA, 22 bp, Artificial Sequence
  chemically synthesized
ggtgcttagcttgaaaattact

SEQ ID NO: 1267765 - DNA, 22 bp, Artificial Sequence
  chemically synthesized
ctacataccagtaattttcaag

SEQ ID NO: 1267766 - DNA, 22 bp, Artificial Sequence
  chemically synthesized
tacataccagtaattttcaagc

SEQ ID NO: 1267767 - DNA, 22 bp, Artificial Sequence
  chemically synthesized
atttggtgcttagcttgaaaat

SEQ ID NO: 1267768 - DNA, 22 bp, Artificial Sequence
  chemically synthesized
gatttggtgcttagcttgaaaa

SEQ ID NO: 1267769 - DNA, 22 bp, Artificial Sequence
  chemically synthesized
cataccagtaattttcaagcta

SEQ ID NO: 1267770 - DNA, 22 bp, Artificial Sequence
  chemically synthesized
catacttgatttggtgcttagc

SEQ ID NO: 1267771 - DNA, 22 bp, Artificial Sequence
  chemically synthesized
tcaagctaagcaccaaatcaag

SEQ ID NO: 1267772 - DNA, 22 bp, Artificial Sequence
  chemically synthesized
caagctaagcaccaaatcaagt

SEQ ID NO: 1267773 - DNA, 22 bp, Artificial Sequence
  chemically synthesized
aagctaagcaccaaatcaagta

SEQ ID NO: 1267774 - DNA, 22 bp, Artificial Sequence
  chemically synthesized
taaatgggattgcatacttgat

SEQ ID NO: 1267775 - DNA, 22 bp, Artificial Sequence
  chemically synthesized
ttataaatgggattgcatactt

SEQ ID NO: 1267776 - DNA, 22 bp, Artificial Sequence
  chemically synthesized
agcaccaaatcaagtatgcaat

SEQ ID NO: 1267777 - DNA, 22 bp, Artificial Sequence
  chemically synthesized
tggctattataaatgggattgc

SEQ ID NO: 1267778 - DNA, 22 bp, Artificial Sequence
  chemically synthesized
atggctattataaatgggattg

SEQ ID NO: 1267779 - DNA, 22 bp, Artificial Sequence
  chemically synthesized
tatggctattataaatgggatt

SEQ ID NO: 1267780 - DNA, 22 bp, Artificial Sequence
  chemically synthesized
ttatggctattataaatgggat

SEQ ID NO: 1267781 - DNA, 22 bp, Artificial Sequence
  chemically synthesized
tttatggctattataaatggga

SEQ ID NO: 1267782 - DNA, 22 bp, Artificial Sequence
  chemically synthesized
ttttttatggctattataaatg

SEQ ID NO: 1267783 - DNA, 22 bp, Artificial Sequence
  chemically synthesized
attttttatggctattataaat

SEQ ID NO: 1267784 - DNA, 22 bp, Artificial Sequence
  chemically synthesized
tattttttatggctattataaa

SEQ ID NO: 1267785 - DNA, 22 bp, Artificial Sequence
  chemically synthesized
ttattttttatggctattataa

SEQ ID NO: 1267786 - DNA, 22 bp, Artificial Sequence
  chemically synthesized
ttttattttttatggctattat

SEQ ID NO: 1267787 - DNA, 22 bp, Artificial Sequence
  chemically synthesized
acctcttttattttttatggct

SEQ ID NO: 1267788 - DNA, 22 bp, Artificial Sequence
  chemically synthesized
ataatagccataaaaaataaaa

SEQ ID NO: 1267789 - DNA, 22 bp, Artificial Sequence
  chemically synthesized
taatagccataaaaaataaaag

SEQ ID NO: 1267790 - DNA, 22 bp, Artificial Sequence
  chemically synthesized
atagagatcattcacctctttt

SEQ ID NO: 1267791 - DNA, 22 bp, Artificial Sequence
  chemically synthesized
tcatagagatcattcacctctt

SEQ ID NO: 1267792 - DNA, 22 bp, Artificial Sequence
  chemically synthesized
ctcatagagatcattcacctct

SEQ ID NO: 1267793 - DNA, 22 bp, Artificial Sequence
  chemically synthesized
taagtcttctcatagagatcat

SEQ ID NO: 1267794 - DNA, 22 bp, Artificial Sequence
  chemically synthesized
tgtaagtcttctcatagagatc

SEQ ID NO: 1267795 - DNA, 22 bp, Artificial Sequence
  chemically synthesized
gtagtgttctgtaagtcttctc

SEQ ID NO: 1267796 - DNA, 22 bp, Artificial Sequence
  chemically synthesized
agtagtgttctgtaagtcttct

SEQ ID NO: 1267797 - DNA, 22 bp, Artificial Sequence
  chemically synthesized
tagtagtgttctgtaagtcttc

SEQ ID NO: 1267798 - DNA, 22 bp, Artificial Sequence
  chemically synthesized
ttttagtagtgttctgtaagtc

SEQ ID NO: 1267799 - DNA, 22 bp, Artificial Sequence
  chemically synthesized
attttagtagtgttctgtaagt

SEQ ID NO: 1267800 - DNA, 22 bp, Artificial Sequence
  chemically synthesized
tatgagaagacttacagaacac

SEQ ID NO: 1267801 - DNA, 22 bp, Artificial Sequence
  chemically synthesized
tgagaagacttacagaacacta

SEQ ID NO: 1267802 - DNA, 22 bp, Artificial Sequence
  chemically synthesized
tgatttattttagtagtgttct

SEQ ID NO: 1267803 - DNA, 22 bp, Artificial Sequence
  chemically synthesized
tgtcatctgtgatttattttag

SEQ ID NO: 1267804 - DNA, 22 bp, Artificial Sequence
  chemically synthesized
acagaacactactaaaataaat

SEQ ID NO: 1267805 - DNA, 22 bp, Artificial Sequence
  chemically synthesized
gtgtcatctgtgatttatttta

SEQ ID NO: 1267806 - DNA, 22 bp, Artificial Sequence
  chemically synthesized
cagaacactactaaaataaatc

SEQ ID NO: 1267807 - DNA, 22 bp, Artificial Sequence
  chemically synthesized
tttgtgtcatctgtgatttatt

SEQ ID NO: 1267808 - DNA, 22 bp, Artificial Sequence
  chemically synthesized
gtttgtgtcatctgtgatttat

SEQ ID NO: 1267809 - DNA, 22 bp, Artificial Sequence
  chemically synthesized
tttgtttgtgtcatctgtgatt

SEQ ID NO: 1267810 - DNA, 22 bp, Artificial Sequence
  chemically synthesized
tatttgtttgtgtcatctgtga

SEQ ID NO: 1267811 - DNA, 22 bp, Artificial Sequence
  chemically synthesized
ctatttgtttgtgtcatctgtg

SEQ ID NO: 1267812 - DNA, 22 bp, Artificial Sequence
  chemically synthesized
ctaaaataaatcacagatgaca

SEQ ID NO: 1267813 - DNA, 22 bp, Artificial Sequence
  chemically synthesized
tctatttgtttgtgtcatctgt

SEQ ID NO: 1267814 - DNA, 22 bp, Artificial Sequence
  chemically synthesized
ttctatttgtttgtgtcatctg

SEQ ID NO: 1267815 - DNA, 22 bp, Artificial Sequence
  chemically synthesized
aaataaatcacagatgacacaa

SEQ ID NO: 1267816 - DNA, 22 bp, Artificial Sequence
  chemically synthesized
atccatgagtatggaaagtttt

SEQ ID NO: 1267817 - DNA, 22 bp, Artificial Sequence
  chemically synthesized
taatccatgagtatggaaagtt

SEQ ID NO: 1267818 - DNA, 22 bp, Artificial Sequence
  chemically synthesized
ctaatccatgagtatggaaagt

SEQ ID NO: 1267819 - DNA, 22 bp, Artificial Sequence
  chemically synthesized
ttctaatccatgagtatggaaa

SEQ ID NO: 1267820 - DNA, 22 bp, Artificial Sequence
  chemically synthesized
attcttctaatccatgagtatg

SEQ ID NO: 1267821 - DNA, 22 bp, Artificial Sequence
  chemically synthesized
atgatattgattcttctaatcc

SEQ ID NO: 1267822 - DNA, 22 bp, Artificial Sequence
  chemically synthesized
tccatactcatggattagaaga

SEQ ID NO: 1267823 - DNA, 22 bp, Artificial Sequence
  chemically synthesized
aatgatattgattcttctaatc

SEQ ID NO: 1267824 - DNA, 22 bp, Artificial Sequence
  chemically synthesized
ccatactcatggattagaagaa

SEQ ID NO: 1267825 - DNA, 22 bp, Artificial Sequence
  chemically synthesized
taatgatattgattcttctaat

SEQ ID NO: 1267826 - DNA, 22 bp, Artificial Sequence
  chemically synthesized
catactcatggattagaagaat

SEQ ID NO: 1267827 - DNA, 22 bp, Artificial Sequence
  chemically synthesized
atggattagaagaatcaatatc

SEQ ID NO: 1267828 - DNA, 22 bp, Artificial Sequence
  chemically synthesized
gaagaatcaatatcattaaaat

SEQ ID NO: 1267829 - DNA, 22 bp, Artificial Sequence
  chemically synthesized
ggtagtatggccattttaatga

SEQ ID NO: 1267830 - DNA, 22 bp, Artificial Sequence
  chemically synthesized
gggtagtatggccattttaatg

SEQ ID NO: 1267831 - DNA, 22 bp, Artificial Sequence
  chemically synthesized
tgggtagtatggccattttaat

SEQ ID NO: 1267832 - DNA, 22 bp, Artificial Sequence
  chemically synthesized
ctttgggtagtatggccatttt

SEQ ID NO: 1267833 - DNA, 22 bp, Artificial Sequence
  chemically synthesized
gtagattgctttgggtagtatg

SEQ ID NO: 1267834 - DNA, 22 bp, Artificial Sequence
  chemically synthesized
attcgtagattgctttgggtag

SEQ ID NO: 1267835 - DNA, 22 bp, Artificial Sequence
  chemically synthesized
aaatggccatactacccaaagc

SEQ ID NO: 1267836 - DNA, 22 bp, Artificial Sequence
  chemically synthesized
aattcgtagattgctttgggta

SEQ ID NO: 1267837 - DNA, 22 bp, Artificial Sequence
  chemically synthesized
cccaaagcaatctacgaattaa

SEQ ID NO: 1267838 - DNA, 22 bp, Artificial Sequence
  chemically synthesized
ataggaataacatttaattcgt

SEQ ID NO: 1267839 - DNA, 22 bp, Artificial Sequence
  chemically synthesized
gataggaataacatttaattcg

SEQ ID NO: 1267840 - DNA, 22 bp, Artificial Sequence
  chemically synthesized
gtggtttgataggaataacatt

SEQ ID NO: 1267841 - DNA, 22 bp, Artificial Sequence
  chemically synthesized
cgaattaaatgttattcctatc

SEQ ID NO: 1267842 - DNA, 22 bp, Artificial Sequence
  chemically synthesized
aatgttattcctatcaaaccac

SEQ ID NO: 1267843 - DNA, 22 bp, Artificial Sequence
  chemically synthesized
tgaaaaatgatgttagtggttt

SEQ ID NO: 1267844 - DNA, 22 bp, Artificial Sequence
  chemically synthesized
tgtgaaaaatgatgttagtggt

SEQ ID NO: 1267845 - DNA, 22 bp, Artificial Sequence
  chemically synthesized
ttcctatcaaaccactaacatc

SEQ ID NO: 1267846 - DNA, 22 bp, Artificial Sequence
  chemically synthesized
ctatcaaaccactaacatcatt

SEQ ID NO: 1267847 - DNA, 22 bp, Artificial Sequence
  chemically synthesized
cagttctgtgaaaaatgatgtt

SEQ ID NO: 1267848 - DNA, 22 bp, Artificial Sequence
  chemically synthesized
ccagttctgtgaaaaatgatgt

SEQ ID NO: 1267849 - DNA, 22 bp, Artificial Sequence
  chemically synthesized
tcaaaccactaacatcattttt

SEQ ID NO: 1267850 - DNA, 22 bp, Artificial Sequence
  chemically synthesized
tccagttctgtgaaaaatgatg

SEQ ID NO: 1267851 - DNA, 22 bp, Artificial Sequence
  chemically synthesized
ttccagttctgtgaaaaatgat

SEQ ID NO: 1267852 - DNA, 22 bp, Artificial Sequence
  chemically synthesized
tttccagttctgtgaaaaatga

SEQ ID NO: 1267853 - DNA, 22 bp, Artificial Sequence
  chemically synthesized
ttttccagttctgtgaaaaatg

SEQ ID NO: 1267854 - DNA, 22 bp, Artificial Sequence
  chemically synthesized
acatcatttttcacagaactgg

SEQ ID NO: 1267855 - DNA, 22 bp, Artificial Sequence
  chemically synthesized
gtatagcttttttccagttctg

SEQ ID NO: 1267856 - DNA, 22 bp, Artificial Sequence
  chemically synthesized
agtatagcttttttccagttct

SEQ ID NO: 1267857 - DNA, 22 bp, Artificial Sequence
  chemically synthesized
tagtatagcttttttccagttc

SEQ ID NO: 1267858 - DNA, 22 bp, Artificial Sequence
  chemically synthesized
ttcacagaactggaaaaaagct

SEQ ID NO: 1267859 - DNA, 22 bp, Artificial Sequence
  chemically synthesized
tcacagaactggaaaaaagcta

SEQ ID NO: 1267860 - DNA, 22 bp, Artificial Sequence
  chemically synthesized
cacagaactggaaaaaagctat

SEQ ID NO: 1267861 - DNA, 22 bp, Artificial Sequence
  chemically synthesized
acagaactggaaaaaagctata

SEQ ID NO: 1267862 - DNA, 22 bp, Artificial Sequence
  chemically synthesized
tatgaattttagtatagctttt

SEQ ID NO: 1267863 - DNA, 22 bp, Artificial Sequence
  chemically synthesized
tatatgaattttagtatagctt

SEQ ID NO: 1267864 - DNA, 22 bp, Artificial Sequence
  chemically synthesized
gttctatatgaattttagtata

SEQ ID NO: 1267865 - DNA, 22 bp, Artificial Sequence
  chemically synthesized
ggttctatatgaattttagtat

SEQ ID NO: 1267866 - DNA, 22 bp, Artificial Sequence
  chemically synthesized
tggttctatatgaattttagta

SEQ ID NO: 1267867 - DNA, 22 bp, Artificial Sequence
  chemically synthesized
gaaaaaagctatactaaaattc

SEQ ID NO: 1267868 - DNA, 22 bp, Artificial Sequence
  chemically synthesized
ttggttctatatgaattttagt

SEQ ID NO: 1267869 - DNA, 22 bp, Artificial Sequence
  chemically synthesized
tttggttctatatgaattttag

SEQ ID NO: 1267870 - DNA, 22 bp, Artificial Sequence
  chemically synthesized
ctttttggttctatatgaattt

SEQ ID NO: 1267871 - DNA, 22 bp, Artificial Sequence
  chemically synthesized
ggctcctttttggttctatatg

SEQ ID NO: 1267872 - DNA, 22 bp, Artificial Sequence
  chemically synthesized
gggctcctttttggttctatat

SEQ ID NO: 1267873 - DNA, 22 bp, Artificial Sequence
  chemically synthesized
tactaaaattcatatagaacca

SEQ ID NO: 1267874 - DNA, 22 bp, Artificial Sequence
  chemically synthesized
tgggctcctttttggttctata

SEQ ID NO: 1267875 - DNA, 22 bp, Artificial Sequence
  chemically synthesized
ttgggctcctttttggttctat

SEQ ID NO: 1267876 - DNA, 22 bp, Artificial Sequence
  chemically synthesized
cttttgggctcctttttggttc

SEQ ID NO: 1267877 - DNA, 22 bp, Artificial Sequence
  chemically synthesized
aaattcatatagaaccaaaaag

SEQ ID NO: 1267878 - DNA, 22 bp, Artificial Sequence
  chemically synthesized
ggattacttttgggctcctttt

SEQ ID NO: 1267879 - DNA, 22 bp, Artificial Sequence
  chemically synthesized
atatagaaccaaaaaggagccc

SEQ ID NO: 1267880 - DNA, 22 bp, Artificial Sequence
  chemically synthesized
aggattacttttgggctccttt

SEQ ID NO: 1267881 - DNA, 22 bp, Artificial Sequence
  chemically synthesized
cttaggattacttttgggctcc

SEQ ID NO: 1267882 - DNA, 22 bp, Artificial Sequence
  chemically synthesized
ccttaggattacttttgggctc

SEQ ID NO: 1267883 - DNA, 22 bp, Artificial Sequence
  chemically synthesized
tccttaggattacttttgggct

SEQ ID NO: 1267884 - DNA, 22 bp, Artificial Sequence
  chemically synthesized
ttccttaggattacttttgggc

SEQ ID NO: 1267885 - DNA, 22 bp, Artificial Sequence
  chemically synthesized
tttccttaggattacttttggg

SEQ ID NO: 1267886 - DNA, 22 bp, Artificial Sequence
  chemically synthesized
tttttccttaggattacttttg

SEQ ID NO: 1267887 - DNA, 22 bp, Artificial Sequence
  chemically synthesized
ttctttttccttaggattactt

SEQ ID NO: 1267888 - DNA, 22 bp, Artificial Sequence
  chemically synthesized
gttctttttccttaggattact

SEQ ID NO: 1267889 - DNA, 22 bp, Artificial Sequence
  chemically synthesized
tgttctttttccttaggattac

SEQ ID NO: 1267890 - DNA, 22 bp, Artificial Sequence
  chemically synthesized
gctttgttctttttccttagga

SEQ ID NO: 1267891 - DNA, 22 bp, Artificial Sequence
  chemically synthesized
tggctttgttctttttccttag

SEQ ID NO: 1267892 - DNA, 22 bp, Artificial Sequence
  chemically synthesized
cctctggctttgttctttttcc

SEQ ID NO: 1267893 - DNA, 22 bp, Artificial Sequence
  chemically synthesized
aggaaaaagaacaaagccagag

SEQ ID NO: 1267894 - DNA, 22 bp, Artificial Sequence
  chemically synthesized
ggtaatgtgctgcctctggctt

SEQ ID NO: 1267895 - DNA, 22 bp, Artificial Sequence
  chemically synthesized
aagttgggtaatgtgctgcctc

SEQ ID NO: 1267896 - DNA, 22 bp, Artificial Sequence
  chemically synthesized
gaagttgggtaatgtgctgcct

SEQ ID NO: 1267897 - DNA, 22 bp, Artificial Sequence
  chemically synthesized
tagtatagtttgaagttgggta

SEQ ID NO: 1267898 - DNA, 22 bp, Artificial Sequence
  chemically synthesized
atagtatagtttgaagttgggt

SEQ ID NO: 1267899 - DNA, 22 bp, Artificial Sequence
  chemically synthesized
tagccttatagtatagtttgaa

SEQ ID NO: 1267900 - DNA, 22 bp, Artificial Sequence
  chemically synthesized
ctgtagccttatagtatagttt

SEQ ID NO: 1267901 - DNA, 22 bp, Artificial Sequence
  chemically synthesized
cccaacttcaaactatactata

SEQ ID NO: 1267902 - DNA, 22 bp, Artificial Sequence
  chemically synthesized
ggttgctgtagccttatagtat

SEQ ID NO: 1267903 - DNA, 22 bp, Artificial Sequence
  chemically synthesized
attcggttgctgtagccttata

SEQ ID NO: 1267904 - DNA, 22 bp, Artificial Sequence
  chemically synthesized
caaactatactataaggctaca

SEQ ID NO: 1267905 - DNA, 22 bp, Artificial Sequence
  chemically synthesized
aaactatactataaggctacag

SEQ ID NO: 1267906 - DNA, 22 bp, Artificial Sequence
  chemically synthesized
tactataaggctacagcaaccg

SEQ ID NO: 1267907 - DNA, 22 bp, Artificial Sequence
  chemically synthesized
taccatgctgattcggttgctg

SEQ ID NO: 1267908 - DNA, 22 bp, Artificial Sequence
  chemically synthesized
taaggctacagcaaccgaatca

SEQ ID NO: 1267909 - DNA, 22 bp, Artificial Sequence
  chemically synthesized
aaacgttataccatgctgattc

SEQ ID NO: 1267910 - DNA, 22 bp, Artificial Sequence
  chemically synthesized
cagcaaccgaatcagcatggta

SEQ ID NO: 1267911 - DNA, 22 bp, Artificial Sequence
  chemically synthesized
tatgtaactgaaacgttatacc

SEQ ID NO: 1267912 - DNA, 22 bp, Artificial Sequence
  chemically synthesized
attgtatgtaactgaaacgtta

SEQ ID NO: 1267913 - DNA, 22 bp, Artificial Sequence
  chemically synthesized
ttcattgtatgtaactgaaacg

SEQ ID NO: 1267914 - DNA, 22 bp, Artificial Sequence
  chemically synthesized
attcattgtatgtaactgaaac

SEQ ID NO: 1267915 - DNA, 22 bp, Artificial Sequence
  chemically synthesized
cagaacttattcattgtatgta

SEQ ID NO: 1267916 - DNA, 22 bp, Artificial Sequence
  chemically synthesized
gatctccagaacttattcattg

SEQ ID NO: 1267917 - DNA, 22 bp, Artificial Sequence
  chemically synthesized
cagttacatacaatgaataagt

SEQ ID NO: 1267918 - DNA, 22 bp, Artificial Sequence
  chemically synthesized
agttacatacaatgaataagtt

SEQ ID NO: 1267919 - DNA, 22 bp, Artificial Sequence
  chemically synthesized
tgcattagatctccagaactta

SEQ ID NO: 1267920 - DNA, 22 bp, Artificial Sequence
  chemically synthesized
catacaatgaataagttctgga

SEQ ID NO: 1267921 - DNA, 22 bp, Artificial Sequence
  chemically synthesized
tgctgtgcattagatctccaga

SEQ ID NO: 1267922 - DNA, 22 bp, Artificial Sequence
  chemically synthesized
tagtccctatgctgtgcattag

SEQ ID NO: 1267923 - DNA, 22 bp, Artificial Sequence
  chemically synthesized
actatagtccctatgctgtgca

SEQ ID NO: 1267924 - DNA, 22 bp, Artificial Sequence
  chemically synthesized
tggagatctaatgcacagcata

SEQ ID NO: 1267925 - DNA, 22 bp, Artificial Sequence
  chemically synthesized
gagatctaatgcacagcatagg

SEQ ID NO: 1267926 - DNA, 22 bp, Artificial Sequence
  chemically synthesized
ctgactatagtccctatgctgt

SEQ ID NO: 1267927 - DNA, 22 bp, Artificial Sequence
  chemically synthesized
atgcacagcatagggactatag

SEQ ID NO: 1267928 - DNA, 22 bp, Artificial Sequence
  chemically synthesized
aagtatacaatacagtattact

SEQ ID NO: 1267929 - DNA, 22 bp, Artificial Sequence
  chemically synthesized
caagtatacaatacagtattac

SEQ ID NO: 1267930 - DNA, 22 bp, Artificial Sequence
  chemically synthesized
tagtcagtaatactgtattgta

SEQ ID NO: 1267931 - DNA, 22 bp, Artificial Sequence
  chemically synthesized
agcaaatttcaagtatacaata

SEQ ID NO: 1267932 - DNA, 22 bp, Artificial Sequence
  chemically synthesized
tcagcaaatttcaagtatacaa

SEQ ID NO: 1267933 - DNA, 22 bp, Artificial Sequence
  chemically synthesized
ctctcagcaaatttcaagtata

SEQ ID NO: 1267934 - DNA, 22 bp, Artificial Sequence
  chemically synthesized
actctcagcaaatttcaagtat

SEQ ID NO: 1267935 - DNA, 22 bp, Artificial Sequence
  chemically synthesized
tattgtatacttgaaatttgct

SEQ ID NO: 1267936 - DNA, 22 bp, Artificial Sequence
  chemically synthesized
caatttactctcagcaaatttc

SEQ ID NO: 1267937 - DNA, 22 bp, Artificial Sequence
  chemically synthesized
acaatttactctcagcaaattt

SEQ ID NO: 1267938 - DNA, 22 bp, Artificial Sequence
  chemically synthesized
tatacttgaaatttgctgagag

SEQ ID NO: 1267939 - DNA, 22 bp, Artificial Sequence
  chemically synthesized
gaaatttgctgagagtaaattg

SEQ ID NO: 1267940 - DNA, 22 bp, Artificial Sequence
  chemically synthesized
aaatttgctgagagtaaattgt

SEQ ID NO: 1267941 - DNA, 22 bp, Artificial Sequence
  chemically synthesized
tggtaagaaaacttacaattta

SEQ ID NO: 1267942 - DNA, 22 bp, Artificial Sequence
  chemically synthesized
gctgagagtaaattgtaagttt

SEQ ID NO: 1267943 - DNA, 22 bp, Artificial Sequence
  chemically synthesized
ctgagagtaaattgtaagtttt

SEQ ID NO: 1267944 - DNA, 22 bp, Artificial Sequence
  chemically synthesized
tgtctgtggtaagaaaacttac

SEQ ID NO: 1267945 - DNA, 22 bp, Artificial Sequence
  chemically synthesized
gtgtctgtggtaagaaaactta

SEQ ID NO: 1267946 - DNA, 22 bp, Artificial Sequence
  chemically synthesized
agagtaaattgtaagttttctt

SEQ ID NO: 1267947 - DNA, 22 bp, Artificial Sequence
  chemically synthesized
tgtgtctgtggtaagaaaactt

SEQ ID NO: 1267948 - DNA, 22 bp, Artificial Sequence
  chemically synthesized
ttttgtgtctgtggtaagaaaa

SEQ ID NO: 1267949 - DNA, 22 bp, Artificial Sequence
  chemically synthesized
taagttttcttaccacagacac

SEQ ID NO: 1267950 - DNA, 22 bp, Artificial Sequence
  chemically synthesized
acatagttattttgtgtctgtg

SEQ ID NO: 1267951 - DNA, 22 bp, Artificial Sequence
  chemically synthesized
cacatagttattttgtgtctgt

SEQ ID NO: 1267952 - DNA, 22 bp, Artificial Sequence
  chemically synthesized
ttcacatagttattttgtgtct

SEQ ID NO: 1267953 - DNA, 22 bp, Artificial Sequence
  chemically synthesized
tcttaccacagacacaaaataa

SEQ ID NO: 1267954 - DNA, 22 bp, Artificial Sequence
  chemically synthesized
cttaccacagacacaaaataac

SEQ ID NO: 1267955 - DNA, 22 bp, Artificial Sequence
  chemically synthesized
ttaccacagacacaaaataact

SEQ ID NO: 1267956 - DNA, 22 bp, Artificial Sequence
  chemically synthesized
accacagacacaaaataactat

SEQ ID NO: 1267957 - DNA, 22 bp, Artificial Sequence
  chemically synthesized
ccacagacacaaaataactatg

SEQ ID NO: 1267958 - DNA, 22 bp, Artificial Sequence
  chemically synthesized
acatatccatctcttcacatag

SEQ ID NO: 1267959 - DNA, 22 bp, Artificial Sequence
  chemically synthesized
attaacatatccatctcttcac

SEQ ID NO: 1267960 - DNA, 22 bp, Artificial Sequence
  chemically synthesized
agctaattaacatatccatctc

SEQ ID NO: 1267961 - DNA, 22 bp, Artificial Sequence
  chemically synthesized
tgtgaagagatggatatgttaa

SEQ ID NO: 1267962 - DNA, 22 bp, Artificial Sequence
  chemically synthesized
cagttaagctaattaacatatc

SEQ ID NO: 1267963 - DNA, 22 bp, Artificial Sequence
  chemically synthesized
ctacagttaagctaattaacat

SEQ ID NO: 1267964 - DNA, 22 bp, Artificial Sequence
  chemically synthesized
attactacagttaagctaatta

SEQ ID NO: 1267965 - DNA, 22 bp, Artificial Sequence
  chemically synthesized
attagcttaactgtagtaatca

SEQ ID NO: 1267966 - DNA, 22 bp, Artificial Sequence
  chemically synthesized
gcttaactgtagtaatcagttc

SEQ ID NO: 1267967 - DNA, 22 bp, Artificial Sequence
  chemically synthesized
aactgtagtaatcagttcactg

SEQ ID NO: 1267968 - DNA, 22 bp, Artificial Sequence
  chemically synthesized
actgtagtaatcagttcactgc

SEQ ID NO: 1267969 - DNA, 22 bp, Artificial Sequence
  chemically synthesized
atgtgcatatacgcagtgaact

SEQ ID NO: 1267970 - DNA, 22 bp, Artificial Sequence
  chemically synthesized
gatgtgcatatacgcagtgaac

SEQ ID NO: 1267971 - DNA, 22 bp, Artificial Sequence
  chemically synthesized
tgatgtgcatatacgcagtgaa

SEQ ID NO: 1267972 - DNA, 22 bp, Artificial Sequence
  chemically synthesized
tagtaatcagttcactgcgtat

SEQ ID NO: 1267973 - DNA, 22 bp, Artificial Sequence
  chemically synthesized
actgcgtatatgcacatcaaaa

SEQ ID NO: 1267974 - DNA, 22 bp, Artificial Sequence
  chemically synthesized
cgtatatgcacatcaaaacatc

SEQ ID NO: 1267975 - DNA, 22 bp, Artificial Sequence
  chemically synthesized
agatgtataatgggatgttttg

SEQ ID NO: 1267976 - DNA, 22 bp, Artificial Sequence
  chemically synthesized
aagatgtataatgggatgtttt

SEQ ID NO: 1267977 - DNA, 22 bp, Artificial Sequence
  chemically synthesized
tatttaagatgtataatgggat

SEQ ID NO: 1267978 - DNA, 22 bp, Artificial Sequence
  chemically synthesized
cctatatttaagatgtataatg

SEQ ID NO: 1267979 - DNA, 22 bp, Artificial Sequence
  chemically synthesized
taaaaattgcctatatttaaga

SEQ ID NO: 1267980 - DNA, 22 bp, Artificial Sequence
  chemically synthesized
aatgttataaaaattgcctata

SEQ ID NO: 1267981 - DNA, 22 bp, Artificial Sequence
  chemically synthesized
tacatcttaaatataggcaatt

SEQ ID NO: 1267982 - DNA, 22 bp, Artificial Sequence
  chemically synthesized
aaatgttataaaaattgcctat

SEQ ID NO: 1267983 - DNA, 22 bp, Artificial Sequence
  chemically synthesized
tttaaatgttataaaaattgcc

SEQ ID NO: 1267984 - DNA, 22 bp, Artificial Sequence
  chemically synthesized
atttaaatgttataaaaattgc

SEQ ID NO: 1267985 - DNA, 22 bp, Artificial Sequence
  chemically synthesized
ttatttaaatgttataaaaatt

SEQ ID NO: 1267986 - DNA, 22 bp, Artificial Sequence
  chemically synthesized
aaatataggcaatttttataac

SEQ ID NO: 1267987 - DNA, 22 bp, Artificial Sequence
  chemically synthesized
aatataggcaatttttataaca

SEQ ID NO: 1267988 - DNA, 22 bp, Artificial Sequence
  chemically synthesized
ctcttatttaaatgttataaaa

SEQ ID NO: 1267989 - DNA, 22 bp, Artificial Sequence
  chemically synthesized
gctcttatttaaatgttataaa

SEQ ID NO: 1267990 - DNA, 22 bp, Artificial Sequence
  chemically synthesized
tgctcttatttaaatgttataa

SEQ ID NO: 1267991 - DNA, 22 bp, Artificial Sequence
  chemically synthesized
ttgctcttatttaaatgttata

SEQ ID NO: 1267992 - DNA, 22 bp, Artificial Sequence
  chemically synthesized
tttttgctcttatttaaatgtt

SEQ ID NO: 1267993 - DNA, 22 bp, Artificial Sequence
  chemically synthesized
gtttttgctcttatttaaatgt

SEQ ID NO: 1267994 - DNA, 22 bp, Artificial Sequence
  chemically synthesized
tgtttttgctcttatttaaatg

SEQ ID NO: 1267995 - DNA, 22 bp, Artificial Sequence
  chemically synthesized
ttgtttttgctcttatttaaat

SEQ ID NO: 1267996 - DNA, 22 bp, Artificial Sequence
  chemically synthesized
tttttgtttttgctcttattta

SEQ ID NO: 1267997 - DNA, 22 bp, Artificial Sequence
  chemically synthesized
gtttttgtttttgctcttattt

SEQ ID NO: 1267998 - DNA, 22 bp, Artificial Sequence
  chemically synthesized
ttataacatttaaataagagca

SEQ ID NO: 1267999 - DNA, 22 bp, Artificial Sequence
  chemically synthesized
tgtttttgtttttgctcttatt

SEQ ID NO: 1268000 - DNA, 22 bp, Artificial Sequence
  chemically synthesized
tataacatttaaataagagcaa

SEQ ID NO: 1268001 - DNA, 22 bp, Artificial Sequence
  chemically synthesized
ttgtttttgtttttgctcttat

SEQ ID NO: 1268002 - DNA, 22 bp, Artificial Sequence
  chemically synthesized
ataacatttaaataagagcaaa

SEQ ID NO: 1268003 - DNA, 22 bp, Artificial Sequence
  chemically synthesized
taacatttaaataagagcaaaa

SEQ ID NO: 1268004 - DNA, 22 bp, Artificial Sequence
  chemically synthesized
tttttgtttttgtttttgctct

SEQ ID NO: 1268005 - DNA, 22 bp, Artificial Sequence
  chemically synthesized
aaataagagcaaaaacaaaaac

SEQ ID NO: 1268006 - DNA, 22 bp, Artificial Sequence
  chemically synthesized
aataagagcaaaaacaaaaaca

SEQ ID NO: 1268007 - DNA, 22 bp, Artificial Sequence
  chemically synthesized
tgccagtaccatgctgtttttg

SEQ ID NO: 1268008 - DNA, 22 bp, Artificial Sequence
  chemically synthesized
gtgccagtaccatgctgttttt

SEQ ID NO: 1268009 - DNA, 22 bp, Artificial Sequence
  chemically synthesized
tgtgccagtaccatgctgtttt

SEQ ID NO: 1268010 - DNA, 22 bp, Artificial Sequence
  chemically synthesized
ttgtgccagtaccatgctgttt

SEQ ID NO: 1268011 - DNA, 22 bp, Artificial Sequence
  chemically synthesized
tttttgtgccagtaccatgctg

SEQ ID NO: 1268012 - DNA, 22 bp, Artificial Sequence
  chemically synthesized
tgtgtctgtttttgtgccagta

SEQ ID NO: 1268013 - DNA, 22 bp, Artificial Sequence
  chemically synthesized
atgtgtctgtttttgtgccagt

SEQ ID NO: 1268014 - DNA, 22 bp, Artificial Sequence
  chemically synthesized
gtttatgtgtctgtttttgtgc

SEQ ID NO: 1268015 - DNA, 22 bp, Artificial Sequence
  chemically synthesized
cattggtttatgtgtctgtttt

SEQ ID NO: 1268016 - DNA, 22 bp, Artificial Sequence
  chemically synthesized
ttccattggtttatgtgtctgt

SEQ ID NO: 1268017 - DNA, 22 bp, Artificial Sequence
  chemically synthesized
gttccattggtttatgtgtctg

SEQ ID NO: 1268018 - DNA, 22 bp, Artificial Sequence
  chemically synthesized
tgttccattggtttatgtgtct

SEQ ID NO: 1268019 - DNA, 22 bp, Artificial Sequence
  chemically synthesized
gcacaaaaacagacacataaac

SEQ ID NO: 1268020 - DNA, 22 bp, Artificial Sequence
  chemically synthesized
ctttgttccattggtttatgtg

SEQ ID NO: 1268021 - DNA, 22 bp, Artificial Sequence
  chemically synthesized
tactttgttccattggtttatg

SEQ ID NO: 1268022 - DNA, 22 bp, Artificial Sequence
  chemically synthesized
tctactttgttccattggttta

SEQ ID NO: 1268023 - DNA, 22 bp, Artificial Sequence
  chemically synthesized
ggttctctactttgttccattg

SEQ ID NO: 1268024 - DNA, 22 bp, Artificial Sequence
  chemically synthesized
tgggttctctactttgttccat

SEQ ID NO: 1268025 - DNA, 22 bp, Artificial Sequence
  chemically synthesized
ctgggttctctactttgttcca

SEQ ID NO: 1268026 - DNA, 22 bp, Artificial Sequence
  chemically synthesized
tttctgggttctctactttgtt

SEQ ID NO: 1268027 - DNA, 22 bp, Artificial Sequence
  chemically synthesized
atttctgggttctctactttgt

SEQ ID NO: 1268028 - DNA, 22 bp, Artificial Sequence
  chemically synthesized
tatttctgggttctctactttg

SEQ ID NO: 1268029 - DNA, 22 bp, Artificial Sequence
  chemically synthesized
caggtgtgtggctttatttctg

SEQ ID NO: 1268030 - DNA, 22 bp, Artificial Sequence
  chemically synthesized
aaaatcatatggctgcaggtgt

SEQ ID NO: 1268031 - DNA, 22 bp, Artificial Sequence
  chemically synthesized
ttgaaaatcatatggctgcagg

SEQ ID NO: 1268032 - DNA, 22 bp, Artificial Sequence
  chemically synthesized
gttgaaaatcatatggctgcag

SEQ ID NO: 1268033 - DNA, 22 bp, Artificial Sequence
  chemically synthesized
tgttgaaaatcatatggctgca

SEQ ID NO: 1268034 - DNA, 22 bp, Artificial Sequence
  chemically synthesized
tcaactttgttgaaaatcatat

SEQ ID NO: 1268035 - DNA, 22 bp, Artificial Sequence
  chemically synthesized
gtcaactttgttgaaaatcata

SEQ ID NO: 1268036 - DNA, 22 bp, Artificial Sequence
  chemically synthesized
tgtcaactttgttgaaaatcat

SEQ ID NO: 1268037 - DNA, 22 bp, Artificial Sequence
  chemically synthesized
ttgtcaactttgttgaaaatca

SEQ ID NO: 1268038 - DNA, 22 bp, Artificial Sequence
  chemically synthesized
tttttgtcaactttgttgaaaa

SEQ ID NO: 1268039 - DNA, 22 bp, Artificial Sequence
  chemically synthesized
cagccatatgattttcaacaaa

SEQ ID NO: 1268040 - DNA, 22 bp, Artificial Sequence
  chemically synthesized
atttttgtcaactttgttgaaa

SEQ ID NO: 1268041 - DNA, 22 bp, Artificial Sequence
  chemically synthesized
cttatttttgtcaactttgttg

SEQ ID NO: 1268042 - DNA, 22 bp, Artificial Sequence
  chemically synthesized
ccattgcttatttttgtcaact

SEQ ID NO: 1268043 - DNA, 22 bp, Artificial Sequence
  chemically synthesized
cccattgcttatttttgtcaac

SEQ ID NO: 1268044 - DNA, 22 bp, Artificial Sequence
  chemically synthesized
tcccattgcttatttttgtcaa

SEQ ID NO: 1268045 - DNA, 22 bp, Artificial Sequence
  chemically synthesized
tcaacaaagttgacaaaaataa

SEQ ID NO: 1268046 - DNA, 22 bp, Artificial Sequence
  chemically synthesized
caacaaagttgacaaaaataag

SEQ ID NO: 1268047 - DNA, 22 bp, Artificial Sequence
  chemically synthesized
aacaaagttgacaaaaataagc

SEQ ID NO: 1268048 - DNA, 22 bp, Artificial Sequence
  chemically synthesized
aacagggagtcctttcccattg

SEQ ID NO: 1268049 - DNA, 22 bp, Artificial Sequence
  chemically synthesized
acaaaaataagcaatgggaaag

SEQ ID NO: 1268050 - DNA, 22 bp, Artificial Sequence
  chemically synthesized
ttgaacagggagtcctttccca

SEQ ID NO: 1268051 - DNA, 22 bp, Artificial Sequence
  chemically synthesized
attgaacagggagtcctttccc

SEQ ID NO: 1268052 - DNA, 22 bp, Artificial Sequence
  chemically synthesized
gccagtccatttattgaacagg

SEQ ID NO: 1268053 - DNA, 22 bp, Artificial Sequence
  chemically synthesized
cctgttcaataaatggactggc

SEQ ID NO: 1268054 - DNA, 22 bp, Artificial Sequence
  chemically synthesized
cacatatggctagccagtccat

SEQ ID NO: 1268055 - DNA, 22 bp, Artificial Sequence
  chemically synthesized
ccacatatggctagccagtcca

SEQ ID NO: 1268056 - DNA, 22 bp, Artificial Sequence
  chemically synthesized
ttccacatatggctagccagtc

SEQ ID NO: 1268057 - DNA, 22 bp, Artificial Sequence
  chemically synthesized
ttcaataaatggactggctagc

SEQ ID NO: 1268058 - DNA, 22 bp, Artificial Sequence
  chemically synthesized
aataaatggactggctagccat

SEQ ID NO: 1268059 - DNA, 22 bp, Artificial Sequence
  chemically synthesized
attcttccacatatggctagcc

SEQ ID NO: 1268060 - DNA, 22 bp, Artificial Sequence
  chemically synthesized
cattcttccacatatggctagc

SEQ ID NO: 1268061 - DNA, 22 bp, Artificial Sequence
  chemically synthesized
gctagccatatgtggaagaatg

SEQ ID NO: 1268062 - DNA, 22 bp, Artificial Sequence
  chemically synthesized
gggatccagtttcattcttcca

SEQ ID NO: 1268063 - DNA, 22 bp, Artificial Sequence
  chemically synthesized
gccatatgtggaagaatgaaac

SEQ ID NO: 1268064 - DNA, 22 bp, Artificial Sequence
  chemically synthesized
tacatgtcgaaaattagggatc

SEQ ID NO: 1268065 - DNA, 22 bp, Artificial Sequence
  chemically synthesized
atacatgtcgaaaattagggat

SEQ ID NO: 1268066 - DNA, 22 bp, Artificial Sequence
  chemically synthesized
tatacatgtcgaaaattaggga

SEQ ID NO: 1268067 - DNA, 22 bp, Artificial Sequence
  chemically synthesized
ttatacatgtcgaaaattaggg

SEQ ID NO: 1268068 - DNA, 22 bp, Artificial Sequence
  chemically synthesized
atttttatacatgtcgaaaatt

SEQ ID NO: 1268069 - DNA, 22 bp, Artificial Sequence
  chemically synthesized
gatccctaattttcgacatgta

SEQ ID NO: 1268070 - DNA, 22 bp, Artificial Sequence
  chemically synthesized
ggttaatttttatacatgtcga

SEQ ID NO: 1268071 - DNA, 22 bp, Artificial Sequence
  chemically synthesized
gggttaatttttatacatgtcg

SEQ ID NO: 1268072 - DNA, 22 bp, Artificial Sequence
  chemically synthesized
attttcgacatgtataaaaatt

SEQ ID NO: 1268073 - DNA, 22 bp, Artificial Sequence
  chemically synthesized
atcatcttgggttaatttttat

SEQ ID NO: 1268074 - DNA, 22 bp, Artificial Sequence
  chemically synthesized
aatcatcttgggttaattttta

SEQ ID NO: 1268075 - DNA, 22 bp, Artificial Sequence
  chemically synthesized
taatcatcttgggttaattttt

SEQ ID NO: 1268076 - DNA, 22 bp, Artificial Sequence
  chemically synthesized
tcgacatgtataaaaattaacc

SEQ ID NO: 1268077 - DNA, 22 bp, Artificial Sequence
  chemically synthesized
cgacatgtataaaaattaaccc

SEQ ID NO: 1268078 - DNA, 22 bp, Artificial Sequence
  chemically synthesized
gacatgtataaaaattaaccca

SEQ ID NO: 1268079 - DNA, 22 bp, Artificial Sequence
  chemically synthesized
aatctttaatcatcttgggtta

SEQ ID NO: 1268080 - DNA, 22 bp, Artificial Sequence
  chemically synthesized
aaatctttaatcatcttgggtt

SEQ ID NO: 1268081 - DNA, 22 bp, Artificial Sequence
  chemically synthesized
catttaaatctttaatcatctt

SEQ ID NO: 1268082 - DNA, 22 bp, Artificial Sequence
  chemically synthesized
acatttaaatctttaatcatct

SEQ ID NO: 1268083 - DNA, 22 bp, Artificial Sequence
  chemically synthesized
acccaagatgattaaagattta

SEQ ID NO: 1268084 - DNA, 22 bp, Artificial Sequence
  chemically synthesized
aggtcttacatttaaatcttta

SEQ ID NO: 1268085 - DNA, 22 bp, Artificial Sequence
  chemically synthesized
gaggtcttacatttaaatcttt

SEQ ID NO: 1268086 - DNA, 22 bp, Artificial Sequence
  chemically synthesized
gtttgaggtcttacatttaaat

SEQ ID NO: 1268087 - DNA, 22 bp, Artificial Sequence
  chemically synthesized
tagtttgaggtcttacatttaa

SEQ ID NO: 1268088 - DNA, 22 bp, Artificial Sequence
  chemically synthesized
ctagtttgaggtcttacattta

SEQ ID NO: 1268089 - DNA, 22 bp, Artificial Sequence
  chemically synthesized
ttctagtttgaggtcttacatt

SEQ ID NO: 1268090 - DNA, 22 bp, Artificial Sequence
  chemically synthesized
aagatttaaatgtaagacctca

SEQ ID NO: 1268091 - DNA, 22 bp, Artificial Sequence
  chemically synthesized
caattcttctagtttgaggtct

SEQ ID NO: 1268092 - DNA, 22 bp, Artificial Sequence
  chemically synthesized
tacaattcttctagtttgaggt

SEQ ID NO: 1268093 - DNA, 22 bp, Artificial Sequence
  chemically synthesized
ctacaattcttctagtttgagg

SEQ ID NO: 1268094 - DNA, 22 bp, Artificial Sequence
  chemically synthesized
aaatgtaagacctcaaactaga

SEQ ID NO: 1268095 - DNA, 22 bp, Artificial Sequence
  chemically synthesized
ttctacaattcttctagtttga

SEQ ID NO: 1268096 - DNA, 22 bp, Artificial Sequence
  chemically synthesized
aatgtaagacctcaaactagaa

SEQ ID NO: 1268097 - DNA, 22 bp, Artificial Sequence
  chemically synthesized
cttctacaattcttctagtttg

SEQ ID NO: 1268098 - DNA, 22 bp, Artificial Sequence
  chemically synthesized
tcttctacaattcttctagttt

SEQ ID NO: 1268099 - DNA, 22 bp, Artificial Sequence
  chemically synthesized
ggttttcttctacaattcttct

SEQ ID NO: 1268100 - DNA, 22 bp, Artificial Sequence
  chemically synthesized
aggttttcttctacaattcttc

SEQ ID NO: 1268101 - DNA, 22 bp, Artificial Sequence
  chemically synthesized
ttaggttttcttctacaattct

SEQ ID NO: 1268102 - DNA, 22 bp, Artificial Sequence
  chemically synthesized
cttaggttttcttctacaattc

SEQ ID NO: 1268103 - DNA, 22 bp, Artificial Sequence
  chemically synthesized
aaactagaagaattgtagaaga

SEQ ID NO: 1268104 - DNA, 22 bp, Artificial Sequence
  chemically synthesized
gaagaattgtagaagaaaacct

SEQ ID NO: 1268105 - DNA, 22 bp, Artificial Sequence
  chemically synthesized
tagaagaaaacctaagaaacat

SEQ ID NO: 1268106 - DNA, 22 bp, Artificial Sequence
  chemically synthesized
accccaatgtccagaatgatgt

SEQ ID NO: 1268107 - DNA, 22 bp, Artificial Sequence
  chemically synthesized
ctaaccccaatgtccagaatga

SEQ ID NO: 1268108 - DNA, 22 bp, Artificial Sequence
  chemically synthesized
cctaaccccaatgtccagaatg

SEQ ID NO: 1268109 - DNA, 22 bp, Artificial Sequence
  chemically synthesized
tcctaaccccaatgtccagaat

SEQ ID NO: 1268110 - DNA, 22 bp, Artificial Sequence
  chemically synthesized
agaaacatcattctggacattg

SEQ ID NO: 1268111 - DNA, 22 bp, Artificial Sequence
  chemically synthesized
gtcataaatgctttcctaaccc

SEQ ID NO: 1268112 - DNA, 22 bp, Artificial Sequence
  chemically synthesized
agtcataaatgctttcctaacc

SEQ ID NO: 1268113 - DNA, 22 bp, Artificial Sequence
  chemically synthesized
tggacattggggttaggaaagc

SEQ ID NO: 1268114 - DNA, 22 bp, Artificial Sequence
  chemically synthesized
gacattggggttaggaaagcat

SEQ ID NO: 1268115 - DNA, 22 bp, Artificial Sequence
  chemically synthesized
aggatttagtcataaatgcttt

SEQ ID NO: 1268116 - DNA, 22 bp, Artificial Sequence
  chemically synthesized
gaggatttagtcataaatgctt

SEQ ID NO: 1268117 - DNA, 22 bp, Artificial Sequence
  chemically synthesized
tgaggatttagtcataaatgct

SEQ ID NO: 1268118 - DNA, 22 bp, Artificial Sequence
  chemically synthesized
ttgaggatttagtcataaatgc

SEQ ID NO: 1268119 - DNA, 22 bp, Artificial Sequence
  chemically synthesized
gggttaggaaagcatttatgac

SEQ ID NO: 1268120 - DNA, 22 bp, Artificial Sequence
  chemically synthesized
cttttgaggatttagtcataaa

SEQ ID NO: 1268121 - DNA, 22 bp, Artificial Sequence
  chemically synthesized
ggaaagcatttatgactaaatc

SEQ ID NO: 1268122 - DNA, 22 bp, Artificial Sequence
  chemically synthesized
caattgcttttgaggatttagt

SEQ ID NO: 1268123 - DNA, 22 bp, Artificial Sequence
  chemically synthesized
ctccaattgcttttgaggattt

SEQ ID NO: 1268124 - DNA, 22 bp, Artificial Sequence
  chemically synthesized
gctccaattgcttttgaggatt

SEQ ID NO: 1268125 - DNA, 22 bp, Artificial Sequence
  chemically synthesized
tgctccaattgcttttgaggat

SEQ ID NO: 1268126 - DNA, 22 bp, Artificial Sequence
  chemically synthesized
atgactaaatcctcaaaagcaa

SEQ ID NO: 1268127 - DNA, 22 bp, Artificial Sequence
  chemically synthesized
gttttgctccaattgcttttga

SEQ ID NO: 1268128 - DNA, 22 bp, Artificial Sequence
  chemically synthesized
tgactaaatcctcaaaagcaat

SEQ ID NO: 1268129 - DNA, 22 bp, Artificial Sequence
  chemically synthesized
ggttttgctccaattgcttttg

SEQ ID NO: 1268130 - DNA, 22 bp, Artificial Sequence
  chemically synthesized
tggttttgctccaattgctttt

SEQ ID NO: 1268131 - DNA, 22 bp, Artificial Sequence
  chemically synthesized
ttggttttgctccaattgcttt

SEQ ID NO: 1268132 - DNA, 22 bp, Artificial Sequence
  chemically synthesized
tttggttttgctccaattgctt

SEQ ID NO: 1268133 - DNA, 22 bp, Artificial Sequence
  chemically synthesized
aatcctcaaaagcaattggagc

SEQ ID NO: 1268134 - DNA, 22 bp, Artificial Sequence
  chemically synthesized
tcaattttttggttttgctcca

SEQ ID NO: 1268135 - DNA, 22 bp, Artificial Sequence
  chemically synthesized
gtcaattttttggttttgctcc

SEQ ID NO: 1268136 - DNA, 22 bp, Artificial Sequence
  chemically synthesized
aaaagcaattggagcaaaacca

SEQ ID NO: 1268137 - DNA, 22 bp, Artificial Sequence
  chemically synthesized
gcttgtcaattttttggttttg

SEQ ID NO: 1268138 - DNA, 22 bp, Artificial Sequence
  chemically synthesized
ggtctcgcttgtcaattttttg

SEQ ID NO: 1268139 - DNA, 22 bp, Artificial Sequence
  chemically synthesized
gagcaaaaccaaaaaattgaca

SEQ ID NO: 1268140 - DNA, 22 bp, Artificial Sequence
  chemically synthesized
attaggtctcgcttgtcaattt

SEQ ID NO: 1268141 - DNA, 22 bp, Artificial Sequence
  chemically synthesized
aattaggtctcgcttgtcaatt

SEQ ID NO: 1268142 - DNA, 22 bp, Artificial Sequence
  chemically synthesized
gtttaattaggtctcgcttgtc

SEQ ID NO: 1268143 - DNA, 22 bp, Artificial Sequence
  chemically synthesized
agtttaattaggtctcgcttgt

SEQ ID NO: 1268144 - DNA, 22 bp, Artificial Sequence
  chemically synthesized
tagtttaattaggtctcgcttg

SEQ ID NO: 1268145 - DNA, 22 bp, Artificial Sequence
  chemically synthesized
ttagtttaattaggtctcgctt

SEQ ID NO: 1268146 - DNA, 22 bp, Artificial Sequence
  chemically synthesized
tttagtttaattaggtctcgct

SEQ ID NO: 1268147 - DNA, 22 bp, Artificial Sequence
  chemically synthesized
acaagcgagacctaattaaact

SEQ ID NO: 1268148 - DNA, 22 bp, Artificial Sequence
  chemically synthesized
tgcagaagctttttagtttaat

SEQ ID NO: 1268149 - DNA, 22 bp, Artificial Sequence
  chemically synthesized
ctgtgcagaagctttttagttt

SEQ ID NO: 1268150 - DNA, 22 bp, Artificial Sequence
  chemically synthesized
gctgtgcagaagctttttagtt

SEQ ID NO: 1268151 - DNA, 22 bp, Artificial Sequence
  chemically synthesized
tgctgtgcagaagctttttagt

SEQ ID NO: 1268152 - DNA, 22 bp, Artificial Sequence
  chemically synthesized
ttgctgtgcagaagctttttag

SEQ ID NO: 1268153 - DNA, 22 bp, Artificial Sequence
  chemically synthesized
ttttgctgtgcagaagcttttt

SEQ ID NO: 1268154 - DNA, 22 bp, Artificial Sequence
  chemically synthesized
cttttgctgtgcagaagctttt

SEQ ID NO: 1268155 - DNA, 22 bp, Artificial Sequence
  chemically synthesized
attaaactaaaaagcttctgca

SEQ ID NO: 1268156 - DNA, 22 bp, Artificial Sequence
  chemically synthesized
aactaaaaagcttctgcacagc

SEQ ID NO: 1268157 - DNA, 22 bp, Artificial Sequence
  chemically synthesized
atagtttcttttgctgtgcaga

SEQ ID NO: 1268158 - DNA, 22 bp, Artificial Sequence
  chemically synthesized
ttgatagtttcttttgctgtgc

SEQ ID NO: 1268159 - DNA, 22 bp, Artificial Sequence
  chemically synthesized
aaaagcttctgcacagcaaaag

SEQ ID NO: 1268160 - DNA, 22 bp, Artificial Sequence
  chemically synthesized
tgttgatagtttcttttgctgt

SEQ ID NO: 1268161 - DNA, 22 bp, Artificial Sequence
  chemically synthesized
ctctgttgatagtttcttttgc

SEQ ID NO: 1268162 - DNA, 22 bp, Artificial Sequence
  chemically synthesized
ttactctgttgatagtttcttt

SEQ ID NO: 1268163 - DNA, 22 bp, Artificial Sequence
  chemically synthesized
ctgcacagcaaaagaaactatc

SEQ ID NO: 1268164 - DNA, 22 bp, Artificial Sequence
  chemically synthesized
tgcacagcaaaagaaactatca

SEQ ID NO: 1268165 - DNA, 22 bp, Artificial Sequence
  chemically synthesized
tctgttactctgttgatagttt

SEQ ID NO: 1268166 - DNA, 22 bp, Artificial Sequence
  chemically synthesized
cacagcaaaagaaactatcaac

SEQ ID NO: 1268167 - DNA, 22 bp, Artificial Sequence
  chemically synthesized
cgtaggttgtctgttactctgt

SEQ ID NO: 1268168 - DNA, 22 bp, Artificial Sequence
  chemically synthesized
ttccgtaggttgtctgttactc

SEQ ID NO: 1268169 - DNA, 22 bp, Artificial Sequence
  chemically synthesized
ctgttccgtaggttgtctgtta

SEQ ID NO: 1268170 - DNA, 22 bp, Artificial Sequence
  chemically synthesized
tcctgttccgtaggttgtctgt

SEQ ID NO: 1268171 - DNA, 22 bp, Artificial Sequence
  chemically synthesized
tcaacagagtaacagacaacct

SEQ ID NO: 1268172 - DNA, 22 bp, Artificial Sequence
  chemically synthesized
ctcctgttccgtaggttgtctg

SEQ ID NO: 1268173 - DNA, 22 bp, Artificial Sequence
  chemically synthesized
tctcctgttccgtaggttgtct

SEQ ID NO: 1268174 - DNA, 22 bp, Artificial Sequence
  chemically synthesized
taatgattttctcctgttccgt

SEQ ID NO: 1268175 - DNA, 22 bp, Artificial Sequence
  chemically synthesized
gtaatgattttctcctgttccg

SEQ ID NO: 1268176 - DNA, 22 bp, Artificial Sequence
  chemically synthesized
cggaacaggagaaaatcattac

SEQ ID NO: 1268177 - DNA, 22 bp, Artificial Sequence
  chemically synthesized
tgtgatatgtagtttgtaatga

SEQ ID NO: 1268178 - DNA, 22 bp, Artificial Sequence
  chemically synthesized
gtgtgatatgtagtttgtaatg

SEQ ID NO: 1268179 - DNA, 22 bp, Artificial Sequence
  chemically synthesized
tgtgtgatatgtagtttgtaat

SEQ ID NO: 1268180 - DNA, 22 bp, Artificial Sequence
  chemically synthesized
aacctttgtgtgatatgtagtt

SEQ ID NO: 1268181 - DNA, 22 bp, Artificial Sequence
  chemically synthesized
gatattgaacctttgtgtgata

SEQ ID NO: 1268182 - DNA, 22 bp, Artificial Sequence
  chemically synthesized
tagatattgaacctttgtgtga

SEQ ID NO: 1268183 - DNA, 22 bp, Artificial Sequence
  chemically synthesized
caaactacatatcacacaaagg

SEQ ID NO: 1268184 - DNA, 22 bp, Artificial Sequence
  chemically synthesized
taaattctagatattgaacctt

SEQ ID NO: 1268185 - DNA, 22 bp, Artificial Sequence
  chemically synthesized
catatcacacaaaggttcaata

SEQ ID NO: 1268186 - DNA, 22 bp, Artificial Sequence
  chemically synthesized
gtaaattctagatattgaacct

SEQ ID NO: 1268187 - DNA, 22 bp, Artificial Sequence
  chemically synthesized
cttgtaaattctagatattgaa

SEQ ID NO: 1268188 - DNA, 22 bp, Artificial Sequence
  chemically synthesized
agttccttgtaaattctagata

SEQ ID NO: 1268189 - DNA, 22 bp, Artificial Sequence
  chemically synthesized
aagttccttgtaaattctagat

SEQ ID NO: 1268190 - DNA, 22 bp, Artificial Sequence
  chemically synthesized
taagttccttgtaaattctaga

SEQ ID NO: 1268191 - DNA, 22 bp, Artificial Sequence
  chemically synthesized
ttaagttccttgtaaattctag

SEQ ID NO: 1268192 - DNA, 22 bp, Artificial Sequence
  chemically synthesized
tttaagttccttgtaaattcta

SEQ ID NO: 1268193 - DNA, 22 bp, Artificial Sequence
  chemically synthesized
agttttttaagttccttgtaaa

SEQ ID NO: 1268194 - DNA, 22 bp, Artificial Sequence
  chemically synthesized
aatatctagaatttacaaggaa

SEQ ID NO: 1268195 - DNA, 22 bp, Artificial Sequence
  chemically synthesized
ttcagttttttaagttccttgt

SEQ ID NO: 1268196 - DNA, 22 bp, Artificial Sequence
  chemically synthesized
gttcagttttttaagttccttg

SEQ ID NO: 1268197 - DNA, 22 bp, Artificial Sequence
  chemically synthesized
cttgttcagttttttaagttcc

SEQ ID NO: 1268198 - DNA, 22 bp, Artificial Sequence
  chemically synthesized
gcttgttcagttttttaagttc

SEQ ID NO: 1268199 - DNA, 22 bp, Artificial Sequence
  chemically synthesized
gaatttacaaggaacttaaaaa

SEQ ID NO: 1268200 - DNA, 22 bp, Artificial Sequence
  chemically synthesized
tgcttgttcagttttttaagtt

SEQ ID NO: 1268201 - DNA, 22 bp, Artificial Sequence
  chemically synthesized
tattttgcttgttcagtttttt

SEQ ID NO: 1268202 - DNA, 22 bp, Artificial Sequence
  chemically synthesized
acaaggaacttaaaaaactgaa

SEQ ID NO: 1268203 - DNA, 22 bp, Artificial Sequence
  chemically synthesized
caaggaacttaaaaaactgaac

SEQ ID NO: 1268204 - DNA, 22 bp, Artificial Sequence
  chemically synthesized
atggcgttgtattttgcttgtt

SEQ ID NO: 1268205 - DNA, 22 bp, Artificial Sequence
  chemically synthesized
gatggcgttgtattttgcttgt

SEQ ID NO: 1268206 - DNA, 22 bp, Artificial Sequence
  chemically synthesized
tgatggcgttgtattttgcttg

SEQ ID NO: 1268207 - DNA, 22 bp, Artificial Sequence
  chemically synthesized
aaaaaactgaacaagcaaaata

SEQ ID NO: 1268208 - DNA, 22 bp, Artificial Sequence
  chemically synthesized
ttgatggcgttgtattttgctt

SEQ ID NO: 1268209 - DNA, 22 bp, Artificial Sequence
  chemically synthesized
aaaaactgaacaagcaaaatac

SEQ ID NO: 1268210 - DNA, 22 bp, Artificial Sequence
  chemically synthesized
tttgatggcgttgtattttgct

SEQ ID NO: 1268211 - DNA, 22 bp, Artificial Sequence
  chemically synthesized
ttttttgatggcgttgtatttt

SEQ ID NO: 1268212 - DNA, 22 bp, Artificial Sequence
  chemically synthesized
cctgttttttgatggcgttgta

SEQ ID NO: 1268213 - DNA, 22 bp, Artificial Sequence
  chemically synthesized
aacaagcaaaatacaacgccat

SEQ ID NO: 1268214 - DNA, 22 bp, Artificial Sequence
  chemically synthesized
gcctgttttttgatggcgttgt

SEQ ID NO: 1268215 - DNA, 22 bp, Artificial Sequence
  chemically synthesized
tgcctgttttttgatggcgttg

SEQ ID NO: 1268216 - DNA, 22 bp, Artificial Sequence
  chemically synthesized
atgccctttgcctgttttttga

SEQ ID NO: 1268217 - DNA, 22 bp, Artificial Sequence
  chemically synthesized
ttcatgccctttgcctgttttt

SEQ ID NO: 1268218 - DNA, 22 bp, Artificial Sequence
  chemically synthesized
agaggtgtctgttcatgccctt

SEQ ID NO: 1268219 - DNA, 22 bp, Artificial Sequence
  chemically synthesized
gagaggtgtctgttcatgccct

SEQ ID NO: 1268220 - DNA, 22 bp, Artificial Sequence
  chemically synthesized
tgagaggtgtctgttcatgccc

SEQ ID NO: 1268221 - DNA, 22 bp, Artificial Sequence
  chemically synthesized
ttgagaggtgtctgttcatgcc

SEQ ID NO: 1268222 - DNA, 22 bp, Artificial Sequence
  chemically synthesized
ttttgagaggtgtctgttcatg

SEQ ID NO: 1268223 - DNA, 22 bp, Artificial Sequence
  chemically synthesized
cttttgagaggtgtctgttcat

SEQ ID NO: 1268224 - DNA, 22 bp, Artificial Sequence
  chemically synthesized
tatgtcttcttttgagaggtgt

SEQ ID NO: 1268225 - DNA, 22 bp, Artificial Sequence
  chemically synthesized
gtatgtcttcttttgagaggtg

SEQ ID NO: 1268226 - DNA, 22 bp, Artificial Sequence
  chemically synthesized
cttgtatgtcttcttttgagag

SEQ ID NO: 1268227 - DNA, 22 bp, Artificial Sequence
  chemically synthesized
taggctacttgtatgtcttctt

SEQ ID NO: 1268228 - DNA, 22 bp, Artificial Sequence
  chemically synthesized
gtaggctacttgtatgtcttct

SEQ ID NO: 1268229 - DNA, 22 bp, Artificial Sequence
  chemically synthesized
tcaaaagaagacatacaagtag

SEQ ID NO: 1268230 - DNA, 22 bp, Artificial Sequence
  chemically synthesized
atatgcttgtaggctacttgta

SEQ ID NO: 1268231 - DNA, 22 bp, Artificial Sequence
  chemically synthesized
aaaagaagacatacaagtagcc

SEQ ID NO: 1268232 - DNA, 22 bp, Artificial Sequence
  chemically synthesized
catatgcttgtaggctacttgt

SEQ ID NO: 1268233 - DNA, 22 bp, Artificial Sequence
  chemically synthesized
tcatatgcttgtaggctacttg

SEQ ID NO: 1268234 - DNA, 22 bp, Artificial Sequence
  chemically synthesized
ttcatatgcttgtaggctactt

SEQ ID NO: 1268235 - DNA, 22 bp, Artificial Sequence
  chemically synthesized
tttcatatgcttgtaggctact

SEQ ID NO: 1268236 - DNA, 22 bp, Artificial Sequence
  chemically synthesized
agcattttttcatatgcttgta

SEQ ID NO: 1268237 - DNA, 22 bp, Artificial Sequence
  chemically synthesized
ttcagcattttttcatatgctt

SEQ ID NO: 1268238 - DNA, 22 bp, Artificial Sequence
  chemically synthesized
atgttattcagcattttttcat

SEQ ID NO: 1268239 - DNA, 22 bp, Artificial Sequence
  chemically synthesized
caagcatatgaaaaaatgctga

SEQ ID NO: 1268240 - DNA, 22 bp, Artificial Sequence
  chemically synthesized
acaattaatgttattcagcatt

SEQ ID NO: 1268241 - DNA, 22 bp, Artificial Sequence
  chemically synthesized
tgacaattaatgttattcagca

SEQ ID NO: 1268242 - DNA, 22 bp, Artificial Sequence
  chemically synthesized
tctgacaattaatgttattcag

SEQ ID NO: 1268243 - DNA, 22 bp, Artificial Sequence
  chemically synthesized
ctctgacaattaatgttattca

SEQ ID NO: 1268244 - DNA, 22 bp, Artificial Sequence
  chemically synthesized
catttctctgacaattaatgtt

SEQ ID NO: 1268245 - DNA, 22 bp, Artificial Sequence
  chemically synthesized
gcatttctctgacaattaatgt

SEQ ID NO: 1268246 - DNA, 22 bp, Artificial Sequence
  chemically synthesized
atttgcatttctctgacaatta

SEQ ID NO: 1268247 - DNA, 22 bp, Artificial Sequence
  chemically synthesized
gatttgcatttctctgacaatt

SEQ ID NO: 1268248 - DNA, 22 bp, Artificial Sequence
  chemically synthesized
tgatttgcatttctctgacaat

SEQ ID NO: 1268249 - DNA, 22 bp, Artificial Sequence
  chemically synthesized
aataacattaattgtcagagaa

SEQ ID NO: 1268250 - DNA, 22 bp, Artificial Sequence
  chemically synthesized
tggttttgatttgcatttctct

SEQ ID NO: 1268251 - DNA, 22 bp, Artificial Sequence
  chemically synthesized
attgtggttttgatttgcattt

SEQ ID NO: 1268252 - DNA, 22 bp, Artificial Sequence
  chemically synthesized
attgtcagagaaatgcaaatca

SEQ ID NO: 1268253 - DNA, 22 bp, Artificial Sequence
  chemically synthesized
tcagagaaatgcaaatcaaaac

SEQ ID NO: 1268254 - DNA, 22 bp, Artificial Sequence
  chemically synthesized
gtgtgcgatggtatctcattgt

SEQ ID NO: 1268255 - DNA, 22 bp, Artificial Sequence
  chemically synthesized
actggtgtgcgatggtatctca

SEQ ID NO: 1268256 - DNA, 22 bp, Artificial Sequence
  chemically synthesized
tgactggtgtgcgatggtatct

SEQ ID NO: 1268257 - DNA, 22 bp, Artificial Sequence
  chemically synthesized
ctgactggtgtgcgatggtatc

SEQ ID NO: 1268258 - DNA, 22 bp, Artificial Sequence
  chemically synthesized
tctgactggtgtgcgatggtat

SEQ ID NO: 1268259 - DNA, 22 bp, Artificial Sequence
  chemically synthesized
ataatggcctttctgactggtg

SEQ ID NO: 1268260 - DNA, 22 bp, Artificial Sequence
  chemically synthesized
aataatggcctttctgactggt

SEQ ID NO: 1268261 - DNA, 22 bp, Artificial Sequence
  chemically synthesized
taataatggcctttctgactgg

SEQ ID NO: 1268262 - DNA, 22 bp, Artificial Sequence
  chemically synthesized
ttaataatggcctttctgactg

SEQ ID NO: 1268263 - DNA, 22 bp, Artificial Sequence
  chemically synthesized
agtttttaataatggcctttct

SEQ ID NO: 1268264 - DNA, 22 bp, Artificial Sequence
  chemically synthesized
gagtttttaataatggcctttc

SEQ ID NO: 1268265 - DNA, 22 bp, Artificial Sequence
  chemically synthesized
tgagtttttaataatggccttt

SEQ ID NO: 1268266 - DNA, 22 bp, Artificial Sequence
  chemically synthesized
ttgagtttttaataatggcctt

SEQ ID NO: 1268267 - DNA, 22 bp, Artificial Sequence
  chemically synthesized
tttgagtttttaataatggcct

SEQ ID NO: 1268268 - DNA, 22 bp, Artificial Sequence
  chemically synthesized
ttttttgagtttttaataatgg

SEQ ID NO: 1268269 - DNA, 22 bp, Artificial Sequence
  chemically synthesized
ttgttttttgagtttttaataa

SEQ ID NO: 1268270 - DNA, 22 bp, Artificial Sequence
  chemically synthesized
gttgttttttgagtttttaata

SEQ ID NO: 1268271 - DNA, 22 bp, Artificial Sequence
  chemically synthesized
accagcatttgttgttttttga

SEQ ID NO: 1268272 - DNA, 22 bp, Artificial Sequence
  chemically synthesized
caccagcatttgttgttttttg

SEQ ID NO: 1268273 - DNA, 22 bp, Artificial Sequence
  chemically synthesized
ttaaaaactcaaaaaacaacaa

SEQ ID NO: 1268274 - DNA, 22 bp, Artificial Sequence
  chemically synthesized
aaaactcaaaaaacaacaaatg

SEQ ID NO: 1268275 - DNA, 22 bp, Artificial Sequence
  chemically synthesized
cggcttcaccagcatttgttgt

SEQ ID NO: 1268276 - DNA, 22 bp, Artificial Sequence
  chemically synthesized
tgcggcttcaccagcatttgtt

SEQ ID NO: 1268277 - DNA, 22 bp, Artificial Sequence
  chemically synthesized
tctgcggcttcaccagcatttg

SEQ ID NO: 1268278 - DNA, 22 bp, Artificial Sequence
  chemically synthesized
ctctgcggcttcaccagcattt

SEQ ID NO: 1268279 - DNA, 22 bp, Artificial Sequence
  chemically synthesized
tctctgcggcttcaccagcatt

SEQ ID NO: 1268280 - DNA, 22 bp, Artificial Sequence
  chemically synthesized
aaaaaacaacaaatgctggtga

SEQ ID NO: 1268281 - DNA, 22 bp, Artificial Sequence
  chemically synthesized
ttctctgcggcttcaccagcat

SEQ ID NO: 1268282 - DNA, 22 bp, Artificial Sequence
  chemically synthesized
ccttttctctgcggcttcacca

SEQ ID NO: 1268283 - DNA, 22 bp, Artificial Sequence
  chemically synthesized
gtgaagccgcagagaaaaggga

SEQ ID NO: 1268284 - DNA, 22 bp, Artificial Sequence
  chemically synthesized
ccaccaacagtgtataagcatt

SEQ ID NO: 1268285 - DNA, 22 bp, Artificial Sequence
  chemically synthesized
cattcccaccaacagtgtataa

SEQ ID NO: 1268286 - DNA, 22 bp, Artificial Sequence
  chemically synthesized
acattcccaccaacagtgtata

SEQ ID NO: 1268287 - DNA, 22 bp, Artificial Sequence
  chemically synthesized
atttacattcccaccaacagtg

SEQ ID NO: 1268288 - DNA, 22 bp, Artificial Sequence
  chemically synthesized
aactaatttacattcccaccaa

SEQ ID NO: 1268289 - DNA, 22 bp, Artificial Sequence
  chemically synthesized
atacactgttggtgggaatgta

SEQ ID NO: 1268290 - DNA, 22 bp, Artificial Sequence
  chemically synthesized
tacactgttggtgggaatgtaa

SEQ ID NO: 1268291 - DNA, 22 bp, Artificial Sequence
  chemically synthesized
cacagtggctgaactaatttac

SEQ ID NO: 1268292 - DNA, 22 bp, Artificial Sequence
  chemically synthesized
ttggtgggaatgtaaattagtt

SEQ ID NO: 1268293 - DNA, 22 bp, Artificial Sequence
  chemically synthesized
ccacagtggctgaactaattta

SEQ ID NO: 1268294 - DNA, 22 bp, Artificial Sequence
  chemically synthesized
gtgggaatgtaaattagttcag

SEQ ID NO: 1268295 - DNA, 22 bp, Artificial Sequence
  chemically synthesized
ccttccacagtggctgaactaa

SEQ ID NO: 1268296 - DNA, 22 bp, Artificial Sequence
  chemically synthesized
caaactgccttccacagtggct

SEQ ID NO: 1268297 - DNA, 22 bp, Artificial Sequence
  chemically synthesized
gttcagccactgtggaaggcag

SEQ ID NO: 1268298 - DNA, 22 bp, Artificial Sequence
  chemically synthesized
ggaaatctccaaactgccttcc

SEQ ID NO: 1268299 - DNA, 22 bp, Artificial Sequence
  chemically synthesized
gggaaatctccaaactgccttc

SEQ ID NO: 1268300 - DNA, 22 bp, Artificial Sequence
  chemically synthesized
tgggaaatctccaaactgcctt

SEQ ID NO: 1268301 - DNA, 22 bp, Artificial Sequence
  chemically synthesized
agccactgtggaaggcagtttg

SEQ ID NO: 1268302 - DNA, 22 bp, Artificial Sequence
  chemically synthesized
tttgggaaatctccaaactgcc

SEQ ID NO: 1268303 - DNA, 22 bp, Artificial Sequence
  chemically synthesized
aattctttgggaaatctccaaa

SEQ ID NO: 1268304 - DNA, 22 bp, Artificial Sequence
  chemically synthesized
aaattctttgggaaatctccaa

SEQ ID NO: 1268305 - DNA, 22 bp, Artificial Sequence
  chemically synthesized
tggaaggcagtttggagatttc

SEQ ID NO: 1268306 - DNA, 22 bp, Artificial Sequence
  chemically synthesized
tcttaaattctttgggaaatct

SEQ ID NO: 1268307 - DNA, 22 bp, Artificial Sequence
  chemically synthesized
tgtcttaaattctttgggaaat

SEQ ID NO: 1268308 - DNA, 22 bp, Artificial Sequence
  chemically synthesized
ggagatttcccaaagaatttaa

SEQ ID NO: 1268309 - DNA, 22 bp, Artificial Sequence
  chemically synthesized
gagatttcccaaagaatttaag

SEQ ID NO: 1268310 - DNA, 22 bp, Artificial Sequence
  chemically synthesized
aatggtagttctgtcttaaatt

SEQ ID NO: 1268311 - DNA, 22 bp, Artificial Sequence
  chemically synthesized
cccaaagaatttaagacagaac

SEQ ID NO: 1268312 - DNA, 22 bp, Artificial Sequence
  chemically synthesized
gattgaatggtagttctgtctt

SEQ ID NO: 1268313 - DNA, 22 bp, Artificial Sequence
  chemically synthesized
ccaaagaatttaagacagaact

SEQ ID NO: 1268314 - DNA, 22 bp, Artificial Sequence
  chemically synthesized
ctggattgaatggtagttctgt

SEQ ID NO: 1268315 - DNA, 22 bp, Artificial Sequence
  chemically synthesized
aagacagaactaccattcaatc

SEQ ID NO: 1268316 - DNA, 22 bp, Artificial Sequence
  chemically synthesized
agacagaactaccattcaatcc

SEQ ID NO: 1268317 - DNA, 22 bp, Artificial Sequence
  chemically synthesized
agtaatgggattgctggattga

SEQ ID NO: 1268318 - DNA, 22 bp, Artificial Sequence
  chemically synthesized
ccattcaatccagcaatcccat

SEQ ID NO: 1268319 - DNA, 22 bp, Artificial Sequence
  chemically synthesized
gatatatattcagtaatgggat

SEQ ID NO: 1268320 - DNA, 22 bp, Artificial Sequence
  chemically synthesized
ggatatatattcagtaatggga

SEQ ID NO: 1268321 - DNA, 22 bp, Artificial Sequence
  chemically synthesized
tggatatatattcagtaatggg

SEQ ID NO: 1268322 - DNA, 22 bp, Artificial Sequence
  chemically synthesized
aatccagcaatcccattactga

SEQ ID NO: 1268323 - DNA, 22 bp, Artificial Sequence
  chemically synthesized
ttttggatatatattcagtaat

SEQ ID NO: 1268324 - DNA, 22 bp, Artificial Sequence
  chemically synthesized
attttggatatatattcagtaa

SEQ ID NO: 1268325 - DNA, 22 bp, Artificial Sequence
  chemically synthesized
tttattttggatatatattcag

SEQ ID NO: 1268326 - DNA, 22 bp, Artificial Sequence
  chemically synthesized
atttattttggatatatattca

SEQ ID NO: 1268327 - DNA, 22 bp, Artificial Sequence
  chemically synthesized
tatttattttggatatatattc

SEQ ID NO: 1268328 - DNA, 22 bp, Artificial Sequence
  chemically synthesized
aaacaattttatttattttgga

SEQ ID NO: 1268329 - DNA, 22 bp, Artificial Sequence
  chemically synthesized
ctgaatatatatccaaaataaa

SEQ ID NO: 1268330 - DNA, 22 bp, Artificial Sequence
  chemically synthesized
aatatatatccaaaataaataa

SEQ ID NO: 1268331 - DNA, 22 bp, Artificial Sequence
  chemically synthesized
tgttaaaacaattttatttatt

SEQ ID NO: 1268332 - DNA, 22 bp, Artificial Sequence
  chemically synthesized
atgttaaaacaattttatttat

SEQ ID NO: 1268333 - DNA, 22 bp, Artificial Sequence
  chemically synthesized
tatgttaaaacaattttattta

SEQ ID NO: 1268334 - DNA, 22 bp, Artificial Sequence
  chemically synthesized
ttttaacataaagacacatgca

SEQ ID NO: 1268335 - DNA, 22 bp, Artificial Sequence
  chemically synthesized
taacataaagacacatgcattc

SEQ ID NO: 1268336 - DNA, 22 bp, Artificial Sequence
  chemically synthesized
tgatgaacacgtgaatgcatgt

SEQ ID NO: 1268337 - DNA, 22 bp, Artificial Sequence
  chemically synthesized
aacataaagacacatgcattca

SEQ ID NO: 1268338 - DNA, 22 bp, Artificial Sequence
  chemically synthesized
acataaagacacatgcattcac

SEQ ID NO: 1268339 - DNA, 22 bp, Artificial Sequence
  chemically synthesized
tgaatagtgctgtgatgaacac

SEQ ID NO: 1268340 - DNA, 22 bp, Artificial Sequence
  chemically synthesized
ttgtgaatagtgctgtgatgaa

SEQ ID NO: 1268341 - DNA, 22 bp, Artificial Sequence
  chemically synthesized
ctattgtgaatagtgctgtgat

SEQ ID NO: 1268342 - DNA, 22 bp, Artificial Sequence
  chemically synthesized
gctattgtgaatagtgctgtga

SEQ ID NO: 1268343 - DNA, 22 bp, Artificial Sequence
  chemically synthesized
tgctattgtgaatagtgctgtg

SEQ ID NO: 1268344 - DNA, 22 bp, Artificial Sequence
  chemically synthesized
acgtgttcatcacagcactatt

SEQ ID NO: 1268345 - DNA, 22 bp, Artificial Sequence
  chemically synthesized
catgtctttgctattgtgaata

SEQ ID NO: 1268346 - DNA, 22 bp, Artificial Sequence
  chemically synthesized
atcacagcactattcacaatag

SEQ ID NO: 1268347 - DNA, 22 bp, Artificial Sequence
  chemically synthesized
attccatgtctttgctattgtg

SEQ ID NO: 1268348 - DNA, 22 bp, Artificial Sequence
  chemically synthesized
ggttaattccatgtctttgcta

SEQ ID NO: 1268349 - DNA, 22 bp, Artificial Sequence
  chemically synthesized
ttcacaatagcaaagacatgga

SEQ ID NO: 1268350 - DNA, 22 bp, Artificial Sequence
  chemically synthesized
acaatagcaaagacatggaatt

SEQ ID NO: 1268351 - DNA, 22 bp, Artificial Sequence
  chemically synthesized
tccagtccaccaatgatgtgta

SEQ ID NO: 1268352 - DNA, 22 bp, Artificial Sequence
  chemically synthesized
atccagtccaccaatgatgtgt

SEQ ID NO: 1268353 - DNA, 22 bp, Artificial Sequence
  chemically synthesized
tatccagtccaccaatgatgtg

SEQ ID NO: 1268354 - DNA, 22 bp, Artificial Sequence
  chemically synthesized
tttatccagtccaccaatgatg

SEQ ID NO: 1268355 - DNA, 22 bp, Artificial Sequence
  chemically synthesized
acctagatacacatcattggtg

SEQ ID NO: 1268356 - DNA, 22 bp, Artificial Sequence
  chemically synthesized
ctttatccagtccaccaatgat

SEQ ID NO: 1268357 - DNA, 22 bp, Artificial Sequence
  chemically synthesized
tctttatccagtccaccaatga

SEQ ID NO: 1268358 - DNA, 22 bp, Artificial Sequence
  chemically synthesized
gatacacatcattggtggactg

SEQ ID NO: 1268359 - DNA, 22 bp, Artificial Sequence
  chemically synthesized
gattttctttatccagtccacc

SEQ ID NO: 1268360 - DNA, 22 bp, Artificial Sequence
  chemically synthesized
agattttctttatccagtccac

SEQ ID NO: 1268361 - DNA, 22 bp, Artificial Sequence
  chemically synthesized
gtggactggataaagaaaatct

SEQ ID NO: 1268362 - DNA, 22 bp, Artificial Sequence
  chemically synthesized
catggggtatatttagattttc

SEQ ID NO: 1268363 - DNA, 22 bp, Artificial Sequence
  chemically synthesized
gataaagaaaatctaaatatac

SEQ ID NO: 1268364 - DNA, 22 bp, Artificial Sequence
  chemically synthesized
catagtattccatggggtatat

SEQ ID NO: 1268365 - DNA, 22 bp, Artificial Sequence
  chemically synthesized
tggctgcatagtattccatggg

SEQ ID NO: 1268366 - DNA, 22 bp, Artificial Sequence
  chemically synthesized
atggctgcatagtattccatgg

SEQ ID NO: 1268367 - DNA, 22 bp, Artificial Sequence
  chemically synthesized
tatggctgcatagtattccatg

SEQ ID NO: 1268368 - DNA, 22 bp, Artificial Sequence
  chemically synthesized
aatataccccatggaatactat

SEQ ID NO: 1268369 - DNA, 22 bp, Artificial Sequence
  chemically synthesized
ttttatggctgcatagtattcc

SEQ ID NO: 1268370 - DNA, 22 bp, Artificial Sequence
  chemically synthesized
tgttttatggctgcatagtatt

SEQ ID NO: 1268371 - DNA, 22 bp, Artificial Sequence
  chemically synthesized
attctgttttatggctgcatag

SEQ ID NO: 1268372 - DNA, 22 bp, Artificial Sequence
  chemically synthesized
cattctgttttatggctgcata

SEQ ID NO: 1268373 - DNA, 22 bp, Artificial Sequence
  chemically synthesized
tgcagccataaaacagaatgaa

SEQ ID NO: 1268374 - DNA, 22 bp, Artificial Sequence
  chemically synthesized
cgaaggacatgatttcattctg

SEQ ID NO: 1268375 - DNA, 22 bp, Artificial Sequence
  chemically synthesized
ctacgaaggacatgatttcatt

SEQ ID NO: 1268376 - DNA, 22 bp, Artificial Sequence
  chemically synthesized
tgttgctacgaaggacatgatt

SEQ ID NO: 1268377 - DNA, 22 bp, Artificial Sequence
  chemically synthesized
catctgtgttgctacgaaggac

SEQ ID NO: 1268378 - DNA, 22 bp, Artificial Sequence
  chemically synthesized
catcacagctgcatctgtgttg

SEQ ID NO: 1268379 - DNA, 22 bp, Artificial Sequence
  chemically synthesized
cgtagcaacacagatgcagctg

SEQ ID NO: 1268380 - DNA, 22 bp, Artificial Sequence
  chemically synthesized
gtagcaacacagatgcagctgt

SEQ ID NO: 1268381 - DNA, 22 bp, Artificial Sequence
  chemically synthesized
ggataatggcctccatcacagc

SEQ ID NO: 1268382 - DNA, 22 bp, Artificial Sequence
  chemically synthesized
gcctaggataatggcctccatc

SEQ ID NO: 1268383 - DNA, 22 bp, Artificial Sequence
  chemically synthesized
catgaattcgcctaggataatg

SEQ ID NO: 1268384 - DNA, 22 bp, Artificial Sequence
  chemically synthesized
tgatggaggccattatcctagg

SEQ ID NO: 1268385 - DNA, 22 bp, Artificial Sequence
  chemically synthesized
ctgcatgaattcgcctaggata

SEQ ID NO: 1268386 - DNA, 22 bp, Artificial Sequence
  chemically synthesized
cgttgctgcatgaattcgccta

SEQ ID NO: 1268387 - DNA, 22 bp, Artificial Sequence
  chemically synthesized
gcgttccgttgctgcatgaatt

SEQ ID NO: 1268388 - DNA, 22 bp, Artificial Sequence
  chemically synthesized
ggcgttccgttgctgcatgaat

SEQ ID NO: 1268389 - DNA, 22 bp, Artificial Sequence
  chemically synthesized
tcctaggcgaattcatgcagca

SEQ ID NO: 1268390 - DNA, 22 bp, Artificial Sequence
  chemically synthesized
ggcgaattcatgcagcaacgga

SEQ ID NO: 1268391 - DNA, 22 bp, Artificial Sequence
  chemically synthesized
atgcagcaacggaacgccaaat

SEQ ID NO: 1268392 - DNA, 22 bp, Artificial Sequence
  chemically synthesized
caagtgagaacatgtggtattt

SEQ ID NO: 1268393 - DNA, 22 bp, Artificial Sequence
  chemically synthesized
acaagtgagaacatgtggtatt

SEQ ID NO: 1268394 - DNA, 22 bp, Artificial Sequence
  chemically synthesized
ccacttacaagtgagaacatgt

SEQ ID NO: 1268395 - DNA, 22 bp, Artificial Sequence
  chemically synthesized
tcacttgtaagtgggagctata

SEQ ID NO: 1268396 - DNA, 22 bp, Artificial Sequence
  chemically synthesized
acttgtaagtgggagctatata

SEQ ID NO: 1268397 - DNA, 22 bp, Artificial Sequence
  chemically synthesized
gtaagtgggagctatatattgg

SEQ ID NO: 1268398 - DNA, 22 bp, Artificial Sequence
  chemically synthesized
taagtgggagctatatattggg

SEQ ID NO: 1268399 - DNA, 22 bp, Artificial Sequence
  chemically synthesized
tgtccatgagtacccaatatat

SEQ ID NO: 1268400 - DNA, 22 bp, Artificial Sequence
  chemically synthesized
atgtccatgagtacccaatata

SEQ ID NO: 1268401 - DNA, 22 bp, Artificial Sequence
  chemically synthesized
tatgtccatgagtacccaatat

SEQ ID NO: 1268402 - DNA, 22 bp, Artificial Sequence
  chemically synthesized
acctttatgtccatgagtaccc

SEQ ID NO: 1268403 - DNA, 22 bp, Artificial Sequence
  chemically synthesized
cacctttatgtccatgagtacc

SEQ ID NO: 1268404 - DNA, 22 bp, Artificial Sequence
  chemically synthesized
tcacctttatgtccatgagtac

SEQ ID NO: 1268405 - DNA, 22 bp, Artificial Sequence
  chemically synthesized
tatattgggtactcatggacat

SEQ ID NO: 1268406 - DNA, 22 bp, Artificial Sequence
  chemically synthesized
tcgttttcacctttatgtccat

SEQ ID NO: 1268407 - DNA, 22 bp, Artificial Sequence
  chemically synthesized
ggtactcatggacataaaggtg

SEQ ID NO: 1268408 - DNA, 22 bp, Artificial Sequence
  chemically synthesized
gtgtctatcgttttcaccttta

SEQ ID NO: 1268409 - DNA, 22 bp, Artificial Sequence
  chemically synthesized
atggacataaaggtgaaaacga

SEQ ID NO: 1268410 - DNA, 22 bp, Artificial Sequence
  chemically synthesized
gtaatccctagtgtctatcgtt

SEQ ID NO: 1268411 - DNA, 22 bp, Artificial Sequence
  chemically synthesized
tagtaatccctagtgtctatcg

SEQ ID NO: 1268412 - DNA, 22 bp, Artificial Sequence
  chemically synthesized
ctagtaatccctagtgtctatc

SEQ ID NO: 1268413 - DNA, 22 bp, Artificial Sequence
  chemically synthesized
cccttctagtaatccctagtgt

SEQ ID NO: 1268414 - DNA, 22 bp, Artificial Sequence
  chemically synthesized
ccccttctagtaatccctagtg

SEQ ID NO: 1268415 - DNA, 22 bp, Artificial Sequence
  chemically synthesized
cttccccttctagtaatcccta

SEQ ID NO: 1268416 - DNA, 22 bp, Artificial Sequence
  chemically synthesized
cctccttccccttctagtaatc

SEQ ID NO: 1268417 - DNA, 22 bp, Artificial Sequence
  chemically synthesized
tccccctccctccttccccttc

SEQ ID NO: 1268418 - DNA, 22 bp, Artificial Sequence
  chemically synthesized
atccccctccctccttcccctt

SEQ ID NO: 1268419 - DNA, 22 bp, Artificial Sequence
  chemically synthesized
gggattactagaaggggaagga

SEQ ID NO: 1268420 - DNA, 22 bp, Artificial Sequence
  chemically synthesized
aacccttatccccctccctcct

SEQ ID NO: 1268421 - DNA, 22 bp, Artificial Sequence
  chemically synthesized
ctagaaggggaaggagggaggg

SEQ ID NO: 1268422 - DNA, 22 bp, Artificial Sequence
  chemically synthesized
caacccttatccccctccctcc

SEQ ID NO: 1268423 - DNA, 22 bp, Artificial Sequence
  chemically synthesized
tcaacccttatccccctccctc

SEQ ID NO: 1268424 - DNA, 22 bp, Artificial Sequence
  chemically synthesized
ttcaacccttatccccctccct

SEQ ID NO: 1268425 - DNA, 22 bp, Artificial Sequence
  chemically synthesized
gaaggggaaggagggaggggga

SEQ ID NO: 1268426 - DNA, 22 bp, Artificial Sequence
  chemically synthesized
agtatagtacccaatagtcagt

SEQ ID NO: 1268427 - DNA, 22 bp, Artificial Sequence
  chemically synthesized
aaaaactgactattgggtacta

SEQ ID NO: 1268428 - DNA, 22 bp, Artificial Sequence
  chemically synthesized
tcacccaggtactgagtatagt

SEQ ID NO: 1268429 - DNA, 22 bp, Artificial Sequence
  chemically synthesized
actattgggtactatactcagt

SEQ ID NO: 1268430 - DNA, 22 bp, Artificial Sequence
  chemically synthesized
ttgggtactatactcagtacct

SEQ ID NO: 1268431 - DNA, 22 bp, Artificial Sequence
  chemically synthesized
ggtactatactcagtacctggg

SEQ ID NO: 1268432 - DNA, 22 bp, Artificial Sequence
  chemically synthesized
tactcagtacctgggtgacagg

SEQ ID NO: 1268433 - DNA, 22 bp, Artificial Sequence
  chemically synthesized
gggtacgaatgatcctgtcacc

SEQ ID NO: 1268434 - DNA, 22 bp, Artificial Sequence
  chemically synthesized
ggggtacgaatgatcctgtcac

SEQ ID NO: 1268435 - DNA, 22 bp, Artificial Sequence
  chemically synthesized
agtacctgggtgacaggatcat

SEQ ID NO: 1268436 - DNA, 22 bp, Artificial Sequence
  chemically synthesized
caggggtttggggtacgaatga

SEQ ID NO: 1268437 - DNA, 22 bp, Artificial Sequence
  chemically synthesized
ggtgacaggatcattcgtaccc

SEQ ID NO: 1268438 - DNA, 22 bp, Artificial Sequence
  chemically synthesized
gtaccccaaacccctggaattc

SEQ ID NO: 1268439 - DNA, 22 bp, Artificial Sequence
  chemically synthesized
tgggagggagcatgcaagtgaa

SEQ ID NO: 1268440 - DNA, 22 bp, Artificial Sequence
  chemically synthesized
atgggagggagcatgcaagtga

SEQ ID NO: 1268441 - DNA, 22 bp, Artificial Sequence
  chemically synthesized
cttatgggagggagcatgcaag

SEQ ID NO: 1268442 - DNA, 22 bp, Artificial Sequence
  chemically synthesized
gaattcacttgcatgctccctc

SEQ ID NO: 1268443 - DNA, 22 bp, Artificial Sequence
  chemically synthesized
aactccttatgggagggagcat

SEQ ID NO: 1268444 - DNA, 22 bp, Artificial Sequence
  chemically synthesized
caactccttatgggagggagca

SEQ ID NO: 1268445 - DNA, 22 bp, Artificial Sequence
  chemically synthesized
tcaactccttatgggagggagc

SEQ ID NO: 1268446 - DNA, 22 bp, Artificial Sequence
  chemically synthesized
acttgcatgctccctcccataa

SEQ ID NO: 1268447 - DNA, 22 bp, Artificial Sequence
  chemically synthesized
gcatgctccctcccataaggag

SEQ ID NO: 1268448 - DNA, 22 bp, Artificial Sequence
  chemically synthesized
catgctccctcccataaggagt

SEQ ID NO: 1268449 - DNA, 22 bp, Artificial Sequence
  chemically synthesized
gaccagttttcaactccttatg

SEQ ID NO: 1268450 - DNA, 22 bp, Artificial Sequence
  chemically synthesized
cctagaccagttttcaactcct

SEQ ID NO: 1268451 - DNA, 22 bp, Artificial Sequence
  chemically synthesized
acctagaccagttttcaactcc

SEQ ID NO: 1268452 - DNA, 22 bp, Artificial Sequence
  chemically synthesized
cctcccataaggagttgaaaac

SEQ ID NO: 1268453 - DNA, 22 bp, Artificial Sequence
  chemically synthesized
atttacctagaccagttttcaa

SEQ ID NO: 1268454 - DNA, 22 bp, Artificial Sequence
  chemically synthesized
ccataaggagttgaaaactggt

SEQ ID NO: 1268455 - DNA, 22 bp, Artificial Sequence
  chemically synthesized
cctcatttacctagaccagttt

SEQ ID NO: 1268456 - DNA, 22 bp, Artificial Sequence
  chemically synthesized
aaaactggtctaggtaaatgag

SEQ ID NO: 1268457 - DNA, 22 bp, Artificial Sequence
  chemically synthesized
gtgacagggttgcctcatttac

SEQ ID NO: 1268458 - DNA, 22 bp, Artificial Sequence
  chemically synthesized
gtctaggtaaatgaggcaaccc

SEQ ID NO: 1268459 - DNA, 22 bp, Artificial Sequence
  chemically synthesized
ccgggactcgtgacagggttgc

SEQ ID NO: 1268460 - DNA, 22 bp, Artificial Sequence
  chemically synthesized
cccgggactcgtgacagggttg

SEQ ID NO: 1268461 - DNA, 22 bp, Artificial Sequence
  chemically synthesized
ggtaaatgaggcaaccctgtca

SEQ ID NO: 1268462 - DNA, 22 bp, Artificial Sequence
  chemically synthesized
accccttcccgggactcgtgac

SEQ ID NO: 1268463 - DNA, 22 bp, Artificial Sequence
  chemically synthesized
cctgaccccttcccgggactcg

SEQ ID NO: 1268464 - DNA, 22 bp, Artificial Sequence
  chemically synthesized
ccctgaccccttcccgggactc

SEQ ID NO: 1268465 - DNA, 22 bp, Artificial Sequence
  chemically synthesized
tttccctgaccccttcccggga

SEQ ID NO: 1268466 - DNA, 22 bp, Artificial Sequence
  chemically synthesized
tcacgagtcccgggaaggggtc

SEQ ID NO: 1268467 - DNA, 22 bp, Artificial Sequence
  chemically synthesized
tatgatatcgaagcagcctatt

SEQ ID NO: 1268468 - DNA, 22 bp, Artificial Sequence
  chemically synthesized
aaaagagagttgtatgatatcg

SEQ ID NO: 1268469 - DNA, 22 bp, Artificial Sequence
  chemically synthesized
aaaaagagagttgtatgatatc

SEQ ID NO: 1268470 - DNA, 22 bp, Artificial Sequence
  chemically synthesized
taaaaagagagttgtatgatat

SEQ ID NO: 1268471 - DNA, 22 bp, Artificial Sequence
  chemically synthesized
ttaaaaagagagttgtatgata

SEQ ID NO: 1268472 - DNA, 22 bp, Artificial Sequence
  chemically synthesized
cttcgatatcatacaactctct

SEQ ID NO: 1268473 - DNA, 22 bp, Artificial Sequence
  chemically synthesized
cgatatcatacaactctctttt

SEQ ID NO: 1268474 - DNA, 22 bp, Artificial Sequence
  chemically synthesized
gatatcatacaactctcttttt

SEQ ID NO: 1268475 - DNA, 22 bp, Artificial Sequence
  chemically synthesized
gaaggaccttttaaaaagagag

SEQ ID NO: 1268476 - DNA, 22 bp, Artificial Sequence
  chemically synthesized
gaagaaatattggaaggacctt

SEQ ID NO: 1268477 - DNA, 22 bp, Artificial Sequence
  chemically synthesized
tctttttaaaaggtccttccaa

SEQ ID NO: 1268478 - DNA, 22 bp, Artificial Sequence
  chemically synthesized
tttttaaaaggtccttccaata

SEQ ID NO: 1268479 - DNA, 22 bp, Artificial Sequence
  chemically synthesized
aagttggaagaaatattggaag

SEQ ID NO: 1268480 - DNA, 22 bp, Artificial Sequence
  chemically synthesized
tttaaaaggtccttccaatatt

SEQ ID NO: 1268481 - DNA, 22 bp, Artificial Sequence
  chemically synthesized
caagttggaagaaatattggaa

SEQ ID NO: 1268482 - DNA, 22 bp, Artificial Sequence
  chemically synthesized
ttaaaaggtccttccaatattt

SEQ ID NO: 1268483 - DNA, 22 bp, Artificial Sequence
  chemically synthesized
taaaaggtccttccaatatttc

SEQ ID NO: 1268484 - DNA, 22 bp, Artificial Sequence
  chemically synthesized
aaaaggtccttccaatatttct

SEQ ID NO: 1268485 - DNA, 22 bp, Artificial Sequence
  chemically synthesized
aaaggtccttccaatatttctt

SEQ ID NO: 1268486 - DNA, 22 bp, Artificial Sequence
  chemically synthesized
gacttcaagttggaagaaatat

SEQ ID NO: 1268487 - DNA, 22 bp, Artificial Sequence
  chemically synthesized
taaagctggacttcaagttgga

SEQ ID NO: 1268488 - DNA, 22 bp, Artificial Sequence
  chemically synthesized
ccaatatttcttccaacttgaa

SEQ ID NO: 1268489 - DNA, 22 bp, Artificial Sequence
  chemically synthesized
caatatttcttccaacttgaag

SEQ ID NO: 1268490 - DNA, 22 bp, Artificial Sequence
  chemically synthesized
ttgtaaagctggacttcaagtt

SEQ ID NO: 1268491 - DNA, 22 bp, Artificial Sequence
  chemically synthesized
gttgtaaagctggacttcaagt

SEQ ID NO: 1268492 - DNA, 22 bp, Artificial Sequence
  chemically synthesized
cttccaacttgaagtccagctt

SEQ ID NO: 1268493 - DNA, 22 bp, Artificial Sequence
  chemically synthesized
ttccaacttgaagtccagcttt

SEQ ID NO: 1268494 - DNA, 22 bp, Artificial Sequence
  chemically synthesized
ccaacttgaagtccagctttac

SEQ ID NO: 1268495 - DNA, 22 bp, Artificial Sequence
  chemically synthesized
caacttgaagtccagctttaca

SEQ ID NO: 1268496 - DNA, 22 bp, Artificial Sequence
  chemically synthesized
gaagtccagctttacaacaagt

SEQ ID NO: 1268497 - DNA, 22 bp, Artificial Sequence
  chemically synthesized
aagtccagctttacaacaagtt

SEQ ID NO: 1268498 - DNA, 22 bp, Artificial Sequence
  chemically synthesized
tacaacaagtttctggactctc

SEQ ID NO: 1268499 - DNA, 22 bp, Artificial Sequence
  chemically synthesized
acaacaagtttctggactctct

SEQ ID NO: 1268500 - DNA, 22 bp, Artificial Sequence
  chemically synthesized
caacaagtttctggactctctt

SEQ ID NO: 1268501 - DNA, 22 bp, Artificial Sequence
  chemically synthesized
cagagtaggaaagaagagagtc

SEQ ID NO: 1268502 - DNA, 22 bp, Artificial Sequence
  chemically synthesized
ataacctgcagagtaggaaaga

SEQ ID NO: 1268503 - DNA, 22 bp, Artificial Sequence
  chemically synthesized
ctggactctcttctttcctact

SEQ ID NO: 1268504 - DNA, 22 bp, Artificial Sequence
  chemically synthesized
tggactctcttctttcctactc

SEQ ID NO: 1268505 - DNA, 22 bp, Artificial Sequence
  chemically synthesized
tgataacctgcagagtaggaaa

SEQ ID NO: 1268506 - DNA, 22 bp, Artificial Sequence
  chemically synthesized
ctgataacctgcagagtaggaa

SEQ ID NO: 1268507 - DNA, 22 bp, Artificial Sequence
  chemically synthesized
gactctcttctttcctactctg

SEQ ID NO: 1268508 - DNA, 22 bp, Artificial Sequence
  chemically synthesized
tctgataacctgcagagtagga

SEQ ID NO: 1268509 - DNA, 22 bp, Artificial Sequence
  chemically synthesized
ttttctgataacctgcagagta

SEQ ID NO: 1268510 - DNA, 22 bp, Artificial Sequence
  chemically synthesized
attttctgataacctgcagagt

SEQ ID NO: 1268511 - DNA, 22 bp, Artificial Sequence
  chemically synthesized
tcttctttcctactctgcaggt

SEQ ID NO: 1268512 - DNA, 22 bp, Artificial Sequence
  chemically synthesized
tattttctgataacctgcagag

SEQ ID NO: 1268513 - DNA, 22 bp, Artificial Sequence
  chemically synthesized
ttctttcctactctgcaggtta

SEQ ID NO: 1268514 - DNA, 22 bp, Artificial Sequence
  chemically synthesized
ttttattttctgataacctgca

SEQ ID NO: 1268515 - DNA, 22 bp, Artificial Sequence
  chemically synthesized
ctttcctactctgcaggttatc

SEQ ID NO: 1268516 - DNA, 22 bp, Artificial Sequence
  chemically synthesized
gttttattttctgataacctgc

SEQ ID NO: 1268517 - DNA, 22 bp, Artificial Sequence
  chemically synthesized
tttcctactctgcaggttatca

SEQ ID NO: 1268518 - DNA, 22 bp, Artificial Sequence
  chemically synthesized
tcctactctgcaggttatcaga

SEQ ID NO: 1268519 - DNA, 22 bp, Artificial Sequence
  chemically synthesized
tttgttttattttctgataacc

SEQ ID NO: 1268520 - DNA, 22 bp, Artificial Sequence
  chemically synthesized
cctactctgcaggttatcagaa

SEQ ID NO: 1268521 - DNA, 22 bp, Artificial Sequence
  chemically synthesized
gtttgttttattttctgataac

SEQ ID NO: 1268522 - DNA, 22 bp, Artificial Sequence
  chemically synthesized
ctactctgcaggttatcagaaa

SEQ ID NO: 1268523 - DNA, 22 bp, Artificial Sequence
  chemically synthesized
tgtttgttttattttctgataa

SEQ ID NO: 1268524 - DNA, 22 bp, Artificial Sequence
  chemically synthesized
ctctgcaggttatcagaaaata

SEQ ID NO: 1268525 - DNA, 22 bp, Artificial Sequence
  chemically synthesized
tgcaggttatcagaaaataaaa

SEQ ID NO: 1268526 - DNA, 22 bp, Artificial Sequence
  chemically synthesized
cggttttgtttgttttattttc

SEQ ID NO: 1268527 - DNA, 22 bp, Artificial Sequence
  chemically synthesized
gcggttttgtttgttttatttt

SEQ ID NO: 1268528 - DNA, 22 bp, Artificial Sequence
  chemically synthesized
caggttatcagaaaataaaaca

SEQ ID NO: 1268529 - DNA, 22 bp, Artificial Sequence
  chemically synthesized
tagtttgcggttttgtttgttt

SEQ ID NO: 1268530 - DNA, 22 bp, Artificial Sequence
  chemically synthesized
gtagtttgcggttttgtttgtt

SEQ ID NO: 1268531 - DNA, 22 bp, Artificial Sequence
  chemically synthesized
tcagaaaataaaacaaacaaaa

SEQ ID NO: 1268532 - DNA, 22 bp, Artificial Sequence
  chemically synthesized
tgtagtttgcggttttgtttgt

SEQ ID NO: 1268533 - DNA, 22 bp, Artificial Sequence
  chemically synthesized
ttttgtagtttgcggttttgtt

SEQ ID NO: 1268534 - DNA, 22 bp, Artificial Sequence
  chemically synthesized
ttattttgtagtttgcggtttt

SEQ ID NO: 1268535 - DNA, 22 bp, Artificial Sequence
  chemically synthesized
gttattttgtagtttgcggttt

SEQ ID NO: 1268536 - DNA, 22 bp, Artificial Sequence
  chemically synthesized
tgttattttgtagtttgcggtt

SEQ ID NO: 1268537 - DNA, 22 bp, Artificial Sequence
  chemically synthesized
ttgttattttgtagtttgcggt

SEQ ID NO: 1268538 - DNA, 22 bp, Artificial Sequence
  chemically synthesized
ggtgtttttgttattttgtagt

SEQ ID NO: 1268539 - DNA, 22 bp, Artificial Sequence
  chemically synthesized
gggtgtttttgttattttgtag

SEQ ID NO: 1268540 - DNA, 22 bp, Artificial Sequence
  chemically synthesized
cttgggtgtttttgttattttg

SEQ ID NO: 1268541 - DNA, 22 bp, Artificial Sequence
  chemically synthesized
atcacattgcttgggtgttttt

SEQ ID NO: 1268542 - DNA, 22 bp, Artificial Sequence
  chemically synthesized
caaaataacaaaaacacccaag

SEQ ID NO: 1268543 - DNA, 22 bp, Artificial Sequence
  chemically synthesized
actaatcacattgcttgggtgt

SEQ ID NO: 1268544 - DNA, 22 bp, Artificial Sequence
  chemically synthesized
aactaatcacattgcttgggtg

SEQ ID NO: 1268545 - DNA, 22 bp, Artificial Sequence
  chemically synthesized
ataatgtcttaactaatcacat

SEQ ID NO: 1268546 - DNA, 22 bp, Artificial Sequence
  chemically synthesized
aataatgtcttaactaatcaca

SEQ ID NO: 1268547 - DNA, 22 bp, Artificial Sequence
  chemically synthesized
taataatgtcttaactaatcac

SEQ ID NO: 1268548 - DNA, 22 bp, Artificial Sequence
  chemically synthesized
gaaacacccacactttaataat

SEQ ID NO: 1268549 - DNA, 22 bp, Artificial Sequence
  chemically synthesized
tggaaacacccacactttaata

SEQ ID NO: 1268550 - DNA, 22 bp, Artificial Sequence
  chemically synthesized
gttaagacattattaaagtgtg

SEQ ID NO: 1268551 - DNA, 22 bp, Artificial Sequence
  chemically synthesized
agacattattaaagtgtgggtg

SEQ ID NO: 1268552 - DNA, 22 bp, Artificial Sequence
  chemically synthesized
ttaaagtgtgggtgtttccaga

SEQ ID NO: 1268553 - DNA, 22 bp, Artificial Sequence
  chemically synthesized
aagtgtgggtgtttccagagac

SEQ ID NO: 1268554 - DNA, 22 bp, Artificial Sequence
  chemically synthesized
taaaggggaaacgtctctggaa

SEQ ID NO: 1268555 - DNA, 22 bp, Artificial Sequence
  chemically synthesized
gtaaaggggaaacgtctctgga

SEQ ID NO: 1268556 - DNA, 22 bp, Artificial Sequence
  chemically synthesized
ccagagacgtttcccctttaca

SEQ ID NO: 1268557 - DNA, 22 bp, Artificial Sequence
  chemically synthesized
cagagacgtttcccctttacaa

SEQ ID NO: 1268558 - DNA, 22 bp, Artificial Sequence
  chemically synthesized
cccctttacaaaccatcctatt

SEQ ID NO: 1268559 - DNA, 22 bp, Artificial Sequence
  chemically synthesized
aaaaggtaagagaataggatgg

SEQ ID NO: 1268560 - DNA, 22 bp, Artificial Sequence
  chemically synthesized
ccctttacaaaccatcctattc

SEQ ID NO: 1268561 - DNA, 22 bp, Artificial Sequence
  chemically synthesized
tcaaaaggtaagagaataggat

SEQ ID NO: 1268562 - DNA, 22 bp, Artificial Sequence
  chemically synthesized
ctcaaaaggtaagagaatagga

SEQ ID NO: 1268563 - DNA, 22 bp, Artificial Sequence
  chemically synthesized
tacaaaccatcctattctctta

SEQ ID NO: 1268564 - DNA, 22 bp, Artificial Sequence
  chemically synthesized
acaaaccatcctattctcttac

SEQ ID NO: 1268565 - DNA, 22 bp, Artificial Sequence
  chemically synthesized
ccttctcaaaaggtaagagaat

SEQ ID NO: 1268566 - DNA, 22 bp, Artificial Sequence
  chemically synthesized
caaaccatcctattctcttacc

SEQ ID NO: 1268567 - DNA, 22 bp, Artificial Sequence
  chemically synthesized
ttctcttaccttttgagaaggg

SEQ ID NO: 1268568 - DNA, 22 bp, Artificial Sequence
  chemically synthesized
tcttaccttttgagaagggagt

SEQ ID NO: 1268569 - DNA, 22 bp, Artificial Sequence
  chemically synthesized
ttaccttttgagaagggagtgt

SEQ ID NO: 1268570 - DNA, 22 bp, Artificial Sequence
  chemically synthesized
accttttgagaagggagtgtgt

SEQ ID NO: 1268571 - DNA, 22 bp, Artificial Sequence
  chemically synthesized
ccttttgagaagggagtgtgtg

SEQ ID NO: 1268572 - DNA, 22 bp, Artificial Sequence
  chemically synthesized
ttgagaagggagtgtgtgcgtg

SEQ ID NO: 1268573 - DNA, 22 bp, Artificial Sequence
  chemically synthesized
tgtacacgtagacacgcacaca

SEQ ID NO: 1268574 - DNA, 22 bp, Artificial Sequence
  chemically synthesized
tgagaagggagtgtgtgcgtgt

SEQ ID NO: 1268575 - DNA, 22 bp, Artificial Sequence
  chemically synthesized
atgtacacgtagacacgcacac

SEQ ID NO: 1268576 - DNA, 22 bp, Artificial Sequence
  chemically synthesized
gagaagggagtgtgtgcgtgtc

SEQ ID NO: 1268577 - DNA, 22 bp, Artificial Sequence
  chemically synthesized
agaagggagtgtgtgcgtgtct

SEQ ID NO: 1268578 - DNA, 22 bp, Artificial Sequence
  chemically synthesized
ttatgtacacgtagacacgcac

SEQ ID NO: 1268579 - DNA, 22 bp, Artificial Sequence
  chemically synthesized
tcttatgtacacgtagacacgc

SEQ ID NO: 1268580 - DNA, 22 bp, Artificial Sequence
  chemically synthesized
tctctcttatgtacacgtagac

SEQ ID NO: 1268581 - DNA, 22 bp, Artificial Sequence
  chemically synthesized
tgtctctcttatgtacacgtag

SEQ ID NO: 1268582 - DNA, 22 bp, Artificial Sequence
  chemically synthesized
tctgtctctcttatgtacacgt

SEQ ID NO: 1268583 - DNA, 22 bp, Artificial Sequence
  chemically synthesized
ctctgtctctcttatgtacacg

SEQ ID NO: 1268584 - DNA, 22 bp, Artificial Sequence
  chemically synthesized
tctctgtctctcttatgtacac

SEQ ID NO: 1268585 - DNA, 22 bp, Artificial Sequence
  chemically synthesized
actttctctgtctctcttatgt

SEQ ID NO: 1268586 - DNA, 22 bp, Artificial Sequence
  chemically synthesized
cactttctctgtctctcttatg

SEQ ID NO: 1268587 - DNA, 22 bp, Artificial Sequence
  chemically synthesized
tcactttctctgtctctcttat

SEQ ID NO: 1268588 - DNA, 22 bp, Artificial Sequence
  chemically synthesized
tttcactttctctgtctctctt

SEQ ID NO: 1268589 - DNA, 22 bp, Artificial Sequence
  chemically synthesized
tctttcactttctctgtctctc

SEQ ID NO: 1268590 - DNA, 22 bp, Artificial Sequence
  chemically synthesized
cgtgtacataagagagacagag

SEQ ID NO: 1268591 - DNA, 22 bp, Artificial Sequence
  chemically synthesized
cctctctttcactttctctgtc

SEQ ID NO: 1268592 - DNA, 22 bp, Artificial Sequence
  chemically synthesized
ccaaatctccctctctttcact

SEQ ID NO: 1268593 - DNA, 22 bp, Artificial Sequence
  chemically synthesized
tctaccaaatctccctctcttt

SEQ ID NO: 1268594 - DNA, 22 bp, Artificial Sequence
  chemically synthesized
atctaccaaatctccctctctt

SEQ ID NO: 1268595 - DNA, 22 bp, Artificial Sequence
  chemically synthesized
tatctaccaaatctccctctct

SEQ ID NO: 1268596 - DNA, 22 bp, Artificial Sequence
  chemically synthesized
agtctttatctaccaaatctcc

SEQ ID NO: 1268597 - DNA, 22 bp, Artificial Sequence
  chemically synthesized
ttgagtctttatctaccaaatc

SEQ ID NO: 1268598 - DNA, 22 bp, Artificial Sequence
  chemically synthesized
agtctattgagtctttatctac

SEQ ID NO: 1268599 - DNA, 22 bp, Artificial Sequence
  chemically synthesized
ctaagtctattgagtctttatc

SEQ ID NO: 1268600 - DNA, 22 bp, Artificial Sequence
  chemically synthesized
ggtagataaagactcaatagac

SEQ ID NO: 1268601 - DNA, 22 bp, Artificial Sequence
  chemically synthesized
gtagataaagactcaatagact

SEQ ID NO: 1268602 - DNA, 22 bp, Artificial Sequence
  chemically synthesized
aaataacgacataggaaattcc

SEQ ID NO: 1268603 - DNA, 22 bp, Artificial Sequence
  chemically synthesized
aatagacttaggaatttcctat

SEQ ID NO: 1268604 - DNA, 22 bp, Artificial Sequence
  chemically synthesized
aaattcaaataacgacatagga

SEQ ID NO: 1268605 - DNA, 22 bp, Artificial Sequence
  chemically synthesized
tcaaattcaaataacgacatag

SEQ ID NO: 1268606 - DNA, 22 bp, Artificial Sequence
  chemically synthesized
aggaatttcctatgtcgttatt

SEQ ID NO: 1268607 - DNA, 22 bp, Artificial Sequence
  chemically synthesized
ggaatttcctatgtcgttattt

SEQ ID NO: 1268608 - DNA, 22 bp, Artificial Sequence
  chemically synthesized
agtaatctctcaaattcaaata

SEQ ID NO: 1268609 - DNA, 22 bp, Artificial Sequence
  chemically synthesized
cctatgtcgttatttgaatttg

SEQ ID NO: 1268610 - DNA, 22 bp, Artificial Sequence
  chemically synthesized
ctatgtcgttatttgaatttga

SEQ ID NO: 1268611 - DNA, 22 bp, Artificial Sequence
  chemically synthesized
cactcagtaatctctcaaattc

SEQ ID NO: 1268612 - DNA, 22 bp, Artificial Sequence
  chemically synthesized
tgtcgttatttgaatttgagag

SEQ ID NO: 1268613 - DNA, 22 bp, Artificial Sequence
  chemically synthesized
acactcagtaatctctcaaatt

SEQ ID NO: 1268614 - DNA, 22 bp, Artificial Sequence
  chemically synthesized
ttacactcagtaatctctcaaa

SEQ ID NO: 1268615 - DNA, 22 bp, Artificial Sequence
  chemically synthesized
cttacactcagtaatctctcaa

SEQ ID NO: 1268616 - DNA, 22 bp, Artificial Sequence
  chemically synthesized
tcttacactcagtaatctctca

SEQ ID NO: 1268617 - DNA, 22 bp, Artificial Sequence
  chemically synthesized
ttcttacactcagtaatctctc

SEQ ID NO: 1268618 - DNA, 22 bp, Artificial Sequence
  chemically synthesized
tttgaatttgagagattactga

SEQ ID NO: 1268619 - DNA, 22 bp, Artificial Sequence
  chemically synthesized
tcttttcttacactcagtaatc

SEQ ID NO: 1268620 - DNA, 22 bp, Artificial Sequence
  chemically synthesized
gaatttgagagattactgagtg

SEQ ID NO: 1268621 - DNA, 22 bp, Artificial Sequence
  chemically synthesized
aatttgagagattactgagtgt

SEQ ID NO: 1268622 - DNA, 22 bp, Artificial Sequence
  chemically synthesized
gagagattactgagtgtaagaa

SEQ ID NO: 1268623 - DNA, 22 bp, Artificial Sequence
  chemically synthesized
agagattactgagtgtaagaaa

SEQ ID NO: 1268624 - DNA, 22 bp, Artificial Sequence
  chemically synthesized
cagccaaaatggattatctttt

SEQ ID NO: 1268625 - DNA, 22 bp, Artificial Sequence
  chemically synthesized
ctgagtgtaagaaaagataatc

SEQ ID NO: 1268626 - DNA, 22 bp, Artificial Sequence
  chemically synthesized
ctccagccaaaatggattatct

SEQ ID NO: 1268627 - DNA, 22 bp, Artificial Sequence
  chemically synthesized
agtgtaagaaaagataatccat

SEQ ID NO: 1268628 - DNA, 22 bp, Artificial Sequence
  chemically synthesized
caggcatgagccactgctccag

SEQ ID NO: 1268629 - DNA, 22 bp, Artificial Sequence
  chemically synthesized
ggattacaggcatgagccactg

SEQ ID NO: 1268630 - DNA, 22 bp, Artificial Sequence
  chemically synthesized
tggctggagcagtggctcatgc

SEQ ID NO: 1268631 - DNA, 22 bp, Artificial Sequence
  chemically synthesized
ctgggattacaggcatgagcca

SEQ ID NO: 1268632 - DNA, 22 bp, Artificial Sequence
  chemically synthesized
ggctggagcagtggctcatgcc

SEQ ID NO: 1268633 - DNA, 22 bp, Artificial Sequence
  chemically synthesized
gctggagcagtggctcatgcct

SEQ ID NO: 1268634 - DNA, 22 bp, Artificial Sequence
  chemically synthesized
gagcagtggctcatgcctgtaa

SEQ ID NO: 1268635 - DNA, 22 bp, Artificial Sequence
  chemically synthesized
ccaaattgctgggattacaggc

SEQ ID NO: 1268636 - DNA, 22 bp, Artificial Sequence
  chemically synthesized
ggcctcccaaattgctgggatt

SEQ ID NO: 1268637 - DNA, 22 bp, Artificial Sequence
  chemically synthesized
atgcctgtaatcccagcaattt

SEQ ID NO: 1268638 - DNA, 22 bp, Artificial Sequence
  chemically synthesized
taatcccagcaatttgggaggc

SEQ ID NO: 1268639 - DNA, 22 bp, Artificial Sequence
  chemically synthesized
aggtgatccacccgcctcggcc

SEQ ID NO: 1268640 - DNA, 22 bp, Artificial Sequence
  chemically synthesized
acctcaggtgatccacccgcct

SEQ ID NO: 1268641 - DNA, 22 bp, Artificial Sequence
  chemically synthesized
gggaggccgaggcgggtggatc

SEQ ID NO: 1268642 - DNA, 22 bp, Artificial Sequence
  chemically synthesized
ctgacctcaggtgatccacccg

SEQ ID NO: 1268643 - DNA, 22 bp, Artificial Sequence
  chemically synthesized
ggaggccgaggcgggtggatca

SEQ ID NO: 1268644 - DNA, 22 bp, Artificial Sequence
  chemically synthesized
aaactcctgacctcaggtgatc

SEQ ID NO: 1268645 - DNA, 22 bp, Artificial Sequence
  chemically synthesized
gtctcaaactcctgacctcagg

SEQ ID NO: 1268646 - DNA, 22 bp, Artificial Sequence
  chemically synthesized
gccaggctggtctcaaactcct

SEQ ID NO: 1268647 - DNA, 22 bp, Artificial Sequence
  chemically synthesized
aggtcaggagtttgagaccagc

SEQ ID NO: 1268648 - DNA, 22 bp, Artificial Sequence
  chemically synthesized
accatgttggccaggctggtct

SEQ ID NO: 1268649 - DNA, 22 bp, Artificial Sequence
  chemically synthesized
caccatgttggccaggctggtc

SEQ ID NO: 1268650 - DNA, 22 bp, Artificial Sequence
  chemically synthesized
gagaccagcctggccaacatgg

SEQ ID NO: 1268651 - DNA, 22 bp, Artificial Sequence
  chemically synthesized
agaccagcctggccaacatggt

SEQ ID NO: 1268652 - DNA, 22 bp, Artificial Sequence
  chemically synthesized
gtagagatggggtttcaccatg

SEQ ID NO: 1268653 - DNA, 22 bp, Artificial Sequence
  chemically synthesized
agtagagatggggtttcaccat

SEQ ID NO: 1268654 - DNA, 22 bp, Artificial Sequence
  chemically synthesized
tagtagagatggggtttcacca

SEQ ID NO: 1268655 - DNA, 22 bp, Artificial Sequence
  chemically synthesized
ttagtagagatggggtttcacc

SEQ ID NO: 1268656 - DNA, 22 bp, Artificial Sequence
  chemically synthesized
gccaacatggtgaaaccccatc

SEQ ID NO: 1268657 - DNA, 22 bp, Artificial Sequence
  chemically synthesized
tatttttagtagagatggggtt

SEQ ID NO: 1268658 - DNA, 22 bp, Artificial Sequence
  chemically synthesized
gtatttttagtagagatggggt

SEQ ID NO: 1268659 - DNA, 22 bp, Artificial Sequence
  chemically synthesized
tgtatttttagtagagatgggg

SEQ ID NO: 1268660 - DNA, 22 bp, Artificial Sequence
  chemically synthesized
ttgtatttttagtagagatggg

SEQ ID NO: 1268661 - DNA, 22 bp, Artificial Sequence
  chemically synthesized
atttttgtatttttagtagaga

SEQ ID NO: 1268662 - DNA, 22 bp, Artificial Sequence
  chemically synthesized
gctaatttttgtatttttagta

SEQ ID NO: 1268663 - DNA, 22 bp, Artificial Sequence
  chemically synthesized
tactaaaaatacaaaaattagc

SEQ ID NO: 1268664 - DNA, 22 bp, Artificial Sequence
  chemically synthesized
ctaaaaatacaaaaattagcca

SEQ ID NO: 1268665 - DNA, 22 bp, Artificial Sequence
  chemically synthesized
aaaatacaaaaattagccaggt

SEQ ID NO: 1268666 - DNA, 22 bp, Artificial Sequence
  chemically synthesized
taggcacacaccgccacacctg

SEQ ID NO: 1268667 - DNA, 22 bp, Artificial Sequence
  chemically synthesized
ggattataggcacacaccgcca

SEQ ID NO: 1268668 - DNA, 22 bp, Artificial Sequence
  chemically synthesized
gccaggtgtggcggtgtgtgcc

SEQ ID NO: 1268669 - DNA, 22 bp, Artificial Sequence
  chemically synthesized
gctgggattataggcacacacc

SEQ ID NO: 1268670 - DNA, 22 bp, Artificial Sequence
  chemically synthesized
ccaactagctgggattataggc

SEQ ID NO: 1268671 - DNA, 22 bp, Artificial Sequence
  chemically synthesized
agcctcccaactagctgggatt

SEQ ID NO: 1268672 - DNA, 22 bp, Artificial Sequence
  chemically synthesized
cctcagcctcccaactagctgg

SEQ ID NO: 1268673 - DNA, 22 bp, Artificial Sequence
  chemically synthesized
tgcctcagcctcccaactagct

SEQ ID NO: 1268674 - DNA, 22 bp, Artificial Sequence
  chemically synthesized
ctgcctcagcctcccaactagc

SEQ ID NO: 1268675 - DNA, 22 bp, Artificial Sequence
  chemically synthesized
ttctgcctcagcctcccaacta

SEQ ID NO: 1268676 - DNA, 22 bp, Artificial Sequence
  chemically synthesized
taatcccagctagttgggaggc

SEQ ID NO: 1268677 - DNA, 22 bp, Artificial Sequence
  chemically synthesized
aagcgattcttctgcctcagcc

SEQ ID NO: 1268678 - DNA, 22 bp, Artificial Sequence
  chemically synthesized
gttgggaggctgaggcagaaga

SEQ ID NO: 1268679 - DNA, 22 bp, Artificial Sequence
  chemically synthesized
gattgaagcgattcttctgcct

SEQ ID NO: 1268680 - DNA, 22 bp, Artificial Sequence
  chemically synthesized
ctggattgaagcgattcttctg

SEQ ID NO: 1268681 - DNA, 22 bp, Artificial Sequence
  chemically synthesized
ggaggctgaggcagaagaatcg

SEQ ID NO: 1268682 - DNA, 22 bp, Artificial Sequence
  chemically synthesized
cctcctggattgaagcgattct

SEQ ID NO: 1268683 - DNA, 22 bp, Artificial Sequence
  chemically synthesized
tgcctcctggattgaagcgatt

SEQ ID NO: 1268684 - DNA, 22 bp, Artificial Sequence
  chemically synthesized
aggcagaagaatcgcttcaatc

SEQ ID NO: 1268685 - DNA, 22 bp, Artificial Sequence
  chemically synthesized
cagcctctgcctcctggattga

SEQ ID NO: 1268686 - DNA, 22 bp, Artificial Sequence
  chemically synthesized
actgcagcctctgcctcctgga

SEQ ID NO: 1268687 - DNA, 22 bp, Artificial Sequence
  chemically synthesized
ggctcactgcagcctctgcctc

SEQ ID NO: 1268688 - DNA, 22 bp, Artificial Sequence
  chemically synthesized
caatccaggaggcagaggctgc

SEQ ID NO: 1268689 - DNA, 22 bp, Artificial Sequence
  chemically synthesized
aatccaggaggcagaggctgca

SEQ ID NO: 1268690 - DNA, 22 bp, Artificial Sequence
  chemically synthesized
gagtgcagtggtgccatctcgg

SEQ ID NO: 1268691 - DNA, 22 bp, Artificial Sequence
  chemically synthesized
cagtgagccgagatggcaccac

SEQ ID NO: 1268692 - DNA, 22 bp, Artificial Sequence
  chemically synthesized
tcacccaggctggagtgcagtg

SEQ ID NO: 1268693 - DNA, 22 bp, Artificial Sequence
  chemically synthesized
tgtcacccaggctggagtgcag

SEQ ID NO: 1268694 - DNA, 22 bp, Artificial Sequence
  chemically synthesized
actctgtcacccaggctggagt

SEQ ID NO: 1268695 - DNA, 22 bp, Artificial Sequence
  chemically synthesized
cactccagcctgggtgacagag

SEQ ID NO: 1268696 - DNA, 22 bp, Artificial Sequence
  chemically synthesized
agacagagtctcactctgtcac

SEQ ID NO: 1268697 - DNA, 22 bp, Artificial Sequence
  chemically synthesized
gagacagagtctcactctgtca

SEQ ID NO: 1268698 - DNA, 22 bp, Artificial Sequence
  chemically synthesized
tgagacagagtctcactctgtc

SEQ ID NO: 1268699 - DNA, 22 bp, Artificial Sequence
  chemically synthesized
ttgagacagagtctcactctgt

SEQ ID NO: 1268700 - DNA, 22 bp, Artificial Sequence
  chemically synthesized
cagcctgggtgacagagtgaga

SEQ ID NO: 1268701 - DNA, 22 bp, Artificial Sequence
  chemically synthesized
tttgagacagagtctcactctg

SEQ ID NO: 1268702 - DNA, 22 bp, Artificial Sequence
  chemically synthesized
ttttttgagacagagtctcact

SEQ ID NO: 1268703 - DNA, 22 bp, Artificial Sequence
  chemically synthesized
gttttttgagacagagtctcac

SEQ ID NO: 1268704 - DNA, 22 bp, Artificial Sequence
  chemically synthesized
tgttttttgagacagagtctca

SEQ ID NO: 1268705 - DNA, 22 bp, Artificial Sequence
  chemically synthesized
ttgttttttgagacagagtctc

SEQ ID NO: 1268706 - DNA, 22 bp, Artificial Sequence
  chemically synthesized
ggtgacagagtgagactctgtc

SEQ ID NO: 1268707 - DNA, 22 bp, Artificial Sequence
  chemically synthesized
tttgttttttgagacagagtct

SEQ ID NO: 1268708 - DNA, 22 bp, Artificial Sequence
  chemically synthesized
ttttgttttttgagacagagtc

SEQ ID NO: 1268709 - DNA, 22 bp, Artificial Sequence
  chemically synthesized
tttttgttttttgagacagagt

SEQ ID NO: 1268710 - DNA, 22 bp, Artificial Sequence
  chemically synthesized
tttttttgttttttgagacaga

SEQ ID NO: 1268711 - DNA, 22 bp, Artificial Sequence
  chemically synthesized
ctttttttgttttttgagacag

SEQ ID NO: 1268712 - DNA, 22 bp, Artificial Sequence
  chemically synthesized
tctttttttgttttttgagaca

SEQ ID NO: 1268713 - DNA, 22 bp, Artificial Sequence
  chemically synthesized
ttctttttttgttttttgagac

SEQ ID NO: 1268714 - DNA, 22 bp, Artificial Sequence
  chemically synthesized
tttctttttttgttttttgaga

SEQ ID NO: 1268715 - DNA, 22 bp, Artificial Sequence
  chemically synthesized
ttttctttttttgttttttgag

SEQ ID NO: 1268716 - DNA, 22 bp, Artificial Sequence
  chemically synthesized
tttttctttttttgttttttga

SEQ ID NO: 1268717 - DNA, 22 bp, Artificial Sequence
  chemically synthesized
ttttttctttttttgttttttg

SEQ ID NO: 1268718 - DNA, 22 bp, Artificial Sequence
  chemically synthesized
tttttttctttttttgtttttt

SEQ ID NO: 1268719 - DNA, 22 bp, Artificial Sequence
  chemically synthesized
tttttttttctttttttgtttt

SEQ ID NO: 1268720 - DNA, 22 bp, Artificial Sequence
  chemically synthesized
tctttttttttctttttttgtt

SEQ ID NO: 1268721 - DNA, 22 bp, Artificial Sequence
  chemically synthesized
tgtctcaaaaaacaaaaaaaga

SEQ ID NO: 1268722 - DNA, 22 bp, Artificial Sequence
  chemically synthesized
tctcaaaaaacaaaaaaagaaa

SEQ ID NO: 1268723 - DNA, 22 bp, Artificial Sequence
  chemically synthesized
aaaaaacaaaaaaagaaaaaaa

SEQ ID NO: 1268724 - DNA, 22 bp, Artificial Sequence
  chemically synthesized
aaatggattctctttttttttc

SEQ ID NO: 1268725 - DNA, 22 bp, Artificial Sequence
  chemically synthesized
aagttaaaatggattctctttt

SEQ ID NO: 1268726 - DNA, 22 bp, Artificial Sequence
  chemically synthesized
aagattcaagttaaaatggatt

SEQ ID NO: 1268727 - DNA, 22 bp, Artificial Sequence
  chemically synthesized
caagattcaagttaaaatggat

SEQ ID NO: 1268728 - DNA, 22 bp, Artificial Sequence
  chemically synthesized
cagaaaatttcaagattcaagt

SEQ ID NO: 1268729 - DNA, 22 bp, Artificial Sequence
  chemically synthesized
acagaaaatttcaagattcaag

SEQ ID NO: 1268730 - DNA, 22 bp, Artificial Sequence
  chemically synthesized
tacagaaaatttcaagattcaa

SEQ ID NO: 1268731 - DNA, 22 bp, Artificial Sequence
  chemically synthesized
ctttacagaaaatttcaagatt

SEQ ID NO: 1268732 - DNA, 22 bp, Artificial Sequence
  chemically synthesized
ctactttacagaaaatttcaag

SEQ ID NO: 1268733 - DNA, 22 bp, Artificial Sequence
  chemically synthesized
taacttgaatcttgaaattttc

SEQ ID NO: 1268734 - DNA, 22 bp, Artificial Sequence
  chemically synthesized
tgctactttacagaaaatttca

SEQ ID NO: 1268735 - DNA, 22 bp, Artificial Sequence
  chemically synthesized
aacttgaatcttgaaattttct

SEQ ID NO: 1268736 - DNA, 22 bp, Artificial Sequence
  chemically synthesized
acttgaatcttgaaattttctg

SEQ ID NO: 1268737 - DNA, 22 bp, Artificial Sequence
  chemically synthesized
cctctgctactttacagaaaat

SEQ ID NO: 1268738 - DNA, 22 bp, Artificial Sequence
  chemically synthesized
acctctgctactttacagaaaa

SEQ ID NO: 1268739 - DNA, 22 bp, Artificial Sequence
  chemically synthesized
gaatcttgaaattttctgtaaa

SEQ ID NO: 1268740 - DNA, 22 bp, Artificial Sequence
  chemically synthesized
aatcttgaaattttctgtaaag

SEQ ID NO: 1268741 - DNA, 22 bp, Artificial Sequence
  chemically synthesized
gaaattttctgtaaagtagcag

SEQ ID NO: 1268742 - DNA, 22 bp, Artificial Sequence
  chemically synthesized
aaattttctgtaaagtagcaga

SEQ ID NO: 1268743 - DNA, 22 bp, Artificial Sequence
  chemically synthesized
catggcaatttacctctgctac

SEQ ID NO: 1268744 - DNA, 22 bp, Artificial Sequence
  chemically synthesized
ccatggcaatttacctctgcta

SEQ ID NO: 1268745 - DNA, 22 bp, Artificial Sequence
  chemically synthesized
tctgtaaagtagcagaggtaaa

SEQ ID NO: 1268746 - DNA, 22 bp, Artificial Sequence
  chemically synthesized
ctgtaaagtagcagaggtaaat

SEQ ID NO: 1268747 - DNA, 22 bp, Artificial Sequence
  chemically synthesized
tgtaaagtagcagaggtaaatt

SEQ ID NO: 1268748 - DNA, 22 bp, Artificial Sequence
  chemically synthesized
tgatttccatggcaatttacct

SEQ ID NO: 1268749 - DNA, 22 bp, Artificial Sequence
  chemically synthesized
taaagtagcagaggtaaattgc

SEQ ID NO: 1268750 - DNA, 22 bp, Artificial Sequence
  chemically synthesized
ctatgatttccatggcaattta

SEQ ID NO: 1268751 - DNA, 22 bp, Artificial Sequence
  chemically synthesized
cctatgatttccatggcaattt

SEQ ID NO: 1268752 - DNA, 22 bp, Artificial Sequence
  chemically synthesized
tcctatgatttccatggcaatt

SEQ ID NO: 1268753 - DNA, 22 bp, Artificial Sequence
  chemically synthesized
ctttcctatgatttccatggca

SEQ ID NO: 1268754 - DNA, 22 bp, Artificial Sequence
  chemically synthesized
cctttcctatgatttccatggc

SEQ ID NO: 1268755 - DNA, 22 bp, Artificial Sequence
  chemically synthesized
tatttcctttcctatgatttcc

SEQ ID NO: 1268756 - DNA, 22 bp, Artificial Sequence
  chemically synthesized
atatttcctttcctatgatttc

SEQ ID NO: 1268757 - DNA, 22 bp, Artificial Sequence
  chemically synthesized
ggcttatatttcctttcctatg

SEQ ID NO: 1268758 - DNA, 22 bp, Artificial Sequence
  chemically synthesized
ccatggaaatcataggaaagga

SEQ ID NO: 1268759 - DNA, 22 bp, Artificial Sequence
  chemically synthesized
ccgtgttgggcttatatttcct

SEQ ID NO: 1268760 - DNA, 22 bp, Artificial Sequence
  chemically synthesized
ttaccgtgttgggcttatattt

SEQ ID NO: 1268761 - DNA, 22 bp, Artificial Sequence
  chemically synthesized
cagagtctattaccgtgttggg

SEQ ID NO: 1268762 - DNA, 22 bp, Artificial Sequence
  chemically synthesized
attgcagagtctattaccgtgt

SEQ ID NO: 1268763 - DNA, 22 bp, Artificial Sequence
  chemically synthesized
cattgcagagtctattaccgtg

SEQ ID NO: 1268764 - DNA, 22 bp, Artificial Sequence
  chemically synthesized
tagcaccataaatatatttcat

SEQ ID NO: 1268765 - DNA, 22 bp, Artificial Sequence
  chemically synthesized
ttatagcaccataaatatattt

SEQ ID NO: 1268766 - DNA, 22 bp, Artificial Sequence
  chemically synthesized
ttattatagcaccataaatata

SEQ ID NO: 1268767 - DNA, 22 bp, Artificial Sequence
  chemically synthesized
tgcaatgaaatatatttatggt

SEQ ID NO: 1268768 - DNA, 22 bp, Artificial Sequence
  chemically synthesized
caatgaaatatatttatggtgc

SEQ ID NO: 1268769 - DNA, 22 bp, Artificial Sequence
  chemically synthesized
atggtgctataataatagtgta

SEQ ID NO: 1268770 - DNA, 22 bp, Artificial Sequence
  chemically synthesized
tggtgctataataatagtgtac

SEQ ID NO: 1268771 - DNA, 22 bp, Artificial Sequence
  chemically synthesized
aaaacatataaacagtatgtac

SEQ ID NO: 1268772 - DNA, 22 bp, Artificial Sequence
  chemically synthesized
taataatagtgtacatactgtt

SEQ ID NO: 1268773 - DNA, 22 bp, Artificial Sequence
  chemically synthesized
aaaattgaaaacatataaacag

SEQ ID NO: 1268774 - DNA, 22 bp, Artificial Sequence
  chemically synthesized
taaaaattgaaaacatataaac

SEQ ID NO: 1268775 - DNA, 22 bp, Artificial Sequence
  chemically synthesized
ttctaaaaattgaaaacatata

SEQ ID NO: 1268776 - DNA, 22 bp, Artificial Sequence
  chemically synthesized
attctaaaaattgaaaacatat

SEQ ID NO: 1268777 - DNA, 22 bp, Artificial Sequence
  chemically synthesized
tttatatgttttcaatttttag

SEQ ID NO: 1268778 - DNA, 22 bp, Artificial Sequence
  chemically synthesized
tcaaagatttattctaaaaatt

SEQ ID NO: 1268779 - DNA, 22 bp, Artificial Sequence
  chemically synthesized
gtcaaagatttattctaaaaat

SEQ ID NO: 1268780 - DNA, 22 bp, Artificial Sequence
  chemically synthesized
atatgttttcaatttttagaat

SEQ ID NO: 1268781 - DNA, 22 bp, Artificial Sequence
  chemically synthesized
tgtcaaagatttattctaaaaa

SEQ ID NO: 1268782 - DNA, 22 bp, Artificial Sequence
  chemically synthesized
tatgttttcaatttttagaata

SEQ ID NO: 1268783 - DNA, 22 bp, Artificial Sequence
  chemically synthesized
gtgttttgtcaaagatttattc

SEQ ID NO: 1268784 - DNA, 22 bp, Artificial Sequence
  chemically synthesized
tcaatttttagaataaatcttt

SEQ ID NO: 1268785 - DNA, 22 bp, Artificial Sequence
  chemically synthesized
caatttttagaataaatctttg

SEQ ID NO: 1268786 - DNA, 22 bp, Artificial Sequence
  chemically synthesized
aatttttagaataaatctttga

SEQ ID NO: 1268787 - DNA, 22 bp, Artificial Sequence
  chemically synthesized
ggtctcgtgttttgtcaaagat

SEQ ID NO: 1268788 - DNA, 22 bp, Artificial Sequence
  chemically synthesized
ttagaataaatctttgacaaaa

SEQ ID NO: 1268789 - DNA, 22 bp, Artificial Sequence
  chemically synthesized
tagaataaatctttgacaaaac

SEQ ID NO: 1268790 - DNA, 22 bp, Artificial Sequence
  chemically synthesized
agaataaatctttgacaaaaca

SEQ ID NO: 1268791 - DNA, 22 bp, Artificial Sequence
  chemically synthesized
gaataaatctttgacaaaacac

SEQ ID NO: 1268792 - DNA, 22 bp, Artificial Sequence
  chemically synthesized
tgattaggtctcgtgttttgtc

SEQ ID NO: 1268793 - DNA, 22 bp, Artificial Sequence
  chemically synthesized
actatgattaggtctcgtgttt

SEQ ID NO: 1268794 - DNA, 22 bp, Artificial Sequence
  chemically synthesized
taactatgattaggtctcgtgt

SEQ ID NO: 1268795 - DNA, 22 bp, Artificial Sequence
  chemically synthesized
tctaactatgattaggtctcgt

SEQ ID NO: 1268796 - DNA, 22 bp, Artificial Sequence
  chemically synthesized
tgacaaaacacgagacctaatc

SEQ ID NO: 1268797 - DNA, 22 bp, Artificial Sequence
  chemically synthesized
gacaaaacacgagacctaatca

SEQ ID NO: 1268798 - DNA, 22 bp, Artificial Sequence
  chemically synthesized
acaaaacacgagacctaatcat

SEQ ID NO: 1268799 - DNA, 22 bp, Artificial Sequence
  chemically synthesized
tgttctctaactatgattaggt

SEQ ID NO: 1268800 - DNA, 22 bp, Artificial Sequence
  chemically synthesized
tgtgttctctaactatgattag

SEQ ID NO: 1268801 - DNA, 22 bp, Artificial Sequence
  chemically synthesized
ctgtgttctctaactatgatta

SEQ ID NO: 1268802 - DNA, 22 bp, Artificial Sequence
  chemically synthesized
cttctgtgttctctaactatga

SEQ ID NO: 1268803 - DNA, 22 bp, Artificial Sequence
  chemically synthesized
cattccttctgtgttctctaac

SEQ ID NO: 1268804 - DNA, 22 bp, Artificial Sequence
  chemically synthesized
agttgcattccttctgtgttct

SEQ ID NO: 1268805 - DNA, 22 bp, Artificial Sequence
  chemically synthesized
atcatagttagagaacacagaa

SEQ ID NO: 1268806 - DNA, 22 bp, Artificial Sequence
  chemically synthesized
tgttgagttgcattccttctgt

SEQ ID NO: 1268807 - DNA, 22 bp, Artificial Sequence
  chemically synthesized
atgttgagttgcattccttctg

SEQ ID NO: 1268808 - DNA, 22 bp, Artificial Sequence
  chemically synthesized
tatgttgagttgcattccttct

SEQ ID NO: 1268809 - DNA, 22 bp, Artificial Sequence
  chemically synthesized
gagaacacagaaggaatgcaac

SEQ ID NO: 1268810 - DNA, 22 bp, Artificial Sequence
  chemically synthesized
attttatgttgagttgcattcc

SEQ ID NO: 1268811 - DNA, 22 bp, Artificial Sequence
  chemically synthesized
aattttatgttgagttgcattc

SEQ ID NO: 1268812 - DNA, 22 bp, Artificial Sequence
  chemically synthesized
taattttatgttgagttgcatt

SEQ ID NO: 1268813 - DNA, 22 bp, Artificial Sequence
  chemically synthesized
ttaattttatgttgagttgcat

SEQ ID NO: 1268814 - DNA, 22 bp, Artificial Sequence
  chemically synthesized
cttttaattttatgttgagttg

SEQ ID NO: 1268815 - DNA, 22 bp, Artificial Sequence
  chemically synthesized
taaagtctacttttaattttat

SEQ ID NO: 1268816 - DNA, 22 bp, Artificial Sequence
  chemically synthesized
tgtaaagtctacttttaatttt

SEQ ID NO: 1268817 - DNA, 22 bp, Artificial Sequence
  chemically synthesized
aacataaaattaaaagtagact

SEQ ID NO: 1268818 - DNA, 22 bp, Artificial Sequence
  chemically synthesized
ccaaattctgtaaagtctactt

SEQ ID NO: 1268819 - DNA, 22 bp, Artificial Sequence
  chemically synthesized
tcccaaattctgtaaagtctac

SEQ ID NO: 1268820 - DNA, 22 bp, Artificial Sequence
  chemically synthesized
ctcccaaattctgtaaagtcta

SEQ ID NO: 1268821 - DNA, 22 bp, Artificial Sequence
  chemically synthesized
ttctcccaaattctgtaaagtc

SEQ ID NO: 1268822 - DNA, 22 bp, Artificial Sequence
  chemically synthesized
cttctcccaaattctgtaaagt

SEQ ID NO: 1268823 - DNA, 22 bp, Artificial Sequence
  chemically synthesized
aaagtagactttacagaatttg

SEQ ID NO: 1268824 - DNA, 22 bp, Artificial Sequence
  chemically synthesized
aatttcttctcccaaattctgt

SEQ ID NO: 1268825 - DNA, 22 bp, Artificial Sequence
  chemically synthesized
ctgaatttcttctcccaaattc

SEQ ID NO: 1268826 - DNA, 22 bp, Artificial Sequence
  chemically synthesized
ctactgaatttcttctcccaaa

SEQ ID NO: 1268827 - DNA, 22 bp, Artificial Sequence
  chemically synthesized
tcctactgaatttcttctccca

SEQ ID NO: 1268828 - DNA, 22 bp, Artificial Sequence
  chemically synthesized
ctcctactgaatttcttctccc

SEQ ID NO: 1268829 - DNA, 22 bp, Artificial Sequence
  chemically synthesized
tacagaatttgggagaagaaat

SEQ ID NO: 1268830 - DNA, 22 bp, Artificial Sequence
  chemically synthesized
acagaatttgggagaagaaatt

SEQ ID NO: 1268831 - DNA, 22 bp, Artificial Sequence
  chemically synthesized
cagaatttgggagaagaaattc

SEQ ID NO: 1268832 - DNA, 22 bp, Artificial Sequence
  chemically synthesized
acttctcctactgaatttcttc

SEQ ID NO: 1268833 - DNA, 22 bp, Artificial Sequence
  chemically synthesized
cacttctcctactgaatttctt

SEQ ID NO: 1268834 - DNA, 22 bp, Artificial Sequence
  chemically synthesized
ttcacttctcctactgaatttc

SEQ ID NO: 1268835 - DNA, 22 bp, Artificial Sequence
  chemically synthesized
cttcacttctcctactgaattt

SEQ ID NO: 1268836 - DNA, 22 bp, Artificial Sequence
  chemically synthesized
gggagaagaaattcagtaggag

SEQ ID NO: 1268837 - DNA, 22 bp, Artificial Sequence
  chemically synthesized
ggagaagaaattcagtaggaga

SEQ ID NO: 1268838 - DNA, 22 bp, Artificial Sequence
  chemically synthesized
catgtttcttcacttctcctac

SEQ ID NO: 1268839 - DNA, 22 bp, Artificial Sequence
  chemically synthesized
gtggtcctccatgtttcttcac

SEQ ID NO: 1268840 - DNA, 22 bp, Artificial Sequence
  chemically synthesized
agtggtcctccatgtttcttca

SEQ ID NO: 1268841 - DNA, 22 bp, Artificial Sequence
  chemically synthesized
agtaggagaagtgaagaaacat

SEQ ID NO: 1268842 - DNA, 22 bp, Artificial Sequence
  chemically synthesized
tagtggtcctccatgtttcttc

SEQ ID NO: 1268843 - DNA, 22 bp, Artificial Sequence
  chemically synthesized
acatgataaaatggggatttta

SEQ ID NO: 1268844 - DNA, 22 bp, Artificial Sequence
  chemically synthesized
cacatgataaaatggggatttt

SEQ ID NO: 1268845 - DNA, 22 bp, Artificial Sequence
  chemically synthesized
acccttcacatgataaaatggg

SEQ ID NO: 1268846 - DNA, 22 bp, Artificial Sequence
  chemically synthesized
aacccttcacatgataaaatgg

SEQ ID NO: 1268847 - DNA, 22 bp, Artificial Sequence
  chemically synthesized
aaatccccattttatcatgtga

SEQ ID NO: 1268848 - DNA, 22 bp, Artificial Sequence
  chemically synthesized
tatcatgtgaagggttaagaca

SEQ ID NO: 1268849 - DNA, 22 bp, Artificial Sequence
  chemically synthesized
atcatgtgaagggttaagacat

SEQ ID NO: 1268850 - DNA, 22 bp, Artificial Sequence
  chemically synthesized
tcatgtgaagggttaagacata

SEQ ID NO: 1268851 - DNA, 22 bp, Artificial Sequence
  chemically synthesized
aaaacagtgtcaaaagtatgtc

SEQ ID NO: 1268852 - DNA, 22 bp, Artificial Sequence
  chemically synthesized
caaaacagtgtcaaaagtatgt

SEQ ID NO: 1268853 - DNA, 22 bp, Artificial Sequence
  chemically synthesized
ttcaaaacagtgtcaaaagtat

SEQ ID NO: 1268854 - DNA, 22 bp, Artificial Sequence
  chemically synthesized
cttcaaaacagtgtcaaaagta

SEQ ID NO: 1268855 - DNA, 22 bp, Artificial Sequence
  chemically synthesized
tcttcaaaacagtgtcaaaagt

SEQ ID NO: 1268856 - DNA, 22 bp, Artificial Sequence
  chemically synthesized
ttcttcaaaacagtgtcaaaag

SEQ ID NO: 1268857 - DNA, 22 bp, Artificial Sequence
  chemically synthesized
tttcttcaaaacagtgtcaaaa

SEQ ID NO: 1268858 - DNA, 22 bp, Artificial Sequence
  chemically synthesized
ttttcttcaaaacagtgtcaaa

SEQ ID NO: 1268859 - DNA, 22 bp, Artificial Sequence
  chemically synthesized
agacatacttttgacactgttt

SEQ ID NO: 1268860 - DNA, 22 bp, Artificial Sequence
  chemically synthesized
atttttttcttcaaaacagtgt

SEQ ID NO: 1268861 - DNA, 22 bp, Artificial Sequence
  chemically synthesized
aatgttaatttttttcttcaaa

SEQ ID NO: 1268862 - DNA, 22 bp, Artificial Sequence
  chemically synthesized
aaatgttaatttttttcttcaa

SEQ ID NO: 1268863 - DNA, 22 bp, Artificial Sequence
  chemically synthesized
ttgacactgttttgaagaaaaa

SEQ ID NO: 1268864 - DNA, 22 bp, Artificial Sequence
  chemically synthesized
tgacactgttttgaagaaaaaa

SEQ ID NO: 1268865 - DNA, 22 bp, Artificial Sequence
  chemically synthesized
gacactgttttgaagaaaaaaa

SEQ ID NO: 1268866 - DNA, 22 bp, Artificial Sequence
  chemically synthesized
acactgttttgaagaaaaaaat

SEQ ID NO: 1268867 - DNA, 22 bp, Artificial Sequence
  chemically synthesized
ttttgaagaaaaaaattaacat

SEQ ID NO: 1268868 - DNA, 22 bp, Artificial Sequence
  chemically synthesized
catgaagaccttaaatgttaat

SEQ ID NO: 1268869 - DNA, 22 bp, Artificial Sequence
  chemically synthesized
tgaagaaaaaaattaacattta

SEQ ID NO: 1268870 - DNA, 22 bp, Artificial Sequence
  chemically synthesized
acatgaagaccttaaatgttaa

SEQ ID NO: 1268871 - DNA, 22 bp, Artificial Sequence
  chemically synthesized
gaagaaaaaaattaacatttaa

SEQ ID NO: 1268872 - DNA, 22 bp, Artificial Sequence
  chemically synthesized
tacatgaagaccttaaatgtta

SEQ ID NO: 1268873 - DNA, 22 bp, Artificial Sequence
  chemically synthesized
aagaaaaaaattaacatttaag

SEQ ID NO: 1268874 - DNA, 22 bp, Artificial Sequence
  chemically synthesized
ttacatgaagaccttaaatgtt

SEQ ID NO: 1268875 - DNA, 22 bp, Artificial Sequence
  chemically synthesized
ttttacatgaagaccttaaatg

SEQ ID NO: 1268876 - DNA, 22 bp, Artificial Sequence
  chemically synthesized
cttttacatgaagaccttaaat

SEQ ID NO: 1268877 - DNA, 22 bp, Artificial Sequence
  chemically synthesized
tcttttacatgaagaccttaaa

SEQ ID NO: 1268878 - DNA, 22 bp, Artificial Sequence
  chemically synthesized
ttcttttacatgaagaccttaa

SEQ ID NO: 1268879 - DNA, 22 bp, Artificial Sequence
  chemically synthesized
atttttcttttacatgaagacc

SEQ ID NO: 1268880 - DNA, 22 bp, Artificial Sequence
  chemically synthesized
acatttaaggtcttcatgtaaa

SEQ ID NO: 1268881 - DNA, 22 bp, Artificial Sequence
  chemically synthesized
actaatttttcttttacatgaa

SEQ ID NO: 1268882 - DNA, 22 bp, Artificial Sequence
  chemically synthesized
ttaactaatttttcttttacat

SEQ ID NO: 1268883 - DNA, 22 bp, Artificial Sequence
  chemically synthesized
tattaactaatttttcttttac

SEQ ID NO: 1268884 - DNA, 22 bp, Artificial Sequence
  chemically synthesized
aaggtcttcatgtaaaagaaaa

SEQ ID NO: 1268885 - DNA, 22 bp, Artificial Sequence
  chemically synthesized
aggtcttcatgtaaaagaaaaa

SEQ ID NO: 1268886 - DNA, 22 bp, Artificial Sequence
  chemically synthesized
ttctattaactaatttttcttt

SEQ ID NO: 1268887 - DNA, 22 bp, Artificial Sequence
  chemically synthesized
gttctattaactaatttttctt

SEQ ID NO: 1268888 - DNA, 22 bp, Artificial Sequence
  chemically synthesized
catgtaaaagaaaaattagtta

SEQ ID NO: 1268889 - DNA, 22 bp, Artificial Sequence
  chemically synthesized
atgtaaaagaaaaattagttaa

SEQ ID NO: 1268890 - DNA, 22 bp, Artificial Sequence
  chemically synthesized
ccccatgtatttgttctattaa

SEQ ID NO: 1268891 - DNA, 22 bp, Artificial Sequence
  chemically synthesized
tatctaccccatgtatttgttc

SEQ ID NO: 1268892 - DNA, 22 bp, Artificial Sequence
  chemically synthesized
atatctaccccatgtatttgtt

SEQ ID NO: 1268893 - DNA, 22 bp, Artificial Sequence
  chemically synthesized
gttaatagaacaaatacatggg

SEQ ID NO: 1268894 - DNA, 22 bp, Artificial Sequence
  chemically synthesized
atttatatctaccccatgtatt

SEQ ID NO: 1268895 - DNA, 22 bp, Artificial Sequence
  chemically synthesized
atagaacaaatacatggggtag

SEQ ID NO: 1268896 - DNA, 22 bp, Artificial Sequence
  chemically synthesized
tctcatttatatctaccccatg

SEQ ID NO: 1268897 - DNA, 22 bp, Artificial Sequence
  chemically synthesized
tgagagatgaaaaattatctca

SEQ ID NO: 1268898 - DNA, 22 bp, Artificial Sequence
  chemically synthesized
atgagagatgaaaaattatctc

SEQ ID NO: 1268899 - DNA, 22 bp, Artificial Sequence
  chemically synthesized
ttatgagagatgaaaaattatc

SEQ ID NO: 1268900 - DNA, 22 bp, Artificial Sequence
  chemically synthesized
tcttatgagagatgaaaaatta

SEQ ID NO: 1268901 - DNA, 22 bp, Artificial Sequence
  chemically synthesized
cagtctctcttatgagagatga

SEQ ID NO: 1268902 - DNA, 22 bp, Artificial Sequence
  chemically synthesized
atggtctacagtctctcttatg

SEQ ID NO: 1268903 - DNA, 22 bp, Artificial Sequence
  chemically synthesized
catggtctacagtctctcttat

SEQ ID NO: 1268904 - DNA, 22 bp, Artificial Sequence
  chemically synthesized
tcatggtctacagtctctctta

SEQ ID NO: 1268905 - DNA, 22 bp, Artificial Sequence
  chemically synthesized
ttcatctctcataagagagact

SEQ ID NO: 1268906 - DNA, 22 bp, Artificial Sequence
  chemically synthesized
ttcatggtctacagtctctctt

SEQ ID NO: 1268907 - DNA, 22 bp, Artificial Sequence
  chemically synthesized
tcatctctcataagagagactg

SEQ ID NO: 1268908 - DNA, 22 bp, Artificial Sequence
  chemically synthesized
tttcatggtctacagtctctct

SEQ ID NO: 1268909 - DNA, 22 bp, Artificial Sequence
  chemically synthesized
catctctcataagagagactgt

SEQ ID NO: 1268910 - DNA, 22 bp, Artificial Sequence
  chemically synthesized
atctctcataagagagactgta

SEQ ID NO: 1268911 - DNA, 22 bp, Artificial Sequence
  chemically synthesized
attttttcatggtctacagtct

SEQ ID NO: 1268912 - DNA, 22 bp, Artificial Sequence
  chemically synthesized
tcattttttcatggtctacagt

SEQ ID NO: 1268913 - DNA, 22 bp, Artificial Sequence
  chemically synthesized
tcataagagagactgtagacca

SEQ ID NO: 1268914 - DNA, 22 bp, Artificial Sequence
  chemically synthesized
ctcattttttcatggtctacag

SEQ ID NO: 1268915 - DNA, 22 bp, Artificial Sequence
  chemically synthesized
tctcattttttcatggtctaca

SEQ ID NO: 1268916 - DNA, 22 bp, Artificial Sequence
  chemically synthesized
ataagagagactgtagaccatg

SEQ ID NO: 1268917 - DNA, 22 bp, Artificial Sequence
  chemically synthesized
attttctcattttttcatggtc

SEQ ID NO: 1268918 - DNA, 22 bp, Artificial Sequence
  chemically synthesized
gattttctcattttttcatggt

SEQ ID NO: 1268919 - DNA, 22 bp, Artificial Sequence
  chemically synthesized
ttgattttctcattttttcatg

SEQ ID NO: 1268920 - DNA, 22 bp, Artificial Sequence
  chemically synthesized
attcttgattttctcatttttt

SEQ ID NO: 1268921 - DNA, 22 bp, Artificial Sequence
  chemically synthesized
taattcttgattttctcatttt

SEQ ID NO: 1268922 - DNA, 22 bp, Artificial Sequence
  chemically synthesized
tagaccatgaaaaaatgagaaa

SEQ ID NO: 1268923 - DNA, 22 bp, Artificial Sequence
  chemically synthesized
tatctctaattcttgattttct

SEQ ID NO: 1268924 - DNA, 22 bp, Artificial Sequence
  chemically synthesized
atatctctaattcttgattttc

SEQ ID NO: 1268925 - DNA, 22 bp, Artificial Sequence
  chemically synthesized
taataacatgtttatatctcta

SEQ ID NO: 1268926 - DNA, 22 bp, Artificial Sequence
  chemically synthesized
gagatataaacatgttattaca

SEQ ID NO: 1268927 - DNA, 22 bp, Artificial Sequence
  chemically synthesized
atgcgtgacaaatctgtaataa

SEQ ID NO: 1268928 - DNA, 22 bp, Artificial Sequence
  chemically synthesized
taatgcgtgacaaatctgtaat

SEQ ID NO: 1268929 - DNA, 22 bp, Artificial Sequence
  chemically synthesized
ctaatgcgtgacaaatctgtaa

SEQ ID NO: 1268930 - DNA, 22 bp, Artificial Sequence
  chemically synthesized
tctaatgcgtgacaaatctgta

SEQ ID NO: 1268931 - DNA, 22 bp, Artificial Sequence
  chemically synthesized
ttctaatgcgtgacaaatctgt

SEQ ID NO: 1268932 - DNA, 22 bp, Artificial Sequence
  chemically synthesized
tttctaatgcgtgacaaatctg

SEQ ID NO: 1268933 - DNA, 22 bp, Artificial Sequence
  chemically synthesized
tttttctaatgcgtgacaaatc

SEQ ID NO: 1268934 - DNA, 22 bp, Artificial Sequence
  chemically synthesized
tctttttctaatgcgtgacaaa

SEQ ID NO: 1268935 - DNA, 22 bp, Artificial Sequence
  chemically synthesized
ttacagatttgtcacgcattag

SEQ ID NO: 1268936 - DNA, 22 bp, Artificial Sequence
  chemically synthesized
cagatttgtcacgcattagaaa

SEQ ID NO: 1268937 - DNA, 22 bp, Artificial Sequence
  chemically synthesized
agtcattctctttttctaatgc

SEQ ID NO: 1268938 - DNA, 22 bp, Artificial Sequence
  chemically synthesized
gagtcattctctttttctaatg

SEQ ID NO: 1268939 - DNA, 22 bp, Artificial Sequence
  chemically synthesized
gtcacgcattagaaaaagagaa

SEQ ID NO: 1268940 - DNA, 22 bp, Artificial Sequence
  chemically synthesized
tcacgcattagaaaaagagaat

SEQ ID NO: 1268941 - DNA, 22 bp, Artificial Sequence
  chemically synthesized
agaggcagatatttgagtcatt

SEQ ID NO: 1268942 - DNA, 22 bp, Artificial Sequence
  chemically synthesized
gaaaaagagaatgactcaaata

SEQ ID NO: 1268943 - DNA, 22 bp, Artificial Sequence
  chemically synthesized
ctcagaggcagatatttgagtc

SEQ ID NO: 1268944 - DNA, 22 bp, Artificial Sequence
  chemically synthesized
actcctcagaggcagatatttg

SEQ ID NO: 1268945 - DNA, 22 bp, Artificial Sequence
  chemically synthesized
tcactcctcagaggcagatatt

SEQ ID NO: 1268946 - DNA, 22 bp, Artificial Sequence
  chemically synthesized
ctcactcctcagaggcagatat

SEQ ID NO: 1268947 - DNA, 22 bp, Artificial Sequence
  chemically synthesized
atttctcactcctcagaggcag

SEQ ID NO: 1268948 - DNA, 22 bp, Artificial Sequence
  chemically synthesized
tcatttctcactcctcagaggc

SEQ ID NO: 1268949 - DNA, 22 bp, Artificial Sequence
  chemically synthesized
tctcatttctcactcctcagag

SEQ ID NO: 1268950 - DNA, 22 bp, Artificial Sequence
  chemically synthesized
aaatatctgcctctgaggagtg

SEQ ID NO: 1268951 - DNA, 22 bp, Artificial Sequence
  chemically synthesized
ctctctcatttctcactcctca

SEQ ID NO: 1268952 - DNA, 22 bp, Artificial Sequence
  chemically synthesized
cattcctctctcatttctcact

SEQ ID NO: 1268953 - DNA, 22 bp, Artificial Sequence
  chemically synthesized
cctctgaggagtgagaaatgag

SEQ ID NO: 1268954 - DNA, 22 bp, Artificial Sequence
  chemically synthesized
tgaggagtgagaaatgagagag

SEQ ID NO: 1268955 - DNA, 22 bp, Artificial Sequence
  chemically synthesized
aggagtgagaaatgagagagga

SEQ ID NO: 1268956 - DNA, 22 bp, Artificial Sequence
  chemically synthesized
aatatgctgcattcctctctca

SEQ ID NO: 1268957 - DNA, 22 bp, Artificial Sequence
  chemically synthesized
aaatatgctgcattcctctctc

SEQ ID NO: 1268958 - DNA, 22 bp, Artificial Sequence
  chemically synthesized
tttaaatatgctgcattcctct

SEQ ID NO: 1268959 - DNA, 22 bp, Artificial Sequence
  chemically synthesized
atttaaatatgctgcattcctc

SEQ ID NO: 1268960 - DNA, 22 bp, Artificial Sequence
  chemically synthesized
tatttaaatatgctgcattcct

SEQ ID NO: 1268961 - DNA, 22 bp, Artificial Sequence
  chemically synthesized
ttatttaaatatgctgcattcc

SEQ ID NO: 1268962 - DNA, 22 bp, Artificial Sequence
  chemically synthesized
ttttatttaaatatgctgcatt

SEQ ID NO: 1268963 - DNA, 22 bp, Artificial Sequence
  chemically synthesized
ataagttcttttatttaaatat

SEQ ID NO: 1268964 - DNA, 22 bp, Artificial Sequence
  chemically synthesized
cataagttcttttatttaaata

SEQ ID NO: 1268965 - DNA, 22 bp, Artificial Sequence
  chemically synthesized
cttcataagttcttttatttaa

SEQ ID NO: 1268966 - DNA, 22 bp, Artificial Sequence
  chemically synthesized
acttcataagttcttttattta

SEQ ID NO: 1268967 - DNA, 22 bp, Artificial Sequence
  chemically synthesized
tacttcataagttcttttattt

SEQ ID NO: 1268968 - DNA, 22 bp, Artificial Sequence
  chemically synthesized
ttacttcataagttcttttatt

SEQ ID NO: 1268969 - DNA, 22 bp, Artificial Sequence
  chemically synthesized
aagtaatttttacttcataagt

SEQ ID NO: 1268970 - DNA, 22 bp, Artificial Sequence
  chemically synthesized
aaataaaagaacttatgaagta

SEQ ID NO: 1268971 - DNA, 22 bp, Artificial Sequence
  chemically synthesized
aataaaagaacttatgaagtaa

SEQ ID NO: 1268972 - DNA, 22 bp, Artificial Sequence
  chemically synthesized
tacatgattcaagtaattttta

SEQ ID NO: 1268973 - DNA, 22 bp, Artificial Sequence
  chemically synthesized
tctgtacatgattcaagtaatt

SEQ ID NO: 1268974 - DNA, 22 bp, Artificial Sequence
  chemically synthesized
atgaagtaaaaattacttgaat

SEQ ID NO: 1268975 - DNA, 22 bp, Artificial Sequence
  chemically synthesized
tgaagtaaaaattacttgaatc

SEQ ID NO: 1268976 - DNA, 22 bp, Artificial Sequence
  chemically synthesized
atcaaattatctgtacatgatt

SEQ ID NO: 1268977 - DNA, 22 bp, Artificial Sequence
  chemically synthesized
aatcaaattatctgtacatgat

SEQ ID NO: 1268978 - DNA, 22 bp, Artificial Sequence
  chemically synthesized
taatcaaattatctgtacatga

SEQ ID NO: 1268979 - DNA, 22 bp, Artificial Sequence
  chemically synthesized
ttaatcaaattatctgtacatg

SEQ ID NO: 1268980 - DNA, 22 bp, Artificial Sequence
  chemically synthesized
cttgaatcatgtacagataatt

SEQ ID NO: 1268981 - DNA, 22 bp, Artificial Sequence
  chemically synthesized
aatttttaatcaaattatctgt

SEQ ID NO: 1268982 - DNA, 22 bp, Artificial Sequence
  chemically synthesized
caatttttaatcaaattatctg

SEQ ID NO: 1268983 - DNA, 22 bp, Artificial Sequence
  chemically synthesized
tcaatttttaatcaaattatct

SEQ ID NO: 1268984 - DNA, 22 bp, Artificial Sequence
  chemically synthesized
gaatcatgtacagataatttga

SEQ ID NO: 1268985 - DNA, 22 bp, Artificial Sequence
  chemically synthesized
aatcatgtacagataatttgat

SEQ ID NO: 1268986 - DNA, 22 bp, Artificial Sequence
  chemically synthesized
aatcaatgttttcaatttttaa

SEQ ID NO: 1268987 - DNA, 22 bp, Artificial Sequence
  chemically synthesized
gaatcaatgttttcaattttta

SEQ ID NO: 1268988 - DNA, 22 bp, Artificial Sequence
  chemically synthesized
tttgaatcaatgttttcaattt

SEQ ID NO: 1268989 - DNA, 22 bp, Artificial Sequence
  chemically synthesized
gtttgaatcaatgttttcaatt

SEQ ID NO: 1268990 - DNA, 22 bp, Artificial Sequence
  chemically synthesized
gattaaaaattgaaaacattga

SEQ ID NO: 1268991 - DNA, 22 bp, Artificial Sequence
  chemically synthesized
attaaaaattgaaaacattgat

SEQ ID NO: 1268992 - DNA, 22 bp, Artificial Sequence
  chemically synthesized
aaaattgaaaacattgattcaa

SEQ ID NO: 1268993 - DNA, 22 bp, Artificial Sequence
  chemically synthesized
atgaatataaatttgtttgaat

SEQ ID NO: 1268994 - DNA, 22 bp, Artificial Sequence
  chemically synthesized
aaaacattgattcaaacaaatt

SEQ ID NO: 1268995 - DNA, 22 bp, Artificial Sequence
  chemically synthesized
ttaatgaatataaatttgtttg

SEQ ID NO: 1268996 - DNA, 22 bp, Artificial Sequence
  chemically synthesized
attaatgaatataaatttgttt

SEQ ID NO: 1268997 - DNA, 22 bp, Artificial Sequence
  chemically synthesized
attcaaacaaatttatattcat

SEQ ID NO: 1268998 - DNA, 22 bp, Artificial Sequence
  chemically synthesized
aaacaaatttatattcattaat

SEQ ID NO: 1268999 - DNA, 22 bp, Artificial Sequence
  chemically synthesized
aaaagtgtacaatgcttattaa

SEQ ID NO: 1269000 - DNA, 22 bp, Artificial Sequence
  chemically synthesized
aaaaagtgtacaatgcttatta

SEQ ID NO: 1269001 - DNA, 22 bp, Artificial Sequence
  chemically synthesized
taaaaagtgtacaatgcttatt

SEQ ID NO: 1269002 - DNA, 22 bp, Artificial Sequence
  chemically synthesized
atattcattaataagcattgta

SEQ ID NO: 1269003 - DNA, 22 bp, Artificial Sequence
  chemically synthesized
tattcattaataagcattgtac

SEQ ID NO: 1269004 - DNA, 22 bp, Artificial Sequence
  chemically synthesized
gaattttaaaaagtgtacaatg

SEQ ID NO: 1269005 - DNA, 22 bp, Artificial Sequence
  chemically synthesized
attaataagcattgtacacttt

SEQ ID NO: 1269006 - DNA, 22 bp, Artificial Sequence
  chemically synthesized
ttggaattttaaaaagtgtaca

SEQ ID NO: 1269007 - DNA, 22 bp, Artificial Sequence
  chemically synthesized
attggaattttaaaaagtgtac

SEQ ID NO: 1269008 - DNA, 22 bp, Artificial Sequence
  chemically synthesized
ttattggaattttaaaaagtgt

SEQ ID NO: 1269009 - DNA, 22 bp, Artificial Sequence
  chemically synthesized
ataagcattgtacactttttaa

SEQ ID NO: 1269010 - DNA, 22 bp, Artificial Sequence
  chemically synthesized
cttattggaattttaaaaagtg

SEQ ID NO: 1269011 - DNA, 22 bp, Artificial Sequence
  chemically synthesized
tcttattggaattttaaaaagt

SEQ ID NO: 1269012 - DNA, 22 bp, Artificial Sequence
  chemically synthesized
ttcttattggaattttaaaaag

SEQ ID NO: 1269013 - DNA, 22 bp, Artificial Sequence
  chemically synthesized
tttcttattggaattttaaaaa

SEQ ID NO: 1269014 - DNA, 22 bp, Artificial Sequence
  chemically synthesized
attttttcttattggaatttta

SEQ ID NO: 1269015 - DNA, 22 bp, Artificial Sequence
  chemically synthesized
tcattttttcttattggaattt

SEQ ID NO: 1269016 - DNA, 22 bp, Artificial Sequence
  chemically synthesized
tacactttttaaaattccaata

SEQ ID NO: 1269017 - DNA, 22 bp, Artificial Sequence
  chemically synthesized
agtctctcattttttcttattg

SEQ ID NO: 1269018 - DNA, 22 bp, Artificial Sequence
  chemically synthesized
aagtctctcattttttcttatt

SEQ ID NO: 1269019 - DNA, 22 bp, Artificial Sequence
  chemically synthesized
tttaaaattccaataagaaaaa

SEQ ID NO: 1269020 - DNA, 22 bp, Artificial Sequence
  chemically synthesized
taagtctctcattttttcttat

SEQ ID NO: 1269021 - DNA, 22 bp, Artificial Sequence
  chemically synthesized
ttaaaattccaataagaaaaaa

SEQ ID NO: 1269022 - DNA, 22 bp, Artificial Sequence
  chemically synthesized
taaaattccaataagaaaaaat

SEQ ID NO: 1269023 - DNA, 22 bp, Artificial Sequence
  chemically synthesized
aaaattccaataagaaaaaatg

SEQ ID NO: 1269024 - DNA, 22 bp, Artificial Sequence
  chemically synthesized
aaattccaataagaaaaaatga

SEQ ID NO: 1269025 - DNA, 22 bp, Artificial Sequence
  chemically synthesized
attttaagtctctcattttttc

SEQ ID NO: 1269026 - DNA, 22 bp, Artificial Sequence
  chemically synthesized
cctaattttaagtctctcattt

SEQ ID NO: 1269027 - DNA, 22 bp, Artificial Sequence
  chemically synthesized
caataagaaaaaatgagagact

SEQ ID NO: 1269028 - DNA, 22 bp, Artificial Sequence
  chemically synthesized
ctacctaattttaagtctctca

SEQ ID NO: 1269029 - DNA, 22 bp, Artificial Sequence
  chemically synthesized
ggaaatgcattcctacctaatt

SEQ ID NO: 1269030 - DNA, 22 bp, Artificial Sequence
  chemically synthesized
tgggaaatgcattcctacctaa

SEQ ID NO: 1269031 - DNA, 22 bp, Artificial Sequence
  chemically synthesized
acctctgggaaatgcattccta

SEQ ID NO: 1269032 - DNA, 22 bp, Artificial Sequence
  chemically synthesized
aacctctgggaaatgcattcct

SEQ ID NO: 1269033 - DNA, 22 bp, Artificial Sequence
  chemically synthesized
taacctctgggaaatgcattcc

SEQ ID NO: 1269034 - DNA, 22 bp, Artificial Sequence
  chemically synthesized
aaaattaggtaggaatgcattt

SEQ ID NO: 1269035 - DNA, 22 bp, Artificial Sequence
  chemically synthesized
ttaacctctgggaaatgcattc

SEQ ID NO: 1269036 - DNA, 22 bp, Artificial Sequence
  chemically synthesized
aaattaggtaggaatgcatttc

SEQ ID NO: 1269037 - DNA, 22 bp, Artificial Sequence
  chemically synthesized
ggtaggaatgcatttcccagag

SEQ ID NO: 1269038 - DNA, 22 bp, Artificial Sequence
  chemically synthesized
aaatataaatttttaacctctg

SEQ ID NO: 1269039 - DNA, 22 bp, Artificial Sequence
  chemically synthesized
cccagaggttaaaaatttatat

SEQ ID NO: 1269040 - DNA, 22 bp, Artificial Sequence
  chemically synthesized
ccagaggttaaaaatttatatt

SEQ ID NO: 1269041 - DNA, 22 bp, Artificial Sequence
  chemically synthesized
tatatgcatatatattaaaata

SEQ ID NO: 1269042 - DNA, 22 bp, Artificial Sequence
  chemically synthesized
atatatgcatatatattaaaat

SEQ ID NO: 1269043 - DNA, 22 bp, Artificial Sequence
  chemically synthesized
aaaatttatattttaatatata

SEQ ID NO: 1269044 - DNA, 22 bp, Artificial Sequence
  chemically synthesized
atattttaatatatatgcatat

SEQ ID NO: 1269045 - DNA, 22 bp, Artificial Sequence
  chemically synthesized
tattttaatatatatgcatata

SEQ ID NO: 1269046 - DNA, 22 bp, Artificial Sequence
  chemically synthesized
tgatcccgcttatatatgcata

SEQ ID NO: 1269047 - DNA, 22 bp, Artificial Sequence
  chemically synthesized
taatatatatgcatatataagc

SEQ ID NO: 1269048 - DNA, 22 bp, Artificial Sequence
  chemically synthesized
tattatgatcccgcttatatat

SEQ ID NO: 1269049 - DNA, 22 bp, Artificial Sequence
  chemically synthesized
aatatatatgcatatataagcg

SEQ ID NO: 1269050 - DNA, 22 bp, Artificial Sequence
  chemically synthesized
atatatatgcatatataagcgg

SEQ ID NO: 1269051 - DNA, 22 bp, Artificial Sequence
  chemically synthesized
taatacacagtatgtatacata

SEQ ID NO: 1269052 - DNA, 22 bp, Artificial Sequence
  chemically synthesized
tatgtatacatactgtgtatta

SEQ ID NO: 1269053 - DNA, 22 bp, Artificial Sequence
  chemically synthesized
tgtattacagtctgctttattt

SEQ ID NO: 1269054 - DNA, 22 bp, Artificial Sequence
  chemically synthesized
cagtctgctttattttttcatg

SEQ ID NO: 1269055 - DNA, 22 bp, Artificial Sequence
  chemically synthesized
ctttattttttcatgtatgtat

SEQ ID NO: 1269056 - DNA, 22 bp, Artificial Sequence
  chemically synthesized
aaggtaatccaaatacatacat

SEQ ID NO: 1269057 - DNA, 22 bp, Artificial Sequence
  chemically synthesized
tattttttcatgtatgtatttg

SEQ ID NO: 1269058 - DNA, 22 bp, Artificial Sequence
  chemically synthesized
attttttcatgtatgtatttgg

SEQ ID NO: 1269059 - DNA, 22 bp, Artificial Sequence
  chemically synthesized
ttttttcatgtatgtatttgga

SEQ ID NO: 1269060 - DNA, 22 bp, Artificial Sequence
  chemically synthesized
atattaaaggtaatccaaatac

SEQ ID NO: 1269061 - DNA, 22 bp, Artificial Sequence
  chemically synthesized
tttcatgtatgtatttggatta

SEQ ID NO: 1269062 - DNA, 22 bp, Artificial Sequence
  chemically synthesized
ttcatgtatgtatttggattac

SEQ ID NO: 1269063 - DNA, 22 bp, Artificial Sequence
  chemically synthesized
tcatgtatgtatttggattacc

SEQ ID NO: 1269064 - DNA, 22 bp, Artificial Sequence
  chemically synthesized
catgtatgtatttggattacct

SEQ ID NO: 1269065 - DNA, 22 bp, Artificial Sequence
  chemically synthesized
cattgatattaaaggtaatcca

SEQ ID NO: 1269066 - DNA, 22 bp, Artificial Sequence
  chemically synthesized
atgtatgtatttggattacctt

SEQ ID NO: 1269067 - DNA, 22 bp, Artificial Sequence
  chemically synthesized
caggtgattgcattgatattaa

SEQ ID NO: 1269068 - DNA, 22 bp, Artificial Sequence
  chemically synthesized
acaggtgattgcattgatatta

SEQ ID NO: 1269069 - DNA, 22 bp, Artificial Sequence
  chemically synthesized
tacaggtgattgcattgatatt

SEQ ID NO: 1269070 - DNA, 22 bp, Artificial Sequence
  chemically synthesized
ggattacctttaatatcaatgc

SEQ ID NO: 1269071 - DNA, 22 bp, Artificial Sequence
  chemically synthesized
gattacctttaatatcaatgca

SEQ ID NO: 1269072 - DNA, 22 bp, Artificial Sequence
  chemically synthesized
cctttaatatcaatgcaatcac

SEQ ID NO: 1269073 - DNA, 22 bp, Artificial Sequence
  chemically synthesized
taatatcaatgcaatcacctgt

SEQ ID NO: 1269074 - DNA, 22 bp, Artificial Sequence
  chemically synthesized
aaataaaattttacaggtgatt

SEQ ID NO: 1269075 - DNA, 22 bp, Artificial Sequence
  chemically synthesized
aatatcaatgcaatcacctgta

SEQ ID NO: 1269076 - DNA, 22 bp, Artificial Sequence
  chemically synthesized
aaaataaaattttacaggtgat

SEQ ID NO: 1269077 - DNA, 22 bp, Artificial Sequence
  chemically synthesized
atatcaatgcaatcacctgtaa

SEQ ID NO: 1269078 - DNA, 22 bp, Artificial Sequence
  chemically synthesized
aagaagggaaatttaaaataaa

SEQ ID NO: 1269079 - DNA, 22 bp, Artificial Sequence
  chemically synthesized
taaagaagggaaatttaaaata

SEQ ID NO: 1269080 - DNA, 22 bp, Artificial Sequence
  chemically synthesized
taaaattttattttaaatttcc

SEQ ID NO: 1269081 - DNA, 22 bp, Artificial Sequence
  chemically synthesized
tattttaaatttcccttcttta

SEQ ID NO: 1269082 - DNA, 22 bp, Artificial Sequence
  chemically synthesized
attttaaatttcccttctttag

SEQ ID NO: 1269083 - DNA, 22 bp, Artificial Sequence
  chemically synthesized
ttttaaatttcccttctttaga

SEQ ID NO: 1269084 - DNA, 22 bp, Artificial Sequence
  chemically synthesized
aaaaatgatatatctctaaaga

SEQ ID NO: 1269085 - DNA, 22 bp, Artificial Sequence
  chemically synthesized
taaatttcccttctttagagat

SEQ ID NO: 1269086 - DNA, 22 bp, Artificial Sequence
  chemically synthesized
aaatttcccttctttagagata

SEQ ID NO: 1269087 - DNA, 22 bp, Artificial Sequence
  chemically synthesized
aatttcccttctttagagatat

SEQ ID NO: 1269088 - DNA, 22 bp, Artificial Sequence
  chemically synthesized
ctaaaaaatgatatatctctaa

SEQ ID NO: 1269089 - DNA, 22 bp, Artificial Sequence
  chemically synthesized
cccttctttagagatatatcat

SEQ ID NO: 1269090 - DNA, 22 bp, Artificial Sequence
  chemically synthesized
ccttctttagagatatatcatt

SEQ ID NO: 1269091 - DNA, 22 bp, Artificial Sequence
  chemically synthesized
ctttagagatatatcatttttt

SEQ ID NO: 1269092 - DNA, 22 bp, Artificial Sequence
  chemically synthesized
tttagagatatatcatttttta

SEQ ID NO: 1269093 - DNA, 22 bp, Artificial Sequence
  chemically synthesized
tagagatatatcattttttagt

SEQ ID NO: 1269094 - DNA, 22 bp, Artificial Sequence
  chemically synthesized
agagatatatcattttttagta

SEQ ID NO: 1269095 - DNA, 22 bp, Artificial Sequence
  chemically synthesized
gagatatatcattttttagtag

SEQ ID NO: 1269096 - DNA, 22 bp, Artificial Sequence
  chemically synthesized
atcagtaggaggctactaaaaa

SEQ ID NO: 1269097 - DNA, 22 bp, Artificial Sequence
  chemically synthesized
tttagtagcctcctactgatga

SEQ ID NO: 1269098 - DNA, 22 bp, Artificial Sequence
  chemically synthesized
ttagtagcctcctactgatgaa

SEQ ID NO: 1269099 - DNA, 22 bp, Artificial Sequence
  chemically synthesized
tagtagcctcctactgatgaat

SEQ ID NO: 1269100 - DNA, 22 bp, Artificial Sequence
  chemically synthesized
agtagcctcctactgatgaata

SEQ ID NO: 1269101 - DNA, 22 bp, Artificial Sequence
  chemically synthesized
gtagcctcctactgatgaatac

SEQ ID NO: 1269102 - DNA, 22 bp, Artificial Sequence
  chemically synthesized
ctactgatgaatactggtgttg

SEQ ID NO: 1269103 - DNA, 22 bp, Artificial Sequence
  chemically synthesized
ctgatgaatactggtgttgttt

SEQ ID NO: 1269104 - DNA, 22 bp, Artificial Sequence
  chemically synthesized
cagtgaaaaatggaaacaacac

SEQ ID NO: 1269105 - DNA, 22 bp, Artificial Sequence
  chemically synthesized
atgaatactggtgttgtttcca

SEQ ID NO: 1269106 - DNA, 22 bp, Artificial Sequence
  chemically synthesized
ttacagtgaaaaatggaaacaa

SEQ ID NO: 1269107 - DNA, 22 bp, Artificial Sequence
  chemically synthesized
ttattacagtgaaaaatggaaa

SEQ ID NO: 1269108 - DNA, 22 bp, Artificial Sequence
  chemically synthesized
attgttattacagtgaaaaatg

SEQ ID NO: 1269109 - DNA, 22 bp, Artificial Sequence
  chemically synthesized
aattgttattacagtgaaaaat

SEQ ID NO: 1269110 - DNA, 22 bp, Artificial Sequence
  chemically synthesized
gtgttgtttccatttttcactg

SEQ ID NO: 1269111 - DNA, 22 bp, Artificial Sequence
  chemically synthesized
tttaattgttattacagtgaaa

SEQ ID NO: 1269112 - DNA, 22 bp, Artificial Sequence
  chemically synthesized
ttgtttaattgttattacagtg

SEQ ID NO: 1269113 - DNA, 22 bp, Artificial Sequence
  chemically synthesized
tttccatttttcactgtaataa

SEQ ID NO: 1269114 - DNA, 22 bp, Artificial Sequence
  chemically synthesized
attgtttaattgttattacagt

SEQ ID NO: 1269115 - DNA, 22 bp, Artificial Sequence
  chemically synthesized
ccatttttcactgtaataacaa

SEQ ID NO: 1269116 - DNA, 22 bp, Artificial Sequence
  chemically synthesized
catttttcactgtaataacaat

SEQ ID NO: 1269117 - DNA, 22 bp, Artificial Sequence
  chemically synthesized
tatttattgtttaattgttatt

SEQ ID NO: 1269118 - DNA, 22 bp, Artificial Sequence
  chemically synthesized
ttcactgtaataacaattaaac

SEQ ID NO: 1269119 - DNA, 22 bp, Artificial Sequence
  chemically synthesized
tcactgtaataacaattaaaca

SEQ ID NO: 1269120 - DNA, 22 bp, Artificial Sequence
  chemically synthesized
cactgtaataacaattaaacaa

SEQ ID NO: 1269121 - DNA, 22 bp, Artificial Sequence
  chemically synthesized
tacctatatttattgtttaatt

SEQ ID NO: 1269122 - DNA, 22 bp, Artificial Sequence
  chemically synthesized
actgtaataacaattaaacaat

SEQ ID NO: 1269123 - DNA, 22 bp, Artificial Sequence
  chemically synthesized
taataacaattaaacaataaat

SEQ ID NO: 1269124 - DNA, 22 bp, Artificial Sequence
  chemically synthesized
agttgtacctatatttattgtt

SEQ ID NO: 1269125 - DNA, 22 bp, Artificial Sequence
  chemically synthesized
aacaataaatataggtacaact

SEQ ID NO: 1269126 - DNA, 22 bp, Artificial Sequence
  chemically synthesized
tgtgcaaagactgagttgtacc

SEQ ID NO: 1269127 - DNA, 22 bp, Artificial Sequence
  chemically synthesized
catctatgtgcaaagactgagt

SEQ ID NO: 1269128 - DNA, 22 bp, Artificial Sequence
  chemically synthesized
acatctatgtgcaaagactgag

SEQ ID NO: 1269129 - DNA, 22 bp, Artificial Sequence
  chemically synthesized
tcgaagaaatgcttacatctat

SEQ ID NO: 1269130 - DNA, 22 bp, Artificial Sequence
  chemically synthesized
agtctttgcacatagatgtaag

SEQ ID NO: 1269131 - DNA, 22 bp, Artificial Sequence
  chemically synthesized
tgcacatagatgtaagcatttc

SEQ ID NO: 1269132 - DNA, 22 bp, Artificial Sequence
  chemically synthesized
gcacatagatgtaagcatttct

SEQ ID NO: 1269133 - DNA, 22 bp, Artificial Sequence
  chemically synthesized
cacatagatgtaagcatttctt

SEQ ID NO: 1269134 - DNA, 22 bp, Artificial Sequence
  chemically synthesized
cagggaaattatcgaagaaatg

SEQ ID NO: 1269135 - DNA, 22 bp, Artificial Sequence
  chemically synthesized
ccagggaaattatcgaagaaat

SEQ ID NO: 1269136 - DNA, 22 bp, Artificial Sequence
  chemically synthesized
catttccagggaaattatcgaa

SEQ ID NO: 1269137 - DNA, 22 bp, Artificial Sequence
  chemically synthesized
agcaattgcatttccagggaaa

SEQ ID NO: 1269138 - DNA, 22 bp, Artificial Sequence
  chemically synthesized
cttcgataatttccctggaaat

SEQ ID NO: 1269139 - DNA, 22 bp, Artificial Sequence
  chemically synthesized
ttcgataatttccctggaaatg

SEQ ID NO: 1269140 - DNA, 22 bp, Artificial Sequence
  chemically synthesized
actaagcaattgcatttccagg

SEQ ID NO: 1269141 - DNA, 22 bp, Artificial Sequence
  chemically synthesized
gactaagcaattgcatttccag

SEQ ID NO: 1269142 - DNA, 22 bp, Artificial Sequence
  chemically synthesized
cgataatttccctggaaatgca

SEQ ID NO: 1269143 - DNA, 22 bp, Artificial Sequence
  chemically synthesized
gataatttccctggaaatgcaa

SEQ ID NO: 1269144 - DNA, 22 bp, Artificial Sequence
  chemically synthesized
cacttgactaagcaattgcatt

SEQ ID NO: 1269145 - DNA, 22 bp, Artificial Sequence
  chemically synthesized
acacttgactaagcaattgcat

SEQ ID NO: 1269146 - DNA, 22 bp, Artificial Sequence
  chemically synthesized
ccctggaaatgcaattgcttag

SEQ ID NO: 1269147 - DNA, 22 bp, Artificial Sequence
  chemically synthesized
cctggaaatgcaattgcttagt

SEQ ID NO: 1269148 - DNA, 22 bp, Artificial Sequence
  chemically synthesized
gaaatgcaattgcttagtcaag

SEQ ID NO: 1269149 - DNA, 22 bp, Artificial Sequence
  chemically synthesized
cttagtcaagtgtaagcacgct

SEQ ID NO: 1269150 - DNA, 22 bp, Artificial Sequence
  chemically synthesized
agtcaagtgtaagcacgctttc

SEQ ID NO: 1269151 - DNA, 22 bp, Artificial Sequence
  chemically synthesized
gtcaagtgtaagcacgctttct

SEQ ID NO: 1269152 - DNA, 22 bp, Artificial Sequence
  chemically synthesized
caataccaatcaagagaaagcg

SEQ ID NO: 1269153 - DNA, 22 bp, Artificial Sequence
  chemically synthesized
gcaataccaatcaagagaaagc

SEQ ID NO: 1269154 - DNA, 22 bp, Artificial Sequence
  chemically synthesized
atgagagcagtttgcaatacca

SEQ ID NO: 1269155 - DNA, 22 bp, Artificial Sequence
  chemically synthesized
catgagagcagtttgcaatacc

SEQ ID NO: 1269156 - DNA, 22 bp, Artificial Sequence
  chemically synthesized
tctcttgattggtattgcaaac

SEQ ID NO: 1269157 - DNA, 22 bp, Artificial Sequence
  chemically synthesized
ctcttgattggtattgcaaact

SEQ ID NO: 1269158 - DNA, 22 bp, Artificial Sequence
  chemically synthesized
tttcatgagagcagtttgcaat

SEQ ID NO: 1269159 - DNA, 22 bp, Artificial Sequence
  chemically synthesized
tcttgattggtattgcaaactg

SEQ ID NO: 1269160 - DNA, 22 bp, Artificial Sequence
  chemically synthesized
atttcatgagagcagtttgcaa

SEQ ID NO: 1269161 - DNA, 22 bp, Artificial Sequence
  chemically synthesized
ttgattggtattgcaaactgct

SEQ ID NO: 1269162 - DNA, 22 bp, Artificial Sequence
  chemically synthesized
gattggtattgcaaactgctct

SEQ ID NO: 1269163 - DNA, 22 bp, Artificial Sequence
  chemically synthesized
attggtattgcaaactgctctc

SEQ ID NO: 1269164 - DNA, 22 bp, Artificial Sequence
  chemically synthesized
gtattgcaaactgctctcatga

SEQ ID NO: 1269165 - DNA, 22 bp, Artificial Sequence
  chemically synthesized
aatcaatttatttcatgagagc

SEQ ID NO: 1269166 - DNA, 22 bp, Artificial Sequence
  chemically synthesized
caaactgctctcatgaaataaa

SEQ ID NO: 1269167 - DNA, 22 bp, Artificial Sequence
  chemically synthesized
acagaagactgaatcaatttat

SEQ ID NO: 1269168 - DNA, 22 bp, Artificial Sequence
  chemically synthesized
ctctcatgaaataaattgattc

SEQ ID NO: 1269169 - DNA, 22 bp, Artificial Sequence
  chemically synthesized
tgacagaagactgaatcaattt

SEQ ID NO: 1269170 - DNA, 22 bp, Artificial Sequence
  chemically synthesized
ctgacagaagactgaatcaatt

SEQ ID NO: 1269171 - DNA, 22 bp, Artificial Sequence
  chemically synthesized
tcatgaaataaattgattcagt

SEQ ID NO: 1269172 - DNA, 22 bp, Artificial Sequence
  chemically synthesized
atgaaataaattgattcagtct

SEQ ID NO: 1269173 - DNA, 22 bp, Artificial Sequence
  chemically synthesized
tatgcttctgacagaagactga

SEQ ID NO: 1269174 - DNA, 22 bp, Artificial Sequence
  chemically synthesized
gtatgcttctgacagaagactg

SEQ ID NO: 1269175 - DNA, 22 bp, Artificial Sequence
  chemically synthesized
tgtatgcttctgacagaagact

SEQ ID NO: 1269176 - DNA, 22 bp, Artificial Sequence
  chemically synthesized
tatactttgtatgcttctgaca

SEQ ID NO: 1269177 - DNA, 22 bp, Artificial Sequence
  chemically synthesized
attcagtcttctgtcagaagca

SEQ ID NO: 1269178 - DNA, 22 bp, Artificial Sequence
  chemically synthesized
gtatactttgtatgcttctgac

SEQ ID NO: 1269179 - DNA, 22 bp, Artificial Sequence
  chemically synthesized
cttgtatactttgtatgcttct

SEQ ID NO: 1269180 - DNA, 22 bp, Artificial Sequence
  chemically synthesized
agtcttctgtcagaagcataca

SEQ ID NO: 1269181 - DNA, 22 bp, Artificial Sequence
  chemically synthesized
ccttgtatactttgtatgcttc

SEQ ID NO: 1269182 - DNA, 22 bp, Artificial Sequence
  chemically synthesized
tccttgtatactttgtatgctt

SEQ ID NO: 1269183 - DNA, 22 bp, Artificial Sequence
  chemically synthesized
ttccttgtatactttgtatgct

SEQ ID NO: 1269184 - DNA, 22 bp, Artificial Sequence
  chemically synthesized
ctgtcagaagcatacaaagtat

SEQ ID NO: 1269185 - DNA, 22 bp, Artificial Sequence
  chemically synthesized
tgtcagaagcatacaaagtata

SEQ ID NO: 1269186 - DNA, 22 bp, Artificial Sequence
  chemically synthesized
tcagaagcatacaaagtataca

SEQ ID NO: 1269187 - DNA, 22 bp, Artificial Sequence
  chemically synthesized
taaccaaataatgaaaataaaa

SEQ ID NO: 1269188 - DNA, 22 bp, Artificial Sequence
  chemically synthesized
gtaaccaaataatgaaaataaa

SEQ ID NO: 1269189 - DNA, 22 bp, Artificial Sequence
  chemically synthesized
atttgtaaccaaataatgaaaa

SEQ ID NO: 1269190 - DNA, 22 bp, Artificial Sequence
  chemically synthesized
tttttattttcattatttggtt

SEQ ID NO: 1269191 - DNA, 22 bp, Artificial Sequence
  chemically synthesized
gatctcatttgtaaccaaataa

SEQ ID NO: 1269192 - DNA, 22 bp, Artificial Sequence
  chemically synthesized
ttattttcattatttggttaca

SEQ ID NO: 1269193 - DNA, 22 bp, Artificial Sequence
  chemically synthesized
tattttcattatttggttacaa

SEQ ID NO: 1269194 - DNA, 22 bp, Artificial Sequence
  chemically synthesized
attttcattatttggttacaaa

SEQ ID NO: 1269195 - DNA, 22 bp, Artificial Sequence
  chemically synthesized
ttttcattatttggttacaaat

SEQ ID NO: 1269196 - DNA, 22 bp, Artificial Sequence
  chemically synthesized
tcattatttggttacaaatgag

SEQ ID NO: 1269197 - DNA, 22 bp, Artificial Sequence
  chemically synthesized
cattatttggttacaaatgaga

SEQ ID NO: 1269198 - DNA, 22 bp, Artificial Sequence
  chemically synthesized
attatttggttacaaatgagat

SEQ ID NO: 1269199 - DNA, 22 bp, Artificial Sequence
  chemically synthesized
tttggttacaaatgagatcgaa

SEQ ID NO: 1269200 - DNA, 22 bp, Artificial Sequence
  chemically synthesized
ggttacaaatgagatcgaacat

SEQ ID NO: 1269201 - DNA, 22 bp, Artificial Sequence
  chemically synthesized
gttacaaatgagatcgaacatt

SEQ ID NO: 1269202 - DNA, 22 bp, Artificial Sequence
  chemically synthesized
caaatgagatcgaacatttttt

SEQ ID NO: 1269203 - DNA, 22 bp, Artificial Sequence
  chemically synthesized
tttcatatacctttggatgtgt

SEQ ID NO: 1269204 - DNA, 22 bp, Artificial Sequence
  chemically synthesized
ttcatatacctttggatgtgtt

SEQ ID NO: 1269205 - DNA, 22 bp, Artificial Sequence
  chemically synthesized
tcatatacctttggatgtgttt

SEQ ID NO: 1269206 - DNA, 22 bp, Artificial Sequence
  chemically synthesized
catatacctttggatgtgtttt

SEQ ID NO: 1269207 - DNA, 22 bp, Artificial Sequence
  chemically synthesized
atatacctttggatgtgtttta

SEQ ID NO: 1269208 - DNA, 22 bp, Artificial Sequence
  chemically synthesized
gacaaaaagaaaataaaacaca

SEQ ID NO: 1269209 - DNA, 22 bp, Artificial Sequence
  chemically synthesized
ggacaaaaagaaaataaaacac

SEQ ID NO: 1269210 - DNA, 22 bp, Artificial Sequence
  chemically synthesized
tggatgtgttttattttctttt

SEQ ID NO: 1269211 - DNA, 22 bp, Artificial Sequence
  chemically synthesized
ggatgtgttttattttcttttt

SEQ ID NO: 1269212 - DNA, 22 bp, Artificial Sequence
  chemically synthesized
gatgtgttttattttctttttg

SEQ ID NO: 1269213 - DNA, 22 bp, Artificial Sequence
  chemically synthesized
tattttctttttgtccaaatat

SEQ ID NO: 1269214 - DNA, 22 bp, Artificial Sequence
  chemically synthesized
attttctttttgtccaaatata

SEQ ID NO: 1269215 - DNA, 22 bp, Artificial Sequence
  chemically synthesized
ttttctttttgtccaaatatat

SEQ ID NO: 1269216 - DNA, 22 bp, Artificial Sequence
  chemically synthesized
cacatgtaccccatatatttgg

SEQ ID NO: 1269217 - DNA, 22 bp, Artificial Sequence
  chemically synthesized
tctttttgtccaaatatatggg

SEQ ID NO: 1269218 - DNA, 22 bp, Artificial Sequence
  chemically synthesized
ctttttgtccaaatatatgggg

SEQ ID NO: 1269219 - DNA, 22 bp, Artificial Sequence
  chemically synthesized
tttttgtccaaatatatggggt

SEQ ID NO: 1269220 - DNA, 22 bp, Artificial Sequence
  chemically synthesized
tttgtccaaatatatggggtac

SEQ ID NO: 1269221 - DNA, 22 bp, Artificial Sequence
  chemically synthesized
ttgtccaaatatatggggtaca

SEQ ID NO: 1269222 - DNA, 22 bp, Artificial Sequence
  chemically synthesized
tgtccaaatatatggggtacat

SEQ ID NO: 1269223 - DNA, 22 bp, Artificial Sequence
  chemically synthesized
gtccaaatatatggggtacatg

SEQ ID NO: 1269224 - DNA, 22 bp, Artificial Sequence
  chemically synthesized
tccaaatatatggggtacatgt

SEQ ID NO: 1269225 - DNA, 22 bp, Artificial Sequence
  chemically synthesized
tgcatgtaacaaaattacacat

SEQ ID NO: 1269226 - DNA, 22 bp, Artificial Sequence
  chemically synthesized
cacaatctatgcatgtaacaaa

SEQ ID NO: 1269227 - DNA, 22 bp, Artificial Sequence
  chemically synthesized
accactacacaatctatgcatg

SEQ ID NO: 1269228 - DNA, 22 bp, Artificial Sequence
  chemically synthesized
gaccactacacaatctatgcat

SEQ ID NO: 1269229 - DNA, 22 bp, Artificial Sequence
  chemically synthesized
acttgaccactacacaatctat

SEQ ID NO: 1269230 - DNA, 22 bp, Artificial Sequence
  chemically synthesized
tgttacatgcatagattgtgta

SEQ ID NO: 1269231 - DNA, 22 bp, Artificial Sequence
  chemically synthesized
gttacatgcatagattgtgtag

SEQ ID NO: 1269232 - DNA, 22 bp, Artificial Sequence
  chemically synthesized
ttacatgcatagattgtgtagt

SEQ ID NO: 1269233 - DNA, 22 bp, Artificial Sequence
  chemically synthesized
catgcatagattgtgtagtggt

SEQ ID NO: 1269234 - DNA, 22 bp, Artificial Sequence
  chemically synthesized
aaagccctaacttgaccactac

SEQ ID NO: 1269235 - DNA, 22 bp, Artificial Sequence
  chemically synthesized
taaaagccctaacttgaccact

SEQ ID NO: 1269236 - DNA, 22 bp, Artificial Sequence
  chemically synthesized
tgtagtggtcaagttagggctt

SEQ ID NO: 1269237 - DNA, 22 bp, Artificial Sequence
  chemically synthesized
ggtgagggacgctctaaaagcc

SEQ ID NO: 1269238 - DNA, 22 bp, Artificial Sequence
  chemically synthesized
gggtgagggacgctctaaaagc

SEQ ID NO: 1269239 - DNA, 22 bp, Artificial Sequence
  chemically synthesized
gggcttttagagcgtccctcac

SEQ ID NO: 1269240 - DNA, 22 bp, Artificial Sequence
  chemically synthesized
ttagagcgtccctcacccaaat

SEQ ID NO: 1269241 - DNA, 22 bp, Artificial Sequence
  chemically synthesized
tagagcgtccctcacccaaata

SEQ ID NO: 1269242 - DNA, 22 bp, Artificial Sequence
  chemically synthesized
atgtgtatgatatatttgggtg

SEQ ID NO: 1269243 - DNA, 22 bp, Artificial Sequence
  chemically synthesized
agagcgtccctcacccaaatat

SEQ ID NO: 1269244 - DNA, 22 bp, Artificial Sequence
  chemically synthesized
gagcgtccctcacccaaatata

SEQ ID NO: 1269245 - DNA, 22 bp, Artificial Sequence
  chemically synthesized
acccaaatatatcatacacatt

SEQ ID NO: 1269246 - DNA, 22 bp, Artificial Sequence
  chemically synthesized
gagtggagtggataatgagaaa

SEQ ID NO: 1269247 - DNA, 22 bp, Artificial Sequence
  chemically synthesized
atttctcattatccactccact

SEQ ID NO: 1269248 - DNA, 22 bp, Artificial Sequence
  chemically synthesized
ctcattatccactccactccaa

SEQ ID NO: 1269249 - DNA, 22 bp, Artificial Sequence
  chemically synthesized
tcattatccactccactccaac

SEQ ID NO: 1269250 - DNA, 22 bp, Artificial Sequence
  chemically synthesized
gtagggtgagggggttggagtg

SEQ ID NO: 1269251 - DNA, 22 bp, Artificial Sequence
  chemically synthesized
attatccactccactccaaccc

SEQ ID NO: 1269252 - DNA, 22 bp, Artificial Sequence
  chemically synthesized
agtagggtgagggggttggagt

SEQ ID NO: 1269253 - DNA, 22 bp, Artificial Sequence
  chemically synthesized
tccactccactccaaccccctc

SEQ ID NO: 1269254 - DNA, 22 bp, Artificial Sequence
  chemically synthesized
cactccaaccccctcaccctac

SEQ ID NO: 1269255 - DNA, 22 bp, Artificial Sequence
  chemically synthesized
caaccccctcaccctactaagt

SEQ ID NO: 1269256 - DNA, 22 bp, Artificial Sequence
  chemically synthesized
accctactaagtttccattgtc

SEQ ID NO: 1269257 - DNA, 22 bp, Artificial Sequence
  chemically synthesized
ctaagtttccattgtctatcat

SEQ ID NO: 1269258 - DNA, 22 bp, Artificial Sequence
  chemically synthesized
agtttccattgtctatcattcc

SEQ ID NO: 1269259 - DNA, 22 bp, Artificial Sequence
  chemically synthesized
ccattgtctatcattccactct

SEQ ID NO: 1269260 - DNA, 22 bp, Artificial Sequence
  chemically synthesized
cattgtctatcattccactctc

SEQ ID NO: 1269261 - DNA, 22 bp, Artificial Sequence
  chemically synthesized
tctatcattccactctctgtgt

SEQ ID NO: 1269262 - DNA, 22 bp, Artificial Sequence
  chemically synthesized
tcattccactctctgtgtacat

SEQ ID NO: 1269263 - DNA, 22 bp, Artificial Sequence
  chemically synthesized
aaaaatgtgtacacatgtacac

SEQ ID NO: 1269264 - DNA, 22 bp, Artificial Sequence
  chemically synthesized
cactctctgtgtacatgtgtac

SEQ ID NO: 1269265 - DNA, 22 bp, Artificial Sequence
  chemically synthesized
tgtgctaaaaaatgtgtacaca

SEQ ID NO: 1269266 - DNA, 22 bp, Artificial Sequence
  chemically synthesized
tctgtgtacatgtgtacacatt

SEQ ID NO: 1269267 - DNA, 22 bp, Artificial Sequence
  chemically synthesized
tgtgtacatgtgtacacatttt

SEQ ID NO: 1269268 - DNA, 22 bp, Artificial Sequence
  chemically synthesized
tgtacatgtgtacacatttttt

SEQ ID NO: 1269269 - DNA, 22 bp, Artificial Sequence
  chemically synthesized
acccataattgtgtgctaaaaa

SEQ ID NO: 1269270 - DNA, 22 bp, Artificial Sequence
  chemically synthesized
catgttcacccataattgtgtg

SEQ ID NO: 1269271 - DNA, 22 bp, Artificial Sequence
  chemically synthesized
tttagcacacaattatgggtga

SEQ ID NO: 1269272 - DNA, 22 bp, Artificial Sequence
  chemically synthesized
ttagcacacaattatgggtgaa

SEQ ID NO: 1269273 - DNA, 22 bp, Artificial Sequence
  chemically synthesized
tagcacacaattatgggtgaac

SEQ ID NO: 1269274 - DNA, 22 bp, Artificial Sequence
  chemically synthesized
agcacacaattatgggtgaaca

SEQ ID NO: 1269275 - DNA, 22 bp, Artificial Sequence
  chemically synthesized
gcacacaattatgggtgaacat

SEQ ID NO: 1269276 - DNA, 22 bp, Artificial Sequence
  chemically synthesized
tgggtgaacatgcaatatttga

SEQ ID NO: 1269277 - DNA, 22 bp, Artificial Sequence
  chemically synthesized
agtgaaatgaaccagacacaga

SEQ ID NO: 1269278 - DNA, 22 bp, Artificial Sequence
  chemically synthesized
aagtgaaatgaaccagacacag

SEQ ID NO: 1269279 - DNA, 22 bp, Artificial Sequence
  chemically synthesized
taagtgaaatgaaccagacaca

SEQ ID NO: 1269280 - DNA, 22 bp, Artificial Sequence
  chemically synthesized
ttttaagtgaaatgaaccagac

SEQ ID NO: 1269281 - DNA, 22 bp, Artificial Sequence
  chemically synthesized
gactttctgtgtctggttcatt

SEQ ID NO: 1269282 - DNA, 22 bp, Artificial Sequence
  chemically synthesized
actttctgtgtctggttcattt

SEQ ID NO: 1269283 - DNA, 22 bp, Artificial Sequence
  chemically synthesized
tctgtgtctggttcatttcact

SEQ ID NO: 1269284 - DNA, 22 bp, Artificial Sequence
  chemically synthesized
ctgtgtctggttcatttcactt

SEQ ID NO: 1269285 - DNA, 22 bp, Artificial Sequence
  chemically synthesized
tgtgtctggttcatttcactta

SEQ ID NO: 1269286 - DNA, 22 bp, Artificial Sequence
  chemically synthesized
gaggtcattattttaagtgaaa

SEQ ID NO: 1269287 - DNA, 22 bp, Artificial Sequence
  chemically synthesized
tgtctggttcatttcacttaaa

SEQ ID NO: 1269288 - DNA, 22 bp, Artificial Sequence
  chemically synthesized
gacctggaggtcattattttaa

SEQ ID NO: 1269289 - DNA, 22 bp, Artificial Sequence
  chemically synthesized
gttcatttcacttaaaataatg

SEQ ID NO: 1269290 - DNA, 22 bp, Artificial Sequence
  chemically synthesized
atttcacttaaaataatgacct

SEQ ID NO: 1269291 - DNA, 22 bp, Artificial Sequence
  chemically synthesized
cacttaaaataatgacctccag

SEQ ID NO: 1269292 - DNA, 22 bp, Artificial Sequence
  chemically synthesized
acttaaaataatgacctccagg

SEQ ID NO: 1269293 - DNA, 22 bp, Artificial Sequence
  chemically synthesized
aaaataatgacctccaggtcta

SEQ ID NO: 1269294 - DNA, 22 bp, Artificial Sequence
  chemically synthesized
aaataatgacctccaggtctaa

SEQ ID NO: 1269295 - DNA, 22 bp, Artificial Sequence
  chemically synthesized
agcatacaggaagaaagtgtta

SEQ ID NO: 1269296 - DNA, 22 bp, Artificial Sequence
  chemically synthesized
aagcatacaggaagaaagtgtt

SEQ ID NO: 1269297 - DNA, 22 bp, Artificial Sequence
  chemically synthesized
taagcatacaggaagaaagtgt

SEQ ID NO: 1269298 - DNA, 22 bp, Artificial Sequence
  chemically synthesized
caggtctaacactttcttcctg

SEQ ID NO: 1269299 - DNA, 22 bp, Artificial Sequence
  chemically synthesized
attttaagcatacaggaagaaa

SEQ ID NO: 1269300 - DNA, 22 bp, Artificial Sequence
  chemically synthesized
cctaattttaagcatacaggaa

SEQ ID NO: 1269301 - DNA, 22 bp, Artificial Sequence
  chemically synthesized
acactttcttcctgtatgctta

SEQ ID NO: 1269302 - DNA, 22 bp, Artificial Sequence
  chemically synthesized
tcttcctgtatgcttaaaatta

SEQ ID NO: 1269303 - DNA, 22 bp, Artificial Sequence
  chemically synthesized
cttcctgtatgcttaaaattag

SEQ ID NO: 1269304 - DNA, 22 bp, Artificial Sequence
  chemically synthesized
ttcctgtatgcttaaaattagg

SEQ ID NO: 1269305 - DNA, 22 bp, Artificial Sequence
  chemically synthesized
cctgtatgcttaaaattaggca

SEQ ID NO: 1269306 - DNA, 22 bp, Artificial Sequence
  chemically synthesized
ctgtatgcttaaaattaggcaa

SEQ ID NO: 1269307 - DNA, 22 bp, Artificial Sequence
  chemically synthesized
tatgcttaaaattaggcaatgc

SEQ ID NO: 1269308 - DNA, 22 bp, Artificial Sequence
  chemically synthesized
agaaaaataaatgcattgccta

SEQ ID NO: 1269309 - DNA, 22 bp, Artificial Sequence
  chemically synthesized
aaaattaggcaatgcatttatt

SEQ ID NO: 1269310 - DNA, 22 bp, Artificial Sequence
  chemically synthesized
aaattaggcaatgcatttattt

SEQ ID NO: 1269311 - DNA, 22 bp, Artificial Sequence
  chemically synthesized
caaatcaattcagaaaaataaa

SEQ ID NO: 1269312 - DNA, 22 bp, Artificial Sequence
  chemically synthesized
acaaatcaattcagaaaaataa

SEQ ID NO: 1269313 - DNA, 22 bp, Artificial Sequence
  chemically synthesized
ggcaatgcatttatttttctga

SEQ ID NO: 1269314 - DNA, 22 bp, Artificial Sequence
  chemically synthesized
aatcttacaaatcaattcagaa

SEQ ID NO: 1269315 - DNA, 22 bp, Artificial Sequence
  chemically synthesized
aaattgaatcttacaaatcaat

SEQ ID NO: 1269316 - DNA, 22 bp, Artificial Sequence
  chemically synthesized
atttttctgaattgatttgtaa

SEQ ID NO: 1269317 - DNA, 22 bp, Artificial Sequence
  chemically synthesized
tttttctgaattgatttgtaag

SEQ ID NO: 1269318 - DNA, 22 bp, Artificial Sequence
  chemically synthesized
ttctgaattgatttgtaagatt

SEQ ID NO: 1269319 - DNA, 22 bp, Artificial Sequence
  chemically synthesized
tctgaattgatttgtaagattc

SEQ ID NO: 1269320 - DNA, 22 bp, Artificial Sequence
  chemically synthesized
ctgaattgatttgtaagattca

SEQ ID NO: 1269321 - DNA, 22 bp, Artificial Sequence
  chemically synthesized
tgaattgatttgtaagattcaa

SEQ ID NO: 1269322 - DNA, 22 bp, Artificial Sequence
  chemically synthesized
aattgatttgtaagattcaatt

SEQ ID NO: 1269323 - DNA, 22 bp, Artificial Sequence
  chemically synthesized
aaaaccagtaaactgaaattga

SEQ ID NO: 1269324 - DNA, 22 bp, Artificial Sequence
  chemically synthesized
atttgtaagattcaatttcagt

SEQ ID NO: 1269325 - DNA, 22 bp, Artificial Sequence
  chemically synthesized
gtaagattcaatttcagtttac

SEQ ID NO: 1269326 - DNA, 22 bp, Artificial Sequence
  chemically synthesized
taagattcaatttcagtttact

SEQ ID NO: 1269327 - DNA, 22 bp, Artificial Sequence
  chemically synthesized
tacattaaaaaccagtaaactg

SEQ ID NO: 1269328 - DNA, 22 bp, Artificial Sequence
  chemically synthesized
aatttcagtttactggttttta

SEQ ID NO: 1269329 - DNA, 22 bp, Artificial Sequence
  chemically synthesized
aaatctgtacattaaaaaccag

SEQ ID NO: 1269330 - DNA, 22 bp, Artificial Sequence
  chemically synthesized
aaaatctgtacattaaaaacca

SEQ ID NO: 1269331 - DNA, 22 bp, Artificial Sequence
  chemically synthesized
taaaatctgtacattaaaaacc

SEQ ID NO: 1269332 - DNA, 22 bp, Artificial Sequence
  chemically synthesized
ttaaaatctgtacattaaaaac

SEQ ID NO: 1269333 - DNA, 22 bp, Artificial Sequence
  chemically synthesized
cagtttactggtttttaatgta

SEQ ID NO: 1269334 - DNA, 22 bp, Artificial Sequence
  chemically synthesized
agtttactggtttttaatgtac

SEQ ID NO: 1269335 - DNA, 22 bp, Artificial Sequence
  chemically synthesized
actggtttttaatgtacagatt

SEQ ID NO: 1269336 - DNA, 22 bp, Artificial Sequence
  chemically synthesized
ctggtttttaatgtacagattt

SEQ ID NO: 1269337 - DNA, 22 bp, Artificial Sequence
  chemically synthesized
gtttttaatgtacagattttaa

SEQ ID NO: 1269338 - DNA, 22 bp, Artificial Sequence
  chemically synthesized
ttaatgtacagattttaaaaat

SEQ ID NO: 1269339 - DNA, 22 bp, Artificial Sequence
  chemically synthesized
taatgtacagattttaaaaatt

SEQ ID NO: 1269340 - DNA, 22 bp, Artificial Sequence
  chemically synthesized
aatgtacagattttaaaaatta

SEQ ID NO: 1269341 - DNA, 22 bp, Artificial Sequence
  chemically synthesized
atgtacagattttaaaaattat

SEQ ID NO: 1269342 - DNA, 22 bp, Artificial Sequence
  chemically synthesized
aaatggaaaacacatagataat

SEQ ID NO: 1269343 - DNA, 22 bp, Artificial Sequence
  chemically synthesized
aaaatggaaaacacatagataa

SEQ ID NO: 1269344 - DNA, 22 bp, Artificial Sequence
  chemically synthesized
taaaaattatctatgtgttttc

SEQ ID NO: 1269345 - DNA, 22 bp, Artificial Sequence
  chemically synthesized
aaaaattatctatgtgttttcc

SEQ ID NO: 1269346 - DNA, 22 bp, Artificial Sequence
  chemically synthesized
aaaattatctatgtgttttcca

SEQ ID NO: 1269347 - DNA, 22 bp, Artificial Sequence
  chemically synthesized
aaaacccaaaatttaaaatgga

SEQ ID NO: 1269348 - DNA, 22 bp, Artificial Sequence
  chemically synthesized
tctatgtgttttccattttaaa

SEQ ID NO: 1269349 - DNA, 22 bp, Artificial Sequence
  chemically synthesized
aaaaacccaaaatttaaaatgg

SEQ ID NO: 1269350 - DNA, 22 bp, Artificial Sequence
  chemically synthesized
taaaaacccaaaatttaaaatg

SEQ ID NO: 1269351 - DNA, 22 bp, Artificial Sequence
  chemically synthesized
tgtgttttccattttaaatttt

SEQ ID NO: 1269352 - DNA, 22 bp, Artificial Sequence
  chemically synthesized
tccattttaaattttgggtttt

SEQ ID NO: 1269353 - DNA, 22 bp, Artificial Sequence
  chemically synthesized
ccattttaaattttgggttttt

SEQ ID NO: 1269354 - DNA, 22 bp, Artificial Sequence
  chemically synthesized
cattttaaattttgggttttta

SEQ ID NO: 1269355 - DNA, 22 bp, Artificial Sequence
  chemically synthesized
tgtagaaatgattttaaaaacc

SEQ ID NO: 1269356 - DNA, 22 bp, Artificial Sequence
  chemically synthesized
taaattttgggtttttaaaatc

SEQ ID NO: 1269357 - DNA, 22 bp, Artificial Sequence
  chemically synthesized
aaattttgggtttttaaaatca

SEQ ID NO: 1269358 - DNA, 22 bp, Artificial Sequence
  chemically synthesized
aattttgggtttttaaaatcat

SEQ ID NO: 1269359 - DNA, 22 bp, Artificial Sequence
  chemically synthesized
tgggtttttaaaatcatttcta

SEQ ID NO: 1269360 - DNA, 22 bp, Artificial Sequence
  chemically synthesized
gggtttttaaaatcatttctac

SEQ ID NO: 1269361 - DNA, 22 bp, Artificial Sequence
  chemically synthesized
ggtttttaaaatcatttctaca

SEQ ID NO: 1269362 - DNA, 22 bp, Artificial Sequence
  chemically synthesized
ttaaaatcatttctacatagtt

SEQ ID NO: 1269363 - DNA, 22 bp, Artificial Sequence
  chemically synthesized
taaaatcatttctacatagttc

SEQ ID NO: 1269364 - DNA, 22 bp, Artificial Sequence
  chemically synthesized
aaaatcatttctacatagttct

SEQ ID NO: 1269365 - DNA, 22 bp, Artificial Sequence
  chemically synthesized
aaatcatttctacatagttctc

SEQ ID NO: 1269366 - DNA, 22 bp, Artificial Sequence
  chemically synthesized
caatgaggcgatggtagagaac

SEQ ID NO: 1269367 - DNA, 22 bp, Artificial Sequence
  chemically synthesized
tacaatgaggcgatggtagaga

SEQ ID NO: 1269368 - DNA, 22 bp, Artificial Sequence
  chemically synthesized
ctacaatgaggcgatggtagag

SEQ ID NO: 1269369 - DNA, 22 bp, Artificial Sequence
  chemically synthesized
ctacatagttctctaccatcgc

SEQ ID NO: 1269370 - DNA, 22 bp, Artificial Sequence
  chemically synthesized
tacatagttctctaccatcgcc

SEQ ID NO: 1269371 - DNA, 22 bp, Artificial Sequence
  chemically synthesized
catagttctctaccatcgcctc

SEQ ID NO: 1269372 - DNA, 22 bp, Artificial Sequence
  chemically synthesized
tctaccatcgcctcattgtaga

SEQ ID NO: 1269373 - DNA, 22 bp, Artificial Sequence
  chemically synthesized
taccatcgcctcattgtagaaa

SEQ ID NO: 1269374 - DNA, 22 bp, Artificial Sequence
  chemically synthesized
ccatcgcctcattgtagaaata

SEQ ID NO: 1269375 - DNA, 22 bp, Artificial Sequence
  chemically synthesized
attgtagaaatattcacctatc

SEQ ID NO: 1269376 - DNA, 22 bp, Artificial Sequence
  chemically synthesized
tagaaatattcacctatcgttc

SEQ ID NO: 1269377 - DNA, 22 bp, Artificial Sequence
  chemically synthesized
agaagcccaaagaacaggaaga

SEQ ID NO: 1269378 - DNA, 22 bp, Artificial Sequence
  chemically synthesized
aagaagcccaaagaacaggaag

SEQ ID NO: 1269379 - DNA, 22 bp, Artificial Sequence
  chemically synthesized
acctatcgttcttcctgttctt

SEQ ID NO: 1269380 - DNA, 22 bp, Artificial Sequence
  chemically synthesized
agcttaagaagcccaaagaaca

SEQ ID NO: 1269381 - DNA, 22 bp, Artificial Sequence
  chemically synthesized
tcgttcttcctgttctttgggc

SEQ ID NO: 1269382 - DNA, 22 bp, Artificial Sequence
  chemically synthesized
ttcctgttctttgggcttctta

SEQ ID NO: 1269383 - DNA, 22 bp, Artificial Sequence
  chemically synthesized
cctgttctttgggcttcttaag

SEQ ID NO: 1269384 - DNA, 22 bp, Artificial Sequence
  chemically synthesized
ctgttctttgggcttcttaagc

SEQ ID NO: 1269385 - DNA, 22 bp, Artificial Sequence
  chemically synthesized
aatcataattaagcttaagaag

SEQ ID NO: 1269386 - DNA, 22 bp, Artificial Sequence
  chemically synthesized
ttctttgggcttcttaagctta

SEQ ID NO: 1269387 - DNA, 22 bp, Artificial Sequence
  chemically synthesized
tttgggcttcttaagcttaatt

SEQ ID NO: 1269388 - DNA, 22 bp, Artificial Sequence
  chemically synthesized
tgggcttcttaagcttaattat

SEQ ID NO: 1269389 - DNA, 22 bp, Artificial Sequence
  chemically synthesized
gggcttcttaagcttaattatg

SEQ ID NO: 1269390 - DNA, 22 bp, Artificial Sequence
  chemically synthesized
ggcttcttaagcttaattatga

SEQ ID NO: 1269391 - DNA, 22 bp, Artificial Sequence
  chemically synthesized
aacaaatattcaatcataatta

SEQ ID NO: 1269392 - DNA, 22 bp, Artificial Sequence
  chemically synthesized
gaacaaatattcaatcataatt

SEQ ID NO: 1269393 - DNA, 22 bp, Artificial Sequence
  chemically synthesized
cttaagcttaattatgattgaa

SEQ ID NO: 1269394 - DNA, 22 bp, Artificial Sequence
  chemically synthesized
ttaagcttaattatgattgaat

SEQ ID NO: 1269395 - DNA, 22 bp, Artificial Sequence
  chemically synthesized
accttgaacaaatattcaatca

SEQ ID NO: 1269396 - DNA, 22 bp, Artificial Sequence
  chemically synthesized
aagcttaattatgattgaatat

SEQ ID NO: 1269397 - DNA, 22 bp, Artificial Sequence
  chemically synthesized
caccttgaacaaatattcaatc

SEQ ID NO: 1269398 - DNA, 22 bp, Artificial Sequence
  chemically synthesized
agcttaattatgattgaatatt

SEQ ID NO: 1269399 - DNA, 22 bp, Artificial Sequence
  chemically synthesized
aatttcaccttgaacaaatatt

SEQ ID NO: 1269400 - DNA, 22 bp, Artificial Sequence
  chemically synthesized
aattatgattgaatatttgttc

SEQ ID NO: 1269401 - DNA, 22 bp, Artificial Sequence
  chemically synthesized
attatgattgaatatttgttca

SEQ ID NO: 1269402 - DNA, 22 bp, Artificial Sequence
  chemically synthesized
tgattgaatatttgttcaaggt

SEQ ID NO: 1269403 - DNA, 22 bp, Artificial Sequence
  chemically synthesized
aatatttgttcaaggtgaaatt

SEQ ID NO: 1269404 - DNA, 22 bp, Artificial Sequence
  chemically synthesized
cacaatgcagtgaattaaattt

SEQ ID NO: 1269405 - DNA, 22 bp, Artificial Sequence
  chemically synthesized
acacaatgcagtgaattaaatt

SEQ ID NO: 1269406 - DNA, 22 bp, Artificial Sequence
  chemically synthesized
gttcaaggtgaaatttaattca

SEQ ID NO: 1269407 - DNA, 22 bp, Artificial Sequence
  chemically synthesized
tacacaatgcagtgaattaaat

SEQ ID NO: 1269408 - DNA, 22 bp, Artificial Sequence
  chemically synthesized
ttcaaggtgaaatttaattcac

SEQ ID NO: 1269409 - DNA, 22 bp, Artificial Sequence
  chemically synthesized
ctttacacaatgcagtgaatta

SEQ ID NO: 1269410 - DNA, 22 bp, Artificial Sequence
  chemically synthesized
aaggtgaaatttaattcactgc

SEQ ID NO: 1269411 - DNA, 22 bp, Artificial Sequence
  chemically synthesized
aattcactgcattgtgtaaagc

SEQ ID NO: 1269412 - DNA, 22 bp, Artificial Sequence
  chemically synthesized
attcactgcattgtgtaaagca

SEQ ID NO: 1269413 - DNA, 22 bp, Artificial Sequence
  chemically synthesized
aaaggcaaaaccctgctttaca

SEQ ID NO: 1269414 - DNA, 22 bp, Artificial Sequence
  chemically synthesized
actgcattgtgtaaagcagggt

SEQ ID NO: 1269415 - DNA, 22 bp, Artificial Sequence
  chemically synthesized
cattgtgtaaagcagggttttg

SEQ ID NO: 1269416 - DNA, 22 bp, Artificial Sequence
  chemically synthesized
tgtaaagcagggttttgccttt

SEQ ID NO: 1269417 - DNA, 22 bp, Artificial Sequence
  chemically synthesized
ataatcatgttaaaaggcaaaa

SEQ ID NO: 1269418 - DNA, 22 bp, Artificial Sequence
  chemically synthesized
gataatcatgttaaaaggcaaa

SEQ ID NO: 1269419 - DNA, 22 bp, Artificial Sequence
  chemically synthesized
tgataatcatgttaaaaggcaa

SEQ ID NO: 1269420 - DNA, 22 bp, Artificial Sequence
  chemically synthesized
tgccttttaacatgattatcaa

SEQ ID NO: 1269421 - DNA, 22 bp, Artificial Sequence
  chemically synthesized
gccttttaacatgattatcaaa

SEQ ID NO: 1269422 - DNA, 22 bp, Artificial Sequence
  chemically synthesized
ccttttaacatgattatcaaaa

SEQ ID NO: 1269423 - DNA, 22 bp, Artificial Sequence
  chemically synthesized
tgaaagaaatggttttgataat

SEQ ID NO: 1269424 - DNA, 22 bp, Artificial Sequence
  chemically synthesized
ttaacatgattatcaaaaccat

SEQ ID NO: 1269425 - DNA, 22 bp, Artificial Sequence
  chemically synthesized
taacatgattatcaaaaccatt

SEQ ID NO: 1269426 - DNA, 22 bp, Artificial Sequence
  chemically synthesized
aacatgattatcaaaaccattt

SEQ ID NO: 1269427 - DNA, 22 bp, Artificial Sequence
  chemically synthesized
acatgattatcaaaaccatttc

SEQ ID NO: 1269428 - DNA, 22 bp, Artificial Sequence
  chemically synthesized
tcaaaaccatttctttcatagt

SEQ ID NO: 1269429 - DNA, 22 bp, Artificial Sequence
  chemically synthesized
aaatcagtggatagagatggac

SEQ ID NO: 1269430 - DNA, 22 bp, Artificial Sequence
  chemically synthesized
caaatcagtggatagagatgga

SEQ ID NO: 1269431 - DNA, 22 bp, Artificial Sequence
  chemically synthesized
ctttcatagtccatctctatcc

SEQ ID NO: 1269432 - DNA, 22 bp, Artificial Sequence
  chemically synthesized
tttcatagtccatctctatcca

SEQ ID NO: 1269433 - DNA, 22 bp, Artificial Sequence
  chemically synthesized
tcatagtccatctctatccact

SEQ ID NO: 1269434 - DNA, 22 bp, Artificial Sequence
  chemically synthesized
catagtccatctctatccactg

SEQ ID NO: 1269435 - DNA, 22 bp, Artificial Sequence
  chemically synthesized
atagtccatctctatccactga

SEQ ID NO: 1269436 - DNA, 22 bp, Artificial Sequence
  chemically synthesized
tatccactgatttgaaattcca

SEQ ID NO: 1269437 - DNA, 22 bp, Artificial Sequence
  chemically synthesized
tccactgatttgaaattccatt

SEQ ID NO: 1269438 - DNA, 22 bp, Artificial Sequence
  chemically synthesized
aagtgtatataataaaaatgga

SEQ ID NO: 1269439 - DNA, 22 bp, Artificial Sequence
  chemically synthesized
atttgaaattccatttttatta

SEQ ID NO: 1269440 - DNA, 22 bp, Artificial Sequence
  chemically synthesized
gaaattccatttttattatata

SEQ ID NO: 1269441 - DNA, 22 bp, Artificial Sequence
  chemically synthesized
aaattccatttttattatatac

SEQ ID NO: 1269442 - DNA, 22 bp, Artificial Sequence
  chemically synthesized
catttttattatatacacttga

SEQ ID NO: 1269443 - DNA, 22 bp, Artificial Sequence
  chemically synthesized
ttattatatacacttgagcata

SEQ ID NO: 1269444 - DNA, 22 bp, Artificial Sequence
  chemically synthesized
tattatatacacttgagcatat

SEQ ID NO: 1269445 - DNA, 22 bp, Artificial Sequence
  chemically synthesized
attatatacacttgagcatatt

SEQ ID NO: 1269446 - DNA, 22 bp, Artificial Sequence
  chemically synthesized
ttatatacacttgagcatattt

SEQ ID NO: 1269447 - DNA, 22 bp, Artificial Sequence
  chemically synthesized
tatacacttgagcatattttgg

SEQ ID NO: 1269448 - DNA, 22 bp, Artificial Sequence
  chemically synthesized
gtgaaacaaaagagaaaatccc

SEQ ID NO: 1269449 - DNA, 22 bp, Artificial Sequence
  chemically synthesized
gagcatattttgggattttctc

SEQ ID NO: 1269450 - DNA, 22 bp, Artificial Sequence
  chemically synthesized
agcatattttgggattttctct

SEQ ID NO: 1269451 - DNA, 22 bp, Artificial Sequence
  chemically synthesized
tgggattttctcttttgtttca

SEQ ID NO: 1269452 - DNA, 22 bp, Artificial Sequence
  chemically synthesized
gggattttctcttttgtttcac

SEQ ID NO: 1269453 - DNA, 22 bp, Artificial Sequence
  chemically synthesized
ggattttctcttttgtttcact

SEQ ID NO: 1269454 - DNA, 22 bp, Artificial Sequence
  chemically synthesized
tacaaacagattagtgaaacaa

SEQ ID NO: 1269455 - DNA, 22 bp, Artificial Sequence
  chemically synthesized
tctcttttgtttcactaatctg

SEQ ID NO: 1269456 - DNA, 22 bp, Artificial Sequence
  chemically synthesized
ctcttttgtttcactaatctgt

SEQ ID NO: 1269457 - DNA, 22 bp, Artificial Sequence
  chemically synthesized
tcttttgtttcactaatctgtt

SEQ ID NO: 1269458 - DNA, 22 bp, Artificial Sequence
  chemically synthesized
aaagtctatacaaacagattag

SEQ ID NO: 1269459 - DNA, 22 bp, Artificial Sequence
  chemically synthesized
ttttgtttcactaatctgtttg

SEQ ID NO: 1269460 - DNA, 22 bp, Artificial Sequence
  chemically synthesized
ctaaaagtctatacaaacagat

SEQ ID NO: 1269461 - DNA, 22 bp, Artificial Sequence
  chemically synthesized
ttgtttcactaatctgtttgta

SEQ ID NO: 1269462 - DNA, 22 bp, Artificial Sequence
  chemically synthesized
tgtttcactaatctgtttgtat

SEQ ID NO: 1269463 - DNA, 22 bp, Artificial Sequence
  chemically synthesized
gtttcactaatctgtttgtata

SEQ ID NO: 1269464 - DNA, 22 bp, Artificial Sequence
  chemically synthesized
tttcactaatctgtttgtatag

SEQ ID NO: 1269465 - DNA, 22 bp, Artificial Sequence
  chemically synthesized
cactaatctgtttgtatagact

SEQ ID NO: 1269466 - DNA, 22 bp, Artificial Sequence
  chemically synthesized
actaatctgtttgtatagactt

SEQ ID NO: 1269467 - DNA, 22 bp, Artificial Sequence
  chemically synthesized
atctgtttgtatagacttttag

SEQ ID NO: 1269468 - DNA, 22 bp, Artificial Sequence
  chemically synthesized
tttgtatagacttttagtagat

SEQ ID NO: 1269469 - DNA, 22 bp, Artificial Sequence
  chemically synthesized
gtatagacttttagtagatttt

SEQ ID NO: 1269470 - DNA, 22 bp, Artificial Sequence
  chemically synthesized
tatagacttttagtagattttt

SEQ ID NO: 1269471 - DNA, 22 bp, Artificial Sequence
  chemically synthesized
tataaaaaaaaaaaaaaaatct

SEQ ID NO: 1269472 - DNA, 22 bp, Artificial Sequence
  chemically synthesized
tgtataaaaaaaaaaaaaaaat

SEQ ID NO: 1269473 - DNA, 22 bp, Artificial Sequence
  chemically synthesized
ttagtagatttttttttttttt

SEQ ID NO: 1269474 - DNA, 22 bp, Artificial Sequence
  chemically synthesized
tagtagattttttttttttttt

SEQ ID NO: 1269475 - DNA, 22 bp, Artificial Sequence
  chemically synthesized
agtagatttttttttttttttt

SEQ ID NO: 1269476 - DNA, 22 bp, Artificial Sequence
  chemically synthesized
gtagatttttttttttttttta

SEQ ID NO: 1269477 - DNA, 22 bp, Artificial Sequence
  chemically synthesized
tttttttttttttatacagagt

SEQ ID NO: 1269478 - DNA, 22 bp, Artificial Sequence
  chemically synthesized
ttttttttttttatacagagtc

SEQ ID NO: 1269479 - DNA, 22 bp, Artificial Sequence
  chemically synthesized
tttttttttttatacagagtct

SEQ ID NO: 1269480 - DNA, 22 bp, Artificial Sequence
  chemically synthesized
ggcaacagagcaagactctgta

SEQ ID NO: 1269481 - DNA, 22 bp, Artificial Sequence
  chemically synthesized
ttttttttttatacagagtctt

SEQ ID NO: 1269482 - DNA, 22 bp, Artificial Sequence
  chemically synthesized
tttttttttatacagagtcttg

SEQ ID NO: 1269483 - DNA, 22 bp, Artificial Sequence
  chemically synthesized
ttttttttatacagagtcttgc

SEQ ID NO: 1269484 - DNA, 22 bp, Artificial Sequence
  chemically synthesized
tttttttatacagagtcttgct

SEQ ID NO: 1269485 - DNA, 22 bp, Artificial Sequence
  chemically synthesized
ttttttatacagagtcttgctc

SEQ ID NO: 1269486 - DNA, 22 bp, Artificial Sequence
  chemically synthesized
tttttatacagagtcttgctct

SEQ ID NO: 1269487 - DNA, 22 bp, Artificial Sequence
  chemically synthesized
ttttatacagagtcttgctctg

SEQ ID NO: 1269488 - DNA, 22 bp, Artificial Sequence
  chemically synthesized
cagcctgggcaacagagcaaga

SEQ ID NO: 1269489 - DNA, 22 bp, Artificial Sequence
  chemically synthesized
tttatacagagtcttgctctgt

SEQ ID NO: 1269490 - DNA, 22 bp, Artificial Sequence
  chemically synthesized
ttatacagagtcttgctctgtt

SEQ ID NO: 1269491 - DNA, 22 bp, Artificial Sequence
  chemically synthesized
tatacagagtcttgctctgttg

SEQ ID NO: 1269492 - DNA, 22 bp, Artificial Sequence
  chemically synthesized
atacagagtcttgctctgttgc

SEQ ID NO: 1269493 - DNA, 22 bp, Artificial Sequence
  chemically synthesized
tacagagtcttgctctgttgcc

SEQ ID NO: 1269494 - DNA, 22 bp, Artificial Sequence
  chemically synthesized
cactccagcctgggcaacagag

SEQ ID NO: 1269495 - DNA, 22 bp, Artificial Sequence
  chemically synthesized
gccactgcactccagcctgggc

SEQ ID NO: 1269496 - DNA, 22 bp, Artificial Sequence
  chemically synthesized
cgccactgcactccagcctggg

SEQ ID NO: 1269497 - DNA, 22 bp, Artificial Sequence
  chemically synthesized
gctctgttgcccaggctggagt

SEQ ID NO: 1269498 - DNA, 22 bp, Artificial Sequence
  chemically synthesized
ctctgttgcccaggctggagtg

SEQ ID NO: 1269499 - DNA, 22 bp, Artificial Sequence
  chemically synthesized
agatttcgccactgcactccag

SEQ ID NO: 1269500 - DNA, 22 bp, Artificial Sequence
  chemically synthesized
tgttgcccaggctggagtgcag

SEQ ID NO: 1269501 - DNA, 22 bp, Artificial Sequence
  chemically synthesized
ttgcccaggctggagtgcagtg

SEQ ID NO: 1269502 - DNA, 22 bp, Artificial Sequence
  chemically synthesized
cccaggctggagtgcagtggcg

SEQ ID NO: 1269503 - DNA, 22 bp, Artificial Sequence
  chemically synthesized
cagtgagctgagatttcgccac

SEQ ID NO: 1269504 - DNA, 22 bp, Artificial Sequence
  chemically synthesized
gagtgcagtggcgaaatctcag

SEQ ID NO: 1269505 - DNA, 22 bp, Artificial Sequence
  chemically synthesized
atccagggaggcagaggttgca

SEQ ID NO: 1269506 - DNA, 22 bp, Artificial Sequence
  chemically synthesized
gatccagggaggcagaggttgc

SEQ ID NO: 1269507 - DNA, 22 bp, Artificial Sequence
  chemically synthesized
agctcactgcaacctctgcctc

SEQ ID NO: 1269508 - DNA, 22 bp, Artificial Sequence
  chemically synthesized
actgcaacctctgcctccctgg

SEQ ID NO: 1269509 - DNA, 22 bp, Artificial Sequence
  chemically synthesized
caacctctgcctccctggatca

SEQ ID NO: 1269510 - DNA, 22 bp, Artificial Sequence
  chemically synthesized
cggcaggagaatcgcttgatcc

SEQ ID NO: 1269511 - DNA, 22 bp, Artificial Sequence
  chemically synthesized
tgcctccctggatcaagcgatt

SEQ ID NO: 1269512 - DNA, 22 bp, Artificial Sequence
  chemically synthesized
cctccctggatcaagcgattct

SEQ ID NO: 1269513 - DNA, 22 bp, Artificial Sequence
  chemically synthesized
cctggatcaagcgattctcctg

SEQ ID NO: 1269514 - DNA, 22 bp, Artificial Sequence
  chemically synthesized
gggaggctgcggcaggagaatc

SEQ ID NO: 1269515 - DNA, 22 bp, Artificial Sequence
  chemically synthesized
ctcgggaggctgcggcaggaga

SEQ ID NO: 1269516 - DNA, 22 bp, Artificial Sequence
  chemically synthesized
gatcaagcgattctcctgccgc

SEQ ID NO: 1269517 - DNA, 22 bp, Artificial Sequence
  chemically synthesized
taatcccagctactcgggaggc

SEQ ID NO: 1269518 - DNA, 22 bp, Artificial Sequence
  chemically synthesized
tcctgccgcagcctcccgagta

SEQ ID NO: 1269519 - DNA, 22 bp, Artificial Sequence
  chemically synthesized
ctgccgcagcctcccgagtagc

SEQ ID NO: 1269520 - DNA, 22 bp, Artificial Sequence
  chemically synthesized
ccgcagcctcccgagtagctgg

SEQ ID NO: 1269521 - DNA, 22 bp, Artificial Sequence
  chemically synthesized
ccgagtagctgggattacaggc

SEQ ID NO: 1269522 - DNA, 22 bp, Artificial Sequence
  chemically synthesized
gccgggcatgatggcaggcgcc

SEQ ID NO: 1269523 - DNA, 22 bp, Artificial Sequence
  chemically synthesized
ggattacaggcgcctgccatca

SEQ ID NO: 1269524 - DNA, 22 bp, Artificial Sequence
  chemically synthesized
caggcgcctgccatcatgcccg

SEQ ID NO: 1269525 - DNA, 22 bp, Artificial Sequence
  chemically synthesized
aaaatacaaaaattagccgggc

SEQ ID NO: 1269526 - DNA, 22 bp, Artificial Sequence
  chemically synthesized
aaaaatacaaaaattagccggg

SEQ ID NO: 1269527 - DNA, 22 bp, Artificial Sequence
  chemically synthesized
cttaaaaatacaaaaattagcc

SEQ ID NO: 1269528 - DNA, 22 bp, Artificial Sequence
  chemically synthesized
ccatcatgcccggctaattttt

SEQ ID NO: 1269529 - DNA, 22 bp, Artificial Sequence
  chemically synthesized
tacttaaaaatacaaaaattag

SEQ ID NO: 1269530 - DNA, 22 bp, Artificial Sequence
  chemically synthesized
atttttgtatttttaagtagag

SEQ ID NO: 1269531 - DNA, 22 bp, Artificial Sequence
  chemically synthesized
ttgtatttttaagtagaggctg

SEQ ID NO: 1269532 - DNA, 22 bp, Artificial Sequence
  chemically synthesized
tgtatttttaagtagaggctgg

SEQ ID NO: 1269533 - DNA, 22 bp, Artificial Sequence
  chemically synthesized
gtatttttaagtagaggctggg

SEQ ID NO: 1269534 - DNA, 22 bp, Artificial Sequence
  chemically synthesized
tatttttaagtagaggctgggt

SEQ ID NO: 1269535 - DNA, 22 bp, Artificial Sequence
  chemically synthesized
accaacatcgtgaaacccagcc

SEQ ID NO: 1269536 - DNA, 22 bp, Artificial Sequence
  chemically synthesized
ttaagtagaggctgggtttcac

SEQ ID NO: 1269537 - DNA, 22 bp, Artificial Sequence
  chemically synthesized
taagtagaggctgggtttcacg

SEQ ID NO: 1269538 - DNA, 22 bp, Artificial Sequence
  chemically synthesized
aagtagaggctgggtttcacga

SEQ ID NO: 1269539 - DNA, 22 bp, Artificial Sequence
  chemically synthesized
agtagaggctgggtttcacgat

SEQ ID NO: 1269540 - DNA, 22 bp, Artificial Sequence
  chemically synthesized
gagaccagcctaaccaacatcg

SEQ ID NO: 1269541 - DNA, 22 bp, Artificial Sequence
  chemically synthesized
ggtttcacgatgttggttaggc

SEQ ID NO: 1269542 - DNA, 22 bp, Artificial Sequence
  chemically synthesized
cacgatgttggttaggctggtc

SEQ ID NO: 1269543 - DNA, 22 bp, Artificial Sequence
  chemically synthesized
acgatgttggttaggctggtct

SEQ ID NO: 1269544 - DNA, 22 bp, Artificial Sequence
  chemically synthesized
aggtcaggagttcgagaccagc

SEQ ID NO: 1269545 - DNA, 22 bp, Artificial Sequence
  chemically synthesized
gttaggctggtctcgaactcct

SEQ ID NO: 1269546 - DNA, 22 bp, Artificial Sequence
  chemically synthesized
ggctggtctcgaactcctgacc

SEQ ID NO: 1269547 - DNA, 22 bp, Artificial Sequence
  chemically synthesized
gtctcgaactcctgacctcagg

SEQ ID NO: 1269548 - DNA, 22 bp, Artificial Sequence
  chemically synthesized
gaactcctgacctcaggtgatc

SEQ ID NO: 1269549 - DNA, 22 bp, Artificial Sequence
  chemically synthesized
cgaggccgaggcgggtggatca

SEQ ID NO: 1269550 - DNA, 22 bp, Artificial Sequence
  chemically synthesized
ctgacctcaggtgatccacccg

SEQ ID NO: 1269551 - DNA, 22 bp, Artificial Sequence
  chemically synthesized
gcgaggccgaggcgggtggatc

SEQ ID NO: 1269552 - DNA, 22 bp, Artificial Sequence
  chemically synthesized
tgcgaggccgaggcgggtggat

SEQ ID NO: 1269553 - DNA, 22 bp, Artificial Sequence
  chemically synthesized
acctcaggtgatccacccgcct

SEQ ID NO: 1269554 - DNA, 22 bp, Artificial Sequence
  chemically synthesized
aggtgatccacccgcctcggcc

SEQ ID NO: 1269555 - DNA, 22 bp, Artificial Sequence
  chemically synthesized
taatcccagcactttgcgaggc

SEQ ID NO: 1269556 - DNA, 22 bp, Artificial Sequence
  chemically synthesized
acgcctgtaatcccagcacttt

SEQ ID NO: 1269557 - DNA, 22 bp, Artificial Sequence
  chemically synthesized
ggcctcgcaaagtgctgggatt

SEQ ID NO: 1269558 - DNA, 22 bp, Artificial Sequence
  chemically synthesized
gcaaagtgctgggattacaggc

SEQ ID NO: 1269559 - DNA, 22 bp, Artificial Sequence
  chemically synthesized
ggtgcggtgtctcacgcctgta

SEQ ID NO: 1269560 - DNA, 22 bp, Artificial Sequence
  chemically synthesized
gctgggtgcggtgtctcacgcc

SEQ ID NO: 1269561 - DNA, 22 bp, Artificial Sequence
  chemically synthesized
ctggctgggtgcggtgtctcac

SEQ ID NO: 1269562 - DNA, 22 bp, Artificial Sequence
  chemically synthesized
ggattacaggcgtgagacaccg

SEQ ID NO: 1269563 - DNA, 22 bp, Artificial Sequence
  chemically synthesized
tactggctgggtgcggtgtctc

SEQ ID NO: 1269564 - DNA, 22 bp, Artificial Sequence
  chemically synthesized
ctactggctgggtgcggtgtct

SEQ ID NO: 1269565 - DNA, 22 bp, Artificial Sequence
  chemically synthesized
caggcgtgagacaccgcaccca

SEQ ID NO: 1269566 - DNA, 22 bp, Artificial Sequence
  chemically synthesized
ataaaacttctactggctgggt

SEQ ID NO: 1269567 - DNA, 22 bp, Artificial Sequence
  chemically synthesized
aataaaacttctactggctggg

SEQ ID NO: 1269568 - DNA, 22 bp, Artificial Sequence
  chemically synthesized
gagtgtttaataaaacttctac

SEQ ID NO: 1269569 - DNA, 22 bp, Artificial Sequence
  chemically synthesized
ttagagtgtttaataaaacttc

SEQ ID NO: 1269570 - DNA, 22 bp, Artificial Sequence
  chemically synthesized
cccatgtagctattagagtgtt

SEQ ID NO: 1269571 - DNA, 22 bp, Artificial Sequence
  chemically synthesized
gcccatgtagctattagagtgt

SEQ ID NO: 1269572 - DNA, 22 bp, Artificial Sequence
  chemically synthesized
tattaaacactctaatagctac

SEQ ID NO: 1269573 - DNA, 22 bp, Artificial Sequence
  chemically synthesized
attaaacactctaatagctaca

SEQ ID NO: 1269574 - DNA, 22 bp, Artificial Sequence
  chemically synthesized
ttaaacactctaatagctacat

SEQ ID NO: 1269575 - DNA, 22 bp, Artificial Sequence
  chemically synthesized
aacactctaatagctacatggg

SEQ ID NO: 1269576 - DNA, 22 bp, Artificial Sequence
  chemically synthesized
aatgaaaggtcatttgcccatg

SEQ ID NO: 1269577 - DNA, 22 bp, Artificial Sequence
  chemically synthesized
aaatgaaaggtcatttgcccat

SEQ ID NO: 1269578 - DNA, 22 bp, Artificial Sequence
  chemically synthesized
taatagctacatgggcaaatga

SEQ ID NO: 1269579 - DNA, 22 bp, Artificial Sequence
  chemically synthesized
atagctacatgggcaaatgacc

SEQ ID NO: 1269580 - DNA, 22 bp, Artificial Sequence
  chemically synthesized
aaaaccttaaatgaaaggtcat

SEQ ID NO: 1269581 - DNA, 22 bp, Artificial Sequence
  chemically synthesized
catgggcaaatgacctttcatt

SEQ ID NO: 1269582 - DNA, 22 bp, Artificial Sequence
  chemically synthesized
atagaaaatgttgaaaacctta

SEQ ID NO: 1269583 - DNA, 22 bp, Artificial Sequence
  chemically synthesized
tcatttaaggttttcaacattt

SEQ ID NO: 1269584 - DNA, 22 bp, Artificial Sequence
  chemically synthesized
catttaaggttttcaacatttt

SEQ ID NO: 1269585 - DNA, 22 bp, Artificial Sequence
  chemically synthesized
atttaaggttttcaacattttc

SEQ ID NO: 1269586 - DNA, 22 bp, Artificial Sequence
  chemically synthesized
aaggttttcaacattttctatt

SEQ ID NO: 1269587 - DNA, 22 bp, Artificial Sequence
  chemically synthesized
aggttttcaacattttctatta

SEQ ID NO: 1269588 - DNA, 22 bp, Artificial Sequence
  chemically synthesized
tcaacattttctattaatcctc

SEQ ID NO: 1269589 - DNA, 22 bp, Artificial Sequence
  chemically synthesized
caacattttctattaatcctca

SEQ ID NO: 1269590 - DNA, 22 bp, Artificial Sequence
  chemically synthesized
aacattttctattaatcctcat

SEQ ID NO: 1269591 - DNA, 22 bp, Artificial Sequence
  chemically synthesized
gcagcaatatagatgaggatta

SEQ ID NO: 1269592 - DNA, 22 bp, Artificial Sequence
  chemically synthesized
tctggcagcaatatagatgagg

SEQ ID NO: 1269593 - DNA, 22 bp, Artificial Sequence
  chemically synthesized
atctggcagcaatatagatgag

SEQ ID NO: 1269594 - DNA, 22 bp, Artificial Sequence
  chemically synthesized
tctattaatcctcatctatatt

SEQ ID NO: 1269595 - DNA, 22 bp, Artificial Sequence
  chemically synthesized
ctattaatcctcatctatattg

SEQ ID NO: 1269596 - DNA, 22 bp, Artificial Sequence
  chemically synthesized
tattaatcctcatctatattgc

SEQ ID NO: 1269597 - DNA, 22 bp, Artificial Sequence
  chemically synthesized
ttaatcctcatctatattgctg

SEQ ID NO: 1269598 - DNA, 22 bp, Artificial Sequence
  chemically synthesized
aagtttatctggcagcaatata

SEQ ID NO: 1269599 - DNA, 22 bp, Artificial Sequence
  chemically synthesized
taaagtttatctggcagcaata

SEQ ID NO: 1269600 - DNA, 22 bp, Artificial Sequence
  chemically synthesized
atcctcatctatattgctgcca

SEQ ID NO: 1269601 - DNA, 22 bp, Artificial Sequence
  chemically synthesized
ctctaaagtttatctggcagca

SEQ ID NO: 1269602 - DNA, 22 bp, Artificial Sequence
  chemically synthesized
atctatattgctgccagataaa

SEQ ID NO: 1269603 - DNA, 22 bp, Artificial Sequence
  chemically synthesized
tattgctgccagataaacttta

SEQ ID NO: 1269604 - DNA, 22 bp, Artificial Sequence
  chemically synthesized
ctgccagataaactttagagta

SEQ ID NO: 1269605 - DNA, 22 bp, Artificial Sequence
  chemically synthesized
gatgtgacaagaattactctaa

SEQ ID NO: 1269606 - DNA, 22 bp, Artificial Sequence
  chemically synthesized
ccagataaactttagagtaatt

SEQ ID NO: 1269607 - DNA, 22 bp, Artificial Sequence
  chemically synthesized
tagagtaattcttgtcacatcc

SEQ ID NO: 1269608 - DNA, 22 bp, Artificial Sequence
  chemically synthesized
agagtaattcttgtcacatcca

SEQ ID NO: 1269609 - DNA, 22 bp, Artificial Sequence
  chemically synthesized
gagtaattcttgtcacatccaa

SEQ ID NO: 1269610 - DNA, 22 bp, Artificial Sequence
  chemically synthesized
gggtggcaggaagacattggat

SEQ ID NO: 1269611 - DNA, 22 bp, Artificial Sequence
  chemically synthesized
ttgtcacatccaatgtcttcct

SEQ ID NO: 1269612 - DNA, 22 bp, Artificial Sequence
  chemically synthesized
aattggggtggcaggaagacat

SEQ ID NO: 1269613 - DNA, 22 bp, Artificial Sequence
  chemically synthesized
aaattggggtggcaggaagaca

SEQ ID NO: 1269614 - DNA, 22 bp, Artificial Sequence
  chemically synthesized
gtcacatccaatgtcttcctgc

SEQ ID NO: 1269615 - DNA, 22 bp, Artificial Sequence
  chemically synthesized
tcacatccaatgtcttcctgcc

SEQ ID NO: 1269616 - DNA, 22 bp, Artificial Sequence
  chemically synthesized
cctgccaccccaatttaaattt

SEQ ID NO: 1269617 - DNA, 22 bp, Artificial Sequence
  chemically synthesized
ctgccaccccaatttaaatttt

SEQ ID NO: 1269618 - DNA, 22 bp, Artificial Sequence
  chemically synthesized
atagaaacacataaaatttaaa

SEQ ID NO: 1269619 - DNA, 22 bp, Artificial Sequence
  chemically synthesized
ccaccccaatttaaattttatg

SEQ ID NO: 1269620 - DNA, 22 bp, Artificial Sequence
  chemically synthesized
aaatctgatagaaacacataaa

SEQ ID NO: 1269621 - DNA, 22 bp, Artificial Sequence
  chemically synthesized
agctaaaatctgatagaaacac

SEQ ID NO: 1269622 - DNA, 22 bp, Artificial Sequence
  chemically synthesized
aaattttatgtgtttctatcag

SEQ ID NO: 1269623 - DNA, 22 bp, Artificial Sequence
  chemically synthesized
aattttatgtgtttctatcaga

SEQ ID NO: 1269624 - DNA, 22 bp, Artificial Sequence
  chemically synthesized
caaattaagctaaaatctgata

SEQ ID NO: 1269625 - DNA, 22 bp, Artificial Sequence
  chemically synthesized
tatgtgtttctatcagatttta

SEQ ID NO: 1269626 - DNA, 22 bp, Artificial Sequence
  chemically synthesized
atgtgtttctatcagattttag

SEQ ID NO: 1269627 - DNA, 22 bp, Artificial Sequence
  chemically synthesized
ctacaaattaagctaaaatctg

SEQ ID NO: 1269628 - DNA, 22 bp, Artificial Sequence
  chemically synthesized
tgtgtttctatcagattttagc

SEQ ID NO: 1269629 - DNA, 22 bp, Artificial Sequence
  chemically synthesized
actacaaattaagctaaaatct

SEQ ID NO: 1269630 - DNA, 22 bp, Artificial Sequence
  chemically synthesized
ctatcagattttagcttaattt

SEQ ID NO: 1269631 - DNA, 22 bp, Artificial Sequence
  chemically synthesized
tatcagattttagcttaatttg

SEQ ID NO: 1269632 - DNA, 22 bp, Artificial Sequence
  chemically synthesized
tcagattttagcttaatttgta

SEQ ID NO: 1269633 - DNA, 22 bp, Artificial Sequence
  chemically synthesized
gacatataatttactacaaatt

SEQ ID NO: 1269634 - DNA, 22 bp, Artificial Sequence
  chemically synthesized
agacatataatttactacaaat

SEQ ID NO: 1269635 - DNA, 22 bp, Artificial Sequence
  chemically synthesized
tagacatataatttactacaaa

SEQ ID NO: 1269636 - DNA, 22 bp, Artificial Sequence
  chemically synthesized
tagcttaatttgtagtaaatta

SEQ ID NO: 1269637 - DNA, 22 bp, Artificial Sequence
  chemically synthesized
agcttaatttgtagtaaattat

SEQ ID NO: 1269638 - DNA, 22 bp, Artificial Sequence
  chemically synthesized
gcttaatttgtagtaaattata

SEQ ID NO: 1269639 - DNA, 22 bp, Artificial Sequence
  chemically synthesized
atattttagacatataatttac

SEQ ID NO: 1269640 - DNA, 22 bp, Artificial Sequence
  chemically synthesized
aatttgtagtaaattatatgtc

SEQ ID NO: 1269641 - DNA, 22 bp, Artificial Sequence
  chemically synthesized
atttgtagtaaattatatgtct

SEQ ID NO: 1269642 - DNA, 22 bp, Artificial Sequence
  chemically synthesized
gtagtaaattatatgtctaaaa

SEQ ID NO: 1269643 - DNA, 22 bp, Artificial Sequence
  chemically synthesized
tagtaaattatatgtctaaaat

SEQ ID NO: 1269644 - DNA, 22 bp, Artificial Sequence
  chemically synthesized
gtgggaatattaatattttaga

SEQ ID NO: 1269645 - DNA, 22 bp, Artificial Sequence
  chemically synthesized
ggtgggaatattaatattttag

SEQ ID NO: 1269646 - DNA, 22 bp, Artificial Sequence
  chemically synthesized
ttggtgggaatattaatatttt

SEQ ID NO: 1269647 - DNA, 22 bp, Artificial Sequence
  chemically synthesized
cttggtgggaatattaatattt

SEQ ID NO: 1269648 - DNA, 22 bp, Artificial Sequence
  chemically synthesized
tatgtctaaaatattaatattc

SEQ ID NO: 1269649 - DNA, 22 bp, Artificial Sequence
  chemically synthesized
tatttcttggtgggaatattaa

SEQ ID NO: 1269650 - DNA, 22 bp, Artificial Sequence
  chemically synthesized
atatttcttggtgggaatatta

SEQ ID NO: 1269651 - DNA, 22 bp, Artificial Sequence
  chemically synthesized
tatatttcttggtgggaatatt

SEQ ID NO: 1269652 - DNA, 22 bp, Artificial Sequence
  chemically synthesized
aaatattaatattcccaccaag

SEQ ID NO: 1269653 - DNA, 22 bp, Artificial Sequence
  chemically synthesized
atattcccaccaagaaatataa

SEQ ID NO: 1269654 - DNA, 22 bp, Artificial Sequence
  chemically synthesized
ccaccaagaaatataaaattat

SEQ ID NO: 1269655 - DNA, 22 bp, Artificial Sequence
  chemically synthesized
catccatggacagatataattt

SEQ ID NO: 1269656 - DNA, 22 bp, Artificial Sequence
  chemically synthesized
gcatccatggacagatataatt

SEQ ID NO: 1269657 - DNA, 22 bp, Artificial Sequence
  chemically synthesized
tatctgtccatggatgcaaata

SEQ ID NO: 1269658 - DNA, 22 bp, Artificial Sequence
  chemically synthesized
gaaaaataacagaatatttgca

SEQ ID NO: 1269659 - DNA, 22 bp, Artificial Sequence
  chemically synthesized
ctggaaaaataacagaatattt

SEQ ID NO: 1269660 - DNA, 22 bp, Artificial Sequence
  chemically synthesized
tccatggatgcaaatattctgt

SEQ ID NO: 1269661 - DNA, 22 bp, Artificial Sequence
  chemically synthesized
actggaaaaataacagaatatt

SEQ ID NO: 1269662 - DNA, 22 bp, Artificial Sequence
  chemically synthesized
tactggaaaaataacagaatat

SEQ ID NO: 1269663 - DNA, 22 bp, Artificial Sequence
  chemically synthesized
gtgatatacaagcctttactgg

SEQ ID NO: 1269664 - DNA, 22 bp, Artificial Sequence
  chemically synthesized
ggtgatatacaagcctttactg

SEQ ID NO: 1269665 - DNA, 22 bp, Artificial Sequence
  chemically synthesized
tgttatttttccagtaaaggct

SEQ ID NO: 1269666 - DNA, 22 bp, Artificial Sequence
  chemically synthesized
ttatttttccagtaaaggcttg

SEQ ID NO: 1269667 - DNA, 22 bp, Artificial Sequence
  chemically synthesized
tttttccagtaaaggcttgtat

SEQ ID NO: 1269668 - DNA, 22 bp, Artificial Sequence
  chemically synthesized
ttccagtaaaggcttgtatatc

SEQ ID NO: 1269669 - DNA, 22 bp, Artificial Sequence
  chemically synthesized
tccagtaaaggcttgtatatca

SEQ ID NO: 1269670 - DNA, 22 bp, Artificial Sequence
  chemically synthesized
ccagtaaaggcttgtatatcac

SEQ ID NO: 1269671 - DNA, 22 bp, Artificial Sequence
  chemically synthesized
gcatgaaatttggtgatataca

SEQ ID NO: 1269672 - DNA, 22 bp, Artificial Sequence
  chemically synthesized
cagtaaaggcttgtatatcacc

SEQ ID NO: 1269673 - DNA, 22 bp, Artificial Sequence
  chemically synthesized
agcatgaaatttggtgatatac

SEQ ID NO: 1269674 - DNA, 22 bp, Artificial Sequence
  chemically synthesized
tttagcatgaaatttggtgata

SEQ ID NO: 1269675 - DNA, 22 bp, Artificial Sequence
  chemically synthesized
atttagcatgaaatttggtgat

SEQ ID NO: 1269676 - DNA, 22 bp, Artificial Sequence
  chemically synthesized
tgaatttatttagcatgaaatt

SEQ ID NO: 1269677 - DNA, 22 bp, Artificial Sequence
  chemically synthesized
gtatatcaccaaatttcatgct

SEQ ID NO: 1269678 - DNA, 22 bp, Artificial Sequence
  chemically synthesized
tatatcaccaaatttcatgcta

SEQ ID NO: 1269679 - DNA, 22 bp, Artificial Sequence
  chemically synthesized
ctgtgaatttatttagcatgaa

SEQ ID NO: 1269680 - DNA, 22 bp, Artificial Sequence
  chemically synthesized
catgctaaataaattcacagta

SEQ ID NO: 1269681 - DNA, 22 bp, Artificial Sequence
  chemically synthesized
aaaatgtgaaattactgtgaat

SEQ ID NO: 1269682 - DNA, 22 bp, Artificial Sequence
  chemically synthesized
atgctaaataaattcacagtaa

SEQ ID NO: 1269683 - DNA, 22 bp, Artificial Sequence
  chemically synthesized
aataaattcacagtaatttcac

SEQ ID NO: 1269684 - DNA, 22 bp, Artificial Sequence
  chemically synthesized
cacagaagttcaaaatgtgaaa

SEQ ID NO: 1269685 - DNA, 22 bp, Artificial Sequence
  chemically synthesized
ccacagaagttcaaaatgtgaa

SEQ ID NO: 1269686 - DNA, 22 bp, Artificial Sequence
  chemically synthesized
tccacagaagttcaaaatgtga

SEQ ID NO: 1269687 - DNA, 22 bp, Artificial Sequence
  chemically synthesized
acagtaatttcacattttgaac

SEQ ID NO: 1269688 - DNA, 22 bp, Artificial Sequence
  chemically synthesized
tcattttccacagaagttcaaa

SEQ ID NO: 1269689 - DNA, 22 bp, Artificial Sequence
  chemically synthesized
cacattttgaacttctgtggaa

SEQ ID NO: 1269690 - DNA, 22 bp, Artificial Sequence
  chemically synthesized
acattttgaacttctgtggaaa

SEQ ID NO: 1269691 - DNA, 22 bp, Artificial Sequence
  chemically synthesized
aaaatcaaagctatcattttcc

SEQ ID NO: 1269692 - DNA, 22 bp, Artificial Sequence
  chemically synthesized
tgaacttctgtggaaaatgata

SEQ ID NO: 1269693 - DNA, 22 bp, Artificial Sequence
  chemically synthesized
gaacttctgtggaaaatgatag

SEQ ID NO: 1269694 - DNA, 22 bp, Artificial Sequence
  chemically synthesized
aacttctgtggaaaatgatagc

SEQ ID NO: 1269695 - DNA, 22 bp, Artificial Sequence
  chemically synthesized
ttgaaaatcaaagctatcattt

SEQ ID NO: 1269696 - DNA, 22 bp, Artificial Sequence
  chemically synthesized
ctgtggaaaatgatagctttga

SEQ ID NO: 1269697 - DNA, 22 bp, Artificial Sequence
  chemically synthesized
tgtggaaaatgatagctttgat

SEQ ID NO: 1269698 - DNA, 22 bp, Artificial Sequence
  chemically synthesized
tggaaaatgatagctttgattt

SEQ ID NO: 1269699 - DNA, 22 bp, Artificial Sequence
  chemically synthesized
acaacctattgaaaatcaaagc

SEQ ID NO: 1269700 - DNA, 22 bp, Artificial Sequence
  chemically synthesized
aacaacctattgaaaatcaaag

SEQ ID NO: 1269701 - DNA, 22 bp, Artificial Sequence
  chemically synthesized
taacaacctattgaaaatcaaa

SEQ ID NO: 1269702 - DNA, 22 bp, Artificial Sequence
  chemically synthesized
ttaacaacctattgaaaatcaa

SEQ ID NO: 1269703 - DNA, 22 bp, Artificial Sequence
  chemically synthesized
ttttaacaacctattgaaaatc

SEQ ID NO: 1269704 - DNA, 22 bp, Artificial Sequence
  chemically synthesized
tcttttaacaacctattgaaaa

SEQ ID NO: 1269705 - DNA, 22 bp, Artificial Sequence
  chemically synthesized
ctcttttaacaacctattgaaa

SEQ ID NO: 1269706 - DNA, 22 bp, Artificial Sequence
  chemically synthesized
atttctcttttaacaacctatt

SEQ ID NO: 1269707 - DNA, 22 bp, Artificial Sequence
  chemically synthesized
tgattttcaataggttgttaaa

SEQ ID NO: 1269708 - DNA, 22 bp, Artificial Sequence
  chemically synthesized
gattttcaataggttgttaaaa

SEQ ID NO: 1269709 - DNA, 22 bp, Artificial Sequence
  chemically synthesized
attttcaataggttgttaaaag

SEQ ID NO: 1269710 - DNA, 22 bp, Artificial Sequence
  chemically synthesized
aatgctaatttctcttttaaca

SEQ ID NO: 1269711 - DNA, 22 bp, Artificial Sequence
  chemically synthesized
taaatgctaatttctcttttaa

SEQ ID NO: 1269712 - DNA, 22 bp, Artificial Sequence
  chemically synthesized
tcaataggttgttaaaagagaa

SEQ ID NO: 1269713 - DNA, 22 bp, Artificial Sequence
  chemically synthesized
ctaaatgctaatttctctttta

SEQ ID NO: 1269714 - DNA, 22 bp, Artificial Sequence
  chemically synthesized
caataggttgttaaaagagaaa

SEQ ID NO: 1269715 - DNA, 22 bp, Artificial Sequence
  chemically synthesized
tctaaatgctaatttctctttt

SEQ ID NO: 1269716 - DNA, 22 bp, Artificial Sequence
  chemically synthesized
aataggttgttaaaagagaaat

SEQ ID NO: 1269717 - DNA, 22 bp, Artificial Sequence
  chemically synthesized
ttctaaatgctaatttctcttt

SEQ ID NO: 1269718 - DNA, 22 bp, Artificial Sequence
  chemically synthesized
ttaaaagagaaattagcattta

SEQ ID NO: 1269719 - DNA, 22 bp, Artificial Sequence
  chemically synthesized
aatgtaatttttctaaatgcta

SEQ ID NO: 1269720 - DNA, 22 bp, Artificial Sequence
  chemically synthesized
aaagagaaattagcatttagaa

SEQ ID NO: 1269721 - DNA, 22 bp, Artificial Sequence
  chemically synthesized
attaaatgtaatttttctaaat

SEQ ID NO: 1269722 - DNA, 22 bp, Artificial Sequence
  chemically synthesized
aatattaattaaatgtaatttt

SEQ ID NO: 1269723 - DNA, 22 bp, Artificial Sequence
  chemically synthesized
gcatttagaaaaattacattta

SEQ ID NO: 1269724 - DNA, 22 bp, Artificial Sequence
  chemically synthesized
agaaaaattacatttaattaat

SEQ ID NO: 1269725 - DNA, 22 bp, Artificial Sequence
  chemically synthesized
gaaaaattacatttaattaata

SEQ ID NO: 1269726 - DNA, 22 bp, Artificial Sequence
  chemically synthesized
gaaataattaaatattaattaa

SEQ ID NO: 1269727 - DNA, 22 bp, Artificial Sequence
  chemically synthesized
catttaattaatatttaattat

SEQ ID NO: 1269728 - DNA, 22 bp, Artificial Sequence
  chemically synthesized
aattaatatttaattatttcta

SEQ ID NO: 1269729 - DNA, 22 bp, Artificial Sequence
  chemically synthesized
attaatatttaattatttctag

SEQ ID NO: 1269730 - DNA, 22 bp, Artificial Sequence
  chemically synthesized
agaaaagaaaaaacctagaaat

SEQ ID NO: 1269731 - DNA, 22 bp, Artificial Sequence
  chemically synthesized
atatttaattatttctaggttt

SEQ ID NO: 1269732 - DNA, 22 bp, Artificial Sequence
  chemically synthesized
attaagaaaagaaaaaacctag

SEQ ID NO: 1269733 - DNA, 22 bp, Artificial Sequence
  chemically synthesized
aattatttctaggttttttctt

SEQ ID NO: 1269734 - DNA, 22 bp, Artificial Sequence
  chemically synthesized
attatttctaggttttttcttt

SEQ ID NO: 1269735 - DNA, 22 bp, Artificial Sequence
  chemically synthesized
tttctaggttttttcttttctt

SEQ ID NO: 1269736 - DNA, 22 bp, Artificial Sequence
  chemically synthesized
ctaggttttttcttttcttaat

SEQ ID NO: 1269737 - DNA, 22 bp, Artificial Sequence
  chemically synthesized
gtcccaaagctcattaagaaaa

SEQ ID NO: 1269738 - DNA, 22 bp, Artificial Sequence
  chemically synthesized
taggttttttcttttcttaatg

SEQ ID NO: 1269739 - DNA, 22 bp, Artificial Sequence
  chemically synthesized
ggttttttcttttcttaatgag

SEQ ID NO: 1269740 - DNA, 22 bp, Artificial Sequence
  chemically synthesized
tttcttttcttaatgagctttg

SEQ ID NO: 1269741 - DNA, 22 bp, Artificial Sequence
  chemically synthesized
ttcttttcttaatgagctttgg

SEQ ID NO: 1269742 - DNA, 22 bp, Artificial Sequence
  chemically synthesized
tcttttcttaatgagctttggg

SEQ ID NO: 1269743 - DNA, 22 bp, Artificial Sequence
  chemically synthesized
cttttcttaatgagctttggga

SEQ ID NO: 1269744 - DNA, 22 bp, Artificial Sequence
  chemically synthesized
ttttcttaatgagctttgggac

SEQ ID NO: 1269745 - DNA, 22 bp, Artificial Sequence
  chemically synthesized
atgggaaaaattagtcccaaag

SEQ ID NO: 1269746 - DNA, 22 bp, Artificial Sequence
  chemically synthesized
ttcttaatgagctttgggacta

SEQ ID NO: 1269747 - DNA, 22 bp, Artificial Sequence
  chemically synthesized
tcttaatgagctttgggactaa

SEQ ID NO: 1269748 - DNA, 22 bp, Artificial Sequence
  chemically synthesized
cttaatgagctttgggactaat

SEQ ID NO: 1269749 - DNA, 22 bp, Artificial Sequence
  chemically synthesized
ttaatgagctttgggactaatt

SEQ ID NO: 1269750 - DNA, 22 bp, Artificial Sequence
  chemically synthesized
aatgagctttgggactaatttt

SEQ ID NO: 1269751 - DNA, 22 bp, Artificial Sequence
  chemically synthesized
taactaatgggaaaaattagtc

SEQ ID NO: 1269752 - DNA, 22 bp, Artificial Sequence
  chemically synthesized
atgagctttgggactaattttt

SEQ ID NO: 1269753 - DNA, 22 bp, Artificial Sequence
  chemically synthesized
ttataactaatgggaaaaatta

SEQ ID NO: 1269754 - DNA, 22 bp, Artificial Sequence
  chemically synthesized
tgggactaatttttcccattag

SEQ ID NO: 1269755 - DNA, 22 bp, Artificial Sequence
  chemically synthesized
gggactaatttttcccattagt

SEQ ID NO: 1269756 - DNA, 22 bp, Artificial Sequence
  chemically synthesized
ggactaatttttcccattagtt

SEQ ID NO: 1269757 - DNA, 22 bp, Artificial Sequence
  chemically synthesized
atttttcccattagttataata

SEQ ID NO: 1269758 - DNA, 22 bp, Artificial Sequence
  chemically synthesized
ttcccattagttataatagttg

SEQ ID NO: 1269759 - DNA, 22 bp, Artificial Sequence
  chemically synthesized
tcccattagttataatagttgt

SEQ ID NO: 1269760 - DNA, 22 bp, Artificial Sequence
  chemically synthesized
cccattagttataatagttgtc

SEQ ID NO: 1269761 - DNA, 22 bp, Artificial Sequence
  chemically synthesized
ccattagttataatagttgtca

SEQ ID NO: 1269762 - DNA, 22 bp, Artificial Sequence
  chemically synthesized
agtaaatcaacaatgacaacta

SEQ ID NO: 1269763 - DNA, 22 bp, Artificial Sequence
  chemically synthesized
gttataatagttgtcattgttg

SEQ ID NO: 1269764 - DNA, 22 bp, Artificial Sequence
  chemically synthesized
gtactaagtaaatcaacaatga

SEQ ID NO: 1269765 - DNA, 22 bp, Artificial Sequence
  chemically synthesized
ggtactaagtaaatcaacaatg

SEQ ID NO: 1269766 - DNA, 22 bp, Artificial Sequence
  chemically synthesized
taatagttgtcattgttgattt

SEQ ID NO: 1269767 - DNA, 22 bp, Artificial Sequence
  chemically synthesized
tcaacttggtactaagtaaatc

SEQ ID NO: 1269768 - DNA, 22 bp, Artificial Sequence
  chemically synthesized
tcattgttgatttacttagtac

SEQ ID NO: 1269769 - DNA, 22 bp, Artificial Sequence
  chemically synthesized
ttgatttacttagtaccaagtt

SEQ ID NO: 1269770 - DNA, 22 bp, Artificial Sequence
  chemically synthesized
atttacttagtaccaagttgac

SEQ ID NO: 1269771 - DNA, 22 bp, Artificial Sequence
  chemically synthesized
atagatgatattgtcaacttgg

SEQ ID NO: 1269772 - DNA, 22 bp, Artificial Sequence
  chemically synthesized
acttagtaccaagttgacaata

SEQ ID NO: 1269773 - DNA, 22 bp, Artificial Sequence
  chemically synthesized
cttagtaccaagttgacaatat

SEQ ID NO: 1269774 - DNA, 22 bp, Artificial Sequence
  chemically synthesized
atattaatagatgatattgtca

SEQ ID NO: 1269775 - DNA, 22 bp, Artificial Sequence
  chemically synthesized
agtaccaagttgacaatatcat

SEQ ID NO: 1269776 - DNA, 22 bp, Artificial Sequence
  chemically synthesized
gtaccaagttgacaatatcatc

SEQ ID NO: 1269777 - DNA, 22 bp, Artificial Sequence
  chemically synthesized
ttcatattaatagatgatattg

SEQ ID NO: 1269778 - DNA, 22 bp, Artificial Sequence
  chemically synthesized
acaatatcatctattaatatga

SEQ ID NO: 1269779 - DNA, 22 bp, Artificial Sequence
  chemically synthesized
gggaaaaaagtcaaattattca

SEQ ID NO: 1269780 - DNA, 22 bp, Artificial Sequence
  chemically synthesized
ttaatatgaataatttgacttt

SEQ ID NO: 1269781 - DNA, 22 bp, Artificial Sequence
  chemically synthesized
atatgaataatttgactttttt

SEQ ID NO: 1269782 - DNA, 22 bp, Artificial Sequence
  chemically synthesized
gacttttttccccaatacttat

SEQ ID NO: 1269783 - DNA, 22 bp, Artificial Sequence
  chemically synthesized
acttttttccccaatacttata

SEQ ID NO: 1269784 - DNA, 22 bp, Artificial Sequence
  chemically synthesized
ttttccccaatacttatacttc

SEQ ID NO: 1269785 - DNA, 22 bp, Artificial Sequence
  chemically synthesized
tttccccaatacttatacttcc

SEQ ID NO: 1269786 - DNA, 22 bp, Artificial Sequence
  chemically synthesized
ttccccaatacttatacttcct

SEQ ID NO: 1269787 - DNA, 22 bp, Artificial Sequence
  chemically synthesized
tccccaatacttatacttcctg

SEQ ID NO: 1269788 - DNA, 22 bp, Artificial Sequence
  chemically synthesized
ccccaatacttatacttcctgt

SEQ ID NO: 1269789 - DNA, 22 bp, Artificial Sequence
  chemically synthesized
cccaatacttatacttcctgtt

SEQ ID NO: 1269790 - DNA, 22 bp, Artificial Sequence
  chemically synthesized
atacttcctgtttcttttactt

SEQ ID NO: 1269791 - DNA, 22 bp, Artificial Sequence
  chemically synthesized
tacttcctgtttcttttacttg

SEQ ID NO: 1269792 - DNA, 22 bp, Artificial Sequence
  chemically synthesized
gtcagtgaaagaagccaagtaa

SEQ ID NO: 1269793 - DNA, 22 bp, Artificial Sequence
  chemically synthesized
cctgtttcttttacttggcttc

SEQ ID NO: 1269794 - DNA, 22 bp, Artificial Sequence
  chemically synthesized
tagtcagtgaaagaagccaagt

SEQ ID NO: 1269795 - DNA, 22 bp, Artificial Sequence
  chemically synthesized
ctgtttcttttacttggcttct

SEQ ID NO: 1269796 - DNA, 22 bp, Artificial Sequence
  chemically synthesized
tttcttttacttggcttctttc

SEQ ID NO: 1269797 - DNA, 22 bp, Artificial Sequence
  chemically synthesized
cttttacttggcttctttcact

SEQ ID NO: 1269798 - DNA, 22 bp, Artificial Sequence
  chemically synthesized
catattctagtcagtgaaagaa

SEQ ID NO: 1269799 - DNA, 22 bp, Artificial Sequence
  chemically synthesized
ttttacttggcttctttcactg

SEQ ID NO: 1269800 - DNA, 22 bp, Artificial Sequence
  chemically synthesized
gcatattctagtcagtgaaaga

SEQ ID NO: 1269801 - DNA, 22 bp, Artificial Sequence
  chemically synthesized
tgcatattctagtcagtgaaag

SEQ ID NO: 1269802 - DNA, 22 bp, Artificial Sequence
  chemically synthesized
ttacttggcttctttcactgac

SEQ ID NO: 1269803 - DNA, 22 bp, Artificial Sequence
  chemically synthesized
tacttggcttctttcactgact

SEQ ID NO: 1269804 - DNA, 22 bp, Artificial Sequence
  chemically synthesized
acttggcttctttcactgacta

SEQ ID NO: 1269805 - DNA, 22 bp, Artificial Sequence
  chemically synthesized
ttttgcatattctagtcagtga

SEQ ID NO: 1269806 - DNA, 22 bp, Artificial Sequence
  chemically synthesized
cttggcttctttcactgactag

SEQ ID NO: 1269807 - DNA, 22 bp, Artificial Sequence
  chemically synthesized
ggcttctttcactgactagaat

SEQ ID NO: 1269808 - DNA, 22 bp, Artificial Sequence
  chemically synthesized
gcttctttcactgactagaata

SEQ ID NO: 1269809 - DNA, 22 bp, Artificial Sequence
  chemically synthesized
aatgctattttgcatattctag

SEQ ID NO: 1269810 - DNA, 22 bp, Artificial Sequence
  chemically synthesized
aaatgctattttgcatattcta

SEQ ID NO: 1269811 - DNA, 22 bp, Artificial Sequence
  chemically synthesized
ctttcactgactagaatatgca

SEQ ID NO: 1269812 - DNA, 22 bp, Artificial Sequence
  chemically synthesized
taaatgctattttgcatattct

SEQ ID NO: 1269813 - DNA, 22 bp, Artificial Sequence
  chemically synthesized
tttcactgactagaatatgcaa

SEQ ID NO: 1269814 - DNA, 22 bp, Artificial Sequence
  chemically synthesized
ttaaatgctattttgcatattc

SEQ ID NO: 1269815 - DNA, 22 bp, Artificial Sequence
  chemically synthesized
tttaaatgctattttgcatatt

SEQ ID NO: 1269816 - DNA, 22 bp, Artificial Sequence
  chemically synthesized
tcactgactagaatatgcaaaa

SEQ ID NO: 1269817 - DNA, 22 bp, Artificial Sequence
  chemically synthesized
cactgactagaatatgcaaaat

SEQ ID NO: 1269818 - DNA, 22 bp, Artificial Sequence
  chemically synthesized
tttttaaatgctattttgcata

SEQ ID NO: 1269819 - DNA, 22 bp, Artificial Sequence
  chemically synthesized
actgactagaatatgcaaaata

SEQ ID NO: 1269820 - DNA, 22 bp, Artificial Sequence
  chemically synthesized
ctctttttaaatgctattttgc

SEQ ID NO: 1269821 - DNA, 22 bp, Artificial Sequence
  chemically synthesized
actagaatatgcaaaatagcat

SEQ ID NO: 1269822 - DNA, 22 bp, Artificial Sequence
  chemically synthesized
gaatatgcaaaatagcatttaa

SEQ ID NO: 1269823 - DNA, 22 bp, Artificial Sequence
  chemically synthesized
ccaaaactgctctttttaaatg

SEQ ID NO: 1269824 - DNA, 22 bp, Artificial Sequence
  chemically synthesized
gaatgactaccaaaactgctct

SEQ ID NO: 1269825 - DNA, 22 bp, Artificial Sequence
  chemically synthesized
aaaaagagcagttttggtagtc

SEQ ID NO: 1269826 - DNA, 22 bp, Artificial Sequence
  chemically synthesized
aaaagagcagttttggtagtca

SEQ ID NO: 1269827 - DNA, 22 bp, Artificial Sequence
  chemically synthesized
gaaatataactagaatgactac

SEQ ID NO: 1269828 - DNA, 22 bp, Artificial Sequence
  chemically synthesized
aaattagaaatataactagaat

SEQ ID NO: 1269829 - DNA, 22 bp, Artificial Sequence
  chemically synthesized
tggtagtcattctagttatatt

SEQ ID NO: 1269830 - DNA, 22 bp, Artificial Sequence
  chemically synthesized
attaaaattagaaatataacta

SEQ ID NO: 1269831 - DNA, 22 bp, Artificial Sequence
  chemically synthesized
ggtagtcattctagttatattt

SEQ ID NO: 1269832 - DNA, 22 bp, Artificial Sequence
  chemically synthesized
gtagtcattctagttatatttc

SEQ ID NO: 1269833 - DNA, 22 bp, Artificial Sequence
  chemically synthesized
aaggtatcctcattaaaattag

SEQ ID NO: 1269834 - DNA, 22 bp, Artificial Sequence
  chemically synthesized
tagttatatttctaattttaat

SEQ ID NO: 1269835 - DNA, 22 bp, Artificial Sequence
  chemically synthesized
gttatatttctaattttaatga

SEQ ID NO: 1269836 - DNA, 22 bp, Artificial Sequence
  chemically synthesized
tatttctaattttaatgaggat

SEQ ID NO: 1269837 - DNA, 22 bp, Artificial Sequence
  chemically synthesized
aaatattgaaggtatcctcatt

SEQ ID NO: 1269838 - DNA, 22 bp, Artificial Sequence
  chemically synthesized
ctaattttaatgaggatacctt

SEQ ID NO: 1269839 - DNA, 22 bp, Artificial Sequence
  chemically synthesized
taattttaatgaggataccttc

SEQ ID NO: 1269840 - DNA, 22 bp, Artificial Sequence
  chemically synthesized
attttaatgaggataccttcaa

SEQ ID NO: 1269841 - DNA, 22 bp, Artificial Sequence
  chemically synthesized
taatgaggataccttcaatatt

SEQ ID NO: 1269842 - DNA, 22 bp, Artificial Sequence
  chemically synthesized
aatgaggataccttcaatattt

SEQ ID NO: 1269843 - DNA, 22 bp, Artificial Sequence
  chemically synthesized
tgatcaatgttgaaatattgaa

SEQ ID NO: 1269844 - DNA, 22 bp, Artificial Sequence
  chemically synthesized
atgaggataccttcaatatttc

SEQ ID NO: 1269845 - DNA, 22 bp, Artificial Sequence
  chemically synthesized
tgtgatcaatgttgaaatattg

SEQ ID NO: 1269846 - DNA, 22 bp, Artificial Sequence
  chemically synthesized
caatatttcaacattgatcaca

SEQ ID NO: 1269847 - DNA, 22 bp, Artificial Sequence
  chemically synthesized
aatatttcaacattgatcacag

SEQ ID NO: 1269848 - DNA, 22 bp, Artificial Sequence
  chemically synthesized
aaaacaagagccaactctgtga

SEQ ID NO: 1269849 - DNA, 22 bp, Artificial Sequence
  chemically synthesized
caacattgatcacagagttggc

SEQ ID NO: 1269850 - DNA, 22 bp, Artificial Sequence
  chemically synthesized
aacattgatcacagagttggct

SEQ ID NO: 1269851 - DNA, 22 bp, Artificial Sequence
  chemically synthesized
tctcaaaacaagagccaactct

SEQ ID NO: 1269852 - DNA, 22 bp, Artificial Sequence
  chemically synthesized
tctatctcaaaacaagagccaa

SEQ ID NO: 1269853 - DNA, 22 bp, Artificial Sequence
  chemically synthesized
atcacagagttggctcttgttt

SEQ ID NO: 1269854 - DNA, 22 bp, Artificial Sequence
  chemically synthesized
gctcttgttttgagatagacaa

SEQ ID NO: 1269855 - DNA, 22 bp, Artificial Sequence
  chemically synthesized
taagcatgaaaaatattgtcta

SEQ ID NO: 1269856 - DNA, 22 bp, Artificial Sequence
  chemically synthesized
ttgttttgagatagacaatatt

SEQ ID NO: 1269857 - DNA, 22 bp, Artificial Sequence
  chemically synthesized
ataagcatgaaaaatattgtct

SEQ ID NO: 1269858 - DNA, 22 bp, Artificial Sequence
  chemically synthesized
gttttgagatagacaatatttt

SEQ ID NO: 1269859 - DNA, 22 bp, Artificial Sequence
  chemically synthesized
ttttgagatagacaatattttt

SEQ ID NO: 1269860 - DNA, 22 bp, Artificial Sequence
  chemically synthesized
tgagatagacaatatttttcat

SEQ ID NO: 1269861 - DNA, 22 bp, Artificial Sequence
  chemically synthesized
gagatagacaatatttttcatg

SEQ ID NO: 1269862 - DNA, 22 bp, Artificial Sequence
  chemically synthesized
agatagacaatatttttcatgc

SEQ ID NO: 1269863 - DNA, 22 bp, Artificial Sequence
  chemically synthesized
ttcatgcttataaactatcatc

SEQ ID NO: 1269864 - DNA, 22 bp, Artificial Sequence
  chemically synthesized
tcatgcttataaactatcatct

SEQ ID NO: 1269865 - DNA, 22 bp, Artificial Sequence
  chemically synthesized
catgcttataaactatcatcta

SEQ ID NO: 1269866 - DNA, 22 bp, Artificial Sequence
  chemically synthesized
gcaatgtaagaatagatgatag

SEQ ID NO: 1269867 - DNA, 22 bp, Artificial Sequence
  chemically synthesized
atgcttataaactatcatctat

SEQ ID NO: 1269868 - DNA, 22 bp, Artificial Sequence
  chemically synthesized
agcaatgtaagaatagatgata

SEQ ID NO: 1269869 - DNA, 22 bp, Artificial Sequence
  chemically synthesized
tagcaatgtaagaatagatgat

SEQ ID NO: 1269870 - DNA, 22 bp, Artificial Sequence
  chemically synthesized
ttagcaatgtaagaatagatga

SEQ ID NO: 1269871 - DNA, 22 bp, Artificial Sequence
  chemically synthesized
ataaactatcatctattcttac

SEQ ID NO: 1269872 - DNA, 22 bp, Artificial Sequence
  chemically synthesized
taaactatcatctattcttaca

SEQ ID NO: 1269873 - DNA, 22 bp, Artificial Sequence
  chemically synthesized
tcatctattcttacattgctaa

SEQ ID NO: 1269874 - DNA, 22 bp, Artificial Sequence
  chemically synthesized
ggagtagaaacaaaacttttag

SEQ ID NO: 1269875 - DNA, 22 bp, Artificial Sequence
  chemically synthesized
ttcttacattgctaaaagtttt

SEQ ID NO: 1269876 - DNA, 22 bp, Artificial Sequence
  chemically synthesized
aggagtagaaacaaaactttta

SEQ ID NO: 1269877 - DNA, 22 bp, Artificial Sequence
  chemically synthesized
ttacattgctaaaagttttgtt

SEQ ID NO: 1269878 - DNA, 22 bp, Artificial Sequence
  chemically synthesized
atttaggagtagaaacaaaact

SEQ ID NO: 1269879 - DNA, 22 bp, Artificial Sequence
  chemically synthesized
acattgctaaaagttttgtttc

SEQ ID NO: 1269880 - DNA, 22 bp, Artificial Sequence
  chemically synthesized
cattgctaaaagttttgtttct

SEQ ID NO: 1269881 - DNA, 22 bp, Artificial Sequence
  chemically synthesized
tccctaatttaggagtagaaac

SEQ ID NO: 1269882 - DNA, 22 bp, Artificial Sequence
  chemically synthesized
ctaaaagttttgtttctactcc

SEQ ID NO: 1269883 - DNA, 22 bp, Artificial Sequence
  chemically synthesized
aaagttttgtttctactcctaa

SEQ ID NO: 1269884 - DNA, 22 bp, Artificial Sequence
  chemically synthesized
tgtttctactcctaaattaggg

SEQ ID NO: 1269885 - DNA, 22 bp, Artificial Sequence
  chemically synthesized
gtttctactcctaaattaggga

SEQ ID NO: 1269886 - DNA, 22 bp, Artificial Sequence
  chemically synthesized
tttctactcctaaattagggac

SEQ ID NO: 1269887 - DNA, 22 bp, Artificial Sequence
  chemically synthesized
ctactcctaaattagggacaga

SEQ ID NO: 1269888 - DNA, 22 bp, Artificial Sequence
  chemically synthesized
tactcctaaattagggacagat

SEQ ID NO: 1269889 - DNA, 22 bp, Artificial Sequence
  chemically synthesized
ataaatgaaaagaatctgtccc

SEQ ID NO: 1269890 - DNA, 22 bp, Artificial Sequence
  chemically synthesized
ctcctaaattagggacagattc

SEQ ID NO: 1269891 - DNA, 22 bp, Artificial Sequence
  chemically synthesized
ctaaattagggacagattcttt

SEQ ID NO: 1269892 - DNA, 22 bp, Artificial Sequence
  chemically synthesized
aattagggacagattcttttca

SEQ ID NO: 1269893 - DNA, 22 bp, Artificial Sequence
  chemically synthesized
gggacagattcttttcatttat

SEQ ID NO: 1269894 - DNA, 22 bp, Artificial Sequence
  chemically synthesized
tgaaaaagtattgataaatgaa

SEQ ID NO: 1269895 - DNA, 22 bp, Artificial Sequence
  chemically synthesized
gttatgaaaaagtattgataaa

SEQ ID NO: 1269896 - DNA, 22 bp, Artificial Sequence
  chemically synthesized
agttatgaaaaagtattgataa

SEQ ID NO: 1269897 - DNA, 22 bp, Artificial Sequence
  chemically synthesized
tagttatgaaaaagtattgata

SEQ ID NO: 1269898 - DNA, 22 bp, Artificial Sequence
  chemically synthesized
ttagttatgaaaaagtattgat

SEQ ID NO: 1269899 - DNA, 22 bp, Artificial Sequence
  chemically synthesized
tttagttatgaaaaagtattga

SEQ ID NO: 1269900 - DNA, 22 bp, Artificial Sequence
  chemically synthesized
ttttcatttatcaatacttttt

SEQ ID NO: 1269901 - DNA, 22 bp, Artificial Sequence
  chemically synthesized
ttcatttatcaatactttttca

SEQ ID NO: 1269902 - DNA, 22 bp, Artificial Sequence
  chemically synthesized
tcatttatcaatactttttcat

SEQ ID NO: 1269903 - DNA, 22 bp, Artificial Sequence
  chemically synthesized
catttatcaatactttttcata

SEQ ID NO: 1269904 - DNA, 22 bp, Artificial Sequence
  chemically synthesized
atttatcaatactttttcataa

SEQ ID NO: 1269905 - DNA, 22 bp, Artificial Sequence
  chemically synthesized
atcaatactttttcataactaa

SEQ ID NO: 1269906 - DNA, 22 bp, Artificial Sequence
  chemically synthesized
tcaatactttttcataactaaa

SEQ ID NO: 1269907 - DNA, 22 bp, Artificial Sequence
  chemically synthesized
tttcataactaaaaagtattgt

SEQ ID NO: 1269908 - DNA, 22 bp, Artificial Sequence
  chemically synthesized
ttcataactaaaaagtattgta

SEQ ID NO: 1269909 - DNA, 22 bp, Artificial Sequence
  chemically synthesized
tcataactaaaaagtattgtat

SEQ ID NO: 1269910 - DNA, 22 bp, Artificial Sequence
  chemically synthesized
cataactaaaaagtattgtata

SEQ ID NO: 1269911 - DNA, 22 bp, Artificial Sequence
  chemically synthesized
ataactaaaaagtattgtatat

SEQ ID NO: 1269912 - DNA, 22 bp, Artificial Sequence
  chemically synthesized
aaaagtattgtatattttttcc

SEQ ID NO: 1269913 - DNA, 22 bp, Artificial Sequence
  chemically synthesized
taggtaaagatcagaaggaaaa

SEQ ID NO: 1269914 - DNA, 22 bp, Artificial Sequence
  chemically synthesized
attgtaggtaaagatcagaagg

SEQ ID NO: 1269915 - DNA, 22 bp, Artificial Sequence
  chemically synthesized
cattgtaggtaaagatcagaag

SEQ ID NO: 1269916 - DNA, 22 bp, Artificial Sequence
  chemically synthesized
tatattttttccttctgatctt

SEQ ID NO: 1269917 - DNA, 22 bp, Artificial Sequence
  chemically synthesized
catccttcattgtaggtaaaga

SEQ ID NO: 1269918 - DNA, 22 bp, Artificial Sequence
  chemically synthesized
tttccttctgatctttacctac

SEQ ID NO: 1269919 - DNA, 22 bp, Artificial Sequence
  chemically synthesized
acatccttcattgtaggtaaag

SEQ ID NO: 1269920 - DNA, 22 bp, Artificial Sequence
  chemically synthesized
ttccttctgatctttacctaca

SEQ ID NO: 1269921 - DNA, 22 bp, Artificial Sequence
  chemically synthesized
tccttctgatctttacctacaa

SEQ ID NO: 1269922 - DNA, 22 bp, Artificial Sequence
  chemically synthesized
ccttctgatctttacctacaat

SEQ ID NO: 1269923 - DNA, 22 bp, Artificial Sequence
  chemically synthesized
tttacatccttcattgtaggta

SEQ ID NO: 1269924 - DNA, 22 bp, Artificial Sequence
  chemically synthesized
cttctgatctttacctacaatg

SEQ ID NO: 1269925 - DNA, 22 bp, Artificial Sequence
  chemically synthesized
ctgatctttacctacaatgaag

SEQ ID NO: 1269926 - DNA, 22 bp, Artificial Sequence
  chemically synthesized
tgatctttacctacaatgaagg

SEQ ID NO: 1269927 - DNA, 22 bp, Artificial Sequence
  chemically synthesized
atctttacctacaatgaaggat

SEQ ID NO: 1269928 - DNA, 22 bp, Artificial Sequence
  chemically synthesized
tacctacaatgaaggatgtaaa

SEQ ID NO: 1269929 - DNA, 22 bp, Artificial Sequence
  chemically synthesized
taagagaatctatttacatcct

SEQ ID NO: 1269930 - DNA, 22 bp, Artificial Sequence
  chemically synthesized
acctacaatgaaggatgtaaat

SEQ ID NO: 1269931 - DNA, 22 bp, Artificial Sequence
  chemically synthesized
cctacaatgaaggatgtaaata

SEQ ID NO: 1269932 - DNA, 22 bp, Artificial Sequence
  chemically synthesized
ctataagagaatctatttacat

SEQ ID NO: 1269933 - DNA, 22 bp, Artificial Sequence
  chemically synthesized
caatgaaggatgtaaatagatt

SEQ ID NO: 1269934 - DNA, 22 bp, Artificial Sequence
  chemically synthesized
aggaaaacatatatgcctacta

SEQ ID NO: 1269935 - DNA, 22 bp, Artificial Sequence
  chemically synthesized
caggaaaacatatatgcctact

SEQ ID NO: 1269936 - DNA, 22 bp, Artificial Sequence
  chemically synthesized
tttcaggaaaacatatatgcct

SEQ ID NO: 1269937 - DNA, 22 bp, Artificial Sequence
  chemically synthesized
atttcaggaaaacatatatgcc

SEQ ID NO: 1269938 - DNA, 22 bp, Artificial Sequence
  chemically synthesized
tcttatagtaggcatatatgtt

SEQ ID NO: 1269939 - DNA, 22 bp, Artificial Sequence
  chemically synthesized
ttatagtaggcatatatgtttt

SEQ ID NO: 1269940 - DNA, 22 bp, Artificial Sequence
  chemically synthesized
gatttatttcaggaaaacatat

SEQ ID NO: 1269941 - DNA, 22 bp, Artificial Sequence
  chemically synthesized
atagtaggcatatatgttttcc

SEQ ID NO: 1269942 - DNA, 22 bp, Artificial Sequence
  chemically synthesized
tagtaggcatatatgttttcct

SEQ ID NO: 1269943 - DNA, 22 bp, Artificial Sequence
  chemically synthesized
tcatgccaaattggatttattt

SEQ ID NO: 1269944 - DNA, 22 bp, Artificial Sequence
  chemically synthesized
tcctgaaataaatccaatttgg

SEQ ID NO: 1269945 - DNA, 22 bp, Artificial Sequence
  chemically synthesized
cctgaaataaatccaatttggc

SEQ ID NO: 1269946 - DNA, 22 bp, Artificial Sequence
  chemically synthesized
ctgaaataaatccaatttggca

SEQ ID NO: 1269947 - DNA, 22 bp, Artificial Sequence
  chemically synthesized
aaataaatccaatttggcatga

SEQ ID NO: 1269948 - DNA, 22 bp, Artificial Sequence
  chemically synthesized
gccaataagagaagaagttatc

SEQ ID NO: 1269949 - DNA, 22 bp, Artificial Sequence
  chemically synthesized
agccaataagagaagaagttat

SEQ ID NO: 1269950 - DNA, 22 bp, Artificial Sequence
  chemically synthesized
ggcatgataacttcttctctta

SEQ ID NO: 1269951 - DNA, 22 bp, Artificial Sequence
  chemically synthesized
gcatgataacttcttctcttat

SEQ ID NO: 1269952 - DNA, 22 bp, Artificial Sequence
  chemically synthesized
taaaacatagcagatttagcca

SEQ ID NO: 1269953 - DNA, 22 bp, Artificial Sequence
  chemically synthesized
ataaaacatagcagatttagcc

SEQ ID NO: 1269954 - DNA, 22 bp, Artificial Sequence
  chemically synthesized
cttctcttattggctaaatctg

SEQ ID NO: 1269955 - DNA, 22 bp, Artificial Sequence
  chemically synthesized
ttctcttattggctaaatctgc

SEQ ID NO: 1269956 - DNA, 22 bp, Artificial Sequence
  chemically synthesized
ctcttattggctaaatctgcta

SEQ ID NO: 1269957 - DNA, 22 bp, Artificial Sequence
  chemically synthesized
tcttattggctaaatctgctat

SEQ ID NO: 1269958 - DNA, 22 bp, Artificial Sequence
  chemically synthesized
ttattggctaaatctgctatgt

SEQ ID NO: 1269959 - DNA, 22 bp, Artificial Sequence
  chemically synthesized
aaatcttataaaacatagcaga

SEQ ID NO: 1269960 - DNA, 22 bp, Artificial Sequence
  chemically synthesized
attggctaaatctgctatgttt

SEQ ID NO: 1269961 - DNA, 22 bp, Artificial Sequence
  chemically synthesized
ttggctaaatctgctatgtttt

SEQ ID NO: 1269962 - DNA, 22 bp, Artificial Sequence
  chemically synthesized
gctaaatctgctatgttttata

SEQ ID NO: 1269963 - DNA, 22 bp, Artificial Sequence
  chemically synthesized
aatctgctatgttttataagat

SEQ ID NO: 1269964 - DNA, 22 bp, Artificial Sequence
  chemically synthesized
ctatgttttataagatttgaac

SEQ ID NO: 1269965 - DNA, 22 bp, Artificial Sequence
  chemically synthesized
aggaatacagacgttcaaatct

SEQ ID NO: 1269966 - DNA, 22 bp, Artificial Sequence
  chemically synthesized
tgttttataagatttgaacgtc

SEQ ID NO: 1269967 - DNA, 22 bp, Artificial Sequence
  chemically synthesized
tataagatttgaacgtctgtat

SEQ ID NO: 1269968 - DNA, 22 bp, Artificial Sequence
  chemically synthesized
ataagatttgaacgtctgtatt

SEQ ID NO: 1269969 - DNA, 22 bp, Artificial Sequence
  chemically synthesized
taagatttgaacgtctgtattc

SEQ ID NO: 1269970 - DNA, 22 bp, Artificial Sequence
  chemically synthesized
tcaaccaatctcaggaatacag

SEQ ID NO: 1269971 - DNA, 22 bp, Artificial Sequence
  chemically synthesized
gaacgtctgtattcctgagatt

SEQ ID NO: 1269972 - DNA, 22 bp, Artificial Sequence
  chemically synthesized
aacgtctgtattcctgagattg

SEQ ID NO: 1269973 - DNA, 22 bp, Artificial Sequence
  chemically synthesized
aaaactatcaaccaatctcagg

SEQ ID NO: 1269974 - DNA, 22 bp, Artificial Sequence
  chemically synthesized
tattcctgagattggttgatag

SEQ ID NO: 1269975 - DNA, 22 bp, Artificial Sequence
  chemically synthesized
ctgagattggttgatagttttc

SEQ ID NO: 1269976 - DNA, 22 bp, Artificial Sequence
  chemically synthesized
agattggttgatagttttcaat

SEQ ID NO: 1269977 - DNA, 22 bp, Artificial Sequence
  chemically synthesized
aaaaaaatagcatacacattga

SEQ ID NO: 1269978 - DNA, 22 bp, Artificial Sequence
  chemically synthesized
gttgatagttttcaatgtgtat

SEQ ID NO: 1269979 - DNA, 22 bp, Artificial Sequence
  chemically synthesized
caaaaaaatagcatacacattg

SEQ ID NO: 1269980 - DNA, 22 bp, Artificial Sequence
  chemically synthesized
atagttttcaatgtgtatgcta

SEQ ID NO: 1269981 - DNA, 22 bp, Artificial Sequence
  chemically synthesized
tgagacttcaaaaaaatagcat

SEQ ID NO: 1269982 - DNA, 22 bp, Artificial Sequence
  chemically synthesized
tcaatgtgtatgctattttttt

SEQ ID NO: 1269983 - DNA, 22 bp, Artificial Sequence
  chemically synthesized
caatgtgtatgctatttttttg

SEQ ID NO: 1269984 - DNA, 22 bp, Artificial Sequence
  chemically synthesized
attatgagacttcaaaaaaata

SEQ ID NO: 1269985 - DNA, 22 bp, Artificial Sequence
  chemically synthesized
aatgtgtatgctatttttttga

SEQ ID NO: 1269986 - DNA, 22 bp, Artificial Sequence
  chemically synthesized
gattatgagacttcaaaaaaat

SEQ ID NO: 1269987 - DNA, 22 bp, Artificial Sequence
  chemically synthesized
taatcttgattatgagacttca

SEQ ID NO: 1269988 - DNA, 22 bp, Artificial Sequence
  chemically synthesized
ataatcttgattatgagacttc

SEQ ID NO: 1269989 - DNA, 22 bp, Artificial Sequence
  chemically synthesized
tttttttgaagtctcataatca

SEQ ID NO: 1269990 - DNA, 22 bp, Artificial Sequence
  chemically synthesized
ttttgaagtctcataatcaaga

SEQ ID NO: 1269991 - DNA, 22 bp, Artificial Sequence
  chemically synthesized
aagcccttataatcttgattat

SEQ ID NO: 1269992 - DNA, 22 bp, Artificial Sequence
  chemically synthesized
tttgaagtctcataatcaagat

SEQ ID NO: 1269993 - DNA, 22 bp, Artificial Sequence
  chemically synthesized
ttgaagtctcataatcaagatt

SEQ ID NO: 1269994 - DNA, 22 bp, Artificial Sequence
  chemically synthesized
taaagcccttataatcttgatt

SEQ ID NO: 1269995 - DNA, 22 bp, Artificial Sequence
  chemically synthesized
tgaagtctcataatcaagatta

SEQ ID NO: 1269996 - DNA, 22 bp, Artificial Sequence
  chemically synthesized
gaagtctcataatcaagattat

SEQ ID NO: 1269997 - DNA, 22 bp, Artificial Sequence
  chemically synthesized
aagtctcataatcaagattata

SEQ ID NO: 1269998 - DNA, 22 bp, Artificial Sequence
  chemically synthesized
atgttctaaagcccttataatc

SEQ ID NO: 1269999 - DNA, 22 bp, Artificial Sequence
  chemically synthesized
ataatcaagattataagggctt

SEQ ID NO: 1270000 - DNA, 22 bp, Artificial Sequence
  chemically synthesized
tgttcatgttctaaagccctta

SEQ ID NO: 1270001 - DNA, 22 bp, Artificial Sequence
  chemically synthesized
tatgttcatgttctaaagccct

SEQ ID NO: 1270002 - DNA, 22 bp, Artificial Sequence
  chemically synthesized
aacctctatgttcatgttctaa

SEQ ID NO: 1270003 - DNA, 22 bp, Artificial Sequence
  chemically synthesized
aaacctctatgttcatgttcta

SEQ ID NO: 1270004 - DNA, 22 bp, Artificial Sequence
  chemically synthesized
taagggctttagaacatgaaca

SEQ ID NO: 1270005 - DNA, 22 bp, Artificial Sequence
  chemically synthesized
tagaacatgaacatagaggttt

SEQ ID NO: 1270006 - DNA, 22 bp, Artificial Sequence
  chemically synthesized
agaacatgaacatagaggttta

SEQ ID NO: 1270007 - DNA, 22 bp, Artificial Sequence
  chemically synthesized
gaacatgaacatagaggtttaa

SEQ ID NO: 1270008 - DNA, 22 bp, Artificial Sequence
  chemically synthesized
caaaccatgaaaatagtattta

SEQ ID NO: 1270009 - DNA, 22 bp, Artificial Sequence
  chemically synthesized
caaaattccaaaccatgaaaat

SEQ ID NO: 1270010 - DNA, 22 bp, Artificial Sequence
  chemically synthesized
acaaaattccaaaccatgaaaa

SEQ ID NO: 1270011 - DNA, 22 bp, Artificial Sequence
  chemically synthesized
tttacaaaattccaaaccatga

SEQ ID NO: 1270012 - DNA, 22 bp, Artificial Sequence
  chemically synthesized
aaatactattttcatggtttgg

SEQ ID NO: 1270013 - DNA, 22 bp, Artificial Sequence
  chemically synthesized
aatactattttcatggtttgga

SEQ ID NO: 1270014 - DNA, 22 bp, Artificial Sequence
  chemically synthesized
tctgtttacaaaattccaaacc

SEQ ID NO: 1270015 - DNA, 22 bp, Artificial Sequence
  chemically synthesized
ttttcatggtttggaattttgt

SEQ ID NO: 1270016 - DNA, 22 bp, Artificial Sequence
  chemically synthesized
tcatggtttggaattttgtaaa

SEQ ID NO: 1270017 - DNA, 22 bp, Artificial Sequence
  chemically synthesized
catggtttggaattttgtaaac

SEQ ID NO: 1270018 - DNA, 22 bp, Artificial Sequence
  chemically synthesized
atggtttggaattttgtaaaca

SEQ ID NO: 1270019 - DNA, 22 bp, Artificial Sequence
  chemically synthesized
agtatgaattatctgtttacaa

SEQ ID NO: 1270020 - DNA, 22 bp, Artificial Sequence
  chemically synthesized
ggaattttgtaaacagataatt

SEQ ID NO: 1270021 - DNA, 22 bp, Artificial Sequence
  chemically synthesized
gaattttgtaaacagataattc

SEQ ID NO: 1270022 - DNA, 22 bp, Artificial Sequence
  chemically synthesized
aaacaactaagtatgaattatc

SEQ ID NO: 1270023 - DNA, 22 bp, Artificial Sequence
  chemically synthesized
caaacaactaagtatgaattat

SEQ ID NO: 1270024 - DNA, 22 bp, Artificial Sequence
  chemically synthesized
tcaaacaactaagtatgaatta

SEQ ID NO: 1270025 - DNA, 22 bp, Artificial Sequence
  chemically synthesized
tgtaaacagataattcatactt

SEQ ID NO: 1270026 - DNA, 22 bp, Artificial Sequence
  chemically synthesized
gtaaacagataattcatactta

SEQ ID NO: 1270027 - DNA, 22 bp, Artificial Sequence
  chemically synthesized
taaacagataattcatacttag

SEQ ID NO: 1270028 - DNA, 22 bp, Artificial Sequence
  chemically synthesized
agaaatgctttcaaacaactaa

SEQ ID NO: 1270029 - DNA, 22 bp, Artificial Sequence
  chemically synthesized
tattgagaaatgctttcaaaca

SEQ ID NO: 1270030 - DNA, 22 bp, Artificial Sequence
  chemically synthesized
atacttagttgtttgaaagcat

SEQ ID NO: 1270031 - DNA, 22 bp, Artificial Sequence
  chemically synthesized
agttgtttgaaagcatttctca

SEQ ID NO: 1270032 - DNA, 22 bp, Artificial Sequence
  chemically synthesized
gttgtttgaaagcatttctcaa

SEQ ID NO: 1270033 - DNA, 22 bp, Artificial Sequence
  chemically synthesized
aaaaatactatattgagaaatg

SEQ ID NO: 1270034 - DNA, 22 bp, Artificial Sequence
  chemically synthesized
caaaaatactatattgagaaat

SEQ ID NO: 1270035 - DNA, 22 bp, Artificial Sequence
  chemically synthesized
tttgaaagcatttctcaatata

SEQ ID NO: 1270036 - DNA, 22 bp, Artificial Sequence
  chemically synthesized
gaaagcatttctcaatatagta

SEQ ID NO: 1270037 - DNA, 22 bp, Artificial Sequence
  chemically synthesized
aaagcatttctcaatatagtat

SEQ ID NO: 1270038 - DNA, 22 bp, Artificial Sequence
  chemically synthesized
ctcaatatagtatttttgaagt

SEQ ID NO: 1270039 - DNA, 22 bp, Artificial Sequence
  chemically synthesized
tcaatatagtatttttgaagtt

SEQ ID NO: 1270040 - DNA, 22 bp, Artificial Sequence
  chemically synthesized
aatatagtatttttgaagttat

SEQ ID NO: 1270041 - DNA, 22 bp, Artificial Sequence
  chemically synthesized
aaaagcagtacaagaaataact

SEQ ID NO: 1270042 - DNA, 22 bp, Artificial Sequence
  chemically synthesized
aaaaagcagtacaagaaataac

SEQ ID NO: 1270043 - DNA, 22 bp, Artificial Sequence
  chemically synthesized
taaaaagcagtacaagaaataa

SEQ ID NO: 1270044 - DNA, 22 bp, Artificial Sequence
  chemically synthesized
ttgaagttatttcttgtactgc

SEQ ID NO: 1270045 - DNA, 22 bp, Artificial Sequence
  chemically synthesized
tgaagttatttcttgtactgct

SEQ ID NO: 1270046 - DNA, 22 bp, Artificial Sequence
  chemically synthesized
gaagttatttcttgtactgctt

SEQ ID NO: 1270047 - DNA, 22 bp, Artificial Sequence
  chemically synthesized
aagttatttcttgtactgcttt

SEQ ID NO: 1270048 - DNA, 22 bp, Artificial Sequence
  chemically synthesized
taagaaacctttaaaaagcagt

SEQ ID NO: 1270049 - DNA, 22 bp, Artificial Sequence
  chemically synthesized
tgtaagaaacctttaaaaagca

SEQ ID NO: 1270050 - DNA, 22 bp, Artificial Sequence
  chemically synthesized
tttcttgtactgctttttaaag

SEQ ID NO: 1270051 - DNA, 22 bp, Artificial Sequence
  chemically synthesized
attctgtaagaaacctttaaaa

SEQ ID NO: 1270052 - DNA, 22 bp, Artificial Sequence
  chemically synthesized
cttgtactgctttttaaaggtt

SEQ ID NO: 1270053 - DNA, 22 bp, Artificial Sequence
  chemically synthesized
gattctgtaagaaacctttaaa

SEQ ID NO: 1270054 - DNA, 22 bp, Artificial Sequence
  chemically synthesized
ttgtactgctttttaaaggttt

SEQ ID NO: 1270055 - DNA, 22 bp, Artificial Sequence
  chemically synthesized
gtactgctttttaaaggtttct

SEQ ID NO: 1270056 - DNA, 22 bp, Artificial Sequence
  chemically synthesized
tactgctttttaaaggtttctt

SEQ ID NO: 1270057 - DNA, 22 bp, Artificial Sequence
  chemically synthesized
aacatttgattctgtaagaaac

SEQ ID NO: 1270058 - DNA, 22 bp, Artificial Sequence
  chemically synthesized
ctttttaaaggtttcttacaga

SEQ ID NO: 1270059 - DNA, 22 bp, Artificial Sequence
  chemically synthesized
tttaaaggtttcttacagaatc

SEQ ID NO: 1270060 - DNA, 22 bp, Artificial Sequence
  chemically synthesized
ttaaaggtttcttacagaatca

SEQ ID NO: 1270061 - DNA, 22 bp, Artificial Sequence
  chemically synthesized
taaaggtttcttacagaatcaa

SEQ ID NO: 1270062 - DNA, 22 bp, Artificial Sequence
  chemically synthesized
aaaggtttcttacagaatcaaa

SEQ ID NO: 1270063 - DNA, 22 bp, Artificial Sequence
  chemically synthesized
aaggtttcttacagaatcaaat

SEQ ID NO: 1270064 - DNA, 22 bp, Artificial Sequence
  chemically synthesized
cttacagaatcaaatgtttagt

SEQ ID NO: 1270065 - DNA, 22 bp, Artificial Sequence
  chemically synthesized
ttacagaatcaaatgtttagtt

SEQ ID NO: 1270066 - DNA, 22 bp, Artificial Sequence
  chemically synthesized
acagaatcaaatgtttagttct

SEQ ID NO: 1270067 - DNA, 22 bp, Artificial Sequence
  chemically synthesized
cagaatcaaatgtttagttctc

SEQ ID NO: 1270068 - DNA, 22 bp, Artificial Sequence
  chemically synthesized
aagggaaaataagagaactaaa

SEQ ID NO: 1270069 - DNA, 22 bp, Artificial Sequence
  chemically synthesized
agattaaagggaaaataagaga

SEQ ID NO: 1270070 - DNA, 22 bp, Artificial Sequence
  chemically synthesized
gagattaaagggaaaataagag

SEQ ID NO: 1270071 - DNA, 22 bp, Artificial Sequence
  chemically synthesized
tatttgagattaaagggaaaat

SEQ ID NO: 1270072 - DNA, 22 bp, Artificial Sequence
  chemically synthesized
atatttgagattaaagggaaaa

SEQ ID NO: 1270073 - DNA, 22 bp, Artificial Sequence
  chemically synthesized
tatatttgagattaaagggaaa

SEQ ID NO: 1270074 - DNA, 22 bp, Artificial Sequence
  chemically synthesized
agttctcttattttccctttaa

SEQ ID NO: 1270075 - DNA, 22 bp, Artificial Sequence
  chemically synthesized
ttatatttgagattaaagggaa

SEQ ID NO: 1270076 - DNA, 22 bp, Artificial Sequence
  chemically synthesized
gttctcttattttccctttaat

SEQ ID NO: 1270077 - DNA, 22 bp, Artificial Sequence
  chemically synthesized
tttatatttgagattaaaggga

SEQ ID NO: 1270078 - DNA, 22 bp, Artificial Sequence
  chemically synthesized
ttttatatttgagattaaaggg

SEQ ID NO: 1270079 - DNA, 22 bp, Artificial Sequence
  chemically synthesized
tcttattttccctttaatctca

SEQ ID NO: 1270080 - DNA, 22 bp, Artificial Sequence
  chemically synthesized
atttttttatatttgagattaa

SEQ ID NO: 1270081 - DNA, 22 bp, Artificial Sequence
  chemically synthesized
ttattttccctttaatctcaaa

SEQ ID NO: 1270082 - DNA, 22 bp, Artificial Sequence
  chemically synthesized
aatttttttatatttgagatta

SEQ ID NO: 1270083 - DNA, 22 bp, Artificial Sequence
  chemically synthesized
attttccctttaatctcaaata

SEQ ID NO: 1270084 - DNA, 22 bp, Artificial Sequence
  chemically synthesized
ttttccctttaatctcaaatat

SEQ ID NO: 1270085 - DNA, 22 bp, Artificial Sequence
  chemically synthesized
tccctttaatctcaaatataaa

SEQ ID NO: 1270086 - DNA, 22 bp, Artificial Sequence
  chemically synthesized
ccctttaatctcaaatataaaa

SEQ ID NO: 1270087 - DNA, 22 bp, Artificial Sequence
  chemically synthesized
cctttaatctcaaatataaaaa

SEQ ID NO: 1270088 - DNA, 22 bp, Artificial Sequence
  chemically synthesized
atagccttaatttttttatatt

SEQ ID NO: 1270089 - DNA, 22 bp, Artificial Sequence
  chemically synthesized
taatctcaaatataaaaaaatt

SEQ ID NO: 1270090 - DNA, 22 bp, Artificial Sequence
  chemically synthesized
aatctcaaatataaaaaaatta

SEQ ID NO: 1270091 - DNA, 22 bp, Artificial Sequence
  chemically synthesized
atctcaaatataaaaaaattaa

SEQ ID NO: 1270092 - DNA, 22 bp, Artificial Sequence
  chemically synthesized
aaatataaaaaaattaaggcta

SEQ ID NO: 1270093 - DNA, 22 bp, Artificial Sequence
  chemically synthesized
taatcaaagaaaattaatagcc

SEQ ID NO: 1270094 - DNA, 22 bp, Artificial Sequence
  chemically synthesized
aggctattaattttctttgatt

SEQ ID NO: 1270095 - DNA, 22 bp, Artificial Sequence
  chemically synthesized
ttaattttctttgattacagct

SEQ ID NO: 1270096 - DNA, 22 bp, Artificial Sequence
  chemically synthesized
gaataagaacaaagctgtaatc

SEQ ID NO: 1270097 - DNA, 22 bp, Artificial Sequence
  chemically synthesized
tggaataagaacaaagctgtaa

SEQ ID NO: 1270098 - DNA, 22 bp, Artificial Sequence
  chemically synthesized
attttctttgattacagctttg

SEQ ID NO: 1270099 - DNA, 22 bp, Artificial Sequence
  chemically synthesized
ctggaataagaacaaagctgta

SEQ ID NO: 1270100 - DNA, 22 bp, Artificial Sequence
  chemically synthesized
tctttgattacagctttgttct

SEQ ID NO: 1270101 - DNA, 22 bp, Artificial Sequence
  chemically synthesized
ctttgattacagctttgttctt

SEQ ID NO: 1270102 - DNA, 22 bp, Artificial Sequence
  chemically synthesized
tttgattacagctttgttctta

SEQ ID NO: 1270103 - DNA, 22 bp, Artificial Sequence
  chemically synthesized
tgattacagctttgttcttatt

SEQ ID NO: 1270104 - DNA, 22 bp, Artificial Sequence
  chemically synthesized
gattacagctttgttcttattc

SEQ ID NO: 1270105 - DNA, 22 bp, Artificial Sequence
  chemically synthesized
attacagctttgttcttattcc

SEQ ID NO: 1270106 - DNA, 22 bp, Artificial Sequence
  chemically synthesized
cagctttgttcttattccagaa

SEQ ID NO: 1270107 - DNA, 22 bp, Artificial Sequence
  chemically synthesized
tgttcttattccagaagttttc

SEQ ID NO: 1270108 - DNA, 22 bp, Artificial Sequence
  chemically synthesized
gttcttattccagaagttttca

SEQ ID NO: 1270109 - DNA, 22 bp, Artificial Sequence
  chemically synthesized
ttcttattccagaagttttcat

SEQ ID NO: 1270110 - DNA, 22 bp, Artificial Sequence
  chemically synthesized
ttattccagaagttttcatgtg

SEQ ID NO: 1270111 - DNA, 22 bp, Artificial Sequence
  chemically synthesized
attccagaagttttcatgtgta

SEQ ID NO: 1270112 - DNA, 22 bp, Artificial Sequence
  chemically synthesized
ttccagaagttttcatgtgtat

SEQ ID NO: 1270113 - DNA, 22 bp, Artificial Sequence
  chemically synthesized
atgaataaggaaaatacacatg

SEQ ID NO: 1270114 - DNA, 22 bp, Artificial Sequence
  chemically synthesized
cagaagttttcatgtgtatttt

SEQ ID NO: 1270115 - DNA, 22 bp, Artificial Sequence
  chemically synthesized
aaaattaatgaataaggaaaat

SEQ ID NO: 1270116 - DNA, 22 bp, Artificial Sequence
  chemically synthesized
aaaaattaatgaataaggaaaa

SEQ ID NO: 1270117 - DNA, 22 bp, Artificial Sequence
  chemically synthesized
tcatgtgtattttccttattca

SEQ ID NO: 1270118 - DNA, 22 bp, Artificial Sequence
  chemically synthesized
catgtgtattttccttattcat

SEQ ID NO: 1270119 - DNA, 22 bp, Artificial Sequence
  chemically synthesized
atgtgtattttccttattcatt

SEQ ID NO: 1270120 - DNA, 22 bp, Artificial Sequence
  chemically synthesized
tccttattcattaatttttaaa

SEQ ID NO: 1270121 - DNA, 22 bp, Artificial Sequence
  chemically synthesized
ccttattcattaatttttaaat

SEQ ID NO: 1270122 - DNA, 22 bp, Artificial Sequence
  chemically synthesized
cttattcattaatttttaaatg

SEQ ID NO: 1270123 - DNA, 22 bp, Artificial Sequence
  chemically synthesized
attcattaatttttaaatggcc

SEQ ID NO: 1270124 - DNA, 22 bp, Artificial Sequence
  chemically synthesized
ttcattaatttttaaatggcct

SEQ ID NO: 1270125 - DNA, 22 bp, Artificial Sequence
  chemically synthesized
attaatttttaaatggcctact

SEQ ID NO: 1270126 - DNA, 22 bp, Artificial Sequence
  chemically synthesized
aaccaaaaaaaaagtaggccat

SEQ ID NO: 1270127 - DNA, 22 bp, Artificial Sequence
  chemically synthesized
gaaccaaaaaaaaagtaggcca

SEQ ID NO: 1270128 - DNA, 22 bp, Artificial Sequence
  chemically synthesized
atttttaaatggcctacttttt

SEQ ID NO: 1270129 - DNA, 22 bp, Artificial Sequence
  chemically synthesized
cttgaaccaaaaaaaaagtagg

SEQ ID NO: 1270130 - DNA, 22 bp, Artificial Sequence
  chemically synthesized
ccttgaaccaaaaaaaaagtag

SEQ ID NO: 1270131 - DNA, 22 bp, Artificial Sequence
  chemically synthesized
tccttgaaccaaaaaaaaagta

SEQ ID NO: 1270132 - DNA, 22 bp, Artificial Sequence
  chemically synthesized
ttaaatggcctacttttttttt

SEQ ID NO: 1270133 - DNA, 22 bp, Artificial Sequence
  chemically synthesized
tttccttgaaccaaaaaaaaag

SEQ ID NO: 1270134 - DNA, 22 bp, Artificial Sequence
  chemically synthesized
taaatggcctactttttttttg

SEQ ID NO: 1270135 - DNA, 22 bp, Artificial Sequence
  chemically synthesized
aaatggcctactttttttttgg

SEQ ID NO: 1270136 - DNA, 22 bp, Artificial Sequence
  chemically synthesized
aatggcctactttttttttggt

SEQ ID NO: 1270137 - DNA, 22 bp, Artificial Sequence
  chemically synthesized
ctttttttttggttcaaggaaa

SEQ ID NO: 1270138 - DNA, 22 bp, Artificial Sequence
  chemically synthesized
tttttttggttcaaggaaagaa

SEQ ID NO: 1270139 - DNA, 22 bp, Artificial Sequence
  chemically synthesized
ttttttggttcaaggaaagaac

SEQ ID NO: 1270140 - DNA, 22 bp, Artificial Sequence
  chemically synthesized
tttttggttcaaggaaagaaca

SEQ ID NO: 1270141 - DNA, 22 bp, Artificial Sequence
  chemically synthesized
ttttggttcaaggaaagaacac

SEQ ID NO: 1270142 - DNA, 22 bp, Artificial Sequence
  chemically synthesized
tttggttcaaggaaagaacact

SEQ ID NO: 1270143 - DNA, 22 bp, Artificial Sequence
  chemically synthesized
ttggttcaaggaaagaacacta

SEQ ID NO: 1270144 - DNA, 22 bp, Artificial Sequence
  chemically synthesized
tggttcaaggaaagaacactac

SEQ ID NO: 1270145 - DNA, 22 bp, Artificial Sequence
  chemically synthesized
ggttcaaggaaagaacactact

SEQ ID NO: 1270146 - DNA, 22 bp, Artificial Sequence
  chemically synthesized
gttcaaggaaagaacactactt

SEQ ID NO: 1270147 - DNA, 22 bp, Artificial Sequence
  chemically synthesized
taacaggagagaaaaagtagtg

SEQ ID NO: 1270148 - DNA, 22 bp, Artificial Sequence
  chemically synthesized
gtaacaggagagaaaaagtagt

SEQ ID NO: 1270149 - DNA, 22 bp, Artificial Sequence
  chemically synthesized
aaggaaagaacactactttttc

SEQ ID NO: 1270150 - DNA, 22 bp, Artificial Sequence
  chemically synthesized
tgtaacaggagagaaaaagtag

SEQ ID NO: 1270151 - DNA, 22 bp, Artificial Sequence
  chemically synthesized
ttgtaacaggagagaaaaagta

SEQ ID NO: 1270152 - DNA, 22 bp, Artificial Sequence
  chemically synthesized
tttttgtaacaggagagaaaaa

SEQ ID NO: 1270153 - DNA, 22 bp, Artificial Sequence
  chemically synthesized
ctttttctctcctgttacaaaa

SEQ ID NO: 1270154 - DNA, 22 bp, Artificial Sequence
  chemically synthesized
tttctctcctgttacaaaaaca

SEQ ID NO: 1270155 - DNA, 22 bp, Artificial Sequence
  chemically synthesized
ttctctcctgttacaaaaacaa

SEQ ID NO: 1270156 - DNA, 22 bp, Artificial Sequence
  chemically synthesized
tctctcctgttacaaaaacaat

SEQ ID NO: 1270157 - DNA, 22 bp, Artificial Sequence
  chemically synthesized
tggtaaacatacattgtttttg

SEQ ID NO: 1270158 - DNA, 22 bp, Artificial Sequence
  chemically synthesized
ctctcctgttacaaaaacaatg

SEQ ID NO: 1270159 - DNA, 22 bp, Artificial Sequence
  chemically synthesized
atggtaaacatacattgttttt

SEQ ID NO: 1270160 - DNA, 22 bp, Artificial Sequence
  chemically synthesized
tctcctgttacaaaaacaatgt

SEQ ID NO: 1270161 - DNA, 22 bp, Artificial Sequence
  chemically synthesized
tatggtaaacatacattgtttt

SEQ ID NO: 1270162 - DNA, 22 bp, Artificial Sequence
  chemically synthesized
ttatggtaaacatacattgttt

SEQ ID NO: 1270163 - DNA, 22 bp, Artificial Sequence
  chemically synthesized
tcctgttacaaaaacaatgtat

SEQ ID NO: 1270164 - DNA, 22 bp, Artificial Sequence
  chemically synthesized
tttatggtaaacatacattgtt

SEQ ID NO: 1270165 - DNA, 22 bp, Artificial Sequence
  chemically synthesized
ctgttacaaaaacaatgtatgt

SEQ ID NO: 1270166 - DNA, 22 bp, Artificial Sequence
  chemically synthesized
ttacaaaaacaatgtatgttta

SEQ ID NO: 1270167 - DNA, 22 bp, Artificial Sequence
  chemically synthesized
tatctttttatggtaaacatac

SEQ ID NO: 1270168 - DNA, 22 bp, Artificial Sequence
  chemically synthesized
caaaaacaatgtatgtttacca

SEQ ID NO: 1270169 - DNA, 22 bp, Artificial Sequence
  chemically synthesized
ttgtatctttttatggtaaaca

SEQ ID NO: 1270170 - DNA, 22 bp, Artificial Sequence
  chemically synthesized
ttgttgtatctttttatggtaa

SEQ ID NO: 1270171 - DNA, 22 bp, Artificial Sequence
  chemically synthesized
atagttattgttgtatcttttt

SEQ ID NO: 1270172 - DNA, 22 bp, Artificial Sequence
  chemically synthesized
aatagttattgttgtatctttt

SEQ ID NO: 1270173 - DNA, 22 bp, Artificial Sequence
  chemically synthesized
ttaatagttattgttgtatctt

SEQ ID NO: 1270174 - DNA, 22 bp, Artificial Sequence
  chemically synthesized
cttaatagttattgttgtatct

SEQ ID NO: 1270175 - DNA, 22 bp, Artificial Sequence
  chemically synthesized
tcttaatagttattgttgtatc

SEQ ID NO: 1270176 - DNA, 22 bp, Artificial Sequence
  chemically synthesized
ttcttaatagttattgttgtat

SEQ ID NO: 1270177 - DNA, 22 bp, Artificial Sequence
  chemically synthesized
accataaaaagatacaacaata

SEQ ID NO: 1270178 - DNA, 22 bp, Artificial Sequence
  chemically synthesized
ccataaaaagatacaacaataa

SEQ ID NO: 1270179 - DNA, 22 bp, Artificial Sequence
  chemically synthesized
tacttttcttaatagttattgt

SEQ ID NO: 1270180 - DNA, 22 bp, Artificial Sequence
  chemically synthesized
tctgtacttttcttaatagtta

SEQ ID NO: 1270181 - DNA, 22 bp, Artificial Sequence
  chemically synthesized
atgaaaaaatgagttatctgta

SEQ ID NO: 1270182 - DNA, 22 bp, Artificial Sequence
  chemically synthesized
aatgaaaaaatgagttatctgt

SEQ ID NO: 1270183 - DNA, 22 bp, Artificial Sequence
  chemically synthesized
ttaagaaaagtacagataactc

SEQ ID NO: 1270184 - DNA, 22 bp, Artificial Sequence
  chemically synthesized
cttaatgaaaaaatgagttatc

SEQ ID NO: 1270185 - DNA, 22 bp, Artificial Sequence
  chemically synthesized
agaaaagtacagataactcatt

SEQ ID NO: 1270186 - DNA, 22 bp, Artificial Sequence
  chemically synthesized
gcagtggtgctgcttaatgaaa

SEQ ID NO: 1270187 - DNA, 22 bp, Artificial Sequence
  chemically synthesized
attttttcattaagcagcacca

SEQ ID NO: 1270188 - DNA, 22 bp, Artificial Sequence
  chemically synthesized
tttcattaagcagcaccactgc

SEQ ID NO: 1270189 - DNA, 22 bp, Artificial Sequence
  chemically synthesized
ttcattaagcagcaccactgct

SEQ ID NO: 1270190 - DNA, 22 bp, Artificial Sequence
  chemically synthesized
tcattaagcagcaccactgcta

SEQ ID NO: 1270191 - DNA, 22 bp, Artificial Sequence
  chemically synthesized
cattaagcagcaccactgctaa

SEQ ID NO: 1270192 - DNA, 22 bp, Artificial Sequence
  chemically synthesized
attaagcagcaccactgctaac

SEQ ID NO: 1270193 - DNA, 22 bp, Artificial Sequence
  chemically synthesized
agcagcaccactgctaacatcc

SEQ ID NO: 1270194 - DNA, 22 bp, Artificial Sequence
  chemically synthesized
agagtagacaacaggatgttag

SEQ ID NO: 1270195 - DNA, 22 bp, Artificial Sequence
  chemically synthesized
ctaacatcctgttgtctactct

SEQ ID NO: 1270196 - DNA, 22 bp, Artificial Sequence
  chemically synthesized
acatcctgttgtctactctgag

SEQ ID NO: 1270197 - DNA, 22 bp, Artificial Sequence
  chemically synthesized
ttgtctactctgagtgtttttc

SEQ ID NO: 1270198 - DNA, 22 bp, Artificial Sequence
  chemically synthesized
tagacagatatacagaaaaaca

SEQ ID NO: 1270199 - DNA, 22 bp, Artificial Sequence
  chemically synthesized
tctactctgagtgtttttctgt

SEQ ID NO: 1270200 - DNA, 22 bp, Artificial Sequence
  chemically synthesized
atagacagatatacagaaaaac

SEQ ID NO: 1270201 - DNA, 22 bp, Artificial Sequence
  chemically synthesized
tatagacagatatacagaaaaa

SEQ ID NO: 1270202 - DNA, 22 bp, Artificial Sequence
  chemically synthesized
ttatagacagatatacagaaaa

SEQ ID NO: 1270203 - DNA, 22 bp, Artificial Sequence
  chemically synthesized
ctctgagtgtttttctgtatat

SEQ ID NO: 1270204 - DNA, 22 bp, Artificial Sequence
  chemically synthesized
tgagtgtttttctgtatatctg

SEQ ID NO: 1270205 - DNA, 22 bp, Artificial Sequence
  chemically synthesized
gatttttatagacagatataca

SEQ ID NO: 1270206 - DNA, 22 bp, Artificial Sequence
  chemically synthesized
agtgtttttctgtatatctgtc

SEQ ID NO: 1270207 - DNA, 22 bp, Artificial Sequence
  chemically synthesized
cgttagatttttatagacagat

SEQ ID NO: 1270208 - DNA, 22 bp, Artificial Sequence
  chemically synthesized
acgttagatttttatagacaga

SEQ ID NO: 1270209 - DNA, 22 bp, Artificial Sequence
  chemically synthesized
ttctgtatatctgtctataaaa

SEQ ID NO: 1270210 - DNA, 22 bp, Artificial Sequence
  chemically synthesized
tctgtatatctgtctataaaaa

SEQ ID NO: 1270211 - DNA, 22 bp, Artificial Sequence
  chemically synthesized
ctgtatatctgtctataaaaat

SEQ ID NO: 1270212 - DNA, 22 bp, Artificial Sequence
  chemically synthesized
aatttacgttagatttttatag

SEQ ID NO: 1270213 - DNA, 22 bp, Artificial Sequence
  chemically synthesized
tgtatatctgtctataaaaatc

SEQ ID NO: 1270214 - DNA, 22 bp, Artificial Sequence
  chemically synthesized
tatatctgtctataaaaatcta

SEQ ID NO: 1270215 - DNA, 22 bp, Artificial Sequence
  chemically synthesized
tctataaaaatctaacgtaaat

SEQ ID NO: 1270216 - DNA, 22 bp, Artificial Sequence
  chemically synthesized
taaaaatctaacgtaaattcaa

SEQ ID NO: 1270217 - DNA, 22 bp, Artificial Sequence
  chemically synthesized
gataatacaggaatcggacatt

SEQ ID NO: 1270218 - DNA, 22 bp, Artificial Sequence
  chemically synthesized
agataatacaggaatcggacat

SEQ ID NO: 1270219 - DNA, 22 bp, Artificial Sequence
  chemically synthesized
acgtaaattcaatgtccgattc

SEQ ID NO: 1270220 - DNA, 22 bp, Artificial Sequence
  chemically synthesized
tagataatacaggaatcggaca

SEQ ID NO: 1270221 - DNA, 22 bp, Artificial Sequence
  chemically synthesized
ttagataatacaggaatcggac

SEQ ID NO: 1270222 - DNA, 22 bp, Artificial Sequence
  chemically synthesized
aatgtccgattcctgtattatc

SEQ ID NO: 1270223 - DNA, 22 bp, Artificial Sequence
  chemically synthesized
ctgtattatctaaaaattatat

SEQ ID NO: 1270224 - DNA, 22 bp, Artificial Sequence
  chemically synthesized
gtagatcatatgatataatttt

SEQ ID NO: 1270225 - DNA, 22 bp, Artificial Sequence
  chemically synthesized
tattatctaaaaattatatcat

SEQ ID NO: 1270226 - DNA, 22 bp, Artificial Sequence
  chemically synthesized
tctaaaaattatatcatatgat

SEQ ID NO: 1270227 - DNA, 22 bp, Artificial Sequence
  chemically synthesized
aaaattatatcatatgatctac

SEQ ID NO: 1270228 - DNA, 22 bp, Artificial Sequence
  chemically synthesized
tatcatatgatctactaatcat

SEQ ID NO: 1270229 - DNA, 22 bp, Artificial Sequence
  chemically synthesized
aaacaaataggaaaagatgatt

SEQ ID NO: 1270230 - DNA, 22 bp, Artificial Sequence
  chemically synthesized
aaaacaaataggaaaagatgat

SEQ ID NO: 1270231 - DNA, 22 bp, Artificial Sequence
  chemically synthesized
ctaatcatcttttcctatttgt

SEQ ID NO: 1270232 - DNA, 22 bp, Artificial Sequence
  chemically synthesized
atcatcttttcctatttgtttt

SEQ ID NO: 1270233 - DNA, 22 bp, Artificial Sequence
  chemically synthesized
ttcctatttgttttaaattgct

SEQ ID NO: 1270234 - DNA, 22 bp, Artificial Sequence
  chemically synthesized
tcctatttgttttaaattgctt

SEQ ID NO: 1270235 - DNA, 22 bp, Artificial Sequence
  chemically synthesized
cctatttgttttaaattgcttg

SEQ ID NO: 1270236 - DNA, 22 bp, Artificial Sequence
  chemically synthesized
ctatttgttttaaattgcttgc

SEQ ID NO: 1270237 - DNA, 22 bp, Artificial Sequence
  chemically synthesized
tttgttttaaattgcttgctgg

SEQ ID NO: 1270238 - DNA, 22 bp, Artificial Sequence
  chemically synthesized
gttttaaattgcttgctggttt

SEQ ID NO: 1270239 - DNA, 22 bp, Artificial Sequence
  chemically synthesized
ttttaaattgcttgctggtttt

SEQ ID NO: 1270240 - DNA, 22 bp, Artificial Sequence
  chemically synthesized
taaattgcttgctggttttgtt

SEQ ID NO: 1270241 - DNA, 22 bp, Artificial Sequence
  chemically synthesized
aaattgcttgctggttttgtta

SEQ ID NO: 1270242 - DNA, 22 bp, Artificial Sequence
  chemically synthesized
aattgcttgctggttttgttac

SEQ ID NO: 1270243 - DNA, 22 bp, Artificial Sequence
  chemically synthesized
gaaaaaaatgtaatgtaacaaa

SEQ ID NO: 1270244 - DNA, 22 bp, Artificial Sequence
  chemically synthesized
cttgctggttttgttacattac

SEQ ID NO: 1270245 - DNA, 22 bp, Artificial Sequence
  chemically synthesized
gctggttttgttacattacatt

SEQ ID NO: 1270246 - DNA, 22 bp, Artificial Sequence
  chemically synthesized
ctggttttgttacattacattt

SEQ ID NO: 1270247 - DNA, 22 bp, Artificial Sequence
  chemically synthesized
gttttgttacattacatttttt

SEQ ID NO: 1270248 - DNA, 22 bp, Artificial Sequence
  chemically synthesized
taaaatgtctagaaaaaaatgt

SEQ ID NO: 1270249 - DNA, 22 bp, Artificial Sequence
  chemically synthesized
tgttacattacatttttttcta

SEQ ID NO: 1270250 - DNA, 22 bp, Artificial Sequence
  chemically synthesized
ttataaaatgtctagaaaaaaa

SEQ ID NO: 1270251 - DNA, 22 bp, Artificial Sequence
  chemically synthesized
gttacattacatttttttctag

SEQ ID NO: 1270252 - DNA, 22 bp, Artificial Sequence
  chemically synthesized
gttataaaatgtctagaaaaaa

SEQ ID NO: 1270253 - DNA, 22 bp, Artificial Sequence
  chemically synthesized
ttacattacatttttttctaga

SEQ ID NO: 1270254 - DNA, 22 bp, Artificial Sequence
  chemically synthesized
tgttataaaatgtctagaaaaa

SEQ ID NO: 1270255 - DNA, 22 bp, Artificial Sequence
  chemically synthesized
cattacatttttttctagacat

SEQ ID NO: 1270256 - DNA, 22 bp, Artificial Sequence
  chemically synthesized
ttttgttataaaatgtctagaa

SEQ ID NO: 1270257 - DNA, 22 bp, Artificial Sequence
  chemically synthesized
catttttttctagacattttat

SEQ ID NO: 1270258 - DNA, 22 bp, Artificial Sequence
  chemically synthesized
atatatctgttttgttataaaa

SEQ ID NO: 1270259 - DNA, 22 bp, Artificial Sequence
  chemically synthesized
ttttctagacattttataacaa

SEQ ID NO: 1270260 - DNA, 22 bp, Artificial Sequence
  chemically synthesized
gatatatctgttttgttataaa

SEQ ID NO: 1270261 - DNA, 22 bp, Artificial Sequence
  chemically synthesized
tttctagacattttataacaaa

SEQ ID NO: 1270262 - DNA, 22 bp, Artificial Sequence
  chemically synthesized
ttctagacattttataacaaaa

SEQ ID NO: 1270263 - DNA, 22 bp, Artificial Sequence
  chemically synthesized
tctagacattttataacaaaac

SEQ ID NO: 1270264 - DNA, 22 bp, Artificial Sequence
  chemically synthesized
ctagacattttataacaaaaca

SEQ ID NO: 1270265 - DNA, 22 bp, Artificial Sequence
  chemically synthesized
atttgatatatctgttttgtta

SEQ ID NO: 1270266 - DNA, 22 bp, Artificial Sequence
  chemically synthesized
tagacattttataacaaaacag

SEQ ID NO: 1270267 - DNA, 22 bp, Artificial Sequence
  chemically synthesized
gacattttataacaaaacagat

SEQ ID NO: 1270268 - DNA, 22 bp, Artificial Sequence
  chemically synthesized
tataacaaaacagatatatcaa

SEQ ID NO: 1270269 - DNA, 22 bp, Artificial Sequence
  chemically synthesized
aatatgattaatttgatatatc

SEQ ID NO: 1270270 - DNA, 22 bp, Artificial Sequence
  chemically synthesized
ataacaaaacagatatatcaaa

SEQ ID NO: 1270271 - DNA, 22 bp, Artificial Sequence
  chemically synthesized
taacaaaacagatatatcaaat

SEQ ID NO: 1270272 - DNA, 22 bp, Artificial Sequence
  chemically synthesized
caacaacacatcattgaatatg

SEQ ID NO: 1270273 - DNA, 22 bp, Artificial Sequence
  chemically synthesized
gcaacaacacatcattgaatat

SEQ ID NO: 1270274 - DNA, 22 bp, Artificial Sequence
  chemically synthesized
atcatattcaatgatgtgttgt

SEQ ID NO: 1270275 - DNA, 22 bp, Artificial Sequence
  chemically synthesized
ataaacatatgtttgcaacaac

SEQ ID NO: 1270276 - DNA, 22 bp, Artificial Sequence
  chemically synthesized
cataaacatatgtttgcaacaa

SEQ ID NO: 1270277 - DNA, 22 bp, Artificial Sequence
  chemically synthesized
aatgatgtgttgttgcaaacat

SEQ ID NO: 1270278 - DNA, 22 bp, Artificial Sequence
  chemically synthesized
ttgcaaacatatgtttatgaag

SEQ ID NO: 1270279 - DNA, 22 bp, Artificial Sequence
  chemically synthesized
caaacatatgtttatgaagtcc

SEQ ID NO: 1270280 - DNA, 22 bp, Artificial Sequence
  chemically synthesized
atgaagtccctgcttcgttgac

SEQ ID NO: 1270281 - DNA, 22 bp, Artificial Sequence
  chemically synthesized
tgaagtccctgcttcgttgaca

SEQ ID NO: 1270282 - DNA, 22 bp, Artificial Sequence
  chemically synthesized
cttcgttgacattttttttctt

SEQ ID NO: 1270283 - DNA, 22 bp, Artificial Sequence
  chemically synthesized
cgttgacattttttttcttgtt

SEQ ID NO: 1270284 - DNA, 22 bp, Artificial Sequence
  chemically synthesized
gttgacattttttttcttgttc

SEQ ID NO: 1270285 - DNA, 22 bp, Artificial Sequence
  chemically synthesized
acattttttttcttgttcatat

SEQ ID NO: 1270286 - DNA, 22 bp, Artificial Sequence
  chemically synthesized
aaagaaaatccagccatatgaa

SEQ ID NO: 1270287 - DNA, 22 bp, Artificial Sequence
  chemically synthesized
tttttcttgttcatatggctgg

SEQ ID NO: 1270288 - DNA, 22 bp, Artificial Sequence
  chemically synthesized
ttttcttgttcatatggctgga

SEQ ID NO: 1270289 - DNA, 22 bp, Artificial Sequence
  chemically synthesized
tttcttgttcatatggctggat

SEQ ID NO: 1270290 - DNA, 22 bp, Artificial Sequence
  chemically synthesized
ttcttgttcatatggctggatt

SEQ ID NO: 1270291 - DNA, 22 bp, Artificial Sequence
  chemically synthesized
tcttgttcatatggctggattt

SEQ ID NO: 1270292 - DNA, 22 bp, Artificial Sequence
  chemically synthesized
cttgttcatatggctggatttt

SEQ ID NO: 1270293 - DNA, 22 bp, Artificial Sequence
  chemically synthesized
ttgttcatatggctggattttc

SEQ ID NO: 1270294 - DNA, 22 bp, Artificial Sequence
  chemically synthesized
gttcatatggctggattttctt

SEQ ID NO: 1270295 - DNA, 22 bp, Artificial Sequence
  chemically synthesized
ttcatatggctggattttcttt

SEQ ID NO: 1270296 - DNA, 22 bp, Artificial Sequence
  chemically synthesized
atatggctggattttctttgaa

SEQ ID NO: 1270297 - DNA, 22 bp, Artificial Sequence
  chemically synthesized
ccatacaaaagcccgtaaattc

SEQ ID NO: 1270298 - DNA, 22 bp, Artificial Sequence
  chemically synthesized
gattttctttgaatttacgggc

SEQ ID NO: 1270299 - DNA, 22 bp, Artificial Sequence
  chemically synthesized
tctttgaatttacgggcttttg

SEQ ID NO: 1270300 - DNA, 22 bp, Artificial Sequence
  chemically synthesized
ctttgaatttacgggcttttgt

SEQ ID NO: 1270301 - DNA, 22 bp, Artificial Sequence
  chemically synthesized
tttgaatttacgggcttttgta

SEQ ID NO: 1270302 - DNA, 22 bp, Artificial Sequence
  chemically synthesized
tgaatttacgggcttttgtatg

SEQ ID NO: 1270303 - DNA, 22 bp, Artificial Sequence
  chemically synthesized
gaatttacgggcttttgtatgg

SEQ ID NO: 1270304 - DNA, 22 bp, Artificial Sequence
  chemically synthesized
aatttacgggcttttgtatggg

SEQ ID NO: 1270305 - DNA, 22 bp, Artificial Sequence
  chemically synthesized
acgggcttttgtatgggagctg

SEQ ID NO: 1270306 - DNA, 22 bp, Artificial Sequence
  chemically synthesized
taaacaatatagcagctcccat

SEQ ID NO: 1270307 - DNA, 22 bp, Artificial Sequence
  chemically synthesized
cgggcttttgtatgggagctgc

SEQ ID NO: 1270308 - DNA, 22 bp, Artificial Sequence
  chemically synthesized
gtaaacaatatagcagctccca

SEQ ID NO: 1270309 - DNA, 22 bp, Artificial Sequence
  chemically synthesized
aacttgtaaacaatatagcagc

SEQ ID NO: 1270310 - DNA, 22 bp, Artificial Sequence
  chemically synthesized
ttgtatgggagctgctatattg

SEQ ID NO: 1270311 - DNA, 22 bp, Artificial Sequence
  chemically synthesized
tgtatgggagctgctatattgt

SEQ ID NO: 1270312 - DNA, 22 bp, Artificial Sequence
  chemically synthesized
gtatgggagctgctatattgtt

SEQ ID NO: 1270313 - DNA, 22 bp, Artificial Sequence
  chemically synthesized
tatgggagctgctatattgttt

SEQ ID NO: 1270314 - DNA, 22 bp, Artificial Sequence
  chemically synthesized
caagccattgaacttgtaaaca

SEQ ID NO: 1270315 - DNA, 22 bp, Artificial Sequence
  chemically synthesized
ctatattgtttacaagttcaat

SEQ ID NO: 1270316 - DNA, 22 bp, Artificial Sequence
  chemically synthesized
tattgtttacaagttcaatggc

SEQ ID NO: 1270317 - DNA, 22 bp, Artificial Sequence
  chemically synthesized
tttacaagttcaatggcttgca

SEQ ID NO: 1270318 - DNA, 22 bp, Artificial Sequence
  chemically synthesized
acaagttcaatggcttgcaacc

SEQ ID NO: 1270319 - DNA, 22 bp, Artificial Sequence
  chemically synthesized
caagttcaatggcttgcaacct

SEQ ID NO: 1270320 - DNA, 22 bp, Artificial Sequence
  chemically synthesized
taatgcacaggaaaggttgcaa

SEQ ID NO: 1270321 - DNA, 22 bp, Artificial Sequence
  chemically synthesized
aatggcttgcaacctttcctgt

SEQ ID NO: 1270322 - DNA, 22 bp, Artificial Sequence
  chemically synthesized
cccaggtgactataatgcacag

SEQ ID NO: 1270323 - DNA, 22 bp, Artificial Sequence
  chemically synthesized
gcaacctttcctgtgcattata

SEQ ID NO: 1270324 - DNA, 22 bp, Artificial Sequence
  chemically synthesized
caacctttcctgtgcattatag

SEQ ID NO: 1270325 - DNA, 22 bp, Artificial Sequence
  chemically synthesized
aaagctccccaggtgactataa

SEQ ID NO: 1270326 - DNA, 22 bp, Artificial Sequence
  chemically synthesized
aaaagctccccaggtgactata

SEQ ID NO: 1270327 - DNA, 22 bp, Artificial Sequence
  chemically synthesized
tcctgtgcattatagtcacctg

SEQ ID NO: 1270328 - DNA, 22 bp, Artificial Sequence
  chemically synthesized
cctgtgcattatagtcacctgg

SEQ ID NO: 1270329 - DNA, 22 bp, Artificial Sequence
  chemically synthesized
tttaaaagctccccaggtgact

SEQ ID NO: 1270330 - DNA, 22 bp, Artificial Sequence
  chemically synthesized
ctgtgcattatagtcacctggg

SEQ ID NO: 1270331 - DNA, 22 bp, Artificial Sequence
  chemically synthesized
tgcattatagtcacctggggag

SEQ ID NO: 1270332 - DNA, 22 bp, Artificial Sequence
  chemically synthesized
ggctgtttaaaagctccccagg

SEQ ID NO: 1270333 - DNA, 22 bp, Artificial Sequence
  chemically synthesized
tagtcacctggggagcttttaa

SEQ ID NO: 1270334 - DNA, 22 bp, Artificial Sequence
  chemically synthesized
gtcactgggctgtttaaaagct

SEQ ID NO: 1270335 - DNA, 22 bp, Artificial Sequence
  chemically synthesized
gggagcttttaaacagcccagt

SEQ ID NO: 1270336 - DNA, 22 bp, Artificial Sequence
  chemically synthesized
ggtggcaacctagtcactgggc

SEQ ID NO: 1270337 - DNA, 22 bp, Artificial Sequence
  chemically synthesized
aggtggcaacctagtcactggg

SEQ ID NO: 1270338 - DNA, 22 bp, Artificial Sequence
  chemically synthesized
ttaaacagcccagtgactaggt

SEQ ID NO: 1270339 - DNA, 22 bp, Artificial Sequence
  chemically synthesized
gtttaggtggcaacctagtcac

SEQ ID NO: 1270340 - DNA, 22 bp, Artificial Sequence
  chemically synthesized
taaacagcccagtgactaggtt

SEQ ID NO: 1270341 - DNA, 22 bp, Artificial Sequence
  chemically synthesized
aaacagcccagtgactaggttg

SEQ ID NO: 1270342 - DNA, 22 bp, Artificial Sequence
  chemically synthesized
aacagcccagtgactaggttgc

SEQ ID NO: 1270343 - DNA, 22 bp, Artificial Sequence
  chemically synthesized
attggtttaggtggcaacctag

SEQ ID NO: 1270344 - DNA, 22 bp, Artificial Sequence
  chemically synthesized
aattggtttaggtggcaaccta

SEQ ID NO: 1270345 - DNA, 22 bp, Artificial Sequence
  chemically synthesized
atttaattggtttaggtggcaa

SEQ ID NO: 1270346 - DNA, 22 bp, Artificial Sequence
  chemically synthesized
taatttaattggtttaggtggc

SEQ ID NO: 1270347 - DNA, 22 bp, Artificial Sequence
  chemically synthesized
ctaatttaattggtttaggtgg

SEQ ID NO: 1270348 - DNA, 22 bp, Artificial Sequence
  chemically synthesized
ggttgccacctaaaccaattaa

SEQ ID NO: 1270349 - DNA, 22 bp, Artificial Sequence
  chemically synthesized
ggaagtttctaatttaattggt

SEQ ID NO: 1270350 - DNA, 22 bp, Artificial Sequence
  chemically synthesized
ccacctaaaccaattaaattag

SEQ ID NO: 1270351 - DNA, 22 bp, Artificial Sequence
  chemically synthesized
aaccaattaaattagaaacttc

SEQ ID NO: 1270352 - DNA, 22 bp, Artificial Sequence
  chemically synthesized
ggtcccacctgggaagtttcta

SEQ ID NO: 1270353 - DNA, 22 bp, Artificial Sequence
  chemically synthesized
aattagaaacttcccaggtggg

SEQ ID NO: 1270354 - DNA, 22 bp, Artificial Sequence
  chemically synthesized
cagatgcctaggtcccacctgg

SEQ ID NO: 1270355 - DNA, 22 bp, Artificial Sequence
  chemically synthesized
acagatgcctaggtcccacctg

SEQ ID NO: 1270356 - DNA, 22 bp, Artificial Sequence
  chemically synthesized
gaaacttcccaggtgggaccta

SEQ ID NO: 1270357 - DNA, 22 bp, Artificial Sequence
  chemically synthesized
aaacttacagatgcctaggtcc

SEQ ID NO: 1270358 - DNA, 22 bp, Artificial Sequence
  chemically synthesized
aaaacttacagatgcctaggtc

SEQ ID NO: 1270359 - DNA, 22 bp, Artificial Sequence
  chemically synthesized
taaaacttacagatgcctaggt

SEQ ID NO: 1270360 - DNA, 22 bp, Artificial Sequence
  chemically synthesized
cccaggtgggacctaggcatct

SEQ ID NO: 1270361 - DNA, 22 bp, Artificial Sequence
  chemically synthesized
ccaggtgggacctaggcatctg

SEQ ID NO: 1270362 - DNA, 22 bp, Artificial Sequence
  chemically synthesized
ggcatctgtaagttttaaagac

SEQ ID NO: 1270363 - DNA, 22 bp, Artificial Sequence
  chemically synthesized
gaacatcacgagagtctttaaa

SEQ ID NO: 1270364 - DNA, 22 bp, Artificial Sequence
  chemically synthesized
agaacatcacgagagtctttaa

SEQ ID NO: 1270365 - DNA, 22 bp, Artificial Sequence
  chemically synthesized
taagttttaaagactctcgtga

SEQ ID NO: 1270366 - DNA, 22 bp, Artificial Sequence
  chemically synthesized
atatttagaacatcacgagagt

SEQ ID NO: 1270367 - DNA, 22 bp, Artificial Sequence
  chemically synthesized
ctgatatttagaacatcacgag

SEQ ID NO: 1270368 - DNA, 22 bp, Artificial Sequence
  chemically synthesized
gctgatatttagaacatcacga

SEQ ID NO: 1270369 - DNA, 22 bp, Artificial Sequence
  chemically synthesized
tgctgatatttagaacatcacg

SEQ ID NO: 1270370 - DNA, 22 bp, Artificial Sequence
  chemically synthesized
taaagactctcgtgatgttcta

SEQ ID NO: 1270371 - DNA, 22 bp, Artificial Sequence
  chemically synthesized
aaagactctcgtgatgttctaa

SEQ ID NO: 1270372 - DNA, 22 bp, Artificial Sequence
  chemically synthesized
aagactctcgtgatgttctaaa

SEQ ID NO: 1270373 - DNA, 22 bp, Artificial Sequence
  chemically synthesized
cctttgctgatatttagaacat

SEQ ID NO: 1270374 - DNA, 22 bp, Artificial Sequence
  chemically synthesized
tgcctttgctgatatttagaac

SEQ ID NO: 1270375 - DNA, 22 bp, Artificial Sequence
  chemically synthesized
tcgtgatgttctaaatatcagc

SEQ ID NO: 1270376 - DNA, 22 bp, Artificial Sequence
  chemically synthesized
gtgatgttctaaatatcagcaa

SEQ ID NO: 1270377 - DNA, 22 bp, Artificial Sequence
  chemically synthesized
aatggtcctctgcctttgctga

SEQ ID NO: 1270378 - DNA, 22 bp, Artificial Sequence
  chemically synthesized
taaatatcagcaaaggcagagg

SEQ ID NO: 1270379 - DNA, 22 bp, Artificial Sequence
  chemically synthesized
aatatcagcaaaggcagaggac

SEQ ID NO: 1270380 - DNA, 22 bp, Artificial Sequence
  chemically synthesized
acaagctcaatggtcctctgcc

SEQ ID NO: 1270381 - DNA, 22 bp, Artificial Sequence
  chemically synthesized
taacaagctcaatggtcctctg

SEQ ID NO: 1270382 - DNA, 22 bp, Artificial Sequence
  chemically synthesized
ccaaatattctaacaagctcaa

SEQ ID NO: 1270383 - DNA, 22 bp, Artificial Sequence
  chemically synthesized
cccaaatattctaacaagctca

SEQ ID NO: 1270384 - DNA, 22 bp, Artificial Sequence
  chemically synthesized
tcccaaatattctaacaagctc

SEQ ID NO: 1270385 - DNA, 22 bp, Artificial Sequence
  chemically synthesized
gaaacaccctttcccaaatatt

SEQ ID NO: 1270386 - DNA, 22 bp, Artificial Sequence
  chemically synthesized
agaaacaccctttcccaaatat

SEQ ID NO: 1270387 - DNA, 22 bp, Artificial Sequence
  chemically synthesized
agcttgttagaatatttgggaa

SEQ ID NO: 1270388 - DNA, 22 bp, Artificial Sequence
  chemically synthesized
atcttagaaacaccctttccca

SEQ ID NO: 1270389 - DNA, 22 bp, Artificial Sequence
  chemically synthesized
gttagaatatttgggaaagggt

SEQ ID NO: 1270390 - DNA, 22 bp, Artificial Sequence
  chemically synthesized
aatcttagaaacaccctttccc

SEQ ID NO: 1270391 - DNA, 22 bp, Artificial Sequence
  chemically synthesized
ttagaatatttgggaaagggtg

SEQ ID NO: 1270392 - DNA, 22 bp, Artificial Sequence
  chemically synthesized
taatcttagaaacaccctttcc

SEQ ID NO: 1270393 - DNA, 22 bp, Artificial Sequence
  chemically synthesized
gaatatttgggaaagggtgttt

SEQ ID NO: 1270394 - DNA, 22 bp, Artificial Sequence
  chemically synthesized
agttttaatcttagaaacaccc

SEQ ID NO: 1270395 - DNA, 22 bp, Artificial Sequence
  chemically synthesized
aagttttaatcttagaaacacc

SEQ ID NO: 1270396 - DNA, 22 bp, Artificial Sequence
  chemically synthesized
gggaaagggtgtttctaagatt

SEQ ID NO: 1270397 - DNA, 22 bp, Artificial Sequence
  chemically synthesized
ggaaagggtgtttctaagatta

SEQ ID NO: 1270398 - DNA, 22 bp, Artificial Sequence
  chemically synthesized
cgaaatacataagccttaagtt

SEQ ID NO: 1270399 - DNA, 22 bp, Artificial Sequence
  chemically synthesized
acgaaatacataagccttaagt

SEQ ID NO: 1270400 - DNA, 22 bp, Artificial Sequence
  chemically synthesized
ctaagattaaaacttaaggctt

SEQ ID NO: 1270401 - DNA, 22 bp, Artificial Sequence
  chemically synthesized
taagattaaaacttaaggctta

SEQ ID NO: 1270402 - DNA, 22 bp, Artificial Sequence
  chemically synthesized
agattaaaacttaaggcttatg

SEQ ID NO: 1270403 - DNA, 22 bp, Artificial Sequence
  chemically synthesized
cgtttacgaaatacataagcct

SEQ ID NO: 1270404 - DNA, 22 bp, Artificial Sequence
  chemically synthesized
aaacttaaggcttatgtatttc

SEQ ID NO: 1270405 - DNA, 22 bp, Artificial Sequence
  chemically synthesized
aagcagctgcgtttacgaaata

SEQ ID NO: 1270406 - DNA, 22 bp, Artificial Sequence
  chemically synthesized
aaggcttatgtatttcgtaaac

SEQ ID NO: 1270407 - DNA, 22 bp, Artificial Sequence
  chemically synthesized
aggcttatgtatttcgtaaacg

SEQ ID NO: 1270408 - DNA, 22 bp, Artificial Sequence
  chemically synthesized
ttaaagcagctgcgtttacgaa

SEQ ID NO: 1270409 - DNA, 22 bp, Artificial Sequence
  chemically synthesized
gttaaagcagctgcgtttacga

SEQ ID NO: 1270410 - DNA, 22 bp, Artificial Sequence
  chemically synthesized
atttgttaaagcagctgcgttt

SEQ ID NO: 1270411 - DNA, 22 bp, Artificial Sequence
  chemically synthesized
atgtatttcgtaaacgcagctg

SEQ ID NO: 1270412 - DNA, 22 bp, Artificial Sequence
  chemically synthesized
tgtatttcgtaaacgcagctgc

SEQ ID NO: 1270413 - DNA, 22 bp, Artificial Sequence
  chemically synthesized
ctaatttgttaaagcagctgcg

SEQ ID NO: 1270414 - DNA, 22 bp, Artificial Sequence
  chemically synthesized
actaatttgttaaagcagctgc

SEQ ID NO: 1270415 - DNA, 22 bp, Artificial Sequence
  chemically synthesized
tttactaatttgttaaagcagc

SEQ ID NO: 1270416 - DNA, 22 bp, Artificial Sequence
  chemically synthesized
gtttactaatttgttaaagcag

SEQ ID NO: 1270417 - DNA, 22 bp, Artificial Sequence
  chemically synthesized
cgtaaacgcagctgctttaaca

SEQ ID NO: 1270418 - DNA, 22 bp, Artificial Sequence
  chemically synthesized
gtaaacgcagctgctttaacaa

SEQ ID NO: 1270419 - DNA, 22 bp, Artificial Sequence
  chemically synthesized
gcttgtttactaatttgttaaa

SEQ ID NO: 1270420 - DNA, 22 bp, Artificial Sequence
  chemically synthesized
ggattagcttgtttactaattt

SEQ ID NO: 1270421 - DNA, 22 bp, Artificial Sequence
  chemically synthesized
ctttaacaaattagtaaacaag

SEQ ID NO: 1270422 - DNA, 22 bp, Artificial Sequence
  chemically synthesized
taacaaattagtaaacaagcta

SEQ ID NO: 1270423 - DNA, 22 bp, Artificial Sequence
  chemically synthesized
aacaaattagtaaacaagctaa

SEQ ID NO: 1270424 - DNA, 22 bp, Artificial Sequence
  chemically synthesized
gagatactaggattagcttgtt

SEQ ID NO: 1270425 - DNA, 22 bp, Artificial Sequence
  chemically synthesized
acaaattagtaaacaagctaat

SEQ ID NO: 1270426 - DNA, 22 bp, Artificial Sequence
  chemically synthesized
agagatactaggattagcttgt

SEQ ID NO: 1270427 - DNA, 22 bp, Artificial Sequence
  chemically synthesized
tagagatactaggattagcttg

SEQ ID NO: 1270428 - DNA, 22 bp, Artificial Sequence
  chemically synthesized
ttagagatactaggattagctt

SEQ ID NO: 1270429 - DNA, 22 bp, Artificial Sequence
  chemically synthesized
tttagagatactaggattagct

SEQ ID NO: 1270430 - DNA, 22 bp, Artificial Sequence
  chemically synthesized
gtaaacaagctaatcctagtat

SEQ ID NO: 1270431 - DNA, 22 bp, Artificial Sequence
  chemically synthesized
gtgttttttagagatactagga

SEQ ID NO: 1270432 - DNA, 22 bp, Artificial Sequence
  chemically synthesized
aactagtgttttttagagatac

SEQ ID NO: 1270433 - DNA, 22 bp, Artificial Sequence
  chemically synthesized
atcctagtatctctaaaaaaca

SEQ ID NO: 1270434 - DNA, 22 bp, Artificial Sequence
  chemically synthesized
gtatctctaaaaaacactagtt

SEQ ID NO: 1270435 - DNA, 22 bp, Artificial Sequence
  chemically synthesized
caggcaaaattaaactagtgtt

SEQ ID NO: 1270436 - DNA, 22 bp, Artificial Sequence
  chemically synthesized
cagctccaggcaaaattaaact

SEQ ID NO: 1270437 - DNA, 22 bp, Artificial Sequence
  chemically synthesized
taaaaaacactagtttaatttt

SEQ ID NO: 1270438 - DNA, 22 bp, Artificial Sequence
  chemically synthesized
aaaaacactagtttaattttgc

SEQ ID NO: 1270439 - DNA, 22 bp, Artificial Sequence
  chemically synthesized
agaactgcagctccaggcaaaa

SEQ ID NO: 1270440 - DNA, 22 bp, Artificial Sequence
  chemically synthesized
gtttaattttgcctggagctgc

SEQ ID NO: 1270441 - DNA, 22 bp, Artificial Sequence
  chemically synthesized
aattttgcctggagctgcagtt

SEQ ID NO: 1270442 - DNA, 22 bp, Artificial Sequence
  chemically synthesized
attttgcctggagctgcagttc

SEQ ID NO: 1270443 - DNA, 22 bp, Artificial Sequence
  chemically synthesized
gacaatatattgagaactgcag

SEQ ID NO: 1270444 - DNA, 22 bp, Artificial Sequence
  chemically synthesized
tgcctggagctgcagttctcaa

SEQ ID NO: 1270445 - DNA, 22 bp, Artificial Sequence
  chemically synthesized
gcctggagctgcagttctcaat

SEQ ID NO: 1270446 - DNA, 22 bp, Artificial Sequence
  chemically synthesized
cctggagctgcagttctcaata

SEQ ID NO: 1270447 - DNA, 22 bp, Artificial Sequence
  chemically synthesized
gagctgcagttctcaatatatt

SEQ ID NO: 1270448 - DNA, 22 bp, Artificial Sequence
  chemically synthesized
cagttctcaatatattgtccag

SEQ ID NO: 1270449 - DNA, 22 bp, Artificial Sequence
  chemically synthesized
catggaggatatgctggacaat

SEQ ID NO: 1270450 - DNA, 22 bp, Artificial Sequence
  chemically synthesized
cctgcatggaggatatgctgga

SEQ ID NO: 1270451 - DNA, 22 bp, Artificial Sequence
  chemically synthesized
tcaatatattgtccagcatatc

SEQ ID NO: 1270452 - DNA, 22 bp, Artificial Sequence
  chemically synthesized
ccctgcatggaggatatgctgg

SEQ ID NO: 1270453 - DNA, 22 bp, Artificial Sequence
  chemically synthesized
aatatattgtccagcatatcct

SEQ ID NO: 1270454 - DNA, 22 bp, Artificial Sequence
  chemically synthesized
tccagcatatcctccatgcagg

SEQ ID NO: 1270455 - DNA, 22 bp, Artificial Sequence
  chemically synthesized
gtgtatacagtggtttccctgc

SEQ ID NO: 1270456 - DNA, 22 bp, Artificial Sequence
  chemically synthesized
catgcagggaaaccactgtata

SEQ ID NO: 1270457 - DNA, 22 bp, Artificial Sequence
  chemically synthesized
ataagtattggtgtatacagtg

SEQ ID NO: 1270458 - DNA, 22 bp, Artificial Sequence
  chemically synthesized
cctcataagtattggtgtatac

SEQ ID NO: 1270459 - DNA, 22 bp, Artificial Sequence
  chemically synthesized
tatacaccaatacttatgaggg

SEQ ID NO: 1270460 - DNA, 22 bp, Artificial Sequence
  chemically synthesized
aaaaatcatcctccctcataag

SEQ ID NO: 1270461 - DNA, 22 bp, Artificial Sequence
  chemically synthesized
cagttgaaaaatcatcctccct

SEQ ID NO: 1270462 - DNA, 22 bp, Artificial Sequence
  chemically synthesized
gcagttgaaaaatcatcctccc

SEQ ID NO: 1270463 - DNA, 22 bp, Artificial Sequence
  chemically synthesized
aagatttgcagttgaaaaatca

SEQ ID NO: 1270464 - DNA, 22 bp, Artificial Sequence
  chemically synthesized
atgagggaggatgatttttcaa

SEQ ID NO: 1270465 - DNA, 22 bp, Artificial Sequence
  chemically synthesized
tgagggaggatgatttttcaac

SEQ ID NO: 1270466 - DNA, 22 bp, Artificial Sequence
  chemically synthesized
aaaggcaattaaagatttgcag

SEQ ID NO: 1270467 - DNA, 22 bp, Artificial Sequence
  chemically synthesized
taaaaggcaattaaagatttgc

SEQ ID NO: 1270468 - DNA, 22 bp, Artificial Sequence
  chemically synthesized
ctaaaaggcaattaaagatttg

SEQ ID NO: 1270469 - DNA, 22 bp, Artificial Sequence
  chemically synthesized
tctaaaaggcaattaaagattt

SEQ ID NO: 1270470 - DNA, 22 bp, Artificial Sequence
  chemically synthesized
ttcaactgcaaatctttaattg

SEQ ID NO: 1270471 - DNA, 22 bp, Artificial Sequence
  chemically synthesized
tcaactgcaaatctttaattgc

SEQ ID NO: 1270472 - DNA, 22 bp, Artificial Sequence
  chemically synthesized
caactgcaaatctttaattgcc

SEQ ID NO: 1270473 - DNA, 22 bp, Artificial Sequence
  chemically synthesized
aactgcaaatctttaattgcct

SEQ ID NO: 1270474 - DNA, 22 bp, Artificial Sequence
  chemically synthesized
gatggattttctaaaaggcaat

SEQ ID NO: 1270475 - DNA, 22 bp, Artificial Sequence
  chemically synthesized
caaatctttaattgccttttag

SEQ ID NO: 1270476 - DNA, 22 bp, Artificial Sequence
  chemically synthesized
taattgccttttagaaaatcca

SEQ ID NO: 1270477 - DNA, 22 bp, Artificial Sequence
  chemically synthesized
aggaaaactggatggattttct

SEQ ID NO: 1270478 - DNA, 22 bp, Artificial Sequence
  chemically synthesized
aattgccttttagaaaatccat

SEQ ID NO: 1270479 - DNA, 22 bp, Artificial Sequence
  chemically synthesized
aaggaaaactggatggattttc

SEQ ID NO: 1270480 - DNA, 22 bp, Artificial Sequence
  chemically synthesized
attgccttttagaaaatccatc

SEQ ID NO: 1270481 - DNA, 22 bp, Artificial Sequence
  chemically synthesized
cttaaggaaaactggatggatt

SEQ ID NO: 1270482 - DNA, 22 bp, Artificial Sequence
  chemically synthesized
gcttaaggaaaactggatggat

SEQ ID NO: 1270483 - DNA, 22 bp, Artificial Sequence
  chemically synthesized
ccttttagaaaatccatccagt

SEQ ID NO: 1270484 - DNA, 22 bp, Artificial Sequence
  chemically synthesized
ttagaaaatccatccagttttc

SEQ ID NO: 1270485 - DNA, 22 bp, Artificial Sequence
  chemically synthesized
tagaaaatccatccagttttcc

SEQ ID NO: 1270486 - DNA, 22 bp, Artificial Sequence
  chemically synthesized
aaacttgcttaaggaaaactgg

SEQ ID NO: 1270487 - DNA, 22 bp, Artificial Sequence
  chemically synthesized
agaaaatccatccagttttcct

SEQ ID NO: 1270488 - DNA, 22 bp, Artificial Sequence
  chemically synthesized
gaaaatccatccagttttcctt

SEQ ID NO: 1270489 - DNA, 22 bp, Artificial Sequence
  chemically synthesized
taaaacttgcttaaggaaaact

SEQ ID NO: 1270490 - DNA, 22 bp, Artificial Sequence
  chemically synthesized
ctaaaacttgcttaaggaaaac

SEQ ID NO: 1270491 - DNA, 22 bp, Artificial Sequence
  chemically synthesized
tctaaaacttgcttaaggaaaa

SEQ ID NO: 1270492 - DNA, 22 bp, Artificial Sequence
  chemically synthesized
gtgtatgtgctttctaaaactt

SEQ ID NO: 1270493 - DNA, 22 bp, Artificial Sequence
  chemically synthesized
tccttaagcaagttttagaaag

SEQ ID NO: 1270494 - DNA, 22 bp, Artificial Sequence
  chemically synthesized
ctcgtgtatgtgctttctaaaa

SEQ ID NO: 1270495 - DNA, 22 bp, Artificial Sequence
  chemically synthesized
ccttaagcaagttttagaaagc

SEQ ID NO: 1270496 - DNA, 22 bp, Artificial Sequence
  chemically synthesized
cttaagcaagttttagaaagca

SEQ ID NO: 1270497 - DNA, 22 bp, Artificial Sequence
  chemically synthesized
aagcaagttttagaaagcacat

SEQ ID NO: 1270498 - DNA, 22 bp, Artificial Sequence
  chemically synthesized
agcaagttttagaaagcacata

SEQ ID NO: 1270499 - DNA, 22 bp, Artificial Sequence
  chemically synthesized
taattgctcgtgtatgtgcttt

SEQ ID NO: 1270500 - DNA, 22 bp, Artificial Sequence
  chemically synthesized
gtaattgctcgtgtatgtgctt

SEQ ID NO: 1270501 - DNA, 22 bp, Artificial Sequence
  chemically synthesized
tagaaagcacatacacgagcaa

SEQ ID NO: 1270502 - DNA, 22 bp, Artificial Sequence
  chemically synthesized
agaaagcacatacacgagcaat

SEQ ID NO: 1270503 - DNA, 22 bp, Artificial Sequence
  chemically synthesized
gaaagcacatacacgagcaatt

SEQ ID NO: 1270504 - DNA, 22 bp, Artificial Sequence
  chemically synthesized
aaggccagatttgtaattgctc

SEQ ID NO: 1270505 - DNA, 22 bp, Artificial Sequence
  chemically synthesized
ggctgaaggccagatttgtaat

SEQ ID NO: 1270506 - DNA, 22 bp, Artificial Sequence
  chemically synthesized
agttaggctgaaggccagattt

SEQ ID NO: 1270507 - DNA, 22 bp, Artificial Sequence
  chemically synthesized
gagttaggctgaaggccagatt

SEQ ID NO: 1270508 - DNA, 22 bp, Artificial Sequence
  chemically synthesized
ttgagttaggctgaaggccaga

SEQ ID NO: 1270509 - DNA, 22 bp, Artificial Sequence
  chemically synthesized
attcttgagttaggctgaaggc

SEQ ID NO: 1270510 - DNA, 22 bp, Artificial Sequence
  chemically synthesized
aattcttgagttaggctgaagg

SEQ ID NO: 1270511 - DNA, 22 bp, Artificial Sequence
  chemically synthesized
taattcttgagttaggctgaag

SEQ ID NO: 1270512 - DNA, 22 bp, Artificial Sequence
  chemically synthesized
ttaattcttgagttaggctgaa

SEQ ID NO: 1270513 - DNA, 22 bp, Artificial Sequence
  chemically synthesized
caaatctggccttcagcctaac

SEQ ID NO: 1270514 - DNA, 22 bp, Artificial Sequence
  chemically synthesized
tttaattcttgagttaggctga

SEQ ID NO: 1270515 - DNA, 22 bp, Artificial Sequence
  chemically synthesized
ttttaattcttgagttaggctg

SEQ ID NO: 1270516 - DNA, 22 bp, Artificial Sequence
  chemically synthesized
tttttttaattcttgagttagg

SEQ ID NO: 1270517 - DNA, 22 bp, Artificial Sequence
  chemically synthesized
atttttttaattcttgagttag

SEQ ID NO: 1270518 - DNA, 22 bp, Artificial Sequence
  chemically synthesized
tatttttttaattcttgagtta

SEQ ID NO: 1270519 - DNA, 22 bp, Artificial Sequence
  chemically synthesized
gccttcagcctaactcaagaat

SEQ ID NO: 1270520 - DNA, 22 bp, Artificial Sequence
  chemically synthesized
agattttatttttttaattctt

SEQ ID NO: 1270521 - DNA, 22 bp, Artificial Sequence
  chemically synthesized
cagcctaactcaagaattaaaa

SEQ ID NO: 1270522 - DNA, 22 bp, Artificial Sequence
  chemically synthesized
gagattttatttttttaattct

SEQ ID NO: 1270523 - DNA, 22 bp, Artificial Sequence
  chemically synthesized
agcctaactcaagaattaaaaa

SEQ ID NO: 1270524 - DNA, 22 bp, Artificial Sequence
  chemically synthesized
tgagattttatttttttaattc

SEQ ID NO: 1270525 - DNA, 22 bp, Artificial Sequence
  chemically synthesized
actttgagattttattttttta

SEQ ID NO: 1270526 - DNA, 22 bp, Artificial Sequence
  chemically synthesized
cactttgagattttattttttt

SEQ ID NO: 1270527 - DNA, 22 bp, Artificial Sequence
  chemically synthesized
actcaagaattaaaaaaataaa

SEQ ID NO: 1270528 - DNA, 22 bp, Artificial Sequence
  chemically synthesized
aagaattaaaaaaataaaatct

SEQ ID NO: 1270529 - DNA, 22 bp, Artificial Sequence
  chemically synthesized
atacaacttcactttgagattt

SEQ ID NO: 1270530 - DNA, 22 bp, Artificial Sequence
  chemically synthesized
aaaaaataaaatctcaaagtga

SEQ ID NO: 1270531 - DNA, 22 bp, Artificial Sequence
  chemically synthesized
aaagtgaagttgtattaattct

SEQ ID NO: 1270532 - DNA, 22 bp, Artificial Sequence
  chemically synthesized
tattaattctttttttctcctt

SEQ ID NO: 1270533 - DNA, 22 bp, Artificial Sequence
  chemically synthesized
tgaaataaaagtaaggagaaaa

SEQ ID NO: 1270534 - DNA, 22 bp, Artificial Sequence
  chemically synthesized
atgaaataaaagtaaggagaaa

SEQ ID NO: 1270535 - DNA, 22 bp, Artificial Sequence
  chemically synthesized
tatgaaataaaagtaaggagaa

SEQ ID NO: 1270536 - DNA, 22 bp, Artificial Sequence
  chemically synthesized
ttatgaaataaaagtaaggaga

SEQ ID NO: 1270537 - DNA, 22 bp, Artificial Sequence
  chemically synthesized
attctttttttctccttacttt

SEQ ID NO: 1270538 - DNA, 22 bp, Artificial Sequence
  chemically synthesized
tttttatgaaataaaagtaagg

SEQ ID NO: 1270539 - DNA, 22 bp, Artificial Sequence
  chemically synthesized
tttttttctccttacttttatt

SEQ ID NO: 1270540 - DNA, 22 bp, Artificial Sequence
  chemically synthesized
tttttctccttacttttatttc

SEQ ID NO: 1270541 - DNA, 22 bp, Artificial Sequence
  chemically synthesized
ttttctccttacttttatttca

SEQ ID NO: 1270542 - DNA, 22 bp, Artificial Sequence
  chemically synthesized
tttctccttacttttatttcat

SEQ ID NO: 1270543 - DNA, 22 bp, Artificial Sequence
  chemically synthesized
ttctccttacttttatttcata

SEQ ID NO: 1270544 - DNA, 22 bp, Artificial Sequence
  chemically synthesized
tctccttacttttatttcataa

SEQ ID NO: 1270545 - DNA, 22 bp, Artificial Sequence
  chemically synthesized
ctccttacttttatttcataaa

SEQ ID NO: 1270546 - DNA, 22 bp, Artificial Sequence
  chemically synthesized
tccttacttttatttcataaaa

SEQ ID NO: 1270547 - DNA, 22 bp, Artificial Sequence
  chemically synthesized
cttacttttatttcataaaaat

SEQ ID NO: 1270548 - DNA, 22 bp, Artificial Sequence
  chemically synthesized
tgataaagatgtctatttttat

SEQ ID NO: 1270549 - DNA, 22 bp, Artificial Sequence
  chemically synthesized
acttttatttcataaaaataga

SEQ ID NO: 1270550 - DNA, 22 bp, Artificial Sequence
  chemically synthesized
atgataaagatgtctattttta

SEQ ID NO: 1270551 - DNA, 22 bp, Artificial Sequence
  chemically synthesized
cttttatttcataaaaatagac

SEQ ID NO: 1270552 - DNA, 22 bp, Artificial Sequence
  chemically synthesized
tatgataaagatgtctattttt

SEQ ID NO: 1270553 - DNA, 22 bp, Artificial Sequence
  chemically synthesized
ttatttcataaaaatagacatc

SEQ ID NO: 1270554 - DNA, 22 bp, Artificial Sequence
  chemically synthesized
tatttcataaaaatagacatct

SEQ ID NO: 1270555 - DNA, 22 bp, Artificial Sequence
  chemically synthesized
atttcataaaaatagacatctt

SEQ ID NO: 1270556 - DNA, 22 bp, Artificial Sequence
  chemically synthesized
tttcataaaaatagacatcttt

SEQ ID NO: 1270557 - DNA, 22 bp, Artificial Sequence
  chemically synthesized
cataaaaatagacatctttatc

SEQ ID NO: 1270558 - DNA, 22 bp, Artificial Sequence
  chemically synthesized
ataaaaatagacatctttatca

SEQ ID NO: 1270559 - DNA, 22 bp, Artificial Sequence
  chemically synthesized
tatcataaaactggcttcttga

SEQ ID NO: 1270560 - DNA, 22 bp, Artificial Sequence
  chemically synthesized
atcataaaactggcttcttgac

SEQ ID NO: 1270561 - DNA, 22 bp, Artificial Sequence
  chemically synthesized
tcataaaactggcttcttgaca

SEQ ID NO: 1270562 - DNA, 22 bp, Artificial Sequence
  chemically synthesized
gcttcttgacatcatttggggc

SEQ ID NO: 1270563 - DNA, 22 bp, Artificial Sequence
  chemically synthesized
agagggaaagtggccccaaatg

SEQ ID NO: 1270564 - DNA, 22 bp, Artificial Sequence
  chemically synthesized
cagagggaaagtggccccaaat

SEQ ID NO: 1270565 - DNA, 22 bp, Artificial Sequence
  chemically synthesized
tcagagggaaagtggccccaaa

SEQ ID NO: 1270566 - DNA, 22 bp, Artificial Sequence
  chemically synthesized
cttgacatcatttggggccact

SEQ ID NO: 1270567 - DNA, 22 bp, Artificial Sequence
  chemically synthesized
ttgacatcatttggggccactt

SEQ ID NO: 1270568 - DNA, 22 bp, Artificial Sequence
  chemically synthesized
tctttcagagggaaagtggccc

SEQ ID NO: 1270569 - DNA, 22 bp, Artificial Sequence
  chemically synthesized
gacatcatttggggccactttc

SEQ ID NO: 1270570 - DNA, 22 bp, Artificial Sequence
  chemically synthesized
acatcatttggggccactttcc

SEQ ID NO: 1270571 - DNA, 22 bp, Artificial Sequence
  chemically synthesized
gaattgtctttcagagggaaag

SEQ ID NO: 1270572 - DNA, 22 bp, Artificial Sequence
  chemically synthesized
ggggccactttccctctgaaag

SEQ ID NO: 1270573 - DNA, 22 bp, Artificial Sequence
  chemically synthesized
gggccactttccctctgaaaga

SEQ ID NO: 1270574 - DNA, 22 bp, Artificial Sequence
  chemically synthesized
tccctctgaaagacaattctaa

SEQ ID NO: 1270575 - DNA, 22 bp, Artificial Sequence
  chemically synthesized
ccctctgaaagacaattctaat

SEQ ID NO: 1270576 - DNA, 22 bp, Artificial Sequence
  chemically synthesized
cctctgaaagacaattctaatt

SEQ ID NO: 1270577 - DNA, 22 bp, Artificial Sequence
  chemically synthesized
agaacaagtaaatgcaattaga

SEQ ID NO: 1270578 - DNA, 22 bp, Artificial Sequence
  chemically synthesized
tgaaagacaattctaattgcat

SEQ ID NO: 1270579 - DNA, 22 bp, Artificial Sequence
  chemically synthesized
tgagaacaagtaaatgcaatta

SEQ ID NO: 1270580 - DNA, 22 bp, Artificial Sequence
  chemically synthesized
aaagacaattctaattgcattt

SEQ ID NO: 1270581 - DNA, 22 bp, Artificial Sequence
  chemically synthesized
taattgcatttacttgttctca

SEQ ID NO: 1270582 - DNA, 22 bp, Artificial Sequence
  chemically synthesized
attgcatttacttgttctcaga

SEQ ID NO: 1270583 - DNA, 22 bp, Artificial Sequence
  chemically synthesized
aaaaaatgtatgattctgagaa

SEQ ID NO: 1270584 - DNA, 22 bp, Artificial Sequence
  chemically synthesized
aaaaaaatgtatgattctgaga

SEQ ID NO: 1270585 - DNA, 22 bp, Artificial Sequence
  chemically synthesized
catttacttgttctcagaatca

SEQ ID NO: 1270586 - DNA, 22 bp, Artificial Sequence
  chemically synthesized
taaaaaaatgtatgattctgag

SEQ ID NO: 1270587 - DNA, 22 bp, Artificial Sequence
  chemically synthesized
ttaaaaaaatgtatgattctga

SEQ ID NO: 1270588 - DNA, 22 bp, Artificial Sequence
  chemically synthesized
acttgttctcagaatcatacat

SEQ ID NO: 1270589 - DNA, 22 bp, Artificial Sequence
  chemically synthesized
atttttaaaaaaatgtatgatt

SEQ ID NO: 1270590 - DNA, 22 bp, Artificial Sequence
  chemically synthesized
cttgttctcagaatcatacatt

SEQ ID NO: 1270591 - DNA, 22 bp, Artificial Sequence
  chemically synthesized
catttttaaaaaaatgtatgat

SEQ ID NO: 1270592 - DNA, 22 bp, Artificial Sequence
  chemically synthesized
tcatttttaaaaaaatgtatga

SEQ ID NO: 1270593 - DNA, 22 bp, Artificial Sequence
  chemically synthesized
gttctcagaatcatacattttt

SEQ ID NO: 1270594 - DNA, 22 bp, Artificial Sequence
  chemically synthesized
ttctcagaatcatacatttttt

SEQ ID NO: 1270595 - DNA, 22 bp, Artificial Sequence
  chemically synthesized
ttttcatttttaaaaaaatgta

SEQ ID NO: 1270596 - DNA, 22 bp, Artificial Sequence
  chemically synthesized
tcagaatcatacatttttttaa

SEQ ID NO: 1270597 - DNA, 22 bp, Artificial Sequence
  chemically synthesized
agaatcatacatttttttaaaa

SEQ ID NO: 1270598 - DNA, 22 bp, Artificial Sequence
  chemically synthesized
gtgtacaaactattttcatttt

SEQ ID NO: 1270599 - DNA, 22 bp, Artificial Sequence
  chemically synthesized
ttttaaaaatgaaaatagtttg

SEQ ID NO: 1270600 - DNA, 22 bp, Artificial Sequence
  chemically synthesized
gcaactcgtgtacaaactattt

SEQ ID NO: 1270601 - DNA, 22 bp, Artificial Sequence
  chemically synthesized
tttaaaaatgaaaatagtttgt

SEQ ID NO: 1270602 - DNA, 22 bp, Artificial Sequence
  chemically synthesized
ggcaactcgtgtacaaactatt

SEQ ID NO: 1270603 - DNA, 22 bp, Artificial Sequence
  chemically synthesized
ttaaaaatgaaaatagtttgta

SEQ ID NO: 1270604 - DNA, 22 bp, Artificial Sequence
  chemically synthesized
tggcaactcgtgtacaaactat

SEQ ID NO: 1270605 - DNA, 22 bp, Artificial Sequence
  chemically synthesized
taaaaatgaaaatagtttgtac

SEQ ID NO: 1270606 - DNA, 22 bp, Artificial Sequence
  chemically synthesized
aaaaatgaaaatagtttgtaca

SEQ ID NO: 1270607 - DNA, 22 bp, Artificial Sequence
  chemically synthesized
tttggcaactcgtgtacaaact

SEQ ID NO: 1270608 - DNA, 22 bp, Artificial Sequence
  chemically synthesized
aaaatgaaaatagtttgtacac

SEQ ID NO: 1270609 - DNA, 22 bp, Artificial Sequence
  chemically synthesized
gaccattctttggcaactcgtg

SEQ ID NO: 1270610 - DNA, 22 bp, Artificial Sequence
  chemically synthesized
aattagaccattctttggcaac

SEQ ID NO: 1270611 - DNA, 22 bp, Artificial Sequence
  chemically synthesized
gtacacgagttgccaaagaatg

SEQ ID NO: 1270612 - DNA, 22 bp, Artificial Sequence
  chemically synthesized
tacacgagttgccaaagaatgg

SEQ ID NO: 1270613 - DNA, 22 bp, Artificial Sequence
  chemically synthesized
acactgaattagaccattcttt

SEQ ID NO: 1270614 - DNA, 22 bp, Artificial Sequence
  chemically synthesized
tcctgacactgaattagaccat

SEQ ID NO: 1270615 - DNA, 22 bp, Artificial Sequence
  chemically synthesized
gtcctgacactgaattagacca

SEQ ID NO: 1270616 - DNA, 22 bp, Artificial Sequence
  chemically synthesized
tgtcctgacactgaattagacc

SEQ ID NO: 1270617 - DNA, 22 bp, Artificial Sequence
  chemically synthesized
ccaaagaatggtctaattcagt

SEQ ID NO: 1270618 - DNA, 22 bp, Artificial Sequence
  chemically synthesized
gaccatctttgtcctgacactg

SEQ ID NO: 1270619 - DNA, 22 bp, Artificial Sequence
  chemically synthesized
attcagtgtcaggacaaagatg

SEQ ID NO: 1270620 - DNA, 22 bp, Artificial Sequence
  chemically synthesized
agtgtcaggacaaagatggtct

SEQ ID NO: 1270621 - DNA, 22 bp, Artificial Sequence
  chemically synthesized
aataatgcaaaattagaccatc

SEQ ID NO: 1270622 - DNA, 22 bp, Artificial Sequence
  chemically synthesized
gatgactaaataatgcaaaatt

SEQ ID NO: 1270623 - DNA, 22 bp, Artificial Sequence
  chemically synthesized
attagatgactaaataatgcaa

SEQ ID NO: 1270624 - DNA, 22 bp, Artificial Sequence
  chemically synthesized
aattagatgactaaataatgca

SEQ ID NO: 1270625 - DNA, 22 bp, Artificial Sequence
  chemically synthesized
taattagatgactaaataatgc

SEQ ID NO: 1270626 - DNA, 22 bp, Artificial Sequence
  chemically synthesized
ttaattagatgactaaataatg

SEQ ID NO: 1270627 - DNA, 22 bp, Artificial Sequence
  chemically synthesized
tttttaattagatgactaaata

SEQ ID NO: 1270628 - DNA, 22 bp, Artificial Sequence
  chemically synthesized
gtttttaattagatgactaaat

SEQ ID NO: 1270629 - DNA, 22 bp, Artificial Sequence
  chemically synthesized
tgtttttaattagatgactaaa

SEQ ID NO: 1270630 - DNA, 22 bp, Artificial Sequence
  chemically synthesized
attttgcattatttagtcatct

SEQ ID NO: 1270631 - DNA, 22 bp, Artificial Sequence
  chemically synthesized
gttttgtttttaattagatgac

SEQ ID NO: 1270632 - DNA, 22 bp, Artificial Sequence
  chemically synthesized
tgcattatttagtcatctaatt

SEQ ID NO: 1270633 - DNA, 22 bp, Artificial Sequence
  chemically synthesized
gcattatttagtcatctaatta

SEQ ID NO: 1270634 - DNA, 22 bp, Artificial Sequence
  chemically synthesized
cattatttagtcatctaattaa

SEQ ID NO: 1270635 - DNA, 22 bp, Artificial Sequence
  chemically synthesized
ctagttttgtttttaattagat

SEQ ID NO: 1270636 - DNA, 22 bp, Artificial Sequence
  chemically synthesized
ttactagttttgtttttaatta

SEQ ID NO: 1270637 - DNA, 22 bp, Artificial Sequence
  chemically synthesized
tttagtcatctaattaaaaaca

SEQ ID NO: 1270638 - DNA, 22 bp, Artificial Sequence
  chemically synthesized
agtcatctaattaaaaacaaaa

SEQ ID NO: 1270639 - DNA, 22 bp, Artificial Sequence
  chemically synthesized
aattattactagttttgttttt

SEQ ID NO: 1270640 - DNA, 22 bp, Artificial Sequence
  chemically synthesized
gtcatctaattaaaaacaaaac

SEQ ID NO: 1270641 - DNA, 22 bp, Artificial Sequence
  chemically synthesized
tggctaaattattactagtttt

SEQ ID NO: 1270642 - DNA, 22 bp, Artificial Sequence
  chemically synthesized
atggctaaattattactagttt

SEQ ID NO: 1270643 - DNA, 22 bp, Artificial Sequence
  chemically synthesized
tatggctaaattattactagtt

SEQ ID NO: 1270644 - DNA, 22 bp, Artificial Sequence
  chemically synthesized
attaaaaacaaaactagtaata

SEQ ID NO: 1270645 - DNA, 22 bp, Artificial Sequence
  chemically synthesized
aaaacaaaactagtaataattt

SEQ ID NO: 1270646 - DNA, 22 bp, Artificial Sequence
  chemically synthesized
aatgaacagctttatggctaaa

SEQ ID NO: 1270647 - DNA, 22 bp, Artificial Sequence
  chemically synthesized
caatgaacagctttatggctaa

SEQ ID NO: 1270648 - DNA, 22 bp, Artificial Sequence
  chemically synthesized
ttcaatgaacagctttatggct

SEQ ID NO: 1270649 - DNA, 22 bp, Artificial Sequence
  chemically synthesized
gtaataatttagccataaagct

SEQ ID NO: 1270650 - DNA, 22 bp, Artificial Sequence
  chemically synthesized
ttcttcaatgaacagctttatg

SEQ ID NO: 1270651 - DNA, 22 bp, Artificial Sequence
  chemically synthesized
attcttcaatgaacagctttat

SEQ ID NO: 1270652 - DNA, 22 bp, Artificial Sequence
  chemically synthesized
tattcttcaatgaacagcttta

SEQ ID NO: 1270653 - DNA, 22 bp, Artificial Sequence
  chemically synthesized
ttattcttcaatgaacagcttt

SEQ ID NO: 1270654 - DNA, 22 bp, Artificial Sequence
  chemically synthesized
cttttattcttcaatgaacagc

SEQ ID NO: 1270655 - DNA, 22 bp, Artificial Sequence
  chemically synthesized
agccataaagctgttcattgaa

SEQ ID NO: 1270656 - DNA, 22 bp, Artificial Sequence
  chemically synthesized
gccataaagctgttcattgaag

SEQ ID NO: 1270657 - DNA, 22 bp, Artificial Sequence
  chemically synthesized
acaattgcttttattcttcaat

SEQ ID NO: 1270658 - DNA, 22 bp, Artificial Sequence
  chemically synthesized
attaacaattgcttttattctt

SEQ ID NO: 1270659 - DNA, 22 bp, Artificial Sequence
  chemically synthesized
ttcattgaagaataaaagcaat

SEQ ID NO: 1270660 - DNA, 22 bp, Artificial Sequence
  chemically synthesized
attgaagaataaaagcaattgt

SEQ ID NO: 1270661 - DNA, 22 bp, Artificial Sequence
  chemically synthesized
aagaataaaagcaattgttaat

SEQ ID NO: 1270662 - DNA, 22 bp, Artificial Sequence
  chemically synthesized
aatgaaaagttaattaacaatt

SEQ ID NO: 1270663 - DNA, 22 bp, Artificial Sequence
  chemically synthesized
ctcaatgaaaagttaattaaca

SEQ ID NO: 1270664 - DNA, 22 bp, Artificial Sequence
  chemically synthesized
cctcaatgaaaagttaattaac

SEQ ID NO: 1270665 - DNA, 22 bp, Artificial Sequence
  chemically synthesized
tcctcaatgaaaagttaattaa

SEQ ID NO: 1270666 - DNA, 22 bp, Artificial Sequence
  chemically synthesized
ttaattaacttttcattgagga

SEQ ID NO: 1270667 - DNA, 22 bp, Artificial Sequence
  chemically synthesized
attaacttttcattgaggaaag

SEQ ID NO: 1270668 - DNA, 22 bp, Artificial Sequence
  chemically synthesized
acttttcattgaggaaagtcat

SEQ ID NO: 1270669 - DNA, 22 bp, Artificial Sequence
  chemically synthesized
ttcattgaggaaagtcatacat

SEQ ID NO: 1270670 - DNA, 22 bp, Artificial Sequence
  chemically synthesized
tcattgaggaaagtcatacatt

SEQ ID NO: 1270671 - DNA, 22 bp, Artificial Sequence
  chemically synthesized
cattgaggaaagtcatacattt

SEQ ID NO: 1270672 - DNA, 22 bp, Artificial Sequence
  chemically synthesized
tgataacatgaaaaatgtatga

SEQ ID NO: 1270673 - DNA, 22 bp, Artificial Sequence
  chemically synthesized
attgaggaaagtcatacatttt

SEQ ID NO: 1270674 - DNA, 22 bp, Artificial Sequence
  chemically synthesized
aggaaagtcatacatttttcat

SEQ ID NO: 1270675 - DNA, 22 bp, Artificial Sequence
  chemically synthesized
aaatgttatgataacatgaaaa

SEQ ID NO: 1270676 - DNA, 22 bp, Artificial Sequence
  chemically synthesized
gaaatgttatgataacatgaaa

SEQ ID NO: 1270677 - DNA, 22 bp, Artificial Sequence
  chemically synthesized
tgaaatgttatgataacatgaa

SEQ ID NO: 1270678 - DNA, 22 bp, Artificial Sequence
  chemically synthesized
ccagggcattttgaaatgttat

SEQ ID NO: 1270679 - DNA, 22 bp, Artificial Sequence
  chemically synthesized
ttcatgttatcataacatttca

SEQ ID NO: 1270680 - DNA, 22 bp, Artificial Sequence
  chemically synthesized
cccagggcattttgaaatgtta

SEQ ID NO: 1270681 - DNA, 22 bp, Artificial Sequence
  chemically synthesized
tcatgttatcataacatttcaa

SEQ ID NO: 1270682 - DNA, 22 bp, Artificial Sequence
  chemically synthesized
catgttatcataacatttcaaa

SEQ ID NO: 1270683 - DNA, 22 bp, Artificial Sequence
  chemically synthesized
atgttatcataacatttcaaaa

SEQ ID NO: 1270684 - DNA, 22 bp, Artificial Sequence
  chemically synthesized
taatttcccagggcattttgaa

SEQ ID NO: 1270685 - DNA, 22 bp, Artificial Sequence
  chemically synthesized
gtaatttcccagggcattttga

SEQ ID NO: 1270686 - DNA, 22 bp, Artificial Sequence
  chemically synthesized
tgtaatttcccagggcattttg

SEQ ID NO: 1270687 - DNA, 22 bp, Artificial Sequence
  chemically synthesized
tcataacatttcaaaatgccct

SEQ ID NO: 1270688 - DNA, 22 bp, Artificial Sequence
  chemically synthesized
attttgtaatttcccagggcat

SEQ ID NO: 1270689 - DNA, 22 bp, Artificial Sequence
  chemically synthesized
aattttgtaatttcccagggca

SEQ ID NO: 1270690 - DNA, 22 bp, Artificial Sequence
  chemically synthesized
ccttaattttgtaatttcccag

SEQ ID NO: 1270691 - DNA, 22 bp, Artificial Sequence
  chemically synthesized
caaaatgccctgggaaattaca

SEQ ID NO: 1270692 - DNA, 22 bp, Artificial Sequence
  chemically synthesized
aaaatgccctgggaaattacaa

SEQ ID NO: 1270693 - DNA, 22 bp, Artificial Sequence
  chemically synthesized
cattaccttaattttgtaattt

SEQ ID NO: 1270694 - DNA, 22 bp, Artificial Sequence
  chemically synthesized
acattaccttaattttgtaatt

SEQ ID NO: 1270695 - DNA, 22 bp, Artificial Sequence
  chemically synthesized
ggaaattacaaaattaaggtaa

SEQ ID NO: 1270696 - DNA, 22 bp, Artificial Sequence
  chemically synthesized
caaaattaaggtaatgtaaatt

SEQ ID NO: 1270697 - DNA, 22 bp, Artificial Sequence
  chemically synthesized
taatatatcaataatttacatt

SEQ ID NO: 1270698 - DNA, 22 bp, Artificial Sequence
  chemically synthesized
gagttataatatatcaataatt

SEQ ID NO: 1270699 - DNA, 22 bp, Artificial Sequence
  chemically synthesized
aggtaatgtaaattattgatat

SEQ ID NO: 1270700 - DNA, 22 bp, Artificial Sequence
  chemically synthesized
ttagagttataatatatcaata

SEQ ID NO: 1270701 - DNA, 22 bp, Artificial Sequence
  chemically synthesized
attgttagagttataatatatc

SEQ ID NO: 1270702 - DNA, 22 bp, Artificial Sequence
  chemically synthesized
cattgttagagttataatatat

SEQ ID NO: 1270703 - DNA, 22 bp, Artificial Sequence
  chemically synthesized
ttgatatattataactctaaca

SEQ ID NO: 1270704 - DNA, 22 bp, Artificial Sequence
  chemically synthesized
atatattataactctaacaatg

SEQ ID NO: 1270705 - DNA, 22 bp, Artificial Sequence
  chemically synthesized
ggtaaaatgtttcattgttaga

SEQ ID NO: 1270706 - DNA, 22 bp, Artificial Sequence
  chemically synthesized
taactctaacaatgaaacattt

SEQ ID NO: 1270707 - DNA, 22 bp, Artificial Sequence
  chemically synthesized
gaggcctgggtaaaatgtttca

SEQ ID NO: 1270708 - DNA, 22 bp, Artificial Sequence
  chemically synthesized
attagaggcctgggtaaaatgt

SEQ ID NO: 1270709 - DNA, 22 bp, Artificial Sequence
  chemically synthesized
taacaatgaaacattttaccca

SEQ ID NO: 1270710 - DNA, 22 bp, Artificial Sequence
  chemically synthesized
acaatgaaacattttacccagg

SEQ ID NO: 1270711 - DNA, 22 bp, Artificial Sequence
  chemically synthesized
agaatcctcattagaggcctgg

SEQ ID NO: 1270712 - DNA, 22 bp, Artificial Sequence
  chemically synthesized
actgagaatcctcattagaggc

SEQ ID NO: 1270713 - DNA, 22 bp, Artificial Sequence
  chemically synthesized
aactgagaatcctcattagagg

SEQ ID NO: 1270714 - DNA, 22 bp, Artificial Sequence
  chemically synthesized
tacccaggcctctaatgaggat

SEQ ID NO: 1270715 - DNA, 22 bp, Artificial Sequence
  chemically synthesized
acccaggcctctaatgaggatt

SEQ ID NO: 1270716 - DNA, 22 bp, Artificial Sequence
  chemically synthesized
cccttaactgagaatcctcatt

SEQ ID NO: 1270717 - DNA, 22 bp, Artificial Sequence
  chemically synthesized
cccaggcctctaatgaggattc

SEQ ID NO: 1270718 - DNA, 22 bp, Artificial Sequence
  chemically synthesized
ctccccttaactgagaatcctc

SEQ ID NO: 1270719 - DNA, 22 bp, Artificial Sequence
  chemically synthesized
ctcctccccttaactgagaatc

SEQ ID NO: 1270720 - DNA, 22 bp, Artificial Sequence
  chemically synthesized
tgctcctccccttaactgagaa

SEQ ID NO: 1270721 - DNA, 22 bp, Artificial Sequence
  chemically synthesized
taatgaggattctcagttaagg

SEQ ID NO: 1270722 - DNA, 22 bp, Artificial Sequence
  chemically synthesized
ctctgctcctccccttaactga

SEQ ID NO: 1270723 - DNA, 22 bp, Artificial Sequence
  chemically synthesized
atgaggattctcagttaagggg

SEQ ID NO: 1270724 - DNA, 22 bp, Artificial Sequence
  chemically synthesized
tgcattcctctgctcctcccct

SEQ ID NO: 1270725 - DNA, 22 bp, Artificial Sequence
  chemically synthesized
atgcattcctctgctcctcccc

SEQ ID NO: 1270726 - DNA, 22 bp, Artificial Sequence
  chemically synthesized
tcagttaaggggaggagcagag

SEQ ID NO: 1270727 - DNA, 22 bp, Artificial Sequence
  chemically synthesized
agttaaggggaggagcagagga

SEQ ID NO: 1270728 - DNA, 22 bp, Artificial Sequence
  chemically synthesized
ccatgtgtttatgcattcctct

SEQ ID NO: 1270729 - DNA, 22 bp, Artificial Sequence
  chemically synthesized
aggggaggagcagaggaatgca

SEQ ID NO: 1270730 - DNA, 22 bp, Artificial Sequence
  chemically synthesized
caccccacctcccatgtgttta

SEQ ID NO: 1270731 - DNA, 22 bp, Artificial Sequence
  chemically synthesized
cgctccaccccacctcccatgt

SEQ ID NO: 1270732 - DNA, 22 bp, Artificial Sequence
  chemically synthesized
ccgctccaccccacctcccatg

SEQ ID NO: 1270733 - DNA, 22 bp, Artificial Sequence
  chemically synthesized
ggtttccgctccaccccacctc

SEQ ID NO: 1270734 - DNA, 22 bp, Artificial Sequence
  chemically synthesized
gaagctgggtttccgctccacc

SEQ ID NO: 1270735 - DNA, 22 bp, Artificial Sequence
  chemically synthesized
ctggaagctgggtttccgctcc

SEQ ID NO: 1270736 - DNA, 22 bp, Artificial Sequence
  chemically synthesized
cctggaagctgggtttccgctc

SEQ ID NO: 1270737 - DNA, 22 bp, Artificial Sequence
  chemically synthesized
aaacatcttcctggaagctggg

SEQ ID NO: 1270738 - DNA, 22 bp, Artificial Sequence
  chemically synthesized
ctaaaacatcttcctggaagct

SEQ ID NO: 1270739 - DNA, 22 bp, Artificial Sequence
  chemically synthesized
tcctaaaacatcttcctggaag

SEQ ID NO: 1270740 - DNA, 22 bp, Artificial Sequence
  chemically synthesized
ctcctaaaacatcttcctggaa

SEQ ID NO: 1270741 - DNA, 22 bp, Artificial Sequence
  chemically synthesized
tctcctaaaacatcttcctgga

SEQ ID NO: 1270742 - DNA, 22 bp, Artificial Sequence
  chemically synthesized
ttttctcctaaaacatcttcct

SEQ ID NO: 1270743 - DNA, 22 bp, Artificial Sequence
  chemically synthesized
ggaatctgttttctcctaaaac

SEQ ID NO: 1270744 - DNA, 22 bp, Artificial Sequence
  chemically synthesized
aggaatctgttttctcctaaaa

SEQ ID NO: 1270745 - DNA, 22 bp, Artificial Sequence
  chemically synthesized
ccaggaagatgttttaggagaa

SEQ ID NO: 1270746 - DNA, 22 bp, Artificial Sequence
  chemically synthesized
caggaagatgttttaggagaaa

SEQ ID NO: 1270747 - DNA, 22 bp, Artificial Sequence
  chemically synthesized
aaatagcttaggaatctgtttt

SEQ ID NO: 1270748 - DNA, 22 bp, Artificial Sequence
  chemically synthesized
taggagaaaacagattcctaag

SEQ ID NO: 1270749 - DNA, 22 bp, Artificial Sequence
  chemically synthesized
tacctcaaatagcttaggaatc

SEQ ID NO: 1270750 - DNA, 22 bp, Artificial Sequence
  chemically synthesized
aggagaaaacagattcctaagc

SEQ ID NO: 1270751 - DNA, 22 bp, Artificial Sequence
  chemically synthesized
ggagaaaacagattcctaagct

SEQ ID NO: 1270752 - DNA, 22 bp, Artificial Sequence
  chemically synthesized
ttgtacctcaaatagcttagga

SEQ ID NO: 1270753 - DNA, 22 bp, Artificial Sequence
  chemically synthesized
ggtctgttgtacctcaaatagc

SEQ ID NO: 1270754 - DNA, 22 bp, Artificial Sequence
  chemically synthesized
cggtctgttgtacctcaaatag

SEQ ID NO: 1270755 - DNA, 22 bp, Artificial Sequence
  chemically synthesized
ccttcggtctgttgtacctcaa

SEQ ID NO: 1270756 - DNA, 22 bp, Artificial Sequence
  chemically synthesized
ctaagctatttgaggtacaaca

SEQ ID NO: 1270757 - DNA, 22 bp, Artificial Sequence
  chemically synthesized
agctatttgaggtacaacagac

SEQ ID NO: 1270758 - DNA, 22 bp, Artificial Sequence
  chemically synthesized
cacattgccttcggtctgttgt

SEQ ID NO: 1270759 - DNA, 22 bp, Artificial Sequence
  chemically synthesized
tttgaggtacaacagaccgaag

SEQ ID NO: 1270760 - DNA, 22 bp, Artificial Sequence
  chemically synthesized
cactgcacattgccttcggtct

SEQ ID NO: 1270761 - DNA, 22 bp, Artificial Sequence
  chemically synthesized
gaggtacaacagaccgaaggca

SEQ ID NO: 1270762 - DNA, 22 bp, Artificial Sequence
  chemically synthesized
aggtacaacagaccgaaggcaa

SEQ ID NO: 1270763 - DNA, 22 bp, Artificial Sequence
  chemically synthesized
gggaaataaattgcactgcaca

SEQ ID NO: 1270764 - DNA, 22 bp, Artificial Sequence
  chemically synthesized
agggaaataaattgcactgcac

SEQ ID NO: 1270765 - DNA, 22 bp, Artificial Sequence
  chemically synthesized
taacagataagtttagggaaat

SEQ ID NO: 1270766 - DNA, 22 bp, Artificial Sequence
  chemically synthesized
ataacagataagtttagggaaa

SEQ ID NO: 1270767 - DNA, 22 bp, Artificial Sequence
  chemically synthesized
tataacagataagtttagggaa

SEQ ID NO: 1270768 - DNA, 22 bp, Artificial Sequence
  chemically synthesized
agttttataacagataagttta

SEQ ID NO: 1270769 - DNA, 22 bp, Artificial Sequence
  chemically synthesized
atttccctaaacttatctgtta

SEQ ID NO: 1270770 - DNA, 22 bp, Artificial Sequence
  chemically synthesized
tttccctaaacttatctgttat

SEQ ID NO: 1270771 - DNA, 22 bp, Artificial Sequence
  chemically synthesized
aggattcagttttataacagat

SEQ ID NO: 1270772 - DNA, 22 bp, Artificial Sequence
  chemically synthesized
aaggattcagttttataacaga

SEQ ID NO: 1270773 - DNA, 22 bp, Artificial Sequence
  chemically synthesized
ccctaaacttatctgttataaa

SEQ ID NO: 1270774 - DNA, 22 bp, Artificial Sequence
  chemically synthesized
cctaaacttatctgttataaaa

SEQ ID NO: 1270775 - DNA, 22 bp, Artificial Sequence
  chemically synthesized
aacttatctgttataaaactga

SEQ ID NO: 1270776 - DNA, 22 bp, Artificial Sequence
  chemically synthesized
atctgttataaaactgaatcct

SEQ ID NO: 1270777 - DNA, 22 bp, Artificial Sequence
  chemically synthesized
tctgttataaaactgaatcctt

SEQ ID NO: 1270778 - DNA, 22 bp, Artificial Sequence
  chemically synthesized
tacaaccagcttaaggattcag

SEQ ID NO: 1270779 - DNA, 22 bp, Artificial Sequence
  chemically synthesized
gtacaaccagcttaaggattca

SEQ ID NO: 1270780 - DNA, 22 bp, Artificial Sequence
  chemically synthesized
tgtacaaccagcttaaggattc

SEQ ID NO: 1270781 - DNA, 22 bp, Artificial Sequence
  chemically synthesized
ttataaaactgaatccttaagc

SEQ ID NO: 1270782 - DNA, 22 bp, Artificial Sequence
  chemically synthesized
taaaactgaatccttaagctgg

SEQ ID NO: 1270783 - DNA, 22 bp, Artificial Sequence
  chemically synthesized
tgtgactttgtacaaccagctt

SEQ ID NO: 1270784 - DNA, 22 bp, Artificial Sequence
  chemically synthesized
gttgtgtgactttgtacaacca

SEQ ID NO: 1270785 - DNA, 22 bp, Artificial Sequence
  chemically synthesized
aatccttaagctggttgtacaa

SEQ ID NO: 1270786 - DNA, 22 bp, Artificial Sequence
  chemically synthesized
actagttgtgtgactttgtaca

SEQ ID NO: 1270787 - DNA, 22 bp, Artificial Sequence
  chemically synthesized
aagctggttgtacaaagtcaca

SEQ ID NO: 1270788 - DNA, 22 bp, Artificial Sequence
  chemically synthesized
actgactagttgtgtgactttg

SEQ ID NO: 1270789 - DNA, 22 bp, Artificial Sequence
  chemically synthesized
agctggttgtacaaagtcacac

SEQ ID NO: 1270790 - DNA, 22 bp, Artificial Sequence
  chemically synthesized
gttgtacaaagtcacacaacta

SEQ ID NO: 1270791 - DNA, 22 bp, Artificial Sequence
  chemically synthesized
tacaaagtcacacaactagtca

SEQ ID NO: 1270792 - DNA, 22 bp, Artificial Sequence
  chemically synthesized
tagaacattaactgactagttg

SEQ ID NO: 1270793 - DNA, 22 bp, Artificial Sequence
  chemically synthesized
gtagaacattaactgactagtt

SEQ ID NO: 1270794 - DNA, 22 bp, Artificial Sequence
  chemically synthesized
tttgtagaacattaactgacta

SEQ ID NO: 1270795 - DNA, 22 bp, Artificial Sequence
  chemically synthesized
aaagagctatttgtagaacatt

SEQ ID NO: 1270796 - DNA, 22 bp, Artificial Sequence
  chemically synthesized
tgaaagagctatttgtagaaca

SEQ ID NO: 1270797 - DNA, 22 bp, Artificial Sequence
  chemically synthesized
gtcagttaatgttctacaaata

SEQ ID NO: 1270798 - DNA, 22 bp, Artificial Sequence
  chemically synthesized
atgttctacaaatagctctttc

SEQ ID NO: 1270799 - DNA, 22 bp, Artificial Sequence
  chemically synthesized
gtagaaaaatctctgaaagagc

SEQ ID NO: 1270800 - DNA, 22 bp, Artificial Sequence
  chemically synthesized
tacaaatagctctttcagagat

SEQ ID NO: 1270801 - DNA, 22 bp, Artificial Sequence
  chemically synthesized
caaatagctctttcagagattt

SEQ ID NO: 1270802 - DNA, 22 bp, Artificial Sequence
  chemically synthesized
tttcagagatttttctactaga

SEQ ID NO: 1270803 - DNA, 22 bp, Artificial Sequence
  chemically synthesized
tcagagatttttctactagact

SEQ ID NO: 1270804 - DNA, 22 bp, Artificial Sequence
  chemically synthesized
aataaggtgacaagtctagtag

SEQ ID NO: 1270805 - DNA, 22 bp, Artificial Sequence
  chemically synthesized
cagagatttttctactagactt

SEQ ID NO: 1270806 - DNA, 22 bp, Artificial Sequence
  chemically synthesized
aaataaggtgacaagtctagta

SEQ ID NO: 1270807 - DNA, 22 bp, Artificial Sequence
  chemically synthesized
agagatttttctactagacttg

SEQ ID NO: 1270808 - DNA, 22 bp, Artificial Sequence
  chemically synthesized
aaggtttaaataaggtgacaag

SEQ ID NO: 1270809 - DNA, 22 bp, Artificial Sequence
  chemically synthesized
caaggtttaaataaggtgacaa

SEQ ID NO: 1270810 - DNA, 22 bp, Artificial Sequence
  chemically synthesized
ttctactagacttgtcacctta

SEQ ID NO: 1270811 - DNA, 22 bp, Artificial Sequence
  chemically synthesized
tctactagacttgtcaccttat

SEQ ID NO: 1270812 - DNA, 22 bp, Artificial Sequence
  chemically synthesized
ctactagacttgtcaccttatt

SEQ ID NO: 1270813 - DNA, 22 bp, Artificial Sequence
  chemically synthesized
tactagacttgtcaccttattt

SEQ ID NO: 1270814 - DNA, 22 bp, Artificial Sequence
  chemically synthesized
ctagacttgtcaccttatttaa

SEQ ID NO: 1270815 - DNA, 22 bp, Artificial Sequence
  chemically synthesized
gacttgtcaccttatttaaacc

SEQ ID NO: 1270816 - DNA, 22 bp, Artificial Sequence
  chemically synthesized
agtggggtttcaaggtttaaat

SEQ ID NO: 1270817 - DNA, 22 bp, Artificial Sequence
  chemically synthesized
gagtggggtttcaaggtttaaa

SEQ ID NO: 1270818 - DNA, 22 bp, Artificial Sequence
  chemically synthesized
tgagtggggtttcaaggtttaa

SEQ ID NO: 1270819 - DNA, 22 bp, Artificial Sequence
  chemically synthesized
gtcaccttatttaaaccttgaa

SEQ ID NO: 1270820 - DNA, 22 bp, Artificial Sequence
  chemically synthesized
tcaccttatttaaaccttgaaa

SEQ ID NO: 1270821 - DNA, 22 bp, Artificial Sequence
  chemically synthesized
tcaattttgagtggggtttcaa

SEQ ID NO: 1270822 - DNA, 22 bp, Artificial Sequence
  chemically synthesized
atttaaaccttgaaaccccact

SEQ ID NO: 1270823 - DNA, 22 bp, Artificial Sequence
  chemically synthesized
tttaaaccttgaaaccccactc

SEQ ID NO: 1270824 - DNA, 22 bp, Artificial Sequence
  chemically synthesized
actgtcaattttgagtggggtt

SEQ ID NO: 1270825 - DNA, 22 bp, Artificial Sequence
  chemically synthesized
tcactgtcaattttgagtgggg

SEQ ID NO: 1270826 - DNA, 22 bp, Artificial Sequence
  chemically synthesized
aaaccttgaaaccccactcaaa

SEQ ID NO: 1270827 - DNA, 22 bp, Artificial Sequence
  chemically synthesized
aaccttgaaaccccactcaaaa

SEQ ID NO: 1270828 - DNA, 22 bp, Artificial Sequence
  chemically synthesized
tctcactgtcaattttgagtgg

SEQ ID NO: 1270829 - DNA, 22 bp, Artificial Sequence
  chemically synthesized
ctctcactgtcaattttgagtg

SEQ ID NO: 1270830 - DNA, 22 bp, Artificial Sequence
  chemically synthesized
tttctctcactgtcaattttga

SEQ ID NO: 1270831 - DNA, 22 bp, Artificial Sequence
  chemically synthesized
gaaaccccactcaaaattgaca

SEQ ID NO: 1270832 - DNA, 22 bp, Artificial Sequence
  chemically synthesized
aaaccccactcaaaattgacag

SEQ ID NO: 1270833 - DNA, 22 bp, Artificial Sequence
  chemically synthesized
aaaattgacagtgagagaaaca

SEQ ID NO: 1270834 - DNA, 22 bp, Artificial Sequence
  chemically synthesized
acagtgagagaaacagacacac

SEQ ID NO: 1270835 - DNA, 22 bp, Artificial Sequence
  chemically synthesized
gtgtgtgtgtgtgtgtgtgtgt

SEQ ID NO: 1270836 - DNA, 22 bp, Artificial Sequence
  chemically synthesized
cgtccctggtgtgtgtgtgtgt

SEQ ID NO: 1270837 - DNA, 22 bp, Artificial Sequence
  chemically synthesized
cctccgtccctggtgtgtgtgt

SEQ ID NO: 1270838 - DNA, 22 bp, Artificial Sequence
  chemically synthesized
tccctccgtccctggtgtgtgt

SEQ ID NO: 1270839 - DNA, 22 bp, Artificial Sequence
  chemically synthesized
tctccctccgtccctggtgtgt

SEQ ID NO: 1270840 - DNA, 22 bp, Artificial Sequence
  chemically synthesized
ctctccctccgtccctggtgtg

SEQ ID NO: 1270841 - DNA, 22 bp, Artificial Sequence
  chemically synthesized
tctctccctccgtccctggtgt

SEQ ID NO: 1270842 - DNA, 22 bp, Artificial Sequence
  chemically synthesized
atacactttctctccctccgtc

SEQ ID NO: 1270843 - DNA, 22 bp, Artificial Sequence
  chemically synthesized
ttaatacactttctctccctcc

SEQ ID NO: 1270844 - DNA, 22 bp, Artificial Sequence
  chemically synthesized
gctattaatacactttctctcc

SEQ ID NO: 1270845 - DNA, 22 bp, Artificial Sequence
  chemically synthesized
agctattaatacactttctctc

SEQ ID NO: 1270846 - DNA, 22 bp, Artificial Sequence
  chemically synthesized
tagctattaatacactttctct

SEQ ID NO: 1270847 - DNA, 22 bp, Artificial Sequence
  chemically synthesized
ccaaggccaagaggggttttag

SEQ ID NO: 1270848 - DNA, 22 bp, Artificial Sequence
  chemically synthesized
cccaaggccaagaggggtttta

SEQ ID NO: 1270849 - DNA, 22 bp, Artificial Sequence
  chemically synthesized
tcccaaggccaagaggggtttt

SEQ ID NO: 1270850 - DNA, 22 bp, Artificial Sequence
  chemically synthesized
tttcccaaggccaagaggggtt

SEQ ID NO: 1270851 - DNA, 22 bp, Artificial Sequence
  chemically synthesized
ctttcccaaggccaagaggggt

SEQ ID NO: 1270852 - DNA, 22 bp, Artificial Sequence
  chemically synthesized
atagctaaaacccctcttggcc

SEQ ID NO: 1270853 - DNA, 22 bp, Artificial Sequence
  chemically synthesized
aaacccctcttggccttgggaa

SEQ ID NO: 1270854 - DNA, 22 bp, Artificial Sequence
  chemically synthesized
acagagggtagagagtttcttt

SEQ ID NO: 1270855 - DNA, 22 bp, Artificial Sequence
  chemically synthesized
ttggccttgggaaagaaactct

SEQ ID NO: 1270856 - DNA, 22 bp, Artificial Sequence
  chemically synthesized
ggccttgggaaagaaactctct

SEQ ID NO: 1270857 - DNA, 22 bp, Artificial Sequence
  chemically synthesized
ttaacagagggtagagagtttc

SEQ ID NO: 1270858 - DNA, 22 bp, Artificial Sequence
  chemically synthesized
gccttgggaaagaaactctcta

SEQ ID NO: 1270859 - DNA, 22 bp, Artificial Sequence
  chemically synthesized
attaacagagggtagagagttt

SEQ ID NO: 1270860 - DNA, 22 bp, Artificial Sequence
  chemically synthesized
ttattaacagagggtagagagt

SEQ ID NO: 1270861 - DNA, 22 bp, Artificial Sequence
  chemically synthesized
cttattaacagagggtagagag

SEQ ID NO: 1270862 - DNA, 22 bp, Artificial Sequence
  chemically synthesized
gggaaagaaactctctaccctc

SEQ ID NO: 1270863 - DNA, 22 bp, Artificial Sequence
  chemically synthesized
ggaaagaaactctctaccctct

SEQ ID NO: 1270864 - DNA, 22 bp, Artificial Sequence
  chemically synthesized
acttcttattaacagagggtag

SEQ ID NO: 1270865 - DNA, 22 bp, Artificial Sequence
  chemically synthesized
tcacttcttattaacagagggt

SEQ ID NO: 1270866 - DNA, 22 bp, Artificial Sequence
  chemically synthesized
tctcacttcttattaacagagg

SEQ ID NO: 1270867 - DNA, 22 bp, Artificial Sequence
  chemically synthesized
tctaccctctgttaataagaag

SEQ ID NO: 1270868 - DNA, 22 bp, Artificial Sequence
  chemically synthesized
taccctctgttaataagaagtg

SEQ ID NO: 1270869 - DNA, 22 bp, Artificial Sequence
  chemically synthesized
ccctctgttaataagaagtgag

SEQ ID NO: 1270870 - DNA, 22 bp, Artificial Sequence
  chemically synthesized
tgttaataagaagtgagagagc

SEQ ID NO: 1270871 - DNA, 22 bp, Artificial Sequence
  chemically synthesized
aaagaggaggcagctctctcac

SEQ ID NO: 1270872 - DNA, 22 bp, Artificial Sequence
  chemically synthesized
ttaataagaagtgagagagctg

SEQ ID NO: 1270873 - DNA, 22 bp, Artificial Sequence
  chemically synthesized
ttcaaagaggaggcagctctct

SEQ ID NO: 1270874 - DNA, 22 bp, Artificial Sequence
  chemically synthesized
attcaaagaggaggcagctctc

SEQ ID NO: 1270875 - DNA, 22 bp, Artificial Sequence
  chemically synthesized
ataagaagtgagagagctgcct

SEQ ID NO: 1270876 - DNA, 22 bp, Artificial Sequence
  chemically synthesized
atttattcaaagaggaggcagc

SEQ ID NO: 1270877 - DNA, 22 bp, Artificial Sequence
  chemically synthesized
aagaacctgatttattcaaaga

SEQ ID NO: 1270878 - DNA, 22 bp, Artificial Sequence
  chemically synthesized
tctaaagaacctgatttattca

SEQ ID NO: 1270879 - DNA, 22 bp, Artificial Sequence
  chemically synthesized
cctcctctttgaataaatcagg

SEQ ID NO: 1270880 - DNA, 22 bp, Artificial Sequence
  chemically synthesized
cattgtctaaagaacctgattt

SEQ ID NO: 1270881 - DNA, 22 bp, Artificial Sequence
  chemically synthesized
ctctttgaataaatcaggttct

SEQ ID NO: 1270882 - DNA, 22 bp, Artificial Sequence
  chemically synthesized
tacattgtctaaagaacctgat

SEQ ID NO: 1270883 - DNA, 22 bp, Artificial Sequence
  chemically synthesized
tttgaataaatcaggttcttta

SEQ ID NO: 1270884 - DNA, 22 bp, Artificial Sequence
  chemically synthesized
actctacattgtctaaagaacc

SEQ ID NO: 1270885 - DNA, 22 bp, Artificial Sequence
  chemically synthesized
tgaataaatcaggttctttaga

SEQ ID NO: 1270886 - DNA, 22 bp, Artificial Sequence
  chemically synthesized
aactctacattgtctaaagaac

SEQ ID NO: 1270887 - DNA, 22 bp, Artificial Sequence
  chemically synthesized
gaataaatcaggttctttagac

SEQ ID NO: 1270888 - DNA, 22 bp, Artificial Sequence
  chemically synthesized
aataaatcaggttctttagaca

SEQ ID NO: 1270889 - DNA, 22 bp, Artificial Sequence
  chemically synthesized
tttagacaatgtagagttaagg

SEQ ID NO: 1270890 - DNA, 22 bp, Artificial Sequence
  chemically synthesized
tagacaatgtagagttaagggc

SEQ ID NO: 1270891 - DNA, 22 bp, Artificial Sequence
  chemically synthesized
agacaatgtagagttaagggct

SEQ ID NO: 1270892 - DNA, 22 bp, Artificial Sequence
  chemically synthesized
gacaatgtagagttaagggctt

SEQ ID NO: 1270893 - DNA, 22 bp, Artificial Sequence
  chemically synthesized
agggctttactcatcaccctgt

SEQ ID NO: 1270894 - DNA, 22 bp, Artificial Sequence
  chemically synthesized
catggcatccagagaacagggt

SEQ ID NO: 1270895 - DNA, 22 bp, Artificial Sequence
  chemically synthesized
acatggcatccagagaacaggg

SEQ ID NO: 1270896 - DNA, 22 bp, Artificial Sequence
  chemically synthesized
tactcatcaccctgttctctgg

SEQ ID NO: 1270897 - DNA, 22 bp, Artificial Sequence
  chemically synthesized
actcatcaccctgttctctgga

SEQ ID NO: 1270898 - DNA, 22 bp, Artificial Sequence
  chemically synthesized
ctcatcaccctgttctctggat

SEQ ID NO: 1270899 - DNA, 22 bp, Artificial Sequence
  chemically synthesized
atcaccctgttctctggatgcc

SEQ ID NO: 1270900 - DNA, 22 bp, Artificial Sequence
  chemically synthesized
gtgagcttacatggcatccaga

SEQ ID NO: 1270901 - DNA, 22 bp, Artificial Sequence
  chemically synthesized
ttctctggatgccatgtaagct

SEQ ID NO: 1270902 - DNA, 22 bp, Artificial Sequence
  chemically synthesized
acaagaatctggtgagcttaca

SEQ ID NO: 1270903 - DNA, 22 bp, Artificial Sequence
  chemically synthesized
tctggatgccatgtaagctcac

SEQ ID NO: 1270904 - DNA, 22 bp, Artificial Sequence
  chemically synthesized
cacaagaatctggtgagcttac

SEQ ID NO: 1270905 - DNA, 22 bp, Artificial Sequence
  chemically synthesized
tggatgccatgtaagctcacca

SEQ ID NO: 1270906 - DNA, 22 bp, Artificial Sequence
  chemically synthesized
gatgccatgtaagctcaccaga

SEQ ID NO: 1270907 - DNA, 22 bp, Artificial Sequence
  chemically synthesized
tagtttcacaagaatctggtga

SEQ ID NO: 1270908 - DNA, 22 bp, Artificial Sequence
  chemically synthesized
tgtagtttcacaagaatctggt

SEQ ID NO: 1270909 - DNA, 22 bp, Artificial Sequence
  chemically synthesized
tctgtagtttcacaagaatctg

SEQ ID NO: 1270910 - DNA, 22 bp, Artificial Sequence
  chemically synthesized
atccattctctgtagtttcaca

SEQ ID NO: 1270911 - DNA, 22 bp, Artificial Sequence
  chemically synthesized
accagattcttgtgaaactaca

SEQ ID NO: 1270912 - DNA, 22 bp, Artificial Sequence
  chemically synthesized
tctaatccattctctgtagttt

SEQ ID NO: 1270913 - DNA, 22 bp, Artificial Sequence
  chemically synthesized
gactgtctaatccattctctgt

SEQ ID NO: 1270914 - DNA, 22 bp, Artificial Sequence
  chemically synthesized
ggactgtctaatccattctctg

SEQ ID NO: 1270915 - DNA, 22 bp, Artificial Sequence
  chemically synthesized
ttgtgaaactacagagaatgga

SEQ ID NO: 1270916 - DNA, 22 bp, Artificial Sequence
  chemically synthesized
tggactgtctaatccattctct

SEQ ID NO: 1270917 - DNA, 22 bp, Artificial Sequence
  chemically synthesized
gtgaaactacagagaatggatt

SEQ ID NO: 1270918 - DNA, 22 bp, Artificial Sequence
  chemically synthesized
tgaaactacagagaatggatta

SEQ ID NO: 1270919 - DNA, 22 bp, Artificial Sequence
  chemically synthesized
tgttttggactgtctaatccat

SEQ ID NO: 1270920 - DNA, 22 bp, Artificial Sequence
  chemically synthesized
ttatgttttggactgtctaatc

SEQ ID NO: 1270921 - DNA, 22 bp, Artificial Sequence
  chemically synthesized
cagagaatggattagacagtcc

SEQ ID NO: 1270922 - DNA, 22 bp, Artificial Sequence
  chemically synthesized
gacagtccaaaacataacagat

SEQ ID NO: 1270923 - DNA, 22 bp, Artificial Sequence
  chemically synthesized
ccagagcaaacacaagtacaat

SEQ ID NO: 1270924 - DNA, 22 bp, Artificial Sequence
  chemically synthesized
accagagcaaacacaagtacaa

SEQ ID NO: 1270925 - DNA, 22 bp, Artificial Sequence
  chemically synthesized
cacttaccagagcaaacacaag

SEQ ID NO: 1270926 - DNA, 22 bp, Artificial Sequence
  chemically synthesized
aagctccacttaccagagcaaa

SEQ ID NO: 1270927 - DNA, 22 bp, Artificial Sequence
  chemically synthesized
tacttgtgtttgctctggtaag

SEQ ID NO: 1270928 - DNA, 22 bp, Artificial Sequence
  chemically synthesized
gtgtttgctctggtaagtggag

SEQ ID NO: 1270929 - DNA, 22 bp, Artificial Sequence
  chemically synthesized
tgtttgctctggtaagtggagc

SEQ ID NO: 1270930 - DNA, 22 bp, Artificial Sequence
  chemically synthesized
catcaaactaaagctccactta

SEQ ID NO: 1270931 - DNA, 22 bp, Artificial Sequence
  chemically synthesized
tacatcaaactaaagctccact

SEQ ID NO: 1270932 - DNA, 22 bp, Artificial Sequence
  chemically synthesized
tctacatcaaactaaagctcca

SEQ ID NO: 1270933 - DNA, 22 bp, Artificial Sequence
  chemically synthesized
gctctggtaagtggagctttag

SEQ ID NO: 1270934 - DNA, 22 bp, Artificial Sequence
  chemically synthesized
ctctacatcaaactaaagctcc

SEQ ID NO: 1270935 - DNA, 22 bp, Artificial Sequence
  chemically synthesized
ctctggtaagtggagctttagt

SEQ ID NO: 1270936 - DNA, 22 bp, Artificial Sequence
  chemically synthesized
tttctctacatcaaactaaagc

SEQ ID NO: 1270937 - DNA, 22 bp, Artificial Sequence
  chemically synthesized
tggtaagtggagctttagtttg

SEQ ID NO: 1270938 - DNA, 22 bp, Artificial Sequence
  chemically synthesized
atttctctacatcaaactaaag

SEQ ID NO: 1270939 - DNA, 22 bp, Artificial Sequence
  chemically synthesized
gtaagtggagctttagtttgat

SEQ ID NO: 1270940 - DNA, 22 bp, Artificial Sequence
  chemically synthesized
ttatttctctacatcaaactaa

SEQ ID NO: 1270941 - DNA, 22 bp, Artificial Sequence
  chemically synthesized
ctcttatttctctacatcaaac

SEQ ID NO: 1270942 - DNA, 22 bp, Artificial Sequence
  chemically synthesized
tagtttgatgtagagaaataag

SEQ ID NO: 1270943 - DNA, 22 bp, Artificial Sequence
  chemically synthesized
agtttgatgtagagaaataaga

SEQ ID NO: 1270944 - DNA, 22 bp, Artificial Sequence
  chemically synthesized
gtttgatgtagagaaataagag

SEQ ID NO: 1270945 - DNA, 22 bp, Artificial Sequence
  chemically synthesized
gatgtagagaaataagaggaac

SEQ ID NO: 1270946 - DNA, 22 bp, Artificial Sequence
  chemically synthesized
atgtagagaaataagaggaacc

SEQ ID NO: 1270947 - DNA, 22 bp, Artificial Sequence
  chemically synthesized
ataatgtccaggtgaaagaaat

SEQ ID NO: 1270948 - DNA, 22 bp, Artificial Sequence
  chemically synthesized
cataatgtccaggtgaaagaaa

SEQ ID NO: 1270949 - DNA, 22 bp, Artificial Sequence
  chemically synthesized
tcataatgtccaggtgaaagaa

SEQ ID NO: 1270950 - DNA, 22 bp, Artificial Sequence
  chemically synthesized
tttcataatgtccaggtgaaag

SEQ ID NO: 1270951 - DNA, 22 bp, Artificial Sequence
  chemically synthesized
tctttcataatgtccaggtgaa

SEQ ID NO: 1270952 - DNA, 22 bp, Artificial Sequence
  chemically synthesized
agatacctctctttcataatgt

SEQ ID NO: 1270953 - DNA, 22 bp, Artificial Sequence
  chemically synthesized
ctttcacctggacattatgaaa

SEQ ID NO: 1270954 - DNA, 22 bp, Artificial Sequence
  chemically synthesized
tttcacctggacattatgaaag

SEQ ID NO: 1270955 - DNA, 22 bp, Artificial Sequence
  chemically synthesized
tcacctggacattatgaaagag

SEQ ID NO: 1270956 - DNA, 22 bp, Artificial Sequence
  chemically synthesized
cacctggacattatgaaagaga

SEQ ID NO: 1270957 - DNA, 22 bp, Artificial Sequence
  chemically synthesized
acctggacattatgaaagagag

SEQ ID NO: 1270958 - DNA, 22 bp, Artificial Sequence
  chemically synthesized
gatgattcagatacctctcttt

SEQ ID NO: 1270959 - DNA, 22 bp, Artificial Sequence
  chemically synthesized
gacattatgaaagagaggtatc

SEQ ID NO: 1270960 - DNA, 22 bp, Artificial Sequence
  chemically synthesized
attggatgattcagatacctct

SEQ ID NO: 1270961 - DNA, 22 bp, Artificial Sequence
  chemically synthesized
aattggatgattcagatacctc

SEQ ID NO: 1270962 - DNA, 22 bp, Artificial Sequence
  chemically synthesized
acttaattggatgattcagata

SEQ ID NO: 1270963 - DNA, 22 bp, Artificial Sequence
  chemically synthesized
tgaaagagaggtatctgaatca

SEQ ID NO: 1270964 - DNA, 22 bp, Artificial Sequence
  chemically synthesized
ctcacttaattggatgattcag

SEQ ID NO: 1270965 - DNA, 22 bp, Artificial Sequence
  chemically synthesized
ctgctcacttaattggatgatt

SEQ ID NO: 1270966 - DNA, 22 bp, Artificial Sequence
  chemically synthesized
cctgctcacttaattggatgat

SEQ ID NO: 1270967 - DNA, 22 bp, Artificial Sequence
  chemically synthesized
cagatttcctgctcacttaatt

SEQ ID NO: 1270968 - DNA, 22 bp, Artificial Sequence
  chemically synthesized
aatcatccaattaagtgagcag

SEQ ID NO: 1270969 - DNA, 22 bp, Artificial Sequence
  chemically synthesized
caatattccagatttcctgctc

SEQ ID NO: 1270970 - DNA, 22 bp, Artificial Sequence
  chemically synthesized
agtgagcaggaaatctggaata

SEQ ID NO: 1270971 - DNA, 22 bp, Artificial Sequence
  chemically synthesized
gaatattgtaggtgttttacat

SEQ ID NO: 1270972 - DNA, 22 bp, Artificial Sequence
  chemically synthesized
taggtgttttacatgctcattc

SEQ ID NO: 1270973 - DNA, 22 bp, Artificial Sequence
  chemically synthesized
agcaggtagaaagaaagaatga

SEQ ID NO: 1270974 - DNA, 22 bp, Artificial Sequence
  chemically synthesized
tacatgctcattctttctttct

SEQ ID NO: 1270975 - DNA, 22 bp, Artificial Sequence
  chemically synthesized
acatgctcattctttctttcta

SEQ ID NO: 1270976 - DNA, 22 bp, Artificial Sequence
  chemically synthesized
catgctcattctttctttctac

SEQ ID NO: 1270977 - DNA, 22 bp, Artificial Sequence
  chemically synthesized
attctttctttctacctgctta

SEQ ID NO: 1270978 - DNA, 22 bp, Artificial Sequence
  chemically synthesized
tttctttctacctgcttaattg

SEQ ID NO: 1270979 - DNA, 22 bp, Artificial Sequence
  chemically synthesized
tctttctacctgcttaattgta

SEQ ID NO: 1270980 - DNA, 22 bp, Artificial Sequence
  chemically synthesized
ctttctacctgcttaattgtat

SEQ ID NO: 1270981 - DNA, 22 bp, Artificial Sequence
  chemically synthesized
tttctacctgcttaattgtatc

SEQ ID NO: 1270982 - DNA, 22 bp, Artificial Sequence
  chemically synthesized
tctacctgcttaattgtatctg

SEQ ID NO: 1270983 - DNA, 22 bp, Artificial Sequence
  chemically synthesized
acagaaatagcacagatacaat

SEQ ID NO: 1270984 - DNA, 22 bp, Artificial Sequence
  chemically synthesized
ctacctgcttaattgtatctgt

SEQ ID NO: 1270985 - DNA, 22 bp, Artificial Sequence
  chemically synthesized
aacagaaatagcacagatacaa

SEQ ID NO: 1270986 - DNA, 22 bp, Artificial Sequence
  chemically synthesized
tacctgcttaattgtatctgtg

SEQ ID NO: 1270987 - DNA, 22 bp, Artificial Sequence
  chemically synthesized
cctgcttaattgtatctgtgct

SEQ ID NO: 1270988 - DNA, 22 bp, Artificial Sequence
  chemically synthesized
cttaattgtatctgtgctattt

SEQ ID NO: 1270989 - DNA, 22 bp, Artificial Sequence
  chemically synthesized
aattgtatctgtgctatttctg

SEQ ID NO: 1270990 - DNA, 22 bp, Artificial Sequence
  chemically synthesized
attgtatctgtgctatttctgt

SEQ ID NO: 1270991 - DNA, 22 bp, Artificial Sequence
  chemically synthesized
tatctgtgctatttctgttaaa

SEQ ID NO: 1270992 - DNA, 22 bp, Artificial Sequence
  chemically synthesized
accgcagatgcatttaacagaa

SEQ ID NO: 1270993 - DNA, 22 bp, Artificial Sequence
  chemically synthesized
tgctatttctgttaaatgcatc

SEQ ID NO: 1270994 - DNA, 22 bp, Artificial Sequence
  chemically synthesized
caaagttcaccgcagatgcatt

SEQ ID NO: 1270995 - DNA, 22 bp, Artificial Sequence
  chemically synthesized
tttctgttaaatgcatctgcgg

SEQ ID NO: 1270996 - DNA, 22 bp, Artificial Sequence
  chemically synthesized
ctgttaaatgcatctgcggtga

SEQ ID NO: 1270997 - DNA, 22 bp, Artificial Sequence
  chemically synthesized
tgttaaatgcatctgcggtgaa

SEQ ID NO: 1270998 - DNA, 22 bp, Artificial Sequence
  chemically synthesized
gcaactgcaaagttcaccgcag

SEQ ID NO: 1270999 - DNA, 22 bp, Artificial Sequence
  chemically synthesized
agcaactgcaaagttcaccgca

SEQ ID NO: 1271000 - DNA, 22 bp, Artificial Sequence
  chemically synthesized
ttaaatgcatctgcggtgaact

SEQ ID NO: 1271001 - DNA, 22 bp, Artificial Sequence
  chemically synthesized
cttagcaactgcaaagttcacc

SEQ ID NO: 1271002 - DNA, 22 bp, Artificial Sequence
  chemically synthesized
aatgcatctgcggtgaactttg

SEQ ID NO: 1271003 - DNA, 22 bp, Artificial Sequence
  chemically synthesized
tccttagcaactgcaaagttca

SEQ ID NO: 1271004 - DNA, 22 bp, Artificial Sequence
  chemically synthesized
cggtgaactttgcagttgctaa

SEQ ID NO: 1271005 - DNA, 22 bp, Artificial Sequence
  chemically synthesized
gcaaacgctctccttagcaact

SEQ ID NO: 1271006 - DNA, 22 bp, Artificial Sequence
  chemically synthesized
tgcagttgctaaggagagcgtt

SEQ ID NO: 1271007 - DNA, 22 bp, Artificial Sequence
  chemically synthesized
gcagttgctaaggagagcgttt

SEQ ID NO: 1271008 - DNA, 22 bp, Artificial Sequence
  chemically synthesized
cagttgctaaggagagcgtttg

SEQ ID NO: 1271009 - DNA, 22 bp, Artificial Sequence
  chemically synthesized
ggcatatggaattggcaaacgc

SEQ ID NO: 1271010 - DNA, 22 bp, Artificial Sequence
  chemically synthesized
ctaaggagagcgtttgccaatt

SEQ ID NO: 1271011 - DNA, 22 bp, Artificial Sequence
  chemically synthesized
gactaggcatatggaattggca

SEQ ID NO: 1271012 - DNA, 22 bp, Artificial Sequence
  chemically synthesized
aggagagcgtttgccaattcca

SEQ ID NO: 1271013 - DNA, 22 bp, Artificial Sequence
  chemically synthesized
agactaggcatatggaattggc

SEQ ID NO: 1271014 - DNA, 22 bp, Artificial Sequence
  chemically synthesized
ccttagactaggcatatggaat

SEQ ID NO: 1271015 - DNA, 22 bp, Artificial Sequence
  chemically synthesized
agcctaccttagactaggcata

SEQ ID NO: 1271016 - DNA, 22 bp, Artificial Sequence
  chemically synthesized
cagcctaccttagactaggcat

SEQ ID NO: 1271017 - DNA, 22 bp, Artificial Sequence
  chemically synthesized
gccaattccatatgcctagtct

SEQ ID NO: 1271018 - DNA, 22 bp, Artificial Sequence
  chemically synthesized
ccaattccatatgcctagtcta

SEQ ID NO: 1271019 - DNA, 22 bp, Artificial Sequence
  chemically synthesized
gcttcagcctaccttagactag

SEQ ID NO: 1271020 - DNA, 22 bp, Artificial Sequence
  chemically synthesized
catatgcctagtctaaggtagg

SEQ ID NO: 1271021 - DNA, 22 bp, Artificial Sequence
  chemically synthesized
gtctaaggtaggctgaagctaa

SEQ ID NO: 1271022 - DNA, 22 bp, Artificial Sequence
  chemically synthesized
cagaatgacagattagcttcag

SEQ ID NO: 1271023 - DNA, 22 bp, Artificial Sequence
  chemically synthesized
tccagaatgacagattagcttc

SEQ ID NO: 1271024 - DNA, 22 bp, Artificial Sequence
  chemically synthesized
ctccagaatgacagattagctt

SEQ ID NO: 1271025 - DNA, 22 bp, Artificial Sequence
  chemically synthesized
aggtaggctgaagctaatctgt

SEQ ID NO: 1271026 - DNA, 22 bp, Artificial Sequence
  chemically synthesized
cttctccagaatgacagattag

SEQ ID NO: 1271027 - DNA, 22 bp, Artificial Sequence
  chemically synthesized
gcttctccagaatgacagatta

SEQ ID NO: 1271028 - DNA, 22 bp, Artificial Sequence
  chemically synthesized
ttgcttctccagaatgacagat

SEQ ID NO: 1271029 - DNA, 22 bp, Artificial Sequence
  chemically synthesized
tcttgcttctccagaatgacag

SEQ ID NO: 1271030 - DNA, 22 bp, Artificial Sequence
  chemically synthesized
ctcttgcttctccagaatgaca

SEQ ID NO: 1271031 - DNA, 22 bp, Artificial Sequence
  chemically synthesized
aagctaatctgtcattctggag

SEQ ID NO: 1271032 - DNA, 22 bp, Artificial Sequence
  chemically synthesized
gcttctcttgcttctccagaat

SEQ ID NO: 1271033 - DNA, 22 bp, Artificial Sequence
  chemically synthesized
agcttctcttgcttctccagaa

SEQ ID NO: 1271034 - DNA, 22 bp, Artificial Sequence
  chemically synthesized
atctgtcattctggagaagcaa

SEQ ID NO: 1271035 - DNA, 22 bp, Artificial Sequence
  chemically synthesized
tcattctggagaagcaagagaa

SEQ ID NO: 1271036 - DNA, 22 bp, Artificial Sequence
  chemically synthesized
tgaaaaccttagcttctcttgc

SEQ ID NO: 1271037 - DNA, 22 bp, Artificial Sequence
  chemically synthesized
tggagaagcaagagaagctaag

SEQ ID NO: 1271038 - DNA, 22 bp, Artificial Sequence
  chemically synthesized
gagaagcaagagaagctaaggt

SEQ ID NO: 1271039 - DNA, 22 bp, Artificial Sequence
  chemically synthesized
aatattatgaaaaccttagctt

SEQ ID NO: 1271040 - DNA, 22 bp, Artificial Sequence
  chemically synthesized
tcaactaaatattatgaaaacc

SEQ ID NO: 1271041 - DNA, 22 bp, Artificial Sequence
  chemically synthesized
atcaactaaatattatgaaaac

SEQ ID NO: 1271042 - DNA, 22 bp, Artificial Sequence
  chemically synthesized
atcccttatcaactaaatatta

SEQ ID NO: 1271043 - DNA, 22 bp, Artificial Sequence
  chemically synthesized
tcatcccttatcaactaaatat

SEQ ID NO: 1271044 - DNA, 22 bp, Artificial Sequence
  chemically synthesized
aggttttcataatatttagttg

SEQ ID NO: 1271045 - DNA, 22 bp, Artificial Sequence
  chemically synthesized
aagttctcatcccttatcaact

SEQ ID NO: 1271046 - DNA, 22 bp, Artificial Sequence
  chemically synthesized
tcataatatttagttgataagg

SEQ ID NO: 1271047 - DNA, 22 bp, Artificial Sequence
  chemically synthesized
cataatatttagttgataaggg

SEQ ID NO: 1271048 - DNA, 22 bp, Artificial Sequence
  chemically synthesized
ataatatttagttgataaggga

SEQ ID NO: 1271049 - DNA, 22 bp, Artificial Sequence
  chemically synthesized
agttgataagggatgagaactt

SEQ ID NO: 1271050 - DNA, 22 bp, Artificial Sequence
  chemically synthesized
gttgataagggatgagaacttt

SEQ ID NO: 1271051 - DNA, 22 bp, Artificial Sequence
  chemically synthesized
ataagggatgagaactttagat

SEQ ID NO: 1271052 - DNA, 22 bp, Artificial Sequence
  chemically synthesized
tagatacatgttatctcttact

SEQ ID NO: 1271053 - DNA, 22 bp, Artificial Sequence
  chemically synthesized
gaaaaatagcaaagtaagagat

SEQ ID NO: 1271054 - DNA, 22 bp, Artificial Sequence
  chemically synthesized
agatacatgttatctcttactt

SEQ ID NO: 1271055 - DNA, 22 bp, Artificial Sequence
  chemically synthesized
ggaaaaatagcaaagtaagaga

SEQ ID NO: 1271056 - DNA, 22 bp, Artificial Sequence
  chemically synthesized
gatacatgttatctcttacttt

SEQ ID NO: 1271057 - DNA, 22 bp, Artificial Sequence
  chemically synthesized
tggaaaaatagcaaagtaagag

SEQ ID NO: 1271058 - DNA, 22 bp, Artificial Sequence
  chemically synthesized
ttggaaaaatagcaaagtaaga

SEQ ID NO: 1271059 - DNA, 22 bp, Artificial Sequence
  chemically synthesized
tctcttactttgctatttttcc

SEQ ID NO: 1271060 - DNA, 22 bp, Artificial Sequence
  chemically synthesized
aaatacatttttggaaaaatag

SEQ ID NO: 1271061 - DNA, 22 bp, Artificial Sequence
  chemically synthesized
caaatacatttttggaaaaata

SEQ ID NO: 1271062 - DNA, 22 bp, Artificial Sequence
  chemically synthesized
ttactttgctatttttccaaaa

SEQ ID NO: 1271063 - DNA, 22 bp, Artificial Sequence
  chemically synthesized
actttgctatttttccaaaaat

SEQ ID NO: 1271064 - DNA, 22 bp, Artificial Sequence
  chemically synthesized
ctttgctatttttccaaaaatg

SEQ ID NO: 1271065 - DNA, 22 bp, Artificial Sequence
  chemically synthesized
tgctatttttccaaaaatgtat

SEQ ID NO: 1271066 - DNA, 22 bp, Artificial Sequence
  chemically synthesized
acagtgtttcaaatacattttt

SEQ ID NO: 1271067 - DNA, 22 bp, Artificial Sequence
  chemically synthesized
gctatttttccaaaaatgtatt

SEQ ID NO: 1271068 - DNA, 22 bp, Artificial Sequence
  chemically synthesized
aacagtgtttcaaatacatttt

SEQ ID NO: 1271069 - DNA, 22 bp, Artificial Sequence
  chemically synthesized
ctatttttccaaaaatgtattt

SEQ ID NO: 1271070 - DNA, 22 bp, Artificial Sequence
  chemically synthesized
cttaacagtgtttcaaatacat

SEQ ID NO: 1271071 - DNA, 22 bp, Artificial Sequence
  chemically synthesized
tttttccaaaaatgtatttgaa

SEQ ID NO: 1271072 - DNA, 22 bp, Artificial Sequence
  chemically synthesized
tgcttaacagtgtttcaaatac

SEQ ID NO: 1271073 - DNA, 22 bp, Artificial Sequence
  chemically synthesized
ttccaaaaatgtatttgaaaca

SEQ ID NO: 1271074 - DNA, 22 bp, Artificial Sequence
  chemically synthesized
tccaaaaatgtatttgaaacac

SEQ ID NO: 1271075 - DNA, 22 bp, Artificial Sequence
  chemically synthesized
ctctgcttaacagtgtttcaaa

SEQ ID NO: 1271076 - DNA, 22 bp, Artificial Sequence
  chemically synthesized
ccaaaaatgtatttgaaacact

SEQ ID NO: 1271077 - DNA, 22 bp, Artificial Sequence
  chemically synthesized
caaaaatgtatttgaaacactg

SEQ ID NO: 1271078 - DNA, 22 bp, Artificial Sequence
  chemically synthesized
ttgctctgcttaacagtgtttc

SEQ ID NO: 1271079 - DNA, 22 bp, Artificial Sequence
  chemically synthesized
cataaatattattgctctgctt

SEQ ID NO: 1271080 - DNA, 22 bp, Artificial Sequence
  chemically synthesized
gaaacactgttaagcagagcaa

SEQ ID NO: 1271081 - DNA, 22 bp, Artificial Sequence
  chemically synthesized
aaacactgttaagcagagcaat

SEQ ID NO: 1271082 - DNA, 22 bp, Artificial Sequence
  chemically synthesized
ttaagcagagcaataatattta

SEQ ID NO: 1271083 - DNA, 22 bp, Artificial Sequence
  chemically synthesized
agcagagcaataatatttatgc

SEQ ID NO: 1271084 - DNA, 22 bp, Artificial Sequence
  chemically synthesized
aaaatgtaaaatgctgcataaa

SEQ ID NO: 1271085 - DNA, 22 bp, Artificial Sequence
  chemically synthesized
aaaaatgtaaaatgctgcataa

SEQ ID NO: 1271086 - DNA, 22 bp, Artificial Sequence
  chemically synthesized
taaaaatgtaaaatgctgcata

SEQ ID NO: 1271087 - DNA, 22 bp, Artificial Sequence
  chemically synthesized
aaggactttaaaaatgtaaaat

SEQ ID NO: 1271088 - DNA, 22 bp, Artificial Sequence
  chemically synthesized
aaaggactttaaaaatgtaaaa

SEQ ID NO: 1271089 - DNA, 22 bp, Artificial Sequence
  chemically synthesized
atgcagcattttacatttttaa

SEQ ID NO: 1271090 - DNA, 22 bp, Artificial Sequence
  chemically synthesized
tgcagcattttacatttttaaa

SEQ ID NO: 1271091 - DNA, 22 bp, Artificial Sequence
  chemically synthesized
tacatttttaaagtcctttaaa

SEQ ID NO: 1271092 - DNA, 22 bp, Artificial Sequence
  chemically synthesized
acatttttaaagtcctttaaat

SEQ ID NO: 1271093 - DNA, 22 bp, Artificial Sequence
  chemically synthesized
catttttaaagtcctttaaata

SEQ ID NO: 1271094 - DNA, 22 bp, Artificial Sequence
  chemically synthesized
atgcatgatgtaatatttaaag

SEQ ID NO: 1271095 - DNA, 22 bp, Artificial Sequence
  chemically synthesized
gatgcatgatgtaatatttaaa

SEQ ID NO: 1271096 - DNA, 22 bp, Artificial Sequence
  chemically synthesized
tgatgcatgatgtaatatttaa

SEQ ID NO: 1271097 - DNA, 22 bp, Artificial Sequence
  chemically synthesized
ttgatgcatgatgtaatattta

SEQ ID NO: 1271098 - DNA, 22 bp, Artificial Sequence
  chemically synthesized
ttaaagtcctttaaatattaca

SEQ ID NO: 1271099 - DNA, 22 bp, Artificial Sequence
  chemically synthesized
taaagtcctttaaatattacat

SEQ ID NO: 1271100 - DNA, 22 bp, Artificial Sequence
  chemically synthesized
aaagtcctttaaatattacatc

SEQ ID NO: 1271101 - DNA, 22 bp, Artificial Sequence
  chemically synthesized
aagtcctttaaatattacatca

SEQ ID NO: 1271102 - DNA, 22 bp, Artificial Sequence
  chemically synthesized
taaatattacatcatgcatcaa

SEQ ID NO: 1271103 - DNA, 22 bp, Artificial Sequence
  chemically synthesized
aaatattacatcatgcatcaaa

SEQ ID NO: 1271104 - DNA, 22 bp, Artificial Sequence
  chemically synthesized
gtatcgataatttttgatgcat

SEQ ID NO: 1271105 - DNA, 22 bp, Artificial Sequence
  chemically synthesized
aatattacatcatgcatcaaaa

SEQ ID NO: 1271106 - DNA, 22 bp, Artificial Sequence
  chemically synthesized
ggtatcgataatttttgatgca

SEQ ID NO: 1271107 - DNA, 22 bp, Artificial Sequence
  chemically synthesized
catcatgcatcaaaaattatcg

SEQ ID NO: 1271108 - DNA, 22 bp, Artificial Sequence
  chemically synthesized
agacaatcacatcttggtatcg

SEQ ID NO: 1271109 - DNA, 22 bp, Artificial Sequence
  chemically synthesized
aaattgagacaatcacatcttg

SEQ ID NO: 1271110 - DNA, 22 bp, Artificial Sequence
  chemically synthesized
taaaattgagacaatcacatct

SEQ ID NO: 1271111 - DNA, 22 bp, Artificial Sequence
  chemically synthesized
tcgataccaagatgtgattgtc

SEQ ID NO: 1271112 - DNA, 22 bp, Artificial Sequence
  chemically synthesized
tcgtctctaaaattgagacaat

SEQ ID NO: 1271113 - DNA, 22 bp, Artificial Sequence
  chemically synthesized
atcgtctctaaaattgagacaa

SEQ ID NO: 1271114 - DNA, 22 bp, Artificial Sequence
  chemically synthesized
tatcgtctctaaaattgagaca

SEQ ID NO: 1271115 - DNA, 22 bp, Artificial Sequence
  chemically synthesized
attttatcgtctctaaaattga

SEQ ID NO: 1271116 - DNA, 22 bp, Artificial Sequence
  chemically synthesized
aattttatcgtctctaaaattg

SEQ ID NO: 1271117 - DNA, 22 bp, Artificial Sequence
  chemically synthesized
taattttatcgtctctaaaatt

SEQ ID NO: 1271118 - DNA, 22 bp, Artificial Sequence
  chemically synthesized
ttaattttatcgtctctaaaat

SEQ ID NO: 1271119 - DNA, 22 bp, Artificial Sequence
  chemically synthesized
tttttaattttatcgtctctaa

SEQ ID NO: 1271120 - DNA, 22 bp, Artificial Sequence
  chemically synthesized
atttttaattttatcgtctcta

SEQ ID NO: 1271121 - DNA, 22 bp, Artificial Sequence
  chemically synthesized
ttatttttaattttatcgtctc

SEQ ID NO: 1271122 - DNA, 22 bp, Artificial Sequence
  chemically synthesized
tctcaattttagagacgataaa

SEQ ID NO: 1271123 - DNA, 22 bp, Artificial Sequence
  chemically synthesized
aattttagagacgataaaatta

SEQ ID NO: 1271124 - DNA, 22 bp, Artificial Sequence
  chemically synthesized
agaacctcttatttttaatttt

SEQ ID NO: 1271125 - DNA, 22 bp, Artificial Sequence
  chemically synthesized
gagaacctcttatttttaattt

SEQ ID NO: 1271126 - DNA, 22 bp, Artificial Sequence
  chemically synthesized
tagagacgataaaattaaaaat

SEQ ID NO: 1271127 - DNA, 22 bp, Artificial Sequence
  chemically synthesized
tgagaacctcttatttttaatt

SEQ ID NO: 1271128 - DNA, 22 bp, Artificial Sequence
  chemically synthesized
agagacgataaaattaaaaata

SEQ ID NO: 1271129 - DNA, 22 bp, Artificial Sequence
  chemically synthesized
gagacgataaaattaaaaataa

SEQ ID NO: 1271130 - DNA, 22 bp, Artificial Sequence
  chemically synthesized
taaaataatgacattttgagaa

SEQ ID NO: 1271131 - DNA, 22 bp, Artificial Sequence
  chemically synthesized
aaaataagaggttctcaaaatg

SEQ ID NO: 1271132 - DNA, 22 bp, Artificial Sequence
  chemically synthesized
ttataaaataatgacattttga

SEQ ID NO: 1271133 - DNA, 22 bp, Artificial Sequence
  chemically synthesized
agttattataaaataatgacat

SEQ ID NO: 1271134 - DNA, 22 bp, Artificial Sequence
  chemically synthesized
ttcagttattataaaataatga

SEQ ID NO: 1271135 - DNA, 22 bp, Artificial Sequence
  chemically synthesized
gttcagttattataaaataatg

SEQ ID NO: 1271136 - DNA, 22 bp, Artificial Sequence
  chemically synthesized
tgttcagttattataaaataat

SEQ ID NO: 1271137 - DNA, 22 bp, Artificial Sequence
  chemically synthesized
ttgttcagttattataaaataa

SEQ ID NO: 1271138 - DNA, 22 bp, Artificial Sequence
  chemically synthesized
tcaaaatgtcattattttataa

SEQ ID NO: 1271139 - DNA, 22 bp, Artificial Sequence
  chemically synthesized
aaaatgtcattattttataata

SEQ ID NO: 1271140 - DNA, 22 bp, Artificial Sequence
  chemically synthesized
aggtaaaacttttgttcagtta

SEQ ID NO: 1271141 - DNA, 22 bp, Artificial Sequence
  chemically synthesized
ttttataataactgaacaaaag

SEQ ID NO: 1271142 - DNA, 22 bp, Artificial Sequence
  chemically synthesized
tataataactgaacaaaagttt

SEQ ID NO: 1271143 - DNA, 22 bp, Artificial Sequence
  chemically synthesized
aatgttgaggtaaaacttttgt

SEQ ID NO: 1271144 - DNA, 22 bp, Artificial Sequence
  chemically synthesized
ataataactgaacaaaagtttt

SEQ ID NO: 1271145 - DNA, 22 bp, Artificial Sequence
  chemically synthesized
taataactgaacaaaagtttta

SEQ ID NO: 1271146 - DNA, 22 bp, Artificial Sequence
  chemically synthesized
atgttaaatgttgaggtaaaac

SEQ ID NO: 1271147 - DNA, 22 bp, Artificial Sequence
  chemically synthesized
gatgttaaatgttgaggtaaaa

SEQ ID NO: 1271148 - DNA, 22 bp, Artificial Sequence
  chemically synthesized
tgatgttaaatgttgaggtaaa

SEQ ID NO: 1271149 - DNA, 22 bp, Artificial Sequence
  chemically synthesized
ttgatgttaaatgttgaggtaa

SEQ ID NO: 1271150 - DNA, 22 bp, Artificial Sequence
  chemically synthesized
aacaaaagttttacctcaacat

SEQ ID NO: 1271151 - DNA, 22 bp, Artificial Sequence
  chemically synthesized
tacctcaacatttaacatcaaa

SEQ ID NO: 1271152 - DNA, 22 bp, Artificial Sequence
  chemically synthesized
acctcaacatttaacatcaaaa

SEQ ID NO: 1271153 - DNA, 22 bp, Artificial Sequence
  chemically synthesized
cctcaacatttaacatcaaaaa

SEQ ID NO: 1271154 - DNA, 22 bp, Artificial Sequence
  chemically synthesized
ataaaaatgaaaatgtttttga

SEQ ID NO: 1271155 - DNA, 22 bp, Artificial Sequence
  chemically synthesized
aacatttaacatcaaaaacatt

SEQ ID NO: 1271156 - DNA, 22 bp, Artificial Sequence
  chemically synthesized
aacatcaaaaacattttcattt

SEQ ID NO: 1271157 - DNA, 22 bp, Artificial Sequence
  chemically synthesized
acatcaaaaacattttcatttt

SEQ ID NO: 1271158 - DNA, 22 bp, Artificial Sequence
  chemically synthesized
tcatttttattagatcatgatg

SEQ ID NO: 1271159 - DNA, 22 bp, Artificial Sequence
  chemically synthesized
catttttattagatcatgatgt

SEQ ID NO: 1271160 - DNA, 22 bp, Artificial Sequence
  chemically synthesized
atttttattagatcatgatgtt

SEQ ID NO: 1271161 - DNA, 22 bp, Artificial Sequence
  chemically synthesized
ttattagatcatgatgttctgt

SEQ ID NO: 1271162 - DNA, 22 bp, Artificial Sequence
  chemically synthesized
tgtgacgagcaaacagaacatc

SEQ ID NO: 1271163 - DNA, 22 bp, Artificial Sequence
  chemically synthesized
tattagatcatgatgttctgtt

SEQ ID NO: 1271164 - DNA, 22 bp, Artificial Sequence
  chemically synthesized
atgtgacgagcaaacagaacat

SEQ ID NO: 1271165 - DNA, 22 bp, Artificial Sequence
  chemically synthesized
attagatcatgatgttctgttt

SEQ ID NO: 1271166 - DNA, 22 bp, Artificial Sequence
  chemically synthesized
tatgtgacgagcaaacagaaca

SEQ ID NO: 1271167 - DNA, 22 bp, Artificial Sequence
  chemically synthesized
ttagatcatgatgttctgtttg

SEQ ID NO: 1271168 - DNA, 22 bp, Artificial Sequence
  chemically synthesized
gatcatgatgttctgtttgctc

SEQ ID NO: 1271169 - DNA, 22 bp, Artificial Sequence
  chemically synthesized
aaatattttatgtgacgagcaa

SEQ ID NO: 1271170 - DNA, 22 bp, Artificial Sequence
  chemically synthesized
aaaatattttatgtgacgagca

SEQ ID NO: 1271171 - DNA, 22 bp, Artificial Sequence
  chemically synthesized
taaaatattttatgtgacgagc

SEQ ID NO: 1271172 - DNA, 22 bp, Artificial Sequence
  chemically synthesized
tttaaaatattttatgtgacga

SEQ ID NO: 1271173 - DNA, 22 bp, Artificial Sequence
  chemically synthesized
tgtttgctcgtcacataaaata

SEQ ID NO: 1271174 - DNA, 22 bp, Artificial Sequence
  chemically synthesized
tttgctcgtcacataaaatatt

SEQ ID NO: 1271175 - DNA, 22 bp, Artificial Sequence
  chemically synthesized
gctcgtcacataaaatatttta

SEQ ID NO: 1271176 - DNA, 22 bp, Artificial Sequence
  chemically synthesized
ctcgtcacataaaatattttaa

SEQ ID NO: 1271177 - DNA, 22 bp, Artificial Sequence
  chemically synthesized
gtcacataaaatattttaaaga

SEQ ID NO: 1271178 - DNA, 22 bp, Artificial Sequence
  chemically synthesized
aaccccaaacatctctttaaaa

SEQ ID NO: 1271179 - DNA, 22 bp, Artificial Sequence
  chemically synthesized
aaaccccaaacatctctttaaa

SEQ ID NO: 1271180 - DNA, 22 bp, Artificial Sequence
  chemically synthesized
tttaaaccccaaacatctcttt

SEQ ID NO: 1271181 - DNA, 22 bp, Artificial Sequence
  chemically synthesized
atctgtttaaaccccaaacatc

SEQ ID NO: 1271182 - DNA, 22 bp, Artificial Sequence
  chemically synthesized
aatctgtttaaaccccaaacat

SEQ ID NO: 1271183 - DNA, 22 bp, Artificial Sequence
  chemically synthesized
taaagagatgtttggggtttaa

SEQ ID NO: 1271184 - DNA, 22 bp, Artificial Sequence
  chemically synthesized
aaagagatgtttggggtttaaa

SEQ ID NO: 1271185 - DNA, 22 bp, Artificial Sequence
  chemically synthesized
aagagatgtttggggtttaaac

SEQ ID NO: 1271186 - DNA, 22 bp, Artificial Sequence
  chemically synthesized
tagaaatacttaatctgtttaa

SEQ ID NO: 1271187 - DNA, 22 bp, Artificial Sequence
  chemically synthesized
ggggtttaaacagattaagtat

SEQ ID NO: 1271188 - DNA, 22 bp, Artificial Sequence
  chemically synthesized
gggtttaaacagattaagtatt

SEQ ID NO: 1271189 - DNA, 22 bp, Artificial Sequence
  chemically synthesized
aaggcactatagaaatacttaa

SEQ ID NO: 1271190 - DNA, 22 bp, Artificial Sequence
  chemically synthesized
attcaaggcactatagaaatac

SEQ ID NO: 1271191 - DNA, 22 bp, Artificial Sequence
  chemically synthesized
aaacagattaagtatttctata

SEQ ID NO: 1271192 - DNA, 22 bp, Artificial Sequence
  chemically synthesized
aacagattaagtatttctatag

SEQ ID NO: 1271193 - DNA, 22 bp, Artificial Sequence
  chemically synthesized
ttaattcaaggcactatagaaa

SEQ ID NO: 1271194 - DNA, 22 bp, Artificial Sequence
  chemically synthesized
gttaattcaaggcactatagaa

SEQ ID NO: 1271195 - DNA, 22 bp, Artificial Sequence
  chemically synthesized
tttgttaattcaaggcactata

SEQ ID NO: 1271196 - DNA, 22 bp, Artificial Sequence
  chemically synthesized
atttgttaattcaaggcactat

SEQ ID NO: 1271197 - DNA, 22 bp, Artificial Sequence
  chemically synthesized
tatttgttaattcaaggcacta

SEQ ID NO: 1271198 - DNA, 22 bp, Artificial Sequence
  chemically synthesized
ttatttgttaattcaaggcact

SEQ ID NO: 1271199 - DNA, 22 bp, Artificial Sequence
  chemically synthesized
agtatttctatagtgccttgaa

SEQ ID NO: 1271200 - DNA, 22 bp, Artificial Sequence
  chemically synthesized
cttttatttgttaattcaaggc

SEQ ID NO: 1271201 - DNA, 22 bp, Artificial Sequence
  chemically synthesized
acttttatttgttaattcaagg

SEQ ID NO: 1271202 - DNA, 22 bp, Artificial Sequence
  chemically synthesized
tttacttttatttgttaattca

SEQ ID NO: 1271203 - DNA, 22 bp, Artificial Sequence
  chemically synthesized
ctatagtgccttgaattaacaa

SEQ ID NO: 1271204 - DNA, 22 bp, Artificial Sequence
  chemically synthesized
tatagtgccttgaattaacaaa

SEQ ID NO: 1271205 - DNA, 22 bp, Artificial Sequence
  chemically synthesized
tagtgccttgaattaacaaata

SEQ ID NO: 1271206 - DNA, 22 bp, Artificial Sequence
  chemically synthesized
gtattatttacttttatttgtt

SEQ ID NO: 1271207 - DNA, 22 bp, Artificial Sequence
  chemically synthesized
agtattatttacttttatttgt

SEQ ID NO: 1271208 - DNA, 22 bp, Artificial Sequence
  chemically synthesized
tagtattatttacttttatttg

SEQ ID NO: 1271209 - DNA, 22 bp, Artificial Sequence
  chemically synthesized
gaattaacaaataaaagtaaat

SEQ ID NO: 1271210 - DNA, 22 bp, Artificial Sequence
  chemically synthesized
aattaacaaataaaagtaaata

SEQ ID NO: 1271211 - DNA, 22 bp, Artificial Sequence
  chemically synthesized
acaaataaaagtaaataatact

SEQ ID NO: 1271212 - DNA, 22 bp, Artificial Sequence
  chemically synthesized
atagcaagacaatagatgggtg

SEQ ID NO: 1271213 - DNA, 22 bp, Artificial Sequence
  chemically synthesized
catagcaagacaatagatgggt

SEQ ID NO: 1271214 - DNA, 22 bp, Artificial Sequence
  chemically synthesized
aaactacacccatctattgtct

SEQ ID NO: 1271215 - DNA, 22 bp, Artificial Sequence
  chemically synthesized
ggtttcatagcaagacaataga

SEQ ID NO: 1271216 - DNA, 22 bp, Artificial Sequence
  chemically synthesized
taggtttcatagcaagacaata

SEQ ID NO: 1271217 - DNA, 22 bp, Artificial Sequence
  chemically synthesized
cacccatctattgtcttgctat

SEQ ID NO: 1271218 - DNA, 22 bp, Artificial Sequence
  chemically synthesized
cctctaggtttcatagcaagac

SEQ ID NO: 1271219 - DNA, 22 bp, Artificial Sequence
  chemically synthesized
acctctaggtttcatagcaaga

SEQ ID NO: 1271220 - DNA, 22 bp, Artificial Sequence
  chemically synthesized
tacctctaggtttcatagcaag

SEQ ID NO: 1271221 - DNA, 22 bp, Artificial Sequence
  chemically synthesized
ttgtcttgctatgaaacctaga

SEQ ID NO: 1271222 - DNA, 22 bp, Artificial Sequence
  chemically synthesized
acatacactttacctctaggtt

SEQ ID NO: 1271223 - DNA, 22 bp, Artificial Sequence
  chemically synthesized
tcttgctatgaaacctagaggt

SEQ ID NO: 1271224 - DNA, 22 bp, Artificial Sequence
  chemically synthesized
cacatacactttacctctaggt

SEQ ID NO: 1271225 - DNA, 22 bp, Artificial Sequence
  chemically synthesized
cttcacatacactttacctcta

SEQ ID NO: 1271226 - DNA, 22 bp, Artificial Sequence
  chemically synthesized
gctatgaaacctagaggtaaag

SEQ ID NO: 1271227 - DNA, 22 bp, Artificial Sequence
  chemically synthesized
acttcacatacactttacctct

SEQ ID NO: 1271228 - DNA, 22 bp, Artificial Sequence
  chemically synthesized
ctatgaaacctagaggtaaagt

SEQ ID NO: 1271229 - DNA, 22 bp, Artificial Sequence
  chemically synthesized
tacttcacatacactttacctc

SEQ ID NO: 1271230 - DNA, 22 bp, Artificial Sequence
  chemically synthesized
tgaaacctagaggtaaagtgta

SEQ ID NO: 1271231 - DNA, 22 bp, Artificial Sequence
  chemically synthesized
ttttacttcacatacactttac

SEQ ID NO: 1271232 - DNA, 22 bp, Artificial Sequence
  chemically synthesized
gaggtaaagtgtatgtgaagta

SEQ ID NO: 1271233 - DNA, 22 bp, Artificial Sequence
  chemically synthesized
aaaaatactgttttacttcaca

SEQ ID NO: 1271234 - DNA, 22 bp, Artificial Sequence
  chemically synthesized
caaaaatactgttttacttcac

SEQ ID NO: 1271235 - DNA, 22 bp, Artificial Sequence
  chemically synthesized
caacttcaaaaatactgtttta

SEQ ID NO: 1271236 - DNA, 22 bp, Artificial Sequence
  chemically synthesized
aagcaatggtaagacattacaa

SEQ ID NO: 1271237 - DNA, 22 bp, Artificial Sequence
  chemically synthesized
attgaagcaatggtaagacatt

SEQ ID NO: 1271238 - DNA, 22 bp, Artificial Sequence
  chemically synthesized
aattgaagcaatggtaagacat

SEQ ID NO: 1271239 - DNA, 22 bp, Artificial Sequence
  chemically synthesized
ttgaagttgtaatgtcttacca

SEQ ID NO: 1271240 - DNA, 22 bp, Artificial Sequence
  chemically synthesized
tgaagttgtaatgtcttaccat

SEQ ID NO: 1271241 - DNA, 22 bp, Artificial Sequence
  chemically synthesized
gaagttgtaatgtcttaccatt

SEQ ID NO: 1271242 - DNA, 22 bp, Artificial Sequence
  chemically synthesized
aagttgtaatgtcttaccattg

SEQ ID NO: 1271243 - DNA, 22 bp, Artificial Sequence
  chemically synthesized
taatgtcttaccattgcttcaa

SEQ ID NO: 1271244 - DNA, 22 bp, Artificial Sequence
  chemically synthesized
accattgcttcaattaaatcgt

SEQ ID NO: 1271245 - DNA, 22 bp, Artificial Sequence
  chemically synthesized
ccattgcttcaattaaatcgtt

SEQ ID NO: 1271246 - DNA, 22 bp, Artificial Sequence
  chemically synthesized
cttcaattaaatcgttacatac

SEQ ID NO: 1271247 - DNA, 22 bp, Artificial Sequence
  chemically synthesized
caattaaatcgttacatacaca

SEQ ID NO: 1271248 - DNA, 22 bp, Artificial Sequence
  chemically synthesized
aattaaatcgttacatacacac

SEQ ID NO: 1271249 - DNA, 22 bp, Artificial Sequence
  chemically synthesized
aatcgttacatacacacacaca

SEQ ID NO: 1271250 - DNA, 22 bp, Artificial Sequence
  chemically synthesized
catacacacacacacacacaca

SEQ ID NO: 1271251 - DNA, 22 bp, Artificial Sequence
  chemically synthesized
tgtgtgcgtgtgtgtgtgtgtg

SEQ ID NO: 1271252 - DNA, 22 bp, Artificial Sequence
  chemically synthesized
atatattatgtgtgcgtgtgtg

SEQ ID NO: 1271253 - DNA, 22 bp, Artificial Sequence
  chemically synthesized
tcatctaatatattatgtgtgc

SEQ ID NO: 1271254 - DNA, 22 bp, Artificial Sequence
  chemically synthesized
tctatcatctaatatattatgt

SEQ ID NO: 1271255 - DNA, 22 bp, Artificial Sequence
  chemically synthesized
atctatctatcatctaatatat

SEQ ID NO: 1271256 - DNA, 22 bp, Artificial Sequence
  chemically synthesized
tctaatctatctatcatctaat

SEQ ID NO: 1271257 - DNA, 22 bp, Artificial Sequence
  chemically synthesized
cctatctaatctatctatcatc

SEQ ID NO: 1271258 - DNA, 22 bp, Artificial Sequence
  chemically synthesized
cctacctatctaatctatctat

SEQ ID NO: 1271259 - DNA, 22 bp, Artificial Sequence
  chemically synthesized
cctacctacctatctaatctat

SEQ ID NO: 1271260 - DNA, 22 bp, Artificial Sequence
  chemically synthesized
gatgatagatagattagatagg

SEQ ID NO: 1271261 - DNA, 22 bp, Artificial Sequence
  chemically synthesized
cctacctacctacctatctaat

SEQ ID NO: 1271262 - DNA, 22 bp, Artificial Sequence
  chemically synthesized
tctacctacctacctacctatc

SEQ ID NO: 1271263 - DNA, 22 bp, Artificial Sequence
  chemically synthesized
tctatctacctacctacctacc

SEQ ID NO: 1271264 - DNA, 22 bp, Artificial Sequence
  chemically synthesized
tctatctatctacctacctacc

SEQ ID NO: 1271265 - DNA, 22 bp, Artificial Sequence
  chemically synthesized
gataggtaggtaggtaggtaga

SEQ ID NO: 1271266 - DNA, 22 bp, Artificial Sequence
  chemically synthesized
tctatctatctatctacctacc

SEQ ID NO: 1271267 - DNA, 22 bp, Artificial Sequence
  chemically synthesized
tctatctatctatctatctacc

SEQ ID NO: 1271268 - DNA, 22 bp, Artificial Sequence
  chemically synthesized
tctatctatctatctatctatc

SEQ ID NO: 1271269 - DNA, 22 bp, Artificial Sequence
  chemically synthesized
tctatctatctatctatctatc

SEQ ID NO: 1271270 - DNA, 22 bp, Artificial Sequence
  chemically synthesized
tctatctatctatctatctatc

SEQ ID NO: 1271271 - DNA, 22 bp, Artificial Sequence
  chemically synthesized
tctatctatctatctatctatc

SEQ ID NO: 1271272 - DNA, 22 bp, Artificial Sequence
  chemically synthesized
tctatctatctatctatctatc

SEQ ID NO: 1271273 - DNA, 22 bp, Artificial Sequence
  chemically synthesized
tctatctatctatctatctatc

SEQ ID NO: 1271274 - DNA, 22 bp, Artificial Sequence
  chemically synthesized
tctatctatctatctatctatc

SEQ ID NO: 1271275 - DNA, 22 bp, Artificial Sequence
  chemically synthesized
tctatctatctatctatctatc

SEQ ID NO: 1271276 - DNA, 22 bp, Artificial Sequence
  chemically synthesized
tctgtctatctatctatctatc

SEQ ID NO: 1271277 - DNA, 22 bp, Artificial Sequence
  chemically synthesized
tctgtctgtctatctatctatc

SEQ ID NO: 1271278 - DNA, 22 bp, Artificial Sequence
  chemically synthesized
tctgtctgtctgtctatctatc

SEQ ID NO: 1271279 - DNA, 22 bp, Artificial Sequence
  chemically synthesized
tctgtctgtctgtctgtctatc

SEQ ID NO: 1271280 - DNA, 22 bp, Artificial Sequence
  chemically synthesized
tctgtctgtctgtctgtctgtc

SEQ ID NO: 1271281 - DNA, 22 bp, Artificial Sequence
  chemically synthesized
tctgtctgtctgtctgtctgtc

SEQ ID NO: 1271282 - DNA, 22 bp, Artificial Sequence
  chemically synthesized
agtggggatcacaaatgcctat

SEQ ID NO: 1271283 - DNA, 22 bp, Artificial Sequence
  chemically synthesized
cagtggggatcacaaatgccta

SEQ ID NO: 1271284 - DNA, 22 bp, Artificial Sequence
  chemically synthesized
tcagtggggatcacaaatgcct

SEQ ID NO: 1271285 - DNA, 22 bp, Artificial Sequence
  chemically synthesized
ttcagtggggatcacaaatgcc

SEQ ID NO: 1271286 - DNA, 22 bp, Artificial Sequence
  chemically synthesized
tttcagtggggatcacaaatgc

SEQ ID NO: 1271287 - DNA, 22 bp, Artificial Sequence
  chemically synthesized
ttttcagtggggatcacaaatg

SEQ ID NO: 1271288 - DNA, 22 bp, Artificial Sequence
  chemically synthesized
ccagtttttttcagtggggatc

SEQ ID NO: 1271289 - DNA, 22 bp, Artificial Sequence
  chemically synthesized
gccagtttttttcagtggggat

SEQ ID NO: 1271290 - DNA, 22 bp, Artificial Sequence
  chemically synthesized
gtgatccccactgaaaaaaact

SEQ ID NO: 1271291 - DNA, 22 bp, Artificial Sequence
  chemically synthesized
ggcaagcttgccagtttttttc

SEQ ID NO: 1271292 - DNA, 22 bp, Artificial Sequence
  chemically synthesized
tgatccccactgaaaaaaactg

SEQ ID NO: 1271293 - DNA, 22 bp, Artificial Sequence
  chemically synthesized
aggcaagcttgccagttttttt

SEQ ID NO: 1271294 - DNA, 22 bp, Artificial Sequence
  chemically synthesized
taggcaagcttgccagtttttt

SEQ ID NO: 1271295 - DNA, 22 bp, Artificial Sequence
  chemically synthesized
ttaggcaagcttgccagttttt

SEQ ID NO: 1271296 - DNA, 22 bp, Artificial Sequence
  chemically synthesized
acttttaggcaagcttgccagt

SEQ ID NO: 1271297 - DNA, 22 bp, Artificial Sequence
  chemically synthesized
ctcacttttaggcaagcttgcc

SEQ ID NO: 1271298 - DNA, 22 bp, Artificial Sequence
  chemically synthesized
tcctcacttttaggcaagcttg

SEQ ID NO: 1271299 - DNA, 22 bp, Artificial Sequence
  chemically synthesized
aaaaaaactggcaagcttgcct

SEQ ID NO: 1271300 - DNA, 22 bp, Artificial Sequence
  chemically synthesized
ataattctcctcacttttaggc

SEQ ID NO: 1271301 - DNA, 22 bp, Artificial Sequence
  chemically synthesized
aataattctcctcacttttagg

SEQ ID NO: 1271302 - DNA, 22 bp, Artificial Sequence
  chemically synthesized
ttaataattctcctcactttta

SEQ ID NO: 1271303 - DNA, 22 bp, Artificial Sequence
  chemically synthesized
gcaagcttgcctaaaagtgagg

SEQ ID NO: 1271304 - DNA, 22 bp, Artificial Sequence
  chemically synthesized
cttaataattctcctcactttt

SEQ ID NO: 1271305 - DNA, 22 bp, Artificial Sequence
  chemically synthesized
tttcttaataattctcctcact

SEQ ID NO: 1271306 - DNA, 22 bp, Artificial Sequence
  chemically synthesized
ctatttcttaataattctcctc

SEQ ID NO: 1271307 - DNA, 22 bp, Artificial Sequence
  chemically synthesized
actatttcttaataattctcct

SEQ ID NO: 1271308 - DNA, 22 bp, Artificial Sequence
  chemically synthesized
gcctaaaagtgaggagaattat

SEQ ID NO: 1271309 - DNA, 22 bp, Artificial Sequence
  chemically synthesized
cctaaaagtgaggagaattatt

SEQ ID NO: 1271310 - DNA, 22 bp, Artificial Sequence
  chemically synthesized
aaagtgaggagaattattaaga

SEQ ID NO: 1271311 - DNA, 22 bp, Artificial Sequence
  chemically synthesized
ggtagtttactatttcttaata

SEQ ID NO: 1271312 - DNA, 22 bp, Artificial Sequence
  chemically synthesized
gggtagtttactatttcttaat

SEQ ID NO: 1271313 - DNA, 22 bp, Artificial Sequence
  chemically synthesized
ttaagaaatagtaaactaccca

SEQ ID NO: 1271314 - DNA, 22 bp, Artificial Sequence
  chemically synthesized
agaaatagtaaactacccaagg

SEQ ID NO: 1271315 - DNA, 22 bp, Artificial Sequence
  chemically synthesized
tgtgtaaggaaaagaacagaat

SEQ ID NO: 1271316 - DNA, 22 bp, Artificial Sequence
  chemically synthesized
atgtgtaaggaaaagaacagaa

SEQ ID NO: 1271317 - DNA, 22 bp, Artificial Sequence
  chemically synthesized
cccaaggacattctgttctttt

SEQ ID NO: 1271318 - DNA, 22 bp, Artificial Sequence
  chemically synthesized
atatttatgtgtaaggaaaaga

SEQ ID NO: 1271319 - DNA, 22 bp, Artificial Sequence
  chemically synthesized
tgttcttttccttacacataaa

SEQ ID NO: 1271320 - DNA, 22 bp, Artificial Sequence
  chemically synthesized
ttcttttccttacacataaata

SEQ ID NO: 1271321 - DNA, 22 bp, Artificial Sequence
  chemically synthesized
ttttccttacacataaatatga

SEQ ID NO: 1271322 - DNA, 22 bp, Artificial Sequence
  chemically synthesized
ttccttacacataaatatgaac

SEQ ID NO: 1271323 - DNA, 22 bp, Artificial Sequence
  chemically synthesized
tccttacacataaatatgaacg

SEQ ID NO: 1271324 - DNA, 22 bp, Artificial Sequence
  chemically synthesized
ccttacacataaatatgaacga

SEQ ID NO: 1271325 - DNA, 22 bp, Artificial Sequence
  chemically synthesized
cttacacataaatatgaacgat

SEQ ID NO: 1271326 - DNA, 22 bp, Artificial Sequence
  chemically synthesized
acacataaatatgaacgatggt

SEQ ID NO: 1271327 - DNA, 22 bp, Artificial Sequence
  chemically synthesized
cacataaatatgaacgatggtg

SEQ ID NO: 1271328 - DNA, 22 bp, Artificial Sequence
  chemically synthesized
gaaccaaaggggagcaccatcg

SEQ ID NO: 1271329 - DNA, 22 bp, Artificial Sequence
  chemically synthesized
ccctttggttccaactttctgt

SEQ ID NO: 1271330 - DNA, 22 bp, Artificial Sequence
  chemically synthesized
tggttccaactttctgtgtttc

SEQ ID NO: 1271331 - DNA, 22 bp, Artificial Sequence
  chemically synthesized
ggttccaactttctgtgtttca

SEQ ID NO: 1271332 - DNA, 22 bp, Artificial Sequence
  chemically synthesized
gttccaactttctgtgtttcat

SEQ ID NO: 1271333 - DNA, 22 bp, Artificial Sequence
  chemically synthesized
caactttctgtgtttcatcccc

SEQ ID NO: 1271334 - DNA, 22 bp, Artificial Sequence
  chemically synthesized
tctgtgtttcatcccctatcat

SEQ ID NO: 1271335 - DNA, 22 bp, Artificial Sequence
  chemically synthesized
ctgtgtttcatcccctatcatg

SEQ ID NO: 1271336 - DNA, 22 bp, Artificial Sequence
  chemically synthesized
acacaatggtggcatgataggg

SEQ ID NO: 1271337 - DNA, 22 bp, Artificial Sequence
  chemically synthesized
tgtgtttcatcccctatcatgc

SEQ ID NO: 1271338 - DNA, 22 bp, Artificial Sequence
  chemically synthesized
tgtttcatcccctatcatgcca

SEQ ID NO: 1271339 - DNA, 22 bp, Artificial Sequence
  chemically synthesized
catcccctatcatgccaccatt

SEQ ID NO: 1271340 - DNA, 22 bp, Artificial Sequence
  chemically synthesized
atcccctatcatgccaccattg

SEQ ID NO: 1271341 - DNA, 22 bp, Artificial Sequence
  chemically synthesized
tcatgccaccattgtgttagtg

SEQ ID NO: 1271342 - DNA, 22 bp, Artificial Sequence
  chemically synthesized
aatgtaaaggagaaatgggaaa

SEQ ID NO: 1271343 - DNA, 22 bp, Artificial Sequence
  chemically synthesized
gaatgtaaaggagaaatgggaa

SEQ ID NO: 1271344 - DNA, 22 bp, Artificial Sequence
  chemically synthesized
tgaatgtaaaggagaaatggga

SEQ ID NO: 1271345 - DNA, 22 bp, Artificial Sequence
  chemically synthesized
tgttagtgtttcccatttctcc

SEQ ID NO: 1271346 - DNA, 22 bp, Artificial Sequence
  chemically synthesized
gtgtttcccatttctcctttac

SEQ ID NO: 1271347 - DNA, 22 bp, Artificial Sequence
  chemically synthesized
cccatttctcctttacattcaa

SEQ ID NO: 1271348 - DNA, 22 bp, Artificial Sequence
  chemically synthesized
ccatttctcctttacattcaaa

SEQ ID NO: 1271349 - DNA, 22 bp, Artificial Sequence
  chemically synthesized
aatgggacaggcaacactttga

SEQ ID NO: 1271350 - DNA, 22 bp, Artificial Sequence
  chemically synthesized
ctcctttacattcaaagtgttg

SEQ ID NO: 1271351 - DNA, 22 bp, Artificial Sequence
  chemically synthesized
tcctttacattcaaagtgttgc

SEQ ID NO: 1271352 - DNA, 22 bp, Artificial Sequence
  chemically synthesized
ctttacattcaaagtgttgcct

SEQ ID NO: 1271353 - DNA, 22 bp, Artificial Sequence
  chemically synthesized
tacattcaaagtgttgcctgtc

SEQ ID NO: 1271354 - DNA, 22 bp, Artificial Sequence
  chemically synthesized
acattcaaagtgttgcctgtcc

SEQ ID NO: 1271355 - DNA, 22 bp, Artificial Sequence
  chemically synthesized
aaatattaaatgggacaggcaa

SEQ ID NO: 1271356 - DNA, 22 bp, Artificial Sequence
  chemically synthesized
cattcaaagtgttgcctgtccc

SEQ ID NO: 1271357 - DNA, 22 bp, Artificial Sequence
  chemically synthesized
aaagtgttgcctgtcccattta

SEQ ID NO: 1271358 - DNA, 22 bp, Artificial Sequence
  chemically synthesized
agattaaaatattaaatgggac

SEQ ID NO: 1271359 - DNA, 22 bp, Artificial Sequence
  chemically synthesized
cagattaaaatattaaatggga

SEQ ID NO: 1271360 - DNA, 22 bp, Artificial Sequence
  chemically synthesized
ttcagattaaaatattaaatgg

SEQ ID NO: 1271361 - DNA, 22 bp, Artificial Sequence
  chemically synthesized
cttcagattaaaatattaaatg

SEQ ID NO: 1271362 - DNA, 22 bp, Artificial Sequence
  chemically synthesized
cctgtcccatttaatattttaa

SEQ ID NO: 1271363 - DNA, 22 bp, Artificial Sequence
  chemically synthesized
tcccatttaatattttaatctg

SEQ ID NO: 1271364 - DNA, 22 bp, Artificial Sequence
  chemically synthesized
ccatcccaaggatttcttcaga

SEQ ID NO: 1271365 - DNA, 22 bp, Artificial Sequence
  chemically synthesized
cccatcccaaggatttcttcag

SEQ ID NO: 1271366 - DNA, 22 bp, Artificial Sequence
  chemically synthesized
aatattttaatctgaagaaatc

SEQ ID NO: 1271367 - DNA, 22 bp, Artificial Sequence
  chemically synthesized
atattttaatctgaagaaatcc

SEQ ID NO: 1271368 - DNA, 22 bp, Artificial Sequence
  chemically synthesized
tgtttcccatcccaaggatttc

SEQ ID NO: 1271369 - DNA, 22 bp, Artificial Sequence
  chemically synthesized
taatctgaagaaatccttggga

SEQ ID NO: 1271370 - DNA, 22 bp, Artificial Sequence
  chemically synthesized
aatctgaagaaatccttgggat

SEQ ID NO: 1271371 - DNA, 22 bp, Artificial Sequence
  chemically synthesized
atctgaagaaatccttgggatg

SEQ ID NO: 1271372 - DNA, 22 bp, Artificial Sequence
  chemically synthesized
ccattgtgtttcccatcccaag

SEQ ID NO: 1271373 - DNA, 22 bp, Artificial Sequence
  chemically synthesized
accattgtgtttcccatcccaa

SEQ ID NO: 1271374 - DNA, 22 bp, Artificial Sequence
  chemically synthesized
taccattgtgtttcccatccca

SEQ ID NO: 1271375 - DNA, 22 bp, Artificial Sequence
  chemically synthesized
aagaaatccttgggatgggaaa

SEQ ID NO: 1271376 - DNA, 22 bp, Artificial Sequence
  chemically synthesized
tttaccattgtgtttcccatcc

SEQ ID NO: 1271377 - DNA, 22 bp, Artificial Sequence
  chemically synthesized
attctttaccattgtgtttccc

SEQ ID NO: 1271378 - DNA, 22 bp, Artificial Sequence
  chemically synthesized
cattctttaccattgtgtttcc

SEQ ID NO: 1271379 - DNA, 22 bp, Artificial Sequence
  chemically synthesized
ttcattctttaccattgtgttt

SEQ ID NO: 1271380 - DNA, 22 bp, Artificial Sequence
  chemically synthesized
gggatgggaaacacaatggtaa

SEQ ID NO: 1271381 - DNA, 22 bp, Artificial Sequence
  chemically synthesized
ggatgggaaacacaatggtaaa

SEQ ID NO: 1271382 - DNA, 22 bp, Artificial Sequence
  chemically synthesized
aaaagcgattcttcattcttta

SEQ ID NO: 1271383 - DNA, 22 bp, Artificial Sequence
  chemically synthesized
aaaaagcgattcttcattcttt

SEQ ID NO: 1271384 - DNA, 22 bp, Artificial Sequence
  chemically synthesized
taaaaagcgattcttcattctt

SEQ ID NO: 1271385 - DNA, 22 bp, Artificial Sequence
  chemically synthesized
ttaaaaagcgattcttcattct

SEQ ID NO: 1271386 - DNA, 22 bp, Artificial Sequence
  chemically synthesized
taatcatcagtatttttaaaaa

SEQ ID NO: 1271387 - DNA, 22 bp, Artificial Sequence
  chemically synthesized
agaatacattgtaatcatcagt

SEQ ID NO: 1271388 - DNA, 22 bp, Artificial Sequence
  chemically synthesized
tttaaaaatactgatgattaca

SEQ ID NO: 1271389 - DNA, 22 bp, Artificial Sequence
  chemically synthesized
ttaagaatacattgtaatcatc

SEQ ID NO: 1271390 - DNA, 22 bp, Artificial Sequence
  chemically synthesized
ttaaaaatactgatgattacaa

SEQ ID NO: 1271391 - DNA, 22 bp, Artificial Sequence
  chemically synthesized
gttaagaatacattgtaatcat

SEQ ID NO: 1271392 - DNA, 22 bp, Artificial Sequence
  chemically synthesized
taaaaatactgatgattacaat

SEQ ID NO: 1271393 - DNA, 22 bp, Artificial Sequence
  chemically synthesized
aaaaatactgatgattacaatg

SEQ ID NO: 1271394 - DNA, 22 bp, Artificial Sequence
  chemically synthesized
aaaatactgatgattacaatgt

SEQ ID NO: 1271395 - DNA, 22 bp, Artificial Sequence
  chemically synthesized
atccaaagcttgttaagaatac

SEQ ID NO: 1271396 - DNA, 22 bp, Artificial Sequence
  chemically synthesized
atgattacaatgtattcttaac

SEQ ID NO: 1271397 - DNA, 22 bp, Artificial Sequence
  chemically synthesized
caatgtattcttaacaagcttt

SEQ ID NO: 1271398 - DNA, 22 bp, Artificial Sequence
  chemically synthesized
atacaaattcatccaaagcttg

SEQ ID NO: 1271399 - DNA, 22 bp, Artificial Sequence
  chemically synthesized
ttaacaagctttggatgaattt

SEQ ID NO: 1271400 - DNA, 22 bp, Artificial Sequence
  chemically synthesized
ggcgactaatacaaattcatcc

SEQ ID NO: 1271401 - DNA, 22 bp, Artificial Sequence
  chemically synthesized
gggcgactaatacaaattcatc

SEQ ID NO: 1271402 - DNA, 22 bp, Artificial Sequence
  chemically synthesized
aacaagctttggatgaatttgt

SEQ ID NO: 1271403 - DNA, 22 bp, Artificial Sequence
  chemically synthesized
acaagctttggatgaatttgta

SEQ ID NO: 1271404 - DNA, 22 bp, Artificial Sequence
  chemically synthesized
tttgggcgactaatacaaattc

SEQ ID NO: 1271405 - DNA, 22 bp, Artificial Sequence
  chemically synthesized
gaactgtttgggcgactaatac

SEQ ID NO: 1271406 - DNA, 22 bp, Artificial Sequence
  chemically synthesized
tggatgaatttgtattagtcgc

SEQ ID NO: 1271407 - DNA, 22 bp, Artificial Sequence
  chemically synthesized
agaactgtttgggcgactaata

SEQ ID NO: 1271408 - DNA, 22 bp, Artificial Sequence
  chemically synthesized
ggatgaatttgtattagtcgcc

SEQ ID NO: 1271409 - DNA, 22 bp, Artificial Sequence
  chemically synthesized
tagaactgtttgggcgactaat

SEQ ID NO: 1271410 - DNA, 22 bp, Artificial Sequence
  chemically synthesized
gatgaatttgtattagtcgccc

SEQ ID NO: 1271411 - DNA, 22 bp, Artificial Sequence
  chemically synthesized
ttagaactgtttgggcgactaa

SEQ ID NO: 1271412 - DNA, 22 bp, Artificial Sequence
  chemically synthesized
tttagaactgtttgggcgacta

SEQ ID NO: 1271413 - DNA, 22 bp, Artificial Sequence
  chemically synthesized
ttttagaactgtttgggcgact

SEQ ID NO: 1271414 - DNA, 22 bp, Artificial Sequence
  chemically synthesized
tttttagaactgtttgggcgac

SEQ ID NO: 1271415 - DNA, 22 bp, Artificial Sequence
  chemically synthesized
attttttttagaactgtttggg

SEQ ID NO: 1271416 - DNA, 22 bp, Artificial Sequence
  chemically synthesized
gtattagtcgcccaaacagttc

SEQ ID NO: 1271417 - DNA, 22 bp, Artificial Sequence
  chemically synthesized
tattagtcgcccaaacagttct

SEQ ID NO: 1271418 - DNA, 22 bp, Artificial Sequence
  chemically synthesized
tgctgattttttttagaactgt

SEQ ID NO: 1271419 - DNA, 22 bp, Artificial Sequence
  chemically synthesized
gtcgcccaaacagttctaaaaa

SEQ ID NO: 1271420 - DNA, 22 bp, Artificial Sequence
  chemically synthesized
ttatgctgattttttttagaac

SEQ ID NO: 1271421 - DNA, 22 bp, Artificial Sequence
  chemically synthesized
ctgttatgctgattttttttag

SEQ ID NO: 1271422 - DNA, 22 bp, Artificial Sequence
  chemically synthesized
gctgttatgctgatttttttta

SEQ ID NO: 1271423 - DNA, 22 bp, Artificial Sequence
  chemically synthesized
tcaaatttgctgttatgctgat

SEQ ID NO: 1271424 - DNA, 22 bp, Artificial Sequence
  chemically synthesized
ttgtcaaatttgctgttatgct

SEQ ID NO: 1271425 - DNA, 22 bp, Artificial Sequence
  chemically synthesized
taaaaaaaatcagcataacagc

SEQ ID NO: 1271426 - DNA, 22 bp, Artificial Sequence
  chemically synthesized
aaaaaaatcagcataacagcaa

SEQ ID NO: 1271427 - DNA, 22 bp, Artificial Sequence
  chemically synthesized
attgttgtcaaatttgctgtta

SEQ ID NO: 1271428 - DNA, 22 bp, Artificial Sequence
  chemically synthesized
gattgttgtcaaatttgctgtt

SEQ ID NO: 1271429 - DNA, 22 bp, Artificial Sequence
  chemically synthesized
tgattgttgtcaaatttgctgt

SEQ ID NO: 1271430 - DNA, 22 bp, Artificial Sequence
  chemically synthesized
ttgattgttgtcaaatttgctg

SEQ ID NO: 1271431 - DNA, 22 bp, Artificial Sequence
  chemically synthesized
agaaaggatgagtttttgattg

SEQ ID NO: 1271432 - DNA, 22 bp, Artificial Sequence
  chemically synthesized
gacaacaatcaaaaactcatcc

SEQ ID NO: 1271433 - DNA, 22 bp, Artificial Sequence
  chemically synthesized
acaacaatcaaaaactcatcct

SEQ ID NO: 1271434 - DNA, 22 bp, Artificial Sequence
  chemically synthesized
agggacatattcagaaaggatg

SEQ ID NO: 1271435 - DNA, 22 bp, Artificial Sequence
  chemically synthesized
cagggacatattcagaaaggat

SEQ ID NO: 1271436 - DNA, 22 bp, Artificial Sequence
  chemically synthesized
tcagggacatattcagaaagga

SEQ ID NO: 1271437 - DNA, 22 bp, Artificial Sequence
  chemically synthesized
tttcagggacatattcagaaag

SEQ ID NO: 1271438 - DNA, 22 bp, Artificial Sequence
  chemically synthesized
ctttcagggacatattcagaaa

SEQ ID NO: 1271439 - DNA, 22 bp, Artificial Sequence
  chemically synthesized
tctttcagggacatattcagaa

SEQ ID NO: 1271440 - DNA, 22 bp, Artificial Sequence
  chemically synthesized
ttctttcagggacatattcaga

SEQ ID NO: 1271441 - DNA, 22 bp, Artificial Sequence
  chemically synthesized
agcttttctttcagggacatat

SEQ ID NO: 1271442 - DNA, 22 bp, Artificial Sequence
  chemically synthesized
atcctttctgaatatgtccctg

SEQ ID NO: 1271443 - DNA, 22 bp, Artificial Sequence
  chemically synthesized
tctgaatatgtccctgaaagaa

SEQ ID NO: 1271444 - DNA, 22 bp, Artificial Sequence
  chemically synthesized
ctgaatatgtccctgaaagaaa

SEQ ID NO: 1271445 - DNA, 22 bp, Artificial Sequence
  chemically synthesized
tgaatatgtccctgaaagaaaa

SEQ ID NO: 1271446 - DNA, 22 bp, Artificial Sequence
  chemically synthesized
aatatgtccctgaaagaaaagc

SEQ ID NO: 1271447 - DNA, 22 bp, Artificial Sequence
  chemically synthesized
catacagtgctgagcttttctt

SEQ ID NO: 1271448 - DNA, 22 bp, Artificial Sequence
  chemically synthesized
aaagaaaagctcagcactgtat

SEQ ID NO: 1271449 - DNA, 22 bp, Artificial Sequence
  chemically synthesized
catatgatggagttgcatacag

SEQ ID NO: 1271450 - DNA, 22 bp, Artificial Sequence
  chemically synthesized
ggctccatatgatggagttgca

SEQ ID NO: 1271451 - DNA, 22 bp, Artificial Sequence
  chemically synthesized
tgggctccatatgatggagttg

SEQ ID NO: 1271452 - DNA, 22 bp, Artificial Sequence
  chemically synthesized
agcactgtatgcaactccatca

SEQ ID NO: 1271453 - DNA, 22 bp, Artificial Sequence
  chemically synthesized
tatgcaactccatcatatggag

SEQ ID NO: 1271454 - DNA, 22 bp, Artificial Sequence
  chemically synthesized
catcatatggagcccagaacat

SEQ ID NO: 1271455 - DNA, 22 bp, Artificial Sequence
  chemically synthesized
gtcacatatccacaaagagatg

SEQ ID NO: 1271456 - DNA, 22 bp, Artificial Sequence
  chemically synthesized
agtcacatatccacaaagagat

SEQ ID NO: 1271457 - DNA, 22 bp, Artificial Sequence
  chemically synthesized
tagtcacatatccacaaagaga

SEQ ID NO: 1271458 - DNA, 22 bp, Artificial Sequence
  chemically synthesized
cctttagtcacatatccacaaa

SEQ ID NO: 1271459 - DNA, 22 bp, Artificial Sequence
  chemically synthesized
gcctttagtcacatatccacaa

SEQ ID NO: 1271460 - DNA, 22 bp, Artificial Sequence
  chemically synthesized
tgcctttagtcacatatccaca

SEQ ID NO: 1271461 - DNA, 22 bp, Artificial Sequence
  chemically synthesized
ttttgcctttagtcacatatcc

SEQ ID NO: 1271462 - DNA, 22 bp, Artificial Sequence
  chemically synthesized
attttgcctttagtcacatatc

SEQ ID NO: 1271463 - DNA, 22 bp, Artificial Sequence
  chemically synthesized
tttgtggatatgtgactaaagg

SEQ ID NO: 1271464 - DNA, 22 bp, Artificial Sequence
  chemically synthesized
gatgtttattttgcctttagtc

SEQ ID NO: 1271465 - DNA, 22 bp, Artificial Sequence
  chemically synthesized
tgtggatatgtgactaaaggca

SEQ ID NO: 1271466 - DNA, 22 bp, Artificial Sequence
  chemically synthesized
gtggatatgtgactaaaggcaa

SEQ ID NO: 1271467 - DNA, 22 bp, Artificial Sequence
  chemically synthesized
tggatatgtgactaaaggcaaa

SEQ ID NO: 1271468 - DNA, 22 bp, Artificial Sequence
  chemically synthesized
cactggatgtttattttgcctt

SEQ ID NO: 1271469 - DNA, 22 bp, Artificial Sequence
  chemically synthesized
acactggatgtttattttgcct

SEQ ID NO: 1271470 - DNA, 22 bp, Artificial Sequence
  chemically synthesized
tacactggatgtttattttgcc

SEQ ID NO: 1271471 - DNA, 22 bp, Artificial Sequence
  chemically synthesized
cacctttacactggatgtttat

SEQ ID NO: 1271472 - DNA, 22 bp, Artificial Sequence
  chemically synthesized
tgcacctttacactggatgttt

SEQ ID NO: 1271473 - DNA, 22 bp, Artificial Sequence
  chemically synthesized
aaggcaaaataaacatccagtg

SEQ ID NO: 1271474 - DNA, 22 bp, Artificial Sequence
  chemically synthesized
cctctgcacctttacactggat

SEQ ID NO: 1271475 - DNA, 22 bp, Artificial Sequence
  chemically synthesized
gcctctgcacctttacactgga

SEQ ID NO: 1271476 - DNA, 22 bp, Artificial Sequence
  chemically synthesized
tgcctctgcacctttacactgg

SEQ ID NO: 1271477 - DNA, 22 bp, Artificial Sequence
  chemically synthesized
ttgcctctgcacctttacactg

SEQ ID NO: 1271478 - DNA, 22 bp, Artificial Sequence
  chemically synthesized
tttgcctctgcacctttacact

SEQ ID NO: 1271479 - DNA, 22 bp, Artificial Sequence
  chemically synthesized
ttttgcctctgcacctttacac

SEQ ID NO: 1271480 - DNA, 22 bp, Artificial Sequence
  chemically synthesized
tttttgcctctgcacctttaca

SEQ ID NO: 1271481 - DNA, 22 bp, Artificial Sequence
  chemically synthesized
ttttttgcctctgcacctttac

SEQ ID NO: 1271482 - DNA, 22 bp, Artificial Sequence
  chemically synthesized
tttttttgcctctgcaccttta

SEQ ID NO: 1271483 - DNA, 22 bp, Artificial Sequence
  chemically synthesized
ttttttttgcctctgcaccttt

SEQ ID NO: 1271484 - DNA, 22 bp, Artificial Sequence
  chemically synthesized
tttttttttgcctctgcacctt

SEQ ID NO: 1271485 - DNA, 22 bp, Artificial Sequence
  chemically synthesized
ttttttttttgcctctgcacct

SEQ ID NO: 1271486 - DNA, 22 bp, Artificial Sequence
  chemically synthesized
tttttttttttgcctctgcacc

SEQ ID NO: 1271487 - DNA, 22 bp, Artificial Sequence
  chemically synthesized
ttttttttttttgcctctgcac

SEQ ID NO: 1271488 - DNA, 22 bp, Artificial Sequence
  chemically synthesized
tttttttttttttgcctctgca

SEQ ID NO: 1271489 - DNA, 22 bp, Artificial Sequence
  chemically synthesized
ttttttttttttttgcctctgc

SEQ ID NO: 1271490 - DNA, 22 bp, Artificial Sequence
  chemically synthesized
tttttttttttttttttgcctc

SEQ ID NO: 1271491 - DNA, 22 bp, Artificial Sequence
  chemically synthesized
tatttttttttttttttttgcc

SEQ ID NO: 1271492 - DNA, 22 bp, Artificial Sequence
  chemically synthesized
caatagaccactctattttttt

SEQ ID NO: 1271493 - DNA, 22 bp, Artificial Sequence
  chemically synthesized
ctccaatagaccactctatttt

SEQ ID NO: 1271494 - DNA, 22 bp, Artificial Sequence
  chemically synthesized
cctccaatagaccactctattt

SEQ ID NO: 1271495 - DNA, 22 bp, Artificial Sequence
  chemically synthesized
tatttcctccaatagaccactc

SEQ ID NO: 1271496 - DNA, 22 bp, Artificial Sequence
  chemically synthesized
gcaataccagtccatctgtatt

SEQ ID NO: 1271497 - DNA, 22 bp, Artificial Sequence
  chemically synthesized
ctagcaataccagtccatctgt

SEQ ID NO: 1271498 - DNA, 22 bp, Artificial Sequence
  chemically synthesized
ttggaggaaatacagatggact

SEQ ID NO: 1271499 - DNA, 22 bp, Artificial Sequence
  chemically synthesized
tactagcaataccagtccatct

SEQ ID NO: 1271500 - DNA, 22 bp, Artificial Sequence
  chemically synthesized
gaggaaatacagatggactggt

SEQ ID NO: 1271501 - DNA, 22 bp, Artificial Sequence
  chemically synthesized
accaccgttctactagcaatac

SEQ ID NO: 1271502 - DNA, 22 bp, Artificial Sequence
  chemically synthesized
attcaccaccgttctactagca

SEQ ID NO: 1271503 - DNA, 22 bp, Artificial Sequence
  chemically synthesized
cattcaccaccgttctactagc

SEQ ID NO: 1271504 - DNA, 22 bp, Artificial Sequence
  chemically synthesized
gcttcattcaccaccgttctac

SEQ ID NO: 1271505 - DNA, 22 bp, Artificial Sequence
  chemically synthesized
tagcttcattcaccaccgttct

SEQ ID NO: 1271506 - DNA, 22 bp, Artificial Sequence
  chemically synthesized
gtattgctagtagaacggtggt

SEQ ID NO: 1271507 - DNA, 22 bp, Artificial Sequence
  chemically synthesized
tagttctagcttcattcaccac

SEQ ID NO: 1271508 - DNA, 22 bp, Artificial Sequence
  chemically synthesized
ctagtagaacggtggtgaatga

SEQ ID NO: 1271509 - DNA, 22 bp, Artificial Sequence
  chemically synthesized
gtagaacggtggtgaatgaagc

SEQ ID NO: 1271510 - DNA, 22 bp, Artificial Sequence
  chemically synthesized
atggctatagttctagcttcat

SEQ ID NO: 1271511 - DNA, 22 bp, Artificial Sequence
  chemically synthesized
gttcatggctatagttctagct

SEQ ID NO: 1271512 - DNA, 22 bp, Artificial Sequence
  chemically synthesized
aaaatctagttcatggctatag

SEQ ID NO: 1271513 - DNA, 22 bp, Artificial Sequence
  chemically synthesized
taaaaatctagttcatggctat

SEQ ID NO: 1271514 - DNA, 22 bp, Artificial Sequence
  chemically synthesized
ctaaaaatctagttcatggcta

SEQ ID NO: 1271515 - DNA, 22 bp, Artificial Sequence
  chemically synthesized
gtttctaaaaatctagttcatg

SEQ ID NO: 1271516 - DNA, 22 bp, Artificial Sequence
  chemically synthesized
gaactatagccatgaactagat

SEQ ID NO: 1271517 - DNA, 22 bp, Artificial Sequence
  chemically synthesized
tagccatgaactagatttttag

SEQ ID NO: 1271518 - DNA, 22 bp, Artificial Sequence
  chemically synthesized
gatttttagaaaccagtatcct

SEQ ID NO: 1271519 - DNA, 22 bp, Artificial Sequence
  chemically synthesized
acccccaagtataggatactgg

SEQ ID NO: 1271520 - DNA, 22 bp, Artificial Sequence
  chemically synthesized
ttagaaaccagtatcctatact

SEQ ID NO: 1271521 - DNA, 22 bp, Artificial Sequence
  chemically synthesized
tagaaaccagtatcctatactt

SEQ ID NO: 1271522 - DNA, 22 bp, Artificial Sequence
  chemically synthesized
agaaaccagtatcctatacttg

SEQ ID NO: 1271523 - DNA, 22 bp, Artificial Sequence
  chemically synthesized
gaaaccagtatcctatacttgg

SEQ ID NO: 1271524 - DNA, 22 bp, Artificial Sequence
  chemically synthesized
cataatgaaatctaacccccaa

SEQ ID NO: 1271525 - DNA, 22 bp, Artificial Sequence
  chemically synthesized
tctacataatgaaatctaaccc

SEQ ID NO: 1271526 - DNA, 22 bp, Artificial Sequence
  chemically synthesized
ctgtctacataatgaaatctaa

SEQ ID NO: 1271527 - DNA, 22 bp, Artificial Sequence
  chemically synthesized
tacttgggggttagatttcatt

SEQ ID NO: 1271528 - DNA, 22 bp, Artificial Sequence
  chemically synthesized
gggggttagatttcattatgta

SEQ ID NO: 1271529 - DNA, 22 bp, Artificial Sequence
  chemically synthesized
ggggttagatttcattatgtag

SEQ ID NO: 1271530 - DNA, 22 bp, Artificial Sequence
  chemically synthesized
ccacaactactgtctacataat

SEQ ID NO: 1271531 - DNA, 22 bp, Artificial Sequence
  chemically synthesized
gatttcattatgtagacagtag

SEQ ID NO: 1271532 - DNA, 22 bp, Artificial Sequence
  chemically synthesized
cattatgtagacagtagttgtg

SEQ ID NO: 1271533 - DNA, 22 bp, Artificial Sequence
  chemically synthesized
attatgtagacagtagttgtgg

SEQ ID NO: 1271534 - DNA, 22 bp, Artificial Sequence
  chemically synthesized
atcccataggttgccacaacta

SEQ ID NO: 1271535 - DNA, 22 bp, Artificial Sequence
  chemically synthesized
aatcccataggttgccacaact

SEQ ID NO: 1271536 - DNA, 22 bp, Artificial Sequence
  chemically synthesized
tgtagacagtagttgtggcaac

SEQ ID NO: 1271537 - DNA, 22 bp, Artificial Sequence
  chemically synthesized
cttaatcccataggttgccaca

SEQ ID NO: 1271538 - DNA, 22 bp, Artificial Sequence
  chemically synthesized
gaccctacttaatcccataggt

SEQ ID NO: 1271539 - DNA, 22 bp, Artificial Sequence
  chemically synthesized
ggaccctacttaatcccatagg

SEQ ID NO: 1271540 - DNA, 22 bp, Artificial Sequence
  chemically synthesized
tggaccctacttaatcccatag

SEQ ID NO: 1271541 - DNA, 22 bp, Artificial Sequence
  chemically synthesized
ttggaccctacttaatcccata

SEQ ID NO: 1271542 - DNA, 22 bp, Artificial Sequence
  chemically synthesized
tttttggaccctacttaatccc

SEQ ID NO: 1271543 - DNA, 22 bp, Artificial Sequence
  chemically synthesized
tggcaacctatgggattaagta

SEQ ID NO: 1271544 - DNA, 22 bp, Artificial Sequence
  chemically synthesized
gtttttggaccctacttaatcc

SEQ ID NO: 1271545 - DNA, 22 bp, Artificial Sequence
  chemically synthesized
catatttgtttttggaccctac

SEQ ID NO: 1271546 - DNA, 22 bp, Artificial Sequence
  chemically synthesized
tgggattaagtagggtccaaaa

SEQ ID NO: 1271547 - DNA, 22 bp, Artificial Sequence
  chemically synthesized
ctacatatttgtttttggaccc

SEQ ID NO: 1271548 - DNA, 22 bp, Artificial Sequence
  chemically synthesized
ctactacatatttgtttttgga

SEQ ID NO: 1271549 - DNA, 22 bp, Artificial Sequence
  chemically synthesized
ctactactacatatttgttttt

SEQ ID NO: 1271550 - DNA, 22 bp, Artificial Sequence
  chemically synthesized
agtagggtccaaaaacaaatat

SEQ ID NO: 1271551 - DNA, 22 bp, Artificial Sequence
  chemically synthesized
ctactactactacatatttgtt

SEQ ID NO: 1271552 - DNA, 22 bp, Artificial Sequence
  chemically synthesized
ctactactactactacatattt

SEQ ID NO: 1271553 - DNA, 22 bp, Artificial Sequence
  chemically synthesized
ctactactactactactacata

SEQ ID NO: 1271554 - DNA, 22 bp, Artificial Sequence
  chemically synthesized
ctgctactactactactactac

SEQ ID NO: 1271555 - DNA, 22 bp, Artificial Sequence
  chemically synthesized
ctgctgctactactactactac

SEQ ID NO: 1271556 - DNA, 22 bp, Artificial Sequence
  chemically synthesized
ctgctgctgctactactactac

SEQ ID NO: 1271557 - DNA, 22 bp, Artificial Sequence
  chemically synthesized
ctgctgctgctgctactactac

SEQ ID NO: 1271558 - DNA, 22 bp, Artificial Sequence
  chemically synthesized
ctactgctgctgctgctactac

SEQ ID NO: 1271559 - DNA, 22 bp, Artificial Sequence
  chemically synthesized
ttactactgctgctgctgctac

SEQ ID NO: 1271560 - DNA, 22 bp, Artificial Sequence
  chemically synthesized
ctgttactactgctgctgctgc

SEQ ID NO: 1271561 - DNA, 22 bp, Artificial Sequence
  chemically synthesized
tcattgctgttactactgctgc

SEQ ID NO: 1271562 - DNA, 22 bp, Artificial Sequence
  chemically synthesized
gatgttgtcattgctgttacta

SEQ ID NO: 1271563 - DNA, 22 bp, Artificial Sequence
  chemically synthesized
aatagatcctagatgttgtcat

SEQ ID NO: 1271564 - DNA, 22 bp, Artificial Sequence
  chemically synthesized
agtgctcaatagatcctagatg

SEQ ID NO: 1271565 - DNA, 22 bp, Artificial Sequence
  chemically synthesized
aagtgctcaatagatcctagat

SEQ ID NO: 1271566 - DNA, 22 bp, Artificial Sequence
  chemically synthesized
taagtgctcaatagatcctaga

SEQ ID NO: 1271567 - DNA, 22 bp, Artificial Sequence
  chemically synthesized
ttttaagtgctcaatagatcct

SEQ ID NO: 1271568 - DNA, 22 bp, Artificial Sequence
  chemically synthesized
gcctgttttaagtgctcaatag

SEQ ID NO: 1271569 - DNA, 22 bp, Artificial Sequence
  chemically synthesized
ggcctgttttaagtgctcaata

SEQ ID NO: 1271570 - DNA, 22 bp, Artificial Sequence
  chemically synthesized
ggatctattgagcacttaaaac

SEQ ID NO: 1271571 - DNA, 22 bp, Artificial Sequence
  chemically synthesized
aaacagtatttggcctgtttta

SEQ ID NO: 1271572 - DNA, 22 bp, Artificial Sequence
  chemically synthesized
aaaacagtatttggcctgtttt

SEQ ID NO: 1271573 - DNA, 22 bp, Artificial Sequence
  chemically synthesized
ttgagcacttaaaacaggccaa

SEQ ID NO: 1271574 - DNA, 22 bp, Artificial Sequence
  chemically synthesized
agcacttaaaacaggccaaata

SEQ ID NO: 1271575 - DNA, 22 bp, Artificial Sequence
  chemically synthesized
aaaacaggccaaatactgtttt

SEQ ID NO: 1271576 - DNA, 22 bp, Artificial Sequence
  chemically synthesized
aaacaggccaaatactgtttta

SEQ ID NO: 1271577 - DNA, 22 bp, Artificial Sequence
  chemically synthesized
atacaagtaaagagcttaaaac

SEQ ID NO: 1271578 - DNA, 22 bp, Artificial Sequence
  chemically synthesized
aatagctgatacaagtaaagag

SEQ ID NO: 1271579 - DNA, 22 bp, Artificial Sequence
  chemically synthesized
ttttaagctctttacttgtatc

SEQ ID NO: 1271580 - DNA, 22 bp, Artificial Sequence
  chemically synthesized
taagctctttacttgtatcagc

SEQ ID NO: 1271581 - DNA, 22 bp, Artificial Sequence
  chemically synthesized
aagctctttacttgtatcagct

SEQ ID NO: 1271582 - DNA, 22 bp, Artificial Sequence
  chemically synthesized
tgagaattaaatagctgataca

SEQ ID NO: 1271583 - DNA, 22 bp, Artificial Sequence
  chemically synthesized
agctctttacttgtatcagcta

SEQ ID NO: 1271584 - DNA, 22 bp, Artificial Sequence
  chemically synthesized
tatgagaattaaatagctgata

SEQ ID NO: 1271585 - DNA, 22 bp, Artificial Sequence
  chemically synthesized
ctatgagaattaaatagctgat

SEQ ID NO: 1271586 - DNA, 22 bp, Artificial Sequence
  chemically synthesized
tttacttgtatcagctatttaa

SEQ ID NO: 1271587 - DNA, 22 bp, Artificial Sequence
  chemically synthesized
tttctatgagaattaaatagct

SEQ ID NO: 1271588 - DNA, 22 bp, Artificial Sequence
  chemically synthesized
atttctatgagaattaaatagc

SEQ ID NO: 1271589 - DNA, 22 bp, Artificial Sequence
  chemically synthesized
tacttgtatcagctatttaatt

SEQ ID NO: 1271590 - DNA, 22 bp, Artificial Sequence
  chemically synthesized
acttgtatcagctatttaattc

SEQ ID NO: 1271591 - DNA, 22 bp, Artificial Sequence
  chemically synthesized
cttgtatcagctatttaattct

SEQ ID NO: 1271592 - DNA, 22 bp, Artificial Sequence
  chemically synthesized
gtatcagctatttaattctcat

SEQ ID NO: 1271593 - DNA, 22 bp, Artificial Sequence
  chemically synthesized
tatcagctatttaattctcata

SEQ ID NO: 1271594 - DNA, 22 bp, Artificial Sequence
  chemically synthesized
tttaattctcatagaaataagt

SEQ ID NO: 1271595 - DNA, 22 bp, Artificial Sequence
  chemically synthesized
aattctcatagaaataagtatc

SEQ ID NO: 1271596 - DNA, 22 bp, Artificial Sequence
  chemically synthesized
attctcatagaaataagtatca

SEQ ID NO: 1271597 - DNA, 22 bp, Artificial Sequence
  chemically synthesized
tcatagaaataagtatcatttt

SEQ ID NO: 1271598 - DNA, 22 bp, Artificial Sequence
  chemically synthesized
taaaatgatgataaaatgatac

SEQ ID NO: 1271599 - DNA, 22 bp, Artificial Sequence
  chemically synthesized
atagaaataagtatcattttat

SEQ ID NO: 1271600 - DNA, 22 bp, Artificial Sequence
  chemically synthesized
acctgtaaaatgatgataaaat

SEQ ID NO: 1271601 - DNA, 22 bp, Artificial Sequence
  chemically synthesized
atcactcacctgtaaaatgatg

SEQ ID NO: 1271602 - DNA, 22 bp, Artificial Sequence
  chemically synthesized
catcactcacctgtaaaatgat

SEQ ID NO: 1271603 - DNA, 22 bp, Artificial Sequence
  chemically synthesized
tatcatcattttacaggtgagt

SEQ ID NO: 1271604 - DNA, 22 bp, Artificial Sequence
  chemically synthesized
atcatcattttacaggtgagtg

SEQ ID NO: 1271605 - DNA, 22 bp, Artificial Sequence
  chemically synthesized
tcatcattttacaggtgagtga

SEQ ID NO: 1271606 - DNA, 22 bp, Artificial Sequence
  chemically synthesized
tacaggtgagtgatgaagtatc

SEQ ID NO: 1271607 - DNA, 22 bp, Artificial Sequence
  chemically synthesized
acaggtgagtgatgaagtatct

SEQ ID NO: 1271608 - DNA, 22 bp, Artificial Sequence
  chemically synthesized
caggtgagtgatgaagtatctt

SEQ ID NO: 1271609 - DNA, 22 bp, Artificial Sequence
  chemically synthesized
cataatgtgtagcaagatactt

SEQ ID NO: 1271610 - DNA, 22 bp, Artificial Sequence
  chemically synthesized
cctccataatgtgtagcaagat

SEQ ID NO: 1271611 - DNA, 22 bp, Artificial Sequence
  chemically synthesized
ctacctccataatgtgtagcaa

SEQ ID NO: 1271612 - DNA, 22 bp, Artificial Sequence
  chemically synthesized
actacctccataatgtgtagca

SEQ ID NO: 1271613 - DNA, 22 bp, Artificial Sequence
  chemically synthesized
cttactacctccataatgtgta

SEQ ID NO: 1271614 - DNA, 22 bp, Artificial Sequence
  chemically synthesized
ctacttactacctccataatgt

SEQ ID NO: 1271615 - DNA, 22 bp, Artificial Sequence
  chemically synthesized
gctacttactacctccataatg

SEQ ID NO: 1271616 - DNA, 22 bp, Artificial Sequence
  chemically synthesized
tgctacttactacctccataat

SEQ ID NO: 1271617 - DNA, 22 bp, Artificial Sequence
  chemically synthesized
gctacacattatggaggtagta

SEQ ID NO: 1271618 - DNA, 22 bp, Artificial Sequence
  chemically synthesized
ctacacattatggaggtagtaa

SEQ ID NO: 1271619 - DNA, 22 bp, Artificial Sequence
  chemically synthesized
cagctttgctacttactacctc

SEQ ID NO: 1271620 - DNA, 22 bp, Artificial Sequence
  chemically synthesized
cacattatggaggtagtaagta

SEQ ID NO: 1271621 - DNA, 22 bp, Artificial Sequence
  chemically synthesized
aattccagctttgctacttact

SEQ ID NO: 1271622 - DNA, 22 bp, Artificial Sequence
  chemically synthesized
gaattccagctttgctacttac

SEQ ID NO: 1271623 - DNA, 22 bp, Artificial Sequence
  chemically synthesized
tttgaattccagctttgctact

SEQ ID NO: 1271624 - DNA, 22 bp, Artificial Sequence
  chemically synthesized
tggaggtagtaagtagcaaagc

SEQ ID NO: 1271625 - DNA, 22 bp, Artificial Sequence
  chemically synthesized
tgtttgaattccagctttgcta

SEQ ID NO: 1271626 - DNA, 22 bp, Artificial Sequence
  chemically synthesized
ctgtttgaattccagctttgct

SEQ ID NO: 1271627 - DNA, 22 bp, Artificial Sequence
  chemically synthesized
gtttctgtttgaattccagctt

SEQ ID NO: 1271628 - DNA, 22 bp, Artificial Sequence
  chemically synthesized
gaattcaaacagaaaccagtgt

SEQ ID NO: 1271629 - DNA, 22 bp, Artificial Sequence
  chemically synthesized
aaacagaaaccagtgtgccttt

SEQ ID NO: 1271630 - DNA, 22 bp, Artificial Sequence
  chemically synthesized
agcatacagggtggtgcagtgt

SEQ ID NO: 1271631 - DNA, 22 bp, Artificial Sequence
  chemically synthesized
cctaagcatacagggtggtgca

SEQ ID NO: 1271632 - DNA, 22 bp, Artificial Sequence
  chemically synthesized
tacactgcaccaccctgtatgc

SEQ ID NO: 1271633 - DNA, 22 bp, Artificial Sequence
  chemically synthesized
acactgcaccaccctgtatgct

SEQ ID NO: 1271634 - DNA, 22 bp, Artificial Sequence
  chemically synthesized
cactgcaccaccctgtatgctt

SEQ ID NO: 1271635 - DNA, 22 bp, Artificial Sequence
  chemically synthesized
caccaccctgtatgcttaggga

SEQ ID NO: 1271636 - DNA, 22 bp, Artificial Sequence
  chemically synthesized
caatgtgccaacagagtgatct

SEQ ID NO: 1271637 - DNA, 22 bp, Artificial Sequence
  chemically synthesized
tatgcttagggagatcactctg

SEQ ID NO: 1271638 - DNA, 22 bp, Artificial Sequence
  chemically synthesized
cccctgcaatgtgccaacagag

SEQ ID NO: 1271639 - DNA, 22 bp, Artificial Sequence
  chemically synthesized
agggagatcactctgttggcac

SEQ ID NO: 1271640 - DNA, 22 bp, Artificial Sequence
  chemically synthesized
tccccctgcaatgtgccaacag

SEQ ID NO: 1271641 - DNA, 22 bp, Artificial Sequence
  chemically synthesized
gggagatcactctgttggcaca

SEQ ID NO: 1271642 - DNA, 22 bp, Artificial Sequence
  chemically synthesized
ctccccctgcaatgtgccaaca

SEQ ID NO: 1271643 - DNA, 22 bp, Artificial Sequence
  chemically synthesized
caatgtccttctccccctgcaa

SEQ ID NO: 1271644 - DNA, 22 bp, Artificial Sequence
  chemically synthesized
tgttggcacattgcagggggag

SEQ ID NO: 1271645 - DNA, 22 bp, Artificial Sequence
  chemically synthesized
ttggcacattgcagggggagaa

SEQ ID NO: 1271646 - DNA, 22 bp, Artificial Sequence
  chemically synthesized
gcacattgcagggggagaagga

SEQ ID NO: 1271647 - DNA, 22 bp, Artificial Sequence
  chemically synthesized
cagggggagaaggacattggag

SEQ ID NO: 1271648 - DNA, 22 bp, Artificial Sequence
  chemically synthesized
gagactgtattcaccacggcca

SEQ ID NO: 1271649 - DNA, 22 bp, Artificial Sequence
  chemically synthesized
tattcaccacggccatatattg

SEQ ID NO: 1271650 - DNA, 22 bp, Artificial Sequence
  chemically synthesized
accacggccatatattgtgtga

SEQ ID NO: 1271651 - DNA, 22 bp, Artificial Sequence
  chemically synthesized
caagaaatataccatcacacaa

SEQ ID NO: 1271652 - DNA, 22 bp, Artificial Sequence
  chemically synthesized
ccaagaaatataccatcacaca

SEQ ID NO: 1271653 - DNA, 22 bp, Artificial Sequence
  chemically synthesized
tccaagaaatataccatcacac

SEQ ID NO: 1271654 - DNA, 22 bp, Artificial Sequence
  chemically synthesized
tgctttccaagaaatataccat

SEQ ID NO: 1271655 - DNA, 22 bp, Artificial Sequence
  chemically synthesized
tgtgatggtatatttcttggaa

SEQ ID NO: 1271656 - DNA, 22 bp, Artificial Sequence
  chemically synthesized
ccgaattgtgctttccaagaaa

SEQ ID NO: 1271657 - DNA, 22 bp, Artificial Sequence
  chemically synthesized
tggtgttcccgaattgtgcttt

SEQ ID NO: 1271658 - DNA, 22 bp, Artificial Sequence
  chemically synthesized
ctatggtgttcccgaattgtgc

SEQ ID NO: 1271659 - DNA, 22 bp, Artificial Sequence
  chemically synthesized
tgctatggtgttcccgaattgt

SEQ ID NO: 1271660 - DNA, 22 bp, Artificial Sequence
  chemically synthesized
cttggaaagcacaattcgggaa

SEQ ID NO: 1271661 - DNA, 22 bp, Artificial Sequence
  chemically synthesized
tctgctatggtgttcccgaatt

SEQ ID NO: 1271662 - DNA, 22 bp, Artificial Sequence
  chemically synthesized
ttggaaagcacaattcgggaac

SEQ ID NO: 1271663 - DNA, 22 bp, Artificial Sequence
  chemically synthesized
ctctgctatggtgttcccgaat

SEQ ID NO: 1271664 - DNA, 22 bp, Artificial Sequence
  chemically synthesized
ggaaagcacaattcgggaacac

SEQ ID NO: 1271665 - DNA, 22 bp, Artificial Sequence
  chemically synthesized
gaaagcacaattcgggaacacc

SEQ ID NO: 1271666 - DNA, 22 bp, Artificial Sequence
  chemically synthesized
ccttctctgctatggtgttccc

SEQ ID NO: 1271667 - DNA, 22 bp, Artificial Sequence
  chemically synthesized
gccttctctgctatggtgttcc

SEQ ID NO: 1271668 - DNA, 22 bp, Artificial Sequence
  chemically synthesized
ataatatttgccttctctgcta

SEQ ID NO: 1271669 - DNA, 22 bp, Artificial Sequence
  chemically synthesized
gggaacaccatagcagagaagg

SEQ ID NO: 1271670 - DNA, 22 bp, Artificial Sequence
  chemically synthesized
taaagaaggctgataatatttg

SEQ ID NO: 1271671 - DNA, 22 bp, Artificial Sequence
  chemically synthesized
acctgtaaagaaggctgataat

SEQ ID NO: 1271672 - DNA, 22 bp, Artificial Sequence
  chemically synthesized
taacctgtaaagaaggctgata

SEQ ID NO: 1271673 - DNA, 22 bp, Artificial Sequence
  chemically synthesized
tgttctaacctgtaaagaaggc

SEQ ID NO: 1271674 - DNA, 22 bp, Artificial Sequence
  chemically synthesized
agtctatgttctaacctgtaaa

SEQ ID NO: 1271675 - DNA, 22 bp, Artificial Sequence
  chemically synthesized
tgagtctatgttctaacctgta

SEQ ID NO: 1271676 - DNA, 22 bp, Artificial Sequence
  chemically synthesized
tcagccttctttacaggttaga

SEQ ID NO: 1271677 - DNA, 22 bp, Artificial Sequence
  chemically synthesized
aacactctgagtctatgttcta

SEQ ID NO: 1271678 - DNA, 22 bp, Artificial Sequence
  chemically synthesized
aaacactctgagtctatgttct

SEQ ID NO: 1271679 - DNA, 22 bp, Artificial Sequence
  chemically synthesized
ctttacaggttagaacatagac

SEQ ID NO: 1271680 - DNA, 22 bp, Artificial Sequence
  chemically synthesized
tttacaggttagaacatagact

SEQ ID NO: 1271681 - DNA, 22 bp, Artificial Sequence
  chemically synthesized
tacaggttagaacatagactca

SEQ ID NO: 1271682 - DNA, 22 bp, Artificial Sequence
  chemically synthesized
atttaaacactctgagtctatg

SEQ ID NO: 1271683 - DNA, 22 bp, Artificial Sequence
  chemically synthesized
acaggttagaacatagactcag

SEQ ID NO: 1271684 - DNA, 22 bp, Artificial Sequence
  chemically synthesized
caggttagaacatagactcaga

SEQ ID NO: 1271685 - DNA, 22 bp, Artificial Sequence
  chemically synthesized
gaacatagactcagagtgttta

SEQ ID NO: 1271686 - DNA, 22 bp, Artificial Sequence
  chemically synthesized
agaagggtaaggccaattaatt

SEQ ID NO: 1271687 - DNA, 22 bp, Artificial Sequence
  chemically synthesized
agagtgtttaaattaattggcc

SEQ ID NO: 1271688 - DNA, 22 bp, Artificial Sequence
  chemically synthesized
aaattaattggccttacccttc

SEQ ID NO: 1271689 - DNA, 22 bp, Artificial Sequence
  chemically synthesized
aattaattggccttacccttct

SEQ ID NO: 1271690 - DNA, 22 bp, Artificial Sequence
  chemically synthesized
attggccttacccttctgaatc

SEQ ID NO: 1271691 - DNA, 22 bp, Artificial Sequence
  chemically synthesized
gccttacccttctgaatcttca

SEQ ID NO: 1271692 - DNA, 22 bp, Artificial Sequence
  chemically synthesized
acccttctgaatcttcatacac

SEQ ID NO: 1271693 - DNA, 22 bp, Artificial Sequence
  chemically synthesized
cccttctgaatcttcatacact

SEQ ID NO: 1271694 - DNA, 22 bp, Artificial Sequence
  chemically synthesized
atgggtagaaagtgcagtgtat

SEQ ID NO: 1271695 - DNA, 22 bp, Artificial Sequence
  chemically synthesized
ctgaatcttcatacactgcact

SEQ ID NO: 1271696 - DNA, 22 bp, Artificial Sequence
  chemically synthesized
tgatgggtagaaagtgcagtgt

SEQ ID NO: 1271697 - DNA, 22 bp, Artificial Sequence
  chemically synthesized
tgaatcttcatacactgcactt

SEQ ID NO: 1271698 - DNA, 22 bp, Artificial Sequence
  chemically synthesized
aatcttcatacactgcactttc

SEQ ID NO: 1271699 - DNA, 22 bp, Artificial Sequence
  chemically synthesized
catacactgcactttctaccca

SEQ ID NO: 1271700 - DNA, 22 bp, Artificial Sequence
  chemically synthesized
atacactgcactttctacccat

SEQ ID NO: 1271701 - DNA, 22 bp, Artificial Sequence
  chemically synthesized
cactttctacccatcagaatta

SEQ ID NO: 1271702 - DNA, 22 bp, Artificial Sequence
  chemically synthesized
ggaaataggaataagtaattct

SEQ ID NO: 1271703 - DNA, 22 bp, Artificial Sequence
  chemically synthesized
aggaaataggaataagtaattc

SEQ ID NO: 1271704 - DNA, 22 bp, Artificial Sequence
  chemically synthesized
tctacccatcagaattacttat

SEQ ID NO: 1271705 - DNA, 22 bp, Artificial Sequence
  chemically synthesized
ctacccatcagaattacttatt

SEQ ID NO: 1271706 - DNA, 22 bp, Artificial Sequence
  chemically synthesized
tacccatcagaattacttattc

SEQ ID NO: 1271707 - DNA, 22 bp, Artificial Sequence
  chemically synthesized
cccatcagaattacttattcct

SEQ ID NO: 1271708 - DNA, 22 bp, Artificial Sequence
  chemically synthesized
atcttaggaaataggaataagt

SEQ ID NO: 1271709 - DNA, 22 bp, Artificial Sequence
  chemically synthesized
gaatgactgatcttaggaaata

SEQ ID NO: 1271710 - DNA, 22 bp, Artificial Sequence
  chemically synthesized
tggaatgactgatcttaggaaa

SEQ ID NO: 1271711 - DNA, 22 bp, Artificial Sequence
  chemically synthesized
ctggaatgactgatcttaggaa

SEQ ID NO: 1271712 - DNA, 22 bp, Artificial Sequence
  chemically synthesized
cttattcctatttcctaagatc

SEQ ID NO: 1271713 - DNA, 22 bp, Artificial Sequence
  chemically synthesized
tctggaatgactgatcttagga

SEQ ID NO: 1271714 - DNA, 22 bp, Artificial Sequence
  chemically synthesized
ttctggaatgactgatcttagg

SEQ ID NO: 1271715 - DNA, 22 bp, Artificial Sequence
  chemically synthesized
tttctggaatgactgatcttag

SEQ ID NO: 1271716 - DNA, 22 bp, Artificial Sequence
  chemically synthesized
attcctatttcctaagatcagt

SEQ ID NO: 1271717 - DNA, 22 bp, Artificial Sequence
  chemically synthesized
ttcctatttcctaagatcagtc

SEQ ID NO: 1271718 - DNA, 22 bp, Artificial Sequence
  chemically synthesized
attttttctggaatgactgatc

SEQ ID NO: 1271719 - DNA, 22 bp, Artificial Sequence
  chemically synthesized
ctatttcctaagatcagtcatt

SEQ ID NO: 1271720 - DNA, 22 bp, Artificial Sequence
  chemically synthesized
tttcctaagatcagtcattcca

SEQ ID NO: 1271721 - DNA, 22 bp, Artificial Sequence
  chemically synthesized
cctaagatcagtcattccagaa

SEQ ID NO: 1271722 - DNA, 22 bp, Artificial Sequence
  chemically synthesized
ctaagatcagtcattccagaaa

SEQ ID NO: 1271723 - DNA, 22 bp, Artificial Sequence
  chemically synthesized
agatcagtcattccagaaaaaa

SEQ ID NO: 1271724 - DNA, 22 bp, Artificial Sequence
  chemically synthesized
ataaaaagaagaaagttcattt

SEQ ID NO: 1271725 - DNA, 22 bp, Artificial Sequence
  chemically synthesized
aattcataaaaagaagaaagtt

SEQ ID NO: 1271726 - DNA, 22 bp, Artificial Sequence
  chemically synthesized
cagaaaaaatgaactttcttct

SEQ ID NO: 1271727 - DNA, 22 bp, Artificial Sequence
  chemically synthesized
tgaattcataaaaagaagaaag

SEQ ID NO: 1271728 - DNA, 22 bp, Artificial Sequence
  chemically synthesized
ctgaattcataaaaagaagaaa

SEQ ID NO: 1271729 - DNA, 22 bp, Artificial Sequence
  chemically synthesized
cggtccttctgaattcataaaa

SEQ ID NO: 1271730 - DNA, 22 bp, Artificial Sequence
  chemically synthesized
tctccggtccttctgaattcat

SEQ ID NO: 1271731 - DNA, 22 bp, Artificial Sequence
  chemically synthesized
tcttctttttatgaattcagaa

SEQ ID NO: 1271732 - DNA, 22 bp, Artificial Sequence
  chemically synthesized
cttctttttatgaattcagaag

SEQ ID NO: 1271733 - DNA, 22 bp, Artificial Sequence
  chemically synthesized
ttctttttatgaattcagaagg

SEQ ID NO: 1271734 - DNA, 22 bp, Artificial Sequence
  chemically synthesized
cctgtctccggtccttctgaat

SEQ ID NO: 1271735 - DNA, 22 bp, Artificial Sequence
  chemically synthesized
ctttttatgaattcagaaggac

SEQ ID NO: 1271736 - DNA, 22 bp, Artificial Sequence
  chemically synthesized
tttttatgaattcagaaggacc

SEQ ID NO: 1271737 - DNA, 22 bp, Artificial Sequence
  chemically synthesized
cctacctgtctccggtccttct

SEQ ID NO: 1271738 - DNA, 22 bp, Artificial Sequence
  chemically synthesized
tttatgaattcagaaggaccgg

SEQ ID NO: 1271739 - DNA, 22 bp, Artificial Sequence
  chemically synthesized
gcctacctgtctccggtccttc

SEQ ID NO: 1271740 - DNA, 22 bp, Artificial Sequence
  chemically synthesized
ttatgaattcagaaggaccgga

SEQ ID NO: 1271741 - DNA, 22 bp, Artificial Sequence
  chemically synthesized
tatgaattcagaaggaccggag

SEQ ID NO: 1271742 - DNA, 22 bp, Artificial Sequence
  chemically synthesized
atgaattcagaaggaccggaga

SEQ ID NO: 1271743 - DNA, 22 bp, Artificial Sequence
  chemically synthesized
tgaattcagaaggaccggagac

SEQ ID NO: 1271744 - DNA, 22 bp, Artificial Sequence
  chemically synthesized
atgcgtcttgcctacctgtctc

SEQ ID NO: 1271745 - DNA, 22 bp, Artificial Sequence
  chemically synthesized
agaaggaccggagacaggtagg

SEQ ID NO: 1271746 - DNA, 22 bp, Artificial Sequence
  chemically synthesized
tgttcatgcgtcttgcctacct

SEQ ID NO: 1271747 - DNA, 22 bp, Artificial Sequence
  chemically synthesized
gtgttcatgcgtcttgcctacc

SEQ ID NO: 1271748 - DNA, 22 bp, Artificial Sequence
  chemically synthesized
tgtgttcatgcgtcttgcctac

SEQ ID NO: 1271749 - DNA, 22 bp, Artificial Sequence
  chemically synthesized
ttgtgttcatgcgtcttgccta

SEQ ID NO: 1271750 - DNA, 22 bp, Artificial Sequence
  chemically synthesized
agacacttttgtgttcatgcgt

SEQ ID NO: 1271751 - DNA, 22 bp, Artificial Sequence
  chemically synthesized
aagacacttttgtgttcatgcg

SEQ ID NO: 1271752 - DNA, 22 bp, Artificial Sequence
  chemically synthesized
taagacacttttgtgttcatgc

SEQ ID NO: 1271753 - DNA, 22 bp, Artificial Sequence
  chemically synthesized
agattttaagacacttttgtgt

SEQ ID NO: 1271754 - DNA, 22 bp, Artificial Sequence
  chemically synthesized
tgagattttaagacacttttgt

SEQ ID NO: 1271755 - DNA, 22 bp, Artificial Sequence
  chemically synthesized
aaaatctcagagatacattcat

SEQ ID NO: 1271756 - DNA, 22 bp, Artificial Sequence
  chemically synthesized
aaatctcagagatacattcatt

SEQ ID NO: 1271757 - DNA, 22 bp, Artificial Sequence
  chemically synthesized
agagatacattcatttgtgcac

SEQ ID NO: 1271758 - DNA, 22 bp, Artificial Sequence
  chemically synthesized
aatgaatgaataagtgaaagtg

SEQ ID NO: 1271759 - DNA, 22 bp, Artificial Sequence
  chemically synthesized
ctgaatgaatgaataagtgaaa

SEQ ID NO: 1271760 - DNA, 22 bp, Artificial Sequence
  chemically synthesized
atttgtgcactttcacttattc

SEQ ID NO: 1271761 - DNA, 22 bp, Artificial Sequence
  chemically synthesized
gtgcactttcacttattcattc

SEQ ID NO: 1271762 - DNA, 22 bp, Artificial Sequence
  chemically synthesized
tgcactttcacttattcattca

SEQ ID NO: 1271763 - DNA, 22 bp, Artificial Sequence
  chemically synthesized
taaatgattactgaatgaatga

SEQ ID NO: 1271764 - DNA, 22 bp, Artificial Sequence
  chemically synthesized
tataaatgattactgaatgaat

SEQ ID NO: 1271765 - DNA, 22 bp, Artificial Sequence
  chemically synthesized
tcacttattcattcattcagta

SEQ ID NO: 1271766 - DNA, 22 bp, Artificial Sequence
  chemically synthesized
cacttattcattcattcagtaa

SEQ ID NO: 1271767 - DNA, 22 bp, Artificial Sequence
  chemically synthesized
acttattcattcattcagtaat

SEQ ID NO: 1271768 - DNA, 22 bp, Artificial Sequence
  chemically synthesized
attcattcattcagtaatcatt

SEQ ID NO: 1271769 - DNA, 22 bp, Artificial Sequence
  chemically synthesized
ttcattcattcagtaatcattt

SEQ ID NO: 1271770 - DNA, 22 bp, Artificial Sequence
  chemically synthesized
ataaaagactctataaatgatt

SEQ ID NO: 1271771 - DNA, 22 bp, Artificial Sequence
  chemically synthesized
attcattcagtaatcatttata

SEQ ID NO: 1271772 - DNA, 22 bp, Artificial Sequence
  chemically synthesized
attcagtaatcatttatagagt

SEQ ID NO: 1271773 - DNA, 22 bp, Artificial Sequence
  chemically synthesized
agtaatcatttatagagtcttt

SEQ ID NO: 1271774 - DNA, 22 bp, Artificial Sequence
  chemically synthesized
tagcacatggttcataaaagac

SEQ ID NO: 1271775 - DNA, 22 bp, Artificial Sequence
  chemically synthesized
atagcacatggttcataaaaga

SEQ ID NO: 1271776 - DNA, 22 bp, Artificial Sequence
  chemically synthesized
gcttatagcacatggttcataa

SEQ ID NO: 1271777 - DNA, 22 bp, Artificial Sequence
  chemically synthesized
atagagtcttttatgaaccatg

SEQ ID NO: 1271778 - DNA, 22 bp, Artificial Sequence
  chemically synthesized
tagagtcttttatgaaccatgt

SEQ ID NO: 1271779 - DNA, 22 bp, Artificial Sequence
  chemically synthesized
ccgggacctagcttatagcaca

SEQ ID NO: 1271780 - DNA, 22 bp, Artificial Sequence
  chemically synthesized
ttatgaaccatgtgctataagc

SEQ ID NO: 1271781 - DNA, 22 bp, Artificial Sequence
  chemically synthesized
tatgaaccatgtgctataagct

SEQ ID NO: 1271782 - DNA, 22 bp, Artificial Sequence
  chemically synthesized
ctcccgggacctagcttatagc

SEQ ID NO: 1271783 - DNA, 22 bp, Artificial Sequence
  chemically synthesized
atgaaccatgtgctataagcta

SEQ ID NO: 1271784 - DNA, 22 bp, Artificial Sequence
  chemically synthesized
actcccgggacctagcttatag

SEQ ID NO: 1271785 - DNA, 22 bp, Artificial Sequence
  chemically synthesized
tgaaccatgtgctataagctag

SEQ ID NO: 1271786 - DNA, 22 bp, Artificial Sequence
  chemically synthesized
tactcccgggacctagcttata

SEQ ID NO: 1271787 - DNA, 22 bp, Artificial Sequence
  chemically synthesized
ttactcccgggacctagcttat

SEQ ID NO: 1271788 - DNA, 22 bp, Artificial Sequence
  chemically synthesized
ccgccttttactcccgggacct

SEQ ID NO: 1271789 - DNA, 22 bp, Artificial Sequence
  chemically synthesized
ctcccgccttttactcccggga

SEQ ID NO: 1271790 - DNA, 22 bp, Artificial Sequence
  chemically synthesized
actcccgccttttactcccggg

SEQ ID NO: 1271791 - DNA, 22 bp, Artificial Sequence
  chemically synthesized
taagctaggtcccgggagtaaa

SEQ ID NO: 1271792 - DNA, 22 bp, Artificial Sequence
  chemically synthesized
tcagcttactcccgccttttac

SEQ ID NO: 1271793 - DNA, 22 bp, Artificial Sequence
  chemically synthesized
ggtcccgggagtaaaaggcggg

SEQ ID NO: 1271794 - DNA, 22 bp, Artificial Sequence
  chemically synthesized
attgtcagcttactcccgcctt

SEQ ID NO: 1271795 - DNA, 22 bp, Artificial Sequence
  chemically synthesized
aattgtcagcttactcccgcct

SEQ ID NO: 1271796 - DNA, 22 bp, Artificial Sequence
  chemically synthesized
aatggacaaaagaaaacttaat

SEQ ID NO: 1271797 - DNA, 22 bp, Artificial Sequence
  chemically synthesized
acaattaagttttcttttgtcc

SEQ ID NO: 1271798 - DNA, 22 bp, Artificial Sequence
  chemically synthesized
gacaaaattcaatggacaaaag

SEQ ID NO: 1271799 - DNA, 22 bp, Artificial Sequence
  chemically synthesized
agttttcttttgtccattgaat

SEQ ID NO: 1271800 - DNA, 22 bp, Artificial Sequence
  chemically synthesized
cgaattggacaaaattcaatgg

SEQ ID NO: 1271801 - DNA, 22 bp, Artificial Sequence
  chemically synthesized
tcttttgtccattgaattttgt

SEQ ID NO: 1271802 - DNA, 22 bp, Artificial Sequence
  chemically synthesized
cttttgtccattgaattttgtc

SEQ ID NO: 1271803 - DNA, 22 bp, Artificial Sequence
  chemically synthesized
ttttgtccattgaattttgtcc

SEQ ID NO: 1271804 - DNA, 22 bp, Artificial Sequence
  chemically synthesized
ttgtccattgaattttgtccaa

SEQ ID NO: 1271805 - DNA, 22 bp, Artificial Sequence
  chemically synthesized
tgtccattgaattttgtccaat

SEQ ID NO: 1271806 - DNA, 22 bp, Artificial Sequence
  chemically synthesized
gtccattgaattttgtccaatt

SEQ ID NO: 1271807 - DNA, 22 bp, Artificial Sequence
  chemically synthesized
tccattgaattttgtccaattc

SEQ ID NO: 1271808 - DNA, 22 bp, Artificial Sequence
  chemically synthesized
aattttgtccaattcgcaggtg

SEQ ID NO: 1271809 - DNA, 22 bp, Artificial Sequence
  chemically synthesized
aaccaaccaagtaccacctgcg

SEQ ID NO: 1271810 - DNA, 22 bp, Artificial Sequence
  chemically synthesized
tgtccaattcgcaggtggtact

SEQ ID NO: 1271811 - DNA, 22 bp, Artificial Sequence
  chemically synthesized
gtccaattcgcaggtggtactt

SEQ ID NO: 1271812 - DNA, 22 bp, Artificial Sequence
  chemically synthesized
tccaattcgcaggtggtacttg

SEQ ID NO: 1271813 - DNA, 22 bp, Artificial Sequence
  chemically synthesized
ggaggttcaaccaaccaagtac

SEQ ID NO: 1271814 - DNA, 22 bp, Artificial Sequence
  chemically synthesized
aggaggttcaaccaaccaagta

SEQ ID NO: 1271815 - DNA, 22 bp, Artificial Sequence
  chemically synthesized
taggaggttcaaccaaccaagt

SEQ ID NO: 1271816 - DNA, 22 bp, Artificial Sequence
  chemically synthesized
gcaggtggtacttggttggttg

SEQ ID NO: 1271817 - DNA, 22 bp, Artificial Sequence
  chemically synthesized
gaaggtaactttaggaggttca

SEQ ID NO: 1271818 - DNA, 22 bp, Artificial Sequence
  chemically synthesized
ggttggttgaacctcctaaagt

SEQ ID NO: 1271819 - DNA, 22 bp, Artificial Sequence
  chemically synthesized
gttggttgaacctcctaaagtt

SEQ ID NO: 1271820 - DNA, 22 bp, Artificial Sequence
  chemically synthesized
gttgaacctcctaaagttacct

SEQ ID NO: 1271821 - DNA, 22 bp, Artificial Sequence
  chemically synthesized
ggggcatgagctagaaggtaac

SEQ ID NO: 1271822 - DNA, 22 bp, Artificial Sequence
  chemically synthesized
aacctcctaaagttaccttcta

SEQ ID NO: 1271823 - DNA, 22 bp, Artificial Sequence
  chemically synthesized
ctaaagttaccttctagctcat

SEQ ID NO: 1271824 - DNA, 22 bp, Artificial Sequence
  chemically synthesized
aagttaccttctagctcatgcc

SEQ ID NO: 1271825 - DNA, 22 bp, Artificial Sequence
  chemically synthesized
ccttctagctcatgcccccaac

SEQ ID NO: 1271826 - DNA, 22 bp, Artificial Sequence
  chemically synthesized
taaagtggcaaatagttggggg

SEQ ID NO: 1271827 - DNA, 22 bp, Artificial Sequence
  chemically synthesized
gtaaagtggcaaatagttgggg

SEQ ID NO: 1271828 - DNA, 22 bp, Artificial Sequence
  chemically synthesized
ctagctcatgcccccaactatt

SEQ ID NO: 1271829 - DNA, 22 bp, Artificial Sequence
  chemically synthesized
tgtaaagtggcaaatagttggg

SEQ ID NO: 1271830 - DNA, 22 bp, Artificial Sequence
  chemically synthesized
tagctcatgcccccaactattt

SEQ ID NO: 1271831 - DNA, 22 bp, Artificial Sequence
  chemically synthesized
ttgtaaagtggcaaatagttgg

SEQ ID NO: 1271832 - DNA, 22 bp, Artificial Sequence
  chemically synthesized
gctcatgcccccaactatttgc

SEQ ID NO: 1271833 - DNA, 22 bp, Artificial Sequence
  chemically synthesized
atgcccccaactatttgccact

SEQ ID NO: 1271834 - DNA, 22 bp, Artificial Sequence
  chemically synthesized
tggtgtgtgtgacgtttttgta

SEQ ID NO: 1271835 - DNA, 22 bp, Artificial Sequence
  chemically synthesized
atggtgtgtgtgacgtttttgt

SEQ ID NO: 1271836 - DNA, 22 bp, Artificial Sequence
  chemically synthesized
tttgccactttacaaaaacgtc

SEQ ID NO: 1271837 - DNA, 22 bp, Artificial Sequence
  chemically synthesized
gccactttacaaaaacgtcaca

SEQ ID NO: 1271838 - DNA, 22 bp, Artificial Sequence
  chemically synthesized
ccactttacaaaaacgtcacac

SEQ ID NO: 1271839 - DNA, 22 bp, Artificial Sequence
  chemically synthesized
agtttatggtgtgtgtgacgtt

SEQ ID NO: 1271840 - DNA, 22 bp, Artificial Sequence
  chemically synthesized
tcagtttatggtgtgtgtgacg

SEQ ID NO: 1271841 - DNA, 22 bp, Artificial Sequence
  chemically synthesized
ctcagtttatggtgtgtgtgac

SEQ ID NO: 1271842 - DNA, 22 bp, Artificial Sequence
  chemically synthesized
tctcagtttatggtgtgtgtga

SEQ ID NO: 1271843 - DNA, 22 bp, Artificial Sequence
  chemically synthesized
tacaaaaacgtcacacacacca

SEQ ID NO: 1271844 - DNA, 22 bp, Artificial Sequence
  chemically synthesized
acaaaaacgtcacacacaccat

SEQ ID NO: 1271845 - DNA, 22 bp, Artificial Sequence
  chemically synthesized
caaaaacgtcacacacaccata

SEQ ID NO: 1271846 - DNA, 22 bp, Artificial Sequence
  chemically synthesized
atgattttctcagtttatggtg

SEQ ID NO: 1271847 - DNA, 22 bp, Artificial Sequence
  chemically synthesized
gactgatgattttctcagttta

SEQ ID NO: 1271848 - DNA, 22 bp, Artificial Sequence
  chemically synthesized
cctggactgatgattttctcag

SEQ ID NO: 1271849 - DNA, 22 bp, Artificial Sequence
  chemically synthesized
agaaaatcatcagtccagggag

SEQ ID NO: 1271850 - DNA, 22 bp, Artificial Sequence
  chemically synthesized
atcgcagaaggaatgagcctcc

SEQ ID NO: 1271851 - DNA, 22 bp, Artificial Sequence
  chemically synthesized
catcgcagaaggaatgagcctc

SEQ ID NO: 1271852 - DNA, 22 bp, Artificial Sequence
  chemically synthesized
ttcatcgcagaaggaatgagcc

SEQ ID NO: 1271853 - DNA, 22 bp, Artificial Sequence
  chemically synthesized
attccttctgcgatgaagaatt

SEQ ID NO: 1271854 - DNA, 22 bp, Artificial Sequence
  chemically synthesized
cgacaatataggaattcttcat

SEQ ID NO: 1271855 - DNA, 22 bp, Artificial Sequence
  chemically synthesized
cttctgcgatgaagaattccta

SEQ ID NO: 1271856 - DNA, 22 bp, Artificial Sequence
  chemically synthesized
ctgcgatgaagaattcctatat

SEQ ID NO: 1271857 - DNA, 22 bp, Artificial Sequence
  chemically synthesized
aatattgcgacaatataggaat

SEQ ID NO: 1271858 - DNA, 22 bp, Artificial Sequence
  chemically synthesized
tgcgatgaagaattcctatatt

SEQ ID NO: 1271859 - DNA, 22 bp, Artificial Sequence
  chemically synthesized
cgatgaagaattcctatattgt

SEQ ID NO: 1271860 - DNA, 22 bp, Artificial Sequence
  chemically synthesized
tcagctgaatattgcgacaata

SEQ ID NO: 1271861 - DNA, 22 bp, Artificial Sequence
  chemically synthesized
gtcagctgaatattgcgacaat

SEQ ID NO: 1271862 - DNA, 22 bp, Artificial Sequence
  chemically synthesized
ctatattgtcgcaatattcagc

SEQ ID NO: 1271863 - DNA, 22 bp, Artificial Sequence
  chemically synthesized
tattgtcgcaatattcagctga

SEQ ID NO: 1271864 - DNA, 22 bp, Artificial Sequence
  chemically synthesized
ccccatggcttgtcagctgaat

SEQ ID NO: 1271865 - DNA, 22 bp, Artificial Sequence
  chemically synthesized
accccatggcttgtcagctgaa

SEQ ID NO: 1271866 - DNA, 22 bp, Artificial Sequence
  chemically synthesized
taccccatggcttgtcagctga

SEQ ID NO: 1271867 - DNA, 22 bp, Artificial Sequence
  chemically synthesized
tcgcaatattcagctgacaagc

SEQ ID NO: 1271868 - DNA, 22 bp, Artificial Sequence
  chemically synthesized
acagtagttttaccccatggct

SEQ ID NO: 1271869 - DNA, 22 bp, Artificial Sequence
  chemically synthesized
agctgacaagccatggggtaaa

SEQ ID NO: 1271870 - DNA, 22 bp, Artificial Sequence
  chemically synthesized
aaatgctcacagtagttttacc

SEQ ID NO: 1271871 - DNA, 22 bp, Artificial Sequence
  chemically synthesized
acaagccatggggtaaaactac

SEQ ID NO: 1271872 - DNA, 22 bp, Artificial Sequence
  chemically synthesized
ctgtgagcatttcaacttctga

SEQ ID NO: 1271873 - DNA, 22 bp, Artificial Sequence
  chemically synthesized
tgagcatttcaacttctgatta

SEQ ID NO: 1271874 - DNA, 22 bp, Artificial Sequence
  chemically synthesized
caacttctgattataccccacc

SEQ ID NO: 1271875 - DNA, 22 bp, Artificial Sequence
  chemically synthesized
aacttctgattataccccacca

SEQ ID NO: 1271876 - DNA, 22 bp, Artificial Sequence
  chemically synthesized
catcagaaaaaatggtggggta

SEQ ID NO: 1271877 - DNA, 22 bp, Artificial Sequence
  chemically synthesized
ctgattataccccaccattttt

SEQ ID NO: 1271878 - DNA, 22 bp, Artificial Sequence
  chemically synthesized
tattccatcagaaaaaatggtg

SEQ ID NO: 1271879 - DNA, 22 bp, Artificial Sequence
  chemically synthesized
tgattataccccaccatttttt

SEQ ID NO: 1271880 - DNA, 22 bp, Artificial Sequence
  chemically synthesized
tgtattccatcagaaaaaatgg

SEQ ID NO: 1271881 - DNA, 22 bp, Artificial Sequence
  chemically synthesized
attataccccaccattttttct

SEQ ID NO: 1271882 - DNA, 22 bp, Artificial Sequence
  chemically synthesized
tctgtattccatcagaaaaaat

SEQ ID NO: 1271883 - DNA, 22 bp, Artificial Sequence
  chemically synthesized
taccccaccattttttctgatg

SEQ ID NO: 1271884 - DNA, 22 bp, Artificial Sequence
  chemically synthesized
gccactctctgtattccatcag

SEQ ID NO: 1271885 - DNA, 22 bp, Artificial Sequence
  chemically synthesized
ggccactctctgtattccatca

SEQ ID NO: 1271886 - DNA, 22 bp, Artificial Sequence
  chemically synthesized
gtttggccactctctgtattcc

SEQ ID NO: 1271887 - DNA, 22 bp, Artificial Sequence
  chemically synthesized
ctggtttggccactctctgtat

SEQ ID NO: 1271888 - DNA, 22 bp, Artificial Sequence
  chemically synthesized
tttctgatggaatacagagagt

SEQ ID NO: 1271889 - DNA, 22 bp, Artificial Sequence
  chemically synthesized
ttctgatggaatacagagagtg

SEQ ID NO: 1271890 - DNA, 22 bp, Artificial Sequence
  chemically synthesized
tctgatggaatacagagagtgg

SEQ ID NO: 1271891 - DNA, 22 bp, Artificial Sequence
  chemically synthesized
ctgatggaatacagagagtggc

SEQ ID NO: 1271892 - DNA, 22 bp, Artificial Sequence
  chemically synthesized
tgatggaatacagagagtggcc

SEQ ID NO: 1271893 - DNA, 22 bp, Artificial Sequence
  chemically synthesized
atggaatacagagagtggccaa

SEQ ID NO: 1271894 - DNA, 22 bp, Artificial Sequence
  chemically synthesized
aaggaaggctgctggtttggcc

SEQ ID NO: 1271895 - DNA, 22 bp, Artificial Sequence
  chemically synthesized
gggaaatgtggcctgaaggaag

SEQ ID NO: 1271896 - DNA, 22 bp, Artificial Sequence
  chemically synthesized
ggctggggaaatgtggcctgaa

SEQ ID NO: 1271897 - DNA, 22 bp, Artificial Sequence
  chemically synthesized
tgggctggggaaatgtggcctg

SEQ ID NO: 1271898 - DNA, 22 bp, Artificial Sequence
  chemically synthesized
ctgggctggggaaatgtggcct

SEQ ID NO: 1271899 - DNA, 22 bp, Artificial Sequence
  chemically synthesized
ccttcaggccacatttccccag

SEQ ID NO: 1271900 - DNA, 22 bp, Artificial Sequence
  chemically synthesized
ggaacttctgggctggggaaat

SEQ ID NO: 1271901 - DNA, 22 bp, Artificial Sequence
  chemically synthesized
cttcaggccacatttccccagc

SEQ ID NO: 1271902 - DNA, 22 bp, Artificial Sequence
  chemically synthesized
aggaacttctgggctggggaaa

SEQ ID NO: 1271903 - DNA, 22 bp, Artificial Sequence
  chemically synthesized
taggaacttctgggctggggaa

SEQ ID NO: 1271904 - DNA, 22 bp, Artificial Sequence
  chemically synthesized
caggccacatttccccagccca

SEQ ID NO: 1271905 - DNA, 22 bp, Artificial Sequence
  chemically synthesized
aggccacatttccccagcccag

SEQ ID NO: 1271906 - DNA, 22 bp, Artificial Sequence
  chemically synthesized
cacaagattttaggaacttctg

SEQ ID NO: 1271907 - DNA, 22 bp, Artificial Sequence
  chemically synthesized
ccccagcccagaagttcctaaa

SEQ ID NO: 1271908 - DNA, 22 bp, Artificial Sequence
  chemically synthesized
cccagcccagaagttcctaaaa

SEQ ID NO: 1271909 - DNA, 22 bp, Artificial Sequence
  chemically synthesized
aatcgcctccacaagattttag

SEQ ID NO: 1271910 - DNA, 22 bp, Artificial Sequence
  chemically synthesized
ctaaaatcttgtggaggcgatt

SEQ ID NO: 1271911 - DNA, 22 bp, Artificial Sequence
  chemically synthesized
aaatcttgtggaggcgattcag

SEQ ID NO: 1271912 - DNA, 22 bp, Artificial Sequence
  chemically synthesized
tcaaatataaagctgaatcgcc

SEQ ID NO: 1271913 - DNA, 22 bp, Artificial Sequence
  chemically synthesized
gtggaggcgattcagctttata

SEQ ID NO: 1271914 - DNA, 22 bp, Artificial Sequence
  chemically synthesized
tggaggcgattcagctttatat

SEQ ID NO: 1271915 - DNA, 22 bp, Artificial Sequence
  chemically synthesized
agctttatatttgacagttatt

SEQ ID NO: 1271916 - DNA, 22 bp, Artificial Sequence
  chemically synthesized
tagggccagaaatataaataac

SEQ ID NO: 1271917 - DNA, 22 bp, Artificial Sequence
  chemically synthesized
tatatttgacagttatttatat

SEQ ID NO: 1271918 - DNA, 22 bp, Artificial Sequence
  chemically synthesized
atatttgacagttatttatatt

SEQ ID NO: 1271919 - DNA, 22 bp, Artificial Sequence
  chemically synthesized
tatttgacagttatttatattt

SEQ ID NO: 1271920 - DNA, 22 bp, Artificial Sequence
  chemically synthesized
gacagttatttatatttctggc

SEQ ID NO: 1271921 - DNA, 22 bp, Artificial Sequence
  chemically synthesized
acagttatttatatttctggcc

SEQ ID NO: 1271922 - DNA, 22 bp, Artificial Sequence
  chemically synthesized
ggacagagtctgtagggccaga

SEQ ID NO: 1271923 - DNA, 22 bp, Artificial Sequence
  chemically synthesized
ctcggacagagtctgtagggcc

SEQ ID NO: 1271924 - DNA, 22 bp, Artificial Sequence
  chemically synthesized
tttatatttctggccctacaga

SEQ ID NO: 1271925 - DNA, 22 bp, Artificial Sequence
  chemically synthesized
gctcggacagagtctgtagggc

SEQ ID NO: 1271926 - DNA, 22 bp, Artificial Sequence
  chemically synthesized
tgctcggacagagtctgtaggg

SEQ ID NO: 1271927 - DNA, 22 bp, Artificial Sequence
  chemically synthesized
ttgctcggacagagtctgtagg

SEQ ID NO: 1271928 - DNA, 22 bp, Artificial Sequence
  chemically synthesized
atatttctggccctacagactc

SEQ ID NO: 1271929 - DNA, 22 bp, Artificial Sequence
  chemically synthesized
tatttctggccctacagactct

SEQ ID NO: 1271930 - DNA, 22 bp, Artificial Sequence
  chemically synthesized
ctggccctacagactctgtccg

SEQ ID NO: 1271931 - DNA, 22 bp, Artificial Sequence
  chemically synthesized
tggccctacagactctgtccga

SEQ ID NO: 1271932 - DNA, 22 bp, Artificial Sequence
  chemically synthesized
gaaaagcttttgctcggacaga

SEQ ID NO: 1271933 - DNA, 22 bp, Artificial Sequence
  chemically synthesized
gccctacagactctgtccgagc

SEQ ID NO: 1271934 - DNA, 22 bp, Artificial Sequence
  chemically synthesized
cagactctgtccgagcaaaagc

SEQ ID NO: 1271935 - DNA, 22 bp, Artificial Sequence
  chemically synthesized
tatgtctagaaaagcttttgct

SEQ ID NO: 1271936 - DNA, 22 bp, Artificial Sequence
  chemically synthesized
tgtccgagcaaaagcttttcta

SEQ ID NO: 1271937 - DNA, 22 bp, Artificial Sequence
  chemically synthesized
aaattatatgtctagaaaagct

SEQ ID NO: 1271938 - DNA, 22 bp, Artificial Sequence
  chemically synthesized
aaaattatatgtctagaaaagc

SEQ ID NO: 1271939 - DNA, 22 bp, Artificial Sequence
  chemically synthesized
tccgagcaaaagcttttctaga

SEQ ID NO: 1271940 - DNA, 22 bp, Artificial Sequence
  chemically synthesized
cccttaaaattatatgtctaga

SEQ ID NO: 1271941 - DNA, 22 bp, Artificial Sequence
  chemically synthesized
ccccttaaaattatatgtctag

SEQ ID NO: 1271942 - DNA, 22 bp, Artificial Sequence
  chemically synthesized
tccccttaaaattatatgtcta

SEQ ID NO: 1271943 - DNA, 22 bp, Artificial Sequence
  chemically synthesized
atattttccccttaaaattata

SEQ ID NO: 1271944 - DNA, 22 bp, Artificial Sequence
  chemically synthesized
ttctagacatataattttaagg

SEQ ID NO: 1271945 - DNA, 22 bp, Artificial Sequence
  chemically synthesized
tctagacatataattttaaggg

SEQ ID NO: 1271946 - DNA, 22 bp, Artificial Sequence
  chemically synthesized
ctagacatataattttaagggg

SEQ ID NO: 1271947 - DNA, 22 bp, Artificial Sequence
  chemically synthesized
tagacatataattttaagggga

SEQ ID NO: 1271948 - DNA, 22 bp, Artificial Sequence
  chemically synthesized
gacatataattttaaggggaaa

SEQ ID NO: 1271949 - DNA, 22 bp, Artificial Sequence
  chemically synthesized
aaatattgatattttcccctta

SEQ ID NO: 1271950 - DNA, 22 bp, Artificial Sequence
  chemically synthesized
caaatattgatattttcccctt

SEQ ID NO: 1271951 - DNA, 22 bp, Artificial Sequence
  chemically synthesized
ttcaaatattgatattttcccc

SEQ ID NO: 1271952 - DNA, 22 bp, Artificial Sequence
  chemically synthesized
cttcaaatattgatattttccc

SEQ ID NO: 1271953 - DNA, 22 bp, Artificial Sequence
  chemically synthesized
tcttcaaatattgatattttcc

SEQ ID NO: 1271954 - DNA, 22 bp, Artificial Sequence
  chemically synthesized
ttttcttcaaatattgatattt

SEQ ID NO: 1271955 - DNA, 22 bp, Artificial Sequence
  chemically synthesized
gttttcttcaaatattgatatt

SEQ ID NO: 1271956 - DNA, 22 bp, Artificial Sequence
  chemically synthesized
taaggggaaaatatcaatattt

SEQ ID NO: 1271957 - DNA, 22 bp, Artificial Sequence
  chemically synthesized
aaggggaaaatatcaatatttg

SEQ ID NO: 1271958 - DNA, 22 bp, Artificial Sequence
  chemically synthesized
aggggaaaatatcaatatttga

SEQ ID NO: 1271959 - DNA, 22 bp, Artificial Sequence
  chemically synthesized
cagcacacttgttttcttcaaa

SEQ ID NO: 1271960 - DNA, 22 bp, Artificial Sequence
  chemically synthesized
gaagaaaacaagtgtgctggaa

SEQ ID NO: 1271961 - DNA, 22 bp, Artificial Sequence
  chemically synthesized
aagaaaacaagtgtgctggaat

SEQ ID NO: 1271962 - DNA, 22 bp, Artificial Sequence
  chemically synthesized
gaatgtccctctaccttatgat

SEQ ID NO: 1271963 - DNA, 22 bp, Artificial Sequence
  chemically synthesized
ggaataacaaatgaatcataag

SEQ ID NO: 1271964 - DNA, 22 bp, Artificial Sequence
  chemically synthesized
taccttatgattcatttgttat

SEQ ID NO: 1271965 - DNA, 22 bp, Artificial Sequence
  chemically synthesized
ccttatgattcatttgttattc

SEQ ID NO: 1271966 - DNA, 22 bp, Artificial Sequence
  chemically synthesized
cagaacaccctaggaataacaa

SEQ ID NO: 1271967 - DNA, 22 bp, Artificial Sequence
  chemically synthesized
atgattcatttgttattcctag

SEQ ID NO: 1271968 - DNA, 22 bp, Artificial Sequence
  chemically synthesized
ctgcagaacaccctaggaataa

SEQ ID NO: 1271969 - DNA, 22 bp, Artificial Sequence
  chemically synthesized
tgattcatttgttattcctagg

SEQ ID NO: 1271970 - DNA, 22 bp, Artificial Sequence
  chemically synthesized
acctgctgcagaacaccctagg

SEQ ID NO: 1271971 - DNA, 22 bp, Artificial Sequence
  chemically synthesized
aacctgctgcagaacaccctag

SEQ ID NO: 1271972 - DNA, 22 bp, Artificial Sequence
  chemically synthesized
atttgttattcctagggtgttc

SEQ ID NO: 1271973 - DNA, 22 bp, Artificial Sequence
  chemically synthesized
gttattcctagggtgttctgca

SEQ ID NO: 1271974 - DNA, 22 bp, Artificial Sequence
  chemically synthesized
ttattcctagggtgttctgcag

SEQ ID NO: 1271975 - DNA, 22 bp, Artificial Sequence
  chemically synthesized
ttcctagggtgttctgcagcag

SEQ ID NO: 1271976 - DNA, 22 bp, Artificial Sequence
  chemically synthesized
ctagggtgttctgcagcaggtt

SEQ ID NO: 1271977 - DNA, 22 bp, Artificial Sequence
  chemically synthesized
aatagcccacttaacctgctgc

SEQ ID NO: 1271978 - DNA, 22 bp, Artificial Sequence
  chemically synthesized
gggtgttctgcagcaggttaag

SEQ ID NO: 1271979 - DNA, 22 bp, Artificial Sequence
  chemically synthesized
ttcaatagcccacttaacctgc

SEQ ID NO: 1271980 - DNA, 22 bp, Artificial Sequence
  chemically synthesized
gttcaatagcccacttaacctg

SEQ ID NO: 1271981 - DNA, 22 bp, Artificial Sequence
  chemically synthesized
tgttcaatagcccacttaacct

SEQ ID NO: 1271982 - DNA, 22 bp, Artificial Sequence
  chemically synthesized
tttgttcaatagcccacttaac

SEQ ID NO: 1271983 - DNA, 22 bp, Artificial Sequence
  chemically synthesized
ctttgttcaatagcccacttaa

SEQ ID NO: 1271984 - DNA, 22 bp, Artificial Sequence
  chemically synthesized
tctttgttcaatagcccactta

SEQ ID NO: 1271985 - DNA, 22 bp, Artificial Sequence
  chemically synthesized
tgcagcaggttaagtgggctat

SEQ ID NO: 1271986 - DNA, 22 bp, Artificial Sequence
  chemically synthesized
cagcaggttaagtgggctattg

SEQ ID NO: 1271987 - DNA, 22 bp, Artificial Sequence
  chemically synthesized
gggttttctttgttcaatagcc

SEQ ID NO: 1271988 - DNA, 22 bp, Artificial Sequence
  chemically synthesized
ctggggttttctttgttcaata

SEQ ID NO: 1271989 - DNA, 22 bp, Artificial Sequence
  chemically synthesized
agtgggctattgaacaaagaaa

SEQ ID NO: 1271990 - DNA, 22 bp, Artificial Sequence
  chemically synthesized
ttgaacaaagaaaaccccagga

SEQ ID NO: 1271991 - DNA, 22 bp, Artificial Sequence
  chemically synthesized
aacaaagaaaaccccaggaatt

SEQ ID NO: 1271992 - DNA, 22 bp, Artificial Sequence
  chemically synthesized
aggtaatagaatatgtcagaat

SEQ ID NO: 1271993 - DNA, 22 bp, Artificial Sequence
  chemically synthesized
aaggtaatagaatatgtcagaa

SEQ ID NO: 1271994 - DNA, 22 bp, Artificial Sequence
  chemically synthesized
gatcagtttaaggtaatagaat

SEQ ID NO: 1271995 - DNA, 22 bp, Artificial Sequence
  chemically synthesized
cgatcagtttaaggtaatagaa

SEQ ID NO: 1271996 - DNA, 22 bp, Artificial Sequence
  chemically synthesized
tcgatcagtttaaggtaataga

SEQ ID NO: 1271997 - DNA, 22 bp, Artificial Sequence
  chemically synthesized
tgacatattctattaccttaaa

SEQ ID NO: 1271998 - DNA, 22 bp, Artificial Sequence
  chemically synthesized
attttcgatcagtttaaggtaa

SEQ ID NO: 1271999 - DNA, 22 bp, Artificial Sequence
  chemically synthesized
acatattctattaccttaaact

SEQ ID NO: 1272000 - DNA, 22 bp, Artificial Sequence
  chemically synthesized
tattaccttaaactgatcgaaa

SEQ ID NO: 1272001 - DNA, 22 bp, Artificial Sequence
  chemically synthesized
ttaccttaaactgatcgaaaat

SEQ ID NO: 1272002 - DNA, 22 bp, Artificial Sequence
  chemically synthesized
ccttaaactgatcgaaaatcag

SEQ ID NO: 1272003 - DNA, 22 bp, Artificial Sequence
  chemically synthesized
aacagaagaaaagctgattttc

SEQ ID NO: 1272004 - DNA, 22 bp, Artificial Sequence
  chemically synthesized
aaactgatcgaaaatcagcttt

SEQ ID NO: 1272005 - DNA, 22 bp, Artificial Sequence
  chemically synthesized
aactgatcgaaaatcagctttt

SEQ ID NO: 1272006 - DNA, 22 bp, Artificial Sequence
  chemically synthesized
atctcaacagaagaaaagctga

SEQ ID NO: 1272007 - DNA, 22 bp, Artificial Sequence
  chemically synthesized
atcgaaaatcagcttttcttct

SEQ ID NO: 1272008 - DNA, 22 bp, Artificial Sequence
  chemically synthesized
tcaagtaattcatctcaacaga

SEQ ID NO: 1272009 - DNA, 22 bp, Artificial Sequence
  chemically synthesized
actgtcaagtaattcatctcaa

SEQ ID NO: 1272010 - DNA, 22 bp, Artificial Sequence
  chemically synthesized
ctgactgtcaagtaattcatct

SEQ ID NO: 1272011 - DNA, 22 bp, Artificial Sequence
  chemically synthesized
ttcttctgttgagatgaattac

SEQ ID NO: 1272012 - DNA, 22 bp, Artificial Sequence
  chemically synthesized
tcttctgttgagatgaattact

SEQ ID NO: 1272013 - DNA, 22 bp, Artificial Sequence
  chemically synthesized
tactgactgtcaagtaattcat

SEQ ID NO: 1272014 - DNA, 22 bp, Artificial Sequence
  chemically synthesized
cttctgttgagatgaattactt

SEQ ID NO: 1272015 - DNA, 22 bp, Artificial Sequence
  chemically synthesized
ctactgactgtcaagtaattca

SEQ ID NO: 1272016 - DNA, 22 bp, Artificial Sequence
  chemically synthesized
ttctgttgagatgaattacttg

SEQ ID NO: 1272017 - DNA, 22 bp, Artificial Sequence
  chemically synthesized
tctactgactgtcaagtaattc

SEQ ID NO: 1272018 - DNA, 22 bp, Artificial Sequence
  chemically synthesized
ttctactgactgtcaagtaatt

SEQ ID NO: 1272019 - DNA, 22 bp, Artificial Sequence
  chemically synthesized
ctgttgagatgaattacttgac

SEQ ID NO: 1272020 - DNA, 22 bp, Artificial Sequence
  chemically synthesized
tgttgagatgaattacttgaca

SEQ ID NO: 1272021 - DNA, 22 bp, Artificial Sequence
  chemically synthesized
ttgagatgaattacttgacagt

SEQ ID NO: 1272022 - DNA, 22 bp, Artificial Sequence
  chemically synthesized
agatgaattacttgacagtcag

SEQ ID NO: 1272023 - DNA, 22 bp, Artificial Sequence
  chemically synthesized
cttgacagtcagtagaaaaatt

SEQ ID NO: 1272024 - DNA, 22 bp, Artificial Sequence
  chemically synthesized
gacagtcagtagaaaaattctt

SEQ ID NO: 1272025 - DNA, 22 bp, Artificial Sequence
  chemically synthesized
acagtcagtagaaaaattcttc

SEQ ID NO: 1272026 - DNA, 22 bp, Artificial Sequence
  chemically synthesized
agaaaggagaaacccatgggaa

SEQ ID NO: 1272027 - DNA, 22 bp, Artificial Sequence
  chemically synthesized
cagaaaggagaaacccatggga

SEQ ID NO: 1272028 - DNA, 22 bp, Artificial Sequence
  chemically synthesized
ttcccatgggtttctcctttct

SEQ ID NO: 1272029 - DNA, 22 bp, Artificial Sequence
  chemically synthesized
cccatgggtttctcctttctga

SEQ ID NO: 1272030 - DNA, 22 bp, Artificial Sequence
  chemically synthesized
ccatgggtttctcctttctgaa

SEQ ID NO: 1272031 - DNA, 22 bp, Artificial Sequence
  chemically synthesized
ggggtgggaaaggtttcagaaa

SEQ ID NO: 1272032 - DNA, 22 bp, Artificial Sequence
  chemically synthesized
aggactgggggtgggaaaggtt

SEQ ID NO: 1272033 - DNA, 22 bp, Artificial Sequence
  chemically synthesized
ctcctttctgaaacctttccca

SEQ ID NO: 1272034 - DNA, 22 bp, Artificial Sequence
  chemically synthesized
tcctttctgaaacctttcccac

SEQ ID NO: 1272035 - DNA, 22 bp, Artificial Sequence
  chemically synthesized
tgaggactgggggtgggaaagg

SEQ ID NO: 1272036 - DNA, 22 bp, Artificial Sequence
  chemically synthesized
ctgaggactgggggtgggaaag

SEQ ID NO: 1272037 - DNA, 22 bp, Artificial Sequence
  chemically synthesized
ctttctgaaacctttcccaccc

SEQ ID NO: 1272038 - DNA, 22 bp, Artificial Sequence
  chemically synthesized
tctgaaacctttcccaccccca

SEQ ID NO: 1272039 - DNA, 22 bp, Artificial Sequence
  chemically synthesized
ctgaaacctttcccacccccag

SEQ ID NO: 1272040 - DNA, 22 bp, Artificial Sequence
  chemically synthesized
tgaaacctttcccacccccagt

SEQ ID NO: 1272041 - DNA, 22 bp, Artificial Sequence
  chemically synthesized
aaacctttcccacccccagtcc

SEQ ID NO: 1272042 - DNA, 22 bp, Artificial Sequence
  chemically synthesized
accaaagtatatttctgaggac

SEQ ID NO: 1272043 - DNA, 22 bp, Artificial Sequence
  chemically synthesized
tcccacccccagtcctcagaaa

SEQ ID NO: 1272044 - DNA, 22 bp, Artificial Sequence
  chemically synthesized
cccacccccagtcctcagaaat

SEQ ID NO: 1272045 - DNA, 22 bp, Artificial Sequence
  chemically synthesized
ccacccccagtcctcagaaata

SEQ ID NO: 1272046 - DNA, 22 bp, Artificial Sequence
  chemically synthesized
ggatagaggaaactcaccaaag

SEQ ID NO: 1272047 - DNA, 22 bp, Artificial Sequence
  chemically synthesized
gggatagaggaaactcaccaaa

SEQ ID NO: 1272048 - DNA, 22 bp, Artificial Sequence
  chemically synthesized
tgggatagaggaaactcaccaa

SEQ ID NO: 1272049 - DNA, 22 bp, Artificial Sequence
  chemically synthesized
agaaatatactttggtgagttt

SEQ ID NO: 1272050 - DNA, 22 bp, Artificial Sequence
  chemically synthesized
tggtgagtttcctctatcccaa

SEQ ID NO: 1272051 - DNA, 22 bp, Artificial Sequence
  chemically synthesized
ggtgagtttcctctatcccaaa

SEQ ID NO: 1272052 - DNA, 22 bp, Artificial Sequence
  chemically synthesized
tatgaataatgctttgggatag

SEQ ID NO: 1272053 - DNA, 22 bp, Artificial Sequence
  chemically synthesized
gtgagtttcctctatcccaaag

SEQ ID NO: 1272054 - DNA, 22 bp, Artificial Sequence
  chemically synthesized
gattatatgaataatgctttgg

SEQ ID NO: 1272055 - DNA, 22 bp, Artificial Sequence
  chemically synthesized
ggattatatgaataatgctttg

SEQ ID NO: 1272056 - DNA, 22 bp, Artificial Sequence
  chemically synthesized
ttggattatatgaataatgctt

SEQ ID NO: 1272057 - DNA, 22 bp, Artificial Sequence
  chemically synthesized
cctctatcccaaagcattattc

SEQ ID NO: 1272058 - DNA, 22 bp, Artificial Sequence
  chemically synthesized
cttggattatatgaataatgct

SEQ ID NO: 1272059 - DNA, 22 bp, Artificial Sequence
  chemically synthesized
ctctatcccaaagcattattca

SEQ ID NO: 1272060 - DNA, 22 bp, Artificial Sequence
  chemically synthesized
tcttggattatatgaataatgc

SEQ ID NO: 1272061 - DNA, 22 bp, Artificial Sequence
  chemically synthesized
ttcttggattatatgaataatg

SEQ ID NO: 1272062 - DNA, 22 bp, Artificial Sequence
  chemically synthesized
tatcccaaagcattattcatat

SEQ ID NO: 1272063 - DNA, 22 bp, Artificial Sequence
  chemically synthesized
tcccaaagcattattcatataa

SEQ ID NO: 1272064 - DNA, 22 bp, Artificial Sequence
  chemically synthesized
agtttttcttggattatatgaa

SEQ ID NO: 1272065 - DNA, 22 bp, Artificial Sequence
  chemically synthesized
cagtttttcttggattatatga

SEQ ID NO: 1272066 - DNA, 22 bp, Artificial Sequence
  chemically synthesized
tcagtttttcttggattatatg

SEQ ID NO: 1272067 - DNA, 22 bp, Artificial Sequence
  chemically synthesized
tttcagtttttcttggattata

SEQ ID NO: 1272068 - DNA, 22 bp, Artificial Sequence
  chemically synthesized
aagtctctttcagtttttcttg

SEQ ID NO: 1272069 - DNA, 22 bp, Artificial Sequence
  chemically synthesized
ttcatataatccaagaaaaact

SEQ ID NO: 1272070 - DNA, 22 bp, Artificial Sequence
  chemically synthesized
atataatccaagaaaaactgaa

SEQ ID NO: 1272071 - DNA, 22 bp, Artificial Sequence
  chemically synthesized
gtcctcaagtctctttcagttt

SEQ ID NO: 1272072 - DNA, 22 bp, Artificial Sequence
  chemically synthesized
caaattagtcctcaagtctctt

SEQ ID NO: 1272073 - DNA, 22 bp, Artificial Sequence
  chemically synthesized
agatcattgcaaattagtcctc

SEQ ID NO: 1272074 - DNA, 22 bp, Artificial Sequence
  chemically synthesized
aaagagacttgaggactaattt

SEQ ID NO: 1272075 - DNA, 22 bp, Artificial Sequence
  chemically synthesized
aggtacctcagatcattgcaaa

SEQ ID NO: 1272076 - DNA, 22 bp, Artificial Sequence
  chemically synthesized
caggtacctcagatcattgcaa

SEQ ID NO: 1272077 - DNA, 22 bp, Artificial Sequence
  chemically synthesized
gaggactaatttgcaatgatct

SEQ ID NO: 1272078 - DNA, 22 bp, Artificial Sequence
  chemically synthesized
aggactaatttgcaatgatctg

SEQ ID NO: 1272079 - DNA, 22 bp, Artificial Sequence
  chemically synthesized
atttgcaatgatctgaggtacc

SEQ ID NO: 1272080 - DNA, 22 bp, Artificial Sequence
  chemically synthesized
gcaatgatctgaggtacctgaa

SEQ ID NO: 1272081 - DNA, 22 bp, Artificial Sequence
  chemically synthesized
caatgatctgaggtacctgaaa

SEQ ID NO: 1272082 - DNA, 22 bp, Artificial Sequence
  chemically synthesized
aggtacctgaaatattttattc

SEQ ID NO: 1272083 - DNA, 22 bp, Artificial Sequence
  chemically synthesized
aaatattttattcattttattt

SEQ ID NO: 1272084 - DNA, 22 bp, Artificial Sequence
  chemically synthesized
aaagaaatataaaaataaaatg

SEQ ID NO: 1272085 - DNA, 22 bp, Artificial Sequence
  chemically synthesized
caaagaaatataaaaataaaat

SEQ ID NO: 1272086 - DNA, 22 bp, Artificial Sequence
  chemically synthesized
tttcaaagaaatataaaaataa

SEQ ID NO: 1272087 - DNA, 22 bp, Artificial Sequence
  chemically synthesized
atttcaaagaaatataaaaata

SEQ ID NO: 1272088 - DNA, 22 bp, Artificial Sequence
  chemically synthesized
tattcattttatttttatattt

SEQ ID NO: 1272089 - DNA, 22 bp, Artificial Sequence
  chemically synthesized
attcattttatttttatatttc

SEQ ID NO: 1272090 - DNA, 22 bp, Artificial Sequence
  chemically synthesized
ttcattttatttttatatttct

SEQ ID NO: 1272091 - DNA, 22 bp, Artificial Sequence
  chemically synthesized
attttatttttatatttctttg

SEQ ID NO: 1272092 - DNA, 22 bp, Artificial Sequence
  chemically synthesized
tatttttatatttctttgaaat

SEQ ID NO: 1272093 - DNA, 22 bp, Artificial Sequence
  chemically synthesized
atttttatatttctttgaaata

SEQ ID NO: 1272094 - DNA, 22 bp, Artificial Sequence
  chemically synthesized
tttttatatttctttgaaataa

SEQ ID NO: 1272095 - DNA, 22 bp, Artificial Sequence
  chemically synthesized
ttatatttctttgaaataaata

SEQ ID NO: 1272096 - DNA, 22 bp, Artificial Sequence
  chemically synthesized
ggatagtaagtgtatttatttc

SEQ ID NO: 1272097 - DNA, 22 bp, Artificial Sequence
  chemically synthesized
tatatttctttgaaataaatac

SEQ ID NO: 1272098 - DNA, 22 bp, Artificial Sequence
  chemically synthesized
aggatagtaagtgtatttattt

SEQ ID NO: 1272099 - DNA, 22 bp, Artificial Sequence
  chemically synthesized
atatttctttgaaataaataca

SEQ ID NO: 1272100 - DNA, 22 bp, Artificial Sequence
  chemically synthesized
tatttctttgaaataaatacac

SEQ ID NO: 1272101 - DNA, 22 bp, Artificial Sequence
  chemically synthesized
cccttaggatagtaagtgtatt

SEQ ID NO: 1272102 - DNA, 22 bp, Artificial Sequence
  chemically synthesized
ctttgaaataaatacacttact

SEQ ID NO: 1272103 - DNA, 22 bp, Artificial Sequence
  chemically synthesized
tttgaaataaatacacttacta

SEQ ID NO: 1272104 - DNA, 22 bp, Artificial Sequence
  chemically synthesized
tgaaataaatacacttactatc

SEQ ID NO: 1272105 - DNA, 22 bp, Artificial Sequence
  chemically synthesized
gaaataaatacacttactatcc

SEQ ID NO: 1272106 - DNA, 22 bp, Artificial Sequence
  chemically synthesized
aaataaatacacttactatcct

SEQ ID NO: 1272107 - DNA, 22 bp, Artificial Sequence
  chemically synthesized
atatcagagttacccttaggat

SEQ ID NO: 1272108 - DNA, 22 bp, Artificial Sequence
  chemically synthesized
aatatcagagttacccttagga

SEQ ID NO: 1272109 - DNA, 22 bp, Artificial Sequence
  chemically synthesized
taatatcagagttacccttagg

SEQ ID NO: 1272110 - DNA, 22 bp, Artificial Sequence
  chemically synthesized
ttaatatcagagttacccttag

SEQ ID NO: 1272111 - DNA, 22 bp, Artificial Sequence
  chemically synthesized
tttaatatcagagttaccctta

SEQ ID NO: 1272112 - DNA, 22 bp, Artificial Sequence
  chemically synthesized
actatcctaagggtaactctga

SEQ ID NO: 1272113 - DNA, 22 bp, Artificial Sequence
  chemically synthesized
ctatcctaagggtaactctgat

SEQ ID NO: 1272114 - DNA, 22 bp, Artificial Sequence
  chemically synthesized
tcctaagggtaactctgatatt

SEQ ID NO: 1272115 - DNA, 22 bp, Artificial Sequence
  chemically synthesized
agggtaactctgatattaaaaa

SEQ ID NO: 1272116 - DNA, 22 bp, Artificial Sequence
  chemically synthesized
tgatattaaaaagactcacatt

SEQ ID NO: 1272117 - DNA, 22 bp, Artificial Sequence
  chemically synthesized
atattaaaaagactcacattta

SEQ ID NO: 1272118 - DNA, 22 bp, Artificial Sequence
  chemically synthesized
gtatatatgtaataaatgtgag

SEQ ID NO: 1272119 - DNA, 22 bp, Artificial Sequence
  chemically synthesized
tggtatatatgtaataaatgtg

SEQ ID NO: 1272120 - DNA, 22 bp, Artificial Sequence
  chemically synthesized
aaaagactcacatttattacat

SEQ ID NO: 1272121 - DNA, 22 bp, Artificial Sequence
  chemically synthesized
acatttattacatatataccag

SEQ ID NO: 1272122 - DNA, 22 bp, Artificial Sequence
  chemically synthesized
gggatataggctctggtatata

SEQ ID NO: 1272123 - DNA, 22 bp, Artificial Sequence
  chemically synthesized
ggggatataggctctggtatat

SEQ ID NO: 1272124 - DNA, 22 bp, Artificial Sequence
  chemically synthesized
tttggggatataggctctggta

SEQ ID NO: 1272125 - DNA, 22 bp, Artificial Sequence
  chemically synthesized
attacatatataccagagccta

SEQ ID NO: 1272126 - DNA, 22 bp, Artificial Sequence
  chemically synthesized
tatttggggatataggctctgg

SEQ ID NO: 1272127 - DNA, 22 bp, Artificial Sequence
  chemically synthesized
ttacatatataccagagcctat

SEQ ID NO: 1272128 - DNA, 22 bp, Artificial Sequence
  chemically synthesized
catatataccagagcctatatc

SEQ ID NO: 1272129 - DNA, 22 bp, Artificial Sequence
  chemically synthesized
ataaataattctatttggggat

SEQ ID NO: 1272130 - DNA, 22 bp, Artificial Sequence
  chemically synthesized
tcataaataattctatttgggg

SEQ ID NO: 1272131 - DNA, 22 bp, Artificial Sequence
  chemically synthesized
ctcataaataattctatttggg

SEQ ID NO: 1272132 - DNA, 22 bp, Artificial Sequence
  chemically synthesized
aggtttctcataaataattcta

SEQ ID NO: 1272133 - DNA, 22 bp, Artificial Sequence
  chemically synthesized
tatccccaaatagaattattta

SEQ ID NO: 1272134 - DNA, 22 bp, Artificial Sequence
  chemically synthesized
cgttaaggtttctcataaataa

SEQ ID NO: 1272135 - DNA, 22 bp, Artificial Sequence
  chemically synthesized
gcgttaaggtttctcataaata

SEQ ID NO: 1272136 - DNA, 22 bp, Artificial Sequence
  chemically synthesized
tttgcgttaaggtttctcataa

SEQ ID NO: 1272137 - DNA, 22 bp, Artificial Sequence
  chemically synthesized
atttgcgttaaggtttctcata

SEQ ID NO: 1272138 - DNA, 22 bp, Artificial Sequence
  chemically synthesized
tatttgcgttaaggtttctcat

SEQ ID NO: 1272139 - DNA, 22 bp, Artificial Sequence
  chemically synthesized
gtatctttatttgcgttaaggt

SEQ ID NO: 1272140 - DNA, 22 bp, Artificial Sequence
  chemically synthesized
agtatctttatttgcgttaagg

SEQ ID NO: 1272141 - DNA, 22 bp, Artificial Sequence
  chemically synthesized
tttatgagaaaccttaacgcaa

SEQ ID NO: 1272142 - DNA, 22 bp, Artificial Sequence
  chemically synthesized
atgagaaaccttaacgcaaata

SEQ ID NO: 1272143 - DNA, 22 bp, Artificial Sequence
  chemically synthesized
tgagaaaccttaacgcaaataa

SEQ ID NO: 1272144 - DNA, 22 bp, Artificial Sequence
  chemically synthesized
aacgcaaataaagatactaagc

SEQ ID NO: 1272145 - DNA, 22 bp, Artificial Sequence
  chemically synthesized
acgcaaataaagatactaagcc

SEQ ID NO: 1272146 - DNA, 22 bp, Artificial Sequence
  chemically synthesized
agccctcggggcctcttgtgct

SEQ ID NO: 1272147 - DNA, 22 bp, Artificial Sequence
  chemically synthesized
ggggcctcttgtgcttttatat

SEQ ID NO: 1272148 - DNA, 22 bp, Artificial Sequence
  chemically synthesized
aaaagaggagatgtcaaatata

SEQ ID NO: 1272149 - DNA, 22 bp, Artificial Sequence
  chemically synthesized
aaaaagaggagatgtcaaatat

SEQ ID NO: 1272150 - DNA, 22 bp, Artificial Sequence
  chemically synthesized
ttgtgcttttatatttgacatc

SEQ ID NO: 1272151 - DNA, 22 bp, Artificial Sequence
  chemically synthesized
gtgcttttatatttgacatctc

SEQ ID NO: 1272152 - DNA, 22 bp, Artificial Sequence
  chemically synthesized
tgcttttatatttgacatctcc

SEQ ID NO: 1272153 - DNA, 22 bp, Artificial Sequence
  chemically synthesized
ttatatttgacatctcctcttt

SEQ ID NO: 1272154 - DNA, 22 bp, Artificial Sequence
  chemically synthesized
tatatttgacatctcctctttt

SEQ ID NO: 1272155 - DNA, 22 bp, Artificial Sequence
  chemically synthesized
catgaatatttaaaaagaggag

SEQ ID NO: 1272156 - DNA, 22 bp, Artificial Sequence
  chemically synthesized
atatttgacatctcctcttttt

SEQ ID NO: 1272157 - DNA, 22 bp, Artificial Sequence
  chemically synthesized
tatttgacatctcctcttttta

SEQ ID NO: 1272158 - DNA, 22 bp, Artificial Sequence
  chemically synthesized
tacatgaatatttaaaaagagg

SEQ ID NO: 1272159 - DNA, 22 bp, Artificial Sequence
  chemically synthesized
ttctacatgaatatttaaaaag

SEQ ID NO: 1272160 - DNA, 22 bp, Artificial Sequence
  chemically synthesized
gacatctcctctttttaaatat

SEQ ID NO: 1272161 - DNA, 22 bp, Artificial Sequence
  chemically synthesized
acatctcctctttttaaatatt

SEQ ID NO: 1272162 - DNA, 22 bp, Artificial Sequence
  chemically synthesized
aggctattctacatgaatattt

SEQ ID NO: 1272163 - DNA, 22 bp, Artificial Sequence
  chemically synthesized
aaggctattctacatgaatatt

SEQ ID NO: 1272164 - DNA, 22 bp, Artificial Sequence
  chemically synthesized
ctctttttaaatattcatgtag

SEQ ID NO: 1272165 - DNA, 22 bp, Artificial Sequence
  chemically synthesized
cttaaggctattctacatgaat

SEQ ID NO: 1272166 - DNA, 22 bp, Artificial Sequence
  chemically synthesized
tacttaaggctattctacatga

SEQ ID NO: 1272167 - DNA, 22 bp, Artificial Sequence
  chemically synthesized
tttttaaatattcatgtagaat

SEQ ID NO: 1272168 - DNA, 22 bp, Artificial Sequence
  chemically synthesized
ctacttaaggctattctacatg

SEQ ID NO: 1272169 - DNA, 22 bp, Artificial Sequence
  chemically synthesized
tttaaatattcatgtagaatag

SEQ ID NO: 1272170 - DNA, 22 bp, Artificial Sequence
  chemically synthesized
ttaaatattcatgtagaatagc

SEQ ID NO: 1272171 - DNA, 22 bp, Artificial Sequence
  chemically synthesized
taaatattcatgtagaatagcc

SEQ ID NO: 1272172 - DNA, 22 bp, Artificial Sequence
  chemically synthesized
aaatattcatgtagaatagcct

SEQ ID NO: 1272173 - DNA, 22 bp, Artificial Sequence
  chemically synthesized
aatattcatgtagaatagcctt

SEQ ID NO: 1272174 - DNA, 22 bp, Artificial Sequence
  chemically synthesized
aagtttctacttaaggctattc

SEQ ID NO: 1272175 - DNA, 22 bp, Artificial Sequence
  chemically synthesized
caagtttctacttaaggctatt

SEQ ID NO: 1272176 - DNA, 22 bp, Artificial Sequence
  chemically synthesized
atgtagaatagccttaagtaga

SEQ ID NO: 1272177 - DNA, 22 bp, Artificial Sequence
  chemically synthesized
gcacatcttcaagtttctactt

SEQ ID NO: 1272178 - DNA, 22 bp, Artificial Sequence
  chemically synthesized
tactagcacatcttcaagtttc

SEQ ID NO: 1272179 - DNA, 22 bp, Artificial Sequence
  chemically synthesized
atactagcacatcttcaagttt

SEQ ID NO: 1272180 - DNA, 22 bp, Artificial Sequence
  chemically synthesized
tatactagcacatcttcaagtt

SEQ ID NO: 1272181 - DNA, 22 bp, Artificial Sequence
  chemically synthesized
aagtagaaacttgaagatgtgc

SEQ ID NO: 1272182 - DNA, 22 bp, Artificial Sequence
  chemically synthesized
agtagaaacttgaagatgtgct

SEQ ID NO: 1272183 - DNA, 22 bp, Artificial Sequence
  chemically synthesized
aggaaaatgttttatactagca

SEQ ID NO: 1272184 - DNA, 22 bp, Artificial Sequence
  chemically synthesized
gaagatgtgctagtataaaaca

SEQ ID NO: 1272185 - DNA, 22 bp, Artificial Sequence
  chemically synthesized
aagatgtgctagtataaaacat

SEQ ID NO: 1272186 - DNA, 22 bp, Artificial Sequence
  chemically synthesized
gtataaaacattttcctgagcc

SEQ ID NO: 1272187 - DNA, 22 bp, Artificial Sequence
  chemically synthesized
tcctgagccactttattgttga

SEQ ID NO: 1272188 - DNA, 22 bp, Artificial Sequence
  chemically synthesized
cctgagccactttattgttgat

SEQ ID NO: 1272189 - DNA, 22 bp, Artificial Sequence
  chemically synthesized
agaaaacaccccatcaacaata

SEQ ID NO: 1272190 - DNA, 22 bp, Artificial Sequence
  chemically synthesized
ctgagccactttattgttgatg

SEQ ID NO: 1272191 - DNA, 22 bp, Artificial Sequence
  chemically synthesized
agccactttattgttgatgggg

SEQ ID NO: 1272192 - DNA, 22 bp, Artificial Sequence
  chemically synthesized
tattgttgatggggtgttttct

SEQ ID NO: 1272193 - DNA, 22 bp, Artificial Sequence
  chemically synthesized
agatccagattgagaaaacacc

SEQ ID NO: 1272194 - DNA, 22 bp, Artificial Sequence
  chemically synthesized
attgttgatggggtgttttctc

SEQ ID NO: 1272195 - DNA, 22 bp, Artificial Sequence
  chemically synthesized
ttgttgatggggtgttttctca

SEQ ID NO: 1272196 - DNA, 22 bp, Artificial Sequence
  chemically synthesized
ctgagatccagattgagaaaac

SEQ ID NO: 1272197 - DNA, 22 bp, Artificial Sequence
  chemically synthesized
actgagatccagattgagaaaa

SEQ ID NO: 1272198 - DNA, 22 bp, Artificial Sequence
  chemically synthesized
ttgatggggtgttttctcaatc

SEQ ID NO: 1272199 - DNA, 22 bp, Artificial Sequence
  chemically synthesized
atggggtgttttctcaatctgg

SEQ ID NO: 1272200 - DNA, 22 bp, Artificial Sequence
  chemically synthesized
agggaaagacttactgagatcc

SEQ ID NO: 1272201 - DNA, 22 bp, Artificial Sequence
  chemically synthesized
aagggaaagacttactgagatc

SEQ ID NO: 1272202 - DNA, 22 bp, Artificial Sequence
  chemically synthesized
tctcaatctggatctcagtaag

SEQ ID NO: 1272203 - DNA, 22 bp, Artificial Sequence
  chemically synthesized
ctcaatctggatctcagtaagt

SEQ ID NO: 1272204 - DNA, 22 bp, Artificial Sequence
  chemically synthesized
tcaatctggatctcagtaagtc

SEQ ID NO: 1272205 - DNA, 22 bp, Artificial Sequence
  chemically synthesized
atttaagggaaagacttactga

SEQ ID NO: 1272206 - DNA, 22 bp, Artificial Sequence
  chemically synthesized
catttaagggaaagacttactg

SEQ ID NO: 1272207 - DNA, 22 bp, Artificial Sequence
  chemically synthesized
aatctggatctcagtaagtctt

SEQ ID NO: 1272208 - DNA, 22 bp, Artificial Sequence
  chemically synthesized
tcatttaagggaaagacttact

SEQ ID NO: 1272209 - DNA, 22 bp, Artificial Sequence
  chemically synthesized
ttcatttaagggaaagacttac

SEQ ID NO: 1272210 - DNA, 22 bp, Artificial Sequence
  chemically synthesized
tttcatttaagggaaagactta

SEQ ID NO: 1272211 - DNA, 22 bp, Artificial Sequence
  chemically synthesized
gatctcagtaagtctttccctt

SEQ ID NO: 1272212 - DNA, 22 bp, Artificial Sequence
  chemically synthesized
agtaagtctttcccttaaatga

SEQ ID NO: 1272213 - DNA, 22 bp, Artificial Sequence
  chemically synthesized
agaaatagccctttttcattta

SEQ ID NO: 1272214 - DNA, 22 bp, Artificial Sequence
  chemically synthesized
gagaaatagccctttttcattt

SEQ ID NO: 1272215 - DNA, 22 bp, Artificial Sequence
  chemically synthesized
tcccttaaatgaaaaagggcta

SEQ ID NO: 1272216 - DNA, 22 bp, Artificial Sequence
  chemically synthesized
cccttaaatgaaaaagggctat

SEQ ID NO: 1272217 - DNA, 22 bp, Artificial Sequence
  chemically synthesized
ccttaaatgaaaaagggctatt

SEQ ID NO: 1272218 - DNA, 22 bp, Artificial Sequence
  chemically synthesized
atacatggtttgagaaatagcc

SEQ ID NO: 1272219 - DNA, 22 bp, Artificial Sequence
  chemically synthesized
aaatgaaaaagggctatttctc

SEQ ID NO: 1272220 - DNA, 22 bp, Artificial Sequence
  chemically synthesized
aatgaaaaagggctatttctca

SEQ ID NO: 1272221 - DNA, 22 bp, Artificial Sequence
  chemically synthesized
gcattcatacatggtttgagaa

SEQ ID NO: 1272222 - DNA, 22 bp, Artificial Sequence
  chemically synthesized
tttctcaaaccatgtatgaatg

SEQ ID NO: 1272223 - DNA, 22 bp, Artificial Sequence
  chemically synthesized
aacaaatgctggcattcataca

SEQ ID NO: 1272224 - DNA, 22 bp, Artificial Sequence
  chemically synthesized
ctcaaaccatgtatgaatgcca

SEQ ID NO: 1272225 - DNA, 22 bp, Artificial Sequence
  chemically synthesized
tcaaaccatgtatgaatgccag

SEQ ID NO: 1272226 - DNA, 22 bp, Artificial Sequence
  chemically synthesized
aaaccatgtatgaatgccagca

SEQ ID NO: 1272227 - DNA, 22 bp, Artificial Sequence
  chemically synthesized
gttcagcttctttttttgtttg

SEQ ID NO: 1272228 - DNA, 22 bp, Artificial Sequence
  chemically synthesized
aaaaaaaaaaaacaaacaaaaa

SEQ ID NO: 1272229 - DNA, 22 bp, Artificial Sequence
  chemically synthesized
ttcagcttctttttttgtttgt

SEQ ID NO: 1272230 - DNA, 22 bp, Artificial Sequence
  chemically synthesized
agcttctttttttgtttgtttt

SEQ ID NO: 1272231 - DNA, 22 bp, Artificial Sequence
  chemically synthesized
agtctcaaaaaaaaaaaacaaa

SEQ ID NO: 1272232 - DNA, 22 bp, Artificial Sequence
  chemically synthesized
ctttttttgtttgttttttttt

SEQ ID NO: 1272233 - DNA, 22 bp, Artificial Sequence
  chemically synthesized
tttttttgtttgtttttttttt

SEQ ID NO: 1272234 - DNA, 22 bp, Artificial Sequence
  chemically synthesized
tttttgtttgtttttttttttt

SEQ ID NO: 1272235 - DNA, 22 bp, Artificial Sequence
  chemically synthesized
ttttgtttgttttttttttttg

SEQ ID NO: 1272236 - DNA, 22 bp, Artificial Sequence
  chemically synthesized
tttgtttgttttttttttttga

SEQ ID NO: 1272237 - DNA, 22 bp, Artificial Sequence
  chemically synthesized
ttgtttgttttttttttttgag

SEQ ID NO: 1272238 - DNA, 22 bp, Artificial Sequence
  chemically synthesized
tgtttgttttttttttttgaga

SEQ ID NO: 1272239 - DNA, 22 bp, Artificial Sequence
  chemically synthesized
gtttgttttttttttttgagac

SEQ ID NO: 1272240 - DNA, 22 bp, Artificial Sequence
  chemically synthesized
tttgttttttttttttgagact

SEQ ID NO: 1272241 - DNA, 22 bp, Artificial Sequence
  chemically synthesized
gttttttttttttgagactcag

SEQ ID NO: 1272242 - DNA, 22 bp, Artificial Sequence
  chemically synthesized
ttttttttttttgagactcagt

SEQ ID NO: 1272243 - DNA, 22 bp, Artificial Sequence
  chemically synthesized
ggcgacagagtgagactgagtc

SEQ ID NO: 1272244 - DNA, 22 bp, Artificial Sequence
  chemically synthesized
tttttttttgagactcagtctc

SEQ ID NO: 1272245 - DNA, 22 bp, Artificial Sequence
  chemically synthesized
ttttttttgagactcagtctca

SEQ ID NO: 1272246 - DNA, 22 bp, Artificial Sequence
  chemically synthesized
tttttttgagactcagtctcac

SEQ ID NO: 1272247 - DNA, 22 bp, Artificial Sequence
  chemically synthesized
ttttttgagactcagtctcact

SEQ ID NO: 1272248 - DNA, 22 bp, Artificial Sequence
  chemically synthesized
tttttgagactcagtctcactc

SEQ ID NO: 1272249 - DNA, 22 bp, Artificial Sequence
  chemically synthesized
ttttgagactcagtctcactct

SEQ ID NO: 1272250 - DNA, 22 bp, Artificial Sequence
  chemically synthesized
tttgagactcagtctcactctg

SEQ ID NO: 1272251 - DNA, 22 bp, Artificial Sequence
  chemically synthesized
cagcctgggcgacagagtgaga

SEQ ID NO: 1272252 - DNA, 22 bp, Artificial Sequence
  chemically synthesized
ttgagactcagtctcactctgt

SEQ ID NO: 1272253 - DNA, 22 bp, Artificial Sequence
  chemically synthesized
tgagactcagtctcactctgtc

SEQ ID NO: 1272254 - DNA, 22 bp, Artificial Sequence
  chemically synthesized
gagactcagtctcactctgtcg

SEQ ID NO: 1272255 - DNA, 22 bp, Artificial Sequence
  chemically synthesized
agactcagtctcactctgtcgc

SEQ ID NO: 1272256 - DNA, 22 bp, Artificial Sequence
  chemically synthesized
cactccagcctgggcgacagag

SEQ ID NO: 1272257 - DNA, 22 bp, Artificial Sequence
  chemically synthesized
agtctcactctgtcgcccaggc

SEQ ID NO: 1272258 - DNA, 22 bp, Artificial Sequence
  chemically synthesized
tgccactgcactccagcctggg

SEQ ID NO: 1272259 - DNA, 22 bp, Artificial Sequence
  chemically synthesized
actctgtcgcccaggctggagt

SEQ ID NO: 1272260 - DNA, 22 bp, Artificial Sequence
  chemically synthesized
tgtcgcccaggctggagtgcag

SEQ ID NO: 1272261 - DNA, 22 bp, Artificial Sequence
  chemically synthesized
tcgcccaggctggagtgcagtg

SEQ ID NO: 1272262 - DNA, 22 bp, Artificial Sequence
  chemically synthesized
cagtgaaccgcgattgtgccac

SEQ ID NO: 1272263 - DNA, 22 bp, Artificial Sequence
  chemically synthesized
gagtgcagtggcacaatcgcgg

SEQ ID NO: 1272264 - DNA, 22 bp, Artificial Sequence
  chemically synthesized
aacccaggaggcagaggttgca

SEQ ID NO: 1272265 - DNA, 22 bp, Artificial Sequence
  chemically synthesized
gaacccaggaggcagaggttgc

SEQ ID NO: 1272266 - DNA, 22 bp, Artificial Sequence
  chemically synthesized
actgcaacctctgcctcctggg

SEQ ID NO: 1272267 - DNA, 22 bp, Artificial Sequence
  chemically synthesized
caacctctgcctcctgggttca

SEQ ID NO: 1272268 - DNA, 22 bp, Artificial Sequence
  chemically synthesized
aggcgggagaatcgcttgaacc

SEQ ID NO: 1272269 - DNA, 22 bp, Artificial Sequence
  chemically synthesized
tgcctcctgggttcaagcgatt

SEQ ID NO: 1272270 - DNA, 22 bp, Artificial Sequence
  chemically synthesized
cctcctgggttcaagcgattct

SEQ ID NO: 1272271 - DNA, 22 bp, Artificial Sequence
  chemically synthesized
ctgggttcaagcgattctcccg

SEQ ID NO: 1272272 - DNA, 22 bp, Artificial Sequence
  chemically synthesized
ggggagctgaggcgggagaatc

SEQ ID NO: 1272273 - DNA, 22 bp, Artificial Sequence
  chemically synthesized
ggttcaagcgattctcccgcct

SEQ ID NO: 1272274 - DNA, 22 bp, Artificial Sequence
  chemically synthesized
ctcggggagctgaggcgggaga

SEQ ID NO: 1272275 - DNA, 22 bp, Artificial Sequence
  chemically synthesized
aagcgattctcccgcctcagct

SEQ ID NO: 1272276 - DNA, 22 bp, Artificial Sequence
  chemically synthesized
taatcccagctactcggggagc

SEQ ID NO: 1272277 - DNA, 22 bp, Artificial Sequence
  chemically synthesized
gtaatcccagctactcggggag

SEQ ID NO: 1272278 - DNA, 22 bp, Artificial Sequence
  chemically synthesized
tcccgcctcagctccccgagta

SEQ ID NO: 1272279 - DNA, 22 bp, Artificial Sequence
  chemically synthesized
ccgcctcagctccccgagtagc

SEQ ID NO: 1272280 - DNA, 22 bp, Artificial Sequence
  chemically synthesized
agctccccgagtagctgggatt

SEQ ID NO: 1272281 - DNA, 22 bp, Artificial Sequence
  chemically synthesized
cccgagtagctgggattacaag

SEQ ID NO: 1272282 - DNA, 22 bp, Artificial Sequence
  chemically synthesized
gccgggtgcagtggtacatgct

SEQ ID NO: 1272283 - DNA, 22 bp, Artificial Sequence
  chemically synthesized
ggattacaagcatgtaccactg

SEQ ID NO: 1272284 - DNA, 22 bp, Artificial Sequence
  chemically synthesized
caagcatgtaccactgcacccg

SEQ ID NO: 1272285 - DNA, 22 bp, Artificial Sequence
  chemically synthesized
aaaatacaaaaattagccgggt

SEQ ID NO: 1272286 - DNA, 22 bp, Artificial Sequence
  chemically synthesized
tactaaaaatacaaaaattagc

SEQ ID NO: 1272287 - DNA, 22 bp, Artificial Sequence
  chemically synthesized
cacccggctaatttttgtattt

SEQ ID NO: 1272288 - DNA, 22 bp, Artificial Sequence
  chemically synthesized
atttttgtatttttagtacaga

SEQ ID NO: 1272289 - DNA, 22 bp, Artificial Sequence
  chemically synthesized
ttgtatttttagtacagatggg

SEQ ID NO: 1272290 - DNA, 22 bp, Artificial Sequence
  chemically synthesized
tgtatttttagtacagatggga

SEQ ID NO: 1272291 - DNA, 22 bp, Artificial Sequence
  chemically synthesized
gtatttttagtacagatgggat

SEQ ID NO: 1272292 - DNA, 22 bp, Artificial Sequence
  chemically synthesized
tatttttagtacagatgggatt

SEQ ID NO: 1272293 - DNA, 22 bp, Artificial Sequence
  chemically synthesized
accaacgcggtgaaatcccatc

SEQ ID NO: 1272294 - DNA, 22 bp, Artificial Sequence
  chemically synthesized
ttagtacagatgggatttcacc

SEQ ID NO: 1272295 - DNA, 22 bp, Artificial Sequence
  chemically synthesized
tagtacagatgggatttcaccg

SEQ ID NO: 1272296 - DNA, 22 bp, Artificial Sequence
  chemically synthesized
agtacagatgggatttcaccgc

SEQ ID NO: 1272297 - DNA, 22 bp, Artificial Sequence
  chemically synthesized
gtacagatgggatttcaccgcg

SEQ ID NO: 1272298 - DNA, 22 bp, Artificial Sequence
  chemically synthesized
aagaccagcctgaccaacgcgg

SEQ ID NO: 1272299 - DNA, 22 bp, Artificial Sequence
  chemically synthesized
caccgcgttggtcaggctggtc

SEQ ID NO: 1272300 - DNA, 22 bp, Artificial Sequence
  chemically synthesized
accgcgttggtcaggctggtct

SEQ ID NO: 1272301 - DNA, 22 bp, Artificial Sequence
  chemically synthesized
gtcaggctggtcttgaactcct

SEQ ID NO: 1272302 - DNA, 22 bp, Artificial Sequence
  chemically synthesized
gtcttgaactcctgacctcatg

SEQ ID NO: 1272303 - DNA, 22 bp, Artificial Sequence
  chemically synthesized
gaactcctgacctcatgatccg

SEQ ID NO: 1272304 - DNA, 22 bp, Artificial Sequence
  chemically synthesized
aactcctgacctcatgatccgc

SEQ ID NO: 1272305 - DNA, 22 bp, Artificial Sequence
  chemically synthesized
ggaagcagaggcgggcggatca

SEQ ID NO: 1272306 - DNA, 22 bp, Artificial Sequence
  chemically synthesized
gggaagcagaggcgggcggatc

SEQ ID NO: 1272307 - DNA, 22 bp, Artificial Sequence
  chemically synthesized
tgggaagcagaggcgggcggat

SEQ ID NO: 1272308 - DNA, 22 bp, Artificial Sequence
  chemically synthesized
ctgacctcatgatccgcccgcc

SEQ ID NO: 1272309 - DNA, 22 bp, Artificial Sequence
  chemically synthesized
acctcatgatccgcccgcctct

SEQ ID NO: 1272310 - DNA, 22 bp, Artificial Sequence
  chemically synthesized
atgatccgcccgcctctgcttc

SEQ ID NO: 1272311 - DNA, 22 bp, Artificial Sequence
  chemically synthesized
taatcccagcactttgggaagc

SEQ ID NO: 1272312 - DNA, 22 bp, Artificial Sequence
  chemically synthesized
aggcctgtaatcccagcacttt

SEQ ID NO: 1272313 - DNA, 22 bp, Artificial Sequence
  chemically synthesized
tgcttcccaaagtgctgggatt

SEQ ID NO: 1272314 - DNA, 22 bp, Artificial Sequence
  chemically synthesized
cttcccaaagtgctgggattac

SEQ ID NO: 1272315 - DNA, 22 bp, Artificial Sequence
  chemically synthesized
cccaaagtgctgggattacagg

SEQ ID NO: 1272316 - DNA, 22 bp, Artificial Sequence
  chemically synthesized
ccaaagtgctgggattacaggc

SEQ ID NO: 1272317 - DNA, 22 bp, Artificial Sequence
  chemically synthesized
ggcacagtggctcaggcctgta

SEQ ID NO: 1272318 - DNA, 22 bp, Artificial Sequence
  chemically synthesized
ggattacaggcctgagccactg

SEQ ID NO: 1272319 - DNA, 22 bp, Artificial Sequence
  chemically synthesized
aacaaggctgggcacagtggct

SEQ ID NO: 1272320 - DNA, 22 bp, Artificial Sequence
  chemically synthesized
caggcctgagccactgtgccca

SEQ ID NO: 1272321 - DNA, 22 bp, Artificial Sequence
  chemically synthesized
aaggagctgaacaaggctgggc

SEQ ID NO: 1272322 - DNA, 22 bp, Artificial Sequence
  chemically synthesized
agccactgtgcccagccttgtt

SEQ ID NO: 1272323 - DNA, 22 bp, Artificial Sequence
  chemically synthesized
aagtaagctaaaggagctgaac

SEQ ID NO: 1272324 - DNA, 22 bp, Artificial Sequence
  chemically synthesized
tgcccagccttgttcagctcct

SEQ ID NO: 1272325 - DNA, 22 bp, Artificial Sequence
  chemically synthesized
taaagtaagctaaaggagctga

SEQ ID NO: 1272326 - DNA, 22 bp, Artificial Sequence
  chemically synthesized
ctctaaagtaagctaaaggagc

SEQ ID NO: 1272327 - DNA, 22 bp, Artificial Sequence
  chemically synthesized
tgactgctctaaagtaagctaa

SEQ ID NO: 1272328 - DNA, 22 bp, Artificial Sequence
  chemically synthesized
gttcagctcctttagcttactt

SEQ ID NO: 1272329 - DNA, 22 bp, Artificial Sequence
  chemically synthesized
ttcagctcctttagcttacttt

SEQ ID NO: 1272330 - DNA, 22 bp, Artificial Sequence
  chemically synthesized
agctcctttagcttactttaga

SEQ ID NO: 1272331 - DNA, 22 bp, Artificial Sequence
  chemically synthesized
ctttagcttactttagagcagt

SEQ ID NO: 1272332 - DNA, 22 bp, Artificial Sequence
  chemically synthesized
tagcttactttagagcagtcac

SEQ ID NO: 1272333 - DNA, 22 bp, Artificial Sequence
  chemically synthesized
agcttactttagagcagtcaca

SEQ ID NO: 1272334 - DNA, 22 bp, Artificial Sequence
  chemically synthesized
gcttactttagagcagtcacag

SEQ ID NO: 1272335 - DNA, 22 bp, Artificial Sequence
  chemically synthesized
gaaaagtggcaacctgtgactg

SEQ ID NO: 1272336 - DNA, 22 bp, Artificial Sequence
  chemically synthesized
actttagagcagtcacaggttg

SEQ ID NO: 1272337 - DNA, 22 bp, Artificial Sequence
  chemically synthesized
ctttagagcagtcacaggttgc

SEQ ID NO: 1272338 - DNA, 22 bp, Artificial Sequence
  chemically synthesized
atgctggaaaagtggcaacctg

SEQ ID NO: 1272339 - DNA, 22 bp, Artificial Sequence
  chemically synthesized
tagagcagtcacaggttgccac

SEQ ID NO: 1272340 - DNA, 22 bp, Artificial Sequence
  chemically synthesized
agagcagtcacaggttgccact

SEQ ID NO: 1272341 - DNA, 22 bp, Artificial Sequence
  chemically synthesized
gagcagtcacaggttgccactt

SEQ ID NO: 1272342 - DNA, 22 bp, Artificial Sequence
  chemically synthesized
tccctgatgctggaaaagtggc

SEQ ID NO: 1272343 - DNA, 22 bp, Artificial Sequence
  chemically synthesized
gtccctgatgctggaaaagtgg

SEQ ID NO: 1272344 - DNA, 22 bp, Artificial Sequence
  chemically synthesized
tgtccctgatgctggaaaagtg

SEQ ID NO: 1272345 - DNA, 22 bp, Artificial Sequence
  chemically synthesized
aactttgtccctgatgctggaa

SEQ ID NO: 1272346 - DNA, 22 bp, Artificial Sequence
  chemically synthesized
atctgaactttgtccctgatgc

SEQ ID NO: 1272347 - DNA, 22 bp, Artificial Sequence
  chemically synthesized
ccacttttccagcatcagggac

SEQ ID NO: 1272348 - DNA, 22 bp, Artificial Sequence
  chemically synthesized
ttccagcatcagggacaaagtt

SEQ ID NO: 1272349 - DNA, 22 bp, Artificial Sequence
  chemically synthesized
tccagcatcagggacaaagttc

SEQ ID NO: 1272350 - DNA, 22 bp, Artificial Sequence
  chemically synthesized
taaaattgatctgaactttgtc

SEQ ID NO: 1272351 - DNA, 22 bp, Artificial Sequence
  chemically synthesized
ccagcatcagggacaaagttca

SEQ ID NO: 1272352 - DNA, 22 bp, Artificial Sequence
  chemically synthesized
cagcatcagggacaaagttcag

SEQ ID NO: 1272353 - DNA, 22 bp, Artificial Sequence
  chemically synthesized
gaatcgacgtgttataaaattg

SEQ ID NO: 1272354 - DNA, 22 bp, Artificial Sequence
  chemically synthesized
agaatcgacgtgttataaaatt

SEQ ID NO: 1272355 - DNA, 22 bp, Artificial Sequence
  chemically synthesized
tagaatcgacgtgttataaaat

SEQ ID NO: 1272356 - DNA, 22 bp, Artificial Sequence
  chemically synthesized
ttagaatcgacgtgttataaaa

SEQ ID NO: 1272357 - DNA, 22 bp, Artificial Sequence
  chemically synthesized
agatcaattttataacacgtcg

SEQ ID NO: 1272358 - DNA, 22 bp, Artificial Sequence
  chemically synthesized
tgatttttagaatcgacgtgtt

SEQ ID NO: 1272359 - DNA, 22 bp, Artificial Sequence
  chemically synthesized
tataacacgtcgattctaaaaa

SEQ ID NO: 1272360 - DNA, 22 bp, Artificial Sequence
  chemically synthesized
ataacacgtcgattctaaaaat

SEQ ID NO: 1272361 - DNA, 22 bp, Artificial Sequence
  chemically synthesized
taacacgtcgattctaaaaatc

SEQ ID NO: 1272362 - DNA, 22 bp, Artificial Sequence
  chemically synthesized
ccacgagactgtgatttttaga

SEQ ID NO: 1272363 - DNA, 22 bp, Artificial Sequence
  chemically synthesized
cacctcccacgagactgtgatt

SEQ ID NO: 1272364 - DNA, 22 bp, Artificial Sequence
  chemically synthesized
taaaaatcacagtctcgtggga

SEQ ID NO: 1272365 - DNA, 22 bp, Artificial Sequence
  chemically synthesized
aaaatcacagtctcgtgggagg

SEQ ID NO: 1272366 - DNA, 22 bp, Artificial Sequence
  chemically synthesized
tgacagatattccacctcccac

SEQ ID NO: 1272367 - DNA, 22 bp, Artificial Sequence
  chemically synthesized
tgagttgtgacagatattccac

SEQ ID NO: 1272368 - DNA, 22 bp, Artificial Sequence
  chemically synthesized
gtgggaggtggaatatctgtca

SEQ ID NO: 1272369 - DNA, 22 bp, Artificial Sequence
  chemically synthesized
tcacaactcataacatatttcc

SEQ ID NO: 1272370 - DNA, 22 bp, Artificial Sequence
  chemically synthesized
ataacatatttcctactgcttc

SEQ ID NO: 1272371 - DNA, 22 bp, Artificial Sequence
  chemically synthesized
atatatggaacatgaagcagta

SEQ ID NO: 1272372 - DNA, 22 bp, Artificial Sequence
  chemically synthesized
taatatatggaacatgaagcag

SEQ ID NO: 1272373 - DNA, 22 bp, Artificial Sequence
  chemically synthesized
ctaatatatggaacatgaagca

SEQ ID NO: 1272374 - DNA, 22 bp, Artificial Sequence
  chemically synthesized
cctactgcttcatgttccatat

SEQ ID NO: 1272375 - DNA, 22 bp, Artificial Sequence
  chemically synthesized
ctactgcttcatgttccatata

SEQ ID NO: 1272376 - DNA, 22 bp, Artificial Sequence
  chemically synthesized
ctgcttcatgttccatatatta

SEQ ID NO: 1272377 - DNA, 22 bp, Artificial Sequence
  chemically synthesized
cttcatgttccatatattagaa

SEQ ID NO: 1272378 - DNA, 22 bp, Artificial Sequence
  chemically synthesized
gtggtgaatgggtttctaatat

SEQ ID NO: 1272379 - DNA, 22 bp, Artificial Sequence
  chemically synthesized
catgttccatatattagaaacc

SEQ ID NO: 1272380 - DNA, 22 bp, Artificial Sequence
  chemically synthesized
atgttccatatattagaaaccc

SEQ ID NO: 1272381 - DNA, 22 bp, Artificial Sequence
  chemically synthesized
catatattagaaacccattcac

SEQ ID NO: 1272382 - DNA, 22 bp, Artificial Sequence
  chemically synthesized
gggaaattagtggtgaatgggt

SEQ ID NO: 1272383 - DNA, 22 bp, Artificial Sequence
  chemically synthesized
ggggaaattagtggtgaatggg

SEQ ID NO: 1272384 - DNA, 22 bp, Artificial Sequence
  chemically synthesized
taaatttggggaaattagtggt

SEQ ID NO: 1272385 - DNA, 22 bp, Artificial Sequence
  chemically synthesized
gaaacccattcaccactaattt

SEQ ID NO: 1272386 - DNA, 22 bp, Artificial Sequence
  chemically synthesized
gtaaatttggggaaattagtgg

SEQ ID NO: 1272387 - DNA, 22 bp, Artificial Sequence
  chemically synthesized
acttgtaaatttggggaaatta

SEQ ID NO: 1272388 - DNA, 22 bp, Artificial Sequence
  chemically synthesized
aacttgtaaatttggggaaatt

SEQ ID NO: 1272389 - DNA, 22 bp, Artificial Sequence
  chemically synthesized
ttaacttgtaaatttggggaaa

SEQ ID NO: 1272390 - DNA, 22 bp, Artificial Sequence
  chemically synthesized
accactaatttccccaaattta

SEQ ID NO: 1272391 - DNA, 22 bp, Artificial Sequence
  chemically synthesized
aactcttaacttgtaaatttgg

SEQ ID NO: 1272392 - DNA, 22 bp, Artificial Sequence
  chemically synthesized
aaactcttaacttgtaaatttg

SEQ ID NO: 1272393 - DNA, 22 bp, Artificial Sequence
  chemically synthesized
atttccccaaatttacaagtta

SEQ ID NO: 1272394 - DNA, 22 bp, Artificial Sequence
  chemically synthesized
taatttaaactcttaacttgta

SEQ ID NO: 1272395 - DNA, 22 bp, Artificial Sequence
  chemically synthesized
ccccaaatttacaagttaagag

SEQ ID NO: 1272396 - DNA, 22 bp, Artificial Sequence
  chemically synthesized
cccaaatttacaagttaagagt

SEQ ID NO: 1272397 - DNA, 22 bp, Artificial Sequence
  chemically synthesized
taaaactataatttaaactctt

SEQ ID NO: 1272398 - DNA, 22 bp, Artificial Sequence
  chemically synthesized
ataaaactataatttaaactct

SEQ ID NO: 1272399 - DNA, 22 bp, Artificial Sequence
  chemically synthesized
acaagttaagagtttaaattat

SEQ ID NO: 1272400 - DNA, 22 bp, Artificial Sequence
  chemically synthesized
acttataaaactataatttaaa

SEQ ID NO: 1272401 - DNA, 22 bp, Artificial Sequence
  chemically synthesized
caagttaagagtttaaattata

SEQ ID NO: 1272402 - DNA, 22 bp, Artificial Sequence
  chemically synthesized
agagtttaaattatagttttat

SEQ ID NO: 1272403 - DNA, 22 bp, Artificial Sequence
  chemically synthesized
aaattatagttttataagtgaa

SEQ ID NO: 1272404 - DNA, 22 bp, Artificial Sequence
  chemically synthesized
aattatagttttataagtgaat

SEQ ID NO: 1272405 - DNA, 22 bp, Artificial Sequence
  chemically synthesized
tagttttataagtgaatttatc

SEQ ID NO: 1272406 - DNA, 22 bp, Artificial Sequence
  chemically synthesized
aaaaataaagtagataaattca

SEQ ID NO: 1272407 - DNA, 22 bp, Artificial Sequence
  chemically synthesized
tataagtgaatttatctacttt

SEQ ID NO: 1272408 - DNA, 22 bp, Artificial Sequence
  chemically synthesized
ataagtgaatttatctacttta

SEQ ID NO: 1272409 - DNA, 22 bp, Artificial Sequence
  chemically synthesized
taagtgaatttatctactttat

SEQ ID NO: 1272410 - DNA, 22 bp, Artificial Sequence
  chemically synthesized
gaatccatgacctgaaaaataa

SEQ ID NO: 1272411 - DNA, 22 bp, Artificial Sequence
  chemically synthesized
atctactttatttttcaggtca

SEQ ID NO: 1272412 - DNA, 22 bp, Artificial Sequence
  chemically synthesized
tctactttatttttcaggtcat

SEQ ID NO: 1272413 - DNA, 22 bp, Artificial Sequence
  chemically synthesized
ctttatttttcaggtcatggat

SEQ ID NO: 1272414 - DNA, 22 bp, Artificial Sequence
  chemically synthesized
atatgagagctagaatccatga

SEQ ID NO: 1272415 - DNA, 22 bp, Artificial Sequence
  chemically synthesized
tatttttcaggtcatggattct

SEQ ID NO: 1272416 - DNA, 22 bp, Artificial Sequence
  chemically synthesized
catatgagagctagaatccatg

SEQ ID NO: 1272417 - DNA, 22 bp, Artificial Sequence
  chemically synthesized
atttttcaggtcatggattcta

SEQ ID NO: 1272418 - DNA, 22 bp, Artificial Sequence
  chemically synthesized
tttttcaggtcatggattctag

SEQ ID NO: 1272419 - DNA, 22 bp, Artificial Sequence
  chemically synthesized
cttcatatgagagctagaatcc

SEQ ID NO: 1272420 - DNA, 22 bp, Artificial Sequence
  chemically synthesized
acttcatatgagagctagaatc

SEQ ID NO: 1272421 - DNA, 22 bp, Artificial Sequence
  chemically synthesized
ttcaggtcatggattctagctc

SEQ ID NO: 1272422 - DNA, 22 bp, Artificial Sequence
  chemically synthesized
tcaggtcatggattctagctct

SEQ ID NO: 1272423 - DNA, 22 bp, Artificial Sequence
  chemically synthesized
caggtcatggattctagctctc

SEQ ID NO: 1272424 - DNA, 22 bp, Artificial Sequence
  chemically synthesized
aggtcatggattctagctctca

SEQ ID NO: 1272425 - DNA, 22 bp, Artificial Sequence
  chemically synthesized
agaccttacttcatatgagagc

SEQ ID NO: 1272426 - DNA, 22 bp, Artificial Sequence
  chemically synthesized
tagctctcatatgaagtaaggt

SEQ ID NO: 1272427 - DNA, 22 bp, Artificial Sequence
  chemically synthesized
gctctcatatgaagtaaggtct

SEQ ID NO: 1272428 - DNA, 22 bp, Artificial Sequence
  chemically synthesized
tcatatgaagtaaggtcttaat

SEQ ID NO: 1272429 - DNA, 22 bp, Artificial Sequence
  chemically synthesized
atatgaagtaaggtcttaatgc

SEQ ID NO: 1272430 - DNA, 22 bp, Artificial Sequence
  chemically synthesized
acataaggtaaagaaataaaaa

SEQ ID NO: 1272431 - DNA, 22 bp, Artificial Sequence
  chemically synthesized
aacataaggtaaagaaataaaa

SEQ ID NO: 1272432 - DNA, 22 bp, Artificial Sequence
  chemically synthesized
aatgctttttatttctttacct

SEQ ID NO: 1272433 - DNA, 22 bp, Artificial Sequence
  chemically synthesized
aaatttaacataaggtaaagaa

SEQ ID NO: 1272434 - DNA, 22 bp, Artificial Sequence
  chemically synthesized
atgctttttatttctttacctt

SEQ ID NO: 1272435 - DNA, 22 bp, Artificial Sequence
  chemically synthesized
tttatttctttaccttatgtta

SEQ ID NO: 1272436 - DNA, 22 bp, Artificial Sequence
  chemically synthesized
ttatttctttaccttatgttaa

SEQ ID NO: 1272437 - DNA, 22 bp, Artificial Sequence
  chemically synthesized
tatttctttaccttatgttaaa

SEQ ID NO: 1272438 - DNA, 22 bp, Artificial Sequence
  chemically synthesized
atcaatctgaaatttaacataa

SEQ ID NO: 1272439 - DNA, 22 bp, Artificial Sequence
  chemically synthesized
atttctttaccttatgttaaat

SEQ ID NO: 1272440 - DNA, 22 bp, Artificial Sequence
  chemically synthesized
tttctttaccttatgttaaatt

SEQ ID NO: 1272441 - DNA, 22 bp, Artificial Sequence
  chemically synthesized
ctttaccttatgttaaatttca

SEQ ID NO: 1272442 - DNA, 22 bp, Artificial Sequence
  chemically synthesized
tttaccttatgttaaatttcag

SEQ ID NO: 1272443 - DNA, 22 bp, Artificial Sequence
  chemically synthesized
taccttatgttaaatttcagat

SEQ ID NO: 1272444 - DNA, 22 bp, Artificial Sequence
  chemically synthesized
gaaagctcatcaatctgaaatt

SEQ ID NO: 1272445 - DNA, 22 bp, Artificial Sequence
  chemically synthesized
accttatgttaaatttcagatt

SEQ ID NO: 1272446 - DNA, 22 bp, Artificial Sequence
  chemically synthesized
ccttatgttaaatttcagattg

SEQ ID NO: 1272447 - DNA, 22 bp, Artificial Sequence
  chemically synthesized
ttagaaagctcatcaatctgaa

SEQ ID NO: 1272448 - DNA, 22 bp, Artificial Sequence
  chemically synthesized
atgttaaatttcagattgatga

SEQ ID NO: 1272449 - DNA, 22 bp, Artificial Sequence
  chemically synthesized
tgttaaatttcagattgatgag

SEQ ID NO: 1272450 - DNA, 22 bp, Artificial Sequence
  chemically synthesized
aatattattagaaagctcatca

SEQ ID NO: 1272451 - DNA, 22 bp, Artificial Sequence
  chemically synthesized
caatattattagaaagctcatc

SEQ ID NO: 1272452 - DNA, 22 bp, Artificial Sequence
  chemically synthesized
aatttcagattgatgagctttc

SEQ ID NO: 1272453 - DNA, 22 bp, Artificial Sequence
  chemically synthesized
tcaatattattagaaagctcat

SEQ ID NO: 1272454 - DNA, 22 bp, Artificial Sequence
  chemically synthesized
cagattgatgagctttctaata

SEQ ID NO: 1272455 - DNA, 22 bp, Artificial Sequence
  chemically synthesized
agattgatgagctttctaataa

SEQ ID NO: 1272456 - DNA, 22 bp, Artificial Sequence
  chemically synthesized
atgagctttctaataatattga

SEQ ID NO: 1272457 - DNA, 22 bp, Artificial Sequence
  chemically synthesized
aggtagtaatgtgaactttcaa

SEQ ID NO: 1272458 - DNA, 22 bp, Artificial Sequence
  chemically synthesized
tctaataatattgaaagttcac

SEQ ID NO: 1272459 - DNA, 22 bp, Artificial Sequence
  chemically synthesized
ctaataatattgaaagttcaca

SEQ ID NO: 1272460 - DNA, 22 bp, Artificial Sequence
  chemically synthesized
ctaaggtagtaatgtgaacttt

SEQ ID NO: 1272461 - DNA, 22 bp, Artificial Sequence
  chemically synthesized
taataatattgaaagttcacat

SEQ ID NO: 1272462 - DNA, 22 bp, Artificial Sequence
  chemically synthesized
tactaaggtagtaatgtgaact

SEQ ID NO: 1272463 - DNA, 22 bp, Artificial Sequence
  chemically synthesized
ataatattgaaagttcacatta

SEQ ID NO: 1272464 - DNA, 22 bp, Artificial Sequence
  chemically synthesized
gaagctctactaaggtagtaat

SEQ ID NO: 1272465 - DNA, 22 bp, Artificial Sequence
  chemically synthesized
ggaagctctactaaggtagtaa

SEQ ID NO: 1272466 - DNA, 22 bp, Artificial Sequence
  chemically synthesized
aaagttcacattactaccttag

SEQ ID NO: 1272467 - DNA, 22 bp, Artificial Sequence
  chemically synthesized
aatttggaagctctactaaggt

SEQ ID NO: 1272468 - DNA, 22 bp, Artificial Sequence
  chemically synthesized
gaatttggaagctctactaagg

SEQ ID NO: 1272469 - DNA, 22 bp, Artificial Sequence
  chemically synthesized
acattactaccttagtagagct

SEQ ID NO: 1272470 - DNA, 22 bp, Artificial Sequence
  chemically synthesized
aatttgaatttggaagctctac

SEQ ID NO: 1272471 - DNA, 22 bp, Artificial Sequence
  chemically synthesized
caatttgaatttggaagctcta

SEQ ID NO: 1272472 - DNA, 22 bp, Artificial Sequence
  chemically synthesized
ctaccttagtagagcttccaaa

SEQ ID NO: 1272473 - DNA, 22 bp, Artificial Sequence
  chemically synthesized
ccttagtagagcttccaaattc

SEQ ID NO: 1272474 - DNA, 22 bp, Artificial Sequence
  chemically synthesized
agtagagcttccaaattcaaat

SEQ ID NO: 1272475 - DNA, 22 bp, Artificial Sequence
  chemically synthesized
gtagagcttccaaattcaaatt

SEQ ID NO: 1272476 - DNA, 22 bp, Artificial Sequence
  chemically synthesized
ccaaattcaaattgaaatttca

SEQ ID NO: 1272477 - DNA, 22 bp, Artificial Sequence
  chemically synthesized
caaattcaaattgaaatttcac

SEQ ID NO: 1272478 - DNA, 22 bp, Artificial Sequence
  chemically synthesized
aaattgaaatttcactgggctg

SEQ ID NO: 1272479 - DNA, 22 bp, Artificial Sequence
  chemically synthesized
aaatttcactgggctgggtgcg

SEQ ID NO: 1272480 - DNA, 22 bp, Artificial Sequence
  chemically synthesized
caggtgtgagccaccgcaccca

SEQ ID NO: 1272481 - DNA, 22 bp, Artificial Sequence
  chemically synthesized
cactgggctgggtgcggtggct

SEQ ID NO: 1272482 - DNA, 22 bp, Artificial Sequence
  chemically synthesized
actgggctgggtgcggtggctc

SEQ ID NO: 1272483 - DNA, 22 bp, Artificial Sequence
  chemically synthesized
tgattacaggtgtgagccaccg

SEQ ID NO: 1272484 - DNA, 22 bp, Artificial Sequence
  chemically synthesized
ggctgggtgcggtggctcacac

SEQ ID NO: 1272485 - DNA, 22 bp, Artificial Sequence
  chemically synthesized
ggtgcggtggctcacacctgta

SEQ ID NO: 1272486 - DNA, 22 bp, Artificial Sequence
  chemically synthesized
caaaatgctgtgattacaggtg

SEQ ID NO: 1272487 - DNA, 22 bp, Artificial Sequence
  chemically synthesized
ccaaaatgctgtgattacaggt

SEQ ID NO: 1272488 - DNA, 22 bp, Artificial Sequence
  chemically synthesized
gccttccaaaatgctgtgatta

SEQ ID NO: 1272489 - DNA, 22 bp, Artificial Sequence
  chemically synthesized
ggccttccaaaatgctgtgatt

SEQ ID NO: 1272490 - DNA, 22 bp, Artificial Sequence
  chemically synthesized
acacctgtaatcacagcatttt

SEQ ID NO: 1272491 - DNA, 22 bp, Artificial Sequence
  chemically synthesized
cccgtcttggccttccaaaatg

SEQ ID NO: 1272492 - DNA, 22 bp, Artificial Sequence
  chemically synthesized
taatcacagcattttggaaggc

SEQ ID NO: 1272493 - DNA, 22 bp, Artificial Sequence
  chemically synthesized
aagtgatctgcccgtcttggcc

SEQ ID NO: 1272494 - DNA, 22 bp, Artificial Sequence
  chemically synthesized
acctcaagtgatctgcccgtct

SEQ ID NO: 1272495 - DNA, 22 bp, Artificial Sequence
  chemically synthesized
tggaaggccaagacgggcagat

SEQ ID NO: 1272496 - DNA, 22 bp, Artificial Sequence
  chemically synthesized
ggaaggccaagacgggcagatc

SEQ ID NO: 1272497 - DNA, 22 bp, Artificial Sequence
  chemically synthesized
ctgacctcaagtgatctgcccg

SEQ ID NO: 1272498 - DNA, 22 bp, Artificial Sequence
  chemically synthesized
gaaggccaagacgggcagatca

SEQ ID NO: 1272499 - DNA, 22 bp, Artificial Sequence
  chemically synthesized
aactcctgacctcaagtgatct

SEQ ID NO: 1272500 - DNA, 22 bp, Artificial Sequence
  chemically synthesized
gaactcctgacctcaagtgatc

SEQ ID NO: 1272501 - DNA, 22 bp, Artificial Sequence
  chemically synthesized
gtcttgaactcctgacctcaag

SEQ ID NO: 1272502 - DNA, 22 bp, Artificial Sequence
  chemically synthesized
gccaggctggtcttgaactcct

SEQ ID NO: 1272503 - DNA, 22 bp, Artificial Sequence
  chemically synthesized
gaggtcaggagttcaagaccag

SEQ ID NO: 1272504 - DNA, 22 bp, Artificial Sequence
  chemically synthesized
aggtcaggagttcaagaccagc

SEQ ID NO: 1272505 - DNA, 22 bp, Artificial Sequence
  chemically synthesized
accatgttggccaggctggtct

SEQ ID NO: 1272506 - DNA, 22 bp, Artificial Sequence
  chemically synthesized
caccatgttggccaggctggtc

SEQ ID NO: 1272507 - DNA, 22 bp, Artificial Sequence
  chemically synthesized
aagaccagcctggccaacatgg

SEQ ID NO: 1272508 - DNA, 22 bp, Artificial Sequence
  chemically synthesized
gtagagacggggcttcaccatg

SEQ ID NO: 1272509 - DNA, 22 bp, Artificial Sequence
  chemically synthesized
agtagagacggggcttcaccat

SEQ ID NO: 1272510 - DNA, 22 bp, Artificial Sequence
  chemically synthesized
tagtagagacggggcttcacca

SEQ ID NO: 1272511 - DNA, 22 bp, Artificial Sequence
  chemically synthesized
ttagtagagacggggcttcacc

SEQ ID NO: 1272512 - DNA, 22 bp, Artificial Sequence
  chemically synthesized
gccaacatggtgaagccccgtc

SEQ ID NO: 1272513 - DNA, 22 bp, Artificial Sequence
  chemically synthesized
tatttttagtagagacggggct

SEQ ID NO: 1272514 - DNA, 22 bp, Artificial Sequence
  chemically synthesized
gtatttttagtagagacggggc

SEQ ID NO: 1272515 - DNA, 22 bp, Artificial Sequence
  chemically synthesized
tgtatttttagtagagacgggg

SEQ ID NO: 1272516 - DNA, 22 bp, Artificial Sequence
  chemically synthesized
ttgtatttttagtagagacggg

SEQ ID NO: 1272517 - DNA, 22 bp, Artificial Sequence
  chemically synthesized
tttgtatttttagtagagacgg

SEQ ID NO: 1272518 - DNA, 22 bp, Artificial Sequence
  chemically synthesized
ttttttgtatttttagtagaga

SEQ ID NO: 1272519 - DNA, 22 bp, Artificial Sequence
  chemically synthesized
tactaaaaatacaaaaaatagt

SEQ ID NO: 1272520 - DNA, 22 bp, Artificial Sequence
  chemically synthesized
ctaaaaatacaaaaaatagttg

SEQ ID NO: 1272521 - DNA, 22 bp, Artificial Sequence
  chemically synthesized
aaaatacaaaaaatagttgggt

SEQ ID NO: 1272522 - DNA, 22 bp, Artificial Sequence
  chemically synthesized
caggcatgcaccaagccaccca

SEQ ID NO: 1272523 - DNA, 22 bp, Artificial Sequence
  chemically synthesized
ggattacaggcatgcaccaagc

SEQ ID NO: 1272524 - DNA, 22 bp, Artificial Sequence
  chemically synthesized
ggtggcttggtgcatgcctgta

SEQ ID NO: 1272525 - DNA, 22 bp, Artificial Sequence
  chemically synthesized
ccgagtagctgggattacaggc

SEQ ID NO: 1272526 - DNA, 22 bp, Artificial Sequence
  chemically synthesized
ggtgcatgcctgtaatcccagc

SEQ ID NO: 1272527 - DNA, 22 bp, Artificial Sequence
  chemically synthesized
gtgcatgcctgtaatcccagct

SEQ ID NO: 1272528 - DNA, 22 bp, Artificial Sequence
  chemically synthesized
agcctcccgagtagctgggatt

SEQ ID NO: 1272529 - DNA, 22 bp, Artificial Sequence
  chemically synthesized
cctcagcctcccgagtagctgg

SEQ ID NO: 1272530 - DNA, 22 bp, Artificial Sequence
  chemically synthesized
ctgcctcagcctcccgagtagc

SEQ ID NO: 1272531 - DNA, 22 bp, Artificial Sequence
  chemically synthesized
tcctgcctcagcctcccgagta

SEQ ID NO: 1272532 - DNA, 22 bp, Artificial Sequence
  chemically synthesized
taatcccagctactcgggaggc

SEQ ID NO: 1272533 - DNA, 22 bp, Artificial Sequence
  chemically synthesized
aagtgattctcctgcctcagcc

SEQ ID NO: 1272534 - DNA, 22 bp, Artificial Sequence
  chemically synthesized
ctcgggaggctgaggcaggaga

SEQ ID NO: 1272535 - DNA, 22 bp, Artificial Sequence
  chemically synthesized
ggttcaagtgattctcctgcct

SEQ ID NO: 1272536 - DNA, 22 bp, Artificial Sequence
  chemically synthesized
gggaggctgaggcaggagaatc

SEQ ID NO: 1272537 - DNA, 22 bp, Artificial Sequence
  chemically synthesized
ctgggttcaagtgattctcctg

SEQ ID NO: 1272538 - DNA, 22 bp, Artificial Sequence
  chemically synthesized
catctcctgggttcaagtgatt

SEQ ID NO: 1272539 - DNA, 22 bp, Artificial Sequence
  chemically synthesized
aggcaggagaatcacttgaacc

SEQ ID NO: 1272540 - DNA, 22 bp, Artificial Sequence
  chemically synthesized
caacctccatctcctgggttca

SEQ ID NO: 1272541 - DNA, 22 bp, Artificial Sequence
  chemically synthesized
actacaacctccatctcctggg

SEQ ID NO: 1272542 - DNA, 22 bp, Artificial Sequence
  chemically synthesized
ctcactacaacctccatctcct

SEQ ID NO: 1272543 - DNA, 22 bp, Artificial Sequence
  chemically synthesized
tgctcactacaacctccatctc

SEQ ID NO: 1272544 - DNA, 22 bp, Artificial Sequence
  chemically synthesized
gaacccaggagatggaggttgt

SEQ ID NO: 1272545 - DNA, 22 bp, Artificial Sequence
  chemically synthesized
aacccaggagatggaggttgta

SEQ ID NO: 1272546 - DNA, 22 bp, Artificial Sequence
  chemically synthesized
gagtgcagtgacgcgatctctg

SEQ ID NO: 1272547 - DNA, 22 bp, Artificial Sequence
  chemically synthesized
tagtgagcagagatcgcgtcac

SEQ ID NO: 1272548 - DNA, 22 bp, Artificial Sequence
  chemically synthesized
tcacccaggctggagtgcagtg

SEQ ID NO: 1272549 - DNA, 22 bp, Artificial Sequence
  chemically synthesized
tgtcacccaggctggagtgcag

SEQ ID NO: 1272550 - DNA, 22 bp, Artificial Sequence
  chemically synthesized
ctctgtcacccaggctggagtg

SEQ ID NO: 1272551 - DNA, 22 bp, Artificial Sequence
  chemically synthesized
gctctgtcacccaggctggagt

SEQ ID NO: 1272552 - DNA, 22 bp, Artificial Sequence
  chemically synthesized
gtggagtcttgctctgtcaccc

SEQ ID NO: 1272553 - DNA, 22 bp, Artificial Sequence
  chemically synthesized
cactccagcctgggtgacagag

SEQ ID NO: 1272554 - DNA, 22 bp, Artificial Sequence
  chemically synthesized
ggtggagtcttgctctgtcacc

SEQ ID NO: 1272555 - DNA, 22 bp, Artificial Sequence
  chemically synthesized
tggtggagtcttgctctgtcac

SEQ ID NO: 1272556 - DNA, 22 bp, Artificial Sequence
  chemically synthesized
ttggtggagtcttgctctgtca

SEQ ID NO: 1272557 - DNA, 22 bp, Artificial Sequence
  chemically synthesized
tttggtggagtcttgctctgtc

SEQ ID NO: 1272558 - DNA, 22 bp, Artificial Sequence
  chemically synthesized
ttttggtggagtcttgctctgt

SEQ ID NO: 1272559 - DNA, 22 bp, Artificial Sequence
  chemically synthesized
cagcctgggtgacagagcaaga

SEQ ID NO: 1272560 - DNA, 22 bp, Artificial Sequence
  chemically synthesized
tttttggtggagtcttgctctg

SEQ ID NO: 1272561 - DNA, 22 bp, Artificial Sequence
  chemically synthesized
ttttttggtggagtcttgctct

SEQ ID NO: 1272562 - DNA, 22 bp, Artificial Sequence
  chemically synthesized
tttttttggtggagtcttgctc

SEQ ID NO: 1272563 - DNA, 22 bp, Artificial Sequence
  chemically synthesized
ttttttttggtggagtcttgct

SEQ ID NO: 1272564 - DNA, 22 bp, Artificial Sequence
  chemically synthesized
tttttttttggtggagtcttgc

SEQ ID NO: 1272565 - DNA, 22 bp, Artificial Sequence
  chemically synthesized
ttttttttttggtggagtcttg

SEQ ID NO: 1272566 - DNA, 22 bp, Artificial Sequence
  chemically synthesized
tttttttttttggtggagtctt

SEQ ID NO: 1272567 - DNA, 22 bp, Artificial Sequence
  chemically synthesized
ggtgacagagcaagactccacc

SEQ ID NO: 1272568 - DNA, 22 bp, Artificial Sequence
  chemically synthesized
ttttttttttttggtggagtct

SEQ ID NO: 1272569 - DNA, 22 bp, Artificial Sequence
  chemically synthesized
tttttttttttttggtggagtc

SEQ ID NO: 1272570 - DNA, 22 bp, Artificial Sequence
  chemically synthesized
ttttttttttttttggtggagt

SEQ ID NO: 1272571 - DNA, 22 bp, Artificial Sequence
  chemically synthesized
tttttttttttttttggtggag

SEQ ID NO: 1272572 - DNA, 22 bp, Artificial Sequence
  chemically synthesized
ttttttttttttttttggtgga

SEQ ID NO: 1272573 - DNA, 22 bp, Artificial Sequence
  chemically synthesized
ttttttttttttttttttggtg

SEQ ID NO: 1272574 - DNA, 22 bp, Artificial Sequence
  chemically synthesized
cttttttttttttttttttggt

SEQ ID NO: 1272575 - DNA, 22 bp, Artificial Sequence
  chemically synthesized
ttcttttttttttttttttttg

SEQ ID NO: 1272576 - DNA, 22 bp, Artificial Sequence
  chemically synthesized
cttctttttttttttttttttt

SEQ ID NO: 1272577 - DNA, 22 bp, Artificial Sequence
  chemically synthesized
ttcttctttttttttttttttt

SEQ ID NO: 1272578 - DNA, 22 bp, Artificial Sequence
  chemically synthesized
cttcttcttttttttttttttt

SEQ ID NO: 1272579 - DNA, 22 bp, Artificial Sequence
  chemically synthesized
tcttcttctttttttttttttt

SEQ ID NO: 1272580 - DNA, 22 bp, Artificial Sequence
  chemically synthesized
ttcttcttcttttttttttttt

SEQ ID NO: 1272581 - DNA, 22 bp, Artificial Sequence
  chemically synthesized
ttttcttcttcttttttttttt

SEQ ID NO: 1272582 - DNA, 22 bp, Artificial Sequence
  chemically synthesized
caccaaaaaaaaaaaaaaaaaa

SEQ ID NO: 1272583 - DNA, 22 bp, Artificial Sequence
  chemically synthesized
cttttcttcttctttttttttt

SEQ ID NO: 1272584 - DNA, 22 bp, Artificial Sequence
  chemically synthesized
aatttcttttcttcttcttttt

SEQ ID NO: 1272585 - DNA, 22 bp, Artificial Sequence
  chemically synthesized
aaatttcttttcttcttctttt

SEQ ID NO: 1272586 - DNA, 22 bp, Artificial Sequence
  chemically synthesized
gcttaaatttcttttcttcttc

SEQ ID NO: 1272587 - DNA, 22 bp, Artificial Sequence
  chemically synthesized
cgcttaaatttcttttcttctt

SEQ ID NO: 1272588 - DNA, 22 bp, Artificial Sequence
  chemically synthesized
acatcttcgcttaaatttcttt

SEQ ID NO: 1272589 - DNA, 22 bp, Artificial Sequence
  chemically synthesized
ctcacatcttcgcttaaatttc

SEQ ID NO: 1272590 - DNA, 22 bp, Artificial Sequence
  chemically synthesized
atacagttactcacatcttcgc

SEQ ID NO: 1272591 - DNA, 22 bp, Artificial Sequence
  chemically synthesized
gtctgatacagttactcacatc

SEQ ID NO: 1272592 - DNA, 22 bp, Artificial Sequence
  chemically synthesized
aagcgaagatgtgagtaactgt

SEQ ID NO: 1272593 - DNA, 22 bp, Artificial Sequence
  chemically synthesized
agcgaagatgtgagtaactgta

SEQ ID NO: 1272594 - DNA, 22 bp, Artificial Sequence
  chemically synthesized
catataaaaatgagtctggtct

SEQ ID NO: 1272595 - DNA, 22 bp, Artificial Sequence
  chemically synthesized
acatataaaaatgagtctggtc

SEQ ID NO: 1272596 - DNA, 22 bp, Artificial Sequence
  chemically synthesized
tacatataaaaatgagtctggt

SEQ ID NO: 1272597 - DNA, 22 bp, Artificial Sequence
  chemically synthesized
ttacatataaaaatgagtctgg

SEQ ID NO: 1272598 - DNA, 22 bp, Artificial Sequence
  chemically synthesized
tatcagaccagactcattttta

SEQ ID NO: 1272599 - DNA, 22 bp, Artificial Sequence
  chemically synthesized
atcttttacatataaaaatgag

SEQ ID NO: 1272600 - DNA, 22 bp, Artificial Sequence
  chemically synthesized
catcttttacatataaaaatga

SEQ ID NO: 1272601 - DNA, 22 bp, Artificial Sequence
  chemically synthesized
atttttatatgtaaaagatgaa

SEQ ID NO: 1272602 - DNA, 22 bp, Artificial Sequence
  chemically synthesized
ttatatgtaaaagatgaaatgg

SEQ ID NO: 1272603 - DNA, 22 bp, Artificial Sequence
  chemically synthesized
tatatgtaaaagatgaaatggc

SEQ ID NO: 1272604 - DNA, 22 bp, Artificial Sequence
  chemically synthesized
agagtagaaaacgccatttcat

SEQ ID NO: 1272605 - DNA, 22 bp, Artificial Sequence
  chemically synthesized
atatgtaaaagatgaaatggcg

SEQ ID NO: 1272606 - DNA, 22 bp, Artificial Sequence
  chemically synthesized
tatgtaaaagatgaaatggcgt

SEQ ID NO: 1272607 - DNA, 22 bp, Artificial Sequence
  chemically synthesized
ttaagagtagaaaacgccattt

SEQ ID NO: 1272608 - DNA, 22 bp, Artificial Sequence
  chemically synthesized
attaagagtagaaaacgccatt

SEQ ID NO: 1272609 - DNA, 22 bp, Artificial Sequence
  chemically synthesized
tattaagagtagaaaacgccat

SEQ ID NO: 1272610 - DNA, 22 bp, Artificial Sequence
  chemically synthesized
cctttattaagagtagaaaacg

SEQ ID NO: 1272611 - DNA, 22 bp, Artificial Sequence
  chemically synthesized
gcctttattaagagtagaaaac

SEQ ID NO: 1272612 - DNA, 22 bp, Artificial Sequence
  chemically synthesized
tgcctttattaagagtagaaaa

SEQ ID NO: 1272613 - DNA, 22 bp, Artificial Sequence
  chemically synthesized
atctttgcctttattaagagta

SEQ ID NO: 1272614 - DNA, 22 bp, Artificial Sequence
  chemically synthesized
gttcatctttgcctttattaag

SEQ ID NO: 1272615 - DNA, 22 bp, Artificial Sequence
  chemically synthesized
tctactcttaataaaggcaaag

SEQ ID NO: 1272616 - DNA, 22 bp, Artificial Sequence
  chemically synthesized
ctactcttaataaaggcaaaga

SEQ ID NO: 1272617 - DNA, 22 bp, Artificial Sequence
  chemically synthesized
tgtattagttcatctttgcctt

SEQ ID NO: 1272618 - DNA, 22 bp, Artificial Sequence
  chemically synthesized
tactcttaataaaggcaaagat

SEQ ID NO: 1272619 - DNA, 22 bp, Artificial Sequence
  chemically synthesized
ctcttaataaaggcaaagatga

SEQ ID NO: 1272620 - DNA, 22 bp, Artificial Sequence
  chemically synthesized
cattatgtattagttcatcttt

SEQ ID NO: 1272621 - DNA, 22 bp, Artificial Sequence
  chemically synthesized
ttaataaaggcaaagatgaact

SEQ ID NO: 1272622 - DNA, 22 bp, Artificial Sequence
  chemically synthesized
gcattatgtattagttcatctt

SEQ ID NO: 1272623 - DNA, 22 bp, Artificial Sequence
  chemically synthesized
tgcattatgtattagttcatct

SEQ ID NO: 1272624 - DNA, 22 bp, Artificial Sequence
  chemically synthesized
aataaaggcaaagatgaactaa

SEQ ID NO: 1272625 - DNA, 22 bp, Artificial Sequence
  chemically synthesized
ataaaggcaaagatgaactaat

SEQ ID NO: 1272626 - DNA, 22 bp, Artificial Sequence
  chemically synthesized
attttgcattatgtattagttc

SEQ ID NO: 1272627 - DNA, 22 bp, Artificial Sequence
  chemically synthesized
cagtgctcattttgcattatgt

SEQ ID NO: 1272628 - DNA, 22 bp, Artificial Sequence
  chemically synthesized
ccagtgctcattttgcattatg

SEQ ID NO: 1272629 - DNA, 22 bp, Artificial Sequence
  chemically synthesized
ttccagtgctcattttgcatta

SEQ ID NO: 1272630 - DNA, 22 bp, Artificial Sequence
  chemically synthesized
atacataatgcaaaatgagcac

SEQ ID NO: 1272631 - DNA, 22 bp, Artificial Sequence
  chemically synthesized
tatatctcttccagtgctcatt

SEQ ID NO: 1272632 - DNA, 22 bp, Artificial Sequence
  chemically synthesized
gtatatctcttccagtgctcat

SEQ ID NO: 1272633 - DNA, 22 bp, Artificial Sequence
  chemically synthesized
cccatcttgtatatctcttcca

SEQ ID NO: 1272634 - DNA, 22 bp, Artificial Sequence
  chemically synthesized
acccatcttgtatatctcttcc

SEQ ID NO: 1272635 - DNA, 22 bp, Artificial Sequence
  chemically synthesized
ttacccatcttgtatatctctt

SEQ ID NO: 1272636 - DNA, 22 bp, Artificial Sequence
  chemically synthesized
ctcttacccatcttgtatatct

SEQ ID NO: 1272637 - DNA, 22 bp, Artificial Sequence
  chemically synthesized
gctcttacccatcttgtatatc

SEQ ID NO: 1272638 - DNA, 22 bp, Artificial Sequence
  chemically synthesized
tgctcttacccatcttgtatat

SEQ ID NO: 1272639 - DNA, 22 bp, Artificial Sequence
  chemically synthesized
gaagagatatacaagatgggta

SEQ ID NO: 1272640 - DNA, 22 bp, Artificial Sequence
  chemically synthesized
atagttttgctcttacccatct

SEQ ID NO: 1272641 - DNA, 22 bp, Artificial Sequence
  chemically synthesized
aatgaatgaaaaatacaaaaat

SEQ ID NO: 1272642 - DNA, 22 bp, Artificial Sequence
  chemically synthesized
ctgaatgaatgaaaaatacaaa

SEQ ID NO: 1272643 - DNA, 22 bp, Artificial Sequence
  chemically synthesized
gctgaatgaatgaaaaatacaa

SEQ ID NO: 1272644 - DNA, 22 bp, Artificial Sequence
  chemically synthesized
tttgctgaatgaatgaaaaata

SEQ ID NO: 1272645 - DNA, 22 bp, Artificial Sequence
  chemically synthesized
tcaatttttgtatttttcattc

SEQ ID NO: 1272646 - DNA, 22 bp, Artificial Sequence
  chemically synthesized
gtaattatttgctgaatgaatg

SEQ ID NO: 1272647 - DNA, 22 bp, Artificial Sequence
  chemically synthesized
ggtaattatttgctgaatgaat

SEQ ID NO: 1272648 - DNA, 22 bp, Artificial Sequence
  chemically synthesized
ttgtatttttcattcattcagc

SEQ ID NO: 1272649 - DNA, 22 bp, Artificial Sequence
  chemically synthesized
tgtatttttcattcattcagca

SEQ ID NO: 1272650 - DNA, 22 bp, Artificial Sequence
  chemically synthesized
gtatttttcattcattcagcaa

SEQ ID NO: 1272651 - DNA, 22 bp, Artificial Sequence
  chemically synthesized
cttggtaattatttgctgaatg

SEQ ID NO: 1272652 - DNA, 22 bp, Artificial Sequence
  chemically synthesized
tatttttcattcattcagcaaa

SEQ ID NO: 1272653 - DNA, 22 bp, Artificial Sequence
  chemically synthesized
gcttggtaattatttgctgaat

SEQ ID NO: 1272654 - DNA, 22 bp, Artificial Sequence
  chemically synthesized
ttcattcattcagcaaataatt

SEQ ID NO: 1272655 - DNA, 22 bp, Artificial Sequence
  chemically synthesized
tcattcattcagcaaataatta

SEQ ID NO: 1272656 - DNA, 22 bp, Artificial Sequence
  chemically synthesized
cattcattcagcaaataattac

SEQ ID NO: 1272657 - DNA, 22 bp, Artificial Sequence
  chemically synthesized
attcattcagcaaataattacc

SEQ ID NO: 1272658 - DNA, 22 bp, Artificial Sequence
  chemically synthesized
attcagcaaataattaccaagc

SEQ ID NO: 1272659 - DNA, 22 bp, Artificial Sequence
  chemically synthesized
cgtatgtatgacttgcttggta

SEQ ID NO: 1272660 - DNA, 22 bp, Artificial Sequence
  chemically synthesized
acgtatgtatgacttgcttggt

SEQ ID NO: 1272661 - DNA, 22 bp, Artificial Sequence
  chemically synthesized
agcaaataattaccaagcaagt

SEQ ID NO: 1272662 - DNA, 22 bp, Artificial Sequence
  chemically synthesized
tacgtatgtatgacttgcttgg

SEQ ID NO: 1272663 - DNA, 22 bp, Artificial Sequence
  chemically synthesized
ttttacgtatgtatgacttgct

SEQ ID NO: 1272664 - DNA, 22 bp, Artificial Sequence
  chemically synthesized
ccaagcaagtcatacatacgta

SEQ ID NO: 1272665 - DNA, 22 bp, Artificial Sequence
  chemically synthesized
tcatagagatgggacaaaaaat

SEQ ID NO: 1272666 - DNA, 22 bp, Artificial Sequence
  chemically synthesized
atcactatcatagagatgggac

SEQ ID NO: 1272667 - DNA, 22 bp, Artificial Sequence
  chemically synthesized
catcactatcatagagatggga

SEQ ID NO: 1272668 - DNA, 22 bp, Artificial Sequence
  chemically synthesized
tatattttttgtcccatctcta

SEQ ID NO: 1272669 - DNA, 22 bp, Artificial Sequence
  chemically synthesized
tcatcactatcatagagatggg

SEQ ID NO: 1272670 - DNA, 22 bp, Artificial Sequence
  chemically synthesized
atattttttgtcccatctctat

SEQ ID NO: 1272671 - DNA, 22 bp, Artificial Sequence
  chemically synthesized
tattttttgtcccatctctatg

SEQ ID NO: 1272672 - DNA, 22 bp, Artificial Sequence
  chemically synthesized
actttcatcactatcatagaga

SEQ ID NO: 1272673 - DNA, 22 bp, Artificial Sequence
  chemically synthesized
tttgtcccatctctatgatagt

SEQ ID NO: 1272674 - DNA, 22 bp, Artificial Sequence
  chemically synthesized
ttgtcccatctctatgatagtg

SEQ ID NO: 1272675 - DNA, 22 bp, Artificial Sequence
  chemically synthesized
tgtcccatctctatgatagtga

SEQ ID NO: 1272676 - DNA, 22 bp, Artificial Sequence
  chemically synthesized
gtcccatctctatgatagtgat

SEQ ID NO: 1272677 - DNA, 22 bp, Artificial Sequence
  chemically synthesized
tcccatctctatgatagtgatg

SEQ ID NO: 1272678 - DNA, 22 bp, Artificial Sequence
  chemically synthesized
aagaatcattcactttcatcac

SEQ ID NO: 1272679 - DNA, 22 bp, Artificial Sequence
  chemically synthesized
aaagaatcattcactttcatca

SEQ ID NO: 1272680 - DNA, 22 bp, Artificial Sequence
  chemically synthesized
taaagaatcattcactttcatc

SEQ ID NO: 1272681 - DNA, 22 bp, Artificial Sequence
  chemically synthesized
ttaaagaatcattcactttcat

SEQ ID NO: 1272682 - DNA, 22 bp, Artificial Sequence
  chemically synthesized
tttaaagaatcattcactttca

SEQ ID NO: 1272683 - DNA, 22 bp, Artificial Sequence
  chemically synthesized
tatgatagtgatgaaagtgaat

SEQ ID NO: 1272684 - DNA, 22 bp, Artificial Sequence
  chemically synthesized
ttttaaagaatcattcactttc

SEQ ID NO: 1272685 - DNA, 22 bp, Artificial Sequence
  chemically synthesized
tgatagtgatgaaagtgaatga

SEQ ID NO: 1272686 - DNA, 22 bp, Artificial Sequence
  chemically synthesized
tcatttttttaaagaatcattc

SEQ ID NO: 1272687 - DNA, 22 bp, Artificial Sequence
  chemically synthesized
atcatttttttaaagaatcatt

SEQ ID NO: 1272688 - DNA, 22 bp, Artificial Sequence
  chemically synthesized
atatttatcatttttttaaaga

SEQ ID NO: 1272689 - DNA, 22 bp, Artificial Sequence
  chemically synthesized
aatatttatcatttttttaaag

SEQ ID NO: 1272690 - DNA, 22 bp, Artificial Sequence
  chemically synthesized
gccgatatttaatatttatcat

SEQ ID NO: 1272691 - DNA, 22 bp, Artificial Sequence
  chemically synthesized
tttaaaaaaatgataaatatta

SEQ ID NO: 1272692 - DNA, 22 bp, Artificial Sequence
  chemically synthesized
taaaaaaatgataaatattaaa

SEQ ID NO: 1272693 - DNA, 22 bp, Artificial Sequence
  chemically synthesized
aaaaaaatgataaatattaaat

SEQ ID NO: 1272694 - DNA, 22 bp, Artificial Sequence
  chemically synthesized
tatctagccgatatttaatatt

SEQ ID NO: 1272695 - DNA, 22 bp, Artificial Sequence
  chemically synthesized
aaaaaatgataaatattaaata

SEQ ID NO: 1272696 - DNA, 22 bp, Artificial Sequence
  chemically synthesized
gtatctagccgatatttaatat

SEQ ID NO: 1272697 - DNA, 22 bp, Artificial Sequence
  chemically synthesized
tgtatctagccgatatttaata

SEQ ID NO: 1272698 - DNA, 22 bp, Artificial Sequence
  chemically synthesized
aatatcggctagatacaaaata

SEQ ID NO: 1272699 - DNA, 22 bp, Artificial Sequence
  chemically synthesized
tatacaccaatgataatatttt

SEQ ID NO: 1272700 - DNA, 22 bp, Artificial Sequence
  chemically synthesized
gttatatacaccaatgataata

SEQ ID NO: 1272701 - DNA, 22 bp, Artificial Sequence
  chemically synthesized
tggttatatacaccaatgataa

SEQ ID NO: 1272702 - DNA, 22 bp, Artificial Sequence
  chemically synthesized
gatacaaaatattatcattggt

SEQ ID NO: 1272703 - DNA, 22 bp, Artificial Sequence
  chemically synthesized
aattctggttatatacaccaat

SEQ ID NO: 1272704 - DNA, 22 bp, Artificial Sequence
  chemically synthesized
aaattctggttatatacaccaa

SEQ ID NO: 1272705 - DNA, 22 bp, Artificial Sequence
  chemically synthesized
aacttaaattctggttatatac

SEQ ID NO: 1272706 - DNA, 22 bp, Artificial Sequence
  chemically synthesized
tcattggtgtatataaccagaa

SEQ ID NO: 1272707 - DNA, 22 bp, Artificial Sequence
  chemically synthesized
gtgtatataaccagaatttaag

SEQ ID NO: 1272708 - DNA, 22 bp, Artificial Sequence
  chemically synthesized
atgccaatgattcaacttaaat

SEQ ID NO: 1272709 - DNA, 22 bp, Artificial Sequence
  chemically synthesized
gatgccaatgattcaacttaaa

SEQ ID NO: 1272710 - DNA, 22 bp, Artificial Sequence
  chemically synthesized
tgatgccaatgattcaacttaa

SEQ ID NO: 1272711 - DNA, 22 bp, Artificial Sequence
  chemically synthesized
aaatctttgatgccaatgattc

SEQ ID NO: 1272712 - DNA, 22 bp, Artificial Sequence
  chemically synthesized
aaaatctttgatgccaatgatt

SEQ ID NO: 1272713 - DNA, 22 bp, Artificial Sequence
  chemically synthesized
tttaaaatctttgatgccaatg

SEQ ID NO: 1272714 - DNA, 22 bp, Artificial Sequence
  chemically synthesized
aagttgaatcattggcatcaaa

SEQ ID NO: 1272715 - DNA, 22 bp, Artificial Sequence
  chemically synthesized
agttgaatcattggcatcaaag

SEQ ID NO: 1272716 - DNA, 22 bp, Artificial Sequence
  chemically synthesized
cgaactatttaaaatctttgat

SEQ ID NO: 1272717 - DNA, 22 bp, Artificial Sequence
  chemically synthesized
ccgaactatttaaaatctttga

SEQ ID NO: 1272718 - DNA, 22 bp, Artificial Sequence
  chemically synthesized
aatcattggcatcaaagatttt

SEQ ID NO: 1272719 - DNA, 22 bp, Artificial Sequence
  chemically synthesized
tccgaactatttaaaatctttg

SEQ ID NO: 1272720 - DNA, 22 bp, Artificial Sequence
  chemically synthesized
attttccgaactatttaaaatc

SEQ ID NO: 1272721 - DNA, 22 bp, Artificial Sequence
  chemically synthesized
aattttccgaactatttaaaat

SEQ ID NO: 1272722 - DNA, 22 bp, Artificial Sequence
  chemically synthesized
taattttccgaactatttaaaa

SEQ ID NO: 1272723 - DNA, 22 bp, Artificial Sequence
  chemically synthesized
ttaattttccgaactatttaaa

SEQ ID NO: 1272724 - DNA, 22 bp, Artificial Sequence
  chemically synthesized
gcatcaaagattttaaatagtt

SEQ ID NO: 1272725 - DNA, 22 bp, Artificial Sequence
  chemically synthesized
tttaattttccgaactatttaa

SEQ ID NO: 1272726 - DNA, 22 bp, Artificial Sequence
  chemically synthesized
gcaatgtattttttaattttcc

SEQ ID NO: 1272727 - DNA, 22 bp, Artificial Sequence
  chemically synthesized
taaatagttcggaaaattaaaa

SEQ ID NO: 1272728 - DNA, 22 bp, Artificial Sequence
  chemically synthesized
aaatagttcggaaaattaaaaa

SEQ ID NO: 1272729 - DNA, 22 bp, Artificial Sequence
  chemically synthesized
aatagttcggaaaattaaaaaa

SEQ ID NO: 1272730 - DNA, 22 bp, Artificial Sequence
  chemically synthesized
ggaaaattaaaaaatacattgc

SEQ ID NO: 1272731 - DNA, 22 bp, Artificial Sequence
  chemically synthesized
taagtggggactagcaatgtat

SEQ ID NO: 1272732 - DNA, 22 bp, Artificial Sequence
  chemically synthesized
gtaagtggggactagcaatgta

SEQ ID NO: 1272733 - DNA, 22 bp, Artificial Sequence
  chemically synthesized
cttgtaagtggggactagcaat

SEQ ID NO: 1272734 - DNA, 22 bp, Artificial Sequence
  chemically synthesized
aaaaatacattgctagtcccca

SEQ ID NO: 1272735 - DNA, 22 bp, Artificial Sequence
  chemically synthesized
aagctccttgtaagtggggact

SEQ ID NO: 1272736 - DNA, 22 bp, Artificial Sequence
  chemically synthesized
tcaagctccttgtaagtgggga

SEQ ID NO: 1272737 - DNA, 22 bp, Artificial Sequence
  chemically synthesized
ctcaagctccttgtaagtgggg

SEQ ID NO: 1272738 - DNA, 22 bp, Artificial Sequence
  chemically synthesized
ttctcaagctccttgtaagtgg

SEQ ID NO: 1272739 - DNA, 22 bp, Artificial Sequence
  chemically synthesized
tcttctcaagctccttgtaagt

SEQ ID NO: 1272740 - DNA, 22 bp, Artificial Sequence
  chemically synthesized
ctcttctcaagctccttgtaag

SEQ ID NO: 1272741 - DNA, 22 bp, Artificial Sequence
  chemically synthesized
tctcttctcaagctccttgtaa

SEQ ID NO: 1272742 - DNA, 22 bp, Artificial Sequence
  chemically synthesized
ctagtccccacttacaaggagc

SEQ ID NO: 1272743 - DNA, 22 bp, Artificial Sequence
  chemically synthesized
ttttctcttctcaagctccttg

SEQ ID NO: 1272744 - DNA, 22 bp, Artificial Sequence
  chemically synthesized
gtccccacttacaaggagcttg

SEQ ID NO: 1272745 - DNA, 22 bp, Artificial Sequence
  chemically synthesized
attttctcttctcaagctcctt

SEQ ID NO: 1272746 - DNA, 22 bp, Artificial Sequence
  chemically synthesized
tattttctcttctcaagctcct

SEQ ID NO: 1272747 - DNA, 22 bp, Artificial Sequence
  chemically synthesized
ttattttctcttctcaagctcc

SEQ ID NO: 1272748 - DNA, 22 bp, Artificial Sequence
  chemically synthesized
gtatttttattttctcttctca

SEQ ID NO: 1272749 - DNA, 22 bp, Artificial Sequence
  chemically synthesized
acaaggagcttgagaagagaaa

SEQ ID NO: 1272750 - DNA, 22 bp, Artificial Sequence
  chemically synthesized
caaggagcttgagaagagaaaa

SEQ ID NO: 1272751 - DNA, 22 bp, Artificial Sequence
  chemically synthesized
ttggtatttttattttctcttc

SEQ ID NO: 1272752 - DNA, 22 bp, Artificial Sequence
  chemically synthesized
gttggtatttttattttctctt

SEQ ID NO: 1272753 - DNA, 22 bp, Artificial Sequence
  chemically synthesized
atttgttggtatttttattttc

SEQ ID NO: 1272754 - DNA, 22 bp, Artificial Sequence
  chemically synthesized
gagaagagaaaataaaaatacc

SEQ ID NO: 1272755 - DNA, 22 bp, Artificial Sequence
  chemically synthesized
tattgatttgttggtattttta

SEQ ID NO: 1272756 - DNA, 22 bp, Artificial Sequence
  chemically synthesized
agaagagaaaataaaaatacca

SEQ ID NO: 1272757 - DNA, 22 bp, Artificial Sequence
  chemically synthesized
tgtattgatttgttggtatttt

SEQ ID NO: 1272758 - DNA, 22 bp, Artificial Sequence
  chemically synthesized
ctgtattgatttgttggtattt

SEQ ID NO: 1272759 - DNA, 22 bp, Artificial Sequence
  chemically synthesized
tagtgaatatttctgtattgat

SEQ ID NO: 1272760 - DNA, 22 bp, Artificial Sequence
  chemically synthesized
atgatctatagtgaatatttct

SEQ ID NO: 1272761 - DNA, 22 bp, Artificial Sequence
  chemically synthesized
catgatctatagtgaatatttc

SEQ ID NO: 1272762 - DNA, 22 bp, Artificial Sequence
  chemically synthesized
agtttcatgatctatagtgaat

SEQ ID NO: 1272763 - DNA, 22 bp, Artificial Sequence
  chemically synthesized
caggtcattgagtttcatgatc

SEQ ID NO: 1272764 - DNA, 22 bp, Artificial Sequence
  chemically synthesized
ttacaggtcattgagtttcatg

SEQ ID NO: 1272765 - DNA, 22 bp, Artificial Sequence
  chemically synthesized
attacaggtcattgagtttcat

SEQ ID NO: 1272766 - DNA, 22 bp, Artificial Sequence
  chemically synthesized
tattacaggtcattgagtttca

SEQ ID NO: 1272767 - DNA, 22 bp, Artificial Sequence
  chemically synthesized
actatagatcatgaaactcaat

SEQ ID NO: 1272768 - DNA, 22 bp, Artificial Sequence
  chemically synthesized
tagatcatgaaactcaatgacc

SEQ ID NO: 1272769 - DNA, 22 bp, Artificial Sequence
  chemically synthesized
aactttattacaggtcattgag

SEQ ID NO: 1272770 - DNA, 22 bp, Artificial Sequence
  chemically synthesized
aaactttattacaggtcattga

SEQ ID NO: 1272771 - DNA, 22 bp, Artificial Sequence
  chemically synthesized
ttaaactttattacaggtcatt

SEQ ID NO: 1272772 - DNA, 22 bp, Artificial Sequence
  chemically synthesized
cttaaactttattacaggtcat

SEQ ID NO: 1272773 - DNA, 22 bp, Artificial Sequence
  chemically synthesized
tcttaaactttattacaggtca

SEQ ID NO: 1272774 - DNA, 22 bp, Artificial Sequence
  chemically synthesized
ttcttaaactttattacaggtc

SEQ ID NO: 1272775 - DNA, 22 bp, Artificial Sequence
  chemically synthesized
tttttcttaaactttattacag

SEQ ID NO: 1272776 - DNA, 22 bp, Artificial Sequence
  chemically synthesized
aatgacctgtaataaagtttaa

SEQ ID NO: 1272777 - DNA, 22 bp, Artificial Sequence
  chemically synthesized
taataaagtttaagaaaaacaa

SEQ ID NO: 1272778 - DNA, 22 bp, Artificial Sequence
  chemically synthesized
tcaaggcaatataaaattgttt

SEQ ID NO: 1272779 - DNA, 22 bp, Artificial Sequence
  chemically synthesized
tatcaaggcaatataaaattgt

SEQ ID NO: 1272780 - DNA, 22 bp, Artificial Sequence
  chemically synthesized
ttctatcaaggcaatataaaat

SEQ ID NO: 1272781 - DNA, 22 bp, Artificial Sequence
  chemically synthesized
aagaaaaacaattttatattgc

SEQ ID NO: 1272782 - DNA, 22 bp, Artificial Sequence
  chemically synthesized
agaaaaacaattttatattgcc

SEQ ID NO: 1272783 - DNA, 22 bp, Artificial Sequence
  chemically synthesized
ggctattctatcaaggcaatat

SEQ ID NO: 1272784 - DNA, 22 bp, Artificial Sequence
  chemically synthesized
gggctattctatcaaggcaata

SEQ ID NO: 1272785 - DNA, 22 bp, Artificial Sequence
  chemically synthesized
atgatttgggctattctatcaa

SEQ ID NO: 1272786 - DNA, 22 bp, Artificial Sequence
  chemically synthesized
gatgatttgggctattctatca

SEQ ID NO: 1272787 - DNA, 22 bp, Artificial Sequence
  chemically synthesized
tgatgatttgggctattctatc

SEQ ID NO: 1272788 - DNA, 22 bp, Artificial Sequence
  chemically synthesized
tatattgccttgatagaatagc

SEQ ID NO: 1272789 - DNA, 22 bp, Artificial Sequence
  chemically synthesized
atattgccttgatagaatagcc

SEQ ID NO: 1272790 - DNA, 22 bp, Artificial Sequence
  chemically synthesized
tattgccttgatagaatagccc

SEQ ID NO: 1272791 - DNA, 22 bp, Artificial Sequence
  chemically synthesized
ctttgatgatttgggctattct

SEQ ID NO: 1272792 - DNA, 22 bp, Artificial Sequence
  chemically synthesized
ccttgatagaatagcccaaatc

SEQ ID NO: 1272793 - DNA, 22 bp, Artificial Sequence
  chemically synthesized
catctgctttgatgatttgggc

SEQ ID NO: 1272794 - DNA, 22 bp, Artificial Sequence
  chemically synthesized
gatagaatagcccaaatcatca

SEQ ID NO: 1272795 - DNA, 22 bp, Artificial Sequence
  chemically synthesized
atagaatagcccaaatcatcaa

SEQ ID NO: 1272796 - DNA, 22 bp, Artificial Sequence
  chemically synthesized
aaaattccatctgctttgatga

SEQ ID NO: 1272797 - DNA, 22 bp, Artificial Sequence
  chemically synthesized
gaaaattccatctgctttgatg

SEQ ID NO: 1272798 - DNA, 22 bp, Artificial Sequence
  chemically synthesized
tgaaaattccatctgctttgat

SEQ ID NO: 1272799 - DNA, 22 bp, Artificial Sequence
  chemically synthesized
tctttgaaaattccatctgctt

SEQ ID NO: 1272800 - DNA, 22 bp, Artificial Sequence
  chemically synthesized
atgatagcatactgtctttgaa

SEQ ID NO: 1272801 - DNA, 22 bp, Artificial Sequence
  chemically synthesized
tcatgatagcatactgtctttg

SEQ ID NO: 1272802 - DNA, 22 bp, Artificial Sequence
  chemically synthesized
ctcatgatagcatactgtcttt

SEQ ID NO: 1272803 - DNA, 22 bp, Artificial Sequence
  chemically synthesized
tctcatgatagcatactgtctt

SEQ ID NO: 1272804 - DNA, 22 bp, Artificial Sequence
  chemically synthesized
tcaaagacagtatgctatcatg

SEQ ID NO: 1272805 - DNA, 22 bp, Artificial Sequence
  chemically synthesized
caaagacagtatgctatcatga

SEQ ID NO: 1272806 - DNA, 22 bp, Artificial Sequence
  chemically synthesized
aaagacagtatgctatcatgag

SEQ ID NO: 1272807 - DNA, 22 bp, Artificial Sequence
  chemically synthesized
cgcacatgtctttctcatgata

SEQ ID NO: 1272808 - DNA, 22 bp, Artificial Sequence
  chemically synthesized
ccgcacatgtctttctcatgat

SEQ ID NO: 1272809 - DNA, 22 bp, Artificial Sequence
  chemically synthesized
gtttccgcacatgtctttctca

SEQ ID NO: 1272810 - DNA, 22 bp, Artificial Sequence
  chemically synthesized
ctagtttccgcacatgtctttc

SEQ ID NO: 1272811 - DNA, 22 bp, Artificial Sequence
  chemically synthesized
cctagtttccgcacatgtcttt

SEQ ID NO: 1272812 - DNA, 22 bp, Artificial Sequence
  chemically synthesized
ttcctagtttccgcacatgtct

SEQ ID NO: 1272813 - DNA, 22 bp, Artificial Sequence
  chemically synthesized
cttcctagtttccgcacatgtc

SEQ ID NO: 1272814 - DNA, 22 bp, Artificial Sequence
  chemically synthesized
tcatgagaaagacatgtgcgga

SEQ ID NO: 1272815 - DNA, 22 bp, Artificial Sequence
  chemically synthesized
agaatacaagcttcttcctagt

SEQ ID NO: 1272816 - DNA, 22 bp, Artificial Sequence
  chemically synthesized
gtaacacattcagaatacaagc

SEQ ID NO: 1272817 - DNA, 22 bp, Artificial Sequence
  chemically synthesized
ggtaacacattcagaatacaag

SEQ ID NO: 1272818 - DNA, 22 bp, Artificial Sequence
  chemically synthesized
ttggtaacacattcagaataca

SEQ ID NO: 1272819 - DNA, 22 bp, Artificial Sequence
  chemically synthesized
ggaagaagcttgtattctgaat

SEQ ID NO: 1272820 - DNA, 22 bp, Artificial Sequence
  chemically synthesized
taacctcttggtaacacattca

SEQ ID NO: 1272821 - DNA, 22 bp, Artificial Sequence
  chemically synthesized
attgtaacctcttggtaacaca

SEQ ID NO: 1272822 - DNA, 22 bp, Artificial Sequence
  chemically synthesized
gtattctgaatgtgttaccaag

SEQ ID NO: 1272823 - DNA, 22 bp, Artificial Sequence
  chemically synthesized
tattctgaatgtgttaccaaga

SEQ ID NO: 1272824 - DNA, 22 bp, Artificial Sequence
  chemically synthesized
cattcattgtaacctcttggta

SEQ ID NO: 1272825 - DNA, 22 bp, Artificial Sequence
  chemically synthesized
tgaatgtgttaccaagaggtta

SEQ ID NO: 1272826 - DNA, 22 bp, Artificial Sequence
  chemically synthesized
ttacattcattgtaacctcttg

SEQ ID NO: 1272827 - DNA, 22 bp, Artificial Sequence
  chemically synthesized
attacattcattgtaacctctt

SEQ ID NO: 1272828 - DNA, 22 bp, Artificial Sequence
  chemically synthesized
aatgtgttaccaagaggttaca

SEQ ID NO: 1272829 - DNA, 22 bp, Artificial Sequence
  chemically synthesized
tattacattcattgtaacctct

SEQ ID NO: 1272830 - DNA, 22 bp, Artificial Sequence
  chemically synthesized
ccaagaggttacaatgaatgta

SEQ ID NO: 1272831 - DNA, 22 bp, Artificial Sequence
  chemically synthesized
ccacaaaaagatgttttattac

SEQ ID NO: 1272832 - DNA, 22 bp, Artificial Sequence
  chemically synthesized
accacaaaaagatgttttatta

SEQ ID NO: 1272833 - DNA, 22 bp, Artificial Sequence
  chemically synthesized
ttaccacaaaaagatgttttat

SEQ ID NO: 1272834 - DNA, 22 bp, Artificial Sequence
  chemically synthesized
caatgaatgtaataaaacatct

SEQ ID NO: 1272835 - DNA, 22 bp, Artificial Sequence
  chemically synthesized
cttaccacaaaaagatgtttta

SEQ ID NO: 1272836 - DNA, 22 bp, Artificial Sequence
  chemically synthesized
catatttcttaccacaaaaaga

SEQ ID NO: 1272837 - DNA, 22 bp, Artificial Sequence
  chemically synthesized
ccatatttcttaccacaaaaag

SEQ ID NO: 1272838 - DNA, 22 bp, Artificial Sequence
  chemically synthesized
tccatatttcttaccacaaaaa

SEQ ID NO: 1272839 - DNA, 22 bp, Artificial Sequence
  chemically synthesized
tctttccatatttcttaccaca

SEQ ID NO: 1272840 - DNA, 22 bp, Artificial Sequence
  chemically synthesized
ctgtctttccatatttcttacc

SEQ ID NO: 1272841 - DNA, 22 bp, Artificial Sequence
  chemically synthesized
tttgtggtaagaaatatggaaa

SEQ ID NO: 1272842 - DNA, 22 bp, Artificial Sequence
  chemically synthesized
ttgtggtaagaaatatggaaag

SEQ ID NO: 1272843 - DNA, 22 bp, Artificial Sequence
  chemically synthesized
tgtggtaagaaatatggaaaga

SEQ ID NO: 1272844 - DNA, 22 bp, Artificial Sequence
  chemically synthesized
gtggtaagaaatatggaaagac

SEQ ID NO: 1272845 - DNA, 22 bp, Artificial Sequence
  chemically synthesized
tggtaagaaatatggaaagaca

SEQ ID NO: 1272846 - DNA, 22 bp, Artificial Sequence
  chemically synthesized
atgcagtagaacagctactgtc

SEQ ID NO: 1272847 - DNA, 22 bp, Artificial Sequence
  chemically synthesized
gaaggagattaatgcagtagaa

SEQ ID NO: 1272848 - DNA, 22 bp, Artificial Sequence
  chemically synthesized
acctggaaggagattaatgcag

SEQ ID NO: 1272849 - DNA, 22 bp, Artificial Sequence
  chemically synthesized
ttaacctggaaggagattaatg

SEQ ID NO: 1272850 - DNA, 22 bp, Artificial Sequence
  chemically synthesized
ttctactgcattaatctccttc

SEQ ID NO: 1272851 - DNA, 22 bp, Artificial Sequence
  chemically synthesized
cacctgttaacctggaaggaga

SEQ ID NO: 1272852 - DNA, 22 bp, Artificial Sequence
  chemically synthesized
tactgcattaatctccttccag

SEQ ID NO: 1272853 - DNA, 22 bp, Artificial Sequence
  chemically synthesized
ctgcattaatctccttccaggt

SEQ ID NO: 1272854 - DNA, 22 bp, Artificial Sequence
  chemically synthesized
ctgcacctgttaacctggaagg

SEQ ID NO: 1272855 - DNA, 22 bp, Artificial Sequence
  chemically synthesized
cattaatctccttccaggttaa

SEQ ID NO: 1272856 - DNA, 22 bp, Artificial Sequence
  chemically synthesized
ctgctgcacctgttaacctgga

SEQ ID NO: 1272857 - DNA, 22 bp, Artificial Sequence
  chemically synthesized
atctccttccaggttaacaggt

SEQ ID NO: 1272858 - DNA, 22 bp, Artificial Sequence
  chemically synthesized
cttccaggttaacaggtgcagc

SEQ ID NO: 1272859 - DNA, 22 bp, Artificial Sequence
  chemically synthesized
aagccaactgctgctgcacctg

SEQ ID NO: 1272860 - DNA, 22 bp, Artificial Sequence
  chemically synthesized
tgaagccaactgctgctgcacc

SEQ ID NO: 1272861 - DNA, 22 bp, Artificial Sequence
  chemically synthesized
ccaggttaacaggtgcagcagc

SEQ ID NO: 1272862 - DNA, 22 bp, Artificial Sequence
  chemically synthesized
ctgaagccaactgctgctgcac

SEQ ID NO: 1272863 - DNA, 22 bp, Artificial Sequence
  chemically synthesized
caggttaacaggtgcagcagca

SEQ ID NO: 1272864 - DNA, 22 bp, Artificial Sequence
  chemically synthesized
acaggtgcagcagcagttggct

SEQ ID NO: 1272865 - DNA, 22 bp, Artificial Sequence
  chemically synthesized
acaagagtttctgaagccaact

SEQ ID NO: 1272866 - DNA, 22 bp, Artificial Sequence
  chemically synthesized
aggaacgcattaacaagagttt

SEQ ID NO: 1272867 - DNA, 22 bp, Artificial Sequence
  chemically synthesized
gcttcagaaactcttgttaatg

SEQ ID NO: 1272868 - DNA, 22 bp, Artificial Sequence
  chemically synthesized
cagaaactcttgttaatgcgtt

SEQ ID NO: 1272869 - DNA, 22 bp, Artificial Sequence
  chemically synthesized
agaaactcttgttaatgcgttc

SEQ ID NO: 1272870 - DNA, 22 bp, Artificial Sequence
  chemically synthesized
ttgttaatgcgttcctcagact

SEQ ID NO: 1272871 - DNA, 22 bp, Artificial Sequence
  chemically synthesized
gttaatgcgttcctcagactgt

SEQ ID NO: 1272872 - DNA, 22 bp, Artificial Sequence
  chemically synthesized
ttaatgcgttcctcagactgtc

SEQ ID NO: 1272873 - DNA, 22 bp, Artificial Sequence
  chemically synthesized
atgcgttcctcagactgtccca

SEQ ID NO: 1272874 - DNA, 22 bp, Artificial Sequence
  chemically synthesized
ctcagactgtcccatctgcttc

SEQ ID NO: 1272875 - DNA, 22 bp, Artificial Sequence
  chemically synthesized
agactgtcccatctgcttctta

SEQ ID NO: 1272876 - DNA, 22 bp, Artificial Sequence
  chemically synthesized
tatggagcaaacaataagaagc

SEQ ID NO: 1272877 - DNA, 22 bp, Artificial Sequence
  chemically synthesized
gtatggagcaaacaataagaag

SEQ ID NO: 1272878 - DNA, 22 bp, Artificial Sequence
  chemically synthesized
tgtatggagcaaacaataagaa

SEQ ID NO: 1272879 - DNA, 22 bp, Artificial Sequence
  chemically synthesized
tcccatctgcttcttattgttt

SEQ ID NO: 1272880 - DNA, 22 bp, Artificial Sequence
  chemically synthesized
acatgcctttgtatggagcaaa

SEQ ID NO: 1272881 - DNA, 22 bp, Artificial Sequence
  chemically synthesized
cttcttattgtttgctccatac

SEQ ID NO: 1272882 - DNA, 22 bp, Artificial Sequence
  chemically synthesized
cttattgtttgctccatacaaa

SEQ ID NO: 1272883 - DNA, 22 bp, Artificial Sequence
  chemically synthesized
ttattgtttgctccatacaaag

SEQ ID NO: 1272884 - DNA, 22 bp, Artificial Sequence
  chemically synthesized
attgtttgctccatacaaaggc

SEQ ID NO: 1272885 - DNA, 22 bp, Artificial Sequence
  chemically synthesized
ttgtttgctccatacaaaggca

SEQ ID NO: 1272886 - DNA, 22 bp, Artificial Sequence
  chemically synthesized
tttgctccatacaaaggcatgt

SEQ ID NO: 1272887 - DNA, 22 bp, Artificial Sequence
  chemically synthesized
gctccatacaaaggcatgttaa

SEQ ID NO: 1272888 - DNA, 22 bp, Artificial Sequence
  chemically synthesized
ctccatacaaaggcatgttaat

SEQ ID NO: 1272889 - DNA, 22 bp, Artificial Sequence
  chemically synthesized
catacaaaggcatgttaatatg

SEQ ID NO: 1272890 - DNA, 22 bp, Artificial Sequence
  chemically synthesized
atatgtctacctacatatcatc

SEQ ID NO: 1272891 - DNA, 22 bp, Artificial Sequence
  chemically synthesized
cctacatatcatcattgtttca

SEQ ID NO: 1272892 - DNA, 22 bp, Artificial Sequence
  chemically synthesized
gcaaataataaaatgaaacaat

SEQ ID NO: 1272893 - DNA, 22 bp, Artificial Sequence
  chemically synthesized
catatcatcattgtttcatttt

SEQ ID NO: 1272894 - DNA, 22 bp, Artificial Sequence
  chemically synthesized
agttagcaaataataaaatgaa

SEQ ID NO: 1272895 - DNA, 22 bp, Artificial Sequence
  chemically synthesized
gcacagttcagttagcaaataa

SEQ ID NO: 1272896 - DNA, 22 bp, Artificial Sequence
  chemically synthesized
tttcattttattatttgctaac

SEQ ID NO: 1272897 - DNA, 22 bp, Artificial Sequence
  chemically synthesized
cattttattatttgctaactga

SEQ ID NO: 1272898 - DNA, 22 bp, Artificial Sequence
  chemically synthesized
attttattatttgctaactgaa

SEQ ID NO: 1272899 - DNA, 22 bp, Artificial Sequence
  chemically synthesized
tcatgttggcacagttcagtta

SEQ ID NO: 1272900 - DNA, 22 bp, Artificial Sequence
  chemically synthesized
tattatttgctaactgaactgt

SEQ ID NO: 1272901 - DNA, 22 bp, Artificial Sequence
  chemically synthesized
tatcatgttggcacagttcagt

SEQ ID NO: 1272902 - DNA, 22 bp, Artificial Sequence
  chemically synthesized
attatttgctaactgaactgtg

SEQ ID NO: 1272903 - DNA, 22 bp, Artificial Sequence
  chemically synthesized
ctatcatgttggcacagttcag

SEQ ID NO: 1272904 - DNA, 22 bp, Artificial Sequence
  chemically synthesized
ttatttgctaactgaactgtgc

SEQ ID NO: 1272905 - DNA, 22 bp, Artificial Sequence
  chemically synthesized
tctatcatgttggcacagttca

SEQ ID NO: 1272906 - DNA, 22 bp, Artificial Sequence
  chemically synthesized
ttctatcatgttggcacagttc

SEQ ID NO: 1272907 - DNA, 22 bp, Artificial Sequence
  chemically synthesized
tttgctaactgaactgtgccaa

SEQ ID NO: 1272908 - DNA, 22 bp, Artificial Sequence
  chemically synthesized
ttttctatcatgttggcacagt

SEQ ID NO: 1272909 - DNA, 22 bp, Artificial Sequence
  chemically synthesized
gctaactgaactgtgccaacat

SEQ ID NO: 1272910 - DNA, 22 bp, Artificial Sequence
  chemically synthesized
ctaactgaactgtgccaacatg

SEQ ID NO: 1272911 - DNA, 22 bp, Artificial Sequence
  chemically synthesized
attcttttctatcatgttggca

SEQ ID NO: 1272912 - DNA, 22 bp, Artificial Sequence
  chemically synthesized
gattcttttctatcatgttggc

SEQ ID NO: 1272913 - DNA, 22 bp, Artificial Sequence
  chemically synthesized
actgaactgtgccaacatgata

SEQ ID NO: 1272914 - DNA, 22 bp, Artificial Sequence
  chemically synthesized
aactgtgccaacatgatagaaa

SEQ ID NO: 1272915 - DNA, 22 bp, Artificial Sequence
  chemically synthesized
tagtaagcttgattcttttcta

SEQ ID NO: 1272916 - DNA, 22 bp, Artificial Sequence
  chemically synthesized
tgccaacatgatagaaaagaat

SEQ ID NO: 1272917 - DNA, 22 bp, Artificial Sequence
  chemically synthesized
aaattatagtaagcttgattct

SEQ ID NO: 1272918 - DNA, 22 bp, Artificial Sequence
  chemically synthesized
aaaattatagtaagcttgattc

SEQ ID NO: 1272919 - DNA, 22 bp, Artificial Sequence
  chemically synthesized
gtatcttaaaattatagtaagc

SEQ ID NO: 1272920 - DNA, 22 bp, Artificial Sequence
  chemically synthesized
agtatcttaaaattatagtaag

SEQ ID NO: 1272921 - DNA, 22 bp, Artificial Sequence
  chemically synthesized
gtaagtgtcttagtatcttaaa

SEQ ID NO: 1272922 - DNA, 22 bp, Artificial Sequence
  chemically synthesized
ctagtaagtgtcttagtatctt

SEQ ID NO: 1272923 - DNA, 22 bp, Artificial Sequence
  chemically synthesized
actataattttaagatactaag

SEQ ID NO: 1272924 - DNA, 22 bp, Artificial Sequence
  chemically synthesized
actagtaagtgtcttagtatct

SEQ ID NO: 1272925 - DNA, 22 bp, Artificial Sequence
  chemically synthesized
ctataattttaagatactaaga

SEQ ID NO: 1272926 - DNA, 22 bp, Artificial Sequence
  chemically synthesized
tactagtaagtgtcttagtatc

SEQ ID NO: 1272927 - DNA, 22 bp, Artificial Sequence
  chemically synthesized
ttactagtaagtgtcttagtat

SEQ ID NO: 1272928 - DNA, 22 bp, Artificial Sequence
  chemically synthesized
taattttaagatactaagacac

SEQ ID NO: 1272929 - DNA, 22 bp, Artificial Sequence
  chemically synthesized
tttttactagtaagtgtcttag

SEQ ID NO: 1272930 - DNA, 22 bp, Artificial Sequence
  chemically synthesized
taagatactaagacacttacta

SEQ ID NO: 1272931 - DNA, 22 bp, Artificial Sequence
  chemically synthesized
aagatactaagacacttactag

SEQ ID NO: 1272932 - DNA, 22 bp, Artificial Sequence
  chemically synthesized
agatactaagacacttactagt

SEQ ID NO: 1272933 - DNA, 22 bp, Artificial Sequence
  chemically synthesized
gataaacattgtttttactagt

SEQ ID NO: 1272934 - DNA, 22 bp, Artificial Sequence
  chemically synthesized
agacacttactagtaaaaacaa

SEQ ID NO: 1272935 - DNA, 22 bp, Artificial Sequence
  chemically synthesized
aattcgataaacattgttttta

SEQ ID NO: 1272936 - DNA, 22 bp, Artificial Sequence
  chemically synthesized
aaattcgataaacattgttttt

SEQ ID NO: 1272937 - DNA, 22 bp, Artificial Sequence
  chemically synthesized
actagtaaaaacaatgtttatc

SEQ ID NO: 1272938 - DNA, 22 bp, Artificial Sequence
  chemically synthesized
ctagtaaaaacaatgtttatcg

SEQ ID NO: 1272939 - DNA, 22 bp, Artificial Sequence
  chemically synthesized
gtaaaaacaatgtttatcgaat

SEQ ID NO: 1272940 - DNA, 22 bp, Artificial Sequence
  chemically synthesized
tgagtccacaaaggtcttaaat

SEQ ID NO: 1272941 - DNA, 22 bp, Artificial Sequence
  chemically synthesized
ttatgagtccacaaaggtctta

SEQ ID NO: 1272942 - DNA, 22 bp, Artificial Sequence
  chemically synthesized
tgttatgagtccacaaaggtct

SEQ ID NO: 1272943 - DNA, 22 bp, Artificial Sequence
  chemically synthesized
atcgaatttaagacctttgtgg

SEQ ID NO: 1272944 - DNA, 22 bp, Artificial Sequence
  chemically synthesized
tctgttatgagtccacaaaggt

SEQ ID NO: 1272945 - DNA, 22 bp, Artificial Sequence
  chemically synthesized
tcgaatttaagacctttgtgga

SEQ ID NO: 1272946 - DNA, 22 bp, Artificial Sequence
  chemically synthesized
gttctctgttatgagtccacaa

SEQ ID NO: 1272947 - DNA, 22 bp, Artificial Sequence
  chemically synthesized
aagacctttgtggactcataac

SEQ ID NO: 1272948 - DNA, 22 bp, Artificial Sequence
  chemically synthesized
agacctttgtggactcataaca

SEQ ID NO: 1272949 - DNA, 22 bp, Artificial Sequence
  chemically synthesized
cacagaactagttctctgttat

SEQ ID NO: 1272950 - DNA, 22 bp, Artificial Sequence
  chemically synthesized
tgtggactcataacagagaact

SEQ ID NO: 1272951 - DNA, 22 bp, Artificial Sequence
  chemically synthesized
ttgcacagaactagttctctgt

SEQ ID NO: 1272952 - DNA, 22 bp, Artificial Sequence
  chemically synthesized
gtggactcataacagagaacta

SEQ ID NO: 1272953 - DNA, 22 bp, Artificial Sequence
  chemically synthesized
tggactcataacagagaactag

SEQ ID NO: 1272954 - DNA, 22 bp, Artificial Sequence
  chemically synthesized
ataacagagaactagttctgtg

SEQ ID NO: 1272955 - DNA, 22 bp, Artificial Sequence
  chemically synthesized
aggtgaaaggaacctgttgcac

SEQ ID NO: 1272956 - DNA, 22 bp, Artificial Sequence
  chemically synthesized
gaggtgaaaggaacctgttgca

SEQ ID NO: 1272957 - DNA, 22 bp, Artificial Sequence
  chemically synthesized
gttctgtgcaacaggttccttt

SEQ ID NO: 1272958 - DNA, 22 bp, Artificial Sequence
  chemically synthesized
aatggcttgaggtgaaaggaac

SEQ ID NO: 1272959 - DNA, 22 bp, Artificial Sequence
  chemically synthesized
tgtgcaacaggttcctttcacc

SEQ ID NO: 1272960 - DNA, 22 bp, Artificial Sequence
  chemically synthesized
tgcaacaggttcctttcacctc

SEQ ID NO: 1272961 - DNA, 22 bp, Artificial Sequence
  chemically synthesized
attgaatggcttgaggtgaaag

SEQ ID NO: 1272962 - DNA, 22 bp, Artificial Sequence
  chemically synthesized
aaatgttgattgaatggcttga

SEQ ID NO: 1272963 - DNA, 22 bp, Artificial Sequence
  chemically synthesized
aaaatgttgattgaatggcttg

SEQ ID NO: 1272964 - DNA, 22 bp, Artificial Sequence
  chemically synthesized
taaaatgttgattgaatggctt

SEQ ID NO: 1272965 - DNA, 22 bp, Artificial Sequence
  chemically synthesized
ttaaaatgttgattgaatggct

SEQ ID NO: 1272966 - DNA, 22 bp, Artificial Sequence
  chemically synthesized
ctttcacctcaagccattcaat

SEQ ID NO: 1272967 - DNA, 22 bp, Artificial Sequence
  chemically synthesized
tcacctcaagccattcaatcaa

SEQ ID NO: 1272968 - DNA, 22 bp, Artificial Sequence
  chemically synthesized
cacctcaagccattcaatcaac

SEQ ID NO: 1272969 - DNA, 22 bp, Artificial Sequence
  chemically synthesized
acctcaagccattcaatcaaca

SEQ ID NO: 1272970 - DNA, 22 bp, Artificial Sequence
  chemically synthesized
gaatttttaaaatgttgattga

SEQ ID NO: 1272971 - DNA, 22 bp, Artificial Sequence
  chemically synthesized
aagccattcaatcaacatttta

SEQ ID NO: 1272972 - DNA, 22 bp, Artificial Sequence
  chemically synthesized
aatcaacattttaaaaattcca

SEQ ID NO: 1272973 - DNA, 22 bp, Artificial Sequence
  chemically synthesized
gagcaatcgtattggaattttt

SEQ ID NO: 1272974 - DNA, 22 bp, Artificial Sequence
  chemically synthesized
ggagcaatcgtattggaatttt

SEQ ID NO: 1272975 - DNA, 22 bp, Artificial Sequence
  chemically synthesized
taaaaattccaatacgattgct

SEQ ID NO: 1272976 - DNA, 22 bp, Artificial Sequence
  chemically synthesized
ataggtccttggagcaatcgta

SEQ ID NO: 1272977 - DNA, 22 bp, Artificial Sequence
  chemically synthesized
aaaaattccaatacgattgctc

SEQ ID NO: 1272978 - DNA, 22 bp, Artificial Sequence
  chemically synthesized
aaaattccaatacgattgctcc

SEQ ID NO: 1272979 - DNA, 22 bp, Artificial Sequence
  chemically synthesized
tcataggtccttggagcaatcg

SEQ ID NO: 1272980 - DNA, 22 bp, Artificial Sequence
  chemically synthesized
caatacgattgctccaaggacc

SEQ ID NO: 1272981 - DNA, 22 bp, Artificial Sequence
  chemically synthesized
aatccaaagtatctctcatagg

SEQ ID NO: 1272982 - DNA, 22 bp, Artificial Sequence
  chemically synthesized
gaatccaaagtatctctcatag

SEQ ID NO: 1272983 - DNA, 22 bp, Artificial Sequence
  chemically synthesized
ctccaaggacctatgagagata

SEQ ID NO: 1272984 - DNA, 22 bp, Artificial Sequence
  chemically synthesized
caaggacctatgagagatactt

SEQ ID NO: 1272985 - DNA, 22 bp, Artificial Sequence
  chemically synthesized
aggtccttgaatccaaagtatc

SEQ ID NO: 1272986 - DNA, 22 bp, Artificial Sequence
  chemically synthesized
tgaggtccttgaatccaaagta

SEQ ID NO: 1272987 - DNA, 22 bp, Artificial Sequence
  chemically synthesized
tgagagatactttggattcaag

SEQ ID NO: 1272988 - DNA, 22 bp, Artificial Sequence
  chemically synthesized
gactctgaggtccttgaatcca

SEQ ID NO: 1272989 - DNA, 22 bp, Artificial Sequence
  chemically synthesized
cactcgactctgaggtccttga

SEQ ID NO: 1272990 - DNA, 22 bp, Artificial Sequence
  chemically synthesized
ccactcgactctgaggtccttg

SEQ ID NO: 1272991 - DNA, 22 bp, Artificial Sequence
  chemically synthesized
tggattcaaggacctcagagtc

SEQ ID NO: 1272992 - DNA, 22 bp, Artificial Sequence
  chemically synthesized
ggattcaaggacctcagagtcg

SEQ ID NO: 1272993 - DNA, 22 bp, Artificial Sequence
  chemically synthesized
gattcaaggacctcagagtcga

SEQ ID NO: 1272994 - DNA, 22 bp, Artificial Sequence
  chemically synthesized
aagaaagagtttccactcgact

SEQ ID NO: 1272995 - DNA, 22 bp, Artificial Sequence
  chemically synthesized
aaggacctcagagtcgagtgga

SEQ ID NO: 1272996 - DNA, 22 bp, Artificial Sequence
  chemically synthesized
aaagaaagagtttccactcgac

SEQ ID NO: 1272997 - DNA, 22 bp, Artificial Sequence
  chemically synthesized
tttaaagaaagagtttccactc

SEQ ID NO: 1272998 - DNA, 22 bp, Artificial Sequence
  chemically synthesized
tatttaaagaaagagtttccac

SEQ ID NO: 1272999 - DNA, 22 bp, Artificial Sequence
  chemically synthesized
agagtcgagtggaaactctttc

SEQ ID NO: 1273000 - DNA, 22 bp, Artificial Sequence
  chemically synthesized
ggtcacattctatttaaagaaa

SEQ ID NO: 1273001 - DNA, 22 bp, Artificial Sequence
  chemically synthesized
tgggtcacattctatttaaaga

SEQ ID NO: 1273002 - DNA, 22 bp, Artificial Sequence
  chemically synthesized
ctgggtcacattctatttaaag

SEQ ID NO: 1273003 - DNA, 22 bp, Artificial Sequence
  chemically synthesized
ggcttctgggtcacattctatt

SEQ ID NO: 1273004 - DNA, 22 bp, Artificial Sequence
  chemically synthesized
tttctttaaatagaatgtgacc

SEQ ID NO: 1273005 - DNA, 22 bp, Artificial Sequence
  chemically synthesized
tctttaaatagaatgtgaccca

SEQ ID NO: 1273006 - DNA, 22 bp, Artificial Sequence
  chemically synthesized
atattgggcttctgggtcacat

SEQ ID NO: 1273007 - DNA, 22 bp, Artificial Sequence
  chemically synthesized
ctttaaatagaatgtgacccag

SEQ ID NO: 1273008 - DNA, 22 bp, Artificial Sequence
  chemically synthesized
catattgggcttctgggtcaca

SEQ ID NO: 1273009 - DNA, 22 bp, Artificial Sequence
  chemically synthesized
tttaaatagaatgtgacccaga

SEQ ID NO: 1273010 - DNA, 22 bp, Artificial Sequence
  chemically synthesized
taaatagaatgtgacccagaag

SEQ ID NO: 1273011 - DNA, 22 bp, Artificial Sequence
  chemically synthesized
tttcatattgggcttctgggtc

SEQ ID NO: 1273012 - DNA, 22 bp, Artificial Sequence
  chemically synthesized
aaatagaatgtgacccagaagc

SEQ ID NO: 1273013 - DNA, 22 bp, Artificial Sequence
  chemically synthesized
aatagaatgtgacccagaagcc

SEQ ID NO: 1273014 - DNA, 22 bp, Artificial Sequence
  chemically synthesized
atctgtttcatattgggcttct

SEQ ID NO: 1273015 - DNA, 22 bp, Artificial Sequence
  chemically synthesized
catctgtttcatattgggcttc

SEQ ID NO: 1273016 - DNA, 22 bp, Artificial Sequence
  chemically synthesized
ttcatctgtttcatattgggct

SEQ ID NO: 1273017 - DNA, 22 bp, Artificial Sequence
  chemically synthesized
actcttcatctgtttcatattg

SEQ ID NO: 1273018 - DNA, 22 bp, Artificial Sequence
  chemically synthesized
aatagctcactcttcatctgtt

SEQ ID NO: 1273019 - DNA, 22 bp, Artificial Sequence
  chemically synthesized
gctgaatagctcactcttcatc

SEQ ID NO: 1273020 - DNA, 22 bp, Artificial Sequence
  chemically synthesized
agctgaatagctcactcttcat

SEQ ID NO: 1273021 - DNA, 22 bp, Artificial Sequence
  chemically synthesized
tagctgaatagctcactcttca

SEQ ID NO: 1273022 - DNA, 22 bp, Artificial Sequence
  chemically synthesized
ctttagctgaatagctcactct

SEQ ID NO: 1273023 - DNA, 22 bp, Artificial Sequence
  chemically synthesized
ccaccatcagcattcctttagc

SEQ ID NO: 1273024 - DNA, 22 bp, Artificial Sequence
  chemically synthesized
ttcagctaaaggaatgctgatg

SEQ ID NO: 1273025 - DNA, 22 bp, Artificial Sequence
  chemically synthesized
agctaaaggaatgctgatggtg

SEQ ID NO: 1273026 - DNA, 22 bp, Artificial Sequence
  chemically synthesized
aaggaatgctgatggtggtagt

SEQ ID NO: 1273027 - DNA, 22 bp, Artificial Sequence
  chemically synthesized
atggtggtagtggtggtggtgg

SEQ ID NO: 1273028 - DNA, 22 bp, Artificial Sequence
  chemically synthesized
aagggccatgtgtagggtgaga

SEQ ID NO: 1273029 - DNA, 22 bp, Artificial Sequence
  chemically synthesized
caagggccatgtgtagggtgag

SEQ ID NO: 1273030 - DNA, 22 bp, Artificial Sequence
  chemically synthesized
tcttctcaccctacacatggcc

SEQ ID NO: 1273031 - DNA, 22 bp, Artificial Sequence
  chemically synthesized
gtagtgtttcaagggccatgtg

SEQ ID NO: 1273032 - DNA, 22 bp, Artificial Sequence
  chemically synthesized
agtagtgtttcaagggccatgt

SEQ ID NO: 1273033 - DNA, 22 bp, Artificial Sequence
  chemically synthesized
tagtagtgtttcaagggccatg

SEQ ID NO: 1273034 - DNA, 22 bp, Artificial Sequence
  chemically synthesized
ctcaccctacacatggcccttg

SEQ ID NO: 1273035 - DNA, 22 bp, Artificial Sequence
  chemically synthesized
tcaccctacacatggcccttga

SEQ ID NO: 1273036 - DNA, 22 bp, Artificial Sequence
  chemically synthesized
accctacacatggcccttgaaa

SEQ ID NO: 1273037 - DNA, 22 bp, Artificial Sequence
  chemically synthesized
gtgggttttagtagtgtttcaa

SEQ ID NO: 1273038 - DNA, 22 bp, Artificial Sequence
  chemically synthesized
agtgggttttagtagtgtttca

SEQ ID NO: 1273039 - DNA, 22 bp, Artificial Sequence
  chemically synthesized
cacatggcccttgaaacactac

SEQ ID NO: 1273040 - DNA, 22 bp, Artificial Sequence
  chemically synthesized
gagccttagtgggttttagtag

SEQ ID NO: 1273041 - DNA, 22 bp, Artificial Sequence
  chemically synthesized
actggagccttagtgggtttta

SEQ ID NO: 1273042 - DNA, 22 bp, Artificial Sequence
  chemically synthesized
gaaacactactaaaacccacta

SEQ ID NO: 1273043 - DNA, 22 bp, Artificial Sequence
  chemically synthesized
aaacactactaaaacccactaa

SEQ ID NO: 1273044 - DNA, 22 bp, Artificial Sequence
  chemically synthesized
caatagtctcactggagcctta

SEQ ID NO: 1273045 - DNA, 22 bp, Artificial Sequence
  chemically synthesized
ctaaaacccactaaggctccag

SEQ ID NO: 1273046 - DNA, 22 bp, Artificial Sequence
  chemically synthesized
acaatagtctcactggagcctt

SEQ ID NO: 1273047 - DNA, 22 bp, Artificial Sequence
  chemically synthesized
tacaatagtctcactggagcct

SEQ ID NO: 1273048 - DNA, 22 bp, Artificial Sequence
  chemically synthesized
aaacccactaaggctccagtga

SEQ ID NO: 1273049 - DNA, 22 bp, Artificial Sequence
  chemically synthesized
aggctccagtgagactattgta

SEQ ID NO: 1273050 - DNA, 22 bp, Artificial Sequence
  chemically synthesized
cagtgagactattgtaaaattc

SEQ ID NO: 1273051 - DNA, 22 bp, Artificial Sequence
  chemically synthesized
gagaatatatgggaattttaca

SEQ ID NO: 1273052 - DNA, 22 bp, Artificial Sequence
  chemically synthesized
ggaactggagaatatatgggaa

SEQ ID NO: 1273053 - DNA, 22 bp, Artificial Sequence
  chemically synthesized
ttgtaaaattcccatatattct

SEQ ID NO: 1273054 - DNA, 22 bp, Artificial Sequence
  chemically synthesized
taaaattcccatatattctcca

SEQ ID NO: 1273055 - DNA, 22 bp, Artificial Sequence
  chemically synthesized
gtggacaaactaggaactggag

SEQ ID NO: 1273056 - DNA, 22 bp, Artificial Sequence
  chemically synthesized
ggtggacaaactaggaactgga

SEQ ID NO: 1273057 - DNA, 22 bp, Artificial Sequence
  chemically synthesized
ccatatattctccagttcctag

SEQ ID NO: 1273058 - DNA, 22 bp, Artificial Sequence
  chemically synthesized
tggataggtttggtggacaaac

SEQ ID NO: 1273059 - DNA, 22 bp, Artificial Sequence
  chemically synthesized
tccagttcctagtttgtccacc

SEQ ID NO: 1273060 - DNA, 22 bp, Artificial Sequence
  chemically synthesized
cagttcctagtttgtccaccaa

SEQ ID NO: 1273061 - DNA, 22 bp, Artificial Sequence
  chemically synthesized
ctagtttgtccaccaaacctat

SEQ ID NO: 1273062 - DNA, 22 bp, Artificial Sequence
  chemically synthesized
gtttgtccaccaaacctatcca

SEQ ID NO: 1273063 - DNA, 22 bp, Artificial Sequence
  chemically synthesized
gtccaccaaacctatccacagc

SEQ ID NO: 1273064 - DNA, 22 bp, Artificial Sequence
  chemically synthesized
tccaccaaacctatccacagct

SEQ ID NO: 1273065 - DNA, 22 bp, Artificial Sequence
  chemically synthesized
aaaacaaagaaaagctgtggat

SEQ ID NO: 1273066 - DNA, 22 bp, Artificial Sequence
  chemically synthesized
aaagttaaaaacaaagaaaagc

SEQ ID NO: 1273067 - DNA, 22 bp, Artificial Sequence
  chemically synthesized
aaaagttaaaaacaaagaaaag

SEQ ID NO: 1273068 - DNA, 22 bp, Artificial Sequence
  chemically synthesized
tccacagcttttctttgttttt

SEQ ID NO: 1273069 - DNA, 22 bp, Artificial Sequence
  chemically synthesized
aacttaaaagttaaaaacaaag

SEQ ID NO: 1273070 - DNA, 22 bp, Artificial Sequence
  chemically synthesized
ttctttgtttttaacttttaag

SEQ ID NO: 1273071 - DNA, 22 bp, Artificial Sequence
  chemically synthesized
tctttgtttttaacttttaagt

SEQ ID NO: 1273072 - DNA, 22 bp, Artificial Sequence
  chemically synthesized
ctttgtttttaacttttaagtt

SEQ ID NO: 1273073 - DNA, 22 bp, Artificial Sequence
  chemically synthesized
tttgtttttaacttttaagttc

SEQ ID NO: 1273074 - DNA, 22 bp, Artificial Sequence
  chemically synthesized
tgtttttaacttttaagttcag

SEQ ID NO: 1273075 - DNA, 22 bp, Artificial Sequence
  chemically synthesized
gtttttaacttttaagttcagg

SEQ ID NO: 1273076 - DNA, 22 bp, Artificial Sequence
  chemically synthesized
tttttaacttttaagttcaggg

SEQ ID NO: 1273077 - DNA, 22 bp, Artificial Sequence
  chemically synthesized
ttaacttttaagttcaggggta

SEQ ID NO: 1273078 - DNA, 22 bp, Artificial Sequence
  chemically synthesized
taacttttaagttcaggggtac

SEQ ID NO: 1273079 - DNA, 22 bp, Artificial Sequence
  chemically synthesized
aacttttaagttcaggggtaca

SEQ ID NO: 1273080 - DNA, 22 bp, Artificial Sequence
  chemically synthesized
acttttaagttcaggggtacat

SEQ ID NO: 1273081 - DNA, 22 bp, Artificial Sequence
  chemically synthesized
ttaagttcaggggtacatgtgc

SEQ ID NO: 1273082 - DNA, 22 bp, Artificial Sequence
  chemically synthesized
tataacacacatgcacatgtac

SEQ ID NO: 1273083 - DNA, 22 bp, Artificial Sequence
  chemically synthesized
taagttcaggggtacatgtgca

SEQ ID NO: 1273084 - DNA, 22 bp, Artificial Sequence
  chemically synthesized
aagttcaggggtacatgtgcat

SEQ ID NO: 1273085 - DNA, 22 bp, Artificial Sequence
  chemically synthesized
agttcaggggtacatgtgcatg

SEQ ID NO: 1273086 - DNA, 22 bp, Artificial Sequence
  chemically synthesized
cctatataacacacatgcacat

SEQ ID NO: 1273087 - DNA, 22 bp, Artificial Sequence
  chemically synthesized
acctatataacacacatgcaca

SEQ ID NO: 1273088 - DNA, 22 bp, Artificial Sequence
  chemically synthesized
aggggtacatgtgcatgtgtgt

SEQ ID NO: 1273089 - DNA, 22 bp, Artificial Sequence
  chemically synthesized
tataggtaaacttatgtcatgg

SEQ ID NO: 1273090 - DNA, 22 bp, Artificial Sequence
  chemically synthesized
tacaacaaatccccatgacata

SEQ ID NO: 1273091 - DNA, 22 bp, Artificial Sequence
  chemically synthesized
atgtcatggggatttgttgtac

SEQ ID NO: 1273092 - DNA, 22 bp, Artificial Sequence
  chemically synthesized
tgtcatggggatttgttgtaca

SEQ ID NO: 1273093 - DNA, 22 bp, Artificial Sequence
  chemically synthesized
gatgacaaaataatctgtacaa

SEQ ID NO: 1273094 - DNA, 22 bp, Artificial Sequence
  chemically synthesized
tatctggatgacaaaataatct

SEQ ID NO: 1273095 - DNA, 22 bp, Artificial Sequence
  chemically synthesized
atatctggatgacaaaataatc

SEQ ID NO: 1273096 - DNA, 22 bp, Artificial Sequence
  chemically synthesized
gttgtacagattattttgtcat

SEQ ID NO: 1273097 - DNA, 22 bp, Artificial Sequence
  chemically synthesized
ttgtacagattattttgtcatc

SEQ ID NO: 1273098 - DNA, 22 bp, Artificial Sequence
  chemically synthesized
tacagattattttgtcatccag

SEQ ID NO: 1273099 - DNA, 22 bp, Artificial Sequence
  chemically synthesized
gtaggcttatatctggatgaca

SEQ ID NO: 1273100 - DNA, 22 bp, Artificial Sequence
  chemically synthesized
atggttagtaggcttatatctg

SEQ ID NO: 1273101 - DNA, 22 bp, Artificial Sequence
  chemically synthesized
ttttgtcatccagatataagcc

SEQ ID NO: 1273102 - DNA, 22 bp, Artificial Sequence
  chemically synthesized
tgtcatccagatataagcctac

SEQ ID NO: 1273103 - DNA, 22 bp, Artificial Sequence
  chemically synthesized
gtcatccagatataagcctact

SEQ ID NO: 1273104 - DNA, 22 bp, Artificial Sequence
  chemically synthesized
tcatccagatataagcctacta

SEQ ID NO: 1273105 - DNA, 22 bp, Artificial Sequence
  chemically synthesized
aaaaaaaataactgatggttag

SEQ ID NO: 1273106 - DNA, 22 bp, Artificial Sequence
  chemically synthesized
ctaaccatcagttatttttttt

SEQ ID NO: 1273107 - DNA, 22 bp, Artificial Sequence
  chemically synthesized
accatcagttatttttttttaa

SEQ ID NO: 1273108 - DNA, 22 bp, Artificial Sequence
  chemically synthesized
tttttttttaatcctctccctc

SEQ ID NO: 1273109 - DNA, 22 bp, Artificial Sequence
  chemically synthesized
ttttttaatcctctccctcctc

SEQ ID NO: 1273110 - DNA, 22 bp, Artificial Sequence
  chemically synthesized
tttttaatcctctccctcctcc

SEQ ID NO: 1273111 - DNA, 22 bp, Artificial Sequence
  chemically synthesized
ttttaatcctctccctcctccc

SEQ ID NO: 1273112 - DNA, 22 bp, Artificial Sequence
  chemically synthesized
tttaatcctctccctcctccca

SEQ ID NO: 1273113 - DNA, 22 bp, Artificial Sequence
  chemically synthesized
gagggtggagggtgggaggagg

SEQ ID NO: 1273114 - DNA, 22 bp, Artificial Sequence
  chemically synthesized
ttaatcctctccctcctcccac

SEQ ID NO: 1273115 - DNA, 22 bp, Artificial Sequence
  chemically synthesized
taatcctctccctcctcccacc

SEQ ID NO: 1273116 - DNA, 22 bp, Artificial Sequence
  chemically synthesized
aatcctctccctcctcccaccc

SEQ ID NO: 1273117 - DNA, 22 bp, Artificial Sequence
  chemically synthesized
ttggagggtggagggtgggagg

SEQ ID NO: 1273118 - DNA, 22 bp, Artificial Sequence
  chemically synthesized
atcctctccctcctcccaccct

SEQ ID NO: 1273119 - DNA, 22 bp, Artificial Sequence
  chemically synthesized
tccctcctcccaccctccaccc

SEQ ID NO: 1273120 - DNA, 22 bp, Artificial Sequence
  chemically synthesized
ggacctgttggagggtggaggg

SEQ ID NO: 1273121 - DNA, 22 bp, Artificial Sequence
  chemically synthesized
cctcctcccaccctccaccctc

SEQ ID NO: 1273122 - DNA, 22 bp, Artificial Sequence
  chemically synthesized
ctcccaccctccaccctccaac

SEQ ID NO: 1273123 - DNA, 22 bp, Artificial Sequence
  chemically synthesized
ccaccctccaccctccaacagg

SEQ ID NO: 1273124 - DNA, 22 bp, Artificial Sequence
  chemically synthesized
caccctccaacaggtcccaatg

SEQ ID NO: 1273125 - DNA, 22 bp, Artificial Sequence
  chemically synthesized
gaggggaataacatacattggg

SEQ ID NO: 1273126 - DNA, 22 bp, Artificial Sequence
  chemically synthesized
agaggggaataacatacattgg

SEQ ID NO: 1273127 - DNA, 22 bp, Artificial Sequence
  chemically synthesized
caacaggtcccaatgtatgtta

SEQ ID NO: 1273128 - DNA, 22 bp, Artificial Sequence
  chemically synthesized
aatgatgaaaacacatggacac

SEQ ID NO: 1273129 - DNA, 22 bp, Artificial Sequence
  chemically synthesized
ttcccctctaagtgtccatgtg

SEQ ID NO: 1273130 - DNA, 22 bp, Artificial Sequence
  chemically synthesized
ccctctaagtgtccatgtgttt

SEQ ID NO: 1273131 - DNA, 22 bp, Artificial Sequence
  chemically synthesized
taagtgtccatgtgttttcatc

SEQ ID NO: 1273132 - DNA, 22 bp, Artificial Sequence
  chemically synthesized
agtgtccatgtgttttcatcat

SEQ ID NO: 1273133 - DNA, 22 bp, Artificial Sequence
  chemically synthesized
caggtgggagctaaatgatgaa

SEQ ID NO: 1273134 - DNA, 22 bp, Artificial Sequence
  chemically synthesized
gcaggtgggagctaaatgatga

SEQ ID NO: 1273135 - DNA, 22 bp, Artificial Sequence
  chemically synthesized
acttgcaggtgggagctaaatg

SEQ ID NO: 1273136 - DNA, 22 bp, Artificial Sequence
  chemically synthesized
tcacttgcaggtgggagctaaa

SEQ ID NO: 1273137 - DNA, 22 bp, Artificial Sequence
  chemically synthesized
ctcacttgcaggtgggagctaa

SEQ ID NO: 1273138 - DNA, 22 bp, Artificial Sequence
  chemically synthesized
tcatcatttagctcccacctgc

SEQ ID NO: 1273139 - DNA, 22 bp, Artificial Sequence
  chemically synthesized
catcatttagctcccacctgca

SEQ ID NO: 1273140 - DNA, 22 bp, Artificial Sequence
  chemically synthesized
tgtcttctcacttgcaggtggg

SEQ ID NO: 1273141 - DNA, 22 bp, Artificial Sequence
  chemically synthesized
atcatttagctcccacctgcaa

SEQ ID NO: 1273142 - DNA, 22 bp, Artificial Sequence
  chemically synthesized
agctcccacctgcaagtgagaa

SEQ ID NO: 1273143 - DNA, 22 bp, Artificial Sequence
  chemically synthesized
gctcccacctgcaagtgagaag

SEQ ID NO: 1273144 - DNA, 22 bp, Artificial Sequence
  chemically synthesized
ccacctgcaagtgagaagacac

SEQ ID NO: 1273145 - DNA, 22 bp, Artificial Sequence
  chemically synthesized
caagtgagaagacacagtattt

SEQ ID NO: 1273146 - DNA, 22 bp, Artificial Sequence
  chemically synthesized
atacagtaacagaaaatcaaat

SEQ ID NO: 1273147 - DNA, 22 bp, Artificial Sequence
  chemically synthesized
gcaaactaatacagtaacagaa

SEQ ID NO: 1273148 - DNA, 22 bp, Artificial Sequence
  chemically synthesized
agcaaactaatacagtaacaga

SEQ ID NO: 1273149 - DNA, 22 bp, Artificial Sequence
  chemically synthesized
tccttagcaaactaatacagta

SEQ ID NO: 1273150 - DNA, 22 bp, Artificial Sequence
  chemically synthesized
gattttctgttactgtattagt

SEQ ID NO: 1273151 - DNA, 22 bp, Artificial Sequence
  chemically synthesized
attttctgttactgtattagtt

SEQ ID NO: 1273152 - DNA, 22 bp, Artificial Sequence
  chemically synthesized
tctgttactgtattagtttgct

SEQ ID NO: 1273153 - DNA, 22 bp, Artificial Sequence
  chemically synthesized
ctgttactgtattagtttgcta

SEQ ID NO: 1273154 - DNA, 22 bp, Artificial Sequence
  chemically synthesized
tgttactgtattagtttgctaa

SEQ ID NO: 1273155 - DNA, 22 bp, Artificial Sequence
  chemically synthesized
gaggccattatccttagcaaac

SEQ ID NO: 1273156 - DNA, 22 bp, Artificial Sequence
  chemically synthesized
ttactgtattagtttgctaagg

SEQ ID NO: 1273157 - DNA, 22 bp, Artificial Sequence
  chemically synthesized
ctgtattagtttgctaaggata

SEQ ID NO: 1273158 - DNA, 22 bp, Artificial Sequence
  chemically synthesized
tattagtttgctaaggataatg

SEQ ID NO: 1273159 - DNA, 22 bp, Artificial Sequence
  chemically synthesized
gtttgctaaggataatggcctc

SEQ ID NO: 1273160 - DNA, 22 bp, Artificial Sequence
  chemically synthesized
gctaaggataatggcctccaac

SEQ ID NO: 1273161 - DNA, 22 bp, Artificial Sequence
  chemically synthesized
ctaaggataatggcctccaact

SEQ ID NO: 1273162 - DNA, 22 bp, Artificial Sequence
  chemically synthesized
aggataatggcctccaactcca

SEQ ID NO: 1273163 - DNA, 22 bp, Artificial Sequence
  chemically synthesized
caggaacatggatggagttgga

SEQ ID NO: 1273164 - DNA, 22 bp, Artificial Sequence
  chemically synthesized
gcaggaacatggatggagttgg

SEQ ID NO: 1273165 - DNA, 22 bp, Artificial Sequence
  chemically synthesized
tgcaggaacatggatggagttg

SEQ ID NO: 1273166 - DNA, 22 bp, Artificial Sequence
  chemically synthesized
caactccatccatgttcctgca

SEQ ID NO: 1273167 - DNA, 22 bp, Artificial Sequence
  chemically synthesized
catccatgttcctgcaaagtac

SEQ ID NO: 1273168 - DNA, 22 bp, Artificial Sequence
  chemically synthesized
ctgcaaagtacatggtctcatt

SEQ ID NO: 1273169 - DNA, 22 bp, Artificial Sequence
  chemically synthesized
caaagtacatggtctcattctt

SEQ ID NO: 1273170 - DNA, 22 bp, Artificial Sequence
  chemically synthesized
cgtagccataagaaagaatgag

SEQ ID NO: 1273171 - DNA, 22 bp, Artificial Sequence
  chemically synthesized
attctttcttatggctacgcag

SEQ ID NO: 1273172 - DNA, 22 bp, Artificial Sequence
  chemically synthesized
tttcttatggctacgcagtata

SEQ ID NO: 1273173 - DNA, 22 bp, Artificial Sequence
  chemically synthesized
tcttatggctacgcagtatacc

SEQ ID NO: 1273174 - DNA, 22 bp, Artificial Sequence
  chemically synthesized
cttatggctacgcagtatacca

SEQ ID NO: 1273175 - DNA, 22 bp, Artificial Sequence
  chemically synthesized
ttatggctacgcagtataccat

SEQ ID NO: 1273176 - DNA, 22 bp, Artificial Sequence
  chemically synthesized
atggctacgcagtataccatgg

SEQ ID NO: 1273177 - DNA, 22 bp, Artificial Sequence
  chemically synthesized
tggctacgcagtataccatggt

SEQ ID NO: 1273178 - DNA, 22 bp, Artificial Sequence
  chemically synthesized
cgcagtataccatggtgtatat

SEQ ID NO: 1273179 - DNA, 22 bp, Artificial Sequence
  chemically synthesized
gataaagcaaatgtggtacata

SEQ ID NO: 1273180 - DNA, 22 bp, Artificial Sequence
  chemically synthesized
aatgcccaccaatgatagactg

SEQ ID NO: 1273181 - DNA, 22 bp, Artificial Sequence
  chemically synthesized
gctttatccagtctatcattgg

SEQ ID NO: 1273182 - DNA, 22 bp, Artificial Sequence
  chemically synthesized
ctttatccagtctatcattggt

SEQ ID NO: 1273183 - DNA, 22 bp, Artificial Sequence
  chemically synthesized
tatccagtctatcattggtggg

SEQ ID NO: 1273184 - DNA, 22 bp, Artificial Sequence
  chemically synthesized
atccagtctatcattggtgggc

SEQ ID NO: 1273185 - DNA, 22 bp, Artificial Sequence
  chemically synthesized
tccagtctatcattggtgggca

SEQ ID NO: 1273186 - DNA, 22 bp, Artificial Sequence
  chemically synthesized
tcattggtgggcatttaggttg

SEQ ID NO: 1273187 - DNA, 22 bp, Artificial Sequence
  chemically synthesized
gtgggcatttaggttgattcca

SEQ ID NO: 1273188 - DNA, 22 bp, Artificial Sequence
  chemically synthesized
acaatagcaaagacgtggaatc

SEQ ID NO: 1273189 - DNA, 22 bp, Artificial Sequence
  chemically synthesized
ttcacaatagcaaagacgtgga

SEQ ID NO: 1273190 - DNA, 22 bp, Artificial Sequence
  chemically synthesized
aggttgattccacgtctttgct

SEQ ID NO: 1273191 - DNA, 22 bp, Artificial Sequence
  chemically synthesized
ggttgattccacgtctttgcta

SEQ ID NO: 1273192 - DNA, 22 bp, Artificial Sequence
  chemically synthesized
cagcactattcacaatagcaaa

SEQ ID NO: 1273193 - DNA, 22 bp, Artificial Sequence
  chemically synthesized
attccacgtctttgctattgtg

SEQ ID NO: 1273194 - DNA, 22 bp, Artificial Sequence
  chemically synthesized
attgcagcactattcacaatag

SEQ ID NO: 1273195 - DNA, 22 bp, Artificial Sequence
  chemically synthesized
cacgtctttgctattgtgaata

SEQ ID NO: 1273196 - DNA, 22 bp, Artificial Sequence
  chemically synthesized
tgctattgtgaatagtgctgca

SEQ ID NO: 1273197 - DNA, 22 bp, Artificial Sequence
  chemically synthesized
gctattgtgaatagtgctgcaa

SEQ ID NO: 1273198 - DNA, 22 bp, Artificial Sequence
  chemically synthesized
ctattgtgaatagtgctgcaat

SEQ ID NO: 1273199 - DNA, 22 bp, Artificial Sequence
  chemically synthesized
ttgtgaatagtgctgcaatgaa

SEQ ID NO: 1273200 - DNA, 22 bp, Artificial Sequence
  chemically synthesized
tgaatagtgctgcaatgaacat

SEQ ID NO: 1273201 - DNA, 22 bp, Artificial Sequence
  chemically synthesized
caaaggcacatgcacacgtatg

SEQ ID NO: 1273202 - DNA, 22 bp, Artificial Sequence
  chemically synthesized
ttacaaaggcacatgcacacgt

SEQ ID NO: 1273203 - DNA, 22 bp, Artificial Sequence
  chemically synthesized
caatgaacatacgtgtgcatgt

SEQ ID NO: 1273204 - DNA, 22 bp, Artificial Sequence
  chemically synthesized
tattacaaaggcacatgcacac

SEQ ID NO: 1273205 - DNA, 22 bp, Artificial Sequence
  chemically synthesized
tacccaaaggaatataaatcgt

SEQ ID NO: 1273206 - DNA, 22 bp, Artificial Sequence
  chemically synthesized
atacccaaaggaatataaatcg

SEQ ID NO: 1273207 - DNA, 22 bp, Artificial Sequence
  chemically synthesized
tgtaatagaacgatttatattc

SEQ ID NO: 1273208 - DNA, 22 bp, Artificial Sequence
  chemically synthesized
gtaatagaacgatttatattcc

SEQ ID NO: 1273209 - DNA, 22 bp, Artificial Sequence
  chemically synthesized
taatagaacgatttatattcct

SEQ ID NO: 1273210 - DNA, 22 bp, Artificial Sequence
  chemically synthesized
catttatacccaaaggaatata

SEQ ID NO: 1273211 - DNA, 22 bp, Artificial Sequence
  chemically synthesized
ctgcatttatacccaaaggaat

SEQ ID NO: 1273212 - DNA, 22 bp, Artificial Sequence
  chemically synthesized
atattcctttgggtataaatgc

SEQ ID NO: 1273213 - DNA, 22 bp, Artificial Sequence
  chemically synthesized
tattcctttgggtataaatgca

SEQ ID NO: 1273214 - DNA, 22 bp, Artificial Sequence
  chemically synthesized
ctttgggtataaatgcagtaat

SEQ ID NO: 1273215 - DNA, 22 bp, Artificial Sequence
  chemically synthesized
tgggtataaatgcagtaatgat

SEQ ID NO: 1273216 - DNA, 22 bp, Artificial Sequence
  chemically synthesized
gggtataaatgcagtaatgata

SEQ ID NO: 1273217 - DNA, 22 bp, Artificial Sequence
  chemically synthesized
ggtataaatgcagtaatgatat

SEQ ID NO: 1273218 - DNA, 22 bp, Artificial Sequence
  chemically synthesized
cagacagaaataccatcaaccc

SEQ ID NO: 1273219 - DNA, 22 bp, Artificial Sequence
  chemically synthesized
aaagacctacagacagaaatac

SEQ ID NO: 1273220 - DNA, 22 bp, Artificial Sequence
  chemically synthesized
ctgggttgatggtatttctgtc

SEQ ID NO: 1273221 - DNA, 22 bp, Artificial Sequence
  chemically synthesized
ctcaaagacctacagacagaaa

SEQ ID NO: 1273222 - DNA, 22 bp, Artificial Sequence
  chemically synthesized
ggttgatggtatttctgtctgt

SEQ ID NO: 1273223 - DNA, 22 bp, Artificial Sequence
  chemically synthesized
atggtatttctgtctgtaggtc

SEQ ID NO: 1273224 - DNA, 22 bp, Artificial Sequence
  chemically synthesized
ctgtctgtaggtctttgaggaa

SEQ ID NO: 1273225 - DNA, 22 bp, Artificial Sequence
  chemically synthesized
tgtctgtaggtctttgaggaat

SEQ ID NO: 1273226 - DNA, 22 bp, Artificial Sequence
  chemically synthesized
tctgtaggtctttgaggaattg

SEQ ID NO: 1273227 - DNA, 22 bp, Artificial Sequence
  chemically synthesized
tggaagacagtgtggcaattcc

SEQ ID NO: 1273228 - DNA, 22 bp, Artificial Sequence
  chemically synthesized
taggtctttgaggaattgccac

SEQ ID NO: 1273229 - DNA, 22 bp, Artificial Sequence
  chemically synthesized
aaccattgtggaagacagtgtg

SEQ ID NO: 1273230 - DNA, 22 bp, Artificial Sequence
  chemically synthesized
tgaggaattgccacactgtctt

SEQ ID NO: 1273231 - DNA, 22 bp, Artificial Sequence
  chemically synthesized
gaggaattgccacactgtcttc

SEQ ID NO: 1273232 - DNA, 22 bp, Artificial Sequence
  chemically synthesized
aggaattgccacactgtcttcc

SEQ ID NO: 1273233 - DNA, 22 bp, Artificial Sequence
  chemically synthesized
gttcaaccattgtggaagacag

SEQ ID NO: 1273234 - DNA, 22 bp, Artificial Sequence
  chemically synthesized
ccacactgtcttccacaatggt

SEQ ID NO: 1273235 - DNA, 22 bp, Artificial Sequence
  chemically synthesized
tacattagttcaaccattgtgg

SEQ ID NO: 1273236 - DNA, 22 bp, Artificial Sequence
  chemically synthesized
tcttccacaatggttgaactaa

SEQ ID NO: 1273237 - DNA, 22 bp, Artificial Sequence
  chemically synthesized
gtgggactgtacattagttcaa

SEQ ID NO: 1273238 - DNA, 22 bp, Artificial Sequence
  chemically synthesized
ccacaatggttgaactaatgta

SEQ ID NO: 1273239 - DNA, 22 bp, Artificial Sequence
  chemically synthesized
ttggtgggactgtacattagtt

SEQ ID NO: 1273240 - DNA, 22 bp, Artificial Sequence
  chemically synthesized
cacaatggttgaactaatgtac

SEQ ID NO: 1273241 - DNA, 22 bp, Artificial Sequence
  chemically synthesized
aactaatgtacagtcccaccaa

SEQ ID NO: 1273242 - DNA, 22 bp, Artificial Sequence
  chemically synthesized
atgtacagtcccaccaacaatg

SEQ ID NO: 1273243 - DNA, 22 bp, Artificial Sequence
  chemically synthesized
tggggaaaaaggagcacgtata

SEQ ID NO: 1273244 - DNA, 22 bp, Artificial Sequence
  chemically synthesized
gcacggttgtggggaaaaagga

SEQ ID NO: 1273245 - DNA, 22 bp, Artificial Sequence
  chemically synthesized
ctttttccccacaaccgtgcta

SEQ ID NO: 1273246 - DNA, 22 bp, Artificial Sequence
  chemically synthesized
tttccccacaaccgtgctagca

SEQ ID NO: 1273247 - DNA, 22 bp, Artificial Sequence
  chemically synthesized
ttccccacaaccgtgctagcat

SEQ ID NO: 1273248 - DNA, 22 bp, Artificial Sequence
  chemically synthesized
tccccacaaccgtgctagcatc

SEQ ID NO: 1273249 - DNA, 22 bp, Artificial Sequence
  chemically synthesized
ccccacaaccgtgctagcatct

SEQ ID NO: 1273250 - DNA, 22 bp, Artificial Sequence
  chemically synthesized
cccacaaccgtgctagcatcta

SEQ ID NO: 1273251 - DNA, 22 bp, Artificial Sequence
  chemically synthesized
ataaaaagtcaaaaaatagtag

SEQ ID NO: 1273252 - DNA, 22 bp, Artificial Sequence
  chemically synthesized
ttaataaaaagtcaaaaaatag

SEQ ID NO: 1273253 - DNA, 22 bp, Artificial Sequence
  chemically synthesized
gcatctactattttttgacttt

SEQ ID NO: 1273254 - DNA, 22 bp, Artificial Sequence
  chemically synthesized
ctattttttgactttttattaa

SEQ ID NO: 1273255 - DNA, 22 bp, Artificial Sequence
  chemically synthesized
ttttttgactttttattaatag

SEQ ID NO: 1273256 - DNA, 22 bp, Artificial Sequence
  chemically synthesized
tttgactttttattaatagccg

SEQ ID NO: 1273257 - DNA, 22 bp, Artificial Sequence
  chemically synthesized
ttgactttttattaatagccgt

SEQ ID NO: 1273258 - DNA, 22 bp, Artificial Sequence
  chemically synthesized
acaccagtcaggacggctatta

SEQ ID NO: 1273259 - DNA, 22 bp, Artificial Sequence
  chemically synthesized
tgactttttattaatagccgtc

SEQ ID NO: 1273260 - DNA, 22 bp, Artificial Sequence
  chemically synthesized
gactttttattaatagccgtcc

SEQ ID NO: 1273261 - DNA, 22 bp, Artificial Sequence
  chemically synthesized
actttttattaatagccgtcct

SEQ ID NO: 1273262 - DNA, 22 bp, Artificial Sequence
  chemically synthesized
tttattaatagccgtcctgact

SEQ ID NO: 1273263 - DNA, 22 bp, Artificial Sequence
  chemically synthesized
ttattaatagccgtcctgactg

SEQ ID NO: 1273264 - DNA, 22 bp, Artificial Sequence
  chemically synthesized
tattaatagccgtcctgactgg

SEQ ID NO: 1273265 - DNA, 22 bp, Artificial Sequence
  chemically synthesized
attaatagccgtcctgactggt

SEQ ID NO: 1273266 - DNA, 22 bp, Artificial Sequence
  chemically synthesized
ttaatagccgtcctgactggtg

SEQ ID NO: 1273267 - DNA, 22 bp, Artificial Sequence
  chemically synthesized
atagccgtcctgactggtgtga

SEQ ID NO: 1273268 - DNA, 22 bp, Artificial Sequence
  chemically synthesized
actggtgtgagatggtatttca

SEQ ID NO: 1273269 - DNA, 22 bp, Artificial Sequence
  chemically synthesized
gtgtgagatggtatttcattgt

SEQ ID NO: 1273270 - DNA, 22 bp, Artificial Sequence
  chemically synthesized
gagaaatgcaaatcaaaaccac

SEQ ID NO: 1273271 - DNA, 22 bp, Artificial Sequence
  chemically synthesized
atcattagagaaatgcaaatca

SEQ ID NO: 1273272 - DNA, 22 bp, Artificial Sequence
  chemically synthesized
cattgtggttttgatttgcatt

SEQ ID NO: 1273273 - DNA, 22 bp, Artificial Sequence
  chemically synthesized
attgtggttttgatttgcattt

SEQ ID NO: 1273274 - DNA, 22 bp, Artificial Sequence
  chemically synthesized
tggttttgatttgcatttctct

SEQ ID NO: 1273275 - DNA, 22 bp, Artificial Sequence
  chemically synthesized
aacatcactaatcattagagaa

SEQ ID NO: 1273276 - DNA, 22 bp, Artificial Sequence
  chemically synthesized
tgatttgcatttctctaatgat

SEQ ID NO: 1273277 - DNA, 22 bp, Artificial Sequence
  chemically synthesized
gatttgcatttctctaatgatt

SEQ ID NO: 1273278 - DNA, 22 bp, Artificial Sequence
  chemically synthesized
atttgcatttctctaatgatta

SEQ ID NO: 1273279 - DNA, 22 bp, Artificial Sequence
  chemically synthesized
gcatttctctaatgattagtga

SEQ ID NO: 1273280 - DNA, 22 bp, Artificial Sequence
  chemically synthesized
catttctctaatgattagtgat

SEQ ID NO: 1273281 - DNA, 22 bp, Artificial Sequence
  chemically synthesized
ctctaatgattagtgatgttga

SEQ ID NO: 1273282 - DNA, 22 bp, Artificial Sequence
  chemically synthesized
tctaatgattagtgatgttgag

SEQ ID NO: 1273283 - DNA, 22 bp, Artificial Sequence
  chemically synthesized
taatgattagtgatgttgagct

SEQ ID NO: 1273284 - DNA, 22 bp, Artificial Sequence
  chemically synthesized
atgattagtgatgttgagcttt

SEQ ID NO: 1273285 - DNA, 22 bp, Artificial Sequence
  chemically synthesized
gtgatgttgagcttttttcata

SEQ ID NO: 1273286 - DNA, 22 bp, Artificial Sequence
  chemically synthesized
agcttttttcatatgcttgttg

SEQ ID NO: 1273287 - DNA, 22 bp, Artificial Sequence
  chemically synthesized
ttttcatatgcttgttggccgc

SEQ ID NO: 1273288 - DNA, 22 bp, Artificial Sequence
  chemically synthesized
tttcatatgcttgttggccgca

SEQ ID NO: 1273289 - DNA, 22 bp, Artificial Sequence
  chemically synthesized
ttcatatgcttgttggccgcat

SEQ ID NO: 1273290 - DNA, 22 bp, Artificial Sequence
  chemically synthesized
tcatatgcttgttggccgcatg

SEQ ID NO: 1273291 - DNA, 22 bp, Artificial Sequence
  chemically synthesized
catatgcttgttggccgcatgt

SEQ ID NO: 1273292 - DNA, 22 bp, Artificial Sequence
  chemically synthesized
aaaagaagacatacatgcggcc

SEQ ID NO: 1273293 - DNA, 22 bp, Artificial Sequence
  chemically synthesized
atatgcttgttggccgcatgta

SEQ ID NO: 1273294 - DNA, 22 bp, Artificial Sequence
  chemically synthesized
tcaaaagaagacatacatgcgg

SEQ ID NO: 1273295 - DNA, 22 bp, Artificial Sequence
  chemically synthesized
ctcaaaagaagacatacatgcg

SEQ ID NO: 1273296 - DNA, 22 bp, Artificial Sequence
  chemically synthesized
gttggccgcatgtatgtcttct

SEQ ID NO: 1273297 - DNA, 22 bp, Artificial Sequence
  chemically synthesized
ttggccgcatgtatgtcttctt

SEQ ID NO: 1273298 - DNA, 22 bp, Artificial Sequence
  chemically synthesized
gccgcatgtatgtcttcttttg

SEQ ID NO: 1273299 - DNA, 22 bp, Artificial Sequence
  chemically synthesized
cttttgagaagtgtctgttcat

SEQ ID NO: 1273300 - DNA, 22 bp, Artificial Sequence
  chemically synthesized
ttttgagaagtgtctgttcatg

SEQ ID NO: 1273301 - DNA, 22 bp, Artificial Sequence
  chemically synthesized
ttgagaagtgtctgttcatgcc

SEQ ID NO: 1273302 - DNA, 22 bp, Artificial Sequence
  chemically synthesized
tgagaagtgtctgttcatgccc

SEQ ID NO: 1273303 - DNA, 22 bp, Artificial Sequence
  chemically synthesized
gagaagtgtctgttcatgccct

SEQ ID NO: 1273304 - DNA, 22 bp, Artificial Sequence
  chemically synthesized
agaagtgtctgttcatgccctt

SEQ ID NO: 1273305 - DNA, 22 bp, Artificial Sequence
  chemically synthesized
aaaaagtgggcaaagggcatga

SEQ ID NO: 1273306 - DNA, 22 bp, Artificial Sequence
  chemically synthesized
ctaaaaaagtgggcaaagggca

SEQ ID NO: 1273307 - DNA, 22 bp, Artificial Sequence
  chemically synthesized
ttcatgccctttgcccactttt

SEQ ID NO: 1273308 - DNA, 22 bp, Artificial Sequence
  chemically synthesized
atgccctttgcccactttttta

SEQ ID NO: 1273309 - DNA, 22 bp, Artificial Sequence
  chemically synthesized
tgagaaaaaaaaaccctactaa

SEQ ID NO: 1273310 - DNA, 22 bp, Artificial Sequence
  chemically synthesized
tgcccacttttttagtagggtt

SEQ ID NO: 1273311 - DNA, 22 bp, Artificial Sequence
  chemically synthesized
gcccacttttttagtagggttt

SEQ ID NO: 1273312 - DNA, 22 bp, Artificial Sequence
  chemically synthesized
cccacttttttagtagggtttt

SEQ ID NO: 1273313 - DNA, 22 bp, Artificial Sequence
  chemically synthesized
ttttagtagggtttttttttct

SEQ ID NO: 1273314 - DNA, 22 bp, Artificial Sequence
  chemically synthesized
aacaaatctatgagaaaaaaaa

SEQ ID NO: 1273315 - DNA, 22 bp, Artificial Sequence
  chemically synthesized
tttagtagggtttttttttctc

SEQ ID NO: 1273316 - DNA, 22 bp, Artificial Sequence
  chemically synthesized
aaacaaatctatgagaaaaaaa

SEQ ID NO: 1273317 - DNA, 22 bp, Artificial Sequence
  chemically synthesized
ttagtagggtttttttttctca

SEQ ID NO: 1273318 - DNA, 22 bp, Artificial Sequence
  chemically synthesized
tagtagggtttttttttctcat

SEQ ID NO: 1273319 - DNA, 22 bp, Artificial Sequence
  chemically synthesized
agtagggtttttttttctcata

SEQ ID NO: 1273320 - DNA, 22 bp, Artificial Sequence
  chemically synthesized
gtagggtttttttttctcatag

SEQ ID NO: 1273321 - DNA, 22 bp, Artificial Sequence
  chemically synthesized
taaggaacttaaacaaatctat

SEQ ID NO: 1273322 - DNA, 22 bp, Artificial Sequence
  chemically synthesized
ataaggaacttaaacaaatcta

SEQ ID NO: 1273323 - DNA, 22 bp, Artificial Sequence
  chemically synthesized
ttttttctcatagatttgttta

SEQ ID NO: 1273324 - DNA, 22 bp, Artificial Sequence
  chemically synthesized
tttttctcatagatttgtttaa

SEQ ID NO: 1273325 - DNA, 22 bp, Artificial Sequence
  chemically synthesized
ttttctcatagatttgtttaag

SEQ ID NO: 1273326 - DNA, 22 bp, Artificial Sequence
  chemically synthesized
tttctcatagatttgtttaagt

SEQ ID NO: 1273327 - DNA, 22 bp, Artificial Sequence
  chemically synthesized
ttctcatagatttgtttaagtt

SEQ ID NO: 1273328 - DNA, 22 bp, Artificial Sequence
  chemically synthesized
tctcatagatttgtttaagttc

SEQ ID NO: 1273329 - DNA, 22 bp, Artificial Sequence
  chemically synthesized
ctcatagatttgtttaagttcc

SEQ ID NO: 1273330 - DNA, 22 bp, Artificial Sequence
  chemically synthesized
tcatagatttgtttaagttcct

SEQ ID NO: 1273331 - DNA, 22 bp, Artificial Sequence
  chemically synthesized
atagatttgtttaagttcctta

SEQ ID NO: 1273332 - DNA, 22 bp, Artificial Sequence
  chemically synthesized
aaatccagcatttataaggaac

SEQ ID NO: 1273333 - DNA, 22 bp, Artificial Sequence
  chemically synthesized
gtttaagttccttataaatgct

SEQ ID NO: 1273334 - DNA, 22 bp, Artificial Sequence
  chemically synthesized
tttaagttccttataaatgctg

SEQ ID NO: 1273335 - DNA, 22 bp, Artificial Sequence
  chemically synthesized
aagttccttataaatgctggat

SEQ ID NO: 1273336 - DNA, 22 bp, Artificial Sequence
  chemically synthesized
agttccttataaatgctggatt

SEQ ID NO: 1273337 - DNA, 22 bp, Artificial Sequence
  chemically synthesized
cttataaatgctggattttaga

SEQ ID NO: 1273338 - DNA, 22 bp, Artificial Sequence
  chemically synthesized
ataaatgctggattttagacct

SEQ ID NO: 1273339 - DNA, 22 bp, Artificial Sequence
  chemically synthesized
tgcatccgacaaaggtctaaaa

SEQ ID NO: 1273340 - DNA, 22 bp, Artificial Sequence
  chemically synthesized
taaatgctggattttagacctt

SEQ ID NO: 1273341 - DNA, 22 bp, Artificial Sequence
  chemically synthesized
caaactatgcatccgacaaagg

SEQ ID NO: 1273342 - DNA, 22 bp, Artificial Sequence
  chemically synthesized
gcaaactatgcatccgacaaag

SEQ ID NO: 1273343 - DNA, 22 bp, Artificial Sequence
  chemically synthesized
gattttagacctttgtcggatg

SEQ ID NO: 1273344 - DNA, 22 bp, Artificial Sequence
  chemically synthesized
tagacctttgtcggatgcatag

SEQ ID NO: 1273345 - DNA, 22 bp, Artificial Sequence
  chemically synthesized
agacctttgtcggatgcatagt

SEQ ID NO: 1273346 - DNA, 22 bp, Artificial Sequence
  chemically synthesized
gacctttgtcggatgcatagtt

SEQ ID NO: 1273347 - DNA, 22 bp, Artificial Sequence
  chemically synthesized
tgtcggatgcatagtttgcaaa

SEQ ID NO: 1273348 - DNA, 22 bp, Artificial Sequence
  chemically synthesized
gtcggatgcatagtttgcaaac

SEQ ID NO: 1273349 - DNA, 22 bp, Artificial Sequence
  chemically synthesized
tcggatgcatagtttgcaaaca

SEQ ID NO: 1273350 - DNA, 22 bp, Artificial Sequence
  chemically synthesized
cagaatggaagaaaatgtttgc

SEQ ID NO: 1273351 - DNA, 22 bp, Artificial Sequence
  chemically synthesized
gcaaacattttcttccattctg

SEQ ID NO: 1273352 - DNA, 22 bp, Artificial Sequence
  chemically synthesized
caaacattttcttccattctgt

SEQ ID NO: 1273353 - DNA, 22 bp, Artificial Sequence
  chemically synthesized
tcttccattctgtagtttgtct

SEQ ID NO: 1273354 - DNA, 22 bp, Artificial Sequence
  chemically synthesized
cttccattctgtagtttgtctg

SEQ ID NO: 1273355 - DNA, 22 bp, Artificial Sequence
  chemically synthesized
ttccattctgtagtttgtctgc

SEQ ID NO: 1273356 - DNA, 22 bp, Artificial Sequence
  chemically synthesized
tcaacagagtgagcagacaaac

SEQ ID NO: 1273357 - DNA, 22 bp, Artificial Sequence
  chemically synthesized
ccattctgtagtttgtctgctc

SEQ ID NO: 1273358 - DNA, 22 bp, Artificial Sequence
  chemically synthesized
cattctgtagtttgtctgctca

SEQ ID NO: 1273359 - DNA, 22 bp, Artificial Sequence
  chemically synthesized
tgtagtttgtctgctcactctg

SEQ ID NO: 1273360 - DNA, 22 bp, Artificial Sequence
  chemically synthesized
tagtttgtctgctcactctgtt

SEQ ID NO: 1273361 - DNA, 22 bp, Artificial Sequence
  chemically synthesized
gtctgctcactctgttgatagt

SEQ ID NO: 1273362 - DNA, 22 bp, Artificial Sequence
  chemically synthesized
tctgctcactctgttgatagtt

SEQ ID NO: 1273363 - DNA, 22 bp, Artificial Sequence
  chemically synthesized
cacagcaaaggaaactatcaac

SEQ ID NO: 1273364 - DNA, 22 bp, Artificial Sequence
  chemically synthesized
tgcacagcaaaggaaactatca

SEQ ID NO: 1273365 - DNA, 22 bp, Artificial Sequence
  chemically synthesized
ctgcacagcaaaggaaactatc

SEQ ID NO: 1273366 - DNA, 22 bp, Artificial Sequence
  chemically synthesized
ctcactctgttgatagtttcct

SEQ ID NO: 1273367 - DNA, 22 bp, Artificial Sequence
  chemically synthesized
actctgttgatagtttcctttg

SEQ ID NO: 1273368 - DNA, 22 bp, Artificial Sequence
  chemically synthesized
tgttgatagtttcctttgctgt

SEQ ID NO: 1273369 - DNA, 22 bp, Artificial Sequence
  chemically synthesized
aatagtttctgcacagcaaagg

SEQ ID NO: 1273370 - DNA, 22 bp, Artificial Sequence
  chemically synthesized
ttgatagtttcctttgctgtgc

SEQ ID NO: 1273371 - DNA, 22 bp, Artificial Sequence
  chemically synthesized
atagtttcctttgctgtgcaga

SEQ ID NO: 1273372 - DNA, 22 bp, Artificial Sequence
  chemically synthesized
aactaaatagtttctgcacagc

SEQ ID NO: 1273373 - DNA, 22 bp, Artificial Sequence
  chemically synthesized
attaaactaaatagtttctgca

SEQ ID NO: 1273374 - DNA, 22 bp, Artificial Sequence
  chemically synthesized
cctttgctgtgcagaaactatt

SEQ ID NO: 1273375 - DNA, 22 bp, Artificial Sequence
  chemically synthesized
ctttgctgtgcagaaactattt

SEQ ID NO: 1273376 - DNA, 22 bp, Artificial Sequence
  chemically synthesized
tgctgtgcagaaactatttagt

SEQ ID NO: 1273377 - DNA, 22 bp, Artificial Sequence
  chemically synthesized
gctgtgcagaaactatttagtt

SEQ ID NO: 1273378 - DNA, 22 bp, Artificial Sequence
  chemically synthesized
ctgtgcagaaactatttagttt

SEQ ID NO: 1273379 - DNA, 22 bp, Artificial Sequence
  chemically synthesized
tgcagaaactatttagtttaat

SEQ ID NO: 1273380 - DNA, 22 bp, Artificial Sequence
  chemically synthesized
aaaaatggcatctaattaaact

SEQ ID NO: 1273381 - DNA, 22 bp, Artificial Sequence
  chemically synthesized
tttagtttaattagatgccatt

SEQ ID NO: 1273382 - DNA, 22 bp, Artificial Sequence
  chemically synthesized
agtttaattagatgccattttt

SEQ ID NO: 1273383 - DNA, 22 bp, Artificial Sequence
  chemically synthesized
gtttaattagatgccatttttc

SEQ ID NO: 1273384 - DNA, 22 bp, Artificial Sequence
  chemically synthesized
aattagatgccatttttcaatt

SEQ ID NO: 1273385 - DNA, 22 bp, Artificial Sequence
  chemically synthesized
attagatgccatttttcaattt

SEQ ID NO: 1273386 - DNA, 22 bp, Artificial Sequence
  chemically synthesized
caacaaaagcaaaaattgaaaa

SEQ ID NO: 1273387 - DNA, 22 bp, Artificial Sequence
  chemically synthesized
gatgccatttttcaatttttgc

SEQ ID NO: 1273388 - DNA, 22 bp, Artificial Sequence
  chemically synthesized
ttcaatttttgcttttgttgca

SEQ ID NO: 1273389 - DNA, 22 bp, Artificial Sequence
  chemically synthesized
tcaatttttgcttttgttgcaa

SEQ ID NO: 1273390 - DNA, 22 bp, Artificial Sequence
  chemically synthesized
caatttttgcttttgttgcaat

SEQ ID NO: 1273391 - DNA, 22 bp, Artificial Sequence
  chemically synthesized
aatttttgcttttgttgcaatt

SEQ ID NO: 1273392 - DNA, 22 bp, Artificial Sequence
  chemically synthesized
ttgcttttgttgcaattgcttt

SEQ ID NO: 1273393 - DNA, 22 bp, Artificial Sequence
  chemically synthesized
tgcttttgttgcaattgctttt

SEQ ID NO: 1273394 - DNA, 22 bp, Artificial Sequence
  chemically synthesized
gcttttgttgcaattgcttttg

SEQ ID NO: 1273395 - DNA, 22 bp, Artificial Sequence
  chemically synthesized
cttttgttgcaattgcttttgg

SEQ ID NO: 1273396 - DNA, 22 bp, Artificial Sequence
  chemically synthesized
atgacaaagatgccaaaagcaa

SEQ ID NO: 1273397 - DNA, 22 bp, Artificial Sequence
  chemically synthesized
catgacaaagatgccaaaagca

SEQ ID NO: 1273398 - DNA, 22 bp, Artificial Sequence
  chemically synthesized
ttgttgcaattgcttttggcat

SEQ ID NO: 1273399 - DNA, 22 bp, Artificial Sequence
  chemically synthesized
tgttgcaattgcttttggcatc

SEQ ID NO: 1273400 - DNA, 22 bp, Artificial Sequence
  chemically synthesized
gttgcaattgcttttggcatct

SEQ ID NO: 1273401 - DNA, 22 bp, Artificial Sequence
  chemically synthesized
ttgcaattgcttttggcatctt

SEQ ID NO: 1273402 - DNA, 22 bp, Artificial Sequence
  chemically synthesized
caattgcttttggcatctttgt

SEQ ID NO: 1273403 - DNA, 22 bp, Artificial Sequence
  chemically synthesized
cttttggcatctttgtcatgaa

SEQ ID NO: 1273404 - DNA, 22 bp, Artificial Sequence
  chemically synthesized
ttggcatctttgtcatgaaacc

SEQ ID NO: 1273405 - DNA, 22 bp, Artificial Sequence
  chemically synthesized
tggcatctttgtcatgaaacct

SEQ ID NO: 1273406 - DNA, 22 bp, Artificial Sequence
  chemically synthesized
ggcatctttgtcatgaaacctt

SEQ ID NO: 1273407 - DNA, 22 bp, Artificial Sequence
  chemically synthesized
gcatctttgtcatgaaaccttt

SEQ ID NO: 1273408 - DNA, 22 bp, Artificial Sequence
  chemically synthesized
ggacataggaacagacaaaggt

SEQ ID NO: 1273409 - DNA, 22 bp, Artificial Sequence
  chemically synthesized
aggacataggaacagacaaagg

SEQ ID NO: 1273410 - DNA, 22 bp, Artificial Sequence
  chemically synthesized
tgtcatgaaacctttgtctgtt

SEQ ID NO: 1273411 - DNA, 22 bp, Artificial Sequence
  chemically synthesized
gtcatgaaacctttgtctgttc

SEQ ID NO: 1273412 - DNA, 22 bp, Artificial Sequence
  chemically synthesized
tcatgaaacctttgtctgttcc

SEQ ID NO: 1273413 - DNA, 22 bp, Artificial Sequence
  chemically synthesized
tgtctgttcctatgtcctaaat

SEQ ID NO: 1273414 - DNA, 22 bp, Artificial Sequence
  chemically synthesized
gtctgttcctatgtcctaaatg

SEQ ID NO: 1273415 - DNA, 22 bp, Artificial Sequence
  chemically synthesized
tctgttcctatgtcctaaatgg

SEQ ID NO: 1273416 - DNA, 22 bp, Artificial Sequence
  chemically synthesized
ttcctatgtcctaaatggtatt

SEQ ID NO: 1273417 - DNA, 22 bp, Artificial Sequence
  chemically synthesized
ctatgtcctaaatggtattgcc

SEQ ID NO: 1273418 - DNA, 22 bp, Artificial Sequence
  chemically synthesized
gaagacaacccgggcaatacca

SEQ ID NO: 1273419 - DNA, 22 bp, Artificial Sequence
  chemically synthesized
tgtcctaaatggtattgcccgg

SEQ ID NO: 1273420 - DNA, 22 bp, Artificial Sequence
  chemically synthesized
aatggtattgcccgggttgtct

SEQ ID NO: 1273421 - DNA, 22 bp, Artificial Sequence
  chemically synthesized
taaaaaccctggaagacaaccc

SEQ ID NO: 1273422 - DNA, 22 bp, Artificial Sequence
  chemically synthesized
aaactataaaaaccctggaaga

SEQ ID NO: 1273423 - DNA, 22 bp, Artificial Sequence
  chemically synthesized
cccgggttgtcttccagggttt

SEQ ID NO: 1273424 - DNA, 22 bp, Artificial Sequence
  chemically synthesized
tcttccagggtttttatagttt

SEQ ID NO: 1273425 - DNA, 22 bp, Artificial Sequence
  chemically synthesized
aatataaaacctcaaactataa

SEQ ID NO: 1273426 - DNA, 22 bp, Artificial Sequence
  chemically synthesized
aaatataaaacctcaaactata

SEQ ID NO: 1273427 - DNA, 22 bp, Artificial Sequence
  chemically synthesized
ccagggtttttatagtttgagg

SEQ ID NO: 1273428 - DNA, 22 bp, Artificial Sequence
  chemically synthesized
cagggtttttatagtttgaggt

SEQ ID NO: 1273429 - DNA, 22 bp, Artificial Sequence
  chemically synthesized
aagacttaaatataaaacctca

SEQ ID NO: 1273430 - DNA, 22 bp, Artificial Sequence
  chemically synthesized
ttatagtttgaggttttatatt

SEQ ID NO: 1273431 - DNA, 22 bp, Artificial Sequence
  chemically synthesized
tatagtttgaggttttatattt

SEQ ID NO: 1273432 - DNA, 22 bp, Artificial Sequence
  chemically synthesized
atagtttgaggttttatattta

SEQ ID NO: 1273433 - DNA, 22 bp, Artificial Sequence
  chemically synthesized
tagtttgaggttttatatttaa

SEQ ID NO: 1273434 - DNA, 22 bp, Artificial Sequence
  chemically synthesized
aagatagattaaagacttaaat

SEQ ID NO: 1273435 - DNA, 22 bp, Artificial Sequence
  chemically synthesized
gaggttttatatttaagtcttt

SEQ ID NO: 1273436 - DNA, 22 bp, Artificial Sequence
  chemically synthesized
aggttttatatttaagtcttta

SEQ ID NO: 1273437 - DNA, 22 bp, Artificial Sequence
  chemically synthesized
actcaagatagattaaagactt

SEQ ID NO: 1273438 - DNA, 22 bp, Artificial Sequence
  chemically synthesized
tatatttaagtctttaatctat

SEQ ID NO: 1273439 - DNA, 22 bp, Artificial Sequence
  chemically synthesized
atatttaagtctttaatctatc

SEQ ID NO: 1273440 - DNA, 22 bp, Artificial Sequence
  chemically synthesized
tatttaagtctttaatctatct

SEQ ID NO: 1273441 - DNA, 22 bp, Artificial Sequence
  chemically synthesized
aagtctttaatctatcttgagt

SEQ ID NO: 1273442 - DNA, 22 bp, Artificial Sequence
  chemically synthesized
agtctttaatctatcttgagtt

SEQ ID NO: 1273443 - DNA, 22 bp, Artificial Sequence
  chemically synthesized
caccatgtacaaagattaactc

SEQ ID NO: 1273444 - DNA, 22 bp, Artificial Sequence
  chemically synthesized
taatctatcttgagttaatctt

SEQ ID NO: 1273445 - DNA, 22 bp, Artificial Sequence
  chemically synthesized
acaccatgtacaaagattaact

SEQ ID NO: 1273446 - DNA, 22 bp, Artificial Sequence
  chemically synthesized
aatctatcttgagttaatcttt

SEQ ID NO: 1273447 - DNA, 22 bp, Artificial Sequence
  chemically synthesized
atctatcttgagttaatctttg

SEQ ID NO: 1273448 - DNA, 22 bp, Artificial Sequence
  chemically synthesized
cttacaccatgtacaaagatta

SEQ ID NO: 1273449 - DNA, 22 bp, Artificial Sequence
  chemically synthesized
ccttacaccatgtacaaagatt

SEQ ID NO: 1273450 - DNA, 22 bp, Artificial Sequence
  chemically synthesized
tcttgagttaatctttgtacat

SEQ ID NO: 1273451 - DNA, 22 bp, Artificial Sequence
  chemically synthesized
gagttaatctttgtacatggtg

SEQ ID NO: 1273452 - DNA, 22 bp, Artificial Sequence
  chemically synthesized
agttaatctttgtacatggtgt

SEQ ID NO: 1273453 - DNA, 22 bp, Artificial Sequence
  chemically synthesized
gaccccttccttacaccatgta

SEQ ID NO: 1273454 - DNA, 22 bp, Artificial Sequence
  chemically synthesized
atctttgtacatggtgtaagga

SEQ ID NO: 1273455 - DNA, 22 bp, Artificial Sequence
  chemically synthesized
tgtacatggtgtaaggaagggg

SEQ ID NO: 1273456 - DNA, 22 bp, Artificial Sequence
  chemically synthesized
gtacatggtgtaaggaaggggt

SEQ ID NO: 1273457 - DNA, 22 bp, Artificial Sequence
  chemically synthesized
tacatggtgtaaggaaggggtc

SEQ ID NO: 1273458 - DNA, 22 bp, Artificial Sequence
  chemically synthesized
gccacatgcagaagatagaaac

SEQ ID NO: 1273459 - DNA, 22 bp, Artificial Sequence
  chemically synthesized
gctagccacatgcagaagatag

SEQ ID NO: 1273460 - DNA, 22 bp, Artificial Sequence
  chemically synthesized
ggataactggctagccacatgc

SEQ ID NO: 1273461 - DNA, 22 bp, Artificial Sequence
  chemically synthesized
ctatcttctgcatgtggctagc

SEQ ID NO: 1273462 - DNA, 22 bp, Artificial Sequence
  chemically synthesized
tatcttctgcatgtggctagcc

SEQ ID NO: 1273463 - DNA, 22 bp, Artificial Sequence
  chemically synthesized
tcttctgcatgtggctagccag

SEQ ID NO: 1273464 - DNA, 22 bp, Artificial Sequence
  chemically synthesized
ctgcatgtggctagccagttat

SEQ ID NO: 1273465 - DNA, 22 bp, Artificial Sequence
  chemically synthesized
tgcatgtggctagccagttatc

SEQ ID NO: 1273466 - DNA, 22 bp, Artificial Sequence
  chemically synthesized
catgtggctagccagttatccc

SEQ ID NO: 1273467 - DNA, 22 bp, Artificial Sequence
  chemically synthesized
aataagtggtgctgggataact

SEQ ID NO: 1273468 - DNA, 22 bp, Artificial Sequence
  chemically synthesized
ttcaataagtggtgctgggata

SEQ ID NO: 1273469 - DNA, 22 bp, Artificial Sequence
  chemically synthesized
cctattcaataagtggtgctgg

SEQ ID NO: 1273470 - DNA, 22 bp, Artificial Sequence
  chemically synthesized
gccagttatcccagcaccactt

SEQ ID NO: 1273471 - DNA, 22 bp, Artificial Sequence
  chemically synthesized
tcccagcaccacttattgaata

SEQ ID NO: 1273472 - DNA, 22 bp, Artificial Sequence
  chemically synthesized
attgaataggtagtcctttccc

SEQ ID NO: 1273473 - DNA, 22 bp, Artificial Sequence
  chemically synthesized
ttgaataggtagtcctttcccc

SEQ ID NO: 1273474 - DNA, 22 bp, Artificial Sequence
  chemically synthesized
aataggtagtcctttccccatt

SEQ ID NO: 1273475 - DNA, 22 bp, Artificial Sequence
  chemically synthesized
acaaaaacaagcaatggggaaa

SEQ ID NO: 1273476 - DNA, 22 bp, Artificial Sequence
  chemically synthesized
aacaaagctgacaaaaacaagc

SEQ ID NO: 1273477 - DNA, 22 bp, Artificial Sequence
  chemically synthesized
caacaaagctgacaaaaacaag

SEQ ID NO: 1273478 - DNA, 22 bp, Artificial Sequence
  chemically synthesized
tccccattgcttgtttttgtca

SEQ ID NO: 1273479 - DNA, 22 bp, Artificial Sequence
  chemically synthesized
ccccattgcttgtttttgtcag

SEQ ID NO: 1273480 - DNA, 22 bp, Artificial Sequence
  chemically synthesized
cccattgcttgtttttgtcagc

SEQ ID NO: 1273481 - DNA, 22 bp, Artificial Sequence
  chemically synthesized
atcttcaacaaagctgacaaaa

SEQ ID NO: 1273482 - DNA, 22 bp, Artificial Sequence
  chemically synthesized
cttgtttttgtcagctttgttg

SEQ ID NO: 1273483 - DNA, 22 bp, Artificial Sequence
  chemically synthesized
gtttttgtcagctttgttgaag

SEQ ID NO: 1273484 - DNA, 22 bp, Artificial Sequence
  chemically synthesized
tttttgtcagctttgttgaaga

SEQ ID NO: 1273485 - DNA, 22 bp, Artificial Sequence
  chemically synthesized
gcaaccatctgatcttcaacaa

SEQ ID NO: 1273486 - DNA, 22 bp, Artificial Sequence
  chemically synthesized
ttgtcagctttgttgaagatca

SEQ ID NO: 1273487 - DNA, 22 bp, Artificial Sequence
  chemically synthesized
tgtcagctttgttgaagatcag

SEQ ID NO: 1273488 - DNA, 22 bp, Artificial Sequence
  chemically synthesized
gtcagctttgttgaagatcaga

SEQ ID NO: 1273489 - DNA, 22 bp, Artificial Sequence
  chemically synthesized
tcagctttgttgaagatcagat

SEQ ID NO: 1273490 - DNA, 22 bp, Artificial Sequence
  chemically synthesized
cacacctagcaaccatctgatc

SEQ ID NO: 1273491 - DNA, 22 bp, Artificial Sequence
  chemically synthesized
tgttgaagatcagatggttgct

SEQ ID NO: 1273492 - DNA, 22 bp, Artificial Sequence
  chemically synthesized
gttgaagatcagatggttgcta

SEQ ID NO: 1273493 - DNA, 22 bp, Artificial Sequence
  chemically synthesized
ttgaagatcagatggttgctag

SEQ ID NO: 1273494 - DNA, 22 bp, Artificial Sequence
  chemically synthesized
aagatcagatggttgctaggtg

SEQ ID NO: 1273495 - DNA, 22 bp, Artificial Sequence
  chemically synthesized
ctaggtgtgcagtcttatttct

SEQ ID NO: 1273496 - DNA, 22 bp, Artificial Sequence
  chemically synthesized
ggtgtgcagtcttatttcttgg

SEQ ID NO: 1273497 - DNA, 22 bp, Artificial Sequence
  chemically synthesized
atttcttggttctctgttttgt

SEQ ID NO: 1273498 - DNA, 22 bp, Artificial Sequence
  chemically synthesized
tttcttggttctctgttttgtt

SEQ ID NO: 1273499 - DNA, 22 bp, Artificial Sequence
  chemically synthesized
cttggttctctgttttgttcca

SEQ ID NO: 1273500 - DNA, 22 bp, Artificial Sequence
  chemically synthesized
ttggttctctgttttgttccat

SEQ ID NO: 1273501 - DNA, 22 bp, Artificial Sequence
  chemically synthesized
ggttctctgttttgttccattg

SEQ ID NO: 1273502 - DNA, 22 bp, Artificial Sequence
  chemically synthesized
gttctctgttttgttccattga

SEQ ID NO: 1273503 - DNA, 22 bp, Artificial Sequence
  chemically synthesized
tctgttttgttccattgatcca

SEQ ID NO: 1273504 - DNA, 22 bp, Artificial Sequence
  chemically synthesized
tgttttgttccattgatccatg

SEQ ID NO: 1273505 - DNA, 22 bp, Artificial Sequence
  chemically synthesized
ttttgttccattgatccatgtg

SEQ ID NO: 1273506 - DNA, 22 bp, Artificial Sequence
  chemically synthesized
gtacaagaacagacacatggat

SEQ ID NO: 1273507 - DNA, 22 bp, Artificial Sequence
  chemically synthesized
tgttccattgatccatgtgtct

SEQ ID NO: 1273508 - DNA, 22 bp, Artificial Sequence
  chemically synthesized
gttccattgatccatgtgtctg

SEQ ID NO: 1273509 - DNA, 22 bp, Artificial Sequence
  chemically synthesized
ttccattgatccatgtgtctgt

SEQ ID NO: 1273510 - DNA, 22 bp, Artificial Sequence
  chemically synthesized
cattgatccatgtgtctgttct

SEQ ID NO: 1273511 - DNA, 22 bp, Artificial Sequence
  chemically synthesized
atccatgtgtctgttcttgtac

SEQ ID NO: 1273512 - DNA, 22 bp, Artificial Sequence
  chemically synthesized
ttcttgtaccagtatcatgctg

SEQ ID NO: 1273513 - DNA, 22 bp, Artificial Sequence
  chemically synthesized
cagtggccaaaacagcatgata

SEQ ID NO: 1273514 - DNA, 22 bp, Artificial Sequence
  chemically synthesized
ttgtaccagtatcatgctgttt

SEQ ID NO: 1273515 - DNA, 22 bp, Artificial Sequence
  chemically synthesized
gtaccagtatcatgctgttttg

SEQ ID NO: 1273516 - DNA, 22 bp, Artificial Sequence
  chemically synthesized
taccagtatcatgctgttttgg

SEQ ID NO: 1273517 - DNA, 22 bp, Artificial Sequence
  chemically synthesized
cagggctacagtggccaaaaca

SEQ ID NO: 1273518 - DNA, 22 bp, Artificial Sequence
  chemically synthesized
tactacagggctacagtggcca

SEQ ID NO: 1273519 - DNA, 22 bp, Artificial Sequence
  chemically synthesized
aaactatactacagggctacag

SEQ ID NO: 1273520 - DNA, 22 bp, Artificial Sequence
  chemically synthesized
caaactatactacagggctaca

SEQ ID NO: 1273521 - DNA, 22 bp, Artificial Sequence
  chemically synthesized
ttttggccactgtagccctgta

SEQ ID NO: 1273522 - DNA, 22 bp, Artificial Sequence
  chemically synthesized
acttcaaactatactacagggc

SEQ ID NO: 1273523 - DNA, 22 bp, Artificial Sequence
  chemically synthesized
tggccactgtagccctgtagta

SEQ ID NO: 1273524 - DNA, 22 bp, Artificial Sequence
  chemically synthesized
ggccactgtagccctgtagtat

SEQ ID NO: 1273525 - DNA, 22 bp, Artificial Sequence
  chemically synthesized
gccactgtagccctgtagtata

SEQ ID NO: 1273526 - DNA, 22 bp, Artificial Sequence
  chemically synthesized
cctgacttcaaactatactaca

SEQ ID NO: 1273527 - DNA, 22 bp, Artificial Sequence
  chemically synthesized
tagccctgtagtatagtttgaa

SEQ ID NO: 1273528 - DNA, 22 bp, Artificial Sequence
  chemically synthesized
tagtatagtttgaagtcaggta

SEQ ID NO: 1273529 - DNA, 22 bp, Artificial Sequence
  chemically synthesized
gatgcatcacattacctgactt

SEQ ID NO: 1273530 - DNA, 22 bp, Artificial Sequence
  chemically synthesized
gaagtcaggtaatgtgatgcat

SEQ ID NO: 1273531 - DNA, 22 bp, Artificial Sequence
  chemically synthesized
aagtcaggtaatgtgatgcatc

SEQ ID NO: 1273532 - DNA, 22 bp, Artificial Sequence
  chemically synthesized
agcaaaaagagaaaagctggat

SEQ ID NO: 1273533 - DNA, 22 bp, Artificial Sequence
  chemically synthesized
ttctctttttgcttagtattgc

SEQ ID NO: 1273534 - DNA, 22 bp, Artificial Sequence
  chemically synthesized
tctctttttgcttagtattgcc

SEQ ID NO: 1273535 - DNA, 22 bp, Artificial Sequence
  chemically synthesized
ctctttttgcttagtattgcct

SEQ ID NO: 1273536 - DNA, 22 bp, Artificial Sequence
  chemically synthesized
tctttttgcttagtattgcctt

SEQ ID NO: 1273537 - DNA, 22 bp, Artificial Sequence
  chemically synthesized
tttttgcttagtattgccttgg

SEQ ID NO: 1273538 - DNA, 22 bp, Artificial Sequence
  chemically synthesized
tttgcttagtattgccttggct

SEQ ID NO: 1273539 - DNA, 22 bp, Artificial Sequence
  chemically synthesized
ttgcttagtattgccttggcta

SEQ ID NO: 1273540 - DNA, 22 bp, Artificial Sequence
  chemically synthesized
tgcttagtattgccttggctac

SEQ ID NO: 1273541 - DNA, 22 bp, Artificial Sequence
  chemically synthesized
gcttagtattgccttggctact

SEQ ID NO: 1273542 - DNA, 22 bp, Artificial Sequence
  chemically synthesized
cttagtattgccttggctactt

SEQ ID NO: 1273543 - DNA, 22 bp, Artificial Sequence
  chemically synthesized
agtattgccttggctacttggg

SEQ ID NO: 1273544 - DNA, 22 bp, Artificial Sequence
  chemically synthesized
gtattgccttggctacttgggc

SEQ ID NO: 1273545 - DNA, 22 bp, Artificial Sequence
  chemically synthesized
ccttggctacttgggctctttt

SEQ ID NO: 1273546 - DNA, 22 bp, Artificial Sequence
  chemically synthesized
acatggaaccaaaaaaaagagc

SEQ ID NO: 1273547 - DNA, 22 bp, Artificial Sequence
  chemically synthesized
ggctacttgggctctttttttt

SEQ ID NO: 1273548 - DNA, 22 bp, Artificial Sequence
  chemically synthesized
gctacttgggctcttttttttg

SEQ ID NO: 1273549 - DNA, 22 bp, Artificial Sequence
  chemically synthesized
cttgggctcttttttttggttc

SEQ ID NO: 1273550 - DNA, 22 bp, Artificial Sequence
  chemically synthesized
aaagttcacatggaaccaaaaa

SEQ ID NO: 1273551 - DNA, 22 bp, Artificial Sequence
  chemically synthesized
caaagttcacatggaaccaaaa

SEQ ID NO: 1273552 - DNA, 22 bp, Artificial Sequence
  chemically synthesized
gggctcttttttttggttccat

SEQ ID NO: 1273553 - DNA, 22 bp, Artificial Sequence
  chemically synthesized
ggctcttttttttggttccatg

SEQ ID NO: 1273554 - DNA, 22 bp, Artificial Sequence
  chemically synthesized
tttcaaagttcacatggaacca

SEQ ID NO: 1273555 - DNA, 22 bp, Artificial Sequence
  chemically synthesized
ttttttttggttccatgtgaac

SEQ ID NO: 1273556 - DNA, 22 bp, Artificial Sequence
  chemically synthesized
ttttttggttccatgtgaactt

SEQ ID NO: 1273557 - DNA, 22 bp, Artificial Sequence
  chemically synthesized
tttttggttccatgtgaacttt

SEQ ID NO: 1273558 - DNA, 22 bp, Artificial Sequence
  chemically synthesized
ttttggttccatgtgaactttg

SEQ ID NO: 1273559 - DNA, 22 bp, Artificial Sequence
  chemically synthesized
tttggttccatgtgaactttga

SEQ ID NO: 1273560 - DNA, 22 bp, Artificial Sequence
  chemically synthesized
gaagaaactatttcaaagttca

SEQ ID NO: 1273561 - DNA, 22 bp, Artificial Sequence
  chemically synthesized
ttggttccatgtgaactttgaa

SEQ ID NO: 1273562 - DNA, 22 bp, Artificial Sequence
  chemically synthesized
tggttccatgtgaactttgaaa

SEQ ID NO: 1273563 - DNA, 22 bp, Artificial Sequence
  chemically synthesized
ggttccatgtgaactttgaaat

SEQ ID NO: 1273564 - DNA, 22 bp, Artificial Sequence
  chemically synthesized
gttccatgtgaactttgaaata

SEQ ID NO: 1273565 - DNA, 22 bp, Artificial Sequence
  chemically synthesized
catgtgaactttgaaatagttt

SEQ ID NO: 1273566 - DNA, 22 bp, Artificial Sequence
  chemically synthesized
agagaactagaagaaactattt

SEQ ID NO: 1273567 - DNA, 22 bp, Artificial Sequence
  chemically synthesized
cagagaactagaagaaactatt

SEQ ID NO: 1273568 - DNA, 22 bp, Artificial Sequence
  chemically synthesized
ttcagagaactagaagaaacta

SEQ ID NO: 1273569 - DNA, 22 bp, Artificial Sequence
  chemically synthesized
agattcttcagagaactagaag

SEQ ID NO: 1273570 - DNA, 22 bp, Artificial Sequence
  chemically synthesized
tgaaatagtttcttctagttct

SEQ ID NO: 1273571 - DNA, 22 bp, Artificial Sequence
  chemically synthesized
gaaatagtttcttctagttctc

SEQ ID NO: 1273572 - DNA, 22 bp, Artificial Sequence
  chemically synthesized
aaatagtttcttctagttctct

SEQ ID NO: 1273573 - DNA, 22 bp, Artificial Sequence
  chemically synthesized
ccattgagattcttcagagaac

SEQ ID NO: 1273574 - DNA, 22 bp, Artificial Sequence
  chemically synthesized
aactaccattgagattcttcag

SEQ ID NO: 1273575 - DNA, 22 bp, Artificial Sequence
  chemically synthesized
cttctagttctctgaagaatct

SEQ ID NO: 1273576 - DNA, 22 bp, Artificial Sequence
  chemically synthesized
ttctagttctctgaagaatctc

SEQ ID NO: 1273577 - DNA, 22 bp, Artificial Sequence
  chemically synthesized
ttaaactaccattgagattctt

SEQ ID NO: 1273578 - DNA, 22 bp, Artificial Sequence
  chemically synthesized
ctagttctctgaagaatctcaa

SEQ ID NO: 1273579 - DNA, 22 bp, Artificial Sequence
  chemically synthesized
tagttctctgaagaatctcaat

SEQ ID NO: 1273580 - DNA, 22 bp, Artificial Sequence
  chemically synthesized
ctattaaactaccattgagatt

SEQ ID NO: 1273581 - DNA, 22 bp, Artificial Sequence
  chemically synthesized
gttctctgaagaatctcaatgg

SEQ ID NO: 1273582 - DNA, 22 bp, Artificial Sequence
  chemically synthesized
ttcctattaaactaccattgag

SEQ ID NO: 1273583 - DNA, 22 bp, Artificial Sequence
  chemically synthesized
tctgaagaatctcaatggtagt

SEQ ID NO: 1273584 - DNA, 22 bp, Artificial Sequence
  chemically synthesized
tgaagaatctcaatggtagttt

SEQ ID NO: 1273585 - DNA, 22 bp, Artificial Sequence
  chemically synthesized
aagaatctcaatggtagtttaa

SEQ ID NO: 1273586 - DNA, 22 bp, Artificial Sequence
  chemically synthesized
gagtcaatgctattcctattaa

SEQ ID NO: 1273587 - DNA, 22 bp, Artificial Sequence
  chemically synthesized
aatggtagtttaataggaatag

SEQ ID NO: 1273588 - DNA, 22 bp, Artificial Sequence
  chemically synthesized
ttagagtcaatgctattcctat

SEQ ID NO: 1273589 - DNA, 22 bp, Artificial Sequence
  chemically synthesized
attagagtcaatgctattccta

SEQ ID NO: 1273590 - DNA, 22 bp, Artificial Sequence
  chemically synthesized
agcaatttattagagtcaatgc

SEQ ID NO: 1273591 - DNA, 22 bp, Artificial Sequence
  chemically synthesized
aataggaatagcattgactcta

SEQ ID NO: 1273592 - DNA, 22 bp, Artificial Sequence
  chemically synthesized
ataggaatagcattgactctaa

SEQ ID NO: 1273593 - DNA, 22 bp, Artificial Sequence
  chemically synthesized
actctaataaattgcttaggat

SEQ ID NO: 1273594 - DNA, 22 bp, Artificial Sequence
  chemically synthesized
taataaattgcttaggattgcc

SEQ ID NO: 1273595 - DNA, 22 bp, Artificial Sequence
  chemically synthesized
ataaattgcttaggattgcctt

SEQ ID NO: 1273596 - DNA, 22 bp, Artificial Sequence
  chemically synthesized
cttaggattgccttggctactt

SEQ ID NO: 1273597 - DNA, 22 bp, Artificial Sequence
  chemically synthesized
aggattgccttggctacttggg

SEQ ID NO: 1273598 - DNA, 22 bp, Artificial Sequence
  chemically synthesized
ggattgccttggctacttgggc

SEQ ID NO: 1273599 - DNA, 22 bp, Artificial Sequence
  chemically synthesized
ccttggctacttgggctctttt

SEQ ID NO: 1273600 - DNA, 22 bp, Artificial Sequence
  chemically synthesized
atatggaaccaataaaagagcc

SEQ ID NO: 1273601 - DNA, 22 bp, Artificial Sequence
  chemically synthesized
ggctacttgggctcttttattg

SEQ ID NO: 1273602 - DNA, 22 bp, Artificial Sequence
  chemically synthesized
gctacttgggctcttttattgg

SEQ ID NO: 1273603 - DNA, 22 bp, Artificial Sequence
  chemically synthesized
aagttcatatggaaccaataaa

SEQ ID NO: 1273604 - DNA, 22 bp, Artificial Sequence
  chemically synthesized
aaagttcatatggaaccaataa

SEQ ID NO: 1273605 - DNA, 22 bp, Artificial Sequence
  chemically synthesized
cttgggctcttttattggttcc

SEQ ID NO: 1273606 - DNA, 22 bp, Artificial Sequence
  chemically synthesized
taaagttcatatggaaccaata

SEQ ID NO: 1273607 - DNA, 22 bp, Artificial Sequence
  chemically synthesized
gggctcttttattggttccata

SEQ ID NO: 1273608 - DNA, 22 bp, Artificial Sequence
  chemically synthesized
ttttaaagttcatatggaacca

SEQ ID NO: 1273609 - DNA, 22 bp, Artificial Sequence
  chemically synthesized
ggctcttttattggttccatat

SEQ ID NO: 1273610 - DNA, 22 bp, Artificial Sequence
  chemically synthesized
ttttattggttccatatgaact

SEQ ID NO: 1273611 - DNA, 22 bp, Artificial Sequence
  chemically synthesized
ttattggttccatatgaacttt

SEQ ID NO: 1273612 - DNA, 22 bp, Artificial Sequence
  chemically synthesized
tattggttccatatgaacttta

SEQ ID NO: 1273613 - DNA, 22 bp, Artificial Sequence
  chemically synthesized
attggttccatatgaactttaa

SEQ ID NO: 1273614 - DNA, 22 bp, Artificial Sequence
  chemically synthesized
gaagaaactattttaaagttca

SEQ ID NO: 1273615 - DNA, 22 bp, Artificial Sequence
  chemically synthesized
ttggttccatatgaactttaaa

SEQ ID NO: 1273616 - DNA, 22 bp, Artificial Sequence
  chemically synthesized
gttccatatgaactttaaaata

SEQ ID NO: 1273617 - DNA, 22 bp, Artificial Sequence
  chemically synthesized
catatgaactttaaaatagttt

SEQ ID NO: 1273618 - DNA, 22 bp, Artificial Sequence
  chemically synthesized
agagaactagaagaaactattt

SEQ ID NO: 1273619 - DNA, 22 bp, Artificial Sequence
  chemically synthesized
cagagaactagaagaaactatt

SEQ ID NO: 1273620 - DNA, 22 bp, Artificial Sequence
  chemically synthesized
ttcagagaactagaagaaacta

SEQ ID NO: 1273621 - DNA, 22 bp, Artificial Sequence
  chemically synthesized
agattcttcagagaactagaag

SEQ ID NO: 1273622 - DNA, 22 bp, Artificial Sequence
  chemically synthesized
taaaatagtttcttctagttct

SEQ ID NO: 1273623 - DNA, 22 bp, Artificial Sequence
  chemically synthesized
aaaatagtttcttctagttctc

SEQ ID NO: 1273624 - DNA, 22 bp, Artificial Sequence
  chemically synthesized
aaatagtttcttctagttctct

SEQ ID NO: 1273625 - DNA, 22 bp, Artificial Sequence
  chemically synthesized
ccattgagattcttcagagaac

SEQ ID NO: 1273626 - DNA, 22 bp, Artificial Sequence
  chemically synthesized
aactaccattgagattcttcag

SEQ ID NO: 1273627 - DNA, 22 bp, Artificial Sequence
  chemically synthesized
cttctagttctctgaagaatct

SEQ ID NO: 1273628 - DNA, 22 bp, Artificial Sequence
  chemically synthesized
ttctagttctctgaagaatctc

SEQ ID NO: 1273629 - DNA, 22 bp, Artificial Sequence
  chemically synthesized
ttaaactaccattgagattctt

SEQ ID NO: 1273630 - DNA, 22 bp, Artificial Sequence
  chemically synthesized
ctagttctctgaagaatctcaa

SEQ ID NO: 1273631 - DNA, 22 bp, Artificial Sequence
  chemically synthesized
tagttctctgaagaatctcaat

SEQ ID NO: 1273632 - DNA, 22 bp, Artificial Sequence
  chemically synthesized
ctattaaactaccattgagatt

SEQ ID NO: 1273633 - DNA, 22 bp, Artificial Sequence
  chemically synthesized
gttctctgaagaatctcaatgg

SEQ ID NO: 1273634 - DNA, 22 bp, Artificial Sequence
  chemically synthesized
ttcctattaaactaccattgag

SEQ ID NO: 1273635 - DNA, 22 bp, Artificial Sequence
  chemically synthesized
tctgaagaatctcaatggtagt

SEQ ID NO: 1273636 - DNA, 22 bp, Artificial Sequence
  chemically synthesized
tgaagaatctcaatggtagttt

SEQ ID NO: 1273637 - DNA, 22 bp, Artificial Sequence
  chemically synthesized
aagaatctcaatggtagtttaa

SEQ ID NO: 1273638 - DNA, 22 bp, Artificial Sequence
  chemically synthesized
aatgctattcctattaaactac

SEQ ID NO: 1273639 - DNA, 22 bp, Artificial Sequence
  chemically synthesized
gattcaatgctattcctattaa

SEQ ID NO: 1273640 - DNA, 22 bp, Artificial Sequence
  chemically synthesized
aatggtagtttaataggaatag

SEQ ID NO: 1273641 - DNA, 22 bp, Artificial Sequence
  chemically synthesized
ttagattcaatgctattcctat

SEQ ID NO: 1273642 - DNA, 22 bp, Artificial Sequence
  chemically synthesized
attagattcaatgctattccta

SEQ ID NO: 1273643 - DNA, 22 bp, Artificial Sequence
  chemically synthesized
aataggaatagcattgaatcta

SEQ ID NO: 1273644 - DNA, 22 bp, Artificial Sequence
  chemically synthesized
aacgcaatttattagattcaat

SEQ ID NO: 1273645 - DNA, 22 bp, Artificial Sequence
  chemically synthesized
ataggaatagcattgaatctaa

SEQ ID NO: 1273646 - DNA, 22 bp, Artificial Sequence
  chemically synthesized
ctcaacgcaatttattagattc

SEQ ID NO: 1273647 - DNA, 22 bp, Artificial Sequence
  chemically synthesized
aatctaataaattgcgttgagc

SEQ ID NO: 1273648 - DNA, 22 bp, Artificial Sequence
  chemically synthesized
aaatggccacactgctcaacgc

SEQ ID NO: 1273649 - DNA, 22 bp, Artificial Sequence
  chemically synthesized
ataaattgcgttgagcagtgtg

SEQ ID NO: 1273650 - DNA, 22 bp, Artificial Sequence
  chemically synthesized
cgttgagcagtgtggccatttt

SEQ ID NO: 1273651 - DNA, 22 bp, Artificial Sequence
  chemically synthesized
agcagtgtggccattttaatga

SEQ ID NO: 1273652 - DNA, 22 bp, Artificial Sequence
  chemically synthesized
atggataggaagaatcaatatc

SEQ ID NO: 1273653 - DNA, 22 bp, Artificial Sequence
  chemically synthesized
catgttcatggataggaagaat

SEQ ID NO: 1273654 - DNA, 22 bp, Artificial Sequence
  chemically synthesized
taatgatattgattcttcctat

SEQ ID NO: 1273655 - DNA, 22 bp, Artificial Sequence
  chemically synthesized
aatgatattgattcttcctatc

SEQ ID NO: 1273656 - DNA, 22 bp, Artificial Sequence
  chemically synthesized
atgatattgattcttcctatcc

SEQ ID NO: 1273657 - DNA, 22 bp, Artificial Sequence
  chemically synthesized
attcttcctatccatgaacatg

SEQ ID NO: 1273658 - DNA, 22 bp, Artificial Sequence
  chemically synthesized
ttcctatccatgaacatggaat

SEQ ID NO: 1273659 - DNA, 22 bp, Artificial Sequence
  chemically synthesized
cctatccatgaacatggaatgt

SEQ ID NO: 1273660 - DNA, 22 bp, Artificial Sequence
  chemically synthesized
ctatccatgaacatggaatgtt

SEQ ID NO: 1273661 - DNA, 22 bp, Artificial Sequence
  chemically synthesized
tccatgaacatggaatgttttt

SEQ ID NO: 1273662 - DNA, 22 bp, Artificial Sequence
  chemically synthesized
aaagaaatcagagatgacagaa

SEQ ID NO: 1273663 - DNA, 22 bp, Artificial Sequence
  chemically synthesized
ttccatttgtttctgtcatctc

SEQ ID NO: 1273664 - DNA, 22 bp, Artificial Sequence
  chemically synthesized
tccatttgtttctgtcatctct

SEQ ID NO: 1273665 - DNA, 22 bp, Artificial Sequence
  chemically synthesized
ctcaaagaaatcagagatgaca

SEQ ID NO: 1273666 - DNA, 22 bp, Artificial Sequence
  chemically synthesized
ccatttgtttctgtcatctctg

SEQ ID NO: 1273667 - DNA, 22 bp, Artificial Sequence
  chemically synthesized
catttgtttctgtcatctctga

SEQ ID NO: 1273668 - DNA, 22 bp, Artificial Sequence
  chemically synthesized
gtttctgtcatctctgatttct

SEQ ID NO: 1273669 - DNA, 22 bp, Artificial Sequence
  chemically synthesized
tttctgtcatctctgatttctt

SEQ ID NO: 1273670 - DNA, 22 bp, Artificial Sequence
  chemically synthesized
ccaaacactcctcaaagaaatc

SEQ ID NO: 1273671 - DNA, 22 bp, Artificial Sequence
  chemically synthesized
ctgtcatctctgatttctttga

SEQ ID NO: 1273672 - DNA, 22 bp, Artificial Sequence
  chemically synthesized
tgtcatctctgatttctttgag

SEQ ID NO: 1273673 - DNA, 22 bp, Artificial Sequence
  chemically synthesized
tcatctctgatttctttgagga

SEQ ID NO: 1273674 - DNA, 22 bp, Artificial Sequence
  chemically synthesized
tgatttctttgaggagtgtttg

SEQ ID NO: 1273675 - DNA, 22 bp, Artificial Sequence
  chemically synthesized
cgtggagaactaccaaacactc

SEQ ID NO: 1273676 - DNA, 22 bp, Artificial Sequence
  chemically synthesized
atttctttgaggagtgtttggt

SEQ ID NO: 1273677 - DNA, 22 bp, Artificial Sequence
  chemically synthesized
tacgtggagaactaccaaacac

SEQ ID NO: 1273678 - DNA, 22 bp, Artificial Sequence
  chemically synthesized
ctttgaggagtgtttggtagtt

SEQ ID NO: 1273679 - DNA, 22 bp, Artificial Sequence
  chemically synthesized
tttgaggagtgtttggtagttc

SEQ ID NO: 1273680 - DNA, 22 bp, Artificial Sequence
  chemically synthesized
tgaggagtgtttggtagttctc

SEQ ID NO: 1273681 - DNA, 22 bp, Artificial Sequence
  chemically synthesized
gaggagtgtttggtagttctcc

SEQ ID NO: 1273682 - DNA, 22 bp, Artificial Sequence
  chemically synthesized
aggagtgtttggtagttctcca

SEQ ID NO: 1273683 - DNA, 22 bp, Artificial Sequence
  chemically synthesized
gaggggtgaaagatctctacgt

SEQ ID NO: 1273684 - DNA, 22 bp, Artificial Sequence
  chemically synthesized
ggtagttctccacgtagagatc

SEQ ID NO: 1273685 - DNA, 22 bp, Artificial Sequence
  chemically synthesized
gtagttctccacgtagagatct

SEQ ID NO: 1273686 - DNA, 22 bp, Artificial Sequence
  chemically synthesized
actagaggggtgaaagatctct

SEQ ID NO: 1273687 - DNA, 22 bp, Artificial Sequence
  chemically synthesized
tccacgtagagatctttcaccc

SEQ ID NO: 1273688 - DNA, 22 bp, Artificial Sequence
  chemically synthesized
cacgtagagatctttcacccct

SEQ ID NO: 1273689 - DNA, 22 bp, Artificial Sequence
  chemically synthesized
ggaatacagctaactagagggg

SEQ ID NO: 1273690 - DNA, 22 bp, Artificial Sequence
  chemically synthesized
tcacccctctagttagctgtat

SEQ ID NO: 1273691 - DNA, 22 bp, Artificial Sequence
  chemically synthesized
cacccctctagttagctgtatt

SEQ ID NO: 1273692 - DNA, 22 bp, Artificial Sequence
  chemically synthesized
acccctctagttagctgtattc

SEQ ID NO: 1273693 - DNA, 22 bp, Artificial Sequence
  chemically synthesized
tagttagctgtattcctaggta

SEQ ID NO: 1273694 - DNA, 22 bp, Artificial Sequence
  chemically synthesized
gttagctgtattcctaggtatt

SEQ ID NO: 1273695 - DNA, 22 bp, Artificial Sequence
  chemically synthesized
ccatagaaagaataaaatacct

SEQ ID NO: 1273696 - DNA, 22 bp, Artificial Sequence
  chemically synthesized
gctgtattcctaggtattttat

SEQ ID NO: 1273697 - DNA, 22 bp, Artificial Sequence
  chemically synthesized
tattcctaggtattttattctt

SEQ ID NO: 1273698 - DNA, 22 bp, Artificial Sequence
  chemically synthesized
acaactgccatagaaagaataa

SEQ ID NO: 1273699 - DNA, 22 bp, Artificial Sequence
  chemically synthesized
ctaggtattttattctttctat

SEQ ID NO: 1273700 - DNA, 22 bp, Artificial Sequence
  chemically synthesized
ggtattttattctttctatggc

SEQ ID NO: 1273701 - DNA, 22 bp, Artificial Sequence
  chemically synthesized
tattctttctatggcagttgtg

SEQ ID NO: 1273702 - DNA, 22 bp, Artificial Sequence
  chemically synthesized
attctttctatggcagttgtga

SEQ ID NO: 1273703 - DNA, 22 bp, Artificial Sequence
  chemically synthesized
ttctttctatggcagttgtgaa

SEQ ID NO: 1273704 - DNA, 22 bp, Artificial Sequence
  chemically synthesized
tttctatggcagttgtgaatgt

SEQ ID NO: 1273705 - DNA, 22 bp, Artificial Sequence
  chemically synthesized
tctatggcagttgtgaatgtga

SEQ ID NO: 1273706 - DNA, 22 bp, Artificial Sequence
  chemically synthesized
ctatggcagttgtgaatgtgat

SEQ ID NO: 1273707 - DNA, 22 bp, Artificial Sequence
  chemically synthesized
tatggcagttgtgaatgtgatt

SEQ ID NO: 1273708 - DNA, 22 bp, Artificial Sequence
  chemically synthesized
tggcagttgtgaatgtgattgc

SEQ ID NO: 1273709 - DNA, 22 bp, Artificial Sequence
  chemically synthesized
tgaatgtgattgcattactgat

SEQ ID NO: 1273710 - DNA, 22 bp, Artificial Sequence
  chemically synthesized
catgcagtgcaacagggagaaa

SEQ ID NO: 1273711 - DNA, 22 bp, Artificial Sequence
  chemically synthesized
cattactgatttctccctgttg

SEQ ID NO: 1273712 - DNA, 22 bp, Artificial Sequence
  chemically synthesized
ttgcatgcagtgcaacagggag

SEQ ID NO: 1273713 - DNA, 22 bp, Artificial Sequence
  chemically synthesized
ctgatttctccctgttgcactg

SEQ ID NO: 1273714 - DNA, 22 bp, Artificial Sequence
  chemically synthesized
catctgttgcatgcagtgcaac

SEQ ID NO: 1273715 - DNA, 22 bp, Artificial Sequence
  chemically synthesized
atttctccctgttgcactgcat

SEQ ID NO: 1273716 - DNA, 22 bp, Artificial Sequence
  chemically synthesized
cattgcatctgttgcatgcagt

SEQ ID NO: 1273717 - DNA, 22 bp, Artificial Sequence
  chemically synthesized
ctccctgttgcactgcatgcaa

SEQ ID NO: 1273718 - DNA, 22 bp, Artificial Sequence
  chemically synthesized
tccctgttgcactgcatgcaac

SEQ ID NO: 1273719 - DNA, 22 bp, Artificial Sequence
  chemically synthesized
ttccattgcatctgttgcatgc

SEQ ID NO: 1273720 - DNA, 22 bp, Artificial Sequence
  chemically synthesized
cctgttgcactgcatgcaacag

SEQ ID NO: 1273721 - DNA, 22 bp, Artificial Sequence
  chemically synthesized
ttgcactgcatgcaacagatgc

SEQ ID NO: 1273722 - DNA, 22 bp, Artificial Sequence
  chemically synthesized
cactgcatgcaacagatgcaat

SEQ ID NO: 1273723 - DNA, 22 bp, Artificial Sequence
  chemically synthesized
catgcaacagatgcaatggaac

SEQ ID NO: 1273724 - DNA, 22 bp, Artificial Sequence
  chemically synthesized
tacaccaacaacagagagaaat

SEQ ID NO: 1273725 - DNA, 22 bp, Artificial Sequence
  chemically synthesized
ctatacaccaacaacagagaga

SEQ ID NO: 1273726 - DNA, 22 bp, Artificial Sequence
  chemically synthesized
gcattcctatacaccaacaaca

SEQ ID NO: 1273727 - DNA, 22 bp, Artificial Sequence
  chemically synthesized
ctctctgttgttggtgtatagg

SEQ ID NO: 1273728 - DNA, 22 bp, Artificial Sequence
  chemically synthesized
tctctgttgttggtgtatagga

SEQ ID NO: 1273729 - DNA, 22 bp, Artificial Sequence
  chemically synthesized
tctgttgttggtgtataggaat

SEQ ID NO: 1273730 - DNA, 22 bp, Artificial Sequence
  chemically synthesized
tgttgttggtgtataggaatgc

SEQ ID NO: 1273731 - DNA, 22 bp, Artificial Sequence
  chemically synthesized
ttgttggtgtataggaatgcta

SEQ ID NO: 1273732 - DNA, 22 bp, Artificial Sequence
  chemically synthesized
ttggtgtataggaatgctagtg

SEQ ID NO: 1273733 - DNA, 22 bp, Artificial Sequence
  chemically synthesized
gtgtataggaatgctagtgatt

SEQ ID NO: 1273734 - DNA, 22 bp, Artificial Sequence
  chemically synthesized
aggatacaaaaccaatgtgcca

SEQ ID NO: 1273735 - DNA, 22 bp, Artificial Sequence
  chemically synthesized
gtgattttggcacattggtttt

SEQ ID NO: 1273736 - DNA, 22 bp, Artificial Sequence
  chemically synthesized
agcaaagtctcaggatacaaaa

SEQ ID NO: 1273737 - DNA, 22 bp, Artificial Sequence
  chemically synthesized
tggcacattggttttgtatcct

SEQ ID NO: 1273738 - DNA, 22 bp, Artificial Sequence
  chemically synthesized
cagcaaagtctcaggatacaaa

SEQ ID NO: 1273739 - DNA, 22 bp, Artificial Sequence
  chemically synthesized
ggcacattggttttgtatcctg

SEQ ID NO: 1273740 - DNA, 22 bp, Artificial Sequence
  chemically synthesized
gcacattggttttgtatcctga

SEQ ID NO: 1273741 - DNA, 22 bp, Artificial Sequence
  chemically synthesized
gttttgtatcctgagactttgc

SEQ ID NO: 1273742 - DNA, 22 bp, Artificial Sequence
  chemically synthesized
ataaacaacttcagcaaagtct

SEQ ID NO: 1273743 - DNA, 22 bp, Artificial Sequence
  chemically synthesized
tgtatcctgagactttgctgaa

SEQ ID NO: 1273744 - DNA, 22 bp, Artificial Sequence
  chemically synthesized
gtatcctgagactttgctgaag

SEQ ID NO: 1273745 - DNA, 22 bp, Artificial Sequence
  chemically synthesized
tatcctgagactttgctgaagt

SEQ ID NO: 1273746 - DNA, 22 bp, Artificial Sequence
  chemically synthesized
tgctgataaacaacttcagcaa

SEQ ID NO: 1273747 - DNA, 22 bp, Artificial Sequence
  chemically synthesized
gtgctgataaacaacttcagca

SEQ ID NO: 1273748 - DNA, 22 bp, Artificial Sequence
  chemically synthesized
ttgtgctgataaacaacttcag

SEQ ID NO: 1273749 - DNA, 22 bp, Artificial Sequence
  chemically synthesized
cttgtgctgataaacaacttca

SEQ ID NO: 1273750 - DNA, 22 bp, Artificial Sequence
  chemically synthesized
agactttgctgaagttgtttat

SEQ ID NO: 1273751 - DNA, 22 bp, Artificial Sequence
  chemically synthesized
tgctgaagttgtttatcagcac

SEQ ID NO: 1273752 - DNA, 22 bp, Artificial Sequence
  chemically synthesized
gctgaagttgtttatcagcaca

SEQ ID NO: 1273753 - DNA, 22 bp, Artificial Sequence
  chemically synthesized
ctgaagttgtttatcagcacaa

SEQ ID NO: 1273754 - DNA, 22 bp, Artificial Sequence
  chemically synthesized
agcccaaaagcttcttgtgctg

SEQ ID NO: 1273755 - DNA, 22 bp, Artificial Sequence
  chemically synthesized
aagttgtttatcagcacaagaa

SEQ ID NO: 1273756 - DNA, 22 bp, Artificial Sequence
  chemically synthesized
tttatcagcacaagaagctttt

SEQ ID NO: 1273757 - DNA, 22 bp, Artificial Sequence
  chemically synthesized
atcagcacaagaagcttttggg

SEQ ID NO: 1273758 - DNA, 22 bp, Artificial Sequence
  chemically synthesized
tcagcacaagaagcttttgggc

SEQ ID NO: 1273759 - DNA, 22 bp, Artificial Sequence
  chemically synthesized
gaaaaccccatggtctcagccc

SEQ ID NO: 1273760 - DNA, 22 bp, Artificial Sequence
  chemically synthesized
tatctagaaaaccccatggtct

SEQ ID NO: 1273761 - DNA, 22 bp, Artificial Sequence
  chemically synthesized
ttgggctgagaccatggggttt

SEQ ID NO: 1273762 - DNA, 22 bp, Artificial Sequence
  chemically synthesized
tgggctgagaccatggggtttt

SEQ ID NO: 1273763 - DNA, 22 bp, Artificial Sequence
  chemically synthesized
gggctgagaccatggggttttc

SEQ ID NO: 1273764 - DNA, 22 bp, Artificial Sequence
  chemically synthesized
ggctgagaccatggggttttct

SEQ ID NO: 1273765 - DNA, 22 bp, Artificial Sequence
  chemically synthesized
agaccatggggttttctagata

SEQ ID NO: 1273766 - DNA, 22 bp, Artificial Sequence
  chemically synthesized
cagacaacatgatgctatatct

SEQ ID NO: 1273767 - DNA, 22 bp, Artificial Sequence
  chemically synthesized
gcagacaacatgatgctatatc

SEQ ID NO: 1273768 - DNA, 22 bp, Artificial Sequence
  chemically synthesized
tttgcagacaacatgatgctat

SEQ ID NO: 1273769 - DNA, 22 bp, Artificial Sequence
  chemically synthesized
tgtttgcagacaacatgatgct

SEQ ID NO: 1273770 - DNA, 22 bp, Artificial Sequence
  chemically synthesized
tctagatatagcatcatgttgt

SEQ ID NO: 1273771 - DNA, 22 bp, Artificial Sequence
  chemically synthesized
ctagatatagcatcatgttgtc

SEQ ID NO: 1273772 - DNA, 22 bp, Artificial Sequence
  chemically synthesized
tctctgtttgcagacaacatga

SEQ ID NO: 1273773 - DNA, 22 bp, Artificial Sequence
  chemically synthesized
tagatatagcatcatgttgtct

SEQ ID NO: 1273774 - DNA, 22 bp, Artificial Sequence
  chemically synthesized
gatatagcatcatgttgtctgc

SEQ ID NO: 1273775 - DNA, 22 bp, Artificial Sequence
  chemically synthesized
tctgcaaacagagatagtttga

SEQ ID NO: 1273776 - DNA, 22 bp, Artificial Sequence
  chemically synthesized
ggaagagaggaagtcaaactat

SEQ ID NO: 1273777 - DNA, 22 bp, Artificial Sequence
  chemically synthesized
caaacagagatagtttgacttc

SEQ ID NO: 1273778 - DNA, 22 bp, Artificial Sequence
  chemically synthesized
caactaggaagagaggaagtca

SEQ ID NO: 1273779 - DNA, 22 bp, Artificial Sequence
  chemically synthesized
gacttcctctcttcctagttgg

SEQ ID NO: 1273780 - DNA, 22 bp, Artificial Sequence
  chemically synthesized
acttcctctcttcctagttgga

SEQ ID NO: 1273781 - DNA, 22 bp, Artificial Sequence
  chemically synthesized
cctctcttcctagttggaggcg

SEQ ID NO: 1273782 - DNA, 22 bp, Artificial Sequence
  chemically synthesized
ctctcttcctagttggaggcgc

SEQ ID NO: 1273783 - DNA, 22 bp, Artificial Sequence
  chemically synthesized
tcttcctagttggaggcgcttt

SEQ ID NO: 1273784 - DNA, 22 bp, Artificial Sequence
  chemically synthesized
ttcctagttggaggcgctttat

SEQ ID NO: 1273785 - DNA, 22 bp, Artificial Sequence
  chemically synthesized
cctagttggaggcgctttattt

SEQ ID NO: 1273786 - DNA, 22 bp, Artificial Sequence
  chemically synthesized
ctagttggaggcgctttatttc

SEQ ID NO: 1273787 - DNA, 22 bp, Artificial Sequence
  chemically synthesized
gttggaggcgctttatttcttt

SEQ ID NO: 1273788 - DNA, 22 bp, Artificial Sequence
  chemically synthesized
gaggcgctttatttctttctct

SEQ ID NO: 1273789 - DNA, 22 bp, Artificial Sequence
  chemically synthesized
accagggaaatcaggcaagaga

SEQ ID NO: 1273790 - DNA, 22 bp, Artificial Sequence
  chemically synthesized
tatttctttctcttgcctgatt

SEQ ID NO: 1273791 - DNA, 22 bp, Artificial Sequence
  chemically synthesized
atttctttctcttgcctgattt

SEQ ID NO: 1273792 - DNA, 22 bp, Artificial Sequence
  chemically synthesized
tttctttctcttgcctgatttc

SEQ ID NO: 1273793 - DNA, 22 bp, Artificial Sequence
  chemically synthesized
ctttctcttgcctgatttccct

SEQ ID NO: 1273794 - DNA, 22 bp, Artificial Sequence
  chemically synthesized
gaagtcctgaccagggaaatca

SEQ ID NO: 1273795 - DNA, 22 bp, Artificial Sequence
  chemically synthesized
tttctcttgcctgatttccctg

SEQ ID NO: 1273796 - DNA, 22 bp, Artificial Sequence
  chemically synthesized
tctcttgcctgatttccctggt

SEQ ID NO: 1273797 - DNA, 22 bp, Artificial Sequence
  chemically synthesized
ctcttgcctgatttccctggtc

SEQ ID NO: 1273798 - DNA, 22 bp, Artificial Sequence
  chemically synthesized
tcttgcctgatttccctggtca

SEQ ID NO: 1273799 - DNA, 22 bp, Artificial Sequence
  chemically synthesized
ttgcctgatttccctggtcagg

SEQ ID NO: 1273800 - DNA, 22 bp, Artificial Sequence
  chemically synthesized
gcctgatttccctggtcaggac

SEQ ID NO: 1273801 - DNA, 22 bp, Artificial Sequence
  chemically synthesized
cctgatttccctggtcaggact

SEQ ID NO: 1273802 - DNA, 22 bp, Artificial Sequence
  chemically synthesized
acatagtattagaagtcctgac

SEQ ID NO: 1273803 - DNA, 22 bp, Artificial Sequence
  chemically synthesized
aacatagtattagaagtcctga

SEQ ID NO: 1273804 - DNA, 22 bp, Artificial Sequence
  chemically synthesized
atttccctggtcaggacttcta

SEQ ID NO: 1273805 - DNA, 22 bp, Artificial Sequence
  chemically synthesized
tttaacatagtattagaagtcc

SEQ ID NO: 1273806 - DNA, 22 bp, Artificial Sequence
  chemically synthesized
ccctggtcaggacttctaatac

SEQ ID NO: 1273807 - DNA, 22 bp, Artificial Sequence
  chemically synthesized
ctatttaacatagtattagaag

SEQ ID NO: 1273808 - DNA, 22 bp, Artificial Sequence
  chemically synthesized
cctggtcaggacttctaatact

SEQ ID NO: 1273809 - DNA, 22 bp, Artificial Sequence
  chemically synthesized
gtcaggacttctaatactatgt

SEQ ID NO: 1273810 - DNA, 22 bp, Artificial Sequence
  chemically synthesized
ccattcctatttaacatagtat

SEQ ID NO: 1273811 - DNA, 22 bp, Artificial Sequence
  chemically synthesized
accattcctatttaacatagta

SEQ ID NO: 1273812 - DNA, 22 bp, Artificial Sequence
  chemically synthesized
ttaccattcctatttaacatag

SEQ ID NO: 1273813 - DNA, 22 bp, Artificial Sequence
  chemically synthesized
tcttaccattcctatttaacat

SEQ ID NO: 1273814 - DNA, 22 bp, Artificial Sequence
  chemically synthesized
ctaatactatgttaaataggaa

SEQ ID NO: 1273815 - DNA, 22 bp, Artificial Sequence
  chemically synthesized
taatactatgttaaataggaat

SEQ ID NO: 1273816 - DNA, 22 bp, Artificial Sequence
  chemically synthesized
atactatgttaaataggaatgg

SEQ ID NO: 1273817 - DNA, 22 bp, Artificial Sequence
  chemically synthesized
tgttaaataggaatggtaagag

SEQ ID NO: 1273818 - DNA, 22 bp, Artificial Sequence
  chemically synthesized
aataggaatggtaagagagggc

SEQ ID NO: 1273819 - DNA, 22 bp, Artificial Sequence
  chemically synthesized
ccatggaaaaccagcacaagac

SEQ ID NO: 1273820 - DNA, 22 bp, Artificial Sequence
  chemically synthesized
tgttcccatggaaaaccagcac

SEQ ID NO: 1273821 - DNA, 22 bp, Artificial Sequence
  chemically synthesized
gtcttgtgctggttttccatgg

SEQ ID NO: 1273822 - DNA, 22 bp, Artificial Sequence
  chemically synthesized
tcttgtgctggttttccatggg

SEQ ID NO: 1273823 - DNA, 22 bp, Artificial Sequence
  chemically synthesized
aggaatgctgtgttcccatgga

SEQ ID NO: 1273824 - DNA, 22 bp, Artificial Sequence
  chemically synthesized
aaggaatgctgtgttcccatgg

SEQ ID NO: 1273825 - DNA, 22 bp, Artificial Sequence
  chemically synthesized
gtgctggttttccatgggaaca

SEQ ID NO: 1273826 - DNA, 22 bp, Artificial Sequence
  chemically synthesized
tgctggttttccatgggaacac

SEQ ID NO: 1273827 - DNA, 22 bp, Artificial Sequence
  chemically synthesized
tttaaggaatgctgtgttccca

SEQ ID NO: 1273828 - DNA, 22 bp, Artificial Sequence
  chemically synthesized
gttttccatgggaacacagcat

SEQ ID NO: 1273829 - DNA, 22 bp, Artificial Sequence
  chemically synthesized
atgtctatttaaggaatgctgt

SEQ ID NO: 1273830 - DNA, 22 bp, Artificial Sequence
  chemically synthesized
tccatgggaacacagcattcct

SEQ ID NO: 1273831 - DNA, 22 bp, Artificial Sequence
  chemically synthesized
catgtctatttaaggaatgctg

SEQ ID NO: 1273832 - DNA, 22 bp, Artificial Sequence
  chemically synthesized
ccatgggaacacagcattcctt

SEQ ID NO: 1273833 - DNA, 22 bp, Artificial Sequence
  chemically synthesized
catgggaacacagcattcctta

SEQ ID NO: 1273834 - DNA, 22 bp, Artificial Sequence
  chemically synthesized
gggtgtgggcaggggcttcatg

SEQ ID NO: 1273835 - DNA, 22 bp, Artificial Sequence
  chemically synthesized
cttaaatagacatgaagcccct

SEQ ID NO: 1273836 - DNA, 22 bp, Artificial Sequence
  chemically synthesized
actggggtgtgggcaggggctt

SEQ ID NO: 1273837 - DNA, 22 bp, Artificial Sequence
  chemically synthesized
aaatagacatgaagcccctgcc

SEQ ID NO: 1273838 - DNA, 22 bp, Artificial Sequence
  chemically synthesized
cactggggtgtgggcaggggct

SEQ ID NO: 1273839 - DNA, 22 bp, Artificial Sequence
  chemically synthesized
aatagacatgaagcccctgccc

SEQ ID NO: 1273840 - DNA, 22 bp, Artificial Sequence
  chemically synthesized
tcactggggtgtgggcaggggc

SEQ ID NO: 1273841 - DNA, 22 bp, Artificial Sequence
  chemically synthesized
ttcactggggtgtgggcagggg

SEQ ID NO: 1273842 - DNA, 22 bp, Artificial Sequence
  chemically synthesized
tttttcactggggtgtgggcag

SEQ ID NO: 1273843 - DNA, 22 bp, Artificial Sequence
  chemically synthesized
gaagtagtgagttgtttttcac

SEQ ID NO: 1273844 - DNA, 22 bp, Artificial Sequence
  chemically synthesized
cccacaccccagtgaaaaacaa

SEQ ID NO: 1273845 - DNA, 22 bp, Artificial Sequence
  chemically synthesized
atctggaagtagtgagttgttt

SEQ ID NO: 1273846 - DNA, 22 bp, Artificial Sequence
  chemically synthesized
aatctggaagtagtgagttgtt

SEQ ID NO: 1273847 - DNA, 22 bp, Artificial Sequence
  chemically synthesized
actacttccagattaagctttt

SEQ ID NO: 1273848 - DNA, 22 bp, Artificial Sequence
  chemically synthesized
cttccagattaagctttttata

SEQ ID NO: 1273849 - DNA, 22 bp, Artificial Sequence
  chemically synthesized
ccagattaagctttttatattt

SEQ ID NO: 1273850 - DNA, 22 bp, Artificial Sequence
  chemically synthesized
cagattaagctttttatatttt

SEQ ID NO: 1273851 - DNA, 22 bp, Artificial Sequence
  chemically synthesized
agctttttatatttttggccat

SEQ ID NO: 1273852 - DNA, 22 bp, Artificial Sequence
  chemically synthesized
taacagtgagagatggccaaaa

SEQ ID NO: 1273853 - DNA, 22 bp, Artificial Sequence
  chemically synthesized
gtaacagtgagagatggccaaa

SEQ ID NO: 1273854 - DNA, 22 bp, Artificial Sequence
  chemically synthesized
tgtaacagtgagagatggccaa

SEQ ID NO: 1273855 - DNA, 22 bp, Artificial Sequence
  chemically synthesized
tttatatttttggccatctctc

SEQ ID NO: 1273856 - DNA, 22 bp, Artificial Sequence
  chemically synthesized
ttatatttttggccatctctca

SEQ ID NO: 1273857 - DNA, 22 bp, Artificial Sequence
  chemically synthesized
tatatttttggccatctctcac

SEQ ID NO: 1273858 - DNA, 22 bp, Artificial Sequence
  chemically synthesized
atatttttggccatctctcact

SEQ ID NO: 1273859 - DNA, 22 bp, Artificial Sequence
  chemically synthesized
tatttttggccatctctcactg

SEQ ID NO: 1273860 - DNA, 22 bp, Artificial Sequence
  chemically synthesized
ttggccatctctcactgttaca

SEQ ID NO: 1273861 - DNA, 22 bp, Artificial Sequence
  chemically synthesized
tggccatctctcactgttacaa

SEQ ID NO: 1273862 - DNA, 22 bp, Artificial Sequence
  chemically synthesized
aacaaacaaactttgtaacagt

SEQ ID NO: 1273863 - DNA, 22 bp, Artificial Sequence
  chemically synthesized
ggccatctctcactgttacaaa

SEQ ID NO: 1273864 - DNA, 22 bp, Artificial Sequence
  chemically synthesized
aaacaaacaaactttgtaacag

SEQ ID NO: 1273865 - DNA, 22 bp, Artificial Sequence
  chemically synthesized
gccatctctcactgttacaaag

SEQ ID NO: 1273866 - DNA, 22 bp, Artificial Sequence
  chemically synthesized
aatatttaaacaaacaaacttt

SEQ ID NO: 1273867 - DNA, 22 bp, Artificial Sequence
  chemically synthesized
tcactgttacaaagtttgtttg

SEQ ID NO: 1273868 - DNA, 22 bp, Artificial Sequence
  chemically synthesized
actgttacaaagtttgtttgtt

SEQ ID NO: 1273869 - DNA, 22 bp, Artificial Sequence
  chemically synthesized
tccactaaatatttaaacaaac

SEQ ID NO: 1273870 - DNA, 22 bp, Artificial Sequence
  chemically synthesized
ttacaaagtttgtttgtttaaa

SEQ ID NO: 1273871 - DNA, 22 bp, Artificial Sequence
  chemically synthesized
gtccactaaatatttaaacaaa

SEQ ID NO: 1273872 - DNA, 22 bp, Artificial Sequence
  chemically synthesized
tgtccactaaatatttaaacaa

SEQ ID NO: 1273873 - DNA, 22 bp, Artificial Sequence
  chemically synthesized
caaagtttgtttgtttaaatat

SEQ ID NO: 1273874 - DNA, 22 bp, Artificial Sequence
  chemically synthesized
gtttgtttaaatatttagtgga

SEQ ID NO: 1273875 - DNA, 22 bp, Artificial Sequence
  chemically synthesized
tttgtttaaatatttagtggac

SEQ ID NO: 1273876 - DNA, 22 bp, Artificial Sequence
  chemically synthesized
gtttaaatatttagtggacaaa

SEQ ID NO: 1273877 - DNA, 22 bp, Artificial Sequence
  chemically synthesized
tttaaatatttagtggacaaag

SEQ ID NO: 1273878 - DNA, 22 bp, Artificial Sequence
  chemically synthesized
aaatatttagtggacaaagggc

SEQ ID NO: 1273879 - DNA, 22 bp, Artificial Sequence
  chemically synthesized
aatatttagtggacaaagggct

SEQ ID NO: 1273880 - DNA, 22 bp, Artificial Sequence
  chemically synthesized
agtggacaaagggctctctttc

SEQ ID NO: 1273881 - DNA, 22 bp, Artificial Sequence
  chemically synthesized
gtggacaaagggctctctttcc

SEQ ID NO: 1273882 - DNA, 22 bp, Artificial Sequence
  chemically synthesized
tgatgagaagaaaggaaagaga

SEQ ID NO: 1273883 - DNA, 22 bp, Artificial Sequence
  chemically synthesized
ttatgatgagaagaaaggaaag

SEQ ID NO: 1273884 - DNA, 22 bp, Artificial Sequence
  chemically synthesized
attatgatgagaagaaaggaaa

SEQ ID NO: 1273885 - DNA, 22 bp, Artificial Sequence
  chemically synthesized
ttattatgatgagaagaaagga

SEQ ID NO: 1273886 - DNA, 22 bp, Artificial Sequence
  chemically synthesized
tctttcctttcttctcatcata

SEQ ID NO: 1273887 - DNA, 22 bp, Artificial Sequence
  chemically synthesized
tttcctttcttctcatcataat

SEQ ID NO: 1273888 - DNA, 22 bp, Artificial Sequence
  chemically synthesized
tcctttcttctcatcataataa

SEQ ID NO: 1273889 - DNA, 22 bp, Artificial Sequence
  chemically synthesized
cctttcttctcatcataataag

SEQ ID NO: 1273890 - DNA, 22 bp, Artificial Sequence
  chemically synthesized
ctttcttctcatcataataaga

SEQ ID NO: 1273891 - DNA, 22 bp, Artificial Sequence
  chemically synthesized
tcttctcatcataataagaata

SEQ ID NO: 1273892 - DNA, 22 bp, Artificial Sequence
  chemically synthesized
cttctcatcataataagaatat

SEQ ID NO: 1273893 - DNA, 22 bp, Artificial Sequence
  chemically synthesized
ttctcatcataataagaatatg

SEQ ID NO: 1273894 - DNA, 22 bp, Artificial Sequence
  chemically synthesized
ctcatcataataagaatatgct

SEQ ID NO: 1273895 - DNA, 22 bp, Artificial Sequence
  chemically synthesized
tcatcataataagaatatgctt

SEQ ID NO: 1273896 - DNA, 22 bp, Artificial Sequence
  chemically synthesized
atcataataagaatatgcttca

SEQ ID NO: 1273897 - DNA, 22 bp, Artificial Sequence
  chemically synthesized
atcagtggaaatgcaatgaagc

SEQ ID NO: 1273898 - DNA, 22 bp, Artificial Sequence
  chemically synthesized
agctaatcagtggaaatgcaat

SEQ ID NO: 1273899 - DNA, 22 bp, Artificial Sequence
  chemically synthesized
aaatattcagctaatcagtgga

SEQ ID NO: 1273900 - DNA, 22 bp, Artificial Sequence
  chemically synthesized
caaatattcagctaatcagtgg

SEQ ID NO: 1273901 - DNA, 22 bp, Artificial Sequence
  chemically synthesized
tcaaatattcagctaatcagtg

SEQ ID NO: 1273902 - DNA, 22 bp, Artificial Sequence
  chemically synthesized
cattgcatttccactgattagc

SEQ ID NO: 1273903 - DNA, 22 bp, Artificial Sequence
  chemically synthesized
attgcatttccactgattagct

SEQ ID NO: 1273904 - DNA, 22 bp, Artificial Sequence
  chemically synthesized
ttttcaaatattcagctaatca

SEQ ID NO: 1273905 - DNA, 22 bp, Artificial Sequence
  chemically synthesized
catttccactgattagctgaat

SEQ ID NO: 1273906 - DNA, 22 bp, Artificial Sequence
  chemically synthesized
gctgttttcaaatattcagcta

SEQ ID NO: 1273907 - DNA, 22 bp, Artificial Sequence
  chemically synthesized
ccactgattagctgaatatttg

SEQ ID NO: 1273908 - DNA, 22 bp, Artificial Sequence
  chemically synthesized
cactgattagctgaatatttga

SEQ ID NO: 1273909 - DNA, 22 bp, Artificial Sequence
  chemically synthesized
attagctgaatatttgaaaaca

SEQ ID NO: 1273910 - DNA, 22 bp, Artificial Sequence
  chemically synthesized
gggacgtattagctgttttcaa

SEQ ID NO: 1273911 - DNA, 22 bp, Artificial Sequence
  chemically synthesized
agggacgtattagctgttttca

SEQ ID NO: 1273912 - DNA, 22 bp, Artificial Sequence
  chemically synthesized
tagggacgtattagctgttttc

SEQ ID NO: 1273913 - DNA, 22 bp, Artificial Sequence
  chemically synthesized
gctgaatatttgaaaacagcta

SEQ ID NO: 1273914 - DNA, 22 bp, Artificial Sequence
  chemically synthesized
aatatttgaaaacagctaatac

SEQ ID NO: 1273915 - DNA, 22 bp, Artificial Sequence
  chemically synthesized
taattttagggacgtattagct

SEQ ID NO: 1273916 - DNA, 22 bp, Artificial Sequence
  chemically synthesized
ataattttagggacgtattagc

SEQ ID NO: 1273917 - DNA, 22 bp, Artificial Sequence
  chemically synthesized
gaaaacagctaatacgtcccta

SEQ ID NO: 1273918 - DNA, 22 bp, Artificial Sequence
  chemically synthesized
aaaacagctaatacgtccctaa

SEQ ID NO: 1273919 - DNA, 22 bp, Artificial Sequence
  chemically synthesized
gaaagcaacttataattttagg

SEQ ID NO: 1273920 - DNA, 22 bp, Artificial Sequence
  chemically synthesized
tctagaaagcaacttataattt

SEQ ID NO: 1273921 - DNA, 22 bp, Artificial Sequence
  chemically synthesized
atacgtccctaaaattataagt

SEQ ID NO: 1273922 - DNA, 22 bp, Artificial Sequence
  chemically synthesized
gagcctgtctagaaagcaactt

SEQ ID NO: 1273923 - DNA, 22 bp, Artificial Sequence
  chemically synthesized
aaattataagttgctttctaga

SEQ ID NO: 1273924 - DNA, 22 bp, Artificial Sequence
  chemically synthesized
aaaaactggagcctgtctagaa

SEQ ID NO: 1273925 - DNA, 22 bp, Artificial Sequence
  chemically synthesized
taagttgctttctagacaggct

SEQ ID NO: 1273926 - DNA, 22 bp, Artificial Sequence
  chemically synthesized
ctttctagacaggctccagttt

SEQ ID NO: 1273927 - DNA, 22 bp, Artificial Sequence
  chemically synthesized
aatgagacactgaaaaactgga

SEQ ID NO: 1273928 - DNA, 22 bp, Artificial Sequence
  chemically synthesized
tctagacaggctccagtttttc

SEQ ID NO: 1273929 - DNA, 22 bp, Artificial Sequence
  chemically synthesized
aaatgagacactgaaaaactgg

SEQ ID NO: 1273930 - DNA, 22 bp, Artificial Sequence
  chemically synthesized
ctagacaggctccagtttttca

SEQ ID NO: 1273931 - DNA, 22 bp, Artificial Sequence
  chemically synthesized
tagacaggctccagtttttcag

SEQ ID NO: 1273932 - DNA, 22 bp, Artificial Sequence
  chemically synthesized
gacaggctccagtttttcagtg

SEQ ID NO: 1273933 - DNA, 22 bp, Artificial Sequence
  chemically synthesized
cagtttttcagtgtctcattta

SEQ ID NO: 1273934 - DNA, 22 bp, Artificial Sequence
  chemically synthesized
gggaacataatttaaatgagac

SEQ ID NO: 1273935 - DNA, 22 bp, Artificial Sequence
  chemically synthesized
tggggaacataatttaaatgag

SEQ ID NO: 1273936 - DNA, 22 bp, Artificial Sequence
  chemically synthesized
ttcagtgtctcatttaaattat

SEQ ID NO: 1273937 - DNA, 22 bp, Artificial Sequence
  chemically synthesized
tcagtgtctcatttaaattatg

SEQ ID NO: 1273938 - DNA, 22 bp, Artificial Sequence
  chemically synthesized
agctctggggaacataatttaa

SEQ ID NO: 1273939 - DNA, 22 bp, Artificial Sequence
  chemically synthesized
cagtgtctcatttaaattatgt

SEQ ID NO: 1273940 - DNA, 22 bp, Artificial Sequence
  chemically synthesized
agtgtctcatttaaattatgtt

SEQ ID NO: 1273941 - DNA, 22 bp, Artificial Sequence
  chemically synthesized
ttcagctctggggaacataatt

SEQ ID NO: 1273942 - DNA, 22 bp, Artificial Sequence
  chemically synthesized
tactgttcagctctggggaaca

SEQ ID NO: 1273943 - DNA, 22 bp, Artificial Sequence
  chemically synthesized
atttaaattatgttccccagag

SEQ ID NO: 1273944 - DNA, 22 bp, Artificial Sequence
  chemically synthesized
aaattatgttccccagagctga

SEQ ID NO: 1273945 - DNA, 22 bp, Artificial Sequence
  chemically synthesized
aattatgttccccagagctgaa

SEQ ID NO: 1273946 - DNA, 22 bp, Artificial Sequence
  chemically synthesized
tgttccccagagctgaacagta

SEQ ID NO: 1273947 - DNA, 22 bp, Artificial Sequence
  chemically synthesized
atcagaccaaatctgtactgtt

SEQ ID NO: 1273948 - DNA, 22 bp, Artificial Sequence
  chemically synthesized
cccagagctgaacagtacagat

SEQ ID NO: 1273949 - DNA, 22 bp, Artificial Sequence
  chemically synthesized
aaagtaagttcatcagaccaaa

SEQ ID NO: 1273950 - DNA, 22 bp, Artificial Sequence
  chemically synthesized
aacagtacagatttggtctgat

SEQ ID NO: 1273951 - DNA, 22 bp, Artificial Sequence
  chemically synthesized
acactaaaagtaagttcatcag

SEQ ID NO: 1273952 - DNA, 22 bp, Artificial Sequence
  chemically synthesized
ttgacactaaaagtaagttcat

SEQ ID NO: 1273953 - DNA, 22 bp, Artificial Sequence
  chemically synthesized
gttgacactaaaagtaagttca

SEQ ID NO: 1273954 - DNA, 22 bp, Artificial Sequence
  chemically synthesized
tgttgacactaaaagtaagttc

SEQ ID NO: 1273955 - DNA, 22 bp, Artificial Sequence
  chemically synthesized
tttgttgacactaaaagtaagt

SEQ ID NO: 1273956 - DNA, 22 bp, Artificial Sequence
  chemically synthesized
ggtctgatgaacttacttttag

SEQ ID NO: 1273957 - DNA, 22 bp, Artificial Sequence
  chemically synthesized
gtctgatgaacttacttttagt

SEQ ID NO: 1273958 - DNA, 22 bp, Artificial Sequence
  chemically synthesized
atgaacttacttttagtgtcaa

SEQ ID NO: 1273959 - DNA, 22 bp, Artificial Sequence
  chemically synthesized
acttttagtgtcaacaaagagg

SEQ ID NO: 1273960 - DNA, 22 bp, Artificial Sequence
  chemically synthesized
cttttagtgtcaacaaagaggg

SEQ ID NO: 1273961 - DNA, 22 bp, Artificial Sequence
  chemically synthesized
ttagtgtcaacaaagagggtgt

SEQ ID NO: 1273962 - DNA, 22 bp, Artificial Sequence
  chemically synthesized
tagtgtcaacaaagagggtgtt

SEQ ID NO: 1273963 - DNA, 22 bp, Artificial Sequence
  chemically synthesized
agtgtcaacaaagagggtgttc

SEQ ID NO: 1273964 - DNA, 22 bp, Artificial Sequence
  chemically synthesized
aaatggtgcccagaacaccctc

SEQ ID NO: 1273965 - DNA, 22 bp, Artificial Sequence
  chemically synthesized
gtgtcaacaaagagggtgttct

SEQ ID NO: 1273966 - DNA, 22 bp, Artificial Sequence
  chemically synthesized
tgggcaccatttcaattactat

SEQ ID NO: 1273967 - DNA, 22 bp, Artificial Sequence
  chemically synthesized
ggcaccatttcaattactatac

SEQ ID NO: 1273968 - DNA, 22 bp, Artificial Sequence
  chemically synthesized
caattactatacttatttgttt

SEQ ID NO: 1273969 - DNA, 22 bp, Artificial Sequence
  chemically synthesized
aattactatacttatttgtttt

SEQ ID NO: 1273970 - DNA, 22 bp, Artificial Sequence
  chemically synthesized
tgatagagatacaagaaaaaca

SEQ ID NO: 1273971 - DNA, 22 bp, Artificial Sequence
  chemically synthesized
ctatacttatttgtttttcttg

SEQ ID NO: 1273972 - DNA, 22 bp, Artificial Sequence
  chemically synthesized
tacttatttgtttttcttgtat

SEQ ID NO: 1273973 - DNA, 22 bp, Artificial Sequence
  chemically synthesized
acattatgatagagatacaaga

SEQ ID NO: 1273974 - DNA, 22 bp, Artificial Sequence
  chemically synthesized
aacattatgatagagatacaag

SEQ ID NO: 1273975 - DNA, 22 bp, Artificial Sequence
  chemically synthesized
taacattatgatagagatacaa

SEQ ID NO: 1273976 - DNA, 22 bp, Artificial Sequence
  chemically synthesized
atttgtttttcttgtatctcta

SEQ ID NO: 1273977 - DNA, 22 bp, Artificial Sequence
  chemically synthesized
tttgtttttcttgtatctctat

SEQ ID NO: 1273978 - DNA, 22 bp, Artificial Sequence
  chemically synthesized
gtttttcttgtatctctatcat

SEQ ID NO: 1273979 - DNA, 22 bp, Artificial Sequence
  chemically synthesized
tttttcttgtatctctatcata

SEQ ID NO: 1273980 - DNA, 22 bp, Artificial Sequence
  chemically synthesized
ttcttgtatctctatcataatg

SEQ ID NO: 1273981 - DNA, 22 bp, Artificial Sequence
  chemically synthesized
cgatgactttaacattatgata

SEQ ID NO: 1273982 - DNA, 22 bp, Artificial Sequence
  chemically synthesized
tcttgtatctctatcataatgt

SEQ ID NO: 1273983 - DNA, 22 bp, Artificial Sequence
  chemically synthesized
acgatgactttaacattatgat

SEQ ID NO: 1273984 - DNA, 22 bp, Artificial Sequence
  chemically synthesized
cttgtatctctatcataatgtt

SEQ ID NO: 1273985 - DNA, 22 bp, Artificial Sequence
  chemically synthesized
ttgtatctctatcataatgtta

SEQ ID NO: 1273986 - DNA, 22 bp, Artificial Sequence
  chemically synthesized
gtatctctatcataatgttaaa

SEQ ID NO: 1273987 - DNA, 22 bp, Artificial Sequence
  chemically synthesized
tatctctatcataatgttaaag

SEQ ID NO: 1273988 - DNA, 22 bp, Artificial Sequence
  chemically synthesized
tatcataatgttaaagtcatcg

SEQ ID NO: 1273989 - DNA, 22 bp, Artificial Sequence
  chemically synthesized
tcataatgttaaagtcatcgta

SEQ ID NO: 1273990 - DNA, 22 bp, Artificial Sequence
  chemically synthesized
aataaaaaaacaagagtttacg

SEQ ID NO: 1273991 - DNA, 22 bp, Artificial Sequence
  chemically synthesized
aagtcatcgtaaactcttgttt

SEQ ID NO: 1273992 - DNA, 22 bp, Artificial Sequence
  chemically synthesized
cacccaaaagtattaaataaaa

SEQ ID NO: 1273993 - DNA, 22 bp, Artificial Sequence
  chemically synthesized
tccacccaaaagtattaaataa

SEQ ID NO: 1273994 - DNA, 22 bp, Artificial Sequence
  chemically synthesized
tctccacccaaaagtattaaat

SEQ ID NO: 1273995 - DNA, 22 bp, Artificial Sequence
  chemically synthesized
ttgtttttttatttaatacttt

SEQ ID NO: 1273996 - DNA, 22 bp, Artificial Sequence
  chemically synthesized
gtttttttatttaatacttttg

SEQ ID NO: 1273997 - DNA, 22 bp, Artificial Sequence
  chemically synthesized
tttttttatttaatacttttgg

SEQ ID NO: 1273998 - DNA, 22 bp, Artificial Sequence
  chemically synthesized
ccctctctccacccaaaagtat

SEQ ID NO: 1273999 - DNA, 22 bp, Artificial Sequence
  chemically synthesized
ttttatttaatacttttgggtg

SEQ ID NO: 1274000 - DNA, 22 bp, Artificial Sequence
  chemically synthesized
tttatttaatacttttgggtgg

SEQ ID NO: 1274001 - DNA, 22 bp, Artificial Sequence
  chemically synthesized
ttatttaatacttttgggtgga

SEQ ID NO: 1274002 - DNA, 22 bp, Artificial Sequence
  chemically synthesized
tatttaatacttttgggtggag

SEQ ID NO: 1274003 - DNA, 22 bp, Artificial Sequence
  chemically synthesized
gcattcccctctctccacccaa

SEQ ID NO: 1274004 - DNA, 22 bp, Artificial Sequence
  chemically synthesized
atttaatacttttgggtggaga

SEQ ID NO: 1274005 - DNA, 22 bp, Artificial Sequence
  chemically synthesized
tttaatacttttgggtggagag

SEQ ID NO: 1274006 - DNA, 22 bp, Artificial Sequence
  chemically synthesized
aatacttttgggtggagagagg

SEQ ID NO: 1274007 - DNA, 22 bp, Artificial Sequence
  chemically synthesized
agttagcattcccctctctcca

SEQ ID NO: 1274008 - DNA, 22 bp, Artificial Sequence
  chemically synthesized
atacttttgggtggagagaggg

SEQ ID NO: 1274009 - DNA, 22 bp, Artificial Sequence
  chemically synthesized
aagttagcattcccctctctcc

SEQ ID NO: 1274010 - DNA, 22 bp, Artificial Sequence
  chemically synthesized
ttaagttagcattcccctctct

SEQ ID NO: 1274011 - DNA, 22 bp, Artificial Sequence
  chemically synthesized
cttaagttagcattcccctctc

SEQ ID NO: 1274012 - DNA, 22 bp, Artificial Sequence
  chemically synthesized
ttgggtggagagaggggaatgc

SEQ ID NO: 1274013 - DNA, 22 bp, Artificial Sequence
  chemically synthesized
tgggtggagagaggggaatgct

SEQ ID NO: 1274014 - DNA, 22 bp, Artificial Sequence
  chemically synthesized
gggtggagagaggggaatgcta

SEQ ID NO: 1274015 - DNA, 22 bp, Artificial Sequence
  chemically synthesized
ggtggagagaggggaatgctaa

SEQ ID NO: 1274016 - DNA, 22 bp, Artificial Sequence
  chemically synthesized
aatagggaaaatataatttctt

SEQ ID NO: 1274017 - DNA, 22 bp, Artificial Sequence
  chemically synthesized
acttaagaaattatattttccc

SEQ ID NO: 1274018 - DNA, 22 bp, Artificial Sequence
  chemically synthesized
aagaaattatattttccctatt

SEQ ID NO: 1274019 - DNA, 22 bp, Artificial Sequence
  chemically synthesized
agaaattatattttccctattc

SEQ ID NO: 1274020 - DNA, 22 bp, Artificial Sequence
  chemically synthesized
atacatcaaaataaaattgaat

SEQ ID NO: 1274021 - DNA, 22 bp, Artificial Sequence
  chemically synthesized
aatacatcaaaataaaattgaa

SEQ ID NO: 1274022 - DNA, 22 bp, Artificial Sequence
  chemically synthesized
tattttccctattcaattttat

SEQ ID NO: 1274023 - DNA, 22 bp, Artificial Sequence
  chemically synthesized
cttaatacatcaaaataaaatt

SEQ ID NO: 1274024 - DNA, 22 bp, Artificial Sequence
  chemically synthesized
tccctattcaattttattttga

SEQ ID NO: 1274025 - DNA, 22 bp, Artificial Sequence
  chemically synthesized
ccctattcaattttattttgat

SEQ ID NO: 1274026 - DNA, 22 bp, Artificial Sequence
  chemically synthesized
cctattcaattttattttgatg

SEQ ID NO: 1274027 - DNA, 22 bp, Artificial Sequence
  chemically synthesized
ttcaattttattttgatgtatt

SEQ ID NO: 1274028 - DNA, 22 bp, Artificial Sequence
  chemically synthesized
aaatagttgcttaatacatcaa

SEQ ID NO: 1274029 - DNA, 22 bp, Artificial Sequence
  chemically synthesized
aattttattttgatgtattaag

SEQ ID NO: 1274030 - DNA, 22 bp, Artificial Sequence
  chemically synthesized
ggcactgaaatagttgcttaat

SEQ ID NO: 1274031 - DNA, 22 bp, Artificial Sequence
  chemically synthesized
tattttgatgtattaagcaact

SEQ ID NO: 1274032 - DNA, 22 bp, Artificial Sequence
  chemically synthesized
attttgatgtattaagcaacta

SEQ ID NO: 1274033 - DNA, 22 bp, Artificial Sequence
  chemically synthesized
ttttgatgtattaagcaactat

SEQ ID NO: 1274034 - DNA, 22 bp, Artificial Sequence
  chemically synthesized
tgatgtattaagcaactatttc

SEQ ID NO: 1274035 - DNA, 22 bp, Artificial Sequence
  chemically synthesized
gatgtattaagcaactatttca

SEQ ID NO: 1274036 - DNA, 22 bp, Artificial Sequence
  chemically synthesized
atgtattaagcaactatttcag

SEQ ID NO: 1274037 - DNA, 22 bp, Artificial Sequence
  chemically synthesized
gcacatattaggcactgaaata

SEQ ID NO: 1274038 - DNA, 22 bp, Artificial Sequence
  chemically synthesized
agcaactatttcagtgcctaat

SEQ ID NO: 1274039 - DNA, 22 bp, Artificial Sequence
  chemically synthesized
tcacatgcctggcacatattag

SEQ ID NO: 1274040 - DNA, 22 bp, Artificial Sequence
  chemically synthesized
atcacatgcctggcacatatta

SEQ ID NO: 1274041 - DNA, 22 bp, Artificial Sequence
  chemically synthesized
tttcagtgcctaatatgtgcca

SEQ ID NO: 1274042 - DNA, 22 bp, Artificial Sequence
  chemically synthesized
tttatcacatgcctggcacata

SEQ ID NO: 1274043 - DNA, 22 bp, Artificial Sequence
  chemically synthesized
cagtgcctaatatgtgccaggc

SEQ ID NO: 1274044 - DNA, 22 bp, Artificial Sequence
  chemically synthesized
agtgcctaatatgtgccaggca

SEQ ID NO: 1274045 - DNA, 22 bp, Artificial Sequence
  chemically synthesized
ctgtttatcacatgcctggcac

SEQ ID NO: 1274046 - DNA, 22 bp, Artificial Sequence
  chemically synthesized
catcctgctgtttatcacatgc

SEQ ID NO: 1274047 - DNA, 22 bp, Artificial Sequence
  chemically synthesized
atatgtgccaggcatgtgataa

SEQ ID NO: 1274048 - DNA, 22 bp, Artificial Sequence
  chemically synthesized
gcatcctgctgtttatcacatg

SEQ ID NO: 1274049 - DNA, 22 bp, Artificial Sequence
  chemically synthesized
tgcatcctgctgtttatcacat

SEQ ID NO: 1274050 - DNA, 22 bp, Artificial Sequence
  chemically synthesized
tgtatactttgcatcctgctgt

SEQ ID NO: 1274051 - DNA, 22 bp, Artificial Sequence
  chemically synthesized
tatgtatacaccatgtagatgt

SEQ ID NO: 1274052 - DNA, 22 bp, Artificial Sequence
  chemically synthesized
actatatgtatacaccatgtag

SEQ ID NO: 1274053 - DNA, 22 bp, Artificial Sequence
  chemically synthesized
gactatatgtatacaccatgta

SEQ ID NO: 1274054 - DNA, 22 bp, Artificial Sequence
  chemically synthesized
tgactatatgtatacaccatgt

SEQ ID NO: 1274055 - DNA, 22 bp, Artificial Sequence
  chemically synthesized
tttgactatatgtatacaccat

SEQ ID NO: 1274056 - DNA, 22 bp, Artificial Sequence
  chemically synthesized
ctttgactatatgtatacacca

SEQ ID NO: 1274057 - DNA, 22 bp, Artificial Sequence
  chemically synthesized
catctacatggtgtatacatat

SEQ ID NO: 1274058 - DNA, 22 bp, Artificial Sequence
  chemically synthesized
taatatttctttgactatatgt

SEQ ID NO: 1274059 - DNA, 22 bp, Artificial Sequence
  chemically synthesized
catggtgtatacatatagtcaa

SEQ ID NO: 1274060 - DNA, 22 bp, Artificial Sequence
  chemically synthesized
ttataatatttctttgactata

SEQ ID NO: 1274061 - DNA, 22 bp, Artificial Sequence
  chemically synthesized
actgttataatatttctttgac

SEQ ID NO: 1274062 - DNA, 22 bp, Artificial Sequence
  chemically synthesized
ccaatacatgttaactgttata

SEQ ID NO: 1274063 - DNA, 22 bp, Artificial Sequence
  chemically synthesized
agttaccaatacatgttaactg

SEQ ID NO: 1274064 - DNA, 22 bp, Artificial Sequence
  chemically synthesized
aagttaccaatacatgttaact

SEQ ID NO: 1274065 - DNA, 22 bp, Artificial Sequence
  chemically synthesized
taacagttaacatgtattggta

SEQ ID NO: 1274066 - DNA, 22 bp, Artificial Sequence
  chemically synthesized
tacatatgtcttaagttaccaa

SEQ ID NO: 1274067 - DNA, 22 bp, Artificial Sequence
  chemically synthesized
tatacatatgtcttaagttacc

SEQ ID NO: 1274068 - DNA, 22 bp, Artificial Sequence
  chemically synthesized
acatgtattggtaacttaagac

SEQ ID NO: 1274069 - DNA, 22 bp, Artificial Sequence
  chemically synthesized
ctctatacatatgtcttaagtt

SEQ ID NO: 1274070 - DNA, 22 bp, Artificial Sequence
  chemically synthesized
agattcctctatacatatgtct

SEQ ID NO: 1274071 - DNA, 22 bp, Artificial Sequence
  chemically synthesized
gtaacttaagacatatgtatag

SEQ ID NO: 1274072 - DNA, 22 bp, Artificial Sequence
  chemically synthesized
aagacatatgtatagaggaatc

SEQ ID NO: 1274073 - DNA, 22 bp, Artificial Sequence
  chemically synthesized
agacatatgtatagaggaatct

SEQ ID NO: 1274074 - DNA, 22 bp, Artificial Sequence
  chemically synthesized
accacaaaccaagcctcagatt

SEQ ID NO: 1274075 - DNA, 22 bp, Artificial Sequence
  chemically synthesized
gaccacaaaccaagcctcagat

SEQ ID NO: 1274076 - DNA, 22 bp, Artificial Sequence
  chemically synthesized
tatatataccatcttgaccaca

SEQ ID NO: 1274077 - DNA, 22 bp, Artificial Sequence
  chemically synthesized
aggcttggtttgtggtcaagat

SEQ ID NO: 1274078 - DNA, 22 bp, Artificial Sequence
  chemically synthesized
ggtttgtggtcaagatggtata

SEQ ID NO: 1274079 - DNA, 22 bp, Artificial Sequence
  chemically synthesized
gtttgtggtcaagatggtatat

SEQ ID NO: 1274080 - DNA, 22 bp, Artificial Sequence
  chemically synthesized
gtggtcaagatggtatatatat

SEQ ID NO: 1274081 - DNA, 22 bp, Artificial Sequence
  chemically synthesized
tggtcaagatggtatatatata

SEQ ID NO: 1274082 - DNA, 22 bp, Artificial Sequence
  chemically synthesized
aagaagcaaacaaaccaaggat

SEQ ID NO: 1274083 - DNA, 22 bp, Artificial Sequence
  chemically synthesized
tctcaagaagcaaacaaaccaa

SEQ ID NO: 1274084 - DNA, 22 bp, Artificial Sequence
  chemically synthesized
gtctcaagaagcaaacaaacca

SEQ ID NO: 1274085 - DNA, 22 bp, Artificial Sequence
  chemically synthesized
gatttgtctcaagaagcaaaca

SEQ ID NO: 1274086 - DNA, 22 bp, Artificial Sequence
  chemically synthesized
tagatttgtctcaagaagcaaa

SEQ ID NO: 1274087 - DNA, 22 bp, Artificial Sequence
  chemically synthesized
ctagatttgtctcaagaagcaa

SEQ ID NO: 1274088 - DNA, 22 bp, Artificial Sequence
  chemically synthesized
tttctagatttgtctcaagaag

SEQ ID NO: 1274089 - DNA, 22 bp, Artificial Sequence
  chemically synthesized
ggtttgtttgcttcttgagaca

SEQ ID NO: 1274090 - DNA, 22 bp, Artificial Sequence
  chemically synthesized
gtttgtttgcttcttgagacaa

SEQ ID NO: 1274091 - DNA, 22 bp, Artificial Sequence
  chemically synthesized
gttgtttctagatttgtctcaa

SEQ ID NO: 1274092 - DNA, 22 bp, Artificial Sequence
  chemically synthesized
gtttgcttcttgagacaaatct

SEQ ID NO: 1274093 - DNA, 22 bp, Artificial Sequence
  chemically synthesized
tttgcttcttgagacaaatcta

SEQ ID NO: 1274094 - DNA, 22 bp, Artificial Sequence
  chemically synthesized
gcctagttgtttctagatttgt

SEQ ID NO: 1274095 - DNA, 22 bp, Artificial Sequence
  chemically synthesized
ggcctagttgtttctagatttg

SEQ ID NO: 1274096 - DNA, 22 bp, Artificial Sequence
  chemically synthesized
gcttcttgagacaaatctagaa

SEQ ID NO: 1274097 - DNA, 22 bp, Artificial Sequence
  chemically synthesized
tggcctagttgtttctagattt

SEQ ID NO: 1274098 - DNA, 22 bp, Artificial Sequence
  chemically synthesized
cttcttgagacaaatctagaaa

SEQ ID NO: 1274099 - DNA, 22 bp, Artificial Sequence
  chemically synthesized
ctttggcctagttgtttctaga

SEQ ID NO: 1274100 - DNA, 22 bp, Artificial Sequence
  chemically synthesized
cttgagacaaatctagaaacaa

SEQ ID NO: 1274101 - DNA, 22 bp, Artificial Sequence
  chemically synthesized
actttggcctagttgtttctag

SEQ ID NO: 1274102 - DNA, 22 bp, Artificial Sequence
  chemically synthesized
ttgagacaaatctagaaacaac

SEQ ID NO: 1274103 - DNA, 22 bp, Artificial Sequence
  chemically synthesized
gagacaaatctagaaacaacta

SEQ ID NO: 1274104 - DNA, 22 bp, Artificial Sequence
  chemically synthesized
agacaaatctagaaacaactag

SEQ ID NO: 1274105 - DNA, 22 bp, Artificial Sequence
  chemically synthesized
atagtgtttactttggcctagt

SEQ ID NO: 1274106 - DNA, 22 bp, Artificial Sequence
  chemically synthesized
gaaacaactaggccaaagtaaa

SEQ ID NO: 1274107 - DNA, 22 bp, Artificial Sequence
  chemically synthesized
taatagttgatagtgtttactt

SEQ ID NO: 1274108 - DNA, 22 bp, Artificial Sequence
  chemically synthesized
ttataatagttgatagtgttta

SEQ ID NO: 1274109 - DNA, 22 bp, Artificial Sequence
  chemically synthesized
ggccaaagtaaacactatcaac

SEQ ID NO: 1274110 - DNA, 22 bp, Artificial Sequence
  chemically synthesized
aaaggagtcatgactattataa

SEQ ID NO: 1274111 - DNA, 22 bp, Artificial Sequence
  chemically synthesized
tcaactattataatagtcatga

SEQ ID NO: 1274112 - DNA, 22 bp, Artificial Sequence
  chemically synthesized
ttataatagtcatgactccttt

SEQ ID NO: 1274113 - DNA, 22 bp, Artificial Sequence
  chemically synthesized
taatagtcatgactcctttgag

SEQ ID NO: 1274114 - DNA, 22 bp, Artificial Sequence
  chemically synthesized
cagaagaaagaataaatactca

SEQ ID NO: 1274115 - DNA, 22 bp, Artificial Sequence
  chemically synthesized
ctttgagtatttattctttctt

SEQ ID NO: 1274116 - DNA, 22 bp, Artificial Sequence
  chemically synthesized
tcagagttccagaagaaagaat

SEQ ID NO: 1274117 - DNA, 22 bp, Artificial Sequence
  chemically synthesized
tgagtatttattctttcttctg

SEQ ID NO: 1274118 - DNA, 22 bp, Artificial Sequence
  chemically synthesized
gagtatttattctttcttctgg

SEQ ID NO: 1274119 - DNA, 22 bp, Artificial Sequence
  chemically synthesized
agtatttattctttcttctgga

SEQ ID NO: 1274120 - DNA, 22 bp, Artificial Sequence
  chemically synthesized
attctttcttctggaactctga

SEQ ID NO: 1274121 - DNA, 22 bp, Artificial Sequence
  chemically synthesized
ttctttcttctggaactctgac

SEQ ID NO: 1274122 - DNA, 22 bp, Artificial Sequence
  chemically synthesized
aatcacaatatctgtcagagtt

SEQ ID NO: 1274123 - DNA, 22 bp, Artificial Sequence
  chemically synthesized
aaatcacaatatctgtcagagt

SEQ ID NO: 1274124 - DNA, 22 bp, Artificial Sequence
  chemically synthesized
tttcttctggaactctgacaga

SEQ ID NO: 1274125 - DNA, 22 bp, Artificial Sequence
  chemically synthesized
tcttctggaactctgacagata

SEQ ID NO: 1274126 - DNA, 22 bp, Artificial Sequence
  chemically synthesized
cttctggaactctgacagatat

SEQ ID NO: 1274127 - DNA, 22 bp, Artificial Sequence
  chemically synthesized
ttctggaactctgacagatatt

SEQ ID NO: 1274128 - DNA, 22 bp, Artificial Sequence
  chemically synthesized
ctggaactctgacagatattgt

SEQ ID NO: 1274129 - DNA, 22 bp, Artificial Sequence
  chemically synthesized
cgcccttaaatcacaatatctg

SEQ ID NO: 1274130 - DNA, 22 bp, Artificial Sequence
  chemically synthesized
tggaactctgacagatattgtg

SEQ ID NO: 1274131 - DNA, 22 bp, Artificial Sequence
  chemically synthesized
gaactctgacagatattgtgat

SEQ ID NO: 1274132 - DNA, 22 bp, Artificial Sequence
  chemically synthesized
tccctacgcccttaaatcacaa

SEQ ID NO: 1274133 - DNA, 22 bp, Artificial Sequence
  chemically synthesized
tgacagatattgtgatttaagg

SEQ ID NO: 1274134 - DNA, 22 bp, Artificial Sequence
  chemically synthesized
ctatccctacgcccttaaatca

SEQ ID NO: 1274135 - DNA, 22 bp, Artificial Sequence
  chemically synthesized
cctatccctacgcccttaaatc

SEQ ID NO: 1274136 - DNA, 22 bp, Artificial Sequence
  chemically synthesized
acagatattgtgatttaagggc

SEQ ID NO: 1274137 - DNA, 22 bp, Artificial Sequence
  chemically synthesized
tcctatccctacgcccttaaat

SEQ ID NO: 1274138 - DNA, 22 bp, Artificial Sequence
  chemically synthesized
ctttcctatccctacgccctta

SEQ ID NO: 1274139 - DNA, 22 bp, Artificial Sequence
  chemically synthesized
cctttcctatccctacgccctt

SEQ ID NO: 1274140 - DNA, 22 bp, Artificial Sequence
  chemically synthesized
tcctttcctatccctacgccct

SEQ ID NO: 1274141 - DNA, 22 bp, Artificial Sequence
  chemically synthesized
ttcctttcctatccctacgccc

SEQ ID NO: 1274142 - DNA, 22 bp, Artificial Sequence
  chemically synthesized
tttcctttcctatccctacgcc

SEQ ID NO: 1274143 - DNA, 22 bp, Artificial Sequence
  chemically synthesized
ttttcctttcctatccctacgc

SEQ ID NO: 1274144 - DNA, 22 bp, Artificial Sequence
  chemically synthesized
tgatttaagggcgtagggatag

SEQ ID NO: 1274145 - DNA, 22 bp, Artificial Sequence
  chemically synthesized
atttttttcctttcctatccct

SEQ ID NO: 1274146 - DNA, 22 bp, Artificial Sequence
  chemically synthesized
catttttttcctttcctatccc

SEQ ID NO: 1274147 - DNA, 22 bp, Artificial Sequence
  chemically synthesized
tcatttttttcctttcctatcc

SEQ ID NO: 1274148 - DNA, 22 bp, Artificial Sequence
  chemically synthesized
aagggcgtagggataggaaagg

SEQ ID NO: 1274149 - DNA, 22 bp, Artificial Sequence
  chemically synthesized
agggcgtagggataggaaagga

SEQ ID NO: 1274150 - DNA, 22 bp, Artificial Sequence
  chemically synthesized
ctttcatttttttcctttccta

SEQ ID NO: 1274151 - DNA, 22 bp, Artificial Sequence
  chemically synthesized
gctttcatttttttcctttcct

SEQ ID NO: 1274152 - DNA, 22 bp, Artificial Sequence
  chemically synthesized
tgctttcatttttttcctttcc

SEQ ID NO: 1274153 - DNA, 22 bp, Artificial Sequence
  chemically synthesized
tttgctttcatttttttccttt

SEQ ID NO: 1274154 - DNA, 22 bp, Artificial Sequence
  chemically synthesized
tctctttgctttcatttttttc

SEQ ID NO: 1274155 - DNA, 22 bp, Artificial Sequence
  chemically synthesized
actgtctctttgctttcatttt

SEQ ID NO: 1274156 - DNA, 22 bp, Artificial Sequence
  chemically synthesized
tcactgtctctttgctttcatt

SEQ ID NO: 1274157 - DNA, 22 bp, Artificial Sequence
  chemically synthesized
aaaagtgttctcactgtctctt

SEQ ID NO: 1274158 - DNA, 22 bp, Artificial Sequence
  chemically synthesized
taaaaagtgttctcactgtctc

SEQ ID NO: 1274159 - DNA, 22 bp, Artificial Sequence
  chemically synthesized
gctctaaaaagtgttctcactg

SEQ ID NO: 1274160 - DNA, 22 bp, Artificial Sequence
  chemically synthesized
tgccctggctctaaaaagtgtt

SEQ ID NO: 1274161 - DNA, 22 bp, Artificial Sequence
  chemically synthesized
ggctgtgccctggctctaaaaa

SEQ ID NO: 1274162 - DNA, 22 bp, Artificial Sequence
  chemically synthesized
aggctgtgccctggctctaaaa

SEQ ID NO: 1274163 - DNA, 22 bp, Artificial Sequence
  chemically synthesized
atcttaggctgtgccctggctc

SEQ ID NO: 1274164 - DNA, 22 bp, Artificial Sequence
  chemically synthesized
catcttaggctgtgccctggct

SEQ ID NO: 1274165 - DNA, 22 bp, Artificial Sequence
  chemically synthesized
ttcatcttaggctgtgccctgg

SEQ ID NO: 1274166 - DNA, 22 bp, Artificial Sequence
  chemically synthesized
ttcttcatcttaggctgtgccc

SEQ ID NO: 1274167 - DNA, 22 bp, Artificial Sequence
  chemically synthesized
gttcttcatcttaggctgtgcc

SEQ ID NO: 1274168 - DNA, 22 bp, Artificial Sequence
  chemically synthesized
tttagagccagggcacagccta

SEQ ID NO: 1274169 - DNA, 22 bp, Artificial Sequence
  chemically synthesized
ttagagccagggcacagcctaa

SEQ ID NO: 1274170 - DNA, 22 bp, Artificial Sequence
  chemically synthesized
tagagccagggcacagcctaag

SEQ ID NO: 1274171 - DNA, 22 bp, Artificial Sequence
  chemically synthesized
agagccagggcacagcctaaga

SEQ ID NO: 1274172 - DNA, 22 bp, Artificial Sequence
  chemically synthesized
atttgttcttcatcttaggctg

SEQ ID NO: 1274173 - DNA, 22 bp, Artificial Sequence
  chemically synthesized
gagccagggcacagcctaagat

SEQ ID NO: 1274174 - DNA, 22 bp, Artificial Sequence
  chemically synthesized
catttgttcttcatcttaggct

SEQ ID NO: 1274175 - DNA, 22 bp, Artificial Sequence
  chemically synthesized
tcatttgttcttcatcttaggc

SEQ ID NO: 1274176 - DNA, 22 bp, Artificial Sequence
  chemically synthesized
atgtagatctttcatttgttct

SEQ ID NO: 1274177 - DNA, 22 bp, Artificial Sequence
  chemically synthesized
ctgatgtagatctttcatttgt

SEQ ID NO: 1274178 - DNA, 22 bp, Artificial Sequence
  chemically synthesized
agatgaagaacaaatgaaagat

SEQ ID NO: 1274179 - DNA, 22 bp, Artificial Sequence
  chemically synthesized
gctgctgatgtagatctttcat

SEQ ID NO: 1274180 - DNA, 22 bp, Artificial Sequence
  chemically synthesized
ggctgctgatgtagatctttca

SEQ ID NO: 1274181 - DNA, 22 bp, Artificial Sequence
  chemically synthesized
tggctgctgatgtagatctttc

SEQ ID NO: 1274182 - DNA, 22 bp, Artificial Sequence
  chemically synthesized
cctttggctgctgatgtagatc

SEQ ID NO: 1274183 - DNA, 22 bp, Artificial Sequence
  chemically synthesized
acctttggctgctgatgtagat

SEQ ID NO: 1274184 - DNA, 22 bp, Artificial Sequence
  chemically synthesized
tacctttggctgctgatgtaga

SEQ ID NO: 1274185 - DNA, 22 bp, Artificial Sequence
  chemically synthesized
ttacctttggctgctgatgtag

SEQ ID NO: 1274186 - DNA, 22 bp, Artificial Sequence
  chemically synthesized
tttttacctttggctgctgatg

SEQ ID NO: 1274187 - DNA, 22 bp, Artificial Sequence
  chemically synthesized
atttttacctttggctgctgat

SEQ ID NO: 1274188 - DNA, 22 bp, Artificial Sequence
  chemically synthesized
aagtgcttatttttacctttgg

SEQ ID NO: 1274189 - DNA, 22 bp, Artificial Sequence
  chemically synthesized
tgaagtgcttatttttaccttt

SEQ ID NO: 1274190 - DNA, 22 bp, Artificial Sequence
  chemically synthesized
catcagcagccaaaggtaaaaa

SEQ ID NO: 1274191 - DNA, 22 bp, Artificial Sequence
  chemically synthesized
ctgaagtgcttatttttacctt

SEQ ID NO: 1274192 - DNA, 22 bp, Artificial Sequence
  chemically synthesized
tctgaagtgcttatttttacct

SEQ ID NO: 1274193 - DNA, 22 bp, Artificial Sequence
  chemically synthesized
tttctgaagtgcttatttttac

SEQ ID NO: 1274194 - DNA, 22 bp, Artificial Sequence
  chemically synthesized
ctttctgaagtgcttattttta

SEQ ID NO: 1274195 - DNA, 22 bp, Artificial Sequence
  chemically synthesized
tctttctgaagtgcttattttt

SEQ ID NO: 1274196 - DNA, 22 bp, Artificial Sequence
  chemically synthesized
tggaaaatcagttttctttctg

SEQ ID NO: 1274197 - DNA, 22 bp, Artificial Sequence
  chemically synthesized
tgtggaaaatcagttttctttc

SEQ ID NO: 1274198 - DNA, 22 bp, Artificial Sequence
  chemically synthesized
ctgtggaaaatcagttttcttt

SEQ ID NO: 1274199 - DNA, 22 bp, Artificial Sequence
  chemically synthesized
ttctgtggaaaatcagttttct

SEQ ID NO: 1274200 - DNA, 22 bp, Artificial Sequence
  chemically synthesized
cttctgtggaaaatcagttttc

SEQ ID NO: 1274201 - DNA, 22 bp, Artificial Sequence
  chemically synthesized
tcttctgtggaaaatcagtttt

SEQ ID NO: 1274202 - DNA, 22 bp, Artificial Sequence
  chemically synthesized
ttcttctgtggaaaatcagttt

SEQ ID NO: 1274203 - DNA, 22 bp, Artificial Sequence
  chemically synthesized
tttcttctgtggaaaatcagtt

SEQ ID NO: 1274204 - DNA, 22 bp, Artificial Sequence
  chemically synthesized
cagaaagaaaactgattttcca

SEQ ID NO: 1274205 - DNA, 22 bp, Artificial Sequence
  chemically synthesized
agaaagaaaactgattttccac

SEQ ID NO: 1274206 - DNA, 22 bp, Artificial Sequence
  chemically synthesized
ccatattttttcttctgtggaa

SEQ ID NO: 1274207 - DNA, 22 bp, Artificial Sequence
  chemically synthesized
tgtctgccatattttttcttct

SEQ ID NO: 1274208 - DNA, 22 bp, Artificial Sequence
  chemically synthesized
attttccacagaagaaaaaata

SEQ ID NO: 1274209 - DNA, 22 bp, Artificial Sequence
  chemically synthesized
tccacagaagaaaaaatatggc

SEQ ID NO: 1274210 - DNA, 22 bp, Artificial Sequence
  chemically synthesized
ccacagaagaaaaaatatggca

SEQ ID NO: 1274211 - DNA, 22 bp, Artificial Sequence
  chemically synthesized
cacagaagaaaaaatatggcag

SEQ ID NO: 1274212 - DNA, 22 bp, Artificial Sequence
  chemically synthesized
tgccatcagacattatgtctgc

SEQ ID NO: 1274213 - DNA, 22 bp, Artificial Sequence
  chemically synthesized
gagcctatgccatcagacatta

SEQ ID NO: 1274214 - DNA, 22 bp, Artificial Sequence
  chemically synthesized
catctggagcctatgccatcag

SEQ ID NO: 1274215 - DNA, 22 bp, Artificial Sequence
  chemically synthesized
ttccatctggagcctatgccat

SEQ ID NO: 1274216 - DNA, 22 bp, Artificial Sequence
  chemically synthesized
attccatctggagcctatgcca

SEQ ID NO: 1274217 - DNA, 22 bp, Artificial Sequence
  chemically synthesized
ttattccatctggagcctatgc

SEQ ID NO: 1274218 - DNA, 22 bp, Artificial Sequence
  chemically synthesized
cttattccatctggagcctatg

SEQ ID NO: 1274219 - DNA, 22 bp, Artificial Sequence
  chemically synthesized
tgtatttcttattccatctgga

SEQ ID NO: 1274220 - DNA, 22 bp, Artificial Sequence
  chemically synthesized
atggcataggctccagatggaa

SEQ ID NO: 1274221 - DNA, 22 bp, Artificial Sequence
  chemically synthesized
cagctgtgtatttcttattcca

SEQ ID NO: 1274222 - DNA, 22 bp, Artificial Sequence
  chemically synthesized
tgcagctgtgtatttcttattc

SEQ ID NO: 1274223 - DNA, 22 bp, Artificial Sequence
  chemically synthesized
ctctgcagctgtgtatttctta

SEQ ID NO: 1274224 - DNA, 22 bp, Artificial Sequence
  chemically synthesized
actctgcagctgtgtatttctt

SEQ ID NO: 1274225 - DNA, 22 bp, Artificial Sequence
  chemically synthesized
cagatggaataagaaatacaca

SEQ ID NO: 1274226 - DNA, 22 bp, Artificial Sequence
  chemically synthesized
aagatagccttactctgcagct

SEQ ID NO: 1274227 - DNA, 22 bp, Artificial Sequence
  chemically synthesized
actgaagatagccttactctgc

SEQ ID NO: 1274228 - DNA, 22 bp, Artificial Sequence
  chemically synthesized
gattaactgaagatagccttac

SEQ ID NO: 1274229 - DNA, 22 bp, Artificial Sequence
  chemically synthesized
tcgattaactgaagatagcctt

SEQ ID NO: 1274230 - DNA, 22 bp, Artificial Sequence
  chemically synthesized
tctcgattaactgaagatagcc

SEQ ID NO: 1274231 - DNA, 22 bp, Artificial Sequence
  chemically synthesized
ctctcgattaactgaagatagc

SEQ ID NO: 1274232 - DNA, 22 bp, Artificial Sequence
  chemically synthesized
cagagtaaggctatcttcagtt

SEQ ID NO: 1274233 - DNA, 22 bp, Artificial Sequence
  chemically synthesized
atgatcaggcttctctcgatta

SEQ ID NO: 1274234 - DNA, 22 bp, Artificial Sequence
  chemically synthesized
tgatgatcaggcttctctcgat

SEQ ID NO: 1274235 - DNA, 22 bp, Artificial Sequence
  chemically synthesized
ctgatgatcaggcttctctcga

SEQ ID NO: 1274236 - DNA, 22 bp, Artificial Sequence
  chemically synthesized
tcttcagttaatcgagagaagc

SEQ ID NO: 1274237 - DNA, 22 bp, Artificial Sequence
  chemically synthesized
cagttaatcgagagaagcctga

SEQ ID NO: 1274238 - DNA, 22 bp, Artificial Sequence
  chemically synthesized
agttaatcgagagaagcctgat

SEQ ID NO: 1274239 - DNA, 22 bp, Artificial Sequence
  chemically synthesized
atgcttctgatgatcaggcttc

SEQ ID NO: 1274240 - DNA, 22 bp, Artificial Sequence
  chemically synthesized
gctaatgcttctgatgatcagg

SEQ ID NO: 1274241 - DNA, 22 bp, Artificial Sequence
  chemically synthesized
atcgagagaagcctgatcatca

SEQ ID NO: 1274242 - DNA, 22 bp, Artificial Sequence
  chemically synthesized
cagacattggctaatgcttctg

SEQ ID NO: 1274243 - DNA, 22 bp, Artificial Sequence
  chemically synthesized
acagacattggctaatgcttct

SEQ ID NO: 1274244 - DNA, 22 bp, Artificial Sequence
  chemically synthesized
atcatcagaagcattagccaat

SEQ ID NO: 1274245 - DNA, 22 bp, Artificial Sequence
  chemically synthesized
tatgtttacagacattggctaa

SEQ ID NO: 1274246 - DNA, 22 bp, Artificial Sequence
  chemically synthesized
ttatatgtttacagacattggc

SEQ ID NO: 1274247 - DNA, 22 bp, Artificial Sequence
  chemically synthesized
ttattatatgtttacagacatt

SEQ ID NO: 1274248 - DNA, 22 bp, Artificial Sequence
  chemically synthesized
attattatatgtttacagacat

SEQ ID NO: 1274249 - DNA, 22 bp, Artificial Sequence
  chemically synthesized
tattattatatgtttacagaca

SEQ ID NO: 1274250 - DNA, 22 bp, Artificial Sequence
  chemically synthesized
ttttattattatatgtttacag

SEQ ID NO: 1274251 - DNA, 22 bp, Artificial Sequence
  chemically synthesized
attttattattatatgtttaca

SEQ ID NO: 1274252 - DNA, 22 bp, Artificial Sequence
  chemically synthesized
gccaatgtctgtaaacatataa

SEQ ID NO: 1274253 - DNA, 22 bp, Artificial Sequence
  chemically synthesized
catttattttattattatatgt

SEQ ID NO: 1274254 - DNA, 22 bp, Artificial Sequence
  chemically synthesized
tgcatttattttattattatat

SEQ ID NO: 1274255 - DNA, 22 bp, Artificial Sequence
  chemically synthesized
ctgcatttattttattattata

SEQ ID NO: 1274256 - DNA, 22 bp, Artificial Sequence
  chemically synthesized
taaacatataataataaaataa

SEQ ID NO: 1274257 - DNA, 22 bp, Artificial Sequence
  chemically synthesized
tagtgatttctgcatttatttt

SEQ ID NO: 1274258 - DNA, 22 bp, Artificial Sequence
  chemically synthesized
atagtgatttctgcatttattt

SEQ ID NO: 1274259 - DNA, 22 bp, Artificial Sequence
  chemically synthesized
acacaaagatttatagtgattt

SEQ ID NO: 1274260 - DNA, 22 bp, Artificial Sequence
  chemically synthesized
taaaacaaaattaacacaaaga

SEQ ID NO: 1274261 - DNA, 22 bp, Artificial Sequence
  chemically synthesized
ataaaacaaaattaacacaaag

SEQ ID NO: 1274262 - DNA, 22 bp, Artificial Sequence
  chemically synthesized
tataaaacaaaattaacacaaa

SEQ ID NO: 1274263 - DNA, 22 bp, Artificial Sequence
  chemically synthesized
ttataaaacaaaattaacacaa

SEQ ID NO: 1274264 - DNA, 22 bp, Artificial Sequence
  chemically synthesized
tttttataaaacaaaattaaca

SEQ ID NO: 1274265 - DNA, 22 bp, Artificial Sequence
  chemically synthesized
taaatctttgtgttaattttgt

SEQ ID NO: 1274266 - DNA, 22 bp, Artificial Sequence
  chemically synthesized
aattatttttataaaacaaaat

SEQ ID NO: 1274267 - DNA, 22 bp, Artificial Sequence
  chemically synthesized
gaattatttttataaaacaaaa

SEQ ID NO: 1274268 - DNA, 22 bp, Artificial Sequence
  chemically synthesized
ttgaattatttttataaaacaa

SEQ ID NO: 1274269 - DNA, 22 bp, Artificial Sequence
  chemically synthesized
tgtgttaattttgttttataaa

SEQ ID NO: 1274270 - DNA, 22 bp, Artificial Sequence
  chemically synthesized
gtgttaattttgttttataaaa

SEQ ID NO: 1274271 - DNA, 22 bp, Artificial Sequence
  chemically synthesized
tgttaattttgttttataaaaa

SEQ ID NO: 1274272 - DNA, 22 bp, Artificial Sequence
  chemically synthesized
attttgttttataaaaataatt

SEQ ID NO: 1274273 - DNA, 22 bp, Artificial Sequence
  chemically synthesized
tgttttataaaaataattcaag

SEQ ID NO: 1274274 - DNA, 22 bp, Artificial Sequence
  chemically synthesized
gttttataaaaataattcaaga

SEQ ID NO: 1274275 - DNA, 22 bp, Artificial Sequence
  chemically synthesized
caaaataacagttcttgaatta

SEQ ID NO: 1274276 - DNA, 22 bp, Artificial Sequence
  chemically synthesized
ttttataaaaataattcaagaa

SEQ ID NO: 1274277 - DNA, 22 bp, Artificial Sequence
  chemically synthesized
tataaaaataattcaagaactg

SEQ ID NO: 1274278 - DNA, 22 bp, Artificial Sequence
  chemically synthesized
ataaaaataattcaagaactgt

SEQ ID NO: 1274279 - DNA, 22 bp, Artificial Sequence
  chemically synthesized
taaaaataattcaagaactgtt

SEQ ID NO: 1274280 - DNA, 22 bp, Artificial Sequence
  chemically synthesized
tatacatataatggttccaaaa

SEQ ID NO: 1274281 - DNA, 22 bp, Artificial Sequence
  chemically synthesized
aagaactgttattttggaacca

SEQ ID NO: 1274282 - DNA, 22 bp, Artificial Sequence
  chemically synthesized
ctatatacatataatggttcca

SEQ ID NO: 1274283 - DNA, 22 bp, Artificial Sequence
  chemically synthesized
actatatacatataatggttcc

SEQ ID NO: 1274284 - DNA, 22 bp, Artificial Sequence
  chemically synthesized
ccttactatatacatataatgg

SEQ ID NO: 1274285 - DNA, 22 bp, Artificial Sequence
  chemically synthesized
ttattttggaaccattatatgt

SEQ ID NO: 1274286 - DNA, 22 bp, Artificial Sequence
  chemically synthesized
ttttggaaccattatatgtata

SEQ ID NO: 1274287 - DNA, 22 bp, Artificial Sequence
  chemically synthesized
tggaaccattatatgtatatag

SEQ ID NO: 1274288 - DNA, 22 bp, Artificial Sequence
  chemically synthesized
ggaaccattatatgtatatagt

SEQ ID NO: 1274289 - DNA, 22 bp, Artificial Sequence
  chemically synthesized
gaaccattatatgtatatagta

SEQ ID NO: 1274290 - DNA, 22 bp, Artificial Sequence
  chemically synthesized
tatggtaattaccttactatat

SEQ ID NO: 1274291 - DNA, 22 bp, Artificial Sequence
  chemically synthesized
atatggtaattaccttactata

SEQ ID NO: 1274292 - DNA, 22 bp, Artificial Sequence
  chemically synthesized
cttatatggtaattaccttact

SEQ ID NO: 1274293 - DNA, 22 bp, Artificial Sequence
  chemically synthesized
tatgtatatagtaaggtaatta

SEQ ID NO: 1274294 - DNA, 22 bp, Artificial Sequence
  chemically synthesized
gtataattgcttatatggtaat

SEQ ID NO: 1274295 - DNA, 22 bp, Artificial Sequence
  chemically synthesized
atgacattagtataattgctta

SEQ ID NO: 1274296 - DNA, 22 bp, Artificial Sequence
  chemically synthesized
taatgacattagtataattgct

SEQ ID NO: 1274297 - DNA, 22 bp, Artificial Sequence
  chemically synthesized
ctaatgacattagtataattgc

SEQ ID NO: 1274298 - DNA, 22 bp, Artificial Sequence
  chemically synthesized
ccatataagcaattatactaat

SEQ ID NO: 1274299 - DNA, 22 bp, Artificial Sequence
  chemically synthesized
tgtttctaatgacattagtata

SEQ ID NO: 1274300 - DNA, 22 bp, Artificial Sequence
  chemically synthesized
aaaatctatgtttctaatgaca

SEQ ID NO: 1274301 - DNA, 22 bp, Artificial Sequence
  chemically synthesized
cgctgaaaatctatgtttctaa

SEQ ID NO: 1274302 - DNA, 22 bp, Artificial Sequence
  chemically synthesized
tactaatgtcattagaaacata

SEQ ID NO: 1274303 - DNA, 22 bp, Artificial Sequence
  chemically synthesized
acgctgaaaatctatgtttcta

SEQ ID NO: 1274304 - DNA, 22 bp, Artificial Sequence
  chemically synthesized
ttacgctgaaaatctatgtttc

SEQ ID NO: 1274305 - DNA, 22 bp, Artificial Sequence
  chemically synthesized
tcttacgctgaaaatctatgtt

SEQ ID NO: 1274306 - DNA, 22 bp, Artificial Sequence
  chemically synthesized
atgtcattagaaacatagattt

SEQ ID NO: 1274307 - DNA, 22 bp, Artificial Sequence
  chemically synthesized
tctcttacgctgaaaatctatg

SEQ ID NO: 1274308 - DNA, 22 bp, Artificial Sequence
  chemically synthesized
ctctcttacgctgaaaatctat

SEQ ID NO: 1274309 - DNA, 22 bp, Artificial Sequence
  chemically synthesized
ttctctcttacgctgaaaatct

SEQ ID NO: 1274310 - DNA, 22 bp, Artificial Sequence
  chemically synthesized
gaaacatagattttcagcgtaa

SEQ ID NO: 1274311 - DNA, 22 bp, Artificial Sequence
  chemically synthesized
cagtctcttctctcttacgctg

SEQ ID NO: 1274312 - DNA, 22 bp, Artificial Sequence
  chemically synthesized
actgcagtctcttctctcttac

SEQ ID NO: 1274313 - DNA, 22 bp, Artificial Sequence
  chemically synthesized
aactgcagtctcttctctctta

SEQ ID NO: 1274314 - DNA, 22 bp, Artificial Sequence
  chemically synthesized
taactgcagtctcttctctctt

SEQ ID NO: 1274315 - DNA, 22 bp, Artificial Sequence
  chemically synthesized
attttaactgcagtctcttctc

SEQ ID NO: 1274316 - DNA, 22 bp, Artificial Sequence
  chemically synthesized
tcagcgtaagagagaagagact

SEQ ID NO: 1274317 - DNA, 22 bp, Artificial Sequence
  chemically synthesized
gattttaactgcagtctcttct

SEQ ID NO: 1274318 - DNA, 22 bp, Artificial Sequence
  chemically synthesized
cagcgtaagagagaagagactg

SEQ ID NO: 1274319 - DNA, 22 bp, Artificial Sequence
  chemically synthesized
agcgtaagagagaagagactgc

SEQ ID NO: 1274320 - DNA, 22 bp, Artificial Sequence
  chemically synthesized
ggaacgaacatatttgatttta

SEQ ID NO: 1274321 - DNA, 22 bp, Artificial Sequence
  chemically synthesized
cagttaaaatcaaatatgttcg

SEQ ID NO: 1274322 - DNA, 22 bp, Artificial Sequence
  chemically synthesized
gatcaagaattaggaacgaaca

SEQ ID NO: 1274323 - DNA, 22 bp, Artificial Sequence
  chemically synthesized
ggatcaagaattaggaacgaac

SEQ ID NO: 1274324 - DNA, 22 bp, Artificial Sequence
  chemically synthesized
aaatcaaatatgttcgttccta

SEQ ID NO: 1274325 - DNA, 22 bp, Artificial Sequence
  chemically synthesized
agatcaccacttggatcaagaa

SEQ ID NO: 1274326 - DNA, 22 bp, Artificial Sequence
  chemically synthesized
gttcctaattcttgatccaagt

SEQ ID NO: 1274327 - DNA, 22 bp, Artificial Sequence
  chemically synthesized
ccactcagatcaccacttggat

SEQ ID NO: 1274328 - DNA, 22 bp, Artificial Sequence
  chemically synthesized
ctaattcttgatccaagtggtg

SEQ ID NO: 1274329 - DNA, 22 bp, Artificial Sequence
  chemically synthesized
attcttgatccaagtggtgatc

SEQ ID NO: 1274330 - DNA, 22 bp, Artificial Sequence
  chemically synthesized
ttgatccaagtggtgatctgag

SEQ ID NO: 1274331 - DNA, 22 bp, Artificial Sequence
  chemically synthesized
gatccaagtggtgatctgagtg

SEQ ID NO: 1274332 - DNA, 22 bp, Artificial Sequence
  chemically synthesized
atccaagtggtgatctgagtgg

SEQ ID NO: 1274333 - DNA, 22 bp, Artificial Sequence
  chemically synthesized
agtggtagctatctgtgtttat

SEQ ID NO: 1274334 - DNA, 22 bp, Artificial Sequence
  chemically synthesized
aagcataacataaccatatacc

SEQ ID NO: 1274335 - DNA, 22 bp, Artificial Sequence
  chemically synthesized
tctgtgtttatggtatatggtt

SEQ ID NO: 1274336 - DNA, 22 bp, Artificial Sequence
  chemically synthesized
ttgaagcataacataaccatat

SEQ ID NO: 1274337 - DNA, 22 bp, Artificial Sequence
  chemically synthesized
tgtttatggtatatggttatgt

SEQ ID NO: 1274338 - DNA, 22 bp, Artificial Sequence
  chemically synthesized
ttattgaagcataacataacca

SEQ ID NO: 1274339 - DNA, 22 bp, Artificial Sequence
  chemically synthesized
gttattgaagcataacataacc

SEQ ID NO: 1274340 - DNA, 22 bp, Artificial Sequence
  chemically synthesized
tgttattgaagcataacataac

SEQ ID NO: 1274341 - DNA, 22 bp, Artificial Sequence
  chemically synthesized
atggtatatggttatgttatgc

SEQ ID NO: 1274342 - DNA, 22 bp, Artificial Sequence
  chemically synthesized
tggtatatggttatgttatgct

SEQ ID NO: 1274343 - DNA, 22 bp, Artificial Sequence
  chemically synthesized
atacactttgttattgaagcat

SEQ ID NO: 1274344 - DNA, 22 bp, Artificial Sequence
  chemically synthesized
aatacactttgttattgaagca

SEQ ID NO: 1274345 - DNA, 22 bp, Artificial Sequence
  chemically synthesized
taatacactttgttattgaagc

SEQ ID NO: 1274346 - DNA, 22 bp, Artificial Sequence
  chemically synthesized
ttaatacactttgttattgaag

SEQ ID NO: 1274347 - DNA, 22 bp, Artificial Sequence
  chemically synthesized
tttttaatacactttgttattg

SEQ ID NO: 1274348 - DNA, 22 bp, Artificial Sequence
  chemically synthesized
tgttatgcttcaataacaaagt

SEQ ID NO: 1274349 - DNA, 22 bp, Artificial Sequence
  chemically synthesized
tatttttaatacactttgttat

SEQ ID NO: 1274350 - DNA, 22 bp, Artificial Sequence
  chemically synthesized
ctatttttaatacactttgtta

SEQ ID NO: 1274351 - DNA, 22 bp, Artificial Sequence
  chemically synthesized
ttctatttttaatacactttgt

SEQ ID NO: 1274352 - DNA, 22 bp, Artificial Sequence
  chemically synthesized
cttctatttttaatacactttg

SEQ ID NO: 1274353 - DNA, 22 bp, Artificial Sequence
  chemically synthesized
tgcttcaataacaaagtgtatt

SEQ ID NO: 1274354 - DNA, 22 bp, Artificial Sequence
  chemically synthesized
tcttctatttttaatacacttt

SEQ ID NO: 1274355 - DNA, 22 bp, Artificial Sequence
  chemically synthesized
caataacaaagtgtattaaaaa

SEQ ID NO: 1274356 - DNA, 22 bp, Artificial Sequence
  chemically synthesized
cattttcttctatttttaatac

SEQ ID NO: 1274357 - DNA, 22 bp, Artificial Sequence
  chemically synthesized
aataacaaagtgtattaaaaat

SEQ ID NO: 1274358 - DNA, 22 bp, Artificial Sequence
  chemically synthesized
ttgcattttcttctatttttaa

SEQ ID NO: 1274359 - DNA, 22 bp, Artificial Sequence
  chemically synthesized
attgcattttcttctattttta

SEQ ID NO: 1274360 - DNA, 22 bp, Artificial Sequence
  chemically synthesized
tattgcattttcttctattttt

SEQ ID NO: 1274361 - DNA, 22 bp, Artificial Sequence
  chemically synthesized
ttattgcattttcttctatttt

SEQ ID NO: 1274362 - DNA, 22 bp, Artificial Sequence
  chemically synthesized
aaacttttattgcattttcttc

SEQ ID NO: 1274363 - DNA, 22 bp, Artificial Sequence
  chemically synthesized
aaaacttttattgcattttctt

SEQ ID NO: 1274364 - DNA, 22 bp, Artificial Sequence
  chemically synthesized
taaaacttttattgcattttct

SEQ ID NO: 1274365 - DNA, 22 bp, Artificial Sequence
  chemically synthesized
ttaaaacttttattgcattttc

SEQ ID NO: 1274366 - DNA, 22 bp, Artificial Sequence
  chemically synthesized
tttaaaacttttattgcatttt

SEQ ID NO: 1274367 - DNA, 22 bp, Artificial Sequence
  chemically synthesized
aaaatagaagaaaatgcaataa

SEQ ID NO: 1274368 - DNA, 22 bp, Artificial Sequence
  chemically synthesized
ctttttaaaacttttattgcat

SEQ ID NO: 1274369 - DNA, 22 bp, Artificial Sequence
  chemically synthesized
gctttttaaaacttttattgca

SEQ ID NO: 1274370 - DNA, 22 bp, Artificial Sequence
  chemically synthesized
tgctttttaaaacttttattgc

SEQ ID NO: 1274371 - DNA, 22 bp, Artificial Sequence
  chemically synthesized
ccctttgctttttaaaactttt

SEQ ID NO: 1274372 - DNA, 22 bp, Artificial Sequence
  chemically synthesized
gccctttgctttttaaaacttt

SEQ ID NO: 1274373 - DNA, 22 bp, Artificial Sequence
  chemically synthesized
ttgccctttgctttttaaaact

SEQ ID NO: 1274374 - DNA, 22 bp, Artificial Sequence
  chemically synthesized
ttcttgccctttgctttttaaa

SEQ ID NO: 1274375 - DNA, 22 bp, Artificial Sequence
  chemically synthesized
attcttgccctttgctttttaa

SEQ ID NO: 1274376 - DNA, 22 bp, Artificial Sequence
  chemically synthesized
tattcttgccctttgcttttta

SEQ ID NO: 1274377 - DNA, 22 bp, Artificial Sequence
  chemically synthesized
tctttattcttgccctttgctt

SEQ ID NO: 1274378 - DNA, 22 bp, Artificial Sequence
  chemically synthesized
atctttattcttgccctttgct

SEQ ID NO: 1274379 - DNA, 22 bp, Artificial Sequence
  chemically synthesized
taaaaagcaaagggcaagaata

SEQ ID NO: 1274380 - DNA, 22 bp, Artificial Sequence
  chemically synthesized
aaaaagcaaagggcaagaataa

SEQ ID NO: 1274381 - DNA, 22 bp, Artificial Sequence
  chemically synthesized
aaaagcaaagggcaagaataaa

SEQ ID NO: 1274382 - DNA, 22 bp, Artificial Sequence
  chemically synthesized
aagaaacgatttatctttattc

SEQ ID NO: 1274383 - DNA, 22 bp, Artificial Sequence
  chemically synthesized
ttgaagaaacgatttatcttta

SEQ ID NO: 1274384 - DNA, 22 bp, Artificial Sequence
  chemically synthesized
attgaagaaacgatttatcttt

SEQ ID NO: 1274385 - DNA, 22 bp, Artificial Sequence
  chemically synthesized
tttattgaagaaacgatttatc

SEQ ID NO: 1274386 - DNA, 22 bp, Artificial Sequence
  chemically synthesized
ataagcactgtttattgaagaa

SEQ ID NO: 1274387 - DNA, 22 bp, Artificial Sequence
  chemically synthesized
cttcaataaacagtgcttatca

SEQ ID NO: 1274388 - DNA, 22 bp, Artificial Sequence
  chemically synthesized
ttcaataaacagtgcttatcaa

SEQ ID NO: 1274389 - DNA, 22 bp, Artificial Sequence
  chemically synthesized
caataaacagtgcttatcaatc

SEQ ID NO: 1274390 - DNA, 22 bp, Artificial Sequence
  chemically synthesized
aataaacagtgcttatcaatca

SEQ ID NO: 1274391 - DNA, 22 bp, Artificial Sequence
  chemically synthesized
agtgaaataaaatgtgcaatag

SEQ ID NO: 1274392 - DNA, 22 bp, Artificial Sequence
  chemically synthesized
atcaatcactattgcacatttt

SEQ ID NO: 1274393 - DNA, 22 bp, Artificial Sequence
  chemically synthesized
tcaatcactattgcacatttta

SEQ ID NO: 1274394 - DNA, 22 bp, Artificial Sequence
  chemically synthesized
agaaattaagtgaaataaaatg

SEQ ID NO: 1274395 - DNA, 22 bp, Artificial Sequence
  chemically synthesized
tgagaaattaagtgaaataaaa

SEQ ID NO: 1274396 - DNA, 22 bp, Artificial Sequence
  chemically synthesized
ctgagaaattaagtgaaataaa

SEQ ID NO: 1274397 - DNA, 22 bp, Artificial Sequence
  chemically synthesized
tctgagaaattaagtgaaataa

SEQ ID NO: 1274398 - DNA, 22 bp, Artificial Sequence
  chemically synthesized
ttctgagaaattaagtgaaata

SEQ ID NO: 1274399 - DNA, 22 bp, Artificial Sequence
  chemically synthesized
ttgcacattttatttcacttaa

SEQ ID NO: 1274400 - DNA, 22 bp, Artificial Sequence
  chemically synthesized
cacattttatttcacttaattt

SEQ ID NO: 1274401 - DNA, 22 bp, Artificial Sequence
  chemically synthesized
tatttcacttaatttctcagaa

SEQ ID NO: 1274402 - DNA, 22 bp, Artificial Sequence
  chemically synthesized
atttcacttaatttctcagaaa

SEQ ID NO: 1274403 - DNA, 22 bp, Artificial Sequence
  chemically synthesized
tttcacttaatttctcagaaaa

SEQ ID NO: 1274404 - DNA, 22 bp, Artificial Sequence
  chemically synthesized
aatagaaataaggtttttctga

SEQ ID NO: 1274405 - DNA, 22 bp, Artificial Sequence
  chemically synthesized
cacttaatttctcagaaaaacc

SEQ ID NO: 1274406 - DNA, 22 bp, Artificial Sequence
  chemically synthesized
caatagaaataaggtttttctg

SEQ ID NO: 1274407 - DNA, 22 bp, Artificial Sequence
  chemically synthesized
acttaatttctcagaaaaacct

SEQ ID NO: 1274408 - DNA, 22 bp, Artificial Sequence
  chemically synthesized
tcaatagaaataaggtttttct

SEQ ID NO: 1274409 - DNA, 22 bp, Artificial Sequence
  chemically synthesized
aatttctcagaaaaaccttatt

SEQ ID NO: 1274410 - DNA, 22 bp, Artificial Sequence
  chemically synthesized
atttctcagaaaaaccttattt

SEQ ID NO: 1274411 - DNA, 22 bp, Artificial Sequence
  chemically synthesized
ctcagaaaaaccttatttctat

SEQ ID NO: 1274412 - DNA, 22 bp, Artificial Sequence
  chemically synthesized
tcagaaaaaccttatttctatt

SEQ ID NO: 1274413 - DNA, 22 bp, Artificial Sequence
  chemically synthesized
agaaaaaccttatttctattga

SEQ ID NO: 1274414 - DNA, 22 bp, Artificial Sequence
  chemically synthesized
aagatacagagattttcaatag

SEQ ID NO: 1274415 - DNA, 22 bp, Artificial Sequence
  chemically synthesized
atttctattgaaaatctctgta

SEQ ID NO: 1274416 - DNA, 22 bp, Artificial Sequence
  chemically synthesized
tttctattgaaaatctctgtat

SEQ ID NO: 1274417 - DNA, 22 bp, Artificial Sequence
  chemically synthesized
cagtgcctgaagatacagagat

SEQ ID NO: 1274418 - DNA, 22 bp, Artificial Sequence
  chemically synthesized
ccagtgcctgaagatacagaga

SEQ ID NO: 1274419 - DNA, 22 bp, Artificial Sequence
  chemically synthesized
tccagtgcctgaagatacagag

SEQ ID NO: 1274420 - DNA, 22 bp, Artificial Sequence
  chemically synthesized
ctattgaaaatctctgtatctt

SEQ ID NO: 1274421 - DNA, 22 bp, Artificial Sequence
  chemically synthesized
tattgaaaatctctgtatcttc

SEQ ID NO: 1274422 - DNA, 22 bp, Artificial Sequence
  chemically synthesized
ttgaaaatctctgtatcttcag

SEQ ID NO: 1274423 - DNA, 22 bp, Artificial Sequence
  chemically synthesized
aaaatctctgtatcttcaggca

SEQ ID NO: 1274424 - DNA, 22 bp, Artificial Sequence
  chemically synthesized
gtgggagtctttccagtgcctg

SEQ ID NO: 1274425 - DNA, 22 bp, Artificial Sequence
  chemically synthesized
tgtatcttcaggcactggaaag

SEQ ID NO: 1274426 - DNA, 22 bp, Artificial Sequence
  chemically synthesized
aattggtgggagtctttccagt

SEQ ID NO: 1274427 - DNA, 22 bp, Artificial Sequence
  chemically synthesized
tatcttcaggcactggaaagac

SEQ ID NO: 1274428 - DNA, 22 bp, Artificial Sequence
  chemically synthesized
cagttaaattggtgggagtctt

SEQ ID NO: 1274429 - DNA, 22 bp, Artificial Sequence
  chemically synthesized
caggcactggaaagactcccac

SEQ ID NO: 1274430 - DNA, 22 bp, Artificial Sequence
  chemically synthesized
aggcactggaaagactcccacc

SEQ ID NO: 1274431 - DNA, 22 bp, Artificial Sequence
  chemically synthesized
gaaagactcccaccaatttaac

SEQ ID NO: 1274432 - DNA, 22 bp, Artificial Sequence
  chemically synthesized
ccaccaatttaactgtaactcg

SEQ ID NO: 1274433 - DNA, 22 bp, Artificial Sequence
  chemically synthesized
ggaaatcaacatccgagttaca

SEQ ID NO: 1274434 - DNA, 22 bp, Artificial Sequence
  chemically synthesized
tgttaggaaatcaacatccgag

SEQ ID NO: 1274435 - DNA, 22 bp, Artificial Sequence
  chemically synthesized
gtgttaggaaatcaacatccga

SEQ ID NO: 1274436 - DNA, 22 bp, Artificial Sequence
  chemically synthesized
aactgtaactcggatgttgatt

SEQ ID NO: 1274437 - DNA, 22 bp, Artificial Sequence
  chemically synthesized
actgtaactcggatgttgattt

SEQ ID NO: 1274438 - DNA, 22 bp, Artificial Sequence
  chemically synthesized
taactcggatgttgatttccta

SEQ ID NO: 1274439 - DNA, 22 bp, Artificial Sequence
  chemically synthesized
ggatgttgatttcctaacacaa

SEQ ID NO: 1274440 - DNA, 22 bp, Artificial Sequence
  chemically synthesized
aataatgggaggaacttgtgtt

SEQ ID NO: 1274441 - DNA, 22 bp, Artificial Sequence
  chemically synthesized
atttcctaacacaagttcctcc

SEQ ID NO: 1274442 - DNA, 22 bp, Artificial Sequence
  chemically synthesized
cctaacacaagttcctcccatt

SEQ ID NO: 1274443 - DNA, 22 bp, Artificial Sequence
  chemically synthesized
ggtaaattaaataatgggagga

SEQ ID NO: 1274444 - DNA, 22 bp, Artificial Sequence
  chemically synthesized
ctaacacaagttcctcccatta

SEQ ID NO: 1274445 - DNA, 22 bp, Artificial Sequence
  chemically synthesized
aggtaaattaaataatgggagg

SEQ ID NO: 1274446 - DNA, 22 bp, Artificial Sequence
  chemically synthesized
acacaagttcctcccattattt

SEQ ID NO: 1274447 - DNA, 22 bp, Artificial Sequence
  chemically synthesized
atagtccttaggtaaattaaat

SEQ ID NO: 1274448 - DNA, 22 bp, Artificial Sequence
  chemically synthesized
ctcccattatttaatttaccta

SEQ ID NO: 1274449 - DNA, 22 bp, Artificial Sequence
  chemically synthesized
ccattatttaatttacctaagg

SEQ ID NO: 1274450 - DNA, 22 bp, Artificial Sequence
  chemically synthesized
aggtaactgatagtccttaggt

SEQ ID NO: 1274451 - DNA, 22 bp, Artificial Sequence
  chemically synthesized
tttaatttacctaaggactatc

SEQ ID NO: 1274452 - DNA, 22 bp, Artificial Sequence
  chemically synthesized
cattaaggtaactgatagtcct

SEQ ID NO: 1274453 - DNA, 22 bp, Artificial Sequence
  chemically synthesized
ccattaaggtaactgatagtcc

SEQ ID NO: 1274454 - DNA, 22 bp, Artificial Sequence
  chemically synthesized
aatttacctaaggactatcagt

SEQ ID NO: 1274455 - DNA, 22 bp, Artificial Sequence
  chemically synthesized
tccattaaggtaactgatagtc

SEQ ID NO: 1274456 - DNA, 22 bp, Artificial Sequence
  chemically synthesized
atttacctaaggactatcagtt

SEQ ID NO: 1274457 - DNA, 22 bp, Artificial Sequence
  chemically synthesized
acctaaggactatcagttacct

SEQ ID NO: 1274458 - DNA, 22 bp, Artificial Sequence
  chemically synthesized
cctaaggactatcagttacctt

SEQ ID NO: 1274459 - DNA, 22 bp, Artificial Sequence
  chemically synthesized
aggactatcagttaccttaatg

SEQ ID NO: 1274460 - DNA, 22 bp, Artificial Sequence
  chemically synthesized
tcagttaccttaatggaaaacc

SEQ ID NO: 1274461 - DNA, 22 bp, Artificial Sequence
  chemically synthesized
ccttaatggaaaacccttccac

SEQ ID NO: 1274462 - DNA, 22 bp, Artificial Sequence
  chemically synthesized
gagatataataagtggaagggt

SEQ ID NO: 1274463 - DNA, 22 bp, Artificial Sequence
  chemically synthesized
agagatataataagtggaaggg

SEQ ID NO: 1274464 - DNA, 22 bp, Artificial Sequence
  chemically synthesized
aatggaaaacccttccacttat

SEQ ID NO: 1274465 - DNA, 22 bp, Artificial Sequence
  chemically synthesized
atggaaaacccttccacttatt

SEQ ID NO: 1274466 - DNA, 22 bp, Artificial Sequence
  chemically synthesized
gataacttagagatataataag

SEQ ID NO: 1274467 - DNA, 22 bp, Artificial Sequence
  chemically synthesized
ttagataacttagagatataat

SEQ ID NO: 1274468 - DNA, 22 bp, Artificial Sequence
  chemically synthesized
ccacttattatatctctaagtt

SEQ ID NO: 1274469 - DNA, 22 bp, Artificial Sequence
  chemically synthesized
cacttattatatctctaagtta

SEQ ID NO: 1274470 - DNA, 22 bp, Artificial Sequence
  chemically synthesized
attatatctctaagttatctaa

SEQ ID NO: 1274471 - DNA, 22 bp, Artificial Sequence
  chemically synthesized
ttatatctctaagttatctaac

SEQ ID NO: 1274472 - DNA, 22 bp, Artificial Sequence
  chemically synthesized
agagacatgattgttagataac

SEQ ID NO: 1274473 - DNA, 22 bp, Artificial Sequence
  chemically synthesized
aagagacatgattgttagataa

SEQ ID NO: 1274474 - DNA, 22 bp, Artificial Sequence
  chemically synthesized
tatctctaagttatctaacaat

SEQ ID NO: 1274475 - DNA, 22 bp, Artificial Sequence
  chemically synthesized
ttaagagacatgattgttagat

SEQ ID NO: 1274476 - DNA, 22 bp, Artificial Sequence
  chemically synthesized
cttaagagacatgattgttaga

SEQ ID NO: 1274477 - DNA, 22 bp, Artificial Sequence
  chemically synthesized
tcttaagagacatgattgttag

SEQ ID NO: 1274478 - DNA, 22 bp, Artificial Sequence
  chemically synthesized
taagttatctaacaatcatgtc

SEQ ID NO: 1274479 - DNA, 22 bp, Artificial Sequence
  chemically synthesized
agttatctaacaatcatgtctc

SEQ ID NO: 1274480 - DNA, 22 bp, Artificial Sequence
  chemically synthesized
tctaacaatcatgtctcttaag

SEQ ID NO: 1274481 - DNA, 22 bp, Artificial Sequence
  chemically synthesized
acaatcatgtctcttaagaaaa

SEQ ID NO: 1274482 - DNA, 22 bp, Artificial Sequence
  chemically synthesized
agataaaaatatatattttctt

SEQ ID NO: 1274483 - DNA, 22 bp, Artificial Sequence
  chemically synthesized
gagataaaaatatatattttct

SEQ ID NO: 1274484 - DNA, 22 bp, Artificial Sequence
  chemically synthesized
cttgagataaaaatatatattt

SEQ ID NO: 1274485 - DNA, 22 bp, Artificial Sequence
  chemically synthesized
ttaagaaaatatatatttttat

SEQ ID NO: 1274486 - DNA, 22 bp, Artificial Sequence
  chemically synthesized
agattacttgagataaaaatat

SEQ ID NO: 1274487 - DNA, 22 bp, Artificial Sequence
  chemically synthesized
gagattacttgagataaaaata

SEQ ID NO: 1274488 - DNA, 22 bp, Artificial Sequence
  chemically synthesized
aagaaaatatatatttttatct

SEQ ID NO: 1274489 - DNA, 22 bp, Artificial Sequence
  chemically synthesized
agaaaatatatatttttatctc

SEQ ID NO: 1274490 - DNA, 22 bp, Artificial Sequence
  chemically synthesized
acttgagattacttgagataaa

SEQ ID NO: 1274491 - DNA, 22 bp, Artificial Sequence
  chemically synthesized
aacttgagattacttgagataa

SEQ ID NO: 1274492 - DNA, 22 bp, Artificial Sequence
  chemically synthesized
ttatctcaagtaatctcaagtt

SEQ ID NO: 1274493 - DNA, 22 bp, Artificial Sequence
  chemically synthesized
tatctcaagtaatctcaagtta

SEQ ID NO: 1274494 - DNA, 22 bp, Artificial Sequence
  chemically synthesized
atctcaagtaatctcaagttaa

SEQ ID NO: 1274495 - DNA, 22 bp, Artificial Sequence
  chemically synthesized
aaggtagtaatcttaacttgag

SEQ ID NO: 1274496 - DNA, 22 bp, Artificial Sequence
  chemically synthesized
tctcaagtaatctcaagttaag

SEQ ID NO: 1274497 - DNA, 22 bp, Artificial Sequence
  chemically synthesized
gttaaaggtagtaatcttaact

SEQ ID NO: 1274498 - DNA, 22 bp, Artificial Sequence
  chemically synthesized
aagtaatctcaagttaagatta

SEQ ID NO: 1274499 - DNA, 22 bp, Artificial Sequence
  chemically synthesized
agttaaaggtagtaatcttaac

SEQ ID NO: 1274500 - DNA, 22 bp, Artificial Sequence
  chemically synthesized
tagttaaaggtagtaatcttaa

SEQ ID NO: 1274501 - DNA, 22 bp, Artificial Sequence
  chemically synthesized
aagttaagattactacctttaa

SEQ ID NO: 1274502 - DNA, 22 bp, Artificial Sequence
  chemically synthesized
agattactacctttaactaaaa

SEQ ID NO: 1274503 - DNA, 22 bp, Artificial Sequence
  chemically synthesized
aatggataaacattttagttaa

SEQ ID NO: 1274504 - DNA, 22 bp, Artificial Sequence
  chemically synthesized
attgaatggataaacattttag

SEQ ID NO: 1274505 - DNA, 22 bp, Artificial Sequence
  chemically synthesized
aattgaatggataaacatttta

SEQ ID NO: 1274506 - DNA, 22 bp, Artificial Sequence
  chemically synthesized
ctacctttaactaaaatgttta

SEQ ID NO: 1274507 - DNA, 22 bp, Artificial Sequence
  chemically synthesized
taattgaatggataaacatttt

SEQ ID NO: 1274508 - DNA, 22 bp, Artificial Sequence
  chemically synthesized
cctttaactaaaatgtttatcc

SEQ ID NO: 1274509 - DNA, 22 bp, Artificial Sequence
  chemically synthesized
taactaaaatgtttatccattc

SEQ ID NO: 1274510 - DNA, 22 bp, Artificial Sequence
  chemically synthesized
aactaaaatgtttatccattca

SEQ ID NO: 1274511 - DNA, 22 bp, Artificial Sequence
  chemically synthesized
ataaattttaattgaatggata

SEQ ID NO: 1274512 - DNA, 22 bp, Artificial Sequence
  chemically synthesized
actaaaatgtttatccattcaa

SEQ ID NO: 1274513 - DNA, 22 bp, Artificial Sequence
  chemically synthesized
aataaattttaattgaatggat

SEQ ID NO: 1274514 - DNA, 22 bp, Artificial Sequence
  chemically synthesized
taataaattttaattgaatgga

SEQ ID NO: 1274515 - DNA, 22 bp, Artificial Sequence
  chemically synthesized
aaatgtttatccattcaattaa

SEQ ID NO: 1274516 - DNA, 22 bp, Artificial Sequence
  chemically synthesized
actttaataaattttaattgaa

SEQ ID NO: 1274517 - DNA, 22 bp, Artificial Sequence
  chemically synthesized
atccattcaattaaaatttatt

SEQ ID NO: 1274518 - DNA, 22 bp, Artificial Sequence
  chemically synthesized
tccattcaattaaaatttatta

SEQ ID NO: 1274519 - DNA, 22 bp, Artificial Sequence
  chemically synthesized
caaagctgactttaataaattt

SEQ ID NO: 1274520 - DNA, 22 bp, Artificial Sequence
  chemically synthesized
gcaaagctgactttaataaatt

SEQ ID NO: 1274521 - DNA, 22 bp, Artificial Sequence
  chemically synthesized
aattaaaatttattaaagtcag

SEQ ID NO: 1274522 - DNA, 22 bp, Artificial Sequence
  chemically synthesized
aaatttattaaagtcagctttg

SEQ ID NO: 1274523 - DNA, 22 bp, Artificial Sequence
  chemically synthesized
attaaagtcagctttgcaaatg

SEQ ID NO: 1274524 - DNA, 22 bp, Artificial Sequence
  chemically synthesized
ttaaagtcagctttgcaaatgg

SEQ ID NO: 1274525 - DNA, 22 bp, Artificial Sequence
  chemically synthesized
aagtcagctttgcaaatggtat

SEQ ID NO: 1274526 - DNA, 22 bp, Artificial Sequence
  chemically synthesized
tgcaaatggtatttcttatttt

SEQ ID NO: 1274527 - DNA, 22 bp, Artificial Sequence
  chemically synthesized
gcaaatggtatttcttattttt

SEQ ID NO: 1274528 - DNA, 22 bp, Artificial Sequence
  chemically synthesized
caaatggtatttcttatttttc

SEQ ID NO: 1274529 - DNA, 22 bp, Artificial Sequence
  chemically synthesized
tacacatatgaaaggaagaaga

SEQ ID NO: 1274530 - DNA, 22 bp, Artificial Sequence
  chemically synthesized
gtacacatatgaaaggaagaag

SEQ ID NO: 1274531 - DNA, 22 bp, Artificial Sequence
  chemically synthesized
tgtacacatatgaaaggaagaa

SEQ ID NO: 1274532 - DNA, 22 bp, Artificial Sequence
  chemically synthesized
cttatttttcttcttcctttca

SEQ ID NO: 1274533 - DNA, 22 bp, Artificial Sequence
  chemically synthesized
ttatttttcttcttcctttcat

SEQ ID NO: 1274534 - DNA, 22 bp, Artificial Sequence
  chemically synthesized
atttttcttcttcctttcatat

SEQ ID NO: 1274535 - DNA, 22 bp, Artificial Sequence
  chemically synthesized
tttttcttcttcctttcatatg

SEQ ID NO: 1274536 - DNA, 22 bp, Artificial Sequence
  chemically synthesized
atattttgtacacatatgaaag

SEQ ID NO: 1274537 - DNA, 22 bp, Artificial Sequence
  chemically synthesized
ttcttcttcctttcatatgtgt

SEQ ID NO: 1274538 - DNA, 22 bp, Artificial Sequence
  chemically synthesized
tcttcttcctttcatatgtgta

SEQ ID NO: 1274539 - DNA, 22 bp, Artificial Sequence
  chemically synthesized
cttcttcctttcatatgtgtac

SEQ ID NO: 1274540 - DNA, 22 bp, Artificial Sequence
  chemically synthesized
aattaatattttgtacacatat

SEQ ID NO: 1274541 - DNA, 22 bp, Artificial Sequence
  chemically synthesized
ttcttcctttcatatgtgtaca

SEQ ID NO: 1274542 - DNA, 22 bp, Artificial Sequence
  chemically synthesized
cttcctttcatatgtgtacaaa

SEQ ID NO: 1274543 - DNA, 22 bp, Artificial Sequence
  chemically synthesized
ttcctttcatatgtgtacaaaa

SEQ ID NO: 1274544 - DNA, 22 bp, Artificial Sequence
  chemically synthesized
ggttgaattaatattttgtaca

SEQ ID NO: 1274545 - DNA, 22 bp, Artificial Sequence
  chemically synthesized
cctttcatatgtgtacaaaata

SEQ ID NO: 1274546 - DNA, 22 bp, Artificial Sequence
  chemically synthesized
ctttcatatgtgtacaaaatat

SEQ ID NO: 1274547 - DNA, 22 bp, Artificial Sequence
  chemically synthesized
tgggttgaattaatattttgta

SEQ ID NO: 1274548 - DNA, 22 bp, Artificial Sequence
  chemically synthesized
ctgggttgaattaatattttgt

SEQ ID NO: 1274549 - DNA, 22 bp, Artificial Sequence
  chemically synthesized
tcatatgtgtacaaaatattaa

SEQ ID NO: 1274550 - DNA, 22 bp, Artificial Sequence
  chemically synthesized
catatgtgtacaaaatattaat

SEQ ID NO: 1274551 - DNA, 22 bp, Artificial Sequence
  chemically synthesized
atatgtgtacaaaatattaatt

SEQ ID NO: 1274552 - DNA, 22 bp, Artificial Sequence
  chemically synthesized
gtagggaggaaaaacacttctg

SEQ ID NO: 1274553 - DNA, 22 bp, Artificial Sequence
  chemically synthesized
tggtagggaggaaaaacacttc

SEQ ID NO: 1274554 - DNA, 22 bp, Artificial Sequence
  chemically synthesized
ctggtagggaggaaaaacactt

SEQ ID NO: 1274555 - DNA, 22 bp, Artificial Sequence
  chemically synthesized
attcaacccagaagtgtttttc

SEQ ID NO: 1274556 - DNA, 22 bp, Artificial Sequence
  chemically synthesized
tctggtagggaggaaaaacact

SEQ ID NO: 1274557 - DNA, 22 bp, Artificial Sequence
  chemically synthesized
aacccagaagtgtttttcctcc

SEQ ID NO: 1274558 - DNA, 22 bp, Artificial Sequence
  chemically synthesized
cctttctggtagggaggaaaaa

SEQ ID NO: 1274559 - DNA, 22 bp, Artificial Sequence
  chemically synthesized
accaataagattacctttctgg

SEQ ID NO: 1274560 - DNA, 22 bp, Artificial Sequence
  chemically synthesized
ttcctccctaccagaaaggtaa

SEQ ID NO: 1274561 - DNA, 22 bp, Artificial Sequence
  chemically synthesized
tcctccctaccagaaaggtaat

SEQ ID NO: 1274562 - DNA, 22 bp, Artificial Sequence
  chemically synthesized
cctccctaccagaaaggtaatc

SEQ ID NO: 1274563 - DNA, 22 bp, Artificial Sequence
  chemically synthesized
ctccctaccagaaaggtaatct

SEQ ID NO: 1274564 - DNA, 22 bp, Artificial Sequence
  chemically synthesized
cctaccagaaaggtaatcttat

SEQ ID NO: 1274565 - DNA, 22 bp, Artificial Sequence
  chemically synthesized
ccagaaaggtaatcttattggt

SEQ ID NO: 1274566 - DNA, 22 bp, Artificial Sequence
  chemically synthesized
agtgaatgaggtaataaattaa

SEQ ID NO: 1274567 - DNA, 22 bp, Artificial Sequence
  chemically synthesized
attggttaatttattacctcat

SEQ ID NO: 1274568 - DNA, 22 bp, Artificial Sequence
  chemically synthesized
ttggttaatttattacctcatt

SEQ ID NO: 1274569 - DNA, 22 bp, Artificial Sequence
  chemically synthesized
gttaatttattacctcattcac

SEQ ID NO: 1274570 - DNA, 22 bp, Artificial Sequence
  chemically synthesized
atttattacctcattcacttaa

SEQ ID NO: 1274571 - DNA, 22 bp, Artificial Sequence
  chemically synthesized
ggtaacatgtagaagttaagtg

SEQ ID NO: 1274572 - DNA, 22 bp, Artificial Sequence
  chemically synthesized
attacctcattcacttaacttc

SEQ ID NO: 1274573 - DNA, 22 bp, Artificial Sequence
  chemically synthesized
ttacctcattcacttaacttct

SEQ ID NO: 1274574 - DNA, 22 bp, Artificial Sequence
  chemically synthesized
tctgggtaacatgtagaagtta

SEQ ID NO: 1274575 - DNA, 22 bp, Artificial Sequence
  chemically synthesized
cctcattcacttaacttctaca

SEQ ID NO: 1274576 - DNA, 22 bp, Artificial Sequence
  chemically synthesized
atctgggtaacatgtagaagtt

SEQ ID NO: 1274577 - DNA, 22 bp, Artificial Sequence
  chemically synthesized
attcacttaacttctacatgtt

SEQ ID NO: 1274578 - DNA, 22 bp, Artificial Sequence
  chemically synthesized
acttaacttctacatgttaccc

SEQ ID NO: 1274579 - DNA, 22 bp, Artificial Sequence
  chemically synthesized
caatagtttatctgggtaacat

SEQ ID NO: 1274580 - DNA, 22 bp, Artificial Sequence
  chemically synthesized
aacttctacatgttacccagat

SEQ ID NO: 1274581 - DNA, 22 bp, Artificial Sequence
  chemically synthesized
acttctacatgttacccagata

SEQ ID NO: 1274582 - DNA, 22 bp, Artificial Sequence
  chemically synthesized
gttacaatagtttatctgggta

SEQ ID NO: 1274583 - DNA, 22 bp, Artificial Sequence
  chemically synthesized
tggttacaatagtttatctggg

SEQ ID NO: 1274584 - DNA, 22 bp, Artificial Sequence
  chemically synthesized
ctacatgttacccagataaact

SEQ ID NO: 1274585 - DNA, 22 bp, Artificial Sequence
  chemically synthesized
tacatgttacccagataaacta

SEQ ID NO: 1274586 - DNA, 22 bp, Artificial Sequence
  chemically synthesized
catgttacccagataaactatt

SEQ ID NO: 1274587 - DNA, 22 bp, Artificial Sequence
  chemically synthesized
cccagataaactattgtaacca

SEQ ID NO: 1274588 - DNA, 22 bp, Artificial Sequence
  chemically synthesized
caatcgtaataatgtaagttct

SEQ ID NO: 1274589 - DNA, 22 bp, Artificial Sequence
  chemically synthesized
ttgtaaccagaacttacattat

SEQ ID NO: 1274590 - DNA, 22 bp, Artificial Sequence
  chemically synthesized
taaccagaacttacattattac

SEQ ID NO: 1274591 - DNA, 22 bp, Artificial Sequence
  chemically synthesized
gtaataatgtatattgcaatcg

SEQ ID NO: 1274592 - DNA, 22 bp, Artificial Sequence
  chemically synthesized
acattattacgattgcaatata

SEQ ID NO: 1274593 - DNA, 22 bp, Artificial Sequence
  chemically synthesized
cattattacgattgcaatatac

SEQ ID NO: 1274594 - DNA, 22 bp, Artificial Sequence
  chemically synthesized
ttacgattgcaatatacattat

SEQ ID NO: 1274595 - DNA, 22 bp, Artificial Sequence
  chemically synthesized
cgattgcaatatacattattac

SEQ ID NO: 1274596 - DNA, 22 bp, Artificial Sequence
  chemically synthesized
aatagcaggttggtaataatgt

SEQ ID NO: 1274597 - DNA, 22 bp, Artificial Sequence
  chemically synthesized
ctaaatagcaggttggtaataa

SEQ ID NO: 1274598 - DNA, 22 bp, Artificial Sequence
  chemically synthesized
tcctaaatagcaggttggtaat

SEQ ID NO: 1274599 - DNA, 22 bp, Artificial Sequence
  chemically synthesized
caatatacattattaccaacct

SEQ ID NO: 1274600 - DNA, 22 bp, Artificial Sequence
  chemically synthesized
ctcctaaatagcaggttggtaa

SEQ ID NO: 1274601 - DNA, 22 bp, Artificial Sequence
  chemically synthesized
tctcctaaatagcaggttggta

SEQ ID NO: 1274602 - DNA, 22 bp, Artificial Sequence
  chemically synthesized
ttctcctaaatagcaggttggt

SEQ ID NO: 1274603 - DNA, 22 bp, Artificial Sequence
  chemically synthesized
tttctcctaaatagcaggttgg

SEQ ID NO: 1274604 - DNA, 22 bp, Artificial Sequence
  chemically synthesized
ttaccaacctgctatttaggag

SEQ ID NO: 1274605 - DNA, 22 bp, Artificial Sequence
  chemically synthesized
agaagtgttttttctcctaaat

SEQ ID NO: 1274606 - DNA, 22 bp, Artificial Sequence
  chemically synthesized
ccaacctgctatttaggagaaa

SEQ ID NO: 1274607 - DNA, 22 bp, Artificial Sequence
  chemically synthesized
tgatatctaagaagtgtttttt

SEQ ID NO: 1274608 - DNA, 22 bp, Artificial Sequence
  chemically synthesized
ctatttaggagaaaaaacactt

SEQ ID NO: 1274609 - DNA, 22 bp, Artificial Sequence
  chemically synthesized
atgatatctaagaagtgttttt

SEQ ID NO: 1274610 - DNA, 22 bp, Artificial Sequence
  chemically synthesized
tttaggagaaaaaacacttctt

SEQ ID NO: 1274611 - DNA, 22 bp, Artificial Sequence
  chemically synthesized
catttatgatatctaagaagtg

SEQ ID NO: 1274612 - DNA, 22 bp, Artificial Sequence
  chemically synthesized
aggagaaaaaacacttcttaga

SEQ ID NO: 1274613 - DNA, 22 bp, Artificial Sequence
  chemically synthesized
ggagaaaaaacacttcttagat

SEQ ID NO: 1274614 - DNA, 22 bp, Artificial Sequence
  chemically synthesized
aagctgcatttatgatatctaa

SEQ ID NO: 1274615 - DNA, 22 bp, Artificial Sequence
  chemically synthesized
catgttaaagctgcatttatga

SEQ ID NO: 1274616 - DNA, 22 bp, Artificial Sequence
  chemically synthesized
tgcatgttaaagctgcatttat

SEQ ID NO: 1274617 - DNA, 22 bp, Artificial Sequence
  chemically synthesized
cttagatatcataaatgcagct

SEQ ID NO: 1274618 - DNA, 22 bp, Artificial Sequence
  chemically synthesized
ttagatatcataaatgcagctt

SEQ ID NO: 1274619 - DNA, 22 bp, Artificial Sequence
  chemically synthesized
agatatcataaatgcagcttta

SEQ ID NO: 1274620 - DNA, 22 bp, Artificial Sequence
  chemically synthesized
gatatcataaatgcagctttaa

SEQ ID NO: 1274621 - DNA, 22 bp, Artificial Sequence
  chemically synthesized
aagcagttctgcatgttaaagc

SEQ ID NO: 1274622 - DNA, 22 bp, Artificial Sequence
  chemically synthesized
aaagcagttctgcatgttaaag

SEQ ID NO: 1274623 - DNA, 22 bp, Artificial Sequence
  chemically synthesized
taaagcagttctgcatgttaaa

SEQ ID NO: 1274624 - DNA, 22 bp, Artificial Sequence
  chemically synthesized
ttttaaagcagttctgcatgtt

SEQ ID NO: 1274625 - DNA, 22 bp, Artificial Sequence
  chemically synthesized
tatgcctgttttaaagcagttc

SEQ ID NO: 1274626 - DNA, 22 bp, Artificial Sequence
  chemically synthesized
taacatgcagaactgctttaaa

SEQ ID NO: 1274627 - DNA, 22 bp, Artificial Sequence
  chemically synthesized
ctgtatgcctgttttaaagcag

SEQ ID NO: 1274628 - DNA, 22 bp, Artificial Sequence
  chemically synthesized
aacatgcagaactgctttaaaa

SEQ ID NO: 1274629 - DNA, 22 bp, Artificial Sequence
  chemically synthesized
acatgcagaactgctttaaaac

SEQ ID NO: 1274630 - DNA, 22 bp, Artificial Sequence
  chemically synthesized
ctttaaaacaggcatacaggaa

SEQ ID NO: 1274631 - DNA, 22 bp, Artificial Sequence
  chemically synthesized
taaaacaggcatacaggaattt

SEQ ID NO: 1274632 - DNA, 22 bp, Artificial Sequence
  chemically synthesized
aaaacaggcatacaggaatttt

SEQ ID NO: 1274633 - DNA, 22 bp, Artificial Sequence
  chemically synthesized
atccccccccaaaaaattcctg

SEQ ID NO: 1274634 - DNA, 22 bp, Artificial Sequence
  chemically synthesized
aaacaggcatacaggaattttt

SEQ ID NO: 1274635 - DNA, 22 bp, Artificial Sequence
  chemically synthesized
aaaataacacacccctcatccc

SEQ ID NO: 1274636 - DNA, 22 bp, Artificial Sequence
  chemically synthesized
tttggggggggatgaggggtgt

SEQ ID NO: 1274637 - DNA, 22 bp, Artificial Sequence
  chemically synthesized
ttggggggggatgaggggtgtg

SEQ ID NO: 1274638 - DNA, 22 bp, Artificial Sequence
  chemically synthesized
tggggggggatgaggggtgtgt

SEQ ID NO: 1274639 - DNA, 22 bp, Artificial Sequence
  chemically synthesized
ggggggggatgaggggtgtgtt

SEQ ID NO: 1274640 - DNA, 22 bp, Artificial Sequence
  chemically synthesized
gggggggatgaggggtgtgtta

SEQ ID NO: 1274641 - DNA, 22 bp, Artificial Sequence
  chemically synthesized
gacatattaaaaataacacacc

SEQ ID NO: 1274642 - DNA, 22 bp, Artificial Sequence
  chemically synthesized
agacatattaaaaataacacac

SEQ ID NO: 1274643 - DNA, 22 bp, Artificial Sequence
  chemically synthesized
tagacatattaaaaataacaca

SEQ ID NO: 1274644 - DNA, 22 bp, Artificial Sequence
  chemically synthesized
cctttagacatattaaaaataa

SEQ ID NO: 1274645 - DNA, 22 bp, Artificial Sequence
  chemically synthesized
aatgtattacctttagacatat

SEQ ID NO: 1274646 - DNA, 22 bp, Artificial Sequence
  chemically synthesized
attaaatgtattacctttagac

SEQ ID NO: 1274647 - DNA, 22 bp, Artificial Sequence
  chemically synthesized
tttttaatatgtctaaaggtaa

SEQ ID NO: 1274648 - DNA, 22 bp, Artificial Sequence
  chemically synthesized
ttaatatgtctaaaggtaatac

SEQ ID NO: 1274649 - DNA, 22 bp, Artificial Sequence
  chemically synthesized
taatatgtctaaaggtaataca

SEQ ID NO: 1274650 - DNA, 22 bp, Artificial Sequence
  chemically synthesized
aatatgtctaaaggtaatacat

SEQ ID NO: 1274651 - DNA, 22 bp, Artificial Sequence
  chemically synthesized
atatgtctaaaggtaatacatt

SEQ ID NO: 1274652 - DNA, 22 bp, Artificial Sequence
  chemically synthesized
tatagttcattaaatgtattac

SEQ ID NO: 1274653 - DNA, 22 bp, Artificial Sequence
  chemically synthesized
aaggtaatacatttaatgaact

SEQ ID NO: 1274654 - DNA, 22 bp, Artificial Sequence
  chemically synthesized
taaatattgtatagttcattaa

SEQ ID NO: 1274655 - DNA, 22 bp, Artificial Sequence
  chemically synthesized
ttataaatattgtatagttcat

SEQ ID NO: 1274656 - DNA, 22 bp, Artificial Sequence
  chemically synthesized
attataaatattgtatagttca

SEQ ID NO: 1274657 - DNA, 22 bp, Artificial Sequence
  chemically synthesized
taataacttattataaatattg

SEQ ID NO: 1274658 - DNA, 22 bp, Artificial Sequence
  chemically synthesized
aatgaactatacaatatttata

SEQ ID NO: 1274659 - DNA, 22 bp, Artificial Sequence
  chemically synthesized
gtaataacttattataaatatt

SEQ ID NO: 1274660 - DNA, 22 bp, Artificial Sequence
  chemically synthesized
atgaactatacaatatttataa

SEQ ID NO: 1274661 - DNA, 22 bp, Artificial Sequence
  chemically synthesized
tacaatatttataataagttat

SEQ ID NO: 1274662 - DNA, 22 bp, Artificial Sequence
  chemically synthesized
ataaaatgaacatatttgtaat

SEQ ID NO: 1274663 - DNA, 22 bp, Artificial Sequence
  chemically synthesized
ataataagttattacaaatatg

SEQ ID NO: 1274664 - DNA, 22 bp, Artificial Sequence
  chemically synthesized
taataagttattacaaatatgt

SEQ ID NO: 1274665 - DNA, 22 bp, Artificial Sequence
  chemically synthesized
ttacaaatatgttcattttatg

SEQ ID NO: 1274666 - DNA, 22 bp, Artificial Sequence
  chemically synthesized
caaatatgttcattttatgaat

SEQ ID NO: 1274667 - DNA, 22 bp, Artificial Sequence
  chemically synthesized
agaaaaaataaaaattcataaa

SEQ ID NO: 1274668 - DNA, 22 bp, Artificial Sequence
  chemically synthesized
ataattaagaaaaaataaaaat

SEQ ID NO: 1274669 - DNA, 22 bp, Artificial Sequence
  chemically synthesized
cataattaagaaaaaataaaaa

SEQ ID NO: 1274670 - DNA, 22 bp, Artificial Sequence
  chemically synthesized
attttatgaatttttatttttt

SEQ ID NO: 1274671 - DNA, 22 bp, Artificial Sequence
  chemically synthesized
tatgaatttttattttttctta

SEQ ID NO: 1274672 - DNA, 22 bp, Artificial Sequence
  chemically synthesized
atgaatttttattttttcttaa

SEQ ID NO: 1274673 - DNA, 22 bp, Artificial Sequence
  chemically synthesized
caaacttcataattaagaaaaa

SEQ ID NO: 1274674 - DNA, 22 bp, Artificial Sequence
  chemically synthesized
tgaatttttattttttcttaat

SEQ ID NO: 1274675 - DNA, 22 bp, Artificial Sequence
  chemically synthesized
acaaacttcataattaagaaaa

SEQ ID NO: 1274676 - DNA, 22 bp, Artificial Sequence
  chemically synthesized
ttattttttcttaattatgaag

SEQ ID NO: 1274677 - DNA, 22 bp, Artificial Sequence
  chemically synthesized
tattttttcttaattatgaagt

SEQ ID NO: 1274678 - DNA, 22 bp, Artificial Sequence
  chemically synthesized
atatacttacaaacttcataat

SEQ ID NO: 1274679 - DNA, 22 bp, Artificial Sequence
  chemically synthesized
attttttcttaattatgaagtt

SEQ ID NO: 1274680 - DNA, 22 bp, Artificial Sequence
  chemically synthesized
ttttttcttaattatgaagttt

SEQ ID NO: 1274681 - DNA, 22 bp, Artificial Sequence
  chemically synthesized
ctaatatacttacaaacttcat

SEQ ID NO: 1274682 - DNA, 22 bp, Artificial Sequence
  chemically synthesized
cctaatatacttacaaacttca

SEQ ID NO: 1274683 - DNA, 22 bp, Artificial Sequence
  chemically synthesized
tttcttaattatgaagtttgta

SEQ ID NO: 1274684 - DNA, 22 bp, Artificial Sequence
  chemically synthesized
ttcttaattatgaagtttgtaa

SEQ ID NO: 1274685 - DNA, 22 bp, Artificial Sequence
  chemically synthesized
tcttaattatgaagtttgtaag

SEQ ID NO: 1274686 - DNA, 22 bp, Artificial Sequence
  chemically synthesized
cttaattatgaagtttgtaagt

SEQ ID NO: 1274687 - DNA, 22 bp, Artificial Sequence
  chemically synthesized
ccttcctaatatacttacaaac

SEQ ID NO: 1274688 - DNA, 22 bp, Artificial Sequence
  chemically synthesized
ttaattatgaagtttgtaagta

SEQ ID NO: 1274689 - DNA, 22 bp, Artificial Sequence
  chemically synthesized
aattatgaagtttgtaagtata

SEQ ID NO: 1274690 - DNA, 22 bp, Artificial Sequence
  chemically synthesized
ttaccttcctaatatacttaca

SEQ ID NO: 1274691 - DNA, 22 bp, Artificial Sequence
  chemically synthesized
attatgaagtttgtaagtatat

SEQ ID NO: 1274692 - DNA, 22 bp, Artificial Sequence
  chemically synthesized
tgaagtttgtaagtatattagg

SEQ ID NO: 1274693 - DNA, 22 bp, Artificial Sequence
  chemically synthesized
tgaagttattaccttcctaata

SEQ ID NO: 1274694 - DNA, 22 bp, Artificial Sequence
  chemically synthesized
ctgtgaagttattaccttccta

SEQ ID NO: 1274695 - DNA, 22 bp, Artificial Sequence
  chemically synthesized
gtaagtatattaggaaggtaat

SEQ ID NO: 1274696 - DNA, 22 bp, Artificial Sequence
  chemically synthesized
taagtatattaggaaggtaata

SEQ ID NO: 1274697 - DNA, 22 bp, Artificial Sequence
  chemically synthesized
ccacattgctgtgaagttatta

SEQ ID NO: 1274698 - DNA, 22 bp, Artificial Sequence
  chemically synthesized
ggaaggtaataacttcacagca

SEQ ID NO: 1274699 - DNA, 22 bp, Artificial Sequence
  chemically synthesized
tgtctgccacattgctgtgaag

SEQ ID NO: 1274700 - DNA, 22 bp, Artificial Sequence
  chemically synthesized
aactgtgtctgccacattgctg

SEQ ID NO: 1274701 - DNA, 22 bp, Artificial Sequence
  chemically synthesized
cattcaactgtgtctgccacat

SEQ ID NO: 1274702 - DNA, 22 bp, Artificial Sequence
  chemically synthesized
cacagcaatgtggcagacacag

SEQ ID NO: 1274703 - DNA, 22 bp, Artificial Sequence
  chemically synthesized
acagcaatgtggcagacacagt

SEQ ID NO: 1274704 - DNA, 22 bp, Artificial Sequence
  chemically synthesized
atgagtacgttacattcaactg

SEQ ID NO: 1274705 - DNA, 22 bp, Artificial Sequence
  chemically synthesized
aaaattaatgagtacgttacat

SEQ ID NO: 1274706 - DNA, 22 bp, Artificial Sequence
  chemically synthesized
gaaaattaatgagtacgttaca

SEQ ID NO: 1274707 - DNA, 22 bp, Artificial Sequence
  chemically synthesized
tgaaaattaatgagtacgttac

SEQ ID NO: 1274708 - DNA, 22 bp, Artificial Sequence
  chemically synthesized
ttttgaaaattaatgagtacgt

SEQ ID NO: 1274709 - DNA, 22 bp, Artificial Sequence
  chemically synthesized
aatgtaacgtactcattaattt

SEQ ID NO: 1274710 - DNA, 22 bp, Artificial Sequence
  chemically synthesized
ataggattgttttgaaaattaa

SEQ ID NO: 1274711 - DNA, 22 bp, Artificial Sequence
  chemically synthesized
attaattttcaaaacaatccta

SEQ ID NO: 1274712 - DNA, 22 bp, Artificial Sequence
  chemically synthesized
agagtatatatctcataggatt

SEQ ID NO: 1274713 - DNA, 22 bp, Artificial Sequence
  chemically synthesized
attttcaaaacaatcctatgag

SEQ ID NO: 1274714 - DNA, 22 bp, Artificial Sequence
  chemically synthesized
aagagtatatatctcataggat

SEQ ID NO: 1274715 - DNA, 22 bp, Artificial Sequence
  chemically synthesized
tcaaaacaatcctatgagatat

SEQ ID NO: 1274716 - DNA, 22 bp, Artificial Sequence
  chemically synthesized
caaaacaatcctatgagatata

SEQ ID NO: 1274717 - DNA, 22 bp, Artificial Sequence
  chemically synthesized
aaaacaatcctatgagatatat

SEQ ID NO: 1274718 - DNA, 22 bp, Artificial Sequence
  chemically synthesized
caaaaggaatcttaagagtata

SEQ ID NO: 1274719 - DNA, 22 bp, Artificial Sequence
  chemically synthesized
acaaaaggaatcttaagagtat

SEQ ID NO: 1274720 - DNA, 22 bp, Artificial Sequence
  chemically synthesized
tgagatatatactcttaagatt

SEQ ID NO: 1274721 - DNA, 22 bp, Artificial Sequence
  chemically synthesized
atttacaaaaggaatcttaaga

SEQ ID NO: 1274722 - DNA, 22 bp, Artificial Sequence
  chemically synthesized
ttcatttacaaaaggaatctta

SEQ ID NO: 1274723 - DNA, 22 bp, Artificial Sequence
  chemically synthesized
agtctattcatttacaaaagga

SEQ ID NO: 1274724 - DNA, 22 bp, Artificial Sequence
  chemically synthesized
ttaagattccttttgtaaatga

SEQ ID NO: 1274725 - DNA, 22 bp, Artificial Sequence
  chemically synthesized
tgcctcagtctattcatttaca

SEQ ID NO: 1274726 - DNA, 22 bp, Artificial Sequence
  chemically synthesized
aagattccttttgtaaatgaat

SEQ ID NO: 1274727 - DNA, 22 bp, Artificial Sequence
  chemically synthesized
gtgcctcagtctattcatttac

SEQ ID NO: 1274728 - DNA, 22 bp, Artificial Sequence
  chemically synthesized
agattccttttgtaaatgaata

SEQ ID NO: 1274729 - DNA, 22 bp, Artificial Sequence
  chemically synthesized
tgtgcctcagtctattcattta

SEQ ID NO: 1274730 - DNA, 22 bp, Artificial Sequence
  chemically synthesized
tttgtgcctcagtctattcatt

SEQ ID NO: 1274731 - DNA, 22 bp, Artificial Sequence
  chemically synthesized
ctttgtgcctcagtctattcat

SEQ ID NO: 1274732 - DNA, 22 bp, Artificial Sequence
  chemically synthesized
cttttgtaaatgaatagactga

SEQ ID NO: 1274733 - DNA, 22 bp, Artificial Sequence
  chemically synthesized
ccttctttgtgcctcagtctat

SEQ ID NO: 1274734 - DNA, 22 bp, Artificial Sequence
  chemically synthesized
accttctttgtgcctcagtcta

SEQ ID NO: 1274735 - DNA, 22 bp, Artificial Sequence
  chemically synthesized
ttgtaaatgaatagactgaggc

SEQ ID NO: 1274736 - DNA, 22 bp, Artificial Sequence
  chemically synthesized
tgtaaatgaatagactgaggca

SEQ ID NO: 1274737 - DNA, 22 bp, Artificial Sequence
  chemically synthesized
gtaaatgaatagactgaggcac

SEQ ID NO: 1274738 - DNA, 22 bp, Artificial Sequence
  chemically synthesized
tttaccttctttgtgcctcagt

SEQ ID NO: 1274739 - DNA, 22 bp, Artificial Sequence
  chemically synthesized
taaatgaatagactgaggcaca

SEQ ID NO: 1274740 - DNA, 22 bp, Artificial Sequence
  chemically synthesized
aggcaaattatttaccttcttt

SEQ ID NO: 1274741 - DNA, 22 bp, Artificial Sequence
  chemically synthesized
tcaggcaaattatttaccttct

SEQ ID NO: 1274742 - DNA, 22 bp, Artificial Sequence
  chemically synthesized
aggcacaaagaaggtaaataat

SEQ ID NO: 1274743 - DNA, 22 bp, Artificial Sequence
  chemically synthesized
aatgctctcaggcaaattattt

SEQ ID NO: 1274744 - DNA, 22 bp, Artificial Sequence
  chemically synthesized
cgcactgaatgctctcaggcaa

SEQ ID NO: 1274745 - DNA, 22 bp, Artificial Sequence
  chemically synthesized
gcgcactgaatgctctcaggca

SEQ ID NO: 1274746 - DNA, 22 bp, Artificial Sequence
  chemically synthesized
tgcgcactgaatgctctcaggc

SEQ ID NO: 1274747 - DNA, 22 bp, Artificial Sequence
  chemically synthesized
tactttgcgcactgaatgctct

SEQ ID NO: 1274748 - DNA, 22 bp, Artificial Sequence
  chemically synthesized
gtactttgcgcactgaatgctc

SEQ ID NO: 1274749 - DNA, 22 bp, Artificial Sequence
  chemically synthesized
gcctgagagcattcagtgcgca

SEQ ID NO: 1274750 - DNA, 22 bp, Artificial Sequence
  chemically synthesized
cctgagagcattcagtgcgcaa

SEQ ID NO: 1274751 - DNA, 22 bp, Artificial Sequence
  chemically synthesized
ggtgccttgtactttgcgcact

SEQ ID NO: 1274752 - DNA, 22 bp, Artificial Sequence
  chemically synthesized
agagcattcagtgcgcaaagta

SEQ ID NO: 1274753 - DNA, 22 bp, Artificial Sequence
  chemically synthesized
aaattaggtgccttgtactttg

SEQ ID NO: 1274754 - DNA, 22 bp, Artificial Sequence
  chemically synthesized
agtgcgcaaagtacaaggcacc

SEQ ID NO: 1274755 - DNA, 22 bp, Artificial Sequence
  chemically synthesized
aagccaaattcaaattaggtgc

SEQ ID NO: 1274756 - DNA, 22 bp, Artificial Sequence
  chemically synthesized
tgaagccaaattcaaattaggt

SEQ ID NO: 1274757 - DNA, 22 bp, Artificial Sequence
  chemically synthesized
gattctgaagccaaattcaaat

SEQ ID NO: 1274758 - DNA, 22 bp, Artificial Sequence
  chemically synthesized
agagttggattctgaagccaaa

SEQ ID NO: 1274759 - DNA, 22 bp, Artificial Sequence
  chemically synthesized
ttaagagttggattctgaagcc

SEQ ID NO: 1274760 - DNA, 22 bp, Artificial Sequence
  chemically synthesized
atttgaatttggcttcagaatc

SEQ ID NO: 1274761 - DNA, 22 bp, Artificial Sequence
  chemically synthesized
gaatttggcttcagaatccaac

SEQ ID NO: 1274762 - DNA, 22 bp, Artificial Sequence
  chemically synthesized
aatttggcttcagaatccaact

SEQ ID NO: 1274763 - DNA, 22 bp, Artificial Sequence
  chemically synthesized
ggcttcagaatccaactcttaa

SEQ ID NO: 1274764 - DNA, 22 bp, Artificial Sequence
  chemically synthesized
gcttcagaatccaactcttaat

SEQ ID NO: 1274765 - DNA, 22 bp, Artificial Sequence
  chemically synthesized
cagaatccaactcttaatagct

SEQ ID NO: 1274766 - DNA, 22 bp, Artificial Sequence
  chemically synthesized
agaatccaactcttaatagcta

SEQ ID NO: 1274767 - DNA, 22 bp, Artificial Sequence
  chemically synthesized
gggtcatcagaatgtagctatt

SEQ ID NO: 1274768 - DNA, 22 bp, Artificial Sequence
  chemically synthesized
gatctagggtcatcagaatgta

SEQ ID NO: 1274769 - DNA, 22 bp, Artificial Sequence
  chemically synthesized
ttaatagctacattctgatgac

SEQ ID NO: 1274770 - DNA, 22 bp, Artificial Sequence
  chemically synthesized
aatagctacattctgatgaccc

SEQ ID NO: 1274771 - DNA, 22 bp, Artificial Sequence
  chemically synthesized
atagctacattctgatgaccct

SEQ ID NO: 1274772 - DNA, 22 bp, Artificial Sequence
  chemically synthesized
cattctgatgaccctagatcca

SEQ ID NO: 1274773 - DNA, 22 bp, Artificial Sequence
  chemically synthesized
gatgagaagagtccctggatct

SEQ ID NO: 1274774 - DNA, 22 bp, Artificial Sequence
  chemically synthesized
tgatgaccctagatccagggac

SEQ ID NO: 1274775 - DNA, 22 bp, Artificial Sequence
  chemically synthesized
atgaccctagatccagggactc

SEQ ID NO: 1274776 - DNA, 22 bp, Artificial Sequence
  chemically synthesized
gatccagggactcttctcatcc

SEQ ID NO: 1274777 - DNA, 22 bp, Artificial Sequence
  chemically synthesized
ttctcatccaattccggttttg

SEQ ID NO: 1274778 - DNA, 22 bp, Artificial Sequence
  chemically synthesized
cataaaacacaacaaaaccgga

SEQ ID NO: 1274779 - DNA, 22 bp, Artificial Sequence
  chemically synthesized
acataaaacacaacaaaaccgg

SEQ ID NO: 1274780 - DNA, 22 bp, Artificial Sequence
  chemically synthesized
ctcatccaattccggttttgtt

SEQ ID NO: 1274781 - DNA, 22 bp, Artificial Sequence
  chemically synthesized
tacataaaacacaacaaaaccg

SEQ ID NO: 1274782 - DNA, 22 bp, Artificial Sequence
  chemically synthesized
tcatccaattccggttttgttg

SEQ ID NO: 1274783 - DNA, 22 bp, Artificial Sequence
  chemically synthesized
atccaattccggttttgttgtg

SEQ ID NO: 1274784 - DNA, 22 bp, Artificial Sequence
  chemically synthesized
cggttttgttgtgttttatgta

SEQ ID NO: 1274785 - DNA, 22 bp, Artificial Sequence
  chemically synthesized
tgttgtgttttatgtaaaacac

SEQ ID NO: 1274786 - DNA, 22 bp, Artificial Sequence
  chemically synthesized
gttgtgttttatgtaaaacaca

SEQ ID NO: 1274787 - DNA, 22 bp, Artificial Sequence
  chemically synthesized
ttgtgttttatgtaaaacacac

SEQ ID NO: 1274788 - DNA, 22 bp, Artificial Sequence
  chemically synthesized
ataacccacagtggtgtgtttt

SEQ ID NO: 1274789 - DNA, 22 bp, Artificial Sequence
  chemically synthesized
tgttttatgtaaaacacaccac

SEQ ID NO: 1274790 - DNA, 22 bp, Artificial Sequence
  chemically synthesized
tatgtaaaacacaccactgtgg

SEQ ID NO: 1274791 - DNA, 22 bp, Artificial Sequence
  chemically synthesized
gaatctgataacccacagtggt

SEQ ID NO: 1274792 - DNA, 22 bp, Artificial Sequence
  chemically synthesized
atgtaaaacacaccactgtggg

SEQ ID NO: 1274793 - DNA, 22 bp, Artificial Sequence
  chemically synthesized
tgtaaaacacaccactgtgggt

SEQ ID NO: 1274794 - DNA, 22 bp, Artificial Sequence
  chemically synthesized
tgggttatcagattccaatttt

SEQ ID NO: 1274795 - DNA, 22 bp, Artificial Sequence
  chemically synthesized
aagacaatgaacaaaattggaa

SEQ ID NO: 1274796 - DNA, 22 bp, Artificial Sequence
  chemically synthesized
tcagattccaattttgttcatt

SEQ ID NO: 1274797 - DNA, 22 bp, Artificial Sequence
  chemically synthesized
caattttgttcattgtcttgag

SEQ ID NO: 1274798 - DNA, 22 bp, Artificial Sequence
  chemically synthesized
tgttcattgtcttgaggatttt

SEQ ID NO: 1274799 - DNA, 22 bp, Artificial Sequence
  chemically synthesized
caggtaaatgataaaatcctca

SEQ ID NO: 1274800 - DNA, 22 bp, Artificial Sequence
  chemically synthesized
gttcattgtcttgaggatttta

SEQ ID NO: 1274801 - DNA, 22 bp, Artificial Sequence
  chemically synthesized
acaggtaaatgataaaatcctc

SEQ ID NO: 1274802 - DNA, 22 bp, Artificial Sequence
  chemically synthesized
ttcattgtcttgaggattttat

SEQ ID NO: 1274803 - DNA, 22 bp, Artificial Sequence
  chemically synthesized
attgtcttgaggattttatcat

SEQ ID NO: 1274804 - DNA, 22 bp, Artificial Sequence
  chemically synthesized
gtttacaggtaaatgataaaat

SEQ ID NO: 1274805 - DNA, 22 bp, Artificial Sequence
  chemically synthesized
agtttacaggtaaatgataaaa

SEQ ID NO: 1274806 - DNA, 22 bp, Artificial Sequence
  chemically synthesized
tcttgaggattttatcatttac

SEQ ID NO: 1274807 - DNA, 22 bp, Artificial Sequence
  chemically synthesized
agtttagtttacaggtaaatga

SEQ ID NO: 1274808 - DNA, 22 bp, Artificial Sequence
  chemically synthesized
gaggattttatcatttacctgt

SEQ ID NO: 1274809 - DNA, 22 bp, Artificial Sequence
  chemically synthesized
aggattttatcatttacctgta

SEQ ID NO: 1274810 - DNA, 22 bp, Artificial Sequence
  chemically synthesized
tatcatttacctgtaaactaaa

SEQ ID NO: 1274811 - DNA, 22 bp, Artificial Sequence
  chemically synthesized
atcatttacctgtaaactaaac

SEQ ID NO: 1274812 - DNA, 22 bp, Artificial Sequence
  chemically synthesized
tcatttacctgtaaactaaact

SEQ ID NO: 1274813 - DNA, 22 bp, Artificial Sequence
  chemically synthesized
acctgtaaactaaactgaattc

SEQ ID NO: 1274814 - DNA, 22 bp, Artificial Sequence
  chemically synthesized
cctgtaaactaaactgaattct

SEQ ID NO: 1274815 - DNA, 22 bp, Artificial Sequence
  chemically synthesized
taaactaaactgaattctgcca

SEQ ID NO: 1274816 - DNA, 22 bp, Artificial Sequence
  chemically synthesized
aactgaattctgccatctcacc

SEQ ID NO: 1274817 - DNA, 22 bp, Artificial Sequence
  chemically synthesized
aattctgccatctcacccattt

SEQ ID NO: 1274818 - DNA, 22 bp, Artificial Sequence
  chemically synthesized
gtaagagtggcaaaatgggtga

SEQ ID NO: 1274819 - DNA, 22 bp, Artificial Sequence
  chemically synthesized
agtaagagtggcaaaatgggtg

SEQ ID NO: 1274820 - DNA, 22 bp, Artificial Sequence
  chemically synthesized
tgccatctcacccattttgcca

SEQ ID NO: 1274821 - DNA, 22 bp, Artificial Sequence
  chemically synthesized
ccatctcacccattttgccact

SEQ ID NO: 1274822 - DNA, 22 bp, Artificial Sequence
  chemically synthesized
agtatttagtaagagtggcaaa

SEQ ID NO: 1274823 - DNA, 22 bp, Artificial Sequence
  chemically synthesized
acccattttgccactcttacta

SEQ ID NO: 1274824 - DNA, 22 bp, Artificial Sequence
  chemically synthesized
aacaattgagtatttagtaaga

SEQ ID NO: 1274825 - DNA, 22 bp, Artificial Sequence
  chemically synthesized
tgccactcttactaaatactca

SEQ ID NO: 1274826 - DNA, 22 bp, Artificial Sequence
  chemically synthesized
gccactcttactaaatactcaa

SEQ ID NO: 1274827 - DNA, 22 bp, Artificial Sequence
  chemically synthesized
ccactcttactaaatactcaat

SEQ ID NO: 1274828 - DNA, 22 bp, Artificial Sequence
  chemically synthesized
aaggaaaactaaacaattgagt

SEQ ID NO: 1274829 - DNA, 22 bp, Artificial Sequence
  chemically synthesized
ttactaaatactcaattgttta

SEQ ID NO: 1274830 - DNA, 22 bp, Artificial Sequence
  chemically synthesized
actaaatactcaattgtttagt

SEQ ID NO: 1274831 - DNA, 22 bp, Artificial Sequence
  chemically synthesized
ctaaatactcaattgtttagtt

SEQ ID NO: 1274832 - DNA, 22 bp, Artificial Sequence
  chemically synthesized
aatactcaattgtttagttttc

SEQ ID NO: 1274833 - DNA, 22 bp, Artificial Sequence
  chemically synthesized
aattgtttagttttccttcaat

SEQ ID NO: 1274834 - DNA, 22 bp, Artificial Sequence
  chemically synthesized
tttagttttccttcaatatcgg

SEQ ID NO: 1274835 - DNA, 22 bp, Artificial Sequence
  chemically synthesized
gagagatgtagcccgatattga

SEQ ID NO: 1274836 - DNA, 22 bp, Artificial Sequence
  chemically synthesized
ggagagatgtagcccgatattg

SEQ ID NO: 1274837 - DNA, 22 bp, Artificial Sequence
  chemically synthesized
agttttccttcaatatcgggct

SEQ ID NO: 1274838 - DNA, 22 bp, Artificial Sequence
  chemically synthesized
gttttccttcaatatcgggcta

SEQ ID NO: 1274839 - DNA, 22 bp, Artificial Sequence
  chemically synthesized
tccttcaatatcgggctacatc

SEQ ID NO: 1274840 - DNA, 22 bp, Artificial Sequence
  chemically synthesized
ccttcaatatcgggctacatct

SEQ ID NO: 1274841 - DNA, 22 bp, Artificial Sequence
  chemically synthesized
cttcaatatcgggctacatctc

SEQ ID NO: 1274842 - DNA, 22 bp, Artificial Sequence
  chemically synthesized
caatatcgggctacatctctcc

SEQ ID NO: 1274843 - DNA, 22 bp, Artificial Sequence
  chemically synthesized
aatatcgggctacatctctcca

SEQ ID NO: 1274844 - DNA, 22 bp, Artificial Sequence
  chemically synthesized
taaacatcaatttggagagatg

SEQ ID NO: 1274845 - DNA, 22 bp, Artificial Sequence
  chemically synthesized
catctctccaaattgatgttta

SEQ ID NO: 1274846 - DNA, 22 bp, Artificial Sequence
  chemically synthesized
tccaaattgatgtttataattt

SEQ ID NO: 1274847 - DNA, 22 bp, Artificial Sequence
  chemically synthesized
caaattgatgtttataattttt

SEQ ID NO: 1274848 - DNA, 22 bp, Artificial Sequence
  chemically synthesized
atgtttataattttttgccttc

SEQ ID NO: 1274849 - DNA, 22 bp, Artificial Sequence
  chemically synthesized
ataattttttgccttccctctt

SEQ ID NO: 1274850 - DNA, 22 bp, Artificial Sequence
  chemically synthesized
taattttttgccttccctcttg

SEQ ID NO: 1274851 - DNA, 22 bp, Artificial Sequence
  chemically synthesized
agtgatgtcaagtcaagaggga

SEQ ID NO: 1274852 - DNA, 22 bp, Artificial Sequence
  chemically synthesized
tcagtgatgtcaagtcaagagg

SEQ ID NO: 1274853 - DNA, 22 bp, Artificial Sequence
  chemically synthesized
tttgccttccctcttgacttga

SEQ ID NO: 1274854 - DNA, 22 bp, Artificial Sequence
  chemically synthesized
ttgccttccctcttgacttgac

SEQ ID NO: 1274855 - DNA, 22 bp, Artificial Sequence
  chemically synthesized
attctcagtgatgtcaagtcaa

SEQ ID NO: 1274856 - DNA, 22 bp, Artificial Sequence
  chemically synthesized
tgccttccctcttgacttgaca

SEQ ID NO: 1274857 - DNA, 22 bp, Artificial Sequence
  chemically synthesized
aattctcagtgatgtcaagtca

SEQ ID NO: 1274858 - DNA, 22 bp, Artificial Sequence
  chemically synthesized
gccttccctcttgacttgacat

SEQ ID NO: 1274859 - DNA, 22 bp, Artificial Sequence
  chemically synthesized
taattctcagtgatgtcaagtc

SEQ ID NO: 1274860 - DNA, 22 bp, Artificial Sequence
  chemically synthesized
ccttccctcttgacttgacatc

SEQ ID NO: 1274861 - DNA, 22 bp, Artificial Sequence
  chemically synthesized
ccctcttgacttgacatcactg

SEQ ID NO: 1274862 - DNA, 22 bp, Artificial Sequence
  chemically synthesized
cctcttgacttgacatcactga

SEQ ID NO: 1274863 - DNA, 22 bp, Artificial Sequence
  chemically synthesized
ttgacttgacatcactgagaat

SEQ ID NO: 1274864 - DNA, 22 bp, Artificial Sequence
  chemically synthesized
gacttgacatcactgagaatta

SEQ ID NO: 1274865 - DNA, 22 bp, Artificial Sequence
  chemically synthesized
acttgacatcactgagaattaa

SEQ ID NO: 1274866 - DNA, 22 bp, Artificial Sequence
  chemically synthesized
ggcagtcagattttaattctca

SEQ ID NO: 1274867 - DNA, 22 bp, Artificial Sequence
  chemically synthesized
gggcagtcagattttaattctc

SEQ ID NO: 1274868 - DNA, 22 bp, Artificial Sequence
  chemically synthesized
gacatcactgagaattaaaatc

SEQ ID NO: 1274869 - DNA, 22 bp, Artificial Sequence
  chemically synthesized
acatcactgagaattaaaatct

SEQ ID NO: 1274870 - DNA, 22 bp, Artificial Sequence
  chemically synthesized
agaattaaaatctgactgccca

SEQ ID NO: 1274871 - DNA, 22 bp, Artificial Sequence
  chemically synthesized
aaatctgactgcccaaatcctt

SEQ ID NO: 1274872 - DNA, 22 bp, Artificial Sequence
  chemically synthesized
taggagtcccagtaaggatttg

SEQ ID NO: 1274873 - DNA, 22 bp, Artificial Sequence
  chemically synthesized
actgcccaaatccttactggga

SEQ ID NO: 1274874 - DNA, 22 bp, Artificial Sequence
  chemically synthesized
cccaaatccttactgggactcc

SEQ ID NO: 1274875 - DNA, 22 bp, Artificial Sequence
  chemically synthesized
actgggactcctacaacctact

SEQ ID NO: 1274876 - DNA, 22 bp, Artificial Sequence
  chemically synthesized
ctgggactcctacaacctactg

SEQ ID NO: 1274877 - DNA, 22 bp, Artificial Sequence
  chemically synthesized
tcccagtagaatcagtaggttg

SEQ ID NO: 1274878 - DNA, 22 bp, Artificial Sequence
  chemically synthesized
ggactcctacaacctactgatt

SEQ ID NO: 1274879 - DNA, 22 bp, Artificial Sequence
  chemically synthesized
taggttgtcccagtagaatcag

SEQ ID NO: 1274880 - DNA, 22 bp, Artificial Sequence
  chemically synthesized
gtaggttgtcccagtagaatca

SEQ ID NO: 1274881 - DNA, 22 bp, Artificial Sequence
  chemically synthesized
ctacaacctactgattctactg

SEQ ID NO: 1274882 - DNA, 22 bp, Artificial Sequence
  chemically synthesized
caacctactgattctactggga

SEQ ID NO: 1274883 - DNA, 22 bp, Artificial Sequence
  chemically synthesized
ctgattctactgggacaaccta

SEQ ID NO: 1274884 - DNA, 22 bp, Artificial Sequence
  chemically synthesized
caagacaaccttgtaggttgtc

SEQ ID NO: 1274885 - DNA, 22 bp, Artificial Sequence
  chemically synthesized
attctactgggacaacctacaa

SEQ ID NO: 1274886 - DNA, 22 bp, Artificial Sequence
  chemically synthesized
tactgggacaacctacaaggtt

SEQ ID NO: 1274887 - DNA, 22 bp, Artificial Sequence
  chemically synthesized
ctgggacaacctacaaggttgt

SEQ ID NO: 1274888 - DNA, 22 bp, Artificial Sequence
  chemically synthesized
ggacaacctacaaggttgtctt

SEQ ID NO: 1274889 - DNA, 22 bp, Artificial Sequence
  chemically synthesized
ggggagaaagacagctacaaga

SEQ ID NO: 1274890 - DNA, 22 bp, Artificial Sequence
  chemically synthesized
caaggttgtcttgtagctgtct

SEQ ID NO: 1274891 - DNA, 22 bp, Artificial Sequence
  chemically synthesized
aaatcctgggggagaaagacag

SEQ ID NO: 1274892 - DNA, 22 bp, Artificial Sequence
  chemically synthesized
caaatcctgggggagaaagaca

SEQ ID NO: 1274893 - DNA, 22 bp, Artificial Sequence
  chemically synthesized
tcaaatcctgggggagaaagac

SEQ ID NO: 1274894 - DNA, 22 bp, Artificial Sequence
  chemically synthesized
ttcaaatcctgggggagaaaga

SEQ ID NO: 1274895 - DNA, 22 bp, Artificial Sequence
  chemically synthesized
tcttgtagctgtctttctcccc

SEQ ID NO: 1274896 - DNA, 22 bp, Artificial Sequence
  chemically synthesized
tttcaaatcctgggggagaaag

SEQ ID NO: 1274897 - DNA, 22 bp, Artificial Sequence
  chemically synthesized
gtagctgtctttctcccccagg

SEQ ID NO: 1274898 - DNA, 22 bp, Artificial Sequence
  chemically synthesized
tagctgtctttctcccccagga

SEQ ID NO: 1274899 - DNA, 22 bp, Artificial Sequence
  chemically synthesized
tctttctcccccaggatttgaa

SEQ ID NO: 1274900 - DNA, 22 bp, Artificial Sequence
  chemically synthesized
agtgtgcaaggctttttcaaat

SEQ ID NO: 1274901 - DNA, 22 bp, Artificial Sequence
  chemically synthesized
tctcccccaggatttgaaaaag

SEQ ID NO: 1274902 - DNA, 22 bp, Artificial Sequence
  chemically synthesized
cagtgtgcaaggctttttcaaa

SEQ ID NO: 1274903 - DNA, 22 bp, Artificial Sequence
  chemically synthesized
ctcccccaggatttgaaaaagc

SEQ ID NO: 1274904 - DNA, 22 bp, Artificial Sequence
  chemically synthesized
tcccccaggatttgaaaaagcc

SEQ ID NO: 1274905 - DNA, 22 bp, Artificial Sequence
  chemically synthesized
ccccaggatttgaaaaagcctt

SEQ ID NO: 1274906 - DNA, 22 bp, Artificial Sequence
  chemically synthesized
ggcttcagtgtgcaaggctttt

SEQ ID NO: 1274907 - DNA, 22 bp, Artificial Sequence
  chemically synthesized
gggcttcagtgtgcaaggcttt

SEQ ID NO: 1274908 - DNA, 22 bp, Artificial Sequence
  chemically synthesized
ttgggcttcagtgtgcaaggct

SEQ ID NO: 1274909 - DNA, 22 bp, Artificial Sequence
  chemically synthesized
gaaaaagccttgcacactgaag

SEQ ID NO: 1274910 - DNA, 22 bp, Artificial Sequence
  chemically synthesized
aaaaagccttgcacactgaagc

SEQ ID NO: 1274911 - DNA, 22 bp, Artificial Sequence
  chemically synthesized
tatcaagttcttgggcttcagt

SEQ ID NO: 1274912 - DNA, 22 bp, Artificial Sequence
  chemically synthesized
atatcaagttcttgggcttcag

SEQ ID NO: 1274913 - DNA, 22 bp, Artificial Sequence
  chemically synthesized
aagtttatatcaagttcttggg

SEQ ID NO: 1274914 - DNA, 22 bp, Artificial Sequence
  chemically synthesized
gcacactgaagcccaagaactt

SEQ ID NO: 1274915 - DNA, 22 bp, Artificial Sequence
  chemically synthesized
gaagtttatatcaagttcttgg

SEQ ID NO: 1274916 - DNA, 22 bp, Artificial Sequence
  chemically synthesized
cacactgaagcccaagaacttg

SEQ ID NO: 1274917 - DNA, 22 bp, Artificial Sequence
  chemically synthesized
tgaagtttatatcaagttcttg

SEQ ID NO: 1274918 - DNA, 22 bp, Artificial Sequence
  chemically synthesized
ttgaagtttatatcaagttctt

SEQ ID NO: 1274919 - DNA, 22 bp, Artificial Sequence
  chemically synthesized
aagcccaagaacttgatataaa

SEQ ID NO: 1274920 - DNA, 22 bp, Artificial Sequence
  chemically synthesized
tggtggtaagtcttttgaagtt

SEQ ID NO: 1274921 - DNA, 22 bp, Artificial Sequence
  chemically synthesized
ttgtggtggtaagtcttttgaa

SEQ ID NO: 1274922 - DNA, 22 bp, Artificial Sequence
  chemically synthesized
gttgtggtggtaagtcttttga

SEQ ID NO: 1274923 - DNA, 22 bp, Artificial Sequence
  chemically synthesized
gatataaacttcaaaagactta

SEQ ID NO: 1274924 - DNA, 22 bp, Artificial Sequence
  chemically synthesized
atataaacttcaaaagacttac

SEQ ID NO: 1274925 - DNA, 22 bp, Artificial Sequence
  chemically synthesized
tacgtgatttgttgtggtggta

SEQ ID NO: 1274926 - DNA, 22 bp, Artificial Sequence
  chemically synthesized
caaaagacttaccaccacaaca

SEQ ID NO: 1274927 - DNA, 22 bp, Artificial Sequence
  chemically synthesized
aaaagacttaccaccacaacaa

SEQ ID NO: 1274928 - DNA, 22 bp, Artificial Sequence
  chemically synthesized
cctatacgtgatttgttgtggt

SEQ ID NO: 1274929 - DNA, 22 bp, Artificial Sequence
  chemically synthesized
accaccacaacaaatcacgtat

SEQ ID NO: 1274930 - DNA, 22 bp, Artificial Sequence
  chemically synthesized
ccaccacaacaaatcacgtata

SEQ ID NO: 1274931 - DNA, 22 bp, Artificial Sequence
  chemically synthesized
caggcatgaaggttgcctatac

SEQ ID NO: 1274932 - DNA, 22 bp, Artificial Sequence
  chemically synthesized
tagcaggagctccaggcatgaa

SEQ ID NO: 1274933 - DNA, 22 bp, Artificial Sequence
  chemically synthesized
gtagcaggagctccaggcatga

SEQ ID NO: 1274934 - DNA, 22 bp, Artificial Sequence
  chemically synthesized
ttgtagcaggagctccaggcat

SEQ ID NO: 1274935 - DNA, 22 bp, Artificial Sequence
  chemically synthesized
aatggctcttgtagcaggagct

SEQ ID NO: 1274936 - DNA, 22 bp, Artificial Sequence
  chemically synthesized
tgaatggctcttgtagcaggag

SEQ ID NO: 1274937 - DNA, 22 bp, Artificial Sequence
  chemically synthesized
catgcctggagctcctgctaca

SEQ ID NO: 1274938 - DNA, 22 bp, Artificial Sequence
  chemically synthesized
ctgaatggctcttgtagcagga

SEQ ID NO: 1274939 - DNA, 22 bp, Artificial Sequence
  chemically synthesized
atgcctggagctcctgctacaa

SEQ ID NO: 1274940 - DNA, 22 bp, Artificial Sequence
  chemically synthesized
tctgaatggctcttgtagcagg

SEQ ID NO: 1274941 - DNA, 22 bp, Artificial Sequence
  chemically synthesized
gagctcctgctacaagagccat

SEQ ID NO: 1274942 - DNA, 22 bp, Artificial Sequence
  chemically synthesized
cagtggactttctgaatggctc

SEQ ID NO: 1274943 - DNA, 22 bp, Artificial Sequence
  chemically synthesized
ctgctacaagagccattcagaa

SEQ ID NO: 1274944 - DNA, 22 bp, Artificial Sequence
  chemically synthesized
ctacaagagccattcagaaagt

SEQ ID NO: 1274945 - DNA, 22 bp, Artificial Sequence
  chemically synthesized
gagttccagtggactttctgaa

SEQ ID NO: 1274946 - DNA, 22 bp, Artificial Sequence
  chemically synthesized
caagagccattcagaaagtcca

SEQ ID NO: 1274947 - DNA, 22 bp, Artificial Sequence
  chemically synthesized
agaaagtccactggaactccag

SEQ ID NO: 1274948 - DNA, 22 bp, Artificial Sequence
  chemically synthesized
gaacagaacacggatgatgctg

SEQ ID NO: 1274949 - DNA, 22 bp, Artificial Sequence
  chemically synthesized
ctggaacagaacacggatgatg

SEQ ID NO: 1274950 - DNA, 22 bp, Artificial Sequence
  chemically synthesized
cctggaacagaacacggatgat

SEQ ID NO: 1274951 - DNA, 22 bp, Artificial Sequence
  chemically synthesized
gaactccagcatcatccgtgtt

SEQ ID NO: 1274952 - DNA, 22 bp, Artificial Sequence
  chemically synthesized
tttcctggaacagaacacggat

SEQ ID NO: 1274953 - DNA, 22 bp, Artificial Sequence
  chemically synthesized
cagcatcatccgtgttctgttc

SEQ ID NO: 1274954 - DNA, 22 bp, Artificial Sequence
  chemically synthesized
acagtcatagttatttcctgga

SEQ ID NO: 1274955 - DNA, 22 bp, Artificial Sequence
  chemically synthesized
cacagtcatagttatttcctgg

SEQ ID NO: 1274956 - DNA, 22 bp, Artificial Sequence
  chemically synthesized
atttcacagtcatagttatttc

SEQ ID NO: 1274957 - DNA, 22 bp, Artificial Sequence
  chemically synthesized
tgttccaggaaataactatgac

SEQ ID NO: 1274958 - DNA, 22 bp, Artificial Sequence
  chemically synthesized
ttccaggaaataactatgactg

SEQ ID NO: 1274959 - DNA, 22 bp, Artificial Sequence
  chemically synthesized
caggaaataactatgactgtga

SEQ ID NO: 1274960 - DNA, 22 bp, Artificial Sequence
  chemically synthesized
tgactgtgaaattaatgtttat

SEQ ID NO: 1274961 - DNA, 22 bp, Artificial Sequence
  chemically synthesized
aatgtggtgatggcataaacat

SEQ ID NO: 1274962 - DNA, 22 bp, Artificial Sequence
  chemically synthesized
gaatgtggtgatggcataaaca

SEQ ID NO: 1274963 - DNA, 22 bp, Artificial Sequence
  chemically synthesized
tgaaattaatgtttatgccatc

SEQ ID NO: 1274964 - DNA, 22 bp, Artificial Sequence
  chemically synthesized
tggtttgaatgtggtgatggca

SEQ ID NO: 1274965 - DNA, 22 bp, Artificial Sequence
  chemically synthesized
atggtttgaatgtggtgatggc

SEQ ID NO: 1274966 - DNA, 22 bp, Artificial Sequence
  chemically synthesized
atgtttatgccatcaccacatt

SEQ ID NO: 1274967 - DNA, 22 bp, Artificial Sequence
  chemically synthesized
gtttatggtttgaatgtggtga

SEQ ID NO: 1274968 - DNA, 22 bp, Artificial Sequence
  chemically synthesized
tggtttatggtttgaatgtggt

SEQ ID NO: 1274969 - DNA, 22 bp, Artificial Sequence
  chemically synthesized
ctggtttatggtttgaatgtgg

SEQ ID NO: 1274970 - DNA, 22 bp, Artificial Sequence
  chemically synthesized
tctggtttatggtttgaatgtg

SEQ ID NO: 1274971 - DNA, 22 bp, Artificial Sequence
  chemically synthesized
atgccatcaccacattcaaacc

SEQ ID NO: 1274972 - DNA, 22 bp, Artificial Sequence
  chemically synthesized
tgccatcaccacattcaaacca

SEQ ID NO: 1274973 - DNA, 22 bp, Artificial Sequence
  chemically synthesized
atggattttctggtttatggtt

SEQ ID NO: 1274974 - DNA, 22 bp, Artificial Sequence
  chemically synthesized
aaaccataaaccagaaaatcca

SEQ ID NO: 1274975 - DNA, 22 bp, Artificial Sequence
  chemically synthesized
agatggtagagtggtaatctga

SEQ ID NO: 1274976 - DNA, 22 bp, Artificial Sequence
  chemically synthesized
cagatggtagagtggtaatctg

SEQ ID NO: 1274977 - DNA, 22 bp, Artificial Sequence
  chemically synthesized
agcatcttcagatggtagagtg

SEQ ID NO: 1274978 - DNA, 22 bp, Artificial Sequence
  chemically synthesized
taagcatcttcagatggtagag

SEQ ID NO: 1274979 - DNA, 22 bp, Artificial Sequence
  chemically synthesized
aattctaagcatcttcagatgg

SEQ ID NO: 1274980 - DNA, 22 bp, Artificial Sequence
  chemically synthesized
ccactctaccatctgaagatgc

SEQ ID NO: 1274981 - DNA, 22 bp, Artificial Sequence
  chemically synthesized
gacattgaattctaagcatctt

SEQ ID NO: 1274982 - DNA, 22 bp, Artificial Sequence
  chemically synthesized
tagacattgaattctaagcatc

SEQ ID NO: 1274983 - DNA, 22 bp, Artificial Sequence
  chemically synthesized
taccatctgaagatgcttagaa

SEQ ID NO: 1274984 - DNA, 22 bp, Artificial Sequence
  chemically synthesized
ctagacattgaattctaagcat

SEQ ID NO: 1274985 - DNA, 22 bp, Artificial Sequence
  chemically synthesized
tctagacattgaattctaagca

SEQ ID NO: 1274986 - DNA, 22 bp, Artificial Sequence
  chemically synthesized
ccatctgaagatgcttagaatt

SEQ ID NO: 1274987 - DNA, 22 bp, Artificial Sequence
  chemically synthesized
aagatgcttagaattcaatgtc

SEQ ID NO: 1274988 - DNA, 22 bp, Artificial Sequence
  chemically synthesized
agaagttttctagacattgaat

SEQ ID NO: 1274989 - DNA, 22 bp, Artificial Sequence
  chemically synthesized
agaattcaatgtctagaaaact

SEQ ID NO: 1274990 - DNA, 22 bp, Artificial Sequence
  chemically synthesized
gaattcaatgtctagaaaactt

SEQ ID NO: 1274991 - DNA, 22 bp, Artificial Sequence
  chemically synthesized
gagggcaggcagttaagaagtt

SEQ ID NO: 1274992 - DNA, 22 bp, Artificial Sequence
  chemically synthesized
aatgtctagaaaacttcttaac

SEQ ID NO: 1274993 - DNA, 22 bp, Artificial Sequence
  chemically synthesized
agtctagagggcaggcagttaa

SEQ ID NO: 1274994 - DNA, 22 bp, Artificial Sequence
  chemically synthesized
gaaaacttcttaactgcctgcc

SEQ ID NO: 1274995 - DNA, 22 bp, Artificial Sequence
  chemically synthesized
ttgagtctagagggcaggcagt

SEQ ID NO: 1274996 - DNA, 22 bp, Artificial Sequence
  chemically synthesized
gttgagtctagagggcaggcag

SEQ ID NO: 1274997 - DNA, 22 bp, Artificial Sequence
  chemically synthesized
tttgttgagtctagagggcagg

SEQ ID NO: 1274998 - DNA, 22 bp, Artificial Sequence
  chemically synthesized
cttaactgcctgccctctagac

SEQ ID NO: 1274999 - DNA, 22 bp, Artificial Sequence
  chemically synthesized
ttaactgcctgccctctagact

SEQ ID NO: 1275000 - DNA, 22 bp, Artificial Sequence
  chemically synthesized
aactgcctgccctctagactca

SEQ ID NO: 1275001 - DNA, 22 bp, Artificial Sequence
  chemically synthesized
actgcctgccctctagactcaa

SEQ ID NO: 1275002 - DNA, 22 bp, Artificial Sequence
  chemically synthesized
cctgccctctagactcaacaaa

SEQ ID NO: 1275003 - DNA, 22 bp, Artificial Sequence
  chemically synthesized
ccctctagactcaacaaatagg

SEQ ID NO: 1275004 - DNA, 22 bp, Artificial Sequence
  chemically synthesized
gagaagaatataaatcctattt

SEQ ID NO: 1275005 - DNA, 22 bp, Artificial Sequence
  chemically synthesized
tagactcaacaaataggattta

SEQ ID NO: 1275006 - DNA, 22 bp, Artificial Sequence
  chemically synthesized
ttggagaagaatataaatccta

SEQ ID NO: 1275007 - DNA, 22 bp, Artificial Sequence
  chemically synthesized
gactcaacaaataggatttata

SEQ ID NO: 1275008 - DNA, 22 bp, Artificial Sequence
  chemically synthesized
gttggagaagaatataaatcct

SEQ ID NO: 1275009 - DNA, 22 bp, Artificial Sequence
  chemically synthesized
aacaaataggatttatattctt

SEQ ID NO: 1275010 - DNA, 22 bp, Artificial Sequence
  chemically synthesized
atattcttctccaacaagtttt

SEQ ID NO: 1275011 - DNA, 22 bp, Artificial Sequence
  chemically synthesized
tattcttctccaacaagttttt

SEQ ID NO: 1275012 - DNA, 22 bp, Artificial Sequence
  chemically synthesized
ttctccaacaagtttttgtttt

SEQ ID NO: 1275013 - DNA, 22 bp, Artificial Sequence
  chemically synthesized
ctccaacaagtttttgttttta

SEQ ID NO: 1275014 - DNA, 22 bp, Artificial Sequence
  chemically synthesized
tggaaacaaacataaaaacaaa

SEQ ID NO: 1275015 - DNA, 22 bp, Artificial Sequence
  chemically synthesized
tccaacaagtttttgtttttat

SEQ ID NO: 1275016 - DNA, 22 bp, Artificial Sequence
  chemically synthesized
tatggaaacaaacataaaaaca

SEQ ID NO: 1275017 - DNA, 22 bp, Artificial Sequence
  chemically synthesized
caacaagtttttgtttttatgt

SEQ ID NO: 1275018 - DNA, 22 bp, Artificial Sequence
  chemically synthesized
ttgtttttatgtttgtttccat

SEQ ID NO: 1275019 - DNA, 22 bp, Artificial Sequence
  chemically synthesized
tgtttttatgtttgtttccata

SEQ ID NO: 1275020 - DNA, 22 bp, Artificial Sequence
  chemically synthesized
gtttttatgtttgtttccatag

SEQ ID NO: 1275021 - DNA, 22 bp, Artificial Sequence
  chemically synthesized
tttttatgtttgtttccataga

SEQ ID NO: 1275022 - DNA, 22 bp, Artificial Sequence
  chemically synthesized
atgagaggcacctctatggaaa

SEQ ID NO: 1275023 - DNA, 22 bp, Artificial Sequence
  chemically synthesized
aatgagaggcacctctatggaa

SEQ ID NO: 1275024 - DNA, 22 bp, Artificial Sequence
  chemically synthesized
ttatgtttgtttccatagaggt

SEQ ID NO: 1275025 - DNA, 22 bp, Artificial Sequence
  chemically synthesized
tatgtttgtttccatagaggtg

SEQ ID NO: 1275026 - DNA, 22 bp, Artificial Sequence
  chemically synthesized
atgtttgtttccatagaggtgc

SEQ ID NO: 1275027 - DNA, 22 bp, Artificial Sequence
  chemically synthesized
tgtttgtttccatagaggtgcc

SEQ ID NO: 1275028 - DNA, 22 bp, Artificial Sequence
  chemically synthesized
gtttccatagaggtgcctctca

SEQ ID NO: 1275029 - DNA, 22 bp, Artificial Sequence
  chemically synthesized
tttccatagaggtgcctctcat

SEQ ID NO: 1275030 - DNA, 22 bp, Artificial Sequence
  chemically synthesized
ccatagaggtgcctctcattaa

SEQ ID NO: 1275031 - DNA, 22 bp, Artificial Sequence
  chemically synthesized
catagaggtgcctctcattaaa

SEQ ID NO: 1275032 - DNA, 22 bp, Artificial Sequence
  chemically synthesized
gatgatgcacgtgatcaggcat

SEQ ID NO: 1275033 - DNA, 22 bp, Artificial Sequence
  chemically synthesized
ctggatgatgcacgtgatcagg

SEQ ID NO: 1275034 - DNA, 22 bp, Artificial Sequence
  chemically synthesized
tcattaaatgcctgatcacgtg

SEQ ID NO: 1275035 - DNA, 22 bp, Artificial Sequence
  chemically synthesized
attaaatgcctgatcacgtgca

SEQ ID NO: 1275036 - DNA, 22 bp, Artificial Sequence
  chemically synthesized
aatgcctgatcacgtgcatcat

SEQ ID NO: 1275037 - DNA, 22 bp, Artificial Sequence
  chemically synthesized
gtagagcatagttgctggatga

SEQ ID NO: 1275038 - DNA, 22 bp, Artificial Sequence
  chemically synthesized
atcacgtgcatcatccagcaac

SEQ ID NO: 1275039 - DNA, 22 bp, Artificial Sequence
  chemically synthesized
ctagtagagcatagttgctgga

SEQ ID NO: 1275040 - DNA, 22 bp, Artificial Sequence
  chemically synthesized
gctagtagagcatagttgctgg

SEQ ID NO: 1275041 - DNA, 22 bp, Artificial Sequence
  chemically synthesized
agacttgctagtagagcatagt

SEQ ID NO: 1275042 - DNA, 22 bp, Artificial Sequence
  chemically synthesized
aatcatcggttgagacttgcta

SEQ ID NO: 1275043 - DNA, 22 bp, Artificial Sequence
  chemically synthesized
tgctctactagcaagtctcaac

SEQ ID NO: 1275044 - DNA, 22 bp, Artificial Sequence
  chemically synthesized
gctaaatcatcggttgagactt

SEQ ID NO: 1275045 - DNA, 22 bp, Artificial Sequence
  chemically synthesized
tactagcaagtctcaaccgatg

SEQ ID NO: 1275046 - DNA, 22 bp, Artificial Sequence
  chemically synthesized
ctagcaagtctcaaccgatgat

SEQ ID NO: 1275047 - DNA, 22 bp, Artificial Sequence
  chemically synthesized
aggactagctaaatcatcggtt

SEQ ID NO: 1275048 - DNA, 22 bp, Artificial Sequence
  chemically synthesized
gcaagtctcaaccgatgattta

SEQ ID NO: 1275049 - DNA, 22 bp, Artificial Sequence
  chemically synthesized
ctaaggactagctaaatcatcg

SEQ ID NO: 1275050 - DNA, 22 bp, Artificial Sequence
  chemically synthesized
actaaggactagctaaatcatc

SEQ ID NO: 1275051 - DNA, 22 bp, Artificial Sequence
  chemically synthesized
tttactaaggactagctaaatc

SEQ ID NO: 1275052 - DNA, 22 bp, Artificial Sequence
  chemically synthesized
gtttactaaggactagctaaat

SEQ ID NO: 1275053 - DNA, 22 bp, Artificial Sequence
  chemically synthesized
tgtttactaaggactagctaaa

SEQ ID NO: 1275054 - DNA, 22 bp, Artificial Sequence
  chemically synthesized
ttgtttactaaggactagctaa

SEQ ID NO: 1275055 - DNA, 22 bp, Artificial Sequence
  chemically synthesized
aaccgatgatttagctagtcct

SEQ ID NO: 1275056 - DNA, 22 bp, Artificial Sequence
  chemically synthesized
ccttttgtttactaaggactag

SEQ ID NO: 1275057 - DNA, 22 bp, Artificial Sequence
  chemically synthesized
gattgccttttgtttactaagg

SEQ ID NO: 1275058 - DNA, 22 bp, Artificial Sequence
  chemically synthesized
agctagtccttagtaaacaaaa

SEQ ID NO: 1275059 - DNA, 22 bp, Artificial Sequence
  chemically synthesized
gctagtccttagtaaacaaaag

SEQ ID NO: 1275060 - DNA, 22 bp, Artificial Sequence
  chemically synthesized
tcattcgattgccttttgttta

SEQ ID NO: 1275061 - DNA, 22 bp, Artificial Sequence
  chemically synthesized
gtcattcgattgccttttgttt

SEQ ID NO: 1275062 - DNA, 22 bp, Artificial Sequence
  chemically synthesized
gtccttagtaaacaaaaggcaa

SEQ ID NO: 1275063 - DNA, 22 bp, Artificial Sequence
  chemically synthesized
agtaaacaaaaggcaatcgaat

SEQ ID NO: 1275064 - DNA, 22 bp, Artificial Sequence
  chemically synthesized
gtaaacaaaaggcaatcgaatg

SEQ ID NO: 1275065 - DNA, 22 bp, Artificial Sequence
  chemically synthesized
aacagtgtaagtccatttgtca

SEQ ID NO: 1275066 - DNA, 22 bp, Artificial Sequence
  chemically synthesized
tgaacagtgtaagtccatttgt

SEQ ID NO: 1275067 - DNA, 22 bp, Artificial Sequence
  chemically synthesized
ctgaacagtgtaagtccatttg

SEQ ID NO: 1275068 - DNA, 22 bp, Artificial Sequence
  chemically synthesized
atccttctgaacagtgtaagtc

SEQ ID NO: 1275069 - DNA, 22 bp, Artificial Sequence
  chemically synthesized
ttcatccttctgaacagtgtaa

SEQ ID NO: 1275070 - DNA, 22 bp, Artificial Sequence
  chemically synthesized
acactgttcagaaggatgaata

SEQ ID NO: 1275071 - DNA, 22 bp, Artificial Sequence
  chemically synthesized
cactgttcagaaggatgaataa

SEQ ID NO: 1275072 - DNA, 22 bp, Artificial Sequence
  chemically synthesized
aagtaaagaagacacattattc

SEQ ID NO: 1275073 - DNA, 22 bp, Artificial Sequence
  chemically synthesized
ttcagaaggatgaataatgtgt

SEQ ID NO: 1275074 - DNA, 22 bp, Artificial Sequence
  chemically synthesized
ttcaagtaaagaagacacatta

SEQ ID NO: 1275075 - DNA, 22 bp, Artificial Sequence
  chemically synthesized
agaaggatgaataatgtgtctt

SEQ ID NO: 1275076 - DNA, 22 bp, Artificial Sequence
  chemically synthesized
ctgttcaagtaaagaagacaca

SEQ ID NO: 1275077 - DNA, 22 bp, Artificial Sequence
  chemically synthesized
actcctgttcaagtaaagaaga

SEQ ID NO: 1275078 - DNA, 22 bp, Artificial Sequence
  chemically synthesized
gtggagcctcactcctgttcaa

SEQ ID NO: 1275079 - DNA, 22 bp, Artificial Sequence
  chemically synthesized
ggtggagcctcactcctgttca

SEQ ID NO: 1275080 - DNA, 22 bp, Artificial Sequence
  chemically synthesized
ctttacttgaacaggagtgagg

SEQ ID NO: 1275081 - DNA, 22 bp, Artificial Sequence
  chemically synthesized
tttacttgaacaggagtgaggc

SEQ ID NO: 1275082 - DNA, 22 bp, Artificial Sequence
  chemically synthesized
tacttgaacaggagtgaggctc

SEQ ID NO: 1275083 - DNA, 22 bp, Artificial Sequence
  chemically synthesized
acttgaacaggagtgaggctcc

SEQ ID NO: 1275084 - DNA, 22 bp, Artificial Sequence
  chemically synthesized
cttgaacaggagtgaggctcca

SEQ ID NO: 1275085 - DNA, 22 bp, Artificial Sequence
  chemically synthesized
gaacaggagtgaggctccacca

SEQ ID NO: 1275086 - DNA, 22 bp, Artificial Sequence
  chemically synthesized
aacaggagtgaggctccaccaa

SEQ ID NO: 1275087 - DNA, 22 bp, Artificial Sequence
  chemically synthesized
gtcaaggggagcgtcttggtgg

SEQ ID NO: 1275088 - DNA, 22 bp, Artificial Sequence
  chemically synthesized
ggtcaaggggagcgtcttggtg

SEQ ID NO: 1275089 - DNA, 22 bp, Artificial Sequence
  chemically synthesized
aagtttggtcaaggggagcgtc

SEQ ID NO: 1275090 - DNA, 22 bp, Artificial Sequence
  chemically synthesized
gctaaagtttggtcaaggggag

SEQ ID NO: 1275091 - DNA, 22 bp, Artificial Sequence
  chemically synthesized
caccaagacgctccccttgacc

SEQ ID NO: 1275092 - DNA, 22 bp, Artificial Sequence
  chemically synthesized
agaggagcctagctaaagtttg

SEQ ID NO: 1275093 - DNA, 22 bp, Artificial Sequence
  chemically synthesized
cccttgaccaaactttagctag

SEQ ID NO: 1275094 - DNA, 22 bp, Artificial Sequence
  chemically synthesized
gaccaaactttagctaggctcc

SEQ ID NO: 1275095 - DNA, 22 bp, Artificial Sequence
  chemically synthesized
accaaactttagctaggctcct

SEQ ID NO: 1275096 - DNA, 22 bp, Artificial Sequence
  chemically synthesized
agaagagggctcagaggagcct

SEQ ID NO: 1275097 - DNA, 22 bp, Artificial Sequence
  chemically synthesized
gctgagaagagggctcagagga

SEQ ID NO: 1275098 - DNA, 22 bp, Artificial Sequence
  chemically synthesized
tagctaggctcctctgagccct

SEQ ID NO: 1275099 - DNA, 22 bp, Artificial Sequence
  chemically synthesized
agctaggctcctctgagccctc

SEQ ID NO: 1275100 - DNA, 22 bp, Artificial Sequence
  chemically synthesized
gctaggctcctctgagccctct

SEQ ID NO: 1275101 - DNA, 22 bp, Artificial Sequence
  chemically synthesized
tggcctagctgagaagagggct

SEQ ID NO: 1275102 - DNA, 22 bp, Artificial Sequence
  chemically synthesized
ggctcctctgagccctcttctc

SEQ ID NO: 1275103 - DNA, 22 bp, Artificial Sequence
  chemically synthesized
ctctgagccctcttctcagcta

SEQ ID NO: 1275104 - DNA, 22 bp, Artificial Sequence
  chemically synthesized
tgagccctcttctcagctaggc

SEQ ID NO: 1275105 - DNA, 22 bp, Artificial Sequence
  chemically synthesized
agccctcttctcagctaggcca

SEQ ID NO: 1275106 - DNA, 22 bp, Artificial Sequence
  chemically synthesized
tgcaggccaaggttatggccta

SEQ ID NO: 1275107 - DNA, 22 bp, Artificial Sequence
  chemically synthesized
ttctcagctaggccataacctt

SEQ ID NO: 1275108 - DNA, 22 bp, Artificial Sequence
  chemically synthesized
ctcagctaggccataaccttgg

SEQ ID NO: 1275109 - DNA, 22 bp, Artificial Sequence
  chemically synthesized
tcagctaggccataaccttggc

SEQ ID NO: 1275110 - DNA, 22 bp, Artificial Sequence
  chemically synthesized
aggtctgtgcaggccaaggtta

SEQ ID NO: 1275111 - DNA, 22 bp, Artificial Sequence
  chemically synthesized
agctaggccataaccttggcct

SEQ ID NO: 1275112 - DNA, 22 bp, Artificial Sequence
  chemically synthesized
ttcaggtctgtgcaggccaagg

SEQ ID NO: 1275113 - DNA, 22 bp, Artificial Sequence
  chemically synthesized
gttcaggtctgtgcaggccaag

SEQ ID NO: 1275114 - DNA, 22 bp, Artificial Sequence
  chemically synthesized
tgttcaggtctgtgcaggccaa

SEQ ID NO: 1275115 - DNA, 22 bp, Artificial Sequence
  chemically synthesized
ttgttcaggtctgtgcaggcca

SEQ ID NO: 1275116 - DNA, 22 bp, Artificial Sequence
  chemically synthesized
ggccataaccttggcctgcaca

SEQ ID NO: 1275117 - DNA, 22 bp, Artificial Sequence
  chemically synthesized
tttgttcaggtctgtgcaggcc

SEQ ID NO: 1275118 - DNA, 22 bp, Artificial Sequence
  chemically synthesized
gtgttttttgttcaggtctgtg

SEQ ID NO: 1275119 - DNA, 22 bp, Artificial Sequence
  chemically synthesized
tgttagtgttttttgttcaggt

SEQ ID NO: 1275120 - DNA, 22 bp, Artificial Sequence
  chemically synthesized
ggcctgcacagacctgaacaaa

SEQ ID NO: 1275121 - DNA, 22 bp, Artificial Sequence
  chemically synthesized
gcctgcacagacctgaacaaaa

SEQ ID NO: 1275122 - DNA, 22 bp, Artificial Sequence
  chemically synthesized
cacagacctgaacaaaaaacac

SEQ ID NO: 1275123 - DNA, 22 bp, Artificial Sequence
  chemically synthesized
gaagctatgttagtgttttttg

SEQ ID NO: 1275124 - DNA, 22 bp, Artificial Sequence
  chemically synthesized
ttagaagctatgttagtgtttt

SEQ ID NO: 1275125 - DNA, 22 bp, Artificial Sequence
  chemically synthesized
acctgttagaagctatgttagt

SEQ ID NO: 1275126 - DNA, 22 bp, Artificial Sequence
  chemically synthesized
gacctgttagaagctatgttag

SEQ ID NO: 1275127 - DNA, 22 bp, Artificial Sequence
  chemically synthesized
aacaaaaaacactaacatagct

SEQ ID NO: 1275128 - DNA, 22 bp, Artificial Sequence
  chemically synthesized
tgacctgttagaagctatgtta

SEQ ID NO: 1275129 - DNA, 22 bp, Artificial Sequence
  chemically synthesized
gagaggtggctttgacctgtta

SEQ ID NO: 1275130 - DNA, 22 bp, Artificial Sequence
  chemically synthesized
acatagcttctaacaggtcaaa

SEQ ID NO: 1275131 - DNA, 22 bp, Artificial Sequence
  chemically synthesized
tcctagagaggtggctttgacc

SEQ ID NO: 1275132 - DNA, 22 bp, Artificial Sequence
  chemically synthesized
ctaacaggtcaaagccacctct

SEQ ID NO: 1275133 - DNA, 22 bp, Artificial Sequence
  chemically synthesized
gagttatcctagagaggtggct

SEQ ID NO: 1275134 - DNA, 22 bp, Artificial Sequence
  chemically synthesized
taacaggtcaaagccacctctc

SEQ ID NO: 1275135 - DNA, 22 bp, Artificial Sequence
  chemically synthesized
acaggtcaaagccacctctcta

SEQ ID NO: 1275136 - DNA, 22 bp, Artificial Sequence
  chemically synthesized
agtggggctagagttatcctag

SEQ ID NO: 1275137 - DNA, 22 bp, Artificial Sequence
  chemically synthesized
aagtggggctagagttatccta

SEQ ID NO: 1275138 - DNA, 22 bp, Artificial Sequence
  chemically synthesized
tctaggataactctagccccac

SEQ ID NO: 1275139 - DNA, 22 bp, Artificial Sequence
  chemically synthesized
taggataactctagccccactt

SEQ ID NO: 1275140 - DNA, 22 bp, Artificial Sequence
  chemically synthesized
agaaatgcaccttaagtggggc

SEQ ID NO: 1275141 - DNA, 22 bp, Artificial Sequence
  chemically synthesized
ggataactctagccccacttaa

SEQ ID NO: 1275142 - DNA, 22 bp, Artificial Sequence
  chemically synthesized
tcagaaatgcaccttaagtggg

SEQ ID NO: 1275143 - DNA, 22 bp, Artificial Sequence
  chemically synthesized
ctcagaaatgcaccttaagtgg

SEQ ID NO: 1275144 - DNA, 22 bp, Artificial Sequence
  chemically synthesized
tctcagaaatgcaccttaagtg

SEQ ID NO: 1275145 - DNA, 22 bp, Artificial Sequence
  chemically synthesized
agttttctcagaaatgcacctt

SEQ ID NO: 1275146 - DNA, 22 bp, Artificial Sequence
  chemically synthesized
tagccccacttaaggtgcattt

SEQ ID NO: 1275147 - DNA, 22 bp, Artificial Sequence
  chemically synthesized
gagttttctcagaaatgcacct

SEQ ID NO: 1275148 - DNA, 22 bp, Artificial Sequence
  chemically synthesized
tgagttttctcagaaatgcacc

SEQ ID NO: 1275149 - DNA, 22 bp, Artificial Sequence
  chemically synthesized
gccccacttaaggtgcatttct

SEQ ID NO: 1275150 - DNA, 22 bp, Artificial Sequence
  chemically synthesized
gcagctttgagttttctcagaa

SEQ ID NO: 1275151 - DNA, 22 bp, Artificial Sequence
  chemically synthesized
ggcagctttgagttttctcaga

SEQ ID NO: 1275152 - DNA, 22 bp, Artificial Sequence
  chemically synthesized
tggcagctttgagttttctcag

SEQ ID NO: 1275153 - DNA, 22 bp, Artificial Sequence
  chemically synthesized
aaggtgcatttctgagaaaact

SEQ ID NO: 1275154 - DNA, 22 bp, Artificial Sequence
  chemically synthesized
aggtgcatttctgagaaaactc

SEQ ID NO: 1275155 - DNA, 22 bp, Artificial Sequence
  chemically synthesized
ttttggcagctttgagttttct

SEQ ID NO: 1275156 - DNA, 22 bp, Artificial Sequence
  chemically synthesized
ctgagaaaactcaaagctgcca

SEQ ID NO: 1275157 - DNA, 22 bp, Artificial Sequence
  chemically synthesized
tgagaaaactcaaagctgccaa

SEQ ID NO: 1275158 - DNA, 22 bp, Artificial Sequence
  chemically synthesized
agaaaactcaaagctgccaaaa

SEQ ID NO: 1275159 - DNA, 22 bp, Artificial Sequence
  chemically synthesized
gaacaaagggtaaattattttg

SEQ ID NO: 1275160 - DNA, 22 bp, Artificial Sequence
  chemically synthesized
aaagctgccaaaataatttacc

SEQ ID NO: 1275161 - DNA, 22 bp, Artificial Sequence
  chemically synthesized
actggaacaaagggtaaattat

SEQ ID NO: 1275162 - DNA, 22 bp, Artificial Sequence
  chemically synthesized
gactggaacaaagggtaaatta

SEQ ID NO: 1275163 - DNA, 22 bp, Artificial Sequence
  chemically synthesized
tgactggaacaaagggtaaatt

SEQ ID NO: 1275164 - DNA, 22 bp, Artificial Sequence
  chemically synthesized
ccaaaataatttaccctttgtt

SEQ ID NO: 1275165 - DNA, 22 bp, Artificial Sequence
  chemically synthesized
gggttttgactggaacaaaggg

SEQ ID NO: 1275166 - DNA, 22 bp, Artificial Sequence
  chemically synthesized
cgggttttgactggaacaaagg

SEQ ID NO: 1275167 - DNA, 22 bp, Artificial Sequence
  chemically synthesized
tcttcgggttttgactggaaca

SEQ ID NO: 1275168 - DNA, 22 bp, Artificial Sequence
  chemically synthesized
actgtcttcgggttttgactgg

SEQ ID NO: 1275169 - DNA, 22 bp, Artificial Sequence
  chemically synthesized
accctttgttccagtcaaaacc

SEQ ID NO: 1275170 - DNA, 22 bp, Artificial Sequence
  chemically synthesized
tcactgtcttcgggttttgact

SEQ ID NO: 1275171 - DNA, 22 bp, Artificial Sequence
  chemically synthesized
ccctttgttccagtcaaaaccc

SEQ ID NO: 1275172 - DNA, 22 bp, Artificial Sequence
  chemically synthesized
ctcactgtcttcgggttttgac

SEQ ID NO: 1275173 - DNA, 22 bp, Artificial Sequence
  chemically synthesized
ccttctcactgtcttcgggttt

SEQ ID NO: 1275174 - DNA, 22 bp, Artificial Sequence
  chemically synthesized
tgttccagtcaaaacccgaaga

SEQ ID NO: 1275175 - DNA, 22 bp, Artificial Sequence
  chemically synthesized
gttccagtcaaaacccgaagac

SEQ ID NO: 1275176 - DNA, 22 bp, Artificial Sequence
  chemically synthesized
ttccagtcaaaacccgaagaca

SEQ ID NO: 1275177 - DNA, 22 bp, Artificial Sequence
  chemically synthesized
ctgccttctcactgtcttcggg

SEQ ID NO: 1275178 - DNA, 22 bp, Artificial Sequence
  chemically synthesized
cagtcaaaacccgaagacagtg

SEQ ID NO: 1275179 - DNA, 22 bp, Artificial Sequence
  chemically synthesized
ggctcctgccttctcactgtct

SEQ ID NO: 1275180 - DNA, 22 bp, Artificial Sequence
  chemically synthesized
aggttaggctcctgccttctca

SEQ ID NO: 1275181 - DNA, 22 bp, Artificial Sequence
  chemically synthesized
aaggttaggctcctgccttctc

SEQ ID NO: 1275182 - DNA, 22 bp, Artificial Sequence
  chemically synthesized
aatggcacttaaggttaggctc

SEQ ID NO: 1275183 - DNA, 22 bp, Artificial Sequence
  chemically synthesized
ctaaatggcacttaaggttagg

SEQ ID NO: 1275184 - DNA, 22 bp, Artificial Sequence
  chemically synthesized
gctaaatggcacttaaggttag

SEQ ID NO: 1275185 - DNA, 22 bp, Artificial Sequence
  chemically synthesized
cgtttgctaaatggcacttaag

SEQ ID NO: 1275186 - DNA, 22 bp, Artificial Sequence
  chemically synthesized
tacgtttgctaaatggcactta

SEQ ID NO: 1275187 - DNA, 22 bp, Artificial Sequence
  chemically synthesized
accttaagtgccatttagcaaa

SEQ ID NO: 1275188 - DNA, 22 bp, Artificial Sequence
  chemically synthesized
ggaaacctctacgtttgctaaa

SEQ ID NO: 1275189 - DNA, 22 bp, Artificial Sequence
  chemically synthesized
aagtgccatttagcaaacgtag

SEQ ID NO: 1275190 - DNA, 22 bp, Artificial Sequence
  chemically synthesized
cctgggaaacctctacgtttgc

SEQ ID NO: 1275191 - DNA, 22 bp, Artificial Sequence
  chemically synthesized
agtgccatttagcaaacgtaga

SEQ ID NO: 1275192 - DNA, 22 bp, Artificial Sequence
  chemically synthesized
ttccctgggaaacctctacgtt

SEQ ID NO: 1275193 - DNA, 22 bp, Artificial Sequence
  chemically synthesized
agcaaacgtagaggtttcccag

SEQ ID NO: 1275194 - DNA, 22 bp, Artificial Sequence
  chemically synthesized
gcaaacgtagaggtttcccagg

SEQ ID NO: 1275195 - DNA, 22 bp, Artificial Sequence
  chemically synthesized
caaaaagtggaaaggtgggatt

SEQ ID NO: 1275196 - DNA, 22 bp, Artificial Sequence
  chemically synthesized
cccagggaacaatcccaccttt

SEQ ID NO: 1275197 - DNA, 22 bp, Artificial Sequence
  chemically synthesized
ccagggaacaatcccacctttc

SEQ ID NO: 1275198 - DNA, 22 bp, Artificial Sequence
  chemically synthesized
aagtcagggaagtaacaaatta

SEQ ID NO: 1275199 - DNA, 22 bp, Artificial Sequence
  chemically synthesized
tccactttttgtaatttgttac

SEQ ID NO: 1275200 - DNA, 22 bp, Artificial Sequence
  chemically synthesized
ccactttttgtaatttgttact

SEQ ID NO: 1275201 - DNA, 22 bp, Artificial Sequence
  chemically synthesized
cactttttgtaatttgttactt

SEQ ID NO: 1275202 - DNA, 22 bp, Artificial Sequence
  chemically synthesized
attaaagtcagggaagtaacaa

SEQ ID NO: 1275203 - DNA, 22 bp, Artificial Sequence
  chemically synthesized
tttgtaatttgttacttccctg

SEQ ID NO: 1275204 - DNA, 22 bp, Artificial Sequence
  chemically synthesized
ttgtaatttgttacttccctga

SEQ ID NO: 1275205 - DNA, 22 bp, Artificial Sequence
  chemically synthesized
tgtaatttgttacttccctgac

SEQ ID NO: 1275206 - DNA, 22 bp, Artificial Sequence
  chemically synthesized
gtaatttgttacttccctgact

SEQ ID NO: 1275207 - DNA, 22 bp, Artificial Sequence
  chemically synthesized
taatttgttacttccctgactt

SEQ ID NO: 1275208 - DNA, 22 bp, Artificial Sequence
  chemically synthesized
agtggtggctcattaaagtcag

SEQ ID NO: 1275209 - DNA, 22 bp, Artificial Sequence
  chemically synthesized
gagtggtggctcattaaagtca

SEQ ID NO: 1275210 - DNA, 22 bp, Artificial Sequence
  chemically synthesized
gttacttccctgactttaatga

SEQ ID NO: 1275211 - DNA, 22 bp, Artificial Sequence
  chemically synthesized
ttacttccctgactttaatgag

SEQ ID NO: 1275212 - DNA, 22 bp, Artificial Sequence
  chemically synthesized
cttccctgactttaatgagcca

SEQ ID NO: 1275213 - DNA, 22 bp, Artificial Sequence
  chemically synthesized
ccctgactttaatgagccacca

SEQ ID NO: 1275214 - DNA, 22 bp, Artificial Sequence
  chemically synthesized
cctgactttaatgagccaccac

SEQ ID NO: 1275215 - DNA, 22 bp, Artificial Sequence
  chemically synthesized
actttaatgagccaccactcaa

SEQ ID NO: 1275216 - DNA, 22 bp, Artificial Sequence
  chemically synthesized
taatgagccaccactcaaactc

SEQ ID NO: 1275217 - DNA, 22 bp, Artificial Sequence
  chemically synthesized
aatgagccaccactcaaactca

SEQ ID NO: 1275218 - DNA, 22 bp, Artificial Sequence
  chemically synthesized
atgagccaccactcaaactcat

SEQ ID NO: 1275219 - DNA, 22 bp, Artificial Sequence
  chemically synthesized
aagggagaatgagagaatgagt

SEQ ID NO: 1275220 - DNA, 22 bp, Artificial Sequence
  chemically synthesized
aaagggagaatgagagaatgag

SEQ ID NO: 1275221 - DNA, 22 bp, Artificial Sequence
  chemically synthesized
taaagggagaatgagagaatga

SEQ ID NO: 1275222 - DNA, 22 bp, Artificial Sequence
  chemically synthesized
ggagttttaaagggagaatgag

SEQ ID NO: 1275223 - DNA, 22 bp, Artificial Sequence
  chemically synthesized
aaactcattctctcattctccc

SEQ ID NO: 1275224 - DNA, 22 bp, Artificial Sequence
  chemically synthesized
attctctcattctccctttaaa

SEQ ID NO: 1275225 - DNA, 22 bp, Artificial Sequence
  chemically synthesized
tctcattctccctttaaaactc

SEQ ID NO: 1275226 - DNA, 22 bp, Artificial Sequence
  chemically synthesized
tcattctccctttaaaactccc

SEQ ID NO: 1275227 - DNA, 22 bp, Artificial Sequence
  chemically synthesized
tgtagaggtgactgggagtttt

SEQ ID NO: 1275228 - DNA, 22 bp, Artificial Sequence
  chemically synthesized
attctccctttaaaactcccag

SEQ ID NO: 1275229 - DNA, 22 bp, Artificial Sequence
  chemically synthesized
gtgtagaggtgactgggagttt

SEQ ID NO: 1275230 - DNA, 22 bp, Artificial Sequence
  chemically synthesized
tccctttaaaactcccagtcac

SEQ ID NO: 1275231 - DNA, 22 bp, Artificial Sequence
  chemically synthesized
atttgtgtagaggtgactggga

SEQ ID NO: 1275232 - DNA, 22 bp, Artificial Sequence
  chemically synthesized
gatttgtgtagaggtgactggg

SEQ ID NO: 1275233 - DNA, 22 bp, Artificial Sequence
  chemically synthesized
cctttaaaactcccagtcacct

SEQ ID NO: 1275234 - DNA, 22 bp, Artificial Sequence
  chemically synthesized
tgatttgtgtagaggtgactgg

SEQ ID NO: 1275235 - DNA, 22 bp, Artificial Sequence
  chemically synthesized
taaaactcccagtcacctctac

SEQ ID NO: 1275236 - DNA, 22 bp, Artificial Sequence
  chemically synthesized
aaaactcccagtcacctctaca

SEQ ID NO: 1275237 - DNA, 22 bp, Artificial Sequence
  chemically synthesized
aactttgatttgtgtagaggtg

SEQ ID NO: 1275238 - DNA, 22 bp, Artificial Sequence
  chemically synthesized
aaactcccagtcacctctacac

SEQ ID NO: 1275239 - DNA, 22 bp, Artificial Sequence
  chemically synthesized
aactgaactttgatttgtgtag

SEQ ID NO: 1275240 - DNA, 22 bp, Artificial Sequence
  chemically synthesized
ccagtcacctctacacaaatca

SEQ ID NO: 1275241 - DNA, 22 bp, Artificial Sequence
  chemically synthesized
agcatgaactgaactgaacttt

SEQ ID NO: 1275242 - DNA, 22 bp, Artificial Sequence
  chemically synthesized
tacacaaatcaaagttcagttc

SEQ ID NO: 1275243 - DNA, 22 bp, Artificial Sequence
  chemically synthesized
cacaaatcaaagttcagttcag

SEQ ID NO: 1275244 - DNA, 22 bp, Artificial Sequence
  chemically synthesized
taatagagaagagttcagcatg

SEQ ID NO: 1275245 - DNA, 22 bp, Artificial Sequence
  chemically synthesized
agttcagttcatgctgaactct

SEQ ID NO: 1275246 - DNA, 22 bp, Artificial Sequence
  chemically synthesized
ttataatagagaagagttcagc

SEQ ID NO: 1275247 - DNA, 22 bp, Artificial Sequence
  chemically synthesized
agttcatgctgaactcttctct

SEQ ID NO: 1275248 - DNA, 22 bp, Artificial Sequence
  chemically synthesized
atgctgaactcttctctattat

SEQ ID NO: 1275249 - DNA, 22 bp, Artificial Sequence
  chemically synthesized
atcagtaatacactattataat

SEQ ID NO: 1275250 - DNA, 22 bp, Artificial Sequence
  chemically synthesized
aactcttctctattataatagt

SEQ ID NO: 1275251 - DNA, 22 bp, Artificial Sequence
  chemically synthesized
aatcagtaatacactattataa

SEQ ID NO: 1275252 - DNA, 22 bp, Artificial Sequence
  chemically synthesized
taatcagtaatacactattata

SEQ ID NO: 1275253 - DNA, 22 bp, Artificial Sequence
  chemically synthesized
ttctctattataatagtgtatt

SEQ ID NO: 1275254 - DNA, 22 bp, Artificial Sequence
  chemically synthesized
ctctattataatagtgtattac

SEQ ID NO: 1275255 - DNA, 22 bp, Artificial Sequence
  chemically synthesized
tctattataatagtgtattact

SEQ ID NO: 1275256 - DNA, 22 bp, Artificial Sequence
  chemically synthesized
tattataatagtgtattactga

SEQ ID NO: 1275257 - DNA, 22 bp, Artificial Sequence
  chemically synthesized
ttataatagtgtattactgatt

SEQ ID NO: 1275258 - DNA, 22 bp, Artificial Sequence
  chemically synthesized
taatagtgtattactgattaaa

SEQ ID NO: 1275259 - DNA, 22 bp, Artificial Sequence
  chemically synthesized
gtaaggggagattttaatcagt

SEQ ID NO: 1275260 - DNA, 22 bp, Artificial Sequence
  chemically synthesized
attagtaaggggagattttaat

SEQ ID NO: 1275261 - DNA, 22 bp, Artificial Sequence
  chemically synthesized
aattagtaaggggagattttaa

SEQ ID NO: 1275262 - DNA, 22 bp, Artificial Sequence
  chemically synthesized
ctgattaaaatctccccttact

SEQ ID NO: 1275263 - DNA, 22 bp, Artificial Sequence
  chemically synthesized
attaaaatctccccttactaat

SEQ ID NO: 1275264 - DNA, 22 bp, Artificial Sequence
  chemically synthesized
aaatctccccttactaattaaa

SEQ ID NO: 1275265 - DNA, 22 bp, Artificial Sequence
  chemically synthesized
cccttactaattaaactgacgt

SEQ ID NO: 1275266 - DNA, 22 bp, Artificial Sequence
  chemically synthesized
actaattaaactgacgtccact

SEQ ID NO: 1275267 - DNA, 22 bp, Artificial Sequence
  chemically synthesized
ctaattaaactgacgtccactt

SEQ ID NO: 1275268 - DNA, 22 bp, Artificial Sequence
  chemically synthesized
attaaactgacgtccacttttg

SEQ ID NO: 1275269 - DNA, 22 bp, Artificial Sequence
  chemically synthesized
tccaaagataagcaaaagtgga

SEQ ID NO: 1275270 - DNA, 22 bp, Artificial Sequence
  chemically synthesized
aactgacgtccacttttgctta

SEQ ID NO: 1275271 - DNA, 22 bp, Artificial Sequence
  chemically synthesized
acgtccacttttgcttatcttt

SEQ ID NO: 1275272 - DNA, 22 bp, Artificial Sequence
  chemically synthesized
aataaccagttatccaaagata

SEQ ID NO: 1275273 - DNA, 22 bp, Artificial Sequence
  chemically synthesized
ttgcttatctttggataactgg

SEQ ID NO: 1275274 - DNA, 22 bp, Artificial Sequence
  chemically synthesized
tgcttatctttggataactggt

SEQ ID NO: 1275275 - DNA, 22 bp, Artificial Sequence
  chemically synthesized
gcttatctttggataactggtt

SEQ ID NO: 1275276 - DNA, 22 bp, Artificial Sequence
  chemically synthesized
aaccaactaaataaccagttat

SEQ ID NO: 1275277 - DNA, 22 bp, Artificial Sequence
  chemically synthesized
cttatctttggataactggtta

SEQ ID NO: 1275278 - DNA, 22 bp, Artificial Sequence
  chemically synthesized
atctttggataactggttattt

SEQ ID NO: 1275279 - DNA, 22 bp, Artificial Sequence
  chemically synthesized
tctttggataactggttattta

SEQ ID NO: 1275280 - DNA, 22 bp, Artificial Sequence
  chemically synthesized
aaactaaaccaactaaataacc

SEQ ID NO: 1275281 - DNA, 22 bp, Artificial Sequence
  chemically synthesized
tggataactggttatttagttg

SEQ ID NO: 1275282 - DNA, 22 bp, Artificial Sequence
  chemically synthesized
ggataactggttatttagttgg

SEQ ID NO: 1275283 - DNA, 22 bp, Artificial Sequence
  chemically synthesized
gataactggttatttagttggt

SEQ ID NO: 1275284 - DNA, 22 bp, Artificial Sequence
  chemically synthesized
acaaactgaaactaaaccaact

SEQ ID NO: 1275285 - DNA, 22 bp, Artificial Sequence
  chemically synthesized
gttatttagttggtttagtttc

SEQ ID NO: 1275286 - DNA, 22 bp, Artificial Sequence
  chemically synthesized
tttagttggtttagtttcagtt

SEQ ID NO: 1275287 - DNA, 22 bp, Artificial Sequence
  chemically synthesized
agttggtttagtttcagtttgt

SEQ ID NO: 1275288 - DNA, 22 bp, Artificial Sequence
  chemically synthesized
gttggtttagtttcagtttgtg

SEQ ID NO: 1275289 - DNA, 22 bp, Artificial Sequence
  chemically synthesized
agaccacatgacattcacaaac

SEQ ID NO: 1275290 - DNA, 22 bp, Artificial Sequence
  chemically synthesized
gtttagtttcagtttgtgaatg

SEQ ID NO: 1275291 - DNA, 22 bp, Artificial Sequence
  chemically synthesized
gagaccacatgacattcacaaa

SEQ ID NO: 1275292 - DNA, 22 bp, Artificial Sequence
  chemically synthesized
tgagaccacatgacattcacaa

SEQ ID NO: 1275293 - DNA, 22 bp, Artificial Sequence
  chemically synthesized
ttgagaccacatgacattcaca

SEQ ID NO: 1275294 - DNA, 22 bp, Artificial Sequence
  chemically synthesized
agtttcagtttgtgaatgtcat

SEQ ID NO: 1275295 - DNA, 22 bp, Artificial Sequence
  chemically synthesized
gtttcagtttgtgaatgtcatg

SEQ ID NO: 1275296 - DNA, 22 bp, Artificial Sequence
  chemically synthesized
cagtttgtgaatgtcatgtggt

SEQ ID NO: 1275297 - DNA, 22 bp, Artificial Sequence
  chemically synthesized
agtttgtgaatgtcatgtggtc

SEQ ID NO: 1275298 - DNA, 22 bp, Artificial Sequence
  chemically synthesized
gtgaatgtcatgtggtctcaaa

SEQ ID NO: 1275299 - DNA, 22 bp, Artificial Sequence
  chemically synthesized
tgaatgtcatgtggtctcaaaa

SEQ ID NO: 1275300 - DNA, 22 bp, Artificial Sequence
  chemically synthesized
tatgatgtgaccttttgagacc

SEQ ID NO: 1275301 - DNA, 22 bp, Artificial Sequence
  chemically synthesized
tctatatgatgtgaccttttga

SEQ ID NO: 1275302 - DNA, 22 bp, Artificial Sequence
  chemically synthesized
atctatatgatgtgaccttttg

SEQ ID NO: 1275303 - DNA, 22 bp, Artificial Sequence
  chemically synthesized
tatctatatgatgtgacctttt

SEQ ID NO: 1275304 - DNA, 22 bp, Artificial Sequence
  chemically synthesized
aaaaggtcacatcatatagata

SEQ ID NO: 1275305 - DNA, 22 bp, Artificial Sequence
  chemically synthesized
gcgtgcacggttttatctatat

SEQ ID NO: 1275306 - DNA, 22 bp, Artificial Sequence
  chemically synthesized
atgttggcgtgcacggttttat

SEQ ID NO: 1275307 - DNA, 22 bp, Artificial Sequence
  chemically synthesized
attgatgttggcgtgcacggtt

SEQ ID NO: 1275308 - DNA, 22 bp, Artificial Sequence
  chemically synthesized
acatgttcattgatgttggcgt

SEQ ID NO: 1275309 - DNA, 22 bp, Artificial Sequence
  chemically synthesized
cacatgttcattgatgttggcg

SEQ ID NO: 1275310 - DNA, 22 bp, Artificial Sequence
  chemically synthesized
ttcacatgttcattgatgttgg

SEQ ID NO: 1275311 - DNA, 22 bp, Artificial Sequence
  chemically synthesized
cttcacatgttcattgatgttg

SEQ ID NO: 1275312 - DNA, 22 bp, Artificial Sequence
  chemically synthesized
ccttcttcacatgttcattgat

SEQ ID NO: 1275313 - DNA, 22 bp, Artificial Sequence
  chemically synthesized
accttcttcacatgttcattga

SEQ ID NO: 1275314 - DNA, 22 bp, Artificial Sequence
  chemically synthesized
caaatggtgcaataaaataatc

SEQ ID NO: 1275315 - DNA, 22 bp, Artificial Sequence
  chemically synthesized
acaaatggtgcaataaaataat

SEQ ID NO: 1275316 - DNA, 22 bp, Artificial Sequence
  chemically synthesized
tacaaatggtgcaataaaataa

SEQ ID NO: 1275317 - DNA, 22 bp, Artificial Sequence
  chemically synthesized
ttacaaatggtgcaataaaata

SEQ ID NO: 1275318 - DNA, 22 bp, Artificial Sequence
  chemically synthesized
tttacaaatggtgcaataaaat

SEQ ID NO: 1275319 - DNA, 22 bp, Artificial Sequence
  chemically synthesized
ttttacaaatggtgcaataaaa

SEQ ID NO: 1275320 - DNA, 22 bp, Artificial Sequence
  chemically synthesized
tttttacaaatggtgcaataaa

SEQ ID NO: 1275321 - DNA, 22 bp, Artificial Sequence
  chemically synthesized
ttttttacaaatggtgcaataa

SEQ ID NO: 1275322 - DNA, 22 bp, Artificial Sequence
  chemically synthesized
tttttttacaaatggtgcaata

SEQ ID NO: 1275323 - DNA, 22 bp, Artificial Sequence
  chemically synthesized
ttttttttacaaatggtgcaat

SEQ ID NO: 1275324 - DNA, 22 bp, Artificial Sequence
  chemically synthesized
tttttttttacaaatggtgcaa

SEQ ID NO: 1275325 - DNA, 22 bp, Artificial Sequence
  chemically synthesized
ttttttttttacaaatggtgca

SEQ ID NO: 1275326 - DNA, 22 bp, Artificial Sequence
  chemically synthesized
tttttttttttacaaatggtgc

SEQ ID NO: 1275327 - DNA, 22 bp, Artificial Sequence
  chemically synthesized
ttttttttttttacaaatggtg

SEQ ID NO: 1275328 - DNA, 22 bp, Artificial Sequence
  chemically synthesized
tttttttttttttacaaatggt

SEQ ID NO: 1275329 - DNA, 22 bp, Artificial Sequence
  chemically synthesized
ttttttttttttttacaaatgg

SEQ ID NO: 1275330 - DNA, 22 bp, Artificial Sequence
  chemically synthesized
tttttttttttttttacaaatg

SEQ ID NO: 1275331 - DNA, 22 bp, Artificial Sequence
  chemically synthesized
ttttattgcaccatttgtaaaa

SEQ ID NO: 1275332 - DNA, 22 bp, Artificial Sequence
  chemically synthesized
ttttttttttttttttacaaat

SEQ ID NO: 1275333 - DNA, 22 bp, Artificial Sequence
  chemically synthesized
tttttttttttttttttacaaa

SEQ ID NO: 1275334 - DNA, 22 bp, Artificial Sequence
  chemically synthesized
ttttttttttttttttttacaa

SEQ ID NO: 1275335 - DNA, 22 bp, Artificial Sequence
  chemically synthesized
tattgcaccatttgtaaaaaaa

SEQ ID NO: 1275336 - DNA, 22 bp, Artificial Sequence
  chemically synthesized
tttttttttttttttttttaca

SEQ ID NO: 1275337 - DNA, 22 bp, Artificial Sequence
  chemically synthesized
attgcaccatttgtaaaaaaaa

SEQ ID NO: 1275338 - DNA, 22 bp, Artificial Sequence
  chemically synthesized
ttttttttttttttttttttac

SEQ ID NO: 1275339 - DNA, 22 bp, Artificial Sequence
  chemically synthesized
ttgcaccatttgtaaaaaaaaa

SEQ ID NO: 1275340 - DNA, 22 bp, Artificial Sequence
  chemically synthesized
caccatttgtaaaaaaaaaaaa

SEQ ID NO: 1275341 - DNA, 22 bp, Artificial Sequence
  chemically synthesized
accttttttttttttttttttt

SEQ ID NO: 1275342 - DNA, 22 bp, Artificial Sequence
  chemically synthesized
aattgacctttttttttttttt

SEQ ID NO: 1275343 - DNA, 22 bp, Artificial Sequence
  chemically synthesized
aaattgaccttttttttttttt

SEQ ID NO: 1275344 - DNA, 22 bp, Artificial Sequence
  chemically synthesized
gtaaaaaaaaaaaaaaaaaaaa

SEQ ID NO: 1275345 - DNA, 22 bp, Artificial Sequence
  chemically synthesized
taaaaaaaaaaaaaaaaaaaaa

SEQ ID NO: 1275346 - DNA, 22 bp, Artificial Sequence
  chemically synthesized
gtttaaattgaccttttttttt

SEQ ID NO: 1275347 - DNA, 22 bp, Artificial Sequence
  chemically synthesized
cgtttaaattgacctttttttt

SEQ ID NO: 1275348 - DNA, 22 bp, Artificial Sequence
  chemically synthesized
aatgtaatcatgcagtacttcg

SEQ ID NO: 1275349 - DNA, 22 bp, Artificial Sequence
  chemically synthesized
aaacgaagtactgcatgattac

SEQ ID NO: 1275350 - DNA, 22 bp, Artificial Sequence
  chemically synthesized
aacgaagtactgcatgattaca

SEQ ID NO: 1275351 - DNA, 22 bp, Artificial Sequence
  chemically synthesized
aacaaatacgtaaatacgttca

SEQ ID NO: 1275352 - DNA, 22 bp, Artificial Sequence
  chemically synthesized
catgattacattgaacgtattt

SEQ ID NO: 1275353 - DNA, 22 bp, Artificial Sequence
  chemically synthesized
ttcaacaaatacgtaaatacgt

SEQ ID NO: 1275354 - DNA, 22 bp, Artificial Sequence
  chemically synthesized
cattgaacgtatttacgtattt

SEQ ID NO: 1275355 - DNA, 22 bp, Artificial Sequence
  chemically synthesized
aacgtatttacgtatttgttga

SEQ ID NO: 1275356 - DNA, 22 bp, Artificial Sequence
  chemically synthesized
caagggaaaaatactattcaac

SEQ ID NO: 1275357 - DNA, 22 bp, Artificial Sequence
  chemically synthesized
acaagggaaaaatactattcaa

SEQ ID NO: 1275358 - DNA, 22 bp, Artificial Sequence
  chemically synthesized
tacaagggaaaaatactattca

SEQ ID NO: 1275359 - DNA, 22 bp, Artificial Sequence
  chemically synthesized
acgtatttgttgaatagtattt

SEQ ID NO: 1275360 - DNA, 22 bp, Artificial Sequence
  chemically synthesized
cgtatttgttgaatagtatttt

SEQ ID NO: 1275361 - DNA, 22 bp, Artificial Sequence
  chemically synthesized
gttgaatagtatttttcccttg

SEQ ID NO: 1275362 - DNA, 22 bp, Artificial Sequence
  chemically synthesized
ttgaatagtatttttcccttgt

SEQ ID NO: 1275363 - DNA, 22 bp, Artificial Sequence
  chemically synthesized
acatatacaattttacaaggga

SEQ ID NO: 1275364 - DNA, 22 bp, Artificial Sequence
  chemically synthesized
aatagtatttttcccttgtaaa

SEQ ID NO: 1275365 - DNA, 22 bp, Artificial Sequence
  chemically synthesized
tataattaacatatacaatttt

SEQ ID NO: 1275366 - DNA, 22 bp, Artificial Sequence
  chemically synthesized
gtataattaacatatacaattt

SEQ ID NO: 1275367 - DNA, 22 bp, Artificial Sequence
  chemically synthesized
ttcccttgtaaaattgtatatg

SEQ ID NO: 1275368 - DNA, 22 bp, Artificial Sequence
  chemically synthesized
tcccttgtaaaattgtatatgt

SEQ ID NO: 1275369 - DNA, 22 bp, Artificial Sequence
  chemically synthesized
cccttgtaaaattgtatatgtt

SEQ ID NO: 1275370 - DNA, 22 bp, Artificial Sequence
  chemically synthesized
ccttgtaaaattgtatatgtta

SEQ ID NO: 1275371 - DNA, 22 bp, Artificial Sequence
  chemically synthesized
caacatttgtataattaacata

SEQ ID NO: 1275372 - DNA, 22 bp, Artificial Sequence
  chemically synthesized
gtaaaattgtatatgttaatta

SEQ ID NO: 1275373 - DNA, 22 bp, Artificial Sequence
  chemically synthesized
taaaattgtatatgttaattat

SEQ ID NO: 1275374 - DNA, 22 bp, Artificial Sequence
  chemically synthesized
tagattccaacatttgtataat

SEQ ID NO: 1275375 - DNA, 22 bp, Artificial Sequence
  chemically synthesized
tatatgttaattatacaaatgt

SEQ ID NO: 1275376 - DNA, 22 bp, Artificial Sequence
  chemically synthesized
catggtctgtagattccaacat

SEQ ID NO: 1275377 - DNA, 22 bp, Artificial Sequence
  chemically synthesized
ccatggtctgtagattccaaca

SEQ ID NO: 1275378 - DNA, 22 bp, Artificial Sequence
  chemically synthesized
attatacaaatgttggaatcta

SEQ ID NO: 1275379 - DNA, 22 bp, Artificial Sequence
  chemically synthesized
tgcttccatggtctgtagattc

SEQ ID NO: 1275380 - DNA, 22 bp, Artificial Sequence
  chemically synthesized
tacaaatgttggaatctacaga

SEQ ID NO: 1275381 - DNA, 22 bp, Artificial Sequence
  chemically synthesized
atgcttccatggtctgtagatt

SEQ ID NO: 1275382 - DNA, 22 bp, Artificial Sequence
  chemically synthesized
tatgcttccatggtctgtagat

SEQ ID NO: 1275383 - DNA, 22 bp, Artificial Sequence
  chemically synthesized
gaatctacagaccatggaagca

SEQ ID NO: 1275384 - DNA, 22 bp, Artificial Sequence
  chemically synthesized
cagaccatggaagcataaaata

SEQ ID NO: 1275385 - DNA, 22 bp, Artificial Sequence
  chemically synthesized
agaatgggaggcaatatatatt

SEQ ID NO: 1275386 - DNA, 22 bp, Artificial Sequence
  chemically synthesized
tcagaatgggaggcaatatata

SEQ ID NO: 1275387 - DNA, 22 bp, Artificial Sequence
  chemically synthesized
ctcagaatgggaggcaatatat

SEQ ID NO: 1275388 - DNA, 22 bp, Artificial Sequence
  chemically synthesized
tctcagaatgggaggcaatata

SEQ ID NO: 1275389 - DNA, 22 bp, Artificial Sequence
  chemically synthesized
aataggattttctcagaatggg

SEQ ID NO: 1275390 - DNA, 22 bp, Artificial Sequence
  chemically synthesized
caataggattttctcagaatgg

SEQ ID NO: 1275391 - DNA, 22 bp, Artificial Sequence
  chemically synthesized
tcaataggattttctcagaatg

SEQ ID NO: 1275392 - DNA, 22 bp, Artificial Sequence
  chemically synthesized
tctttcaataggattttctcag

SEQ ID NO: 1275393 - DNA, 22 bp, Artificial Sequence
  chemically synthesized
atctttcaataggattttctca

SEQ ID NO: 1275394 - DNA, 22 bp, Artificial Sequence
  chemically synthesized
cctcccattctgagaaaatcct

SEQ ID NO: 1275395 - DNA, 22 bp, Artificial Sequence
  chemically synthesized
ccattctgagaaaatcctattg

SEQ ID NO: 1275396 - DNA, 22 bp, Artificial Sequence
  chemically synthesized
tgagaaaatcctattgaaagat

SEQ ID NO: 1275397 - DNA, 22 bp, Artificial Sequence
  chemically synthesized
agaaaatcctattgaaagataa

SEQ ID NO: 1275398 - DNA, 22 bp, Artificial Sequence
  chemically synthesized
tgatgacataacttatctttca

SEQ ID NO: 1275399 - DNA, 22 bp, Artificial Sequence
  chemically synthesized
ttgaaagataagttatgtcatc

SEQ ID NO: 1275400 - DNA, 22 bp, Artificial Sequence
  chemically synthesized
aaagataagttatgtcatcaca

SEQ ID NO: 1275401 - DNA, 22 bp, Artificial Sequence
  chemically synthesized
tgtcatcacagtttttctgttt

SEQ ID NO: 1275402 - DNA, 22 bp, Artificial Sequence
  chemically synthesized
ttctgtttttgtttcgttttgg

SEQ ID NO: 1275403 - DNA, 22 bp, Artificial Sequence
  chemically synthesized
tctgtttttgtttcgttttggt

SEQ ID NO: 1275404 - DNA, 22 bp, Artificial Sequence
  chemically synthesized
ctgtttttgtttcgttttggta

SEQ ID NO: 1275405 - DNA, 22 bp, Artificial Sequence
  chemically synthesized
tgtttttgtttcgttttggtat

SEQ ID NO: 1275406 - DNA, 22 bp, Artificial Sequence
  chemically synthesized
tttttgtttcgttttggtatgg

SEQ ID NO: 1275407 - DNA, 22 bp, Artificial Sequence
  chemically synthesized
ttgtttcgttttggtatggctt

SEQ ID NO: 1275408 - DNA, 22 bp, Artificial Sequence
  chemically synthesized
tgtttcgttttggtatggcttg

SEQ ID NO: 1275409 - DNA, 22 bp, Artificial Sequence
  chemically synthesized
gtttcgttttggtatggcttgg

SEQ ID NO: 1275410 - DNA, 22 bp, Artificial Sequence
  chemically synthesized
tttcgttttggtatggcttggt

SEQ ID NO: 1275411 - DNA, 22 bp, Artificial Sequence
  chemically synthesized
cgttttggtatggcttggtttc

SEQ ID NO: 1275412 - DNA, 22 bp, Artificial Sequence
  chemically synthesized
gttttggtatggcttggtttct

SEQ ID NO: 1275413 - DNA, 22 bp, Artificial Sequence
  chemically synthesized
tggtatggcttggtttctggct

SEQ ID NO: 1275414 - DNA, 22 bp, Artificial Sequence
  chemically synthesized
ggtatggcttggtttctggctt

SEQ ID NO: 1275415 - DNA, 22 bp, Artificial Sequence
  chemically synthesized
gtatggcttggtttctggcttt

SEQ ID NO: 1275416 - DNA, 22 bp, Artificial Sequence
  chemically synthesized
ggtttctggcttttgttgttat

SEQ ID NO: 1275417 - DNA, 22 bp, Artificial Sequence
  chemically synthesized
gtttctggcttttgttgttatt

SEQ ID NO: 1275418 - DNA, 22 bp, Artificial Sequence
  chemically synthesized
tatagacaaaataataacaaca

SEQ ID NO: 1275419 - DNA, 22 bp, Artificial Sequence
  chemically synthesized
ctggcttttgttgttattattt

SEQ ID NO: 1275420 - DNA, 22 bp, Artificial Sequence
  chemically synthesized
cctatatagacaaaataataac

SEQ ID NO: 1275421 - DNA, 22 bp, Artificial Sequence
  chemically synthesized
tggcttttgttgttattatttt

SEQ ID NO: 1275422 - DNA, 22 bp, Artificial Sequence
  chemically synthesized
gcctatatagacaaaataataa

SEQ ID NO: 1275423 - DNA, 22 bp, Artificial Sequence
  chemically synthesized
gcttttgttgttattattttgt

SEQ ID NO: 1275424 - DNA, 22 bp, Artificial Sequence
  chemically synthesized
ttgttgttattattttgtctat

SEQ ID NO: 1275425 - DNA, 22 bp, Artificial Sequence
  chemically synthesized
tgttgttattattttgtctata

SEQ ID NO: 1275426 - DNA, 22 bp, Artificial Sequence
  chemically synthesized
gttgttattattttgtctatat

SEQ ID NO: 1275427 - DNA, 22 bp, Artificial Sequence
  chemically synthesized
ttgttattattttgtctatata

SEQ ID NO: 1275428 - DNA, 22 bp, Artificial Sequence
  chemically synthesized
ttattattttgtctatataggc

SEQ ID NO: 1275429 - DNA, 22 bp, Artificial Sequence
  chemically synthesized
ttattttgtctatataggcaag

SEQ ID NO: 1275430 - DNA, 22 bp, Artificial Sequence
  chemically synthesized
ttttgtctatataggcaagtat

SEQ ID NO: 1275431 - DNA, 22 bp, Artificial Sequence
  chemically synthesized
tgtctatataggcaagtattca

SEQ ID NO: 1275432 - DNA, 22 bp, Artificial Sequence
  chemically synthesized
gtctatataggcaagtattcat

SEQ ID NO: 1275433 - DNA, 22 bp, Artificial Sequence
  chemically synthesized
tctatataggcaagtattcatt

SEQ ID NO: 1275434 - DNA, 22 bp, Artificial Sequence
  chemically synthesized
atgcaggaaataaatgaatact

SEQ ID NO: 1275435 - DNA, 22 bp, Artificial Sequence
  chemically synthesized
tataggcaagtattcatttatt

SEQ ID NO: 1275436 - DNA, 22 bp, Artificial Sequence
  chemically synthesized
actaatgcaggaaataaatgaa

SEQ ID NO: 1275437 - DNA, 22 bp, Artificial Sequence
  chemically synthesized
gactaatgcaggaaataaatga

SEQ ID NO: 1275438 - DNA, 22 bp, Artificial Sequence
  chemically synthesized
gagacccttgactaatgcagga

SEQ ID NO: 1275439 - DNA, 22 bp, Artificial Sequence
  chemically synthesized
agagacccttgactaatgcagg

SEQ ID NO: 1275440 - DNA, 22 bp, Artificial Sequence
  chemically synthesized
cttagagacccttgactaatgc

SEQ ID NO: 1275441 - DNA, 22 bp, Artificial Sequence
  chemically synthesized
atttatttcctgcattagtcaa

SEQ ID NO: 1275442 - DNA, 22 bp, Artificial Sequence
  chemically synthesized
ccttagagacccttgactaatg

SEQ ID NO: 1275443 - DNA, 22 bp, Artificial Sequence
  chemically synthesized
atttcctgcattagtcaagggt

SEQ ID NO: 1275444 - DNA, 22 bp, Artificial Sequence
  chemically synthesized
tttcctgcattagtcaagggtc

SEQ ID NO: 1275445 - DNA, 22 bp, Artificial Sequence
  chemically synthesized
cctgcattagtcaagggtctct

SEQ ID NO: 1275446 - DNA, 22 bp, Artificial Sequence
  chemically synthesized
ctgcattagtcaagggtctcta

SEQ ID NO: 1275447 - DNA, 22 bp, Artificial Sequence
  chemically synthesized
cattagtcaagggtctctaagg

SEQ ID NO: 1275448 - DNA, 22 bp, Artificial Sequence
  chemically synthesized
ataaaatcaaatatttccttag

SEQ ID NO: 1275449 - DNA, 22 bp, Artificial Sequence
  chemically synthesized
gtcaagggtctctaaggaaata

SEQ ID NO: 1275450 - DNA, 22 bp, Artificial Sequence
  chemically synthesized
ttgataaaatcaaatatttcct

SEQ ID NO: 1275451 - DNA, 22 bp, Artificial Sequence
  chemically synthesized
agctgttgataaaatcaaatat

SEQ ID NO: 1275452 - DNA, 22 bp, Artificial Sequence
  chemically synthesized
cagctgttgataaaatcaaata

SEQ ID NO: 1275453 - DNA, 22 bp, Artificial Sequence
  chemically synthesized
cttcagctgttgataaaatcaa

SEQ ID NO: 1275454 - DNA, 22 bp, Artificial Sequence
  chemically synthesized
taaggaaatatttgattttatc

SEQ ID NO: 1275455 - DNA, 22 bp, Artificial Sequence
  chemically synthesized
aggaaatatttgattttatcaa

SEQ ID NO: 1275456 - DNA, 22 bp, Artificial Sequence
  chemically synthesized
ctacttcagctgttgataaaat

SEQ ID NO: 1275457 - DNA, 22 bp, Artificial Sequence
  chemically synthesized
cctacttcagctgttgataaaa

SEQ ID NO: 1275458 - DNA, 22 bp, Artificial Sequence
  chemically synthesized
tcctacttcagctgttgataaa

SEQ ID NO: 1275459 - DNA, 22 bp, Artificial Sequence
  chemically synthesized
tttcctacttcagctgttgata

SEQ ID NO: 1275460 - DNA, 22 bp, Artificial Sequence
  chemically synthesized
gattttatcaacagctgaagta

SEQ ID NO: 1275461 - DNA, 22 bp, Artificial Sequence
  chemically synthesized
attttatcaacagctgaagtag

SEQ ID NO: 1275462 - DNA, 22 bp, Artificial Sequence
  chemically synthesized
caggcactctttcctacttcag

SEQ ID NO: 1275463 - DNA, 22 bp, Artificial Sequence
  chemically synthesized
tatcaacagctgaagtaggaaa

SEQ ID NO: 1275464 - DNA, 22 bp, Artificial Sequence
  chemically synthesized
atcaacagctgaagtaggaaag

SEQ ID NO: 1275465 - DNA, 22 bp, Artificial Sequence
  chemically synthesized
tcaacagctgaagtaggaaaga

SEQ ID NO: 1275466 - DNA, 22 bp, Artificial Sequence
  chemically synthesized
tattccaggcactctttcctac

SEQ ID NO: 1275467 - DNA, 22 bp, Artificial Sequence
  chemically synthesized
aagtaggaaagagtgcctggaa

SEQ ID NO: 1275468 - DNA, 22 bp, Artificial Sequence
  chemically synthesized
agtggatattatattccaggca

SEQ ID NO: 1275469 - DNA, 22 bp, Artificial Sequence
  chemically synthesized
taagtggatattatattccagg

SEQ ID NO: 1275470 - DNA, 22 bp, Artificial Sequence
  chemically synthesized
ctaagtggatattatattccag

SEQ ID NO: 1275471 - DNA, 22 bp, Artificial Sequence
  chemically synthesized
gaatataatatccacttagaag

SEQ ID NO: 1275472 - DNA, 22 bp, Artificial Sequence
  chemically synthesized
agaagttttttatggtatggtt

SEQ ID NO: 1275473 - DNA, 22 bp, Artificial Sequence
  chemically synthesized
gaagttttttatggtatggttg

SEQ ID NO: 1275474 - DNA, 22 bp, Artificial Sequence
  chemically synthesized
aatagaatgggtgaatcaacca

SEQ ID NO: 1275475 - DNA, 22 bp, Artificial Sequence
  chemically synthesized
tttatggtatggttgattcacc

SEQ ID NO: 1275476 - DNA, 22 bp, Artificial Sequence
  chemically synthesized
ttatggtatggttgattcaccc

SEQ ID NO: 1275477 - DNA, 22 bp, Artificial Sequence
  chemically synthesized
tatggtatggttgattcaccca

SEQ ID NO: 1275478 - DNA, 22 bp, Artificial Sequence
  chemically synthesized
atggtatggttgattcacccat

SEQ ID NO: 1275479 - DNA, 22 bp, Artificial Sequence
  chemically synthesized
aggttaaatagaatgggtgaat

SEQ ID NO: 1275480 - DNA, 22 bp, Artificial Sequence
  chemically synthesized
tggtatggttgattcacccatt

SEQ ID NO: 1275481 - DNA, 22 bp, Artificial Sequence
  chemically synthesized
aatgctgaggttaaatagaatg

SEQ ID NO: 1275482 - DNA, 22 bp, Artificial Sequence
  chemically synthesized
attcacccattctatttaacct

SEQ ID NO: 1275483 - DNA, 22 bp, Artificial Sequence
  chemically synthesized
acccattctatttaacctcagc

SEQ ID NO: 1275484 - DNA, 22 bp, Artificial Sequence
  chemically synthesized
tatttaacctcagcattcaatt

SEQ ID NO: 1275485 - DNA, 22 bp, Artificial Sequence
  chemically synthesized
tttaacctcagcattcaattac

SEQ ID NO: 1275486 - DNA, 22 bp, Artificial Sequence
  chemically synthesized
aacctcagcattcaattactct

SEQ ID NO: 1275487 - DNA, 22 bp, Artificial Sequence
  chemically synthesized
acctcagcattcaattactctc

SEQ ID NO: 1275488 - DNA, 22 bp, Artificial Sequence
  chemically synthesized
aaaaaaaatagcagtgagagta

SEQ ID NO: 1275489 - DNA, 22 bp, Artificial Sequence
  chemically synthesized
aaaaaaaaatagcagtgagagt

SEQ ID NO: 1275490 - DNA, 22 bp, Artificial Sequence
  chemically synthesized
agcattcaattactctcactgc

SEQ ID NO: 1275491 - DNA, 22 bp, Artificial Sequence
  chemically synthesized
aggtttaaaaaaaaatagcagt

SEQ ID NO: 1275492 - DNA, 22 bp, Artificial Sequence
  chemically synthesized
aattactctcactgctattttt

SEQ ID NO: 1275493 - DNA, 22 bp, Artificial Sequence
  chemically synthesized
ctctcactgctattttttttta

SEQ ID NO: 1275494 - DNA, 22 bp, Artificial Sequence
  chemically synthesized
tcactgctatttttttttaaac

SEQ ID NO: 1275495 - DNA, 22 bp, Artificial Sequence
  chemically synthesized
actgctatttttttttaaacct

SEQ ID NO: 1275496 - DNA, 22 bp, Artificial Sequence
  chemically synthesized
ctatttttttttaaacctgaat

SEQ ID NO: 1275497 - DNA, 22 bp, Artificial Sequence
  chemically synthesized
tttttttttaaacctgaatcat

SEQ ID NO: 1275498 - DNA, 22 bp, Artificial Sequence
  chemically synthesized
aatgtaaaatgtatgattcagg

SEQ ID NO: 1275499 - DNA, 22 bp, Artificial Sequence
  chemically synthesized
ttttttaaacctgaatcataca

SEQ ID NO: 1275500 - DNA, 22 bp, Artificial Sequence
  chemically synthesized
tttttaaacctgaatcatacat

SEQ ID NO: 1275501 - DNA, 22 bp, Artificial Sequence
  chemically synthesized
ttttaaacctgaatcatacatt

SEQ ID NO: 1275502 - DNA, 22 bp, Artificial Sequence
  chemically synthesized
tttaaacctgaatcatacattt

SEQ ID NO: 1275503 - DNA, 22 bp, Artificial Sequence
  chemically synthesized
ttaaacctgaatcatacatttt

SEQ ID NO: 1275504 - DNA, 22 bp, Artificial Sequence
  chemically synthesized
taaacctgaatcatacatttta

SEQ ID NO: 1275505 - DNA, 22 bp, Artificial Sequence
  chemically synthesized
aaacctgaatcatacattttac

SEQ ID NO: 1275506 - DNA, 22 bp, Artificial Sequence
  chemically synthesized
aacctgaatcatacattttaca

SEQ ID NO: 1275507 - DNA, 22 bp, Artificial Sequence
  chemically synthesized
aatcatacattttacatttaat

SEQ ID NO: 1275508 - DNA, 22 bp, Artificial Sequence
  chemically synthesized
caatgagtgtatattaaatgta

SEQ ID NO: 1275509 - DNA, 22 bp, Artificial Sequence
  chemically synthesized
gcaatgagtgtatattaaatgt

SEQ ID NO: 1275510 - DNA, 22 bp, Artificial Sequence
  chemically synthesized
aatgtatttgcaatgagtgtat

SEQ ID NO: 1275511 - DNA, 22 bp, Artificial Sequence
  chemically synthesized
aaatgtatttgcaatgagtgta

SEQ ID NO: 1275512 - DNA, 22 bp, Artificial Sequence
  chemically synthesized
tacatttaatatacactcattg

SEQ ID NO: 1275513 - DNA, 22 bp, Artificial Sequence
  chemically synthesized
taaatgtatttgcaatgagtgt

SEQ ID NO: 1275514 - DNA, 22 bp, Artificial Sequence
  chemically synthesized
acatttaatatacactcattgc

SEQ ID NO: 1275515 - DNA, 22 bp, Artificial Sequence
  chemically synthesized
ttaaatgtatttgcaatgagtg

SEQ ID NO: 1275516 - DNA, 22 bp, Artificial Sequence
  chemically synthesized
catttaatatacactcattgca

SEQ ID NO: 1275517 - DNA, 22 bp, Artificial Sequence
  chemically synthesized
aatatacactcattgcaaatac

SEQ ID NO: 1275518 - DNA, 22 bp, Artificial Sequence
  chemically synthesized
gaatttttaaatgtatttgcaa

SEQ ID NO: 1275519 - DNA, 22 bp, Artificial Sequence
  chemically synthesized
atatacactcattgcaaataca

SEQ ID NO: 1275520 - DNA, 22 bp, Artificial Sequence
  chemically synthesized
ttagaatttttaaatgtatttg

SEQ ID NO: 1275521 - DNA, 22 bp, Artificial Sequence
  chemically synthesized
attagaatttttaaatgtattt

SEQ ID NO: 1275522 - DNA, 22 bp, Artificial Sequence
  chemically synthesized
ccttattagaatttttaaatgt

SEQ ID NO: 1275523 - DNA, 22 bp, Artificial Sequence
  chemically synthesized
tgccttattagaatttttaaat

SEQ ID NO: 1275524 - DNA, 22 bp, Artificial Sequence
  chemically synthesized
attgcaaatacatttaaaaatt

SEQ ID NO: 1275525 - DNA, 22 bp, Artificial Sequence
  chemically synthesized
caaatacatttaaaaattctaa

SEQ ID NO: 1275526 - DNA, 22 bp, Artificial Sequence
  chemically synthesized
aaggctctgccttattagaatt

SEQ ID NO: 1275527 - DNA, 22 bp, Artificial Sequence
  chemically synthesized
taaaggctctgccttattagaa

SEQ ID NO: 1275528 - DNA, 22 bp, Artificial Sequence
  chemically synthesized
ctaaaggctctgccttattaga

SEQ ID NO: 1275529 - DNA, 22 bp, Artificial Sequence
  chemically synthesized
ttctaaaggctctgccttatta

SEQ ID NO: 1275530 - DNA, 22 bp, Artificial Sequence
  chemically synthesized
aaaaattctaataaggcagagc

SEQ ID NO: 1275531 - DNA, 22 bp, Artificial Sequence
  chemically synthesized
aaaattctaataaggcagagcc

SEQ ID NO: 1275532 - DNA, 22 bp, Artificial Sequence
  chemically synthesized
taataaggcagagcctttagaa

SEQ ID NO: 1275533 - DNA, 22 bp, Artificial Sequence
  chemically synthesized
agtcaagcattcttctaaaggc

SEQ ID NO: 1275534 - DNA, 22 bp, Artificial Sequence
  chemically synthesized
ataaggcagagcctttagaaga

SEQ ID NO: 1275535 - DNA, 22 bp, Artificial Sequence
  chemically synthesized
tgagtcaagcattcttctaaag

SEQ ID NO: 1275536 - DNA, 22 bp, Artificial Sequence
  chemically synthesized
ctgagtcaagcattcttctaaa

SEQ ID NO: 1275537 - DNA, 22 bp, Artificial Sequence
  chemically synthesized
agtttctgagtcaagcattctt

SEQ ID NO: 1275538 - DNA, 22 bp, Artificial Sequence
  chemically synthesized
ttgagtttctgagtcaagcatt

SEQ ID NO: 1275539 - DNA, 22 bp, Artificial Sequence
  chemically synthesized
attgagtttctgagtcaagcat

SEQ ID NO: 1275540 - DNA, 22 bp, Artificial Sequence
  chemically synthesized
tagaagaatgcttgactcagaa

SEQ ID NO: 1275541 - DNA, 22 bp, Artificial Sequence
  chemically synthesized
agaagaatgcttgactcagaaa

SEQ ID NO: 1275542 - DNA, 22 bp, Artificial Sequence
  chemically synthesized
gaagaatgcttgactcagaaac

SEQ ID NO: 1275543 - DNA, 22 bp, Artificial Sequence
  chemically synthesized
acaaagatttattgagtttctg

SEQ ID NO: 1275544 - DNA, 22 bp, Artificial Sequence
  chemically synthesized
gactcagaaactcaataaatct

SEQ ID NO: 1275545 - DNA, 22 bp, Artificial Sequence
  chemically synthesized
aatagttaacaaagatttattg

SEQ ID NO: 1275546 - DNA, 22 bp, Artificial Sequence
  chemically synthesized
actcagaaactcaataaatctt

SEQ ID NO: 1275547 - DNA, 22 bp, Artificial Sequence
  chemically synthesized
caatagttaacaaagatttatt

SEQ ID NO: 1275548 - DNA, 22 bp, Artificial Sequence
  chemically synthesized
cttcaatagttaacaaagattt

SEQ ID NO: 1275549 - DNA, 22 bp, Artificial Sequence
  chemically synthesized
agaaactcaataaatctttgtt

SEQ ID NO: 1275550 - DNA, 22 bp, Artificial Sequence
  chemically synthesized
ccttcaatagttaacaaagatt

SEQ ID NO: 1275551 - DNA, 22 bp, Artificial Sequence
  chemically synthesized
aaatttccttcaatagttaaca

SEQ ID NO: 1275552 - DNA, 22 bp, Artificial Sequence
  chemically synthesized
aataaatctttgttaactattg

SEQ ID NO: 1275553 - DNA, 22 bp, Artificial Sequence
  chemically synthesized
attaaaatttccttcaatagtt

SEQ ID NO: 1275554 - DNA, 22 bp, Artificial Sequence
  chemically synthesized
aattaaaatttccttcaatagt

SEQ ID NO: 1275555 - DNA, 22 bp, Artificial Sequence
  chemically synthesized
tttaattaaaatttccttcaat

SEQ ID NO: 1275556 - DNA, 22 bp, Artificial Sequence
  chemically synthesized
tgttaactattgaaggaaattt

SEQ ID NO: 1275557 - DNA, 22 bp, Artificial Sequence
  chemically synthesized
attatttaattaaaatttcctt

SEQ ID NO: 1275558 - DNA, 22 bp, Artificial Sequence
  chemically synthesized
gttaactattgaaggaaatttt

SEQ ID NO: 1275559 - DNA, 22 bp, Artificial Sequence
  chemically synthesized
ttaactattgaaggaaatttta

SEQ ID NO: 1275560 - DNA, 22 bp, Artificial Sequence
  chemically synthesized
actattgaaggaaattttaatt

SEQ ID NO: 1275561 - DNA, 22 bp, Artificial Sequence
  chemically synthesized
ttgaaggaaattttaattaaat

SEQ ID NO: 1275562 - DNA, 22 bp, Artificial Sequence
  chemically synthesized
tgaatattaattatttaattaa

SEQ ID NO: 1275563 - DNA, 22 bp, Artificial Sequence
  chemically synthesized
aaggaaattttaattaaataat

SEQ ID NO: 1275564 - DNA, 22 bp, Artificial Sequence
  chemically synthesized
agtgggattatgaatattaatt

SEQ ID NO: 1275565 - DNA, 22 bp, Artificial Sequence
  chemically synthesized
taattaaataattaatattcat

SEQ ID NO: 1275566 - DNA, 22 bp, Artificial Sequence
  chemically synthesized
ttgagtgggattatgaatatta

SEQ ID NO: 1275567 - DNA, 22 bp, Artificial Sequence
  chemically synthesized
aattaaataattaatattcata

SEQ ID NO: 1275568 - DNA, 22 bp, Artificial Sequence
  chemically synthesized
gttgagtgggattatgaatatt

SEQ ID NO: 1275569 - DNA, 22 bp, Artificial Sequence
  chemically synthesized
attaaataattaatattcataa

SEQ ID NO: 1275570 - DNA, 22 bp, Artificial Sequence
  chemically synthesized
tgttgagtgggattatgaatat

SEQ ID NO: 1275571 - DNA, 22 bp, Artificial Sequence
  chemically synthesized
aataattaatattcataatccc

SEQ ID NO: 1275572 - DNA, 22 bp, Artificial Sequence
  chemically synthesized
atattcataatcccactcaaca

SEQ ID NO: 1275573 - DNA, 22 bp, Artificial Sequence
  chemically synthesized
ataaaaatcagtaattttgttg

SEQ ID NO: 1275574 - DNA, 22 bp, Artificial Sequence
  chemically synthesized
ataatcccactcaacaaaatta

SEQ ID NO: 1275575 - DNA, 22 bp, Artificial Sequence
  chemically synthesized
ttaataaaaatcagtaattttg

SEQ ID NO: 1275576 - DNA, 22 bp, Artificial Sequence
  chemically synthesized
aaaaaactattaataaaaatca

SEQ ID NO: 1275577 - DNA, 22 bp, Artificial Sequence
  chemically synthesized
aacaaaattactgatttttatt

SEQ ID NO: 1275578 - DNA, 22 bp, Artificial Sequence
  chemically synthesized
ctgatttttattaatagttttt

SEQ ID NO: 1275579 - DNA, 22 bp, Artificial Sequence
  chemically synthesized
atttttattaatagttttttca

SEQ ID NO: 1275580 - DNA, 22 bp, Artificial Sequence
  chemically synthesized
aaatatacaggtgattgaaaaa

SEQ ID NO: 1275581 - DNA, 22 bp, Artificial Sequence
  chemically synthesized
ttattaatagttttttcaatca

SEQ ID NO: 1275582 - DNA, 22 bp, Artificial Sequence
  chemically synthesized
tattaatagttttttcaatcac

SEQ ID NO: 1275583 - DNA, 22 bp, Artificial Sequence
  chemically synthesized
attaatagttttttcaatcacc

SEQ ID NO: 1275584 - DNA, 22 bp, Artificial Sequence
  chemically synthesized
ttaatagttttttcaatcacct

SEQ ID NO: 1275585 - DNA, 22 bp, Artificial Sequence
  chemically synthesized
attaaaatatacaggtgattga

SEQ ID NO: 1275586 - DNA, 22 bp, Artificial Sequence
  chemically synthesized
atagttttttcaatcacctgta

SEQ ID NO: 1275587 - DNA, 22 bp, Artificial Sequence
  chemically synthesized
tttcaatcacctgtatatttta

SEQ ID NO: 1275588 - DNA, 22 bp, Artificial Sequence
  chemically synthesized
cagtatgctaattaaaatatac

SEQ ID NO: 1275589 - DNA, 22 bp, Artificial Sequence
  chemically synthesized
ttcaatcacctgtatattttaa

SEQ ID NO: 1275590 - DNA, 22 bp, Artificial Sequence
  chemically synthesized
acagtatgctaattaaaatata

SEQ ID NO: 1275591 - DNA, 22 bp, Artificial Sequence
  chemically synthesized
tcaatcacctgtatattttaat

SEQ ID NO: 1275592 - DNA, 22 bp, Artificial Sequence
  chemically synthesized
tacagtatgctaattaaaatat

SEQ ID NO: 1275593 - DNA, 22 bp, Artificial Sequence
  chemically synthesized
caatcacctgtatattttaatt

SEQ ID NO: 1275594 - DNA, 22 bp, Artificial Sequence
  chemically synthesized
aatcacctgtatattttaatta

SEQ ID NO: 1275595 - DNA, 22 bp, Artificial Sequence
  chemically synthesized
tttacagtatgctaattaaaat

SEQ ID NO: 1275596 - DNA, 22 bp, Artificial Sequence
  chemically synthesized
ctttacagtatgctaattaaaa

SEQ ID NO: 1275597 - DNA, 22 bp, Artificial Sequence
  chemically synthesized
tctttacagtatgctaattaaa

SEQ ID NO: 1275598 - DNA, 22 bp, Artificial Sequence
  chemically synthesized
ctttctttacagtatgctaatt

SEQ ID NO: 1275599 - DNA, 22 bp, Artificial Sequence
  chemically synthesized
tatattttaattagcatactgt

SEQ ID NO: 1275600 - DNA, 22 bp, Artificial Sequence
  chemically synthesized
taattagcatactgtaaagaaa

SEQ ID NO: 1275601 - DNA, 22 bp, Artificial Sequence
  chemically synthesized
aattagcatactgtaaagaaag

SEQ ID NO: 1275602 - DNA, 22 bp, Artificial Sequence
  chemically synthesized
attagcatactgtaaagaaagt

SEQ ID NO: 1275603 - DNA, 22 bp, Artificial Sequence
  chemically synthesized
gcatactgtaaagaaagtaatc

SEQ ID NO: 1275604 - DNA, 22 bp, Artificial Sequence
  chemically synthesized
aaaaggaaaaatgattactttc

SEQ ID NO: 1275605 - DNA, 22 bp, Artificial Sequence
  chemically synthesized
aaaaaggaaaaatgattacttt

SEQ ID NO: 1275606 - DNA, 22 bp, Artificial Sequence
  chemically synthesized
taaaaaggaaaaatgattactt

SEQ ID NO: 1275607 - DNA, 22 bp, Artificial Sequence
  chemically synthesized
ttttaaaaaggaaaaatgatta

SEQ ID NO: 1275608 - DNA, 22 bp, Artificial Sequence
  chemically synthesized
attttaaaaaggaaaaatgatt

SEQ ID NO: 1275609 - DNA, 22 bp, Artificial Sequence
  chemically synthesized
tattttaaaaaggaaaaatgat

SEQ ID NO: 1275610 - DNA, 22 bp, Artificial Sequence
  chemically synthesized
taaagaaagtaatcatttttcc

SEQ ID NO: 1275611 - DNA, 22 bp, Artificial Sequence
  chemically synthesized
ttattttaaaaaggaaaaatga

SEQ ID NO: 1275612 - DNA, 22 bp, Artificial Sequence
  chemically synthesized
tttattttaaaaaggaaaaatg

SEQ ID NO: 1275613 - DNA, 22 bp, Artificial Sequence
  chemically synthesized
ttcctttttaaaataaaaaaca

SEQ ID NO: 1275614 - DNA, 22 bp, Artificial Sequence
  chemically synthesized
tcctttttaaaataaaaaacac

SEQ ID NO: 1275615 - DNA, 22 bp, Artificial Sequence
  chemically synthesized
cctttttaaaataaaaaacact

SEQ ID NO: 1275616 - DNA, 22 bp, Artificial Sequence
  chemically synthesized
ctttttaaaataaaaaacacta

SEQ ID NO: 1275617 - DNA, 22 bp, Artificial Sequence
  chemically synthesized
tttaaaataaaaaacactatgt

SEQ ID NO: 1275618 - DNA, 22 bp, Artificial Sequence
  chemically synthesized
ttaaaataaaaaacactatgtt

SEQ ID NO: 1275619 - DNA, 22 bp, Artificial Sequence
  chemically synthesized
taaaataaaaaacactatgtta

SEQ ID NO: 1275620 - DNA, 22 bp, Artificial Sequence
  chemically synthesized
aaaataaaaaacactatgttat

SEQ ID NO: 1275621 - DNA, 22 bp, Artificial Sequence
  chemically synthesized
aaataaaaaacactatgttata

SEQ ID NO: 1275622 - DNA, 22 bp, Artificial Sequence
  chemically synthesized
agtgataaagtcagtataacat

SEQ ID NO: 1275623 - DNA, 22 bp, Artificial Sequence
  chemically synthesized
tctcagtgataaagtcagtata

SEQ ID NO: 1275624 - DNA, 22 bp, Artificial Sequence
  chemically synthesized
agattatctcagtgataaagtc

SEQ ID NO: 1275625 - DNA, 22 bp, Artificial Sequence
  chemically synthesized
gagattatctcagtgataaagt

SEQ ID NO: 1275626 - DNA, 22 bp, Artificial Sequence
  chemically synthesized
tgttatactgactttatcactg

SEQ ID NO: 1275627 - DNA, 22 bp, Artificial Sequence
  chemically synthesized
cttgagattatctcagtgataa

SEQ ID NO: 1275628 - DNA, 22 bp, Artificial Sequence
  chemically synthesized
tactgactttatcactgagata

SEQ ID NO: 1275629 - DNA, 22 bp, Artificial Sequence
  chemically synthesized
actttatcactgagataatctc

SEQ ID NO: 1275630 - DNA, 22 bp, Artificial Sequence
  chemically synthesized
ataataactgcttgagattatc

SEQ ID NO: 1275631 - DNA, 22 bp, Artificial Sequence
  chemically synthesized
tatcactgagataatctcaagc

SEQ ID NO: 1275632 - DNA, 22 bp, Artificial Sequence
  chemically synthesized
atcactgagataatctcaagca

SEQ ID NO: 1275633 - DNA, 22 bp, Artificial Sequence
  chemically synthesized
tcactgagataatctcaagcag

SEQ ID NO: 1275634 - DNA, 22 bp, Artificial Sequence
  chemically synthesized
agataatctcaagcagttatta

SEQ ID NO: 1275635 - DNA, 22 bp, Artificial Sequence
  chemically synthesized
aaaagcagctcataataactgc

SEQ ID NO: 1275636 - DNA, 22 bp, Artificial Sequence
  chemically synthesized
aaatagctcaaaagcagctcat

SEQ ID NO: 1275637 - DNA, 22 bp, Artificial Sequence
  chemically synthesized
aagcagttattatgagctgctt

SEQ ID NO: 1275638 - DNA, 22 bp, Artificial Sequence
  chemically synthesized
caaatagctcaaaagcagctca

SEQ ID NO: 1275639 - DNA, 22 bp, Artificial Sequence
  chemically synthesized
taccttcaaatagctcaaaagc

SEQ ID NO: 1275640 - DNA, 22 bp, Artificial Sequence
  chemically synthesized
ttatgagctgcttttgagctat

SEQ ID NO: 1275641 - DNA, 22 bp, Artificial Sequence
  chemically synthesized
tgagctgcttttgagctatttg

SEQ ID NO: 1275642 - DNA, 22 bp, Artificial Sequence
  chemically synthesized
cttttgagctatttgaaggtac

SEQ ID NO: 1275643 - DNA, 22 bp, Artificial Sequence
  chemically synthesized
ttgagctatttgaaggtacagt

SEQ ID NO: 1275644 - DNA, 22 bp, Artificial Sequence
  chemically synthesized
catagcagtaaaactgtacctt

SEQ ID NO: 1275645 - DNA, 22 bp, Artificial Sequence
  chemically synthesized
tgagctatttgaaggtacagtt

SEQ ID NO: 1275646 - DNA, 22 bp, Artificial Sequence
  chemically synthesized
gagctatttgaaggtacagttt

SEQ ID NO: 1275647 - DNA, 22 bp, Artificial Sequence
  chemically synthesized
agctatttgaaggtacagtttt

SEQ ID NO: 1275648 - DNA, 22 bp, Artificial Sequence
  chemically synthesized
gaaattacatagcagtaaaact

SEQ ID NO: 1275649 - DNA, 22 bp, Artificial Sequence
  chemically synthesized
tttgaaggtacagttttactgc

SEQ ID NO: 1275650 - DNA, 22 bp, Artificial Sequence
  chemically synthesized
gaaggtacagttttactgctat

SEQ ID NO: 1275651 - DNA, 22 bp, Artificial Sequence
  chemically synthesized
aaggtacagttttactgctatg

SEQ ID NO: 1275652 - DNA, 22 bp, Artificial Sequence
  chemically synthesized
gatgtacataggcctggaaatt

SEQ ID NO: 1275653 - DNA, 22 bp, Artificial Sequence
  chemically synthesized
tactgctatgtaatttccaggc

SEQ ID NO: 1275654 - DNA, 22 bp, Artificial Sequence
  chemically synthesized
actgctatgtaatttccaggcc

SEQ ID NO: 1275655 - DNA, 22 bp, Artificial Sequence
  chemically synthesized
ctgctatgtaatttccaggcct

SEQ ID NO: 1275656 - DNA, 22 bp, Artificial Sequence
  chemically synthesized
ctatgtaatttccaggcctatg

SEQ ID NO: 1275657 - DNA, 22 bp, Artificial Sequence
  chemically synthesized
tgcctagatgtacataggcctg

SEQ ID NO: 1275658 - DNA, 22 bp, Artificial Sequence
  chemically synthesized
atgcctagatgtacataggcct

SEQ ID NO: 1275659 - DNA, 22 bp, Artificial Sequence
  chemically synthesized
tgtaatttccaggcctatgtac

SEQ ID NO: 1275660 - DNA, 22 bp, Artificial Sequence
  chemically synthesized
ccaggcctatgtacatctaggc

SEQ ID NO: 1275661 - DNA, 22 bp, Artificial Sequence
  chemically synthesized
agaaaatcttatgcctagatgt

SEQ ID NO: 1275662 - DNA, 22 bp, Artificial Sequence
  chemically synthesized
caggcctatgtacatctaggca

SEQ ID NO: 1275663 - DNA, 22 bp, Artificial Sequence
  chemically synthesized
acagctgagaaaatcttatgcc

SEQ ID NO: 1275664 - DNA, 22 bp, Artificial Sequence
  chemically synthesized
aacagctgagaaaatcttatgc

SEQ ID NO: 1275665 - DNA, 22 bp, Artificial Sequence
  chemically synthesized
tgtacatctaggcataagattt

SEQ ID NO: 1275666 - DNA, 22 bp, Artificial Sequence
  chemically synthesized
taacagctgagaaaatcttatg

SEQ ID NO: 1275667 - DNA, 22 bp, Artificial Sequence
  chemically synthesized
ggcataagattttctcagctgt

SEQ ID NO: 1275668 - DNA, 22 bp, Artificial Sequence
  chemically synthesized
tctcagctgttaaagctcgtct

SEQ ID NO: 1275669 - DNA, 22 bp, Artificial Sequence
  chemically synthesized
ctcagctgttaaagctcgtctc

SEQ ID NO: 1275670 - DNA, 22 bp, Artificial Sequence
  chemically synthesized
tcagctgttaaagctcgtctcg

SEQ ID NO: 1275671 - DNA, 22 bp, Artificial Sequence
  chemically synthesized
agctgttaaagctcgtctcgtt

SEQ ID NO: 1275672 - DNA, 22 bp, Artificial Sequence
  chemically synthesized
agaggggacaaatggcaacgag

SEQ ID NO: 1275673 - DNA, 22 bp, Artificial Sequence
  chemically synthesized
ttaaagctcgtctcgttgccat

SEQ ID NO: 1275674 - DNA, 22 bp, Artificial Sequence
  chemically synthesized
aagctcgtctcgttgccatttg

SEQ ID NO: 1275675 - DNA, 22 bp, Artificial Sequence
  chemically synthesized
tcattaagaggggacaaatggc

SEQ ID NO: 1275676 - DNA, 22 bp, Artificial Sequence
  chemically synthesized
ctatcattaagaggggacaaat

SEQ ID NO: 1275677 - DNA, 22 bp, Artificial Sequence
  chemically synthesized
gtctcgttgccatttgtcccct

SEQ ID NO: 1275678 - DNA, 22 bp, Artificial Sequence
  chemically synthesized
gctatcattaagaggggacaaa

SEQ ID NO: 1275679 - DNA, 22 bp, Artificial Sequence
  chemically synthesized
ttgctatcattaagaggggaca

SEQ ID NO: 1275680 - DNA, 22 bp, Artificial Sequence
  chemically synthesized
gttgccatttgtcccctcttaa

SEQ ID NO: 1275681 - DNA, 22 bp, Artificial Sequence
  chemically synthesized
gttcttgctatcattaagaggg

SEQ ID NO: 1275682 - DNA, 22 bp, Artificial Sequence
  chemically synthesized
agttcttgctatcattaagagg

SEQ ID NO: 1275683 - DNA, 22 bp, Artificial Sequence
  chemically synthesized
ccatttgtcccctcttaatgat

SEQ ID NO: 1275684 - DNA, 22 bp, Artificial Sequence
  chemically synthesized
gtcccctcttaatgatagcaag

SEQ ID NO: 1275685 - DNA, 22 bp, Artificial Sequence
  chemically synthesized
tcccctcttaatgatagcaaga

SEQ ID NO: 1275686 - DNA, 22 bp, Artificial Sequence
  chemically synthesized
ggatgacttagttcttgctatc

SEQ ID NO: 1275687 - DNA, 22 bp, Artificial Sequence
  chemically synthesized
ttaatgatagcaagaactaagt

SEQ ID NO: 1275688 - DNA, 22 bp, Artificial Sequence
  chemically synthesized
aatgatagcaagaactaagtca

SEQ ID NO: 1275689 - DNA, 22 bp, Artificial Sequence
  chemically synthesized
atgatagcaagaactaagtcat

SEQ ID NO: 1275690 - DNA, 22 bp, Artificial Sequence
  chemically synthesized
agtcatcccagttttgcacata

SEQ ID NO: 1275691 - DNA, 22 bp, Artificial Sequence
  chemically synthesized
acgcaagtataatatgtgcaaa

SEQ ID NO: 1275692 - DNA, 22 bp, Artificial Sequence
  chemically synthesized
aacgcaagtataatatgtgcaa

SEQ ID NO: 1275693 - DNA, 22 bp, Artificial Sequence
  chemically synthesized
gaaaaagaacttaacgcaagta

SEQ ID NO: 1275694 - DNA, 22 bp, Artificial Sequence
  chemically synthesized
tgcacatattatacttgcgtta

SEQ ID NO: 1275695 - DNA, 22 bp, Artificial Sequence
  chemically synthesized
gcacatattatacttgcgttaa

SEQ ID NO: 1275696 - DNA, 22 bp, Artificial Sequence
  chemically synthesized
cacatattatacttgcgttaag

SEQ ID NO: 1275697 - DNA, 22 bp, Artificial Sequence
  chemically synthesized
taactggaaaaagaacttaacg

SEQ ID NO: 1275698 - DNA, 22 bp, Artificial Sequence
  chemically synthesized
ataactggaaaaagaacttaac

SEQ ID NO: 1275699 - DNA, 22 bp, Artificial Sequence
  chemically synthesized
ttataactggaaaaagaactta

SEQ ID NO: 1275700 - DNA, 22 bp, Artificial Sequence
  chemically synthesized
tacttgcgttaagttctttttc

SEQ ID NO: 1275701 - DNA, 22 bp, Artificial Sequence
  chemically synthesized
tgttcttataactggaaaaaga

SEQ ID NO: 1275702 - DNA, 22 bp, Artificial Sequence
  chemically synthesized
gcgttaagttctttttccagtt

SEQ ID NO: 1275703 - DNA, 22 bp, Artificial Sequence
  chemically synthesized
cgttaagttctttttccagtta

SEQ ID NO: 1275704 - DNA, 22 bp, Artificial Sequence
  chemically synthesized
aagttgtgttcttataactgga

SEQ ID NO: 1275705 - DNA, 22 bp, Artificial Sequence
  chemically synthesized
agttctttttccagttataaga

SEQ ID NO: 1275706 - DNA, 22 bp, Artificial Sequence
  chemically synthesized
tttttccagttataagaacaca

SEQ ID NO: 1275707 - DNA, 22 bp, Artificial Sequence
  chemically synthesized
tttccagttataagaacacaac

SEQ ID NO: 1275708 - DNA, 22 bp, Artificial Sequence
  chemically synthesized
ttccagttataagaacacaact

SEQ ID NO: 1275709 - DNA, 22 bp, Artificial Sequence
  chemically synthesized
tccagttataagaacacaactt

SEQ ID NO: 1275710 - DNA, 22 bp, Artificial Sequence
  chemically synthesized
ccagttataagaacacaacttt

SEQ ID NO: 1275711 - DNA, 22 bp, Artificial Sequence
  chemically synthesized
cagttataagaacacaacttta

SEQ ID NO: 1275712 - DNA, 22 bp, Artificial Sequence
  chemically synthesized
tccataagaaattaaagttgtg

SEQ ID NO: 1275713 - DNA, 22 bp, Artificial Sequence
  chemically synthesized
taagaacacaactttaatttct

SEQ ID NO: 1275714 - DNA, 22 bp, Artificial Sequence
  chemically synthesized
agatgaaattatccataagaaa

SEQ ID NO: 1275715 - DNA, 22 bp, Artificial Sequence
  chemically synthesized
ttcagatgaaattatccataag

SEQ ID NO: 1275716 - DNA, 22 bp, Artificial Sequence
  chemically synthesized
taatttcttatggataatttca

SEQ ID NO: 1275717 - DNA, 22 bp, Artificial Sequence
  chemically synthesized
aatttcttatggataatttcat

SEQ ID NO: 1275718 - DNA, 22 bp, Artificial Sequence
  chemically synthesized
atttcttatggataatttcatc

SEQ ID NO: 1275719 - DNA, 22 bp, Artificial Sequence
  chemically synthesized
aaatgtgttgttcagatgaaat

SEQ ID NO: 1275720 - DNA, 22 bp, Artificial Sequence
  chemically synthesized
cttatggataatttcatctgaa

SEQ ID NO: 1275721 - DNA, 22 bp, Artificial Sequence
  chemically synthesized
ttatggataatttcatctgaac

SEQ ID NO: 1275722 - DNA, 22 bp, Artificial Sequence
  chemically synthesized
atggataatttcatctgaacaa

SEQ ID NO: 1275723 - DNA, 22 bp, Artificial Sequence
  chemically synthesized
tggataatttcatctgaacaac

SEQ ID NO: 1275724 - DNA, 22 bp, Artificial Sequence
  chemically synthesized
ggtctaaaatgtgttgttcaga

SEQ ID NO: 1275725 - DNA, 22 bp, Artificial Sequence
  chemically synthesized
cggtctaaaatgtgttgttcag

SEQ ID NO: 1275726 - DNA, 22 bp, Artificial Sequence
  chemically synthesized
aagtttcggtctaaaatgtgtt

SEQ ID NO: 1275727 - DNA, 22 bp, Artificial Sequence
  chemically synthesized
catctgaacaacacattttaga

SEQ ID NO: 1275728 - DNA, 22 bp, Artificial Sequence
  chemically synthesized
atctgaacaacacattttagac

SEQ ID NO: 1275729 - DNA, 22 bp, Artificial Sequence
  chemically synthesized
aacaacacattttagaccgaaa

SEQ ID NO: 1275730 - DNA, 22 bp, Artificial Sequence
  chemically synthesized
aggaaactgaagtttcggtcta

SEQ ID NO: 1275731 - DNA, 22 bp, Artificial Sequence
  chemically synthesized
ttaaggaaactgaagtttcggt

SEQ ID NO: 1275732 - DNA, 22 bp, Artificial Sequence
  chemically synthesized
tagaccgaaacttcagtttcct

SEQ ID NO: 1275733 - DNA, 22 bp, Artificial Sequence
  chemically synthesized
agaccgaaacttcagtttcctt

SEQ ID NO: 1275734 - DNA, 22 bp, Artificial Sequence
  chemically synthesized
gaccgaaacttcagtttcctta

SEQ ID NO: 1275735 - DNA, 22 bp, Artificial Sequence
  chemically synthesized
cagtttccttaataatttgtac

SEQ ID NO: 1275736 - DNA, 22 bp, Artificial Sequence
  chemically synthesized
ccacaatcaaaagtacaaatta

SEQ ID NO: 1275737 - DNA, 22 bp, Artificial Sequence
  chemically synthesized
agtttccttaataatttgtact

SEQ ID NO: 1275738 - DNA, 22 bp, Artificial Sequence
  chemically synthesized
cccacaatcaaaagtacaaatt

SEQ ID NO: 1275739 - DNA, 22 bp, Artificial Sequence
  chemically synthesized
tcccacaatcaaaagtacaaat

SEQ ID NO: 1275740 - DNA, 22 bp, Artificial Sequence
  chemically synthesized
ccttaataatttgtacttttga

SEQ ID NO: 1275741 - DNA, 22 bp, Artificial Sequence
  chemically synthesized
cttaataatttgtacttttgat

SEQ ID NO: 1275742 - DNA, 22 bp, Artificial Sequence
  chemically synthesized
tcattttcccacaatcaaaagt

SEQ ID NO: 1275743 - DNA, 22 bp, Artificial Sequence
  chemically synthesized
aataatttgtacttttgattgt

SEQ ID NO: 1275744 - DNA, 22 bp, Artificial Sequence
  chemically synthesized
ataatttgtacttttgattgtg

SEQ ID NO: 1275745 - DNA, 22 bp, Artificial Sequence
  chemically synthesized
ttgtcattttcccacaatcaaa

SEQ ID NO: 1275746 - DNA, 22 bp, Artificial Sequence
  chemically synthesized
gtacttttgattgtgggaaaat

SEQ ID NO: 1275747 - DNA, 22 bp, Artificial Sequence
  chemically synthesized
tatgctgttgtcattttcccac

SEQ ID NO: 1275748 - DNA, 22 bp, Artificial Sequence
  chemically synthesized
tacttttgattgtgggaaaatg

SEQ ID NO: 1275749 - DNA, 22 bp, Artificial Sequence
  chemically synthesized
ttgtatgctgttgtcattttcc

SEQ ID NO: 1275750 - DNA, 22 bp, Artificial Sequence
  chemically synthesized
ttgattgtgggaaaatgacaac

SEQ ID NO: 1275751 - DNA, 22 bp, Artificial Sequence
  chemically synthesized
ttattgtatgctgttgtcattt

SEQ ID NO: 1275752 - DNA, 22 bp, Artificial Sequence
  chemically synthesized
tgattgtgggaaaatgacaaca

SEQ ID NO: 1275753 - DNA, 22 bp, Artificial Sequence
  chemically synthesized
gattgtgggaaaatgacaacag

SEQ ID NO: 1275754 - DNA, 22 bp, Artificial Sequence
  chemically synthesized
tattattgtatgctgttgtcat

SEQ ID NO: 1275755 - DNA, 22 bp, Artificial Sequence
  chemically synthesized
attgtgggaaaatgacaacagc

SEQ ID NO: 1275756 - DNA, 22 bp, Artificial Sequence
  chemically synthesized
tgggaaaatgacaacagcatac

SEQ ID NO: 1275757 - DNA, 22 bp, Artificial Sequence
  chemically synthesized
gaaaagtataatattctattat

SEQ ID NO: 1275758 - DNA, 22 bp, Artificial Sequence
  chemically synthesized
cccagctagaaaagtataatat

SEQ ID NO: 1275759 - DNA, 22 bp, Artificial Sequence
  chemically synthesized
ccccagctagaaaagtataata

SEQ ID NO: 1275760 - DNA, 22 bp, Artificial Sequence
  chemically synthesized
tgtcatcagccttccccagcta

SEQ ID NO: 1275761 - DNA, 22 bp, Artificial Sequence
  chemically synthesized
gtgtcatcagccttccccagct

SEQ ID NO: 1275762 - DNA, 22 bp, Artificial Sequence
  chemically synthesized
tgtgtcatcagccttccccagc

SEQ ID NO: 1275763 - DNA, 22 bp, Artificial Sequence
  chemically synthesized
ttgtgtcatcagccttccccag

SEQ ID NO: 1275764 - DNA, 22 bp, Artificial Sequence
  chemically synthesized
tacttttctagctggggaaggc

SEQ ID NO: 1275765 - DNA, 22 bp, Artificial Sequence
  chemically synthesized
tgcttttgtgtcatcagccttc

SEQ ID NO: 1275766 - DNA, 22 bp, Artificial Sequence
  chemically synthesized
ttctagctggggaaggctgatg

SEQ ID NO: 1275767 - DNA, 22 bp, Artificial Sequence
  chemically synthesized
tctagctggggaaggctgatga

SEQ ID NO: 1275768 - DNA, 22 bp, Artificial Sequence
  chemically synthesized
ctagctggggaaggctgatgac

SEQ ID NO: 1275769 - DNA, 22 bp, Artificial Sequence
  chemically synthesized
tagctggggaaggctgatgaca

SEQ ID NO: 1275770 - DNA, 22 bp, Artificial Sequence
  chemically synthesized
gctggggaaggctgatgacaca

SEQ ID NO: 1275771 - DNA, 22 bp, Artificial Sequence
  chemically synthesized
tagtcctatgcttttgtgtcat

SEQ ID NO: 1275772 - DNA, 22 bp, Artificial Sequence
  chemically synthesized
gtagtcctatgcttttgtgtca

SEQ ID NO: 1275773 - DNA, 22 bp, Artificial Sequence
  chemically synthesized
gggaaggctgatgacacaaaag

SEQ ID NO: 1275774 - DNA, 22 bp, Artificial Sequence
  chemically synthesized
tgtagtcctatgcttttgtgtc

SEQ ID NO: 1275775 - DNA, 22 bp, Artificial Sequence
  chemically synthesized
ccattttgtagtcctatgcttt

SEQ ID NO: 1275776 - DNA, 22 bp, Artificial Sequence
  chemically synthesized
gccattttgtagtcctatgctt

SEQ ID NO: 1275777 - DNA, 22 bp, Artificial Sequence
  chemically synthesized
tgccattttgtagtcctatgct

SEQ ID NO: 1275778 - DNA, 22 bp, Artificial Sequence
  chemically synthesized
ttgccattttgtagtcctatgc

SEQ ID NO: 1275779 - DNA, 22 bp, Artificial Sequence
  chemically synthesized
atgacacaaaagcataggacta

SEQ ID NO: 1275780 - DNA, 22 bp, Artificial Sequence
  chemically synthesized
tttgccattttgtagtcctatg

SEQ ID NO: 1275781 - DNA, 22 bp, Artificial Sequence
  chemically synthesized
taatcatgttttttgccatttt

SEQ ID NO: 1275782 - DNA, 22 bp, Artificial Sequence
  chemically synthesized
caaaatggcaaaaaacatgatt

SEQ ID NO: 1275783 - DNA, 22 bp, Artificial Sequence
  chemically synthesized
atgtatacactataatcatgtt

SEQ ID NO: 1275784 - DNA, 22 bp, Artificial Sequence
  chemically synthesized
caaaaaaactcatgtatacact

SEQ ID NO: 1275785 - DNA, 22 bp, Artificial Sequence
  chemically synthesized
gcaaaaaaactcatgtatacac

SEQ ID NO: 1275786 - DNA, 22 bp, Artificial Sequence
  chemically synthesized
tgcaaaaaaactcatgtataca

SEQ ID NO: 1275787 - DNA, 22 bp, Artificial Sequence
  chemically synthesized
agatctttgcaaaaaaactcat

SEQ ID NO: 1275788 - DNA, 22 bp, Artificial Sequence
  chemically synthesized
tagtgtatacatgagttttttt

SEQ ID NO: 1275789 - DNA, 22 bp, Artificial Sequence
  chemically synthesized
ttcagatctttgcaaaaaaact

SEQ ID NO: 1275790 - DNA, 22 bp, Artificial Sequence
  chemically synthesized
tattcagatctttgcaaaaaaa

SEQ ID NO: 1275791 - DNA, 22 bp, Artificial Sequence
  chemically synthesized
tctattcagatctttgcaaaaa

SEQ ID NO: 1275792 - DNA, 22 bp, Artificial Sequence
  chemically synthesized
ctctattcagatctttgcaaaa

SEQ ID NO: 1275793 - DNA, 22 bp, Artificial Sequence
  chemically synthesized
tctctattcagatctttgcaaa

SEQ ID NO: 1275794 - DNA, 22 bp, Artificial Sequence
  chemically synthesized
ttctctattcagatctttgcaa

SEQ ID NO: 1275795 - DNA, 22 bp, Artificial Sequence
  chemically synthesized
cttttctctattcagatctttg

SEQ ID NO: 1275796 - DNA, 22 bp, Artificial Sequence
  chemically synthesized
ctgcttttctctattcagatct

SEQ ID NO: 1275797 - DNA, 22 bp, Artificial Sequence
  chemically synthesized
actgcttttctctattcagatc

SEQ ID NO: 1275798 - DNA, 22 bp, Artificial Sequence
  chemically synthesized
tactgcttttctctattcagat

SEQ ID NO: 1275799 - DNA, 22 bp, Artificial Sequence
  chemically synthesized
ttttgcaaagatctgaatagag

SEQ ID NO: 1275800 - DNA, 22 bp, Artificial Sequence
  chemically synthesized
tttgcaaagatctgaatagaga

SEQ ID NO: 1275801 - DNA, 22 bp, Artificial Sequence
  chemically synthesized
ttttactgcttttctctattca

SEQ ID NO: 1275802 - DNA, 22 bp, Artificial Sequence
  chemically synthesized
ttgcaaagatctgaatagagaa

SEQ ID NO: 1275803 - DNA, 22 bp, Artificial Sequence
  chemically synthesized
tgcaaagatctgaatagagaaa

SEQ ID NO: 1275804 - DNA, 22 bp, Artificial Sequence
  chemically synthesized
gcaaagatctgaatagagaaaa

SEQ ID NO: 1275805 - DNA, 22 bp, Artificial Sequence
  chemically synthesized
caaagatctgaatagagaaaag

SEQ ID NO: 1275806 - DNA, 22 bp, Artificial Sequence
  chemically synthesized
tgaagactattttactgctttt

SEQ ID NO: 1275807 - DNA, 22 bp, Artificial Sequence
  chemically synthesized
aatagagaaaagcagtaaaata

SEQ ID NO: 1275808 - DNA, 22 bp, Artificial Sequence
  chemically synthesized
aatatatgttgtgaagactatt

SEQ ID NO: 1275809 - DNA, 22 bp, Artificial Sequence
  chemically synthesized
caatatatgttgtgaagactat

SEQ ID NO: 1275810 - DNA, 22 bp, Artificial Sequence
  chemically synthesized
tcaatatatgttgtgaagacta

SEQ ID NO: 1275811 - DNA, 22 bp, Artificial Sequence
  chemically synthesized
ttcaatatatgttgtgaagact

SEQ ID NO: 1275812 - DNA, 22 bp, Artificial Sequence
  chemically synthesized
gcatttttcaatatatgttgtg

SEQ ID NO: 1275813 - DNA, 22 bp, Artificial Sequence
  chemically synthesized
agcatttttcaatatatgttgt

SEQ ID NO: 1275814 - DNA, 22 bp, Artificial Sequence
  chemically synthesized
tagcatttttcaatatatgttg

SEQ ID NO: 1275815 - DNA, 22 bp, Artificial Sequence
  chemically synthesized
ttagcatttttcaatatatgtt

SEQ ID NO: 1275816 - DNA, 22 bp, Artificial Sequence
  chemically synthesized
tatttttagcatttttcaatat

SEQ ID NO: 1275817 - DNA, 22 bp, Artificial Sequence
  chemically synthesized
ttgtatttttagcatttttcaa

SEQ ID NO: 1275818 - DNA, 22 bp, Artificial Sequence
  chemically synthesized
cacaacatatattgaaaaatgc

SEQ ID NO: 1275819 - DNA, 22 bp, Artificial Sequence
  chemically synthesized
acaacatatattgaaaaatgct

SEQ ID NO: 1275820 - DNA, 22 bp, Artificial Sequence
  chemically synthesized
aaaaatgctaaaaatacaataa

SEQ ID NO: 1275821 - DNA, 22 bp, Artificial Sequence
  chemically synthesized
caatggtgcaagttattgtatt

SEQ ID NO: 1275822 - DNA, 22 bp, Artificial Sequence
  chemically synthesized
gctgcaatggtgcaagttattg

SEQ ID NO: 1275823 - DNA, 22 bp, Artificial Sequence
  chemically synthesized
aaaatacaataacttgcaccat

SEQ ID NO: 1275824 - DNA, 22 bp, Artificial Sequence
  chemically synthesized
taatgtgaatatagtactagct

SEQ ID NO: 1275825 - DNA, 22 bp, Artificial Sequence
  chemically synthesized
ataatgtgaatatagtactagc

SEQ ID NO: 1275826 - DNA, 22 bp, Artificial Sequence
  chemically synthesized
gcaccattgcagctagtactat

SEQ ID NO: 1275827 - DNA, 22 bp, Artificial Sequence
  chemically synthesized
tataatgtgaatatagtactag

SEQ ID NO: 1275828 - DNA, 22 bp, Artificial Sequence
  chemically synthesized
caccattgcagctagtactata

SEQ ID NO: 1275829 - DNA, 22 bp, Artificial Sequence
  chemically synthesized
ttataatgtgaatatagtacta

SEQ ID NO: 1275830 - DNA, 22 bp, Artificial Sequence
  chemically synthesized
cagctagtactatattcacatt

SEQ ID NO: 1275831 - DNA, 22 bp, Artificial Sequence
  chemically synthesized
aatggccttttataatgtgaat

SEQ ID NO: 1275832 - DNA, 22 bp, Artificial Sequence
  chemically synthesized
gtactatattcacattataaaa

SEQ ID NO: 1275833 - DNA, 22 bp, Artificial Sequence
  chemically synthesized
gatacattaaatggccttttat

SEQ ID NO: 1275834 - DNA, 22 bp, Artificial Sequence
  chemically synthesized
ggatacattaaatggcctttta

SEQ ID NO: 1275835 - DNA, 22 bp, Artificial Sequence
  chemically synthesized
tattcacattataaaaggccat

SEQ ID NO: 1275836 - DNA, 22 bp, Artificial Sequence
  chemically synthesized
tcttggatacattaaatggcct

SEQ ID NO: 1275837 - DNA, 22 bp, Artificial Sequence
  chemically synthesized
acattataaaaggccatttaat

SEQ ID NO: 1275838 - DNA, 22 bp, Artificial Sequence
  chemically synthesized
taaaaggccatttaatgtatcc

SEQ ID NO: 1275839 - DNA, 22 bp, Artificial Sequence
  chemically synthesized
ccaatgttgtcttggatacatt

SEQ ID NO: 1275840 - DNA, 22 bp, Artificial Sequence
  chemically synthesized
atgtgtctgccaatgttgtctt

SEQ ID NO: 1275841 - DNA, 22 bp, Artificial Sequence
  chemically synthesized
aatgtgtctgccaatgttgtct

SEQ ID NO: 1275842 - DNA, 22 bp, Artificial Sequence
  chemically synthesized
aatgtatccaagacaacattgg

SEQ ID NO: 1275843 - DNA, 22 bp, Artificial Sequence
  chemically synthesized
atgtatccaagacaacattggc

SEQ ID NO: 1275844 - DNA, 22 bp, Artificial Sequence
  chemically synthesized
aaaagcataaccttaatgtgtc

SEQ ID NO: 1275845 - DNA, 22 bp, Artificial Sequence
  chemically synthesized
gcagacacattaaggttatgct

SEQ ID NO: 1275846 - DNA, 22 bp, Artificial Sequence
  chemically synthesized
aggttatgcttttgagttctat

SEQ ID NO: 1275847 - DNA, 22 bp, Artificial Sequence
  chemically synthesized
tgcttttgagttctattgcttt

SEQ ID NO: 1275848 - DNA, 22 bp, Artificial Sequence
  chemically synthesized
ttgagttctattgcttttctgt

SEQ ID NO: 1275849 - DNA, 22 bp, Artificial Sequence
  chemically synthesized
tgagttctattgcttttctgta

SEQ ID NO: 1275850 - DNA, 22 bp, Artificial Sequence
  chemically synthesized
gagttctattgcttttctgtac

SEQ ID NO: 1275851 - DNA, 22 bp, Artificial Sequence
  chemically synthesized
agttctattgcttttctgtact

SEQ ID NO: 1275852 - DNA, 22 bp, Artificial Sequence
  chemically synthesized
tattgcttttctgtacttctgt

SEQ ID NO: 1275853 - DNA, 22 bp, Artificial Sequence
  chemically synthesized
aaatcaaataaaacagaagtac

SEQ ID NO: 1275854 - DNA, 22 bp, Artificial Sequence
  chemically synthesized
caaatcaaataaaacagaagta

SEQ ID NO: 1275855 - DNA, 22 bp, Artificial Sequence
  chemically synthesized
ttgcttttctgtacttctgttt

SEQ ID NO: 1275856 - DNA, 22 bp, Artificial Sequence
  chemically synthesized
tcaaatcaaataaaacagaagt

SEQ ID NO: 1275857 - DNA, 22 bp, Artificial Sequence
  chemically synthesized
cttttctgtacttctgttttat

SEQ ID NO: 1275858 - DNA, 22 bp, Artificial Sequence
  chemically synthesized
ttctgtacttctgttttatttg

SEQ ID NO: 1275859 - DNA, 22 bp, Artificial Sequence
  chemically synthesized
tctgtacttctgttttatttga

SEQ ID NO: 1275860 - DNA, 22 bp, Artificial Sequence
  chemically synthesized
ctgtacttctgttttatttgat

SEQ ID NO: 1275861 - DNA, 22 bp, Artificial Sequence
  chemically synthesized
tgtacttctgttttatttgatt

SEQ ID NO: 1275862 - DNA, 22 bp, Artificial Sequence
  chemically synthesized
tacttctgttttatttgatttg

SEQ ID NO: 1275863 - DNA, 22 bp, Artificial Sequence
  chemically synthesized
ctgttttatttgatttgaaaat

SEQ ID NO: 1275864 - DNA, 22 bp, Artificial Sequence
  chemically synthesized
tgttttatttgatttgaaaata

SEQ ID NO: 1275865 - DNA, 22 bp, Artificial Sequence
  chemically synthesized
caacaacaaatcatattttcaa

SEQ ID NO: 1275866 - DNA, 22 bp, Artificial Sequence
  chemically synthesized
ttttatttgatttgaaaatatg

SEQ ID NO: 1275867 - DNA, 22 bp, Artificial Sequence
  chemically synthesized
tatttgatttgaaaatatgatt

SEQ ID NO: 1275868 - DNA, 22 bp, Artificial Sequence
  chemically synthesized
atttgatttgaaaatatgattt

SEQ ID NO: 1275869 - DNA, 22 bp, Artificial Sequence
  chemically synthesized
tttgatttgaaaatatgatttg

SEQ ID NO: 1275870 - DNA, 22 bp, Artificial Sequence
  chemically synthesized
gatttgaaaatatgatttgttg

SEQ ID NO: 1275871 - DNA, 22 bp, Artificial Sequence
  chemically synthesized
atttgaaaatatgatttgttgt

SEQ ID NO: 1275872 - DNA, 22 bp, Artificial Sequence
  chemically synthesized
gaaaatatgatttgttgttgta

SEQ ID NO: 1275873 - DNA, 22 bp, Artificial Sequence
  chemically synthesized
aaaatatgatttgttgttgtag

SEQ ID NO: 1275874 - DNA, 22 bp, Artificial Sequence
  chemically synthesized
tggtgaaagggcatatagatct

SEQ ID NO: 1275875 - DNA, 22 bp, Artificial Sequence
  chemically synthesized
atggtgaaagggcatatagatc

SEQ ID NO: 1275876 - DNA, 22 bp, Artificial Sequence
  chemically synthesized
tatggtgaaagggcatatagat

SEQ ID NO: 1275877 - DNA, 22 bp, Artificial Sequence
  chemically synthesized
gttgttgtagatctatatgccc

SEQ ID NO: 1275878 - DNA, 22 bp, Artificial Sequence
  chemically synthesized
tttatggtgaaagggcatatag

SEQ ID NO: 1275879 - DNA, 22 bp, Artificial Sequence
  chemically synthesized
ttgttgtagatctatatgccct

SEQ ID NO: 1275880 - DNA, 22 bp, Artificial Sequence
  chemically synthesized
ttgtagatctatatgccctttc

SEQ ID NO: 1275881 - DNA, 22 bp, Artificial Sequence
  chemically synthesized
tagatctatatgccctttcacc

SEQ ID NO: 1275882 - DNA, 22 bp, Artificial Sequence
  chemically synthesized
tatgccctttcaccataaagag

SEQ ID NO: 1275883 - DNA, 22 bp, Artificial Sequence
  chemically synthesized
tcaccataaagagtgtgccctt

SEQ ID NO: 1275884 - DNA, 22 bp, Artificial Sequence
  chemically synthesized
caccataaagagtgtgcccttt

SEQ ID NO: 1275885 - DNA, 22 bp, Artificial Sequence
  chemically synthesized
accataaagagtgtgccctttg

SEQ ID NO: 1275886 - DNA, 22 bp, Artificial Sequence
  chemically synthesized
tagaagcacgaatataaaacaa

SEQ ID NO: 1275887 - DNA, 22 bp, Artificial Sequence
  chemically synthesized
cctatagaagcacgaatataaa

SEQ ID NO: 1275888 - DNA, 22 bp, Artificial Sequence
  chemically synthesized
acctatagaagcacgaatataa

SEQ ID NO: 1275889 - DNA, 22 bp, Artificial Sequence
  chemically synthesized
aaatttacctatagaagcacga

SEQ ID NO: 1275890 - DNA, 22 bp, Artificial Sequence
  chemically synthesized
tgttttatattcgtgcttctat

SEQ ID NO: 1275891 - DNA, 22 bp, Artificial Sequence
  chemically synthesized
gttttatattcgtgcttctata

SEQ ID NO: 1275892 - DNA, 22 bp, Artificial Sequence
  chemically synthesized
ttaaaatttacctatagaagca

SEQ ID NO: 1275893 - DNA, 22 bp, Artificial Sequence
  chemically synthesized
ttttatattcgtgcttctatag

SEQ ID NO: 1275894 - DNA, 22 bp, Artificial Sequence
  chemically synthesized
attaaaatttacctatagaagc

SEQ ID NO: 1275895 - DNA, 22 bp, Artificial Sequence
  chemically synthesized
tattaaaatttacctatagaag

SEQ ID NO: 1275896 - DNA, 22 bp, Artificial Sequence
  chemically synthesized
ttattaaaatttacctatagaa

SEQ ID NO: 1275897 - DNA, 22 bp, Artificial Sequence
  chemically synthesized
tatattcgtgcttctataggta

SEQ ID NO: 1275898 - DNA, 22 bp, Artificial Sequence
  chemically synthesized
atattcgtgcttctataggtaa

SEQ ID NO: 1275899 - DNA, 22 bp, Artificial Sequence
  chemically synthesized
tattcgtgcttctataggtaaa

SEQ ID NO: 1275900 - DNA, 22 bp, Artificial Sequence
  chemically synthesized
tttttattaaaatttacctata

SEQ ID NO: 1275901 - DNA, 22 bp, Artificial Sequence
  chemically synthesized
gtgcttctataggtaaatttta

SEQ ID NO: 1275902 - DNA, 22 bp, Artificial Sequence
  chemically synthesized
aaattatttttattaaaattta

SEQ ID NO: 1275903 - DNA, 22 bp, Artificial Sequence
  chemically synthesized
attaaaattatttttattaaaa

SEQ ID NO: 1275904 - DNA, 22 bp, Artificial Sequence
  chemically synthesized
ctataggtaaattttaataaaa

SEQ ID NO: 1275905 - DNA, 22 bp, Artificial Sequence
  chemically synthesized
tataggtaaattttaataaaaa

SEQ ID NO: 1275906 - DNA, 22 bp, Artificial Sequence
  chemically synthesized
taggtaaattttaataaaaata

SEQ ID NO: 1275907 - DNA, 22 bp, Artificial Sequence
  chemically synthesized
aaccaatgctgattaaaattat

SEQ ID NO: 1275908 - DNA, 22 bp, Artificial Sequence
  chemically synthesized
taataaaaataattttaatcag

SEQ ID NO: 1275909 - DNA, 22 bp, Artificial Sequence
  chemically synthesized
aataaaaataattttaatcagc

SEQ ID NO: 1275910 - DNA, 22 bp, Artificial Sequence
  chemically synthesized
tgctcaaccaatgctgattaaa

SEQ ID NO: 1275911 - DNA, 22 bp, Artificial Sequence
  chemically synthesized
ataaaaataattttaatcagca

SEQ ID NO: 1275912 - DNA, 22 bp, Artificial Sequence
  chemically synthesized
taatcagcattggttgagcata

SEQ ID NO: 1275913 - DNA, 22 bp, Artificial Sequence
  chemically synthesized
aatcagcattggttgagcatag

SEQ ID NO: 1275914 - DNA, 22 bp, Artificial Sequence
  chemically synthesized
atcagcattggttgagcatagg

SEQ ID NO: 1275915 - DNA, 22 bp, Artificial Sequence
  chemically synthesized
aagaaataaaaagccctatgct

SEQ ID NO: 1275916 - DNA, 22 bp, Artificial Sequence
  chemically synthesized
aaagaaataaaaagccctatgc

SEQ ID NO: 1275917 - DNA, 22 bp, Artificial Sequence
  chemically synthesized
gttgagcatagggctttttatt

SEQ ID NO: 1275918 - DNA, 22 bp, Artificial Sequence
  chemically synthesized
agcatagggctttttatttctt

SEQ ID NO: 1275919 - DNA, 22 bp, Artificial Sequence
  chemically synthesized
agtaataaacaggccagtttaa

SEQ ID NO: 1275920 - DNA, 22 bp, Artificial Sequence
  chemically synthesized
tttatttctttaaactggcctg

SEQ ID NO: 1275921 - DNA, 22 bp, Artificial Sequence
  chemically synthesized
ttatttctttaaactggcctgt

SEQ ID NO: 1275922 - DNA, 22 bp, Artificial Sequence
  chemically synthesized
tatttctttaaactggcctgtt

SEQ ID NO: 1275923 - DNA, 22 bp, Artificial Sequence
  chemically synthesized
atttctttaaactggcctgttt

SEQ ID NO: 1275924 - DNA, 22 bp, Artificial Sequence
  chemically synthesized
tttctttaaactggcctgttta

SEQ ID NO: 1275925 - DNA, 22 bp, Artificial Sequence
  chemically synthesized
aaacctgagtaataaacaggcc

SEQ ID NO: 1275926 - DNA, 22 bp, Artificial Sequence
  chemically synthesized
ctttaaactggcctgtttatta

SEQ ID NO: 1275927 - DNA, 22 bp, Artificial Sequence
  chemically synthesized
ctcaaacctgagtaataaacag

SEQ ID NO: 1275928 - DNA, 22 bp, Artificial Sequence
  chemically synthesized
tttaaactggcctgtttattac

SEQ ID NO: 1275929 - DNA, 22 bp, Artificial Sequence
  chemically synthesized
taaactggcctgtttattactc

SEQ ID NO: 1275930 - DNA, 22 bp, Artificial Sequence
  chemically synthesized
aaactggcctgtttattactca

SEQ ID NO: 1275931 - DNA, 22 bp, Artificial Sequence
  chemically synthesized
aactggcctgtttattactcag

SEQ ID NO: 1275932 - DNA, 22 bp, Artificial Sequence
  chemically synthesized
gcctgtttattactcaggtttg

SEQ ID NO: 1275933 - DNA, 22 bp, Artificial Sequence
  chemically synthesized
tttattactcaggtttgagtag

SEQ ID NO: 1275934 - DNA, 22 bp, Artificial Sequence
  chemically synthesized
gtatagtgtagtgctactcaaa

SEQ ID NO: 1275935 - DNA, 22 bp, Artificial Sequence
  chemically synthesized
ggtatagtgtagtgctactcaa

SEQ ID NO: 1275936 - DNA, 22 bp, Artificial Sequence
  chemically synthesized
attactcaggtttgagtagcac

SEQ ID NO: 1275937 - DNA, 22 bp, Artificial Sequence
  chemically synthesized
ttactcaggtttgagtagcact

SEQ ID NO: 1275938 - DNA, 22 bp, Artificial Sequence
  chemically synthesized
ctcaggtttgagtagcactaca

SEQ ID NO: 1275939 - DNA, 22 bp, Artificial Sequence
  chemically synthesized
atgcttggtatagtgtagtgct

SEQ ID NO: 1275940 - DNA, 22 bp, Artificial Sequence
  chemically synthesized
catgcttggtatagtgtagtgc

SEQ ID NO: 1275941 - DNA, 22 bp, Artificial Sequence
  chemically synthesized
aggtttgagtagcactacacta

SEQ ID NO: 1275942 - DNA, 22 bp, Artificial Sequence
  chemically synthesized
cttcatgcttggtatagtgtag

SEQ ID NO: 1275943 - DNA, 22 bp, Artificial Sequence
  chemically synthesized
gcttcatgcttggtatagtgta

SEQ ID NO: 1275944 - DNA, 22 bp, Artificial Sequence
  chemically synthesized
tgcttcatgcttggtatagtgt

SEQ ID NO: 1275945 - DNA, 22 bp, Artificial Sequence
  chemically synthesized
gagtagcactacactataccaa

SEQ ID NO: 1275946 - DNA, 22 bp, Artificial Sequence
  chemically synthesized
agtagcactacactataccaag

SEQ ID NO: 1275947 - DNA, 22 bp, Artificial Sequence
  chemically synthesized
agacattttgcttcatgcttgg

SEQ ID NO: 1275948 - DNA, 22 bp, Artificial Sequence
  chemically synthesized
cactataccaagcatgaagcaa

SEQ ID NO: 1275949 - DNA, 22 bp, Artificial Sequence
  chemically synthesized
gtgttaagacattttgcttcat

SEQ ID NO: 1275950 - DNA, 22 bp, Artificial Sequence
  chemically synthesized
taccaagcatgaagcaaaatgt

SEQ ID NO: 1275951 - DNA, 22 bp, Artificial Sequence
  chemically synthesized
ccctagtgttaagacattttgc

SEQ ID NO: 1275952 - DNA, 22 bp, Artificial Sequence
  chemically synthesized
cccctagtgttaagacattttg

SEQ ID NO: 1275953 - DNA, 22 bp, Artificial Sequence
  chemically synthesized
agcttcccctagtgttaagaca

SEQ ID NO: 1275954 - DNA, 22 bp, Artificial Sequence
  chemically synthesized
caaagaaccaagctcagcttcc

SEQ ID NO: 1275955 - DNA, 22 bp, Artificial Sequence
  chemically synthesized
tacaaagaaccaagctcagctt

SEQ ID NO: 1275956 - DNA, 22 bp, Artificial Sequence
  chemically synthesized
aacactaggggaagctgagctt

SEQ ID NO: 1275957 - DNA, 22 bp, Artificial Sequence
  chemically synthesized
ctacaaagaaccaagctcagct

SEQ ID NO: 1275958 - DNA, 22 bp, Artificial Sequence
  chemically synthesized
acactaggggaagctgagcttg

SEQ ID NO: 1275959 - DNA, 22 bp, Artificial Sequence
  chemically synthesized
tctacaaagaaccaagctcagc

SEQ ID NO: 1275960 - DNA, 22 bp, Artificial Sequence
  chemically synthesized
ttctacaaagaaccaagctcag

SEQ ID NO: 1275961 - DNA, 22 bp, Artificial Sequence
  chemically synthesized
ggggaagctgagcttggttctt

SEQ ID NO: 1275962 - DNA, 22 bp, Artificial Sequence
  chemically synthesized
gatagagtttttctacaaagaa

SEQ ID NO: 1275963 - DNA, 22 bp, Artificial Sequence
  chemically synthesized
ctggatagagtttttctacaaa

SEQ ID NO: 1275964 - DNA, 22 bp, Artificial Sequence
  chemically synthesized
agcttggttctttgtagaaaaa

SEQ ID NO: 1275965 - DNA, 22 bp, Artificial Sequence
  chemically synthesized
ggttctttgtagaaaaactcta

SEQ ID NO: 1275966 - DNA, 22 bp, Artificial Sequence
  chemically synthesized
gttctttgtagaaaaactctat

SEQ ID NO: 1275967 - DNA, 22 bp, Artificial Sequence
  chemically synthesized
ccccatgtctcctggatagagt

SEQ ID NO: 1275968 - DNA, 22 bp, Artificial Sequence
  chemically synthesized
tttgtagaaaaactctatccag

SEQ ID NO: 1275969 - DNA, 22 bp, Artificial Sequence
  chemically synthesized
tgtagaaaaactctatccagga

SEQ ID NO: 1275970 - DNA, 22 bp, Artificial Sequence
  chemically synthesized
gtagaaaaactctatccaggag

SEQ ID NO: 1275971 - DNA, 22 bp, Artificial Sequence
  chemically synthesized
tagaaaaactctatccaggaga

SEQ ID NO: 1275972 - DNA, 22 bp, Artificial Sequence
  chemically synthesized
atctaccccatgtctcctggat

SEQ ID NO: 1275973 - DNA, 22 bp, Artificial Sequence
  chemically synthesized
tattaatctaccccatgtctcc

SEQ ID NO: 1275974 - DNA, 22 bp, Artificial Sequence
  chemically synthesized
tatccaggagacatggggtaga

SEQ ID NO: 1275975 - DNA, 22 bp, Artificial Sequence
  chemically synthesized
tccaggagacatggggtagatt

SEQ ID NO: 1275976 - DNA, 22 bp, Artificial Sequence
  chemically synthesized
atacagacattcacacacacct

SEQ ID NO: 1275977 - DNA, 22 bp, Artificial Sequence
  chemically synthesized
ccatatgtgtggaggtgtgtgt

SEQ ID NO: 1275978 - DNA, 22 bp, Artificial Sequence
  chemically synthesized
cccatatgtgtggaggtgtgtg

SEQ ID NO: 1275979 - DNA, 22 bp, Artificial Sequence
  chemically synthesized
aaccttcccatatgtgtggagg

SEQ ID NO: 1275980 - DNA, 22 bp, Artificial Sequence
  chemically synthesized
caaccttcccatatgtgtggag

SEQ ID NO: 1275981 - DNA, 22 bp, Artificial Sequence
  chemically synthesized
ttcaaccttcccatatgtgtgg

SEQ ID NO: 1275982 - DNA, 22 bp, Artificial Sequence
  chemically synthesized
acacacacctccacacatatgg

SEQ ID NO: 1275983 - DNA, 22 bp, Artificial Sequence
  chemically synthesized
caaattcttcaaccttcccata

SEQ ID NO: 1275984 - DNA, 22 bp, Artificial Sequence
  chemically synthesized
cacacatatgggaaggttgaag

SEQ ID NO: 1275985 - DNA, 22 bp, Artificial Sequence
  chemically synthesized
ataaaacgatgatgttacaaat

SEQ ID NO: 1275986 - DNA, 22 bp, Artificial Sequence
  chemically synthesized
aataaaacgatgatgttacaaa

SEQ ID NO: 1275987 - DNA, 22 bp, Artificial Sequence
  chemically synthesized
taataaaacgatgatgttacaa

SEQ ID NO: 1275988 - DNA, 22 bp, Artificial Sequence
  chemically synthesized
ttttaataaaacgatgatgtta

SEQ ID NO: 1275989 - DNA, 22 bp, Artificial Sequence
  chemically synthesized
gttttaataaaacgatgatgtt

SEQ ID NO: 1275990 - DNA, 22 bp, Artificial Sequence
  chemically synthesized
tgttttaataaaacgatgatgt

SEQ ID NO: 1275991 - DNA, 22 bp, Artificial Sequence
  chemically synthesized
aagaatttgtaacatcatcgtt

SEQ ID NO: 1275992 - DNA, 22 bp, Artificial Sequence
  chemically synthesized
gtaacatcatcgttttattaaa

SEQ ID NO: 1275993 - DNA, 22 bp, Artificial Sequence
  chemically synthesized
taacatcatcgttttattaaaa

SEQ ID NO: 1275994 - DNA, 22 bp, Artificial Sequence
  chemically synthesized
tattaaaacaaaatatgtctca

SEQ ID NO: 1275995 - DNA, 22 bp, Artificial Sequence
  chemically synthesized
attaaaacaaaatatgtctcac

SEQ ID NO: 1275996 - DNA, 22 bp, Artificial Sequence
  chemically synthesized
ttaaaacaaaatatgtctcacc

SEQ ID NO: 1275997 - DNA, 22 bp, Artificial Sequence
  chemically synthesized
aaacaaaatatgtctcaccaca

SEQ ID NO: 1275998 - DNA, 22 bp, Artificial Sequence
  chemically synthesized
accacattgttgggtacatgtt

SEQ ID NO: 1275999 - DNA, 22 bp, Artificial Sequence
  chemically synthesized
agccagatcagtaacatgtacc

SEQ ID NO: 1276000 - DNA, 22 bp, Artificial Sequence
  chemically synthesized
ttaagccagatcagtaacatgt

SEQ ID NO: 1276001 - DNA, 22 bp, Artificial Sequence
  chemically synthesized
ttgggtacatgttactgatctg

SEQ ID NO: 1276002 - DNA, 22 bp, Artificial Sequence
  chemically synthesized
tatattattaagccagatcagt

SEQ ID NO: 1276003 - DNA, 22 bp, Artificial Sequence
  chemically synthesized
ggtacatgttactgatctggct

SEQ ID NO: 1276004 - DNA, 22 bp, Artificial Sequence
  chemically synthesized
aatcctatatattattaagcca

SEQ ID NO: 1276005 - DNA, 22 bp, Artificial Sequence
  chemically synthesized
ctgatctggcttaataatatat

SEQ ID NO: 1276006 - DNA, 22 bp, Artificial Sequence
  chemically synthesized
atctggcttaataatatatagg

SEQ ID NO: 1276007 - DNA, 22 bp, Artificial Sequence
  chemically synthesized
gcttaataatatataggattta

SEQ ID NO: 1276008 - DNA, 22 bp, Artificial Sequence
  chemically synthesized
aataatatataggatttaactt

SEQ ID NO: 1276009 - DNA, 22 bp, Artificial Sequence
  chemically synthesized
ataatatataggatttaacttc

SEQ ID NO: 1276010 - DNA, 22 bp, Artificial Sequence
  chemically synthesized
caagcatatcaagtacaggaag

SEQ ID NO: 1276011 - DNA, 22 bp, Artificial Sequence
  chemically synthesized
cctccaagcatatcaagtacag

SEQ ID NO: 1276012 - DNA, 22 bp, Artificial Sequence
  chemically synthesized
aacttcctgtacttgatatgct

SEQ ID NO: 1276013 - DNA, 22 bp, Artificial Sequence
  chemically synthesized
acttcctgtacttgatatgctt

SEQ ID NO: 1276014 - DNA, 22 bp, Artificial Sequence
  chemically synthesized
cctgtacttgatatgcttggag

SEQ ID NO: 1276015 - DNA, 22 bp, Artificial Sequence
  chemically synthesized
cagtaatattgcctccaagcat

SEQ ID NO: 1276016 - DNA, 22 bp, Artificial Sequence
  chemically synthesized
ctgtacttgatatgcttggagg

SEQ ID NO: 1276017 - DNA, 22 bp, Artificial Sequence
  chemically synthesized
tacttgatatgcttggaggcaa

SEQ ID NO: 1276018 - DNA, 22 bp, Artificial Sequence
  chemically synthesized
tactgcagtaatattgcctcca

SEQ ID NO: 1276019 - DNA, 22 bp, Artificial Sequence
  chemically synthesized
gtactgcagtaatattgcctcc

SEQ ID NO: 1276020 - DNA, 22 bp, Artificial Sequence
  chemically synthesized
gatatgcttggaggcaatatta

SEQ ID NO: 1276021 - DNA, 22 bp, Artificial Sequence
  chemically synthesized
atatgcttggaggcaatattac

SEQ ID NO: 1276022 - DNA, 22 bp, Artificial Sequence
  chemically synthesized
gcttgtactgcagtaatattgc

SEQ ID NO: 1276023 - DNA, 22 bp, Artificial Sequence
  chemically synthesized
ggaggcaatattactgcagtac

SEQ ID NO: 1276024 - DNA, 22 bp, Artificial Sequence
  chemically synthesized
atgccctggcttgtactgcagt

SEQ ID NO: 1276025 - DNA, 22 bp, Artificial Sequence
  chemically synthesized
gaggcaatattactgcagtaca

SEQ ID NO: 1276026 - DNA, 22 bp, Artificial Sequence
  chemically synthesized
ctgcagtacaagccagggcatc

SEQ ID NO: 1276027 - DNA, 22 bp, Artificial Sequence
  chemically synthesized
cagtacaagccagggcatcagt

SEQ ID NO: 1276028 - DNA, 22 bp, Artificial Sequence
  chemically synthesized
acaaaagcatagtgaaactgat

SEQ ID NO: 1276029 - DNA, 22 bp, Artificial Sequence
  chemically synthesized
tgctgacaaaagcatagtgaaa

SEQ ID NO: 1276030 - DNA, 22 bp, Artificial Sequence
  chemically synthesized
tatgctgacaaaagcatagtga

SEQ ID NO: 1276031 - DNA, 22 bp, Artificial Sequence
  chemically synthesized
ctatgctgacaaaagcatagtg

SEQ ID NO: 1276032 - DNA, 22 bp, Artificial Sequence
  chemically synthesized
tctatgctgacaaaagcatagt

SEQ ID NO: 1276033 - DNA, 22 bp, Artificial Sequence
  chemically synthesized
ctttctatgctgacaaaagcat

SEQ ID NO: 1276034 - DNA, 22 bp, Artificial Sequence
  chemically synthesized
gtgctactttctatgctgacaa

SEQ ID NO: 1276035 - DNA, 22 bp, Artificial Sequence
  chemically synthesized
cactatgcttttgtcagcatag

SEQ ID NO: 1276036 - DNA, 22 bp, Artificial Sequence
  chemically synthesized
tagtgctactttctatgctgac

SEQ ID NO: 1276037 - DNA, 22 bp, Artificial Sequence
  chemically synthesized
actatgcttttgtcagcataga

SEQ ID NO: 1276038 - DNA, 22 bp, Artificial Sequence
  chemically synthesized
tgcttttgtcagcatagaaagt

SEQ ID NO: 1276039 - DNA, 22 bp, Artificial Sequence
  chemically synthesized
tcctctagtgctactttctatg

SEQ ID NO: 1276040 - DNA, 22 bp, Artificial Sequence
  chemically synthesized
gtcctctagtgctactttctat

SEQ ID NO: 1276041 - DNA, 22 bp, Artificial Sequence
  chemically synthesized
tgtcctctagtgctactttcta

SEQ ID NO: 1276042 - DNA, 22 bp, Artificial Sequence
  chemically synthesized
ttgtcagcatagaaagtagcac

SEQ ID NO: 1276043 - DNA, 22 bp, Artificial Sequence
  chemically synthesized
tgtcagcatagaaagtagcact

SEQ ID NO: 1276044 - DNA, 22 bp, Artificial Sequence
  chemically synthesized
attttgtcctctagtgctactt

SEQ ID NO: 1276045 - DNA, 22 bp, Artificial Sequence
  chemically synthesized
gtcagcatagaaagtagcacta

SEQ ID NO: 1276046 - DNA, 22 bp, Artificial Sequence
  chemically synthesized
tcagcatagaaagtagcactag

SEQ ID NO: 1276047 - DNA, 22 bp, Artificial Sequence
  chemically synthesized
aaattcattttgtcctctagtg

SEQ ID NO: 1276048 - DNA, 22 bp, Artificial Sequence
  chemically synthesized
gttcaaattcattttgtcctct

SEQ ID NO: 1276049 - DNA, 22 bp, Artificial Sequence
  chemically synthesized
attggttcaaattcattttgtc

SEQ ID NO: 1276050 - DNA, 22 bp, Artificial Sequence
  chemically synthesized
cattggttcaaattcattttgt

SEQ ID NO: 1276051 - DNA, 22 bp, Artificial Sequence
  chemically synthesized
gaggacaaaatgaatttgaacc

SEQ ID NO: 1276052 - DNA, 22 bp, Artificial Sequence
  chemically synthesized
tatgaaagcttcattggttcaa

SEQ ID NO: 1276053 - DNA, 22 bp, Artificial Sequence
  chemically synthesized
agggtattgtatgaaagcttca

SEQ ID NO: 1276054 - DNA, 22 bp, Artificial Sequence
  chemically synthesized
cagggtattgtatgaaagcttc

SEQ ID NO: 1276055 - DNA, 22 bp, Artificial Sequence
  chemically synthesized
gaaccaatgaagctttcataca

SEQ ID NO: 1276056 - DNA, 22 bp, Artificial Sequence
  chemically synthesized
aaccaatgaagctttcatacaa

SEQ ID NO: 1276057 - DNA, 22 bp, Artificial Sequence
  chemically synthesized
gtacccttcagggtattgtatg

SEQ ID NO: 1276058 - DNA, 22 bp, Artificial Sequence
  chemically synthesized
cactagtacccttcagggtatt

SEQ ID NO: 1276059 - DNA, 22 bp, Artificial Sequence
  chemically synthesized
acactagtacccttcagggtat

SEQ ID NO: 1276060 - DNA, 22 bp, Artificial Sequence
  chemically synthesized
tcttacactagtacccttcagg

SEQ ID NO: 1276061 - DNA, 22 bp, Artificial Sequence
  chemically synthesized
tcatacaataccctgaagggta

SEQ ID NO: 1276062 - DNA, 22 bp, Artificial Sequence
  chemically synthesized
catacaataccctgaagggtac

SEQ ID NO: 1276063 - DNA, 22 bp, Artificial Sequence
  chemically synthesized
atacaataccctgaagggtact

SEQ ID NO: 1276064 - DNA, 22 bp, Artificial Sequence
  chemically synthesized
cccctgtcttacactagtaccc

SEQ ID NO: 1276065 - DNA, 22 bp, Artificial Sequence
  chemically synthesized
gcccctgtcttacactagtacc

SEQ ID NO: 1276066 - DNA, 22 bp, Artificial Sequence
  chemically synthesized
ttgcccctgtcttacactagta

SEQ ID NO: 1276067 - DNA, 22 bp, Artificial Sequence
  chemically synthesized
cttgcccctgtcttacactagt

SEQ ID NO: 1276068 - DNA, 22 bp, Artificial Sequence
  chemically synthesized
tcttgcccctgtcttacactag

SEQ ID NO: 1276069 - DNA, 22 bp, Artificial Sequence
  chemically synthesized
tttcttgcccctgtcttacact

SEQ ID NO: 1276070 - DNA, 22 bp, Artificial Sequence
  chemically synthesized
ctttcttgcccctgtcttacac

SEQ ID NO: 1276071 - DNA, 22 bp, Artificial Sequence
  chemically synthesized
aagggtactagtgtaagacagg

SEQ ID NO: 1276072 - DNA, 22 bp, Artificial Sequence
  chemically synthesized
tttctttcttgcccctgtctta

SEQ ID NO: 1276073 - DNA, 22 bp, Artificial Sequence
  chemically synthesized
gtgtaagacaggggcaagaaag

SEQ ID NO: 1276074 - DNA, 22 bp, Artificial Sequence
  chemically synthesized
acatcatcactgtttctttctt

SEQ ID NO: 1276075 - DNA, 22 bp, Artificial Sequence
  chemically synthesized
tcgggtcacatctcacatcatc

SEQ ID NO: 1276076 - DNA, 22 bp, Artificial Sequence
  chemically synthesized
tgtagatccatgaaggacagtt

SEQ ID NO: 1276077 - DNA, 22 bp, Artificial Sequence
  chemically synthesized
cagaggttgtgtagatccatga

SEQ ID NO: 1276078 - DNA, 22 bp, Artificial Sequence
  chemically synthesized
ccagaggttgtgtagatccatg

SEQ ID NO: 1276079 - DNA, 22 bp, Artificial Sequence
  chemically synthesized
tccttcatggatctacacaacc

SEQ ID NO: 1276080 - DNA, 22 bp, Artificial Sequence
  chemically synthesized
catggatctacacaacctctgg

SEQ ID NO: 1276081 - DNA, 22 bp, Artificial Sequence
  chemically synthesized
atggatctacacaacctctgga

SEQ ID NO: 1276082 - DNA, 22 bp, Artificial Sequence
  chemically synthesized
caggcagaaggcatttccagag

SEQ ID NO: 1276083 - DNA, 22 bp, Artificial Sequence
  chemically synthesized
gcaggcagaaggcatttccaga

SEQ ID NO: 1276084 - DNA, 22 bp, Artificial Sequence
  chemically synthesized
ttgcaggcagaaggcatttcca

SEQ ID NO: 1276085 - DNA, 22 bp, Artificial Sequence
  chemically synthesized
cttgcaggcagaaggcatttcc

SEQ ID NO: 1276086 - DNA, 22 bp, Artificial Sequence
  chemically synthesized
cacaacctctggaaatgccttc

SEQ ID NO: 1276087 - DNA, 22 bp, Artificial Sequence
  chemically synthesized
acgcttcttgcaggcagaaggc

SEQ ID NO: 1276088 - DNA, 22 bp, Artificial Sequence
  chemically synthesized
ctgacgcttcttgcaggcagaa

SEQ ID NO: 1276089 - DNA, 22 bp, Artificial Sequence
  chemically synthesized
tggaaatgccttctgcctgcaa

SEQ ID NO: 1276090 - DNA, 22 bp, Artificial Sequence
  chemically synthesized
gaaatgccttctgcctgcaaga

SEQ ID NO: 1276091 - DNA, 22 bp, Artificial Sequence
  chemically synthesized
gggctcctgacgcttcttgcag

SEQ ID NO: 1276092 - DNA, 22 bp, Artificial Sequence
  chemically synthesized
tagggctcctgacgcttcttgc

SEQ ID NO: 1276093 - DNA, 22 bp, Artificial Sequence
  chemically synthesized
ctgcctgcaagaagcgtcagga

SEQ ID NO: 1276094 - DNA, 22 bp, Artificial Sequence
  chemically synthesized
tgcctgcaagaagcgtcaggag

SEQ ID NO: 1276095 - DNA, 22 bp, Artificial Sequence
  chemically synthesized
cctgcaagaagcgtcaggagcc

SEQ ID NO: 1276096 - DNA, 22 bp, Artificial Sequence
  chemically synthesized
gcatatgttctagggctcctga

SEQ ID NO: 1276097 - DNA, 22 bp, Artificial Sequence
  chemically synthesized
caagaagcgtcaggagccctag

SEQ ID NO: 1276098 - DNA, 22 bp, Artificial Sequence
  chemically synthesized
tatatattagcatatgttctag

SEQ ID NO: 1276099 - DNA, 22 bp, Artificial Sequence
  chemically synthesized
attatatatattagcatatgtt

SEQ ID NO: 1276100 - DNA, 22 bp, Artificial Sequence
  chemically synthesized
aattatatatattagcatatgt

SEQ ID NO: 1276101 - DNA, 22 bp, Artificial Sequence
  chemically synthesized
cttaattatatatattagcata

SEQ ID NO: 1276102 - DNA, 22 bp, Artificial Sequence
  chemically synthesized
gcctccttaattatatatatta

SEQ ID NO: 1276103 - DNA, 22 bp, Artificial Sequence
  chemically synthesized
ggcctccttaattatatatatt

SEQ ID NO: 1276104 - DNA, 22 bp, Artificial Sequence
  chemically synthesized
gaacatatgctaatatatataa

SEQ ID NO: 1276105 - DNA, 22 bp, Artificial Sequence
  chemically synthesized
tggcctccttaattatatatat

SEQ ID NO: 1276106 - DNA, 22 bp, Artificial Sequence
  chemically synthesized
tctttggcctccttaattatat

SEQ ID NO: 1276107 - DNA, 22 bp, Artificial Sequence
  chemically synthesized
atatatataattaaggaggcca

SEQ ID NO: 1276108 - DNA, 22 bp, Artificial Sequence
  chemically synthesized
aatagagtggtatgattgtctt

SEQ ID NO: 1276109 - DNA, 22 bp, Artificial Sequence
  chemically synthesized
aggaggccaaagacaatcatac

SEQ ID NO: 1276110 - DNA, 22 bp, Artificial Sequence
  chemically synthesized
gttgaatagagtggtatgattg

SEQ ID NO: 1276111 - DNA, 22 bp, Artificial Sequence
  chemically synthesized
cgttgaatagagtggtatgatt

SEQ ID NO: 1276112 - DNA, 22 bp, Artificial Sequence
  chemically synthesized
tattcaacgaaatttatatatt

SEQ ID NO: 1276113 - DNA, 22 bp, Artificial Sequence
  chemically synthesized
ttcaacgaaatttatatattca

SEQ ID NO: 1276114 - DNA, 22 bp, Artificial Sequence
  chemically synthesized
aacgaaatttatatattcacat

SEQ ID NO: 1276115 - DNA, 22 bp, Artificial Sequence
  chemically synthesized
atatattcacatacatacacac

SEQ ID NO: 1276116 - DNA, 22 bp, Artificial Sequence
  chemically synthesized
tatattcacatacatacacaca

SEQ ID NO: 1276117 - DNA, 22 bp, Artificial Sequence
  chemically synthesized
acatacatacacacatatacac

SEQ ID NO: 1276118 - DNA, 22 bp, Artificial Sequence
  chemically synthesized
tatatgtggcatgcgtgtatat

SEQ ID NO: 1276119 - DNA, 22 bp, Artificial Sequence
  chemically synthesized
tgtatatgtggcatgcgtgtat

SEQ ID NO: 1276120 - DNA, 22 bp, Artificial Sequence
  chemically synthesized
ctgtatatgtggcatgcgtgta

SEQ ID NO: 1276121 - DNA, 22 bp, Artificial Sequence
  chemically synthesized
caatacacatgtatgcataaat

SEQ ID NO: 1276122 - DNA, 22 bp, Artificial Sequence
  chemically synthesized
aaactacaatacacatgtatgc

SEQ ID NO: 1276123 - DNA, 22 bp, Artificial Sequence
  chemically synthesized
tgaaactcaaactacaatacac

SEQ ID NO: 1276124 - DNA, 22 bp, Artificial Sequence
  chemically synthesized
atgcatacatgtgtattgtagt

SEQ ID NO: 1276125 - DNA, 22 bp, Artificial Sequence
  chemically synthesized
tgcatacatgtgtattgtagtt

SEQ ID NO: 1276126 - DNA, 22 bp, Artificial Sequence
  chemically synthesized
ttatgaaactcaaactacaata

SEQ ID NO: 1276127 - DNA, 22 bp, Artificial Sequence
  chemically synthesized
attatgaaactcaaactacaat

SEQ ID NO: 1276128 - DNA, 22 bp, Artificial Sequence
  chemically synthesized
tattatgaaactcaaactacaa

SEQ ID NO: 1276129 - DNA, 22 bp, Artificial Sequence
  chemically synthesized
agttttattatgaaactcaaac

SEQ ID NO: 1276130 - DNA, 22 bp, Artificial Sequence
  chemically synthesized
gagttttattatgaaactcaaa

SEQ ID NO: 1276131 - DNA, 22 bp, Artificial Sequence
  chemically synthesized
tgagttttattatgaaactcaa

SEQ ID NO: 1276132 - DNA, 22 bp, Artificial Sequence
  chemically synthesized
ttgagttttattatgaaactca

SEQ ID NO: 1276133 - DNA, 22 bp, Artificial Sequence
  chemically synthesized
acttttgagttttattatgaaa

SEQ ID NO: 1276134 - DNA, 22 bp, Artificial Sequence
  chemically synthesized
cacttttgagttttattatgaa

SEQ ID NO: 1276135 - DNA, 22 bp, Artificial Sequence
  chemically synthesized
tagtttgagtttcataataaaa

SEQ ID NO: 1276136 - DNA, 22 bp, Artificial Sequence
  chemically synthesized
tcttcacttttgagttttatta

SEQ ID NO: 1276137 - DNA, 22 bp, Artificial Sequence
  chemically synthesized
gagtttcataataaaactcaaa

SEQ ID NO: 1276138 - DNA, 22 bp, Artificial Sequence
  chemically synthesized
agtttcataataaaactcaaaa

SEQ ID NO: 1276139 - DNA, 22 bp, Artificial Sequence
  chemically synthesized
cataataaaactcaaaagtgaa

SEQ ID NO: 1276140 - DNA, 22 bp, Artificial Sequence
  chemically synthesized
ataataaaactcaaaagtgaag

SEQ ID NO: 1276141 - DNA, 22 bp, Artificial Sequence
  chemically synthesized
gtgtgcatgtgaactgtcttca

SEQ ID NO: 1276142 - DNA, 22 bp, Artificial Sequence
  chemically synthesized
aaaagtgaagacagttcacatg

SEQ ID NO: 1276143 - DNA, 22 bp, Artificial Sequence
  chemically synthesized
ataattcgtgtgcatgtgaact

SEQ ID NO: 1276144 - DNA, 22 bp, Artificial Sequence
  chemically synthesized
tgtctaataattcgtgtgcatg

SEQ ID NO: 1276145 - DNA, 22 bp, Artificial Sequence
  chemically synthesized
gtgtctaataattcgtgtgcat

SEQ ID NO: 1276146 - DNA, 22 bp, Artificial Sequence
  chemically synthesized
tgtgtctaataattcgtgtgca

SEQ ID NO: 1276147 - DNA, 22 bp, Artificial Sequence
  chemically synthesized
ttgtgtctaataattcgtgtgc

SEQ ID NO: 1276148 - DNA, 22 bp, Artificial Sequence
  chemically synthesized
caatttttgtgtctaataattc

SEQ ID NO: 1276149 - DNA, 22 bp, Artificial Sequence
  chemically synthesized
ccaatttttgtgtctaataatt

SEQ ID NO: 1276150 - DNA, 22 bp, Artificial Sequence
  chemically synthesized
acatgcacacgaattattagac

SEQ ID NO: 1276151 - DNA, 22 bp, Artificial Sequence
  chemically synthesized
cttccaatttttgtgtctaata

SEQ ID NO: 1276152 - DNA, 22 bp, Artificial Sequence
  chemically synthesized
cctccttccaatttttgtgtct

SEQ ID NO: 1276153 - DNA, 22 bp, Artificial Sequence
  chemically synthesized
acctccttccaatttttgtgtc

SEQ ID NO: 1276154 - DNA, 22 bp, Artificial Sequence
  chemically synthesized
tacctccttccaatttttgtgt

SEQ ID NO: 1276155 - DNA, 22 bp, Artificial Sequence
  chemically synthesized
tcctttacctccttccaatttt

SEQ ID NO: 1276156 - DNA, 22 bp, Artificial Sequence
  chemically synthesized
ttagacacaaaaattggaagga

SEQ ID NO: 1276157 - DNA, 22 bp, Artificial Sequence
  chemically synthesized
ttatcctttacctccttccaat

SEQ ID NO: 1276158 - DNA, 22 bp, Artificial Sequence
  chemically synthesized
attatcctttacctccttccaa

SEQ ID NO: 1276159 - DNA, 22 bp, Artificial Sequence
  chemically synthesized
tattatcctttacctccttcca

SEQ ID NO: 1276160 - DNA, 22 bp, Artificial Sequence
  chemically synthesized
gacacaaaaattggaaggaggt

SEQ ID NO: 1276161 - DNA, 22 bp, Artificial Sequence
  chemically synthesized
taacactttattatcctttacc

SEQ ID NO: 1276162 - DNA, 22 bp, Artificial Sequence
  chemically synthesized
ttataacactttattatccttt

SEQ ID NO: 1276163 - DNA, 22 bp, Artificial Sequence
  chemically synthesized
gaaggaggtaaaggataataaa

SEQ ID NO: 1276164 - DNA, 22 bp, Artificial Sequence
  chemically synthesized
ttattataacactttattatcc

SEQ ID NO: 1276165 - DNA, 22 bp, Artificial Sequence
  chemically synthesized
agcctgttattataacacttta

SEQ ID NO: 1276166 - DNA, 22 bp, Artificial Sequence
  chemically synthesized
cagcctgttattataacacttt

SEQ ID NO: 1276167 - DNA, 22 bp, Artificial Sequence
  chemically synthesized
tcagcctgttattataacactt

SEQ ID NO: 1276168 - DNA, 22 bp, Artificial Sequence
  chemically synthesized
tttcagcctgttattataacac

SEQ ID NO: 1276169 - DNA, 22 bp, Artificial Sequence
  chemically synthesized
taataacaggctgaaagaacta

SEQ ID NO: 1276170 - DNA, 22 bp, Artificial Sequence
  chemically synthesized
ggataaagaagacagaatcata

SEQ ID NO: 1276171 - DNA, 22 bp, Artificial Sequence
  chemically synthesized
gggataaagaagacagaatcat

SEQ ID NO: 1276172 - DNA, 22 bp, Artificial Sequence
  chemically synthesized
tgggataaagaagacagaatca

SEQ ID NO: 1276173 - DNA, 22 bp, Artificial Sequence
  chemically synthesized
aaagaactatgattctgtcttc

SEQ ID NO: 1276174 - DNA, 22 bp, Artificial Sequence
  chemically synthesized
attttgggataaagaagacaga

SEQ ID NO: 1276175 - DNA, 22 bp, Artificial Sequence
  chemically synthesized
agttcattttgggataaagaag

SEQ ID NO: 1276176 - DNA, 22 bp, Artificial Sequence
  chemically synthesized
tgattctgtcttctttatccca

SEQ ID NO: 1276177 - DNA, 22 bp, Artificial Sequence
  chemically synthesized
ttaagttcattttgggataaag

SEQ ID NO: 1276178 - DNA, 22 bp, Artificial Sequence
  chemically synthesized
attaagttcattttgggataaa

SEQ ID NO: 1276179 - DNA, 22 bp, Artificial Sequence
  chemically synthesized
atttattaagttcattttggga

SEQ ID NO: 1276180 - DNA, 22 bp, Artificial Sequence
  chemically synthesized
tgtcttctttatcccaaaatga

SEQ ID NO: 1276181 - DNA, 22 bp, Artificial Sequence
  chemically synthesized
tcttctttatcccaaaatgaac

SEQ ID NO: 1276182 - DNA, 22 bp, Artificial Sequence
  chemically synthesized
tattaatttattaagttcattt

SEQ ID NO: 1276183 - DNA, 22 bp, Artificial Sequence
  chemically synthesized
ctttatcccaaaatgaacttaa

SEQ ID NO: 1276184 - DNA, 22 bp, Artificial Sequence
  chemically synthesized
tttatcccaaaatgaacttaat

SEQ ID NO: 1276185 - DNA, 22 bp, Artificial Sequence
  chemically synthesized
tatcccaaaatgaacttaataa

SEQ ID NO: 1276186 - DNA, 22 bp, Artificial Sequence
  chemically synthesized
atcccaaaatgaacttaataaa

SEQ ID NO: 1276187 - DNA, 22 bp, Artificial Sequence
  chemically synthesized
aggttatattaatttattaagt

SEQ ID NO: 1276188 - DNA, 22 bp, Artificial Sequence
  chemically synthesized
tcccaaaatgaacttaataaat

SEQ ID NO: 1276189 - DNA, 22 bp, Artificial Sequence
  chemically synthesized
caattgaggttatattaattta

SEQ ID NO: 1276190 - DNA, 22 bp, Artificial Sequence
  chemically synthesized
gcaattgaggttatattaattt

SEQ ID NO: 1276191 - DNA, 22 bp, Artificial Sequence
  chemically synthesized
ttgcaattgaggttatattaat

SEQ ID NO: 1276192 - DNA, 22 bp, Artificial Sequence
  chemically synthesized
ctcttgcaattgaggttatatt

SEQ ID NO: 1276193 - DNA, 22 bp, Artificial Sequence
  chemically synthesized
cctcttgcaattgaggttatat

SEQ ID NO: 1276194 - DNA, 22 bp, Artificial Sequence
  chemically synthesized
ttcctcttgcaattgaggttat

SEQ ID NO: 1276195 - DNA, 22 bp, Artificial Sequence
  chemically synthesized
aataaattaatataacctcaat

SEQ ID NO: 1276196 - DNA, 22 bp, Artificial Sequence
  chemically synthesized
ataaattaatataacctcaatt

SEQ ID NO: 1276197 - DNA, 22 bp, Artificial Sequence
  chemically synthesized
aacgtgttcttcctcttgcaat

SEQ ID NO: 1276198 - DNA, 22 bp, Artificial Sequence
  chemically synthesized
atataacctcaattgcaagagg

SEQ ID NO: 1276199 - DNA, 22 bp, Artificial Sequence
  chemically synthesized
aattgcaagaggaagaacacgt

SEQ ID NO: 1276200 - DNA, 22 bp, Artificial Sequence
  chemically synthesized
gtatgcaacctcaacgtgttct

SEQ ID NO: 1276201 - DNA, 22 bp, Artificial Sequence
  chemically synthesized
agtatgcaacctcaacgtgttc

SEQ ID NO: 1276202 - DNA, 22 bp, Artificial Sequence
  chemically synthesized
caagaggaagaacacgttgagg

SEQ ID NO: 1276203 - DNA, 22 bp, Artificial Sequence
  chemically synthesized
aggttgcatactaaggtgtatt

SEQ ID NO: 1276204 - DNA, 22 bp, Artificial Sequence
  chemically synthesized
catactaaggtgtattttatat

SEQ ID NO: 1276205 - DNA, 22 bp, Artificial Sequence
  chemically synthesized
tggaaccatcagatataaaata

SEQ ID NO: 1276206 - DNA, 22 bp, Artificial Sequence
  chemically synthesized
aggtgtattttatatctgatgg

SEQ ID NO: 1276207 - DNA, 22 bp, Artificial Sequence
  chemically synthesized
atagctatggaaccatcagata

SEQ ID NO: 1276208 - DNA, 22 bp, Artificial Sequence
  chemically synthesized
catagctatggaaccatcagat

SEQ ID NO: 1276209 - DNA, 22 bp, Artificial Sequence
  chemically synthesized
tcatagctatggaaccatcaga

SEQ ID NO: 1276210 - DNA, 22 bp, Artificial Sequence
  chemically synthesized
tatatctgatggttccatagct

SEQ ID NO: 1276211 - DNA, 22 bp, Artificial Sequence
  chemically synthesized
atatctgatggttccatagcta

SEQ ID NO: 1276212 - DNA, 22 bp, Artificial Sequence
  chemically synthesized
tatctgatggttccatagctat

SEQ ID NO: 1276213 - DNA, 22 bp, Artificial Sequence
  chemically synthesized
gcatcatcaagactttcatagc

SEQ ID NO: 1276214 - DNA, 22 bp, Artificial Sequence
  chemically synthesized
atggttccatagctatgaaagt

SEQ ID NO: 1276215 - DNA, 22 bp, Artificial Sequence
  chemically synthesized
gcattggcatcatcaagacttt

SEQ ID NO: 1276216 - DNA, 22 bp, Artificial Sequence
  chemically synthesized
catagctatgaaagtcttgatg

SEQ ID NO: 1276217 - DNA, 22 bp, Artificial Sequence
  chemically synthesized
gatgcctagcattggcatcatc

SEQ ID NO: 1276218 - DNA, 22 bp, Artificial Sequence
  chemically synthesized
ggatgcctagcattggcatcat

SEQ ID NO: 1276219 - DNA, 22 bp, Artificial Sequence
  chemically synthesized
tgaaagtcttgatgatgccaat

SEQ ID NO: 1276220 - DNA, 22 bp, Artificial Sequence
  chemically synthesized
caaatttggatgcctagcattg

SEQ ID NO: 1276221 - DNA, 22 bp, Artificial Sequence
  chemically synthesized
tgcaaatttggatgcctagcat

SEQ ID NO: 1276222 - DNA, 22 bp, Artificial Sequence
  chemically synthesized
ctgcaaatttggatgcctagca

SEQ ID NO: 1276223 - DNA, 22 bp, Artificial Sequence
  chemically synthesized
gatgatgccaatgctaggcatc

SEQ ID NO: 1276224 - DNA, 22 bp, Artificial Sequence
  chemically synthesized
atgatgccaatgctaggcatcc

SEQ ID NO: 1276225 - DNA, 22 bp, Artificial Sequence
  chemically synthesized
cttctgcaaatttggatgccta

SEQ ID NO: 1276226 - DNA, 22 bp, Artificial Sequence
  chemically synthesized
gcttctgcaaatttggatgcct

SEQ ID NO: 1276227 - DNA, 22 bp, Artificial Sequence
  chemically synthesized
tgcttctgcaaatttggatgcc

SEQ ID NO: 1276228 - DNA, 22 bp, Artificial Sequence
  chemically synthesized
accagagattttgcttctgcaa

SEQ ID NO: 1276229 - DNA, 22 bp, Artificial Sequence
  chemically synthesized
ggcatccaaatttgcagaagca

SEQ ID NO: 1276230 - DNA, 22 bp, Artificial Sequence
  chemically synthesized
aatctgaccagagattttgctt

SEQ ID NO: 1276231 - DNA, 22 bp, Artificial Sequence
  chemically synthesized
caatctgaccagagattttgct

SEQ ID NO: 1276232 - DNA, 22 bp, Artificial Sequence
  chemically synthesized
tcaatctgaccagagattttgc

SEQ ID NO: 1276233 - DNA, 22 bp, Artificial Sequence
  chemically synthesized
gcagaagcaaaatctctggtca

SEQ ID NO: 1276234 - DNA, 22 bp, Artificial Sequence
  chemically synthesized
cagaagcaaaatctctggtcag

SEQ ID NO: 1276235 - DNA, 22 bp, Artificial Sequence
  chemically synthesized
taacacattttcaatctgacca

SEQ ID NO: 1276236 - DNA, 22 bp, Artificial Sequence
  chemically synthesized
ctgtaacacattttcaatctga

SEQ ID NO: 1276237 - DNA, 22 bp, Artificial Sequence
  chemically synthesized
actgtaacacattttcaatctg

SEQ ID NO: 1276238 - DNA, 22 bp, Artificial Sequence
  chemically synthesized
cttactgtaacacattttcaat

SEQ ID NO: 1276239 - DNA, 22 bp, Artificial Sequence
  chemically synthesized
ctccttactgtaacacattttc

SEQ ID NO: 1276240 - DNA, 22 bp, Artificial Sequence
  chemically synthesized
tggtcagattgaaaatgtgtta

SEQ ID NO: 1276241 - DNA, 22 bp, Artificial Sequence
  chemically synthesized
gtcagattgaaaatgtgttaca

SEQ ID NO: 1276242 - DNA, 22 bp, Artificial Sequence
  chemically synthesized
gacctcctccttactgtaacac

SEQ ID NO: 1276243 - DNA, 22 bp, Artificial Sequence
  chemically synthesized
aaaatgtgttacagtaaggagg

SEQ ID NO: 1276244 - DNA, 22 bp, Artificial Sequence
  chemically synthesized
cagtaaggaggaggtctaatct

SEQ ID NO: 1276245 - DNA, 22 bp, Artificial Sequence
  chemically synthesized
tgcagagaaaaaagatgagaga

SEQ ID NO: 1276246 - DNA, 22 bp, Artificial Sequence
  chemically synthesized
atgcagagaaaaaagatgagag

SEQ ID NO: 1276247 - DNA, 22 bp, Artificial Sequence
  chemically synthesized
aaaatttatgcagagaaaaaag

SEQ ID NO: 1276248 - DNA, 22 bp, Artificial Sequence
  chemically synthesized
atctctcatcttttttctctgc

SEQ ID NO: 1276249 - DNA, 22 bp, Artificial Sequence
  chemically synthesized
tcatcttttttctctgcataaa

SEQ ID NO: 1276250 - DNA, 22 bp, Artificial Sequence
  chemically synthesized
gcacactcaaaatttatgcaga

SEQ ID NO: 1276251 - DNA, 22 bp, Artificial Sequence
  chemically synthesized
atcttttttctctgcataaatt

SEQ ID NO: 1276252 - DNA, 22 bp, Artificial Sequence
  chemically synthesized
ttttctctgcataaattttgag

SEQ ID NO: 1276253 - DNA, 22 bp, Artificial Sequence
  chemically synthesized
tttctctgcataaattttgagt

SEQ ID NO: 1276254 - DNA, 22 bp, Artificial Sequence
  chemically synthesized
tgtggttagcacactcaaaatt

SEQ ID NO: 1276255 - DNA, 22 bp, Artificial Sequence
  chemically synthesized
ttctctgcataaattttgagtg

SEQ ID NO: 1276256 - DNA, 22 bp, Artificial Sequence
  chemically synthesized
tctctgcataaattttgagtgt

SEQ ID NO: 1276257 - DNA, 22 bp, Artificial Sequence
  chemically synthesized
ctctgcataaattttgagtgtg

SEQ ID NO: 1276258 - DNA, 22 bp, Artificial Sequence
  chemically synthesized
ttgtgtggttagcacactcaaa

SEQ ID NO: 1276259 - DNA, 22 bp, Artificial Sequence
  chemically synthesized
tctgcataaattttgagtgtgc

SEQ ID NO: 1276260 - DNA, 22 bp, Artificial Sequence
  chemically synthesized
attgtgtggttagcacactcaa

SEQ ID NO: 1276261 - DNA, 22 bp, Artificial Sequence
  chemically synthesized
tgcataaattttgagtgtgcta

SEQ ID NO: 1276262 - DNA, 22 bp, Artificial Sequence
  chemically synthesized
cttattgtgtggttagcacact

SEQ ID NO: 1276263 - DNA, 22 bp, Artificial Sequence
  chemically synthesized
cataaattttgagtgtgctaac

SEQ ID NO: 1276264 - DNA, 22 bp, Artificial Sequence
  chemically synthesized
acttattgtgtggttagcacac

SEQ ID NO: 1276265 - DNA, 22 bp, Artificial Sequence
  chemically synthesized
acaacttacttattgtgtggtt

SEQ ID NO: 1276266 - DNA, 22 bp, Artificial Sequence
  chemically synthesized
tgagtgtgctaaccacacaata

SEQ ID NO: 1276267 - DNA, 22 bp, Artificial Sequence
  chemically synthesized
gagtgtgctaaccacacaataa

SEQ ID NO: 1276268 - DNA, 22 bp, Artificial Sequence
  chemically synthesized
ttgacaacttacttattgtgtg

SEQ ID NO: 1276269 - DNA, 22 bp, Artificial Sequence
  chemically synthesized
agtgtgctaaccacacaataag

SEQ ID NO: 1276270 - DNA, 22 bp, Artificial Sequence
  chemically synthesized
accacacaataagtaagttgtc

SEQ ID NO: 1276271 - DNA, 22 bp, Artificial Sequence
  chemically synthesized
atacaatcaatcaaaacagtag

SEQ ID NO: 1276272 - DNA, 22 bp, Artificial Sequence
  chemically synthesized
tcaataactactgttttgattg

SEQ ID NO: 1276273 - DNA, 22 bp, Artificial Sequence
  chemically synthesized
gattaatacaatcaatcaaaac

SEQ ID NO: 1276274 - DNA, 22 bp, Artificial Sequence
  chemically synthesized
ggattaatacaatcaatcaaaa

SEQ ID NO: 1276275 - DNA, 22 bp, Artificial Sequence
  chemically synthesized
aatatttggattaatacaatca

SEQ ID NO: 1276276 - DNA, 22 bp, Artificial Sequence
  chemically synthesized
caatatttggattaatacaatc

SEQ ID NO: 1276277 - DNA, 22 bp, Artificial Sequence
  chemically synthesized
ctgttttgattgattgtattaa

SEQ ID NO: 1276278 - DNA, 22 bp, Artificial Sequence
  chemically synthesized
ttttgattgattgtattaatcc

SEQ ID NO: 1276279 - DNA, 22 bp, Artificial Sequence
  chemically synthesized
atttcaatatttggattaatac

SEQ ID NO: 1276280 - DNA, 22 bp, Artificial Sequence
  chemically synthesized
tgattgattgtattaatccaaa

SEQ ID NO: 1276281 - DNA, 22 bp, Artificial Sequence
  chemically synthesized
gattgattgtattaatccaaat

SEQ ID NO: 1276282 - DNA, 22 bp, Artificial Sequence
  chemically synthesized
attgattgtattaatccaaata

SEQ ID NO: 1276283 - DNA, 22 bp, Artificial Sequence
  chemically synthesized
attgtattaatccaaatattga

SEQ ID NO: 1276284 - DNA, 22 bp, Artificial Sequence
  chemically synthesized
tattaatccaaatattgaaatg

SEQ ID NO: 1276285 - DNA, 22 bp, Artificial Sequence
  chemically synthesized
atccaaatattgaaatgagcat

SEQ ID NO: 1276286 - DNA, 22 bp, Artificial Sequence
  chemically synthesized
aaatgagcatgtttgctgcttt

SEQ ID NO: 1276287 - DNA, 22 bp, Artificial Sequence
  chemically synthesized
acaaggaagcagtaaagcagca

SEQ ID NO: 1276288 - DNA, 22 bp, Artificial Sequence
  chemically synthesized
ggcgttaacaaggaagcagtaa

SEQ ID NO: 1276289 - DNA, 22 bp, Artificial Sequence
  chemically synthesized
ctaggcgttaacaaggaagcag

SEQ ID NO: 1276290 - DNA, 22 bp, Artificial Sequence
  chemically synthesized
actaggcgttaacaaggaagca

SEQ ID NO: 1276291 - DNA, 22 bp, Artificial Sequence
  chemically synthesized
gctgctttactgcttccttgtt

SEQ ID NO: 1276292 - DNA, 22 bp, Artificial Sequence
  chemically synthesized
ctgctttactgcttccttgtta

SEQ ID NO: 1276293 - DNA, 22 bp, Artificial Sequence
  chemically synthesized
ctttactgcttccttgttaacg

SEQ ID NO: 1276294 - DNA, 22 bp, Artificial Sequence
  chemically synthesized
acatttactaggcgttaacaag

SEQ ID NO: 1276295 - DNA, 22 bp, Artificial Sequence
  chemically synthesized
tactgcttccttgttaacgcct

SEQ ID NO: 1276296 - DNA, 22 bp, Artificial Sequence
  chemically synthesized
actgcttccttgttaacgccta

SEQ ID NO: 1276297 - DNA, 22 bp, Artificial Sequence
  chemically synthesized
ctgcttccttgttaacgcctag

SEQ ID NO: 1276298 - DNA, 22 bp, Artificial Sequence
  chemically synthesized
gtaattaacatttactaggcgt

SEQ ID NO: 1276299 - DNA, 22 bp, Artificial Sequence
  chemically synthesized
cttccttgttaacgcctagtaa

SEQ ID NO: 1276300 - DNA, 22 bp, Artificial Sequence
  chemically synthesized
agtaattaacatttactaggcg

SEQ ID NO: 1276301 - DNA, 22 bp, Artificial Sequence
  chemically synthesized
ccttgttaacgcctagtaaatg

SEQ ID NO: 1276302 - DNA, 22 bp, Artificial Sequence
  chemically synthesized
cttagtaattaacatttactag

SEQ ID NO: 1276303 - DNA, 22 bp, Artificial Sequence
  chemically synthesized
cttgttaacgcctagtaaatgt

SEQ ID NO: 1276304 - DNA, 22 bp, Artificial Sequence
  chemically synthesized
acttagtaattaacatttacta

SEQ ID NO: 1276305 - DNA, 22 bp, Artificial Sequence
  chemically synthesized
tacttagtaattaacatttact

SEQ ID NO: 1276306 - DNA, 22 bp, Artificial Sequence
  chemically synthesized
gttaacgcctagtaaatgttaa

SEQ ID NO: 1276307 - DNA, 22 bp, Artificial Sequence
  chemically synthesized
ttaacgcctagtaaatgttaat

SEQ ID NO: 1276308 - DNA, 22 bp, Artificial Sequence
  chemically synthesized
acgcctagtaaatgttaattac

SEQ ID NO: 1276309 - DNA, 22 bp, Artificial Sequence
  chemically synthesized
agaaactttacttagtaattaa

SEQ ID NO: 1276310 - DNA, 22 bp, Artificial Sequence
  chemically synthesized
attcagaaactttacttagtaa

SEQ ID NO: 1276311 - DNA, 22 bp, Artificial Sequence
  chemically synthesized
gtaaatgttaattactaagtaa

SEQ ID NO: 1276312 - DNA, 22 bp, Artificial Sequence
  chemically synthesized
ttcattcagaaactttacttag

SEQ ID NO: 1276313 - DNA, 22 bp, Artificial Sequence
  chemically synthesized
attcattcagaaactttactta

SEQ ID NO: 1276314 - DNA, 22 bp, Artificial Sequence
  chemically synthesized
tttattcattcagaaactttac

SEQ ID NO: 1276315 - DNA, 22 bp, Artificial Sequence
  chemically synthesized
attactaagtaaagtttctgaa

SEQ ID NO: 1276316 - DNA, 22 bp, Artificial Sequence
  chemically synthesized
gattatttattcattcagaaac

SEQ ID NO: 1276317 - DNA, 22 bp, Artificial Sequence
  chemically synthesized
tggattatttattcattcagaa

SEQ ID NO: 1276318 - DNA, 22 bp, Artificial Sequence
  chemically synthesized
ctaagtaaagtttctgaatgaa

SEQ ID NO: 1276319 - DNA, 22 bp, Artificial Sequence
  chemically synthesized
agtaaagtttctgaatgaataa

SEQ ID NO: 1276320 - DNA, 22 bp, Artificial Sequence
  chemically synthesized
tctctggattatttattcattc

SEQ ID NO: 1276321 - DNA, 22 bp, Artificial Sequence
  chemically synthesized
atctctggattatttattcatt

SEQ ID NO: 1276322 - DNA, 22 bp, Artificial Sequence
  chemically synthesized
ctgaatgaataaataatccaga

SEQ ID NO: 1276323 - DNA, 22 bp, Artificial Sequence
  chemically synthesized
tgaatgaataaataatccagag

SEQ ID NO: 1276324 - DNA, 22 bp, Artificial Sequence
  chemically synthesized
aatgaataaataatccagagat

SEQ ID NO: 1276325 - DNA, 22 bp, Artificial Sequence
  chemically synthesized
aggtgtgggtataacatttatc

SEQ ID NO: 1276326 - DNA, 22 bp, Artificial Sequence
  chemically synthesized
ctgaggtgtgggtataacattt

SEQ ID NO: 1276327 - DNA, 22 bp, Artificial Sequence
  chemically synthesized
tacccacacctcaggaatgccc

SEQ ID NO: 1276328 - DNA, 22 bp, Artificial Sequence
  chemically synthesized
tagatcaccagtgggcattcct

SEQ ID NO: 1276329 - DNA, 22 bp, Artificial Sequence
  chemically synthesized
gtagatcaccagtgggcattcc

SEQ ID NO: 1276330 - DNA, 22 bp, Artificial Sequence
  chemically synthesized
ttgtagatcaccagtgggcatt

SEQ ID NO: 1276331 - DNA, 22 bp, Artificial Sequence
  chemically synthesized
tcttgtagatcaccagtgggca

SEQ ID NO: 1276332 - DNA, 22 bp, Artificial Sequence
  chemically synthesized
ctcttgtagatcaccagtgggc

SEQ ID NO: 1276333 - DNA, 22 bp, Artificial Sequence
  chemically synthesized
aggaatgcccactggtgatcta

SEQ ID NO: 1276334 - DNA, 22 bp, Artificial Sequence
  chemically synthesized
accccaacttctcttgtagatc

SEQ ID NO: 1276335 - DNA, 22 bp, Artificial Sequence
  chemically synthesized
gttgaccccaacttctcttgta

SEQ ID NO: 1276336 - DNA, 22 bp, Artificial Sequence
  chemically synthesized
ggttgaccccaacttctcttgt

SEQ ID NO: 1276337 - DNA, 22 bp, Artificial Sequence
  chemically synthesized
tggttgaccccaacttctcttg

SEQ ID NO: 1276338 - DNA, 22 bp, Artificial Sequence
  chemically synthesized
gtgatctacaagagaagttggg

SEQ ID NO: 1276339 - DNA, 22 bp, Artificial Sequence
  chemically synthesized
tacactttggttgaccccaact

SEQ ID NO: 1276340 - DNA, 22 bp, Artificial Sequence
  chemically synthesized
atacactttggttgaccccaac

SEQ ID NO: 1276341 - DNA, 22 bp, Artificial Sequence
  chemically synthesized
tatacactttggttgaccccaa

SEQ ID NO: 1276342 - DNA, 22 bp, Artificial Sequence
  chemically synthesized
caagagaagttggggtcaacca

SEQ ID NO: 1276343 - DNA, 22 bp, Artificial Sequence
  chemically synthesized
tatgacctttatacactttggt

SEQ ID NO: 1276344 - DNA, 22 bp, Artificial Sequence
  chemically synthesized
tgtatgacctttatacactttg

SEQ ID NO: 1276345 - DNA, 22 bp, Artificial Sequence
  chemically synthesized
ctgtatgacctttatacacttt

SEQ ID NO: 1276346 - DNA, 22 bp, Artificial Sequence
  chemically synthesized
tctgtatgacctttatacactt

SEQ ID NO: 1276347 - DNA, 22 bp, Artificial Sequence
  chemically synthesized
gggtcaaccaaagtgtataaag

SEQ ID NO: 1276348 - DNA, 22 bp, Artificial Sequence
  chemically synthesized
agtcctttctgtatgaccttta

SEQ ID NO: 1276349 - DNA, 22 bp, Artificial Sequence
  chemically synthesized
ctgagtcctttctgtatgacct

SEQ ID NO: 1276350 - DNA, 22 bp, Artificial Sequence
  chemically synthesized
acctcctgagtcctttctgtat

SEQ ID NO: 1276351 - DNA, 22 bp, Artificial Sequence
  chemically synthesized
cattgacctcctgagtcctttc

SEQ ID NO: 1276352 - DNA, 22 bp, Artificial Sequence
  chemically synthesized
acattgacctcctgagtccttt

SEQ ID NO: 1276353 - DNA, 22 bp, Artificial Sequence
  chemically synthesized
tacattgacctcctgagtcctt

SEQ ID NO: 1276354 - DNA, 22 bp, Artificial Sequence
  chemically synthesized
ctttacattgacctcctgagtc

SEQ ID NO: 1276355 - DNA, 22 bp, Artificial Sequence
  chemically synthesized
tgcgatggaagcctcctttaca

SEQ ID NO: 1276356 - DNA, 22 bp, Artificial Sequence
  chemically synthesized
atgcgatggaagcctcctttac

SEQ ID NO: 1276357 - DNA, 22 bp, Artificial Sequence
  chemically synthesized
aggaggtcaatgtaaaggaggc

SEQ ID NO: 1276358 - DNA, 22 bp, Artificial Sequence
  chemically synthesized
tatgcgatggaagcctccttta

SEQ ID NO: 1276359 - DNA, 22 bp, Artificial Sequence
  chemically synthesized
atctttatgcgatggaagcctc

SEQ ID NO: 1276360 - DNA, 22 bp, Artificial Sequence
  chemically synthesized
catctttatgcgatggaagcct

SEQ ID NO: 1276361 - DNA, 22 bp, Artificial Sequence
  chemically synthesized
tcatctttatgcgatggaagcc

SEQ ID NO: 1276362 - DNA, 22 bp, Artificial Sequence
  chemically synthesized
ttcatctttatgcgatggaagc

SEQ ID NO: 1276363 - DNA, 22 bp, Artificial Sequence
  chemically synthesized
atatttttcatctttatgcgat

SEQ ID NO: 1276364 - DNA, 22 bp, Artificial Sequence
  chemically synthesized
tcctcatatttttcatctttat

SEQ ID NO: 1276365 - DNA, 22 bp, Artificial Sequence
  chemically synthesized
ttgtcctcatatttttcatctt

SEQ ID NO: 1276366 - DNA, 22 bp, Artificial Sequence
  chemically synthesized
attgtcctcatatttttcatct

SEQ ID NO: 1276367 - DNA, 22 bp, Artificial Sequence
  chemically synthesized
ccatcgcataaagatgaaaaat

SEQ ID NO: 1276368 - DNA, 22 bp, Artificial Sequence
  chemically synthesized
tattgtcctcatatttttcatc

SEQ ID NO: 1276369 - DNA, 22 bp, Artificial Sequence
  chemically synthesized
catcgcataaagatgaaaaata

SEQ ID NO: 1276370 - DNA, 22 bp, Artificial Sequence
  chemically synthesized
tgatctttattgtcctcatatt

SEQ ID NO: 1276371 - DNA, 22 bp, Artificial Sequence
  chemically synthesized
tattatgatctttattgtcctc

SEQ ID NO: 1276372 - DNA, 22 bp, Artificial Sequence
  chemically synthesized
tgtattatgatctttattgtcc

SEQ ID NO: 1276373 - DNA, 22 bp, Artificial Sequence
  chemically synthesized
ctgtattatgatctttattgtc

SEQ ID NO: 1276374 - DNA, 22 bp, Artificial Sequence
  chemically synthesized
caccttctgtattatgatcttt

SEQ ID NO: 1276375 - DNA, 22 bp, Artificial Sequence
  chemically synthesized
tccaccttctgtattatgatct

SEQ ID NO: 1276376 - DNA, 22 bp, Artificial Sequence
  chemically synthesized
aggctctccaccttctgtatta

SEQ ID NO: 1276377 - DNA, 22 bp, Artificial Sequence
  chemically synthesized
aatgtaactgaggctctccacc

SEQ ID NO: 1276378 - DNA, 22 bp, Artificial Sequence
  chemically synthesized
aaatgtaactgaggctctccac

SEQ ID NO: 1276379 - DNA, 22 bp, Artificial Sequence
  chemically synthesized
aatatatttaaatgtaactgag

SEQ ID NO: 1276380 - DNA, 22 bp, Artificial Sequence
  chemically synthesized
aaatatatttaaatgtaactga

SEQ ID NO: 1276381 - DNA, 22 bp, Artificial Sequence
  chemically synthesized
agttacatttaaatatatttaa

SEQ ID NO: 1276382 - DNA, 22 bp, Artificial Sequence
  chemically synthesized
cgaatgcatgaatttaaatata

SEQ ID NO: 1276383 - DNA, 22 bp, Artificial Sequence
  chemically synthesized
catttaaatatatttaaattca

SEQ ID NO: 1276384 - DNA, 22 bp, Artificial Sequence
  chemically synthesized
aaatatatttaaattcatgcat

SEQ ID NO: 1276385 - DNA, 22 bp, Artificial Sequence
  chemically synthesized
gcatcactgcgaatgcatgaat

SEQ ID NO: 1276386 - DNA, 22 bp, Artificial Sequence
  chemically synthesized
aatatatttaaattcatgcatt

SEQ ID NO: 1276387 - DNA, 22 bp, Artificial Sequence
  chemically synthesized
ggcatcactgcgaatgcatgaa

SEQ ID NO: 1276388 - DNA, 22 bp, Artificial Sequence
  chemically synthesized
tggcatcactgcgaatgcatga

SEQ ID NO: 1276389 - DNA, 22 bp, Artificial Sequence
  chemically synthesized
ttttggcatcactgcgaatgca

SEQ ID NO: 1276390 - DNA, 22 bp, Artificial Sequence
  chemically synthesized
gttttggcatcactgcgaatgc

SEQ ID NO: 1276391 - DNA, 22 bp, Artificial Sequence
  chemically synthesized
tttgttttggcatcactgcgaa

SEQ ID NO: 1276392 - DNA, 22 bp, Artificial Sequence
  chemically synthesized
aaattcatgcattcgcagtgat

SEQ ID NO: 1276393 - DNA, 22 bp, Artificial Sequence
  chemically synthesized
aattcatgcattcgcagtgatg

SEQ ID NO: 1276394 - DNA, 22 bp, Artificial Sequence
  chemically synthesized
atgcattcgcagtgatgccaaa

SEQ ID NO: 1276395 - DNA, 22 bp, Artificial Sequence
  chemically synthesized
tcatccagttgtttgttttggc

SEQ ID NO: 1276396 - DNA, 22 bp, Artificial Sequence
  chemically synthesized
ttatcatccagttgtttgtttt

SEQ ID NO: 1276397 - DNA, 22 bp, Artificial Sequence
  chemically synthesized
gcagtgatgccaaaacaaacaa

SEQ ID NO: 1276398 - DNA, 22 bp, Artificial Sequence
  chemically synthesized
attatcatccagttgtttgttt

SEQ ID NO: 1276399 - DNA, 22 bp, Artificial Sequence
  chemically synthesized
tttattatcatccagttgtttg

SEQ ID NO: 1276400 - DNA, 22 bp, Artificial Sequence
  chemically synthesized
atttattatcatccagttgttt

SEQ ID NO: 1276401 - DNA, 22 bp, Artificial Sequence
  chemically synthesized
tttatttattatcatccagttg

SEQ ID NO: 1276402 - DNA, 22 bp, Artificial Sequence
  chemically synthesized
atttatttattatcatccagtt

SEQ ID NO: 1276403 - DNA, 22 bp, Artificial Sequence
  chemically synthesized
tatttatttattatcatccagt

SEQ ID NO: 1276404 - DNA, 22 bp, Artificial Sequence
  chemically synthesized
gatgataataaataaataaaat

SEQ ID NO: 1276405 - DNA, 22 bp, Artificial Sequence
  chemically synthesized
caggcgtgagccaccgcacccg

SEQ ID NO: 1276406 - DNA, 22 bp, Artificial Sequence
  chemically synthesized
actggtggtcgggtgcggtggc

SEQ ID NO: 1276407 - DNA, 22 bp, Artificial Sequence
  chemically synthesized
ggattacaggcgtgagccaccg

SEQ ID NO: 1276408 - DNA, 22 bp, Artificial Sequence
  chemically synthesized
gtggtcgggtgcggtggctcac

SEQ ID NO: 1276409 - DNA, 22 bp, Artificial Sequence
  chemically synthesized
ccaaagtgctgggattacaggc

SEQ ID NO: 1276410 - DNA, 22 bp, Artificial Sequence
  chemically synthesized
agcctcccaaagtgctgggatt

SEQ ID NO: 1276411 - DNA, 22 bp, Artificial Sequence
  chemically synthesized
acgcctgtaatcccagcacttt

SEQ ID NO: 1276412 - DNA, 22 bp, Artificial Sequence
  chemically synthesized
cccacctcagcctcccaaagtg

SEQ ID NO: 1276413 - DNA, 22 bp, Artificial Sequence
  chemically synthesized
taatcccagcactttgggaggc

SEQ ID NO: 1276414 - DNA, 22 bp, Artificial Sequence
  chemically synthesized
gtgatctgcccacctcagcctc

SEQ ID NO: 1276415 - DNA, 22 bp, Artificial Sequence
  chemically synthesized
acctcgtgatctgcccacctca

SEQ ID NO: 1276416 - DNA, 22 bp, Artificial Sequence
  chemically synthesized
gacctcgtgatctgcccacctc

SEQ ID NO: 1276417 - DNA, 22 bp, Artificial Sequence
  chemically synthesized
ttgacctcgtgatctgcccacc

SEQ ID NO: 1276418 - DNA, 22 bp, Artificial Sequence
  chemically synthesized
tgggaggctgaggtgggcagat

SEQ ID NO: 1276419 - DNA, 22 bp, Artificial Sequence
  chemically synthesized
gggaggctgaggtgggcagatc

SEQ ID NO: 1276420 - DNA, 22 bp, Artificial Sequence
  chemically synthesized
ggaggctgaggtgggcagatca

SEQ ID NO: 1276421 - DNA, 22 bp, Artificial Sequence
  chemically synthesized
gatctcttgacctcgtgatctg

SEQ ID NO: 1276422 - DNA, 22 bp, Artificial Sequence
  chemically synthesized
aggtgggcagatcacgaggtca

SEQ ID NO: 1276423 - DNA, 22 bp, Artificial Sequence
  chemically synthesized
gccaggacggtctcgatctctt

SEQ ID NO: 1276424 - DNA, 22 bp, Artificial Sequence
  chemically synthesized
accatgatgttggccaggacgg

SEQ ID NO: 1276425 - DNA, 22 bp, Artificial Sequence
  chemically synthesized
caccatgatgttggccaggacg

SEQ ID NO: 1276426 - DNA, 22 bp, Artificial Sequence
  chemically synthesized
gtagagacggggtttcaccatg

SEQ ID NO: 1276427 - DNA, 22 bp, Artificial Sequence
  chemically synthesized
agtagagacggggtttcaccat

SEQ ID NO: 1276428 - DNA, 22 bp, Artificial Sequence
  chemically synthesized
tagtagagacggggtttcacca

SEQ ID NO: 1276429 - DNA, 22 bp, Artificial Sequence
  chemically synthesized
ttagtagagacggggtttcacc

SEQ ID NO: 1276430 - DNA, 22 bp, Artificial Sequence
  chemically synthesized
gccaacatcatggtgaaacccc

SEQ ID NO: 1276431 - DNA, 22 bp, Artificial Sequence
  chemically synthesized
tatttttagtagagacggggtt

SEQ ID NO: 1276432 - DNA, 22 bp, Artificial Sequence
  chemically synthesized
gtatttttagtagagacggggt

SEQ ID NO: 1276433 - DNA, 22 bp, Artificial Sequence
  chemically synthesized
tgtatttttagtagagacgggg

SEQ ID NO: 1276434 - DNA, 22 bp, Artificial Sequence
  chemically synthesized
ttgtatttttagtagagacggg

SEQ ID NO: 1276435 - DNA, 22 bp, Artificial Sequence
  chemically synthesized
atttttgtatttttagtagaga

SEQ ID NO: 1276436 - DNA, 22 bp, Artificial Sequence
  chemically synthesized
tactaaaaatacaaaaattagc

SEQ ID NO: 1276437 - DNA, 22 bp, Artificial Sequence
  chemically synthesized
ctaaaaatacaaaaattagctg

SEQ ID NO: 1276438 - DNA, 22 bp, Artificial Sequence
  chemically synthesized
aaaatacaaaaattagctgggc

SEQ ID NO: 1276439 - DNA, 22 bp, Artificial Sequence
  chemically synthesized
cagacgcgcaccaccacgccca

SEQ ID NO: 1276440 - DNA, 22 bp, Artificial Sequence
  chemically synthesized
ggactacagacgcgcaccacca

SEQ ID NO: 1276441 - DNA, 22 bp, Artificial Sequence
  chemically synthesized
gctgggcgtggtggtgcgcgtc

SEQ ID NO: 1276442 - DNA, 22 bp, Artificial Sequence
  chemically synthesized
ggcgtggtggtgcgcgtctgta

SEQ ID NO: 1276443 - DNA, 22 bp, Artificial Sequence
  chemically synthesized
ccgaatagctgggactacagac

SEQ ID NO: 1276444 - DNA, 22 bp, Artificial Sequence
  chemically synthesized
atcctcccgaatagctgggact

SEQ ID NO: 1276445 - DNA, 22 bp, Artificial Sequence
  chemically synthesized
cctcatcctcccgaatagctgg

SEQ ID NO: 1276446 - DNA, 22 bp, Artificial Sequence
  chemically synthesized
ctgcctcatcctcccgaatagc

SEQ ID NO: 1276447 - DNA, 22 bp, Artificial Sequence
  chemically synthesized
tcctgcctcatcctcccgaata

SEQ ID NO: 1276448 - DNA, 22 bp, Artificial Sequence
  chemically synthesized
tagtcccagctattcgggagga

SEQ ID NO: 1276449 - DNA, 22 bp, Artificial Sequence
  chemically synthesized
aagggattctcctgcctcatcc

SEQ ID NO: 1276450 - DNA, 22 bp, Artificial Sequence
  chemically synthesized
ttcgggaggatgaggcaggaga

SEQ ID NO: 1276451 - DNA, 22 bp, Artificial Sequence
  chemically synthesized
aggttcaagggattctcctgcc

SEQ ID NO: 1276452 - DNA, 22 bp, Artificial Sequence
  chemically synthesized
gggaggatgaggcaggagaatc

SEQ ID NO: 1276453 - DNA, 22 bp, Artificial Sequence
  chemically synthesized
tcaggttcaagggattctcctg

SEQ ID NO: 1276454 - DNA, 22 bp, Artificial Sequence
  chemically synthesized
cacctctcaggttcaagggatt

SEQ ID NO: 1276455 - DNA, 22 bp, Artificial Sequence
  chemically synthesized
caacctccacctctcaggttca

SEQ ID NO: 1276456 - DNA, 22 bp, Artificial Sequence
  chemically synthesized
gcaacctccacctctcaggttc

SEQ ID NO: 1276457 - DNA, 22 bp, Artificial Sequence
  chemically synthesized
acttgcaacctccacctctcag

SEQ ID NO: 1276458 - DNA, 22 bp, Artificial Sequence
  chemically synthesized
gctcacttgcaacctccacctc

SEQ ID NO: 1276459 - DNA, 22 bp, Artificial Sequence
  chemically synthesized
ggctcacttgcaacctccacct

SEQ ID NO: 1276460 - DNA, 22 bp, Artificial Sequence
  chemically synthesized
gaacctgagaggtggaggttgc

SEQ ID NO: 1276461 - DNA, 22 bp, Artificial Sequence
  chemically synthesized
aacctgagaggtggaggttgca

SEQ ID NO: 1276462 - DNA, 22 bp, Artificial Sequence
  chemically synthesized
agaggtggaggttgcaagtgag

SEQ ID NO: 1276463 - DNA, 22 bp, Artificial Sequence
  chemically synthesized
gagtgcagcagcgtgatcttgg

SEQ ID NO: 1276464 - DNA, 22 bp, Artificial Sequence
  chemically synthesized
caagtgagccaagatcacgctg

SEQ ID NO: 1276465 - DNA, 22 bp, Artificial Sequence
  chemically synthesized
tcaccaggctggagtgcagcag

SEQ ID NO: 1276466 - DNA, 22 bp, Artificial Sequence
  chemically synthesized
tgtcaccaggctggagtgcagc

SEQ ID NO: 1276467 - DNA, 22 bp, Artificial Sequence
  chemically synthesized
ctctgtcaccaggctggagtgc

SEQ ID NO: 1276468 - DNA, 22 bp, Artificial Sequence
  chemically synthesized
gctctgtcaccaggctggagtg

SEQ ID NO: 1276469 - DNA, 22 bp, Artificial Sequence
  chemically synthesized
ctgcactccagcctggtgacag

SEQ ID NO: 1276470 - DNA, 22 bp, Artificial Sequence
  chemically synthesized
cactccagcctggtgacagagc

SEQ ID NO: 1276471 - DNA, 22 bp, Artificial Sequence
  chemically synthesized
agatggagtcttgctctgtcac

SEQ ID NO: 1276472 - DNA, 22 bp, Artificial Sequence
  chemically synthesized
gagatggagtcttgctctgtca

SEQ ID NO: 1276473 - DNA, 22 bp, Artificial Sequence
  chemically synthesized
tgagatggagtcttgctctgtc

SEQ ID NO: 1276474 - DNA, 22 bp, Artificial Sequence
  chemically synthesized
ttgagatggagtcttgctctgt

SEQ ID NO: 1276475 - DNA, 22 bp, Artificial Sequence
  chemically synthesized
tttgagatggagtcttgctctg

SEQ ID NO: 1276476 - DNA, 22 bp, Artificial Sequence
  chemically synthesized
cagcctggtgacagagcaagac

SEQ ID NO: 1276477 - DNA, 22 bp, Artificial Sequence
  chemically synthesized
ttttgagatggagtcttgctct

SEQ ID NO: 1276478 - DNA, 22 bp, Artificial Sequence
  chemically synthesized
tttttgagatggagtcttgctc

SEQ ID NO: 1276479 - DNA, 22 bp, Artificial Sequence
  chemically synthesized
ttttttgagatggagtcttgct

SEQ ID NO: 1276480 - DNA, 22 bp, Artificial Sequence
  chemically synthesized
tttttttgagatggagtcttgc

SEQ ID NO: 1276481 - DNA, 22 bp, Artificial Sequence
  chemically synthesized
ttttttttgagatggagtcttg

SEQ ID NO: 1276482 - DNA, 22 bp, Artificial Sequence
  chemically synthesized
tttttttttgagatggagtctt

SEQ ID NO: 1276483 - DNA, 22 bp, Artificial Sequence
  chemically synthesized
ttttttttttgagatggagtct

SEQ ID NO: 1276484 - DNA, 22 bp, Artificial Sequence
  chemically synthesized
gtgacagagcaagactccatct

SEQ ID NO: 1276485 - DNA, 22 bp, Artificial Sequence
  chemically synthesized
tttttttttttgagatggagtc

SEQ ID NO: 1276486 - DNA, 22 bp, Artificial Sequence
  chemically synthesized
ttttttttttttgagatggagt

SEQ ID NO: 1276487 - DNA, 22 bp, Artificial Sequence
  chemically synthesized
tttttttttttttgagatggag

SEQ ID NO: 1276488 - DNA, 22 bp, Artificial Sequence
  chemically synthesized
ttttttttttttttgagatgga

SEQ ID NO: 1276489 - DNA, 22 bp, Artificial Sequence
  chemically synthesized
tttttttttttttttgagatgg

SEQ ID NO: 1276490 - DNA, 22 bp, Artificial Sequence
  chemically synthesized
ttttttttttttttttgagatg

SEQ ID NO: 1276491 - DNA, 22 bp, Artificial Sequence
  chemically synthesized
tttttttttttttttttgagat

SEQ ID NO: 1276492 - DNA, 22 bp, Artificial Sequence
  chemically synthesized
catctcaaaaaaaaaaaaaaaa

SEQ ID NO: 1276493 - DNA, 22 bp, Artificial Sequence
  chemically synthesized
ccagtgaatttttttttttttt

SEQ ID NO: 1276494 - DNA, 22 bp, Artificial Sequence
  chemically synthesized
aaaaaaaaaaaaaaaaaaaatt

SEQ ID NO: 1276495 - DNA, 22 bp, Artificial Sequence
  chemically synthesized
caaaagttgccagtgaattttt

SEQ ID NO: 1276496 - DNA, 22 bp, Artificial Sequence
  chemically synthesized
ccaaaagttgccagtgaatttt

SEQ ID NO: 1276497 - DNA, 22 bp, Artificial Sequence
  chemically synthesized
ttccaaaagttgccagtgaatt

SEQ ID NO: 1276498 - DNA, 22 bp, Artificial Sequence
  chemically synthesized
gtctcttccaaaagttgccagt

SEQ ID NO: 1276499 - DNA, 22 bp, Artificial Sequence
  chemically synthesized
tagtctcttccaaaagttgcca

SEQ ID NO: 1276500 - DNA, 22 bp, Artificial Sequence
  chemically synthesized
tctagtctcttccaaaagttgc

SEQ ID NO: 1276501 - DNA, 22 bp, Artificial Sequence
  chemically synthesized
ctctagtctcttccaaaagttg

SEQ ID NO: 1276502 - DNA, 22 bp, Artificial Sequence
  chemically synthesized
cttctctagtctcttccaaaag

SEQ ID NO: 1276503 - DNA, 22 bp, Artificial Sequence
  chemically synthesized
actggcaacttttggaagagac

SEQ ID NO: 1276504 - DNA, 22 bp, Artificial Sequence
  chemically synthesized
gcaacttttggaagagactaga

SEQ ID NO: 1276505 - DNA, 22 bp, Artificial Sequence
  chemically synthesized
aaaataatgaattgcttctcta

SEQ ID NO: 1276506 - DNA, 22 bp, Artificial Sequence
  chemically synthesized
ttggaagagactagagaagcaa

SEQ ID NO: 1276507 - DNA, 22 bp, Artificial Sequence
  chemically synthesized
caaaataatgaattgcttctct

SEQ ID NO: 1276508 - DNA, 22 bp, Artificial Sequence
  chemically synthesized
tggaagagactagagaagcaat

SEQ ID NO: 1276509 - DNA, 22 bp, Artificial Sequence
  chemically synthesized
tcaaaataatgaattgcttctc

SEQ ID NO: 1276510 - DNA, 22 bp, Artificial Sequence
  chemically synthesized
ggaagagactagagaagcaatt

SEQ ID NO: 1276511 - DNA, 22 bp, Artificial Sequence
  chemically synthesized
gaagagactagagaagcaattc

SEQ ID NO: 1276512 - DNA, 22 bp, Artificial Sequence
  chemically synthesized
gagaagcaattcattattttga

SEQ ID NO: 1276513 - DNA, 22 bp, Artificial Sequence
  chemically synthesized
ccccaaaagaacaattttcaaa

SEQ ID NO: 1276514 - DNA, 22 bp, Artificial Sequence
  chemically synthesized
cccccaaaagaacaattttcaa

SEQ ID NO: 1276515 - DNA, 22 bp, Artificial Sequence
  chemically synthesized
tcccccaaaagaacaattttca

SEQ ID NO: 1276516 - DNA, 22 bp, Artificial Sequence
  chemically synthesized
ttcccccaaaagaacaattttc

SEQ ID NO: 1276517 - DNA, 22 bp, Artificial Sequence
  chemically synthesized
attattttgaaaattgttcttt

SEQ ID NO: 1276518 - DNA, 22 bp, Artificial Sequence
  chemically synthesized
agtttttcccccaaaagaacaa

SEQ ID NO: 1276519 - DNA, 22 bp, Artificial Sequence
  chemically synthesized
cagtttttcccccaaaagaaca

SEQ ID NO: 1276520 - DNA, 22 bp, Artificial Sequence
  chemically synthesized
ttttgaaaattgttcttttggg

SEQ ID NO: 1276521 - DNA, 22 bp, Artificial Sequence
  chemically synthesized
tgaaaattgttcttttggggga

SEQ ID NO: 1276522 - DNA, 22 bp, Artificial Sequence
  chemically synthesized
gaaaattgttcttttgggggaa

SEQ ID NO: 1276523 - DNA, 22 bp, Artificial Sequence
  chemically synthesized
aaaattgttcttttgggggaaa

SEQ ID NO: 1276524 - DNA, 22 bp, Artificial Sequence
  chemically synthesized
ttcttttgggggaaaaactgaa

SEQ ID NO: 1276525 - DNA, 22 bp, Artificial Sequence
  chemically synthesized
ttttgggggaaaaactgaagca

SEQ ID NO: 1276526 - DNA, 22 bp, Artificial Sequence
  chemically synthesized
ttgggggaaaaactgaagcatt

SEQ ID NO: 1276527 - DNA, 22 bp, Artificial Sequence
  chemically synthesized
tgggggaaaaactgaagcattt

SEQ ID NO: 1276528 - DNA, 22 bp, Artificial Sequence
  chemically synthesized
gggggaaaaactgaagcattta

SEQ ID NO: 1276529 - DNA, 22 bp, Artificial Sequence
  chemically synthesized
ggggaaaaactgaagcatttac

SEQ ID NO: 1276530 - DNA, 22 bp, Artificial Sequence
  chemically synthesized
atacaaagcaaagcagagtaaa

SEQ ID NO: 1276531 - DNA, 22 bp, Artificial Sequence
  chemically synthesized
aagcatttactctgctttgctt

SEQ ID NO: 1276532 - DNA, 22 bp, Artificial Sequence
  chemically synthesized
atagtataattgatacaaagca

SEQ ID NO: 1276533 - DNA, 22 bp, Artificial Sequence
  chemically synthesized
actctgctttgctttgtatcaa

SEQ ID NO: 1276534 - DNA, 22 bp, Artificial Sequence
  chemically synthesized
ctctgctttgctttgtatcaat

SEQ ID NO: 1276535 - DNA, 22 bp, Artificial Sequence
  chemically synthesized
cctcatagtataattgatacaa

SEQ ID NO: 1276536 - DNA, 22 bp, Artificial Sequence
  chemically synthesized
tgctttgctttgtatcaattat

SEQ ID NO: 1276537 - DNA, 22 bp, Artificial Sequence
  chemically synthesized
gttgcctcatagtataattgat

SEQ ID NO: 1276538 - DNA, 22 bp, Artificial Sequence
  chemically synthesized
ctttgctttgtatcaattatac

SEQ ID NO: 1276539 - DNA, 22 bp, Artificial Sequence
  chemically synthesized
ggttgcctcatagtataattga

SEQ ID NO: 1276540 - DNA, 22 bp, Artificial Sequence
  chemically synthesized
tgctttgtatcaattatactat

SEQ ID NO: 1276541 - DNA, 22 bp, Artificial Sequence
  chemically synthesized
tttggttgcctcatagtataat

SEQ ID NO: 1276542 - DNA, 22 bp, Artificial Sequence
  chemically synthesized
gctttgtatcaattatactatg

SEQ ID NO: 1276543 - DNA, 22 bp, Artificial Sequence
  chemically synthesized
ctttgtatcaattatactatga

SEQ ID NO: 1276544 - DNA, 22 bp, Artificial Sequence
  chemically synthesized
tatttggttgcctcatagtata

SEQ ID NO: 1276545 - DNA, 22 bp, Artificial Sequence
  chemically synthesized
ctatttggttgcctcatagtat

SEQ ID NO: 1276546 - DNA, 22 bp, Artificial Sequence
  chemically synthesized
tgtatcaattatactatgaggc

SEQ ID NO: 1276547 - DNA, 22 bp, Artificial Sequence
  chemically synthesized
gtatcaattatactatgaggca

SEQ ID NO: 1276548 - DNA, 22 bp, Artificial Sequence
  chemically synthesized
tatcaattatactatgaggcaa

SEQ ID NO: 1276549 - DNA, 22 bp, Artificial Sequence
  chemically synthesized
catttctatttggttgcctcat

SEQ ID NO: 1276550 - DNA, 22 bp, Artificial Sequence
  chemically synthesized
tgcatttctatttggttgcctc

SEQ ID NO: 1276551 - DNA, 22 bp, Artificial Sequence
  chemically synthesized
tactatgaggcaaccaaataga

SEQ ID NO: 1276552 - DNA, 22 bp, Artificial Sequence
  chemically synthesized
tgaggcaaccaaatagaaatgc

SEQ ID NO: 1276553 - DNA, 22 bp, Artificial Sequence
  chemically synthesized
taaagagaactctgcatttcta

SEQ ID NO: 1276554 - DNA, 22 bp, Artificial Sequence
  chemically synthesized
ataaagagaactctgcatttct

SEQ ID NO: 1276555 - DNA, 22 bp, Artificial Sequence
  chemically synthesized
agcccggcttataaagagaact

SEQ ID NO: 1276556 - DNA, 22 bp, Artificial Sequence
  chemically synthesized
caggtgtgagtcactgagcccg

SEQ ID NO: 1276557 - DNA, 22 bp, Artificial Sequence
  chemically synthesized
tctttataagccgggctcagtg

SEQ ID NO: 1276558 - DNA, 22 bp, Artificial Sequence
  chemically synthesized
tttataagccgggctcagtgac

SEQ ID NO: 1276559 - DNA, 22 bp, Artificial Sequence
  chemically synthesized
tataagccgggctcagtgactc

SEQ ID NO: 1276560 - DNA, 22 bp, Artificial Sequence
  chemically synthesized
ataagccgggctcagtgactca

SEQ ID NO: 1276561 - DNA, 22 bp, Artificial Sequence
  chemically synthesized
ggattacaggtgtgagtcactg

SEQ ID NO: 1276562 - DNA, 22 bp, Artificial Sequence
  chemically synthesized
taagccgggctcagtgactcac

SEQ ID NO: 1276563 - DNA, 22 bp, Artificial Sequence
  chemically synthesized
caaagtgctgggattacaggtg

SEQ ID NO: 1276564 - DNA, 22 bp, Artificial Sequence
  chemically synthesized
ccaaagtgctgggattacaggt

SEQ ID NO: 1276565 - DNA, 22 bp, Artificial Sequence
  chemically synthesized
tccaaagtgctgggattacagg

SEQ ID NO: 1276566 - DNA, 22 bp, Artificial Sequence
  chemically synthesized
agtgactcacacctgtaatccc

SEQ ID NO: 1276567 - DNA, 22 bp, Artificial Sequence
  chemically synthesized
ctttccaaagtgctgggattac

SEQ ID NO: 1276568 - DNA, 22 bp, Artificial Sequence
  chemically synthesized
gctttccaaagtgctgggatta

SEQ ID NO: 1276569 - DNA, 22 bp, Artificial Sequence
  chemically synthesized
tgctttccaaagtgctgggatt

SEQ ID NO: 1276570 - DNA, 22 bp, Artificial Sequence
  chemically synthesized
acacctgtaatcccagcacttt

SEQ ID NO: 1276571 - DNA, 22 bp, Artificial Sequence
  chemically synthesized
taatcccagcactttggaaagc

SEQ ID NO: 1276572 - DNA, 22 bp, Artificial Sequence
  chemically synthesized
aggtgatccacccacctttgct

SEQ ID NO: 1276573 - DNA, 22 bp, Artificial Sequence
  chemically synthesized
acctcaggtgatccacccacct

SEQ ID NO: 1276574 - DNA, 22 bp, Artificial Sequence
  chemically synthesized
tggaaagcaaaggtgggtggat

SEQ ID NO: 1276575 - DNA, 22 bp, Artificial Sequence
  chemically synthesized
ggaaagcaaaggtgggtggatc

SEQ ID NO: 1276576 - DNA, 22 bp, Artificial Sequence
  chemically synthesized
ctgacctcaggtgatccaccca

SEQ ID NO: 1276577 - DNA, 22 bp, Artificial Sequence
  chemically synthesized
gaaagcaaaggtgggtggatca

SEQ ID NO: 1276578 - DNA, 22 bp, Artificial Sequence
  chemically synthesized
aaactcctgacctcaggtgatc

SEQ ID NO: 1276579 - DNA, 22 bp, Artificial Sequence
  chemically synthesized
gtctcaaactcctgacctcagg

SEQ ID NO: 1276580 - DNA, 22 bp, Artificial Sequence
  chemically synthesized
gccaggctggtctcaaactcct

SEQ ID NO: 1276581 - DNA, 22 bp, Artificial Sequence
  chemically synthesized
aggtcaggagtttgagaccagc

SEQ ID NO: 1276582 - DNA, 22 bp, Artificial Sequence
  chemically synthesized
ccatgttggccaggctggtctc

SEQ ID NO: 1276583 - DNA, 22 bp, Artificial Sequence
  chemically synthesized
tgccatgttggccaggctggtc

SEQ ID NO: 1276584 - DNA, 22 bp, Artificial Sequence
  chemically synthesized
gagaccagcctggccaacatgg

SEQ ID NO: 1276585 - DNA, 22 bp, Artificial Sequence
  chemically synthesized
agaccagcctggccaacatggc

SEQ ID NO: 1276586 - DNA, 22 bp, Artificial Sequence
  chemically synthesized
gtagagatgggattctgccatg

SEQ ID NO: 1276587 - DNA, 22 bp, Artificial Sequence
  chemically synthesized
agtagagatgggattctgccat

SEQ ID NO: 1276588 - DNA, 22 bp, Artificial Sequence
  chemically synthesized
tagtagagatgggattctgcca

SEQ ID NO: 1276589 - DNA, 22 bp, Artificial Sequence
  chemically synthesized
ttagtagagatgggattctgcc

SEQ ID NO: 1276590 - DNA, 22 bp, Artificial Sequence
  chemically synthesized
gccaacatggcagaatcccatc

SEQ ID NO: 1276591 - DNA, 22 bp, Artificial Sequence
  chemically synthesized
tatttttagtagagatgggatt

SEQ ID NO: 1276592 - DNA, 22 bp, Artificial Sequence
  chemically synthesized
gtatttttagtagagatgggat

SEQ ID NO: 1276593 - DNA, 22 bp, Artificial Sequence
  chemically synthesized
tgtatttttagtagagatggga

SEQ ID NO: 1276594 - DNA, 22 bp, Artificial Sequence
  chemically synthesized
ttgtatttttagtagagatggg

SEQ ID NO: 1276595 - DNA, 22 bp, Artificial Sequence
  chemically synthesized
atttttgtatttttagtagaga

SEQ ID NO: 1276596 - DNA, 22 bp, Artificial Sequence
  chemically synthesized
tactaaaaatacaaaaattagc

SEQ ID NO: 1276597 - DNA, 22 bp, Artificial Sequence
  chemically synthesized
ctaaaaatacaaaaattagccg

SEQ ID NO: 1276598 - DNA, 22 bp, Artificial Sequence
  chemically synthesized
aaaatacaaaaattagccgggc

SEQ ID NO: 1276599 - DNA, 22 bp, Artificial Sequence
  chemically synthesized
caggcgcacgccaccacgcccg

SEQ ID NO: 1276600 - DNA, 22 bp, Artificial Sequence
  chemically synthesized
ggattacaggcgcacgccacca

SEQ ID NO: 1276601 - DNA, 22 bp, Artificial Sequence
  chemically synthesized
gccgggcgtggtggcgtgcgcc

SEQ ID NO: 1276602 - DNA, 22 bp, Artificial Sequence
  chemically synthesized
gtagctgggattacaggcgcac

SEQ ID NO: 1276603 - DNA, 22 bp, Artificial Sequence
  chemically synthesized
cctagtagctgggattacaggc

SEQ ID NO: 1276604 - DNA, 22 bp, Artificial Sequence
  chemically synthesized
agcctccctagtagctgggatt

SEQ ID NO: 1276605 - DNA, 22 bp, Artificial Sequence
  chemically synthesized
cctcagcctccctagtagctgg

SEQ ID NO: 1276606 - DNA, 22 bp, Artificial Sequence
  chemically synthesized
ctgcctcagcctccctagtagc

SEQ ID NO: 1276607 - DNA, 22 bp, Artificial Sequence
  chemically synthesized
tcctgcctcagcctccctagta

SEQ ID NO: 1276608 - DNA, 22 bp, Artificial Sequence
  chemically synthesized
taatcccagctactagggaggc

SEQ ID NO: 1276609 - DNA, 22 bp, Artificial Sequence
  chemically synthesized
aagcaattctcctgcctcagcc

SEQ ID NO: 1276610 - DNA, 22 bp, Artificial Sequence
  chemically synthesized
ctagggaggctgaggcaggaga

SEQ ID NO: 1276611 - DNA, 22 bp, Artificial Sequence
  chemically synthesized
gggaggctgaggcaggagaatt

SEQ ID NO: 1276612 - DNA, 22 bp, Artificial Sequence
  chemically synthesized
ccaggttcaagcaattctcctg

SEQ ID NO: 1276613 - DNA, 22 bp, Artificial Sequence
  chemically synthesized
cctcccaggttcaagcaattct

SEQ ID NO: 1276614 - DNA, 22 bp, Artificial Sequence
  chemically synthesized
tgcctcccaggttcaagcaatt

SEQ ID NO: 1276615 - DNA, 22 bp, Artificial Sequence
  chemically synthesized
aggcaggagaattgcttgaacc

SEQ ID NO: 1276616 - DNA, 22 bp, Artificial Sequence
  chemically synthesized
caacctctgcctcccaggttca

SEQ ID NO: 1276617 - DNA, 22 bp, Artificial Sequence
  chemically synthesized
actgcaacctctgcctcccagg

SEQ ID NO: 1276618 - DNA, 22 bp, Artificial Sequence
  chemically synthesized
ggctcactgcaacctctgcctc

SEQ ID NO: 1276619 - DNA, 22 bp, Artificial Sequence
  chemically synthesized
cttgaacctgggaggcagaggt

SEQ ID NO: 1276620 - DNA, 22 bp, Artificial Sequence
  chemically synthesized
gaacctgggaggcagaggttgc

SEQ ID NO: 1276621 - DNA, 22 bp, Artificial Sequence
  chemically synthesized
aacctgggaggcagaggttgca

SEQ ID NO: 1276622 - DNA, 22 bp, Artificial Sequence
  chemically synthesized
ggaggcagaggttgcagtgagc

SEQ ID NO: 1276623 - DNA, 22 bp, Artificial Sequence
  chemically synthesized
gagtgcagtggcataatctcgg

SEQ ID NO: 1276624 - DNA, 22 bp, Artificial Sequence
  chemically synthesized
cagtgagccgagattatgccac

SEQ ID NO: 1276625 - DNA, 22 bp, Artificial Sequence
  chemically synthesized
tcacccaggctggagtgcagtg

SEQ ID NO: 1276626 - DNA, 22 bp, Artificial Sequence
  chemically synthesized
tgtcacccaggctggagtgcag

SEQ ID NO: 1276627 - DNA, 22 bp, Artificial Sequence
  chemically synthesized
ctctgtcacccaggctggagtg

SEQ ID NO: 1276628 - DNA, 22 bp, Artificial Sequence
  chemically synthesized
gctctgtcacccaggctggagt

SEQ ID NO: 1276629 - DNA, 22 bp, Artificial Sequence
  chemically synthesized
tgccactgcactccagcctggg

SEQ ID NO: 1276630 - DNA, 22 bp, Artificial Sequence
  chemically synthesized
cactccagcctgggtgacagag

SEQ ID NO: 1276631 - DNA, 22 bp, Artificial Sequence
  chemically synthesized
agacagagtcttgctctgtcac

SEQ ID NO: 1276632 - DNA, 22 bp, Artificial Sequence
  chemically synthesized
gagacagagtcttgctctgtca

SEQ ID NO: 1276633 - DNA, 22 bp, Artificial Sequence
  chemically synthesized
tgagacagagtcttgctctgtc

SEQ ID NO: 1276634 - DNA, 22 bp, Artificial Sequence
  chemically synthesized
ttgagacagagtcttgctctgt

SEQ ID NO: 1276635 - DNA, 22 bp, Artificial Sequence
  chemically synthesized
cagcctgggtgacagagcaaga

SEQ ID NO: 1276636 - DNA, 22 bp, Artificial Sequence
  chemically synthesized
tttttgagacagagtcttgctc

SEQ ID NO: 1276637 - DNA, 22 bp, Artificial Sequence
  chemically synthesized
gtttttgagacagagtcttgct

SEQ ID NO: 1276638 - DNA, 22 bp, Artificial Sequence
  chemically synthesized
tgtttttgagacagagtcttgc

SEQ ID NO: 1276639 - DNA, 22 bp, Artificial Sequence
  chemically synthesized
ttgtttttgagacagagtcttg

SEQ ID NO: 1276640 - DNA, 22 bp, Artificial Sequence
  chemically synthesized
tttgtttttgagacagagtctt

SEQ ID NO: 1276641 - DNA, 22 bp, Artificial Sequence
  chemically synthesized
ggtgacagagcaagactctgtc

SEQ ID NO: 1276642 - DNA, 22 bp, Artificial Sequence
  chemically synthesized
attttttgtttttgagacagag

SEQ ID NO: 1276643 - DNA, 22 bp, Artificial Sequence
  chemically synthesized
gattttttgtttttgagacaga

SEQ ID NO: 1276644 - DNA, 22 bp, Artificial Sequence
  chemically synthesized
tgattttttgtttttgagacag

SEQ ID NO: 1276645 - DNA, 22 bp, Artificial Sequence
  chemically synthesized
ttttgattttttgtttttgaga

SEQ ID NO: 1276646 - DNA, 22 bp, Artificial Sequence
  chemically synthesized
gttttgattttttgtttttgag

SEQ ID NO: 1276647 - DNA, 22 bp, Artificial Sequence
  chemically synthesized
tgttttgattttttgtttttga

SEQ ID NO: 1276648 - DNA, 22 bp, Artificial Sequence
  chemically synthesized
ttttgttttgattttttgtttt

SEQ ID NO: 1276649 - DNA, 22 bp, Artificial Sequence
  chemically synthesized
gttttgttttgattttttgttt

SEQ ID NO: 1276650 - DNA, 22 bp, Artificial Sequence
  chemically synthesized
tgttttgttttgattttttgtt

SEQ ID NO: 1276651 - DNA, 22 bp, Artificial Sequence
  chemically synthesized
ttgttttgttttgattttttgt

SEQ ID NO: 1276652 - DNA, 22 bp, Artificial Sequence
  chemically synthesized
tttgttttgttttgattttttg

SEQ ID NO: 1276653 - DNA, 22 bp, Artificial Sequence
  chemically synthesized
tgtctcaaaaacaaaaaatcaa

SEQ ID NO: 1276654 - DNA, 22 bp, Artificial Sequence
  chemically synthesized
tctcaaaaacaaaaaatcaaaa

SEQ ID NO: 1276655 - DNA, 22 bp, Artificial Sequence
  chemically synthesized
aaaaacaaaaaatcaaaacaaa

SEQ ID NO: 1276656 - DNA, 22 bp, Artificial Sequence
  chemically synthesized
taaagagaactttttgttttgt

SEQ ID NO: 1276657 - DNA, 22 bp, Artificial Sequence
  chemically synthesized
tataaagagaactttttgtttt

SEQ ID NO: 1276658 - DNA, 22 bp, Artificial Sequence
  chemically synthesized
ggaggagcagttctataaagag

SEQ ID NO: 1276659 - DNA, 22 bp, Artificial Sequence
  chemically synthesized
ttaggaggagcagttctataaa

SEQ ID NO: 1276660 - DNA, 22 bp, Artificial Sequence
  chemically synthesized
gttaggaggagcagttctataa

SEQ ID NO: 1276661 - DNA, 22 bp, Artificial Sequence
  chemically synthesized
atttgttaggaggagcagttct

SEQ ID NO: 1276662 - DNA, 22 bp, Artificial Sequence
  chemically synthesized
catttgttaggaggagcagttc

SEQ ID NO: 1276663 - DNA, 22 bp, Artificial Sequence
  chemically synthesized
ttcatttgttaggaggagcagt

SEQ ID NO: 1276664 - DNA, 22 bp, Artificial Sequence
  chemically synthesized
cttcatttgttaggaggagcag

SEQ ID NO: 1276665 - DNA, 22 bp, Artificial Sequence
  chemically synthesized
tctttatagaactgctcctcct

SEQ ID NO: 1276666 - DNA, 22 bp, Artificial Sequence
  chemically synthesized
tttatagaactgctcctcctaa

SEQ ID NO: 1276667 - DNA, 22 bp, Artificial Sequence
  chemically synthesized
cttcttcatttgttaggaggag

SEQ ID NO: 1276668 - DNA, 22 bp, Artificial Sequence
  chemically synthesized
acttcttcatttgttaggagga

SEQ ID NO: 1276669 - DNA, 22 bp, Artificial Sequence
  chemically synthesized
tatagaactgctcctcctaaca

SEQ ID NO: 1276670 - DNA, 22 bp, Artificial Sequence
  chemically synthesized
tacttcttcatttgttaggagg

SEQ ID NO: 1276671 - DNA, 22 bp, Artificial Sequence
  chemically synthesized
atagaactgctcctcctaacaa

SEQ ID NO: 1276672 - DNA, 22 bp, Artificial Sequence
  chemically synthesized
ttacttcttcatttgttaggag

SEQ ID NO: 1276673 - DNA, 22 bp, Artificial Sequence
  chemically synthesized
tagaactgctcctcctaacaaa

SEQ ID NO: 1276674 - DNA, 22 bp, Artificial Sequence
  chemically synthesized
tttttacttcttcatttgttag

SEQ ID NO: 1276675 - DNA, 22 bp, Artificial Sequence
  chemically synthesized
ctcctcctaacaaatgaagaag

SEQ ID NO: 1276676 - DNA, 22 bp, Artificial Sequence
  chemically synthesized
ctcctaacaaatgaagaagtaa

SEQ ID NO: 1276677 - DNA, 22 bp, Artificial Sequence
  chemically synthesized
ctaacaaatgaagaagtaaaaa

SEQ ID NO: 1276678 - DNA, 22 bp, Artificial Sequence
  chemically synthesized
acaaatgaagaagtaaaaacag

SEQ ID NO: 1276679 - DNA, 22 bp, Artificial Sequence
  chemically synthesized
caaaacaatgatatactgtttt

SEQ ID NO: 1276680 - DNA, 22 bp, Artificial Sequence
  chemically synthesized
tgagttgcaaaacaatgatata

SEQ ID NO: 1276681 - DNA, 22 bp, Artificial Sequence
  chemically synthesized
attatgagttgcaaaacaatga

SEQ ID NO: 1276682 - DNA, 22 bp, Artificial Sequence
  chemically synthesized
cattatgagttgcaaaacaatg

SEQ ID NO: 1276683 - DNA, 22 bp, Artificial Sequence
  chemically synthesized
tttcattatgagttgcaaaaca

SEQ ID NO: 1276684 - DNA, 22 bp, Artificial Sequence
  chemically synthesized
attatttcattatgagttgcaa

SEQ ID NO: 1276685 - DNA, 22 bp, Artificial Sequence
  chemically synthesized
attgattatttcattatgagtt

SEQ ID NO: 1276686 - DNA, 22 bp, Artificial Sequence
  chemically synthesized
gattgattatttcattatgagt

SEQ ID NO: 1276687 - DNA, 22 bp, Artificial Sequence
  chemically synthesized
tgattgattatttcattatgag

SEQ ID NO: 1276688 - DNA, 22 bp, Artificial Sequence
  chemically synthesized
ttttgattgattatttcattat

SEQ ID NO: 1276689 - DNA, 22 bp, Artificial Sequence
  chemically synthesized
ttttgcaactcataatgaaata

SEQ ID NO: 1276690 - DNA, 22 bp, Artificial Sequence
  chemically synthesized
tgcaactcataatgaaataatc

SEQ ID NO: 1276691 - DNA, 22 bp, Artificial Sequence
  chemically synthesized
gcaactcataatgaaataatca

SEQ ID NO: 1276692 - DNA, 22 bp, Artificial Sequence
  chemically synthesized
caactcataatgaaataatcaa

SEQ ID NO: 1276693 - DNA, 22 bp, Artificial Sequence
  chemically synthesized
atgatcattgttttgattgatt

SEQ ID NO: 1276694 - DNA, 22 bp, Artificial Sequence
  chemically synthesized
ataatgaaataatcaatcaaaa

SEQ ID NO: 1276695 - DNA, 22 bp, Artificial Sequence
  chemically synthesized
gcagccattgatgatcattgtt

SEQ ID NO: 1276696 - DNA, 22 bp, Artificial Sequence
  chemically synthesized
atattggcagccattgatgatc

SEQ ID NO: 1276697 - DNA, 22 bp, Artificial Sequence
  chemically synthesized
gatattggcagccattgatgat

SEQ ID NO: 1276698 - DNA, 22 bp, Artificial Sequence
  chemically synthesized
aacaaaaggtatataacgtttg

SEQ ID NO: 1276699 - DNA, 22 bp, Artificial Sequence
  chemically synthesized
caacaaaaggtatataacgttt

SEQ ID NO: 1276700 - DNA, 22 bp, Artificial Sequence
  chemically synthesized
tcaacaaaaggtatataacgtt

SEQ ID NO: 1276701 - DNA, 22 bp, Artificial Sequence
  chemically synthesized
ccaatatcaaacgttatatacc

SEQ ID NO: 1276702 - DNA, 22 bp, Artificial Sequence
  chemically synthesized
tgtactttcaacaaaaggtata

SEQ ID NO: 1276703 - DNA, 22 bp, Artificial Sequence
  chemically synthesized
tataccttttgttgaaagtaca

SEQ ID NO: 1276704 - DNA, 22 bp, Artificial Sequence
  chemically synthesized
tatagaaagtgttgtgtacttt

SEQ ID NO: 1276705 - DNA, 22 bp, Artificial Sequence
  chemically synthesized
ttgttgaaagtacacaacactt

SEQ ID NO: 1276706 - DNA, 22 bp, Artificial Sequence
  chemically synthesized
tgttgaaagtacacaacacttt

SEQ ID NO: 1276707 - DNA, 22 bp, Artificial Sequence
  chemically synthesized
gttgaaagtacacaacactttc

SEQ ID NO: 1276708 - DNA, 22 bp, Artificial Sequence
  chemically synthesized
ttgaaagtacacaacactttct

SEQ ID NO: 1276709 - DNA, 22 bp, Artificial Sequence
  chemically synthesized
aagatgattgtatagaaagtgt

SEQ ID NO: 1276710 - DNA, 22 bp, Artificial Sequence
  chemically synthesized
aaagtacacaacactttctata

SEQ ID NO: 1276711 - DNA, 22 bp, Artificial Sequence
  chemically synthesized
ctcaagatgattgtatagaaag

SEQ ID NO: 1276712 - DNA, 22 bp, Artificial Sequence
  chemically synthesized
actcaagatgattgtatagaaa

SEQ ID NO: 1276713 - DNA, 22 bp, Artificial Sequence
  chemically synthesized
tactcaagatgattgtatagaa

SEQ ID NO: 1276714 - DNA, 22 bp, Artificial Sequence
  chemically synthesized
ttactcaagatgattgtataga

SEQ ID NO: 1276715 - DNA, 22 bp, Artificial Sequence
  chemically synthesized
tttactcaagatgattgtatag

SEQ ID NO: 1276716 - DNA, 22 bp, Artificial Sequence
  chemically synthesized
ttttactcaagatgattgtata

SEQ ID NO: 1276717 - DNA, 22 bp, Artificial Sequence
  chemically synthesized
tttttactcaagatgattgtat

SEQ ID NO: 1276718 - DNA, 22 bp, Artificial Sequence
  chemically synthesized
tttttttactcaagatgattgt

SEQ ID NO: 1276719 - DNA, 22 bp, Artificial Sequence
  chemically synthesized
ttctttttttactcaagatgat

SEQ ID NO: 1276720 - DNA, 22 bp, Artificial Sequence
  chemically synthesized
gttctttttttactcaagatga

SEQ ID NO: 1276721 - DNA, 22 bp, Artificial Sequence
  chemically synthesized
tgttctttttttactcaagatg

SEQ ID NO: 1276722 - DNA, 22 bp, Artificial Sequence
  chemically synthesized
tctatacaatcatcttgagtaa

SEQ ID NO: 1276723 - DNA, 22 bp, Artificial Sequence
  chemically synthesized
ctatacaatcatcttgagtaaa

SEQ ID NO: 1276724 - DNA, 22 bp, Artificial Sequence
  chemically synthesized
tatacaatcatcttgagtaaaa

SEQ ID NO: 1276725 - DNA, 22 bp, Artificial Sequence
  chemically synthesized
attttgttctttttttactcaa

SEQ ID NO: 1276726 - DNA, 22 bp, Artificial Sequence
  chemically synthesized
gattttgttctttttttactca

SEQ ID NO: 1276727 - DNA, 22 bp, Artificial Sequence
  chemically synthesized
tacaatcatcttgagtaaaaaa

SEQ ID NO: 1276728 - DNA, 22 bp, Artificial Sequence
  chemically synthesized
tagtcagtttgattttgttctt

SEQ ID NO: 1276729 - DNA, 22 bp, Artificial Sequence
  chemically synthesized
gtagtcagtttgattttgttct

SEQ ID NO: 1276730 - DNA, 22 bp, Artificial Sequence
  chemically synthesized
gagtaaaaaaagaacaaaatca

SEQ ID NO: 1276731 - DNA, 22 bp, Artificial Sequence
  chemically synthesized
agtaaaaaaagaacaaaatcaa

SEQ ID NO: 1276732 - DNA, 22 bp, Artificial Sequence
  chemically synthesized
cttgtagtcagtttgattttgt

SEQ ID NO: 1276733 - DNA, 22 bp, Artificial Sequence
  chemically synthesized
gagagctacttgtagtcagttt

SEQ ID NO: 1276734 - DNA, 22 bp, Artificial Sequence
  chemically synthesized
agtctagagagctacttgtagt

SEQ ID NO: 1276735 - DNA, 22 bp, Artificial Sequence
  chemically synthesized
gcagctaagtctagagagctac

SEQ ID NO: 1276736 - DNA, 22 bp, Artificial Sequence
  chemically synthesized
actacaagtagctctctagact

SEQ ID NO: 1276737 - DNA, 22 bp, Artificial Sequence
  chemically synthesized
acaaattagcagctaagtctag

SEQ ID NO: 1276738 - DNA, 22 bp, Artificial Sequence
  chemically synthesized
caagtagctctctagacttagc

SEQ ID NO: 1276739 - DNA, 22 bp, Artificial Sequence
  chemically synthesized
tggtgctgacaaattagcagct

SEQ ID NO: 1276740 - DNA, 22 bp, Artificial Sequence
  chemically synthesized
tctagacttagctgctaatttg

SEQ ID NO: 1276741 - DNA, 22 bp, Artificial Sequence
  chemically synthesized
ctgtggtgctgacaaattagca

SEQ ID NO: 1276742 - DNA, 22 bp, Artificial Sequence
  chemically synthesized
tagacttagctgctaatttgtc

SEQ ID NO: 1276743 - DNA, 22 bp, Artificial Sequence
  chemically synthesized
gacttagctgctaatttgtcag

SEQ ID NO: 1276744 - DNA, 22 bp, Artificial Sequence
  chemically synthesized
accagctcctgtggtgctgaca

SEQ ID NO: 1276745 - DNA, 22 bp, Artificial Sequence
  chemically synthesized
agctgctaatttgtcagcacca

SEQ ID NO: 1276746 - DNA, 22 bp, Artificial Sequence
  chemically synthesized
caccagctcctgtggtgctgac

SEQ ID NO: 1276747 - DNA, 22 bp, Artificial Sequence
  chemically synthesized
gctgctaatttgtcagcaccac

SEQ ID NO: 1276748 - DNA, 22 bp, Artificial Sequence
  chemically synthesized
ctaatttgtcagcaccacagga

SEQ ID NO: 1276749 - DNA, 22 bp, Artificial Sequence
  chemically synthesized
atttgtcagcaccacaggagct

SEQ ID NO: 1276750 - DNA, 22 bp, Artificial Sequence
  chemically synthesized
atgtgtttcaccagctcctgtg

SEQ ID NO: 1276751 - DNA, 22 bp, Artificial Sequence
  chemically synthesized
aatgtgtttcaccagctcctgt

SEQ ID NO: 1276752 - DNA, 22 bp, Artificial Sequence
  chemically synthesized
gtcagcaccacaggagctggtg

SEQ ID NO: 1276753 - DNA, 22 bp, Artificial Sequence
  chemically synthesized
tttaatgtgtttcaccagctcc

SEQ ID NO: 1276754 - DNA, 22 bp, Artificial Sequence
  chemically synthesized
tcagcaccacaggagctggtga

SEQ ID NO: 1276755 - DNA, 22 bp, Artificial Sequence
  chemically synthesized
catccacatgatattgtttaat

SEQ ID NO: 1276756 - DNA, 22 bp, Artificial Sequence
  chemically synthesized
gtgaaacacattaaacaatatc

SEQ ID NO: 1276757 - DNA, 22 bp, Artificial Sequence
  chemically synthesized
attacatccacatgatattgtt

SEQ ID NO: 1276758 - DNA, 22 bp, Artificial Sequence
  chemically synthesized
ttgattacatccacatgatatt

SEQ ID NO: 1276759 - DNA, 22 bp, Artificial Sequence
  chemically synthesized
gttgattacatccacatgatat

SEQ ID NO: 1276760 - DNA, 22 bp, Artificial Sequence
  chemically synthesized
ggtttgttgattacatccacat

SEQ ID NO: 1276761 - DNA, 22 bp, Artificial Sequence
  chemically synthesized
aacaatatcatgtggatgtaat

SEQ ID NO: 1276762 - DNA, 22 bp, Artificial Sequence
  chemically synthesized
tctaggtttgttgattacatcc

SEQ ID NO: 1276763 - DNA, 22 bp, Artificial Sequence
  chemically synthesized
gtctaggtttgttgattacatc

SEQ ID NO: 1276764 - DNA, 22 bp, Artificial Sequence
  chemically synthesized
tgtctaggtttgttgattacat

SEQ ID NO: 1276765 - DNA, 22 bp, Artificial Sequence
  chemically synthesized
ttgtctaggtttgttgattaca

SEQ ID NO: 1276766 - DNA, 22 bp, Artificial Sequence
  chemically synthesized
aagaaacaggaccttttgtcta

SEQ ID NO: 1276767 - DNA, 22 bp, Artificial Sequence
  chemically synthesized
gaagaaacaggaccttttgtct

SEQ ID NO: 1276768 - DNA, 22 bp, Artificial Sequence
  chemically synthesized
tgaagaaacaggaccttttgtc

SEQ ID NO: 1276769 - DNA, 22 bp, Artificial Sequence
  chemically synthesized
ttgaagaaacaggaccttttgt

SEQ ID NO: 1276770 - DNA, 22 bp, Artificial Sequence
  chemically synthesized
atttttgaagaaacaggacctt

SEQ ID NO: 1276771 - DNA, 22 bp, Artificial Sequence
  chemically synthesized
catttttgaagaaacaggacct

SEQ ID NO: 1276772 - DNA, 22 bp, Artificial Sequence
  chemically synthesized
tcatttttgaagaaacaggacc

SEQ ID NO: 1276773 - DNA, 22 bp, Artificial Sequence
  chemically synthesized
ttcatttttgaagaaacaggac

SEQ ID NO: 1276774 - DNA, 22 bp, Artificial Sequence
  chemically synthesized
gacaaaaggtcctgtttcttca

SEQ ID NO: 1276775 - DNA, 22 bp, Artificial Sequence
  chemically synthesized
ccttttcatttttgaagaaaca

SEQ ID NO: 1276776 - DNA, 22 bp, Artificial Sequence
  chemically synthesized
tcccttttcatttttgaagaaa

SEQ ID NO: 1276777 - DNA, 22 bp, Artificial Sequence
  chemically synthesized
actctcccttttcatttttgaa

SEQ ID NO: 1276778 - DNA, 22 bp, Artificial Sequence
  chemically synthesized
tcactctcccttttcatttttg

SEQ ID NO: 1276779 - DNA, 22 bp, Artificial Sequence
  chemically synthesized
gttctcactctcccttttcatt

SEQ ID NO: 1276780 - DNA, 22 bp, Artificial Sequence
  chemically synthesized
tttcttcaaaaatgaaaaggga

SEQ ID NO: 1276781 - DNA, 22 bp, Artificial Sequence
  chemically synthesized
cttcaaaaatgaaaagggagag

SEQ ID NO: 1276782 - DNA, 22 bp, Artificial Sequence
  chemically synthesized
ttcaaaaatgaaaagggagagt

SEQ ID NO: 1276783 - DNA, 22 bp, Artificial Sequence
  chemically synthesized
atcctcgttctcactctccctt

SEQ ID NO: 1276784 - DNA, 22 bp, Artificial Sequence
  chemically synthesized
caaaaatgaaaagggagagtga

SEQ ID NO: 1276785 - DNA, 22 bp, Artificial Sequence
  chemically synthesized
aaaaatgaaaagggagagtgag

SEQ ID NO: 1276786 - DNA, 22 bp, Artificial Sequence
  chemically synthesized
cctcatcctcgttctcactctc

SEQ ID NO: 1276787 - DNA, 22 bp, Artificial Sequence
  chemically synthesized
ctccctcatcctcgttctcact

SEQ ID NO: 1276788 - DNA, 22 bp, Artificial Sequence
  chemically synthesized
ctcctccctcatcctcgttctc

SEQ ID NO: 1276789 - DNA, 22 bp, Artificial Sequence
  chemically synthesized
catcctcctcctccctcatcct

SEQ ID NO: 1276790 - DNA, 22 bp, Artificial Sequence
  chemically synthesized
cacaccctacatcctcctcctc

SEQ ID NO: 1276791 - DNA, 22 bp, Artificial Sequence
  chemically synthesized
ctccacaccctacatcctcctc

SEQ ID NO: 1276792 - DNA, 22 bp, Artificial Sequence
  chemically synthesized
cctccacaccctacatcctcct

SEQ ID NO: 1276793 - DNA, 22 bp, Artificial Sequence
  chemically synthesized
tttcctccacaccctacatcct

SEQ ID NO: 1276794 - DNA, 22 bp, Artificial Sequence
  chemically synthesized
tgtttcctccacaccctacatc

SEQ ID NO: 1276795 - DNA, 22 bp, Artificial Sequence
  chemically synthesized
tctctgtttcctccacacccta

SEQ ID NO: 1276796 - DNA, 22 bp, Artificial Sequence
  chemically synthesized
ttgtctctgtttcctccacacc

SEQ ID NO: 1276797 - DNA, 22 bp, Artificial Sequence
  chemically synthesized
tgttgtctctgtttcctccaca

SEQ ID NO: 1276798 - DNA, 22 bp, Artificial Sequence
  chemically synthesized
tctgttgtctctgtttcctcca

SEQ ID NO: 1276799 - DNA, 22 bp, Artificial Sequence
  chemically synthesized
tctctgttgtctctgtttcctc

SEQ ID NO: 1276800 - DNA, 22 bp, Artificial Sequence
  chemically synthesized
ctctctgttgtctctgtttcct

SEQ ID NO: 1276801 - DNA, 22 bp, Artificial Sequence
  chemically synthesized
ttctctctgttgtctctgtttc

SEQ ID NO: 1276802 - DNA, 22 bp, Artificial Sequence
  chemically synthesized
tcttctctctgttgtctctgtt

SEQ ID NO: 1276803 - DNA, 22 bp, Artificial Sequence
  chemically synthesized
ctctcttctctctgttgtctct

SEQ ID NO: 1276804 - DNA, 22 bp, Artificial Sequence
  chemically synthesized
taggactcctctcttctctctg

SEQ ID NO: 1276805 - DNA, 22 bp, Artificial Sequence
  chemically synthesized
tcctataggactcctctcttct

SEQ ID NO: 1276806 - DNA, 22 bp, Artificial Sequence
  chemically synthesized
ccaaattatcctataggactcc

SEQ ID NO: 1276807 - DNA, 22 bp, Artificial Sequence
  chemically synthesized
cccaaattatcctataggactc

SEQ ID NO: 1276808 - DNA, 22 bp, Artificial Sequence
  chemically synthesized
tatttcccaaattatcctatag

SEQ ID NO: 1276809 - DNA, 22 bp, Artificial Sequence
  chemically synthesized
atatttcccaaattatcctata

SEQ ID NO: 1276810 - DNA, 22 bp, Artificial Sequence
  chemically synthesized
tatatttcccaaattatcctat

SEQ ID NO: 1276811 - DNA, 22 bp, Artificial Sequence
  chemically synthesized
taggataatttgggaaatataa

SEQ ID NO: 1276812 - DNA, 22 bp, Artificial Sequence
  chemically synthesized
atatcatcaaatacattttata

SEQ ID NO: 1276813 - DNA, 22 bp, Artificial Sequence
  chemically synthesized
aatatcatcaaatacattttat

SEQ ID NO: 1276814 - DNA, 22 bp, Artificial Sequence
  chemically synthesized
cttaatatcatcaaatacattt

SEQ ID NO: 1276815 - DNA, 22 bp, Artificial Sequence
  chemically synthesized
gcttaatatcatcaaatacatt

SEQ ID NO: 1276816 - DNA, 22 bp, Artificial Sequence
  chemically synthesized
gggaaatataaaatgtatttga

SEQ ID NO: 1276817 - DNA, 22 bp, Artificial Sequence
  chemically synthesized
ggaaatataaaatgtatttgat

SEQ ID NO: 1276818 - DNA, 22 bp, Artificial Sequence
  chemically synthesized
gatgatattaagcaaatatttt

SEQ ID NO: 1276819 - DNA, 22 bp, Artificial Sequence
  chemically synthesized
atgatattaagcaaatattttc

SEQ ID NO: 1276820 - DNA, 22 bp, Artificial Sequence
  chemically synthesized
agcaaatattttccggggctgg

SEQ ID NO: 1276821 - DNA, 22 bp, Artificial Sequence
  chemically synthesized
caggcgtgagccaccgcaccca

SEQ ID NO: 1276822 - DNA, 22 bp, Artificial Sequence
  chemically synthesized
tccggggctgggtgcggtggct

SEQ ID NO: 1276823 - DNA, 22 bp, Artificial Sequence
  chemically synthesized
ccggggctgggtgcggtggctc

SEQ ID NO: 1276824 - DNA, 22 bp, Artificial Sequence
  chemically synthesized
cggggctgggtgcggtggctca

SEQ ID NO: 1276825 - DNA, 22 bp, Artificial Sequence
  chemically synthesized
agattacaggcgtgagccaccg

SEQ ID NO: 1276826 - DNA, 22 bp, Artificial Sequence
  chemically synthesized
ggtgcggtggctcacgcctgta

SEQ ID NO: 1276827 - DNA, 22 bp, Artificial Sequence
  chemically synthesized
aaagtgctgagattacaggcgt

SEQ ID NO: 1276828 - DNA, 22 bp, Artificial Sequence
  chemically synthesized
gcccctcaaagtgctgagatta

SEQ ID NO: 1276829 - DNA, 22 bp, Artificial Sequence
  chemically synthesized
ggcccctcaaagtgctgagatt

SEQ ID NO: 1276830 - DNA, 22 bp, Artificial Sequence
  chemically synthesized
acgcctgtaatctcagcacttt

SEQ ID NO: 1276831 - DNA, 22 bp, Artificial Sequence
  chemically synthesized
taatctcagcactttgaggggc

SEQ ID NO: 1276832 - DNA, 22 bp, Artificial Sequence
  chemically synthesized
agcactttgaggggccaaggtg

SEQ ID NO: 1276833 - DNA, 22 bp, Artificial Sequence
  chemically synthesized
aaatgatccgcccaccttggcc

SEQ ID NO: 1276834 - DNA, 22 bp, Artificial Sequence
  chemically synthesized
acctcaaatgatccgcccacct

SEQ ID NO: 1276835 - DNA, 22 bp, Artificial Sequence
  chemically synthesized
tgaggggccaaggtgggcggat

SEQ ID NO: 1276836 - DNA, 22 bp, Artificial Sequence
  chemically synthesized
gaggggccaaggtgggcggatc

SEQ ID NO: 1276837 - DNA, 22 bp, Artificial Sequence
  chemically synthesized
ctgacctcaaatgatccgccca

SEQ ID NO: 1276838 - DNA, 22 bp, Artificial Sequence
  chemically synthesized
aggggccaaggtgggcggatca

SEQ ID NO: 1276839 - DNA, 22 bp, Artificial Sequence
  chemically synthesized
aactcctgacctcaaatgatcc

SEQ ID NO: 1276840 - DNA, 22 bp, Artificial Sequence
  chemically synthesized
gaactcctgacctcaaatgatc

SEQ ID NO: 1276841 - DNA, 22 bp, Artificial Sequence
  chemically synthesized
gtcttgaactcctgacctcaaa

SEQ ID NO: 1276842 - DNA, 22 bp, Artificial Sequence
  chemically synthesized
gtcaggctggtcttgaactcct

SEQ ID NO: 1276843 - DNA, 22 bp, Artificial Sequence
  chemically synthesized
gaggtcaggagttcaagaccag

SEQ ID NO: 1276844 - DNA, 22 bp, Artificial Sequence
  chemically synthesized
aggtcaggagttcaagaccagc

SEQ ID NO: 1276845 - DNA, 22 bp, Artificial Sequence
  chemically synthesized
accatgttggtcaggctggtct

SEQ ID NO: 1276846 - DNA, 22 bp, Artificial Sequence
  chemically synthesized
caccatgttggtcaggctggtc

SEQ ID NO: 1276847 - DNA, 22 bp, Artificial Sequence
  chemically synthesized
aagaccagcctgaccaacatgg

SEQ ID NO: 1276848 - DNA, 22 bp, Artificial Sequence
  chemically synthesized
gtacagatgggatttcaccatg

SEQ ID NO: 1276849 - DNA, 22 bp, Artificial Sequence
  chemically synthesized
agtacagatgggatttcaccat

SEQ ID NO: 1276850 - DNA, 22 bp, Artificial Sequence
  chemically synthesized
tagtacagatgggatttcacca

SEQ ID NO: 1276851 - DNA, 22 bp, Artificial Sequence
  chemically synthesized
ttagtacagatgggatttcacc

SEQ ID NO: 1276852 - DNA, 22 bp, Artificial Sequence
  chemically synthesized
accaacatggtgaaatcccatc

SEQ ID NO: 1276853 - DNA, 22 bp, Artificial Sequence
  chemically synthesized
tatttttagtacagatgggatt

SEQ ID NO: 1276854 - DNA, 22 bp, Artificial Sequence
  chemically synthesized
gtatttttagtacagatgggat

SEQ ID NO: 1276855 - DNA, 22 bp, Artificial Sequence
  chemically synthesized
tgtatttttagtacagatggga

SEQ ID NO: 1276856 - DNA, 22 bp, Artificial Sequence
  chemically synthesized
ttgtatttttagtacagatggg

SEQ ID NO: 1276857 - DNA, 22 bp, Artificial Sequence
  chemically synthesized
tttgtatttttagtacagatgg

SEQ ID NO: 1276858 - DNA, 22 bp, Artificial Sequence
  chemically synthesized
ttttgtatttttagtacagatg

SEQ ID NO: 1276859 - DNA, 22 bp, Artificial Sequence
  chemically synthesized
tactaaaaatacaaaaaaatta

SEQ ID NO: 1276860 - DNA, 22 bp, Artificial Sequence
  chemically synthesized
aaaatacaaaaaaattatccgg

SEQ ID NO: 1276861 - DNA, 22 bp, Artificial Sequence
  chemically synthesized
caggcatgcgccaccacacccg

SEQ ID NO: 1276862 - DNA, 22 bp, Artificial Sequence
  chemically synthesized
ctacaggcatgcgccaccacac

SEQ ID NO: 1276863 - DNA, 22 bp, Artificial Sequence
  chemically synthesized
ctactacaggcatgcgccacca

SEQ ID NO: 1276864 - DNA, 22 bp, Artificial Sequence
  chemically synthesized
tccgggtgtggtggcgcatgcc

SEQ ID NO: 1276865 - DNA, 22 bp, Artificial Sequence
  chemically synthesized
ccgagtagctgctactacaggc

SEQ ID NO: 1276866 - DNA, 22 bp, Artificial Sequence
  chemically synthesized
agcctcccgagtagctgctact

SEQ ID NO: 1276867 - DNA, 22 bp, Artificial Sequence
  chemically synthesized
cctcagcctcccgagtagctgc

SEQ ID NO: 1276868 - DNA, 22 bp, Artificial Sequence
  chemically synthesized
ctgcctcagcctcccgagtagc

SEQ ID NO: 1276869 - DNA, 22 bp, Artificial Sequence
  chemically synthesized
tcctgcctcagcctcccgagta

SEQ ID NO: 1276870 - DNA, 22 bp, Artificial Sequence
  chemically synthesized
tagtagcagctactcgggaggc

SEQ ID NO: 1276871 - DNA, 22 bp, Artificial Sequence
  chemically synthesized
aaatgattctcctgcctcagcc

SEQ ID NO: 1276872 - DNA, 22 bp, Artificial Sequence
  chemically synthesized
ctcgggaggctgaggcaggaga

SEQ ID NO: 1276873 - DNA, 22 bp, Artificial Sequence
  chemically synthesized
gggaggctgaggcaggagaatc

SEQ ID NO: 1276874 - DNA, 22 bp, Artificial Sequence
  chemically synthesized
ccaggttcaaatgattctcctg

SEQ ID NO: 1276875 - DNA, 22 bp, Artificial Sequence
  chemically synthesized
cgcctcccaggttcaaatgatt

SEQ ID NO: 1276876 - DNA, 22 bp, Artificial Sequence
  chemically synthesized
aggcaggagaatcatttgaacc

SEQ ID NO: 1276877 - DNA, 22 bp, Artificial Sequence
  chemically synthesized
caacctccgcctcccaggttca

SEQ ID NO: 1276878 - DNA, 22 bp, Artificial Sequence
  chemically synthesized
actgcaacctccgcctcccagg

SEQ ID NO: 1276879 - DNA, 22 bp, Artificial Sequence
  chemically synthesized
gctcactgcaacctccgcctcc

SEQ ID NO: 1276880 - DNA, 22 bp, Artificial Sequence
  chemically synthesized
ggctcactgcaacctccgcctc

SEQ ID NO: 1276881 - DNA, 22 bp, Artificial Sequence
  chemically synthesized
gaacctgggaggcggaggttgc

SEQ ID NO: 1276882 - DNA, 22 bp, Artificial Sequence
  chemically synthesized
aacctgggaggcggaggttgca

SEQ ID NO: 1276883 - DNA, 22 bp, Artificial Sequence
  chemically synthesized
ggaggcggaggttgcagtgagc

SEQ ID NO: 1276884 - DNA, 22 bp, Artificial Sequence
  chemically synthesized
gagtgcagtggcacgatcttgg

SEQ ID NO: 1276885 - DNA, 22 bp, Artificial Sequence
  chemically synthesized
cagtgagccaagatcgtgccac

SEQ ID NO: 1276886 - DNA, 22 bp, Artificial Sequence
  chemically synthesized
tcacccaggctggagtgcagtg

SEQ ID NO: 1276887 - DNA, 22 bp, Artificial Sequence
  chemically synthesized
tgtcacccaggctggagtgcag

SEQ ID NO: 1276888 - DNA, 22 bp, Artificial Sequence
  chemically synthesized
gctctgtcacccaggctggagt

SEQ ID NO: 1276889 - DNA, 22 bp, Artificial Sequence
  chemically synthesized
cactccagcctgggtgacagag

SEQ ID NO: 1276890 - DNA, 22 bp, Artificial Sequence
  chemically synthesized
agacagagtctcgctctgtcac

SEQ ID NO: 1276891 - DNA, 22 bp, Artificial Sequence
  chemically synthesized
gagacagagtctcgctctgtca

SEQ ID NO: 1276892 - DNA, 22 bp, Artificial Sequence
  chemically synthesized
tgagacagagtctcgctctgtc

SEQ ID NO: 1276893 - DNA, 22 bp, Artificial Sequence
  chemically synthesized
ttgagacagagtctcgctctgt

SEQ ID NO: 1276894 - DNA, 22 bp, Artificial Sequence
  chemically synthesized
cagcctgggtgacagagcgaga

SEQ ID NO: 1276895 - DNA, 22 bp, Artificial Sequence
  chemically synthesized
tttgagacagagtctcgctctg

SEQ ID NO: 1276896 - DNA, 22 bp, Artificial Sequence
  chemically synthesized
ttttgagacagagtctcgctct

SEQ ID NO: 1276897 - DNA, 22 bp, Artificial Sequence
  chemically synthesized
tttttgagacagagtctcgctc

SEQ ID NO: 1276898 - DNA, 22 bp, Artificial Sequence
  chemically synthesized
ttttttgagacagagtctcgct

SEQ ID NO: 1276899 - DNA, 22 bp, Artificial Sequence
  chemically synthesized
tttttttgagacagagtctcgc

SEQ ID NO: 1276900 - DNA, 22 bp, Artificial Sequence
  chemically synthesized
ttttttttgagacagagtctcg

SEQ ID NO: 1276901 - DNA, 22 bp, Artificial Sequence
  chemically synthesized
tttttttttgagacagagtctc

SEQ ID NO: 1276902 - DNA, 22 bp, Artificial Sequence
  chemically synthesized
ggtgacagagcgagactctgtc

SEQ ID NO: 1276903 - DNA, 22 bp, Artificial Sequence
  chemically synthesized
ttttttttttgagacagagtct

SEQ ID NO: 1276904 - DNA, 22 bp, Artificial Sequence
  chemically synthesized
tttttttttttgagacagagtc

SEQ ID NO: 1276905 - DNA, 22 bp, Artificial Sequence
  chemically synthesized
ttttttttttttgagacagagt

SEQ ID NO: 1276906 - DNA, 22 bp, Artificial Sequence
  chemically synthesized
tttttttttttttgagacagag

SEQ ID NO: 1276907 - DNA, 22 bp, Artificial Sequence
  chemically synthesized
ttttttttttttttgagacaga

SEQ ID NO: 1276908 - DNA, 22 bp, Artificial Sequence
  chemically synthesized
ttttttttttttttttgagaca

SEQ ID NO: 1276909 - DNA, 22 bp, Artificial Sequence
  chemically synthesized
cttttttttttttttttgagac

SEQ ID NO: 1276910 - DNA, 22 bp, Artificial Sequence
  chemically synthesized
tgtctcaaaaaaaaaaaaaaaa

SEQ ID NO: 1276911 - DNA, 22 bp, Artificial Sequence
  chemically synthesized
tctcaaaaaaaaaaaaaaaaga

SEQ ID NO: 1276912 - DNA, 22 bp, Artificial Sequence
  chemically synthesized
aaaaaaaaaaaaaaaagaagtg

SEQ ID NO: 1276913 - DNA, 22 bp, Artificial Sequence
  chemically synthesized
ccaagtaacccccccaccccac

SEQ ID NO: 1276914 - DNA, 22 bp, Artificial Sequence
  chemically synthesized
tattcccaagtaacccccccac

SEQ ID NO: 1276915 - DNA, 22 bp, Artificial Sequence
  chemically synthesized
agactgtattcccaagtaaccc

SEQ ID NO: 1276916 - DNA, 22 bp, Artificial Sequence
  chemically synthesized
cagactgtattcccaagtaacc

SEQ ID NO: 1276917 - DNA, 22 bp, Artificial Sequence
  chemically synthesized
aacatttcagactgtattccca

SEQ ID NO: 1276918 - DNA, 22 bp, Artificial Sequence
  chemically synthesized
taaacatttcagactgtattcc

SEQ ID NO: 1276919 - DNA, 22 bp, Artificial Sequence
  chemically synthesized
ctctaaacatttcagactgtat

SEQ ID NO: 1276920 - DNA, 22 bp, Artificial Sequence
  chemically synthesized
tactctaaacatttcagactgt

SEQ ID NO: 1276921 - DNA, 22 bp, Artificial Sequence
  chemically synthesized
ctactctaaacatttcagactg

SEQ ID NO: 1276922 - DNA, 22 bp, Artificial Sequence
  chemically synthesized
cttgggaatacagtctgaaatg

SEQ ID NO: 1276923 - DNA, 22 bp, Artificial Sequence
  chemically synthesized
gggaatacagtctgaaatgttt

SEQ ID NO: 1276924 - DNA, 22 bp, Artificial Sequence
  chemically synthesized
ggaatacagtctgaaatgttta

SEQ ID NO: 1276925 - DNA, 22 bp, Artificial Sequence
  chemically synthesized
aaatgtttagagtagaagtgat

SEQ ID NO: 1276926 - DNA, 22 bp, Artificial Sequence
  chemically synthesized
agagtagaagtgatatactttc

SEQ ID NO: 1276927 - DNA, 22 bp, Artificial Sequence
  chemically synthesized
aggcaaatccccgaaagtatat

SEQ ID NO: 1276928 - DNA, 22 bp, Artificial Sequence
  chemically synthesized
gagtagaagtgatatactttcg

SEQ ID NO: 1276929 - DNA, 22 bp, Artificial Sequence
  chemically synthesized
gaggcaaatccccgaaagtata

SEQ ID NO: 1276930 - DNA, 22 bp, Artificial Sequence
  chemically synthesized
tgaggcaaatccccgaaagtat

SEQ ID NO: 1276931 - DNA, 22 bp, Artificial Sequence
  chemically synthesized
ttttgaggcaaatccccgaaag

SEQ ID NO: 1276932 - DNA, 22 bp, Artificial Sequence
  chemically synthesized
tgttttgaggcaaatccccgaa

SEQ ID NO: 1276933 - DNA, 22 bp, Artificial Sequence
  chemically synthesized
tctgttttgaggcaaatccccg

SEQ ID NO: 1276934 - DNA, 22 bp, Artificial Sequence
  chemically synthesized
ttctctgttttgaggcaaatcc

SEQ ID NO: 1276935 - DNA, 22 bp, Artificial Sequence
  chemically synthesized
ctattctctgttttgaggcaaa

SEQ ID NO: 1276936 - DNA, 22 bp, Artificial Sequence
  chemically synthesized
cctattctctgttttgaggcaa

SEQ ID NO: 1276937 - DNA, 22 bp, Artificial Sequence
  chemically synthesized
tcggggatttgcctcaaaacag

SEQ ID NO: 1276938 - DNA, 22 bp, Artificial Sequence
  chemically synthesized
cggggatttgcctcaaaacaga

SEQ ID NO: 1276939 - DNA, 22 bp, Artificial Sequence
  chemically synthesized
ggggatttgcctcaaaacagag

SEQ ID NO: 1276940 - DNA, 22 bp, Artificial Sequence
  chemically synthesized
cccacttcctattctctgtttt

SEQ ID NO: 1276941 - DNA, 22 bp, Artificial Sequence
  chemically synthesized
cctacccacttcctattctctg

SEQ ID NO: 1276942 - DNA, 22 bp, Artificial Sequence
  chemically synthesized
tacctacccacttcctattctc

SEQ ID NO: 1276943 - DNA, 22 bp, Artificial Sequence
  chemically synthesized
gcctcaaaacagagaataggaa

SEQ ID NO: 1276944 - DNA, 22 bp, Artificial Sequence
  chemically synthesized
cctcaaaacagagaataggaag

SEQ ID NO: 1276945 - DNA, 22 bp, Artificial Sequence
  chemically synthesized
tctacctacccacttcctattc

SEQ ID NO: 1276946 - DNA, 22 bp, Artificial Sequence
  chemically synthesized
ctctctacctacccacttccta

SEQ ID NO: 1276947 - DNA, 22 bp, Artificial Sequence
  chemically synthesized
aaaacagagaataggaagtggg

SEQ ID NO: 1276948 - DNA, 22 bp, Artificial Sequence
  chemically synthesized
cctctctacctacccacttcct

SEQ ID NO: 1276949 - DNA, 22 bp, Artificial Sequence
  chemically synthesized
gtttcctctctacctacccact

SEQ ID NO: 1276950 - DNA, 22 bp, Artificial Sequence
  chemically synthesized
ccatctggtttcctctctacct

SEQ ID NO: 1276951 - DNA, 22 bp, Artificial Sequence
  chemically synthesized
tcattaccatctggtttcctct

SEQ ID NO: 1276952 - DNA, 22 bp, Artificial Sequence
  chemically synthesized
ttatcattaccatctggtttcc

SEQ ID NO: 1276953 - DNA, 22 bp, Artificial Sequence
  chemically synthesized
accattattatcattaccatct

SEQ ID NO: 1276954 - DNA, 22 bp, Artificial Sequence
  chemically synthesized
taaccattattatcattaccat

SEQ ID NO: 1276955 - DNA, 22 bp, Artificial Sequence
  chemically synthesized
gctctaaccattattatcatta

SEQ ID NO: 1276956 - DNA, 22 bp, Artificial Sequence
  chemically synthesized
attagctctaaccattattatc

SEQ ID NO: 1276957 - DNA, 22 bp, Artificial Sequence
  chemically synthesized
ctcattagctctaaccattatt

SEQ ID NO: 1276958 - DNA, 22 bp, Artificial Sequence
  chemically synthesized
gagctaatgagcagtgtatggt

SEQ ID NO: 1276959 - DNA, 22 bp, Artificial Sequence
  chemically synthesized
atgagcagtgtatggtatgcat

SEQ ID NO: 1276960 - DNA, 22 bp, Artificial Sequence
  chemically synthesized
aaacatatacaaaataaaaaag

SEQ ID NO: 1276961 - DNA, 22 bp, Artificial Sequence
  chemically synthesized
caaacatatacaaaataaaaaa

SEQ ID NO: 1276962 - DNA, 22 bp, Artificial Sequence
  chemically synthesized
tgttacttttttattttgtata

SEQ ID NO: 1276963 - DNA, 22 bp, Artificial Sequence
  chemically synthesized
tgaagaatttcaaacatataca

SEQ ID NO: 1276964 - DNA, 22 bp, Artificial Sequence
  chemically synthesized
cttttttattttgtatatgttt

SEQ ID NO: 1276965 - DNA, 22 bp, Artificial Sequence
  chemically synthesized
atgaagaatttcaaacatatac

SEQ ID NO: 1276966 - DNA, 22 bp, Artificial Sequence
  chemically synthesized
ttatgaagaatttcaaacatat

SEQ ID NO: 1276967 - DNA, 22 bp, Artificial Sequence
  chemically synthesized
ttttattttgtatatgtttgaa

SEQ ID NO: 1276968 - DNA, 22 bp, Artificial Sequence
  chemically synthesized
tttattttgtatatgtttgaaa

SEQ ID NO: 1276969 - DNA, 22 bp, Artificial Sequence
  chemically synthesized
tcttatgaagaatttcaaacat

SEQ ID NO: 1276970 - DNA, 22 bp, Artificial Sequence
  chemically synthesized
ttattttgtatatgtttgaaat

SEQ ID NO: 1276971 - DNA, 22 bp, Artificial Sequence
  chemically synthesized
ctcttatgaagaatttcaaaca

SEQ ID NO: 1276972 - DNA, 22 bp, Artificial Sequence
  chemically synthesized
tattttgtatatgtttgaaatt

SEQ ID NO: 1276973 - DNA, 22 bp, Artificial Sequence
  chemically synthesized
tctcttatgaagaatttcaaac

SEQ ID NO: 1276974 - DNA, 22 bp, Artificial Sequence
  chemically synthesized
attttgtatatgtttgaaattc

SEQ ID NO: 1276975 - DNA, 22 bp, Artificial Sequence
  chemically synthesized
ttctcttatgaagaatttcaaa

SEQ ID NO: 1276976 - DNA, 22 bp, Artificial Sequence
  chemically synthesized
ttttgtatatgtttgaaattct

SEQ ID NO: 1276977 - DNA, 22 bp, Artificial Sequence
  chemically synthesized
tttctcttatgaagaatttcaa

SEQ ID NO: 1276978 - DNA, 22 bp, Artificial Sequence
  chemically synthesized
tgtatatgtttgaaattcttca

SEQ ID NO: 1276979 - DNA, 22 bp, Artificial Sequence
  chemically synthesized
ttttttctcttatgaagaattt

SEQ ID NO: 1276980 - DNA, 22 bp, Artificial Sequence
  chemically synthesized
gtatatgtttgaaattcttcat

SEQ ID NO: 1276981 - DNA, 22 bp, Artificial Sequence
  chemically synthesized
attttttctcttatgaagaatt

SEQ ID NO: 1276982 - DNA, 22 bp, Artificial Sequence
  chemically synthesized
tatatgtttgaaattcttcata

SEQ ID NO: 1276983 - DNA, 22 bp, Artificial Sequence
  chemically synthesized
gaaattcttcataagagaaaaa

SEQ ID NO: 1276984 - DNA, 22 bp, Artificial Sequence
  chemically synthesized
aaattcttcataagagaaaaaa

SEQ ID NO: 1276985 - DNA, 22 bp, Artificial Sequence
  chemically synthesized
ttcataagagaaaaaataaatg

SEQ ID NO: 1276986 - DNA, 22 bp, Artificial Sequence
  chemically synthesized
cataagagaaaaaataaatggt

SEQ ID NO: 1276987 - DNA, 22 bp, Artificial Sequence
  chemically synthesized
ataagagaaaaaataaatggtc

SEQ ID NO: 1276988 - DNA, 22 bp, Artificial Sequence
  chemically synthesized
caggtgcacatggaccatttat

SEQ ID NO: 1276989 - DNA, 22 bp, Artificial Sequence
  chemically synthesized
tgttacaggtgcacatggacca

SEQ ID NO: 1276990 - DNA, 22 bp, Artificial Sequence
  chemically synthesized
ttatgttacaggtgcacatgga

SEQ ID NO: 1276991 - DNA, 22 bp, Artificial Sequence
  chemically synthesized
tcattattatgttacaggtgca

SEQ ID NO: 1276992 - DNA, 22 bp, Artificial Sequence
  chemically synthesized
gtcattattatgttacaggtgc

SEQ ID NO: 1276993 - DNA, 22 bp, Artificial Sequence
  chemically synthesized
acatatcttgtcattattatgt

SEQ ID NO: 1276994 - DNA, 22 bp, Artificial Sequence
  chemically synthesized
ggctgacatatcttgtcattat

SEQ ID NO: 1276995 - DNA, 22 bp, Artificial Sequence
  chemically synthesized
aggctgacatatcttgtcatta

SEQ ID NO: 1276996 - DNA, 22 bp, Artificial Sequence
  chemically synthesized
ttaggctgacatatcttgtcat

SEQ ID NO: 1276997 - DNA, 22 bp, Artificial Sequence
  chemically synthesized
taacataataatgacaagatat

SEQ ID NO: 1276998 - DNA, 22 bp, Artificial Sequence
  chemically synthesized
ttcttaggctgacatatcttgt

SEQ ID NO: 1276999 - DNA, 22 bp, Artificial Sequence
  chemically synthesized
attcttaggctgacatatcttg

SEQ ID NO: 1277000 - DNA, 22 bp, Artificial Sequence
  chemically synthesized
agacatatttattcttaggctg

SEQ ID NO: 1277001 - DNA, 22 bp, Artificial Sequence
  chemically synthesized
aagacatatttattcttaggct

SEQ ID NO: 1277002 - DNA, 22 bp, Artificial Sequence
  chemically synthesized
agaataaatatgtcttaagtta

SEQ ID NO: 1277003 - DNA, 22 bp, Artificial Sequence
  chemically synthesized
aagccaagatgaggtaaagggg

SEQ ID NO: 1277004 - DNA, 22 bp, Artificial Sequence
  chemically synthesized
gaagccaagatgaggtaaaggg

SEQ ID NO: 1277005 - DNA, 22 bp, Artificial Sequence
  chemically synthesized
tgaagccaagatgaggtaaagg

SEQ ID NO: 1277006 - DNA, 22 bp, Artificial Sequence
  chemically synthesized
aagttatcccctttacctcatc

SEQ ID NO: 1277007 - DNA, 22 bp, Artificial Sequence
  chemically synthesized
ctttgaagccaagatgaggtaa

SEQ ID NO: 1277008 - DNA, 22 bp, Artificial Sequence
  chemically synthesized
agttatcccctttacctcatct

SEQ ID NO: 1277009 - DNA, 22 bp, Artificial Sequence
  chemically synthesized
tcccctttacctcatcttggct

SEQ ID NO: 1277010 - DNA, 22 bp, Artificial Sequence
  chemically synthesized
tacctcatcttggcttcaaagt

SEQ ID NO: 1277011 - DNA, 22 bp, Artificial Sequence
  chemically synthesized
aagcatatagttactttgaagc

SEQ ID NO: 1277012 - DNA, 22 bp, Artificial Sequence
  chemically synthesized
acctcatcttggcttcaaagta

SEQ ID NO: 1277013 - DNA, 22 bp, Artificial Sequence
  chemically synthesized
cctcatcttggcttcaaagtaa

SEQ ID NO: 1277014 - DNA, 22 bp, Artificial Sequence
  chemically synthesized
atcttggcttcaaagtaactat

SEQ ID NO: 1277015 - DNA, 22 bp, Artificial Sequence
  chemically synthesized
taatgattaaagcatatagtta

SEQ ID NO: 1277016 - DNA, 22 bp, Artificial Sequence
  chemically synthesized
ggcttcaaagtaactatatgct

SEQ ID NO: 1277017 - DNA, 22 bp, Artificial Sequence
  chemically synthesized
gcttcaaagtaactatatgctt

SEQ ID NO: 1277018 - DNA, 22 bp, Artificial Sequence
  chemically synthesized
caaagtaactatatgctttaat

SEQ ID NO: 1277019 - DNA, 22 bp, Artificial Sequence
  chemically synthesized
aaagtaactatatgctttaatc

SEQ ID NO: 1277020 - DNA, 22 bp, Artificial Sequence
  chemically synthesized
gacaaactataatgattaaagc

SEQ ID NO: 1277021 - DNA, 22 bp, Artificial Sequence
  chemically synthesized
gggacctagacaaactataatg

SEQ ID NO: 1277022 - DNA, 22 bp, Artificial Sequence
  chemically synthesized
tatgctttaatcattatagttt

SEQ ID NO: 1277023 - DNA, 22 bp, Artificial Sequence
  chemically synthesized
tggggacctagacaaactataa

SEQ ID NO: 1277024 - DNA, 22 bp, Artificial Sequence
  chemically synthesized
tctggggacctagacaaactat

SEQ ID NO: 1277025 - DNA, 22 bp, Artificial Sequence
  chemically synthesized
taatcattatagtttgtctagg

SEQ ID NO: 1277026 - DNA, 22 bp, Artificial Sequence
  chemically synthesized
aatcattatagtttgtctaggt

SEQ ID NO: 1277027 - DNA, 22 bp, Artificial Sequence
  chemically synthesized
atcattatagtttgtctaggtc

SEQ ID NO: 1277028 - DNA, 22 bp, Artificial Sequence
  chemically synthesized
aaaacactctctggggacctag

SEQ ID NO: 1277029 - DNA, 22 bp, Artificial Sequence
  chemically synthesized
tagtttgtctaggtccccagag

SEQ ID NO: 1277030 - DNA, 22 bp, Artificial Sequence
  chemically synthesized
gtctaggtccccagagagtgtt

SEQ ID NO: 1277031 - DNA, 22 bp, Artificial Sequence
  chemically synthesized
tctaggtccccagagagtgttt

SEQ ID NO: 1277032 - DNA, 22 bp, Artificial Sequence
  chemically synthesized
ggtccccagagagtgtttttag

SEQ ID NO: 1277033 - DNA, 22 bp, Artificial Sequence
  chemically synthesized
acaaataaaaatctaaaaacac

SEQ ID NO: 1277034 - DNA, 22 bp, Artificial Sequence
  chemically synthesized
ataaactaacaaataaaaatct

SEQ ID NO: 1277035 - DNA, 22 bp, Artificial Sequence
  chemically synthesized
aagttcataaactaacaaataa

SEQ ID NO: 1277036 - DNA, 22 bp, Artificial Sequence
  chemically synthesized
ttagatttttatttgttagttt

SEQ ID NO: 1277037 - DNA, 22 bp, Artificial Sequence
  chemically synthesized
actgaagttcataaactaacaa

SEQ ID NO: 1277038 - DNA, 22 bp, Artificial Sequence
  chemically synthesized
tagatttttatttgttagttta

SEQ ID NO: 1277039 - DNA, 22 bp, Artificial Sequence
  chemically synthesized
gactgaagttcataaactaaca

SEQ ID NO: 1277040 - DNA, 22 bp, Artificial Sequence
  chemically synthesized
agatttttatttgttagtttat

SEQ ID NO: 1277041 - DNA, 22 bp, Artificial Sequence
  chemically synthesized
gatttttatttgttagtttatg

SEQ ID NO: 1277042 - DNA, 22 bp, Artificial Sequence
  chemically synthesized
cttgactgaagttcataaacta

SEQ ID NO: 1277043 - DNA, 22 bp, Artificial Sequence
  chemically synthesized
ttatttgttagtttatgaactt

SEQ ID NO: 1277044 - DNA, 22 bp, Artificial Sequence
  chemically synthesized
attacttgactgaagttcataa

SEQ ID NO: 1277045 - DNA, 22 bp, Artificial Sequence
  chemically synthesized
tatttgttagtttatgaacttc

SEQ ID NO: 1277046 - DNA, 22 bp, Artificial Sequence
  chemically synthesized
atttgttagtttatgaacttca

SEQ ID NO: 1277047 - DNA, 22 bp, Artificial Sequence
  chemically synthesized
tgattacttgactgaagttcat

SEQ ID NO: 1277048 - DNA, 22 bp, Artificial Sequence
  chemically synthesized
tttgttagtttatgaacttcag

SEQ ID NO: 1277049 - DNA, 22 bp, Artificial Sequence
  chemically synthesized
ctgattacttgactgaagttca

SEQ ID NO: 1277050 - DNA, 22 bp, Artificial Sequence
  chemically synthesized
tctgattacttgactgaagttc

SEQ ID NO: 1277051 - DNA, 22 bp, Artificial Sequence
  chemically synthesized
gttagtttatgaacttcagtca

SEQ ID NO: 1277052 - DNA, 22 bp, Artificial Sequence
  chemically synthesized
ttagtttatgaacttcagtcaa

SEQ ID NO: 1277053 - DNA, 22 bp, Artificial Sequence
  chemically synthesized
gctttctgattacttgactgaa

SEQ ID NO: 1277054 - DNA, 22 bp, Artificial Sequence
  chemically synthesized
gtttatgaacttcagtcaagta

SEQ ID NO: 1277055 - DNA, 22 bp, Artificial Sequence
  chemically synthesized
tattggctttctgattacttga

SEQ ID NO: 1277056 - DNA, 22 bp, Artificial Sequence
  chemically synthesized
atgaacttcagtcaagtaatca

SEQ ID NO: 1277057 - DNA, 22 bp, Artificial Sequence
  chemically synthesized
tgaacttcagtcaagtaatcag

SEQ ID NO: 1277058 - DNA, 22 bp, Artificial Sequence
  chemically synthesized
ttatattggctttctgattact

SEQ ID NO: 1277059 - DNA, 22 bp, Artificial Sequence
  chemically synthesized
attatattggctttctgattac

SEQ ID NO: 1277060 - DNA, 22 bp, Artificial Sequence
  chemically synthesized
tattatattggctttctgatta

SEQ ID NO: 1277061 - DNA, 22 bp, Artificial Sequence
  chemically synthesized
ttttattatattggctttctga

SEQ ID NO: 1277062 - DNA, 22 bp, Artificial Sequence
  chemically synthesized
cagtcaagtaatcagaaagcca

SEQ ID NO: 1277063 - DNA, 22 bp, Artificial Sequence
  chemically synthesized
agtcaagtaatcagaaagccaa

SEQ ID NO: 1277064 - DNA, 22 bp, Artificial Sequence
  chemically synthesized
aagactattttattatattggc

SEQ ID NO: 1277065 - DNA, 22 bp, Artificial Sequence
  chemically synthesized
cagaaagttaaagactatttta

SEQ ID NO: 1277066 - DNA, 22 bp, Artificial Sequence
  chemically synthesized
ccagaaagttaaagactatttt

SEQ ID NO: 1277067 - DNA, 22 bp, Artificial Sequence
  chemically synthesized
tccagaaagttaaagactattt

SEQ ID NO: 1277068 - DNA, 22 bp, Artificial Sequence
  chemically synthesized
catgttttccagaaagttaaag

SEQ ID NO: 1277069 - DNA, 22 bp, Artificial Sequence
  chemically synthesized
gcatgttttccagaaagttaaa

SEQ ID NO: 1277070 - DNA, 22 bp, Artificial Sequence
  chemically synthesized
tgcttgcatgttttccagaaag

SEQ ID NO: 1277071 - DNA, 22 bp, Artificial Sequence
  chemically synthesized
atgcttgcatgttttccagaaa

SEQ ID NO: 1277072 - DNA, 22 bp, Artificial Sequence
  chemically synthesized
tttatgcttgcatgttttccag

SEQ ID NO: 1277073 - DNA, 22 bp, Artificial Sequence
  chemically synthesized
taactttctggaaaacatgcaa

SEQ ID NO: 1277074 - DNA, 22 bp, Artificial Sequence
  chemically synthesized
aactttctggaaaacatgcaag

SEQ ID NO: 1277075 - DNA, 22 bp, Artificial Sequence
  chemically synthesized
actttctggaaaacatgcaagc

SEQ ID NO: 1277076 - DNA, 22 bp, Artificial Sequence
  chemically synthesized
tctggaaaacatgcaagcataa

SEQ ID NO: 1277077 - DNA, 22 bp, Artificial Sequence
  chemically synthesized
ctggaaaacatgcaagcataaa

SEQ ID NO: 1277078 - DNA, 22 bp, Artificial Sequence
  chemically synthesized
tggaaaacatgcaagcataaat

SEQ ID NO: 1277079 - DNA, 22 bp, Artificial Sequence
  chemically synthesized
gaaaacatgcaagcataaataa

SEQ ID NO: 1277080 - DNA, 22 bp, Artificial Sequence
  chemically synthesized
cagaagtataaatgatggttat

SEQ ID NO: 1277081 - DNA, 22 bp, Artificial Sequence
  chemically synthesized
ctacagaagtataaatgatggt

SEQ ID NO: 1277082 - DNA, 22 bp, Artificial Sequence
  chemically synthesized
ttgctacagaagtataaatgat

SEQ ID NO: 1277083 - DNA, 22 bp, Artificial Sequence
  chemically synthesized
aatgtcactgttgctacagaag

SEQ ID NO: 1277084 - DNA, 22 bp, Artificial Sequence
  chemically synthesized
atacttctgtagcaacagtgac

SEQ ID NO: 1277085 - DNA, 22 bp, Artificial Sequence
  chemically synthesized
tacttctgtagcaacagtgaca

SEQ ID NO: 1277086 - DNA, 22 bp, Artificial Sequence
  chemically synthesized
agtatgattcaatgtcactgtt

SEQ ID NO: 1277087 - DNA, 22 bp, Artificial Sequence
  chemically synthesized
gagtatgattcaatgtcactgt

SEQ ID NO: 1277088 - DNA, 22 bp, Artificial Sequence
  chemically synthesized
tgagtatgattcaatgtcactg

SEQ ID NO: 1277089 - DNA, 22 bp, Artificial Sequence
  chemically synthesized
ctgtagcaacagtgacattgaa

SEQ ID NO: 1277090 - DNA, 22 bp, Artificial Sequence
  chemically synthesized
ctttgagtatgattcaatgtca

SEQ ID NO: 1277091 - DNA, 22 bp, Artificial Sequence
  chemically synthesized
tgtagcaacagtgacattgaat

SEQ ID NO: 1277092 - DNA, 22 bp, Artificial Sequence
  chemically synthesized
gctttgagtatgattcaatgtc

SEQ ID NO: 1277093 - DNA, 22 bp, Artificial Sequence
  chemically synthesized
tgctttgagtatgattcaatgt

SEQ ID NO: 1277094 - DNA, 22 bp, Artificial Sequence
  chemically synthesized
tagcaacagtgacattgaatca

SEQ ID NO: 1277095 - DNA, 22 bp, Artificial Sequence
  chemically synthesized
gatactttgctttgagtatgat

SEQ ID NO: 1277096 - DNA, 22 bp, Artificial Sequence
  chemically synthesized
agatactttgctttgagtatga

SEQ ID NO: 1277097 - DNA, 22 bp, Artificial Sequence
  chemically synthesized
aatcttagatactttgctttga

SEQ ID NO: 1277098 - DNA, 22 bp, Artificial Sequence
  chemically synthesized
tgaatcttagatactttgcttt

SEQ ID NO: 1277099 - DNA, 22 bp, Artificial Sequence
  chemically synthesized
aatcatactcaaagcaaagtat

SEQ ID NO: 1277100 - DNA, 22 bp, Artificial Sequence
  chemically synthesized
ctctgaatcttagatactttgc

SEQ ID NO: 1277101 - DNA, 22 bp, Artificial Sequence
  chemically synthesized
actctgaatcttagatactttg

SEQ ID NO: 1277102 - DNA, 22 bp, Artificial Sequence
  chemically synthesized
cttactctgaatcttagatact

SEQ ID NO: 1277103 - DNA, 22 bp, Artificial Sequence
  chemically synthesized
aaagcaaagtatctaagattca

SEQ ID NO: 1277104 - DNA, 22 bp, Artificial Sequence
  chemically synthesized
gacaagtgagaatcctacttac

SEQ ID NO: 1277105 - DNA, 22 bp, Artificial Sequence
  chemically synthesized
agattcagagtaagtaggattc

SEQ ID NO: 1277106 - DNA, 22 bp, Artificial Sequence
  chemically synthesized
cattggacaagtgagaatccta

SEQ ID NO: 1277107 - DNA, 22 bp, Artificial Sequence
  chemically synthesized
gcattggacaagtgagaatcct

SEQ ID NO: 1277108 - DNA, 22 bp, Artificial Sequence
  chemically synthesized
tgcattggacaagtgagaatcc

SEQ ID NO: 1277109 - DNA, 22 bp, Artificial Sequence
  chemically synthesized
agagtaagtaggattctcactt

SEQ ID NO: 1277110 - DNA, 22 bp, Artificial Sequence
  chemically synthesized
aatctttgcattggacaagtga

SEQ ID NO: 1277111 - DNA, 22 bp, Artificial Sequence
  chemically synthesized
tcacttgtccaatgcaaagatt

SEQ ID NO: 1277112 - DNA, 22 bp, Artificial Sequence
  chemically synthesized
acttgtccaatgcaaagattca

SEQ ID NO: 1277113 - DNA, 22 bp, Artificial Sequence
  chemically synthesized
cccaccagatgtagctgaatct

SEQ ID NO: 1277114 - DNA, 22 bp, Artificial Sequence
  chemically synthesized
gtccaatgcaaagattcagcta

SEQ ID NO: 1277115 - DNA, 22 bp, Artificial Sequence
  chemically synthesized
acccaccagatgtagctgaatc

SEQ ID NO: 1277116 - DNA, 22 bp, Artificial Sequence
  chemically synthesized
tccaatgcaaagattcagctac

SEQ ID NO: 1277117 - DNA, 22 bp, Artificial Sequence
  chemically synthesized
tacccaccagatgtagctgaat

SEQ ID NO: 1277118 - DNA, 22 bp, Artificial Sequence
  chemically synthesized
ctttacccaccagatgtagctg

SEQ ID NO: 1277119 - DNA, 22 bp, Artificial Sequence
  chemically synthesized
actcctttacccaccagatgta

SEQ ID NO: 1277120 - DNA, 22 bp, Artificial Sequence
  chemically synthesized
aactcctttacccaccagatgt

SEQ ID NO: 1277121 - DNA, 22 bp, Artificial Sequence
  chemically synthesized
atatttaactcctttacccacc

SEQ ID NO: 1277122 - DNA, 22 bp, Artificial Sequence
  chemically synthesized
agctacatctggtgggtaaagg

SEQ ID NO: 1277123 - DNA, 22 bp, Artificial Sequence
  chemically synthesized
catctggtgggtaaaggagtta

SEQ ID NO: 1277124 - DNA, 22 bp, Artificial Sequence
  chemically synthesized
gtgggtaaaggagttaaatatt

SEQ ID NO: 1277125 - DNA, 22 bp, Artificial Sequence
  chemically synthesized
aaagatgaagttaatatttaac

SEQ ID NO: 1277126 - DNA, 22 bp, Artificial Sequence
  chemically synthesized
aatagatactaaaagatgaagt

SEQ ID NO: 1277127 - DNA, 22 bp, Artificial Sequence
  chemically synthesized
aatattaacttcatcttttagt

SEQ ID NO: 1277128 - DNA, 22 bp, Artificial Sequence
  chemically synthesized
gatctaaatagatactaaaaga

SEQ ID NO: 1277129 - DNA, 22 bp, Artificial Sequence
  chemically synthesized
acttcatcttttagtatctatt

SEQ ID NO: 1277130 - DNA, 22 bp, Artificial Sequence
  chemically synthesized
tacaaattagatctaaatagat

SEQ ID NO: 1277131 - DNA, 22 bp, Artificial Sequence
  chemically synthesized
catcttttagtatctatttaga

SEQ ID NO: 1277132 - DNA, 22 bp, Artificial Sequence
  chemically synthesized
atcttttagtatctatttagat

SEQ ID NO: 1277133 - DNA, 22 bp, Artificial Sequence
  chemically synthesized
ttagtatctatttagatctaat

SEQ ID NO: 1277134 - DNA, 22 bp, Artificial Sequence
  chemically synthesized
tagtatctatttagatctaatt

SEQ ID NO: 1277135 - DNA, 22 bp, Artificial Sequence
  chemically synthesized
accccctatacaaattagatct

SEQ ID NO: 1277136 - DNA, 22 bp, Artificial Sequence
  chemically synthesized
agtatctatttagatctaattt

SEQ ID NO: 1277137 - DNA, 22 bp, Artificial Sequence
  chemically synthesized
aaccccctatacaaattagatc

SEQ ID NO: 1277138 - DNA, 22 bp, Artificial Sequence
  chemically synthesized
gtatctatttagatctaatttg

SEQ ID NO: 1277139 - DNA, 22 bp, Artificial Sequence
  chemically synthesized
tttagatctaatttgtataggg

SEQ ID NO: 1277140 - DNA, 22 bp, Artificial Sequence
  chemically synthesized
agatctaatttgtatagggggt

SEQ ID NO: 1277141 - DNA, 22 bp, Artificial Sequence
  chemically synthesized
gatctaatttgtatagggggtt

SEQ ID NO: 1277142 - DNA, 22 bp, Artificial Sequence
  chemically synthesized
tcaggagatccttaacccccta

SEQ ID NO: 1277143 - DNA, 22 bp, Artificial Sequence
  chemically synthesized
atcaggagatccttaaccccct

SEQ ID NO: 1277144 - DNA, 22 bp, Artificial Sequence
  chemically synthesized
tatcaggagatccttaaccccc

SEQ ID NO: 1277145 - DNA, 22 bp, Artificial Sequence
  chemically synthesized
ttatcaggagatccttaacccc

SEQ ID NO: 1277146 - DNA, 22 bp, Artificial Sequence
  chemically synthesized
atttgtatagggggttaaggat

SEQ ID NO: 1277147 - DNA, 22 bp, Artificial Sequence
  chemically synthesized
tttttatcaggagatccttaac

SEQ ID NO: 1277148 - DNA, 22 bp, Artificial Sequence
  chemically synthesized
atttttatcaggagatccttaa

SEQ ID NO: 1277149 - DNA, 22 bp, Artificial Sequence
  chemically synthesized
tatttttatcaggagatcctta

SEQ ID NO: 1277150 - DNA, 22 bp, Artificial Sequence
  chemically synthesized
gtatagggggttaaggatctcc

SEQ ID NO: 1277151 - DNA, 22 bp, Artificial Sequence
  chemically synthesized
tatagggggttaaggatctcct

SEQ ID NO: 1277152 - DNA, 22 bp, Artificial Sequence
  chemically synthesized
attttatttttatcaggagatc

SEQ ID NO: 1277153 - DNA, 22 bp, Artificial Sequence
  chemically synthesized
ttaattttatttttatcaggag

SEQ ID NO: 1277154 - DNA, 22 bp, Artificial Sequence
  chemically synthesized
agttattaattttatttttatc

SEQ ID NO: 1277155 - DNA, 22 bp, Artificial Sequence
  chemically synthesized
aagttattaattttatttttat

SEQ ID NO: 1277156 - DNA, 22 bp, Artificial Sequence
  chemically synthesized
aggatctcctgataaaaataaa

SEQ ID NO: 1277157 - DNA, 22 bp, Artificial Sequence
  chemically synthesized
taagttattaattttattttta

SEQ ID NO: 1277158 - DNA, 22 bp, Artificial Sequence
  chemically synthesized
ctgataaaaataaaattaataa

SEQ ID NO: 1277159 - DNA, 22 bp, Artificial Sequence
  chemically synthesized
tggagagttttaagttattaat

SEQ ID NO: 1277160 - DNA, 22 bp, Artificial Sequence
  chemically synthesized
ataaaaataaaattaataactt

SEQ ID NO: 1277161 - DNA, 22 bp, Artificial Sequence
  chemically synthesized
attatggagagttttaagttat

SEQ ID NO: 1277162 - DNA, 22 bp, Artificial Sequence
  chemically synthesized
tctaattatggagagttttaag

SEQ ID NO: 1277163 - DNA, 22 bp, Artificial Sequence
  chemically synthesized
ataacttaaaactctccataat

SEQ ID NO: 1277164 - DNA, 22 bp, Artificial Sequence
  chemically synthesized
atatgttgtctaattatggaga

SEQ ID NO: 1277165 - DNA, 22 bp, Artificial Sequence
  chemically synthesized
aaaactctccataattagacaa

SEQ ID NO: 1277166 - DNA, 22 bp, Artificial Sequence
  chemically synthesized
aaactctccataattagacaac

SEQ ID NO: 1277167 - DNA, 22 bp, Artificial Sequence
  chemically synthesized
tccataattagacaacatatta

SEQ ID NO: 1277168 - DNA, 22 bp, Artificial Sequence
  chemically synthesized
cataattagacaacatattagc

SEQ ID NO: 1277169 - DNA, 22 bp, Artificial Sequence
  chemically synthesized
atgggcatgaaagctaatatgt

SEQ ID NO: 1277170 - DNA, 22 bp, Artificial Sequence
  chemically synthesized
gatgggcatgaaagctaatatg

SEQ ID NO: 1277171 - DNA, 22 bp, Artificial Sequence
  chemically synthesized
atatttgatgggcatgaaagct

SEQ ID NO: 1277172 - DNA, 22 bp, Artificial Sequence
  chemically synthesized
gacaacatattagctttcatgc

SEQ ID NO: 1277173 - DNA, 22 bp, Artificial Sequence
  chemically synthesized
ctcatatttgatgggcatgaaa

SEQ ID NO: 1277174 - DNA, 22 bp, Artificial Sequence
  chemically synthesized
cagctcctcatatttgatgggc

SEQ ID NO: 1277175 - DNA, 22 bp, Artificial Sequence
  chemically synthesized
gcagctcctcatatttgatggg

SEQ ID NO: 1277176 - DNA, 22 bp, Artificial Sequence
  chemically synthesized
tgcagctcctcatatttgatgg

SEQ ID NO: 1277177 - DNA, 22 bp, Artificial Sequence
  chemically synthesized
ttgcagctcctcatatttgatg

SEQ ID NO: 1277178 - DNA, 22 bp, Artificial Sequence
  chemically synthesized
gctttcatgcccatcaaatatg

SEQ ID NO: 1277179 - DNA, 22 bp, Artificial Sequence
  chemically synthesized
tttgcagctcctcatatttgat

SEQ ID NO: 1277180 - DNA, 22 bp, Artificial Sequence
  chemically synthesized
tcatgcccatcaaatatgagga

SEQ ID NO: 1277181 - DNA, 22 bp, Artificial Sequence
  chemically synthesized
catgcccatcaaatatgaggag

SEQ ID NO: 1277182 - DNA, 22 bp, Artificial Sequence
  chemically synthesized
tgctttttgcagctcctcatat

SEQ ID NO: 1277183 - DNA, 22 bp, Artificial Sequence
  chemically synthesized
atgcccatcaaatatgaggagc

SEQ ID NO: 1277184 - DNA, 22 bp, Artificial Sequence
  chemically synthesized
acactgtgctttttgcagctcc

SEQ ID NO: 1277185 - DNA, 22 bp, Artificial Sequence
  chemically synthesized
gacactgtgctttttgcagctc

SEQ ID NO: 1277186 - DNA, 22 bp, Artificial Sequence
  chemically synthesized
ccccttgacactgtgctttttg

SEQ ID NO: 1277187 - DNA, 22 bp, Artificial Sequence
  chemically synthesized
accccttgacactgtgcttttt

SEQ ID NO: 1277188 - DNA, 22 bp, Artificial Sequence
  chemically synthesized
gacttaccccttgacactgtgc

SEQ ID NO: 1277189 - DNA, 22 bp, Artificial Sequence
  chemically synthesized
caaaaagcacagtgtcaagggg

SEQ ID NO: 1277190 - DNA, 22 bp, Artificial Sequence
  chemically synthesized
cgtgagaacactagacttaccc

SEQ ID NO: 1277191 - DNA, 22 bp, Artificial Sequence
  chemically synthesized
acgtgagaacactagacttacc

SEQ ID NO: 1277192 - DNA, 22 bp, Artificial Sequence
  chemically synthesized
tacgtgagaacactagacttac

SEQ ID NO: 1277193 - DNA, 22 bp, Artificial Sequence
  chemically synthesized
ttacgtgagaacactagactta

SEQ ID NO: 1277194 - DNA, 22 bp, Artificial Sequence
  chemically synthesized
caagatgatttttacgtgagaa

SEQ ID NO: 1277195 - DNA, 22 bp, Artificial Sequence
  chemically synthesized
tatctgcaagatgatttttacg

SEQ ID NO: 1277196 - DNA, 22 bp, Artificial Sequence
  chemically synthesized
gtgttctcacgtaaaaatcatc

SEQ ID NO: 1277197 - DNA, 22 bp, Artificial Sequence
  chemically synthesized
tctgtatctgcaagatgatttt

SEQ ID NO: 1277198 - DNA, 22 bp, Artificial Sequence
  chemically synthesized
tcacgtaaaaatcatcttgcag

SEQ ID NO: 1277199 - DNA, 22 bp, Artificial Sequence
  chemically synthesized
tcctgtctgtatctgcaagatg

SEQ ID NO: 1277200 - DNA, 22 bp, Artificial Sequence
  chemically synthesized
atcctgtctgtatctgcaagat

SEQ ID NO: 1277201 - DNA, 22 bp, Artificial Sequence
  chemically synthesized
acgtaaaaatcatcttgcagat

SEQ ID NO: 1277202 - DNA, 22 bp, Artificial Sequence
  chemically synthesized
gtttatcctgtctgtatctgca

SEQ ID NO: 1277203 - DNA, 22 bp, Artificial Sequence
  chemically synthesized
agtttatcctgtctgtatctgc

SEQ ID NO: 1277204 - DNA, 22 bp, Artificial Sequence
  chemically synthesized
tttagtttatcctgtctgtatc

SEQ ID NO: 1277205 - DNA, 22 bp, Artificial Sequence
  chemically synthesized
ttatttagtttatcctgtctgt

SEQ ID NO: 1277206 - DNA, 22 bp, Artificial Sequence
  chemically synthesized
attattatttagtttatcctgt

SEQ ID NO: 1277207 - DNA, 22 bp, Artificial Sequence
  chemically synthesized
gcagatacagacaggataaact

SEQ ID NO: 1277208 - DNA, 22 bp, Artificial Sequence
  chemically synthesized
cagatacagacaggataaacta

SEQ ID NO: 1277209 - DNA, 22 bp, Artificial Sequence
  chemically synthesized
ggcctcattattatttagttta

SEQ ID NO: 1277210 - DNA, 22 bp, Artificial Sequence
  chemically synthesized
aggcctcattattatttagttt

SEQ ID NO: 1277211 - DNA, 22 bp, Artificial Sequence
  chemically synthesized
caaatcttaggcctcattatta

SEQ ID NO: 1277212 - DNA, 22 bp, Artificial Sequence
  chemically synthesized
cactccaaatcttaggcctcat

SEQ ID NO: 1277213 - DNA, 22 bp, Artificial Sequence
  chemically synthesized
ctccactccaaatcttaggcct

SEQ ID NO: 1277214 - DNA, 22 bp, Artificial Sequence
  chemically synthesized
aataataatgaggcctaagatt

SEQ ID NO: 1277215 - DNA, 22 bp, Artificial Sequence
  chemically synthesized
ctcctccactccaaatcttagg

SEQ ID NO: 1277216 - DNA, 22 bp, Artificial Sequence
  chemically synthesized
ggactcctcctccactccaaat

SEQ ID NO: 1277217 - DNA, 22 bp, Artificial Sequence
  chemically synthesized
gggactcctcctccactccaaa

SEQ ID NO: 1277218 - DNA, 22 bp, Artificial Sequence
  chemically synthesized
agatttggagtggaggaggagt

SEQ ID NO: 1277219 - DNA, 22 bp, Artificial Sequence
  chemically synthesized
ggagtggaggaggagtcccaag

SEQ ID NO: 1277220 - DNA, 22 bp, Artificial Sequence
  chemically synthesized
gagtggaggaggagtcccaagt

SEQ ID NO: 1277221 - DNA, 22 bp, Artificial Sequence
  chemically synthesized
taagtgcaggtaacagccatca

SEQ ID NO: 1277222 - DNA, 22 bp, Artificial Sequence
  chemically synthesized
gttgtaagtgcaggtaacagcc

SEQ ID NO: 1277223 - DNA, 22 bp, Artificial Sequence
  chemically synthesized
ggttgtaagtgcaggtaacagc

SEQ ID NO: 1277224 - DNA, 22 bp, Artificial Sequence
  chemically synthesized
tggttgtaagtgcaggtaacag

SEQ ID NO: 1277225 - DNA, 22 bp, Artificial Sequence
  chemically synthesized
ttttggttgtaagtgcaggtaa

SEQ ID NO: 1277226 - DNA, 22 bp, Artificial Sequence
  chemically synthesized
gatggctgttacctgcacttac

SEQ ID NO: 1277227 - DNA, 22 bp, Artificial Sequence
  chemically synthesized
atggctgttacctgcacttaca

SEQ ID NO: 1277228 - DNA, 22 bp, Artificial Sequence
  chemically synthesized
ttacctgcacttacaaccaaaa

SEQ ID NO: 1277229 - DNA, 22 bp, Artificial Sequence
  chemically synthesized
cctgcacttacaaccaaaacag

SEQ ID NO: 1277230 - DNA, 22 bp, Artificial Sequence
  chemically synthesized
acatgaaaatggctgttttggt

SEQ ID NO: 1277231 - DNA, 22 bp, Artificial Sequence
  chemically synthesized
gacatgaaaatggctgttttgg

SEQ ID NO: 1277232 - DNA, 22 bp, Artificial Sequence
  chemically synthesized
cacttacaaccaaaacagccat

SEQ ID NO: 1277233 - DNA, 22 bp, Artificial Sequence
  chemically synthesized
acaaccaaaacagccattttca

SEQ ID NO: 1277234 - DNA, 22 bp, Artificial Sequence
  chemically synthesized
caaccaaaacagccattttcat

SEQ ID NO: 1277235 - DNA, 22 bp, Artificial Sequence
  chemically synthesized
tatcccagggcacacatttgac

SEQ ID NO: 1277236 - DNA, 22 bp, Artificial Sequence
  chemically synthesized
gtatcccagggcacacatttga

SEQ ID NO: 1277237 - DNA, 22 bp, Artificial Sequence
  chemically synthesized
tcatgtcaaatgtgtgccctgg

SEQ ID NO: 1277238 - DNA, 22 bp, Artificial Sequence
  chemically synthesized
catgtcaaatgtgtgccctggg

SEQ ID NO: 1277239 - DNA, 22 bp, Artificial Sequence
  chemically synthesized
atgtcaaatgtgtgccctggga

SEQ ID NO: 1277240 - DNA, 22 bp, Artificial Sequence
  chemically synthesized
aaatgtatacatagatcttgta

SEQ ID NO: 1277241 - DNA, 22 bp, Artificial Sequence
  chemically synthesized
aaaatgtatacatagatcttgt

SEQ ID NO: 1277242 - DNA, 22 bp, Artificial Sequence
  chemically synthesized
taaaatgtatacatagatcttg

SEQ ID NO: 1277243 - DNA, 22 bp, Artificial Sequence
  chemically synthesized
tttaaaatgtatacatagatct

SEQ ID NO: 1277244 - DNA, 22 bp, Artificial Sequence
  chemically synthesized
ggatacaagatctatgtataca

SEQ ID NO: 1277245 - DNA, 22 bp, Artificial Sequence
  chemically synthesized
taataaaataattctttaaaat

SEQ ID NO: 1277246 - DNA, 22 bp, Artificial Sequence
  chemically synthesized
gtaataaaataattctttaaaa

SEQ ID NO: 1277247 - DNA, 22 bp, Artificial Sequence
  chemically synthesized
tgtatacattttaaagaattat

SEQ ID NO: 1277248 - DNA, 22 bp, Artificial Sequence
  chemically synthesized
taaagaattattttattacaag

SEQ ID NO: 1277249 - DNA, 22 bp, Artificial Sequence
  chemically synthesized
aaagaattattttattacaagt

SEQ ID NO: 1277250 - DNA, 22 bp, Artificial Sequence
  chemically synthesized
aagaattattttattacaagtc

SEQ ID NO: 1277251 - DNA, 22 bp, Artificial Sequence
  chemically synthesized
gaccccaaagagtgacttgtaa

SEQ ID NO: 1277252 - DNA, 22 bp, Artificial Sequence
  chemically synthesized
ctggaccccaaagagtgacttg

SEQ ID NO: 1277253 - DNA, 22 bp, Artificial Sequence
  chemically synthesized
ttttattacaagtcactctttg

SEQ ID NO: 1277254 - DNA, 22 bp, Artificial Sequence
  chemically synthesized
tattacaagtcactctttgggg

SEQ ID NO: 1277255 - DNA, 22 bp, Artificial Sequence
  chemically synthesized
attacaagtcactctttggggt

SEQ ID NO: 1277256 - DNA, 22 bp, Artificial Sequence
  chemically synthesized
ttacaagtcactctttggggtc

SEQ ID NO: 1277257 - DNA, 22 bp, Artificial Sequence
  chemically synthesized
caagtcactctttggggtccag

SEQ ID NO: 1277258 - DNA, 22 bp, Artificial Sequence
  chemically synthesized
tttggggtccagcaactctact

SEQ ID NO: 1277259 - DNA, 22 bp, Artificial Sequence
  chemically synthesized
taaaggaggcatagtagagttg

SEQ ID NO: 1277260 - DNA, 22 bp, Artificial Sequence
  chemically synthesized
tggggtccagcaactctactat

SEQ ID NO: 1277261 - DNA, 22 bp, Artificial Sequence
  chemically synthesized
ggggtccagcaactctactatg

SEQ ID NO: 1277262 - DNA, 22 bp, Artificial Sequence
  chemically synthesized
ttataaaggaggcatagtagag

SEQ ID NO: 1277263 - DNA, 22 bp, Artificial Sequence
  chemically synthesized
gggtccagcaactctactatgc

SEQ ID NO: 1277264 - DNA, 22 bp, Artificial Sequence
  chemically synthesized
tgttataaaggaggcatagtag

SEQ ID NO: 1277265 - DNA, 22 bp, Artificial Sequence
  chemically synthesized
tctgttataaaggaggcatagt

SEQ ID NO: 1277266 - DNA, 22 bp, Artificial Sequence
  chemically synthesized
ttctctgttataaaggaggcat

SEQ ID NO: 1277267 - DNA, 22 bp, Artificial Sequence
  chemically synthesized
atctgttctctgttataaagga

SEQ ID NO: 1277268 - DNA, 22 bp, Artificial Sequence
  chemically synthesized
aatctgttctctgttataaagg

SEQ ID NO: 1277269 - DNA, 22 bp, Artificial Sequence
  chemically synthesized
taatctgttctctgttataaag

SEQ ID NO: 1277270 - DNA, 22 bp, Artificial Sequence
  chemically synthesized
tactatgcctcctttataacag

SEQ ID NO: 1277271 - DNA, 22 bp, Artificial Sequence
  chemically synthesized
ctatgcctcctttataacagag

SEQ ID NO: 1277272 - DNA, 22 bp, Artificial Sequence
  chemically synthesized
tgcctcctttataacagagaac

SEQ ID NO: 1277273 - DNA, 22 bp, Artificial Sequence
  chemically synthesized
agtgttttaatctgttctctgt

SEQ ID NO: 1277274 - DNA, 22 bp, Artificial Sequence
  chemically synthesized
tcagtgttttaatctgttctct

SEQ ID NO: 1277275 - DNA, 22 bp, Artificial Sequence
  chemically synthesized
ctttataacagagaacagatta

SEQ ID NO: 1277276 - DNA, 22 bp, Artificial Sequence
  chemically synthesized
tataacagagaacagattaaaa

SEQ ID NO: 1277277 - DNA, 22 bp, Artificial Sequence
  chemically synthesized
ccattctcagtgttttaatctg

SEQ ID NO: 1277278 - DNA, 22 bp, Artificial Sequence
  chemically synthesized
ataacagagaacagattaaaac

SEQ ID NO: 1277279 - DNA, 22 bp, Artificial Sequence
  chemically synthesized
cccattctcagtgttttaatct

SEQ ID NO: 1277280 - DNA, 22 bp, Artificial Sequence
  chemically synthesized
taacagagaacagattaaaaca

SEQ ID NO: 1277281 - DNA, 22 bp, Artificial Sequence
  chemically synthesized
aaacactgagaatgggaagttt

SEQ ID NO: 1277282 - DNA, 22 bp, Artificial Sequence
  chemically synthesized
agaatgggaagtttccccttgc

SEQ ID NO: 1277283 - DNA, 22 bp, Artificial Sequence
  chemically synthesized
catccatgaagcagcaagggga

SEQ ID NO: 1277284 - DNA, 22 bp, Artificial Sequence
  chemically synthesized
acatccatgaagcagcaagggg

SEQ ID NO: 1277285 - DNA, 22 bp, Artificial Sequence
  chemically synthesized
aacttacatccatgaagcagca

SEQ ID NO: 1277286 - DNA, 22 bp, Artificial Sequence
  chemically synthesized
ctcaacttacatccatgaagca

SEQ ID NO: 1277287 - DNA, 22 bp, Artificial Sequence
  chemically synthesized
ccccttgctgcttcatggatgt

SEQ ID NO: 1277288 - DNA, 22 bp, Artificial Sequence
  chemically synthesized
cccttgctgcttcatggatgta

SEQ ID NO: 1277289 - DNA, 22 bp, Artificial Sequence
  chemically synthesized
gctgcttcatggatgtaagttg

SEQ ID NO: 1277290 - DNA, 22 bp, Artificial Sequence
  chemically synthesized
ctgcttcatggatgtaagttga

SEQ ID NO: 1277291 - DNA, 22 bp, Artificial Sequence
  chemically synthesized
cttcatggatgtaagttgagta

SEQ ID NO: 1277292 - DNA, 22 bp, Artificial Sequence
  chemically synthesized
catgaagtcgcagctactcaac

SEQ ID NO: 1277293 - DNA, 22 bp, Artificial Sequence
  chemically synthesized
catggatgtaagttgagtagct

SEQ ID NO: 1277294 - DNA, 22 bp, Artificial Sequence
  chemically synthesized
atggatgtaagttgagtagctg

SEQ ID NO: 1277295 - DNA, 22 bp, Artificial Sequence
  chemically synthesized
agtctgcatgaagtcgcagcta

SEQ ID NO: 1277296 - DNA, 22 bp, Artificial Sequence
  chemically synthesized
cagtctgcatgaagtcgcagct

SEQ ID NO: 1277297 - DNA, 22 bp, Artificial Sequence
  chemically synthesized
tcagtctgcatgaagtcgcagc

SEQ ID NO: 1277298 - DNA, 22 bp, Artificial Sequence
  chemically synthesized
tttcagtctgcatgaagtcgca

SEQ ID NO: 1277299 - DNA, 22 bp, Artificial Sequence
  chemically synthesized
gttctttcagtctgcatgaagt

SEQ ID NO: 1277300 - DNA, 22 bp, Artificial Sequence
  chemically synthesized
ggttctttcagtctgcatgaag

SEQ ID NO: 1277301 - DNA, 22 bp, Artificial Sequence
  chemically synthesized
agtagctgcgacttcatgcaga

SEQ ID NO: 1277302 - DNA, 22 bp, Artificial Sequence
  chemically synthesized
cttggttctttcagtctgcatg

SEQ ID NO: 1277303 - DNA, 22 bp, Artificial Sequence
  chemically synthesized
gcttggttctttcagtctgcat

SEQ ID NO: 1277304 - DNA, 22 bp, Artificial Sequence
  chemically synthesized
tgcttggttctttcagtctgca

SEQ ID NO: 1277305 - DNA, 22 bp, Artificial Sequence
  chemically synthesized
cgacttcatgcagactgaaaga

SEQ ID NO: 1277306 - DNA, 22 bp, Artificial Sequence
  chemically synthesized
gtgctttgcttggttctttcag

SEQ ID NO: 1277307 - DNA, 22 bp, Artificial Sequence
  chemically synthesized
ggtgctttgcttggttctttca

SEQ ID NO: 1277308 - DNA, 22 bp, Artificial Sequence
  chemically synthesized
catgcagactgaaagaaccaag

SEQ ID NO: 1277309 - DNA, 22 bp, Artificial Sequence
  chemically synthesized
tttggtgctttgcttggttctt

SEQ ID NO: 1277310 - DNA, 22 bp, Artificial Sequence
  chemically synthesized
atgcagactgaaagaaccaagc

SEQ ID NO: 1277311 - DNA, 22 bp, Artificial Sequence
  chemically synthesized
aatgccactgtttggtgctttg

SEQ ID NO: 1277312 - DNA, 22 bp, Artificial Sequence
  chemically synthesized
aaagaaccaagcaaagcaccaa

SEQ ID NO: 1277313 - DNA, 22 bp, Artificial Sequence
  chemically synthesized
caatgccactgtttggtgcttt

SEQ ID NO: 1277314 - DNA, 22 bp, Artificial Sequence
  chemically synthesized
ttcaatgccactgtttggtgct

SEQ ID NO: 1277315 - DNA, 22 bp, Artificial Sequence
  chemically synthesized
tcagtcaacctcttcaatgcca

SEQ ID NO: 1277316 - DNA, 22 bp, Artificial Sequence
  chemically synthesized
gaccactgtcagtcaacctctt

SEQ ID NO: 1277317 - DNA, 22 bp, Artificial Sequence
  chemically synthesized
tgccctagaccactgtcagtca

SEQ ID NO: 1277318 - DNA, 22 bp, Artificial Sequence
  chemically synthesized
aagaggttgactgacagtggtc

SEQ ID NO: 1277319 - DNA, 22 bp, Artificial Sequence
  chemically synthesized
aaactgtgccctagaccactgt

SEQ ID NO: 1277320 - DNA, 22 bp, Artificial Sequence
  chemically synthesized
cagctcaaactgtgccctagac

SEQ ID NO: 1277321 - DNA, 22 bp, Artificial Sequence
  chemically synthesized
actgacagtggtctagggcaca

SEQ ID NO: 1277322 - DNA, 22 bp, Artificial Sequence
  chemically synthesized
acagtggtctagggcacagttt

SEQ ID NO: 1277323 - DNA, 22 bp, Artificial Sequence
  chemically synthesized
cacgggtgctgcagctcaaact

SEQ ID NO: 1277324 - DNA, 22 bp, Artificial Sequence
  chemically synthesized
cctccacgggtgctgcagctca

SEQ ID NO: 1277325 - DNA, 22 bp, Artificial Sequence
  chemically synthesized
ccctccacgggtgctgcagctc

SEQ ID NO: 1277326 - DNA, 22 bp, Artificial Sequence
  chemically synthesized
gggcacagtttgagctgcagca

SEQ ID NO: 1277327 - DNA, 22 bp, Artificial Sequence
  chemically synthesized
gacagaggtttccctccacggg

SEQ ID NO: 1277328 - DNA, 22 bp, Artificial Sequence
  chemically synthesized
gagctgcagcacccgtggaggg

SEQ ID NO: 1277329 - DNA, 22 bp, Artificial Sequence
  chemically synthesized
agctgcagcacccgtggaggga

SEQ ID NO: 1277330 - DNA, 22 bp, Artificial Sequence
  chemically synthesized
cagcacccgtggagggaaacct

SEQ ID NO: 1277331 - DNA, 22 bp, Artificial Sequence
  chemically synthesized
atgataatctagacagaggttt

SEQ ID NO: 1277332 - DNA, 22 bp, Artificial Sequence
  chemically synthesized
cgctaatgataatctagacaga

SEQ ID NO: 1277333 - DNA, 22 bp, Artificial Sequence
  chemically synthesized
tcagctacgctaatgataatct

SEQ ID NO: 1277334 - DNA, 22 bp, Artificial Sequence
  chemically synthesized
tatcagctacgctaatgataat

SEQ ID NO: 1277335 - DNA, 22 bp, Artificial Sequence
  chemically synthesized
tgtctagattatcattagcgta

SEQ ID NO: 1277336 - DNA, 22 bp, Artificial Sequence
  chemically synthesized
acctctatcagctacgctaatg

SEQ ID NO: 1277337 - DNA, 22 bp, Artificial Sequence
  chemically synthesized
tctagattatcattagcgtagc

SEQ ID NO: 1277338 - DNA, 22 bp, Artificial Sequence
  chemically synthesized
tcacctctatcagctacgctaa

SEQ ID NO: 1277339 - DNA, 22 bp, Artificial Sequence
  chemically synthesized
ctcacctctatcagctacgcta

SEQ ID NO: 1277340 - DNA, 22 bp, Artificial Sequence
  chemically synthesized
tctcacctctatcagctacgct

SEQ ID NO: 1277341 - DNA, 22 bp, Artificial Sequence
  chemically synthesized
gattatcattagcgtagctgat

SEQ ID NO: 1277342 - DNA, 22 bp, Artificial Sequence
  chemically synthesized
tcattagcgtagctgatagagg

SEQ ID NO: 1277343 - DNA, 22 bp, Artificial Sequence
  chemically synthesized
ccagaacctttctcacctctat

SEQ ID NO: 1277344 - DNA, 22 bp, Artificial Sequence
  chemically synthesized
tcccagaacctttctcacctct

SEQ ID NO: 1277345 - DNA, 22 bp, Artificial Sequence
  chemically synthesized
gcgtagctgatagaggtgagaa

SEQ ID NO: 1277346 - DNA, 22 bp, Artificial Sequence
  chemically synthesized
ctcccagaacctttctcacctc

SEQ ID NO: 1277347 - DNA, 22 bp, Artificial Sequence
  chemically synthesized
gatgcttctcccagaacctttc

SEQ ID NO: 1277348 - DNA, 22 bp, Artificial Sequence
  chemically synthesized
atagaggtgagaaaggttctgg

SEQ ID NO: 1277349 - DNA, 22 bp, Artificial Sequence
  chemically synthesized
tgattggatgcttctcccagaa

SEQ ID NO: 1277350 - DNA, 22 bp, Artificial Sequence
  chemically synthesized
tgtgattggatgcttctcccag

SEQ ID NO: 1277351 - DNA, 22 bp, Artificial Sequence
  chemically synthesized
gctctgtgattggatgcttctc

SEQ ID NO: 1277352 - DNA, 22 bp, Artificial Sequence
  chemically synthesized
agctctgtgattggatgcttct

SEQ ID NO: 1277353 - DNA, 22 bp, Artificial Sequence
  chemically synthesized
acttagctctgtgattggatgc

SEQ ID NO: 1277354 - DNA, 22 bp, Artificial Sequence
  chemically synthesized
gacttagctctgtgattggatg

SEQ ID NO: 1277355 - DNA, 22 bp, Artificial Sequence
  chemically synthesized
tgggagaagcatccaatcacag

SEQ ID NO: 1277356 - DNA, 22 bp, Artificial Sequence
  chemically synthesized
ggagaagcatccaatcacagag

SEQ ID NO: 1277357 - DNA, 22 bp, Artificial Sequence
  chemically synthesized
atgcttgacttagctctgtgat

SEQ ID NO: 1277358 - DNA, 22 bp, Artificial Sequence
  chemically synthesized
gactgatgcttgacttagctct

SEQ ID NO: 1277359 - DNA, 22 bp, Artificial Sequence
  chemically synthesized
ggactgatgcttgacttagctc

SEQ ID NO: 1277360 - DNA, 22 bp, Artificial Sequence
  chemically synthesized
aaatttggactgatgcttgact

SEQ ID NO: 1277361 - DNA, 22 bp, Artificial Sequence
  chemically synthesized
tgaaatttggactgatgcttga

SEQ ID NO: 1277362 - DNA, 22 bp, Artificial Sequence
  chemically synthesized
agacattctgaaatttggactg

SEQ ID NO: 1277363 - DNA, 22 bp, Artificial Sequence
  chemically synthesized
agtcaagcatcagtccaaattt

SEQ ID NO: 1277364 - DNA, 22 bp, Artificial Sequence
  chemically synthesized
tcactcagacattctgaaattt

SEQ ID NO: 1277365 - DNA, 22 bp, Artificial Sequence
  chemically synthesized
atcactcagacattctgaaatt

SEQ ID NO: 1277366 - DNA, 22 bp, Artificial Sequence
  chemically synthesized
caggatgtttatcactcagaca

SEQ ID NO: 1277367 - DNA, 22 bp, Artificial Sequence
  chemically synthesized
tccctgcaggatgtttatcact

SEQ ID NO: 1277368 - DNA, 22 bp, Artificial Sequence
  chemically synthesized
cagaatgtctgagtgataaaca

SEQ ID NO: 1277369 - DNA, 22 bp, Artificial Sequence
  chemically synthesized
agaatgtctgagtgataaacat

SEQ ID NO: 1277370 - DNA, 22 bp, Artificial Sequence
  chemically synthesized
catcattgtccctgcaggatgt

SEQ ID NO: 1277371 - DNA, 22 bp, Artificial Sequence
  chemically synthesized
gcatcattgtccctgcaggatg

SEQ ID NO: 1277372 - DNA, 22 bp, Artificial Sequence
  chemically synthesized
agtgataaacatcctgcaggga

SEQ ID NO: 1277373 - DNA, 22 bp, Artificial Sequence
  chemically synthesized
caatttgcatcattgtccctgc

SEQ ID NO: 1277374 - DNA, 22 bp, Artificial Sequence
  chemically synthesized
ctccaatttgcatcattgtccc

SEQ ID NO: 1277375 - DNA, 22 bp, Artificial Sequence
  chemically synthesized
tactccaatttgcatcattgtc

SEQ ID NO: 1277376 - DNA, 22 bp, Artificial Sequence
  chemically synthesized
ctactccaatttgcatcattgt

SEQ ID NO: 1277377 - DNA, 22 bp, Artificial Sequence
  chemically synthesized
tctactccaatttgcatcattg

SEQ ID NO: 1277378 - DNA, 22 bp, Artificial Sequence
  chemically synthesized
cagggacaatgatgcaaattgg

SEQ ID NO: 1277379 - DNA, 22 bp, Artificial Sequence
  chemically synthesized
agtgttttctactccaatttgc

SEQ ID NO: 1277380 - DNA, 22 bp, Artificial Sequence
  chemically synthesized
cagtgttttctactccaatttg

SEQ ID NO: 1277381 - DNA, 22 bp, Artificial Sequence
  chemically synthesized
ttcagtgttttctactccaatt

SEQ ID NO: 1277382 - DNA, 22 bp, Artificial Sequence
  chemically synthesized
gccactcttcagtgttttctac

SEQ ID NO: 1277383 - DNA, 22 bp, Artificial Sequence
  chemically synthesized
ggccactcttcagtgttttcta

SEQ ID NO: 1277384 - DNA, 22 bp, Artificial Sequence
  chemically synthesized
gagtagaaaacactgaagagtg

SEQ ID NO: 1277385 - DNA, 22 bp, Artificial Sequence
  chemically synthesized
caagaccttggccactcttcag

SEQ ID NO: 1277386 - DNA, 22 bp, Artificial Sequence
  chemically synthesized
gcaagaccttggccactcttca

SEQ ID NO: 1277387 - DNA, 22 bp, Artificial Sequence
  chemically synthesized
catgtgcatttgcaagaccttg

SEQ ID NO: 1277388 - DNA, 22 bp, Artificial Sequence
  chemically synthesized
aagagtggccaaggtcttgcaa

SEQ ID NO: 1277389 - DNA, 22 bp, Artificial Sequence
  chemically synthesized
gcatctccatgtgcatttgcaa

SEQ ID NO: 1277390 - DNA, 22 bp, Artificial Sequence
  chemically synthesized
ttagcatctccatgtgcatttg

SEQ ID NO: 1277391 - DNA, 22 bp, Artificial Sequence
  chemically synthesized
gttagcatctccatgtgcattt

SEQ ID NO: 1277392 - DNA, 22 bp, Artificial Sequence
  chemically synthesized
gcttgttagcatctccatgtgc

SEQ ID NO: 1277393 - DNA, 22 bp, Artificial Sequence
  chemically synthesized
ctagcttgttagcatctccatg

SEQ ID NO: 1277394 - DNA, 22 bp, Artificial Sequence
  chemically synthesized
gctagcttgttagcatctccat

SEQ ID NO: 1277395 - DNA, 22 bp, Artificial Sequence
  chemically synthesized
tgctagcttgttagcatctcca

SEQ ID NO: 1277396 - DNA, 22 bp, Artificial Sequence
  chemically synthesized
gcaaatgcacatggagatgcta

SEQ ID NO: 1277397 - DNA, 22 bp, Artificial Sequence
  chemically synthesized
caaatgcacatggagatgctaa

SEQ ID NO: 1277398 - DNA, 22 bp, Artificial Sequence
  chemically synthesized
taccaggattttgctagcttgt

SEQ ID NO: 1277399 - DNA, 22 bp, Artificial Sequence
  chemically synthesized
ataccaggattttgctagcttg

SEQ ID NO: 1277400 - DNA, 22 bp, Artificial Sequence
  chemically synthesized
tataccaggattttgctagctt

SEQ ID NO: 1277401 - DNA, 22 bp, Artificial Sequence
  chemically synthesized
gctttataccaggattttgcta

SEQ ID NO: 1277402 - DNA, 22 bp, Artificial Sequence
  chemically synthesized
acaagctagcaaaatcctggta

SEQ ID NO: 1277403 - DNA, 22 bp, Artificial Sequence
  chemically synthesized
gcaaaatcctggtataaagcca

SEQ ID NO: 1277404 - DNA, 22 bp, Artificial Sequence
  chemically synthesized
tgtaatcatgggtagtgttggc

SEQ ID NO: 1277405 - DNA, 22 bp, Artificial Sequence
  chemically synthesized
gtataaagccaacactacccat

SEQ ID NO: 1277406 - DNA, 22 bp, Artificial Sequence
  chemically synthesized
tgaacctgtgtaatcatgggta

SEQ ID NO: 1277407 - DNA, 22 bp, Artificial Sequence
  chemically synthesized
tggcattatgaacctgtgtaat

SEQ ID NO: 1277408 - DNA, 22 bp, Artificial Sequence
  chemically synthesized
cctgtggcattatgaacctgtg

SEQ ID NO: 1277409 - DNA, 22 bp, Artificial Sequence
  chemically synthesized
cccatgattacacaggttcata

SEQ ID NO: 1277410 - DNA, 22 bp, Artificial Sequence
  chemically synthesized
aactgcctgtggcattatgaac

SEQ ID NO: 1277411 - DNA, 22 bp, Artificial Sequence
  chemically synthesized
cacaggttcataatgccacagg

SEQ ID NO: 1277412 - DNA, 22 bp, Artificial Sequence
  chemically synthesized
taacctaaactgcctgtggcat

SEQ ID NO: 1277413 - DNA, 22 bp, Artificial Sequence
  chemically synthesized
ttgtaacctaaactgcctgtgg

SEQ ID NO: 1277414 - DNA, 22 bp, Artificial Sequence
  chemically synthesized
attgtaacctaaactgcctgtg

SEQ ID NO: 1277415 - DNA, 22 bp, Artificial Sequence
  chemically synthesized
tattgtaacctaaactgcctgt

SEQ ID NO: 1277416 - DNA, 22 bp, Artificial Sequence
  chemically synthesized
ataatgccacaggcagtttagg

SEQ ID NO: 1277417 - DNA, 22 bp, Artificial Sequence
  chemically synthesized
atgaattttattgtaacctaaa

SEQ ID NO: 1277418 - DNA, 22 bp, Artificial Sequence
  chemically synthesized
aagaattcatgaattttattgt

SEQ ID NO: 1277419 - DNA, 22 bp, Artificial Sequence
  chemically synthesized
aggttacaataaaattcatgaa

SEQ ID NO: 1277420 - DNA, 22 bp, Artificial Sequence
  chemically synthesized
ggttacaataaaattcatgaat

SEQ ID NO: 1277421 - DNA, 22 bp, Artificial Sequence
  chemically synthesized
caataaaattcatgaattcttc

SEQ ID NO: 1277422 - DNA, 22 bp, Artificial Sequence
  chemically synthesized
cccagccaagcactgaagaatt

SEQ ID NO: 1277423 - DNA, 22 bp, Artificial Sequence
  chemically synthesized
atgaattcttcagtgcttggct

SEQ ID NO: 1277424 - DNA, 22 bp, Artificial Sequence
  chemically synthesized
agtacatatcctgcccagccaa

SEQ ID NO: 1277425 - DNA, 22 bp, Artificial Sequence
  chemically synthesized
ttcagtacatatcctgcccagc

SEQ ID NO: 1277426 - DNA, 22 bp, Artificial Sequence
  chemically synthesized
ttcagtgcttggctgggcagga

SEQ ID NO: 1277427 - DNA, 22 bp, Artificial Sequence
  chemically synthesized
gttcagtacatatcctgcccag

SEQ ID NO: 1277428 - DNA, 22 bp, Artificial Sequence
  chemically synthesized
tgttcagtacatatcctgccca

SEQ ID NO: 1277429 - DNA, 22 bp, Artificial Sequence
  chemically synthesized
cagtgcttggctgggcaggata

SEQ ID NO: 1277430 - DNA, 22 bp, Artificial Sequence
  chemically synthesized
agtgcttggctgggcaggatat

SEQ ID NO: 1277431 - DNA, 22 bp, Artificial Sequence
  chemically synthesized
ggctgggcaggatatgtactga

SEQ ID NO: 1277432 - DNA, 22 bp, Artificial Sequence
  chemically synthesized
gctgggcaggatatgtactgaa

SEQ ID NO: 1277433 - DNA, 22 bp, Artificial Sequence
  chemically synthesized
cgggagtgctttgttcagtaca

SEQ ID NO: 1277434 - DNA, 22 bp, Artificial Sequence
  chemically synthesized
ggcaggatatgtactgaacaaa

SEQ ID NO: 1277435 - DNA, 22 bp, Artificial Sequence
  chemically synthesized
agtacctacgggagtgctttgt

SEQ ID NO: 1277436 - DNA, 22 bp, Artificial Sequence
  chemically synthesized
cagtacctacgggagtgctttg

SEQ ID NO: 1277437 - DNA, 22 bp, Artificial Sequence
  chemically synthesized
tcagtacctacgggagtgcttt

SEQ ID NO: 1277438 - DNA, 22 bp, Artificial Sequence
  chemically synthesized
cctttcagtacctacgggagtg

SEQ ID NO: 1277439 - DNA, 22 bp, Artificial Sequence
  chemically synthesized
aacaaagcactcccgtaggtac

SEQ ID NO: 1277440 - DNA, 22 bp, Artificial Sequence
  chemically synthesized
gtgaataggcactgcctttcag

SEQ ID NO: 1277441 - DNA, 22 bp, Artificial Sequence
  chemically synthesized
ccgtaggtactgaaaggcagtg

SEQ ID NO: 1277442 - DNA, 22 bp, Artificial Sequence
  chemically synthesized
aaaggcagtgcctattcactaa

SEQ ID NO: 1277443 - DNA, 22 bp, Artificial Sequence
  chemically synthesized
ttcactaactggtgatgttatt

SEQ ID NO: 1277444 - DNA, 22 bp, Artificial Sequence
  chemically synthesized
aggaaacggatgaataacatca

SEQ ID NO: 1277445 - DNA, 22 bp, Artificial Sequence
  chemically synthesized
actaactggtgatgttattcat

SEQ ID NO: 1277446 - DNA, 22 bp, Artificial Sequence
  chemically synthesized
gttcaggaaacggatgaataac

SEQ ID NO: 1277447 - DNA, 22 bp, Artificial Sequence
  chemically synthesized
actggtgatgttattcatccgt

SEQ ID NO: 1277448 - DNA, 22 bp, Artificial Sequence
  chemically synthesized
ctggttcaggaaacggatgaat

SEQ ID NO: 1277449 - DNA, 22 bp, Artificial Sequence
  chemically synthesized
gtgatgttattcatccgtttcc

SEQ ID NO: 1277450 - DNA, 22 bp, Artificial Sequence
  chemically synthesized
tgttcctggttcaggaaacgga

SEQ ID NO: 1277451 - DNA, 22 bp, Artificial Sequence
  chemically synthesized
ctatgttcctggttcaggaaac

SEQ ID NO: 1277452 - DNA, 22 bp, Artificial Sequence
  chemically synthesized
ttcatccgtttcctgaaccagg

SEQ ID NO: 1277453 - DNA, 22 bp, Artificial Sequence
  chemically synthesized
atccgtttcctgaaccaggaac

SEQ ID NO: 1277454 - DNA, 22 bp, Artificial Sequence
  chemically synthesized
cctgaaccaggaacataggagc

SEQ ID NO: 1277455 - DNA, 22 bp, Artificial Sequence
  chemically synthesized
ctgaaccaggaacataggagcc

SEQ ID NO: 1277456 - DNA, 22 bp, Artificial Sequence
  chemically synthesized
aaccaggaacataggagcccct

SEQ ID NO: 1277457 - DNA, 22 bp, Artificial Sequence
  chemically synthesized
ggagggatgaaagaggagacaa

SEQ ID NO: 1277458 - DNA, 22 bp, Artificial Sequence
  chemically synthesized
gctgggagggatgaaagaggag

SEQ ID NO: 1277459 - DNA, 22 bp, Artificial Sequence
  chemically synthesized
tgtctcctctttcatccctccc

SEQ ID NO: 1277460 - DNA, 22 bp, Artificial Sequence
  chemically synthesized
gtctcctctttcatccctccca

SEQ ID NO: 1277461 - DNA, 22 bp, Artificial Sequence
  chemically synthesized
tctcctctttcatccctcccag

SEQ ID NO: 1277462 - DNA, 22 bp, Artificial Sequence
  chemically synthesized
agcaatggactggctgggaggg

SEQ ID NO: 1277463 - DNA, 22 bp, Artificial Sequence
  chemically synthesized
ctctttcatccctcccagccag

SEQ ID NO: 1277464 - DNA, 22 bp, Artificial Sequence
  chemically synthesized
tttcatccctcccagccagtcc

SEQ ID NO: 1277465 - DNA, 22 bp, Artificial Sequence
  chemically synthesized
gacattgagcaatggactggct

SEQ ID NO: 1277466 - DNA, 22 bp, Artificial Sequence
  chemically synthesized
tcatccctcccagccagtccat

SEQ ID NO: 1277467 - DNA, 22 bp, Artificial Sequence
  chemically synthesized
agacattgagcaatggactggc

SEQ ID NO: 1277468 - DNA, 22 bp, Artificial Sequence
  chemically synthesized
catccctcccagccagtccatt

SEQ ID NO: 1277469 - DNA, 22 bp, Artificial Sequence
  chemically synthesized
tagacattgagcaatggactgg

SEQ ID NO: 1277470 - DNA, 22 bp, Artificial Sequence
  chemically synthesized
atccctcccagccagtccattg

SEQ ID NO: 1277471 - DNA, 22 bp, Artificial Sequence
  chemically synthesized
ccagccagtccattgctcaatg

SEQ ID NO: 1277472 - DNA, 22 bp, Artificial Sequence
  chemically synthesized
gggaatccaattttagacattg

SEQ ID NO: 1277473 - DNA, 22 bp, Artificial Sequence
  chemically synthesized
ggggaatccaattttagacatt

SEQ ID NO: 1277474 - DNA, 22 bp, Artificial Sequence
  chemically synthesized
atcttggggaatccaattttag

SEQ ID NO: 1277475 - DNA, 22 bp, Artificial Sequence
  chemically synthesized
ctcaatgtctaaaattggattc

SEQ ID NO: 1277476 - DNA, 22 bp, Artificial Sequence
  chemically synthesized
agtctgatcttggggaatccaa

SEQ ID NO: 1277477 - DNA, 22 bp, Artificial Sequence
  chemically synthesized
aatgtctaaaattggattcccc

SEQ ID NO: 1277478 - DNA, 22 bp, Artificial Sequence
  chemically synthesized
aagtctgatcttggggaatcca

SEQ ID NO: 1277479 - DNA, 22 bp, Artificial Sequence
  chemically synthesized
tcatttaagtctgatcttgggg

SEQ ID NO: 1277480 - DNA, 22 bp, Artificial Sequence
  chemically synthesized
gtcatttaagtctgatcttggg

SEQ ID NO: 1277481 - DNA, 22 bp, Artificial Sequence
  chemically synthesized
aaattggattccccaagatcag

SEQ ID NO: 1277482 - DNA, 22 bp, Artificial Sequence
  chemically synthesized
aaatttgtcatttaagtctgat

SEQ ID NO: 1277483 - DNA, 22 bp, Artificial Sequence
  chemically synthesized
gattccccaagatcagacttaa

SEQ ID NO: 1277484 - DNA, 22 bp, Artificial Sequence
  chemically synthesized
cccaagatcagacttaaatgac

SEQ ID NO: 1277485 - DNA, 22 bp, Artificial Sequence
  chemically synthesized
catggactcaaatttgtcattt

SEQ ID NO: 1277486 - DNA, 22 bp, Artificial Sequence
  chemically synthesized
aaatgacaaatttgagtccatg

SEQ ID NO: 1277487 - DNA, 22 bp, Artificial Sequence
  chemically synthesized
aatgacaaatttgagtccatgt

SEQ ID NO: 1277488 - DNA, 22 bp, Artificial Sequence
  chemically synthesized
catcataatcagctacatggac

SEQ ID NO: 1277489 - DNA, 22 bp, Artificial Sequence
  chemically synthesized
tgatctccatcataatcagcta

SEQ ID NO: 1277490 - DNA, 22 bp, Artificial Sequence
  chemically synthesized
tgtgatctccatcataatcagc

SEQ ID NO: 1277491 - DNA, 22 bp, Artificial Sequence
  chemically synthesized
gagtccatgtagctgattatga

SEQ ID NO: 1277492 - DNA, 22 bp, Artificial Sequence
  chemically synthesized
ctgtgatctccatcataatcag

SEQ ID NO: 1277493 - DNA, 22 bp, Artificial Sequence
  chemically synthesized
agtccatgtagctgattatgat

SEQ ID NO: 1277494 - DNA, 22 bp, Artificial Sequence
  chemically synthesized
tctgtgatctccatcataatca

SEQ ID NO: 1277495 - DNA, 22 bp, Artificial Sequence
  chemically synthesized
atgctttctgtgatctccatca

SEQ ID NO: 1277496 - DNA, 22 bp, Artificial Sequence
  chemically synthesized
ttgatgctttctgtgatctcca

SEQ ID NO: 1277497 - DNA, 22 bp, Artificial Sequence
  chemically synthesized
ctgttgatgctttctgtgatct

SEQ ID NO: 1277498 - DNA, 22 bp, Artificial Sequence
  chemically synthesized
cctgttgatgctttctgtgatc

SEQ ID NO: 1277499 - DNA, 22 bp, Artificial Sequence
  chemically synthesized
attatgatggagatcacagaaa

SEQ ID NO: 1277500 - DNA, 22 bp, Artificial Sequence
  chemically synthesized
acttcctgttgatgctttctgt

SEQ ID NO: 1277501 - DNA, 22 bp, Artificial Sequence
  chemically synthesized
tgatggagatcacagaaagcat

SEQ ID NO: 1277502 - DNA, 22 bp, Artificial Sequence
  chemically synthesized
tcacttcctgttgatgctttct

SEQ ID NO: 1277503 - DNA, 22 bp, Artificial Sequence
  chemically synthesized
ctcacttcctgttgatgctttc

SEQ ID NO: 1277504 - DNA, 22 bp, Artificial Sequence
  chemically synthesized
tttctcacttcctgttgatgct

SEQ ID NO: 1277505 - DNA, 22 bp, Artificial Sequence
  chemically synthesized
ctgtttctcacttcctgttgat

SEQ ID NO: 1277506 - DNA, 22 bp, Artificial Sequence
  chemically synthesized
cctgtttctcacttcctgttga

SEQ ID NO: 1277507 - DNA, 22 bp, Artificial Sequence
  chemically synthesized
catcacagatcttcctgtttct

SEQ ID NO: 1277508 - DNA, 22 bp, Artificial Sequence
  chemically synthesized
tgatctccatcacagatcttcc

SEQ ID NO: 1277509 - DNA, 22 bp, Artificial Sequence
  chemically synthesized
tgtgatctccatcacagatctt

SEQ ID NO: 1277510 - DNA, 22 bp, Artificial Sequence
  chemically synthesized
ctgtgatctccatcacagatct

SEQ ID NO: 1277511 - DNA, 22 bp, Artificial Sequence
  chemically synthesized
tctgtgatctccatcacagatc

SEQ ID NO: 1277512 - DNA, 22 bp, Artificial Sequence
  chemically synthesized
atgctttctgtgatctccatca

SEQ ID NO: 1277513 - DNA, 22 bp, Artificial Sequence
  chemically synthesized
ttgatgctttctgtgatctcca

SEQ ID NO: 1277514 - DNA, 22 bp, Artificial Sequence
  chemically synthesized
ctgttgatgctttctgtgatct

SEQ ID NO: 1277515 - DNA, 22 bp, Artificial Sequence
  chemically synthesized
cctgttgatgctttctgtgatc

SEQ ID NO: 1277516 - DNA, 22 bp, Artificial Sequence
  chemically synthesized
cttcctgttgatgctttctgtg

SEQ ID NO: 1277517 - DNA, 22 bp, Artificial Sequence
  chemically synthesized
tgatggagatcacagaaagcat

SEQ ID NO: 1277518 - DNA, 22 bp, Artificial Sequence
  chemically synthesized
tacttcctgttgatgctttctg

SEQ ID NO: 1277519 - DNA, 22 bp, Artificial Sequence
  chemically synthesized
tctacttcctgttgatgctttc

SEQ ID NO: 1277520 - DNA, 22 bp, Artificial Sequence
  chemically synthesized
ctctacttcctgttgatgcttt

SEQ ID NO: 1277521 - DNA, 22 bp, Artificial Sequence
  chemically synthesized
acttctctacttcctgttgatg

SEQ ID NO: 1277522 - DNA, 22 bp, Artificial Sequence
  chemically synthesized
tctcacttctctacttcctgtt

SEQ ID NO: 1277523 - DNA, 22 bp, Artificial Sequence
  chemically synthesized
tatctcacttctctacttcctg

SEQ ID NO: 1277524 - DNA, 22 bp, Artificial Sequence
  chemically synthesized
tctatctcacttctctacttcc

SEQ ID NO: 1277525 - DNA, 22 bp, Artificial Sequence
  chemically synthesized
ctctatctcacttctctacttc

SEQ ID NO: 1277526 - DNA, 22 bp, Artificial Sequence
  chemically synthesized
ttctctatctcacttctctact

SEQ ID NO: 1277527 - DNA, 22 bp, Artificial Sequence
  chemically synthesized
cttctctatctcacttctctac

SEQ ID NO: 1277528 - DNA, 22 bp, Artificial Sequence
  chemically synthesized
tcttctctatctcacttctcta

SEQ ID NO: 1277529 - DNA, 22 bp, Artificial Sequence
  chemically synthesized
ctttcttctctatctcacttct

SEQ ID NO: 1277530 - DNA, 22 bp, Artificial Sequence
  chemically synthesized
tgtgttcctttcttctctatct

SEQ ID NO: 1277531 - DNA, 22 bp, Artificial Sequence
  chemically synthesized
tgtgtgttcctttcttctctat

SEQ ID NO: 1277532 - DNA, 22 bp, Artificial Sequence
  chemically synthesized
atgtactctgtgtgttcctttc

SEQ ID NO: 1277533 - DNA, 22 bp, Artificial Sequence
  chemically synthesized
attaatgtactctgtgtgttcc

SEQ ID NO: 1277534 - DNA, 22 bp, Artificial Sequence
  chemically synthesized
ctcattaatgtactctgtgtgt

SEQ ID NO: 1277535 - DNA, 22 bp, Artificial Sequence
  chemically synthesized
gctcattaatgtactctgtgtg

SEQ ID NO: 1277536 - DNA, 22 bp, Artificial Sequence
  chemically synthesized
agtcccagtcatccatagtcat

SEQ ID NO: 1277537 - DNA, 22 bp, Artificial Sequence
  chemically synthesized
atgagcaagttatgactatgga

SEQ ID NO: 1277538 - DNA, 22 bp, Artificial Sequence
  chemically synthesized
cagtggcattaagtcccagtca

SEQ ID NO: 1277539 - DNA, 22 bp, Artificial Sequence
  chemically synthesized
tgactatggatgactgggactt

SEQ ID NO: 1277540 - DNA, 22 bp, Artificial Sequence
  chemically synthesized
tggatgactgggacttaatgcc

SEQ ID NO: 1277541 - DNA, 22 bp, Artificial Sequence
  chemically synthesized
gaagtctccagtggcattaagt

SEQ ID NO: 1277542 - DNA, 22 bp, Artificial Sequence
  chemically synthesized
ctagaagtctccagtggcatta

SEQ ID NO: 1277543 - DNA, 22 bp, Artificial Sequence
  chemically synthesized
gctagaagtctccagtggcatt

SEQ ID NO: 1277544 - DNA, 22 bp, Artificial Sequence
  chemically synthesized
atttgctagaagtctccagtgg

SEQ ID NO: 1277545 - DNA, 22 bp, Artificial Sequence
  chemically synthesized
catttgctagaagtctccagtg

SEQ ID NO: 1277546 - DNA, 22 bp, Artificial Sequence
  chemically synthesized
ggacttaatgccactggagact

SEQ ID NO: 1277547 - DNA, 22 bp, Artificial Sequence
  chemically synthesized
tttcatttgctagaagtctcca

SEQ ID NO: 1277548 - DNA, 22 bp, Artificial Sequence
  chemically synthesized
aatgccactggagacttctagc

SEQ ID NO: 1277549 - DNA, 22 bp, Artificial Sequence
  chemically synthesized
atgccactggagacttctagca

SEQ ID NO: 1277550 - DNA, 22 bp, Artificial Sequence
  chemically synthesized
gagacttctagcaaatgaaata

SEQ ID NO: 1277551 - DNA, 22 bp, Artificial Sequence
  chemically synthesized
ctagcaaatgaaatagacatgc

SEQ ID NO: 1277552 - DNA, 22 bp, Artificial Sequence
  chemically synthesized
tagcaaatgaaatagacatgcc

SEQ ID NO: 1277553 - DNA, 22 bp, Artificial Sequence
  chemically synthesized
gcaaatgaaatagacatgcctc

SEQ ID NO: 1277554 - DNA, 22 bp, Artificial Sequence
  chemically synthesized
aaataggatgcatgaggcatgt

SEQ ID NO: 1277555 - DNA, 22 bp, Artificial Sequence
  chemically synthesized
cactcaaataggatgcatgagg

SEQ ID NO: 1277556 - DNA, 22 bp, Artificial Sequence
  chemically synthesized
acactcaaataggatgcatgag

SEQ ID NO: 1277557 - DNA, 22 bp, Artificial Sequence
  chemically synthesized
tacactcaaataggatgcatga

SEQ ID NO: 1277558 - DNA, 22 bp, Artificial Sequence
  chemically synthesized
ttacactcaaataggatgcatg

SEQ ID NO: 1277559 - DNA, 22 bp, Artificial Sequence
  chemically synthesized
tttacactcaaataggatgcat

SEQ ID NO: 1277560 - DNA, 22 bp, Artificial Sequence
  chemically synthesized
aactttttacactcaaatagga

SEQ ID NO: 1277561 - DNA, 22 bp, Artificial Sequence
  chemically synthesized
taaactttttacactcaaatag

SEQ ID NO: 1277562 - DNA, 22 bp, Artificial Sequence
  chemically synthesized
atgcatcctatttgagtgtaaa

SEQ ID NO: 1277563 - DNA, 22 bp, Artificial Sequence
  chemically synthesized
gatgataaaaactctaaacttt

SEQ ID NO: 1277564 - DNA, 22 bp, Artificial Sequence
  chemically synthesized
tttgagtgtaaaaagtttagag

SEQ ID NO: 1277565 - DNA, 22 bp, Artificial Sequence
  chemically synthesized
gagtgtaaaaagtttagagttt

SEQ ID NO: 1277566 - DNA, 22 bp, Artificial Sequence
  chemically synthesized
agtgtaaaaagtttagagtttt

SEQ ID NO: 1277567 - DNA, 22 bp, Artificial Sequence
  chemically synthesized
ataatagatgagaattggatga

SEQ ID NO: 1277568 - DNA, 22 bp, Artificial Sequence
  chemically synthesized
agagtttttatcatccaattct

SEQ ID NO: 1277569 - DNA, 22 bp, Artificial Sequence
  chemically synthesized
gagtttttatcatccaattctc

SEQ ID NO: 1277570 - DNA, 22 bp, Artificial Sequence
  chemically synthesized
aggttaataatagatgagaatt

SEQ ID NO: 1277571 - DNA, 22 bp, Artificial Sequence
  chemically synthesized
caggttaataatagatgagaat

SEQ ID NO: 1277572 - DNA, 22 bp, Artificial Sequence
  chemically synthesized
ttatcatccaattctcatctat

SEQ ID NO: 1277573 - DNA, 22 bp, Artificial Sequence
  chemically synthesized
ttcaggttaataatagatgaga

SEQ ID NO: 1277574 - DNA, 22 bp, Artificial Sequence
  chemically synthesized
tatcatccaattctcatctatt

SEQ ID NO: 1277575 - DNA, 22 bp, Artificial Sequence
  chemically synthesized
atcatccaattctcatctatta

SEQ ID NO: 1277576 - DNA, 22 bp, Artificial Sequence
  chemically synthesized
tcatccaattctcatctattat

SEQ ID NO: 1277577 - DNA, 22 bp, Artificial Sequence
  chemically synthesized
tcatctattattaacctgaaga

SEQ ID NO: 1277578 - DNA, 22 bp, Artificial Sequence
  chemically synthesized
atctattattaacctgaagaat

SEQ ID NO: 1277579 - DNA, 22 bp, Artificial Sequence
  chemically synthesized
aagacccaagcagcattcttca

SEQ ID NO: 1277580 - DNA, 22 bp, Artificial Sequence
  chemically synthesized
ttattaacctgaagaatgctgc

SEQ ID NO: 1277581 - DNA, 22 bp, Artificial Sequence
  chemically synthesized
ttaacctgaagaatgctgcttg

SEQ ID NO: 1277582 - DNA, 22 bp, Artificial Sequence
  chemically synthesized
gaatattgaagacccaagcagc

SEQ ID NO: 1277583 - DNA, 22 bp, Artificial Sequence
  chemically synthesized
acctgaagaatgctgcttgggt

SEQ ID NO: 1277584 - DNA, 22 bp, Artificial Sequence
  chemically synthesized
aagaatgctgcttgggtcttca

SEQ ID NO: 1277585 - DNA, 22 bp, Artificial Sequence
  chemically synthesized
gaagtgctggaatattgaagac

SEQ ID NO: 1277586 - DNA, 22 bp, Artificial Sequence
  chemically synthesized
cttgggtcttcaatattccagc

SEQ ID NO: 1277587 - DNA, 22 bp, Artificial Sequence
  chemically synthesized
gggtcttcaatattccagcact

SEQ ID NO: 1277588 - DNA, 22 bp, Artificial Sequence
  chemically synthesized
ggtcttcaatattccagcactt

SEQ ID NO: 1277589 - DNA, 22 bp, Artificial Sequence
  chemically synthesized
cggggaaggctagaagtgctgg

SEQ ID NO: 1277590 - DNA, 22 bp, Artificial Sequence
  chemically synthesized
caatattccagcacttctagcc

SEQ ID NO: 1277591 - DNA, 22 bp, Artificial Sequence
  chemically synthesized
aatattccagcacttctagcct

SEQ ID NO: 1277592 - DNA, 22 bp, Artificial Sequence
  chemically synthesized
ccactgcggggaaggctagaag

SEQ ID NO: 1277593 - DNA, 22 bp, Artificial Sequence
  chemically synthesized
gccactgcggggaaggctagaa

SEQ ID NO: 1277594 - DNA, 22 bp, Artificial Sequence
  chemically synthesized
cagcacttctagccttccccgc

SEQ ID NO: 1277595 - DNA, 22 bp, Artificial Sequence
  chemically synthesized
atgggtttgccactgcggggaa

SEQ ID NO: 1277596 - DNA, 22 bp, Artificial Sequence
  chemically synthesized
tgatgggtttgccactgcgggg

SEQ ID NO: 1277597 - DNA, 22 bp, Artificial Sequence
  chemically synthesized
tctgatgggtttgccactgcgg

SEQ ID NO: 1277598 - DNA, 22 bp, Artificial Sequence
  chemically synthesized
ctctgatgggtttgccactgcg

SEQ ID NO: 1277599 - DNA, 22 bp, Artificial Sequence
  chemically synthesized
ctagccttccccgcagtggcaa

SEQ ID NO: 1277600 - DNA, 22 bp, Artificial Sequence
  chemically synthesized
tctctgatgggtttgccactgc

SEQ ID NO: 1277601 - DNA, 22 bp, Artificial Sequence
  chemically synthesized
tagccttccccgcagtggcaaa

SEQ ID NO: 1277602 - DNA, 22 bp, Artificial Sequence
  chemically synthesized
gccttccccgcagtggcaaacc

SEQ ID NO: 1277603 - DNA, 22 bp, Artificial Sequence
  chemically synthesized
aagactttctctgatgggtttg

SEQ ID NO: 1277604 - DNA, 22 bp, Artificial Sequence
  chemically synthesized
ccccgcagtggcaaacccatca

SEQ ID NO: 1277605 - DNA, 22 bp, Artificial Sequence
  chemically synthesized
cccgcagtggcaaacccatcag

SEQ ID NO: 1277606 - DNA, 22 bp, Artificial Sequence
  chemically synthesized
cgtgcacctgaagactttctct

SEQ ID NO: 1277607 - DNA, 22 bp, Artificial Sequence
  chemically synthesized
attgcgtgcacctgaagacttt

SEQ ID NO: 1277608 - DNA, 22 bp, Artificial Sequence
  chemically synthesized
atcatctaattgcgtgcacctg

SEQ ID NO: 1277609 - DNA, 22 bp, Artificial Sequence
  chemically synthesized
tctcatcatctaattgcgtgca

SEQ ID NO: 1277610 - DNA, 22 bp, Artificial Sequence
  chemically synthesized
gtctcatcatctaattgcgtgc

SEQ ID NO: 1277611 - DNA, 22 bp, Artificial Sequence
  chemically synthesized
tgtctcatcatctaattgcgtg

SEQ ID NO: 1277612 - DNA, 22 bp, Artificial Sequence
  chemically synthesized
caggtgcacgcaattagatgat

SEQ ID NO: 1277613 - DNA, 22 bp, Artificial Sequence
  chemically synthesized
ccattttgtctcatcatctaat

SEQ ID NO: 1277614 - DNA, 22 bp, Artificial Sequence
  chemically synthesized
aggtgcacgcaattagatgatg

SEQ ID NO: 1277615 - DNA, 22 bp, Artificial Sequence
  chemically synthesized
agcgctcccattttgtctcatc

SEQ ID NO: 1277616 - DNA, 22 bp, Artificial Sequence
  chemically synthesized
cagcgctcccattttgtctcat

SEQ ID NO: 1277617 - DNA, 22 bp, Artificial Sequence
  chemically synthesized
tcagcgctcccattttgtctca

SEQ ID NO: 1277618 - DNA, 22 bp, Artificial Sequence
  chemically synthesized
gatgatgagacaaaatgggagc

SEQ ID NO: 1277619 - DNA, 22 bp, Artificial Sequence
  chemically synthesized
tccgtaccctttcagcgctccc

SEQ ID NO: 1277620 - DNA, 22 bp, Artificial Sequence
  chemically synthesized
gtggacgctgtccgtacccttt

SEQ ID NO: 1277621 - DNA, 22 bp, Artificial Sequence
  chemically synthesized
aatctagtggacgctgtccgta

SEQ ID NO: 1277622 - DNA, 22 bp, Artificial Sequence
  chemically synthesized
aaatctagtggacgctgtccgt

SEQ ID NO: 1277623 - DNA, 22 bp, Artificial Sequence
  chemically synthesized
taaatctagtggacgctgtccg

SEQ ID NO: 1277624 - DNA, 22 bp, Artificial Sequence
  chemically synthesized
tttaaatctagtggacgctgtc

SEQ ID NO: 1277625 - DNA, 22 bp, Artificial Sequence
  chemically synthesized
aaagggtacggacagcgtccac

SEQ ID NO: 1277626 - DNA, 22 bp, Artificial Sequence
  chemically synthesized
taagataaatgtagggtactct

SEQ ID NO: 1277627 - DNA, 22 bp, Artificial Sequence
  chemically synthesized
gatttaaagagtaccctacatt

SEQ ID NO: 1277628 - DNA, 22 bp, Artificial Sequence
  chemically synthesized
cactataagataaatgtagggt

SEQ ID NO: 1277629 - DNA, 22 bp, Artificial Sequence
  chemically synthesized
aaagagtaccctacatttatct

SEQ ID NO: 1277630 - DNA, 22 bp, Artificial Sequence
  chemically synthesized
aagagtaccctacatttatctt

SEQ ID NO: 1277631 - DNA, 22 bp, Artificial Sequence
  chemically synthesized
tagtctacactataagataaat

SEQ ID NO: 1277632 - DNA, 22 bp, Artificial Sequence
  chemically synthesized
catttatcttatagtgtagact

SEQ ID NO: 1277633 - DNA, 22 bp, Artificial Sequence
  chemically synthesized
atcttatagtgtagactatagc

SEQ ID NO: 1277634 - DNA, 22 bp, Artificial Sequence
  chemically synthesized
tcttatagtgtagactatagct

SEQ ID NO: 1277635 - DNA, 22 bp, Artificial Sequence
  chemically synthesized
atagtgtagactatagctgttc

SEQ ID NO: 1277636 - DNA, 22 bp, Artificial Sequence
  chemically synthesized
tagtgtagactatagctgttct

SEQ ID NO: 1277637 - DNA, 22 bp, Artificial Sequence
  chemically synthesized
gtacaaaaaagcaagaacagct

SEQ ID NO: 1277638 - DNA, 22 bp, Artificial Sequence
  chemically synthesized
ggtacaaaaaagcaagaacagc

SEQ ID NO: 1277639 - DNA, 22 bp, Artificial Sequence
  chemically synthesized
tagctgttcttgcttttttgta

SEQ ID NO: 1277640 - DNA, 22 bp, Artificial Sequence
  chemically synthesized
ttcttgcttttttgtaccaaat

SEQ ID NO: 1277641 - DNA, 22 bp, Artificial Sequence
  chemically synthesized
ttgcttttttgtaccaaatgac

SEQ ID NO: 1277642 - DNA, 22 bp, Artificial Sequence
  chemically synthesized
gcttttttgtaccaaatgactc

SEQ ID NO: 1277643 - DNA, 22 bp, Artificial Sequence
  chemically synthesized
cttttttgtaccaaatgactca

SEQ ID NO: 1277644 - DNA, 22 bp, Artificial Sequence
  chemically synthesized
ttttgtaccaaatgactcatct

SEQ ID NO: 1277645 - DNA, 22 bp, Artificial Sequence
  chemically synthesized
tttgtaccaaatgactcatctt

SEQ ID NO: 1277646 - DNA, 22 bp, Artificial Sequence
  chemically synthesized
ttgtaccaaatgactcatcttt

SEQ ID NO: 1277647 - DNA, 22 bp, Artificial Sequence
  chemically synthesized
aaggaaggaaaaaaagatgagt

SEQ ID NO: 1277648 - DNA, 22 bp, Artificial Sequence
  chemically synthesized
tgtaccaaatgactcatctttt

SEQ ID NO: 1277649 - DNA, 22 bp, Artificial Sequence
  chemically synthesized
gtaccaaatgactcatcttttt

SEQ ID NO: 1277650 - DNA, 22 bp, Artificial Sequence
  chemically synthesized
taaaggaaggaaaaaaagatga

SEQ ID NO: 1277651 - DNA, 22 bp, Artificial Sequence
  chemically synthesized
taccaaatgactcatctttttt

SEQ ID NO: 1277652 - DNA, 22 bp, Artificial Sequence
  chemically synthesized
ctaaaggaaggaaaaaaagatg

SEQ ID NO: 1277653 - DNA, 22 bp, Artificial Sequence
  chemically synthesized
tttctaaaggaaggaaaaaaag

SEQ ID NO: 1277654 - DNA, 22 bp, Artificial Sequence
  chemically synthesized
gtttctaaaggaaggaaaaaaa

SEQ ID NO: 1277655 - DNA, 22 bp, Artificial Sequence
  chemically synthesized
aatcttgtttctaaaggaagga

SEQ ID NO: 1277656 - DNA, 22 bp, Artificial Sequence
  chemically synthesized
caatcttgtttctaaaggaagg

SEQ ID NO: 1277657 - DNA, 22 bp, Artificial Sequence
  chemically synthesized
tcaatcttgtttctaaaggaag

SEQ ID NO: 1277658 - DNA, 22 bp, Artificial Sequence
  chemically synthesized
atctttttttccttcctttaga

SEQ ID NO: 1277659 - DNA, 22 bp, Artificial Sequence
  chemically synthesized
cattttcaatcttgtttctaaa

SEQ ID NO: 1277660 - DNA, 22 bp, Artificial Sequence
  chemically synthesized
tttttccttcctttagaaacaa

SEQ ID NO: 1277661 - DNA, 22 bp, Artificial Sequence
  chemically synthesized
ttttccttcctttagaaacaag

SEQ ID NO: 1277662 - DNA, 22 bp, Artificial Sequence
  chemically synthesized
tttccttcctttagaaacaaga

SEQ ID NO: 1277663 - DNA, 22 bp, Artificial Sequence
  chemically synthesized
ttccttcctttagaaacaagat

SEQ ID NO: 1277664 - DNA, 22 bp, Artificial Sequence
  chemically synthesized
tccttcctttagaaacaagatt

SEQ ID NO: 1277665 - DNA, 22 bp, Artificial Sequence
  chemically synthesized
ccttcctttagaaacaagattg

SEQ ID NO: 1277666 - DNA, 22 bp, Artificial Sequence
  chemically synthesized
cttcctttagaaacaagattga

SEQ ID NO: 1277667 - DNA, 22 bp, Artificial Sequence
  chemically synthesized
cctttagaaacaagattgaaaa

SEQ ID NO: 1277668 - DNA, 22 bp, Artificial Sequence
  chemically synthesized
ctttagaaacaagattgaaaat

SEQ ID NO: 1277669 - DNA, 22 bp, Artificial Sequence
  chemically synthesized
aaccgagattacattttcaatc

SEQ ID NO: 1277670 - DNA, 22 bp, Artificial Sequence
  chemically synthesized
tagaaacaagattgaaaatgta

SEQ ID NO: 1277671 - DNA, 22 bp, Artificial Sequence
  chemically synthesized
ttcaaccgagattacattttca

SEQ ID NO: 1277672 - DNA, 22 bp, Artificial Sequence
  chemically synthesized
agaaacaagattgaaaatgtaa

SEQ ID NO: 1277673 - DNA, 22 bp, Artificial Sequence
  chemically synthesized
gaaacaagattgaaaatgtaat

SEQ ID NO: 1277674 - DNA, 22 bp, Artificial Sequence
  chemically synthesized
ctgttcaaccgagattacattt

SEQ ID NO: 1277675 - DNA, 22 bp, Artificial Sequence
  chemically synthesized
cctgttcaaccgagattacatt

SEQ ID NO: 1277676 - DNA, 22 bp, Artificial Sequence
  chemically synthesized
catgcttcctgttcaaccgaga

SEQ ID NO: 1277677 - DNA, 22 bp, Artificial Sequence
  chemically synthesized
aaaatgtaatctcggttgaaca

SEQ ID NO: 1277678 - DNA, 22 bp, Artificial Sequence
  chemically synthesized
tctccatgcttcctgttcaacc

SEQ ID NO: 1277679 - DNA, 22 bp, Artificial Sequence
  chemically synthesized
aactatctccatgcttcctgtt

SEQ ID NO: 1277680 - DNA, 22 bp, Artificial Sequence
  chemically synthesized
agttgaactatctccatgcttc

SEQ ID NO: 1277681 - DNA, 22 bp, Artificial Sequence
  chemically synthesized
ggttgaacaggaagcatggaga

SEQ ID NO: 1277682 - DNA, 22 bp, Artificial Sequence
  chemically synthesized
caattcagttgaactatctcca

SEQ ID NO: 1277683 - DNA, 22 bp, Artificial Sequence
  chemically synthesized
aacaggaagcatggagatagtt

SEQ ID NO: 1277684 - DNA, 22 bp, Artificial Sequence
  chemically synthesized
ccaattcagttgaactatctcc

SEQ ID NO: 1277685 - DNA, 22 bp, Artificial Sequence
  chemically synthesized
caaccagcaacttccaattcag

SEQ ID NO: 1277686 - DNA, 22 bp, Artificial Sequence
  chemically synthesized
tacaaccagcaacttccaattc

SEQ ID NO: 1277687 - DNA, 22 bp, Artificial Sequence
  chemically synthesized
aactgaattggaagttgctggt

SEQ ID NO: 1277688 - DNA, 22 bp, Artificial Sequence
  chemically synthesized
aattggaagttgctggttgtag

SEQ ID NO: 1277689 - DNA, 22 bp, Artificial Sequence
  chemically synthesized
gaagttgctggttgtagaatat

SEQ ID NO: 1277690 - DNA, 22 bp, Artificial Sequence
  chemically synthesized
aagaatgcatagaaatattcta

SEQ ID NO: 1277691 - DNA, 22 bp, Artificial Sequence
  chemically synthesized
gaagaatgcatagaaatattct

SEQ ID NO: 1277692 - DNA, 22 bp, Artificial Sequence
  chemically synthesized
ctggttgtagaatatttctatg

SEQ ID NO: 1277693 - DNA, 22 bp, Artificial Sequence
  chemically synthesized
tcttgaagaatgcatagaaata

SEQ ID NO: 1277694 - DNA, 22 bp, Artificial Sequence
  chemically synthesized
gttgtagaatatttctatgcat

SEQ ID NO: 1277695 - DNA, 22 bp, Artificial Sequence
  chemically synthesized
tagaatatttctatgcattctt

SEQ ID NO: 1277696 - DNA, 22 bp, Artificial Sequence
  chemically synthesized
acatggcactgtcttgaagaat

SEQ ID NO: 1277697 - DNA, 22 bp, Artificial Sequence
  chemically synthesized
cacatggcactgtcttgaagaa

SEQ ID NO: 1277698 - DNA, 22 bp, Artificial Sequence
  chemically synthesized
ctatgcattcttcaagacagtg

SEQ ID NO: 1277699 - DNA, 22 bp, Artificial Sequence
  chemically synthesized
tatgcattcttcaagacagtgc

SEQ ID NO: 1277700 - DNA, 22 bp, Artificial Sequence
  chemically synthesized
tgcattcttcaagacagtgcca

SEQ ID NO: 1277701 - DNA, 22 bp, Artificial Sequence
  chemically synthesized
ttcaagacagtgccatgtgaag

SEQ ID NO: 1277702 - DNA, 22 bp, Artificial Sequence
  chemically synthesized
caagacagtgccatgtgaagcc

SEQ ID NO: 1277703 - DNA, 22 bp, Artificial Sequence
  chemically synthesized
aagacagtgccatgtgaagcct

SEQ ID NO: 1277704 - DNA, 22 bp, Artificial Sequence
  chemically synthesized
gacaggtcagaagaggcttcac

SEQ ID NO: 1277705 - DNA, 22 bp, Artificial Sequence
  chemically synthesized
actggacaggtcagaagaggct

SEQ ID NO: 1277706 - DNA, 22 bp, Artificial Sequence
  chemically synthesized
ttctgacctgtccagttagctt

SEQ ID NO: 1277707 - DNA, 22 bp, Artificial Sequence
  chemically synthesized
ctgacctgtccagttagctttt

SEQ ID NO: 1277708 - DNA, 22 bp, Artificial Sequence
  chemically synthesized
tgacctgtccagttagctttta

SEQ ID NO: 1277709 - DNA, 22 bp, Artificial Sequence
  chemically synthesized
acctgtccagttagcttttatt

SEQ ID NO: 1277710 - DNA, 22 bp, Artificial Sequence
  chemically synthesized
tcacaaaagagagagaaataaa

SEQ ID NO: 1277711 - DNA, 22 bp, Artificial Sequence
  chemically synthesized
tccagttagcttttatttctct

SEQ ID NO: 1277712 - DNA, 22 bp, Artificial Sequence
  chemically synthesized
gcttttatttctctctcttttg

SEQ ID NO: 1277713 - DNA, 22 bp, Artificial Sequence
  chemically synthesized
ttatttctctctcttttgtgac

SEQ ID NO: 1277714 - DNA, 22 bp, Artificial Sequence
  chemically synthesized
tatttctctctcttttgtgaca

SEQ ID NO: 1277715 - DNA, 22 bp, Artificial Sequence
  chemically synthesized
atttctctctcttttgtgacag

SEQ ID NO: 1277716 - DNA, 22 bp, Artificial Sequence
  chemically synthesized
tttctctctcttttgtgacagc

SEQ ID NO: 1277717 - DNA, 22 bp, Artificial Sequence
  chemically synthesized
ctctctcttttgtgacagcact

SEQ ID NO: 1277718 - DNA, 22 bp, Artificial Sequence
  chemically synthesized
tctctcttttgtgacagcactg

SEQ ID NO: 1277719 - DNA, 22 bp, Artificial Sequence
  chemically synthesized
tctcttttgtgacagcactgta

SEQ ID NO: 1277720 - DNA, 22 bp, Artificial Sequence
  chemically synthesized
tcttttgtgacagcactgtact

SEQ ID NO: 1277721 - DNA, 22 bp, Artificial Sequence
  chemically synthesized
ttttgtgacagcactgtacttt

SEQ ID NO: 1277722 - DNA, 22 bp, Artificial Sequence
  chemically synthesized
ttgtgacagcactgtactttgc

SEQ ID NO: 1277723 - DNA, 22 bp, Artificial Sequence
  chemically synthesized
tgtgacagcactgtactttgca

SEQ ID NO: 1277724 - DNA, 22 bp, Artificial Sequence
  chemically synthesized
gtgacagcactgtactttgcac

SEQ ID NO: 1277725 - DNA, 22 bp, Artificial Sequence
  chemically synthesized
tgacagcactgtactttgcaca

SEQ ID NO: 1277726 - DNA, 22 bp, Artificial Sequence
  chemically synthesized
tactttgcacatcttattgttt

SEQ ID NO: 1277727 - DNA, 22 bp, Artificial Sequence
  chemically synthesized
aaaagtgtgaagaatgaaacaa

SEQ ID NO: 1277728 - DNA, 22 bp, Artificial Sequence
  chemically synthesized
tgcacatcttattgtttcattc

SEQ ID NO: 1277729 - DNA, 22 bp, Artificial Sequence
  chemically synthesized
gcacatcttattgtttcattct

SEQ ID NO: 1277730 - DNA, 22 bp, Artificial Sequence
  chemically synthesized
cacatcttattgtttcattctt

SEQ ID NO: 1277731 - DNA, 22 bp, Artificial Sequence
  chemically synthesized
attgtttcattcttcacacttt

SEQ ID NO: 1277732 - DNA, 22 bp, Artificial Sequence
  chemically synthesized
ttgtttcattcttcacactttt

SEQ ID NO: 1277733 - DNA, 22 bp, Artificial Sequence
  chemically synthesized
tttcattcttcacacttttcag

SEQ ID NO: 1277734 - DNA, 22 bp, Artificial Sequence
  chemically synthesized
cattcttcacacttttcagtat

SEQ ID NO: 1277735 - DNA, 22 bp, Artificial Sequence
  chemically synthesized
attcttcacacttttcagtatt

SEQ ID NO: 1277736 - DNA, 22 bp, Artificial Sequence
  chemically synthesized
ttcacacttttcagtattatac

SEQ ID NO: 1277737 - DNA, 22 bp, Artificial Sequence
  chemically synthesized
gaagatagataagtataatact

SEQ ID NO: 1277738 - DNA, 22 bp, Artificial Sequence
  chemically synthesized
cacacttttcagtattatactt

SEQ ID NO: 1277739 - DNA, 22 bp, Artificial Sequence
  chemically synthesized
acacttttcagtattatactta

SEQ ID NO: 1277740 - DNA, 22 bp, Artificial Sequence
  chemically synthesized
ctggaagatagataagtataat

SEQ ID NO: 1277741 - DNA, 22 bp, Artificial Sequence
  chemically synthesized
actggaagatagataagtataa

SEQ ID NO: 1277742 - DNA, 22 bp, Artificial Sequence
  chemically synthesized
ttcagtattatacttatctatc

SEQ ID NO: 1277743 - DNA, 22 bp, Artificial Sequence
  chemically synthesized
tcagtattatacttatctatct

SEQ ID NO: 1277744 - DNA, 22 bp, Artificial Sequence
  chemically synthesized
cagtattatacttatctatctt

SEQ ID NO: 1277745 - DNA, 22 bp, Artificial Sequence
  chemically synthesized
agtattatacttatctatcttc

SEQ ID NO: 1277746 - DNA, 22 bp, Artificial Sequence
  chemically synthesized
agaagaatttactggaagatag

SEQ ID NO: 1277747 - DNA, 22 bp, Artificial Sequence
  chemically synthesized
ttaagaagaatttactggaaga

SEQ ID NO: 1277748 - DNA, 22 bp, Artificial Sequence
  chemically synthesized
tacttatctatcttccagtaaa

SEQ ID NO: 1277749 - DNA, 22 bp, Artificial Sequence
  chemically synthesized
atctatcttccagtaaattctt

SEQ ID NO: 1277750 - DNA, 22 bp, Artificial Sequence
  chemically synthesized
tctatcttccagtaaattcttc

SEQ ID NO: 1277751 - DNA, 22 bp, Artificial Sequence
  chemically synthesized
tcttccagtaaattcttcttaa

SEQ ID NO: 1277752 - DNA, 22 bp, Artificial Sequence
  chemically synthesized
ccagtaaattcttcttaacaga

SEQ ID NO: 1277753 - DNA, 22 bp, Artificial Sequence
  chemically synthesized
cagtaaattcttcttaacagac

SEQ ID NO: 1277754 - DNA, 22 bp, Artificial Sequence
  chemically synthesized
aagaaaatgatagtctgttaag

SEQ ID NO: 1277755 - DNA, 22 bp, Artificial Sequence
  chemically synthesized
tcaagaaaatgatagtctgtta

SEQ ID NO: 1277756 - DNA, 22 bp, Artificial Sequence
  chemically synthesized
ctctcaagaaaatgatagtctg

SEQ ID NO: 1277757 - DNA, 22 bp, Artificial Sequence
  chemically synthesized
gctctcaagaaaatgatagtct

SEQ ID NO: 1277758 - DNA, 22 bp, Artificial Sequence
  chemically synthesized
ttgctctcaagaaaatgatagt

SEQ ID NO: 1277759 - DNA, 22 bp, Artificial Sequence
  chemically synthesized
ttcttaacagactatcattttc

SEQ ID NO: 1277760 - DNA, 22 bp, Artificial Sequence
  chemically synthesized
cttaacagactatcattttctt

SEQ ID NO: 1277761 - DNA, 22 bp, Artificial Sequence
  chemically synthesized
ttaacagactatcattttcttg

SEQ ID NO: 1277762 - DNA, 22 bp, Artificial Sequence
  chemically synthesized
aacagactatcattttcttgag

SEQ ID NO: 1277763 - DNA, 22 bp, Artificial Sequence
  chemically synthesized
acagactatcattttcttgaga

SEQ ID NO: 1277764 - DNA, 22 bp, Artificial Sequence
  chemically synthesized
tcattttcttgagagcaagaat

SEQ ID NO: 1277765 - DNA, 22 bp, Artificial Sequence
  chemically synthesized
tcttgagagcaagaattgggtc

SEQ ID NO: 1277766 - DNA, 22 bp, Artificial Sequence
  chemically synthesized
cttgagagcaagaattgggtct

SEQ ID NO: 1277767 - DNA, 22 bp, Artificial Sequence
  chemically synthesized
ttgagagcaagaattgggtctt

SEQ ID NO: 1277768 - DNA, 22 bp, Artificial Sequence
  chemically synthesized
gagagcaagaattgggtcttcg

SEQ ID NO: 1277769 - DNA, 22 bp, Artificial Sequence
  chemically synthesized
agagcaagaattgggtcttcgt

SEQ ID NO: 1277770 - DNA, 22 bp, Artificial Sequence
  chemically synthesized
aaatacaaagatgaacgaagac

SEQ ID NO: 1277771 - DNA, 22 bp, Artificial Sequence
  chemically synthesized
catgcctaaaatacaaagatga

SEQ ID NO: 1277772 - DNA, 22 bp, Artificial Sequence
  chemically synthesized
ggtcttcgttcatctttgtatt

SEQ ID NO: 1277773 - DNA, 22 bp, Artificial Sequence
  chemically synthesized
tactccatgcctaaaatacaaa

SEQ ID NO: 1277774 - DNA, 22 bp, Artificial Sequence
  chemically synthesized
cgttcatctttgtattttaggc

SEQ ID NO: 1277775 - DNA, 22 bp, Artificial Sequence
  chemically synthesized
gttcatctttgtattttaggca

SEQ ID NO: 1277776 - DNA, 22 bp, Artificial Sequence
  chemically synthesized
gggactatactccatgcctaaa

SEQ ID NO: 1277777 - DNA, 22 bp, Artificial Sequence
  chemically synthesized
ggggactatactccatgcctaa

SEQ ID NO: 1277778 - DNA, 22 bp, Artificial Sequence
  chemically synthesized
atctttgtattttaggcatgga

SEQ ID NO: 1277779 - DNA, 22 bp, Artificial Sequence
  chemically synthesized
ttggggactatactccatgcct

SEQ ID NO: 1277780 - DNA, 22 bp, Artificial Sequence
  chemically synthesized
tgtattttaggcatggagtata

SEQ ID NO: 1277781 - DNA, 22 bp, Artificial Sequence
  chemically synthesized
gttcttggggactatactccat

SEQ ID NO: 1277782 - DNA, 22 bp, Artificial Sequence
  chemically synthesized
gtattttaggcatggagtatag

SEQ ID NO: 1277783 - DNA, 22 bp, Artificial Sequence
  chemically synthesized
tattttaggcatggagtatagt

SEQ ID NO: 1277784 - DNA, 22 bp, Artificial Sequence
  chemically synthesized
ctggttcttggggactatactc

SEQ ID NO: 1277785 - DNA, 22 bp, Artificial Sequence
  chemically synthesized
actggttcttggggactatact

SEQ ID NO: 1277786 - DNA, 22 bp, Artificial Sequence
  chemically synthesized
taggcatggagtatagtcccca

SEQ ID NO: 1277787 - DNA, 22 bp, Artificial Sequence
  chemically synthesized
aggcatggagtatagtccccaa

SEQ ID NO: 1277788 - DNA, 22 bp, Artificial Sequence
  chemically synthesized
ggcatggagtatagtccccaag

SEQ ID NO: 1277789 - DNA, 22 bp, Artificial Sequence
  chemically synthesized
atgaacacttactggttcttgg

SEQ ID NO: 1277790 - DNA, 22 bp, Artificial Sequence
  chemically synthesized
gatgaacacttactggttcttg

SEQ ID NO: 1277791 - DNA, 22 bp, Artificial Sequence
  chemically synthesized
aacagatgaacatttgatgaac

SEQ ID NO: 1277792 - DNA, 22 bp, Artificial Sequence
  chemically synthesized
attcaacagatgaacatttgat

SEQ ID NO: 1277793 - DNA, 22 bp, Artificial Sequence
  chemically synthesized
ttcattcaacagatgaacattt

SEQ ID NO: 1277794 - DNA, 22 bp, Artificial Sequence
  chemically synthesized
attcattcaacagatgaacatt

SEQ ID NO: 1277795 - DNA, 22 bp, Artificial Sequence
  chemically synthesized
atcaaatgttcatctgttgaat

SEQ ID NO: 1277796 - DNA, 22 bp, Artificial Sequence
  chemically synthesized
atctgttgaatgaataaatgac

SEQ ID NO: 1277797 - DNA, 22 bp, Artificial Sequence
  chemically synthesized
gcagcaatgcacacagtcattt

SEQ ID NO: 1277798 - DNA, 22 bp, Artificial Sequence
  chemically synthesized
ttgaatgaataaatgactgtgt

SEQ ID NO: 1277799 - DNA, 22 bp, Artificial Sequence
  chemically synthesized
aatgaataaatgactgtgtgca

SEQ ID NO: 1277800 - DNA, 22 bp, Artificial Sequence
  chemically synthesized
tgtgcattgctgctaatgatat

SEQ ID NO: 1277801 - DNA, 22 bp, Artificial Sequence
  chemically synthesized
aagaaaatggtgaagaatatca

SEQ ID NO: 1277802 - DNA, 22 bp, Artificial Sequence
  chemically synthesized
tgaagaaaatggtgaagaatat

SEQ ID NO: 1277803 - DNA, 22 bp, Artificial Sequence
  chemically synthesized
ctgctaatgatattcttcacca

SEQ ID NO: 1277804 - DNA, 22 bp, Artificial Sequence
  chemically synthesized
ctaatgatattcttcaccattt

SEQ ID NO: 1277805 - DNA, 22 bp, Artificial Sequence
  chemically synthesized
atgatattcttcaccattttct

SEQ ID NO: 1277806 - DNA, 22 bp, Artificial Sequence
  chemically synthesized
ttcaccattttcttcagaatct

SEQ ID NO: 1277807 - DNA, 22 bp, Artificial Sequence
  chemically synthesized
accagcataagcagattctgaa

SEQ ID NO: 1277808 - DNA, 22 bp, Artificial Sequence
  chemically synthesized
caccattttcttcagaatctgc

SEQ ID NO: 1277809 - DNA, 22 bp, Artificial Sequence
  chemically synthesized
accattttcttcagaatctgct

SEQ ID NO: 1277810 - DNA, 22 bp, Artificial Sequence
  chemically synthesized
atctgaccagcataagcagatt

SEQ ID NO: 1277811 - DNA, 22 bp, Artificial Sequence
  chemically synthesized
aatctgaccagcataagcagat

SEQ ID NO: 1277812 - DNA, 22 bp, Artificial Sequence
  chemically synthesized
tcttcagaatctgcttatgctg

SEQ ID NO: 1277813 - DNA, 22 bp, Artificial Sequence
  chemically synthesized
cttcagaatctgcttatgctgg

SEQ ID NO: 1277814 - DNA, 22 bp, Artificial Sequence
  chemically synthesized
ttcagaatctgcttatgctggt

SEQ ID NO: 1277815 - DNA, 22 bp, Artificial Sequence
  chemically synthesized
cagaatctgcttatgctggtca

SEQ ID NO: 1277816 - DNA, 22 bp, Artificial Sequence
  chemically synthesized
agaatctgcttatgctggtcag

SEQ ID NO: 1277817 - DNA, 22 bp, Artificial Sequence
  chemically synthesized
aagtaaagccatttaatctgac

SEQ ID NO: 1277818 - DNA, 22 bp, Artificial Sequence
  chemically synthesized
cttatgctggtcagattaaatg

SEQ ID NO: 1277819 - DNA, 22 bp, Artificial Sequence
  chemically synthesized
atgctggtcagattaaatggct

SEQ ID NO: 1277820 - DNA, 22 bp, Artificial Sequence
  chemically synthesized
tgctggtcagattaaatggctt

SEQ ID NO: 1277821 - DNA, 22 bp, Artificial Sequence
  chemically synthesized
gaaacagctcaagtaaagccat

SEQ ID NO: 1277822 - DNA, 22 bp, Artificial Sequence
  chemically synthesized
gtcagattaaatggctttactt

SEQ ID NO: 1277823 - DNA, 22 bp, Artificial Sequence
  chemically synthesized
aaagttggaaacagctcaagta

SEQ ID NO: 1277824 - DNA, 22 bp, Artificial Sequence
  chemically synthesized
gaaagttggaaacagctcaagt

SEQ ID NO: 1277825 - DNA, 22 bp, Artificial Sequence
  chemically synthesized
aatggctttacttgagctgttt

SEQ ID NO: 1277826 - DNA, 22 bp, Artificial Sequence
  chemically synthesized
tttgaaagttggaaacagctca

SEQ ID NO: 1277827 - DNA, 22 bp, Artificial Sequence
  chemically synthesized
tacttgagctgtttccaacttt

SEQ ID NO: 1277828 - DNA, 22 bp, Artificial Sequence
  chemically synthesized
acttgagctgtttccaactttc

SEQ ID NO: 1277829 - DNA, 22 bp, Artificial Sequence
  chemically synthesized
cttgagctgtttccaactttca

SEQ ID NO: 1277830 - DNA, 22 bp, Artificial Sequence
  chemically synthesized
gagctgtttccaactttcaaac

SEQ ID NO: 1277831 - DNA, 22 bp, Artificial Sequence
  chemically synthesized
agctgtttccaactttcaaaca

SEQ ID NO: 1277832 - DNA, 22 bp, Artificial Sequence
  chemically synthesized
tttccaactttcaaacagattt

SEQ ID NO: 1277833 - DNA, 22 bp, Artificial Sequence
  chemically synthesized
ccaactttcaaacagatttttt

SEQ ID NO: 1277834 - DNA, 22 bp, Artificial Sequence
  chemically synthesized
tcagaaaaaaaaaaaaaatctg

SEQ ID NO: 1277835 - DNA, 22 bp, Artificial Sequence
  chemically synthesized
caactttcaaacagattttttt

SEQ ID NO: 1277836 - DNA, 22 bp, Artificial Sequence
  chemically synthesized
tcaaacagattttttttttttt

SEQ ID NO: 1277837 - DNA, 22 bp, Artificial Sequence
  chemically synthesized
caaacagatttttttttttttt

SEQ ID NO: 1277838 - DNA, 22 bp, Artificial Sequence
  chemically synthesized
aatcactgtcagaaaaaaaaaa

SEQ ID NO: 1277839 - DNA, 22 bp, Artificial Sequence
  chemically synthesized
aaacagattttttttttttttc

SEQ ID NO: 1277840 - DNA, 22 bp, Artificial Sequence
  chemically synthesized
agtggtgttaaatcactgtcag

SEQ ID NO: 1277841 - DNA, 22 bp, Artificial Sequence
  chemically synthesized
tttttttttttctgacagtgat

SEQ ID NO: 1277842 - DNA, 22 bp, Artificial Sequence
  chemically synthesized
cagtggtgttaaatcactgtca

SEQ ID NO: 1277843 - DNA, 22 bp, Artificial Sequence
  chemically synthesized
ttttttttttctgacagtgatt

SEQ ID NO: 1277844 - DNA, 22 bp, Artificial Sequence
  chemically synthesized
tcagtggtgttaaatcactgtc

SEQ ID NO: 1277845 - DNA, 22 bp, Artificial Sequence
  chemically synthesized
tttttttttctgacagtgattt

SEQ ID NO: 1277846 - DNA, 22 bp, Artificial Sequence
  chemically synthesized
ttttttttctgacagtgattta

SEQ ID NO: 1277847 - DNA, 22 bp, Artificial Sequence
  chemically synthesized
tttttttctgacagtgatttaa

SEQ ID NO: 1277848 - DNA, 22 bp, Artificial Sequence
  chemically synthesized
ttttttctgacagtgatttaac

SEQ ID NO: 1277849 - DNA, 22 bp, Artificial Sequence
  chemically synthesized
tttttctgacagtgatttaaca

SEQ ID NO: 1277850 - DNA, 22 bp, Artificial Sequence
  chemically synthesized
ttttctgacagtgatttaacac

SEQ ID NO: 1277851 - DNA, 22 bp, Artificial Sequence
  chemically synthesized
tttctgacagtgatttaacacc

SEQ ID NO: 1277852 - DNA, 22 bp, Artificial Sequence
  chemically synthesized
aaaactttcagtggtgttaaat

SEQ ID NO: 1277853 - DNA, 22 bp, Artificial Sequence
  chemically synthesized
ttctgacagtgatttaacacca

SEQ ID NO: 1277854 - DNA, 22 bp, Artificial Sequence
  chemically synthesized
tctgacagtgatttaacaccac

SEQ ID NO: 1277855 - DNA, 22 bp, Artificial Sequence
  chemically synthesized
ctgacagtgatttaacaccact

SEQ ID NO: 1277856 - DNA, 22 bp, Artificial Sequence
  chemically synthesized
tgacagtgatttaacaccactg

SEQ ID NO: 1277857 - DNA, 22 bp, Artificial Sequence
  chemically synthesized
acagtgatttaacaccactgaa

SEQ ID NO: 1277858 - DNA, 22 bp, Artificial Sequence
  chemically synthesized
gaaggtaactgaaaactttcag

SEQ ID NO: 1277859 - DNA, 22 bp, Artificial Sequence
  chemically synthesized
aacaccactgaaagttttcagt

SEQ ID NO: 1277860 - DNA, 22 bp, Artificial Sequence
  chemically synthesized
acaccactgaaagttttcagtt

SEQ ID NO: 1277861 - DNA, 22 bp, Artificial Sequence
  chemically synthesized
aaacaactggaaggtaactgaa

SEQ ID NO: 1277862 - DNA, 22 bp, Artificial Sequence
  chemically synthesized
aaaacaactggaaggtaactga

SEQ ID NO: 1277863 - DNA, 22 bp, Artificial Sequence
  chemically synthesized
taaaacaactggaaggtaactg

SEQ ID NO: 1277864 - DNA, 22 bp, Artificial Sequence
  chemically synthesized
aaagttttcagttaccttccag

SEQ ID NO: 1277865 - DNA, 22 bp, Artificial Sequence
  chemically synthesized
atgttttaaaacaactggaagg

SEQ ID NO: 1277866 - DNA, 22 bp, Artificial Sequence
  chemically synthesized
catgttttaaaacaactggaag

SEQ ID NO: 1277867 - DNA, 22 bp, Artificial Sequence
  chemically synthesized
tttcatgttttaaaacaactgg

SEQ ID NO: 1277868 - DNA, 22 bp, Artificial Sequence
  chemically synthesized
tcagttaccttccagttgtttt

SEQ ID NO: 1277869 - DNA, 22 bp, Artificial Sequence
  chemically synthesized
cagttaccttccagttgtttta

SEQ ID NO: 1277870 - DNA, 22 bp, Artificial Sequence
  chemically synthesized
agttaccttccagttgttttaa

SEQ ID NO: 1277871 - DNA, 22 bp, Artificial Sequence
  chemically synthesized
ccttccagttgttttaaaacat

SEQ ID NO: 1277872 - DNA, 22 bp, Artificial Sequence
  chemically synthesized
ccagttgttttaaaacatgaaa

SEQ ID NO: 1277873 - DNA, 22 bp, Artificial Sequence
  chemically synthesized
cagttgttttaaaacatgaaat

SEQ ID NO: 1277874 - DNA, 22 bp, Artificial Sequence
  chemically synthesized
accagaaatagctatttcatgt

SEQ ID NO: 1277875 - DNA, 22 bp, Artificial Sequence
  chemically synthesized
caccagaaatagctatttcatg

SEQ ID NO: 1277876 - DNA, 22 bp, Artificial Sequence
  chemically synthesized
tcaccagaaatagctatttcat

SEQ ID NO: 1277877 - DNA, 22 bp, Artificial Sequence
  chemically synthesized
ttttaaaacatgaaatagctat

SEQ ID NO: 1277878 - DNA, 22 bp, Artificial Sequence
  chemically synthesized
ctttcaccagaaatagctattt

SEQ ID NO: 1277879 - DNA, 22 bp, Artificial Sequence
  chemically synthesized
cctttcaccagaaatagctatt

SEQ ID NO: 1277880 - DNA, 22 bp, Artificial Sequence
  chemically synthesized
taaaacatgaaatagctatttc

SEQ ID NO: 1277881 - DNA, 22 bp, Artificial Sequence
  chemically synthesized
aaaacatgaaatagctatttct

SEQ ID NO: 1277882 - DNA, 22 bp, Artificial Sequence
  chemically synthesized
tttcctttcaccagaaatagct

SEQ ID NO: 1277883 - DNA, 22 bp, Artificial Sequence
  chemically synthesized
aaacatgaaatagctatttctg

SEQ ID NO: 1277884 - DNA, 22 bp, Artificial Sequence
  chemically synthesized
atttcctttcaccagaaatagc

SEQ ID NO: 1277885 - DNA, 22 bp, Artificial Sequence
  chemically synthesized
tatttcctttcaccagaaatag

SEQ ID NO: 1277886 - DNA, 22 bp, Artificial Sequence
  chemically synthesized
ctttatttcctttcaccagaaa

SEQ ID NO: 1277887 - DNA, 22 bp, Artificial Sequence
  chemically synthesized
tcctttatttcctttcaccaga

SEQ ID NO: 1277888 - DNA, 22 bp, Artificial Sequence
  chemically synthesized
ctcctttatttcctttcaccag

SEQ ID NO: 1277889 - DNA, 22 bp, Artificial Sequence
  chemically synthesized
ttctcctttatttcctttcacc

SEQ ID NO: 1277890 - DNA, 22 bp, Artificial Sequence
  chemically synthesized
tctcttctcctttatttccttt

SEQ ID NO: 1277891 - DNA, 22 bp, Artificial Sequence
  chemically synthesized
tttctggtgaaaggaaataaag

SEQ ID NO: 1277892 - DNA, 22 bp, Artificial Sequence
  chemically synthesized
ctggtgaaaggaaataaaggag

SEQ ID NO: 1277893 - DNA, 22 bp, Artificial Sequence
  chemically synthesized
tggtgaaaggaaataaaggaga

SEQ ID NO: 1277894 - DNA, 22 bp, Artificial Sequence
  chemically synthesized
gtgaaaggaaataaaggagaag

SEQ ID NO: 1277895 - DNA, 22 bp, Artificial Sequence
  chemically synthesized
aagtgagaactatctcttctcc

SEQ ID NO: 1277896 - DNA, 22 bp, Artificial Sequence
  chemically synthesized
aaattgaagtgagaactatctc

SEQ ID NO: 1277897 - DNA, 22 bp, Artificial Sequence
  chemically synthesized
aaaactcaaattgaagtgagaa

SEQ ID NO: 1277898 - DNA, 22 bp, Artificial Sequence
  chemically synthesized
tcaaaactcaaattgaagtgag

SEQ ID NO: 1277899 - DNA, 22 bp, Artificial Sequence
  chemically synthesized
gatcctctcaaaactcaaattg

SEQ ID NO: 1277900 - DNA, 22 bp, Artificial Sequence
  chemically synthesized
tcacttcaatttgagttttgag

SEQ ID NO: 1277901 - DNA, 22 bp, Artificial Sequence
  chemically synthesized
acttcaatttgagttttgagag

SEQ ID NO: 1277902 - DNA, 22 bp, Artificial Sequence
  chemically synthesized
aagcaattcgatcctctcaaaa

SEQ ID NO: 1277903 - DNA, 22 bp, Artificial Sequence
  chemically synthesized
caatttgagttttgagaggatc

SEQ ID NO: 1277904 - DNA, 22 bp, Artificial Sequence
  chemically synthesized
aatttgagttttgagaggatcg

SEQ ID NO: 1277905 - DNA, 22 bp, Artificial Sequence
  chemically synthesized
ggctgaagcaattcgatcctct

SEQ ID NO: 1277906 - DNA, 22 bp, Artificial Sequence
  chemically synthesized
gggctgaagcaattcgatcctc

SEQ ID NO: 1277907 - DNA, 22 bp, Artificial Sequence
  chemically synthesized
gagttttgagaggatcgaattg

SEQ ID NO: 1277908 - DNA, 22 bp, Artificial Sequence
  chemically synthesized
agttttgagaggatcgaattgc

SEQ ID NO: 1277909 - DNA, 22 bp, Artificial Sequence
  chemically synthesized
accccttgggctgaagcaattc

SEQ ID NO: 1277910 - DNA, 22 bp, Artificial Sequence
  chemically synthesized
tgagaggatcgaattgcttcag

SEQ ID NO: 1277911 - DNA, 22 bp, Artificial Sequence
  chemically synthesized
gagaggatcgaattgcttcagc

SEQ ID NO: 1277912 - DNA, 22 bp, Artificial Sequence
  chemically synthesized
agaggatcgaattgcttcagcc

SEQ ID NO: 1277913 - DNA, 22 bp, Artificial Sequence
  chemically synthesized
tcagtattgaccccttgggctg

SEQ ID NO: 1277914 - DNA, 22 bp, Artificial Sequence
  chemically synthesized
cttcagcccaaggggtcaatac

SEQ ID NO: 1277915 - DNA, 22 bp, Artificial Sequence
  chemically synthesized
gggatgacctgtcagtattgac

SEQ ID NO: 1277916 - DNA, 22 bp, Artificial Sequence
  chemically synthesized
cagcccaaggggtcaatactga

SEQ ID NO: 1277917 - DNA, 22 bp, Artificial Sequence
  chemically synthesized
agcccaaggggtcaatactgac

SEQ ID NO: 1277918 - DNA, 22 bp, Artificial Sequence
  chemically synthesized
ctagggatgacctgtcagtatt

SEQ ID NO: 1277919 - DNA, 22 bp, Artificial Sequence
  chemically synthesized
cagctgctagggatgacctgtc

SEQ ID NO: 1277920 - DNA, 22 bp, Artificial Sequence
  chemically synthesized
tccagctgctagggatgacctg

SEQ ID NO: 1277921 - DNA, 22 bp, Artificial Sequence
  chemically synthesized
acatactctccagctgctaggg

SEQ ID NO: 1277922 - DNA, 22 bp, Artificial Sequence
  chemically synthesized
gacatactctccagctgctagg

SEQ ID NO: 1277923 - DNA, 22 bp, Artificial Sequence
  chemically synthesized
acaggtcatccctagcagctgg

SEQ ID NO: 1277924 - DNA, 22 bp, Artificial Sequence
  chemically synthesized
tcttgacatactctccagctgc

SEQ ID NO: 1277925 - DNA, 22 bp, Artificial Sequence
  chemically synthesized
gagtattatcttgacatactct

SEQ ID NO: 1277926 - DNA, 22 bp, Artificial Sequence
  chemically synthesized
ggagtattatcttgacatactc

SEQ ID NO: 1277927 - DNA, 22 bp, Artificial Sequence
  chemically synthesized
tggagtattatcttgacatact

SEQ ID NO: 1277928 - DNA, 22 bp, Artificial Sequence
  chemically synthesized
ttggagtattatcttgacatac

SEQ ID NO: 1277929 - DNA, 22 bp, Artificial Sequence
  chemically synthesized
gcagctggagagtatgtcaaga

SEQ ID NO: 1277930 - DNA, 22 bp, Artificial Sequence
  chemically synthesized
gagagtatgtcaagataatact

SEQ ID NO: 1277931 - DNA, 22 bp, Artificial Sequence
  chemically synthesized
tagcaaatgaaggataaaaata

SEQ ID NO: 1277932 - DNA, 22 bp, Artificial Sequence
  chemically synthesized
gtagcaaatgaaggataaaaat

SEQ ID NO: 1277933 - DNA, 22 bp, Artificial Sequence
  chemically synthesized
tgtagcaaatgaaggataaaaa

SEQ ID NO: 1277934 - DNA, 22 bp, Artificial Sequence
  chemically synthesized
caaaagatatttttatccttca

SEQ ID NO: 1277935 - DNA, 22 bp, Artificial Sequence
  chemically synthesized
tctttgtagcaaatgaaggata

SEQ ID NO: 1277936 - DNA, 22 bp, Artificial Sequence
  chemically synthesized
atctttgtagcaaatgaaggat

SEQ ID NO: 1277937 - DNA, 22 bp, Artificial Sequence
  chemically synthesized
tttatctttgtagcaaatgaag

SEQ ID NO: 1277938 - DNA, 22 bp, Artificial Sequence
  chemically synthesized
atttatctttgtagcaaatgaa

SEQ ID NO: 1277939 - DNA, 22 bp, Artificial Sequence
  chemically synthesized
ttatccttcatttgctacaaag

SEQ ID NO: 1277940 - DNA, 22 bp, Artificial Sequence
  chemically synthesized
tatccttcatttgctacaaaga

SEQ ID NO: 1277941 - DNA, 22 bp, Artificial Sequence
  chemically synthesized
atccttcatttgctacaaagat

SEQ ID NO: 1277942 - DNA, 22 bp, Artificial Sequence
  chemically synthesized
tccttcatttgctacaaagata

SEQ ID NO: 1277943 - DNA, 22 bp, Artificial Sequence
  chemically synthesized
tatatatgcatttatttatctt

SEQ ID NO: 1277944 - DNA, 22 bp, Artificial Sequence
  chemically synthesized
catttgctacaaagataaataa

SEQ ID NO: 1277945 - DNA, 22 bp, Artificial Sequence
  chemically synthesized
gtatatatgcatttatttatct

SEQ ID NO: 1277946 - DNA, 22 bp, Artificial Sequence
  chemically synthesized
atttgctacaaagataaataaa

SEQ ID NO: 1277947 - DNA, 22 bp, Artificial Sequence
  chemically synthesized
tgtatatatgcatttatttatc

SEQ ID NO: 1277948 - DNA, 22 bp, Artificial Sequence
  chemically synthesized
gctacaaagataaataaatgca

SEQ ID NO: 1277949 - DNA, 22 bp, Artificial Sequence
  chemically synthesized
actttgtatatatgcatttatt

SEQ ID NO: 1277950 - DNA, 22 bp, Artificial Sequence
  chemically synthesized
ctacaaagataaataaatgcat

SEQ ID NO: 1277951 - DNA, 22 bp, Artificial Sequence
  chemically synthesized
ttcactttgtatatatgcattt

SEQ ID NO: 1277952 - DNA, 22 bp, Artificial Sequence
  chemically synthesized
caaagataaataaatgcatata

SEQ ID NO: 1277953 - DNA, 22 bp, Artificial Sequence
  chemically synthesized
gttcactttgtatatatgcatt

SEQ ID NO: 1277954 - DNA, 22 bp, Artificial Sequence
  chemically synthesized
tgttcactttgtatatatgcat

SEQ ID NO: 1277955 - DNA, 22 bp, Artificial Sequence
  chemically synthesized
ttgttcactttgtatatatgca

SEQ ID NO: 1277956 - DNA, 22 bp, Artificial Sequence
  chemically synthesized
aaagcttttgttcactttgtat

SEQ ID NO: 1277957 - DNA, 22 bp, Artificial Sequence
  chemically synthesized
caaagcttttgttcactttgta

SEQ ID NO: 1277958 - DNA, 22 bp, Artificial Sequence
  chemically synthesized
tcaaagcttttgttcactttgt

SEQ ID NO: 1277959 - DNA, 22 bp, Artificial Sequence
  chemically synthesized
ttttcaaagcttttgttcactt

SEQ ID NO: 1277960 - DNA, 22 bp, Artificial Sequence
  chemically synthesized
ctattttcaaagcttttgttca

SEQ ID NO: 1277961 - DNA, 22 bp, Artificial Sequence
  chemically synthesized
actattttcaaagcttttgttc

SEQ ID NO: 1277962 - DNA, 22 bp, Artificial Sequence
  chemically synthesized
tactattttcaaagcttttgtt

SEQ ID NO: 1277963 - DNA, 22 bp, Artificial Sequence
  chemically synthesized
acattttactattttcaaagct

SEQ ID NO: 1277964 - DNA, 22 bp, Artificial Sequence
  chemically synthesized
tgttaacattttactattttca

SEQ ID NO: 1277965 - DNA, 22 bp, Artificial Sequence
  chemically synthesized
tcctatgttaacattttactat

SEQ ID NO: 1277966 - DNA, 22 bp, Artificial Sequence
  chemically synthesized
tactatcctatgttaacatttt

SEQ ID NO: 1277967 - DNA, 22 bp, Artificial Sequence
  chemically synthesized
tgaaaatagtaaaatgttaaca

SEQ ID NO: 1277968 - DNA, 22 bp, Artificial Sequence
  chemically synthesized
gaaaatagtaaaatgttaacat

SEQ ID NO: 1277969 - DNA, 22 bp, Artificial Sequence
  chemically synthesized
aaaatagtaaaatgttaacata

SEQ ID NO: 1277970 - DNA, 22 bp, Artificial Sequence
  chemically synthesized
aataacagtgactatactatcc

SEQ ID NO: 1277971 - DNA, 22 bp, Artificial Sequence
  chemically synthesized
attcaataacagtgactatact

SEQ ID NO: 1277972 - DNA, 22 bp, Artificial Sequence
  chemically synthesized
acataggatagtatagtcactg

SEQ ID NO: 1277973 - DNA, 22 bp, Artificial Sequence
  chemically synthesized
ggtggacacaaacattcattca

SEQ ID NO: 1277974 - DNA, 22 bp, Artificial Sequence
  chemically synthesized
gggtggacacaaacattcattc

SEQ ID NO: 1277975 - DNA, 22 bp, Artificial Sequence
  chemically synthesized
tgggtggacacaaacattcatt

SEQ ID NO: 1277976 - DNA, 22 bp, Artificial Sequence
  chemically synthesized
ttattgaatgaatgtttgtgtc

SEQ ID NO: 1277977 - DNA, 22 bp, Artificial Sequence
  chemically synthesized
ttgaatgaatgtttgtgtccac

SEQ ID NO: 1277978 - DNA, 22 bp, Artificial Sequence
  chemically synthesized
aatgaatgtttgtgtccaccca

SEQ ID NO: 1277979 - DNA, 22 bp, Artificial Sequence
  chemically synthesized
aacatatgaattttgggtggac

SEQ ID NO: 1277980 - DNA, 22 bp, Artificial Sequence
  chemically synthesized
caacatatgaattttgggtgga

SEQ ID NO: 1277981 - DNA, 22 bp, Artificial Sequence
  chemically synthesized
ggatttcaacatatgaattttg

SEQ ID NO: 1277982 - DNA, 22 bp, Artificial Sequence
  chemically synthesized
gtgtccacccaaaattcatatg

SEQ ID NO: 1277983 - DNA, 22 bp, Artificial Sequence
  chemically synthesized
tgtccacccaaaattcatatgt

SEQ ID NO: 1277984 - DNA, 22 bp, Artificial Sequence
  chemically synthesized
ggagttaggatttcaacatatg

SEQ ID NO: 1277985 - DNA, 22 bp, Artificial Sequence
  chemically synthesized
gggagttaggatttcaacatat

SEQ ID NO: 1277986 - DNA, 22 bp, Artificial Sequence
  chemically synthesized
tgggagttaggatttcaacata

SEQ ID NO: 1277987 - DNA, 22 bp, Artificial Sequence
  chemically synthesized
tcactttgggagttaggatttc

SEQ ID NO: 1277988 - DNA, 22 bp, Artificial Sequence
  chemically synthesized
atatgttgaaatcctaactccc

SEQ ID NO: 1277989 - DNA, 22 bp, Artificial Sequence
  chemically synthesized
atactatcactttgggagttag

SEQ ID NO: 1277990 - DNA, 22 bp, Artificial Sequence
  chemically synthesized
ctaatactatcactttgggagt

SEQ ID NO: 1277991 - DNA, 22 bp, Artificial Sequence
  chemically synthesized
aaatcctaactcccaaagtgat

SEQ ID NO: 1277992 - DNA, 22 bp, Artificial Sequence
  chemically synthesized
actcccaaagtgatagtattag

SEQ ID NO: 1277993 - DNA, 22 bp, Artificial Sequence
  chemically synthesized
ccaaagtgatagtattaggaga

SEQ ID NO: 1277994 - DNA, 22 bp, Artificial Sequence
  chemically synthesized
ccaaaaagccccaaacccatct

SEQ ID NO: 1277995 - DNA, 22 bp, Artificial Sequence
  chemically synthesized
atcacctcccaaaaagccccaa

SEQ ID NO: 1277996 - DNA, 22 bp, Artificial Sequence
  chemically synthesized
ggagatgggtttggggcttttt

SEQ ID NO: 1277997 - DNA, 22 bp, Artificial Sequence
  chemically synthesized
gtgacctaatcacctcccaaaa

SEQ ID NO: 1277998 - DNA, 22 bp, Artificial Sequence
  chemically synthesized
ggggctttttgggaggtgatta

SEQ ID NO: 1277999 - DNA, 22 bp, Artificial Sequence
  chemically synthesized
gggctttttgggaggtgattag

SEQ ID NO: 1278000 - DNA, 22 bp, Artificial Sequence
  chemically synthesized
catcctcgtgacctaatcacct

SEQ ID NO: 1278001 - DNA, 22 bp, Artificial Sequence
  chemically synthesized
tttgggaggtgattaggtcacg

SEQ ID NO: 1278002 - DNA, 22 bp, Artificial Sequence
  chemically synthesized
ttgggaggtgattaggtcacga

SEQ ID NO: 1278003 - DNA, 22 bp, Artificial Sequence
  chemically synthesized
tgggaggtgattaggtcacgag

SEQ ID NO: 1278004 - DNA, 22 bp, Artificial Sequence
  chemically synthesized
gggaggtgattaggtcacgagg

SEQ ID NO: 1278005 - DNA, 22 bp, Artificial Sequence
  chemically synthesized
ggaggtgattaggtcacgagga

SEQ ID NO: 1278006 - DNA, 22 bp, Artificial Sequence
  chemically synthesized
caataatgagagctccatcctc

SEQ ID NO: 1278007 - DNA, 22 bp, Artificial Sequence
  chemically synthesized
attccaataatgagagctccat

SEQ ID NO: 1278008 - DNA, 22 bp, Artificial Sequence
  chemically synthesized
ggtcacgaggatggagctctca

SEQ ID NO: 1278009 - DNA, 22 bp, Artificial Sequence
  chemically synthesized
cgaggcaactaattccaataat

SEQ ID NO: 1278010 - DNA, 22 bp, Artificial Sequence
  chemically synthesized
acgaggcaactaattccaataa

SEQ ID NO: 1278011 - DNA, 22 bp, Artificial Sequence
  chemically synthesized
tacgaggcaactaattccaata

SEQ ID NO: 1278012 - DNA, 22 bp, Artificial Sequence
  chemically synthesized
ttacgaggcaactaattccaat

SEQ ID NO: 1278013 - DNA, 22 bp, Artificial Sequence
  chemically synthesized
ttttacgaggcaactaattcca

SEQ ID NO: 1278014 - DNA, 22 bp, Artificial Sequence
  chemically synthesized
tcttttacgaggcaactaattc

SEQ ID NO: 1278015 - DNA, 22 bp, Artificial Sequence
  chemically synthesized
tcattattggaattagttgcct

SEQ ID NO: 1278016 - DNA, 22 bp, Artificial Sequence
  chemically synthesized
attattggaattagttgcctcg

SEQ ID NO: 1278017 - DNA, 22 bp, Artificial Sequence
  chemically synthesized
taggttctcttttacgaggcaa

SEQ ID NO: 1278018 - DNA, 22 bp, Artificial Sequence
  chemically synthesized
ttggaattagttgcctcgtaaa

SEQ ID NO: 1278019 - DNA, 22 bp, Artificial Sequence
  chemically synthesized
gaattagttgcctcgtaaaaga

SEQ ID NO: 1278020 - DNA, 22 bp, Artificial Sequence
  chemically synthesized
gcctgtaggttctcttttacga

SEQ ID NO: 1278021 - DNA, 22 bp, Artificial Sequence
  chemically synthesized
gttgcctcgtaaaagagaacct

SEQ ID NO: 1278022 - DNA, 22 bp, Artificial Sequence
  chemically synthesized
cctcgtaaaagagaacctacag

SEQ ID NO: 1278023 - DNA, 22 bp, Artificial Sequence
  chemically synthesized
gtaaaagagaacctacaggcca

SEQ ID NO: 1278024 - DNA, 22 bp, Artificial Sequence
  chemically synthesized
caggtgtgagccaccgcgcctg

SEQ ID NO: 1278025 - DNA, 22 bp, Artificial Sequence
  chemically synthesized
ggattacaggtgtgagccaccg

SEQ ID NO: 1278026 - DNA, 22 bp, Artificial Sequence
  chemically synthesized
caggccaggcgcggtggctcac

SEQ ID NO: 1278027 - DNA, 22 bp, Artificial Sequence
  chemically synthesized
ccaaagtgctgggattacaggt

SEQ ID NO: 1278028 - DNA, 22 bp, Artificial Sequence
  chemically synthesized
gcctcccaaagtgctgggatta

SEQ ID NO: 1278029 - DNA, 22 bp, Artificial Sequence
  chemically synthesized
acacctgtaatcccagcacttt

SEQ ID NO: 1278030 - DNA, 22 bp, Artificial Sequence
  chemically synthesized
taatcccagcactttgggaggc

SEQ ID NO: 1278031 - DNA, 22 bp, Artificial Sequence
  chemically synthesized
gtgatccacccaccctggcctc

SEQ ID NO: 1278032 - DNA, 22 bp, Artificial Sequence
  chemically synthesized
acctcgtgatccacccaccctg

SEQ ID NO: 1278033 - DNA, 22 bp, Artificial Sequence
  chemically synthesized
ctgacctcgtgatccacccacc

SEQ ID NO: 1278034 - DNA, 22 bp, Artificial Sequence
  chemically synthesized
tgggaggccagggtgggtggat

SEQ ID NO: 1278035 - DNA, 22 bp, Artificial Sequence
  chemically synthesized
gggaggccagggtgggtggatc

SEQ ID NO: 1278036 - DNA, 22 bp, Artificial Sequence
  chemically synthesized
ggaggccagggtgggtggatca

SEQ ID NO: 1278037 - DNA, 22 bp, Artificial Sequence
  chemically synthesized
aactcctgacctcgtgatccac

SEQ ID NO: 1278038 - DNA, 22 bp, Artificial Sequence
  chemically synthesized
gaactcctgacctcgtgatcca

SEQ ID NO: 1278039 - DNA, 22 bp, Artificial Sequence
  chemically synthesized
gtcttgaactcctgacctcgtg

SEQ ID NO: 1278040 - DNA, 22 bp, Artificial Sequence
  chemically synthesized
gccaggctggtcttgaactcct

SEQ ID NO: 1278041 - DNA, 22 bp, Artificial Sequence
  chemically synthesized
ggccaggctggtcttgaactcc

SEQ ID NO: 1278042 - DNA, 22 bp, Artificial Sequence
  chemically synthesized
tggccaggctggtcttgaactc

SEQ ID NO: 1278043 - DNA, 22 bp, Artificial Sequence
  chemically synthesized
accattttggccaggctggtct

SEQ ID NO: 1278044 - DNA, 22 bp, Artificial Sequence
  chemically synthesized
caccattttggccaggctggtc

SEQ ID NO: 1278045 - DNA, 22 bp, Artificial Sequence
  chemically synthesized
aagaccagcctggccaaaatgg

SEQ ID NO: 1278046 - DNA, 22 bp, Artificial Sequence
  chemically synthesized
gtagaggtggggtttcaccatt

SEQ ID NO: 1278047 - DNA, 22 bp, Artificial Sequence
  chemically synthesized
agtagaggtggggtttcaccat

SEQ ID NO: 1278048 - DNA, 22 bp, Artificial Sequence
  chemically synthesized
tagtagaggtggggtttcacca

SEQ ID NO: 1278049 - DNA, 22 bp, Artificial Sequence
  chemically synthesized
ttagtagaggtggggtttcacc

SEQ ID NO: 1278050 - DNA, 22 bp, Artificial Sequence
  chemically synthesized
gccaaaatggtgaaaccccacc

SEQ ID NO: 1278051 - DNA, 22 bp, Artificial Sequence
  chemically synthesized
tatttttagtagaggtggggtt

SEQ ID NO: 1278052 - DNA, 22 bp, Artificial Sequence
  chemically synthesized
gtatttttagtagaggtggggt

SEQ ID NO: 1278053 - DNA, 22 bp, Artificial Sequence
  chemically synthesized
tgtatttttagtagaggtgggg

SEQ ID NO: 1278054 - DNA, 22 bp, Artificial Sequence
  chemically synthesized
ttgtatttttagtagaggtggg

SEQ ID NO: 1278055 - DNA, 22 bp, Artificial Sequence
  chemically synthesized
tttgtatttttagtagaggtgg

SEQ ID NO: 1278056 - DNA, 22 bp, Artificial Sequence
  chemically synthesized
attttttgtatttttagtagag

SEQ ID NO: 1278057 - DNA, 22 bp, Artificial Sequence
  chemically synthesized
gctaattttttgtatttttagt

SEQ ID NO: 1278058 - DNA, 22 bp, Artificial Sequence
  chemically synthesized
tactaaaaatacaaaaaattag

SEQ ID NO: 1278059 - DNA, 22 bp, Artificial Sequence
  chemically synthesized
ctaaaaatacaaaaaattagcc

SEQ ID NO: 1278060 - DNA, 22 bp, Artificial Sequence
  chemically synthesized
aaaatacaaaaaattagccagg

SEQ ID NO: 1278061 - DNA, 22 bp, Artificial Sequence
  chemically synthesized
taggcacccaccaccacgcctg

SEQ ID NO: 1278062 - DNA, 22 bp, Artificial Sequence
  chemically synthesized
ggattataggcacccaccacca

SEQ ID NO: 1278063 - DNA, 22 bp, Artificial Sequence
  chemically synthesized
gccaggcgtggtggtgggtgcc

SEQ ID NO: 1278064 - DNA, 22 bp, Artificial Sequence
  chemically synthesized
ccaagtagctgggattataggc

SEQ ID NO: 1278065 - DNA, 22 bp, Artificial Sequence
  chemically synthesized
agcctcccaagtagctgggatt

SEQ ID NO: 1278066 - DNA, 22 bp, Artificial Sequence
  chemically synthesized
cctcagcctcccaagtagctgg

SEQ ID NO: 1278067 - DNA, 22 bp, Artificial Sequence
  chemically synthesized
tgcctcagcctcccaagtagct

SEQ ID NO: 1278068 - DNA, 22 bp, Artificial Sequence
  chemically synthesized
tctgcctcagcctcccaagtag

SEQ ID NO: 1278069 - DNA, 22 bp, Artificial Sequence
  chemically synthesized
taatcccagctacttgggaggc

SEQ ID NO: 1278070 - DNA, 22 bp, Artificial Sequence
  chemically synthesized
aagcaattctctgcctcagcct

SEQ ID NO: 1278071 - DNA, 22 bp, Artificial Sequence
  chemically synthesized
caagcaattctctgcctcagcc

SEQ ID NO: 1278072 - DNA, 22 bp, Artificial Sequence
  chemically synthesized
cttgggaggctgaggcagagaa

SEQ ID NO: 1278073 - DNA, 22 bp, Artificial Sequence
  chemically synthesized
cgggtttcaagcaattctctgc

SEQ ID NO: 1278074 - DNA, 22 bp, Artificial Sequence
  chemically synthesized
gggaggctgaggcagagaattg

SEQ ID NO: 1278075 - DNA, 22 bp, Artificial Sequence
  chemically synthesized
ggaggctgaggcagagaattgc

SEQ ID NO: 1278076 - DNA, 22 bp, Artificial Sequence
  chemically synthesized
cctccgggtttcaagcaattct

SEQ ID NO: 1278077 - DNA, 22 bp, Artificial Sequence
  chemically synthesized
tgcctccgggtttcaagcaatt

SEQ ID NO: 1278078 - DNA, 22 bp, Artificial Sequence
  chemically synthesized
aggcagagaattgcttgaaacc

SEQ ID NO: 1278079 - DNA, 22 bp, Artificial Sequence
  chemically synthesized
caacctctgcctccgggtttca

SEQ ID NO: 1278080 - DNA, 22 bp, Artificial Sequence
  chemically synthesized
actgcaacctctgcctccgggt

SEQ ID NO: 1278081 - DNA, 22 bp, Artificial Sequence
  chemically synthesized
gctcactgcaacctctgcctcc

SEQ ID NO: 1278082 - DNA, 22 bp, Artificial Sequence
  chemically synthesized
ggctcactgcaacctctgcctc

SEQ ID NO: 1278083 - DNA, 22 bp, Artificial Sequence
  chemically synthesized
cttgaaacccggaggcagaggt

SEQ ID NO: 1278084 - DNA, 22 bp, Artificial Sequence
  chemically synthesized
gaaacccggaggcagaggttgc

SEQ ID NO: 1278085 - DNA, 22 bp, Artificial Sequence
  chemically synthesized
aaacccggaggcagaggttgca

SEQ ID NO: 1278086 - DNA, 22 bp, Artificial Sequence
  chemically synthesized
gagggcagtggcacgatcttgg

SEQ ID NO: 1278087 - DNA, 22 bp, Artificial Sequence
  chemically synthesized
cagtgagccaagatcgtgccac

SEQ ID NO: 1278088 - DNA, 22 bp, Artificial Sequence
  chemically synthesized
ccaggctggagggcagtggcac

SEQ ID NO: 1278089 - DNA, 22 bp, Artificial Sequence
  chemically synthesized
tctcccaggctggagggcagtg

SEQ ID NO: 1278090 - DNA, 22 bp, Artificial Sequence
  chemically synthesized
tgtctcccaggctggagggcag

SEQ ID NO: 1278091 - DNA, 22 bp, Artificial Sequence
  chemically synthesized
attctgtctcccaggctggagg

SEQ ID NO: 1278092 - DNA, 22 bp, Artificial Sequence
  chemically synthesized
ccctccagcctgggagacagaa

SEQ ID NO: 1278093 - DNA, 22 bp, Artificial Sequence
  chemically synthesized
agacagaatctcattctgtctc

SEQ ID NO: 1278094 - DNA, 22 bp, Artificial Sequence
  chemically synthesized
gagacagaatctcattctgtct

SEQ ID NO: 1278095 - DNA, 22 bp, Artificial Sequence
  chemically synthesized
tgagacagaatctcattctgtc

SEQ ID NO: 1278096 - DNA, 22 bp, Artificial Sequence
  chemically synthesized
ttgagacagaatctcattctgt

SEQ ID NO: 1278097 - DNA, 22 bp, Artificial Sequence
  chemically synthesized
cagcctgggagacagaatgaga

SEQ ID NO: 1278098 - DNA, 22 bp, Artificial Sequence
  chemically synthesized
tttgagacagaatctcattctg

SEQ ID NO: 1278099 - DNA, 22 bp, Artificial Sequence
  chemically synthesized
ttttgagacagaatctcattct

SEQ ID NO: 1278100 - DNA, 22 bp, Artificial Sequence
  chemically synthesized
tttttgagacagaatctcattc

SEQ ID NO: 1278101 - DNA, 22 bp, Artificial Sequence
  chemically synthesized
ttttttgagacagaatctcatt

SEQ ID NO: 1278102 - DNA, 22 bp, Artificial Sequence
  chemically synthesized
tttttttgagacagaatctcat

SEQ ID NO: 1278103 - DNA, 22 bp, Artificial Sequence
  chemically synthesized
ttttttttgagacagaatctca

SEQ ID NO: 1278104 - DNA, 22 bp, Artificial Sequence
  chemically synthesized
tttttttttgagacagaatctc

SEQ ID NO: 1278105 - DNA, 22 bp, Artificial Sequence
  chemically synthesized
ggagacagaatgagattctgtc

SEQ ID NO: 1278106 - DNA, 22 bp, Artificial Sequence
  chemically synthesized
ttttttttttgagacagaatct

SEQ ID NO: 1278107 - DNA, 22 bp, Artificial Sequence
  chemically synthesized
tttttttttttgagacagaatc

SEQ ID NO: 1278108 - DNA, 22 bp, Artificial Sequence
  chemically synthesized
ttttttttttttgagacagaat

SEQ ID NO: 1278109 - DNA, 22 bp, Artificial Sequence
  chemically synthesized
tttttttttttttgagacagaa

SEQ ID NO: 1278110 - DNA, 22 bp, Artificial Sequence
  chemically synthesized
ttttttttttttttgagacaga

SEQ ID NO: 1278111 - DNA, 22 bp, Artificial Sequence
  chemically synthesized
tttttttttttttttgagacag

SEQ ID NO: 1278112 - DNA, 22 bp, Artificial Sequence
  chemically synthesized
ttttttttttttttttgagaca

SEQ ID NO: 1278113 - DNA, 22 bp, Artificial Sequence
  chemically synthesized
tttttttttttttttttgagac

SEQ ID NO: 1278114 - DNA, 22 bp, Artificial Sequence
  chemically synthesized
ttttttttttttttttttgaga

SEQ ID NO: 1278115 - DNA, 22 bp, Artificial Sequence
  chemically synthesized
tttttttttttttttttttgag

SEQ ID NO: 1278116 - DNA, 22 bp, Artificial Sequence
  chemically synthesized
ttttttttttttttttttttga

SEQ ID NO: 1278117 - DNA, 22 bp, Artificial Sequence
  chemically synthesized
tttttttttttttttttttttg

SEQ ID NO: 1278118 - DNA, 22 bp, Artificial Sequence
  chemically synthesized
tttttttttttttttttttttt

SEQ ID NO: 1278119 - DNA, 22 bp, Artificial Sequence
  chemically synthesized
tttttttttttttttttttttt

SEQ ID NO: 1278120 - DNA, 22 bp, Artificial Sequence
  chemically synthesized
tttttttttttttttttttttt

SEQ ID NO: 1278121 - DNA, 22 bp, Artificial Sequence
  chemically synthesized
tttttttttttttttttttttt

SEQ ID NO: 1278122 - DNA, 22 bp, Artificial Sequence
  chemically synthesized
tttttttttttttttttttttt

SEQ ID NO: 1278123 - DNA, 22 bp, Artificial Sequence
  chemically synthesized
tttttttttttttttttttttt

SEQ ID NO: 1278124 - DNA, 22 bp, Artificial Sequence
  chemically synthesized
tgtctcaaaaaaaaaaaaaaaa

SEQ ID NO: 1278125 - DNA, 22 bp, Artificial Sequence
  chemically synthesized
tttttttttttttttttttttt

SEQ ID NO: 1278126 - DNA, 22 bp, Artificial Sequence
  chemically synthesized
tctcaaaaaaaaaaaaaaaaaa

SEQ ID NO: 1278127 - DNA, 22 bp, Artificial Sequence
  chemically synthesized
aaaaaaaaaaaaaaaaaaaaaa

SEQ ID NO: 1278128 - DNA, 22 bp, Artificial Sequence
  chemically synthesized
ggttcttttttttttttttttt

SEQ ID NO: 1278129 - DNA, 22 bp, Artificial Sequence
  chemically synthesized
taggttcttttttttttttttt

SEQ ID NO: 1278130 - DNA, 22 bp, Artificial Sequence
  chemically synthesized
acatggtggaggggaaagggag

SEQ ID NO: 1278131 - DNA, 22 bp, Artificial Sequence
  chemically synthesized
ctcacatggtggaggggaaagg

SEQ ID NO: 1278132 - DNA, 22 bp, Artificial Sequence
  chemically synthesized
gaacgctccctttcccctccac

SEQ ID NO: 1278133 - DNA, 22 bp, Artificial Sequence
  chemically synthesized
atgattcctcacatggtggagg

SEQ ID NO: 1278134 - DNA, 22 bp, Artificial Sequence
  chemically synthesized
ttgatgattcctcacatggtgg

SEQ ID NO: 1278135 - DNA, 22 bp, Artificial Sequence
  chemically synthesized
gttgatgattcctcacatggtg

SEQ ID NO: 1278136 - DNA, 22 bp, Artificial Sequence
  chemically synthesized
cctttcccctccaccatgtgag

SEQ ID NO: 1278137 - DNA, 22 bp, Artificial Sequence
  chemically synthesized
tcccctccaccatgtgaggaat

SEQ ID NO: 1278138 - DNA, 22 bp, Artificial Sequence
  chemically synthesized
atcttgttgatgattcctcaca

SEQ ID NO: 1278139 - DNA, 22 bp, Artificial Sequence
  chemically synthesized
cccctccaccatgtgaggaatc

SEQ ID NO: 1278140 - DNA, 22 bp, Artificial Sequence
  chemically synthesized
ccctccaccatgtgaggaatca

SEQ ID NO: 1278141 - DNA, 22 bp, Artificial Sequence
  chemically synthesized
caccatgtgaggaatcatcaac

SEQ ID NO: 1278142 - DNA, 22 bp, Artificial Sequence
  chemically synthesized
agtgacgttcatcttgttgatg

SEQ ID NO: 1278143 - DNA, 22 bp, Artificial Sequence
  chemically synthesized
ctcagtgacgttcatcttgttg

SEQ ID NO: 1278144 - DNA, 22 bp, Artificial Sequence
  chemically synthesized
cctcagtgacgttcatcttgtt

SEQ ID NO: 1278145 - DNA, 22 bp, Artificial Sequence
  chemically synthesized
tgagcccgcttcctcagtgacg

SEQ ID NO: 1278146 - DNA, 22 bp, Artificial Sequence
  chemically synthesized
gtgagcccgcttcctcagtgac

SEQ ID NO: 1278147 - DNA, 22 bp, Artificial Sequence
  chemically synthesized
ggtgtcttgtgagcccgcttcc

SEQ ID NO: 1278148 - DNA, 22 bp, Artificial Sequence
  chemically synthesized
aggaagcgggctcacaagacac

SEQ ID NO: 1278149 - DNA, 22 bp, Artificial Sequence
  chemically synthesized
acaagacacctaacatgctggt

SEQ ID NO: 1278150 - DNA, 22 bp, Artificial Sequence
  chemically synthesized
gtgagtccaaaagtcaccagca

SEQ ID NO: 1278151 - DNA, 22 bp, Artificial Sequence
  chemically synthesized
gaggctggtgagtccaaaagtc

SEQ ID NO: 1278152 - DNA, 22 bp, Artificial Sequence
  chemically synthesized
acatgctggtgacttttggact

SEQ ID NO: 1278153 - DNA, 22 bp, Artificial Sequence
  chemically synthesized
tagaggctggtgagtccaaaag

SEQ ID NO: 1278154 - DNA, 22 bp, Artificial Sequence
  chemically synthesized
gttctagaggctggtgagtcca

SEQ ID NO: 1278155 - DNA, 22 bp, Artificial Sequence
  chemically synthesized
ctagttctagaggctggtgagt

SEQ ID NO: 1278156 - DNA, 22 bp, Artificial Sequence
  chemically synthesized
gtgacttttggactcaccagcc

SEQ ID NO: 1278157 - DNA, 22 bp, Artificial Sequence
  chemically synthesized
ctcctagttctagaggctggtg

SEQ ID NO: 1278158 - DNA, 22 bp, Artificial Sequence
  chemically synthesized
ttggactcaccagcctctagaa

SEQ ID NO: 1278159 - DNA, 22 bp, Artificial Sequence
  chemically synthesized
tggactcaccagcctctagaac

SEQ ID NO: 1278160 - DNA, 22 bp, Artificial Sequence
  chemically synthesized
ggactcaccagcctctagaact

SEQ ID NO: 1278161 - DNA, 22 bp, Artificial Sequence
  chemically synthesized
gactcaccagcctctagaacta

SEQ ID NO: 1278162 - DNA, 22 bp, Artificial Sequence
  chemically synthesized
accagcctctagaactaggagc

SEQ ID NO: 1278163 - DNA, 22 bp, Artificial Sequence
  chemically synthesized
taaagagcagaaatgtgttgct

SEQ ID NO: 1278164 - DNA, 22 bp, Artificial Sequence
  chemically synthesized
ataaagagcagaaatgtgttgc

SEQ ID NO: 1278165 - DNA, 22 bp, Artificial Sequence
  chemically synthesized
tagaactaggagcaacacattt

SEQ ID NO: 1278166 - DNA, 22 bp, Artificial Sequence
  chemically synthesized
gaactaggagcaacacatttct

SEQ ID NO: 1278167 - DNA, 22 bp, Artificial Sequence
  chemically synthesized
ggtggtttataaagagcagaaa

SEQ ID NO: 1278168 - DNA, 22 bp, Artificial Sequence
  chemically synthesized
ggagcaacacatttctgctctt

SEQ ID NO: 1278169 - DNA, 22 bp, Artificial Sequence
  chemically synthesized
tgggtggtttataaagagcaga

SEQ ID NO: 1278170 - DNA, 22 bp, Artificial Sequence
  chemically synthesized
ctgggtggtttataaagagcag

SEQ ID NO: 1278171 - DNA, 22 bp, Artificial Sequence
  chemically synthesized
tatttctgggtggtttataaag

SEQ ID NO: 1278172 - DNA, 22 bp, Artificial Sequence
  chemically synthesized
ctgctctttataaaccacccag

SEQ ID NO: 1278173 - DNA, 22 bp, Artificial Sequence
  chemically synthesized
tgctctttataaaccacccaga

SEQ ID NO: 1278174 - DNA, 22 bp, Artificial Sequence
  chemically synthesized
ctctttataaaccacccagaaa

SEQ ID NO: 1278175 - DNA, 22 bp, Artificial Sequence
  chemically synthesized
tttataaaccacccagaaatat

SEQ ID NO: 1278176 - DNA, 22 bp, Artificial Sequence
  chemically synthesized
tataaaccacccagaaatataa

SEQ ID NO: 1278177 - DNA, 22 bp, Artificial Sequence
  chemically synthesized
ataaaccacccagaaatataat

SEQ ID NO: 1278178 - DNA, 22 bp, Artificial Sequence
  chemically synthesized
taaaccacccagaaatataata

SEQ ID NO: 1278179 - DNA, 22 bp, Artificial Sequence
  chemically synthesized
tatacatatagatattatattt

SEQ ID NO: 1278180 - DNA, 22 bp, Artificial Sequence
  chemically synthesized
tatgtatatagccaccacccat

SEQ ID NO: 1278181 - DNA, 22 bp, Artificial Sequence
  chemically synthesized
tgtgtgtgtacatatatgggtg

SEQ ID NO: 1278182 - DNA, 22 bp, Artificial Sequence
  chemically synthesized
ataaactgtgtgtgtgtacata

SEQ ID NO: 1278183 - DNA, 22 bp, Artificial Sequence
  chemically synthesized
aaaaattgataaactgtgtgtg

SEQ ID NO: 1278184 - DNA, 22 bp, Artificial Sequence
  chemically synthesized
caaaaattgataaactgtgtgt

SEQ ID NO: 1278185 - DNA, 22 bp, Artificial Sequence
  chemically synthesized
acttcaaaaattgataaactgt

SEQ ID NO: 1278186 - DNA, 22 bp, Artificial Sequence
  chemically synthesized
cacttcaaaaattgataaactg

SEQ ID NO: 1278187 - DNA, 22 bp, Artificial Sequence
  chemically synthesized
tttcacttcaaaaattgataaa

SEQ ID NO: 1278188 - DNA, 22 bp, Artificial Sequence
  chemically synthesized
tatgttatttcacttcaaaaat

SEQ ID NO: 1278189 - DNA, 22 bp, Artificial Sequence
  chemically synthesized
atatgttatttcacttcaaaaa

SEQ ID NO: 1278190 - DNA, 22 bp, Artificial Sequence
  chemically synthesized
atttatatgttatttcacttca

SEQ ID NO: 1278191 - DNA, 22 bp, Artificial Sequence
  chemically synthesized
atcaatttttgaagtgaaataa

SEQ ID NO: 1278192 - DNA, 22 bp, Artificial Sequence
  chemically synthesized
ttaatttatatgttatttcact

SEQ ID NO: 1278193 - DNA, 22 bp, Artificial Sequence
  chemically synthesized
tcaatttttgaagtgaaataac

SEQ ID NO: 1278194 - DNA, 22 bp, Artificial Sequence
  chemically synthesized
gttaatttatatgttatttcac

SEQ ID NO: 1278195 - DNA, 22 bp, Artificial Sequence
  chemically synthesized
tgttaatttatatgttatttca

SEQ ID NO: 1278196 - DNA, 22 bp, Artificial Sequence
  chemically synthesized
ttgttaatttatatgttatttc

SEQ ID NO: 1278197 - DNA, 22 bp, Artificial Sequence
  chemically synthesized
ttgaagtgaaataacatataaa

SEQ ID NO: 1278198 - DNA, 22 bp, Artificial Sequence
  chemically synthesized
tgaagtgaaataacatataaat

SEQ ID NO: 1278199 - DNA, 22 bp, Artificial Sequence
  chemically synthesized
gaagtgaaataacatataaatt

SEQ ID NO: 1278200 - DNA, 22 bp, Artificial Sequence
  chemically synthesized
aagtgaaataacatataaatta

SEQ ID NO: 1278201 - DNA, 22 bp, Artificial Sequence
  chemically synthesized
tgtatgtggtagcacgtgagag

SEQ ID NO: 1278202 - DNA, 22 bp, Artificial Sequence
  chemically synthesized
acaaaaattctctcacgtgcta

SEQ ID NO: 1278203 - DNA, 22 bp, Artificial Sequence
  chemically synthesized
tctatgtatgtggtagcacgtg

SEQ ID NO: 1278204 - DNA, 22 bp, Artificial Sequence
  chemically synthesized
atctatgtatgtggtagcacgt

SEQ ID NO: 1278205 - DNA, 22 bp, Artificial Sequence
  chemically synthesized
tatctatgtatgtggtagcacg

SEQ ID NO: 1278206 - DNA, 22 bp, Artificial Sequence
  chemically synthesized
tctcacgtgctaccacatacat

SEQ ID NO: 1278207 - DNA, 22 bp, Artificial Sequence
  chemically synthesized
tcacgtgctaccacatacatag

SEQ ID NO: 1278208 - DNA, 22 bp, Artificial Sequence
  chemically synthesized
acgtgctaccacatacatagat

SEQ ID NO: 1278209 - DNA, 22 bp, Artificial Sequence
  chemically synthesized
ccacatacatagataaaatatg

SEQ ID NO: 1278210 - DNA, 22 bp, Artificial Sequence
  chemically synthesized
tatacatacatatatgcatgta

SEQ ID NO: 1278211 - DNA, 22 bp, Artificial Sequence
  chemically synthesized
atacatacatatatgcatgtat

SEQ ID NO: 1278212 - DNA, 22 bp, Artificial Sequence
  chemically synthesized
tacatacatatatgcatgtata

SEQ ID NO: 1278213 - DNA, 22 bp, Artificial Sequence
  chemically synthesized
tgtatatgtatgtatacatgca

SEQ ID NO: 1278214 - DNA, 22 bp, Artificial Sequence
  chemically synthesized
atgtatatgtatgtatacatgc

SEQ ID NO: 1278215 - DNA, 22 bp, Artificial Sequence
  chemically synthesized
tatgtatatgtatgtatacatg

SEQ ID NO: 1278216 - DNA, 22 bp, Artificial Sequence
  chemically synthesized
tgtatgtggtacatacatgttt

SEQ ID NO: 1278217 - DNA, 22 bp, Artificial Sequence
  chemically synthesized
tctatgtatgtggtacatacat

SEQ ID NO: 1278218 - DNA, 22 bp, Artificial Sequence
  chemically synthesized
atctatgtatgtggtacataca

SEQ ID NO: 1278219 - DNA, 22 bp, Artificial Sequence
  chemically synthesized
tatctatgtatgtggtacatac

SEQ ID NO: 1278220 - DNA, 22 bp, Artificial Sequence
  chemically synthesized
tgtatgtggtagcatattttat

SEQ ID NO: 1278221 - DNA, 22 bp, Artificial Sequence
  chemically synthesized
tctatgtatgtggtagcatatt

SEQ ID NO: 1278222 - DNA, 22 bp, Artificial Sequence
  chemically synthesized
atctatgtatgtggtagcatat

SEQ ID NO: 1278223 - DNA, 22 bp, Artificial Sequence
  chemically synthesized
tatctatgtatgtggtagcata

SEQ ID NO: 1278224 - DNA, 22 bp, Artificial Sequence
  chemically synthesized
ggcaagtattttatctatgtat

SEQ ID NO: 1278225 - DNA, 22 bp, Artificial Sequence
  chemically synthesized
ccacatacatagataaaatact

SEQ ID NO: 1278226 - DNA, 22 bp, Artificial Sequence
  chemically synthesized
tgtatctgggcaagtattttat

SEQ ID NO: 1278227 - DNA, 22 bp, Artificial Sequence
  chemically synthesized
tctatgtatctgggcaagtatt

SEQ ID NO: 1278228 - DNA, 22 bp, Artificial Sequence
  chemically synthesized
atctatgtatctgggcaagtat

SEQ ID NO: 1278229 - DNA, 22 bp, Artificial Sequence
  chemically synthesized
tatctatgtatctgggcaagta

SEQ ID NO: 1278230 - DNA, 22 bp, Artificial Sequence
  chemically synthesized
ttatctatgtatctgggcaagt

SEQ ID NO: 1278231 - DNA, 22 bp, Artificial Sequence
  chemically synthesized
aatttttatctatgtatctggg

SEQ ID NO: 1278232 - DNA, 22 bp, Artificial Sequence
  chemically synthesized
gaatttttatctatgtatctgg

SEQ ID NO: 1278233 - DNA, 22 bp, Artificial Sequence
  chemically synthesized
atggtacttgaatttttatcta

SEQ ID NO: 1278234 - DNA, 22 bp, Artificial Sequence
  chemically synthesized
gcccagatacatagataaaaat

SEQ ID NO: 1278235 - DNA, 22 bp, Artificial Sequence
  chemically synthesized
gatggtacttgaatttttatct

SEQ ID NO: 1278236 - DNA, 22 bp, Artificial Sequence
  chemically synthesized
cccagatacatagataaaaatt

SEQ ID NO: 1278237 - DNA, 22 bp, Artificial Sequence
  chemically synthesized
tgatggtacttgaatttttatc

SEQ ID NO: 1278238 - DNA, 22 bp, Artificial Sequence
  chemically synthesized
tagataggaagaaggtagactt

SEQ ID NO: 1278239 - DNA, 22 bp, Artificial Sequence
  chemically synthesized
aagtaccatcaaagtctacctt

SEQ ID NO: 1278240 - DNA, 22 bp, Artificial Sequence
  chemically synthesized
atagataggaagaaggtagact

SEQ ID NO: 1278241 - DNA, 22 bp, Artificial Sequence
  chemically synthesized
tatagataggaagaaggtagac

SEQ ID NO: 1278242 - DNA, 22 bp, Artificial Sequence
  chemically synthesized
tagctttatagataggaagaag

SEQ ID NO: 1278243 - DNA, 22 bp, Artificial Sequence
  chemically synthesized
atagctttatagataggaagaa

SEQ ID NO: 1278244 - DNA, 22 bp, Artificial Sequence
  chemically synthesized
tatagctttatagataggaaga

SEQ ID NO: 1278245 - DNA, 22 bp, Artificial Sequence
  chemically synthesized
attttatagctttatagatagg

SEQ ID NO: 1278246 - DNA, 22 bp, Artificial Sequence
  chemically synthesized
ccttcttcctatctataaagct

SEQ ID NO: 1278247 - DNA, 22 bp, Artificial Sequence
  chemically synthesized
cttcctatctataaagctataa

SEQ ID NO: 1278248 - DNA, 22 bp, Artificial Sequence
  chemically synthesized
ataccactcattttatagcttt

SEQ ID NO: 1278249 - DNA, 22 bp, Artificial Sequence
  chemically synthesized
ttcctatctataaagctataaa

SEQ ID NO: 1278250 - DNA, 22 bp, Artificial Sequence
  chemically synthesized
cctatctataaagctataaaat

SEQ ID NO: 1278251 - DNA, 22 bp, Artificial Sequence
  chemically synthesized
ctatctataaagctataaaatg

SEQ ID NO: 1278252 - DNA, 22 bp, Artificial Sequence
  chemically synthesized
gtctcataccactcattttata

SEQ ID NO: 1278253 - DNA, 22 bp, Artificial Sequence
  chemically synthesized
agtctcataccactcattttat

SEQ ID NO: 1278254 - DNA, 22 bp, Artificial Sequence
  chemically synthesized
tctataaagctataaaatgagt

SEQ ID NO: 1278255 - DNA, 22 bp, Artificial Sequence
  chemically synthesized
tttagtctcataccactcattt

SEQ ID NO: 1278256 - DNA, 22 bp, Artificial Sequence
  chemically synthesized
taaagctataaaatgagtggta

SEQ ID NO: 1278257 - DNA, 22 bp, Artificial Sequence
  chemically synthesized
tgtttagtctcataccactcat

SEQ ID NO: 1278258 - DNA, 22 bp, Artificial Sequence
  chemically synthesized
ctgtttagtctcataccactca

SEQ ID NO: 1278259 - DNA, 22 bp, Artificial Sequence
  chemically synthesized
taaaatgagtggtatgagacta

SEQ ID NO: 1278260 - DNA, 22 bp, Artificial Sequence
  chemically synthesized
tgccaaaaagcacagaacattt

SEQ ID NO: 1278261 - DNA, 22 bp, Artificial Sequence
  chemically synthesized
gtgccaaaaagcacagaacatt

SEQ ID NO: 1278262 - DNA, 22 bp, Artificial Sequence
  chemically synthesized
aacagaaatgttctgtgctttt

SEQ ID NO: 1278263 - DNA, 22 bp, Artificial Sequence
  chemically synthesized
tgtgctttttggcacaaacgca

SEQ ID NO: 1278264 - DNA, 22 bp, Artificial Sequence
  chemically synthesized
tgctttttggcacaaacgcata

SEQ ID NO: 1278265 - DNA, 22 bp, Artificial Sequence
  chemically synthesized
tttggcacaaacgcatatttgt

SEQ ID NO: 1278266 - DNA, 22 bp, Artificial Sequence
  chemically synthesized
ttggcacaaacgcatatttgtt

SEQ ID NO: 1278267 - DNA, 22 bp, Artificial Sequence
  chemically synthesized
tggcacaaacgcatatttgttt

SEQ ID NO: 1278268 - DNA, 22 bp, Artificial Sequence
  chemically synthesized
ggcacaaacgcatatttgttta

SEQ ID NO: 1278269 - DNA, 22 bp, Artificial Sequence
  chemically synthesized
gcacaaacgcatatttgtttat

SEQ ID NO: 1278270 - DNA, 22 bp, Artificial Sequence
  chemically synthesized
taaatacatacataataaataa

SEQ ID NO: 1278271 - DNA, 22 bp, Artificial Sequence
  chemically synthesized
gtttatttattatgtatgtatt

SEQ ID NO: 1278272 - DNA, 22 bp, Artificial Sequence
  chemically synthesized
tttatttattatgtatgtattt

SEQ ID NO: 1278273 - DNA, 22 bp, Artificial Sequence
  chemically synthesized
tatgaaaacactataaatacat

SEQ ID NO: 1278274 - DNA, 22 bp, Artificial Sequence
  chemically synthesized
atttattatgtatgtatttata

SEQ ID NO: 1278275 - DNA, 22 bp, Artificial Sequence
  chemically synthesized
gtatgaaaacactataaataca

SEQ ID NO: 1278276 - DNA, 22 bp, Artificial Sequence
  chemically synthesized
tttattatgtatgtatttatag

SEQ ID NO: 1278277 - DNA, 22 bp, Artificial Sequence
  chemically synthesized
tttgtatgaaaacactataaat

SEQ ID NO: 1278278 - DNA, 22 bp, Artificial Sequence
  chemically synthesized
attatgtatgtatttatagtgt

SEQ ID NO: 1278279 - DNA, 22 bp, Artificial Sequence
  chemically synthesized
ttatgtatgtatttatagtgtt

SEQ ID NO: 1278280 - DNA, 22 bp, Artificial Sequence
  chemically synthesized
tatttgtatgaaaacactataa

SEQ ID NO: 1278281 - DNA, 22 bp, Artificial Sequence
  chemically synthesized
tgtatgtatttatagtgttttc

SEQ ID NO: 1278282 - DNA, 22 bp, Artificial Sequence
  chemically synthesized
ttctatttgtatgaaaacacta

SEQ ID NO: 1278283 - DNA, 22 bp, Artificial Sequence
  chemically synthesized
atagtgttttcatacaaataga

SEQ ID NO: 1278284 - DNA, 22 bp, Artificial Sequence
  chemically synthesized
tagtgttttcatacaaatagaa

SEQ ID NO: 1278285 - DNA, 22 bp, Artificial Sequence
  chemically synthesized
tatatatgtcaaattgttctat

SEQ ID NO: 1278286 - DNA, 22 bp, Artificial Sequence
  chemically synthesized
ttatatatatgtcaaattgttc

SEQ ID NO: 1278287 - DNA, 22 bp, Artificial Sequence
  chemically synthesized
tcatacaaatagaacaatttga

SEQ ID NO: 1278288 - DNA, 22 bp, Artificial Sequence
  chemically synthesized
attatatatatgtcaaattgtt

SEQ ID NO: 1278289 - DNA, 22 bp, Artificial Sequence
  chemically synthesized
catacaaatagaacaatttgac

SEQ ID NO: 1278290 - DNA, 22 bp, Artificial Sequence
  chemically synthesized
atacaaatagaacaatttgaca

SEQ ID NO: 1278291 - DNA, 22 bp, Artificial Sequence
  chemically synthesized
gtttattatatatatgtcaaat

SEQ ID NO: 1278292 - DNA, 22 bp, Artificial Sequence
  chemically synthesized
tagtttattatatatatgtcaa

SEQ ID NO: 1278293 - DNA, 22 bp, Artificial Sequence
  chemically synthesized
gacatatatataataaactaga

SEQ ID NO: 1278294 - DNA, 22 bp, Artificial Sequence
  chemically synthesized
acatatatataataaactagaa

SEQ ID NO: 1278295 - DNA, 22 bp, Artificial Sequence
  chemically synthesized
gaacacatatgcacatatgtat

SEQ ID NO: 1278296 - DNA, 22 bp, Artificial Sequence
  chemically synthesized
cacaaaagtagaacatatatat

SEQ ID NO: 1278297 - DNA, 22 bp, Artificial Sequence
  chemically synthesized
attgcacaaaagtagaacatat

SEQ ID NO: 1278298 - DNA, 22 bp, Artificial Sequence
  chemically synthesized
tgtagtattaattgcacaaaag

SEQ ID NO: 1278299 - DNA, 22 bp, Artificial Sequence
  chemically synthesized
tacttttgtgcaattaatacta

SEQ ID NO: 1278300 - DNA, 22 bp, Artificial Sequence
  chemically synthesized
cttttgtgcaattaatactaca

SEQ ID NO: 1278301 - DNA, 22 bp, Artificial Sequence
  chemically synthesized
aaatgtgatcgttatgtagtat

SEQ ID NO: 1278302 - DNA, 22 bp, Artificial Sequence
  chemically synthesized
ttgtgcaattaatactacataa

SEQ ID NO: 1278303 - DNA, 22 bp, Artificial Sequence
  chemically synthesized
tgtgcaattaatactacataac

SEQ ID NO: 1278304 - DNA, 22 bp, Artificial Sequence
  chemically synthesized
gtgcaattaatactacataacg

SEQ ID NO: 1278305 - DNA, 22 bp, Artificial Sequence
  chemically synthesized
tgcaattaatactacataacga

SEQ ID NO: 1278306 - DNA, 22 bp, Artificial Sequence
  chemically synthesized
atactacataacgatcacattt

SEQ ID NO: 1278307 - DNA, 22 bp, Artificial Sequence
  chemically synthesized
tataaacagatgttgaaatgtg

SEQ ID NO: 1278308 - DNA, 22 bp, Artificial Sequence
  chemically synthesized
atataaacagatgttgaaatgt

SEQ ID NO: 1278309 - DNA, 22 bp, Artificial Sequence
  chemically synthesized
cataacgatcacatttcaacat

SEQ ID NO: 1278310 - DNA, 22 bp, Artificial Sequence
  chemically synthesized
aacaagagatgaatttatataa

SEQ ID NO: 1278311 - DNA, 22 bp, Artificial Sequence
  chemically synthesized
aaacaagagatgaatttatata

SEQ ID NO: 1278312 - DNA, 22 bp, Artificial Sequence
  chemically synthesized
caacatctgtttatataaattc

SEQ ID NO: 1278313 - DNA, 22 bp, Artificial Sequence
  chemically synthesized
taaacaagagatgaatttatat

SEQ ID NO: 1278314 - DNA, 22 bp, Artificial Sequence
  chemically synthesized
aacatctgtttatataaattca

SEQ ID NO: 1278315 - DNA, 22 bp, Artificial Sequence
  chemically synthesized
cagttttaaacaagagatgaat

SEQ ID NO: 1278316 - DNA, 22 bp, Artificial Sequence
  chemically synthesized
tttatataaattcatctcttgt

SEQ ID NO: 1278317 - DNA, 22 bp, Artificial Sequence
  chemically synthesized
tactacagttttaaacaagaga

SEQ ID NO: 1278318 - DNA, 22 bp, Artificial Sequence
  chemically synthesized
atataaattcatctcttgttta

SEQ ID NO: 1278319 - DNA, 22 bp, Artificial Sequence
  chemically synthesized
atactacagttttaaacaagag

SEQ ID NO: 1278320 - DNA, 22 bp, Artificial Sequence
  chemically synthesized
tataaattcatctcttgtttaa

SEQ ID NO: 1278321 - DNA, 22 bp, Artificial Sequence
  chemically synthesized
tatactacagttttaaacaaga

SEQ ID NO: 1278322 - DNA, 22 bp, Artificial Sequence
  chemically synthesized
tgccctttatactacagtttta

SEQ ID NO: 1278323 - DNA, 22 bp, Artificial Sequence
  chemically synthesized
atctcttgtttaaaactgtagt

SEQ ID NO: 1278324 - DNA, 22 bp, Artificial Sequence
  chemically synthesized
ttgtttaaaactgtagtataaa

SEQ ID NO: 1278325 - DNA, 22 bp, Artificial Sequence
  chemically synthesized
gtttaaaactgtagtataaagg

SEQ ID NO: 1278326 - DNA, 22 bp, Artificial Sequence
  chemically synthesized
tttaaaactgtagtataaaggg

SEQ ID NO: 1278327 - DNA, 22 bp, Artificial Sequence
  chemically synthesized
aaaactgtagtataaagggcac

SEQ ID NO: 1278328 - DNA, 22 bp, Artificial Sequence
  chemically synthesized
aaactgtagtataaagggcaca

SEQ ID NO: 1278329 - DNA, 22 bp, Artificial Sequence
  chemically synthesized
gtggtagtccatgcctgtgccc

SEQ ID NO: 1278330 - DNA, 22 bp, Artificial Sequence
  chemically synthesized
ggtggtagtccatgcctgtgcc

SEQ ID NO: 1278331 - DNA, 22 bp, Artificial Sequence
  chemically synthesized
tagtataaagggcacaggcatg

SEQ ID NO: 1278332 - DNA, 22 bp, Artificial Sequence
  chemically synthesized
aatggacatagcttggtggtag

SEQ ID NO: 1278333 - DNA, 22 bp, Artificial Sequence
  chemically synthesized
ccaccaagctatgtccatttag

SEQ ID NO: 1278334 - DNA, 22 bp, Artificial Sequence
  chemically synthesized
ggtaatagtaaaataggtaatc

SEQ ID NO: 1278335 - DNA, 22 bp, Artificial Sequence
  chemically synthesized
tgtccatttagattacctattt

SEQ ID NO: 1278336 - DNA, 22 bp, Artificial Sequence
  chemically synthesized
tagctaggtaatagtaaaatag

SEQ ID NO: 1278337 - DNA, 22 bp, Artificial Sequence
  chemically synthesized
gtagctaggtaatagtaaaata

SEQ ID NO: 1278338 - DNA, 22 bp, Artificial Sequence
  chemically synthesized
tgtagctaggtaatagtaaaat

SEQ ID NO: 1278339 - DNA, 22 bp, Artificial Sequence
  chemically synthesized
tttgtagctaggtaatagtaaa

SEQ ID NO: 1278340 - DNA, 22 bp, Artificial Sequence
  chemically synthesized
agattacctattttactattac

SEQ ID NO: 1278341 - DNA, 22 bp, Artificial Sequence
  chemically synthesized
ctttgtagctaggtaatagtaa

SEQ ID NO: 1278342 - DNA, 22 bp, Artificial Sequence
  chemically synthesized
gattacctattttactattacc

SEQ ID NO: 1278343 - DNA, 22 bp, Artificial Sequence
  chemically synthesized
tctttgtagctaggtaatagta

SEQ ID NO: 1278344 - DNA, 22 bp, Artificial Sequence
  chemically synthesized
cctattttactattacctagct

SEQ ID NO: 1278345 - DNA, 22 bp, Artificial Sequence
  chemically synthesized
ttttactattacctagctacaa

SEQ ID NO: 1278346 - DNA, 22 bp, Artificial Sequence
  chemically synthesized
tactattacctagctacaaaga

SEQ ID NO: 1278347 - DNA, 22 bp, Artificial Sequence
  chemically synthesized
actattacctagctacaaagaa

SEQ ID NO: 1278348 - DNA, 22 bp, Artificial Sequence
  chemically synthesized
ctattacctagctacaaagaaa

SEQ ID NO: 1278349 - DNA, 22 bp, Artificial Sequence
  chemically synthesized
gatggacatgggttttctttgt

SEQ ID NO: 1278350 - DNA, 22 bp, Artificial Sequence
  chemically synthesized
agatggacatgggttttctttg

SEQ ID NO: 1278351 - DNA, 22 bp, Artificial Sequence
  chemically synthesized
ttacctagctacaaagaaaacc

SEQ ID NO: 1278352 - DNA, 22 bp, Artificial Sequence
  chemically synthesized
cctagctacaaagaaaacccat

SEQ ID NO: 1278353 - DNA, 22 bp, Artificial Sequence
  chemically synthesized
gctacaaagaaaacccatgtcc

SEQ ID NO: 1278354 - DNA, 22 bp, Artificial Sequence
  chemically synthesized
caaagaaaacccatgtccatct

SEQ ID NO: 1278355 - DNA, 22 bp, Artificial Sequence
  chemically synthesized
acatgagtaagggtttagatgg

SEQ ID NO: 1278356 - DNA, 22 bp, Artificial Sequence
  chemically synthesized
cacatgagtaagggtttagatg

SEQ ID NO: 1278357 - DNA, 22 bp, Artificial Sequence
  chemically synthesized
tcacatgagtaagggtttagat

SEQ ID NO: 1278358 - DNA, 22 bp, Artificial Sequence
  chemically synthesized
tgttttcacatgagtaagggtt

SEQ ID NO: 1278359 - DNA, 22 bp, Artificial Sequence
  chemically synthesized
atgttttcacatgagtaagggt

SEQ ID NO: 1278360 - DNA, 22 bp, Artificial Sequence
  chemically synthesized
atttatgttttcacatgagtaa

SEQ ID NO: 1278361 - DNA, 22 bp, Artificial Sequence
  chemically synthesized
catttatgttttcacatgagta

SEQ ID NO: 1278362 - DNA, 22 bp, Artificial Sequence
  chemically synthesized
cccttcatttatgttttcacat

SEQ ID NO: 1278363 - DNA, 22 bp, Artificial Sequence
  chemically synthesized
aacccttactcatgtgaaaaca

SEQ ID NO: 1278364 - DNA, 22 bp, Artificial Sequence
  chemically synthesized
gcccttcatttatgttttcaca

SEQ ID NO: 1278365 - DNA, 22 bp, Artificial Sequence
  chemically synthesized
actcatgtgaaaacataaatga

SEQ ID NO: 1278366 - DNA, 22 bp, Artificial Sequence
  chemically synthesized
ctcatgtgaaaacataaatgaa

SEQ ID NO: 1278367 - DNA, 22 bp, Artificial Sequence
  chemically synthesized
aaggagtttgcccttcatttat

SEQ ID NO: 1278368 - DNA, 22 bp, Artificial Sequence
  chemically synthesized
caaggagtttgcccttcattta

SEQ ID NO: 1278369 - DNA, 22 bp, Artificial Sequence
  chemically synthesized
atgtgaaaacataaatgaaggg

SEQ ID NO: 1278370 - DNA, 22 bp, Artificial Sequence
  chemically synthesized
cttcaaggagtttgcccttcat

SEQ ID NO: 1278371 - DNA, 22 bp, Artificial Sequence
  chemically synthesized
tacttcaaggagtttgcccttc

SEQ ID NO: 1278372 - DNA, 22 bp, Artificial Sequence
  chemically synthesized
catagcaattctacttcaagga

SEQ ID NO: 1278373 - DNA, 22 bp, Artificial Sequence
  chemically synthesized
acatagcaattctacttcaagg

SEQ ID NO: 1278374 - DNA, 22 bp, Artificial Sequence
  chemically synthesized
catatttacatagcaattctac

SEQ ID NO: 1278375 - DNA, 22 bp, Artificial Sequence
  chemically synthesized
cttgaagtagaattgctatgta

SEQ ID NO: 1278376 - DNA, 22 bp, Artificial Sequence
  chemically synthesized
gaagtagaattgctatgtaaat

SEQ ID NO: 1278377 - DNA, 22 bp, Artificial Sequence
  chemically synthesized
aagtagaattgctatgtaaata

SEQ ID NO: 1278378 - DNA, 22 bp, Artificial Sequence
  chemically synthesized
aaagtataattacatatttaca

SEQ ID NO: 1278379 - DNA, 22 bp, Artificial Sequence
  chemically synthesized
aaaattaaaagtataattacat

SEQ ID NO: 1278380 - DNA, 22 bp, Artificial Sequence
  chemically synthesized
caaaattaaaagtataattaca

SEQ ID NO: 1278381 - DNA, 22 bp, Artificial Sequence
  chemically synthesized
ctatgtaaatatgtaattatac

SEQ ID NO: 1278382 - DNA, 22 bp, Artificial Sequence
  chemically synthesized
tcaaaattaaaagtataattac

SEQ ID NO: 1278383 - DNA, 22 bp, Artificial Sequence
  chemically synthesized
tgtaaatatgtaattatacttt

SEQ ID NO: 1278384 - DNA, 22 bp, Artificial Sequence
  chemically synthesized
tctttcaaaattaaaagtataa

SEQ ID NO: 1278385 - DNA, 22 bp, Artificial Sequence
  chemically synthesized
gcattatctttcaaaattaaaa

SEQ ID NO: 1278386 - DNA, 22 bp, Artificial Sequence
  chemically synthesized
ggcattatctttcaaaattaaa

SEQ ID NO: 1278387 - DNA, 22 bp, Artificial Sequence
  chemically synthesized
atttggcattatctttcaaaat

SEQ ID NO: 1278388 - DNA, 22 bp, Artificial Sequence
  chemically synthesized
tacttttaattttgaaagataa

SEQ ID NO: 1278389 - DNA, 22 bp, Artificial Sequence
  chemically synthesized
agattaatttggcattatcttt

SEQ ID NO: 1278390 - DNA, 22 bp, Artificial Sequence
  chemically synthesized
gagattaatttggcattatctt

SEQ ID NO: 1278391 - DNA, 22 bp, Artificial Sequence
  chemically synthesized
ttaattttgaaagataatgcca

SEQ ID NO: 1278392 - DNA, 22 bp, Artificial Sequence
  chemically synthesized
ttgagattaatttggcattatc

SEQ ID NO: 1278393 - DNA, 22 bp, Artificial Sequence
  chemically synthesized
taattttgaaagataatgccaa

SEQ ID NO: 1278394 - DNA, 22 bp, Artificial Sequence
  chemically synthesized
aattttgaaagataatgccaaa

SEQ ID NO: 1278395 - DNA, 22 bp, Artificial Sequence
  chemically synthesized
attttgaaagataatgccaaat

SEQ ID NO: 1278396 - DNA, 22 bp, Artificial Sequence
  chemically synthesized
tgaaagataatgccaaattaat

SEQ ID NO: 1278397 - DNA, 22 bp, Artificial Sequence
  chemically synthesized
gaaagataatgccaaattaatc

SEQ ID NO: 1278398 - DNA, 22 bp, Artificial Sequence
  chemically synthesized
aaagataatgccaaattaatct

SEQ ID NO: 1278399 - DNA, 22 bp, Artificial Sequence
  chemically synthesized
tggagtaacacaagcccagact

SEQ ID NO: 1278400 - DNA, 22 bp, Artificial Sequence
  chemically synthesized
atctcaagagtctgggcttgtg

SEQ ID NO: 1278401 - DNA, 22 bp, Artificial Sequence
  chemically synthesized
actatggagtaacacaagccca

SEQ ID NO: 1278402 - DNA, 22 bp, Artificial Sequence
  chemically synthesized
aagagtctgggcttgtgttact

SEQ ID NO: 1278403 - DNA, 22 bp, Artificial Sequence
  chemically synthesized
ggcttgtgttactccatagtca

SEQ ID NO: 1278404 - DNA, 22 bp, Artificial Sequence
  chemically synthesized
gtgttactccatagtcaatgat

SEQ ID NO: 1278405 - DNA, 22 bp, Artificial Sequence
  chemically synthesized
aggaccatcgccatcattgact

SEQ ID NO: 1278406 - DNA, 22 bp, Artificial Sequence
  chemically synthesized
tgttactccatagtcaatgatg

SEQ ID NO: 1278407 - DNA, 22 bp, Artificial Sequence
  chemically synthesized
ctccatagtcaatgatggcgat

SEQ ID NO: 1278408 - DNA, 22 bp, Artificial Sequence
  chemically synthesized
catagtcaatgatggcgatggt

SEQ ID NO: 1278409 - DNA, 22 bp, Artificial Sequence
  chemically synthesized
gaggcaagagttgaggaccatc

SEQ ID NO: 1278410 - DNA, 22 bp, Artificial Sequence
  chemically synthesized
ggaggcaagagttgaggaccat

SEQ ID NO: 1278411 - DNA, 22 bp, Artificial Sequence
  chemically synthesized
tggaggcaagagttgaggacca

SEQ ID NO: 1278412 - DNA, 22 bp, Artificial Sequence
  chemically synthesized
aagaatgaatgcattttggagg

SEQ ID NO: 1278413 - DNA, 22 bp, Artificial Sequence
  chemically synthesized
ttcaagaatgaatgcattttgg

SEQ ID NO: 1278414 - DNA, 22 bp, Artificial Sequence
  chemically synthesized
aactcttgcctccaaaatgcat

SEQ ID NO: 1278415 - DNA, 22 bp, Artificial Sequence
  chemically synthesized
ttgcctccaaaatgcattcatt

SEQ ID NO: 1278416 - DNA, 22 bp, Artificial Sequence
  chemically synthesized
gcctccaaaatgcattcattct

SEQ ID NO: 1278417 - DNA, 22 bp, Artificial Sequence
  chemically synthesized
cctccaaaatgcattcattctt

SEQ ID NO: 1278418 - DNA, 22 bp, Artificial Sequence
  chemically synthesized
atcaaagttattcaagaatgaa

SEQ ID NO: 1278419 - DNA, 22 bp, Artificial Sequence
  chemically synthesized
caaaatgcattcattcttgaat

SEQ ID NO: 1278420 - DNA, 22 bp, Artificial Sequence
  chemically synthesized
atctgatcaaagttattcaaga

SEQ ID NO: 1278421 - DNA, 22 bp, Artificial Sequence
  chemically synthesized
attcttgaataactttgatcag

SEQ ID NO: 1278422 - DNA, 22 bp, Artificial Sequence
  chemically synthesized
ttgaataactttgatcagatga

SEQ ID NO: 1278423 - DNA, 22 bp, Artificial Sequence
  chemically synthesized
gaataactttgatcagatgaga

SEQ ID NO: 1278424 - DNA, 22 bp, Artificial Sequence
  chemically synthesized
agatcataagtgtctcatctga

SEQ ID NO: 1278425 - DNA, 22 bp, Artificial Sequence
  chemically synthesized
aataactttgatcagatgagac

SEQ ID NO: 1278426 - DNA, 22 bp, Artificial Sequence
  chemically synthesized
tgatcagatgagacacttatga

SEQ ID NO: 1278427 - DNA, 22 bp, Artificial Sequence
  chemically synthesized
gatcagatgagacacttatgat

SEQ ID NO: 1278428 - DNA, 22 bp, Artificial Sequence
  chemically synthesized
atcagatgagacacttatgatc

SEQ ID NO: 1278429 - DNA, 22 bp, Artificial Sequence
  chemically synthesized
atgatctcaatgctcattctcc

SEQ ID NO: 1278430 - DNA, 22 bp, Artificial Sequence
  chemically synthesized
tgatctcaatgctcattctcct

SEQ ID NO: 1278431 - DNA, 22 bp, Artificial Sequence
  chemically synthesized
tccaaagagtagtaggagaatg

SEQ ID NO: 1278432 - DNA, 22 bp, Artificial Sequence
  chemically synthesized
aatgctcattctcctactactc

SEQ ID NO: 1278433 - DNA, 22 bp, Artificial Sequence
  chemically synthesized
attctcctactactctttggat

SEQ ID NO: 1278434 - DNA, 22 bp, Artificial Sequence
  chemically synthesized
tcctactactctttggataacc

SEQ ID NO: 1278435 - DNA, 22 bp, Artificial Sequence
  chemically synthesized
ctactactctttggataacctt

SEQ ID NO: 1278436 - DNA, 22 bp, Artificial Sequence
  chemically synthesized
ctactctttggataaccttgtt

SEQ ID NO: 1278437 - DNA, 22 bp, Artificial Sequence
  chemically synthesized
ctctttggataaccttgtttga

SEQ ID NO: 1278438 - DNA, 22 bp, Artificial Sequence
  chemically synthesized
taaaaaaaaatgtcaaacaagg

SEQ ID NO: 1278439 - DNA, 22 bp, Artificial Sequence
  chemically synthesized
tttggataaccttgtttgacat

SEQ ID NO: 1278440 - DNA, 22 bp, Artificial Sequence
  chemically synthesized
tggataaccttgtttgacattt

SEQ ID NO: 1278441 - DNA, 22 bp, Artificial Sequence
  chemically synthesized
ggataaccttgtttgacatttt

SEQ ID NO: 1278442 - DNA, 22 bp, Artificial Sequence
  chemically synthesized
gataaccttgtttgacattttt

SEQ ID NO: 1278443 - DNA, 22 bp, Artificial Sequence
  chemically synthesized
cacactgtaaaaaaaaatgtca

SEQ ID NO: 1278444 - DNA, 22 bp, Artificial Sequence
  chemically synthesized
acacactgtaaaaaaaaatgtc

SEQ ID NO: 1278445 - DNA, 22 bp, Artificial Sequence
  chemically synthesized
tacacactgtaaaaaaaaatgt

SEQ ID NO: 1278446 - DNA, 22 bp, Artificial Sequence
  chemically synthesized
ctttacacactgtaaaaaaaaa

SEQ ID NO: 1278447 - DNA, 22 bp, Artificial Sequence
  chemically synthesized
gctttacacactgtaaaaaaaa

SEQ ID NO: 1278448 - DNA, 22 bp, Artificial Sequence
  chemically synthesized
tgctttacacactgtaaaaaaa

SEQ ID NO: 1278449 - DNA, 22 bp, Artificial Sequence
  chemically synthesized
gtttgacatttttttttacagt

SEQ ID NO: 1278450 - DNA, 22 bp, Artificial Sequence
  chemically synthesized
tttgctttacacactgtaaaaa

SEQ ID NO: 1278451 - DNA, 22 bp, Artificial Sequence
  chemically synthesized
tttgacatttttttttacagtg

SEQ ID NO: 1278452 - DNA, 22 bp, Artificial Sequence
  chemically synthesized
tctttgctttacacactgtaaa

SEQ ID NO: 1278453 - DNA, 22 bp, Artificial Sequence
  chemically synthesized
ctctttgctttacacactgtaa

SEQ ID NO: 1278454 - DNA, 22 bp, Artificial Sequence
  chemically synthesized
gacatttttttttacagtgtgt

SEQ ID NO: 1278455 - DNA, 22 bp, Artificial Sequence
  chemically synthesized
acatttttttttacagtgtgta

SEQ ID NO: 1278456 - DNA, 22 bp, Artificial Sequence
  chemically synthesized
gagtttctctttgctttacaca

SEQ ID NO: 1278457 - DNA, 22 bp, Artificial Sequence
  chemically synthesized
ggagtttctctttgctttacac

SEQ ID NO: 1278458 - DNA, 22 bp, Artificial Sequence
  chemically synthesized
ttttttacagtgtgtaaagcaa

SEQ ID NO: 1278459 - DNA, 22 bp, Artificial Sequence
  chemically synthesized
tttttacagtgtgtaaagcaaa

SEQ ID NO: 1278460 - DNA, 22 bp, Artificial Sequence
  chemically synthesized
ttttacagtgtgtaaagcaaag

SEQ ID NO: 1278461 - DNA, 22 bp, Artificial Sequence
  chemically synthesized
tttacagtgtgtaaagcaaaga

SEQ ID NO: 1278462 - DNA, 22 bp, Artificial Sequence
  chemically synthesized
ttacagtgtgtaaagcaaagag

SEQ ID NO: 1278463 - DNA, 22 bp, Artificial Sequence
  chemically synthesized
tacagtgtgtaaagcaaagaga

SEQ ID NO: 1278464 - DNA, 22 bp, Artificial Sequence
  chemically synthesized
acagtgtgtaaagcaaagagaa

SEQ ID NO: 1278465 - DNA, 22 bp, Artificial Sequence
  chemically synthesized
cagtgtgtaaagcaaagagaaa

SEQ ID NO: 1278466 - DNA, 22 bp, Artificial Sequence
  chemically synthesized
taaagagtttggagtttctctt

SEQ ID NO: 1278467 - DNA, 22 bp, Artificial Sequence
  chemically synthesized
gtaaagagtttggagtttctct

SEQ ID NO: 1278468 - DNA, 22 bp, Artificial Sequence
  chemically synthesized
gcaaagcatatttgtaaagagt

SEQ ID NO: 1278469 - DNA, 22 bp, Artificial Sequence
  chemically synthesized
agcaaagcatatttgtaaagag

SEQ ID NO: 1278470 - DNA, 22 bp, Artificial Sequence
  chemically synthesized
tagcaaagcatatttgtaaaga

SEQ ID NO: 1278471 - DNA, 22 bp, Artificial Sequence
  chemically synthesized
tttagcaaagcatatttgtaaa

SEQ ID NO: 1278472 - DNA, 22 bp, Artificial Sequence
  chemically synthesized
ttctttagcaaagcatatttgt

SEQ ID NO: 1278473 - DNA, 22 bp, Artificial Sequence
  chemically synthesized
attctttagcaaagcatatttg

SEQ ID NO: 1278474 - DNA, 22 bp, Artificial Sequence
  chemically synthesized
caaactctttacaaatatgctt

SEQ ID NO: 1278475 - DNA, 22 bp, Artificial Sequence
  chemically synthesized
tttacaaatatgctttgctaaa

SEQ ID NO: 1278476 - DNA, 22 bp, Artificial Sequence
  chemically synthesized
tacaaatatgctttgctaaaga

SEQ ID NO: 1278477 - DNA, 22 bp, Artificial Sequence
  chemically synthesized
acaaatatgctttgctaaagaa

SEQ ID NO: 1278478 - DNA, 22 bp, Artificial Sequence
  chemically synthesized
caaatatgctttgctaaagaat

SEQ ID NO: 1278479 - DNA, 22 bp, Artificial Sequence
  chemically synthesized
tcaaataggtcttattctttag

SEQ ID NO: 1278480 - DNA, 22 bp, Artificial Sequence
  chemically synthesized
tgctatcaaataggtcttattc

SEQ ID NO: 1278481 - DNA, 22 bp, Artificial Sequence
  chemically synthesized
ttgtgctatcaaataggtctta

SEQ ID NO: 1278482 - DNA, 22 bp, Artificial Sequence
  chemically synthesized
tgctaaagaataagacctattt

SEQ ID NO: 1278483 - DNA, 22 bp, Artificial Sequence
  chemically synthesized
gctaaagaataagacctatttg

SEQ ID NO: 1278484 - DNA, 22 bp, Artificial Sequence
  chemically synthesized
ctaaagaataagacctatttga

SEQ ID NO: 1278485 - DNA, 22 bp, Artificial Sequence
  chemically synthesized
ccctgttgtgctatcaaatagg

SEQ ID NO: 1278486 - DNA, 22 bp, Artificial Sequence
  chemically synthesized
accctgttgtgctatcaaatag

SEQ ID NO: 1278487 - DNA, 22 bp, Artificial Sequence
  chemically synthesized
aagaataagacctatttgatag

SEQ ID NO: 1278488 - DNA, 22 bp, Artificial Sequence
  chemically synthesized
tacttaccctgttgtgctatca

SEQ ID NO: 1278489 - DNA, 22 bp, Artificial Sequence
  chemically synthesized
actatacttaccctgttgtgct

SEQ ID NO: 1278490 - DNA, 22 bp, Artificial Sequence
  chemically synthesized
ttgactatacttaccctgttgt

SEQ ID NO: 1278491 - DNA, 22 bp, Artificial Sequence
  chemically synthesized
tttgatagcacaacagggtaag

SEQ ID NO: 1278492 - DNA, 22 bp, Artificial Sequence
  chemically synthesized
ttattgactatacttaccctgt

SEQ ID NO: 1278493 - DNA, 22 bp, Artificial Sequence
  chemically synthesized
gatagcacaacagggtaagtat

SEQ ID NO: 1278494 - DNA, 22 bp, Artificial Sequence
  chemically synthesized
atagcacaacagggtaagtata

SEQ ID NO: 1278495 - DNA, 22 bp, Artificial Sequence
  chemically synthesized
agttattattgactatacttac

SEQ ID NO: 1278496 - DNA, 22 bp, Artificial Sequence
  chemically synthesized
caattaagttattattgactat

SEQ ID NO: 1278497 - DNA, 22 bp, Artificial Sequence
  chemically synthesized
acaattaagttattattgacta

SEQ ID NO: 1278498 - DNA, 22 bp, Artificial Sequence
  chemically synthesized
aatttacaattaagttattatt

SEQ ID NO: 1278499 - DNA, 22 bp, Artificial Sequence
  chemically synthesized
aaatttacaattaagttattat

SEQ ID NO: 1278500 - DNA, 22 bp, Artificial Sequence
  chemically synthesized
taaatttacaattaagttatta

SEQ ID NO: 1278501 - DNA, 22 bp, Artificial Sequence
  chemically synthesized
ttaaatttacaattaagttatt

SEQ ID NO: 1278502 - DNA, 22 bp, Artificial Sequence
  chemically synthesized
tttttaaatttacaattaagtt

SEQ ID NO: 1278503 - DNA, 22 bp, Artificial Sequence
  chemically synthesized
gttatttttaaatttacaatta

SEQ ID NO: 1278504 - DNA, 22 bp, Artificial Sequence
  chemically synthesized
agttatttttaaatttacaatt

SEQ ID NO: 1278505 - DNA, 22 bp, Artificial Sequence
  chemically synthesized
tagttatttttaaatttacaat

SEQ ID NO: 1278506 - DNA, 22 bp, Artificial Sequence
  chemically synthesized
ttagttatttttaaatttacaa

SEQ ID NO: 1278507 - DNA, 22 bp, Artificial Sequence
  chemically synthesized
ttttagttatttttaaatttac

SEQ ID NO: 1278508 - DNA, 22 bp, Artificial Sequence
  chemically synthesized
cactcttttagttatttttaaa

SEQ ID NO: 1278509 - DNA, 22 bp, Artificial Sequence
  chemically synthesized
aattgtaaatttaaaaataact

SEQ ID NO: 1278510 - DNA, 22 bp, Artificial Sequence
  chemically synthesized
attgtaaatttaaaaataacta

SEQ ID NO: 1278511 - DNA, 22 bp, Artificial Sequence
  chemically synthesized
taaatttaaaaataactaaaag

SEQ ID NO: 1278512 - DNA, 22 bp, Artificial Sequence
  chemically synthesized
aaaaataactaaaagagtgtaa

SEQ ID NO: 1278513 - DNA, 22 bp, Artificial Sequence
  chemically synthesized
caagcaatccaattacactctt

SEQ ID NO: 1278514 - DNA, 22 bp, Artificial Sequence
  chemically synthesized
aaaataactaaaagagtgtaat

SEQ ID NO: 1278515 - DNA, 22 bp, Artificial Sequence
  chemically synthesized
atgttacaagcaatccaattac

SEQ ID NO: 1278516 - DNA, 22 bp, Artificial Sequence
  chemically synthesized
catgttacaagcaatccaatta

SEQ ID NO: 1278517 - DNA, 22 bp, Artificial Sequence
  chemically synthesized
aaagagtgtaattggattgctt

SEQ ID NO: 1278518 - DNA, 22 bp, Artificial Sequence
  chemically synthesized
tccttcatgttacaagcaatcc

SEQ ID NO: 1278519 - DNA, 22 bp, Artificial Sequence
  chemically synthesized
atccttcatgttacaagcaatc

SEQ ID NO: 1278520 - DNA, 22 bp, Artificial Sequence
  chemically synthesized
aagcatttatccttcatgttac

SEQ ID NO: 1278521 - DNA, 22 bp, Artificial Sequence
  chemically synthesized
gattgcttgtaacatgaaggat

SEQ ID NO: 1278522 - DNA, 22 bp, Artificial Sequence
  chemically synthesized
cttgtaacatgaaggataaatg

SEQ ID NO: 1278523 - DNA, 22 bp, Artificial Sequence
  chemically synthesized
gtaacatgaaggataaatgctt

SEQ ID NO: 1278524 - DNA, 22 bp, Artificial Sequence
  chemically synthesized
taacatgaaggataaatgcttg

SEQ ID NO: 1278525 - DNA, 22 bp, Artificial Sequence
  chemically synthesized
gaggggtgtatatcccattctc

SEQ ID NO: 1278526 - DNA, 22 bp, Artificial Sequence
  chemically synthesized
aggggtgtatatcccattctcc

SEQ ID NO: 1278527 - DNA, 22 bp, Artificial Sequence
  chemically synthesized
tccatgatgtgattatttcaca

SEQ ID NO: 1278528 - DNA, 22 bp, Artificial Sequence
  chemically synthesized
catgatgtgattatttcacatt

SEQ ID NO: 1278529 - DNA, 22 bp, Artificial Sequence
  chemically synthesized
atacagacatgcaatgtgaaat

SEQ ID NO: 1278530 - DNA, 22 bp, Artificial Sequence
  chemically synthesized
gatacagacatgcaatgtgaaa

SEQ ID NO: 1278531 - DNA, 22 bp, Artificial Sequence
  chemically synthesized
tgatacagacatgcaatgtgaa

SEQ ID NO: 1278532 - DNA, 22 bp, Artificial Sequence
  chemically synthesized
tttcacattgcatgtctgtatc

SEQ ID NO: 1278533 - DNA, 22 bp, Artificial Sequence
  chemically synthesized
cacattgcatgtctgtatcaaa

SEQ ID NO: 1278534 - DNA, 22 bp, Artificial Sequence
  chemically synthesized
acattgcatgtctgtatcaaaa

SEQ ID NO: 1278535 - DNA, 22 bp, Artificial Sequence
  chemically synthesized
tggggtacatgagatgttttga

SEQ ID NO: 1278536 - DNA, 22 bp, Artificial Sequence
  chemically synthesized
atggggtacatgagatgttttg

SEQ ID NO: 1278537 - DNA, 22 bp, Artificial Sequence
  chemically synthesized
catgtctgtatcaaaacatctc

SEQ ID NO: 1278538 - DNA, 22 bp, Artificial Sequence
  chemically synthesized
tatcaaaacatctcatgtaccc

SEQ ID NO: 1278539 - DNA, 22 bp, Artificial Sequence
  chemically synthesized
atgtaccccataaatatatata

SEQ ID NO: 1278540 - DNA, 22 bp, Artificial Sequence
  chemically synthesized
tgggtacacaatagatatatat

SEQ ID NO: 1278541 - DNA, 22 bp, Artificial Sequence
  chemically synthesized
gtgggtacacaatagatatata

SEQ ID NO: 1278542 - DNA, 22 bp, Artificial Sequence
  chemically synthesized
tgtgggtacacaatagatatat

SEQ ID NO: 1278543 - DNA, 22 bp, Artificial Sequence
  chemically synthesized
ttgtgggtacacaatagatata

SEQ ID NO: 1278544 - DNA, 22 bp, Artificial Sequence
  chemically synthesized
tttttgtgggtacacaatagat

SEQ ID NO: 1278545 - DNA, 22 bp, Artificial Sequence
  chemically synthesized
atttttgtgggtacacaataga

SEQ ID NO: 1278546 - DNA, 22 bp, Artificial Sequence
  chemically synthesized
gtatcttatttttgtgggtaca

SEQ ID NO: 1278547 - DNA, 22 bp, Artificial Sequence
  chemically synthesized
agtatcttatttttgtgggtac

SEQ ID NO: 1278548 - DNA, 22 bp, Artificial Sequence
  chemically synthesized
tagtatcttatttttgtgggta

SEQ ID NO: 1278549 - DNA, 22 bp, Artificial Sequence
  chemically synthesized
ttagtatcttatttttgtgggt

SEQ ID NO: 1278550 - DNA, 22 bp, Artificial Sequence
  chemically synthesized
tatttttagtatcttatttttg

SEQ ID NO: 1278551 - DNA, 22 bp, Artificial Sequence
  chemically synthesized
ttgtgtacccacaaaaataaga

SEQ ID NO: 1278552 - DNA, 22 bp, Artificial Sequence
  chemically synthesized
gtatttttagtatcttattttt

SEQ ID NO: 1278553 - DNA, 22 bp, Artificial Sequence
  chemically synthesized
tgtatttttagtatcttatttt

SEQ ID NO: 1278554 - DNA, 22 bp, Artificial Sequence
  chemically synthesized
ttgtatttttagtatcttattt

SEQ ID NO: 1278555 - DNA, 22 bp, Artificial Sequence
  chemically synthesized
tgtacccacaaaaataagatac

SEQ ID NO: 1278556 - DNA, 22 bp, Artificial Sequence
  chemically synthesized
atttttgtatttttagtatctt

SEQ ID NO: 1278557 - DNA, 22 bp, Artificial Sequence
  chemically synthesized
aaaatacaaaaattagctggac

SEQ ID NO: 1278558 - DNA, 22 bp, Artificial Sequence
  chemically synthesized
caggtgtgcgccaccatgtcca

SEQ ID NO: 1278559 - DNA, 22 bp, Artificial Sequence
  chemically synthesized
ggattacaggtgtgcgccacca

SEQ ID NO: 1278560 - DNA, 22 bp, Artificial Sequence
  chemically synthesized
gctggacatggtggcgcacacc

SEQ ID NO: 1278561 - DNA, 22 bp, Artificial Sequence
  chemically synthesized
gacatggtggcgcacacctgta

SEQ ID NO: 1278562 - DNA, 22 bp, Artificial Sequence
  chemically synthesized
gggagctaggattacaggtgtg

SEQ ID NO: 1278563 - DNA, 22 bp, Artificial Sequence
  chemically synthesized
ctggggagctaggattacaggt

SEQ ID NO: 1278564 - DNA, 22 bp, Artificial Sequence
  chemically synthesized
agcctcctggggagctaggatt

SEQ ID NO: 1278565 - DNA, 22 bp, Artificial Sequence
  chemically synthesized
cctcagcctcctggggagctag

SEQ ID NO: 1278566 - DNA, 22 bp, Artificial Sequence
  chemically synthesized
ctgcctcagcctcctggggagc

SEQ ID NO: 1278567 - DNA, 22 bp, Artificial Sequence
  chemically synthesized
tcctgcctcagcctcctgggga

SEQ ID NO: 1278568 - DNA, 22 bp, Artificial Sequence
  chemically synthesized
taatcctagctccccaggaggc

SEQ ID NO: 1278569 - DNA, 22 bp, Artificial Sequence
  chemically synthesized
aagcgattctcctgcctcagcc

SEQ ID NO: 1278570 - DNA, 22 bp, Artificial Sequence
  chemically synthesized
gctccccaggaggctgaggcag

SEQ ID NO: 1278571 - DNA, 22 bp, Artificial Sequence
  chemically synthesized
cccaggaggctgaggcaggaga

SEQ ID NO: 1278572 - DNA, 22 bp, Artificial Sequence
  chemically synthesized
ccgggttcaagcgattctcctg

SEQ ID NO: 1278573 - DNA, 22 bp, Artificial Sequence
  chemically synthesized
cgcctcccgggttcaagcgatt

SEQ ID NO: 1278574 - DNA, 22 bp, Artificial Sequence
  chemically synthesized
aggcaggagaatcgcttgaacc

SEQ ID NO: 1278575 - DNA, 22 bp, Artificial Sequence
  chemically synthesized
caacctccgcctcccgggttca

SEQ ID NO: 1278576 - DNA, 22 bp, Artificial Sequence
  chemically synthesized
actgcaacctccgcctcccggg

SEQ ID NO: 1278577 - DNA, 22 bp, Artificial Sequence
  chemically synthesized
gctcactgcaacctccgcctcc

SEQ ID NO: 1278578 - DNA, 22 bp, Artificial Sequence
  chemically synthesized
ggctcactgcaacctccgcctc

SEQ ID NO: 1278579 - DNA, 22 bp, Artificial Sequence
  chemically synthesized
gaacccgggaggcggaggttgc

SEQ ID NO: 1278580 - DNA, 22 bp, Artificial Sequence
  chemically synthesized
aacccgggaggcggaggttgca

SEQ ID NO: 1278581 - DNA, 22 bp, Artificial Sequence
  chemically synthesized
gagtgcagtggcgccatcttgg

SEQ ID NO: 1278582 - DNA, 22 bp, Artificial Sequence
  chemically synthesized
cagtgagccaagatggcgccac

SEQ ID NO: 1278583 - DNA, 22 bp, Artificial Sequence
  chemically synthesized
tcacccaggctggagtgcagtg

SEQ ID NO: 1278584 - DNA, 22 bp, Artificial Sequence
  chemically synthesized
tgtcacccaggctggagtgcag

SEQ ID NO: 1278585 - DNA, 22 bp, Artificial Sequence
  chemically synthesized
gctctgtcacccaggctggagt

SEQ ID NO: 1278586 - DNA, 22 bp, Artificial Sequence
  chemically synthesized
cactccagcctgggtgacagag

SEQ ID NO: 1278587 - DNA, 22 bp, Artificial Sequence
  chemically synthesized
agatggagtctcgctctgtcac

SEQ ID NO: 1278588 - DNA, 22 bp, Artificial Sequence
  chemically synthesized
gagatggagtctcgctctgtca

SEQ ID NO: 1278589 - DNA, 22 bp, Artificial Sequence
  chemically synthesized
cagcctgggtgacagagcgaga

SEQ ID NO: 1278590 - DNA, 22 bp, Artificial Sequence
  chemically synthesized
tttgagatggagtctcgctctg

SEQ ID NO: 1278591 - DNA, 22 bp, Artificial Sequence
  chemically synthesized
ggtgacagagcgagactccatc

SEQ ID NO: 1278592 - DNA, 22 bp, Artificial Sequence
  chemically synthesized
tcagtattatttgagatggagt

SEQ ID NO: 1278593 - DNA, 22 bp, Artificial Sequence
  chemically synthesized
tcattatcagtattatttgaga

SEQ ID NO: 1278594 - DNA, 22 bp, Artificial Sequence
  chemically synthesized
tcattatcattatcagtattat

SEQ ID NO: 1278595 - DNA, 22 bp, Artificial Sequence
  chemically synthesized
catctcaaataatactgataat

SEQ ID NO: 1278596 - DNA, 22 bp, Artificial Sequence
  chemically synthesized
tcattatcattatcattatcag

SEQ ID NO: 1278597 - DNA, 22 bp, Artificial Sequence
  chemically synthesized
ttatcattatcattatcattat

SEQ ID NO: 1278598 - DNA, 22 bp, Artificial Sequence
  chemically synthesized
aaataatactgataatgataat

SEQ ID NO: 1278599 - DNA, 22 bp, Artificial Sequence
  chemically synthesized
attatcattatcattatcatta

SEQ ID NO: 1278600 - DNA, 22 bp, Artificial Sequence
  chemically synthesized
tattatcattatcattatcatt

SEQ ID NO: 1278601 - DNA, 22 bp, Artificial Sequence
  chemically synthesized
ttattatcattatcattatcat

SEQ ID NO: 1278602 - DNA, 22 bp, Artificial Sequence
  chemically synthesized
tttttattatcattatcattat

SEQ ID NO: 1278603 - DNA, 22 bp, Artificial Sequence
  chemically synthesized
ttatttttattatcattatcat

SEQ ID NO: 1278604 - DNA, 22 bp, Artificial Sequence
  chemically synthesized
ataatgataatgataatgataa

SEQ ID NO: 1278605 - DNA, 22 bp, Artificial Sequence
  chemically synthesized
gttattatttttattatcatta

SEQ ID NO: 1278606 - DNA, 22 bp, Artificial Sequence
  chemically synthesized
cgttattatttttattatcatt

SEQ ID NO: 1278607 - DNA, 22 bp, Artificial Sequence
  chemically synthesized
aatttcgttattatttttatta

SEQ ID NO: 1278608 - DNA, 22 bp, Artificial Sequence
  chemically synthesized
agaatccactgaatttcgttat

SEQ ID NO: 1278609 - DNA, 22 bp, Artificial Sequence
  chemically synthesized
ttcagaatccactgaatttcgt

SEQ ID NO: 1278610 - DNA, 22 bp, Artificial Sequence
  chemically synthesized
attcagaatccactgaatttcg

SEQ ID NO: 1278611 - DNA, 22 bp, Artificial Sequence
  chemically synthesized
tgccttattcagaatccactga

SEQ ID NO: 1278612 - DNA, 22 bp, Artificial Sequence
  chemically synthesized
ttgtgccttattcagaatccac

SEQ ID NO: 1278613 - DNA, 22 bp, Artificial Sequence
  chemically synthesized
attgtgccttattcagaatcca

SEQ ID NO: 1278614 - DNA, 22 bp, Artificial Sequence
  chemically synthesized
ttattgtgccttattcagaatc

SEQ ID NO: 1278615 - DNA, 22 bp, Artificial Sequence
  chemically synthesized
cttattgtgccttattcagaat

SEQ ID NO: 1278616 - DNA, 22 bp, Artificial Sequence
  chemically synthesized
ttcttattgtgccttattcaga

SEQ ID NO: 1278617 - DNA, 22 bp, Artificial Sequence
  chemically synthesized
agtggattctgaataaggcaca

SEQ ID NO: 1278618 - DNA, 22 bp, Artificial Sequence
  chemically synthesized
tgaataaggcacaataagaaga

SEQ ID NO: 1278619 - DNA, 22 bp, Artificial Sequence
  chemically synthesized
aataaggcacaataagaagaat

SEQ ID NO: 1278620 - DNA, 22 bp, Artificial Sequence
  chemically synthesized
aataaagaaaaagaaaattctt

SEQ ID NO: 1278621 - DNA, 22 bp, Artificial Sequence
  chemically synthesized
agactaaataaagaaaaagaaa

SEQ ID NO: 1278622 - DNA, 22 bp, Artificial Sequence
  chemically synthesized
agtgttaagactaaataaagaa

SEQ ID NO: 1278623 - DNA, 22 bp, Artificial Sequence
  chemically synthesized
cagtgttaagactaaataaaga

SEQ ID NO: 1278624 - DNA, 22 bp, Artificial Sequence
  chemically synthesized
tcagtgttaagactaaataaag

SEQ ID NO: 1278625 - DNA, 22 bp, Artificial Sequence
  chemically synthesized
ttcagtgttaagactaaataaa

SEQ ID NO: 1278626 - DNA, 22 bp, Artificial Sequence
  chemically synthesized
tctttttctttatttagtctta

SEQ ID NO: 1278627 - DNA, 22 bp, Artificial Sequence
  chemically synthesized
ctttttctttatttagtcttaa

SEQ ID NO: 1278628 - DNA, 22 bp, Artificial Sequence
  chemically synthesized
tttttctttatttagtcttaac

SEQ ID NO: 1278629 - DNA, 22 bp, Artificial Sequence
  chemically synthesized
agacttttcagtgttaagacta

SEQ ID NO: 1278630 - DNA, 22 bp, Artificial Sequence
  chemically synthesized
tttctttatttagtcttaacac

SEQ ID NO: 1278631 - DNA, 22 bp, Artificial Sequence
  chemically synthesized
ttctttatttagtcttaacact

SEQ ID NO: 1278632 - DNA, 22 bp, Artificial Sequence
  chemically synthesized
tctttatttagtcttaacactg

SEQ ID NO: 1278633 - DNA, 22 bp, Artificial Sequence
  chemically synthesized
attaagacttttcagtgttaag

SEQ ID NO: 1278634 - DNA, 22 bp, Artificial Sequence
  chemically synthesized
ctttatttagtcttaacactga

SEQ ID NO: 1278635 - DNA, 22 bp, Artificial Sequence
  chemically synthesized
tttatttagtcttaacactgaa

SEQ ID NO: 1278636 - DNA, 22 bp, Artificial Sequence
  chemically synthesized
tatttagtcttaacactgaaaa

SEQ ID NO: 1278637 - DNA, 22 bp, Artificial Sequence
  chemically synthesized
atttagtcttaacactgaaaag

SEQ ID NO: 1278638 - DNA, 22 bp, Artificial Sequence
  chemically synthesized
tttagtcttaacactgaaaagt

SEQ ID NO: 1278639 - DNA, 22 bp, Artificial Sequence
  chemically synthesized
agtcttaacactgaaaagtctt

SEQ ID NO: 1278640 - DNA, 22 bp, Artificial Sequence
  chemically synthesized
gtcttaacactgaaaagtctta

SEQ ID NO: 1278641 - DNA, 22 bp, Artificial Sequence
  chemically synthesized
aacactgaaaagtcttaatgaa

SEQ ID NO: 1278642 - DNA, 22 bp, Artificial Sequence
  chemically synthesized
acactgaaaagtcttaatgaat

SEQ ID NO: 1278643 - DNA, 22 bp, Artificial Sequence
  chemically synthesized
acatggtagatacacattcatt

SEQ ID NO: 1278644 - DNA, 22 bp, Artificial Sequence
  chemically synthesized
cacatggtagatacacattcat

SEQ ID NO: 1278645 - DNA, 22 bp, Artificial Sequence
  chemically synthesized
aaaagtcttaatgaatgtgtat

SEQ ID NO: 1278646 - DNA, 22 bp, Artificial Sequence
  chemically synthesized
atttcacatggtagatacacat

SEQ ID NO: 1278647 - DNA, 22 bp, Artificial Sequence
  chemically synthesized
tctaatttcacatggtagatac

SEQ ID NO: 1278648 - DNA, 22 bp, Artificial Sequence
  chemically synthesized
tgtctaatttcacatggtagat

SEQ ID NO: 1278649 - DNA, 22 bp, Artificial Sequence
  chemically synthesized
aatgaatgtgtatctaccatgt

SEQ ID NO: 1278650 - DNA, 22 bp, Artificial Sequence
  chemically synthesized
atgaatgtgtatctaccatgtg

SEQ ID NO: 1278651 - DNA, 22 bp, Artificial Sequence
  chemically synthesized
aattctgtctaatttcacatgg

SEQ ID NO: 1278652 - DNA, 22 bp, Artificial Sequence
  chemically synthesized
ttaaattctgtctaatttcaca

SEQ ID NO: 1278653 - DNA, 22 bp, Artificial Sequence
  chemically synthesized
aactgttaaattctgtctaatt

SEQ ID NO: 1278654 - DNA, 22 bp, Artificial Sequence
  chemically synthesized
aaactgttaaattctgtctaat

SEQ ID NO: 1278655 - DNA, 22 bp, Artificial Sequence
  chemically synthesized
taaactgttaaattctgtctaa

SEQ ID NO: 1278656 - DNA, 22 bp, Artificial Sequence
  chemically synthesized
ccatgtgaaattagacagaatt

SEQ ID NO: 1278657 - DNA, 22 bp, Artificial Sequence
  chemically synthesized
atattttaaactgttaaattct

SEQ ID NO: 1278658 - DNA, 22 bp, Artificial Sequence
  chemically synthesized
cattaatattttaaactgttaa

SEQ ID NO: 1278659 - DNA, 22 bp, Artificial Sequence
  chemically synthesized
ccattaatattttaaactgtta

SEQ ID NO: 1278660 - DNA, 22 bp, Artificial Sequence
  chemically synthesized
gacagaatttaacagtttaaaa

SEQ ID NO: 1278661 - DNA, 22 bp, Artificial Sequence
  chemically synthesized
aacagtttaaaatattaatgga

SEQ ID NO: 1278662 - DNA, 22 bp, Artificial Sequence
  chemically synthesized
acagtttaaaatattaatggaa

SEQ ID NO: 1278663 - DNA, 22 bp, Artificial Sequence
  chemically synthesized
aatgaaaaatatttccattaat

SEQ ID NO: 1278664 - DNA, 22 bp, Artificial Sequence
  chemically synthesized
aaaatattaatggaaatatttt

SEQ ID NO: 1278665 - DNA, 22 bp, Artificial Sequence
  chemically synthesized
aaatattaatggaaatattttt

SEQ ID NO: 1278666 - DNA, 22 bp, Artificial Sequence
  chemically synthesized
gaacaaatagattaaatgaaaa

SEQ ID NO: 1278667 - DNA, 22 bp, Artificial Sequence
  chemically synthesized
agaacaaatagattaaatgaaa

SEQ ID NO: 1278668 - DNA, 22 bp, Artificial Sequence
  chemically synthesized
atggaaatatttttcatttaat

SEQ ID NO: 1278669 - DNA, 22 bp, Artificial Sequence
  chemically synthesized
tttagaacaaatagattaaatg

SEQ ID NO: 1278670 - DNA, 22 bp, Artificial Sequence
  chemically synthesized
gcaattgtttagaacaaataga

SEQ ID NO: 1278671 - DNA, 22 bp, Artificial Sequence
  chemically synthesized
agcaattgtttagaacaaatag

SEQ ID NO: 1278672 - DNA, 22 bp, Artificial Sequence
  chemically synthesized
tagcaattgtttagaacaaata

SEQ ID NO: 1278673 - DNA, 22 bp, Artificial Sequence
  chemically synthesized
ttcatttaatctatttgttcta

SEQ ID NO: 1278674 - DNA, 22 bp, Artificial Sequence
  chemically synthesized
tcatttaatctatttgttctaa

SEQ ID NO: 1278675 - DNA, 22 bp, Artificial Sequence
  chemically synthesized
catttaatctatttgttctaaa

SEQ ID NO: 1278676 - DNA, 22 bp, Artificial Sequence
  chemically synthesized
atttaatctatttgttctaaac

SEQ ID NO: 1278677 - DNA, 22 bp, Artificial Sequence
  chemically synthesized
aatctatttgttctaaacaatt

SEQ ID NO: 1278678 - DNA, 22 bp, Artificial Sequence
  chemically synthesized
atctatttgttctaaacaattg

SEQ ID NO: 1278679 - DNA, 22 bp, Artificial Sequence
  chemically synthesized
tttgttctaaacaattgctaaa

SEQ ID NO: 1278680 - DNA, 22 bp, Artificial Sequence
  chemically synthesized
gttctaaacaattgctaaaata

SEQ ID NO: 1278681 - DNA, 22 bp, Artificial Sequence
  chemically synthesized
ttctaaacaattgctaaaatat

SEQ ID NO: 1278682 - DNA, 22 bp, Artificial Sequence
  chemically synthesized
gatgtaaccaaaatattttagc

SEQ ID NO: 1278683 - DNA, 22 bp, Artificial Sequence
  chemically synthesized
taaacaattgctaaaatatttt

SEQ ID NO: 1278684 - DNA, 22 bp, Artificial Sequence
  chemically synthesized
aacaattgctaaaatattttgg

SEQ ID NO: 1278685 - DNA, 22 bp, Artificial Sequence
  chemically synthesized
tgaggttagatgtaaccaaaat

SEQ ID NO: 1278686 - DNA, 22 bp, Artificial Sequence
  chemically synthesized
gtgaggttagatgtaaccaaaa

SEQ ID NO: 1278687 - DNA, 22 bp, Artificial Sequence
  chemically synthesized
tgtgaggttagatgtaaccaaa

SEQ ID NO: 1278688 - DNA, 22 bp, Artificial Sequence
  chemically synthesized
ctaaaatattttggttacatct

SEQ ID NO: 1278689 - DNA, 22 bp, Artificial Sequence
  chemically synthesized
cctttgtgaggttagatgtaac

SEQ ID NO: 1278690 - DNA, 22 bp, Artificial Sequence
  chemically synthesized
aaatattttggttacatctaac

SEQ ID NO: 1278691 - DNA, 22 bp, Artificial Sequence
  chemically synthesized
tggttacatctaacctcacaaa

SEQ ID NO: 1278692 - DNA, 22 bp, Artificial Sequence
  chemically synthesized
ggttacatctaacctcacaaag

SEQ ID NO: 1278693 - DNA, 22 bp, Artificial Sequence
  chemically synthesized
gttacatctaacctcacaaagg

SEQ ID NO: 1278694 - DNA, 22 bp, Artificial Sequence
  chemically synthesized
catctaacctcacaaaggcaac

SEQ ID NO: 1278695 - DNA, 22 bp, Artificial Sequence
  chemically synthesized
acctcacaaaggcaaccatttt

SEQ ID NO: 1278696 - DNA, 22 bp, Artificial Sequence
  chemically synthesized
acaaaggcaaccattttctatt

SEQ ID NO: 1278697 - DNA, 22 bp, Artificial Sequence
  chemically synthesized
tctattacttttctatattcac

SEQ ID NO: 1278698 - DNA, 22 bp, Artificial Sequence
  chemically synthesized
ctattacttttctatattcact

SEQ ID NO: 1278699 - DNA, 22 bp, Artificial Sequence
  chemically synthesized
tattacttttctatattcactt

SEQ ID NO: 1278700 - DNA, 22 bp, Artificial Sequence
  chemically synthesized
ttacttttctatattcactttt

SEQ ID NO: 1278701 - DNA, 22 bp, Artificial Sequence
  chemically synthesized
cttttctatattcacttttttc

SEQ ID NO: 1278702 - DNA, 22 bp, Artificial Sequence
  chemically synthesized
ttctatattcacttttttccta

SEQ ID NO: 1278703 - DNA, 22 bp, Artificial Sequence
  chemically synthesized
tctatattcacttttttcctat

SEQ ID NO: 1278704 - DNA, 22 bp, Artificial Sequence
  chemically synthesized
ctatattcacttttttcctatt

SEQ ID NO: 1278705 - DNA, 22 bp, Artificial Sequence
  chemically synthesized
tatattcacttttttcctatta

SEQ ID NO: 1278706 - DNA, 22 bp, Artificial Sequence
  chemically synthesized
tattcacttttttcctattatt

SEQ ID NO: 1278707 - DNA, 22 bp, Artificial Sequence
  chemically synthesized
acttttttcctattatttactg

SEQ ID NO: 1278708 - DNA, 22 bp, Artificial Sequence
  chemically synthesized
ttttcctattatttactgggtt

SEQ ID NO: 1278709 - DNA, 22 bp, Artificial Sequence
  chemically synthesized
tttcctattatttactgggttt

SEQ ID NO: 1278710 - DNA, 22 bp, Artificial Sequence
  chemically synthesized
ttcctattatttactgggtttc

SEQ ID NO: 1278711 - DNA, 22 bp, Artificial Sequence
  chemically synthesized
tcctattatttactgggtttct

SEQ ID NO: 1278712 - DNA, 22 bp, Artificial Sequence
  chemically synthesized
cctattatttactgggtttctt

SEQ ID NO: 1278713 - DNA, 22 bp, Artificial Sequence
  chemically synthesized
ctattatttactgggtttcttc

SEQ ID NO: 1278714 - DNA, 22 bp, Artificial Sequence
  chemically synthesized
ttatttactgggtttcttctgt

SEQ ID NO: 1278715 - DNA, 22 bp, Artificial Sequence
  chemically synthesized
tttactgggtttcttctgttat

SEQ ID NO: 1278716 - DNA, 22 bp, Artificial Sequence
  chemically synthesized
actgggtttcttctgttattgt

SEQ ID NO: 1278717 - DNA, 22 bp, Artificial Sequence
  chemically synthesized
ctgggtttcttctgttattgtt

SEQ ID NO: 1278718 - DNA, 22 bp, Artificial Sequence
  chemically synthesized
ggtttcttctgttattgttgtt

SEQ ID NO: 1278719 - DNA, 22 bp, Artificial Sequence
  chemically synthesized
aaaaaggaaaaaacaacaacaa

SEQ ID NO: 1278720 - DNA, 22 bp, Artificial Sequence
  chemically synthesized
cttctgttattgttgttgtttt

SEQ ID NO: 1278721 - DNA, 22 bp, Artificial Sequence
  chemically synthesized
ttctgttattgttgttgttttt

SEQ ID NO: 1278722 - DNA, 22 bp, Artificial Sequence
  chemically synthesized
tctcaaaaaggaaaaaacaaca

SEQ ID NO: 1278723 - DNA, 22 bp, Artificial Sequence
  chemically synthesized
ctgttattgttgttgttttttc

SEQ ID NO: 1278724 - DNA, 22 bp, Artificial Sequence
  chemically synthesized
tgtctcaaaaaggaaaaaacaa

SEQ ID NO: 1278725 - DNA, 22 bp, Artificial Sequence
  chemically synthesized
tgttattgttgttgttttttcc

SEQ ID NO: 1278726 - DNA, 22 bp, Artificial Sequence
  chemically synthesized
ttattgttgttgttttttcctt

SEQ ID NO: 1278727 - DNA, 22 bp, Artificial Sequence
  chemically synthesized
ttgttgttgttttttccttttt

SEQ ID NO: 1278728 - DNA, 22 bp, Artificial Sequence
  chemically synthesized
ttgttgttttttcctttttgag

SEQ ID NO: 1278729 - DNA, 22 bp, Artificial Sequence
  chemically synthesized
ttgttttttcctttttgagaca

SEQ ID NO: 1278730 - DNA, 22 bp, Artificial Sequence
  chemically synthesized
ttttttcctttttgagacagag

SEQ ID NO: 1278731 - DNA, 22 bp, Artificial Sequence
  chemically synthesized
tttcctttttgagacagaggtt

SEQ ID NO: 1278732 - DNA, 22 bp, Artificial Sequence
  chemically synthesized
ttcctttttgagacagaggttc

SEQ ID NO: 1278733 - DNA, 22 bp, Artificial Sequence
  chemically synthesized
ggcaacaagagtgaacctctgt

SEQ ID NO: 1278734 - DNA, 22 bp, Artificial Sequence
  chemically synthesized
tcctttttgagacagaggttca

SEQ ID NO: 1278735 - DNA, 22 bp, Artificial Sequence
  chemically synthesized
cctttttgagacagaggttcac

SEQ ID NO: 1278736 - DNA, 22 bp, Artificial Sequence
  chemically synthesized
ctttttgagacagaggttcact

SEQ ID NO: 1278737 - DNA, 22 bp, Artificial Sequence
  chemically synthesized
tttgagacagaggttcactctt

SEQ ID NO: 1278738 - DNA, 22 bp, Artificial Sequence
  chemically synthesized
ttgagacagaggttcactcttg

SEQ ID NO: 1278739 - DNA, 22 bp, Artificial Sequence
  chemically synthesized
cagcctgggcaacaagagtgaa

SEQ ID NO: 1278740 - DNA, 22 bp, Artificial Sequence
  chemically synthesized
tgagacagaggttcactcttgt

SEQ ID NO: 1278741 - DNA, 22 bp, Artificial Sequence
  chemically synthesized
gagacagaggttcactcttgtt

SEQ ID NO: 1278742 - DNA, 22 bp, Artificial Sequence
  chemically synthesized
agacagaggttcactcttgttg

SEQ ID NO: 1278743 - DNA, 22 bp, Artificial Sequence
  chemically synthesized
cactccagcctgggcaacaaga

SEQ ID NO: 1278744 - DNA, 22 bp, Artificial Sequence
  chemically synthesized
cgccactgcactccagcctggg

SEQ ID NO: 1278745 - DNA, 22 bp, Artificial Sequence
  chemically synthesized
actcttgttgcccaggctggag

SEQ ID NO: 1278746 - DNA, 22 bp, Artificial Sequence
  chemically synthesized
ttgttgcccaggctggagtgca

SEQ ID NO: 1278747 - DNA, 22 bp, Artificial Sequence
  chemically synthesized
gttgcccaggctggagtgcagt

SEQ ID NO: 1278748 - DNA, 22 bp, Artificial Sequence
  chemically synthesized
ttgcccaggctggagtgcagtg

SEQ ID NO: 1278749 - DNA, 22 bp, Artificial Sequence
  chemically synthesized
cccaggctggagtgcagtggcg

SEQ ID NO: 1278750 - DNA, 22 bp, Artificial Sequence
  chemically synthesized
ccatgagccgaaattgcgccac

SEQ ID NO: 1278751 - DNA, 22 bp, Artificial Sequence
  chemically synthesized
gagtgcagtggcgcaatttcgg

SEQ ID NO: 1278752 - DNA, 22 bp, Artificial Sequence
  chemically synthesized
aacccgggaggcagaggttgcc

SEQ ID NO: 1278753 - DNA, 22 bp, Artificial Sequence
  chemically synthesized
gaacccgggaggcagaggttgc

SEQ ID NO: 1278754 - DNA, 22 bp, Artificial Sequence
  chemically synthesized
cggctcatggcaacctctgcct

SEQ ID NO: 1278755 - DNA, 22 bp, Artificial Sequence
  chemically synthesized
ggctcatggcaacctctgcctc

SEQ ID NO: 1278756 - DNA, 22 bp, Artificial Sequence
  chemically synthesized
atggcaacctctgcctcccggg

SEQ ID NO: 1278757 - DNA, 22 bp, Artificial Sequence
  chemically synthesized
aggcaggagaatcacttgaacc

SEQ ID NO: 1278758 - DNA, 22 bp, Artificial Sequence
  chemically synthesized
tgcctcccgggttcaagtgatt

SEQ ID NO: 1278759 - DNA, 22 bp, Artificial Sequence
  chemically synthesized
cctcccgggttcaagtgattct

SEQ ID NO: 1278760 - DNA, 22 bp, Artificial Sequence
  chemically synthesized
ccgggttcaagtgattctcctg

SEQ ID NO: 1278761 - DNA, 22 bp, Artificial Sequence
  chemically synthesized
aggaggctgaggcaggagaatc

SEQ ID NO: 1278762 - DNA, 22 bp, Artificial Sequence
  chemically synthesized
ctcaggaggctgaggcaggaga

SEQ ID NO: 1278763 - DNA, 22 bp, Artificial Sequence
  chemically synthesized
aagtgattctcctgcctcagcc

SEQ ID NO: 1278764 - DNA, 22 bp, Artificial Sequence
  chemically synthesized
taatcccagctactcaggaggc

SEQ ID NO: 1278765 - DNA, 22 bp, Artificial Sequence
  chemically synthesized
tcctgcctcagcctcctgagta

SEQ ID NO: 1278766 - DNA, 22 bp, Artificial Sequence
  chemically synthesized
ctgcctcagcctcctgagtagc

SEQ ID NO: 1278767 - DNA, 22 bp, Artificial Sequence
  chemically synthesized
cctcagcctcctgagtagctgg

SEQ ID NO: 1278768 - DNA, 22 bp, Artificial Sequence
  chemically synthesized
agcctcctgagtagctgggatt

SEQ ID NO: 1278769 - DNA, 22 bp, Artificial Sequence
  chemically synthesized
gtggcaggcatctgtaatccca

SEQ ID NO: 1278770 - DNA, 22 bp, Artificial Sequence
  chemically synthesized
ctgagtagctgggattacagat

SEQ ID NO: 1278771 - DNA, 22 bp, Artificial Sequence
  chemically synthesized
acctggtggcaggcatctgtaa

SEQ ID NO: 1278772 - DNA, 22 bp, Artificial Sequence
  chemically synthesized
agtagctgggattacagatgcc

SEQ ID NO: 1278773 - DNA, 22 bp, Artificial Sequence
  chemically synthesized
gcctgacctggtggcaggcatc

SEQ ID NO: 1278774 - DNA, 22 bp, Artificial Sequence
  chemically synthesized
ggattacagatgcctgccacca

SEQ ID NO: 1278775 - DNA, 22 bp, Artificial Sequence
  chemically synthesized
cagatgcctgccaccaggtcag

SEQ ID NO: 1278776 - DNA, 22 bp, Artificial Sequence
  chemically synthesized
aaaatacaaaaattagcctgac

SEQ ID NO: 1278777 - DNA, 22 bp, Artificial Sequence
  chemically synthesized
ctaaaaatacaaaaattagcct

SEQ ID NO: 1278778 - DNA, 22 bp, Artificial Sequence
  chemically synthesized
ccaccaggtcaggctaattttt

SEQ ID NO: 1278779 - DNA, 22 bp, Artificial Sequence
  chemically synthesized
tactaaaaatacaaaaattagc

SEQ ID NO: 1278780 - DNA, 22 bp, Artificial Sequence
  chemically synthesized
atttttgtatttttagtagaga

SEQ ID NO: 1278781 - DNA, 22 bp, Artificial Sequence
  chemically synthesized
ttgtatttttagtagagatggg

SEQ ID NO: 1278782 - DNA, 22 bp, Artificial Sequence
  chemically synthesized
tgtatttttagtagagatgggg

SEQ ID NO: 1278783 - DNA, 22 bp, Artificial Sequence
  chemically synthesized
gtatttttagtagagatggggt

SEQ ID NO: 1278784 - DNA, 22 bp, Artificial Sequence
  chemically synthesized
tatttttagtagagatggggtt

SEQ ID NO: 1278785 - DNA, 22 bp, Artificial Sequence
  chemically synthesized
gccaacatggtgaaaccccatc

SEQ ID NO: 1278786 - DNA, 22 bp, Artificial Sequence
  chemically synthesized
ttagtagagatggggtttcacc

SEQ ID NO: 1278787 - DNA, 22 bp, Artificial Sequence
  chemically synthesized
tagtagagatggggtttcacca

SEQ ID NO: 1278788 - DNA, 22 bp, Artificial Sequence
  chemically synthesized
agtagagatggggtttcaccat

SEQ ID NO: 1278789 - DNA, 22 bp, Artificial Sequence
  chemically synthesized
gtagagatggggtttcaccatg

SEQ ID NO: 1278790 - DNA, 22 bp, Artificial Sequence
  chemically synthesized
aagaccagcctggccaacatgg

SEQ ID NO: 1278791 - DNA, 22 bp, Artificial Sequence
  chemically synthesized
caccatgttggccaggctggtc

SEQ ID NO: 1278792 - DNA, 22 bp, Artificial Sequence
  chemically synthesized
accatgttggccaggctggtct

SEQ ID NO: 1278793 - DNA, 22 bp, Artificial Sequence
  chemically synthesized
gaagtcaagagttcaagaccag

SEQ ID NO: 1278794 - DNA, 22 bp, Artificial Sequence
  chemically synthesized
gccaggctggtcttgaactctt

SEQ ID NO: 1278795 - DNA, 22 bp, Artificial Sequence
  chemically synthesized
gtcttgaactcttgacttccag

SEQ ID NO: 1278796 - DNA, 22 bp, Artificial Sequence
  chemically synthesized
gaactcttgacttccagtcatc

SEQ ID NO: 1278797 - DNA, 22 bp, Artificial Sequence
  chemically synthesized
aactcttgacttccagtcatcc

SEQ ID NO: 1278798 - DNA, 22 bp, Artificial Sequence
  chemically synthesized
ggaggccaaggcaagcggatga

SEQ ID NO: 1278799 - DNA, 22 bp, Artificial Sequence
  chemically synthesized
ttgacttccagtcatccgcttg

SEQ ID NO: 1278800 - DNA, 22 bp, Artificial Sequence
  chemically synthesized
gggaggccaaggcaagcggatg

SEQ ID NO: 1278801 - DNA, 22 bp, Artificial Sequence
  chemically synthesized
tgggaggccaaggcaagcggat

SEQ ID NO: 1278802 - DNA, 22 bp, Artificial Sequence
  chemically synthesized
gacttccagtcatccgcttgcc

SEQ ID NO: 1278803 - DNA, 22 bp, Artificial Sequence
  chemically synthesized
acttccagtcatccgcttgcct

SEQ ID NO: 1278804 - DNA, 22 bp, Artificial Sequence
  chemically synthesized
ccagtcatccgcttgccttggc

SEQ ID NO: 1278805 - DNA, 22 bp, Artificial Sequence
  chemically synthesized
cagtcatccgcttgccttggcc

SEQ ID NO: 1278806 - DNA, 22 bp, Artificial Sequence
  chemically synthesized
taatcccagcactttgggaggc

SEQ ID NO: 1278807 - DNA, 22 bp, Artificial Sequence
  chemically synthesized
gtaatcccagcactttgggagg

SEQ ID NO: 1278808 - DNA, 22 bp, Artificial Sequence
  chemically synthesized
gccttggcctcccaaagtgctg

SEQ ID NO: 1278809 - DNA, 22 bp, Artificial Sequence
  chemically synthesized
ccttggcctcccaaagtgctgg

SEQ ID NO: 1278810 - DNA, 22 bp, Artificial Sequence
  chemically synthesized
acgcttgtaatcccagcacttt

SEQ ID NO: 1278811 - DNA, 22 bp, Artificial Sequence
  chemically synthesized
ggcctcccaaagtgctgggatt

SEQ ID NO: 1278812 - DNA, 22 bp, Artificial Sequence
  chemically synthesized
gcctcccaaagtgctgggatta

SEQ ID NO: 1278813 - DNA, 22 bp, Artificial Sequence
  chemically synthesized
ccaaagtgctgggattacaagc

SEQ ID NO: 1278814 - DNA, 22 bp, Artificial Sequence
  chemically synthesized
agtgcggtggctcacgcttgta

SEQ ID NO: 1278815 - DNA, 22 bp, Artificial Sequence
  chemically synthesized
gctgagtgcggtggctcacgct

SEQ ID NO: 1278816 - DNA, 22 bp, Artificial Sequence
  chemically synthesized
ggattacaagcgtgagccaccg

SEQ ID NO: 1278817 - DNA, 22 bp, Artificial Sequence
  chemically synthesized
acaaactggctgagtgcggtgg

SEQ ID NO: 1278818 - DNA, 22 bp, Artificial Sequence
  chemically synthesized
caagcgtgagccaccgcactca

SEQ ID NO: 1278819 - DNA, 22 bp, Artificial Sequence
  chemically synthesized
ataaaaacctaacaaactggct

SEQ ID NO: 1278820 - DNA, 22 bp, Artificial Sequence
  chemically synthesized
cacctaataaaaacctaacaaa

SEQ ID NO: 1278821 - DNA, 22 bp, Artificial Sequence
  chemically synthesized
gcacctaataaaaacctaacaa

SEQ ID NO: 1278822 - DNA, 22 bp, Artificial Sequence
  chemically synthesized
agccagtttgttaggtttttat

SEQ ID NO: 1278823 - DNA, 22 bp, Artificial Sequence
  chemically synthesized
gttaggtttttattaggtgcaa

SEQ ID NO: 1278824 - DNA, 22 bp, Artificial Sequence
  chemically synthesized
ttaggtttttattaggtgcaag

SEQ ID NO: 1278825 - DNA, 22 bp, Artificial Sequence
  chemically synthesized
ggtttttattaggtgcaagatt

SEQ ID NO: 1278826 - DNA, 22 bp, Artificial Sequence
  chemically synthesized
aaaaatacagcacaatcttgca

SEQ ID NO: 1278827 - DNA, 22 bp, Artificial Sequence
  chemically synthesized
ttattaggtgcaagattgtgct

SEQ ID NO: 1278828 - DNA, 22 bp, Artificial Sequence
  chemically synthesized
attaaaaaatacagcacaatct

SEQ ID NO: 1278829 - DNA, 22 bp, Artificial Sequence
  chemically synthesized
tattaggtgcaagattgtgctg

SEQ ID NO: 1278830 - DNA, 22 bp, Artificial Sequence
  chemically synthesized
attaggtgcaagattgtgctgt

SEQ ID NO: 1278831 - DNA, 22 bp, Artificial Sequence
  chemically synthesized
ttaggtgcaagattgtgctgta

SEQ ID NO: 1278832 - DNA, 22 bp, Artificial Sequence
  chemically synthesized
ttgattaaaaaatacagcacaa

SEQ ID NO: 1278833 - DNA, 22 bp, Artificial Sequence
  chemically synthesized
attgattaaaaaatacagcaca

SEQ ID NO: 1278834 - DNA, 22 bp, Artificial Sequence
  chemically synthesized
tattgattaaaaaatacagcac

SEQ ID NO: 1278835 - DNA, 22 bp, Artificial Sequence
  chemically synthesized
ggtgcaagattgtgctgtattt

SEQ ID NO: 1278836 - DNA, 22 bp, Artificial Sequence
  chemically synthesized
ttattgattaaaaaatacagca

SEQ ID NO: 1278837 - DNA, 22 bp, Artificial Sequence
  chemically synthesized
tgtttttattgattaaaaaata

SEQ ID NO: 1278838 - DNA, 22 bp, Artificial Sequence
  chemically synthesized
gtgtttttattgattaaaaaat

SEQ ID NO: 1278839 - DNA, 22 bp, Artificial Sequence
  chemically synthesized
cttgtgtttttattgattaaaa

SEQ ID NO: 1278840 - DNA, 22 bp, Artificial Sequence
  chemically synthesized
gcttgtgtttttattgattaaa

SEQ ID NO: 1278841 - DNA, 22 bp, Artificial Sequence
  chemically synthesized
tgctgtattttttaatcaataa

SEQ ID NO: 1278842 - DNA, 22 bp, Artificial Sequence
  chemically synthesized
tggcttgcttgtgtttttattg

SEQ ID NO: 1278843 - DNA, 22 bp, Artificial Sequence
  chemically synthesized
tattttttaatcaataaaaaca

SEQ ID NO: 1278844 - DNA, 22 bp, Artificial Sequence
  chemically synthesized
tttaatcaataaaaacacaagc

SEQ ID NO: 1278845 - DNA, 22 bp, Artificial Sequence
  chemically synthesized
gagctgtggcttgcttgtgttt

SEQ ID NO: 1278846 - DNA, 22 bp, Artificial Sequence
  chemically synthesized
ttaatcaataaaaacacaagca

SEQ ID NO: 1278847 - DNA, 22 bp, Artificial Sequence
  chemically synthesized
ggagctgtggcttgcttgtgtt

SEQ ID NO: 1278848 - DNA, 22 bp, Artificial Sequence
  chemically synthesized
taatcaataaaaacacaagcaa

SEQ ID NO: 1278849 - DNA, 22 bp, Artificial Sequence
  chemically synthesized
aatcaataaaaacacaagcaag

SEQ ID NO: 1278850 - DNA, 22 bp, Artificial Sequence
  chemically synthesized
ttggagctgtggcttgcttgtg

SEQ ID NO: 1278851 - DNA, 22 bp, Artificial Sequence
  chemically synthesized
atcaataaaaacacaagcaagc

SEQ ID NO: 1278852 - DNA, 22 bp, Artificial Sequence
  chemically synthesized
cttggagctgtggcttgcttgt

SEQ ID NO: 1278853 - DNA, 22 bp, Artificial Sequence
  chemically synthesized
tacacttcttggagctgtggct

SEQ ID NO: 1278854 - DNA, 22 bp, Artificial Sequence
  chemically synthesized
ttgtacacttcttggagctgtg

SEQ ID NO: 1278855 - DNA, 22 bp, Artificial Sequence
  chemically synthesized
gttgtacacttcttggagctgt

SEQ ID NO: 1278856 - DNA, 22 bp, Artificial Sequence
  chemically synthesized
cagtcaaatcatttgttgtaca

SEQ ID NO: 1278857 - DNA, 22 bp, Artificial Sequence
  chemically synthesized
tccagtcaaatcatttgttgta

SEQ ID NO: 1278858 - DNA, 22 bp, Artificial Sequence
  chemically synthesized
caagaagtgtacaacaaatgat

SEQ ID NO: 1278859 - DNA, 22 bp, Artificial Sequence
  chemically synthesized
ttctccagtcaaatcatttgtt

SEQ ID NO: 1278860 - DNA, 22 bp, Artificial Sequence
  chemically synthesized
aaaaaattattctccagtcaaa

SEQ ID NO: 1278861 - DNA, 22 bp, Artificial Sequence
  chemically synthesized
gttaaaaaaattattctccagt

SEQ ID NO: 1278862 - DNA, 22 bp, Artificial Sequence
  chemically synthesized
agttaaaaaaattattctccag

SEQ ID NO: 1278863 - DNA, 22 bp, Artificial Sequence
  chemically synthesized
gactggagaataatttttttaa

SEQ ID NO: 1278864 - DNA, 22 bp, Artificial Sequence
  chemically synthesized
actggagaataatttttttaac

SEQ ID NO: 1278865 - DNA, 22 bp, Artificial Sequence
  chemically synthesized
gagaataatttttttaactaaa

SEQ ID NO: 1278866 - DNA, 22 bp, Artificial Sequence
  chemically synthesized
tatagtgtgaccaagtatttag

SEQ ID NO: 1278867 - DNA, 22 bp, Artificial Sequence
  chemically synthesized
atatagtgtgaccaagtattta

SEQ ID NO: 1278868 - DNA, 22 bp, Artificial Sequence
  chemically synthesized
ttttaactaaatacttggtcac

SEQ ID NO: 1278869 - DNA, 22 bp, Artificial Sequence
  chemically synthesized
tttaactaaatacttggtcaca

SEQ ID NO: 1278870 - DNA, 22 bp, Artificial Sequence
  chemically synthesized
ttaactaaatacttggtcacac

SEQ ID NO: 1278871 - DNA, 22 bp, Artificial Sequence
  chemically synthesized
taactaaatacttggtcacact

SEQ ID NO: 1278872 - DNA, 22 bp, Artificial Sequence
  chemically synthesized
aactaaatacttggtcacacta

SEQ ID NO: 1278873 - DNA, 22 bp, Artificial Sequence
  chemically synthesized
actaaatacttggtcacactat

SEQ ID NO: 1278874 - DNA, 22 bp, Artificial Sequence
  chemically synthesized
acatgccacttatatagtgtga

SEQ ID NO: 1278875 - DNA, 22 bp, Artificial Sequence
  chemically synthesized
cacatgccacttatatagtgtg

SEQ ID NO: 1278876 - DNA, 22 bp, Artificial Sequence
  chemically synthesized
aatacttggtcacactatataa

SEQ ID NO: 1278877 - DNA, 22 bp, Artificial Sequence
  chemically synthesized
ttcacatgccacttatatagtg

SEQ ID NO: 1278878 - DNA, 22 bp, Artificial Sequence
  chemically synthesized
cttcacatgccacttatatagt

SEQ ID NO: 1278879 - DNA, 22 bp, Artificial Sequence
  chemically synthesized
tcttcacatgccacttatatag

SEQ ID NO: 1278880 - DNA, 22 bp, Artificial Sequence
  chemically synthesized
ttcttcacatgccacttatata

SEQ ID NO: 1278881 - DNA, 22 bp, Artificial Sequence
  chemically synthesized
tttcttcacatgccacttatat

SEQ ID NO: 1278882 - DNA, 22 bp, Artificial Sequence
  chemically synthesized
ggtcacactatataagtggcat

SEQ ID NO: 1278883 - DNA, 22 bp, Artificial Sequence
  chemically synthesized
ttttttcttcacatgccactta

SEQ ID NO: 1278884 - DNA, 22 bp, Artificial Sequence
  chemically synthesized
gtcacactatataagtggcatg

SEQ ID NO: 1278885 - DNA, 22 bp, Artificial Sequence
  chemically synthesized
tataagtggcatgtgaagaaaa

SEQ ID NO: 1278886 - DNA, 22 bp, Artificial Sequence
  chemically synthesized
ggcccaaagtgactgttttttc

SEQ ID NO: 1278887 - DNA, 22 bp, Artificial Sequence
  chemically synthesized
cggcccaaagtgactgtttttt

SEQ ID NO: 1278888 - DNA, 22 bp, Artificial Sequence
  chemically synthesized
tcggcccaaagtgactgttttt

SEQ ID NO: 1278889 - DNA, 22 bp, Artificial Sequence
  chemically synthesized
aaattttcggcccaaagtgact

SEQ ID NO: 1278890 - DNA, 22 bp, Artificial Sequence
  chemically synthesized
cctgaaattttcggcccaaagt

SEQ ID NO: 1278891 - DNA, 22 bp, Artificial Sequence
  chemically synthesized
ccctgaaattttcggcccaaag

SEQ ID NO: 1278892 - DNA, 22 bp, Artificial Sequence
  chemically synthesized
tccctgaaattttcggcccaaa

SEQ ID NO: 1278893 - DNA, 22 bp, Artificial Sequence
  chemically synthesized
ttccctgaaattttcggcccaa

SEQ ID NO: 1278894 - DNA, 22 bp, Artificial Sequence
  chemically synthesized
tttccctgaaattttcggccca

SEQ ID NO: 1278895 - DNA, 22 bp, Artificial Sequence
  chemically synthesized
ttttccctgaaattttcggccc

SEQ ID NO: 1278896 - DNA, 22 bp, Artificial Sequence
  chemically synthesized
tgggccgaaaatttcagggaaa

SEQ ID NO: 1278897 - DNA, 22 bp, Artificial Sequence
  chemically synthesized
cataagggtttttttccctgaa

SEQ ID NO: 1278898 - DNA, 22 bp, Artificial Sequence
  chemically synthesized
gggccgaaaatttcagggaaaa

SEQ ID NO: 1278899 - DNA, 22 bp, Artificial Sequence
  chemically synthesized
ggccgaaaatttcagggaaaaa

SEQ ID NO: 1278900 - DNA, 22 bp, Artificial Sequence
  chemically synthesized
ctccataagggtttttttccct

SEQ ID NO: 1278901 - DNA, 22 bp, Artificial Sequence
  chemically synthesized
actccataagggtttttttccc

SEQ ID NO: 1278902 - DNA, 22 bp, Artificial Sequence
  chemically synthesized
tactccataagggtttttttcc

SEQ ID NO: 1278903 - DNA, 22 bp, Artificial Sequence
  chemically synthesized
ttactccataagggtttttttc

SEQ ID NO: 1278904 - DNA, 22 bp, Artificial Sequence
  chemically synthesized
tttttactccataagggttttt

SEQ ID NO: 1278905 - DNA, 22 bp, Artificial Sequence
  chemically synthesized
cagggaaaaaaacccttatgga

SEQ ID NO: 1278906 - DNA, 22 bp, Artificial Sequence
  chemically synthesized
agggaaaaaaacccttatggag

SEQ ID NO: 1278907 - DNA, 22 bp, Artificial Sequence
  chemically synthesized
taaagttatttttactccataa

SEQ ID NO: 1278908 - DNA, 22 bp, Artificial Sequence
  chemically synthesized
agcaataaactataaagttatt

SEQ ID NO: 1278909 - DNA, 22 bp, Artificial Sequence
  chemically synthesized
atggagtaaaaataactttata

SEQ ID NO: 1278910 - DNA, 22 bp, Artificial Sequence
  chemically synthesized
tggagtaaaaataactttatag

SEQ ID NO: 1278911 - DNA, 22 bp, Artificial Sequence
  chemically synthesized
tatagtttattgctgaatgatt

SEQ ID NO: 1278912 - DNA, 22 bp, Artificial Sequence
  chemically synthesized
atagtttattgctgaatgattt

SEQ ID NO: 1278913 - DNA, 22 bp, Artificial Sequence
  chemically synthesized
tagtttattgctgaatgattta

SEQ ID NO: 1278914 - DNA, 22 bp, Artificial Sequence
  chemically synthesized
tatcaataaaaatgtaaatcat

SEQ ID NO: 1278915 - DNA, 22 bp, Artificial Sequence
  chemically synthesized
attgctgaatgatttacatttt

SEQ ID NO: 1278916 - DNA, 22 bp, Artificial Sequence
  chemically synthesized
gctgtatcaataaaaatgtaaa

SEQ ID NO: 1278917 - DNA, 22 bp, Artificial Sequence
  chemically synthesized
ttgctgaatgatttacattttt

SEQ ID NO: 1278918 - DNA, 22 bp, Artificial Sequence
  chemically synthesized
ctgaatgatttacatttttatt

SEQ ID NO: 1278919 - DNA, 22 bp, Artificial Sequence
  chemically synthesized
aatgatttacatttttattgat

SEQ ID NO: 1278920 - DNA, 22 bp, Artificial Sequence
  chemically synthesized
acatttttattgatacagctaa

SEQ ID NO: 1278921 - DNA, 22 bp, Artificial Sequence
  chemically synthesized
agtatatacaagttagctgtat

SEQ ID NO: 1278922 - DNA, 22 bp, Artificial Sequence
  chemically synthesized
catttttattgatacagctaac

SEQ ID NO: 1278923 - DNA, 22 bp, Artificial Sequence
  chemically synthesized
ttattgatacagctaacttgta

SEQ ID NO: 1278924 - DNA, 22 bp, Artificial Sequence
  chemically synthesized
acactgagtatatacaagttag

SEQ ID NO: 1278925 - DNA, 22 bp, Artificial Sequence
  chemically synthesized
tattgatacagctaacttgtat

SEQ ID NO: 1278926 - DNA, 22 bp, Artificial Sequence
  chemically synthesized
attgatacagctaacttgtata

SEQ ID NO: 1278927 - DNA, 22 bp, Artificial Sequence
  chemically synthesized
ttgatacagctaacttgtatat

SEQ ID NO: 1278928 - DNA, 22 bp, Artificial Sequence
  chemically synthesized
atacagctaacttgtatatact

SEQ ID NO: 1278929 - DNA, 22 bp, Artificial Sequence
  chemically synthesized
agaactaacactgagtatatac

SEQ ID NO: 1278930 - DNA, 22 bp, Artificial Sequence
  chemically synthesized
acttgtatatactcagtgttag

SEQ ID NO: 1278931 - DNA, 22 bp, Artificial Sequence
  chemically synthesized
aatatgattaagaactaacact

SEQ ID NO: 1278932 - DNA, 22 bp, Artificial Sequence
  chemically synthesized
gtatatactcagtgttagttct

SEQ ID NO: 1278933 - DNA, 22 bp, Artificial Sequence
  chemically synthesized
tatatactcagtgttagttctt

SEQ ID NO: 1278934 - DNA, 22 bp, Artificial Sequence
  chemically synthesized
agtgttagttcttaatcatatt

SEQ ID NO: 1278935 - DNA, 22 bp, Artificial Sequence
  chemically synthesized
gttcttaatcatatttaatgcc

SEQ ID NO: 1278936 - DNA, 22 bp, Artificial Sequence
  chemically synthesized
ttaatcatatttaatgcctgtt

SEQ ID NO: 1278937 - DNA, 22 bp, Artificial Sequence
  chemically synthesized
aatcatatttaatgcctgttac

SEQ ID NO: 1278938 - DNA, 22 bp, Artificial Sequence
  chemically synthesized
atcatatttaatgcctgttaca

SEQ ID NO: 1278939 - DNA, 22 bp, Artificial Sequence
  chemically synthesized
atgaggaatgtggcatgtgtaa

SEQ ID NO: 1278940 - DNA, 22 bp, Artificial Sequence
  chemically synthesized
catgaggaatgtggcatgtgta

SEQ ID NO: 1278941 - DNA, 22 bp, Artificial Sequence
  chemically synthesized
aatgcctgttacacatgccaca

SEQ ID NO: 1278942 - DNA, 22 bp, Artificial Sequence
  chemically synthesized
atgcctgttacacatgccacat

SEQ ID NO: 1278943 - DNA, 22 bp, Artificial Sequence
  chemically synthesized
ttacacatgccacattcctcat

SEQ ID NO: 1278944 - DNA, 22 bp, Artificial Sequence
  chemically synthesized
cacatgccacattcctcatgaa

SEQ ID NO: 1278945 - DNA, 22 bp, Artificial Sequence
  chemically synthesized
ctcatgaaactattcatgattc

SEQ ID NO: 1278946 - DNA, 22 bp, Artificial Sequence
  chemically synthesized
gtatggggagaagaatcatgaa

SEQ ID NO: 1278947 - DNA, 22 bp, Artificial Sequence
  chemically synthesized
atgaaactattcatgattcttc

SEQ ID NO: 1278948 - DNA, 22 bp, Artificial Sequence
  chemically synthesized
ttggtatggggagaagaatcat

SEQ ID NO: 1278949 - DNA, 22 bp, Artificial Sequence
  chemically synthesized
ttcatgattcttctccccatac

SEQ ID NO: 1278950 - DNA, 22 bp, Artificial Sequence
  chemically synthesized
atgattcttctccccataccaa

SEQ ID NO: 1278951 - DNA, 22 bp, Artificial Sequence
  chemically synthesized
ttctccccataccaataatttg

SEQ ID NO: 1278952 - DNA, 22 bp, Artificial Sequence
  chemically synthesized
ctccccataccaataatttgta

SEQ ID NO: 1278953 - DNA, 22 bp, Artificial Sequence
  chemically synthesized
tccccataccaataatttgtat

SEQ ID NO: 1278954 - DNA, 22 bp, Artificial Sequence
  chemically synthesized
cccataccaataatttgtatta

SEQ ID NO: 1278955 - DNA, 22 bp, Artificial Sequence
  chemically synthesized
tatgagaatggaataatacaaa

SEQ ID NO: 1278956 - DNA, 22 bp, Artificial Sequence
  chemically synthesized
gtattattccattctcatataa

SEQ ID NO: 1278957 - DNA, 22 bp, Artificial Sequence
  chemically synthesized
tattattccattctcatataac

SEQ ID NO: 1278958 - DNA, 22 bp, Artificial Sequence
  chemically synthesized
ttccattctcatataacatgtt

SEQ ID NO: 1278959 - DNA, 22 bp, Artificial Sequence
  chemically synthesized
aaagcataccgaaaacatgtta

SEQ ID NO: 1278960 - DNA, 22 bp, Artificial Sequence
  chemically synthesized
aaaagcataccgaaaacatgtt

SEQ ID NO: 1278961 - DNA, 22 bp, Artificial Sequence
  chemically synthesized
cattctcatataacatgttttc

SEQ ID NO: 1278962 - DNA, 22 bp, Artificial Sequence
  chemically synthesized
tcatataacatgttttcggtat

SEQ ID NO: 1278963 - DNA, 22 bp, Artificial Sequence
  chemically synthesized
tcaatttaaaagcataccgaaa

SEQ ID NO: 1278964 - DNA, 22 bp, Artificial Sequence
  chemically synthesized
atataacatgttttcggtatgc

SEQ ID NO: 1278965 - DNA, 22 bp, Artificial Sequence
  chemically synthesized
aaatatattgtcaatttaaaag

SEQ ID NO: 1278966 - DNA, 22 bp, Artificial Sequence
  chemically synthesized
tcggtatgcttttaaattgaca

SEQ ID NO: 1278967 - DNA, 22 bp, Artificial Sequence
  chemically synthesized
cggtatgcttttaaattgacaa

SEQ ID NO: 1278968 - DNA, 22 bp, Artificial Sequence
  chemically synthesized
ggtatgcttttaaattgacaat

SEQ ID NO: 1278969 - DNA, 22 bp, Artificial Sequence
  chemically synthesized
taagagaaattaaaatatattg

SEQ ID NO: 1278970 - DNA, 22 bp, Artificial Sequence
  chemically synthesized
ttaaattgacaatatattttaa

SEQ ID NO: 1278971 - DNA, 22 bp, Artificial Sequence
  chemically synthesized
taaattgacaatatattttaat

SEQ ID NO: 1278972 - DNA, 22 bp, Artificial Sequence
  chemically synthesized
aaattgacaatatattttaatt

SEQ ID NO: 1278973 - DNA, 22 bp, Artificial Sequence
  chemically synthesized
aattgacaatatattttaattt

SEQ ID NO: 1278974 - DNA, 22 bp, Artificial Sequence
  chemically synthesized
acaatatattttaatttctctt

SEQ ID NO: 1278975 - DNA, 22 bp, Artificial Sequence
  chemically synthesized
taatttctcttataattttcta

SEQ ID NO: 1278976 - DNA, 22 bp, Artificial Sequence
  chemically synthesized
aatttctcttataattttctat

SEQ ID NO: 1278977 - DNA, 22 bp, Artificial Sequence
  chemically synthesized
atttctcttataattttctatg

SEQ ID NO: 1278978 - DNA, 22 bp, Artificial Sequence
  chemically synthesized
tagaacatagaacatagaaaat

SEQ ID NO: 1278979 - DNA, 22 bp, Artificial Sequence
  chemically synthesized
ctcttataattttctatgttct

SEQ ID NO: 1278980 - DNA, 22 bp, Artificial Sequence
  chemically synthesized
tcttataattttctatgttcta

SEQ ID NO: 1278981 - DNA, 22 bp, Artificial Sequence
  chemically synthesized
atactatagaacatagaacata

SEQ ID NO: 1278982 - DNA, 22 bp, Artificial Sequence
  chemically synthesized
ttataattttctatgttctatg

SEQ ID NO: 1278983 - DNA, 22 bp, Artificial Sequence
  chemically synthesized
aatactatagaacatagaacat

SEQ ID NO: 1278984 - DNA, 22 bp, Artificial Sequence
  chemically synthesized
taatactatagaacatagaaca

SEQ ID NO: 1278985 - DNA, 22 bp, Artificial Sequence
  chemically synthesized
ataattttctatgttctatgtt

SEQ ID NO: 1278986 - DNA, 22 bp, Artificial Sequence
  chemically synthesized
ttaatactatagaacatagaac

SEQ ID NO: 1278987 - DNA, 22 bp, Artificial Sequence
  chemically synthesized
taattttctatgttctatgttc

SEQ ID NO: 1278988 - DNA, 22 bp, Artificial Sequence
  chemically synthesized
tctatgttctatgttctatagt

SEQ ID NO: 1278989 - DNA, 22 bp, Artificial Sequence
  chemically synthesized
ctatgttctatgttctatagta

SEQ ID NO: 1278990 - DNA, 22 bp, Artificial Sequence
  chemically synthesized
tatgttctatgttctatagtat

SEQ ID NO: 1278991 - DNA, 22 bp, Artificial Sequence
  chemically synthesized
tgttctatgttctatagtatta

SEQ ID NO: 1278992 - DNA, 22 bp, Artificial Sequence
  chemically synthesized
ggtcatgaatcttttaatacta

SEQ ID NO: 1278993 - DNA, 22 bp, Artificial Sequence
  chemically synthesized
taggtcatgaatcttttaatac

SEQ ID NO: 1278994 - DNA, 22 bp, Artificial Sequence
  chemically synthesized
tatgttctatagtattaaaaga

SEQ ID NO: 1278995 - DNA, 22 bp, Artificial Sequence
  chemically synthesized
tgttctatagtattaaaagatt

SEQ ID NO: 1278996 - DNA, 22 bp, Artificial Sequence
  chemically synthesized
tatagtattaaaagattcatga

SEQ ID NO: 1278997 - DNA, 22 bp, Artificial Sequence
  chemically synthesized
tagtattaaaagattcatgacc

SEQ ID NO: 1278998 - DNA, 22 bp, Artificial Sequence
  chemically synthesized
aaagattcatgacctagagaca

SEQ ID NO: 1278999 - DNA, 22 bp, Artificial Sequence
  chemically synthesized
atgacctagagacacacacata

SEQ ID NO: 1279000 - DNA, 22 bp, Artificial Sequence
  chemically synthesized
gagacacacacatatatatata

SEQ ID NO: 1279001 - DNA, 22 bp, Artificial Sequence
  chemically synthesized
aatatatatggatgtgtgcaca

SEQ ID NO: 1279002 - DNA, 22 bp, Artificial Sequence
  chemically synthesized
taaagttaaatatatatggatg

SEQ ID NO: 1279003 - DNA, 22 bp, Artificial Sequence
  chemically synthesized
tataaagttaaatatatatgga

SEQ ID NO: 1279004 - DNA, 22 bp, Artificial Sequence
  chemically synthesized
aagaattctataaagttaaata

SEQ ID NO: 1279005 - DNA, 22 bp, Artificial Sequence
  chemically synthesized
agtcaaattcaagaattctata

SEQ ID NO: 1279006 - DNA, 22 bp, Artificial Sequence
  chemically synthesized
ttcagtcaaattcaagaattct

SEQ ID NO: 1279007 - DNA, 22 bp, Artificial Sequence
  chemically synthesized
tattcagtcaaattcaagaatt

SEQ ID NO: 1279008 - DNA, 22 bp, Artificial Sequence
  chemically synthesized
ctattcagtcaaattcaagaat

SEQ ID NO: 1279009 - DNA, 22 bp, Artificial Sequence
  chemically synthesized
aactttatagaattcttgaatt

SEQ ID NO: 1279010 - DNA, 22 bp, Artificial Sequence
  chemically synthesized
tctattcagtcaaattcaagaa

SEQ ID NO: 1279011 - DNA, 22 bp, Artificial Sequence
  chemically synthesized
actttatagaattcttgaattt

SEQ ID NO: 1279012 - DNA, 22 bp, Artificial Sequence
  chemically synthesized
tatagaattcttgaatttgact

SEQ ID NO: 1279013 - DNA, 22 bp, Artificial Sequence
  chemically synthesized
atagaattcttgaatttgactg

SEQ ID NO: 1279014 - DNA, 22 bp, Artificial Sequence
  chemically synthesized
tagaattcttgaatttgactga

SEQ ID NO: 1279015 - DNA, 22 bp, Artificial Sequence
  chemically synthesized
gccaccactttctattcagtca

SEQ ID NO: 1279016 - DNA, 22 bp, Artificial Sequence
  chemically synthesized
ggccaccactttctattcagtc

SEQ ID NO: 1279017 - DNA, 22 bp, Artificial Sequence
  chemically synthesized
ttggccaccactttctattcag

SEQ ID NO: 1279018 - DNA, 22 bp, Artificial Sequence
  chemically synthesized
ttgaatttgactgaatagaaag

SEQ ID NO: 1279019 - DNA, 22 bp, Artificial Sequence
  chemically synthesized
gaatttgactgaatagaaagtg

SEQ ID NO: 1279020 - DNA, 22 bp, Artificial Sequence
  chemically synthesized
aatttgactgaatagaaagtgg

SEQ ID NO: 1279021 - DNA, 22 bp, Artificial Sequence
  chemically synthesized
atattcttggccaccactttct

SEQ ID NO: 1279022 - DNA, 22 bp, Artificial Sequence
  chemically synthesized
aatattcttggccaccactttc

SEQ ID NO: 1279023 - DNA, 22 bp, Artificial Sequence
  chemically synthesized
gactgaatagaaagtggtggcc

SEQ ID NO: 1279024 - DNA, 22 bp, Artificial Sequence
  chemically synthesized
actgaatagaaagtggtggcca

SEQ ID NO: 1279025 - DNA, 22 bp, Artificial Sequence
  chemically synthesized
aatagaaagtggtggccaagaa

SEQ ID NO: 1279026 - DNA, 22 bp, Artificial Sequence
  chemically synthesized
ggtagatttaatattcttggcc

SEQ ID NO: 1279027 - DNA, 22 bp, Artificial Sequence
  chemically synthesized
aggtagatttaatattcttggc

SEQ ID NO: 1279028 - DNA, 22 bp, Artificial Sequence
  chemically synthesized
taggtagatttaatattcttgg

SEQ ID NO: 1279029 - DNA, 22 bp, Artificial Sequence
  chemically synthesized
tgaattttaggtagatttaata

SEQ ID NO: 1279030 - DNA, 22 bp, Artificial Sequence
  chemically synthesized
tgtgaattttaggtagatttaa

SEQ ID NO: 1279031 - DNA, 22 bp, Artificial Sequence
  chemically synthesized
aaacctctgtgaattttaggta

SEQ ID NO: 1279032 - DNA, 22 bp, Artificial Sequence
  chemically synthesized
aatctacctaaaattcacagag

SEQ ID NO: 1279033 - DNA, 22 bp, Artificial Sequence
  chemically synthesized
tgaatctcaaacctctgtgaat

SEQ ID NO: 1279034 - DNA, 22 bp, Artificial Sequence
  chemically synthesized
gtgaatctcaaacctctgtgaa

SEQ ID NO: 1279035 - DNA, 22 bp, Artificial Sequence
  chemically synthesized
tgtgaatctcaaacctctgtga

SEQ ID NO: 1279036 - DNA, 22 bp, Artificial Sequence
  chemically synthesized
ttgtgaatctcaaacctctgtg

SEQ ID NO: 1279037 - DNA, 22 bp, Artificial Sequence
  chemically synthesized
cctaaaattcacagaggtttga

SEQ ID NO: 1279038 - DNA, 22 bp, Artificial Sequence
  chemically synthesized
aaattcacagaggtttgagatt

SEQ ID NO: 1279039 - DNA, 22 bp, Artificial Sequence
  chemically synthesized
acagaggtttgagattcacaaa

SEQ ID NO: 1279040 - DNA, 22 bp, Artificial Sequence
  chemically synthesized
taagccaaatcaagtgaccttt

SEQ ID NO: 1279041 - DNA, 22 bp, Artificial Sequence
  chemically synthesized
gagattcacaaaaggtcacttg

SEQ ID NO: 1279042 - DNA, 22 bp, Artificial Sequence
  chemically synthesized
agattcacaaaaggtcacttga

SEQ ID NO: 1279043 - DNA, 22 bp, Artificial Sequence
  chemically synthesized
aacctgtaagccaaatcaagtg

SEQ ID NO: 1279044 - DNA, 22 bp, Artificial Sequence
  chemically synthesized
acaaaaggtcacttgatttggc

SEQ ID NO: 1279045 - DNA, 22 bp, Artificial Sequence
  chemically synthesized
ccctgaacctgtaagccaaatc

SEQ ID NO: 1279046 - DNA, 22 bp, Artificial Sequence
  chemically synthesized
tcccctgaacctgtaagccaaa

SEQ ID NO: 1279047 - DNA, 22 bp, Artificial Sequence
  chemically synthesized
ctcccctgaacctgtaagccaa

SEQ ID NO: 1279048 - DNA, 22 bp, Artificial Sequence
  chemically synthesized
tctcccctgaacctgtaagcca

SEQ ID NO: 1279049 - DNA, 22 bp, Artificial Sequence
  chemically synthesized
ttctcccctgaacctgtaagcc

SEQ ID NO: 1279050 - DNA, 22 bp, Artificial Sequence
  chemically synthesized
cttttctcccctgaacctgtaa

SEQ ID NO: 1279051 - DNA, 22 bp, Artificial Sequence
  chemically synthesized
acttttctcccctgaacctgta

SEQ ID NO: 1279052 - DNA, 22 bp, Artificial Sequence
  chemically synthesized
gatttggcttacaggttcaggg

SEQ ID NO: 1279053 - DNA, 22 bp, Artificial Sequence
  chemically synthesized
atttggcttacaggttcagggg

SEQ ID NO: 1279054 - DNA, 22 bp, Artificial Sequence
  chemically synthesized
ggcttacaggttcaggggagaa

SEQ ID NO: 1279055 - DNA, 22 bp, Artificial Sequence
  chemically synthesized
gcttacaggttcaggggagaaa

SEQ ID NO: 1279056 - DNA, 22 bp, Artificial Sequence
  chemically synthesized
catgaaatttacttttctcccc

SEQ ID NO: 1279057 - DNA, 22 bp, Artificial Sequence
  chemically synthesized
ccatgaaatttacttttctccc

SEQ ID NO: 1279058 - DNA, 22 bp, Artificial Sequence
  chemically synthesized
acaggttcaggggagaaaagta

SEQ ID NO: 1279059 - DNA, 22 bp, Artificial Sequence
  chemically synthesized
ttccatgaaatttacttttctc

SEQ ID NO: 1279060 - DNA, 22 bp, Artificial Sequence
  chemically synthesized
caggttcaggggagaaaagtaa

SEQ ID NO: 1279061 - DNA, 22 bp, Artificial Sequence
  chemically synthesized
cttccatgaaatttacttttct

SEQ ID NO: 1279062 - DNA, 22 bp, Artificial Sequence
  chemically synthesized
tcttccatgaaatttacttttc

SEQ ID NO: 1279063 - DNA, 22 bp, Artificial Sequence
  chemically synthesized
aggggagaaaagtaaatttcat

SEQ ID NO: 1279064 - DNA, 22 bp, Artificial Sequence
  chemically synthesized
tgattttcttccatgaaattta

SEQ ID NO: 1279065 - DNA, 22 bp, Artificial Sequence
  chemically synthesized
atgattttcttccatgaaattt

SEQ ID NO: 1279066 - DNA, 22 bp, Artificial Sequence
  chemically synthesized
gcaaatatttatgattttcttc

SEQ ID NO: 1279067 - DNA, 22 bp, Artificial Sequence
  chemically synthesized
ctcgcaaatatttatgattttc

SEQ ID NO: 1279068 - DNA, 22 bp, Artificial Sequence
  chemically synthesized
tctactcgcaaatatttatgat

SEQ ID NO: 1279069 - DNA, 22 bp, Artificial Sequence
  chemically synthesized
catggaagaaaatcataaatat

SEQ ID NO: 1279070 - DNA, 22 bp, Artificial Sequence
  chemically synthesized
atctactcgcaaatatttatga

SEQ ID NO: 1279071 - DNA, 22 bp, Artificial Sequence
  chemically synthesized
atggaagaaaatcataaatatt

SEQ ID NO: 1279072 - DNA, 22 bp, Artificial Sequence
  chemically synthesized
ccttatctactcgcaaatattt

SEQ ID NO: 1279073 - DNA, 22 bp, Artificial Sequence
  chemically synthesized
ctaccttatctactcgcaaata

SEQ ID NO: 1279074 - DNA, 22 bp, Artificial Sequence
  chemically synthesized
catctgctaccttatctactcg

SEQ ID NO: 1279075 - DNA, 22 bp, Artificial Sequence
  chemically synthesized
gcgagtagataaggtagcagat

SEQ ID NO: 1279076 - DNA, 22 bp, Artificial Sequence
  chemically synthesized
cgagtagataaggtagcagatg

SEQ ID NO: 1279077 - DNA, 22 bp, Artificial Sequence
  chemically synthesized
tagataacgtctacatctgcta

SEQ ID NO: 1279078 - DNA, 22 bp, Artificial Sequence
  chemically synthesized
cctatagataacgtctacatct

SEQ ID NO: 1279079 - DNA, 22 bp, Artificial Sequence
  chemically synthesized
ccctatagataacgtctacatc

SEQ ID NO: 1279080 - DNA, 22 bp, Artificial Sequence
  chemically synthesized
tcagatttccctatagataacg

SEQ ID NO: 1279081 - DNA, 22 bp, Artificial Sequence
  chemically synthesized
ctgtcagatttccctatagata

SEQ ID NO: 1279082 - DNA, 22 bp, Artificial Sequence
  chemically synthesized
gctgtcagatttccctatagat

SEQ ID NO: 1279083 - DNA, 22 bp, Artificial Sequence
  chemically synthesized
tgctgtcagatttccctataga

SEQ ID NO: 1279084 - DNA, 22 bp, Artificial Sequence
  chemically synthesized
ttgctgtcagatttccctatag

SEQ ID NO: 1279085 - DNA, 22 bp, Artificial Sequence
  chemically synthesized
cttttgctgtcagatttcccta

SEQ ID NO: 1279086 - DNA, 22 bp, Artificial Sequence
  chemically synthesized
attccttttgctgtcagatttc

SEQ ID NO: 1279087 - DNA, 22 bp, Artificial Sequence
  chemically synthesized
tcattccttttgctgtcagatt

SEQ ID NO: 1279088 - DNA, 22 bp, Artificial Sequence
  chemically synthesized
tctatagggaaatctgacagca

SEQ ID NO: 1279089 - DNA, 22 bp, Artificial Sequence
  chemically synthesized
gctctcattccttttgctgtca

SEQ ID NO: 1279090 - DNA, 22 bp, Artificial Sequence
  chemically synthesized
tagggaaatctgacagcaaaag

SEQ ID NO: 1279091 - DNA, 22 bp, Artificial Sequence
  chemically synthesized
acagcaaaaggaatgagagcta

SEQ ID NO: 1279092 - DNA, 22 bp, Artificial Sequence
  chemically synthesized
aatgtaacatcctagctctcat

SEQ ID NO: 1279093 - DNA, 22 bp, Artificial Sequence
  chemically synthesized
aggcccctgaatgtaacatcct

SEQ ID NO: 1279094 - DNA, 22 bp, Artificial Sequence
  chemically synthesized
taattcaggcccctgaatgtaa

SEQ ID NO: 1279095 - DNA, 22 bp, Artificial Sequence
  chemically synthesized
ggatgttacattcaggggcctg

SEQ ID NO: 1279096 - DNA, 22 bp, Artificial Sequence
  chemically synthesized
tagcaaactgtaattcaggccc

SEQ ID NO: 1279097 - DNA, 22 bp, Artificial Sequence
  chemically synthesized
cattcaggggcctgaattacag

SEQ ID NO: 1279098 - DNA, 22 bp, Artificial Sequence
  chemically synthesized
tatctgtagcaaactgtaattc

SEQ ID NO: 1279099 - DNA, 22 bp, Artificial Sequence
  chemically synthesized
aggggcctgaattacagtttgc

SEQ ID NO: 1279100 - DNA, 22 bp, Artificial Sequence
  chemically synthesized
aattacagtttgctacagatac

SEQ ID NO: 1279101 - DNA, 22 bp, Artificial Sequence
  chemically synthesized
agtgcggatgtattgtatctgt

SEQ ID NO: 1279102 - DNA, 22 bp, Artificial Sequence
  chemically synthesized
cagtttgctacagatacaatac

SEQ ID NO: 1279103 - DNA, 22 bp, Artificial Sequence
  chemically synthesized
ctaagtgcggatgtattgtatc

SEQ ID NO: 1279104 - DNA, 22 bp, Artificial Sequence
  chemically synthesized
gctaagtgcggatgtattgtat

SEQ ID NO: 1279105 - DNA, 22 bp, Artificial Sequence
  chemically synthesized
tgctaagtgcggatgtattgta

SEQ ID NO: 1279106 - DNA, 22 bp, Artificial Sequence
  chemically synthesized
ttgctaagtgcggatgtattgt

SEQ ID NO: 1279107 - DNA, 22 bp, Artificial Sequence
  chemically synthesized
gctacagatacaatacatccgc

SEQ ID NO: 1279108 - DNA, 22 bp, Artificial Sequence
  chemically synthesized
ctacagatacaatacatccgca

SEQ ID NO: 1279109 - DNA, 22 bp, Artificial Sequence
  chemically synthesized
cagatacaatacatccgcactt

SEQ ID NO: 1279110 - DNA, 22 bp, Artificial Sequence
  chemically synthesized
taaatgtaatttttgctaagtg

SEQ ID NO: 1279111 - DNA, 22 bp, Artificial Sequence
  chemically synthesized
aaagccaaggttataaatgtaa

SEQ ID NO: 1279112 - DNA, 22 bp, Artificial Sequence
  chemically synthesized
agcaaaaattacatttataacc

SEQ ID NO: 1279113 - DNA, 22 bp, Artificial Sequence
  chemically synthesized
attaaaagccaaggttataaat

SEQ ID NO: 1279114 - DNA, 22 bp, Artificial Sequence
  chemically synthesized
gcaaaaattacatttataacct

SEQ ID NO: 1279115 - DNA, 22 bp, Artificial Sequence
  chemically synthesized
gattaaaagccaaggttataaa

SEQ ID NO: 1279116 - DNA, 22 bp, Artificial Sequence
  chemically synthesized
catttataaccttggcttttaa

SEQ ID NO: 1279117 - DNA, 22 bp, Artificial Sequence
  chemically synthesized
tggtaaaccttgattaaaagcc

SEQ ID NO: 1279118 - DNA, 22 bp, Artificial Sequence
  chemically synthesized
ataaccttggcttttaatcaag

SEQ ID NO: 1279119 - DNA, 22 bp, Artificial Sequence
  chemically synthesized
attatggtaaaccttgattaaa

SEQ ID NO: 1279120 - DNA, 22 bp, Artificial Sequence
  chemically synthesized
taaccttggcttttaatcaagg

SEQ ID NO: 1279121 - DNA, 22 bp, Artificial Sequence
  chemically synthesized
cattatggtaaaccttgattaa

SEQ ID NO: 1279122 - DNA, 22 bp, Artificial Sequence
  chemically synthesized
tcattatggtaaaccttgatta

SEQ ID NO: 1279123 - DNA, 22 bp, Artificial Sequence
  chemically synthesized
ttcattatggtaaaccttgatt

SEQ ID NO: 1279124 - DNA, 22 bp, Artificial Sequence
  chemically synthesized
ggcttttaatcaaggtttacca

SEQ ID NO: 1279125 - DNA, 22 bp, Artificial Sequence
  chemically synthesized
gcttttaatcaaggtttaccat

SEQ ID NO: 1279126 - DNA, 22 bp, Artificial Sequence
  chemically synthesized
acagcttttcattatggtaaac

SEQ ID NO: 1279127 - DNA, 22 bp, Artificial Sequence
  chemically synthesized
cacagcttttcattatggtaaa

SEQ ID NO: 1279128 - DNA, 22 bp, Artificial Sequence
  chemically synthesized
ttaatcaaggtttaccataatg

SEQ ID NO: 1279129 - DNA, 22 bp, Artificial Sequence
  chemically synthesized
ttcacagcttttcattatggta

SEQ ID NO: 1279130 - DNA, 22 bp, Artificial Sequence
  chemically synthesized
taatcaaggtttaccataatga

SEQ ID NO: 1279131 - DNA, 22 bp, Artificial Sequence
  chemically synthesized
aatcaaggtttaccataatgaa

SEQ ID NO: 1279132 - DNA, 22 bp, Artificial Sequence
  chemically synthesized
atcaaggtttaccataatgaaa

SEQ ID NO: 1279133 - DNA, 22 bp, Artificial Sequence
  chemically synthesized
accataatgaaaagctgtgaag

SEQ ID NO: 1279134 - DNA, 22 bp, Artificial Sequence
  chemically synthesized
ccataatgaaaagctgtgaaga

SEQ ID NO: 1279135 - DNA, 22 bp, Artificial Sequence
  chemically synthesized
taagcgagtcatacaagttctt

SEQ ID NO: 1279136 - DNA, 22 bp, Artificial Sequence
  chemically synthesized
tgaagaacttgtatgactcgct

SEQ ID NO: 1279137 - DNA, 22 bp, Artificial Sequence
  chemically synthesized
aaaaaaaccaaaaaaattataa

SEQ ID NO: 1279138 - DNA, 22 bp, Artificial Sequence
  chemically synthesized
gtatgactcgcttataattttt

SEQ ID NO: 1279139 - DNA, 22 bp, Artificial Sequence
  chemically synthesized
aaaaaaaaccaaaaaaattata

SEQ ID NO: 1279140 - DNA, 22 bp, Artificial Sequence
  chemically synthesized
tatgactcgcttataatttttt

SEQ ID NO: 1279141 - DNA, 22 bp, Artificial Sequence
  chemically synthesized
tcttaaaaaaaaccaaaaaaat

SEQ ID NO: 1279142 - DNA, 22 bp, Artificial Sequence
  chemically synthesized
gcttataatttttttggttttt

SEQ ID NO: 1279143 - DNA, 22 bp, Artificial Sequence
  chemically synthesized
ataatttttttggtttttttta

SEQ ID NO: 1279144 - DNA, 22 bp, Artificial Sequence
  chemically synthesized
taatttttttggttttttttaa

SEQ ID NO: 1279145 - DNA, 22 bp, Artificial Sequence
  chemically synthesized
cagagcaagaccctatcttaaa

SEQ ID NO: 1279146 - DNA, 22 bp, Artificial Sequence
  chemically synthesized
ttttggttttttttaagatagg

SEQ ID NO: 1279147 - DNA, 22 bp, Artificial Sequence
  chemically synthesized
tttggttttttttaagataggg

SEQ ID NO: 1279148 - DNA, 22 bp, Artificial Sequence
  chemically synthesized
ttggttttttttaagatagggt

SEQ ID NO: 1279149 - DNA, 22 bp, Artificial Sequence
  chemically synthesized
tggttttttttaagatagggtc

SEQ ID NO: 1279150 - DNA, 22 bp, Artificial Sequence
  chemically synthesized
ggttttttttaagatagggtct

SEQ ID NO: 1279151 - DNA, 22 bp, Artificial Sequence
  chemically synthesized
ggctacagagcaagaccctatc

SEQ ID NO: 1279152 - DNA, 22 bp, Artificial Sequence
  chemically synthesized
gttttttttaagatagggtctt

SEQ ID NO: 1279153 - DNA, 22 bp, Artificial Sequence
  chemically synthesized
tttttaagatagggtcttgctc

SEQ ID NO: 1279154 - DNA, 22 bp, Artificial Sequence
  chemically synthesized
ttttaagatagggtcttgctct

SEQ ID NO: 1279155 - DNA, 22 bp, Artificial Sequence
  chemically synthesized
tttaagatagggtcttgctctg

SEQ ID NO: 1279156 - DNA, 22 bp, Artificial Sequence
  chemically synthesized
cagcctgggctacagagcaaga

SEQ ID NO: 1279157 - DNA, 22 bp, Artificial Sequence
  chemically synthesized
ttaagatagggtcttgctctgt

SEQ ID NO: 1279158 - DNA, 22 bp, Artificial Sequence
  chemically synthesized
taagatagggtcttgctctgta

SEQ ID NO: 1279159 - DNA, 22 bp, Artificial Sequence
  chemically synthesized
aagatagggtcttgctctgtag

SEQ ID NO: 1279160 - DNA, 22 bp, Artificial Sequence
  chemically synthesized
agatagggtcttgctctgtagc

SEQ ID NO: 1279161 - DNA, 22 bp, Artificial Sequence
  chemically synthesized
caccatcgcactccagcctggg

SEQ ID NO: 1279162 - DNA, 22 bp, Artificial Sequence
  chemically synthesized
gctctgtagcccaggctggagt

SEQ ID NO: 1279163 - DNA, 22 bp, Artificial Sequence
  chemically synthesized
ctctgtagcccaggctggagtg

SEQ ID NO: 1279164 - DNA, 22 bp, Artificial Sequence
  chemically synthesized
tgtagcccaggctggagtgcga

SEQ ID NO: 1279165 - DNA, 22 bp, Artificial Sequence
  chemically synthesized
tagcccaggctggagtgcgatg

SEQ ID NO: 1279166 - DNA, 22 bp, Artificial Sequence
  chemically synthesized
cagtgagccatcattgcaccat

SEQ ID NO: 1279167 - DNA, 22 bp, Artificial Sequence
  chemically synthesized
gagtgcgatggtgcaatgatgg

SEQ ID NO: 1279168 - DNA, 22 bp, Artificial Sequence
  chemically synthesized
agcccgggaggtcaaggctgca

SEQ ID NO: 1279169 - DNA, 22 bp, Artificial Sequence
  chemically synthesized
gagcccgggaggtcaaggctgc

SEQ ID NO: 1279170 - DNA, 22 bp, Artificial Sequence
  chemically synthesized
ttgagcccgggaggtcaaggct

SEQ ID NO: 1279171 - DNA, 22 bp, Artificial Sequence
  chemically synthesized
actgcagccttgacctcccggg

SEQ ID NO: 1279172 - DNA, 22 bp, Artificial Sequence
  chemically synthesized
cagccttgacctcccgggctca

SEQ ID NO: 1279173 - DNA, 22 bp, Artificial Sequence
  chemically synthesized
aggtaggaggatctcttgagcc

SEQ ID NO: 1279174 - DNA, 22 bp, Artificial Sequence
  chemically synthesized
gacctcccgggctcaagagatc

SEQ ID NO: 1279175 - DNA, 22 bp, Artificial Sequence
  chemically synthesized
acctcccgggctcaagagatcc

SEQ ID NO: 1279176 - DNA, 22 bp, Artificial Sequence
  chemically synthesized
ggaggctgaggtaggaggatct

SEQ ID NO: 1279177 - DNA, 22 bp, Artificial Sequence
  chemically synthesized
ccgggctcaagagatcctccta

SEQ ID NO: 1279178 - DNA, 22 bp, Artificial Sequence
  chemically synthesized
gggaggctgaggtaggaggatc

SEQ ID NO: 1279179 - DNA, 22 bp, Artificial Sequence
  chemically synthesized
cttgggaggctgaggtaggagg

SEQ ID NO: 1279180 - DNA, 22 bp, Artificial Sequence
  chemically synthesized
aagagatcctcctacctcagcc

SEQ ID NO: 1279181 - DNA, 22 bp, Artificial Sequence
  chemically synthesized
ccagctacttgggaggctgagg

SEQ ID NO: 1279182 - DNA, 22 bp, Artificial Sequence
  chemically synthesized
tattcccagctacttgggaggc

SEQ ID NO: 1279183 - DNA, 22 bp, Artificial Sequence
  chemically synthesized
ctacctcagcctcccaagtagc

SEQ ID NO: 1279184 - DNA, 22 bp, Artificial Sequence
  chemically synthesized
cctcagcctcccaagtagctgg

SEQ ID NO: 1279185 - DNA, 22 bp, Artificial Sequence
  chemically synthesized
agcctcccaagtagctgggaat

SEQ ID NO: 1279186 - DNA, 22 bp, Artificial Sequence
  chemically synthesized
ccaagtagctgggaatacaggc

SEQ ID NO: 1279187 - DNA, 22 bp, Artificial Sequence
  chemically synthesized
acagagcgtcgtggtgcatgcc

SEQ ID NO: 1279188 - DNA, 22 bp, Artificial Sequence
  chemically synthesized
ggaatacaggcatgcaccacga

SEQ ID NO: 1279189 - DNA, 22 bp, Artificial Sequence
  chemically synthesized
taaaaaaaatacaaaaattaac

SEQ ID NO: 1279190 - DNA, 22 bp, Artificial Sequence
  chemically synthesized
tataaaaaaaatacaaaaatta

SEQ ID NO: 1279191 - DNA, 22 bp, Artificial Sequence
  chemically synthesized
acctctataaaaaaaatacaaa

SEQ ID NO: 1279192 - DNA, 22 bp, Artificial Sequence
  chemically synthesized
tgttaatttttgtatttttttt

SEQ ID NO: 1279193 - DNA, 22 bp, Artificial Sequence
  chemically synthesized
ttaatttttgtattttttttat

SEQ ID NO: 1279194 - DNA, 22 bp, Artificial Sequence
  chemically synthesized
atttttgtattttttttataga

SEQ ID NO: 1279195 - DNA, 22 bp, Artificial Sequence
  chemically synthesized
ttgtattttttttatagaggtg

SEQ ID NO: 1279196 - DNA, 22 bp, Artificial Sequence
  chemically synthesized
tgtattttttttatagaggtga

SEQ ID NO: 1279197 - DNA, 22 bp, Artificial Sequence
  chemically synthesized
gtattttttttatagaggtgag

SEQ ID NO: 1279198 - DNA, 22 bp, Artificial Sequence
  chemically synthesized
tattttttttatagaggtgagg

SEQ ID NO: 1279199 - DNA, 22 bp, Artificial Sequence
  chemically synthesized
tttttatagaggtgaggttttg

SEQ ID NO: 1279200 - DNA, 22 bp, Artificial Sequence
  chemically synthesized
ttttatagaggtgaggttttgc

SEQ ID NO: 1279201 - DNA, 22 bp, Artificial Sequence
  chemically synthesized
tttatagaggtgaggttttgcc

SEQ ID NO: 1279202 - DNA, 22 bp, Artificial Sequence
  chemically synthesized
ttatagaggtgaggttttgcca

SEQ ID NO: 1279203 - DNA, 22 bp, Artificial Sequence
  chemically synthesized
tatagaggtgaggttttgccat

SEQ ID NO: 1279204 - DNA, 22 bp, Artificial Sequence
  chemically synthesized
atagaggtgaggttttgccatg

SEQ ID NO: 1279205 - DNA, 22 bp, Artificial Sequence
  chemically synthesized
tagaggtgaggttttgccatgt

SEQ ID NO: 1279206 - DNA, 22 bp, Artificial Sequence
  chemically synthesized
aggcaagccagggtaacatggc

SEQ ID NO: 1279207 - DNA, 22 bp, Artificial Sequence
  chemically synthesized
gaggcaagccagggtaacatgg

SEQ ID NO: 1279208 - DNA, 22 bp, Artificial Sequence
  chemically synthesized
aggagtttgaggcaagccaggg

SEQ ID NO: 1279209 - DNA, 22 bp, Artificial Sequence
  chemically synthesized
tgccatgttaccctggcttgcc

SEQ ID NO: 1279210 - DNA, 22 bp, Artificial Sequence
  chemically synthesized
gccatgttaccctggcttgcct

SEQ ID NO: 1279211 - DNA, 22 bp, Artificial Sequence
  chemically synthesized
ccatgttaccctggcttgcctc

SEQ ID NO: 1279212 - DNA, 22 bp, Artificial Sequence
  chemically synthesized
agctcaggagtttgaggcaagc

SEQ ID NO: 1279213 - DNA, 22 bp, Artificial Sequence
  chemically synthesized
gagctcaggagtttgaggcaag

SEQ ID NO: 1279214 - DNA, 22 bp, Artificial Sequence
  chemically synthesized
ccctggcttgcctcaaactcct

SEQ ID NO: 1279215 - DNA, 22 bp, Artificial Sequence
  chemically synthesized
gcttgcctcaaactcctgagct

SEQ ID NO: 1279216 - DNA, 22 bp, Artificial Sequence
  chemically synthesized
gcctcaaactcctgagctcaag

SEQ ID NO: 1279217 - DNA, 22 bp, Artificial Sequence
  chemically synthesized
cctcaaactcctgagctcaagt

SEQ ID NO: 1279218 - DNA, 22 bp, Artificial Sequence
  chemically synthesized
aaactcctgagctcaagtgatc

SEQ ID NO: 1279219 - DNA, 22 bp, Artificial Sequence
  chemically synthesized
ggaggccaaggtgggcagatca

SEQ ID NO: 1279220 - DNA, 22 bp, Artificial Sequence
  chemically synthesized
ctgagctcaagtgatctgccca

SEQ ID NO: 1279221 - DNA, 22 bp, Artificial Sequence
  chemically synthesized
aggaggccaaggtgggcagatc

SEQ ID NO: 1279222 - DNA, 22 bp, Artificial Sequence
  chemically synthesized
taggaggccaaggtgggcagat

SEQ ID NO: 1279223 - DNA, 22 bp, Artificial Sequence
  chemically synthesized
agctcaagtgatctgcccacct

SEQ ID NO: 1279224 - DNA, 22 bp, Artificial Sequence
  chemically synthesized
aagtgatctgcccaccttggcc

SEQ ID NO: 1279225 - DNA, 22 bp, Artificial Sequence
  chemically synthesized
taatcccagcactttaggaggc

SEQ ID NO: 1279226 - DNA, 22 bp, Artificial Sequence
  chemically synthesized
cccaccttggcctcctaaagtg

SEQ ID NO: 1279227 - DNA, 22 bp, Artificial Sequence
  chemically synthesized
atgcctgtaatcccagcacttt

SEQ ID NO: 1279228 - DNA, 22 bp, Artificial Sequence
  chemically synthesized
ggcctcctaaagtgctgggatt

SEQ ID NO: 1279229 - DNA, 22 bp, Artificial Sequence
  chemically synthesized
gcctcctaaagtgctgggatta

SEQ ID NO: 1279230 - DNA, 22 bp, Artificial Sequence
  chemically synthesized
ctaaagtgctgggattacaggc

SEQ ID NO: 1279231 - DNA, 22 bp, Artificial Sequence
  chemically synthesized
aagtgctgggattacaggcatg

SEQ ID NO: 1279232 - DNA, 22 bp, Artificial Sequence
  chemically synthesized
ggcacagtggctcatgcctgta

SEQ ID NO: 1279233 - DNA, 22 bp, Artificial Sequence
  chemically synthesized
ggctgggcacagtggctcatgc

SEQ ID NO: 1279234 - DNA, 22 bp, Artificial Sequence
  chemically synthesized
aggctgggcacagtggctcatg

SEQ ID NO: 1279235 - DNA, 22 bp, Artificial Sequence
  chemically synthesized
taggctgggcacagtggctcat

SEQ ID NO: 1279236 - DNA, 22 bp, Artificial Sequence
  chemically synthesized
ggattacaggcatgagccactg

SEQ ID NO: 1279237 - DNA, 22 bp, Artificial Sequence
  chemically synthesized
ttaggctgggcacagtggctca

SEQ ID NO: 1279238 - DNA, 22 bp, Artificial Sequence
  chemically synthesized
tttaggctgggcacagtggctc

SEQ ID NO: 1279239 - DNA, 22 bp, Artificial Sequence
  chemically synthesized
ttttaggctgggcacagtggct

SEQ ID NO: 1279240 - DNA, 22 bp, Artificial Sequence
  chemically synthesized
caggcatgagccactgtgccca

SEQ ID NO: 1279241 - DNA, 22 bp, Artificial Sequence
  chemically synthesized
gtgacatcaataacaatttttt

SEQ ID NO: 1279242 - DNA, 22 bp, Artificial Sequence
  chemically synthesized
tgcccagcctaaaaaaattgtt

SEQ ID NO: 1279243 - DNA, 22 bp, Artificial Sequence
  chemically synthesized
agtgacatcaataacaattttt

SEQ ID NO: 1279244 - DNA, 22 bp, Artificial Sequence
  chemically synthesized
tagtgacatcaataacaatttt

SEQ ID NO: 1279245 - DNA, 22 bp, Artificial Sequence
  chemically synthesized
ttagtgacatcaataacaattt

SEQ ID NO: 1279246 - DNA, 22 bp, Artificial Sequence
  chemically synthesized
agcagtttttagtgacatcaat

SEQ ID NO: 1279247 - DNA, 22 bp, Artificial Sequence
  chemically synthesized
aaaaaattgttattgatgtcac

SEQ ID NO: 1279248 - DNA, 22 bp, Artificial Sequence
  chemically synthesized
ctgagcagtttttagtgacatc

SEQ ID NO: 1279249 - DNA, 22 bp, Artificial Sequence
  chemically synthesized
ctcctgagcagtttttagtgac

SEQ ID NO: 1279250 - DNA, 22 bp, Artificial Sequence
  chemically synthesized
cctcctgagcagtttttagtga

SEQ ID NO: 1279251 - DNA, 22 bp, Artificial Sequence
  chemically synthesized
tcctcctgagcagtttttagtg

SEQ ID NO: 1279252 - DNA, 22 bp, Artificial Sequence
  chemically synthesized
ttattgatgtcactaaaaactg

SEQ ID NO: 1279253 - DNA, 22 bp, Artificial Sequence
  chemically synthesized
ttttcctcctgagcagttttta

SEQ ID NO: 1279254 - DNA, 22 bp, Artificial Sequence
  chemically synthesized
attttcctcctgagcagttttt

SEQ ID NO: 1279255 - DNA, 22 bp, Artificial Sequence
  chemically synthesized
ttgatgtcactaaaaactgctc

SEQ ID NO: 1279256 - DNA, 22 bp, Artificial Sequence
  chemically synthesized
cttattttcctcctgagcagtt

SEQ ID NO: 1279257 - DNA, 22 bp, Artificial Sequence
  chemically synthesized
atgtcactaaaaactgctcagg

SEQ ID NO: 1279258 - DNA, 22 bp, Artificial Sequence
  chemically synthesized
aaaactgctcaggaggaaaata

SEQ ID NO: 1279259 - DNA, 22 bp, Artificial Sequence
  chemically synthesized
atcacaataagacctacttatt

SEQ ID NO: 1279260 - DNA, 22 bp, Artificial Sequence
  chemically synthesized
ctcaggaggaaaataagtaggt

SEQ ID NO: 1279261 - DNA, 22 bp, Artificial Sequence
  chemically synthesized
catcacaataagacctacttat

SEQ ID NO: 1279262 - DNA, 22 bp, Artificial Sequence
  chemically synthesized
aggaggaaaataagtaggtctt

SEQ ID NO: 1279263 - DNA, 22 bp, Artificial Sequence
  chemically synthesized
tttcatcacaataagacctact

SEQ ID NO: 1279264 - DNA, 22 bp, Artificial Sequence
  chemically synthesized
aataaaatattgtttcatcaca

SEQ ID NO: 1279265 - DNA, 22 bp, Artificial Sequence
  chemically synthesized
caataaaatattgtttcatcac

SEQ ID NO: 1279266 - DNA, 22 bp, Artificial Sequence
  chemically synthesized
tcaataaaatattgtttcatca

SEQ ID NO: 1279267 - DNA, 22 bp, Artificial Sequence
  chemically synthesized
ttcaataaaatattgtttcatc

SEQ ID NO: 1279268 - DNA, 22 bp, Artificial Sequence
  chemically synthesized
tttcaataaaatattgtttcat

SEQ ID NO: 1279269 - DNA, 22 bp, Artificial Sequence
  chemically synthesized
ttttcaataaaatattgtttca

SEQ ID NO: 1279270 - DNA, 22 bp, Artificial Sequence
  chemically synthesized
attgtgatgaaacaatatttta

SEQ ID NO: 1279271 - DNA, 22 bp, Artificial Sequence
  chemically synthesized
ttgtgatgaaacaatattttat

SEQ ID NO: 1279272 - DNA, 22 bp, Artificial Sequence
  chemically synthesized
atcaatttttttcaataaaata

SEQ ID NO: 1279273 - DNA, 22 bp, Artificial Sequence
  chemically synthesized
tgatgaaacaatattttattga

SEQ ID NO: 1279274 - DNA, 22 bp, Artificial Sequence
  chemically synthesized
aataaaaaatgttgatcaattt

SEQ ID NO: 1279275 - DNA, 22 bp, Artificial Sequence
  chemically synthesized
aaataaaaaatgttgatcaatt

SEQ ID NO: 1279276 - DNA, 22 bp, Artificial Sequence
  chemically synthesized
taaataaaaaatgttgatcaat

SEQ ID NO: 1279277 - DNA, 22 bp, Artificial Sequence
  chemically synthesized
tattgaaaaaaattgatcaaca

SEQ ID NO: 1279278 - DNA, 22 bp, Artificial Sequence
  chemically synthesized
ttaaataaaaaatgttgatcaa

SEQ ID NO: 1279279 - DNA, 22 bp, Artificial Sequence
  chemically synthesized
attgaaaaaaattgatcaacat

SEQ ID NO: 1279280 - DNA, 22 bp, Artificial Sequence
  chemically synthesized
ttgaaaaaaattgatcaacatt

SEQ ID NO: 1279281 - DNA, 22 bp, Artificial Sequence
  chemically synthesized
tttttaaataaaaaatgttgat

SEQ ID NO: 1279282 - DNA, 22 bp, Artificial Sequence
  chemically synthesized
gtttttaaataaaaaatgttga

SEQ ID NO: 1279283 - DNA, 22 bp, Artificial Sequence
  chemically synthesized
aaaaaaattgatcaacattttt

SEQ ID NO: 1279284 - DNA, 22 bp, Artificial Sequence
  chemically synthesized
tgtttttaaataaaaaatgttg

SEQ ID NO: 1279285 - DNA, 22 bp, Artificial Sequence
  chemically synthesized
atcaacattttttatttaaaaa

SEQ ID NO: 1279286 - DNA, 22 bp, Artificial Sequence
  chemically synthesized
aataaaatagccccagttttgt

SEQ ID NO: 1279287 - DNA, 22 bp, Artificial Sequence
  chemically synthesized
tttatttaaaaacaaaactggg

SEQ ID NO: 1279288 - DNA, 22 bp, Artificial Sequence
  chemically synthesized
ttatttaaaaacaaaactgggg

SEQ ID NO: 1279289 - DNA, 22 bp, Artificial Sequence
  chemically synthesized
tatttaaaaacaaaactggggc

SEQ ID NO: 1279290 - DNA, 22 bp, Artificial Sequence
  chemically synthesized
ctgaataaaatagccccagttt

SEQ ID NO: 1279291 - DNA, 22 bp, Artificial Sequence
  chemically synthesized
atttaaaaacaaaactggggct

SEQ ID NO: 1279292 - DNA, 22 bp, Artificial Sequence
  chemically synthesized
tttaaaaacaaaactggggcta

SEQ ID NO: 1279293 - DNA, 22 bp, Artificial Sequence
  chemically synthesized
aaaaacaaaactggggctattt

SEQ ID NO: 1279294 - DNA, 22 bp, Artificial Sequence
  chemically synthesized
aaaacaaaactggggctatttt

SEQ ID NO: 1279295 - DNA, 22 bp, Artificial Sequence
  chemically synthesized
gcatattactgaataaaatagc

SEQ ID NO: 1279296 - DNA, 22 bp, Artificial Sequence
  chemically synthesized
gggctattttattcagtaatat

SEQ ID NO: 1279297 - DNA, 22 bp, Artificial Sequence
  chemically synthesized
tgtgaatactggcatattactg

SEQ ID NO: 1279298 - DNA, 22 bp, Artificial Sequence
  chemically synthesized
ctatgtgaatactggcatatta

SEQ ID NO: 1279299 - DNA, 22 bp, Artificial Sequence
  chemically synthesized
gctatgtgaatactggcatatt

SEQ ID NO: 1279300 - DNA, 22 bp, Artificial Sequence
  chemically synthesized
ttttattcagtaatatgccagt

SEQ ID NO: 1279301 - DNA, 22 bp, Artificial Sequence
  chemically synthesized
ttgctatgtgaatactggcata

SEQ ID NO: 1279302 - DNA, 22 bp, Artificial Sequence
  chemically synthesized
tattcagtaatatgccagtatt

SEQ ID NO: 1279303 - DNA, 22 bp, Artificial Sequence
  chemically synthesized
attcagtaatatgccagtattc

SEQ ID NO: 1279304 - DNA, 22 bp, Artificial Sequence
  chemically synthesized
ttcagtaatatgccagtattca

SEQ ID NO: 1279305 - DNA, 22 bp, Artificial Sequence
  chemically synthesized
agtaatatgccagtattcacat

SEQ ID NO: 1279306 - DNA, 22 bp, Artificial Sequence
  chemically synthesized
aaaactcttgctatgtgaatac

SEQ ID NO: 1279307 - DNA, 22 bp, Artificial Sequence
  chemically synthesized
tgctcaaaactcttgctatgtg

SEQ ID NO: 1279308 - DNA, 22 bp, Artificial Sequence
  chemically synthesized
caaagcctatgctcaaaactct

SEQ ID NO: 1279309 - DNA, 22 bp, Artificial Sequence
  chemically synthesized
acatagcaagagttttgagcat

SEQ ID NO: 1279310 - DNA, 22 bp, Artificial Sequence
  chemically synthesized
aggctccaaagcctatgctcaa

SEQ ID NO: 1279311 - DNA, 22 bp, Artificial Sequence
  chemically synthesized
gatgctcaggctccaaagccta

SEQ ID NO: 1279312 - DNA, 22 bp, Artificial Sequence
  chemically synthesized
tgagcataggctttggagcctg

SEQ ID NO: 1279313 - DNA, 22 bp, Artificial Sequence
  chemically synthesized
aacctagatgctcaggctccaa

SEQ ID NO: 1279314 - DNA, 22 bp, Artificial Sequence
  chemically synthesized
gagcataggctttggagcctga

SEQ ID NO: 1279315 - DNA, 22 bp, Artificial Sequence
  chemically synthesized
gaacctagatgctcaggctcca

SEQ ID NO: 1279316 - DNA, 22 bp, Artificial Sequence
  chemically synthesized
agcataggctttggagcctgag

SEQ ID NO: 1279317 - DNA, 22 bp, Artificial Sequence
  chemically synthesized
tggagcctgagcatctaggttc

SEQ ID NO: 1279318 - DNA, 22 bp, Artificial Sequence
  chemically synthesized
aagtcaggatttgaacctagat

SEQ ID NO: 1279319 - DNA, 22 bp, Artificial Sequence
  chemically synthesized
ggagcctgagcatctaggttca

SEQ ID NO: 1279320 - DNA, 22 bp, Artificial Sequence
  chemically synthesized
gagcctgagcatctaggttcaa

SEQ ID NO: 1279321 - DNA, 22 bp, Artificial Sequence
  chemically synthesized
agcatctaggttcaaatcctga

SEQ ID NO: 1279322 - DNA, 22 bp, Artificial Sequence
  chemically synthesized
ataaatgttaaagtcaggattt

SEQ ID NO: 1279323 - DNA, 22 bp, Artificial Sequence
  chemically synthesized
ggttcaaatcctgactttaaca

SEQ ID NO: 1279324 - DNA, 22 bp, Artificial Sequence
  chemically synthesized
aaatcctgactttaacatttat

SEQ ID NO: 1279325 - DNA, 22 bp, Artificial Sequence
  chemically synthesized
cccatcgtcccactaataaatg

SEQ ID NO: 1279326 - DNA, 22 bp, Artificial Sequence
  chemically synthesized
acccatcgtcccactaataaat

SEQ ID NO: 1279327 - DNA, 22 bp, Artificial Sequence
  chemically synthesized
actttaacatttattagtggga

SEQ ID NO: 1279328 - DNA, 22 bp, Artificial Sequence
  chemically synthesized
taacatttattagtgggacgat

SEQ ID NO: 1279329 - DNA, 22 bp, Artificial Sequence
  chemically synthesized
atgaacttacccatcgtcccac

SEQ ID NO: 1279330 - DNA, 22 bp, Artificial Sequence
  chemically synthesized
aacatttattagtgggacgatg

SEQ ID NO: 1279331 - DNA, 22 bp, Artificial Sequence
  chemically synthesized
acatttattagtgggacgatgg

SEQ ID NO: 1279332 - DNA, 22 bp, Artificial Sequence
  chemically synthesized
attagtgggacgatgggtaagt

SEQ ID NO: 1279333 - DNA, 22 bp, Artificial Sequence
  chemically synthesized
ttagtgggacgatgggtaagtt

SEQ ID NO: 1279334 - DNA, 22 bp, Artificial Sequence
  chemically synthesized
gtgggacgatgggtaagttcat

SEQ ID NO: 1279335 - DNA, 22 bp, Artificial Sequence
  chemically synthesized
aagtacggagatgctaatgaac

SEQ ID NO: 1279336 - DNA, 22 bp, Artificial Sequence
  chemically synthesized
attagcatctccgtactttagt

SEQ ID NO: 1279337 - DNA, 22 bp, Artificial Sequence
  chemically synthesized
acatatggaaagaaactaaagt

SEQ ID NO: 1279338 - DNA, 22 bp, Artificial Sequence
  chemically synthesized
aacatatggaaagaaactaaag

SEQ ID NO: 1279339 - DNA, 22 bp, Artificial Sequence
  chemically synthesized
gcatctccgtactttagtttct

SEQ ID NO: 1279340 - DNA, 22 bp, Artificial Sequence
  chemically synthesized
cgtactttagtttctttccata

SEQ ID NO: 1279341 - DNA, 22 bp, Artificial Sequence
  chemically synthesized
tccatatttaacatatggaaag

SEQ ID NO: 1279342 - DNA, 22 bp, Artificial Sequence
  chemically synthesized
ttatccatatttaacatatgga

SEQ ID NO: 1279343 - DNA, 22 bp, Artificial Sequence
  chemically synthesized
tagtttctttccatatgttaaa

SEQ ID NO: 1279344 - DNA, 22 bp, Artificial Sequence
  chemically synthesized
agtttctttccatatgttaaat

SEQ ID NO: 1279345 - DNA, 22 bp, Artificial Sequence
  chemically synthesized
gtttctttccatatgttaaata

SEQ ID NO: 1279346 - DNA, 22 bp, Artificial Sequence
  chemically synthesized
ctttccatatgttaaatatgga

SEQ ID NO: 1279347 - DNA, 22 bp, Artificial Sequence
  chemically synthesized
tttccatatgttaaatatggat

SEQ ID NO: 1279348 - DNA, 22 bp, Artificial Sequence
  chemically synthesized
gacaccattattatccatattt

SEQ ID NO: 1279349 - DNA, 22 bp, Artificial Sequence
  chemically synthesized
tccatatgttaaatatggataa

SEQ ID NO: 1279350 - DNA, 22 bp, Artificial Sequence
  chemically synthesized
ccatatgttaaatatggataat

SEQ ID NO: 1279351 - DNA, 22 bp, Artificial Sequence
  chemically synthesized
catatgttaaatatggataata

SEQ ID NO: 1279352 - DNA, 22 bp, Artificial Sequence
  chemically synthesized
tgaattagacaccattattatc

SEQ ID NO: 1279353 - DNA, 22 bp, Artificial Sequence
  chemically synthesized
aatatggataataatggtgtct

SEQ ID NO: 1279354 - DNA, 22 bp, Artificial Sequence
  chemically synthesized
ataagaatcctatgaattagac

SEQ ID NO: 1279355 - DNA, 22 bp, Artificial Sequence
  chemically synthesized
tcataagaatcctatgaattag

SEQ ID NO: 1279356 - DNA, 22 bp, Artificial Sequence
  chemically synthesized
aattctcataagaatcctatga

SEQ ID NO: 1279357 - DNA, 22 bp, Artificial Sequence
  chemically synthesized
attcataggattcttatgagaa

SEQ ID NO: 1279358 - DNA, 22 bp, Artificial Sequence
  chemically synthesized
taatcaggcattaaattctcat

SEQ ID NO: 1279359 - DNA, 22 bp, Artificial Sequence
  chemically synthesized
ataggattcttatgagaattta

SEQ ID NO: 1279360 - DNA, 22 bp, Artificial Sequence
  chemically synthesized
ataatcaggcattaaattctca

SEQ ID NO: 1279361 - DNA, 22 bp, Artificial Sequence
  chemically synthesized
acttataatcaggcattaaatt

SEQ ID NO: 1279362 - DNA, 22 bp, Artificial Sequence
  chemically synthesized
ttatgagaatttaatgcctgat

SEQ ID NO: 1279363 - DNA, 22 bp, Artificial Sequence
  chemically synthesized
acctcacttataatcaggcatt

SEQ ID NO: 1279364 - DNA, 22 bp, Artificial Sequence
  chemically synthesized
atgagaatttaatgcctgatta

SEQ ID NO: 1279365 - DNA, 22 bp, Artificial Sequence
  chemically synthesized
tgagaatttaatgcctgattat

SEQ ID NO: 1279366 - DNA, 22 bp, Artificial Sequence
  chemically synthesized
aatgcctgattataagtgaggt

SEQ ID NO: 1279367 - DNA, 22 bp, Artificial Sequence
  chemically synthesized
atgcctgattataagtgaggtt

SEQ ID NO: 1279368 - DNA, 22 bp, Artificial Sequence
  chemically synthesized
tgtcaaggtaccatcctaacct

SEQ ID NO: 1279369 - DNA, 22 bp, Artificial Sequence
  chemically synthesized
attataagtgaggttaggatgg

SEQ ID NO: 1279370 - DNA, 22 bp, Artificial Sequence
  chemically synthesized
ctatgtcaaggtaccatcctaa

SEQ ID NO: 1279371 - DNA, 22 bp, Artificial Sequence
  chemically synthesized
taagtgaggttaggatggtacc

SEQ ID NO: 1279372 - DNA, 22 bp, Artificial Sequence
  chemically synthesized
ggatggtaccttgacatagtag

SEQ ID NO: 1279373 - DNA, 22 bp, Artificial Sequence
  chemically synthesized
gacatagtagctgttttatcat

SEQ ID NO: 1279374 - DNA, 22 bp, Artificial Sequence
  chemically synthesized
acatagtagctgttttatcatt

SEQ ID NO: 1279375 - DNA, 22 bp, Artificial Sequence
  chemically synthesized
ttttatcattgttctggattat

SEQ ID NO: 1279376 - DNA, 22 bp, Artificial Sequence
  chemically synthesized
tatcattgttctggattattat

SEQ ID NO: 1279377 - DNA, 22 bp, Artificial Sequence
  chemically synthesized
atcattgttctggattattata

SEQ ID NO: 1279378 - DNA, 22 bp, Artificial Sequence
  chemically synthesized
tcattgttctggattattatat

SEQ ID NO: 1279379 - DNA, 22 bp, Artificial Sequence
  chemically synthesized
ttctggattattatatttatta

SEQ ID NO: 1279380 - DNA, 22 bp, Artificial Sequence
  chemically synthesized
tggattattatatttattatct

SEQ ID NO: 1279381 - DNA, 22 bp, Artificial Sequence
  chemically synthesized
gattattatatttattatctat

SEQ ID NO: 1279382 - DNA, 22 bp, Artificial Sequence
  chemically synthesized
ttatatttattatctatgccta

SEQ ID NO: 1279383 - DNA, 22 bp, Artificial Sequence
  chemically synthesized
tatttattatctatgcctattt

SEQ ID NO: 1279384 - DNA, 22 bp, Artificial Sequence
  chemically synthesized
attatctatgcctattttatat

SEQ ID NO: 1279385 - DNA, 22 bp, Artificial Sequence
  chemically synthesized
ttatctatgcctattttatata

SEQ ID NO: 1279386 - DNA, 22 bp, Artificial Sequence
  chemically synthesized
caggcatgtatggtatataaaa

SEQ ID NO: 1279387 - DNA, 22 bp, Artificial Sequence
  chemically synthesized
acaggcatgtatggtatataaa

SEQ ID NO: 1279388 - DNA, 22 bp, Artificial Sequence
  chemically synthesized
tctatgcctattttatatacca

SEQ ID NO: 1279389 - DNA, 22 bp, Artificial Sequence
  chemically synthesized
tttacaggcatgtatggtatat

SEQ ID NO: 1279390 - DNA, 22 bp, Artificial Sequence
  chemically synthesized
atttacaggcatgtatggtata

SEQ ID NO: 1279391 - DNA, 22 bp, Artificial Sequence
  chemically synthesized
tgcctattttatataccataca

SEQ ID NO: 1279392 - DNA, 22 bp, Artificial Sequence
  chemically synthesized
tatttacaggcatgtatggtat

SEQ ID NO: 1279393 - DNA, 22 bp, Artificial Sequence
  chemically synthesized
ttttatataccatacatgcctg

SEQ ID NO: 1279394 - DNA, 22 bp, Artificial Sequence
  chemically synthesized
tatataccatacatgcctgtaa

SEQ ID NO: 1279395 - DNA, 22 bp, Artificial Sequence
  chemically synthesized
gacaaactttatttacaggcat

SEQ ID NO: 1279396 - DNA, 22 bp, Artificial Sequence
  chemically synthesized
atataccatacatgcctgtaaa

SEQ ID NO: 1279397 - DNA, 22 bp, Artificial Sequence
  chemically synthesized
tataccatacatgcctgtaaat

SEQ ID NO: 1279398 - DNA, 22 bp, Artificial Sequence
  chemically synthesized
catggcatcctagacaaacttt

SEQ ID NO: 1279399 - DNA, 22 bp, Artificial Sequence
  chemically synthesized
ccatggcatcctagacaaactt

SEQ ID NO: 1279400 - DNA, 22 bp, Artificial Sequence
  chemically synthesized
gtcttccatggcatcctagaca

SEQ ID NO: 1279401 - DNA, 22 bp, Artificial Sequence
  chemically synthesized
taaataaagtttgtctaggatg

SEQ ID NO: 1279402 - DNA, 22 bp, Artificial Sequence
  chemically synthesized
tggtcttccatggcatcctaga

SEQ ID NO: 1279403 - DNA, 22 bp, Artificial Sequence
  chemically synthesized
gtctaggatgccatggaagacc

SEQ ID NO: 1279404 - DNA, 22 bp, Artificial Sequence
  chemically synthesized
tctaggatgccatggaagacca

SEQ ID NO: 1279405 - DNA, 22 bp, Artificial Sequence
  chemically synthesized
ggatgccatggaagaccagagt

SEQ ID NO: 1279406 - DNA, 22 bp, Artificial Sequence
  chemically synthesized
cacaaaggtggtgaactctggt

SEQ ID NO: 1279407 - DNA, 22 bp, Artificial Sequence
  chemically synthesized
tcaaatctccacaaaggtggtg

SEQ ID NO: 1279408 - DNA, 22 bp, Artificial Sequence
  chemically synthesized
accacctttgtggagatttgat

SEQ ID NO: 1279409 - DNA, 22 bp, Artificial Sequence
  chemically synthesized
atggtgaaaatcctatcaaatc

SEQ ID NO: 1279410 - DNA, 22 bp, Artificial Sequence
  chemically synthesized
tctaatggtgaaaatcctatca

SEQ ID NO: 1279411 - DNA, 22 bp, Artificial Sequence
  chemically synthesized
tgtggagatttgataggatttt

SEQ ID NO: 1279412 - DNA, 22 bp, Artificial Sequence
  chemically synthesized
gtggagatttgataggattttc

SEQ ID NO: 1279413 - DNA, 22 bp, Artificial Sequence
  chemically synthesized
ttatctaatggtgaaaatccta

SEQ ID NO: 1279414 - DNA, 22 bp, Artificial Sequence
  chemically synthesized
tggagatttgataggattttca

SEQ ID NO: 1279415 - DNA, 22 bp, Artificial Sequence
  chemically synthesized
attatctaatggtgaaaatcct

SEQ ID NO: 1279416 - DNA, 22 bp, Artificial Sequence
  chemically synthesized
ttattatctaatggtgaaaatc

SEQ ID NO: 1279417 - DNA, 22 bp, Artificial Sequence
  chemically synthesized
gataggattttcaccattagat

SEQ ID NO: 1279418 - DNA, 22 bp, Artificial Sequence
  chemically synthesized
ataggattttcaccattagata

SEQ ID NO: 1279419 - DNA, 22 bp, Artificial Sequence
  chemically synthesized
tatagctcttattatctaatgg

SEQ ID NO: 1279420 - DNA, 22 bp, Artificial Sequence
  chemically synthesized
tcaccattagataataagagct

SEQ ID NO: 1279421 - DNA, 22 bp, Artificial Sequence
  chemically synthesized
caccattagataataagagcta

SEQ ID NO: 1279422 - DNA, 22 bp, Artificial Sequence
  chemically synthesized
accattagataataagagctat

SEQ ID NO: 1279423 - DNA, 22 bp, Artificial Sequence
  chemically synthesized
gataataagagctatataatgt

SEQ ID NO: 1279424 - DNA, 22 bp, Artificial Sequence
  chemically synthesized
aagaggaaacatacattatata

SEQ ID NO: 1279425 - DNA, 22 bp, Artificial Sequence
  chemically synthesized
tataatgtatgtttcctcttta

SEQ ID NO: 1279426 - DNA, 22 bp, Artificial Sequence
  chemically synthesized
cctctttagtctgggctcccat

SEQ ID NO: 1279427 - DNA, 22 bp, Artificial Sequence
  chemically synthesized
gcaccaagaatcatgggagccc

SEQ ID NO: 1279428 - DNA, 22 bp, Artificial Sequence
  chemically synthesized
ctctttagtctgggctcccatg

SEQ ID NO: 1279429 - DNA, 22 bp, Artificial Sequence
  chemically synthesized
ggcaccaagaatcatgggagcc

SEQ ID NO: 1279430 - DNA, 22 bp, Artificial Sequence
  chemically synthesized
tttagtctgggctcccatgatt

SEQ ID NO: 1279431 - DNA, 22 bp, Artificial Sequence
  chemically synthesized
tagtctgggctcccatgattct

SEQ ID NO: 1279432 - DNA, 22 bp, Artificial Sequence
  chemically synthesized
agtctgggctcccatgattctt

SEQ ID NO: 1279433 - DNA, 22 bp, Artificial Sequence
  chemically synthesized
gtctgggctcccatgattcttg

SEQ ID NO: 1279434 - DNA, 22 bp, Artificial Sequence
  chemically synthesized
ggctcccatgattcttggtgcc

SEQ ID NO: 1279435 - DNA, 22 bp, Artificial Sequence
  chemically synthesized
aaccaaaacgtttggcaccaag

SEQ ID NO: 1279436 - DNA, 22 bp, Artificial Sequence
  chemically synthesized
aaaccaaaacgtttggcaccaa

SEQ ID NO: 1279437 - DNA, 22 bp, Artificial Sequence
  chemically synthesized
ccatgattcttggtgccaaacg

SEQ ID NO: 1279438 - DNA, 22 bp, Artificial Sequence
  chemically synthesized
aatttaaaccaaaacgtttggc

SEQ ID NO: 1279439 - DNA, 22 bp, Artificial Sequence
  chemically synthesized
ctgaatttaaaccaaaacgttt

SEQ ID NO: 1279440 - DNA, 22 bp, Artificial Sequence
  chemically synthesized
ttggtgccaaacgttttggttt

SEQ ID NO: 1279441 - DNA, 22 bp, Artificial Sequence
  chemically synthesized
ggtgccaaacgttttggtttaa

SEQ ID NO: 1279442 - DNA, 22 bp, Artificial Sequence
  chemically synthesized
gagttactgaatttaaaccaaa

SEQ ID NO: 1279443 - DNA, 22 bp, Artificial Sequence
  chemically synthesized
gtgccaaacgttttggtttaaa

SEQ ID NO: 1279444 - DNA, 22 bp, Artificial Sequence
  chemically synthesized
aattggagttactgaatttaaa

SEQ ID NO: 1279445 - DNA, 22 bp, Artificial Sequence
  chemically synthesized
tggtttaaattcagtaactcca

SEQ ID NO: 1279446 - DNA, 22 bp, Artificial Sequence
  chemically synthesized
ggtttaaattcagtaactccaa

SEQ ID NO: 1279447 - DNA, 22 bp, Artificial Sequence
  chemically synthesized
gtttaaattcagtaactccaat

SEQ ID NO: 1279448 - DNA, 22 bp, Artificial Sequence
  chemically synthesized
aaattcagtaactccaattgag

SEQ ID NO: 1279449 - DNA, 22 bp, Artificial Sequence
  chemically synthesized
acagaaatatggctcaattgga

SEQ ID NO: 1279450 - DNA, 22 bp, Artificial Sequence
  chemically synthesized
aattcagtaactccaattgagc

SEQ ID NO: 1279451 - DNA, 22 bp, Artificial Sequence
  chemically synthesized
gacagaaatatggctcaattgg

SEQ ID NO: 1279452 - DNA, 22 bp, Artificial Sequence
  chemically synthesized
agtaactccaattgagccatat

SEQ ID NO: 1279453 - DNA, 22 bp, Artificial Sequence
  chemically synthesized
gaagaatttgacagaaatatgg

SEQ ID NO: 1279454 - DNA, 22 bp, Artificial Sequence
  chemically synthesized
ggaagaatttgacagaaatatg

SEQ ID NO: 1279455 - DNA, 22 bp, Artificial Sequence
  chemically synthesized
caattgagccatatttctgtca

SEQ ID NO: 1279456 - DNA, 22 bp, Artificial Sequence
  chemically synthesized
acatttggaagaatttgacaga

SEQ ID NO: 1279457 - DNA, 22 bp, Artificial Sequence
  chemically synthesized
agccatatttctgtcaaattct

SEQ ID NO: 1279458 - DNA, 22 bp, Artificial Sequence
  chemically synthesized
ctgtcaaattcttccaaatgtc

SEQ ID NO: 1279459 - DNA, 22 bp, Artificial Sequence
  chemically synthesized
tgtcaaattcttccaaatgtca

SEQ ID NO: 1279460 - DNA, 22 bp, Artificial Sequence
  chemically synthesized
tcaaattcttccaaatgtcaac

SEQ ID NO: 1279461 - DNA, 22 bp, Artificial Sequence
  chemically synthesized
gaagccacatatagttgacatt

SEQ ID NO: 1279462 - DNA, 22 bp, Artificial Sequence
  chemically synthesized
actagaagccacatatagttga

SEQ ID NO: 1279463 - DNA, 22 bp, Artificial Sequence
  chemically synthesized
ttccaaatgtcaactatatgtg

SEQ ID NO: 1279464 - DNA, 22 bp, Artificial Sequence
  chemically synthesized
ccaaatgtcaactatatgtggc

SEQ ID NO: 1279465 - DNA, 22 bp, Artificial Sequence
  chemically synthesized
caaatgtcaactatatgtggct

SEQ ID NO: 1279466 - DNA, 22 bp, Artificial Sequence
  chemically synthesized
tatgtggcttctagtcaatttg

SEQ ID NO: 1279467 - DNA, 22 bp, Artificial Sequence
  chemically synthesized
ctagtcaatttgaccttgtttt

SEQ ID NO: 1279468 - DNA, 22 bp, Artificial Sequence
  chemically synthesized
tagtcaatttgaccttgtttta

SEQ ID NO: 1279469 - DNA, 22 bp, Artificial Sequence
  chemically synthesized
aatcagaatcagtaaaacaagg

SEQ ID NO: 1279470 - DNA, 22 bp, Artificial Sequence
  chemically synthesized
gtcaatttgaccttgttttact

SEQ ID NO: 1279471 - DNA, 22 bp, Artificial Sequence
  chemically synthesized
ccactaaatcagaatcagtaaa

SEQ ID NO: 1279472 - DNA, 22 bp, Artificial Sequence
  chemically synthesized
gccactaaatcagaatcagtaa

SEQ ID NO: 1279473 - DNA, 22 bp, Artificial Sequence
  chemically synthesized
gaccttgttttactgattctga

SEQ ID NO: 1279474 - DNA, 22 bp, Artificial Sequence
  chemically synthesized
accttgttttactgattctgat

SEQ ID NO: 1279475 - DNA, 22 bp, Artificial Sequence
  chemically synthesized
ccatcttgccactaaatcagaa

SEQ ID NO: 1279476 - DNA, 22 bp, Artificial Sequence
  chemically synthesized
gttttactgattctgatttagt

SEQ ID NO: 1279477 - DNA, 22 bp, Artificial Sequence
  chemically synthesized
ttttactgattctgatttagtg

SEQ ID NO: 1279478 - DNA, 22 bp, Artificial Sequence
  chemically synthesized
atctaccatcttgccactaaat

SEQ ID NO: 1279479 - DNA, 22 bp, Artificial Sequence
  chemically synthesized
tactgattctgatttagtggca

SEQ ID NO: 1279480 - DNA, 22 bp, Artificial Sequence
  chemically synthesized
actgattctgatttagtggcaa

SEQ ID NO: 1279481 - DNA, 22 bp, Artificial Sequence
  chemically synthesized
ctgattctgatttagtggcaag

SEQ ID NO: 1279482 - DNA, 22 bp, Artificial Sequence
  chemically synthesized
cattcatctaccatcttgccac

SEQ ID NO: 1279483 - DNA, 22 bp, Artificial Sequence
  chemically synthesized
attctgatttagtggcaagatg

SEQ ID NO: 1279484 - DNA, 22 bp, Artificial Sequence
  chemically synthesized
tgatttagtggcaagatggtag

SEQ ID NO: 1279485 - DNA, 22 bp, Artificial Sequence
  chemically synthesized
atttagtggcaagatggtagat

SEQ ID NO: 1279486 - DNA, 22 bp, Artificial Sequence
  chemically synthesized
agtggcaagatggtagatgaat

SEQ ID NO: 1279487 - DNA, 22 bp, Artificial Sequence
  chemically synthesized
gtggcaagatggtagatgaatg

SEQ ID NO: 1279488 - DNA, 22 bp, Artificial Sequence
  chemically synthesized
aaatcacgagaataaaccattg

SEQ ID NO: 1279489 - DNA, 22 bp, Artificial Sequence
  chemically synthesized
aaaatcacgagaataaaccatt

SEQ ID NO: 1279490 - DNA, 22 bp, Artificial Sequence
  chemically synthesized
aatttaaaatcacgagaataaa

SEQ ID NO: 1279491 - DNA, 22 bp, Artificial Sequence
  chemically synthesized
caaatgattaaatttaaaatca

SEQ ID NO: 1279492 - DNA, 22 bp, Artificial Sequence
  chemically synthesized
attctcgtgattttaaatttaa

SEQ ID NO: 1279493 - DNA, 22 bp, Artificial Sequence
  chemically synthesized
ttctcgtgattttaaatttaat

SEQ ID NO: 1279494 - DNA, 22 bp, Artificial Sequence
  chemically synthesized
tcgtgattttaaatttaatcat

SEQ ID NO: 1279495 - DNA, 22 bp, Artificial Sequence
  chemically synthesized
gtgattttaaatttaatcattt

SEQ ID NO: 1279496 - DNA, 22 bp, Artificial Sequence
  chemically synthesized
aaagtatataattacaaatgat

SEQ ID NO: 1279497 - DNA, 22 bp, Artificial Sequence
  chemically synthesized
aaaagtatataattacaaatga

SEQ ID NO: 1279498 - DNA, 22 bp, Artificial Sequence
  chemically synthesized
taaatttaatcatttgtaatta

SEQ ID NO: 1279499 - DNA, 22 bp, Artificial Sequence
  chemically synthesized
aaatttaatcatttgtaattat

SEQ ID NO: 1279500 - DNA, 22 bp, Artificial Sequence
  chemically synthesized
aatttaatcatttgtaattata

SEQ ID NO: 1279501 - DNA, 22 bp, Artificial Sequence
  chemically synthesized
cgtcttaaaagtatataattac

SEQ ID NO: 1279502 - DNA, 22 bp, Artificial Sequence
  chemically synthesized
acgtcttaaaagtatataatta

SEQ ID NO: 1279503 - DNA, 22 bp, Artificial Sequence
  chemically synthesized
tacgtcttaaaagtatataatt

SEQ ID NO: 1279504 - DNA, 22 bp, Artificial Sequence
  chemically synthesized
aatcatttgtaattatatactt

SEQ ID NO: 1279505 - DNA, 22 bp, Artificial Sequence
  chemically synthesized
atcatttgtaattatatacttt

SEQ ID NO: 1279506 - DNA, 22 bp, Artificial Sequence
  chemically synthesized
gtaattatatacttttaagacg

SEQ ID NO: 1279507 - DNA, 22 bp, Artificial Sequence
  chemically synthesized
taattatatacttttaagacgt

SEQ ID NO: 1279508 - DNA, 22 bp, Artificial Sequence
  chemically synthesized
tgacaggtgaagctttacgtct

SEQ ID NO: 1279509 - DNA, 22 bp, Artificial Sequence
  chemically synthesized
atgacaggtgaagctttacgtc

SEQ ID NO: 1279510 - DNA, 22 bp, Artificial Sequence
  chemically synthesized
tatacttttaagacgtaaagct

SEQ ID NO: 1279511 - DNA, 22 bp, Artificial Sequence
  chemically synthesized
tatgacaggtgaagctttacgt

SEQ ID NO: 1279512 - DNA, 22 bp, Artificial Sequence
  chemically synthesized
ttaagacgtaaagcttcacctg

SEQ ID NO: 1279513 - DNA, 22 bp, Artificial Sequence
  chemically synthesized
taagacgtaaagcttcacctgt

SEQ ID NO: 1279514 - DNA, 22 bp, Artificial Sequence
  chemically synthesized
aagacgtaaagcttcacctgtc

SEQ ID NO: 1279515 - DNA, 22 bp, Artificial Sequence
  chemically synthesized
agacgtaaagcttcacctgtca

SEQ ID NO: 1279516 - DNA, 22 bp, Artificial Sequence
  chemically synthesized
tgccataaagggcatgttttat

SEQ ID NO: 1279517 - DNA, 22 bp, Artificial Sequence
  chemically synthesized
cacctgtcataaaacatgccct

SEQ ID NO: 1279518 - DNA, 22 bp, Artificial Sequence
  chemically synthesized
acctgtcataaaacatgccctt

SEQ ID NO: 1279519 - DNA, 22 bp, Artificial Sequence
  chemically synthesized
aaaccattgtgccataaagggc

SEQ ID NO: 1279520 - DNA, 22 bp, Artificial Sequence
  chemically synthesized
tcataaaacatgccctttatgg

SEQ ID NO: 1279521 - DNA, 22 bp, Artificial Sequence
  chemically synthesized
aaaaccattgtgccataaaggg

SEQ ID NO: 1279522 - DNA, 22 bp, Artificial Sequence
  chemically synthesized
taaaaccattgtgccataaagg

SEQ ID NO: 1279523 - DNA, 22 bp, Artificial Sequence
  chemically synthesized
ggaccatattttaaaaccattg

SEQ ID NO: 1279524 - DNA, 22 bp, Artificial Sequence
  chemically synthesized
gggaccatattttaaaaccatt

SEQ ID NO: 1279525 - DNA, 22 bp, Artificial Sequence
  chemically synthesized
tgggaccatattttaaaaccat

SEQ ID NO: 1279526 - DNA, 22 bp, Artificial Sequence
  chemically synthesized
tatggcacaatggttttaaaat

SEQ ID NO: 1279527 - DNA, 22 bp, Artificial Sequence
  chemically synthesized
atggcacaatggttttaaaata

SEQ ID NO: 1279528 - DNA, 22 bp, Artificial Sequence
  chemically synthesized
tggcacaatggttttaaaatat

SEQ ID NO: 1279529 - DNA, 22 bp, Artificial Sequence
  chemically synthesized
ccaatgagttttgggaccatat

SEQ ID NO: 1279530 - DNA, 22 bp, Artificial Sequence
  chemically synthesized
gccaatgagttttgggaccata

SEQ ID NO: 1279531 - DNA, 22 bp, Artificial Sequence
  chemically synthesized
catttgccaatgagttttggga

SEQ ID NO: 1279532 - DNA, 22 bp, Artificial Sequence
  chemically synthesized
ccatttgccaatgagttttggg

SEQ ID NO: 1279533 - DNA, 22 bp, Artificial Sequence
  chemically synthesized
taaaatatggtcccaaaactca

SEQ ID NO: 1279534 - DNA, 22 bp, Artificial Sequence
  chemically synthesized
tccatttgccaatgagttttgg

SEQ ID NO: 1279535 - DNA, 22 bp, Artificial Sequence
  chemically synthesized
aaaatatggtcccaaaactcat

SEQ ID NO: 1279536 - DNA, 22 bp, Artificial Sequence
  chemically synthesized
aaatatggtcccaaaactcatt

SEQ ID NO: 1279537 - DNA, 22 bp, Artificial Sequence
  chemically synthesized
cctttccatttgccaatgagtt

SEQ ID NO: 1279538 - DNA, 22 bp, Artificial Sequence
  chemically synthesized
attggcaaatggaaaggtaggg

SEQ ID NO: 1279539 - DNA, 22 bp, Artificial Sequence
  chemically synthesized
gcaaatggaaaggtagggtcta

SEQ ID NO: 1279540 - DNA, 22 bp, Artificial Sequence
  chemically synthesized
aagaggaaaggacatagaccct

SEQ ID NO: 1279541 - DNA, 22 bp, Artificial Sequence
  chemically synthesized
acccagattgaagaggaaagga

SEQ ID NO: 1279542 - DNA, 22 bp, Artificial Sequence
  chemically synthesized
caaactcacccagattgaagag

SEQ ID NO: 1279543 - DNA, 22 bp, Artificial Sequence
  chemically synthesized
tgtcctttcctcttcaatctgg

SEQ ID NO: 1279544 - DNA, 22 bp, Artificial Sequence
  chemically synthesized
aagtagttacaaactcacccag

SEQ ID NO: 1279545 - DNA, 22 bp, Artificial Sequence
  chemically synthesized
tcctcttcaatctgggtgagtt

SEQ ID NO: 1279546 - DNA, 22 bp, Artificial Sequence
  chemically synthesized
cctcttcaatctgggtgagttt

SEQ ID NO: 1279547 - DNA, 22 bp, Artificial Sequence
  chemically synthesized
ctcttcaatctgggtgagtttg

SEQ ID NO: 1279548 - DNA, 22 bp, Artificial Sequence
  chemically synthesized
ttgaagtagttacaaactcacc

SEQ ID NO: 1279549 - DNA, 22 bp, Artificial Sequence
  chemically synthesized
ttcaatctgggtgagtttgtaa

SEQ ID NO: 1279550 - DNA, 22 bp, Artificial Sequence
  chemically synthesized
tctgttgaagtagttacaaact

SEQ ID NO: 1279551 - DNA, 22 bp, Artificial Sequence
  chemically synthesized
caatctgggtgagtttgtaact

SEQ ID NO: 1279552 - DNA, 22 bp, Artificial Sequence
  chemically synthesized
aatctgggtgagtttgtaacta

SEQ ID NO: 1279553 - DNA, 22 bp, Artificial Sequence
  chemically synthesized
tatctgttgaagtagttacaaa

SEQ ID NO: 1279554 - DNA, 22 bp, Artificial Sequence
  chemically synthesized
ggtgagtttgtaactacttcaa

SEQ ID NO: 1279555 - DNA, 22 bp, Artificial Sequence
  chemically synthesized
ccatcctctatctgttgaagta

SEQ ID NO: 1279556 - DNA, 22 bp, Artificial Sequence
  chemically synthesized
gccatcctctatctgttgaagt

SEQ ID NO: 1279557 - DNA, 22 bp, Artificial Sequence
  chemically synthesized
ttgccatcctctatctgttgaa

SEQ ID NO: 1279558 - DNA, 22 bp, Artificial Sequence
  chemically synthesized
ctcttgccatcctctatctgtt

SEQ ID NO: 1279559 - DNA, 22 bp, Artificial Sequence
  chemically synthesized
gtaactacttcaacagatagag

SEQ ID NO: 1279560 - DNA, 22 bp, Artificial Sequence
  chemically synthesized
taactacttcaacagatagagg

SEQ ID NO: 1279561 - DNA, 22 bp, Artificial Sequence
  chemically synthesized
cttcaacagatagaggatggca

SEQ ID NO: 1279562 - DNA, 22 bp, Artificial Sequence
  chemically synthesized
caacagatagaggatggcaaga

SEQ ID NO: 1279563 - DNA, 22 bp, Artificial Sequence
  chemically synthesized
aacagatagaggatggcaagag

SEQ ID NO: 1279564 - DNA, 22 bp, Artificial Sequence
  chemically synthesized
ccatggagggcacaaaacatta

SEQ ID NO: 1279565 - DNA, 22 bp, Artificial Sequence
  chemically synthesized
tgaccctgccatggagggcaca

SEQ ID NO: 1279566 - DNA, 22 bp, Artificial Sequence
  chemically synthesized
atgaccctgccatggagggcac

SEQ ID NO: 1279567 - DNA, 22 bp, Artificial Sequence
  chemically synthesized
tatgaccctgccatggagggca

SEQ ID NO: 1279568 - DNA, 22 bp, Artificial Sequence
  chemically synthesized
ttatgaccctgccatggagggc

SEQ ID NO: 1279569 - DNA, 22 bp, Artificial Sequence
  chemically synthesized
tgtgccctccatggcagggtca

SEQ ID NO: 1279570 - DNA, 22 bp, Artificial Sequence
  chemically synthesized
gtgccctccatggcagggtcat

SEQ ID NO: 1279571 - DNA, 22 bp, Artificial Sequence
  chemically synthesized
tgccctccatggcagggtcata

SEQ ID NO: 1279572 - DNA, 22 bp, Artificial Sequence
  chemically synthesized
catggcagggtcataaaagacc

SEQ ID NO: 1279573 - DNA, 22 bp, Artificial Sequence
  chemically synthesized
gcaaacaaggtagtagtcatat

SEQ ID NO: 1279574 - DNA, 22 bp, Artificial Sequence
  chemically synthesized
tagcaaacaaggtagtagtcat

SEQ ID NO: 1279575 - DNA, 22 bp, Artificial Sequence
  chemically synthesized
ttctagcaaacaaggtagtagt

SEQ ID NO: 1279576 - DNA, 22 bp, Artificial Sequence
  chemically synthesized
caagcaaacgctgttctagcaa

SEQ ID NO: 1279577 - DNA, 22 bp, Artificial Sequence
  chemically synthesized
ctaccttgtttgctagaacagc

SEQ ID NO: 1279578 - DNA, 22 bp, Artificial Sequence
  chemically synthesized
ccttgtttgctagaacagcgtt

SEQ ID NO: 1279579 - DNA, 22 bp, Artificial Sequence
  chemically synthesized
agggttccaagcaaacgctgtt

SEQ ID NO: 1279580 - DNA, 22 bp, Artificial Sequence
  chemically synthesized
gtttgctagaacagcgtttgct

SEQ ID NO: 1279581 - DNA, 22 bp, Artificial Sequence
  chemically synthesized
tttgctagaacagcgtttgctt

SEQ ID NO: 1279582 - DNA, 22 bp, Artificial Sequence
  chemically synthesized
gctagaacagcgtttgcttgga

SEQ ID NO: 1279583 - DNA, 22 bp, Artificial Sequence
  chemically synthesized
ctagaacagcgtttgcttggaa

SEQ ID NO: 1279584 - DNA, 22 bp, Artificial Sequence
  chemically synthesized
tggtaactcagggttccaagca

SEQ ID NO: 1279585 - DNA, 22 bp, Artificial Sequence
  chemically synthesized
gaacagcgtttgcttggaaccc

SEQ ID NO: 1279586 - DNA, 22 bp, Artificial Sequence
  chemically synthesized
tatggtaactcagggttccaag

SEQ ID NO: 1279587 - DNA, 22 bp, Artificial Sequence
  chemically synthesized
ctatggtaactcagggttccaa

SEQ ID NO: 1279588 - DNA, 22 bp, Artificial Sequence
  chemically synthesized
tctatggtaactcagggttcca

SEQ ID NO: 1279589 - DNA, 22 bp, Artificial Sequence
  chemically synthesized
acacattttctatggtaactca

SEQ ID NO: 1279590 - DNA, 22 bp, Artificial Sequence
  chemically synthesized
gcttggaaccctgagttaccat

SEQ ID NO: 1279591 - DNA, 22 bp, Artificial Sequence
  chemically synthesized
cttggaaccctgagttaccata

SEQ ID NO: 1279592 - DNA, 22 bp, Artificial Sequence
  chemically synthesized
ggaaccctgagttaccatagaa

SEQ ID NO: 1279593 - DNA, 22 bp, Artificial Sequence
  chemically synthesized
gaaccctgagttaccatagaaa

SEQ ID NO: 1279594 - DNA, 22 bp, Artificial Sequence
  chemically synthesized
cgatactcacacattttctatg

SEQ ID NO: 1279595 - DNA, 22 bp, Artificial Sequence
  chemically synthesized
acgatactcacacattttctat

SEQ ID NO: 1279596 - DNA, 22 bp, Artificial Sequence
  chemically synthesized
tacgatactcacacattttcta

SEQ ID NO: 1279597 - DNA, 22 bp, Artificial Sequence
  chemically synthesized
agttaccatagaaaatgtgtga

SEQ ID NO: 1279598 - DNA, 22 bp, Artificial Sequence
  chemically synthesized
ccatagaaaatgtgtgagtatc

SEQ ID NO: 1279599 - DNA, 22 bp, Artificial Sequence
  chemically synthesized
gcatggtggctttacgatactc

SEQ ID NO: 1279600 - DNA, 22 bp, Artificial Sequence
  chemically synthesized
ctagcatggtggctttacgata

SEQ ID NO: 1279601 - DNA, 22 bp, Artificial Sequence
  chemically synthesized
cctagcatggtggctttacgat

SEQ ID NO: 1279602 - DNA, 22 bp, Artificial Sequence
  chemically synthesized
ttcctagcatggtggctttacg

SEQ ID NO: 1279603 - DNA, 22 bp, Artificial Sequence
  chemically synthesized
cttcctagcatggtggctttac

SEQ ID NO: 1279604 - DNA, 22 bp, Artificial Sequence
  chemically synthesized
gcttcttcctagcatggtggct

SEQ ID NO: 1279605 - DNA, 22 bp, Artificial Sequence
  chemically synthesized
ggcttcttcctagcatggtggc

SEQ ID NO: 1279606 - DNA, 22 bp, Artificial Sequence
  chemically synthesized
tttggcttcttcctagcatggt

SEQ ID NO: 1279607 - DNA, 22 bp, Artificial Sequence
  chemically synthesized
tgttgtttggcttcttcctagc

SEQ ID NO: 1279608 - DNA, 22 bp, Artificial Sequence
  chemically synthesized
ctatgttgtttggcttcttcct

SEQ ID NO: 1279609 - DNA, 22 bp, Artificial Sequence
  chemically synthesized
gctatgttgtttggcttcttcc

SEQ ID NO: 1279610 - DNA, 22 bp, Artificial Sequence
  chemically synthesized
catgtgaacttgctatgttgtt

SEQ ID NO: 1279611 - DNA, 22 bp, Artificial Sequence
  chemically synthesized
ggaagaagccaaacaacatagc

SEQ ID NO: 1279612 - DNA, 22 bp, Artificial Sequence
  chemically synthesized
aaggcctacatgtgaacttgct

SEQ ID NO: 1279613 - DNA, 22 bp, Artificial Sequence
  chemically synthesized
tgaaggcctacatgtgaacttg

SEQ ID NO: 1279614 - DNA, 22 bp, Artificial Sequence
  chemically synthesized
gagggtggaattctgaaggcct

SEQ ID NO: 1279615 - DNA, 22 bp, Artificial Sequence
  chemically synthesized
acatgtaggccttcagaattcc

SEQ ID NO: 1279616 - DNA, 22 bp, Artificial Sequence
  chemically synthesized
aatggctggagggtggaattct

SEQ ID NO: 1279617 - DNA, 22 bp, Artificial Sequence
  chemically synthesized
gactcaatggctggagggtgga

SEQ ID NO: 1279618 - DNA, 22 bp, Artificial Sequence
  chemically synthesized
agttggactcaatggctggagg

SEQ ID NO: 1279619 - DNA, 22 bp, Artificial Sequence
  chemically synthesized
cagaattccaccctccagccat

SEQ ID NO: 1279620 - DNA, 22 bp, Artificial Sequence
  chemically synthesized
agaattccaccctccagccatt

SEQ ID NO: 1279621 - DNA, 22 bp, Artificial Sequence
  chemically synthesized
aaagctaagttggactcaatgg

SEQ ID NO: 1279622 - DNA, 22 bp, Artificial Sequence
  chemically synthesized
gaaagctaagttggactcaatg

SEQ ID NO: 1279623 - DNA, 22 bp, Artificial Sequence
  chemically synthesized
caccctccagccattgagtcca

SEQ ID NO: 1279624 - DNA, 22 bp, Artificial Sequence
  chemically synthesized
cagccattgagtccaacttagc

SEQ ID NO: 1279625 - DNA, 22 bp, Artificial Sequence
  chemically synthesized
tcaagacttgaaagctaagttg

SEQ ID NO: 1279626 - DNA, 22 bp, Artificial Sequence
  chemically synthesized
atctgtcaagacttgaaagcta

SEQ ID NO: 1279627 - DNA, 22 bp, Artificial Sequence
  chemically synthesized
agtccaacttagctttcaagtc

SEQ ID NO: 1279628 - DNA, 22 bp, Artificial Sequence
  chemically synthesized
tagcctcatctgtcaagacttg

SEQ ID NO: 1279629 - DNA, 22 bp, Artificial Sequence
  chemically synthesized
agctttcaagtcttgacagatg

SEQ ID NO: 1279630 - DNA, 22 bp, Artificial Sequence
  chemically synthesized
gctttcaagtcttgacagatga

SEQ ID NO: 1279631 - DNA, 22 bp, Artificial Sequence
  chemically synthesized
caatatctatagcctcatctgt

SEQ ID NO: 1279632 - DNA, 22 bp, Artificial Sequence
  chemically synthesized
tcaagtcttgacagatgaggct

SEQ ID NO: 1279633 - DNA, 22 bp, Artificial Sequence
  chemically synthesized
tgcaatatctatagcctcatct

SEQ ID NO: 1279634 - DNA, 22 bp, Artificial Sequence
  chemically synthesized
caagtcttgacagatgaggcta

SEQ ID NO: 1279635 - DNA, 22 bp, Artificial Sequence
  chemically synthesized
aagtcttgacagatgaggctat

SEQ ID NO: 1279636 - DNA, 22 bp, Artificial Sequence
  chemically synthesized
tgctctgcaatatctatagcct

SEQ ID NO: 1279637 - DNA, 22 bp, Artificial Sequence
  chemically synthesized
atgctctgcaatatctatagcc

SEQ ID NO: 1279638 - DNA, 22 bp, Artificial Sequence
  chemically synthesized
gacagatgaggctatagatatt

SEQ ID NO: 1279639 - DNA, 22 bp, Artificial Sequence
  chemically synthesized
tttatgctctgcaatatctata

SEQ ID NO: 1279640 - DNA, 22 bp, Artificial Sequence
  chemically synthesized
acagatgaggctatagatattg

SEQ ID NO: 1279641 - DNA, 22 bp, Artificial Sequence
  chemically synthesized
tgtttatgctctgcaatatcta

SEQ ID NO: 1279642 - DNA, 22 bp, Artificial Sequence
  chemically synthesized
tagatattgcagagcataaaca

SEQ ID NO: 1279643 - DNA, 22 bp, Artificial Sequence
  chemically synthesized
cagagcataaacagaacatccc

SEQ ID NO: 1279644 - DNA, 22 bp, Artificial Sequence
  chemically synthesized
agataggacacagcagggatgt

SEQ ID NO: 1279645 - DNA, 22 bp, Artificial Sequence
  chemically synthesized
tgagtaataaattcagatagga

SEQ ID NO: 1279646 - DNA, 22 bp, Artificial Sequence
  chemically synthesized
ctgtgtcctatctgaatttatt

SEQ ID NO: 1279647 - DNA, 22 bp, Artificial Sequence
  chemically synthesized
tgtcctatctgaatttattact

SEQ ID NO: 1279648 - DNA, 22 bp, Artificial Sequence
  chemically synthesized
tgccgtggatgctgtgagtaat

SEQ ID NO: 1279649 - DNA, 22 bp, Artificial Sequence
  chemically synthesized
tctgaatttattactcacagca

SEQ ID NO: 1279650 - DNA, 22 bp, Artificial Sequence
  chemically synthesized
ttatgccgtggatgctgtgagt

SEQ ID NO: 1279651 - DNA, 22 bp, Artificial Sequence
  chemically synthesized
attatgccgtggatgctgtgag

SEQ ID NO: 1279652 - DNA, 22 bp, Artificial Sequence
  chemically synthesized
tattatgccgtggatgctgtga

SEQ ID NO: 1279653 - DNA, 22 bp, Artificial Sequence
  chemically synthesized
aatttattactcacagcatcca

SEQ ID NO: 1279654 - DNA, 22 bp, Artificial Sequence
  chemically synthesized
ctttattatgccgtggatgctg

SEQ ID NO: 1279655 - DNA, 22 bp, Artificial Sequence
  chemically synthesized
attactcacagcatccacggca

SEQ ID NO: 1279656 - DNA, 22 bp, Artificial Sequence
  chemically synthesized
ttactcacagcatccacggcat

SEQ ID NO: 1279657 - DNA, 22 bp, Artificial Sequence
  chemically synthesized
ctcacagcatccacggcataat

SEQ ID NO: 1279658 - DNA, 22 bp, Artificial Sequence
  chemically synthesized
aaacaattactttattatgccg

SEQ ID NO: 1279659 - DNA, 22 bp, Artificial Sequence
  chemically synthesized
aaaacaattactttattatgcc

SEQ ID NO: 1279660 - DNA, 22 bp, Artificial Sequence
  chemically synthesized
acagcatccacggcataataaa

SEQ ID NO: 1279661 - DNA, 22 bp, Artificial Sequence
  chemically synthesized
gcagtttaaaacaattacttta

SEQ ID NO: 1279662 - DNA, 22 bp, Artificial Sequence
  chemically synthesized
agcagtttaaaacaattacttt

SEQ ID NO: 1279663 - DNA, 22 bp, Artificial Sequence
  chemically synthesized
atacttagcagtttaaaacaat

SEQ ID NO: 1279664 - DNA, 22 bp, Artificial Sequence
  chemically synthesized
ttttaaactgctaagtatcagg

SEQ ID NO: 1279665 - DNA, 22 bp, Artificial Sequence
  chemically synthesized
tgtataaaatcaccctgatact

SEQ ID NO: 1279666 - DNA, 22 bp, Artificial Sequence
  chemically synthesized
taaactgctaagtatcagggtg

SEQ ID NO: 1279667 - DNA, 22 bp, Artificial Sequence
  chemically synthesized
aaactgctaagtatcagggtga

SEQ ID NO: 1279668 - DNA, 22 bp, Artificial Sequence
  chemically synthesized
ctgtgtataaaatcaccctgat

SEQ ID NO: 1279669 - DNA, 22 bp, Artificial Sequence
  chemically synthesized
aactgctaagtatcagggtgat

SEQ ID NO: 1279670 - DNA, 22 bp, Artificial Sequence
  chemically synthesized
gctgtgtataaaatcaccctga

SEQ ID NO: 1279671 - DNA, 22 bp, Artificial Sequence
  chemically synthesized
tgctgtgtataaaatcaccctg

SEQ ID NO: 1279672 - DNA, 22 bp, Artificial Sequence
  chemically synthesized
ttgctgtgtataaaatcaccct

SEQ ID NO: 1279673 - DNA, 22 bp, Artificial Sequence
  chemically synthesized
ctaagtatcagggtgattttat

SEQ ID NO: 1279674 - DNA, 22 bp, Artificial Sequence
  chemically synthesized
cttttgctgtgtataaaatcac

SEQ ID NO: 1279675 - DNA, 22 bp, Artificial Sequence
  chemically synthesized
acttttgctgtgtataaaatca

SEQ ID NO: 1279676 - DNA, 22 bp, Artificial Sequence
  chemically synthesized
agtatcagggtgattttataca

SEQ ID NO: 1279677 - DNA, 22 bp, Artificial Sequence
  chemically synthesized
gcagggtatcccacttactttt

SEQ ID NO: 1279678 - DNA, 22 bp, Artificial Sequence
  chemically synthesized
tatacacagcaaaagtaagtgg

SEQ ID NO: 1279679 - DNA, 22 bp, Artificial Sequence
  chemically synthesized
atacacagcaaaagtaagtggg

SEQ ID NO: 1279680 - DNA, 22 bp, Artificial Sequence
  chemically synthesized
tacacagcaaaagtaagtggga

SEQ ID NO: 1279681 - DNA, 22 bp, Artificial Sequence
  chemically synthesized
gaaatatgtagacatattggca

SEQ ID NO: 1279682 - DNA, 22 bp, Artificial Sequence
  chemically synthesized
ggaaatatgtagacatattggc

SEQ ID NO: 1279683 - DNA, 22 bp, Artificial Sequence
  chemically synthesized
tttggaaatatgtagacatatt

SEQ ID NO: 1279684 - DNA, 22 bp, Artificial Sequence
  chemically synthesized
agttgtttggaaatatgtagac

SEQ ID NO: 1279685 - DNA, 22 bp, Artificial Sequence
  chemically synthesized
cagttgtttggaaatatgtaga

SEQ ID NO: 1279686 - DNA, 22 bp, Artificial Sequence
  chemically synthesized
tcagttgtttggaaatatgtag

SEQ ID NO: 1279687 - DNA, 22 bp, Artificial Sequence
  chemically synthesized
ccaatatgtctacatatttcca

SEQ ID NO: 1279688 - DNA, 22 bp, Artificial Sequence
  chemically synthesized
gggtgtgcatgttttcagttgt

SEQ ID NO: 1279689 - DNA, 22 bp, Artificial Sequence
  chemically synthesized
catatttccaaacaactgaaaa

SEQ ID NO: 1279690 - DNA, 22 bp, Artificial Sequence
  chemically synthesized
ggggtgtgcatgttttcagttg

SEQ ID NO: 1279691 - DNA, 22 bp, Artificial Sequence
  chemically synthesized
tggggtgtgcatgttttcagtt

SEQ ID NO: 1279692 - DNA, 22 bp, Artificial Sequence
  chemically synthesized
ccaaacaactgaaaacatgcac

SEQ ID NO: 1279693 - DNA, 22 bp, Artificial Sequence
  chemically synthesized
caaacaactgaaaacatgcaca

SEQ ID NO: 1279694 - DNA, 22 bp, Artificial Sequence
  chemically synthesized
agaaaacattttggggtgtgca

SEQ ID NO: 1279695 - DNA, 22 bp, Artificial Sequence
  chemically synthesized
attaagaaaacattttggggtg

SEQ ID NO: 1279696 - DNA, 22 bp, Artificial Sequence
  chemically synthesized
aaaacatgcacaccccaaaatg

SEQ ID NO: 1279697 - DNA, 22 bp, Artificial Sequence
  chemically synthesized
tcattaagaaaacattttgggg

SEQ ID NO: 1279698 - DNA, 22 bp, Artificial Sequence
  chemically synthesized
ctcattaagaaaacattttggg

SEQ ID NO: 1279699 - DNA, 22 bp, Artificial Sequence
  chemically synthesized
tctcattaagaaaacattttgg

SEQ ID NO: 1279700 - DNA, 22 bp, Artificial Sequence
  chemically synthesized
tattttctcattaagaaaacat

SEQ ID NO: 1279701 - DNA, 22 bp, Artificial Sequence
  chemically synthesized
tcttaatgagaaaatacaactc

SEQ ID NO: 1279702 - DNA, 22 bp, Artificial Sequence
  chemically synthesized
cttaatgagaaaatacaactca

SEQ ID NO: 1279703 - DNA, 22 bp, Artificial Sequence
  chemically synthesized
ttaatgagaaaatacaactcac

SEQ ID NO: 1279704 - DNA, 22 bp, Artificial Sequence
  chemically synthesized
aatgagaaaatacaactcactt

SEQ ID NO: 1279705 - DNA, 22 bp, Artificial Sequence
  chemically synthesized
atgagaaaatacaactcacttt

SEQ ID NO: 1279706 - DNA, 22 bp, Artificial Sequence
  chemically synthesized
atcaaggcacagaaataaaaaa

SEQ ID NO: 1279707 - DNA, 22 bp, Artificial Sequence
  chemically synthesized
aatcaaggcacagaaataaaaa

SEQ ID NO: 1279708 - DNA, 22 bp, Artificial Sequence
  chemically synthesized
taatcaaggcacagaaataaaa

SEQ ID NO: 1279709 - DNA, 22 bp, Artificial Sequence
  chemically synthesized
ttaatcaaggcacagaaataaa

SEQ ID NO: 1279710 - DNA, 22 bp, Artificial Sequence
  chemically synthesized
tttaatcaaggcacagaaataa

SEQ ID NO: 1279711 - DNA, 22 bp, Artificial Sequence
  chemically synthesized
ttttaatcaaggcacagaaata

SEQ ID NO: 1279712 - DNA, 22 bp, Artificial Sequence
  chemically synthesized
tttttaatcaaggcacagaaat

SEQ ID NO: 1279713 - DNA, 22 bp, Artificial Sequence
  chemically synthesized
acttttttatttctgtgccttg

SEQ ID NO: 1279714 - DNA, 22 bp, Artificial Sequence
  chemically synthesized
ttttatttctgtgccttgatta

SEQ ID NO: 1279715 - DNA, 22 bp, Artificial Sequence
  chemically synthesized
tttatttctgtgccttgattaa

SEQ ID NO: 1279716 - DNA, 22 bp, Artificial Sequence
  chemically synthesized
ttatttctgtgccttgattaaa

SEQ ID NO: 1279717 - DNA, 22 bp, Artificial Sequence
  chemically synthesized
tatttctgtgccttgattaaaa

SEQ ID NO: 1279718 - DNA, 22 bp, Artificial Sequence
  chemically synthesized
atttctgtgccttgattaaaaa

SEQ ID NO: 1279719 - DNA, 22 bp, Artificial Sequence
  chemically synthesized
tttctgtgccttgattaaaaaa

SEQ ID NO: 1279720 - DNA, 22 bp, Artificial Sequence
  chemically synthesized
gtggacgtgcctttttttaatc

SEQ ID NO: 1279721 - DNA, 22 bp, Artificial Sequence
  chemically synthesized
agtggacgtgcctttttttaat

SEQ ID NO: 1279722 - DNA, 22 bp, Artificial Sequence
  chemically synthesized
tagtggacgtgcctttttttaa

SEQ ID NO: 1279723 - DNA, 22 bp, Artificial Sequence
  chemically synthesized
ctgtgccttgattaaaaaaagg

SEQ ID NO: 1279724 - DNA, 22 bp, Artificial Sequence
  chemically synthesized
ttagtggacgtgccttttttta

SEQ ID NO: 1279725 - DNA, 22 bp, Artificial Sequence
  chemically synthesized
tgtgccttgattaaaaaaaggc

SEQ ID NO: 1279726 - DNA, 22 bp, Artificial Sequence
  chemically synthesized
ttttagtggacgtgcctttttt

SEQ ID NO: 1279727 - DNA, 22 bp, Artificial Sequence
  chemically synthesized
tgccttgattaaaaaaaggcac

SEQ ID NO: 1279728 - DNA, 22 bp, Artificial Sequence
  chemically synthesized
tcattcttttagtggacgtgcc

SEQ ID NO: 1279729 - DNA, 22 bp, Artificial Sequence
  chemically synthesized
gattaaaaaaaggcacgtccac

SEQ ID NO: 1279730 - DNA, 22 bp, Artificial Sequence
  chemically synthesized
attaaaaaaaggcacgtccact

SEQ ID NO: 1279731 - DNA, 22 bp, Artificial Sequence
  chemically synthesized
aaaaaaggcacgtccactaaaa

SEQ ID NO: 1279732 - DNA, 22 bp, Artificial Sequence
  chemically synthesized
tcccataatcagaataaaaatt

SEQ ID NO: 1279733 - DNA, 22 bp, Artificial Sequence
  chemically synthesized
atcccataatcagaataaaaat

SEQ ID NO: 1279734 - DNA, 22 bp, Artificial Sequence
  chemically synthesized
aaagaatgataatttttattct

SEQ ID NO: 1279735 - DNA, 22 bp, Artificial Sequence
  chemically synthesized
tatcccataatcagaataaaaa

SEQ ID NO: 1279736 - DNA, 22 bp, Artificial Sequence
  chemically synthesized
tttatcccataatcagaataaa

SEQ ID NO: 1279737 - DNA, 22 bp, Artificial Sequence
  chemically synthesized
ctttatcccataatcagaataa

SEQ ID NO: 1279738 - DNA, 22 bp, Artificial Sequence
  chemically synthesized
ttattctgattatgggataaag

SEQ ID NO: 1279739 - DNA, 22 bp, Artificial Sequence
  chemically synthesized
tattctgattatgggataaaga

SEQ ID NO: 1279740 - DNA, 22 bp, Artificial Sequence
  chemically synthesized
attctgattatgggataaagaa

SEQ ID NO: 1279741 - DNA, 22 bp, Artificial Sequence
  chemically synthesized
ttctgattatgggataaagaaa

SEQ ID NO: 1279742 - DNA, 22 bp, Artificial Sequence
  chemically synthesized
tgattatgggataaagaaacat

SEQ ID NO: 1279743 - DNA, 22 bp, Artificial Sequence
  chemically synthesized
attatgggataaagaaacatat

SEQ ID NO: 1279744 - DNA, 22 bp, Artificial Sequence
  chemically synthesized
tgggataaagaaacatatggcc

SEQ ID NO: 1279745 - DNA, 22 bp, Artificial Sequence
  chemically synthesized
tatgtcacaaatggccatatgt

SEQ ID NO: 1279746 - DNA, 22 bp, Artificial Sequence
  chemically synthesized
gtatgtcacaaatggccatatg

SEQ ID NO: 1279747 - DNA, 22 bp, Artificial Sequence
  chemically synthesized
tgtatgtcacaaatggccatat

SEQ ID NO: 1279748 - DNA, 22 bp, Artificial Sequence
  chemically synthesized
ttgtatgtcacaaatggccata

SEQ ID NO: 1279749 - DNA, 22 bp, Artificial Sequence
  chemically synthesized
tttgtatgtcacaaatggccat

SEQ ID NO: 1279750 - DNA, 22 bp, Artificial Sequence
  chemically synthesized
cagtagactttttgtatgtcac

SEQ ID NO: 1279751 - DNA, 22 bp, Artificial Sequence
  chemically synthesized
ccagtagactttttgtatgtca

SEQ ID NO: 1279752 - DNA, 22 bp, Artificial Sequence
  chemically synthesized
cttccagtagactttttgtatg

SEQ ID NO: 1279753 - DNA, 22 bp, Artificial Sequence
  chemically synthesized
gcttccagtagactttttgtat

SEQ ID NO: 1279754 - DNA, 22 bp, Artificial Sequence
  chemically synthesized
tgcttccagtagactttttgta

SEQ ID NO: 1279755 - DNA, 22 bp, Artificial Sequence
  chemically synthesized
ttgcttccagtagactttttgt

SEQ ID NO: 1279756 - DNA, 22 bp, Artificial Sequence
  chemically synthesized
tttgcttccagtagactttttg

SEQ ID NO: 1279757 - DNA, 22 bp, Artificial Sequence
  chemically synthesized
gtgacatacaaaaagtctactg

SEQ ID NO: 1279758 - DNA, 22 bp, Artificial Sequence
  chemically synthesized
tgacatacaaaaagtctactgg

SEQ ID NO: 1279759 - DNA, 22 bp, Artificial Sequence
  chemically synthesized
ccactttttgcttccagtagac

SEQ ID NO: 1279760 - DNA, 22 bp, Artificial Sequence
  chemically synthesized
cccactttttgcttccagtaga

SEQ ID NO: 1279761 - DNA, 22 bp, Artificial Sequence
  chemically synthesized
tcccactttttgcttccagtag

SEQ ID NO: 1279762 - DNA, 22 bp, Artificial Sequence
  chemically synthesized
ttcccactttttgcttccagta

SEQ ID NO: 1279763 - DNA, 22 bp, Artificial Sequence
  chemically synthesized
tttcccactttttgcttccagt

SEQ ID NO: 1279764 - DNA, 22 bp, Artificial Sequence
  chemically synthesized
ttttcccactttttgcttccag

SEQ ID NO: 1279765 - DNA, 22 bp, Artificial Sequence
  chemically synthesized
tttttcccactttttgcttcca

SEQ ID NO: 1279766 - DNA, 22 bp, Artificial Sequence
  chemically synthesized
ttttttcccactttttgcttcc

SEQ ID NO: 1279767 - DNA, 22 bp, Artificial Sequence
  chemically synthesized
gtaaggcttttttttcccactt

SEQ ID NO: 1279768 - DNA, 22 bp, Artificial Sequence
  chemically synthesized
ctggaagcaaaaagtgggaaaa

SEQ ID NO: 1279769 - DNA, 22 bp, Artificial Sequence
  chemically synthesized
gaagcaaaaagtgggaaaaaaa

SEQ ID NO: 1279770 - DNA, 22 bp, Artificial Sequence
  chemically synthesized
cgggtattcgtaaggctttttt

SEQ ID NO: 1279771 - DNA, 22 bp, Artificial Sequence
  chemically synthesized
acgggtattcgtaaggcttttt

SEQ ID NO: 1279772 - DNA, 22 bp, Artificial Sequence
  chemically synthesized
tcaccagtttacgggtattcgt

SEQ ID NO: 1279773 - DNA, 22 bp, Artificial Sequence
  chemically synthesized
atcaccagtttacgggtattcg

SEQ ID NO: 1279774 - DNA, 22 bp, Artificial Sequence
  chemically synthesized
tccatttatcaccagtttacgg

SEQ ID NO: 1279775 - DNA, 22 bp, Artificial Sequence
  chemically synthesized
gtccatttatcaccagtttacg

SEQ ID NO: 1279776 - DNA, 22 bp, Artificial Sequence
  chemically synthesized
acgaatacccgtaaactggtga

SEQ ID NO: 1279777 - DNA, 22 bp, Artificial Sequence
  chemically synthesized
tttgtccatttatcaccagttt

SEQ ID NO: 1279778 - DNA, 22 bp, Artificial Sequence
  chemically synthesized
cgaatacccgtaaactggtgat

SEQ ID NO: 1279779 - DNA, 22 bp, Artificial Sequence
  chemically synthesized
gtttgtccatttatcaccagtt

SEQ ID NO: 1279780 - DNA, 22 bp, Artificial Sequence
  chemically synthesized
tgtttgtccatttatcaccagt

SEQ ID NO: 1279781 - DNA, 22 bp, Artificial Sequence
  chemically synthesized
gtgataaatggacaaacaaaat

SEQ ID NO: 1279782 - DNA, 22 bp, Artificial Sequence
  chemically synthesized
tatggatataccaaattttgtt

SEQ ID NO: 1279783 - DNA, 22 bp, Artificial Sequence
  chemically synthesized
attgtatggatataccaaattt

SEQ ID NO: 1279784 - DNA, 22 bp, Artificial Sequence
  chemically synthesized
cattgtatggatataccaaatt

SEQ ID NO: 1279785 - DNA, 22 bp, Artificial Sequence
  chemically synthesized
aataaaatttcattgtatggat

SEQ ID NO: 1279786 - DNA, 22 bp, Artificial Sequence
  chemically synthesized
ctaaataaaatttcattgtatg

SEQ ID NO: 1279787 - DNA, 22 bp, Artificial Sequence
  chemically synthesized
gctaaataaaatttcattgtat

SEQ ID NO: 1279788 - DNA, 22 bp, Artificial Sequence
  chemically synthesized
ggtatatccatacaatgaaatt

SEQ ID NO: 1279789 - DNA, 22 bp, Artificial Sequence
  chemically synthesized
tttgctaaataaaatttcattg

SEQ ID NO: 1279790 - DNA, 22 bp, Artificial Sequence
  chemically synthesized
gtatatccatacaatgaaattt

SEQ ID NO: 1279791 - DNA, 22 bp, Artificial Sequence
  chemically synthesized
atttgctaaataaaatttcatt

SEQ ID NO: 1279792 - DNA, 22 bp, Artificial Sequence
  chemically synthesized
tatttgctaaataaaatttcat

SEQ ID NO: 1279793 - DNA, 22 bp, Artificial Sequence
  chemically synthesized
ttatttgctaaataaaatttca

SEQ ID NO: 1279794 - DNA, 22 bp, Artificial Sequence
  chemically synthesized
cttttatttgctaaataaaatt

SEQ ID NO: 1279795 - DNA, 22 bp, Artificial Sequence
  chemically synthesized
attccttttatttgctaaataa

SEQ ID NO: 1279796 - DNA, 22 bp, Artificial Sequence
  chemically synthesized
cattccttttatttgctaaata

SEQ ID NO: 1279797 - DNA, 22 bp, Artificial Sequence
  chemically synthesized
tcattccttttatttgctaaat

SEQ ID NO: 1279798 - DNA, 22 bp, Artificial Sequence
  chemically synthesized
tatttagcaaataaaaggaatg

SEQ ID NO: 1279799 - DNA, 22 bp, Artificial Sequence
  chemically synthesized
atttagcaaataaaaggaatga

SEQ ID NO: 1279800 - DNA, 22 bp, Artificial Sequence
  chemically synthesized
tttagcaaataaaaggaatgaa

SEQ ID NO: 1279801 - DNA, 22 bp, Artificial Sequence
  chemically synthesized
agcaaataaaaggaatgaaaga

SEQ ID NO: 1279802 - DNA, 22 bp, Artificial Sequence
  chemically synthesized
gcaaataaaaggaatgaaagac

SEQ ID NO: 1279803 - DNA, 22 bp, Artificial Sequence
  chemically synthesized
tagaatgtatcagtctttcatt

SEQ ID NO: 1279804 - DNA, 22 bp, Artificial Sequence
  chemically synthesized
atattgtagaatgtatcagtct

SEQ ID NO: 1279805 - DNA, 22 bp, Artificial Sequence
  chemically synthesized
aggtccattcatattgtagaat

SEQ ID NO: 1279806 - DNA, 22 bp, Artificial Sequence
  chemically synthesized
aaggtccattcatattgtagaa

SEQ ID NO: 1279807 - DNA, 22 bp, Artificial Sequence
  chemically synthesized
taaggtccattcatattgtaga

SEQ ID NO: 1279808 - DNA, 22 bp, Artificial Sequence
  chemically synthesized
ttaaggtccattcatattgtag

SEQ ID NO: 1279809 - DNA, 22 bp, Artificial Sequence
  chemically synthesized
atacattctacaatatgaatgg

SEQ ID NO: 1279810 - DNA, 22 bp, Artificial Sequence
  chemically synthesized
cataatgtttttaaggtccatt

SEQ ID NO: 1279811 - DNA, 22 bp, Artificial Sequence
  chemically synthesized
gcataatgtttttaaggtccat

SEQ ID NO: 1279812 - DNA, 22 bp, Artificial Sequence
  chemically synthesized
tgcataatgtttttaaggtcca

SEQ ID NO: 1279813 - DNA, 22 bp, Artificial Sequence
  chemically synthesized
tacaatatgaatggaccttaaa

SEQ ID NO: 1279814 - DNA, 22 bp, Artificial Sequence
  chemically synthesized
caatatgaatggaccttaaaaa

SEQ ID NO: 1279815 - DNA, 22 bp, Artificial Sequence
  chemically synthesized
attttgcataatgtttttaagg

SEQ ID NO: 1279816 - DNA, 22 bp, Artificial Sequence
  chemically synthesized
cattttgcataatgtttttaag

SEQ ID NO: 1279817 - DNA, 22 bp, Artificial Sequence
  chemically synthesized
tcattttgcataatgtttttaa

SEQ ID NO: 1279818 - DNA, 22 bp, Artificial Sequence
  chemically synthesized
taatctttcattttgcataatg

SEQ ID NO: 1279819 - DNA, 22 bp, Artificial Sequence
  chemically synthesized
aaaaacattatgcaaaatgaaa

SEQ ID NO: 1279820 - DNA, 22 bp, Artificial Sequence
  chemically synthesized
gtgtctgtaatctttcattttg

SEQ ID NO: 1279821 - DNA, 22 bp, Artificial Sequence
  chemically synthesized
aaaacattatgcaaaatgaaag

SEQ ID NO: 1279822 - DNA, 22 bp, Artificial Sequence
  chemically synthesized
tagtgtctgtaatctttcattt

SEQ ID NO: 1279823 - DNA, 22 bp, Artificial Sequence
  chemically synthesized
tgcaaaatgaaagattacagac

SEQ ID NO: 1279824 - DNA, 22 bp, Artificial Sequence
  chemically synthesized
tatgtggcctctagtgtctgta

SEQ ID NO: 1279825 - DNA, 22 bp, Artificial Sequence
  chemically synthesized
cagacactagaggccacatata

SEQ ID NO: 1279826 - DNA, 22 bp, Artificial Sequence
  chemically synthesized
atataaatggaatcatactata

SEQ ID NO: 1279827 - DNA, 22 bp, Artificial Sequence
  chemically synthesized
catataaatggaatcatactat

SEQ ID NO: 1279828 - DNA, 22 bp, Artificial Sequence
  chemically synthesized
gaggccacatatagtatgattc

SEQ ID NO: 1279829 - DNA, 22 bp, Artificial Sequence
  chemically synthesized
gacatttcatataaatggaatc

SEQ ID NO: 1279830 - DNA, 22 bp, Artificial Sequence
  chemically synthesized
ggacatttcatataaatggaat

SEQ ID NO: 1279831 - DNA, 22 bp, Artificial Sequence
  chemically synthesized
tggacatttcatataaatggaa

SEQ ID NO: 1279832 - DNA, 22 bp, Artificial Sequence
  chemically synthesized
ttttggacatttcatataaatg

SEQ ID NO: 1279833 - DNA, 22 bp, Artificial Sequence
  chemically synthesized
cctattttggacatttcatata

SEQ ID NO: 1279834 - DNA, 22 bp, Artificial Sequence
  chemically synthesized
catttatatgaaatgtccaaaa

SEQ ID NO: 1279835 - DNA, 22 bp, Artificial Sequence
  chemically synthesized
tagatctgcctattttggacat

SEQ ID NO: 1279836 - DNA, 22 bp, Artificial Sequence
  chemically synthesized
tatagatctgcctattttggac

SEQ ID NO: 1279837 - DNA, 22 bp, Artificial Sequence
  chemically synthesized
atatgaaatgtccaaaataggc

SEQ ID NO: 1279838 - DNA, 22 bp, Artificial Sequence
  chemically synthesized
tatgaaatgtccaaaataggca

SEQ ID NO: 1279839 - DNA, 22 bp, Artificial Sequence
  chemically synthesized
tgtctctatagatctgcctatt

SEQ ID NO: 1279840 - DNA, 22 bp, Artificial Sequence
  chemically synthesized
tgttgtgtctctatagatctgc

SEQ ID NO: 1279841 - DNA, 22 bp, Artificial Sequence
  chemically synthesized
tgtgttgtgtctctatagatct

SEQ ID NO: 1279842 - DNA, 22 bp, Artificial Sequence
  chemically synthesized
ctctgtgttgtgtctctataga

SEQ ID NO: 1279843 - DNA, 22 bp, Artificial Sequence
  chemically synthesized
gcaaccgctactctgtgttgtg

SEQ ID NO: 1279844 - DNA, 22 bp, Artificial Sequence
  chemically synthesized
tggcaaccgctactctgtgttg

SEQ ID NO: 1279845 - DNA, 22 bp, Artificial Sequence
  chemically synthesized
tagagacacaacacagagtagc

SEQ ID NO: 1279846 - DNA, 22 bp, Artificial Sequence
  chemically synthesized
gcctctggcaaccgctactctg

SEQ ID NO: 1279847 - DNA, 22 bp, Artificial Sequence
  chemically synthesized
tagcctctggcaaccgctactc

SEQ ID NO: 1279848 - DNA, 22 bp, Artificial Sequence
  chemically synthesized
cctctagcctctggcaaccgct

SEQ ID NO: 1279849 - DNA, 22 bp, Artificial Sequence
  chemically synthesized
tccctctagcctctggcaaccg

SEQ ID NO: 1279850 - DNA, 22 bp, Artificial Sequence
  chemically synthesized
tctccctctagcctctggcaac

SEQ ID NO: 1279851 - DNA, 22 bp, Artificial Sequence
  chemically synthesized
ctctctccctctagcctctggc

SEQ ID NO: 1279852 - DNA, 22 bp, Artificial Sequence
  chemically synthesized
cccattcctctctccctctagc

SEQ ID NO: 1279853 - DNA, 22 bp, Artificial Sequence
  chemically synthesized
ccagaggctagagggagagagg

SEQ ID NO: 1279854 - DNA, 22 bp, Artificial Sequence
  chemically synthesized
gcagtcactccccattcctctc

SEQ ID NO: 1279855 - DNA, 22 bp, Artificial Sequence
  chemically synthesized
gagggagagaggaatggggagt

SEQ ID NO: 1279856 - DNA, 22 bp, Artificial Sequence
  chemically synthesized
tatgcccattagcagtcactcc

SEQ ID NO: 1279857 - DNA, 22 bp, Artificial Sequence
  chemically synthesized
atcatccccaaaagaaactgta

SEQ ID NO: 1279858 - DNA, 22 bp, Artificial Sequence
  chemically synthesized
catcatccccaaaagaaactgt

SEQ ID NO: 1279859 - DNA, 22 bp, Artificial Sequence
  chemically synthesized
ctaatgggcatacagtttcttt

SEQ ID NO: 1279860 - DNA, 22 bp, Artificial Sequence
  chemically synthesized
tcatcatccccaaaagaaactg

SEQ ID NO: 1279861 - DNA, 22 bp, Artificial Sequence
  chemically synthesized
atgggcatacagtttcttttgg

SEQ ID NO: 1279862 - DNA, 22 bp, Artificial Sequence
  chemically synthesized
cagaatactttcatcatcccca

SEQ ID NO: 1279863 - DNA, 22 bp, Artificial Sequence
  chemically synthesized
gttgcagaatactttcatcatc

SEQ ID NO: 1279864 - DNA, 22 bp, Artificial Sequence
  chemically synthesized
cttttggggatgatgaaagtat

SEQ ID NO: 1279865 - DNA, 22 bp, Artificial Sequence
  chemically synthesized
tctagttgcagaatactttcat

SEQ ID NO: 1279866 - DNA, 22 bp, Artificial Sequence
  chemically synthesized
ttttggggatgatgaaagtatt

SEQ ID NO: 1279867 - DNA, 22 bp, Artificial Sequence
  chemically synthesized
ttggggatgatgaaagtattct

SEQ ID NO: 1279868 - DNA, 22 bp, Artificial Sequence
  chemically synthesized
tggggatgatgaaagtattctg

SEQ ID NO: 1279869 - DNA, 22 bp, Artificial Sequence
  chemically synthesized
ggggatgatgaaagtattctgc

SEQ ID NO: 1279870 - DNA, 22 bp, Artificial Sequence
  chemically synthesized
gggatgatgaaagtattctgca

SEQ ID NO: 1279871 - DNA, 22 bp, Artificial Sequence
  chemically synthesized
tcatcactatctagttgcagaa

SEQ ID NO: 1279872 - DNA, 22 bp, Artificial Sequence
  chemically synthesized
tgcaactatcatcactatctag

SEQ ID NO: 1279873 - DNA, 22 bp, Artificial Sequence
  chemically synthesized
tgcaactagatagtgatgatag

SEQ ID NO: 1279874 - DNA, 22 bp, Artificial Sequence
  chemically synthesized
caactagatagtgatgatagtt

SEQ ID NO: 1279875 - DNA, 22 bp, Artificial Sequence
  chemically synthesized
acagagctatgcaactatcatc

SEQ ID NO: 1279876 - DNA, 22 bp, Artificial Sequence
  chemically synthesized
gatagtgatgatagttgcatag

SEQ ID NO: 1279877 - DNA, 22 bp, Artificial Sequence
  chemically synthesized
agtatgttcacagagctatgca

SEQ ID NO: 1279878 - DNA, 22 bp, Artificial Sequence
  chemically synthesized
cagtatgttcacagagctatgc

SEQ ID NO: 1279879 - DNA, 22 bp, Artificial Sequence
  chemically synthesized
tcagtatgttcacagagctatg

SEQ ID NO: 1279880 - DNA, 22 bp, Artificial Sequence
  chemically synthesized
ttcagtatgttcacagagctat

SEQ ID NO: 1279881 - DNA, 22 bp, Artificial Sequence
  chemically synthesized
tttcagtatgttcacagagcta

SEQ ID NO: 1279882 - DNA, 22 bp, Artificial Sequence
  chemically synthesized
agtgttttttcagtatgttcac

SEQ ID NO: 1279883 - DNA, 22 bp, Artificial Sequence
  chemically synthesized
catagctctgtgaacatactga

SEQ ID NO: 1279884 - DNA, 22 bp, Artificial Sequence
  chemically synthesized
tgtgaacatactgaaaaaacac

SEQ ID NO: 1279885 - DNA, 22 bp, Artificial Sequence
  chemically synthesized
tgaacatactgaaaaaacactg

SEQ ID NO: 1279886 - DNA, 22 bp, Artificial Sequence
  chemically synthesized
gaagtgtacaattcagtgtttt

SEQ ID NO: 1279887 - DNA, 22 bp, Artificial Sequence
  chemically synthesized
tagaagtgtacaattcagtgtt

SEQ ID NO: 1279888 - DNA, 22 bp, Artificial Sequence
  chemically synthesized
tctagaagtgtacaattcagtg

SEQ ID NO: 1279889 - DNA, 22 bp, Artificial Sequence
  chemically synthesized
actctctagaagtgtacaattc

SEQ ID NO: 1279890 - DNA, 22 bp, Artificial Sequence
  chemically synthesized
aaaaaacactgaattgtacact

SEQ ID NO: 1279891 - DNA, 22 bp, Artificial Sequence
  chemically synthesized
taaaattcactctctagaagtg

SEQ ID NO: 1279892 - DNA, 22 bp, Artificial Sequence
  chemically synthesized
aattgtacacttctagagagtg

SEQ ID NO: 1279893 - DNA, 22 bp, Artificial Sequence
  chemically synthesized
acatactgtaaaattcactctc

SEQ ID NO: 1279894 - DNA, 22 bp, Artificial Sequence
  chemically synthesized
tacacttctagagagtgaattt

SEQ ID NO: 1279895 - DNA, 22 bp, Artificial Sequence
  chemically synthesized
ttcacatactgtaaaattcact

SEQ ID NO: 1279896 - DNA, 22 bp, Artificial Sequence
  chemically synthesized
ctagagagtgaattttacagta

SEQ ID NO: 1279897 - DNA, 22 bp, Artificial Sequence
  chemically synthesized
tagagagtgaattttacagtat

SEQ ID NO: 1279898 - DNA, 22 bp, Artificial Sequence
  chemically synthesized
agatattattcacatactgtaa

SEQ ID NO: 1279899 - DNA, 22 bp, Artificial Sequence
  chemically synthesized
gagagtgaattttacagtatgt

SEQ ID NO: 1279900 - DNA, 22 bp, Artificial Sequence
  chemically synthesized
ttaagatattattcacatactg

SEQ ID NO: 1279901 - DNA, 22 bp, Artificial Sequence
  chemically synthesized
attaagatattattcacatact

SEQ ID NO: 1279902 - DNA, 22 bp, Artificial Sequence
  chemically synthesized
tattaagatattattcacatac

SEQ ID NO: 1279903 - DNA, 22 bp, Artificial Sequence
  chemically synthesized
tacagtatgtgaataatatctt

SEQ ID NO: 1279904 - DNA, 22 bp, Artificial Sequence
  chemically synthesized
acagtatgtgaataatatctta

SEQ ID NO: 1279905 - DNA, 22 bp, Artificial Sequence
  chemically synthesized
cagcagctttattaagatatta

SEQ ID NO: 1279906 - DNA, 22 bp, Artificial Sequence
  chemically synthesized
cagtatgtgaataatatcttaa

SEQ ID NO: 1279907 - DNA, 22 bp, Artificial Sequence
  chemically synthesized
ttacagcagctttattaagata

SEQ ID NO: 1279908 - DNA, 22 bp, Artificial Sequence
  chemically synthesized
gttacagcagctttattaagat

SEQ ID NO: 1279909 - DNA, 22 bp, Artificial Sequence
  chemically synthesized
tgttacagcagctttattaaga

SEQ ID NO: 1279910 - DNA, 22 bp, Artificial Sequence
  chemically synthesized
gggattttgttacagcagcttt

SEQ ID NO: 1279911 - DNA, 22 bp, Artificial Sequence
  chemically synthesized
aataaagctgctgtaacaaaat

SEQ ID NO: 1279912 - DNA, 22 bp, Artificial Sequence
  chemically synthesized
ataaagctgctgtaacaaaatc

SEQ ID NO: 1279913 - DNA, 22 bp, Artificial Sequence
  chemically synthesized
gaaatgggatatcctggggatt

SEQ ID NO: 1279914 - DNA, 22 bp, Artificial Sequence
  chemically synthesized
agaaatgggatatcctggggat

SEQ ID NO: 1279915 - DNA, 22 bp, Artificial Sequence
  chemically synthesized
ctgtaacaaaatccccaggata

SEQ ID NO: 1279916 - DNA, 22 bp, Artificial Sequence
  chemically synthesized
tttagaaatgggatatcctggg

SEQ ID NO: 1279917 - DNA, 22 bp, Artificial Sequence
  chemically synthesized
atttagaaatgggatatcctgg

SEQ ID NO: 1279918 - DNA, 22 bp, Artificial Sequence
  chemically synthesized
taacaaaatccccaggatatcc

SEQ ID NO: 1279919 - DNA, 22 bp, Artificial Sequence
  chemically synthesized
aagggaaaaatacgtttattta

SEQ ID NO: 1279920 - DNA, 22 bp, Artificial Sequence
  chemically synthesized
ctaaataaacgtatttttccct

SEQ ID NO: 1279921 - DNA, 22 bp, Artificial Sequence
  chemically synthesized
taaataaacgtatttttccctt

SEQ ID NO: 1279922 - DNA, 22 bp, Artificial Sequence
  chemically synthesized
aataaacgtatttttcccttga

SEQ ID NO: 1279923 - DNA, 22 bp, Artificial Sequence
  chemically synthesized
ttcccttgaggtcttctgatgt

SEQ ID NO: 1279924 - DNA, 22 bp, Artificial Sequence
  chemically synthesized
tcccttgaggtcttctgatgtt

SEQ ID NO: 1279925 - DNA, 22 bp, Artificial Sequence
  chemically synthesized
cccttgaggtcttctgatgttt

SEQ ID NO: 1279926 - DNA, 22 bp, Artificial Sequence
  chemically synthesized
ccttgaggtcttctgatgttta

SEQ ID NO: 1279927 - DNA, 22 bp, Artificial Sequence
  chemically synthesized
gaggtcttctgatgtttacacc

SEQ ID NO: 1279928 - DNA, 22 bp, Artificial Sequence
  chemically synthesized
aggtcttctgatgtttacacct

SEQ ID NO: 1279929 - DNA, 22 bp, Artificial Sequence
  chemically synthesized
ctgatgtttacacctctttttg

SEQ ID NO: 1279930 - DNA, 22 bp, Artificial Sequence
  chemically synthesized
tgatgtttacacctctttttgt

SEQ ID NO: 1279931 - DNA, 22 bp, Artificial Sequence
  chemically synthesized
atgtttacacctctttttgttg

SEQ ID NO: 1279932 - DNA, 22 bp, Artificial Sequence
  chemically synthesized
caaaaagccacagcacaacaaa

SEQ ID NO: 1279933 - DNA, 22 bp, Artificial Sequence
  chemically synthesized
ccaaaaagccacagcacaacaa

SEQ ID NO: 1279934 - DNA, 22 bp, Artificial Sequence
  chemically synthesized
acacctctttttgttgtgctgt

SEQ ID NO: 1279935 - DNA, 22 bp, Artificial Sequence
  chemically synthesized
cacctctttttgttgtgctgtg

SEQ ID NO: 1279936 - DNA, 22 bp, Artificial Sequence
  chemically synthesized
cttccaaaaagccacagcacaa

SEQ ID NO: 1279937 - DNA, 22 bp, Artificial Sequence
  chemically synthesized
tttttgttgtgctgtggctttt

SEQ ID NO: 1279938 - DNA, 22 bp, Artificial Sequence
  chemically synthesized
tttgttgtgctgtggctttttg

SEQ ID NO: 1279939 - DNA, 22 bp, Artificial Sequence
  chemically synthesized
ttgttgtgctgtggctttttgg

SEQ ID NO: 1279940 - DNA, 22 bp, Artificial Sequence
  chemically synthesized
tgttgtgctgtggctttttgga

SEQ ID NO: 1279941 - DNA, 22 bp, Artificial Sequence
  chemically synthesized
gttgtgctgtggctttttggaa

SEQ ID NO: 1279942 - DNA, 22 bp, Artificial Sequence
  chemically synthesized
ttgtgctgtggctttttggaag

SEQ ID NO: 1279943 - DNA, 22 bp, Artificial Sequence
  chemically synthesized
tgctgtggctttttggaagcag

SEQ ID NO: 1279944 - DNA, 22 bp, Artificial Sequence
  chemically synthesized
tggctttttggaagcagatttc

SEQ ID NO: 1279945 - DNA, 22 bp, Artificial Sequence
  chemically synthesized
tttggaagcagatttctctggg

SEQ ID NO: 1279946 - DNA, 22 bp, Artificial Sequence
  chemically synthesized
ttggaagcagatttctctgggt

SEQ ID NO: 1279947 - DNA, 22 bp, Artificial Sequence
  chemically synthesized
tggaagcagatttctctgggtt

SEQ ID NO: 1279948 - DNA, 22 bp, Artificial Sequence
  chemically synthesized
ggaagcagatttctctgggttt

SEQ ID NO: 1279949 - DNA, 22 bp, Artificial Sequence
  chemically synthesized
gaagcagatttctctgggtttg

SEQ ID NO: 1279950 - DNA, 22 bp, Artificial Sequence
  chemically synthesized
aaataaaacaaaaatgaacaaa

SEQ ID NO: 1279951 - DNA, 22 bp, Artificial Sequence
  chemically synthesized
ctctgggtttgttcatttttgt

SEQ ID NO: 1279952 - DNA, 22 bp, Artificial Sequence
  chemically synthesized
tctgggtttgttcatttttgtt

SEQ ID NO: 1279953 - DNA, 22 bp, Artificial Sequence
  chemically synthesized
atactgaaataaaacaaaaatg

SEQ ID NO: 1279954 - DNA, 22 bp, Artificial Sequence
  chemically synthesized
tgggtttgttcatttttgtttt

SEQ ID NO: 1279955 - DNA, 22 bp, Artificial Sequence
  chemically synthesized
taatactgaaataaaacaaaaa

SEQ ID NO: 1279956 - DNA, 22 bp, Artificial Sequence
  chemically synthesized
ggtttgttcatttttgttttat

SEQ ID NO: 1279957 - DNA, 22 bp, Artificial Sequence
  chemically synthesized
gttctaatactgaaataaaaca

SEQ ID NO: 1279958 - DNA, 22 bp, Artificial Sequence
  chemically synthesized
gttcatttttgttttatttcag

SEQ ID NO: 1279959 - DNA, 22 bp, Artificial Sequence
  chemically synthesized
ttcatttttgttttatttcagt

SEQ ID NO: 1279960 - DNA, 22 bp, Artificial Sequence
  chemically synthesized
atttttgttttatttcagtatt

SEQ ID NO: 1279961 - DNA, 22 bp, Artificial Sequence
  chemically synthesized
ttgttttatttcagtattagaa

SEQ ID NO: 1279962 - DNA, 22 bp, Artificial Sequence
  chemically synthesized
tgttttatttcagtattagaac

SEQ ID NO: 1279963 - DNA, 22 bp, Artificial Sequence
  chemically synthesized
gttttatttcagtattagaacc

SEQ ID NO: 1279964 - DNA, 22 bp, Artificial Sequence
  chemically synthesized
ttttatttcagtattagaacca

SEQ ID NO: 1279965 - DNA, 22 bp, Artificial Sequence
  chemically synthesized
tatttcagtattagaaccaacc

SEQ ID NO: 1279966 - DNA, 22 bp, Artificial Sequence
  chemically synthesized
atttcagtattagaaccaaccc

SEQ ID NO: 1279967 - DNA, 22 bp, Artificial Sequence
  chemically synthesized
tttcagtattagaaccaaccct

SEQ ID NO: 1279968 - DNA, 22 bp, Artificial Sequence
  chemically synthesized
cagtattagaaccaaccctgct

SEQ ID NO: 1279969 - DNA, 22 bp, Artificial Sequence
  chemically synthesized
agtattagaaccaaccctgctt

SEQ ID NO: 1279970 - DNA, 22 bp, Artificial Sequence
  chemically synthesized
aaaaaagacaggatatataagc

SEQ ID NO: 1279971 - DNA, 22 bp, Artificial Sequence
  chemically synthesized
gaaccaaccctgcttatatatc

SEQ ID NO: 1279972 - DNA, 22 bp, Artificial Sequence
  chemically synthesized
aaaaaaagacaggatatataag

SEQ ID NO: 1279973 - DNA, 22 bp, Artificial Sequence
  chemically synthesized
aatttaaaaaaagacaggatat

SEQ ID NO: 1279974 - DNA, 22 bp, Artificial Sequence
  chemically synthesized
aaatttaaaaaaagacaggata

SEQ ID NO: 1279975 - DNA, 22 bp, Artificial Sequence
  chemically synthesized
cttatatatcctgtcttttttt

SEQ ID NO: 1279976 - DNA, 22 bp, Artificial Sequence
  chemically synthesized
agccttaaatttaaaaaaagac

SEQ ID NO: 1279977 - DNA, 22 bp, Artificial Sequence
  chemically synthesized
atatatcctgtctttttttaaa

SEQ ID NO: 1279978 - DNA, 22 bp, Artificial Sequence
  chemically synthesized
ttaagccttaaatttaaaaaaa

SEQ ID NO: 1279979 - DNA, 22 bp, Artificial Sequence
  chemically synthesized
tatatcctgtctttttttaaat

SEQ ID NO: 1279980 - DNA, 22 bp, Artificial Sequence
  chemically synthesized
ttgttaagccttaaatttaaaa

SEQ ID NO: 1279981 - DNA, 22 bp, Artificial Sequence
  chemically synthesized
gttgttaagccttaaatttaaa

SEQ ID NO: 1279982 - DNA, 22 bp, Artificial Sequence
  chemically synthesized
tttgttgttaagccttaaattt

SEQ ID NO: 1279983 - DNA, 22 bp, Artificial Sequence
  chemically synthesized
gtttgttgttaagccttaaatt

SEQ ID NO: 1279984 - DNA, 22 bp, Artificial Sequence
  chemically synthesized
tctttttttaaatttaaggctt

SEQ ID NO: 1279985 - DNA, 22 bp, Artificial Sequence
  chemically synthesized
tttgtttgttgttaagccttaa

SEQ ID NO: 1279986 - DNA, 22 bp, Artificial Sequence
  chemically synthesized
tttttaaatttaaggcttaaca

SEQ ID NO: 1279987 - DNA, 22 bp, Artificial Sequence
  chemically synthesized
ctgtttgtttgttgttaagcct

SEQ ID NO: 1279988 - DNA, 22 bp, Artificial Sequence
  chemically synthesized
ttttaaatttaaggcttaacaa

SEQ ID NO: 1279989 - DNA, 22 bp, Artificial Sequence
  chemically synthesized
tttaaatttaaggcttaacaac

SEQ ID NO: 1279990 - DNA, 22 bp, Artificial Sequence
  chemically synthesized
ttaaatttaaggcttaacaaca

SEQ ID NO: 1279991 - DNA, 22 bp, Artificial Sequence
  chemically synthesized
ctactgtttgtttgttgttaag

SEQ ID NO: 1279992 - DNA, 22 bp, Artificial Sequence
  chemically synthesized
taaatttaaggcttaacaacaa

SEQ ID NO: 1279993 - DNA, 22 bp, Artificial Sequence
  chemically synthesized
aaatttaaggcttaacaacaaa

SEQ ID NO: 1279994 - DNA, 22 bp, Artificial Sequence
  chemically synthesized
aatttaaggcttaacaacaaac

SEQ ID NO: 1279995 - DNA, 22 bp, Artificial Sequence
  chemically synthesized
ttgctactgtttgtttgttgtt

SEQ ID NO: 1279996 - DNA, 22 bp, Artificial Sequence
  chemically synthesized
aaggcttaacaacaaacaaaca

SEQ ID NO: 1279997 - DNA, 22 bp, Artificial Sequence
  chemically synthesized
aggcttaacaacaaacaaacag

SEQ ID NO: 1279998 - DNA, 22 bp, Artificial Sequence
  chemically synthesized
ggattattgctactgtttgttt

SEQ ID NO: 1279999 - DNA, 22 bp, Artificial Sequence
  chemically synthesized
aacaacaaacaaacagtagcaa

SEQ ID NO: 1280000 - DNA, 22 bp, Artificial Sequence
  chemically synthesized
acaacaaacaaacagtagcaat

SEQ ID NO: 1280001 - DNA, 22 bp, Artificial Sequence
  chemically synthesized
gggaattgggattattgctact

SEQ ID NO: 1280002 - DNA, 22 bp, Artificial Sequence
  chemically synthesized
aatcactcgggaattgggatta

SEQ ID NO: 1280003 - DNA, 22 bp, Artificial Sequence
  chemically synthesized
ttgaatcactcgggaattggga

SEQ ID NO: 1280004 - DNA, 22 bp, Artificial Sequence
  chemically synthesized
gttgaatcactcgggaattggg

SEQ ID NO: 1280005 - DNA, 22 bp, Artificial Sequence
  chemically synthesized
cacaataaaacttgttgaatca

SEQ ID NO: 1280006 - DNA, 22 bp, Artificial Sequence
  chemically synthesized
ccgagtgattcaacaagtttta

SEQ ID NO: 1280007 - DNA, 22 bp, Artificial Sequence
  chemically synthesized
ccatctgcacaataaaacttgt

SEQ ID NO: 1280008 - DNA, 22 bp, Artificial Sequence
  chemically synthesized
accatctgcacaataaaacttg

SEQ ID NO: 1280009 - DNA, 22 bp, Artificial Sequence
  chemically synthesized
ttaccatctgcacaataaaact

SEQ ID NO: 1280010 - DNA, 22 bp, Artificial Sequence
  chemically synthesized
cttaccatctgcacaataaaac

SEQ ID NO: 1280011 - DNA, 22 bp, Artificial Sequence
  chemically synthesized
aacaagttttattgtgcagatg

SEQ ID NO: 1280012 - DNA, 22 bp, Artificial Sequence
  chemically synthesized
tattgtgcagatggtaagaaac

SEQ ID NO: 1280013 - DNA, 22 bp, Artificial Sequence
  chemically synthesized
attgtgcagatggtaagaaact

SEQ ID NO: 1280014 - DNA, 22 bp, Artificial Sequence
  chemically synthesized
ttgtgcagatggtaagaaactg

SEQ ID NO: 1280015 - DNA, 22 bp, Artificial Sequence
  chemically synthesized
tgcagatggtaagaaactgttt

SEQ ID NO: 1280016 - DNA, 22 bp, Artificial Sequence
  chemically synthesized
gtagcaaacaatgagggaaaca

SEQ ID NO: 1280017 - DNA, 22 bp, Artificial Sequence
  chemically synthesized
ctggtagcaaacaatgagggaa

SEQ ID NO: 1280018 - DNA, 22 bp, Artificial Sequence
  chemically synthesized
tcctggtagcaaacaatgaggg

SEQ ID NO: 1280019 - DNA, 22 bp, Artificial Sequence
  chemically synthesized
ctcctggtagcaaacaatgagg

SEQ ID NO: 1280020 - DNA, 22 bp, Artificial Sequence
  chemically synthesized
tctcctggtagcaaacaatgag

SEQ ID NO: 1280021 - DNA, 22 bp, Artificial Sequence
  chemically synthesized
tttccctcattgtttgctacca

SEQ ID NO: 1280022 - DNA, 22 bp, Artificial Sequence
  chemically synthesized
acagcctttctcctggtagcaa

SEQ ID NO: 1280023 - DNA, 22 bp, Artificial Sequence
  chemically synthesized
cacagcctttctcctggtagca

SEQ ID NO: 1280024 - DNA, 22 bp, Artificial Sequence
  chemically synthesized
ccctcattgtttgctaccagga

SEQ ID NO: 1280025 - DNA, 22 bp, Artificial Sequence
  chemically synthesized
cctcattgtttgctaccaggag

SEQ ID NO: 1280026 - DNA, 22 bp, Artificial Sequence
  chemically synthesized
tttcacagcctttctcctggta

SEQ ID NO: 1280027 - DNA, 22 bp, Artificial Sequence
  chemically synthesized
attgtttgctaccaggagaaag

SEQ ID NO: 1280028 - DNA, 22 bp, Artificial Sequence
  chemically synthesized
tttgctaccaggagaaaggctg

SEQ ID NO: 1280029 - DNA, 22 bp, Artificial Sequence
  chemically synthesized
gctaccaggagaaaggctgtga

SEQ ID NO: 1280030 - DNA, 22 bp, Artificial Sequence
  chemically synthesized
ctaccaggagaaaggctgtgaa

SEQ ID NO: 1280031 - DNA, 22 bp, Artificial Sequence
  chemically synthesized
ccaggagaaaggctgtgaaata

SEQ ID NO: 1280032 - DNA, 22 bp, Artificial Sequence
  chemically synthesized
acccagaagaactatttcacag

SEQ ID NO: 1280033 - DNA, 22 bp, Artificial Sequence
  chemically synthesized
gacccagaagaactatttcaca

SEQ ID NO: 1280034 - DNA, 22 bp, Artificial Sequence
  chemically synthesized
tgacccagaagaactatttcac

SEQ ID NO: 1280035 - DNA, 22 bp, Artificial Sequence
  chemically synthesized
tgaaatagttcttctgggtcaa

SEQ ID NO: 1280036 - DNA, 22 bp, Artificial Sequence
  chemically synthesized
tgaaccatatgttttgacccag

SEQ ID NO: 1280037 - DNA, 22 bp, Artificial Sequence
  chemically synthesized
gtgaaccatatgttttgaccca

SEQ ID NO: 1280038 - DNA, 22 bp, Artificial Sequence
  chemically synthesized
tgtgaaccatatgttttgaccc

SEQ ID NO: 1280039 - DNA, 22 bp, Artificial Sequence
  chemically synthesized
ttgtgaaccatatgttttgacc

SEQ ID NO: 1280040 - DNA, 22 bp, Artificial Sequence
  chemically synthesized
ttctgggtcaaaacatatggtt

SEQ ID NO: 1280041 - DNA, 22 bp, Artificial Sequence
  chemically synthesized
ctgggtcaaaacatatggttca

SEQ ID NO: 1280042 - DNA, 22 bp, Artificial Sequence
  chemically synthesized
tgggtcaaaacatatggttcac

SEQ ID NO: 1280043 - DNA, 22 bp, Artificial Sequence
  chemically synthesized
ggtcaaaacatatggttcacaa

SEQ ID NO: 1280044 - DNA, 22 bp, Artificial Sequence
  chemically synthesized
acaaaaatgacttcctttcatc

SEQ ID NO: 1280045 - DNA, 22 bp, Artificial Sequence
  chemically synthesized
agaaggcaagaagagaccaaga

SEQ ID NO: 1280046 - DNA, 22 bp, Artificial Sequence
  chemically synthesized
cagaaggcaagaagagaccaag

SEQ ID NO: 1280047 - DNA, 22 bp, Artificial Sequence
  chemically synthesized
tcagaaggcaagaagagaccaa

SEQ ID NO: 1280048 - DNA, 22 bp, Artificial Sequence
  chemically synthesized
cctttcatcttggtctcttctt

SEQ ID NO: 1280049 - DNA, 22 bp, Artificial Sequence
  chemically synthesized
ctttcatcttggtctcttcttg

SEQ ID NO: 1280050 - DNA, 22 bp, Artificial Sequence
  chemically synthesized
gtctttcagaaggcaagaagag

SEQ ID NO: 1280051 - DNA, 22 bp, Artificial Sequence
  chemically synthesized
tcatcttggtctcttcttgcct

SEQ ID NO: 1280052 - DNA, 22 bp, Artificial Sequence
  chemically synthesized
catcttggtctcttcttgcctt

SEQ ID NO: 1280053 - DNA, 22 bp, Artificial Sequence
  chemically synthesized
atcttggtctcttcttgccttc

SEQ ID NO: 1280054 - DNA, 22 bp, Artificial Sequence
  chemically synthesized
ggtctcttcttgccttctgaaa

SEQ ID NO: 1280055 - DNA, 22 bp, Artificial Sequence
  chemically synthesized
gtctcttcttgccttctgaaag

SEQ ID NO: 1280056 - DNA, 22 bp, Artificial Sequence
  chemically synthesized
ggaggaattggtctttcagaag

SEQ ID NO: 1280057 - DNA, 22 bp, Artificial Sequence
  chemically synthesized
ttcttgccttctgaaagaccaa

SEQ ID NO: 1280058 - DNA, 22 bp, Artificial Sequence
  chemically synthesized
aaattaggaggaattggtcttt

SEQ ID NO: 1280059 - DNA, 22 bp, Artificial Sequence
  chemically synthesized
cttgccttctgaaagaccaatt

SEQ ID NO: 1280060 - DNA, 22 bp, Artificial Sequence
  chemically synthesized
aaaattaggaggaattggtctt

SEQ ID NO: 1280061 - DNA, 22 bp, Artificial Sequence
  chemically synthesized
ttgccttctgaaagaccaattc

SEQ ID NO: 1280062 - DNA, 22 bp, Artificial Sequence
  chemically synthesized
gccttctgaaagaccaattcct

SEQ ID NO: 1280063 - DNA, 22 bp, Artificial Sequence
  chemically synthesized
ccttctgaaagaccaattcctc

SEQ ID NO: 1280064 - DNA, 22 bp, Artificial Sequence
  chemically synthesized
ctgaaagaccaattcctcctaa

SEQ ID NO: 1280065 - DNA, 22 bp, Artificial Sequence
  chemically synthesized
tgaaagaccaattcctcctaat

SEQ ID NO: 1280066 - DNA, 22 bp, Artificial Sequence
  chemically synthesized
aaagaccaattcctcctaattt

SEQ ID NO: 1280067 - DNA, 22 bp, Artificial Sequence
  chemically synthesized
ccaaaagtaaacttaaaattag

SEQ ID NO: 1280068 - DNA, 22 bp, Artificial Sequence
  chemically synthesized
gccaaaagtaaacttaaaatta

SEQ ID NO: 1280069 - DNA, 22 bp, Artificial Sequence
  chemically synthesized
tgccaaaagtaaacttaaaatt

SEQ ID NO: 1280070 - DNA, 22 bp, Artificial Sequence
  chemically synthesized
ctcctaattttaagtttacttt

SEQ ID NO: 1280071 - DNA, 22 bp, Artificial Sequence
  chemically synthesized
ctaattttaagtttacttttgg

SEQ ID NO: 1280072 - DNA, 22 bp, Artificial Sequence
  chemically synthesized
attttaagtttacttttggcaa

SEQ ID NO: 1280073 - DNA, 22 bp, Artificial Sequence
  chemically synthesized
atacatgagaccattttgccaa

SEQ ID NO: 1280074 - DNA, 22 bp, Artificial Sequence
  chemically synthesized
taagtttacttttggcaaaatg

SEQ ID NO: 1280075 - DNA, 22 bp, Artificial Sequence
  chemically synthesized
aagtttacttttggcaaaatgg

SEQ ID NO: 1280076 - DNA, 22 bp, Artificial Sequence
  chemically synthesized
agtttacttttggcaaaatggt

SEQ ID NO: 1280077 - DNA, 22 bp, Artificial Sequence
  chemically synthesized
acttttggcaaaatggtctcat

SEQ ID NO: 1280078 - DNA, 22 bp, Artificial Sequence
  chemically synthesized
cttttggcaaaatggtctcatg

SEQ ID NO: 1280079 - DNA, 22 bp, Artificial Sequence
  chemically synthesized
ttggcaaaatggtctcatgtat

SEQ ID NO: 1280080 - DNA, 22 bp, Artificial Sequence
  chemically synthesized
tggcaaaatggtctcatgtatt

SEQ ID NO: 1280081 - DNA, 22 bp, Artificial Sequence
  chemically synthesized
ggcaaaatggtctcatgtatta

SEQ ID NO: 1280082 - DNA, 22 bp, Artificial Sequence
  chemically synthesized
gcaaaatggtctcatgtattaa

SEQ ID NO: 1280083 - DNA, 22 bp, Artificial Sequence
  chemically synthesized
accaaataaagtcattaataca

SEQ ID NO: 1280084 - DNA, 22 bp, Artificial Sequence
  chemically synthesized
ttaaccaaataaagtcattaat

SEQ ID NO: 1280085 - DNA, 22 bp, Artificial Sequence
  chemically synthesized
gttaaccaaataaagtcattaa

SEQ ID NO: 1280086 - DNA, 22 bp, Artificial Sequence
  chemically synthesized
tgttaaccaaataaagtcatta

SEQ ID NO: 1280087 - DNA, 22 bp, Artificial Sequence
  chemically synthesized
ctttgttaaccaaataaagtca

SEQ ID NO: 1280088 - DNA, 22 bp, Artificial Sequence
  chemically synthesized
atgtattaatgactttatttgg

SEQ ID NO: 1280089 - DNA, 22 bp, Artificial Sequence
  chemically synthesized
atgactttatttggttaacaaa

SEQ ID NO: 1280090 - DNA, 22 bp, Artificial Sequence
  chemically synthesized
taaacatgttactttgttaacc

SEQ ID NO: 1280091 - DNA, 22 bp, Artificial Sequence
  chemically synthesized
tatttggttaacaaagtaacat

SEQ ID NO: 1280092 - DNA, 22 bp, Artificial Sequence
  chemically synthesized
atttggttaacaaagtaacatg

SEQ ID NO: 1280093 - DNA, 22 bp, Artificial Sequence
  chemically synthesized
tttggttaacaaagtaacatgt

SEQ ID NO: 1280094 - DNA, 22 bp, Artificial Sequence
  chemically synthesized
ccatgcctgtaaacatgttact

SEQ ID NO: 1280095 - DNA, 22 bp, Artificial Sequence
  chemically synthesized
tcccatgcctgtaaacatgtta

SEQ ID NO: 1280096 - DNA, 22 bp, Artificial Sequence
  chemically synthesized
ggttaacaaagtaacatgttta

SEQ ID NO: 1280097 - DNA, 22 bp, Artificial Sequence
  chemically synthesized
gttaacaaagtaacatgtttac

SEQ ID NO: 1280098 - DNA, 22 bp, Artificial Sequence
  chemically synthesized
tcctctcccatgcctgtaaaca

SEQ ID NO: 1280099 - DNA, 22 bp, Artificial Sequence
  chemically synthesized
acaaagtaacatgtttacaggc

SEQ ID NO: 1280100 - DNA, 22 bp, Artificial Sequence
  chemically synthesized
atcctctcccatgcctgtaaac

SEQ ID NO: 1280101 - DNA, 22 bp, Artificial Sequence
  chemically synthesized
atttatcctctcccatgcctgt

SEQ ID NO: 1280102 - DNA, 22 bp, Artificial Sequence
  chemically synthesized
catttatcctctcccatgcctg

SEQ ID NO: 1280103 - DNA, 22 bp, Artificial Sequence
  chemically synthesized
gcttcatttatcctctcccatg

SEQ ID NO: 1280104 - DNA, 22 bp, Artificial Sequence
  chemically synthesized
tagcttcatttatcctctccca

SEQ ID NO: 1280105 - DNA, 22 bp, Artificial Sequence
  chemically synthesized
ctagcttcatttatcctctccc

SEQ ID NO: 1280106 - DNA, 22 bp, Artificial Sequence
  chemically synthesized
tctagcttcatttatcctctcc

SEQ ID NO: 1280107 - DNA, 22 bp, Artificial Sequence
  chemically synthesized
ttctagcttcatttatcctctc

SEQ ID NO: 1280108 - DNA, 22 bp, Artificial Sequence
  chemically synthesized
tttctagcttcatttatcctct

SEQ ID NO: 1280109 - DNA, 22 bp, Artificial Sequence
  chemically synthesized
acaggcatgggagaggataaat

SEQ ID NO: 1280110 - DNA, 22 bp, Artificial Sequence
  chemically synthesized
caggcatgggagaggataaatg

SEQ ID NO: 1280111 - DNA, 22 bp, Artificial Sequence
  chemically synthesized
ctttttctagcttcatttatcc

SEQ ID NO: 1280112 - DNA, 22 bp, Artificial Sequence
  chemically synthesized
agtactcctttttctagcttca

SEQ ID NO: 1280113 - DNA, 22 bp, Artificial Sequence
  chemically synthesized
cagtactcctttttctagcttc

SEQ ID NO: 1280114 - DNA, 22 bp, Artificial Sequence
  chemically synthesized
tcagtactcctttttctagctt

SEQ ID NO: 1280115 - DNA, 22 bp, Artificial Sequence
  chemically synthesized
atattttcagtactcctttttc

SEQ ID NO: 1280116 - DNA, 22 bp, Artificial Sequence
  chemically synthesized
acctaatattttcagtactcct

SEQ ID NO: 1280117 - DNA, 22 bp, Artificial Sequence
  chemically synthesized
gaaaaaggagtactgaaaatat

SEQ ID NO: 1280118 - DNA, 22 bp, Artificial Sequence
  chemically synthesized
aaaacaataacacattaaccta

SEQ ID NO: 1280119 - DNA, 22 bp, Artificial Sequence
  chemically synthesized
gaaaacaataacacattaacct

SEQ ID NO: 1280120 - DNA, 22 bp, Artificial Sequence
  chemically synthesized
ttgaaaacaataacacattaac

SEQ ID NO: 1280121 - DNA, 22 bp, Artificial Sequence
  chemically synthesized
aaaatattaggttaatgtgtta

SEQ ID NO: 1280122 - DNA, 22 bp, Artificial Sequence
  chemically synthesized
tagatggctcttgaaaacaata

SEQ ID NO: 1280123 - DNA, 22 bp, Artificial Sequence
  chemically synthesized
ggttaatgtgttattgttttca

SEQ ID NO: 1280124 - DNA, 22 bp, Artificial Sequence
  chemically synthesized
atgtgttattgttttcaagagc

SEQ ID NO: 1280125 - DNA, 22 bp, Artificial Sequence
  chemically synthesized
aaggatgttatagatggctctt

SEQ ID NO: 1280126 - DNA, 22 bp, Artificial Sequence
  chemically synthesized
caaggatgttatagatggctct

SEQ ID NO: 1280127 - DNA, 22 bp, Artificial Sequence
  chemically synthesized
ttgttttcaagagccatctata

SEQ ID NO: 1280128 - DNA, 22 bp, Artificial Sequence
  chemically synthesized
ttttcaagagccatctataaca

SEQ ID NO: 1280129 - DNA, 22 bp, Artificial Sequence
  chemically synthesized
tcaagagccatctataacatcc

SEQ ID NO: 1280130 - DNA, 22 bp, Artificial Sequence
  chemically synthesized
tgtaagtttcaaggatgttata

SEQ ID NO: 1280131 - DNA, 22 bp, Artificial Sequence
  chemically synthesized
caagagccatctataacatcct

SEQ ID NO: 1280132 - DNA, 22 bp, Artificial Sequence
  chemically synthesized
aagagccatctataacatcctt

SEQ ID NO: 1280133 - DNA, 22 bp, Artificial Sequence
  chemically synthesized
gtcagtggttgtgtaagtttca

SEQ ID NO: 1280134 - DNA, 22 bp, Artificial Sequence
  chemically synthesized
agtcagtggttgtgtaagtttc

SEQ ID NO: 1280135 - DNA, 22 bp, Artificial Sequence
  chemically synthesized
taacatccttgaaacttacaca

SEQ ID NO: 1280136 - DNA, 22 bp, Artificial Sequence
  chemically synthesized
gaaacttacacaaccactgact

SEQ ID NO: 1280137 - DNA, 22 bp, Artificial Sequence
  chemically synthesized
aataaaatgtttagtcagtggt

SEQ ID NO: 1280138 - DNA, 22 bp, Artificial Sequence
  chemically synthesized
aaacttacacaaccactgacta

SEQ ID NO: 1280139 - DNA, 22 bp, Artificial Sequence
  chemically synthesized
taaataaaatgtttagtcagtg

SEQ ID NO: 1280140 - DNA, 22 bp, Artificial Sequence
  chemically synthesized
ttctaaataaaatgtttagtca

SEQ ID NO: 1280141 - DNA, 22 bp, Artificial Sequence
  chemically synthesized
acacaaccactgactaaacatt

SEQ ID NO: 1280142 - DNA, 22 bp, Artificial Sequence
  chemically synthesized
cacaaccactgactaaacattt

SEQ ID NO: 1280143 - DNA, 22 bp, Artificial Sequence
  chemically synthesized
attattctaaataaaatgttta

SEQ ID NO: 1280144 - DNA, 22 bp, Artificial Sequence
  chemically synthesized
ctgattattctaaataaaatgt

SEQ ID NO: 1280145 - DNA, 22 bp, Artificial Sequence
  chemically synthesized
gttcctgattattctaaataaa

SEQ ID NO: 1280146 - DNA, 22 bp, Artificial Sequence
  chemically synthesized
actaaacattttatttagaata

SEQ ID NO: 1280147 - DNA, 22 bp, Artificial Sequence
  chemically synthesized
cactggttcctgattattctaa

SEQ ID NO: 1280148 - DNA, 22 bp, Artificial Sequence
  chemically synthesized
ccactggttcctgattattcta

SEQ ID NO: 1280149 - DNA, 22 bp, Artificial Sequence
  chemically synthesized
aacattttatttagaataatca

SEQ ID NO: 1280150 - DNA, 22 bp, Artificial Sequence
  chemically synthesized
tccactggttcctgattattct

SEQ ID NO: 1280151 - DNA, 22 bp, Artificial Sequence
  chemically synthesized
tatttagaataatcaggaacca

SEQ ID NO: 1280152 - DNA, 22 bp, Artificial Sequence
  chemically synthesized
atttagaataatcaggaaccag

SEQ ID NO: 1280153 - DNA, 22 bp, Artificial Sequence
  chemically synthesized
tttagaataatcaggaaccagt

SEQ ID NO: 1280154 - DNA, 22 bp, Artificial Sequence
  chemically synthesized
agaataatcaggaaccagtgga

SEQ ID NO: 1280155 - DNA, 22 bp, Artificial Sequence
  chemically synthesized
gaataatcaggaaccagtggaa

SEQ ID NO: 1280156 - DNA, 22 bp, Artificial Sequence
  chemically synthesized
gataagcagattttccactggt

SEQ ID NO: 1280157 - DNA, 22 bp, Artificial Sequence
  chemically synthesized
aaggtctagataagcagatttt

SEQ ID NO: 1280158 - DNA, 22 bp, Artificial Sequence
  chemically synthesized
caaggtctagataagcagattt

SEQ ID NO: 1280159 - DNA, 22 bp, Artificial Sequence
  chemically synthesized
cttatctagaccttgaagcatc

SEQ ID NO: 1280160 - DNA, 22 bp, Artificial Sequence
  chemically synthesized
agaaaaaaaaaatgatgcttca

SEQ ID NO: 1280161 - DNA, 22 bp, Artificial Sequence
  chemically synthesized
cagaaaaaaaaaatgatgcttc

SEQ ID NO: 1280162 - DNA, 22 bp, Artificial Sequence
  chemically synthesized
atctagaccttgaagcatcatt

SEQ ID NO: 1280163 - DNA, 22 bp, Artificial Sequence
  chemically synthesized
tcagaaaaaaaaaatgatgctt

SEQ ID NO: 1280164 - DNA, 22 bp, Artificial Sequence
  chemically synthesized
tctagaccttgaagcatcattt

SEQ ID NO: 1280165 - DNA, 22 bp, Artificial Sequence
  chemically synthesized
gaccttgaagcatcattttttt

SEQ ID NO: 1280166 - DNA, 22 bp, Artificial Sequence
  chemically synthesized
gaagcatcattttttttttctg

SEQ ID NO: 1280167 - DNA, 22 bp, Artificial Sequence
  chemically synthesized
aagcatcattttttttttctga

SEQ ID NO: 1280168 - DNA, 22 bp, Artificial Sequence
  chemically synthesized
gatgtaatcaggaagaaatttt

SEQ ID NO: 1280169 - DNA, 22 bp, Artificial Sequence
  chemically synthesized
tttttttctgaaaatttcttcc

SEQ ID NO: 1280170 - DNA, 22 bp, Artificial Sequence
  chemically synthesized
ttttttctgaaaatttcttcct

SEQ ID NO: 1280171 - DNA, 22 bp, Artificial Sequence
  chemically synthesized
tttttctgaaaatttcttcctg

SEQ ID NO: 1280172 - DNA, 22 bp, Artificial Sequence
  chemically synthesized
ttttctgaaaatttcttcctga

SEQ ID NO: 1280173 - DNA, 22 bp, Artificial Sequence
  chemically synthesized
tttctgaaaatttcttcctgat

SEQ ID NO: 1280174 - DNA, 22 bp, Artificial Sequence
  chemically synthesized
ccactggatgtaatcaggaaga

SEQ ID NO: 1280175 - DNA, 22 bp, Artificial Sequence
  chemically synthesized
ttctgaaaatttcttcctgatt

SEQ ID NO: 1280176 - DNA, 22 bp, Artificial Sequence
  chemically synthesized
tctgaaaatttcttcctgatta

SEQ ID NO: 1280177 - DNA, 22 bp, Artificial Sequence
  chemically synthesized
ctgaaaatttcttcctgattac

SEQ ID NO: 1280178 - DNA, 22 bp, Artificial Sequence
  chemically synthesized
tgaaaatttcttcctgattaca

SEQ ID NO: 1280179 - DNA, 22 bp, Artificial Sequence
  chemically synthesized
aaaatttcttcctgattacatc

SEQ ID NO: 1280180 - DNA, 22 bp, Artificial Sequence
  chemically synthesized
cttcctgattacatccagtggc

SEQ ID NO: 1280181 - DNA, 22 bp, Artificial Sequence
  chemically synthesized
ttcctgattacatccagtggca

SEQ ID NO: 1280182 - DNA, 22 bp, Artificial Sequence
  chemically synthesized
cctgattacatccagtggcaga

SEQ ID NO: 1280183 - DNA, 22 bp, Artificial Sequence
  chemically synthesized
ctgattacatccagtggcagat

SEQ ID NO: 1280184 - DNA, 22 bp, Artificial Sequence
  chemically synthesized
attacatccagtggcagatact

SEQ ID NO: 1280185 - DNA, 22 bp, Artificial Sequence
  chemically synthesized
catccagtggcagatactgcta

SEQ ID NO: 1280186 - DNA, 22 bp, Artificial Sequence
  chemically synthesized
ggcaagcaaacaagcaaatagc

SEQ ID NO: 1280187 - DNA, 22 bp, Artificial Sequence
  chemically synthesized
gatattgggcaagcaaacaagc

SEQ ID NO: 1280188 - DNA, 22 bp, Artificial Sequence
  chemically synthesized
ttggatattgggcaagcaaaca

SEQ ID NO: 1280189 - DNA, 22 bp, Artificial Sequence
  chemically synthesized
attggatattgggcaagcaaac

SEQ ID NO: 1280190 - DNA, 22 bp, Artificial Sequence
  chemically synthesized
ctatttgcttgtttgcttgccc

SEQ ID NO: 1280191 - DNA, 22 bp, Artificial Sequence
  chemically synthesized
tttgcttgtttgcttgcccaat

SEQ ID NO: 1280192 - DNA, 22 bp, Artificial Sequence
  chemically synthesized
ggtttattggatattgggcaag

SEQ ID NO: 1280193 - DNA, 22 bp, Artificial Sequence
  chemically synthesized
gcttgtttgcttgcccaatatc

SEQ ID NO: 1280194 - DNA, 22 bp, Artificial Sequence
  chemically synthesized
ctgggtttattggatattgggc

SEQ ID NO: 1280195 - DNA, 22 bp, Artificial Sequence
  chemically synthesized
cttgtttgcttgcccaatatcc

SEQ ID NO: 1280196 - DNA, 22 bp, Artificial Sequence
  chemically synthesized
gctgggtttattggatattggg

SEQ ID NO: 1280197 - DNA, 22 bp, Artificial Sequence
  chemically synthesized
tgctgggtttattggatattgg

SEQ ID NO: 1280198 - DNA, 22 bp, Artificial Sequence
  chemically synthesized
gtttgcttgcccaatatccaat

SEQ ID NO: 1280199 - DNA, 22 bp, Artificial Sequence
  chemically synthesized
tttgctgggtttattggatatt

SEQ ID NO: 1280200 - DNA, 22 bp, Artificial Sequence
  chemically synthesized
tttgcttgcccaatatccaata

SEQ ID NO: 1280201 - DNA, 22 bp, Artificial Sequence
  chemically synthesized
ctttgctgggtttattggatat

SEQ ID NO: 1280202 - DNA, 22 bp, Artificial Sequence
  chemically synthesized
gcttgcccaatatccaataaac

SEQ ID NO: 1280203 - DNA, 22 bp, Artificial Sequence
  chemically synthesized
tttctttgctgggtttattgga

SEQ ID NO: 1280204 - DNA, 22 bp, Artificial Sequence
  chemically synthesized
cttgcccaatatccaataaacc

SEQ ID NO: 1280205 - DNA, 22 bp, Artificial Sequence
  chemically synthesized
gcccaatatccaataaacccag

SEQ ID NO: 1280206 - DNA, 22 bp, Artificial Sequence
  chemically synthesized
cccaatatccaataaacccagc

SEQ ID NO: 1280207 - DNA, 22 bp, Artificial Sequence
  chemically synthesized
atagtccatcaagacaactatt

SEQ ID NO: 1280208 - DNA, 22 bp, Artificial Sequence
  chemically synthesized
ttaatagtccatcaagacaact

SEQ ID NO: 1280209 - DNA, 22 bp, Artificial Sequence
  chemically synthesized
gctgttaatagtccatcaagac

SEQ ID NO: 1280210 - DNA, 22 bp, Artificial Sequence
  chemically synthesized
tgggttggctgttaatagtcca

SEQ ID NO: 1280211 - DNA, 22 bp, Artificial Sequence
  chemically synthesized
ctgtgggttggctgttaatagt

SEQ ID NO: 1280212 - DNA, 22 bp, Artificial Sequence
  chemically synthesized
actgtgggttggctgttaatag

SEQ ID NO: 1280213 - DNA, 22 bp, Artificial Sequence
  chemically synthesized
tactgtgggttggctgttaata

SEQ ID NO: 1280214 - DNA, 22 bp, Artificial Sequence
  chemically synthesized
tcttgatggactattaacagcc

SEQ ID NO: 1280215 - DNA, 22 bp, Artificial Sequence
  chemically synthesized
ttactgtgggttggctgttaat

SEQ ID NO: 1280216 - DNA, 22 bp, Artificial Sequence
  chemically synthesized
tttttactgtgggttggctgtt

SEQ ID NO: 1280217 - DNA, 22 bp, Artificial Sequence
  chemically synthesized
gatggactattaacagccaacc

SEQ ID NO: 1280218 - DNA, 22 bp, Artificial Sequence
  chemically synthesized
gtttttactgtgggttggctgt

SEQ ID NO: 1280219 - DNA, 22 bp, Artificial Sequence
  chemically synthesized
atggactattaacagccaaccc

SEQ ID NO: 1280220 - DNA, 22 bp, Artificial Sequence
  chemically synthesized
gaatttgtttttactgtgggtt

SEQ ID NO: 1280221 - DNA, 22 bp, Artificial Sequence
  chemically synthesized
agaatttgtttttactgtgggt

SEQ ID NO: 1280222 - DNA, 22 bp, Artificial Sequence
  chemically synthesized
tagaatttgtttttactgtggg

SEQ ID NO: 1280223 - DNA, 22 bp, Artificial Sequence
  chemically synthesized
ttaacagccaacccacagtaaa

SEQ ID NO: 1280224 - DNA, 22 bp, Artificial Sequence
  chemically synthesized
ttagaatttgtttttactgtgg

SEQ ID NO: 1280225 - DNA, 22 bp, Artificial Sequence
  chemically synthesized
acagccaacccacagtaaaaac

SEQ ID NO: 1280226 - DNA, 22 bp, Artificial Sequence
  chemically synthesized
aatttttagaatttgtttttac

SEQ ID NO: 1280227 - DNA, 22 bp, Artificial Sequence
  chemically synthesized
aaatttttagaatttgttttta

SEQ ID NO: 1280228 - DNA, 22 bp, Artificial Sequence
  chemically synthesized
taaatttttagaatttgttttt

SEQ ID NO: 1280229 - DNA, 22 bp, Artificial Sequence
  chemically synthesized
ttaaatttttagaatttgtttt

SEQ ID NO: 1280230 - DNA, 22 bp, Artificial Sequence
  chemically synthesized
tttaaatttttagaatttgttt

SEQ ID NO: 1280231 - DNA, 22 bp, Artificial Sequence
  chemically synthesized
tgctttttaaatttttagaatt

SEQ ID NO: 1280232 - DNA, 22 bp, Artificial Sequence
  chemically synthesized
ctatgctttttaaatttttaga

SEQ ID NO: 1280233 - DNA, 22 bp, Artificial Sequence
  chemically synthesized
gttactatgctttttaaatttt

SEQ ID NO: 1280234 - DNA, 22 bp, Artificial Sequence
  chemically synthesized
ggttactatgctttttaaattt

SEQ ID NO: 1280235 - DNA, 22 bp, Artificial Sequence
  chemically synthesized
tggttactatgctttttaaatt

SEQ ID NO: 1280236 - DNA, 22 bp, Artificial Sequence
  chemically synthesized
ttggttactatgctttttaaat

SEQ ID NO: 1280237 - DNA, 22 bp, Artificial Sequence
  chemically synthesized
tttggttactatgctttttaaa

SEQ ID NO: 1280238 - DNA, 22 bp, Artificial Sequence
  chemically synthesized
taaaaatttaaaaagcatagta

SEQ ID NO: 1280239 - DNA, 22 bp, Artificial Sequence
  chemically synthesized
aaaatttaaaaagcatagtaac

SEQ ID NO: 1280240 - DNA, 22 bp, Artificial Sequence
  chemically synthesized
aaaaagcatagtaaccaaaaaa

SEQ ID NO: 1280241 - DNA, 22 bp, Artificial Sequence
  chemically synthesized
aaaagcatagtaaccaaaaaat

SEQ ID NO: 1280242 - DNA, 22 bp, Artificial Sequence
  chemically synthesized
aaaagcaaaatgtggagtgaat

SEQ ID NO: 1280243 - DNA, 22 bp, Artificial Sequence
  chemically synthesized
aaaaagcaaaatgtggagtgaa

SEQ ID NO: 1280244 - DNA, 22 bp, Artificial Sequence
  chemically synthesized
aagtttaaaaagcaaaatgtgg

SEQ ID NO: 1280245 - DNA, 22 bp, Artificial Sequence
  chemically synthesized
aaagtttaaaaagcaaaatgtg

SEQ ID NO: 1280246 - DNA, 22 bp, Artificial Sequence
  chemically synthesized
taaagtttaaaaagcaaaatgt

SEQ ID NO: 1280247 - DNA, 22 bp, Artificial Sequence
  chemically synthesized
ttaaagtttaaaaagcaaaatg

SEQ ID NO: 1280248 - DNA, 22 bp, Artificial Sequence
  chemically synthesized
tttaaagtttaaaaagcaaaat

SEQ ID NO: 1280249 - DNA, 22 bp, Artificial Sequence
  chemically synthesized
actccacattttgctttttaaa

SEQ ID NO: 1280250 - DNA, 22 bp, Artificial Sequence
  chemically synthesized
cacattttgctttttaaacttt

SEQ ID NO: 1280251 - DNA, 22 bp, Artificial Sequence
  chemically synthesized
tgctttttaaactttaaaaaat

SEQ ID NO: 1280252 - DNA, 22 bp, Artificial Sequence
  chemically synthesized
gctttttaaactttaaaaaatg

SEQ ID NO: 1280253 - DNA, 22 bp, Artificial Sequence
  chemically synthesized
ctttttaaactttaaaaaatgc

SEQ ID NO: 1280254 - DNA, 22 bp, Artificial Sequence
  chemically synthesized
tttaaactttaaaaaatgcttt

SEQ ID NO: 1280255 - DNA, 22 bp, Artificial Sequence
  chemically synthesized
ttaaactttaaaaaatgctttt

SEQ ID NO: 1280256 - DNA, 22 bp, Artificial Sequence
  chemically synthesized
taaactttaaaaaatgcttttt

SEQ ID NO: 1280257 - DNA, 22 bp, Artificial Sequence
  chemically synthesized
aaactttaaaaaatgctttttt

SEQ ID NO: 1280258 - DNA, 22 bp, Artificial Sequence
  chemically synthesized
aactttaaaaaatgcttttttt

SEQ ID NO: 1280259 - DNA, 22 bp, Artificial Sequence
  chemically synthesized
aaaaaaaaaaaaaaaaaaaaaa

SEQ ID NO: 1280260 - DNA, 22 bp, Artificial Sequence
  chemically synthesized
taaaaaatgctttttttttttt

SEQ ID NO: 1280261 - DNA, 22 bp, Artificial Sequence
  chemically synthesized
caaaaaaaaaaaaaaaaaaaaa

SEQ ID NO: 1280262 - DNA, 22 bp, Artificial Sequence
  chemically synthesized
aaaaaatgcttttttttttttt

SEQ ID NO: 1280263 - DNA, 22 bp, Artificial Sequence
  chemically synthesized
aaaaatgctttttttttttttt

SEQ ID NO: 1280264 - DNA, 22 bp, Artificial Sequence
  chemically synthesized
agggtttcaaaaaaaaaaaaaa

SEQ ID NO: 1280265 - DNA, 22 bp, Artificial Sequence
  chemically synthesized
cagggtttcaaaaaaaaaaaaa

SEQ ID NO: 1280266 - DNA, 22 bp, Artificial Sequence
  chemically synthesized
tcagggtttcaaaaaaaaaaaa

SEQ ID NO: 1280267 - DNA, 22 bp, Artificial Sequence
  chemically synthesized
ttcagggtttcaaaaaaaaaaa

SEQ ID NO: 1280268 - DNA, 22 bp, Artificial Sequence
  chemically synthesized
tttcagggtttcaaaaaaaaaa

SEQ ID NO: 1280269 - DNA, 22 bp, Artificial Sequence
  chemically synthesized
tttttttttttttttttttttg

SEQ ID NO: 1280270 - DNA, 22 bp, Artificial Sequence
  chemically synthesized
ttttttttttttttttttttga

SEQ ID NO: 1280271 - DNA, 22 bp, Artificial Sequence
  chemically synthesized
tttttttttttttttttttgaa

SEQ ID NO: 1280272 - DNA, 22 bp, Artificial Sequence
  chemically synthesized
ctttttcagggtttcaaaaaaa

SEQ ID NO: 1280273 - DNA, 22 bp, Artificial Sequence
  chemically synthesized
ttttttttttttttttttgaaa

SEQ ID NO: 1280274 - DNA, 22 bp, Artificial Sequence
  chemically synthesized
tttttttttttttttttgaaac

SEQ ID NO: 1280275 - DNA, 22 bp, Artificial Sequence
  chemically synthesized
ttttttttttttttttgaaacc

SEQ ID NO: 1280276 - DNA, 22 bp, Artificial Sequence
  chemically synthesized
tttttttttttttttgaaaccc

SEQ ID NO: 1280277 - DNA, 22 bp, Artificial Sequence
  chemically synthesized
tctactttttcagggtttcaaa

SEQ ID NO: 1280278 - DNA, 22 bp, Artificial Sequence
  chemically synthesized
ttttttttttttttgaaaccct

SEQ ID NO: 1280279 - DNA, 22 bp, Artificial Sequence
  chemically synthesized
tttttttttttttgaaaccctg

SEQ ID NO: 1280280 - DNA, 22 bp, Artificial Sequence
  chemically synthesized
ttttttttttttgaaaccctga

SEQ ID NO: 1280281 - DNA, 22 bp, Artificial Sequence
  chemically synthesized
ctgtctactttttcagggtttc

SEQ ID NO: 1280282 - DNA, 22 bp, Artificial Sequence
  chemically synthesized
tttttttttttgaaaccctgaa

SEQ ID NO: 1280283 - DNA, 22 bp, Artificial Sequence
  chemically synthesized
actgtctactttttcagggttt

SEQ ID NO: 1280284 - DNA, 22 bp, Artificial Sequence
  chemically synthesized
ttttttttttgaaaccctgaaa

SEQ ID NO: 1280285 - DNA, 22 bp, Artificial Sequence
  chemically synthesized
tttttttttgaaaccctgaaaa

SEQ ID NO: 1280286 - DNA, 22 bp, Artificial Sequence
  chemically synthesized
ttttttttgaaaccctgaaaaa

SEQ ID NO: 1280287 - DNA, 22 bp, Artificial Sequence
  chemically synthesized
tttttttgaaaccctgaaaaag

SEQ ID NO: 1280288 - DNA, 22 bp, Artificial Sequence
  chemically synthesized
gcttactgtctactttttcagg

SEQ ID NO: 1280289 - DNA, 22 bp, Artificial Sequence
  chemically synthesized
ttttttgaaaccctgaaaaagt

SEQ ID NO: 1280290 - DNA, 22 bp, Artificial Sequence
  chemically synthesized
tttttgaaaccctgaaaaagta

SEQ ID NO: 1280291 - DNA, 22 bp, Artificial Sequence
  chemically synthesized
ttttgaaaccctgaaaaagtag

SEQ ID NO: 1280292 - DNA, 22 bp, Artificial Sequence
  chemically synthesized
tttgaaaccctgaaaaagtaga

SEQ ID NO: 1280293 - DNA, 22 bp, Artificial Sequence
  chemically synthesized
ttgaaaccctgaaaaagtagac

SEQ ID NO: 1280294 - DNA, 22 bp, Artificial Sequence
  chemically synthesized
tgaaaccctgaaaaagtagaca

SEQ ID NO: 1280295 - DNA, 22 bp, Artificial Sequence
  chemically synthesized
gaaaccctgaaaaagtagacag

SEQ ID NO: 1280296 - DNA, 22 bp, Artificial Sequence
  chemically synthesized
aaaccctgaaaaagtagacagt

SEQ ID NO: 1280297 - DNA, 22 bp, Artificial Sequence
  chemically synthesized
caggagctggcttactgtctac

SEQ ID NO: 1280298 - DNA, 22 bp, Artificial Sequence
  chemically synthesized
ccaggagctggcttactgtcta

SEQ ID NO: 1280299 - DNA, 22 bp, Artificial Sequence
  chemically synthesized
ttccaggagctggcttactgtc

SEQ ID NO: 1280300 - DNA, 22 bp, Artificial Sequence
  chemically synthesized
aaaaagtagacagtaagccagc

SEQ ID NO: 1280301 - DNA, 22 bp, Artificial Sequence
  chemically synthesized
caattcttccaggagctggctt

SEQ ID NO: 1280302 - DNA, 22 bp, Artificial Sequence
  chemically synthesized
ccaattcttccaggagctggct

SEQ ID NO: 1280303 - DNA, 22 bp, Artificial Sequence
  chemically synthesized
atttccaattcttccaggagct

SEQ ID NO: 1280304 - DNA, 22 bp, Artificial Sequence
  chemically synthesized
atgcagttgatttccaattctt

SEQ ID NO: 1280305 - DNA, 22 bp, Artificial Sequence
  chemically synthesized
gaccctcatgcagttgatttcc

SEQ ID NO: 1280306 - DNA, 22 bp, Artificial Sequence
  chemically synthesized
ctggaagaattggaaatcaact

SEQ ID NO: 1280307 - DNA, 22 bp, Artificial Sequence
  chemically synthesized
ctagaccctcatgcagttgatt

SEQ ID NO: 1280308 - DNA, 22 bp, Artificial Sequence
  chemically synthesized
gaagaattggaaatcaactgca

SEQ ID NO: 1280309 - DNA, 22 bp, Artificial Sequence
  chemically synthesized
cctagaccctcatgcagttgat

SEQ ID NO: 1280310 - DNA, 22 bp, Artificial Sequence
  chemically synthesized
agcttcctagaccctcatgcag

SEQ ID NO: 1280311 - DNA, 22 bp, Artificial Sequence
  chemically synthesized
tcagcttcctagaccctcatgc

SEQ ID NO: 1280312 - DNA, 22 bp, Artificial Sequence
  chemically synthesized
gaaatcaactgcatgagggtct

SEQ ID NO: 1280313 - DNA, 22 bp, Artificial Sequence
  chemically synthesized
agcctctcagcttcctagaccc

SEQ ID NO: 1280314 - DNA, 22 bp, Artificial Sequence
  chemically synthesized
cagcctctcagcttcctagacc

SEQ ID NO: 1280315 - DNA, 22 bp, Artificial Sequence
  chemically synthesized
cttcagcctctcagcttcctag

SEQ ID NO: 1280316 - DNA, 22 bp, Artificial Sequence
  chemically synthesized
catgagggtctaggaagctgag

SEQ ID NO: 1280317 - DNA, 22 bp, Artificial Sequence
  chemically synthesized
agactgcttcagcctctcagct

SEQ ID NO: 1280318 - DNA, 22 bp, Artificial Sequence
  chemically synthesized
tcctgagactgcttcagcctct

SEQ ID NO: 1280319 - DNA, 22 bp, Artificial Sequence
  chemically synthesized
gtcctgagactgcttcagcctc

SEQ ID NO: 1280320 - DNA, 22 bp, Artificial Sequence
  chemically synthesized
ggaagctgagaggctgaagcag

SEQ ID NO: 1280321 - DNA, 22 bp, Artificial Sequence
  chemically synthesized
cttgtcctgagactgcttcagc

SEQ ID NO: 1280322 - DNA, 22 bp, Artificial Sequence
  chemically synthesized
tctacttgtcctgagactgctt

SEQ ID NO: 1280323 - DNA, 22 bp, Artificial Sequence
  chemically synthesized
agaggctgaagcagtctcagga

SEQ ID NO: 1280324 - DNA, 22 bp, Artificial Sequence
  chemically synthesized
cctatctacttgtcctgagact

SEQ ID NO: 1280325 - DNA, 22 bp, Artificial Sequence
  chemically synthesized
ctccctatctacttgtcctgag

SEQ ID NO: 1280326 - DNA, 22 bp, Artificial Sequence
  chemically synthesized
aagcagtctcaggacaagtaga

SEQ ID NO: 1280327 - DNA, 22 bp, Artificial Sequence
  chemically synthesized
aggacaagtagatagggaggag

SEQ ID NO: 1280328 - DNA, 22 bp, Artificial Sequence
  chemically synthesized
agagaaaaaggactcctcccta

SEQ ID NO: 1280329 - DNA, 22 bp, Artificial Sequence
  chemically synthesized
ttgagagaaaaaggactcctcc

SEQ ID NO: 1280330 - DNA, 22 bp, Artificial Sequence
  chemically synthesized
ttgttgagagaaaaaggactcc

SEQ ID NO: 1280331 - DNA, 22 bp, Artificial Sequence
  chemically synthesized
gttgttgagagaaaaaggactc

SEQ ID NO: 1280332 - DNA, 22 bp, Artificial Sequence
  chemically synthesized
tgttgttgagagaaaaaggact

SEQ ID NO: 1280333 - DNA, 22 bp, Artificial Sequence
  chemically synthesized
aacaaaatcacgattttgttgt

SEQ ID NO: 1280334 - DNA, 22 bp, Artificial Sequence
  chemically synthesized
taaacaaaatcacgattttgtt

SEQ ID NO: 1280335 - DNA, 22 bp, Artificial Sequence
  chemically synthesized
tttctctcaacaacaaaatcgt

SEQ ID NO: 1280336 - DNA, 22 bp, Artificial Sequence
  chemically synthesized
ctaaacaaaatcacgattttgt

SEQ ID NO: 1280337 - DNA, 22 bp, Artificial Sequence
  chemically synthesized
ttctctcaacaacaaaatcgtg

SEQ ID NO: 1280338 - DNA, 22 bp, Artificial Sequence
  chemically synthesized
tctctcaacaacaaaatcgtga

SEQ ID NO: 1280339 - DNA, 22 bp, Artificial Sequence
  chemically synthesized
ctctcaacaacaaaatcgtgat

SEQ ID NO: 1280340 - DNA, 22 bp, Artificial Sequence
  chemically synthesized
cttctaaacaaaatcacgattt

SEQ ID NO: 1280341 - DNA, 22 bp, Artificial Sequence
  chemically synthesized
tctcaacaacaaaatcgtgatt

SEQ ID NO: 1280342 - DNA, 22 bp, Artificial Sequence
  chemically synthesized
tcaacaacaaaatcgtgatttt

SEQ ID NO: 1280343 - DNA, 22 bp, Artificial Sequence
  chemically synthesized
ctacttctaaacaaaatcacga

SEQ ID NO: 1280344 - DNA, 22 bp, Artificial Sequence
  chemically synthesized
gctacttctaaacaaaatcacg

SEQ ID NO: 1280345 - DNA, 22 bp, Artificial Sequence
  chemically synthesized
aacaacaaaatcgtgattttgt

SEQ ID NO: 1280346 - DNA, 22 bp, Artificial Sequence
  chemically synthesized
acaccttgctacttctaaacaa

SEQ ID NO: 1280347 - DNA, 22 bp, Artificial Sequence
  chemically synthesized
gacaccttgctacttctaaaca

SEQ ID NO: 1280348 - DNA, 22 bp, Artificial Sequence
  chemically synthesized
cttgacaccttgctacttctaa

SEQ ID NO: 1280349 - DNA, 22 bp, Artificial Sequence
  chemically synthesized
gcttgacaccttgctacttcta

SEQ ID NO: 1280350 - DNA, 22 bp, Artificial Sequence
  chemically synthesized
ttgcttgacaccttgctacttc

SEQ ID NO: 1280351 - DNA, 22 bp, Artificial Sequence
  chemically synthesized
ttcttgcttgacaccttgctac

SEQ ID NO: 1280352 - DNA, 22 bp, Artificial Sequence
  chemically synthesized
gttcttgcttgacaccttgcta

SEQ ID NO: 1280353 - DNA, 22 bp, Artificial Sequence
  chemically synthesized
tgttcttgcttgacaccttgct

SEQ ID NO: 1280354 - DNA, 22 bp, Artificial Sequence
  chemically synthesized
tgtttagaagtagcaaggtgtc

SEQ ID NO: 1280355 - DNA, 22 bp, Artificial Sequence
  chemically synthesized
gtttagaagtagcaaggtgtca

SEQ ID NO: 1280356 - DNA, 22 bp, Artificial Sequence
  chemically synthesized
tttgttcttgcttgacaccttg

SEQ ID NO: 1280357 - DNA, 22 bp, Artificial Sequence
  chemically synthesized
tttagaagtagcaaggtgtcaa

SEQ ID NO: 1280358 - DNA, 22 bp, Artificial Sequence
  chemically synthesized
agaagtagcaaggtgtcaagca

SEQ ID NO: 1280359 - DNA, 22 bp, Artificial Sequence
  chemically synthesized
gaagtagcaaggtgtcaagcaa

SEQ ID NO: 1280360 - DNA, 22 bp, Artificial Sequence
  chemically synthesized
aaatagagctctttgttcttgc

SEQ ID NO: 1280361 - DNA, 22 bp, Artificial Sequence
  chemically synthesized
gaaatagagctctttgttcttg

SEQ ID NO: 1280362 - DNA, 22 bp, Artificial Sequence
  chemically synthesized
ggtgccagagatgcttgaaata

SEQ ID NO: 1280363 - DNA, 22 bp, Artificial Sequence
  chemically synthesized
tatttcaagcatctctggcacc

SEQ ID NO: 1280364 - DNA, 22 bp, Artificial Sequence
  chemically synthesized
tttcaagcatctctggcaccca

SEQ ID NO: 1280365 - DNA, 22 bp, Artificial Sequence
  chemically synthesized
caagcatctctggcacccagtc

SEQ ID NO: 1280366 - DNA, 22 bp, Artificial Sequence
  chemically synthesized
aagcatctctggcacccagtca

SEQ ID NO: 1280367 - DNA, 22 bp, Artificial Sequence
  chemically synthesized
agatgccaaaaggccatgactg

SEQ ID NO: 1280368 - DNA, 22 bp, Artificial Sequence
  chemically synthesized
tcagatgccaaaaggccatgac

SEQ ID NO: 1280369 - DNA, 22 bp, Artificial Sequence
  chemically synthesized
tggcacccagtcatggcctttt

SEQ ID NO: 1280370 - DNA, 22 bp, Artificial Sequence
  chemically synthesized
gcacccagtcatggccttttgg

SEQ ID NO: 1280371 - DNA, 22 bp, Artificial Sequence
  chemically synthesized
tcgtcctctcagatgccaaaag

SEQ ID NO: 1280372 - DNA, 22 bp, Artificial Sequence
  chemically synthesized
gctgtcgtcctctcagatgcca

SEQ ID NO: 1280373 - DNA, 22 bp, Artificial Sequence
  chemically synthesized
ttggcatctgagaggacgacag

SEQ ID NO: 1280374 - DNA, 22 bp, Artificial Sequence
  chemically synthesized
tggcatctgagaggacgacagc

SEQ ID NO: 1280375 - DNA, 22 bp, Artificial Sequence
  chemically synthesized
ggcatctgagaggacgacagct

SEQ ID NO: 1280376 - DNA, 22 bp, Artificial Sequence
  chemically synthesized
gcatctgagaggacgacagcta

SEQ ID NO: 1280377 - DNA, 22 bp, Artificial Sequence
  chemically synthesized
tcccagaaatccctagctgtcg

SEQ ID NO: 1280378 - DNA, 22 bp, Artificial Sequence
  chemically synthesized
agaggacgacagctagggattt

SEQ ID NO: 1280379 - DNA, 22 bp, Artificial Sequence
  chemically synthesized
gggatttctgggatagttttgt

SEQ ID NO: 1280380 - DNA, 22 bp, Artificial Sequence
  chemically synthesized
ctgggatagttttgttttcctg

SEQ ID NO: 1280381 - DNA, 22 bp, Artificial Sequence
  chemically synthesized
tgggatagttttgttttcctga

SEQ ID NO: 1280382 - DNA, 22 bp, Artificial Sequence
  chemically synthesized
ggatagttttgttttcctgatg

SEQ ID NO: 1280383 - DNA, 22 bp, Artificial Sequence
  chemically synthesized
tgttttcctgatgtacatgctg

SEQ ID NO: 1280384 - DNA, 22 bp, Artificial Sequence
  chemically synthesized
gttttcctgatgtacatgctgc

SEQ ID NO: 1280385 - DNA, 22 bp, Artificial Sequence
  chemically synthesized
ttttcctgatgtacatgctgcc

SEQ ID NO: 1280386 - DNA, 22 bp, Artificial Sequence
  chemically synthesized
tcctgatgtacatgctgcctct

SEQ ID NO: 1280387 - DNA, 22 bp, Artificial Sequence
  chemically synthesized
cctgatgtacatgctgcctctt

SEQ ID NO: 1280388 - DNA, 22 bp, Artificial Sequence
  chemically synthesized
ctgatgtacatgctgcctcttc

SEQ ID NO: 1280389 - DNA, 22 bp, Artificial Sequence
  chemically synthesized
atgtacatgctgcctcttcctt

SEQ ID NO: 1280390 - DNA, 22 bp, Artificial Sequence
  chemically synthesized
cctcttccttcttcttgcttcc

SEQ ID NO: 1280391 - DNA, 22 bp, Artificial Sequence
  chemically synthesized
ttccttcttcttgcttcctttt

SEQ ID NO: 1280392 - DNA, 22 bp, Artificial Sequence
  chemically synthesized
ccttcttcttgcttcctttttc

SEQ ID NO: 1280393 - DNA, 22 bp, Artificial Sequence
  chemically synthesized
cttcttcttgcttcctttttca

SEQ ID NO: 1280394 - DNA, 22 bp, Artificial Sequence
  chemically synthesized
agagcagaaagatgaaaaagga

SEQ ID NO: 1280395 - DNA, 22 bp, Artificial Sequence
  chemically synthesized
cagagcagaaagatgaaaaagg

SEQ ID NO: 1280396 - DNA, 22 bp, Artificial Sequence
  chemically synthesized
cttcttgcttcctttttcatct

SEQ ID NO: 1280397 - DNA, 22 bp, Artificial Sequence
  chemically synthesized
ttcttgcttcctttttcatctt

SEQ ID NO: 1280398 - DNA, 22 bp, Artificial Sequence
  chemically synthesized
cttgcttcctttttcatctttc

SEQ ID NO: 1280399 - DNA, 22 bp, Artificial Sequence
  chemically synthesized
catttcagagcagaaagatgaa

SEQ ID NO: 1280400 - DNA, 22 bp, Artificial Sequence
  chemically synthesized
ttgcttcctttttcatctttct

SEQ ID NO: 1280401 - DNA, 22 bp, Artificial Sequence
  chemically synthesized
acatttcagagcagaaagatga

SEQ ID NO: 1280402 - DNA, 22 bp, Artificial Sequence
  chemically synthesized
gcttcctttttcatctttctgc

SEQ ID NO: 1280403 - DNA, 22 bp, Artificial Sequence
  chemically synthesized
cttcctttttcatctttctgct

SEQ ID NO: 1280404 - DNA, 22 bp, Artificial Sequence
  chemically synthesized
cctttttcatctttctgctctg

SEQ ID NO: 1280405 - DNA, 22 bp, Artificial Sequence
  chemically synthesized
ctttttcatctttctgctctga

SEQ ID NO: 1280406 - DNA, 22 bp, Artificial Sequence
  chemically synthesized
aagtcttacatttcagagcaga

SEQ ID NO: 1280407 - DNA, 22 bp, Artificial Sequence
  chemically synthesized
tttcatctttctgctctgaaat

SEQ ID NO: 1280408 - DNA, 22 bp, Artificial Sequence
  chemically synthesized
ttcatctttctgctctgaaatg

SEQ ID NO: 1280409 - DNA, 22 bp, Artificial Sequence
  chemically synthesized
tcatctttctgctctgaaatgt

SEQ ID NO: 1280410 - DNA, 22 bp, Artificial Sequence
  chemically synthesized
catctttctgctctgaaatgta

SEQ ID NO: 1280411 - DNA, 22 bp, Artificial Sequence
  chemically synthesized
atctttctgctctgaaatgtaa

SEQ ID NO: 1280412 - DNA, 22 bp, Artificial Sequence
  chemically synthesized
cagcctcaagtcttacatttca

SEQ ID NO: 1280413 - DNA, 22 bp, Artificial Sequence
  chemically synthesized
tctgctctgaaatgtaagactt

SEQ ID NO: 1280414 - DNA, 22 bp, Artificial Sequence
  chemically synthesized
ctgctctgaaatgtaagacttg

SEQ ID NO: 1280415 - DNA, 22 bp, Artificial Sequence
  chemically synthesized
tgctctgaaatgtaagacttga

SEQ ID NO: 1280416 - DNA, 22 bp, Artificial Sequence
  chemically synthesized
aacatctccagcctcaagtctt

SEQ ID NO: 1280417 - DNA, 22 bp, Artificial Sequence
  chemically synthesized
ctctgaaatgtaagacttgagg

SEQ ID NO: 1280418 - DNA, 22 bp, Artificial Sequence
  chemically synthesized
caacatctccagcctcaagtct

SEQ ID NO: 1280419 - DNA, 22 bp, Artificial Sequence
  chemically synthesized
tgaaatgtaagacttgaggctg

SEQ ID NO: 1280420 - DNA, 22 bp, Artificial Sequence
  chemically synthesized
aaatgtaagacttgaggctgga

SEQ ID NO: 1280421 - DNA, 22 bp, Artificial Sequence
  chemically synthesized
caagatgatggtttcaacatct

SEQ ID NO: 1280422 - DNA, 22 bp, Artificial Sequence
  chemically synthesized
gaggctggagatgttgaaacca

SEQ ID NO: 1280423 - DNA, 22 bp, Artificial Sequence
  chemically synthesized
gttgcaagatgatggtttcaac

SEQ ID NO: 1280424 - DNA, 22 bp, Artificial Sequence
  chemically synthesized
aggctggagatgttgaaaccat

SEQ ID NO: 1280425 - DNA, 22 bp, Artificial Sequence
  chemically synthesized
ggttgcaagatgatggtttcaa

SEQ ID NO: 1280426 - DNA, 22 bp, Artificial Sequence
  chemically synthesized
ttggttgcaagatgatggtttc

SEQ ID NO: 1280427 - DNA, 22 bp, Artificial Sequence
  chemically synthesized
gagatgttgaaaccatcatctt

SEQ ID NO: 1280428 - DNA, 22 bp, Artificial Sequence
  chemically synthesized
tcaactcttggttgcaagatga

SEQ ID NO: 1280429 - DNA, 22 bp, Artificial Sequence
  chemically synthesized
gtcaactcttggttgcaagatg

SEQ ID NO: 1280430 - DNA, 22 bp, Artificial Sequence
  chemically synthesized
aaaccatcatcttgcaaccaag

SEQ ID NO: 1280431 - DNA, 22 bp, Artificial Sequence
  chemically synthesized
atgcttgtcaactcttggttgc

SEQ ID NO: 1280432 - DNA, 22 bp, Artificial Sequence
  chemically synthesized
tcatgcttgtcaactcttggtt

SEQ ID NO: 1280433 - DNA, 22 bp, Artificial Sequence
  chemically synthesized
tcattctcatgcttgtcaactc

SEQ ID NO: 1280434 - DNA, 22 bp, Artificial Sequence
  chemically synthesized
ctatcattctcatgcttgtcaa

SEQ ID NO: 1280435 - DNA, 22 bp, Artificial Sequence
  chemically synthesized
gcaaccaagagttgacaagcat

SEQ ID NO: 1280436 - DNA, 22 bp, Artificial Sequence
  chemically synthesized
actatcattctcatgcttgtca

SEQ ID NO: 1280437 - DNA, 22 bp, Artificial Sequence
  chemically synthesized
caaccaagagttgacaagcatg

SEQ ID NO: 1280438 - DNA, 22 bp, Artificial Sequence
  chemically synthesized
caccttactatcattctcatgc

SEQ ID NO: 1280439 - DNA, 22 bp, Artificial Sequence
  chemically synthesized
acaccttactatcattctcatg

SEQ ID NO: 1280440 - DNA, 22 bp, Artificial Sequence
  chemically synthesized
tacaccttactatcattctcat

SEQ ID NO: 1280441 - DNA, 22 bp, Artificial Sequence
  chemically synthesized
ttacaccttactatcattctca

SEQ ID NO: 1280442 - DNA, 22 bp, Artificial Sequence
  chemically synthesized
ttttacaccttactatcattct

SEQ ID NO: 1280443 - DNA, 22 bp, Artificial Sequence
  chemically synthesized
acaagcatgagaatgatagtaa

SEQ ID NO: 1280444 - DNA, 22 bp, Artificial Sequence
  chemically synthesized
ctcttttacaccttactatcat

SEQ ID NO: 1280445 - DNA, 22 bp, Artificial Sequence
  chemically synthesized
gctcttttacaccttactatca

SEQ ID NO: 1280446 - DNA, 22 bp, Artificial Sequence
  chemically synthesized
ttgctcttttacaccttactat

SEQ ID NO: 1280447 - DNA, 22 bp, Artificial Sequence
  chemically synthesized
cttgctcttttacaccttacta

SEQ ID NO: 1280448 - DNA, 22 bp, Artificial Sequence
  chemically synthesized
atcttcttgctcttttacacct

SEQ ID NO: 1280449 - DNA, 22 bp, Artificial Sequence
  chemically synthesized
gatcttcttgctcttttacacc

SEQ ID NO: 1280450 - DNA, 22 bp, Artificial Sequence
  chemically synthesized
tgatcttcttgctcttttacac

SEQ ID NO: 1280451 - DNA, 22 bp, Artificial Sequence
  chemically synthesized
tgatggcatgaaaatcccaggc

SEQ ID NO: 1280452 - DNA, 22 bp, Artificial Sequence
  chemically synthesized
gccctgtgatggcatgaaaatc

SEQ ID NO: 1280453 - DNA, 22 bp, Artificial Sequence
  chemically synthesized
ggattttcatgccatcacaggg

SEQ ID NO: 1280454 - DNA, 22 bp, Artificial Sequence
  chemically synthesized
aagcaagaaactggccctgtga

SEQ ID NO: 1280455 - DNA, 22 bp, Artificial Sequence
  chemically synthesized
tcatgccatcacagggccagtt

SEQ ID NO: 1280456 - DNA, 22 bp, Artificial Sequence
  chemically synthesized
catgccatcacagggccagttt

SEQ ID NO: 1280457 - DNA, 22 bp, Artificial Sequence
  chemically synthesized
atgccatcacagggccagtttc

SEQ ID NO: 1280458 - DNA, 22 bp, Artificial Sequence
  chemically synthesized
aaggaatggagtctaaagcaag

SEQ ID NO: 1280459 - DNA, 22 bp, Artificial Sequence
  chemically synthesized
cttgctttagactccattcctt

SEQ ID NO: 1280460 - DNA, 22 bp, Artificial Sequence
  chemically synthesized
ttgctttagactccattccttc

SEQ ID NO: 1280461 - DNA, 22 bp, Artificial Sequence
  chemically synthesized
gctttagactccattccttcag

SEQ ID NO: 1280462 - DNA, 22 bp, Artificial Sequence
  chemically synthesized
atatgatggaatctgaaggaat

SEQ ID NO: 1280463 - DNA, 22 bp, Artificial Sequence
  chemically synthesized
ctttagactccattccttcaga

SEQ ID NO: 1280464 - DNA, 22 bp, Artificial Sequence
  chemically synthesized
tcatatgatggaatctgaagga

SEQ ID NO: 1280465 - DNA, 22 bp, Artificial Sequence
  chemically synthesized
ctcatatgatggaatctgaagg

SEQ ID NO: 1280466 - DNA, 22 bp, Artificial Sequence
  chemically synthesized
tagactccattccttcagattc

SEQ ID NO: 1280467 - DNA, 22 bp, Artificial Sequence
  chemically synthesized
tctcatatgatggaatctgaag

SEQ ID NO: 1280468 - DNA, 22 bp, Artificial Sequence
  chemically synthesized
agactccattccttcagattcc

SEQ ID NO: 1280469 - DNA, 22 bp, Artificial Sequence
  chemically synthesized
gactccattccttcagattcca

SEQ ID NO: 1280470 - DNA, 22 bp, Artificial Sequence
  chemically synthesized
actttctcatatgatggaatct

SEQ ID NO: 1280471 - DNA, 22 bp, Artificial Sequence
  chemically synthesized
aactttctcatatgatggaatc

SEQ ID NO: 1280472 - DNA, 22 bp, Artificial Sequence
  chemically synthesized
taactttctcatatgatggaat

SEQ ID NO: 1280473 - DNA, 22 bp, Artificial Sequence
  chemically synthesized
cattccttcagattccatcata

SEQ ID NO: 1280474 - DNA, 22 bp, Artificial Sequence
  chemically synthesized
cttcagattccatcatatgaga

SEQ ID NO: 1280475 - DNA, 22 bp, Artificial Sequence
  chemically synthesized
cagattccatcatatgagaaag

SEQ ID NO: 1280476 - DNA, 22 bp, Artificial Sequence
  chemically synthesized
agattccatcatatgagaaagt

SEQ ID NO: 1280477 - DNA, 22 bp, Artificial Sequence
  chemically synthesized
gaaccagaggattttaactttc

SEQ ID NO: 1280478 - DNA, 22 bp, Artificial Sequence
  chemically synthesized
catcatatgagaaagttaaaat

SEQ ID NO: 1280479 - DNA, 22 bp, Artificial Sequence
  chemically synthesized
aaatcctctggttctagtttct

SEQ ID NO: 1280480 - DNA, 22 bp, Artificial Sequence
  chemically synthesized
catcgaagtagcagaaactaga

SEQ ID NO: 1280481 - DNA, 22 bp, Artificial Sequence
  chemically synthesized
gcatcgaagtagcagaaactag

SEQ ID NO: 1280482 - DNA, 22 bp, Artificial Sequence
  chemically synthesized
tgcatcgaagtagcagaaacta

SEQ ID NO: 1280483 - DNA, 22 bp, Artificial Sequence
  chemically synthesized
ttgcatcgaagtagcagaaact

SEQ ID NO: 1280484 - DNA, 22 bp, Artificial Sequence
  chemically synthesized
tggttctagtttctgctacttc

SEQ ID NO: 1280485 - DNA, 22 bp, Artificial Sequence
  chemically synthesized
catttttgcatcgaagtagcag

SEQ ID NO: 1280486 - DNA, 22 bp, Artificial Sequence
  chemically synthesized
gttctagtttctgctacttcga

SEQ ID NO: 1280487 - DNA, 22 bp, Artificial Sequence
  chemically synthesized
tagtttctgctacttcgatgca

SEQ ID NO: 1280488 - DNA, 22 bp, Artificial Sequence
  chemically synthesized
gtttctgctacttcgatgcaaa

SEQ ID NO: 1280489 - DNA, 22 bp, Artificial Sequence
  chemically synthesized
ctgctacttcgatgcaaaaatg

SEQ ID NO: 1280490 - DNA, 22 bp, Artificial Sequence
  chemically synthesized
tgctacttcgatgcaaaaatgc

SEQ ID NO: 1280491 - DNA, 22 bp, Artificial Sequence
  chemically synthesized
ctacttcgatgcaaaaatgcaa

SEQ ID NO: 1280492 - DNA, 22 bp, Artificial Sequence
  chemically synthesized
cttcgatgcaaaaatgcaatcc

SEQ ID NO: 1280493 - DNA, 22 bp, Artificial Sequence
  chemically synthesized
cgatgcaaaaatgcaatccctg

SEQ ID NO: 1280494 - DNA, 22 bp, Artificial Sequence
  chemically synthesized
gatgcaaaaatgcaatccctgg

SEQ ID NO: 1280495 - DNA, 22 bp, Artificial Sequence
  chemically synthesized
caagcatgagccaccgtgccag

SEQ ID NO: 1280496 - DNA, 22 bp, Artificial Sequence
  chemically synthesized
ggattacaagcatgagccaccg

SEQ ID NO: 1280497 - DNA, 22 bp, Artificial Sequence
  chemically synthesized
gcctggcacggtggctcatgct

SEQ ID NO: 1280498 - DNA, 22 bp, Artificial Sequence
  chemically synthesized
gcacggtggctcatgcttgtaa

SEQ ID NO: 1280499 - DNA, 22 bp, Artificial Sequence
  chemically synthesized
ccaaagtgctaggattacaagc

SEQ ID NO: 1280500 - DNA, 22 bp, Artificial Sequence
  chemically synthesized
ggcctcccaaagtgctaggatt

SEQ ID NO: 1280501 - DNA, 22 bp, Artificial Sequence
  chemically synthesized
atgcttgtaatcctagcacttt

SEQ ID NO: 1280502 - DNA, 22 bp, Artificial Sequence
  chemically synthesized
cctcggcctcccaaagtgctag

SEQ ID NO: 1280503 - DNA, 22 bp, Artificial Sequence
  chemically synthesized
gtaatcctagcactttgggagg

SEQ ID NO: 1280504 - DNA, 22 bp, Artificial Sequence
  chemically synthesized
taatcctagcactttgggaggc

SEQ ID NO: 1280505 - DNA, 22 bp, Artificial Sequence
  chemically synthesized
aaatgatccacctacctcggcc

SEQ ID NO: 1280506 - DNA, 22 bp, Artificial Sequence
  chemically synthesized
gcactttgggaggccgaggtag

SEQ ID NO: 1280507 - DNA, 22 bp, Artificial Sequence
  chemically synthesized
acctcaaatgatccacctacct

SEQ ID NO: 1280508 - DNA, 22 bp, Artificial Sequence
  chemically synthesized
tgggaggccgaggtaggtggat

SEQ ID NO: 1280509 - DNA, 22 bp, Artificial Sequence
  chemically synthesized
tgacctcaaatgatccacctac

SEQ ID NO: 1280510 - DNA, 22 bp, Artificial Sequence
  chemically synthesized
gggaggccgaggtaggtggatc

SEQ ID NO: 1280511 - DNA, 22 bp, Artificial Sequence
  chemically synthesized
ctgacctcaaatgatccaccta

SEQ ID NO: 1280512 - DNA, 22 bp, Artificial Sequence
  chemically synthesized
ggaggccgaggtaggtggatca

SEQ ID NO: 1280513 - DNA, 22 bp, Artificial Sequence
  chemically synthesized
gtcacaaacttctgacctcaaa

SEQ ID NO: 1280514 - DNA, 22 bp, Artificial Sequence
  chemically synthesized
gccagactggtcacaaacttct

SEQ ID NO: 1280515 - DNA, 22 bp, Artificial Sequence
  chemically synthesized
gaggtcagaagtttgtgaccag

SEQ ID NO: 1280516 - DNA, 22 bp, Artificial Sequence
  chemically synthesized
aggtcagaagtttgtgaccagt

SEQ ID NO: 1280517 - DNA, 22 bp, Artificial Sequence
  chemically synthesized
accatgttggccagactggtca

SEQ ID NO: 1280518 - DNA, 22 bp, Artificial Sequence
  chemically synthesized
caccatgttggccagactggtc

SEQ ID NO: 1280519 - DNA, 22 bp, Artificial Sequence
  chemically synthesized
gtgaccagtctggccaacatgg

SEQ ID NO: 1280520 - DNA, 22 bp, Artificial Sequence
  chemically synthesized
tgaccagtctggccaacatggt

SEQ ID NO: 1280521 - DNA, 22 bp, Artificial Sequence
  chemically synthesized
gtagagatggggtttcaccatg

SEQ ID NO: 1280522 - DNA, 22 bp, Artificial Sequence
  chemically synthesized
agtagagatggggtttcaccat

SEQ ID NO: 1280523 - DNA, 22 bp, Artificial Sequence
  chemically synthesized
tagtagagatggggtttcacca

SEQ ID NO: 1280524 - DNA, 22 bp, Artificial Sequence
  chemically synthesized
ttagtagagatggggtttcacc

SEQ ID NO: 1280525 - DNA, 22 bp, Artificial Sequence
  chemically synthesized
gccaacatggtgaaaccccatc

SEQ ID NO: 1280526 - DNA, 22 bp, Artificial Sequence
  chemically synthesized
tatttttagtagagatggggtt

SEQ ID NO: 1280527 - DNA, 22 bp, Artificial Sequence
  chemically synthesized
gtatttttagtagagatggggt

SEQ ID NO: 1280528 - DNA, 22 bp, Artificial Sequence
  chemically synthesized
tgtatttttagtagagatgggg

SEQ ID NO: 1280529 - DNA, 22 bp, Artificial Sequence
  chemically synthesized
ttgtatttttagtagagatggg

SEQ ID NO: 1280530 - DNA, 22 bp, Artificial Sequence
  chemically synthesized
atttttgtatttttagtagaga

SEQ ID NO: 1280531 - DNA, 22 bp, Artificial Sequence
  chemically synthesized
tactaaaaatacaaaaattagc

SEQ ID NO: 1280532 - DNA, 22 bp, Artificial Sequence
  chemically synthesized
ctaaaaatacaaaaattagctg

SEQ ID NO: 1280533 - DNA, 22 bp, Artificial Sequence
  chemically synthesized
cgccaccacacccagctaattt

SEQ ID NO: 1280534 - DNA, 22 bp, Artificial Sequence
  chemically synthesized
gcgccaccacacccagctaatt

SEQ ID NO: 1280535 - DNA, 22 bp, Artificial Sequence
  chemically synthesized
aaaatacaaaaattagctgggt

SEQ ID NO: 1280536 - DNA, 22 bp, Artificial Sequence
  chemically synthesized
caggcttgcgccaccacaccca

SEQ ID NO: 1280537 - DNA, 22 bp, Artificial Sequence
  chemically synthesized
ggattacaggcttgcgccacca

SEQ ID NO: 1280538 - DNA, 22 bp, Artificial Sequence
  chemically synthesized
gctgggtgtggtggcgcaagcc

SEQ ID NO: 1280539 - DNA, 22 bp, Artificial Sequence
  chemically synthesized
ggtgtggtggcgcaagcctgta

SEQ ID NO: 1280540 - DNA, 22 bp, Artificial Sequence
  chemically synthesized
ccgagtagctgggattacaggc

SEQ ID NO: 1280541 - DNA, 22 bp, Artificial Sequence
  chemically synthesized
agcctcccgagtagctgggatt

SEQ ID NO: 1280542 - DNA, 22 bp, Artificial Sequence
  chemically synthesized
cctcagcctcccgagtagctgg

SEQ ID NO: 1280543 - DNA, 22 bp, Artificial Sequence
  chemically synthesized
ctgcctcagcctcccgagtagc

SEQ ID NO: 1280544 - DNA, 22 bp, Artificial Sequence
  chemically synthesized
tcctgcctcagcctcccgagta

SEQ ID NO: 1280545 - DNA, 22 bp, Artificial Sequence
  chemically synthesized
taatcccagctactcgggaggc

SEQ ID NO: 1280546 - DNA, 22 bp, Artificial Sequence
  chemically synthesized
aagcgattctcctgcctcagcc

SEQ ID NO: 1280547 - DNA, 22 bp, Artificial Sequence
  chemically synthesized
caagcgattctcctgcctcagc

SEQ ID NO: 1280548 - DNA, 22 bp, Artificial Sequence
  chemically synthesized
ctcgggaggctgaggcaggaga

SEQ ID NO: 1280549 - DNA, 22 bp, Artificial Sequence
  chemically synthesized
gggaggctgaggcaggagaatc

SEQ ID NO: 1280550 - DNA, 22 bp, Artificial Sequence
  chemically synthesized
ccagcttcaagcgattctcctg

SEQ ID NO: 1280551 - DNA, 22 bp, Artificial Sequence
  chemically synthesized
cgcctcccagcttcaagcgatt

SEQ ID NO: 1280552 - DNA, 22 bp, Artificial Sequence
  chemically synthesized
aggcaggagaatcgcttgaagc

SEQ ID NO: 1280553 - DNA, 22 bp, Artificial Sequence
  chemically synthesized
caacctccgcctcccagcttca

SEQ ID NO: 1280554 - DNA, 22 bp, Artificial Sequence
  chemically synthesized
actgcaacctccgcctcccagc

SEQ ID NO: 1280555 - DNA, 22 bp, Artificial Sequence
  chemically synthesized
aattcactgcaacctccgcctc

SEQ ID NO: 1280556 - DNA, 22 bp, Artificial Sequence
  chemically synthesized
gaagctgggaggcggaggttgc

SEQ ID NO: 1280557 - DNA, 22 bp, Artificial Sequence
  chemically synthesized
aagctgggaggcggaggttgca

SEQ ID NO: 1280558 - DNA, 22 bp, Artificial Sequence
  chemically synthesized
ggaggcggaggttgcagtgaat

SEQ ID NO: 1280559 - DNA, 22 bp, Artificial Sequence
  chemically synthesized
gagtgcagaggcgcgatctcaa

SEQ ID NO: 1280560 - DNA, 22 bp, Artificial Sequence
  chemically synthesized
cagtgaattgagatcgcgcctc

SEQ ID NO: 1280561 - DNA, 22 bp, Artificial Sequence
  chemically synthesized
ccaaagctggagtgcagaggcg

SEQ ID NO: 1280562 - DNA, 22 bp, Artificial Sequence
  chemically synthesized
ttaccaaagctggagtgcagag

SEQ ID NO: 1280563 - DNA, 22 bp, Artificial Sequence
  chemically synthesized
tattaccaaagctggagtgcag

SEQ ID NO: 1280564 - DNA, 22 bp, Artificial Sequence
  chemically synthesized
agatcgcgcctctgcactccag

SEQ ID NO: 1280565 - DNA, 22 bp, Artificial Sequence
  chemically synthesized
gttctattaccaaagctggagt

SEQ ID NO: 1280566 - DNA, 22 bp, Artificial Sequence
  chemically synthesized
tgcactccagctttggtaatag

SEQ ID NO: 1280567 - DNA, 22 bp, Artificial Sequence
  chemically synthesized
cactccagctttggtaatagaa

SEQ ID NO: 1280568 - DNA, 22 bp, Artificial Sequence
  chemically synthesized
agacgagtctcgttctattacc

SEQ ID NO: 1280569 - DNA, 22 bp, Artificial Sequence
  chemically synthesized
gagacgagtctcgttctattac

SEQ ID NO: 1280570 - DNA, 22 bp, Artificial Sequence
  chemically synthesized
tgagacgagtctcgttctatta

SEQ ID NO: 1280571 - DNA, 22 bp, Artificial Sequence
  chemically synthesized
ttgagacgagtctcgttctatt

SEQ ID NO: 1280572 - DNA, 22 bp, Artificial Sequence
  chemically synthesized
tttgagacgagtctcgttctat

SEQ ID NO: 1280573 - DNA, 22 bp, Artificial Sequence
  chemically synthesized
cagctttggtaatagaacgaga

SEQ ID NO: 1280574 - DNA, 22 bp, Artificial Sequence
  chemically synthesized
ttttgagacgagtctcgttcta

SEQ ID NO: 1280575 - DNA, 22 bp, Artificial Sequence
  chemically synthesized
tttttgagacgagtctcgttct

SEQ ID NO: 1280576 - DNA, 22 bp, Artificial Sequence
  chemically synthesized
ttttttgagacgagtctcgttc

SEQ ID NO: 1280577 - DNA, 22 bp, Artificial Sequence
  chemically synthesized
tttttttgagacgagtctcgtt

SEQ ID NO: 1280578 - DNA, 22 bp, Artificial Sequence
  chemically synthesized
ttttttttgagacgagtctcgt

SEQ ID NO: 1280579 - DNA, 22 bp, Artificial Sequence
  chemically synthesized
tttttttttgagacgagtctcg

SEQ ID NO: 1280580 - DNA, 22 bp, Artificial Sequence
  chemically synthesized
tggtaatagaacgagactcgtc

SEQ ID NO: 1280581 - DNA, 22 bp, Artificial Sequence
  chemically synthesized
ttttttttttgagacgagtctc

SEQ ID NO: 1280582 - DNA, 22 bp, Artificial Sequence
  chemically synthesized
ggtaatagaacgagactcgtct

SEQ ID NO: 1280583 - DNA, 22 bp, Artificial Sequence
  chemically synthesized
gtaatagaacgagactcgtctc

SEQ ID NO: 1280584 - DNA, 22 bp, Artificial Sequence
  chemically synthesized
tatttttttttttttgagacga

SEQ ID NO: 1280585 - DNA, 22 bp, Artificial Sequence
  chemically synthesized
caagtgagggttgtattttttt

SEQ ID NO: 1280586 - DNA, 22 bp, Artificial Sequence
  chemically synthesized
gtctcaaaaaaaaaaaaataca

SEQ ID NO: 1280587 - DNA, 22 bp, Artificial Sequence
  chemically synthesized
aaaaaaaaaaaaatacaaccct

SEQ ID NO: 1280588 - DNA, 22 bp, Artificial Sequence
  chemically synthesized
agaggaactgcaagtgagggtt

SEQ ID NO: 1280589 - DNA, 22 bp, Artificial Sequence
  chemically synthesized
acttgcagttcctctcaactgg

SEQ ID NO: 1280590 - DNA, 22 bp, Artificial Sequence
  chemically synthesized
gcagttcctctcaactgggcac

SEQ ID NO: 1280591 - DNA, 22 bp, Artificial Sequence
  chemically synthesized
cagttcctctcaactgggcaca

SEQ ID NO: 1280592 - DNA, 22 bp, Artificial Sequence
  chemically synthesized
ctctcaactgggcacaccacca

SEQ ID NO: 1280593 - DNA, 22 bp, Artificial Sequence
  chemically synthesized
tcaactgggcacaccaccatac

SEQ ID NO: 1280594 - DNA, 22 bp, Artificial Sequence
  chemically synthesized
aatgtacccagggtatggtggt

SEQ ID NO: 1280595 - DNA, 22 bp, Artificial Sequence
  chemically synthesized
aaatgtacccagggtatggtgg

SEQ ID NO: 1280596 - DNA, 22 bp, Artificial Sequence
  chemically synthesized
aactgggcacaccaccataccc

SEQ ID NO: 1280597 - DNA, 22 bp, Artificial Sequence
  chemically synthesized
ttaaatgtacccagggtatggt

SEQ ID NO: 1280598 - DNA, 22 bp, Artificial Sequence
  chemically synthesized
cttaaatgtacccagggtatgg

SEQ ID NO: 1280599 - DNA, 22 bp, Artificial Sequence
  chemically synthesized
ggcacaccaccataccctgggt

SEQ ID NO: 1280600 - DNA, 22 bp, Artificial Sequence
  chemically synthesized
acgtttcttaaatgtacccagg

SEQ ID NO: 1280601 - DNA, 22 bp, Artificial Sequence
  chemically synthesized
cacgtttcttaaatgtacccag

SEQ ID NO: 1280602 - DNA, 22 bp, Artificial Sequence
  chemically synthesized
tcacgtttcttaaatgtaccca

SEQ ID NO: 1280603 - DNA, 22 bp, Artificial Sequence
  chemically synthesized
ggtacatttaagaaacgtgaaa

SEQ ID NO: 1280604 - DNA, 22 bp, Artificial Sequence
  chemically synthesized
tggggacaatcacagtgctttc

SEQ ID NO: 1280605 - DNA, 22 bp, Artificial Sequence
  chemically synthesized
aagaaacgtgaaagcactgtga

SEQ ID NO: 1280606 - DNA, 22 bp, Artificial Sequence
  chemically synthesized
agaaacgtgaaagcactgtgat

SEQ ID NO: 1280607 - DNA, 22 bp, Artificial Sequence
  chemically synthesized
catccgttatggggacaatcac

SEQ ID NO: 1280608 - DNA, 22 bp, Artificial Sequence
  chemically synthesized
ccatccgttatggggacaatca

SEQ ID NO: 1280609 - DNA, 22 bp, Artificial Sequence
  chemically synthesized
tccatccgttatggggacaatc

SEQ ID NO: 1280610 - DNA, 22 bp, Artificial Sequence
  chemically synthesized
gagcacctttccatccgttatg

SEQ ID NO: 1280611 - DNA, 22 bp, Artificial Sequence
  chemically synthesized
agagcacctttccatccgttat

SEQ ID NO: 1280612 - DNA, 22 bp, Artificial Sequence
  chemically synthesized
tgattgtccccataacggatgg

SEQ ID NO: 1280613 - DNA, 22 bp, Artificial Sequence
  chemically synthesized
tccccataacggatggaaaggt

SEQ ID NO: 1280614 - DNA, 22 bp, Artificial Sequence
  chemically synthesized
gcgtccttagagcacctttcca

SEQ ID NO: 1280615 - DNA, 22 bp, Artificial Sequence
  chemically synthesized
gatgtctggcgtccttagagca

SEQ ID NO: 1280616 - DNA, 22 bp, Artificial Sequence
  chemically synthesized
ctggatgtctggcgtccttaga

SEQ ID NO: 1280617 - DNA, 22 bp, Artificial Sequence
  chemically synthesized
cgtgttactggatgtctggcgt

SEQ ID NO: 1280618 - DNA, 22 bp, Artificial Sequence
  chemically synthesized
ctgcgtgttactggatgtctgg

SEQ ID NO: 1280619 - DNA, 22 bp, Artificial Sequence
  chemically synthesized
cctgcgtgttactggatgtctg

SEQ ID NO: 1280620 - DNA, 22 bp, Artificial Sequence
  chemically synthesized
tcctgcgtgttactggatgtct

SEQ ID NO: 1280621 - DNA, 22 bp, Artificial Sequence
  chemically synthesized
taaggacgccagacatccagta

SEQ ID NO: 1280622 - DNA, 22 bp, Artificial Sequence
  chemically synthesized
aggacgccagacatccagtaac

SEQ ID NO: 1280623 - DNA, 22 bp, Artificial Sequence
  chemically synthesized
gactttcctgcgtgttactgga

SEQ ID NO: 1280624 - DNA, 22 bp, Artificial Sequence
  chemically synthesized
ctggactttcctgcgtgttact

SEQ ID NO: 1280625 - DNA, 22 bp, Artificial Sequence
  chemically synthesized
cctggactttcctgcgtgttac

SEQ ID NO: 1280626 - DNA, 22 bp, Artificial Sequence
  chemically synthesized
tcctggactttcctgcgtgtta

SEQ ID NO: 1280627 - DNA, 22 bp, Artificial Sequence
  chemically synthesized
attttcctggactttcctgcgt

SEQ ID NO: 1280628 - DNA, 22 bp, Artificial Sequence
  chemically synthesized
ctcattttcctggactttcctg

SEQ ID NO: 1280629 - DNA, 22 bp, Artificial Sequence
  chemically synthesized
aataggacatgaaacaattact

SEQ ID NO: 1280630 - DNA, 22 bp, Artificial Sequence
  chemically synthesized
aaaagctgaataggacatgaaa

SEQ ID NO: 1280631 - DNA, 22 bp, Artificial Sequence
  chemically synthesized
caaaagctgaataggacatgaa

SEQ ID NO: 1280632 - DNA, 22 bp, Artificial Sequence
  chemically synthesized
tcaaaagctgaataggacatga

SEQ ID NO: 1280633 - DNA, 22 bp, Artificial Sequence
  chemically synthesized
ttcaaaagctgaataggacatg

SEQ ID NO: 1280634 - DNA, 22 bp, Artificial Sequence
  chemically synthesized
cttttcaaaagctgaataggac

SEQ ID NO: 1280635 - DNA, 22 bp, Artificial Sequence
  chemically synthesized
tttcatgtcctattcagctttt

SEQ ID NO: 1280636 - DNA, 22 bp, Artificial Sequence
  chemically synthesized
tcccctacttttcaaaagctga

SEQ ID NO: 1280637 - DNA, 22 bp, Artificial Sequence
  chemically synthesized
catgtcctattcagcttttgaa

SEQ ID NO: 1280638 - DNA, 22 bp, Artificial Sequence
  chemically synthesized
atgtcctattcagcttttgaaa

SEQ ID NO: 1280639 - DNA, 22 bp, Artificial Sequence
  chemically synthesized
ttcagcttttgaaaagtagggg

SEQ ID NO: 1280640 - DNA, 22 bp, Artificial Sequence
  chemically synthesized
taaacaggctgtcccctacttt

SEQ ID NO: 1280641 - DNA, 22 bp, Artificial Sequence
  chemically synthesized
ataaacaggctgtcccctactt

SEQ ID NO: 1280642 - DNA, 22 bp, Artificial Sequence
  chemically synthesized
agcttttgaaaagtaggggaca

SEQ ID NO: 1280643 - DNA, 22 bp, Artificial Sequence
  chemically synthesized
ttgaaaagtaggggacagcctg

SEQ ID NO: 1280644 - DNA, 22 bp, Artificial Sequence
  chemically synthesized
tgaaaagtaggggacagcctgt

SEQ ID NO: 1280645 - DNA, 22 bp, Artificial Sequence
  chemically synthesized
acatacttataaacaggctgtc

SEQ ID NO: 1280646 - DNA, 22 bp, Artificial Sequence
  chemically synthesized
gaaaagtaggggacagcctgtt

SEQ ID NO: 1280647 - DNA, 22 bp, Artificial Sequence
  chemically synthesized
aaaagtaggggacagcctgttt

SEQ ID NO: 1280648 - DNA, 22 bp, Artificial Sequence
  chemically synthesized
tatattcacatacttataaaca

SEQ ID NO: 1280649 - DNA, 22 bp, Artificial Sequence
  chemically synthesized
tatatattcacatacttataaa

SEQ ID NO: 1280650 - DNA, 22 bp, Artificial Sequence
  chemically synthesized
ggttctatatattcacatactt

SEQ ID NO: 1280651 - DNA, 22 bp, Artificial Sequence
  chemically synthesized
agctaggttctatatattcaca

SEQ ID NO: 1280652 - DNA, 22 bp, Artificial Sequence
  chemically synthesized
tttataagtatgtgaatatata

SEQ ID NO: 1280653 - DNA, 22 bp, Artificial Sequence
  chemically synthesized
ataagtatgtgaatatatagaa

SEQ ID NO: 1280654 - DNA, 22 bp, Artificial Sequence
  chemically synthesized
taagtatgtgaatatatagaac

SEQ ID NO: 1280655 - DNA, 22 bp, Artificial Sequence
  chemically synthesized
tatgtaaaattgagctaggttc

SEQ ID NO: 1280656 - DNA, 22 bp, Artificial Sequence
  chemically synthesized
atatgtaaaattgagctaggtt

SEQ ID NO: 1280657 - DNA, 22 bp, Artificial Sequence
  chemically synthesized
tatttatatgtaaaattgagct

SEQ ID NO: 1280658 - DNA, 22 bp, Artificial Sequence
  chemically synthesized
gtatttatatgtaaaattgagc

SEQ ID NO: 1280659 - DNA, 22 bp, Artificial Sequence
  chemically synthesized
tgtatttatatgtaaaattgag

SEQ ID NO: 1280660 - DNA, 22 bp, Artificial Sequence
  chemically synthesized
gctcaattttacatataaatac

SEQ ID NO: 1280661 - DNA, 22 bp, Artificial Sequence
  chemically synthesized
aattttacatataaatacaaag

SEQ ID NO: 1280662 - DNA, 22 bp, Artificial Sequence
  chemically synthesized
tacatataaatacaaagtcttt

SEQ ID NO: 1280663 - DNA, 22 bp, Artificial Sequence
  chemically synthesized
acatataaatacaaagtcttta

SEQ ID NO: 1280664 - DNA, 22 bp, Artificial Sequence
  chemically synthesized
catataaatacaaagtctttat

SEQ ID NO: 1280665 - DNA, 22 bp, Artificial Sequence
  chemically synthesized
gaaaatgcagtgcatataaaga

SEQ ID NO: 1280666 - DNA, 22 bp, Artificial Sequence
  chemically synthesized
ggaaaatgcagtgcatataaag

SEQ ID NO: 1280667 - DNA, 22 bp, Artificial Sequence
  chemically synthesized
ttggaaaatgcagtgcatataa

SEQ ID NO: 1280668 - DNA, 22 bp, Artificial Sequence
  chemically synthesized
attcttggaaaatgcagtgcat

SEQ ID NO: 1280669 - DNA, 22 bp, Artificial Sequence
  chemically synthesized
cattcttggaaaatgcagtgca

SEQ ID NO: 1280670 - DNA, 22 bp, Artificial Sequence
  chemically synthesized
tatatgcactgcattttccaag

SEQ ID NO: 1280671 - DNA, 22 bp, Artificial Sequence
  chemically synthesized
atatgcactgcattttccaaga

SEQ ID NO: 1280672 - DNA, 22 bp, Artificial Sequence
  chemically synthesized
tatgcactgcattttccaagaa

SEQ ID NO: 1280673 - DNA, 22 bp, Artificial Sequence
  chemically synthesized
tgggatagtttcattcttggaa

SEQ ID NO: 1280674 - DNA, 22 bp, Artificial Sequence
  chemically synthesized
ttgtgggatagtttcattcttg

SEQ ID NO: 1280675 - DNA, 22 bp, Artificial Sequence
  chemically synthesized
attgtgggatagtttcattctt

SEQ ID NO: 1280676 - DNA, 22 bp, Artificial Sequence
  chemically synthesized
cattttccaagaatgaaactat

SEQ ID NO: 1280677 - DNA, 22 bp, Artificial Sequence
  chemically synthesized
atttattgtgggatagtttcat

SEQ ID NO: 1280678 - DNA, 22 bp, Artificial Sequence
  chemically synthesized
gatttattgtgggatagtttca

SEQ ID NO: 1280679 - DNA, 22 bp, Artificial Sequence
  chemically synthesized
tgatttattgtgggatagtttc

SEQ ID NO: 1280680 - DNA, 22 bp, Artificial Sequence
  chemically synthesized
tccaagaatgaaactatcccac

SEQ ID NO: 1280681 - DNA, 22 bp, Artificial Sequence
  chemically synthesized
ccaagaatgaaactatcccaca

SEQ ID NO: 1280682 - DNA, 22 bp, Artificial Sequence
  chemically synthesized
cctttgatttattgtgggatag

SEQ ID NO: 1280683 - DNA, 22 bp, Artificial Sequence
  chemically synthesized
caagaatgaaactatcccacaa

SEQ ID NO: 1280684 - DNA, 22 bp, Artificial Sequence
  chemically synthesized
ccctttgatttattgtgggata

SEQ ID NO: 1280685 - DNA, 22 bp, Artificial Sequence
  chemically synthesized
tccctttgatttattgtgggat

SEQ ID NO: 1280686 - DNA, 22 bp, Artificial Sequence
  chemically synthesized
tcccacaataaatcaaagggaa

SEQ ID NO: 1280687 - DNA, 22 bp, Artificial Sequence
  chemically synthesized
aataaaataagtgcacattttc

SEQ ID NO: 1280688 - DNA, 22 bp, Artificial Sequence
  chemically synthesized
tgaataaaataagtgcacattt

SEQ ID NO: 1280689 - DNA, 22 bp, Artificial Sequence
  chemically synthesized
gtaaagttctgaataaaataag

SEQ ID NO: 1280690 - DNA, 22 bp, Artificial Sequence
  chemically synthesized
ggtaaagttctgaataaaataa

SEQ ID NO: 1280691 - DNA, 22 bp, Artificial Sequence
  chemically synthesized
ataacatttggtaaagttctga

SEQ ID NO: 1280692 - DNA, 22 bp, Artificial Sequence
  chemically synthesized
attttattcagaactttaccaa

SEQ ID NO: 1280693 - DNA, 22 bp, Artificial Sequence
  chemically synthesized
ttttattcagaactttaccaaa

SEQ ID NO: 1280694 - DNA, 22 bp, Artificial Sequence
  chemically synthesized
tatgattaataacatttggtaa

SEQ ID NO: 1280695 - DNA, 22 bp, Artificial Sequence
  chemically synthesized
tattcagaactttaccaaatgt

SEQ ID NO: 1280696 - DNA, 22 bp, Artificial Sequence
  chemically synthesized
attcagaactttaccaaatgtt

SEQ ID NO: 1280697 - DNA, 22 bp, Artificial Sequence
  chemically synthesized
tgtatgattaataacatttggt

SEQ ID NO: 1280698 - DNA, 22 bp, Artificial Sequence
  chemically synthesized
ttcagaactttaccaaatgtta

SEQ ID NO: 1280699 - DNA, 22 bp, Artificial Sequence
  chemically synthesized
ctgtatgattaataacatttgg

SEQ ID NO: 1280700 - DNA, 22 bp, Artificial Sequence
  chemically synthesized
tctgtatgattaataacatttg

SEQ ID NO: 1280701 - DNA, 22 bp, Artificial Sequence
  chemically synthesized
ttctgtatgattaataacattt

SEQ ID NO: 1280702 - DNA, 22 bp, Artificial Sequence
  chemically synthesized
agaactttaccaaatgttatta

SEQ ID NO: 1280703 - DNA, 22 bp, Artificial Sequence
  chemically synthesized
taccaaatgttattaatcatac

SEQ ID NO: 1280704 - DNA, 22 bp, Artificial Sequence
  chemically synthesized
accaaatgttattaatcataca

SEQ ID NO: 1280705 - DNA, 22 bp, Artificial Sequence
  chemically synthesized
ccaaatgttattaatcatacag

SEQ ID NO: 1280706 - DNA, 22 bp, Artificial Sequence
  chemically synthesized
aagtaatgggatttttctgtat

SEQ ID NO: 1280707 - DNA, 22 bp, Artificial Sequence
  chemically synthesized
aaagtaatgggatttttctgta

SEQ ID NO: 1280708 - DNA, 22 bp, Artificial Sequence
  chemically synthesized
taaagtaatgggatttttctgt

SEQ ID NO: 1280709 - DNA, 22 bp, Artificial Sequence
  chemically synthesized
ttaatcatacagaaaaatccca

SEQ ID NO: 1280710 - DNA, 22 bp, Artificial Sequence
  chemically synthesized
atcatacagaaaaatcccatta

SEQ ID NO: 1280711 - DNA, 22 bp, Artificial Sequence
  chemically synthesized
aaatgccatgaacagcatattt

SEQ ID NO: 1280712 - DNA, 22 bp, Artificial Sequence
  chemically synthesized
ctttaaaatatgctgttcatgg

SEQ ID NO: 1280713 - DNA, 22 bp, Artificial Sequence
  chemically synthesized
taaaatatgctgttcatggcat

SEQ ID NO: 1280714 - DNA, 22 bp, Artificial Sequence
  chemically synthesized
aaaatatgctgttcatggcatt

SEQ ID NO: 1280715 - DNA, 22 bp, Artificial Sequence
  chemically synthesized
aaatatgctgttcatggcattt

SEQ ID NO: 1280716 - DNA, 22 bp, Artificial Sequence
  chemically synthesized
ttcatggcattttaatcattca

SEQ ID NO: 1280717 - DNA, 22 bp, Artificial Sequence
  chemically synthesized
atggcattttaatcattcatac

SEQ ID NO: 1280718 - DNA, 22 bp, Artificial Sequence
  chemically synthesized
acgtatgcaggtgagtggtatg

SEQ ID NO: 1280719 - DNA, 22 bp, Artificial Sequence
  chemically synthesized
taatcattcataccactcacct

SEQ ID NO: 1280720 - DNA, 22 bp, Artificial Sequence
  chemically synthesized
aatcattcataccactcacctg

SEQ ID NO: 1280721 - DNA, 22 bp, Artificial Sequence
  chemically synthesized
atcattcataccactcacctgc

SEQ ID NO: 1280722 - DNA, 22 bp, Artificial Sequence
  chemically synthesized
gaaatgctgacgtatgcaggtg

SEQ ID NO: 1280723 - DNA, 22 bp, Artificial Sequence
  chemically synthesized
ataccactcacctgcatacgtc

SEQ ID NO: 1280724 - DNA, 22 bp, Artificial Sequence
  chemically synthesized
acctgcatacgtcagcatttcg

SEQ ID NO: 1280725 - DNA, 22 bp, Artificial Sequence
  chemically synthesized
catacgtcagcatttcgagctg

SEQ ID NO: 1280726 - DNA, 22 bp, Artificial Sequence
  chemically synthesized
aaaccacagaagtagacagctc

SEQ ID NO: 1280727 - DNA, 22 bp, Artificial Sequence
  chemically synthesized
tacctaaaaccacagaagtaga

SEQ ID NO: 1280728 - DNA, 22 bp, Artificial Sequence
  chemically synthesized
cgagctgtctacttctgtggtt

SEQ ID NO: 1280729 - DNA, 22 bp, Artificial Sequence
  chemically synthesized
gagctgtctacttctgtggttt

SEQ ID NO: 1280730 - DNA, 22 bp, Artificial Sequence
  chemically synthesized
tctacttctgtggttttaggta

SEQ ID NO: 1280731 - DNA, 22 bp, Artificial Sequence
  chemically synthesized
cttctgtggttttaggtacagg

SEQ ID NO: 1280732 - DNA, 22 bp, Artificial Sequence
  chemically synthesized
gataaatgtagtacctgtacct

SEQ ID NO: 1280733 - DNA, 22 bp, Artificial Sequence
  chemically synthesized
ctgtggttttaggtacaggtac

SEQ ID NO: 1280734 - DNA, 22 bp, Artificial Sequence
  chemically synthesized
tagataaatgtagtacctgtac

SEQ ID NO: 1280735 - DNA, 22 bp, Artificial Sequence
  chemically synthesized
tgtggttttaggtacaggtact

SEQ ID NO: 1280736 - DNA, 22 bp, Artificial Sequence
  chemically synthesized
tggttttaggtacaggtactac

SEQ ID NO: 1280737 - DNA, 22 bp, Artificial Sequence
  chemically synthesized
ctctagataaatgtagtacctg

SEQ ID NO: 1280738 - DNA, 22 bp, Artificial Sequence
  chemically synthesized
taggtacaggtactacatttat

SEQ ID NO: 1280739 - DNA, 22 bp, Artificial Sequence
  chemically synthesized
aggtacaggtactacatttatc

SEQ ID NO: 1280740 - DNA, 22 bp, Artificial Sequence
  chemically synthesized
ggtacaggtactacatttatct

SEQ ID NO: 1280741 - DNA, 22 bp, Artificial Sequence
  chemically synthesized
catttatctagagcagtatgta

SEQ ID NO: 1280742 - DNA, 22 bp, Artificial Sequence
  chemically synthesized
atctagagcagtatgtaccttt

SEQ ID NO: 1280743 - DNA, 22 bp, Artificial Sequence
  chemically synthesized
tctagagcagtatgtacctttc

SEQ ID NO: 1280744 - DNA, 22 bp, Artificial Sequence
  chemically synthesized
aatatgaaaataagaaaggtac

SEQ ID NO: 1280745 - DNA, 22 bp, Artificial Sequence
  chemically synthesized
gagcagtatgtacctttcttat

SEQ ID NO: 1280746 - DNA, 22 bp, Artificial Sequence
  chemically synthesized
ttcaatatgaaaataagaaagg

SEQ ID NO: 1280747 - DNA, 22 bp, Artificial Sequence
  chemically synthesized
attattcaatatgaaaataaga

SEQ ID NO: 1280748 - DNA, 22 bp, Artificial Sequence
  chemically synthesized
tcttattttcatattgaataat

SEQ ID NO: 1280749 - DNA, 22 bp, Artificial Sequence
  chemically synthesized
cttattttcatattgaataatt

SEQ ID NO: 1280750 - DNA, 22 bp, Artificial Sequence
  chemically synthesized
tcatcaataattaattattcaa

SEQ ID NO: 1280751 - DNA, 22 bp, Artificial Sequence
  chemically synthesized
ttattttcatattgaataatta

SEQ ID NO: 1280752 - DNA, 22 bp, Artificial Sequence
  chemically synthesized
atcatcaataattaattattca

SEQ ID NO: 1280753 - DNA, 22 bp, Artificial Sequence
  chemically synthesized
attttcatattgaataattaat

SEQ ID NO: 1280754 - DNA, 22 bp, Artificial Sequence
  chemically synthesized
ttttcatattgaataattaatt

SEQ ID NO: 1280755 - DNA, 22 bp, Artificial Sequence
  chemically synthesized
tcatattgaataattaattatt

SEQ ID NO: 1280756 - DNA, 22 bp, Artificial Sequence
  chemically synthesized
catattgaataattaattattg

SEQ ID NO: 1280757 - DNA, 22 bp, Artificial Sequence
  chemically synthesized
atattgaataattaattattga

SEQ ID NO: 1280758 - DNA, 22 bp, Artificial Sequence
  chemically synthesized
aataattaattattgatgataa

SEQ ID NO: 1280759 - DNA, 22 bp, Artificial Sequence
  chemically synthesized
aaaataatggatatatttatca

SEQ ID NO: 1280760 - DNA, 22 bp, Artificial Sequence
  chemically synthesized
attattgatgataaatatatcc

SEQ ID NO: 1280761 - DNA, 22 bp, Artificial Sequence
  chemically synthesized
ttgatgataaatatatccatta

SEQ ID NO: 1280762 - DNA, 22 bp, Artificial Sequence
  chemically synthesized
atgataaatatatccattattt

SEQ ID NO: 1280763 - DNA, 22 bp, Artificial Sequence
  chemically synthesized
tttttaattcattattgtcctt

SEQ ID NO: 1280764 - DNA, 22 bp, Artificial Sequence
  chemically synthesized
taaaaaataaatcaaaggacaa

SEQ ID NO: 1280765 - DNA, 22 bp, Artificial Sequence
  chemically synthesized
ttaattcattattgtcctttga

SEQ ID NO: 1280766 - DNA, 22 bp, Artificial Sequence
  chemically synthesized
gtaaaaaataaatcaaaggaca

SEQ ID NO: 1280767 - DNA, 22 bp, Artificial Sequence
  chemically synthesized
taattcattattgtcctttgat

SEQ ID NO: 1280768 - DNA, 22 bp, Artificial Sequence
  chemically synthesized
aattcattattgtcctttgatt

SEQ ID NO: 1280769 - DNA, 22 bp, Artificial Sequence
  chemically synthesized
attcattattgtcctttgattt

SEQ ID NO: 1280770 - DNA, 22 bp, Artificial Sequence
  chemically synthesized
ccttgtaaaaaataaatcaaag

SEQ ID NO: 1280771 - DNA, 22 bp, Artificial Sequence
  chemically synthesized
attattgtcctttgatttattt

SEQ ID NO: 1280772 - DNA, 22 bp, Artificial Sequence
  chemically synthesized
ttgtcctttgatttatttttta

SEQ ID NO: 1280773 - DNA, 22 bp, Artificial Sequence
  chemically synthesized
aaacaattaccttgtaaaaaat

SEQ ID NO: 1280774 - DNA, 22 bp, Artificial Sequence
  chemically synthesized
tcctttgatttattttttacaa

SEQ ID NO: 1280775 - DNA, 22 bp, Artificial Sequence
  chemically synthesized
taaaacaattaccttgtaaaaa

SEQ ID NO: 1280776 - DNA, 22 bp, Artificial Sequence
  chemically synthesized
tgatttattttttacaaggtaa

SEQ ID NO: 1280777 - DNA, 22 bp, Artificial Sequence
  chemically synthesized
gatttattttttacaaggtaat

SEQ ID NO: 1280778 - DNA, 22 bp, Artificial Sequence
  chemically synthesized
atttattttttacaaggtaatt

SEQ ID NO: 1280779 - DNA, 22 bp, Artificial Sequence
  chemically synthesized
attttttacaaggtaattgttt

SEQ ID NO: 1280780 - DNA, 22 bp, Artificial Sequence
  chemically synthesized
ttttttacaaggtaattgtttt

SEQ ID NO: 1280781 - DNA, 22 bp, Artificial Sequence
  chemically synthesized
tttacaaggtaattgttttaga

SEQ ID NO: 1280782 - DNA, 22 bp, Artificial Sequence
  chemically synthesized
ttacaaggtaattgttttagaa

SEQ ID NO: 1280783 - DNA, 22 bp, Artificial Sequence
  chemically synthesized
tacaaggtaattgttttagaat

SEQ ID NO: 1280784 - DNA, 22 bp, Artificial Sequence
  chemically synthesized
acaaggtaattgttttagaatt

SEQ ID NO: 1280785 - DNA, 22 bp, Artificial Sequence
  chemically synthesized
caaggtaattgttttagaattt

SEQ ID NO: 1280786 - DNA, 22 bp, Artificial Sequence
  chemically synthesized
catatatatataaaattctaaa

SEQ ID NO: 1280787 - DNA, 22 bp, Artificial Sequence
  chemically synthesized
acatatatatataaaattctaa

SEQ ID NO: 1280788 - DNA, 22 bp, Artificial Sequence
  chemically synthesized
ttttagaattttatatatatat

SEQ ID NO: 1280789 - DNA, 22 bp, Artificial Sequence
  chemically synthesized
tagaattttatatatatatgta

SEQ ID NO: 1280790 - DNA, 22 bp, Artificial Sequence
  chemically synthesized
agaattttatatatatatgtaa

SEQ ID NO: 1280791 - DNA, 22 bp, Artificial Sequence
  chemically synthesized
gaattttatatatatatgtaag

SEQ ID NO: 1280792 - DNA, 22 bp, Artificial Sequence
  chemically synthesized
ccaaaaatgtaacttacatata

SEQ ID NO: 1280793 - DNA, 22 bp, Artificial Sequence
  chemically synthesized
accaaaaatgtaacttacatat

SEQ ID NO: 1280794 - DNA, 22 bp, Artificial Sequence
  chemically synthesized
tatatatatatgtaagttacat

SEQ ID NO: 1280795 - DNA, 22 bp, Artificial Sequence
  chemically synthesized
atatatatatgtaagttacatt

SEQ ID NO: 1280796 - DNA, 22 bp, Artificial Sequence
  chemically synthesized
tatatatatgtaagttacattt

SEQ ID NO: 1280797 - DNA, 22 bp, Artificial Sequence
  chemically synthesized
aaagagaatttaccaaaaatgt

SEQ ID NO: 1280798 - DNA, 22 bp, Artificial Sequence
  chemically synthesized
tcctcaaagagaatttaccaaa

SEQ ID NO: 1280799 - DNA, 22 bp, Artificial Sequence
  chemically synthesized
ctatcctcaaagagaatttacc

SEQ ID NO: 1280800 - DNA, 22 bp, Artificial Sequence
  chemically synthesized
catttttggtaaattctctttg

SEQ ID NO: 1280801 - DNA, 22 bp, Artificial Sequence
  chemically synthesized
ccattactatcctcaaagagaa

SEQ ID NO: 1280802 - DNA, 22 bp, Artificial Sequence
  chemically synthesized
ttggtaaattctctttgaggat

SEQ ID NO: 1280803 - DNA, 22 bp, Artificial Sequence
  chemically synthesized
tggtaaattctctttgaggata

SEQ ID NO: 1280804 - DNA, 22 bp, Artificial Sequence
  chemically synthesized
ggtaaattctctttgaggatag

SEQ ID NO: 1280805 - DNA, 22 bp, Artificial Sequence
  chemically synthesized
gtaaattctctttgaggatagt

SEQ ID NO: 1280806 - DNA, 22 bp, Artificial Sequence
  chemically synthesized
taatactcccattactatcctc

SEQ ID NO: 1280807 - DNA, 22 bp, Artificial Sequence
  chemically synthesized
gtaatactcccattactatcct

SEQ ID NO: 1280808 - DNA, 22 bp, Artificial Sequence
  chemically synthesized
tgtaatactcccattactatcc

SEQ ID NO: 1280809 - DNA, 22 bp, Artificial Sequence
  chemically synthesized
tctttgaggatagtaatgggag

SEQ ID NO: 1280810 - DNA, 22 bp, Artificial Sequence
  chemically synthesized
tttgaggatagtaatgggagta

SEQ ID NO: 1280811 - DNA, 22 bp, Artificial Sequence
  chemically synthesized
tgaggatagtaatgggagtatt

SEQ ID NO: 1280812 - DNA, 22 bp, Artificial Sequence
  chemically synthesized
gaggatagtaatgggagtatta

SEQ ID NO: 1280813 - DNA, 22 bp, Artificial Sequence
  chemically synthesized
aggatagtaatgggagtattac

SEQ ID NO: 1280814 - DNA, 22 bp, Artificial Sequence
  chemically synthesized
taagacatattttgtaatactc

SEQ ID NO: 1280815 - DNA, 22 bp, Artificial Sequence
  chemically synthesized
gtaagacatattttgtaatact

SEQ ID NO: 1280816 - DNA, 22 bp, Artificial Sequence
  chemically synthesized
tgtaagacatattttgtaatac

SEQ ID NO: 1280817 - DNA, 22 bp, Artificial Sequence
  chemically synthesized
ttgtaagacatattttgtaata

SEQ ID NO: 1280818 - DNA, 22 bp, Artificial Sequence
  chemically synthesized
ttttgtaagacatattttgtaa

SEQ ID NO: 1280819 - DNA, 22 bp, Artificial Sequence
  chemically synthesized
aacaccctcttttgtaagacat

SEQ ID NO: 1280820 - DNA, 22 bp, Artificial Sequence
  chemically synthesized
caaaatatgtcttacaaaagag

SEQ ID NO: 1280821 - DNA, 22 bp, Artificial Sequence
  chemically synthesized
taagactgaacaccctcttttg

SEQ ID NO: 1280822 - DNA, 22 bp, Artificial Sequence
  chemically synthesized
accctgtaagactgaacaccct

SEQ ID NO: 1280823 - DNA, 22 bp, Artificial Sequence
  chemically synthesized
aaccctgtaagactgaacaccc

SEQ ID NO: 1280824 - DNA, 22 bp, Artificial Sequence
  chemically synthesized
taaccctgtaagactgaacacc

SEQ ID NO: 1280825 - DNA, 22 bp, Artificial Sequence
  chemically synthesized
acaaaagagggtgttcagtctt

SEQ ID NO: 1280826 - DNA, 22 bp, Artificial Sequence
  chemically synthesized
caaaagagggtgttcagtctta

SEQ ID NO: 1280827 - DNA, 22 bp, Artificial Sequence
  chemically synthesized
tgtaccgtataggttttaaccc

SEQ ID NO: 1280828 - DNA, 22 bp, Artificial Sequence
  chemically synthesized
tatgtaccgtataggttttaac

SEQ ID NO: 1280829 - DNA, 22 bp, Artificial Sequence
  chemically synthesized
agtcttacagggttaaaaccta

SEQ ID NO: 1280830 - DNA, 22 bp, Artificial Sequence
  chemically synthesized
ctatgtaccgtataggttttaa

SEQ ID NO: 1280831 - DNA, 22 bp, Artificial Sequence
  chemically synthesized
ttctatgtaccgtataggtttt

SEQ ID NO: 1280832 - DNA, 22 bp, Artificial Sequence
  chemically synthesized
cttctatgtaccgtataggttt

SEQ ID NO: 1280833 - DNA, 22 bp, Artificial Sequence
  chemically synthesized
tcttctatgtaccgtataggtt

SEQ ID NO: 1280834 - DNA, 22 bp, Artificial Sequence
  chemically synthesized
ttcttctatgtaccgtataggt

SEQ ID NO: 1280835 - DNA, 22 bp, Artificial Sequence
  chemically synthesized
acagggttaaaacctatacggt

SEQ ID NO: 1280836 - DNA, 22 bp, Artificial Sequence
  chemically synthesized
tttcttctatgtaccgtatagg

SEQ ID NO: 1280837 - DNA, 22 bp, Artificial Sequence
  chemically synthesized
cagggttaaaacctatacggta

SEQ ID NO: 1280838 - DNA, 22 bp, Artificial Sequence
  chemically synthesized
ttttcttctatgtaccgtatag

SEQ ID NO: 1280839 - DNA, 22 bp, Artificial Sequence
  chemically synthesized
tttttcttctatgtaccgtata

SEQ ID NO: 1280840 - DNA, 22 bp, Artificial Sequence
  chemically synthesized
aaacctatacggtacatagaag

SEQ ID NO: 1280841 - DNA, 22 bp, Artificial Sequence
  chemically synthesized
aaaactttttttcttctatgta

SEQ ID NO: 1280842 - DNA, 22 bp, Artificial Sequence
  chemically synthesized
aaaaactttttttcttctatgt

SEQ ID NO: 1280843 - DNA, 22 bp, Artificial Sequence
  chemically synthesized
taaaaactttttttcttctatg

SEQ ID NO: 1280844 - DNA, 22 bp, Artificial Sequence
  chemically synthesized
ttaaaaactttttttcttctat

SEQ ID NO: 1280845 - DNA, 22 bp, Artificial Sequence
  chemically synthesized
ttttaaaaactttttttcttct

SEQ ID NO: 1280846 - DNA, 22 bp, Artificial Sequence
  chemically synthesized
cttttaaaaactttttttcttc

SEQ ID NO: 1280847 - DNA, 22 bp, Artificial Sequence
  chemically synthesized
tacggtacatagaagaaaaaaa

SEQ ID NO: 1280848 - DNA, 22 bp, Artificial Sequence
  chemically synthesized
ccgtgtttcttttaaaaacttt

SEQ ID NO: 1280849 - DNA, 22 bp, Artificial Sequence
  chemically synthesized
ttaaaagaaacacggtagcctg

SEQ ID NO: 1280850 - DNA, 22 bp, Artificial Sequence
  chemically synthesized
taaaagaaacacggtagcctgg

SEQ ID NO: 1280851 - DNA, 22 bp, Artificial Sequence
  chemically synthesized
aaaagaaacacggtagcctggc

SEQ ID NO: 1280852 - DNA, 22 bp, Artificial Sequence
  chemically synthesized
aaagaaacacggtagcctggcg

SEQ ID NO: 1280853 - DNA, 22 bp, Artificial Sequence
  chemically synthesized
caggtgtgagccaccacgccag

SEQ ID NO: 1280854 - DNA, 22 bp, Artificial Sequence
  chemically synthesized
ggattacaggtgtgagccacca

SEQ ID NO: 1280855 - DNA, 22 bp, Artificial Sequence
  chemically synthesized
gcgtggtggctcacacctgtaa

SEQ ID NO: 1280856 - DNA, 22 bp, Artificial Sequence
  chemically synthesized
ccaatgtgttgggattacaggt

SEQ ID NO: 1280857 - DNA, 22 bp, Artificial Sequence
  chemically synthesized
gactcccaatgtgttgggatta

SEQ ID NO: 1280858 - DNA, 22 bp, Artificial Sequence
  chemically synthesized
ggactcccaatgtgttgggatt

SEQ ID NO: 1280859 - DNA, 22 bp, Artificial Sequence
  chemically synthesized
acacctgtaatcccaacacatt

SEQ ID NO: 1280860 - DNA, 22 bp, Artificial Sequence
  chemically synthesized
taatcccaacacattgggagtc

SEQ ID NO: 1280861 - DNA, 22 bp, Artificial Sequence
  chemically synthesized
aagcgatccgccccaccttgga

SEQ ID NO: 1280862 - DNA, 22 bp, Artificial Sequence
  chemically synthesized
acctcaagcgatccgccccacc

SEQ ID NO: 1280863 - DNA, 22 bp, Artificial Sequence
  chemically synthesized
ggagtccaaggtggggcggatc

SEQ ID NO: 1280864 - DNA, 22 bp, Artificial Sequence
  chemically synthesized
ctgacctcaagcgatccgcccc

SEQ ID NO: 1280865 - DNA, 22 bp, Artificial Sequence
  chemically synthesized
aaactcctgacctcaagcgatc

SEQ ID NO: 1280866 - DNA, 22 bp, Artificial Sequence
  chemically synthesized
gtctcaaactcctgacctcaag

SEQ ID NO: 1280867 - DNA, 22 bp, Artificial Sequence
  chemically synthesized
gccaggctggtctcaaactcct

SEQ ID NO: 1280868 - DNA, 22 bp, Artificial Sequence
  chemically synthesized
gaggtcaggagtttgagaccag

SEQ ID NO: 1280869 - DNA, 22 bp, Artificial Sequence
  chemically synthesized
aggtcaggagtttgagaccagc

SEQ ID NO: 1280870 - DNA, 22 bp, Artificial Sequence
  chemically synthesized
ccacgttggccaggctggtctc

SEQ ID NO: 1280871 - DNA, 22 bp, Artificial Sequence
  chemically synthesized
gccacgttggccaggctggtct

SEQ ID NO: 1280872 - DNA, 22 bp, Artificial Sequence
  chemically synthesized
tgccacgttggccaggctggtc

SEQ ID NO: 1280873 - DNA, 22 bp, Artificial Sequence
  chemically synthesized
gagaccagcctggccaacgtgg

SEQ ID NO: 1280874 - DNA, 22 bp, Artificial Sequence
  chemically synthesized
agaccagcctggccaacgtggc

SEQ ID NO: 1280875 - DNA, 22 bp, Artificial Sequence
  chemically synthesized
taacagtggagatggggttttg

SEQ ID NO: 1280876 - DNA, 22 bp, Artificial Sequence
  chemically synthesized
gccaacgtggcaaaaccccatc

SEQ ID NO: 1280877 - DNA, 22 bp, Artificial Sequence
  chemically synthesized
ttgtaacagtggagatggggtt

SEQ ID NO: 1280878 - DNA, 22 bp, Artificial Sequence
  chemically synthesized
attgtaacagtggagatggggt

SEQ ID NO: 1280879 - DNA, 22 bp, Artificial Sequence
  chemically synthesized
tattgtaacagtggagatgggg

SEQ ID NO: 1280880 - DNA, 22 bp, Artificial Sequence
  chemically synthesized
ttattgtaacagtggagatggg

SEQ ID NO: 1280881 - DNA, 22 bp, Artificial Sequence
  chemically synthesized
tatttttattgtaacagtggag

SEQ ID NO: 1280882 - DNA, 22 bp, Artificial Sequence
  chemically synthesized
gtatttttattgtaacagtgga

SEQ ID NO: 1280883 - DNA, 22 bp, Artificial Sequence
  chemically synthesized
tgtatttttattgtaacagtgg

SEQ ID NO: 1280884 - DNA, 22 bp, Artificial Sequence
  chemically synthesized
ttgtatttttattgtaacagtg

SEQ ID NO: 1280885 - DNA, 22 bp, Artificial Sequence
  chemically synthesized
atttttgtatttttattgtaac

SEQ ID NO: 1280886 - DNA, 22 bp, Artificial Sequence
  chemically synthesized
cactgttacaataaaaatacaa

SEQ ID NO: 1280887 - DNA, 22 bp, Artificial Sequence
  chemically synthesized
ttacaataaaaatacaaaaatt

SEQ ID NO: 1280888 - DNA, 22 bp, Artificial Sequence
  chemically synthesized
caataaaaatacaaaaattaac

SEQ ID NO: 1280889 - DNA, 22 bp, Artificial Sequence
  chemically synthesized
taggggtgtgccaccatgcccg

SEQ ID NO: 1280890 - DNA, 22 bp, Artificial Sequence
  chemically synthesized
ggactataggggtgtgccacca

SEQ ID NO: 1280891 - DNA, 22 bp, Artificial Sequence
  chemically synthesized
accgggcatggtggcacacccc

SEQ ID NO: 1280892 - DNA, 22 bp, Artificial Sequence
  chemically synthesized
agcagctgggactataggggtg

SEQ ID NO: 1280893 - DNA, 22 bp, Artificial Sequence
  chemically synthesized
ctgagcagctgggactataggg

SEQ ID NO: 1280894 - DNA, 22 bp, Artificial Sequence
  chemically synthesized
aacctcctgagcagctgggact

SEQ ID NO: 1280895 - DNA, 22 bp, Artificial Sequence
  chemically synthesized
tctcaacctcctgagcagctgg

SEQ ID NO: 1280896 - DNA, 22 bp, Artificial Sequence
  chemically synthesized
ctgtctcaacctcctgagcagc

SEQ ID NO: 1280897 - DNA, 22 bp, Artificial Sequence
  chemically synthesized
tcctgtctcaacctcctgagca

SEQ ID NO: 1280898 - DNA, 22 bp, Artificial Sequence
  chemically synthesized
tagtcccagctgctcaggaggt

SEQ ID NO: 1280899 - DNA, 22 bp, Artificial Sequence
  chemically synthesized
aagcgattctcctgtctcaacc

SEQ ID NO: 1280900 - DNA, 22 bp, Artificial Sequence
  chemically synthesized
ctcaggaggttgagacaggaga

SEQ ID NO: 1280901 - DNA, 22 bp, Artificial Sequence
  chemically synthesized
ggttcaagcgattctcctgtct

SEQ ID NO: 1280902 - DNA, 22 bp, Artificial Sequence
  chemically synthesized
aggaggttgagacaggagaatc

SEQ ID NO: 1280903 - DNA, 22 bp, Artificial Sequence
  chemically synthesized
ctgggttcaagcgattctcctg

SEQ ID NO: 1280904 - DNA, 22 bp, Artificial Sequence
  chemically synthesized
cgcctcctgggttcaagcgatt

SEQ ID NO: 1280905 - DNA, 22 bp, Artificial Sequence
  chemically synthesized
agacaggagaatcgcttgaacc

SEQ ID NO: 1280906 - DNA, 22 bp, Artificial Sequence
  chemically synthesized
aatgcaacctccgcctcctggg

SEQ ID NO: 1280907 - DNA, 22 bp, Artificial Sequence
  chemically synthesized
ggctcaatgcaacctccgcctc

SEQ ID NO: 1280908 - DNA, 22 bp, Artificial Sequence
  chemically synthesized
gaacccaggaggcggaggttgc

SEQ ID NO: 1280909 - DNA, 22 bp, Artificial Sequence
  chemically synthesized
aacccaggaggcggaggttgca

SEQ ID NO: 1280910 - DNA, 22 bp, Artificial Sequence
  chemically synthesized
gagtgcagtggcatgatctcgg

SEQ ID NO: 1280911 - DNA, 22 bp, Artificial Sequence
  chemically synthesized
cattgagccgagatcatgccac

SEQ ID NO: 1280912 - DNA, 22 bp, Artificial Sequence
  chemically synthesized
aggctggagtgcagtggcatga

SEQ ID NO: 1280913 - DNA, 22 bp, Artificial Sequence
  chemically synthesized
agccgagatcatgccactgcac

SEQ ID NO: 1280914 - DNA, 22 bp, Artificial Sequence
  chemically synthesized
tcactcaggctggagtgcagtg

SEQ ID NO: 1280915 - DNA, 22 bp, Artificial Sequence
  chemically synthesized
tgtcactcaggctggagtgcag

SEQ ID NO: 1280916 - DNA, 22 bp, Artificial Sequence
  chemically synthesized
ctctgtcactcaggctggagtg

SEQ ID NO: 1280917 - DNA, 22 bp, Artificial Sequence
  chemically synthesized
gctctgtcactcaggctggagt

SEQ ID NO: 1280918 - DNA, 22 bp, Artificial Sequence
  chemically synthesized
cactccagcctgagtgacagag

SEQ ID NO: 1280919 - DNA, 22 bp, Artificial Sequence
  chemically synthesized
tgagatggagtcttgctctgtc

SEQ ID NO: 1280920 - DNA, 22 bp, Artificial Sequence
  chemically synthesized
gtgagatggagtcttgctctgt

SEQ ID NO: 1280921 - DNA, 22 bp, Artificial Sequence
  chemically synthesized
cagcctgagtgacagagcaaga

SEQ ID NO: 1280922 - DNA, 22 bp, Artificial Sequence
  chemically synthesized
tgtgagatggagtcttgctctg

SEQ ID NO: 1280923 - DNA, 22 bp, Artificial Sequence
  chemically synthesized
ttgtgagatggagtcttgctct

SEQ ID NO: 1280924 - DNA, 22 bp, Artificial Sequence
  chemically synthesized
tttgtgagatggagtcttgctc

SEQ ID NO: 1280925 - DNA, 22 bp, Artificial Sequence
  chemically synthesized
ttttgtgagatggagtcttgct

SEQ ID NO: 1280926 - DNA, 22 bp, Artificial Sequence
  chemically synthesized
ttttttgtgagatggagtcttg

SEQ ID NO: 1280927 - DNA, 22 bp, Artificial Sequence
  chemically synthesized
cttttttgtgagatggagtctt

SEQ ID NO: 1280928 - DNA, 22 bp, Artificial Sequence
  chemically synthesized
agtgacagagcaagactccatc

SEQ ID NO: 1280929 - DNA, 22 bp, Artificial Sequence
  chemically synthesized
tcttttttgtgagatggagtct

SEQ ID NO: 1280930 - DNA, 22 bp, Artificial Sequence
  chemically synthesized
ttcttttttgtgagatggagtc

SEQ ID NO: 1280931 - DNA, 22 bp, Artificial Sequence
  chemically synthesized
tttcttttttgtgagatggagt

SEQ ID NO: 1280932 - DNA, 22 bp, Artificial Sequence
  chemically synthesized
ttttcttttttgtgagatggag

SEQ ID NO: 1280933 - DNA, 22 bp, Artificial Sequence
  chemically synthesized
tttttcttttttgtgagatgga

SEQ ID NO: 1280934 - DNA, 22 bp, Artificial Sequence
  chemically synthesized
tttttttcttttttgtgagatg

SEQ ID NO: 1280935 - DNA, 22 bp, Artificial Sequence
  chemically synthesized
ctttttttcttttttgtgagat

SEQ ID NO: 1280936 - DNA, 22 bp, Artificial Sequence
  chemically synthesized
tttctttttttcttttttgtga

SEQ ID NO: 1280937 - DNA, 22 bp, Artificial Sequence
  chemically synthesized
catctcacaaaaaagaaaaaaa

SEQ ID NO: 1280938 - DNA, 22 bp, Artificial Sequence
  chemically synthesized
acaaaaaagaaaaaaagaaata

SEQ ID NO: 1280939 - DNA, 22 bp, Artificial Sequence
  chemically synthesized
aatatgtatacattatttcttt

SEQ ID NO: 1280940 - DNA, 22 bp, Artificial Sequence
  chemically synthesized
taaatatgtatacattatttct

SEQ ID NO: 1280941 - DNA, 22 bp, Artificial Sequence
  chemically synthesized
ctaaatatgtatacattatttc

SEQ ID NO: 1280942 - DNA, 22 bp, Artificial Sequence
  chemically synthesized
tctaaatatgtatacattattt

SEQ ID NO: 1280943 - DNA, 22 bp, Artificial Sequence
  chemically synthesized
ttttctaaatatgtatacatta

SEQ ID NO: 1280944 - DNA, 22 bp, Artificial Sequence
  chemically synthesized
attttctaaatatgtatacatt

SEQ ID NO: 1280945 - DNA, 22 bp, Artificial Sequence
  chemically synthesized
tcttattttctaaatatgtata

SEQ ID NO: 1280946 - DNA, 22 bp, Artificial Sequence
  chemically synthesized
ggtgtattatcttattttctaa

SEQ ID NO: 1280947 - DNA, 22 bp, Artificial Sequence
  chemically synthesized
atcaattgggtgtattatctta

SEQ ID NO: 1280948 - DNA, 22 bp, Artificial Sequence
  chemically synthesized
aatcaattgggtgtattatctt

SEQ ID NO: 1280949 - DNA, 22 bp, Artificial Sequence
  chemically synthesized
agaaaataagataatacaccca

SEQ ID NO: 1280950 - DNA, 22 bp, Artificial Sequence
  chemically synthesized
gaaaataagataatacacccaa

SEQ ID NO: 1280951 - DNA, 22 bp, Artificial Sequence
  chemically synthesized
cagatgaaaatcataatttaat

SEQ ID NO: 1280952 - DNA, 22 bp, Artificial Sequence
  chemically synthesized
acagatgaaaatcataatttaa

SEQ ID NO: 1280953 - DNA, 22 bp, Artificial Sequence
  chemically synthesized
attaaattatgattttcatctg

SEQ ID NO: 1280954 - DNA, 22 bp, Artificial Sequence
  chemically synthesized
aattatgattttcatctgtaaa

SEQ ID NO: 1280955 - DNA, 22 bp, Artificial Sequence
  chemically synthesized
aaggcataggaacatttacaga

SEQ ID NO: 1280956 - DNA, 22 bp, Artificial Sequence
  chemically synthesized
tgattttcatctgtaaatgttc

SEQ ID NO: 1280957 - DNA, 22 bp, Artificial Sequence
  chemically synthesized
tcatctgtaaatgttcctatgc

SEQ ID NO: 1280958 - DNA, 22 bp, Artificial Sequence
  chemically synthesized
catctgtaaatgttcctatgcc

SEQ ID NO: 1280959 - DNA, 22 bp, Artificial Sequence
  chemically synthesized
atctgtaaatgttcctatgcct

SEQ ID NO: 1280960 - DNA, 22 bp, Artificial Sequence
  chemically synthesized
aaataaacatctgaaggcatag

SEQ ID NO: 1280961 - DNA, 22 bp, Artificial Sequence
  chemically synthesized
taaatgttcctatgccttcaga

SEQ ID NO: 1280962 - DNA, 22 bp, Artificial Sequence
  chemically synthesized
ctatgccttcagatgtttattt

SEQ ID NO: 1280963 - DNA, 22 bp, Artificial Sequence
  chemically synthesized
tgccttcagatgtttattttag

SEQ ID NO: 1280964 - DNA, 22 bp, Artificial Sequence
  chemically synthesized
cagatgtttattttaggactgt

SEQ ID NO: 1280965 - DNA, 22 bp, Artificial Sequence
  chemically synthesized
agatgtttattttaggactgtg

SEQ ID NO: 1280966 - DNA, 22 bp, Artificial Sequence
  chemically synthesized
gaaccaagtcggccacagtcct

SEQ ID NO: 1280967 - DNA, 22 bp, Artificial Sequence
  chemically synthesized
agaaccaagtcggccacagtcc

SEQ ID NO: 1280968 - DNA, 22 bp, Artificial Sequence
  chemically synthesized
tagaaccaagtcggccacagtc

SEQ ID NO: 1280969 - DNA, 22 bp, Artificial Sequence
  chemically synthesized
tttagaaccaagtcggccacag

SEQ ID NO: 1280970 - DNA, 22 bp, Artificial Sequence
  chemically synthesized
ctttagaaccaagtcggccaca

SEQ ID NO: 1280971 - DNA, 22 bp, Artificial Sequence
  chemically synthesized
attttaggactgtggccgactt

SEQ ID NO: 1280972 - DNA, 22 bp, Artificial Sequence
  chemically synthesized
ttttaggactgtggccgacttg

SEQ ID NO: 1280973 - DNA, 22 bp, Artificial Sequence
  chemically synthesized
taggactgtggccgacttggtt

SEQ ID NO: 1280974 - DNA, 22 bp, Artificial Sequence
  chemically synthesized
aggactgtggccgacttggttc

SEQ ID NO: 1280975 - DNA, 22 bp, Artificial Sequence
  chemically synthesized
ggactgtggccgacttggttct

SEQ ID NO: 1280976 - DNA, 22 bp, Artificial Sequence
  chemically synthesized
gtgatccatcttctttagaacc

SEQ ID NO: 1280977 - DNA, 22 bp, Artificial Sequence
  chemically synthesized
tggccgacttggttctaaagaa

SEQ ID NO: 1280978 - DNA, 22 bp, Artificial Sequence
  chemically synthesized
taatgacctggtgatccatctt

SEQ ID NO: 1280979 - DNA, 22 bp, Artificial Sequence
  chemically synthesized
ggttctaaagaagatggatcac

SEQ ID NO: 1280980 - DNA, 22 bp, Artificial Sequence
  chemically synthesized
gttctaaagaagatggatcacc

SEQ ID NO: 1280981 - DNA, 22 bp, Artificial Sequence
  chemically synthesized
taaagaagatggatcaccaggt

SEQ ID NO: 1280982 - DNA, 22 bp, Artificial Sequence
  chemically synthesized
aagaagatggatcaccaggtca

SEQ ID NO: 1280983 - DNA, 22 bp, Artificial Sequence
  chemically synthesized
tgaaggaaagccctgtaatgac

SEQ ID NO: 1280984 - DNA, 22 bp, Artificial Sequence
  chemically synthesized
attgtgaaggaaagccctgtaa

SEQ ID NO: 1280985 - DNA, 22 bp, Artificial Sequence
  chemically synthesized
taattgtgaaggaaagccctgt

SEQ ID NO: 1280986 - DNA, 22 bp, Artificial Sequence
  chemically synthesized
ctaattgtgaaggaaagccctg

SEQ ID NO: 1280987 - DNA, 22 bp, Artificial Sequence
  chemically synthesized
gtttctaattgtgaaggaaagc

SEQ ID NO: 1280988 - DNA, 22 bp, Artificial Sequence
  chemically synthesized
agtttctaattgtgaaggaaag

SEQ ID NO: 1280989 - DNA, 22 bp, Artificial Sequence
  chemically synthesized
tatttagtttctaattgtgaag

SEQ ID NO: 1280990 - DNA, 22 bp, Artificial Sequence
  chemically synthesized
atatttagtttctaattgtgaa

SEQ ID NO: 1280991 - DNA, 22 bp, Artificial Sequence
  chemically synthesized
cagggctttccttcacaattag

SEQ ID NO: 1280992 - DNA, 22 bp, Artificial Sequence
  chemically synthesized
agtcttatatttagtttctaat

SEQ ID NO: 1280993 - DNA, 22 bp, Artificial Sequence
  chemically synthesized
tccttcacaattagaaactaaa

SEQ ID NO: 1280994 - DNA, 22 bp, Artificial Sequence
  chemically synthesized
ccttcacaattagaaactaaat

SEQ ID NO: 1280995 - DNA, 22 bp, Artificial Sequence
  chemically synthesized
cttcacaattagaaactaaata

SEQ ID NO: 1280996 - DNA, 22 bp, Artificial Sequence
  chemically synthesized
ggttgagtcttatatttagttt

SEQ ID NO: 1280997 - DNA, 22 bp, Artificial Sequence
  chemically synthesized
tgggttgagtcttatatttagt

SEQ ID NO: 1280998 - DNA, 22 bp, Artificial Sequence
  chemically synthesized
cacaattagaaactaaatataa

SEQ ID NO: 1280999 - DNA, 22 bp, Artificial Sequence
  chemically synthesized
acaattagaaactaaatataag

SEQ ID NO: 1281000 - DNA, 22 bp, Artificial Sequence
  chemically synthesized
ctctgggttgagtcttatattt

SEQ ID NO: 1281001 - DNA, 22 bp, Artificial Sequence
  chemically synthesized
gaaactaaatataagactcaac

SEQ ID NO: 1281002 - DNA, 22 bp, Artificial Sequence
  chemically synthesized
aaattactctgggttgagtctt

SEQ ID NO: 1281003 - DNA, 22 bp, Artificial Sequence
  chemically synthesized
tgaaattactctgggttgagtc

SEQ ID NO: 1281004 - DNA, 22 bp, Artificial Sequence
  chemically synthesized
ctgaaattactctgggttgagt

SEQ ID NO: 1281005 - DNA, 22 bp, Artificial Sequence
  chemically synthesized
tctgaaattactctgggttgag

SEQ ID NO: 1281006 - DNA, 22 bp, Artificial Sequence
  chemically synthesized
ttctgaaattactctgggttga

SEQ ID NO: 1281007 - DNA, 22 bp, Artificial Sequence
  chemically synthesized
tttctgaaattactctgggttg

SEQ ID NO: 1281008 - DNA, 22 bp, Artificial Sequence
  chemically synthesized
aatataagactcaacccagagt

SEQ ID NO: 1281009 - DNA, 22 bp, Artificial Sequence
  chemically synthesized
ttttctgaaattactctgggtt

SEQ ID NO: 1281010 - DNA, 22 bp, Artificial Sequence
  chemically synthesized
tttttctgaaattactctgggt

SEQ ID NO: 1281011 - DNA, 22 bp, Artificial Sequence
  chemically synthesized
ttttttttctgaaattactctg

SEQ ID NO: 1281012 - DNA, 22 bp, Artificial Sequence
  chemically synthesized
attttttttctgaaattactct

SEQ ID NO: 1281013 - DNA, 22 bp, Artificial Sequence
  chemically synthesized
tattttttttctgaaattactc

SEQ ID NO: 1281014 - DNA, 22 bp, Artificial Sequence
  chemically synthesized
aacccagagtaatttcagaaaa

SEQ ID NO: 1281015 - DNA, 22 bp, Artificial Sequence
  chemically synthesized
gtattttattttttttctgaaa

SEQ ID NO: 1281016 - DNA, 22 bp, Artificial Sequence
  chemically synthesized
tattggtattttattttttttc

SEQ ID NO: 1281017 - DNA, 22 bp, Artificial Sequence
  chemically synthesized
atattggtattttatttttttt

SEQ ID NO: 1281018 - DNA, 22 bp, Artificial Sequence
  chemically synthesized
cagaaaaaaaataaaataccaa

SEQ ID NO: 1281019 - DNA, 22 bp, Artificial Sequence
  chemically synthesized
agaaaaaaaataaaataccaat

SEQ ID NO: 1281020 - DNA, 22 bp, Artificial Sequence
  chemically synthesized
acaatacaccttatattggtat

SEQ ID NO: 1281021 - DNA, 22 bp, Artificial Sequence
  chemically synthesized
gacaatacaccttatattggta

SEQ ID NO: 1281022 - DNA, 22 bp, Artificial Sequence
  chemically synthesized
tgacaatacaccttatattggt

SEQ ID NO: 1281023 - DNA, 22 bp, Artificial Sequence
  chemically synthesized
tctttgacaatacaccttatat

SEQ ID NO: 1281024 - DNA, 22 bp, Artificial Sequence
  chemically synthesized
caggagcacaattatctttgac

SEQ ID NO: 1281025 - DNA, 22 bp, Artificial Sequence
  chemically synthesized
tcaaagataattgtgctcctgc

SEQ ID NO: 1281026 - DNA, 22 bp, Artificial Sequence
  chemically synthesized
tacacagaaaagctgcaggagc

SEQ ID NO: 1281027 - DNA, 22 bp, Artificial Sequence
  chemically synthesized
ttatacacagaaaagctgcagg

SEQ ID NO: 1281028 - DNA, 22 bp, Artificial Sequence
  chemically synthesized
tgctcctgcagcttttctgtgt

SEQ ID NO: 1281029 - DNA, 22 bp, Artificial Sequence
  chemically synthesized
ctgcagcttttctgtgtataat

SEQ ID NO: 1281030 - DNA, 22 bp, Artificial Sequence
  chemically synthesized
cagcttttctgtgtataataga

SEQ ID NO: 1281031 - DNA, 22 bp, Artificial Sequence
  chemically synthesized
caaggaaggaagagtctattat

SEQ ID NO: 1281032 - DNA, 22 bp, Artificial Sequence
  chemically synthesized
ctacaaggaaggaagagtctat

SEQ ID NO: 1281033 - DNA, 22 bp, Artificial Sequence
  chemically synthesized
ttctgtgtataatagactcttc

SEQ ID NO: 1281034 - DNA, 22 bp, Artificial Sequence
  chemically synthesized
tctgtgtataatagactcttcc

SEQ ID NO: 1281035 - DNA, 22 bp, Artificial Sequence
  chemically synthesized
ctgtgtataatagactcttcct

SEQ ID NO: 1281036 - DNA, 22 bp, Artificial Sequence
  chemically synthesized
tgtgtataatagactcttcctt

SEQ ID NO: 1281037 - DNA, 22 bp, Artificial Sequence
  chemically synthesized
tgtataatagactcttccttcc

SEQ ID NO: 1281038 - DNA, 22 bp, Artificial Sequence
  chemically synthesized
ggcaagctgctacaaggaagga

SEQ ID NO: 1281039 - DNA, 22 bp, Artificial Sequence
  chemically synthesized
acaatctaggcaagctgctaca

SEQ ID NO: 1281040 - DNA, 22 bp, Artificial Sequence
  chemically synthesized
cacaatctaggcaagctgctac

SEQ ID NO: 1281041 - DNA, 22 bp, Artificial Sequence
  chemically synthesized
tcacaatctaggcaagctgcta

SEQ ID NO: 1281042 - DNA, 22 bp, Artificial Sequence
  chemically synthesized
ttccttccttgtagcagcttgc

SEQ ID NO: 1281043 - DNA, 22 bp, Artificial Sequence
  chemically synthesized
ttcacaatctaggcaagctgct

SEQ ID NO: 1281044 - DNA, 22 bp, Artificial Sequence
  chemically synthesized
ccttccttgtagcagcttgcct

SEQ ID NO: 1281045 - DNA, 22 bp, Artificial Sequence
  chemically synthesized
cttccttgtagcagcttgccta

SEQ ID NO: 1281046 - DNA, 22 bp, Artificial Sequence
  chemically synthesized
ccttgtagcagcttgcctagat

SEQ ID NO: 1281047 - DNA, 22 bp, Artificial Sequence
  chemically synthesized
cttgtagcagcttgcctagatt

SEQ ID NO: 1281048 - DNA, 22 bp, Artificial Sequence
  chemically synthesized
gtagcagcttgcctagattgtg

SEQ ID NO: 1281049 - DNA, 22 bp, Artificial Sequence
  chemically synthesized
tagcagcttgcctagattgtga

SEQ ID NO: 1281050 - DNA, 22 bp, Artificial Sequence
  chemically synthesized
agggtcaaacaccatgtttttc

SEQ ID NO: 1281051 - DNA, 22 bp, Artificial Sequence
  chemically synthesized
gcctagattgtgaaaaacatgg

SEQ ID NO: 1281052 - DNA, 22 bp, Artificial Sequence
  chemically synthesized
cctagattgtgaaaaacatggt

SEQ ID NO: 1281053 - DNA, 22 bp, Artificial Sequence
  chemically synthesized
taagggtcaaacaccatgtttt

SEQ ID NO: 1281054 - DNA, 22 bp, Artificial Sequence
  chemically synthesized
ctaagggtcaaacaccatgttt

SEQ ID NO: 1281055 - DNA, 22 bp, Artificial Sequence
  chemically synthesized
tctaagggtcaaacaccatgtt

SEQ ID NO: 1281056 - DNA, 22 bp, Artificial Sequence
  chemically synthesized
gattgtgaaaaacatggtgttt

SEQ ID NO: 1281057 - DNA, 22 bp, Artificial Sequence
  chemically synthesized
acctttctaagggtcaaacacc

SEQ ID NO: 1281058 - DNA, 22 bp, Artificial Sequence
  chemically synthesized
gacctttctaagggtcaaacac

SEQ ID NO: 1281059 - DNA, 22 bp, Artificial Sequence
  chemically synthesized
tgaaaaacatggtgtttgaccc

SEQ ID NO: 1281060 - DNA, 22 bp, Artificial Sequence
  chemically synthesized
tgacctttctaagggtcaaaca

SEQ ID NO: 1281061 - DNA, 22 bp, Artificial Sequence
  chemically synthesized
tataagtctttgacctttctaa

SEQ ID NO: 1281062 - DNA, 22 bp, Artificial Sequence
  chemically synthesized
atataagtctttgacctttcta

SEQ ID NO: 1281063 - DNA, 22 bp, Artificial Sequence
  chemically synthesized
gacccttagaaaggtcaaagac

SEQ ID NO: 1281064 - DNA, 22 bp, Artificial Sequence
  chemically synthesized
acccttagaaaggtcaaagact

SEQ ID NO: 1281065 - DNA, 22 bp, Artificial Sequence
  chemically synthesized
agaaaggtcaaagacttatata

SEQ ID NO: 1281066 - DNA, 22 bp, Artificial Sequence
  chemically synthesized
gaaaggtcaaagacttatataa

SEQ ID NO: 1281067 - DNA, 22 bp, Artificial Sequence
  chemically synthesized
atatatacatatatatcttata

SEQ ID NO: 1281068 - DNA, 22 bp, Artificial Sequence
  chemically synthesized
atataagatatatatgtatata

SEQ ID NO: 1281069 - DNA, 22 bp, Artificial Sequence
  chemically synthesized
tataagatatatatgtatatat

SEQ ID NO: 1281070 - DNA, 22 bp, Artificial Sequence
  chemically synthesized
atatatgtacatatatagatat

SEQ ID NO: 1281071 - DNA, 22 bp, Artificial Sequence
  chemically synthesized
ccacactgatatatgtacatat

SEQ ID NO: 1281072 - DNA, 22 bp, Artificial Sequence
  chemically synthesized
cccacactgatatatgtacata

SEQ ID NO: 1281073 - DNA, 22 bp, Artificial Sequence
  chemically synthesized
atatctatatatgtacatatat

SEQ ID NO: 1281074 - DNA, 22 bp, Artificial Sequence
  chemically synthesized
cttcccacactgatatatgtac

SEQ ID NO: 1281075 - DNA, 22 bp, Artificial Sequence
  chemically synthesized
ccttcccacactgatatatgta

SEQ ID NO: 1281076 - DNA, 22 bp, Artificial Sequence
  chemically synthesized
catttccttcccacactgatat

SEQ ID NO: 1281077 - DNA, 22 bp, Artificial Sequence
  chemically synthesized
tatatgtacatatatcagtgtg

SEQ ID NO: 1281078 - DNA, 22 bp, Artificial Sequence
  chemically synthesized
ctccatttccttcccacactga

SEQ ID NO: 1281079 - DNA, 22 bp, Artificial Sequence
  chemically synthesized
ttcctccatttccttcccacac

SEQ ID NO: 1281080 - DNA, 22 bp, Artificial Sequence
  chemically synthesized
tattcctccatttccttcccac

SEQ ID NO: 1281081 - DNA, 22 bp, Artificial Sequence
  chemically synthesized
acattctattcctccatttcct

SEQ ID NO: 1281082 - DNA, 22 bp, Artificial Sequence
  chemically synthesized
caattaacattctattcctcca

SEQ ID NO: 1281083 - DNA, 22 bp, Artificial Sequence
  chemically synthesized
ttccaattaacattctattcct

SEQ ID NO: 1281084 - DNA, 22 bp, Artificial Sequence
  chemically synthesized
gttccaattaacattctattcc

SEQ ID NO: 1281085 - DNA, 22 bp, Artificial Sequence
  chemically synthesized
gtcttgttccaattaacattct

SEQ ID NO: 1281086 - DNA, 22 bp, Artificial Sequence
  chemically synthesized
ctagtcttgttccaattaacat

SEQ ID NO: 1281087 - DNA, 22 bp, Artificial Sequence
  chemically synthesized
ctactagtcttgttccaattaa

SEQ ID NO: 1281088 - DNA, 22 bp, Artificial Sequence
  chemically synthesized
atcagctactactagtcttgtt

SEQ ID NO: 1281089 - DNA, 22 bp, Artificial Sequence
  chemically synthesized
attggaacaagactagtagtag

SEQ ID NO: 1281090 - DNA, 22 bp, Artificial Sequence
  chemically synthesized
gaacaagactagtagtagctga

SEQ ID NO: 1281091 - DNA, 22 bp, Artificial Sequence
  chemically synthesized
gtggaatgaagaactaatcagc

SEQ ID NO: 1281092 - DNA, 22 bp, Artificial Sequence
  chemically synthesized
agtggaatgaagaactaatcag

SEQ ID NO: 1281093 - DNA, 22 bp, Artificial Sequence
  chemically synthesized
gtagtagctgattagttcttca

SEQ ID NO: 1281094 - DNA, 22 bp, Artificial Sequence
  chemically synthesized
tgtttagtggaatgaagaacta

SEQ ID NO: 1281095 - DNA, 22 bp, Artificial Sequence
  chemically synthesized
attagttcttcattccactaaa

SEQ ID NO: 1281096 - DNA, 22 bp, Artificial Sequence
  chemically synthesized
cccatcgttatgtttagtggaa

SEQ ID NO: 1281097 - DNA, 22 bp, Artificial Sequence
  chemically synthesized
gcccatcgttatgtttagtgga

SEQ ID NO: 1281098 - DNA, 22 bp, Artificial Sequence
  chemically synthesized
gttcttcattccactaaacata

SEQ ID NO: 1281099 - DNA, 22 bp, Artificial Sequence
  chemically synthesized
ttcattccactaaacataacga

SEQ ID NO: 1281100 - DNA, 22 bp, Artificial Sequence
  chemically synthesized
gatatttgcccatcgttatgtt

SEQ ID NO: 1281101 - DNA, 22 bp, Artificial Sequence
  chemically synthesized
cattccactaaacataacgatg

SEQ ID NO: 1281102 - DNA, 22 bp, Artificial Sequence
  chemically synthesized
attccactaaacataacgatgg

SEQ ID NO: 1281103 - DNA, 22 bp, Artificial Sequence
  chemically synthesized
cactaaacataacgatgggcaa

SEQ ID NO: 1281104 - DNA, 22 bp, Artificial Sequence
  chemically synthesized
aagcagctagatatttgcccat

SEQ ID NO: 1281105 - DNA, 22 bp, Artificial Sequence
  chemically synthesized
aaagcagctagatatttgccca

SEQ ID NO: 1281106 - DNA, 22 bp, Artificial Sequence
  chemically synthesized
aacataacgatgggcaaatatc

SEQ ID NO: 1281107 - DNA, 22 bp, Artificial Sequence
  chemically synthesized
taaaataagacttaaagcagct

SEQ ID NO: 1281108 - DNA, 22 bp, Artificial Sequence
  chemically synthesized
ataaaataagacttaaagcagc

SEQ ID NO: 1281109 - DNA, 22 bp, Artificial Sequence
  chemically synthesized
aatttataaaataagacttaaa

SEQ ID NO: 1281110 - DNA, 22 bp, Artificial Sequence
  chemically synthesized
atattcaatttataaaataaga

SEQ ID NO: 1281111 - DNA, 22 bp, Artificial Sequence
  chemically synthesized
gctgctttaagtcttattttat

SEQ ID NO: 1281112 - DNA, 22 bp, Artificial Sequence
  chemically synthesized
gatattcaatttataaaataag

SEQ ID NO: 1281113 - DNA, 22 bp, Artificial Sequence
  chemically synthesized
ctttaagtcttattttataaat

SEQ ID NO: 1281114 - DNA, 22 bp, Artificial Sequence
  chemically synthesized
gtatttgatattcaatttataa

SEQ ID NO: 1281115 - DNA, 22 bp, Artificial Sequence
  chemically synthesized
taagtcttattttataaattga

SEQ ID NO: 1281116 - DNA, 22 bp, Artificial Sequence
  chemically synthesized
agtatttgatattcaatttata

SEQ ID NO: 1281117 - DNA, 22 bp, Artificial Sequence
  chemically synthesized
aagtcttattttataaattgaa

SEQ ID NO: 1281118 - DNA, 22 bp, Artificial Sequence
  chemically synthesized
tagtatttgatattcaatttat

SEQ ID NO: 1281119 - DNA, 22 bp, Artificial Sequence
  chemically synthesized
agtcttattttataaattgaat

SEQ ID NO: 1281120 - DNA, 22 bp, Artificial Sequence
  chemically synthesized
tttagtatttgatattcaattt

SEQ ID NO: 1281121 - DNA, 22 bp, Artificial Sequence
  chemically synthesized
ctttagtatttgatattcaatt

SEQ ID NO: 1281122 - DNA, 22 bp, Artificial Sequence
  chemically synthesized
tctttagtatttgatattcaat

SEQ ID NO: 1281123 - DNA, 22 bp, Artificial Sequence
  chemically synthesized
ttctttagtatttgatattcaa

SEQ ID NO: 1281124 - DNA, 22 bp, Artificial Sequence
  chemically synthesized
tttctttagtatttgatattca

SEQ ID NO: 1281125 - DNA, 22 bp, Artificial Sequence
  chemically synthesized
attttataaattgaatatcaaa

SEQ ID NO: 1281126 - DNA, 22 bp, Artificial Sequence
  chemically synthesized
ttttataaattgaatatcaaat

SEQ ID NO: 1281127 - DNA, 22 bp, Artificial Sequence
  chemically synthesized
tataaattgaatatcaaatact

SEQ ID NO: 1281128 - DNA, 22 bp, Artificial Sequence
  chemically synthesized
ataaattgaatatcaaatacta

SEQ ID NO: 1281129 - DNA, 22 bp, Artificial Sequence
  chemically synthesized
taaattgaatatcaaatactaa

SEQ ID NO: 1281130 - DNA, 22 bp, Artificial Sequence
  chemically synthesized
tgaaaatgtattttttctttag

SEQ ID NO: 1281131 - DNA, 22 bp, Artificial Sequence
  chemically synthesized
aatatcaaatactaaagaaaaa

SEQ ID NO: 1281132 - DNA, 22 bp, Artificial Sequence
  chemically synthesized
gctgtgaaaatgtattttttct

SEQ ID NO: 1281133 - DNA, 22 bp, Artificial Sequence
  chemically synthesized
ctggctgtgaaaatgtattttt

SEQ ID NO: 1281134 - DNA, 22 bp, Artificial Sequence
  chemically synthesized
cctggctgtgaaaatgtatttt

SEQ ID NO: 1281135 - DNA, 22 bp, Artificial Sequence
  chemically synthesized
tcctggctgtgaaaatgtattt

SEQ ID NO: 1281136 - DNA, 22 bp, Artificial Sequence
  chemically synthesized
ttcctggctgtgaaaatgtatt

SEQ ID NO: 1281137 - DNA, 22 bp, Artificial Sequence
  chemically synthesized
aagaaaaaatacattttcacag

SEQ ID NO: 1281138 - DNA, 22 bp, Artificial Sequence
  chemically synthesized
tgtttttcctggctgtgaaaat

SEQ ID NO: 1281139 - DNA, 22 bp, Artificial Sequence
  chemically synthesized
tatgtttttcctggctgtgaaa

SEQ ID NO: 1281140 - DNA, 22 bp, Artificial Sequence
  chemically synthesized
aaaaaaattctatgtttttcct

SEQ ID NO: 1281141 - DNA, 22 bp, Artificial Sequence
  chemically synthesized
gaaaaaaattctatgtttttcc

SEQ ID NO: 1281142 - DNA, 22 bp, Artificial Sequence
  chemically synthesized
tcacagccaggaaaaacataga

SEQ ID NO: 1281143 - DNA, 22 bp, Artificial Sequence
  chemically synthesized
cacagccaggaaaaacatagaa

SEQ ID NO: 1281144 - DNA, 22 bp, Artificial Sequence
  chemically synthesized
acagccaggaaaaacatagaat

SEQ ID NO: 1281145 - DNA, 22 bp, Artificial Sequence
  chemically synthesized
aaatttgaaaaaaattctatgt

SEQ ID NO: 1281146 - DNA, 22 bp, Artificial Sequence
  chemically synthesized
gaaatttgaaaaaaattctatg

SEQ ID NO: 1281147 - DNA, 22 bp, Artificial Sequence
  chemically synthesized
tgaaatttgaaaaaaattctat

SEQ ID NO: 1281148 - DNA, 22 bp, Artificial Sequence
  chemically synthesized
gcattttgaaatttgaaaaaaa

SEQ ID NO: 1281149 - DNA, 22 bp, Artificial Sequence
  chemically synthesized
ggcattttgaaatttgaaaaaa

SEQ ID NO: 1281150 - DNA, 22 bp, Artificial Sequence
  chemically synthesized
cttggcattttgaaatttgaaa

SEQ ID NO: 1281151 - DNA, 22 bp, Artificial Sequence
  chemically synthesized
acttggcattttgaaatttgaa

SEQ ID NO: 1281152 - DNA, 22 bp, Artificial Sequence
  chemically synthesized
tacttggcattttgaaatttga

SEQ ID NO: 1281153 - DNA, 22 bp, Artificial Sequence
  chemically synthesized
aagttttacttggcattttgaa

SEQ ID NO: 1281154 - DNA, 22 bp, Artificial Sequence
  chemically synthesized
tcaagttttacttggcattttg

SEQ ID NO: 1281155 - DNA, 22 bp, Artificial Sequence
  chemically synthesized
ttttcaaatttcaaaatgccaa

SEQ ID NO: 1281156 - DNA, 22 bp, Artificial Sequence
  chemically synthesized
tttcaaatttcaaaatgccaag

SEQ ID NO: 1281157 - DNA, 22 bp, Artificial Sequence
  chemically synthesized
ttcaaatttcaaaatgccaagt

SEQ ID NO: 1281158 - DNA, 22 bp, Artificial Sequence
  chemically synthesized
ctctcaagttttacttggcatt

SEQ ID NO: 1281159 - DNA, 22 bp, Artificial Sequence
  chemically synthesized
tcaaatttcaaaatgccaagta

SEQ ID NO: 1281160 - DNA, 22 bp, Artificial Sequence
  chemically synthesized
cctctcaagttttacttggcat

SEQ ID NO: 1281161 - DNA, 22 bp, Artificial Sequence
  chemically synthesized
caaatttcaaaatgccaagtaa

SEQ ID NO: 1281162 - DNA, 22 bp, Artificial Sequence
  chemically synthesized
aaatttcaaaatgccaagtaaa

SEQ ID NO: 1281163 - DNA, 22 bp, Artificial Sequence
  chemically synthesized
ggtatttcctctcaagttttac

SEQ ID NO: 1281164 - DNA, 22 bp, Artificial Sequence
  chemically synthesized
caaaatgccaagtaaaacttga

SEQ ID NO: 1281165 - DNA, 22 bp, Artificial Sequence
  chemically synthesized
aaaatgccaagtaaaacttgag

SEQ ID NO: 1281166 - DNA, 22 bp, Artificial Sequence
  chemically synthesized
ctcggtatttcctctcaagttt

SEQ ID NO: 1281167 - DNA, 22 bp, Artificial Sequence
  chemically synthesized
gctcggtatttcctctcaagtt

SEQ ID NO: 1281168 - DNA, 22 bp, Artificial Sequence
  chemically synthesized
tttgctcggtatttcctctcaa

SEQ ID NO: 1281169 - DNA, 22 bp, Artificial Sequence
  chemically synthesized
atttgctcggtatttcctctca

SEQ ID NO: 1281170 - DNA, 22 bp, Artificial Sequence
  chemically synthesized
cttatttgctcggtatttcctc

SEQ ID NO: 1281171 - DNA, 22 bp, Artificial Sequence
  chemically synthesized
gagaggaaataccgagcaaata

SEQ ID NO: 1281172 - DNA, 22 bp, Artificial Sequence
  chemically synthesized
agaggaaataccgagcaaataa

SEQ ID NO: 1281173 - DNA, 22 bp, Artificial Sequence
  chemically synthesized
ggacaaagttccttatttgctc

SEQ ID NO: 1281174 - DNA, 22 bp, Artificial Sequence
  chemically synthesized
gggacaaagttccttatttgct

SEQ ID NO: 1281175 - DNA, 22 bp, Artificial Sequence
  chemically synthesized
cataccttgggacaaagttcct

SEQ ID NO: 1281176 - DNA, 22 bp, Artificial Sequence
  chemically synthesized
ccataccttgggacaaagttcc

SEQ ID NO: 1281177 - DNA, 22 bp, Artificial Sequence
  chemically synthesized
tcaatgtttccataccttggga

SEQ ID NO: 1281178 - DNA, 22 bp, Artificial Sequence
  chemically synthesized
gtcaatgtttccataccttggg

SEQ ID NO: 1281179 - DNA, 22 bp, Artificial Sequence
  chemically synthesized
tgtcaatgtttccataccttgg

SEQ ID NO: 1281180 - DNA, 22 bp, Artificial Sequence
  chemically synthesized
tgtcccaaggtatggaaacatt

SEQ ID NO: 1281181 - DNA, 22 bp, Artificial Sequence
  chemically synthesized
gtcccaaggtatggaaacattg

SEQ ID NO: 1281182 - DNA, 22 bp, Artificial Sequence
  chemically synthesized
tcccaaggtatggaaacattga

SEQ ID NO: 1281183 - DNA, 22 bp, Artificial Sequence
  chemically synthesized
gtaatagttttgtcaatgtttc

SEQ ID NO: 1281184 - DNA, 22 bp, Artificial Sequence
  chemically synthesized
taactggtaatagttttgtcaa

SEQ ID NO: 1281185 - DNA, 22 bp, Artificial Sequence
  chemically synthesized
acaaaactattaccagttatag

SEQ ID NO: 1281186 - DNA, 22 bp, Artificial Sequence
  chemically synthesized
cccagtaaaggtcagctataac

SEQ ID NO: 1281187 - DNA, 22 bp, Artificial Sequence
  chemically synthesized
acccagtaaaggtcagctataa

SEQ ID NO: 1281188 - DNA, 22 bp, Artificial Sequence
  chemically synthesized
tacccagtaaaggtcagctata

SEQ ID NO: 1281189 - DNA, 22 bp, Artificial Sequence
  chemically synthesized
ttaccagttatagctgaccttt

SEQ ID NO: 1281190 - DNA, 22 bp, Artificial Sequence
  chemically synthesized
ccagttatagctgacctttact

SEQ ID NO: 1281191 - DNA, 22 bp, Artificial Sequence
  chemically synthesized
tccaggttttacccagtaaagg

SEQ ID NO: 1281192 - DNA, 22 bp, Artificial Sequence
  chemically synthesized
atccaggttttacccagtaaag

SEQ ID NO: 1281193 - DNA, 22 bp, Artificial Sequence
  chemically synthesized
tttatccaggttttacccagta

SEQ ID NO: 1281194 - DNA, 22 bp, Artificial Sequence
  chemically synthesized
tagctgacctttactgggtaaa

SEQ ID NO: 1281195 - DNA, 22 bp, Artificial Sequence
  chemically synthesized
ctgtttatccaggttttaccca

SEQ ID NO: 1281196 - DNA, 22 bp, Artificial Sequence
  chemically synthesized
cctgtttatccaggttttaccc

SEQ ID NO: 1281197 - DNA, 22 bp, Artificial Sequence
  chemically synthesized
tcctgtttatccaggttttacc

SEQ ID NO: 1281198 - DNA, 22 bp, Artificial Sequence
  chemically synthesized
ttcctgtttatccaggttttac

SEQ ID NO: 1281199 - DNA, 22 bp, Artificial Sequence
  chemically synthesized
acctttactgggtaaaacctgg

SEQ ID NO: 1281200 - DNA, 22 bp, Artificial Sequence
  chemically synthesized
tactgggtaaaacctggataaa

SEQ ID NO: 1281201 - DNA, 22 bp, Artificial Sequence
  chemically synthesized
aagtttttcctgtttatccagg

SEQ ID NO: 1281202 - DNA, 22 bp, Artificial Sequence
  chemically synthesized
actgggtaaaacctggataaac

SEQ ID NO: 1281203 - DNA, 22 bp, Artificial Sequence
  chemically synthesized
aaagtttttcctgtttatccag

SEQ ID NO: 1281204 - DNA, 22 bp, Artificial Sequence
  chemically synthesized
ctgggtaaaacctggataaaca

SEQ ID NO: 1281205 - DNA, 22 bp, Artificial Sequence
  chemically synthesized
ttaaagtttttcctgtttatcc

SEQ ID NO: 1281206 - DNA, 22 bp, Artificial Sequence
  chemically synthesized
ggtaaaacctggataaacagga

SEQ ID NO: 1281207 - DNA, 22 bp, Artificial Sequence
  chemically synthesized
tcttaaagtttttcctgtttat

SEQ ID NO: 1281208 - DNA, 22 bp, Artificial Sequence
  chemically synthesized
ctcttaaagtttttcctgttta

SEQ ID NO: 1281209 - DNA, 22 bp, Artificial Sequence
  chemically synthesized
tctcttaaagtttttcctgttt

SEQ ID NO: 1281210 - DNA, 22 bp, Artificial Sequence
  chemically synthesized
ttctcttaaagtttttcctgtt

SEQ ID NO: 1281211 - DNA, 22 bp, Artificial Sequence
  chemically synthesized
gataaacaggaaaaactttaag

SEQ ID NO: 1281212 - DNA, 22 bp, Artificial Sequence
  chemically synthesized
aagaagacttttctcttaaagt

SEQ ID NO: 1281213 - DNA, 22 bp, Artificial Sequence
  chemically synthesized
acccactgaagaagacttttct

SEQ ID NO: 1281214 - DNA, 22 bp, Artificial Sequence
  chemically synthesized
gacccactgaagaagacttttc

SEQ ID NO: 1281215 - DNA, 22 bp, Artificial Sequence
  chemically synthesized
taagagaaaagtcttcttcagt

SEQ ID NO: 1281216 - DNA, 22 bp, Artificial Sequence
  chemically synthesized
aagagaaaagtcttcttcagtg

SEQ ID NO: 1281217 - DNA, 22 bp, Artificial Sequence
  chemically synthesized
agagaaaagtcttcttcagtgg

SEQ ID NO: 1281218 - DNA, 22 bp, Artificial Sequence
  chemically synthesized
atgaaaaccatgggatttgacc

SEQ ID NO: 1281219 - DNA, 22 bp, Artificial Sequence
  chemically synthesized
cttcagtgggtcaaatcccatg

SEQ ID NO: 1281220 - DNA, 22 bp, Artificial Sequence
  chemically synthesized
ttcagtgggtcaaatcccatgg

SEQ ID NO: 1281221 - DNA, 22 bp, Artificial Sequence
  chemically synthesized
cagtgggtcaaatcccatggtt

SEQ ID NO: 1281222 - DNA, 22 bp, Artificial Sequence
  chemically synthesized
agtgggtcaaatcccatggttt

SEQ ID NO: 1281223 - DNA, 22 bp, Artificial Sequence
  chemically synthesized
tagcagtccgcccagttcatga

SEQ ID NO: 1281224 - DNA, 22 bp, Artificial Sequence
  chemically synthesized
ccctgtagcagtccgcccagtt

SEQ ID NO: 1281225 - DNA, 22 bp, Artificial Sequence
  chemically synthesized
ctgccctgtagcagtccgccca

SEQ ID NO: 1281226 - DNA, 22 bp, Artificial Sequence
  chemically synthesized
cctgccctgtagcagtccgccc

SEQ ID NO: 1281227 - DNA, 22 bp, Artificial Sequence
  chemically synthesized
ttcctgccctgtagcagtccgc

SEQ ID NO: 1281228 - DNA, 22 bp, Artificial Sequence
  chemically synthesized
tcatgaactgggcggactgcta

SEQ ID NO: 1281229 - DNA, 22 bp, Artificial Sequence
  chemically synthesized
catgaactgggcggactgctac

SEQ ID NO: 1281230 - DNA, 22 bp, Artificial Sequence
  chemically synthesized
atgaactgggcggactgctaca

SEQ ID NO: 1281231 - DNA, 22 bp, Artificial Sequence
  chemically synthesized
ggcggactgctacagggcagga

SEQ ID NO: 1281232 - DNA, 22 bp, Artificial Sequence
  chemically synthesized
tgtagtaaactcttcctgccct

SEQ ID NO: 1281233 - DNA, 22 bp, Artificial Sequence
  chemically synthesized
tgtgtagtaaactcttcctgcc

SEQ ID NO: 1281234 - DNA, 22 bp, Artificial Sequence
  chemically synthesized
tctgtgtagtaaactcttcctg

SEQ ID NO: 1281235 - DNA, 22 bp, Artificial Sequence
  chemically synthesized
ctctgtgtagtaaactcttcct

SEQ ID NO: 1281236 - DNA, 22 bp, Artificial Sequence
  chemically synthesized
tctctgtgtagtaaactcttcc

SEQ ID NO: 1281237 - DNA, 22 bp, Artificial Sequence
  chemically synthesized
ttctctgtgtagtaaactcttc

SEQ ID NO: 1281238 - DNA, 22 bp, Artificial Sequence
  chemically synthesized
ctacagggcaggaagagtttac

SEQ ID NO: 1281239 - DNA, 22 bp, Artificial Sequence
  chemically synthesized
cagggcaggaagagtttactac

SEQ ID NO: 1281240 - DNA, 22 bp, Artificial Sequence
  chemically synthesized
ccacaacttttctctgtgtagt

SEQ ID NO: 1281241 - DNA, 22 bp, Artificial Sequence
  chemically synthesized
tgttcccacaacttttctctgt

SEQ ID NO: 1281242 - DNA, 22 bp, Artificial Sequence
  chemically synthesized
actacacagagaaaagttgtgg

SEQ ID NO: 1281243 - DNA, 22 bp, Artificial Sequence
  chemically synthesized
ctacacagagaaaagttgtggg

SEQ ID NO: 1281244 - DNA, 22 bp, Artificial Sequence
  chemically synthesized
cacagagaaaagttgtgggaac

SEQ ID NO: 1281245 - DNA, 22 bp, Artificial Sequence
  chemically synthesized
aaagataattgtgttcccacaa

SEQ ID NO: 1281246 - DNA, 22 bp, Artificial Sequence
  chemically synthesized
caaagataattgtgttcccaca

SEQ ID NO: 1281247 - DNA, 22 bp, Artificial Sequence
  chemically synthesized
ttcaaagataattgtgttccca

SEQ ID NO: 1281248 - DNA, 22 bp, Artificial Sequence
  chemically synthesized
tgggaacacaattatctttgaa

SEQ ID NO: 1281249 - DNA, 22 bp, Artificial Sequence
  chemically synthesized
gcccaagagttcttcaaagata

SEQ ID NO: 1281250 - DNA, 22 bp, Artificial Sequence
  chemically synthesized
cactggcccaagagttcttcaa

SEQ ID NO: 1281251 - DNA, 22 bp, Artificial Sequence
  chemically synthesized
tctttgaagaactcttgggcca

SEQ ID NO: 1281252 - DNA, 22 bp, Artificial Sequence
  chemically synthesized
tgaagaactcttgggccagtgt

SEQ ID NO: 1281253 - DNA, 22 bp, Artificial Sequence
  chemically synthesized
gaagaactcttgggccagtgta

SEQ ID NO: 1281254 - DNA, 22 bp, Artificial Sequence
  chemically synthesized
aagaactcttgggccagtgtag

SEQ ID NO: 1281255 - DNA, 22 bp, Artificial Sequence
  chemically synthesized
gcaccacggggcctacactggc

SEQ ID NO: 1281256 - DNA, 22 bp, Artificial Sequence
  chemically synthesized
ttgggccagtgtaggccccgtg

SEQ ID NO: 1281257 - DNA, 22 bp, Artificial Sequence
  chemically synthesized
gggccagtgtaggccccgtggt

SEQ ID NO: 1281258 - DNA, 22 bp, Artificial Sequence
  chemically synthesized
ggccagtgtaggccccgtggtg

SEQ ID NO: 1281259 - DNA, 22 bp, Artificial Sequence
  chemically synthesized
gcacagggaactggcaccacgg

SEQ ID NO: 1281260 - DNA, 22 bp, Artificial Sequence
  chemically synthesized
agcacagggaactggcaccacg

SEQ ID NO: 1281261 - DNA, 22 bp, Artificial Sequence
  chemically synthesized
ttagcacagggaactggcacca

SEQ ID NO: 1281262 - DNA, 22 bp, Artificial Sequence
  chemically synthesized
cctcttagcacagggaactggc

SEQ ID NO: 1281263 - DNA, 22 bp, Artificial Sequence
  chemically synthesized
gctgcctcttagcacagggaac

SEQ ID NO: 1281264 - DNA, 22 bp, Artificial Sequence
  chemically synthesized
cctgtgctaagaggcagccagg

SEQ ID NO: 1281265 - DNA, 22 bp, Artificial Sequence
  chemically synthesized
tgctaagaggcagccagggata

SEQ ID NO: 1281266 - DNA, 22 bp, Artificial Sequence
  chemically synthesized
agaggcagccagggatatatac

SEQ ID NO: 1281267 - DNA, 22 bp, Artificial Sequence
  chemically synthesized
tatagcaaagggtgaggtatat

SEQ ID NO: 1281268 - DNA, 22 bp, Artificial Sequence
  chemically synthesized
agcaaggcagctatatagcaaa

SEQ ID NO: 1281269 - DNA, 22 bp, Artificial Sequence
  chemically synthesized
taagcaaggcagctatatagca

SEQ ID NO: 1281270 - DNA, 22 bp, Artificial Sequence
  chemically synthesized
ctaagcaaggcagctatatagc

SEQ ID NO: 1281271 - DNA, 22 bp, Artificial Sequence
  chemically synthesized
accctttgctatatagctgcct

SEQ ID NO: 1281272 - DNA, 22 bp, Artificial Sequence
  chemically synthesized
gaagaagtttctaagcaaggca

SEQ ID NO: 1281273 - DNA, 22 bp, Artificial Sequence
  chemically synthesized
tgctatatagctgccttgctta

SEQ ID NO: 1281274 - DNA, 22 bp, Artificial Sequence
  chemically synthesized
agaagaagtttctaagcaaggc

SEQ ID NO: 1281275 - DNA, 22 bp, Artificial Sequence
  chemically synthesized
gctatatagctgccttgcttag

SEQ ID NO: 1281276 - DNA, 22 bp, Artificial Sequence
  chemically synthesized
ctatatagctgccttgcttaga

SEQ ID NO: 1281277 - DNA, 22 bp, Artificial Sequence
  chemically synthesized
ttagaagaagtttctaagcaag

SEQ ID NO: 1281278 - DNA, 22 bp, Artificial Sequence
  chemically synthesized
tcttagaagaagtttctaagca

SEQ ID NO: 1281279 - DNA, 22 bp, Artificial Sequence
  chemically synthesized
tatagctgccttgcttagaaac

SEQ ID NO: 1281280 - DNA, 22 bp, Artificial Sequence
  chemically synthesized
ctcttagaagaagtttctaagc

SEQ ID NO: 1281281 - DNA, 22 bp, Artificial Sequence
  chemically synthesized
ccttgcttagaaacttcttcta

SEQ ID NO: 1281282 - DNA, 22 bp, Artificial Sequence
  chemically synthesized
gcttagaaacttcttctaagag

SEQ ID NO: 1281283 - DNA, 22 bp, Artificial Sequence
  chemically synthesized
cttagaaacttcttctaagaga

SEQ ID NO: 1281284 - DNA, 22 bp, Artificial Sequence
  chemically synthesized
agaaacttcttctaagagaaat

SEQ ID NO: 1281285 - DNA, 22 bp, Artificial Sequence
  chemically synthesized
aaaagataaggcatttctctta

SEQ ID NO: 1281286 - DNA, 22 bp, Artificial Sequence
  chemically synthesized
gaaacttcttctaagagaaatg

SEQ ID NO: 1281287 - DNA, 22 bp, Artificial Sequence
  chemically synthesized
cttctaagagaaatgccttatc

SEQ ID NO: 1281288 - DNA, 22 bp, Artificial Sequence
  chemically synthesized
ttctaagagaaatgccttatct

SEQ ID NO: 1281289 - DNA, 22 bp, Artificial Sequence
  chemically synthesized
ctaagagaaatgccttatcttt

SEQ ID NO: 1281290 - DNA, 22 bp, Artificial Sequence
  chemically synthesized
atataaatctgaaaagataagg

SEQ ID NO: 1281291 - DNA, 22 bp, Artificial Sequence
  chemically synthesized
taagagaaatgccttatctttt

SEQ ID NO: 1281292 - DNA, 22 bp, Artificial Sequence
  chemically synthesized
aatataaatctgaaaagataag

SEQ ID NO: 1281293 - DNA, 22 bp, Artificial Sequence
  chemically synthesized
agagaaatgccttatcttttca

SEQ ID NO: 1281294 - DNA, 22 bp, Artificial Sequence
  chemically synthesized
gaaaatatttaatataaatctg

SEQ ID NO: 1281295 - DNA, 22 bp, Artificial Sequence
  chemically synthesized
atcttttcagatttatattaaa

SEQ ID NO: 1281296 - DNA, 22 bp, Artificial Sequence
  chemically synthesized
tcttttcagatttatattaaat

SEQ ID NO: 1281297 - DNA, 22 bp, Artificial Sequence
  chemically synthesized
ttcagatttatattaaatattt

SEQ ID NO: 1281298 - DNA, 22 bp, Artificial Sequence
  chemically synthesized
tcagatttatattaaatatttt

SEQ ID NO: 1281299 - DNA, 22 bp, Artificial Sequence
  chemically synthesized
cagatttatattaaatattttc

SEQ ID NO: 1281300 - DNA, 22 bp, Artificial Sequence
  chemically synthesized
agatttatattaaatattttcc

SEQ ID NO: 1281301 - DNA, 22 bp, Artificial Sequence
  chemically synthesized
atattaaatattttccaattct

SEQ ID NO: 1281302 - DNA, 22 bp, Artificial Sequence
  chemically synthesized
tattaaatattttccaattcta

SEQ ID NO: 1281303 - DNA, 22 bp, Artificial Sequence
  chemically synthesized
agataaaggcagaaatagaatt

SEQ ID NO: 1281304 - DNA, 22 bp, Artificial Sequence
  chemically synthesized
aatattttccaattctatttct

SEQ ID NO: 1281305 - DNA, 22 bp, Artificial Sequence
  chemically synthesized
ctgagataaaggcagaaataga

SEQ ID NO: 1281306 - DNA, 22 bp, Artificial Sequence
  chemically synthesized
cctgagataaaggcagaaatag

SEQ ID NO: 1281307 - DNA, 22 bp, Artificial Sequence
  chemically synthesized
tccaattctatttctgccttta

SEQ ID NO: 1281308 - DNA, 22 bp, Artificial Sequence
  chemically synthesized
ccaattctatttctgcctttat

SEQ ID NO: 1281309 - DNA, 22 bp, Artificial Sequence
  chemically synthesized
gaatttcctgagataaaggcag

SEQ ID NO: 1281310 - DNA, 22 bp, Artificial Sequence
  chemically synthesized
caattctatttctgcctttatc

SEQ ID NO: 1281311 - DNA, 22 bp, Artificial Sequence
  chemically synthesized
ggaatttcctgagataaaggca

SEQ ID NO: 1281312 - DNA, 22 bp, Artificial Sequence
  chemically synthesized
acttggaatttcctgagataaa

SEQ ID NO: 1281313 - DNA, 22 bp, Artificial Sequence
  chemically synthesized
tatttctgcctttatctcagga

SEQ ID NO: 1281314 - DNA, 22 bp, Artificial Sequence
  chemically synthesized
tttctgcctttatctcaggaaa

SEQ ID NO: 1281315 - DNA, 22 bp, Artificial Sequence
  chemically synthesized
atactcacttggaatttcctga

SEQ ID NO: 1281316 - DNA, 22 bp, Artificial Sequence
  chemically synthesized
ctgcctttatctcaggaaattc

SEQ ID NO: 1281317 - DNA, 22 bp, Artificial Sequence
  chemically synthesized
catactcacttggaatttcctg

SEQ ID NO: 1281318 - DNA, 22 bp, Artificial Sequence
  chemically synthesized
tgcctttatctcaggaaattcc

SEQ ID NO: 1281319 - DNA, 22 bp, Artificial Sequence
  chemically synthesized
cctttatctcaggaaattccaa

SEQ ID NO: 1281320 - DNA, 22 bp, Artificial Sequence
  chemically synthesized
tatctcaggaaattccaagtga

SEQ ID NO: 1281321 - DNA, 22 bp, Artificial Sequence
  chemically synthesized
atctcaggaaattccaagtgag

SEQ ID NO: 1281322 - DNA, 22 bp, Artificial Sequence
  chemically synthesized
tctcaggaaattccaagtgagt

SEQ ID NO: 1281323 - DNA, 22 bp, Artificial Sequence
  chemically synthesized
aggaaattccaagtgagtatga

SEQ ID NO: 1281324 - DNA, 22 bp, Artificial Sequence
  chemically synthesized
gggagggagcatgagcttcata

SEQ ID NO: 1281325 - DNA, 22 bp, Artificial Sequence
  chemically synthesized
agggagggagcatgagcttcat

SEQ ID NO: 1281326 - DNA, 22 bp, Artificial Sequence
  chemically synthesized
tagggagggagcatgagcttca

SEQ ID NO: 1281327 - DNA, 22 bp, Artificial Sequence
  chemically synthesized
caagtgagtatgaagctcatgc

SEQ ID NO: 1281328 - DNA, 22 bp, Artificial Sequence
  chemically synthesized
ttttagggagggagcatgagct

SEQ ID NO: 1281329 - DNA, 22 bp, Artificial Sequence
  chemically synthesized
ctattttagggagggagcatga

SEQ ID NO: 1281330 - DNA, 22 bp, Artificial Sequence
  chemically synthesized
gctattttagggagggagcatg

SEQ ID NO: 1281331 - DNA, 22 bp, Artificial Sequence
  chemically synthesized
tgctattttagggagggagcat

SEQ ID NO: 1281332 - DNA, 22 bp, Artificial Sequence
  chemically synthesized
ttttgctattttagggagggag

SEQ ID NO: 1281333 - DNA, 22 bp, Artificial Sequence
  chemically synthesized
ctattttgctattttagggagg

SEQ ID NO: 1281334 - DNA, 22 bp, Artificial Sequence
  chemically synthesized
gctattttgctattttagggag

SEQ ID NO: 1281335 - DNA, 22 bp, Artificial Sequence
  chemically synthesized
atgctccctccctaaaatagca

SEQ ID NO: 1281336 - DNA, 22 bp, Artificial Sequence
  chemically synthesized
cctccctaaaatagcaaaatag

SEQ ID NO: 1281337 - DNA, 22 bp, Artificial Sequence
  chemically synthesized
cctaaaatagcaaaatagcaag

SEQ ID NO: 1281338 - DNA, 22 bp, Artificial Sequence
  chemically synthesized
aaatagcaaaatagcaagctct

SEQ ID NO: 1281339 - DNA, 22 bp, Artificial Sequence
  chemically synthesized
aaaatccatgcaaagagcttgc

SEQ ID NO: 1281340 - DNA, 22 bp, Artificial Sequence
  chemically synthesized
aaaaatccatgcaaagagcttg

SEQ ID NO: 1281341 - DNA, 22 bp, Artificial Sequence
  chemically synthesized
taaaaatccatgcaaagagctt

SEQ ID NO: 1281342 - DNA, 22 bp, Artificial Sequence
  chemically synthesized
ttaaaaatccatgcaaagagct

SEQ ID NO: 1281343 - DNA, 22 bp, Artificial Sequence
  chemically synthesized
tttgcatggatttttaaaaatt

SEQ ID NO: 1281344 - DNA, 22 bp, Artificial Sequence
  chemically synthesized
aaaaaaaaagataaatttttaa

SEQ ID NO: 1281345 - DNA, 22 bp, Artificial Sequence
  chemically synthesized
tgcatggatttttaaaaattta

SEQ ID NO: 1281346 - DNA, 22 bp, Artificial Sequence
  chemically synthesized
gcatggatttttaaaaatttat

SEQ ID NO: 1281347 - DNA, 22 bp, Artificial Sequence
  chemically synthesized
catggatttttaaaaatttatc

SEQ ID NO: 1281348 - DNA, 22 bp, Artificial Sequence
  chemically synthesized
tctcaaaaaaaaagataaattt

SEQ ID NO: 1281349 - DNA, 22 bp, Artificial Sequence
  chemically synthesized
ttaaaaatttatcttttttttt

SEQ ID NO: 1281350 - DNA, 22 bp, Artificial Sequence
  chemically synthesized
taaaaatttatctttttttttg

SEQ ID NO: 1281351 - DNA, 22 bp, Artificial Sequence
  chemically synthesized
aaaaatttatctttttttttga

SEQ ID NO: 1281352 - DNA, 22 bp, Artificial Sequence
  chemically synthesized
aaaatttatctttttttttgag

SEQ ID NO: 1281353 - DNA, 22 bp, Artificial Sequence
  chemically synthesized
atctttttttttgagacagggt

SEQ ID NO: 1281354 - DNA, 22 bp, Artificial Sequence
  chemically synthesized
tctttttttttgagacagggtc

SEQ ID NO: 1281355 - DNA, 22 bp, Artificial Sequence
  chemically synthesized
ggtgagagagtgagaccctgtc

SEQ ID NO: 1281356 - DNA, 22 bp, Artificial Sequence
  chemically synthesized
tttttttgagacagggtctcac

SEQ ID NO: 1281357 - DNA, 22 bp, Artificial Sequence
  chemically synthesized
ttttttgagacagggtctcact

SEQ ID NO: 1281358 - DNA, 22 bp, Artificial Sequence
  chemically synthesized
tttttgagacagggtctcactc

SEQ ID NO: 1281359 - DNA, 22 bp, Artificial Sequence
  chemically synthesized
ttttgagacagggtctcactct

SEQ ID NO: 1281360 - DNA, 22 bp, Artificial Sequence
  chemically synthesized
tttgagacagggtctcactctc

SEQ ID NO: 1281361 - DNA, 22 bp, Artificial Sequence
  chemically synthesized
caatctgggtgagagagtgaga

SEQ ID NO: 1281362 - DNA, 22 bp, Artificial Sequence
  chemically synthesized
ttgagacagggtctcactctct

SEQ ID NO: 1281363 - DNA, 22 bp, Artificial Sequence
  chemically synthesized
tgagacagggtctcactctctc

SEQ ID NO: 1281364 - DNA, 22 bp, Artificial Sequence
  chemically synthesized
gagacagggtctcactctctca

SEQ ID NO: 1281365 - DNA, 22 bp, Artificial Sequence
  chemically synthesized
agacagggtctcactctctcac

SEQ ID NO: 1281366 - DNA, 22 bp, Artificial Sequence
  chemically synthesized
cactccaatctgggtgagagag

SEQ ID NO: 1281367 - DNA, 22 bp, Artificial Sequence
  chemically synthesized
caccactgcactccaatctggg

SEQ ID NO: 1281368 - DNA, 22 bp, Artificial Sequence
  chemically synthesized
actctctcacccagattggagt

SEQ ID NO: 1281369 - DNA, 22 bp, Artificial Sequence
  chemically synthesized
tctcacccagattggagtgcag

SEQ ID NO: 1281370 - DNA, 22 bp, Artificial Sequence
  chemically synthesized
tcacccagattggagtgcagtg

SEQ ID NO: 1281371 - DNA, 22 bp, Artificial Sequence
  chemically synthesized
acccagattggagtgcagtggt

SEQ ID NO: 1281372 - DNA, 22 bp, Artificial Sequence
  chemically synthesized
catcgagccgagattgcaccac

SEQ ID NO: 1281373 - DNA, 22 bp, Artificial Sequence
  chemically synthesized
gagtgcagtggtgcaatctcgg

SEQ ID NO: 1281374 - DNA, 22 bp, Artificial Sequence
  chemically synthesized
ggaggcggaggttgcatcgagc

SEQ ID NO: 1281375 - DNA, 22 bp, Artificial Sequence
  chemically synthesized
agcctgggaggcggaggttgca

SEQ ID NO: 1281376 - DNA, 22 bp, Artificial Sequence
  chemically synthesized
gagcctgggaggcggaggttgc

SEQ ID NO: 1281377 - DNA, 22 bp, Artificial Sequence
  chemically synthesized
ggctcgatgcaacctccgcctc

SEQ ID NO: 1281378 - DNA, 22 bp, Artificial Sequence
  chemically synthesized
gatgcaacctccgcctcccagg

SEQ ID NO: 1281379 - DNA, 22 bp, Artificial Sequence
  chemically synthesized
aggtgggggaatcacttgagcc

SEQ ID NO: 1281380 - DNA, 22 bp, Artificial Sequence
  chemically synthesized
cgcctcccaggctcaagtgatt

SEQ ID NO: 1281381 - DNA, 22 bp, Artificial Sequence
  chemically synthesized
ccaggctcaagtgattccccca

SEQ ID NO: 1281382 - DNA, 22 bp, Artificial Sequence
  chemically synthesized
aggaggctgaggtgggggaatc

SEQ ID NO: 1281383 - DNA, 22 bp, Artificial Sequence
  chemically synthesized
ctcaggaggctgaggtggggga

SEQ ID NO: 1281384 - DNA, 22 bp, Artificial Sequence
  chemically synthesized
aagtgattcccccacctcagcc

SEQ ID NO: 1281385 - DNA, 22 bp, Artificial Sequence
  chemically synthesized
taatcccagctactcaggaggc

SEQ ID NO: 1281386 - DNA, 22 bp, Artificial Sequence
  chemically synthesized
ccccacctcagcctcctgagta

SEQ ID NO: 1281387 - DNA, 22 bp, Artificial Sequence
  chemically synthesized
agcctcctgagtagctgggatt

SEQ ID NO: 1281388 - DNA, 22 bp, Artificial Sequence
  chemically synthesized
ctgagtagctgggattacaggc

SEQ ID NO: 1281389 - DNA, 22 bp, Artificial Sequence
  chemically synthesized
agtagctgggattacaggcgtg

SEQ ID NO: 1281390 - DNA, 22 bp, Artificial Sequence
  chemically synthesized
agtgtaatggcgcacgcctgta

SEQ ID NO: 1281391 - DNA, 22 bp, Artificial Sequence
  chemically synthesized
gttcagtgtaatggcgcacgcc

SEQ ID NO: 1281392 - DNA, 22 bp, Artificial Sequence
  chemically synthesized
ggattacaggcgtgcgccatta

SEQ ID NO: 1281393 - DNA, 22 bp, Artificial Sequence
  chemically synthesized
caggcgtgcgccattacactga

SEQ ID NO: 1281394 - DNA, 22 bp, Artificial Sequence
  chemically synthesized
aaaatataaaaattagttcagt

SEQ ID NO: 1281395 - DNA, 22 bp, Artificial Sequence
  chemically synthesized
ctaaaaatataaaaattagttc

SEQ ID NO: 1281396 - DNA, 22 bp, Artificial Sequence
  chemically synthesized
tactaaaaatataaaaattagt

SEQ ID NO: 1281397 - DNA, 22 bp, Artificial Sequence
  chemically synthesized
cactgaactaatttttatattt

SEQ ID NO: 1281398 - DNA, 22 bp, Artificial Sequence
  chemically synthesized
aactaatttttatatttttagt

SEQ ID NO: 1281399 - DNA, 22 bp, Artificial Sequence
  chemically synthesized
atttttatatttttagtagaga

SEQ ID NO: 1281400 - DNA, 22 bp, Artificial Sequence
  chemically synthesized
ttatatttttagtagagacggg

SEQ ID NO: 1281401 - DNA, 22 bp, Artificial Sequence
  chemically synthesized
tatatttttagtagagacgggt

SEQ ID NO: 1281402 - DNA, 22 bp, Artificial Sequence
  chemically synthesized
atatttttagtagagacgggtt

SEQ ID NO: 1281403 - DNA, 22 bp, Artificial Sequence
  chemically synthesized
tatttttagtagagacgggttt

SEQ ID NO: 1281404 - DNA, 22 bp, Artificial Sequence
  chemically synthesized
gccaacatggtgaaacccgtct

SEQ ID NO: 1281405 - DNA, 22 bp, Artificial Sequence
  chemically synthesized
ttagtagagacgggtttcacca

SEQ ID NO: 1281406 - DNA, 22 bp, Artificial Sequence
  chemically synthesized
tagtagagacgggtttcaccat

SEQ ID NO: 1281407 - DNA, 22 bp, Artificial Sequence
  chemically synthesized
agtagagacgggtttcaccatg

SEQ ID NO: 1281408 - DNA, 22 bp, Artificial Sequence
  chemically synthesized
gtagagacgggtttcaccatgt

SEQ ID NO: 1281409 - DNA, 22 bp, Artificial Sequence
  chemically synthesized
gagaccaacctggccaacatgg

SEQ ID NO: 1281410 - DNA, 22 bp, Artificial Sequence
  chemically synthesized
caccatgttggccaggttggtc

SEQ ID NO: 1281411 - DNA, 22 bp, Artificial Sequence
  chemically synthesized
accatgttggccaggttggtct

SEQ ID NO: 1281412 - DNA, 22 bp, Artificial Sequence
  chemically synthesized
aggtcaggagttggagaccaac

SEQ ID NO: 1281413 - DNA, 22 bp, Artificial Sequence
  chemically synthesized
gaggtcaggagttggagaccaa

SEQ ID NO: 1281414 - DNA, 22 bp, Artificial Sequence
  chemically synthesized
gccaggttggtctccaactcct

SEQ ID NO: 1281415 - DNA, 22 bp, Artificial Sequence
  chemically synthesized
gtctccaactcctgacctcaaa

SEQ ID NO: 1281416 - DNA, 22 bp, Artificial Sequence
  chemically synthesized
caactcctgacctcaaatgatc

SEQ ID NO: 1281417 - DNA, 22 bp, Artificial Sequence
  chemically synthesized
ggaggcccagacaggtggatca

SEQ ID NO: 1281418 - DNA, 22 bp, Artificial Sequence
  chemically synthesized
ctgacctcaaatgatccacctg

SEQ ID NO: 1281419 - DNA, 22 bp, Artificial Sequence
  chemically synthesized
gggaggcccagacaggtggatc

SEQ ID NO: 1281420 - DNA, 22 bp, Artificial Sequence
  chemically synthesized
tgggaggcccagacaggtggat

SEQ ID NO: 1281421 - DNA, 22 bp, Artificial Sequence
  chemically synthesized
acctcaaatgatccacctgtct

SEQ ID NO: 1281422 - DNA, 22 bp, Artificial Sequence
  chemically synthesized
aaatgatccacctgtctgggcc

SEQ ID NO: 1281423 - DNA, 22 bp, Artificial Sequence
  chemically synthesized
taatcccagcactttgggaggc

SEQ ID NO: 1281424 - DNA, 22 bp, Artificial Sequence
  chemically synthesized
tctgggcctcccaaagtgctgg

SEQ ID NO: 1281425 - DNA, 22 bp, Artificial Sequence
  chemically synthesized
atgcctgtaatcccagcacttt

SEQ ID NO: 1281426 - DNA, 22 bp, Artificial Sequence
  chemically synthesized
ggcctcccaaagtgctgggatt

SEQ ID NO: 1281427 - DNA, 22 bp, Artificial Sequence
  chemically synthesized
ccaaagtgctgggattacaggc

SEQ ID NO: 1281428 - DNA, 22 bp, Artificial Sequence
  chemically synthesized
ggattacaggcatgagacactg

SEQ ID NO: 1281429 - DNA, 22 bp, Artificial Sequence
  chemically synthesized
caggcatgagacactgcgcccg

SEQ ID NO: 1281430 - DNA, 22 bp, Artificial Sequence
  chemically synthesized
taaaaagatcatacggccgggc

SEQ ID NO: 1281431 - DNA, 22 bp, Artificial Sequence
  chemically synthesized
gtaaaaagatcatacggccggg

SEQ ID NO: 1281432 - DNA, 22 bp, Artificial Sequence
  chemically synthesized
aaaccttgtaaaaagatcatac

SEQ ID NO: 1281433 - DNA, 22 bp, Artificial Sequence
  chemically synthesized
gaaaccttgtaaaaagatcata

SEQ ID NO: 1281434 - DNA, 22 bp, Artificial Sequence
  chemically synthesized
cgcccggccgtatgatcttttt

SEQ ID NO: 1281435 - DNA, 22 bp, Artificial Sequence
  chemically synthesized
cttgaaaccttgtaaaaagatc

SEQ ID NO: 1281436 - DNA, 22 bp, Artificial Sequence
  chemically synthesized
ttacttgaaaccttgtaaaaag

SEQ ID NO: 1281437 - DNA, 22 bp, Artificial Sequence
  chemically synthesized
tttacaaggtttcaagtaacaa

SEQ ID NO: 1281438 - DNA, 22 bp, Artificial Sequence
  chemically synthesized
ttacaaggtttcaagtaacaat

SEQ ID NO: 1281439 - DNA, 22 bp, Artificial Sequence
  chemically synthesized
tacaaggtttcaagtaacaatt

SEQ ID NO: 1281440 - DNA, 22 bp, Artificial Sequence
  chemically synthesized
acaaggtttcaagtaacaattt

SEQ ID NO: 1281441 - DNA, 22 bp, Artificial Sequence
  chemically synthesized
caaggtttcaagtaacaatttt

SEQ ID NO: 1281442 - DNA, 22 bp, Artificial Sequence
  chemically synthesized
aagcaaaggaaataaaattgtt

SEQ ID NO: 1281443 - DNA, 22 bp, Artificial Sequence
  chemically synthesized
gaagcaaaggaaataaaattgt

SEQ ID NO: 1281444 - DNA, 22 bp, Artificial Sequence
  chemically synthesized
tgaagcaaaggaaataaaattg

SEQ ID NO: 1281445 - DNA, 22 bp, Artificial Sequence
  chemically synthesized
caagtaacaattttatttcctt

SEQ ID NO: 1281446 - DNA, 22 bp, Artificial Sequence
  chemically synthesized
aagtaacaattttatttccttt

SEQ ID NO: 1281447 - DNA, 22 bp, Artificial Sequence
  chemically synthesized
gaaattttgaagcaaaggaaat

SEQ ID NO: 1281448 - DNA, 22 bp, Artificial Sequence
  chemically synthesized
tatttcctttgcttcaaaattt

SEQ ID NO: 1281449 - DNA, 22 bp, Artificial Sequence
  chemically synthesized
atttcctttgcttcaaaatttc

SEQ ID NO: 1281450 - DNA, 22 bp, Artificial Sequence
  chemically synthesized
tttcctttgcttcaaaatttcc

SEQ ID NO: 1281451 - DNA, 22 bp, Artificial Sequence
  chemically synthesized
aatggcaatagttggaaatttt

SEQ ID NO: 1281452 - DNA, 22 bp, Artificial Sequence
  chemically synthesized
gaatggcaatagttggaaattt

SEQ ID NO: 1281453 - DNA, 22 bp, Artificial Sequence
  chemically synthesized
cctttgcttcaaaatttccaac

SEQ ID NO: 1281454 - DNA, 22 bp, Artificial Sequence
  chemically synthesized
ctttgcttcaaaatttccaact

SEQ ID NO: 1281455 - DNA, 22 bp, Artificial Sequence
  chemically synthesized
tgcttcaaaatttccaactatt

SEQ ID NO: 1281456 - DNA, 22 bp, Artificial Sequence
  chemically synthesized
gcttcaaaatttccaactattg

SEQ ID NO: 1281457 - DNA, 22 bp, Artificial Sequence
  chemically synthesized
cttcaaaatttccaactattgc

SEQ ID NO: 1281458 - DNA, 22 bp, Artificial Sequence
  chemically synthesized
caaaatttccaactattgccat

SEQ ID NO: 1281459 - DNA, 22 bp, Artificial Sequence
  chemically synthesized
aaaatttccaactattgccatt

SEQ ID NO: 1281460 - DNA, 22 bp, Artificial Sequence
  chemically synthesized
tcagtggaaagcacttgaatgg

SEQ ID NO: 1281461 - DNA, 22 bp, Artificial Sequence
  chemically synthesized
ccaactattgccattcaagtgc

SEQ ID NO: 1281462 - DNA, 22 bp, Artificial Sequence
  chemically synthesized
caactattgccattcaagtgct

SEQ ID NO: 1281463 - DNA, 22 bp, Artificial Sequence
  chemically synthesized
cagactatcagtggaaagcact

SEQ ID NO: 1281464 - DNA, 22 bp, Artificial Sequence
  chemically synthesized
gcagactatcagtggaaagcac

SEQ ID NO: 1281465 - DNA, 22 bp, Artificial Sequence
  chemically synthesized
ttgccattcaagtgctttccac

SEQ ID NO: 1281466 - DNA, 22 bp, Artificial Sequence
  chemically synthesized
ccattcaagtgctttccactga

SEQ ID NO: 1281467 - DNA, 22 bp, Artificial Sequence
  chemically synthesized
tgtatttgcagactatcagtgg

SEQ ID NO: 1281468 - DNA, 22 bp, Artificial Sequence
  chemically synthesized
aagtgctttccactgatagtct

SEQ ID NO: 1281469 - DNA, 22 bp, Artificial Sequence
  chemically synthesized
aagggttgtgtatttgcagact

SEQ ID NO: 1281470 - DNA, 22 bp, Artificial Sequence
  chemically synthesized
caagggttgtgtatttgcagac

SEQ ID NO: 1281471 - DNA, 22 bp, Artificial Sequence
  chemically synthesized
tccactgatagtctgcaaatac

SEQ ID NO: 1281472 - DNA, 22 bp, Artificial Sequence
  chemically synthesized
ttcaagggttgtgtatttgcag

SEQ ID NO: 1281473 - DNA, 22 bp, Artificial Sequence
  chemically synthesized
ccactgatagtctgcaaataca

SEQ ID NO: 1281474 - DNA, 22 bp, Artificial Sequence
  chemically synthesized
cactgatagtctgcaaatacac

SEQ ID NO: 1281475 - DNA, 22 bp, Artificial Sequence
  chemically synthesized
atagtctgcaaatacacaaccc

SEQ ID NO: 1281476 - DNA, 22 bp, Artificial Sequence
  chemically synthesized
caatgagttcttcaagggttgt

SEQ ID NO: 1281477 - DNA, 22 bp, Artificial Sequence
  chemically synthesized
caaatacacaacccttgaagaa

SEQ ID NO: 1281478 - DNA, 22 bp, Artificial Sequence
  chemically synthesized
gccatagttacaatgagttctt

SEQ ID NO: 1281479 - DNA, 22 bp, Artificial Sequence
  chemically synthesized
ggccatagttacaatgagttct

SEQ ID NO: 1281480 - DNA, 22 bp, Artificial Sequence
  chemically synthesized
tggccatagttacaatgagttc

SEQ ID NO: 1281481 - DNA, 22 bp, Artificial Sequence
  chemically synthesized
ttggccatagttacaatgagtt

SEQ ID NO: 1281482 - DNA, 22 bp, Artificial Sequence
  chemically synthesized
ttttggccatagttacaatgag

SEQ ID NO: 1281483 - DNA, 22 bp, Artificial Sequence
  chemically synthesized
gaagaactcattgtaactatgg

SEQ ID NO: 1281484 - DNA, 22 bp, Artificial Sequence
  chemically synthesized
aagaactcattgtaactatggc

SEQ ID NO: 1281485 - DNA, 22 bp, Artificial Sequence
  chemically synthesized
aaacagtgactcttttggccat

SEQ ID NO: 1281486 - DNA, 22 bp, Artificial Sequence
  chemically synthesized
aaaacagtgactcttttggcca

SEQ ID NO: 1281487 - DNA, 22 bp, Artificial Sequence
  chemically synthesized
attgtaactatggccaaaagag

SEQ ID NO: 1281488 - DNA, 22 bp, Artificial Sequence
  chemically synthesized
tgtttaaaacagtgactctttt

SEQ ID NO: 1281489 - DNA, 22 bp, Artificial Sequence
  chemically synthesized
taactatggccaaaagagtcac

SEQ ID NO: 1281490 - DNA, 22 bp, Artificial Sequence
  chemically synthesized
tggccaaaagagtcactgtttt

SEQ ID NO: 1281491 - DNA, 22 bp, Artificial Sequence
  chemically synthesized
tgtgagattgtgtttaaaacag

SEQ ID NO: 1281492 - DNA, 22 bp, Artificial Sequence
  chemically synthesized
atgtgagattgtgtttaaaaca

SEQ ID NO: 1281493 - DNA, 22 bp, Artificial Sequence
  chemically synthesized
tatgtgagattgtgtttaaaac

SEQ ID NO: 1281494 - DNA, 22 bp, Artificial Sequence
  chemically synthesized
tttatgtgagattgtgtttaaa

SEQ ID NO: 1281495 - DNA, 22 bp, Artificial Sequence
  chemically synthesized
ctttatgtgagattgtgtttaa

SEQ ID NO: 1281496 - DNA, 22 bp, Artificial Sequence
  chemically synthesized
agtcttctttatgtgagattgt

SEQ ID NO: 1281497 - DNA, 22 bp, Artificial Sequence
  chemically synthesized
aagtcttctttatgtgagattg

SEQ ID NO: 1281498 - DNA, 22 bp, Artificial Sequence
  chemically synthesized
ttttaaacacaatctcacataa

SEQ ID NO: 1281499 - DNA, 22 bp, Artificial Sequence
  chemically synthesized
gtttaagtcttctttatgtgag

SEQ ID NO: 1281500 - DNA, 22 bp, Artificial Sequence
  chemically synthesized
taaacacaatctcacataaaga

SEQ ID NO: 1281501 - DNA, 22 bp, Artificial Sequence
  chemically synthesized
aaacacaatctcacataaagaa

SEQ ID NO: 1281502 - DNA, 22 bp, Artificial Sequence
  chemically synthesized
aacacaatctcacataaagaag

SEQ ID NO: 1281503 - DNA, 22 bp, Artificial Sequence
  chemically synthesized
gtacacctagtttaagtcttct

SEQ ID NO: 1281504 - DNA, 22 bp, Artificial Sequence
  chemically synthesized
acataaagaagacttaaactag

SEQ ID NO: 1281505 - DNA, 22 bp, Artificial Sequence
  chemically synthesized
gatggagtcaactagtacacct

SEQ ID NO: 1281506 - DNA, 22 bp, Artificial Sequence
  chemically synthesized
tagatggagtcaactagtacac

SEQ ID NO: 1281507 - DNA, 22 bp, Artificial Sequence
  chemically synthesized
ctagatggagtcaactagtaca

SEQ ID NO: 1281508 - DNA, 22 bp, Artificial Sequence
  chemically synthesized
tctagatggagtcaactagtac

SEQ ID NO: 1281509 - DNA, 22 bp, Artificial Sequence
  chemically synthesized
aaactaggtgtactagttgact

SEQ ID NO: 1281510 - DNA, 22 bp, Artificial Sequence
  chemically synthesized
aactaggtgtactagttgactc

SEQ ID NO: 1281511 - DNA, 22 bp, Artificial Sequence
  chemically synthesized
ggtgtactagttgactccatct

SEQ ID NO: 1281512 - DNA, 22 bp, Artificial Sequence
  chemically synthesized
ggagaaataattttctagatgg

SEQ ID NO: 1281513 - DNA, 22 bp, Artificial Sequence
  chemically synthesized
tctaggagaaataattttctag

SEQ ID NO: 1281514 - DNA, 22 bp, Artificial Sequence
  chemically synthesized
gttgactccatctagaaaatta

SEQ ID NO: 1281515 - DNA, 22 bp, Artificial Sequence
  chemically synthesized
tgtctaggagaaataattttct

SEQ ID NO: 1281516 - DNA, 22 bp, Artificial Sequence
  chemically synthesized
ctgtctaggagaaataattttc

SEQ ID NO: 1281517 - DNA, 22 bp, Artificial Sequence
  chemically synthesized
actccatctagaaaattatttc

SEQ ID NO: 1281518 - DNA, 22 bp, Artificial Sequence
  chemically synthesized
catctagaaaattatttctcct

SEQ ID NO: 1281519 - DNA, 22 bp, Artificial Sequence
  chemically synthesized
agatttctgtctaggagaaata

SEQ ID NO: 1281520 - DNA, 22 bp, Artificial Sequence
  chemically synthesized
atctaagatttctgtctaggag

SEQ ID NO: 1281521 - DNA, 22 bp, Artificial Sequence
  chemically synthesized
gaaaattatttctcctagacag

SEQ ID NO: 1281522 - DNA, 22 bp, Artificial Sequence
  chemically synthesized
cctaatctaagatttctgtcta

SEQ ID NO: 1281523 - DNA, 22 bp, Artificial Sequence
  chemically synthesized
gcctaatctaagatttctgtct

SEQ ID NO: 1281524 - DNA, 22 bp, Artificial Sequence
  chemically synthesized
tttctcctagacagaaatctta

SEQ ID NO: 1281525 - DNA, 22 bp, Artificial Sequence
  chemically synthesized
ctcctagacagaaatcttagat

SEQ ID NO: 1281526 - DNA, 22 bp, Artificial Sequence
  chemically synthesized
tcctagacagaaatcttagatt

SEQ ID NO: 1281527 - DNA, 22 bp, Artificial Sequence
  chemically synthesized
ctagacagaaatcttagattag

SEQ ID NO: 1281528 - DNA, 22 bp, Artificial Sequence
  chemically synthesized
agtcacatttgcctaatctaag

SEQ ID NO: 1281529 - DNA, 22 bp, Artificial Sequence
  chemically synthesized
gacagaaatcttagattaggca

SEQ ID NO: 1281530 - DNA, 22 bp, Artificial Sequence
  chemically synthesized
gctcagtcacatttgcctaatc

SEQ ID NO: 1281531 - DNA, 22 bp, Artificial Sequence
  chemically synthesized
agctcagtcacatttgcctaat

SEQ ID NO: 1281532 - DNA, 22 bp, Artificial Sequence
  chemically synthesized
tttagctcagtcacatttgcct

SEQ ID NO: 1281533 - DNA, 22 bp, Artificial Sequence
  chemically synthesized
gtttagctcagtcacatttgcc

SEQ ID NO: 1281534 - DNA, 22 bp, Artificial Sequence
  chemically synthesized
tgtttagctcagtcacatttgc

SEQ ID NO: 1281535 - DNA, 22 bp, Artificial Sequence
  chemically synthesized
agattaggcaaatgtgactgag

SEQ ID NO: 1281536 - DNA, 22 bp, Artificial Sequence
  chemically synthesized
gattaggcaaatgtgactgagc

SEQ ID NO: 1281537 - DNA, 22 bp, Artificial Sequence
  chemically synthesized
taaagactttgtttagctcagt

SEQ ID NO: 1281538 - DNA, 22 bp, Artificial Sequence
  chemically synthesized
ggcaaatgtgactgagctaaac

SEQ ID NO: 1281539 - DNA, 22 bp, Artificial Sequence
  chemically synthesized
taaattataaagactttgttta

SEQ ID NO: 1281540 - DNA, 22 bp, Artificial Sequence
  chemically synthesized
gtaaattataaagactttgttt

SEQ ID NO: 1281541 - DNA, 22 bp, Artificial Sequence
  chemically synthesized
agaacttgtaaattataaagac

SEQ ID NO: 1281542 - DNA, 22 bp, Artificial Sequence
  chemically synthesized
agctaaacaaagtctttataat

SEQ ID NO: 1281543 - DNA, 22 bp, Artificial Sequence
  chemically synthesized
aacaaagtctttataatttaca

SEQ ID NO: 1281544 - DNA, 22 bp, Artificial Sequence
  chemically synthesized
atccctaagaacttgtaaatta

SEQ ID NO: 1281545 - DNA, 22 bp, Artificial Sequence
  chemically synthesized
agaattgatccctaagaacttg

SEQ ID NO: 1281546 - DNA, 22 bp, Artificial Sequence
  chemically synthesized
tataatttacaagttcttaggg

SEQ ID NO: 1281547 - DNA, 22 bp, Artificial Sequence
  chemically synthesized
ataatttacaagttcttaggga

SEQ ID NO: 1281548 - DNA, 22 bp, Artificial Sequence
  chemically synthesized
taatttacaagttcttagggat

SEQ ID NO: 1281549 - DNA, 22 bp, Artificial Sequence
  chemically synthesized
tacaaaattaagaattgatccc

SEQ ID NO: 1281550 - DNA, 22 bp, Artificial Sequence
  chemically synthesized
acaagttcttagggatcaattc

SEQ ID NO: 1281551 - DNA, 22 bp, Artificial Sequence
  chemically synthesized
gtacaaaattaagaattgatcc

SEQ ID NO: 1281552 - DNA, 22 bp, Artificial Sequence
  chemically synthesized
caagttcttagggatcaattct

SEQ ID NO: 1281553 - DNA, 22 bp, Artificial Sequence
  chemically synthesized
tgtacaaaattaagaattgatc

SEQ ID NO: 1281554 - DNA, 22 bp, Artificial Sequence
  chemically synthesized
tggttttgtacaaaattaagaa

SEQ ID NO: 1281555 - DNA, 22 bp, Artificial Sequence
  chemically synthesized
ttagggatcaattcttaatttt

SEQ ID NO: 1281556 - DNA, 22 bp, Artificial Sequence
  chemically synthesized
agggatcaattcttaattttgt

SEQ ID NO: 1281557 - DNA, 22 bp, Artificial Sequence
  chemically synthesized
gggatcaattcttaattttgta

SEQ ID NO: 1281558 - DNA, 22 bp, Artificial Sequence
  chemically synthesized
gtaattgtggttttgtacaaaa

SEQ ID NO: 1281559 - DNA, 22 bp, Artificial Sequence
  chemically synthesized
ttaattttgtacaaaaccacaa

SEQ ID NO: 1281560 - DNA, 22 bp, Artificial Sequence
  chemically synthesized
aattttgtacaaaaccacaatt

SEQ ID NO: 1281561 - DNA, 22 bp, Artificial Sequence
  chemically synthesized
attttgtacaaaaccacaatta

SEQ ID NO: 1281562 - DNA, 22 bp, Artificial Sequence
  chemically synthesized
gagatcatatgttggtaattgt

SEQ ID NO: 1281563 - DNA, 22 bp, Artificial Sequence
  chemically synthesized
tgtacaaaaccacaattaccaa

SEQ ID NO: 1281564 - DNA, 22 bp, Artificial Sequence
  chemically synthesized
gtacaaaaccacaattaccaac

SEQ ID NO: 1281565 - DNA, 22 bp, Artificial Sequence
  chemically synthesized
tacaaaaccacaattaccaaca

SEQ ID NO: 1281566 - DNA, 22 bp, Artificial Sequence
  chemically synthesized
tcagagttggagatcatatgtt

SEQ ID NO: 1281567 - DNA, 22 bp, Artificial Sequence
  chemically synthesized
ccaacatatgatctccaactct

SEQ ID NO: 1281568 - DNA, 22 bp, Artificial Sequence
  chemically synthesized
aaaataagaccccattgtcaga

SEQ ID NO: 1281569 - DNA, 22 bp, Artificial Sequence
  chemically synthesized
caactctgacaatggggtctta

SEQ ID NO: 1281570 - DNA, 22 bp, Artificial Sequence
  chemically synthesized
taatggagattaaaaataagac

SEQ ID NO: 1281571 - DNA, 22 bp, Artificial Sequence
  chemically synthesized
ataatggagattaaaaataaga

SEQ ID NO: 1281572 - DNA, 22 bp, Artificial Sequence
  chemically synthesized
tgacaatggggtcttattttta

SEQ ID NO: 1281573 - DNA, 22 bp, Artificial Sequence
  chemically synthesized
acaatggggtcttatttttaat

SEQ ID NO: 1281574 - DNA, 22 bp, Artificial Sequence
  chemically synthesized
ccaatttataatggagattaaa

SEQ ID NO: 1281575 - DNA, 22 bp, Artificial Sequence
  chemically synthesized
ttgccaatttataatggagatt

SEQ ID NO: 1281576 - DNA, 22 bp, Artificial Sequence
  chemically synthesized
tgttgccaatttataatggaga

SEQ ID NO: 1281577 - DNA, 22 bp, Artificial Sequence
  chemically synthesized
ctgttgccaatttataatggag

SEQ ID NO: 1281578 - DNA, 22 bp, Artificial Sequence
  chemically synthesized
atttttaatctccattataaat

SEQ ID NO: 1281579 - DNA, 22 bp, Artificial Sequence
  chemically synthesized
tttttaatctccattataaatt

SEQ ID NO: 1281580 - DNA, 22 bp, Artificial Sequence
  chemically synthesized
ttaatctccattataaattggc

SEQ ID NO: 1281581 - DNA, 22 bp, Artificial Sequence
  chemically synthesized
taatctccattataaattggca

SEQ ID NO: 1281582 - DNA, 22 bp, Artificial Sequence
  chemically synthesized
aatctccattataaattggcaa

SEQ ID NO: 1281583 - DNA, 22 bp, Artificial Sequence
  chemically synthesized
atctccattataaattggcaac

SEQ ID NO: 1281584 - DNA, 22 bp, Artificial Sequence
  chemically synthesized
cattataaattggcaacagaaa

SEQ ID NO: 1281585 - DNA, 22 bp, Artificial Sequence
  chemically synthesized
aaatgagatgagaagatttctg

SEQ ID NO: 1281586 - DNA, 22 bp, Artificial Sequence
  chemically synthesized
taaattggcaacagaaatcttc

SEQ ID NO: 1281587 - DNA, 22 bp, Artificial Sequence
  chemically synthesized
ctgaaatgagatgagaagattt

SEQ ID NO: 1281588 - DNA, 22 bp, Artificial Sequence
  chemically synthesized
actgaaatgagatgagaagatt

SEQ ID NO: 1281589 - DNA, 22 bp, Artificial Sequence
  chemically synthesized
tactgaaatgagatgagaagat

SEQ ID NO: 1281590 - DNA, 22 bp, Artificial Sequence
  chemically synthesized
gcaacagaaatcttctcatctc

SEQ ID NO: 1281591 - DNA, 22 bp, Artificial Sequence
  chemically synthesized
gcaaagccaactttactgaaat

SEQ ID NO: 1281592 - DNA, 22 bp, Artificial Sequence
  chemically synthesized
ggcaaagccaactttactgaaa

SEQ ID NO: 1281593 - DNA, 22 bp, Artificial Sequence
  chemically synthesized
tggcaaagccaactttactgaa

SEQ ID NO: 1281594 - DNA, 22 bp, Artificial Sequence
  chemically synthesized
ctcatctcatttcagtaaagtt

SEQ ID NO: 1281595 - DNA, 22 bp, Artificial Sequence
  chemically synthesized
tcatctcatttcagtaaagttg

SEQ ID NO: 1281596 - DNA, 22 bp, Artificial Sequence
  chemically synthesized
ttttggcaaagccaactttact

SEQ ID NO: 1281597 - DNA, 22 bp, Artificial Sequence
  chemically synthesized
attttggcaaagccaactttac

SEQ ID NO: 1281598 - DNA, 22 bp, Artificial Sequence
  chemically synthesized
atctcatttcagtaaagttggc

SEQ ID NO: 1281599 - DNA, 22 bp, Artificial Sequence
  chemically synthesized
tattttggcaaagccaacttta

SEQ ID NO: 1281600 - DNA, 22 bp, Artificial Sequence
  chemically synthesized
tttattttggcaaagccaactt

SEQ ID NO: 1281601 - DNA, 22 bp, Artificial Sequence
  chemically synthesized
ctttattttggcaaagccaact

SEQ ID NO: 1281602 - DNA, 22 bp, Artificial Sequence
  chemically synthesized
atttcagtaaagttggctttgc

SEQ ID NO: 1281603 - DNA, 22 bp, Artificial Sequence
  chemically synthesized
cagtaaagttggctttgccaaa

SEQ ID NO: 1281604 - DNA, 22 bp, Artificial Sequence
  chemically synthesized
agtaaagttggctttgccaaaa

SEQ ID NO: 1281605 - DNA, 22 bp, Artificial Sequence
  chemically synthesized
aaagagagtttctttattttgg

SEQ ID NO: 1281606 - DNA, 22 bp, Artificial Sequence
  chemically synthesized
gctttgccaaaataaagaaact

SEQ ID NO: 1281607 - DNA, 22 bp, Artificial Sequence
  chemically synthesized
aggttcaaagagagtttcttta

SEQ ID NO: 1281608 - DNA, 22 bp, Artificial Sequence
  chemically synthesized
tgccaaaataaagaaactctct

SEQ ID NO: 1281609 - DNA, 22 bp, Artificial Sequence
  chemically synthesized
attcaggttcaaagagagtttc

SEQ ID NO: 1281610 - DNA, 22 bp, Artificial Sequence
  chemically synthesized
gccaaaataaagaaactctctt

SEQ ID NO: 1281611 - DNA, 22 bp, Artificial Sequence
  chemically synthesized
ccaaaataaagaaactctcttt

SEQ ID NO: 1281612 - DNA, 22 bp, Artificial Sequence
  chemically synthesized
tacatccatcatctgattcagg

SEQ ID NO: 1281613 - DNA, 22 bp, Artificial Sequence
  chemically synthesized
gtacatccatcatctgattcag

SEQ ID NO: 1281614 - DNA, 22 bp, Artificial Sequence
  chemically synthesized
tctttgaacctgaatcagatga

SEQ ID NO: 1281615 - DNA, 22 bp, Artificial Sequence
  chemically synthesized
tttgaacctgaatcagatgatg

SEQ ID NO: 1281616 - DNA, 22 bp, Artificial Sequence
  chemically synthesized
tgaacctgaatcagatgatgga

SEQ ID NO: 1281617 - DNA, 22 bp, Artificial Sequence
  chemically synthesized
gaacctgaatcagatgatggat

SEQ ID NO: 1281618 - DNA, 22 bp, Artificial Sequence
  chemically synthesized
aacctgaatcagatgatggatg

SEQ ID NO: 1281619 - DNA, 22 bp, Artificial Sequence
  chemically synthesized
aatcagatgatggatgtacaag

SEQ ID NO: 1281620 - DNA, 22 bp, Artificial Sequence
  chemically synthesized
agcccagaaaataagtgacttg

SEQ ID NO: 1281621 - DNA, 22 bp, Artificial Sequence
  chemically synthesized
taagcccagaaaataagtgact

SEQ ID NO: 1281622 - DNA, 22 bp, Artificial Sequence
  chemically synthesized
cagagtaactctaagcccagaa

SEQ ID NO: 1281623 - DNA, 22 bp, Artificial Sequence
  chemically synthesized
tccagagtaactctaagcccag

SEQ ID NO: 1281624 - DNA, 22 bp, Artificial Sequence
  chemically synthesized
ctctccagagtaactctaagcc

SEQ ID NO: 1281625 - DNA, 22 bp, Artificial Sequence
  chemically synthesized
attttctgggcttagagttact

SEQ ID NO: 1281626 - DNA, 22 bp, Artificial Sequence
  chemically synthesized
gttactctccagagtaactcta

SEQ ID NO: 1281627 - DNA, 22 bp, Artificial Sequence
  chemically synthesized
ttttctgggcttagagttactc

SEQ ID NO: 1281628 - DNA, 22 bp, Artificial Sequence
  chemically synthesized
tctgggcttagagttactctgg

SEQ ID NO: 1281629 - DNA, 22 bp, Artificial Sequence
  chemically synthesized
ctgggcttagagttactctgga

SEQ ID NO: 1281630 - DNA, 22 bp, Artificial Sequence
  chemically synthesized
tgggcttagagttactctggag

SEQ ID NO: 1281631 - DNA, 22 bp, Artificial Sequence
  chemically synthesized
aacattggttactctccagagt

SEQ ID NO: 1281632 - DNA, 22 bp, Artificial Sequence
  chemically synthesized
ggcttagagttactctggagag

SEQ ID NO: 1281633 - DNA, 22 bp, Artificial Sequence
  chemically synthesized
agagttactctggagagtaacc

SEQ ID NO: 1281634 - DNA, 22 bp, Artificial Sequence
  chemically synthesized
gagttactctggagagtaacca

SEQ ID NO: 1281635 - DNA, 22 bp, Artificial Sequence
  chemically synthesized
ataaattaaacattggttactc

SEQ ID NO: 1281636 - DNA, 22 bp, Artificial Sequence
  chemically synthesized
ctctggagagtaaccaatgttt

SEQ ID NO: 1281637 - DNA, 22 bp, Artificial Sequence
  chemically synthesized
tggagagtaaccaatgtttaat

SEQ ID NO: 1281638 - DNA, 22 bp, Artificial Sequence
  chemically synthesized
ggaacattgataaattaaacat

SEQ ID NO: 1281639 - DNA, 22 bp, Artificial Sequence
  chemically synthesized
gagagtaaccaatgtttaattt

SEQ ID NO: 1281640 - DNA, 22 bp, Artificial Sequence
  chemically synthesized
taggaacattgataaattaaac

SEQ ID NO: 1281641 - DNA, 22 bp, Artificial Sequence
  chemically synthesized
ctaggaacattgataaattaaa

SEQ ID NO: 1281642 - DNA, 22 bp, Artificial Sequence
  chemically synthesized
atttctaggaacattgataaat

SEQ ID NO: 1281643 - DNA, 22 bp, Artificial Sequence
  chemically synthesized
attaatttctaggaacattgat

SEQ ID NO: 1281644 - DNA, 22 bp, Artificial Sequence
  chemically synthesized
aactaattaatttctaggaaca

SEQ ID NO: 1281645 - DNA, 22 bp, Artificial Sequence
  chemically synthesized
aatttatcaatgttcctagaaa

SEQ ID NO: 1281646 - DNA, 22 bp, Artificial Sequence
  chemically synthesized
atttatcaatgttcctagaaat

SEQ ID NO: 1281647 - DNA, 22 bp, Artificial Sequence
  chemically synthesized
atcaatgttcctagaaattaat

SEQ ID NO: 1281648 - DNA, 22 bp, Artificial Sequence
  chemically synthesized
tcaatgttcctagaaattaatt

SEQ ID NO: 1281649 - DNA, 22 bp, Artificial Sequence
  chemically synthesized
ctagaaattaattagtttaaca

SEQ ID NO: 1281650 - DNA, 22 bp, Artificial Sequence
  chemically synthesized
gaaattaattagtttaacatga

SEQ ID NO: 1281651 - DNA, 22 bp, Artificial Sequence
  chemically synthesized
gtaacaacagtaggtcatgtta

SEQ ID NO: 1281652 - DNA, 22 bp, Artificial Sequence
  chemically synthesized
ggtaacaacagtaggtcatgtt

SEQ ID NO: 1281653 - DNA, 22 bp, Artificial Sequence
  chemically synthesized
tggtaacaacagtaggtcatgt

SEQ ID NO: 1281654 - DNA, 22 bp, Artificial Sequence
  chemically synthesized
attagtttaacatgacctactg

SEQ ID NO: 1281655 - DNA, 22 bp, Artificial Sequence
  chemically synthesized
gtttaacatgacctactgttgt

SEQ ID NO: 1281656 - DNA, 22 bp, Artificial Sequence
  chemically synthesized
aacatgacctactgttgttacc

SEQ ID NO: 1281657 - DNA, 22 bp, Artificial Sequence
  chemically synthesized
acatgacctactgttgttacca

SEQ ID NO: 1281658 - DNA, 22 bp, Artificial Sequence
  chemically synthesized
gtatgaaaaacactttggtaac

SEQ ID NO: 1281659 - DNA, 22 bp, Artificial Sequence
  chemically synthesized
cctagtatgaaaaacactttgg

SEQ ID NO: 1281660 - DNA, 22 bp, Artificial Sequence
  chemically synthesized
ctgttgttaccaaagtgttttt

SEQ ID NO: 1281661 - DNA, 22 bp, Artificial Sequence
  chemically synthesized
tattacctagtatgaaaaacac

SEQ ID NO: 1281662 - DNA, 22 bp, Artificial Sequence
  chemically synthesized
ttgttaccaaagtgtttttcat

SEQ ID NO: 1281663 - DNA, 22 bp, Artificial Sequence
  chemically synthesized
gtattacctagtatgaaaaaca

SEQ ID NO: 1281664 - DNA, 22 bp, Artificial Sequence
  chemically synthesized
ttaccaaagtgtttttcatact

SEQ ID NO: 1281665 - DNA, 22 bp, Artificial Sequence
  chemically synthesized
ccaaagtgtttttcatactagg

SEQ ID NO: 1281666 - DNA, 22 bp, Artificial Sequence
  chemically synthesized
ttcatactaggtaatacaaatt

SEQ ID NO: 1281667 - DNA, 22 bp, Artificial Sequence
  chemically synthesized
tcatactaggtaatacaaattg

SEQ ID NO: 1281668 - DNA, 22 bp, Artificial Sequence
  chemically synthesized
gataatcaggcccaatttgtat

SEQ ID NO: 1281669 - DNA, 22 bp, Artificial Sequence
  chemically synthesized
catactaggtaatacaaattgg

SEQ ID NO: 1281670 - DNA, 22 bp, Artificial Sequence
  chemically synthesized
atactaggtaatacaaattggg

SEQ ID NO: 1281671 - DNA, 22 bp, Artificial Sequence
  chemically synthesized
cctagataatcaggcccaattt

SEQ ID NO: 1281672 - DNA, 22 bp, Artificial Sequence
  chemically synthesized
ggtaatacaaattgggcctgat

SEQ ID NO: 1281673 - DNA, 22 bp, Artificial Sequence
  chemically synthesized
aatacaattgcctagataatca

SEQ ID NO: 1281674 - DNA, 22 bp, Artificial Sequence
  chemically synthesized
ggcctgattatctaggcaattg

SEQ ID NO: 1281675 - DNA, 22 bp, Artificial Sequence
  chemically synthesized
attatctaggcaattgtattta

SEQ ID NO: 1281676 - DNA, 22 bp, Artificial Sequence
  chemically synthesized
tctaggcaattgtatttaattt

SEQ ID NO: 1281677 - DNA, 22 bp, Artificial Sequence
  chemically synthesized
ggcaattgtatttaattttctg

SEQ ID NO: 1281678 - DNA, 22 bp, Artificial Sequence
  chemically synthesized
ccatgaaccaaaacagaaaatt

SEQ ID NO: 1281679 - DNA, 22 bp, Artificial Sequence
  chemically synthesized
gttgccatgaaccaaaacagaa

SEQ ID NO: 1281680 - DNA, 22 bp, Artificial Sequence
  chemically synthesized
ggttgccatgaaccaaaacaga

SEQ ID NO: 1281681 - DNA, 22 bp, Artificial Sequence
  chemically synthesized
tatttaattttctgttttggtt

SEQ ID NO: 1281682 - DNA, 22 bp, Artificial Sequence
  chemically synthesized
aattttctgttttggttcatgg

SEQ ID NO: 1281683 - DNA, 22 bp, Artificial Sequence
  chemically synthesized
attttctgttttggttcatggc

SEQ ID NO: 1281684 - DNA, 22 bp, Artificial Sequence
  chemically synthesized
tctgttttggttcatggcaacc

SEQ ID NO: 1281685 - DNA, 22 bp, Artificial Sequence
  chemically synthesized
ctgttttggttcatggcaacca

SEQ ID NO: 1281686 - DNA, 22 bp, Artificial Sequence
  chemically synthesized
taagtgccaatttggttgccat

SEQ ID NO: 1281687 - DNA, 22 bp, Artificial Sequence
  chemically synthesized
tgttttggttcatggcaaccaa

SEQ ID NO: 1281688 - DNA, 22 bp, Artificial Sequence
  chemically synthesized
ttttggttcatggcaaccaaat

SEQ ID NO: 1281689 - DNA, 22 bp, Artificial Sequence
  chemically synthesized
tggttcatggcaaccaaattgg

SEQ ID NO: 1281690 - DNA, 22 bp, Artificial Sequence
  chemically synthesized
ggttcatggcaaccaaattggc

SEQ ID NO: 1281691 - DNA, 22 bp, Artificial Sequence
  chemically synthesized
gttcatggcaaccaaattggca

SEQ ID NO: 1281692 - DNA, 22 bp, Artificial Sequence
  chemically synthesized
atggcaaccaaattggcactta

SEQ ID NO: 1281693 - DNA, 22 bp, Artificial Sequence
  chemically synthesized
gacaaaagggaaaaagttataa

SEQ ID NO: 1281694 - DNA, 22 bp, Artificial Sequence
  chemically synthesized
ggacaaaagggaaaaagttata

SEQ ID NO: 1281695 - DNA, 22 bp, Artificial Sequence
  chemically synthesized
tggacaaaagggaaaaagttat

SEQ ID NO: 1281696 - DNA, 22 bp, Artificial Sequence
  chemically synthesized
gcacttataactttttcccttt

SEQ ID NO: 1281697 - DNA, 22 bp, Artificial Sequence
  chemically synthesized
caatggaattttggacaaaagg

SEQ ID NO: 1281698 - DNA, 22 bp, Artificial Sequence
  chemically synthesized
ataactttttcccttttgtcca

SEQ ID NO: 1281699 - DNA, 22 bp, Artificial Sequence
  chemically synthesized
taactttttcccttttgtccaa

SEQ ID NO: 1281700 - DNA, 22 bp, Artificial Sequence
  chemically synthesized
tttcccttttgtccaaaattcc

SEQ ID NO: 1281701 - DNA, 22 bp, Artificial Sequence
  chemically synthesized
cgtcattccaatggaattttgg

SEQ ID NO: 1281702 - DNA, 22 bp, Artificial Sequence
  chemically synthesized
ttcccttttgtccaaaattcca

SEQ ID NO: 1281703 - DNA, 22 bp, Artificial Sequence
  chemically synthesized
ccgtcattccaatggaattttg

SEQ ID NO: 1281704 - DNA, 22 bp, Artificial Sequence
  chemically synthesized
tcccttttgtccaaaattccat

SEQ ID NO: 1281705 - DNA, 22 bp, Artificial Sequence
  chemically synthesized
cccttttgtccaaaattccatt

SEQ ID NO: 1281706 - DNA, 22 bp, Artificial Sequence
  chemically synthesized
ccttttgtccaaaattccattg

SEQ ID NO: 1281707 - DNA, 22 bp, Artificial Sequence
  chemically synthesized
ttgtccaaaattccattggaat

SEQ ID NO: 1281708 - DNA, 22 bp, Artificial Sequence
  chemically synthesized
tgtccaaaattccattggaatg

SEQ ID NO: 1281709 - DNA, 22 bp, Artificial Sequence
  chemically synthesized
gtccaaaattccattggaatga

SEQ ID NO: 1281710 - DNA, 22 bp, Artificial Sequence
  chemically synthesized
tccaaaattccattggaatgac

SEQ ID NO: 1281711 - DNA, 22 bp, Artificial Sequence
  chemically synthesized
aacacatgaataccttccgtca

SEQ ID NO: 1281712 - DNA, 22 bp, Artificial Sequence
  chemically synthesized
taaacacatgaataccttccgt

SEQ ID NO: 1281713 - DNA, 22 bp, Artificial Sequence
  chemically synthesized
cattggaatgacggaaggtatt

SEQ ID NO: 1281714 - DNA, 22 bp, Artificial Sequence
  chemically synthesized
ctctaaacacatgaataccttc

SEQ ID NO: 1281715 - DNA, 22 bp, Artificial Sequence
  chemically synthesized
ttcctctaaacacatgaatacc

SEQ ID NO: 1281716 - DNA, 22 bp, Artificial Sequence
  chemically synthesized
gaatgacggaaggtattcatgt

SEQ ID NO: 1281717 - DNA, 22 bp, Artificial Sequence
  chemically synthesized
attcctctaaacacatgaatac

SEQ ID NO: 1281718 - DNA, 22 bp, Artificial Sequence
  chemically synthesized
tattcctctaaacacatgaata

SEQ ID NO: 1281719 - DNA, 22 bp, Artificial Sequence
  chemically synthesized
taattttattcctctaaacaca

SEQ ID NO: 1281720 - DNA, 22 bp, Artificial Sequence
  chemically synthesized
attataattttattcctctaaa

SEQ ID NO: 1281721 - DNA, 22 bp, Artificial Sequence
  chemically synthesized
ggttgattataattttattcct

SEQ ID NO: 1281722 - DNA, 22 bp, Artificial Sequence
  chemically synthesized
atgtgtttagaggaataaaatt

SEQ ID NO: 1281723 - DNA, 22 bp, Artificial Sequence
  chemically synthesized
taggttgattataattttattc

SEQ ID NO: 1281724 - DNA, 22 bp, Artificial Sequence
  chemically synthesized
ctaggttgattataattttatt

SEQ ID NO: 1281725 - DNA, 22 bp, Artificial Sequence
  chemically synthesized
tctaggttgattataattttat

SEQ ID NO: 1281726 - DNA, 22 bp, Artificial Sequence
  chemically synthesized
ttttctaggttgattataattt

SEQ ID NO: 1281727 - DNA, 22 bp, Artificial Sequence
  chemically synthesized
gttttctaggttgattataatt

SEQ ID NO: 1281728 - DNA, 22 bp, Artificial Sequence
  chemically synthesized
agaggaataaaattataatcaa

SEQ ID NO: 1281729 - DNA, 22 bp, Artificial Sequence
  chemically synthesized
ttgttttctaggttgattataa

SEQ ID NO: 1281730 - DNA, 22 bp, Artificial Sequence
  chemically synthesized
gaggaataaaattataatcaac

SEQ ID NO: 1281731 - DNA, 22 bp, Artificial Sequence
  chemically synthesized
cttgttttctaggttgattata

SEQ ID NO: 1281732 - DNA, 22 bp, Artificial Sequence
  chemically synthesized
tcttgttttctaggttgattat

SEQ ID NO: 1281733 - DNA, 22 bp, Artificial Sequence
  chemically synthesized
ctttcttgttttctaggttgat

SEQ ID NO: 1281734 - DNA, 22 bp, Artificial Sequence
  chemically synthesized
gctttcttgttttctaggttga

SEQ ID NO: 1281735 - DNA, 22 bp, Artificial Sequence
  chemically synthesized
cttgctttcttgttttctaggt

SEQ ID NO: 1281736 - DNA, 22 bp, Artificial Sequence
  chemically synthesized
gcttgctttcttgttttctagg

SEQ ID NO: 1281737 - DNA, 22 bp, Artificial Sequence
  chemically synthesized
cttgcttgctttcttgttttct

SEQ ID NO: 1281738 - DNA, 22 bp, Artificial Sequence
  chemically synthesized
gcttgcttgctttcttgttttc

SEQ ID NO: 1281739 - DNA, 22 bp, Artificial Sequence
  chemically synthesized
taatcaacctagaaaacaagaa

SEQ ID NO: 1281740 - DNA, 22 bp, Artificial Sequence
  chemically synthesized
tgcttgcttgctttcttgtttt

SEQ ID NO: 1281741 - DNA, 22 bp, Artificial Sequence
  chemically synthesized
ttgcttgcttgctttcttgttt

SEQ ID NO: 1281742 - DNA, 22 bp, Artificial Sequence
  chemically synthesized
gtcttttgcttgcttgctttct

SEQ ID NO: 1281743 - DNA, 22 bp, Artificial Sequence
  chemically synthesized
ggtcttttgcttgcttgctttc

SEQ ID NO: 1281744 - DNA, 22 bp, Artificial Sequence
  chemically synthesized
gaaaacaagaaagcaagcaagc

SEQ ID NO: 1281745 - DNA, 22 bp, Artificial Sequence
  chemically synthesized
accagtatcttggtcttttgct

SEQ ID NO: 1281746 - DNA, 22 bp, Artificial Sequence
  chemically synthesized
caccagtatcttggtcttttgc

SEQ ID NO: 1281747 - DNA, 22 bp, Artificial Sequence
  chemically synthesized
tcaccagtatcttggtcttttg

SEQ ID NO: 1281748 - DNA, 22 bp, Artificial Sequence
  chemically synthesized
agtattttcaccagtatcttgg

SEQ ID NO: 1281749 - DNA, 22 bp, Artificial Sequence
  chemically synthesized
cagtattttcaccagtatcttg

SEQ ID NO: 1281750 - DNA, 22 bp, Artificial Sequence
  chemically synthesized
tcagtattttcaccagtatctt

SEQ ID NO: 1281751 - DNA, 22 bp, Artificial Sequence
  chemically synthesized
catctttcagtattttcaccag

SEQ ID NO: 1281752 - DNA, 22 bp, Artificial Sequence
  chemically synthesized
gtgaaaatactgaaagatgtag

SEQ ID NO: 1281753 - DNA, 22 bp, Artificial Sequence
  chemically synthesized
ccagtgagatcccatctacatc

SEQ ID NO: 1281754 - DNA, 22 bp, Artificial Sequence
  chemically synthesized
accagtgagatcccatctacat

SEQ ID NO: 1281755 - DNA, 22 bp, Artificial Sequence
  chemically synthesized
taccagtgagatcccatctaca

SEQ ID NO: 1281756 - DNA, 22 bp, Artificial Sequence
  chemically synthesized
tttaccagtgagatcccatcta

SEQ ID NO: 1281757 - DNA, 22 bp, Artificial Sequence
  chemically synthesized
ctttaccagtgagatcccatct

SEQ ID NO: 1281758 - DNA, 22 bp, Artificial Sequence
  chemically synthesized
tctttaccagtgagatcccatc

SEQ ID NO: 1281759 - DNA, 22 bp, Artificial Sequence
  chemically synthesized
aaagatgtagatgggatctcac

SEQ ID NO: 1281760 - DNA, 22 bp, Artificial Sequence
  chemically synthesized
ttttctttaccagtgagatccc

SEQ ID NO: 1281761 - DNA, 22 bp, Artificial Sequence
  chemically synthesized
gttttctttaccagtgagatcc

SEQ ID NO: 1281762 - DNA, 22 bp, Artificial Sequence
  chemically synthesized
tgttttctttaccagtgagatc

SEQ ID NO: 1281763 - DNA, 22 bp, Artificial Sequence
  chemically synthesized
tttgttttctttaccagtgaga

SEQ ID NO: 1281764 - DNA, 22 bp, Artificial Sequence
  chemically synthesized
ctttgttttctttaccagtgag

SEQ ID NO: 1281765 - DNA, 22 bp, Artificial Sequence
  chemically synthesized
ttctttgttttctttaccagtg

SEQ ID NO: 1281766 - DNA, 22 bp, Artificial Sequence
  chemically synthesized
actcttctttgttttctttacc

SEQ ID NO: 1281767 - DNA, 22 bp, Artificial Sequence
  chemically synthesized
ttgactcttctttgttttcttt

SEQ ID NO: 1281768 - DNA, 22 bp, Artificial Sequence
  chemically synthesized
attgactcttctttgttttctt

SEQ ID NO: 1281769 - DNA, 22 bp, Artificial Sequence
  chemically synthesized
tattgactcttctttgttttct

SEQ ID NO: 1281770 - DNA, 22 bp, Artificial Sequence
  chemically synthesized
actggtaaagaaaacaaagaag

SEQ ID NO: 1281771 - DNA, 22 bp, Artificial Sequence
  chemically synthesized
tggttttattgactcttctttg

SEQ ID NO: 1281772 - DNA, 22 bp, Artificial Sequence
  chemically synthesized
gtggttttattgactcttcttt

SEQ ID NO: 1281773 - DNA, 22 bp, Artificial Sequence
  chemically synthesized
gtaaagaaaacaaagaagagtc

SEQ ID NO: 1281774 - DNA, 22 bp, Artificial Sequence
  chemically synthesized
gtgtttgtggttttattgactc

SEQ ID NO: 1281775 - DNA, 22 bp, Artificial Sequence
  chemically synthesized
ctggtgtttgtggttttattga

SEQ ID NO: 1281776 - DNA, 22 bp, Artificial Sequence
  chemically synthesized
ctcctggtgtttgtggttttat

SEQ ID NO: 1281777 - DNA, 22 bp, Artificial Sequence
  chemically synthesized
actcctggtgtttgtggtttta

SEQ ID NO: 1281778 - DNA, 22 bp, Artificial Sequence
  chemically synthesized
ttactcctggtgtttgtggttt

SEQ ID NO: 1281779 - DNA, 22 bp, Artificial Sequence
  chemically synthesized
cttactcctggtgtttgtggtt

SEQ ID NO: 1281780 - DNA, 22 bp, Artificial Sequence
  chemically synthesized
ttcttactcctggtgtttgtgg

SEQ ID NO: 1281781 - DNA, 22 bp, Artificial Sequence
  chemically synthesized
cttcttactcctggtgtttgtg

SEQ ID NO: 1281782 - DNA, 22 bp, Artificial Sequence
  chemically synthesized
tcaaccaaaggtgtgaagcttc

SEQ ID NO: 1281783 - DNA, 22 bp, Artificial Sequence
  chemically synthesized
gtcaaccaaaggtgtgaagctt

SEQ ID NO: 1281784 - DNA, 22 bp, Artificial Sequence
  chemically synthesized
tttgtcaaccaaaggtgtgaag

SEQ ID NO: 1281785 - DNA, 22 bp, Artificial Sequence
  chemically synthesized
aagtacactatttgtcaaccaa

SEQ ID NO: 1281786 - DNA, 22 bp, Artificial Sequence
  chemically synthesized
cacacctttggttgacaaatag

SEQ ID NO: 1281787 - DNA, 22 bp, Artificial Sequence
  chemically synthesized
acacctttggttgacaaatagt

SEQ ID NO: 1281788 - DNA, 22 bp, Artificial Sequence
  chemically synthesized
tggttgacaaatagtgtacttc

SEQ ID NO: 1281789 - DNA, 22 bp, Artificial Sequence
  chemically synthesized
ggttgacaaatagtgtacttca

SEQ ID NO: 1281790 - DNA, 22 bp, Artificial Sequence
  chemically synthesized
gttgacaaatagtgtacttcaa

SEQ ID NO: 1281791 - DNA, 22 bp, Artificial Sequence
  chemically synthesized
caacagccagcagaattgaagt

SEQ ID NO: 1281792 - DNA, 22 bp, Artificial Sequence
  chemically synthesized
acaaatagtgtacttcaattct

SEQ ID NO: 1281793 - DNA, 22 bp, Artificial Sequence
  chemically synthesized
acaacagccagcagaattgaag

SEQ ID NO: 1281794 - DNA, 22 bp, Artificial Sequence
  chemically synthesized
tacaacagccagcagaattgaa

SEQ ID NO: 1281795 - DNA, 22 bp, Artificial Sequence
  chemically synthesized
ctttacaacagccagcagaatt

SEQ ID NO: 1281796 - DNA, 22 bp, Artificial Sequence
  chemically synthesized
taatctcctttacaacagccag

SEQ ID NO: 1281797 - DNA, 22 bp, Artificial Sequence
  chemically synthesized
caattctgctggctgttgtaaa

SEQ ID NO: 1281798 - DNA, 22 bp, Artificial Sequence
  chemically synthesized
aattctgctggctgttgtaaag

SEQ ID NO: 1281799 - DNA, 22 bp, Artificial Sequence
  chemically synthesized
tgctggctgttgtaaaggagat

SEQ ID NO: 1281800 - DNA, 22 bp, Artificial Sequence
  chemically synthesized
caggtatcctgtaatctccttt

SEQ ID NO: 1281801 - DNA, 22 bp, Artificial Sequence
  chemically synthesized
ctggctgttgtaaaggagatta

SEQ ID NO: 1281802 - DNA, 22 bp, Artificial Sequence
  chemically synthesized
ccaggtatcctgtaatctcctt

SEQ ID NO: 1281803 - DNA, 22 bp, Artificial Sequence
  chemically synthesized
gctgttgtaaaggagattacag

SEQ ID NO: 1281804 - DNA, 22 bp, Artificial Sequence
  chemically synthesized
ttgtaaaggagattacaggata

SEQ ID NO: 1281805 - DNA, 22 bp, Artificial Sequence
  chemically synthesized
tatatcttccaggtatcctgta

SEQ ID NO: 1281806 - DNA, 22 bp, Artificial Sequence
  chemically synthesized
taaaggagattacaggatacct

SEQ ID NO: 1281807 - DNA, 22 bp, Artificial Sequence
  chemically synthesized
ccattatatatcttccaggtat

SEQ ID NO: 1281808 - DNA, 22 bp, Artificial Sequence
  chemically synthesized
tcccattatatatcttccaggt

SEQ ID NO: 1281809 - DNA, 22 bp, Artificial Sequence
  chemically synthesized
ctcccattatatatcttccagg

SEQ ID NO: 1281810 - DNA, 22 bp, Artificial Sequence
  chemically synthesized
cttctcccattatatatcttcc

SEQ ID NO: 1281811 - DNA, 22 bp, Artificial Sequence
  chemically synthesized
caggatacctggaagatatata

SEQ ID NO: 1281812 - DNA, 22 bp, Artificial Sequence
  chemically synthesized
tatgagactacttctcccatta

SEQ ID NO: 1281813 - DNA, 22 bp, Artificial Sequence
  chemically synthesized
tatatgagactacttctcccat

SEQ ID NO: 1281814 - DNA, 22 bp, Artificial Sequence
  chemically synthesized
gaagatatataatgggagaagt

SEQ ID NO: 1281815 - DNA, 22 bp, Artificial Sequence
  chemically synthesized
ctatatgagactacttctccca

SEQ ID NO: 1281816 - DNA, 22 bp, Artificial Sequence
  chemically synthesized
aaggacccaaacccacaatagc

SEQ ID NO: 1281817 - DNA, 22 bp, Artificial Sequence
  chemically synthesized
taaaggacccaaacccacaata

SEQ ID NO: 1281818 - DNA, 22 bp, Artificial Sequence
  chemically synthesized
ctaaaggacccaaacccacaat

SEQ ID NO: 1281819 - DNA, 22 bp, Artificial Sequence
  chemically synthesized
atatagaagctattgtgggttt

SEQ ID NO: 1281820 - DNA, 22 bp, Artificial Sequence
  chemically synthesized
agagaaatttctaaaggaccca

SEQ ID NO: 1281821 - DNA, 22 bp, Artificial Sequence
  chemically synthesized
ttgtgggtttgggtcctttaga

SEQ ID NO: 1281822 - DNA, 22 bp, Artificial Sequence
  chemically synthesized
ctcagagaaatttctaaaggac

SEQ ID NO: 1281823 - DNA, 22 bp, Artificial Sequence
  chemically synthesized
cctcagagaaatttctaaagga

SEQ ID NO: 1281824 - DNA, 22 bp, Artificial Sequence
  chemically synthesized
tgggtttgggtcctttagaaat

SEQ ID NO: 1281825 - DNA, 22 bp, Artificial Sequence
  chemically synthesized
ttcctcagagaaatttctaaag

SEQ ID NO: 1281826 - DNA, 22 bp, Artificial Sequence
  chemically synthesized
cttcctcagagaaatttctaaa

SEQ ID NO: 1281827 - DNA, 22 bp, Artificial Sequence
  chemically synthesized
gggtcctttagaaatttctctg

SEQ ID NO: 1281828 - DNA, 22 bp, Artificial Sequence
  chemically synthesized
atgtttcttcctcagagaaatt

SEQ ID NO: 1281829 - DNA, 22 bp, Artificial Sequence
  chemically synthesized
ggtcctttagaaatttctctga

SEQ ID NO: 1281830 - DNA, 22 bp, Artificial Sequence
  chemically synthesized
aatgtttcttcctcagagaaat

SEQ ID NO: 1281831 - DNA, 22 bp, Artificial Sequence
  chemically synthesized
tagaaatttctctgaggaagaa

SEQ ID NO: 1281832 - DNA, 22 bp, Artificial Sequence
  chemically synthesized
agaaatttctctgaggaagaaa

SEQ ID NO: 1281833 - DNA, 22 bp, Artificial Sequence
  chemically synthesized
gaaatttctctgaggaagaaac

SEQ ID NO: 1281834 - DNA, 22 bp, Artificial Sequence
  chemically synthesized
ggccacaacttaatgtttcttc

SEQ ID NO: 1281835 - DNA, 22 bp, Artificial Sequence
  chemically synthesized
aggccacaacttaatgtttctt

SEQ ID NO: 1281836 - DNA, 22 bp, Artificial Sequence
  chemically synthesized
taggccacaacttaatgtttct

SEQ ID NO: 1281837 - DNA, 22 bp, Artificial Sequence
  chemically synthesized
ttaggccacaacttaatgtttc

SEQ ID NO: 1281838 - DNA, 22 bp, Artificial Sequence
  chemically synthesized
ctctgaggaagaaacattaagt

SEQ ID NO: 1281839 - DNA, 22 bp, Artificial Sequence
  chemically synthesized
tctgaggaagaaacattaagtt

SEQ ID NO: 1281840 - DNA, 22 bp, Artificial Sequence
  chemically synthesized
tgaggaagaaacattaagttgt

SEQ ID NO: 1281841 - DNA, 22 bp, Artificial Sequence
  chemically synthesized
atcttttaggccacaacttaat

SEQ ID NO: 1281842 - DNA, 22 bp, Artificial Sequence
  chemically synthesized
catcttttaggccacaacttaa

SEQ ID NO: 1281843 - DNA, 22 bp, Artificial Sequence
  chemically synthesized
aggaagaaacattaagttgtgg

SEQ ID NO: 1281844 - DNA, 22 bp, Artificial Sequence
  chemically synthesized
tcatcttttaggccacaactta

SEQ ID NO: 1281845 - DNA, 22 bp, Artificial Sequence
  chemically synthesized
ttcatcttttaggccacaactt

SEQ ID NO: 1281846 - DNA, 22 bp, Artificial Sequence
  chemically synthesized
tttcatcttttaggccacaact

SEQ ID NO: 1281847 - DNA, 22 bp, Artificial Sequence
  chemically synthesized
ctttttcatcttttaggccaca

SEQ ID NO: 1281848 - DNA, 22 bp, Artificial Sequence
  chemically synthesized
tcagcctcctttttcatctttt

SEQ ID NO: 1281849 - DNA, 22 bp, Artificial Sequence
  chemically synthesized
agttgtggcctaaaagatgaaa

SEQ ID NO: 1281850 - DNA, 22 bp, Artificial Sequence
  chemically synthesized
ctatcagcctcctttttcatct

SEQ ID NO: 1281851 - DNA, 22 bp, Artificial Sequence
  chemically synthesized
tggcctaaaagatgaaaaagga

SEQ ID NO: 1281852 - DNA, 22 bp, Artificial Sequence
  chemically synthesized
aaagatgaaaaaggaggctgat

SEQ ID NO: 1281853 - DNA, 22 bp, Artificial Sequence
  chemically synthesized
aaatacaggactactatcagcc

SEQ ID NO: 1281854 - DNA, 22 bp, Artificial Sequence
  chemically synthesized
aaaatacaggactactatcagc

SEQ ID NO: 1281855 - DNA, 22 bp, Artificial Sequence
  chemically synthesized
taaaatacaggactactatcag

SEQ ID NO: 1281856 - DNA, 22 bp, Artificial Sequence
  chemically synthesized
ttaaaatacaggactactatca

SEQ ID NO: 1281857 - DNA, 22 bp, Artificial Sequence
  chemically synthesized
ttttaaaatacaggactactat

SEQ ID NO: 1281858 - DNA, 22 bp, Artificial Sequence
  chemically synthesized
cttttaaaatacaggactacta

SEQ ID NO: 1281859 - DNA, 22 bp, Artificial Sequence
  chemically synthesized
tcttttaaaatacaggactact

SEQ ID NO: 1281860 - DNA, 22 bp, Artificial Sequence
  chemically synthesized
attttcttttaaaatacaggac

SEQ ID NO: 1281861 - DNA, 22 bp, Artificial Sequence
  chemically synthesized
atagtagtcctgtattttaaaa

SEQ ID NO: 1281862 - DNA, 22 bp, Artificial Sequence
  chemically synthesized
cggtgatactgattttctttta

SEQ ID NO: 1281863 - DNA, 22 bp, Artificial Sequence
  chemically synthesized
aattacggtgatactgattttc

SEQ ID NO: 1281864 - DNA, 22 bp, Artificial Sequence
  chemically synthesized
tattttaaaagaaaatcagtat

SEQ ID NO: 1281865 - DNA, 22 bp, Artificial Sequence
  chemically synthesized
cctaaattacggtgatactgat

SEQ ID NO: 1281866 - DNA, 22 bp, Artificial Sequence
  chemically synthesized
taaaagaaaatcagtatcaccg

SEQ ID NO: 1281867 - DNA, 22 bp, Artificial Sequence
  chemically synthesized
aaaagaaaatcagtatcaccgt

SEQ ID NO: 1281868 - DNA, 22 bp, Artificial Sequence
  chemically synthesized
cctccctaaattacggtgatac

SEQ ID NO: 1281869 - DNA, 22 bp, Artificial Sequence
  chemically synthesized
aaagaaaatcagtatcaccgta

SEQ ID NO: 1281870 - DNA, 22 bp, Artificial Sequence
  chemically synthesized
caacctccctccctaaattacg

SEQ ID NO: 1281871 - DNA, 22 bp, Artificial Sequence
  chemically synthesized
tccaacctccctccctaaatta

SEQ ID NO: 1281872 - DNA, 22 bp, Artificial Sequence
  chemically synthesized
tctccaacctccctccctaaat

SEQ ID NO: 1281873 - DNA, 22 bp, Artificial Sequence
  chemically synthesized
ctctccaacctccctccctaaa

SEQ ID NO: 1281874 - DNA, 22 bp, Artificial Sequence
  chemically synthesized
cacttctctccaacctccctcc

SEQ ID NO: 1281875 - DNA, 22 bp, Artificial Sequence
  chemically synthesized
ccacttctctccaacctccctc

SEQ ID NO: 1281876 - DNA, 22 bp, Artificial Sequence
  chemically synthesized
tccacttctctccaacctccct

SEQ ID NO: 1281877 - DNA, 22 bp, Artificial Sequence
  chemically synthesized
attttccacttctctccaacct

SEQ ID NO: 1281878 - DNA, 22 bp, Artificial Sequence
  chemically synthesized
tgattttccacttctctccaac

SEQ ID NO: 1281879 - DNA, 22 bp, Artificial Sequence
  chemically synthesized
ctgattttccacttctctccaa

SEQ ID NO: 1281880 - DNA, 22 bp, Artificial Sequence
  chemically synthesized
agggagggaggttggagagaag

SEQ ID NO: 1281881 - DNA, 22 bp, Artificial Sequence
  chemically synthesized
tctgattttccacttctctcca

SEQ ID NO: 1281882 - DNA, 22 bp, Artificial Sequence
  chemically synthesized
gggagggaggttggagagaagt

SEQ ID NO: 1281883 - DNA, 22 bp, Artificial Sequence
  chemically synthesized
tttctgattttccacttctctc

SEQ ID NO: 1281884 - DNA, 22 bp, Artificial Sequence
  chemically synthesized
tctctttctgattttccacttc

SEQ ID NO: 1281885 - DNA, 22 bp, Artificial Sequence
  chemically synthesized
acagctatctctttctgatttt

SEQ ID NO: 1281886 - DNA, 22 bp, Artificial Sequence
  chemically synthesized
gagagaagtggaaaatcagaaa

SEQ ID NO: 1281887 - DNA, 22 bp, Artificial Sequence
  chemically synthesized
aacagctatctctttctgattt

SEQ ID NO: 1281888 - DNA, 22 bp, Artificial Sequence
  chemically synthesized
taacagctatctctttctgatt

SEQ ID NO: 1281889 - DNA, 22 bp, Artificial Sequence
  chemically synthesized
ttaacagctatctctttctgat

SEQ ID NO: 1281890 - DNA, 22 bp, Artificial Sequence
  chemically synthesized
ccttttaacagctatctctttc

SEQ ID NO: 1281891 - DNA, 22 bp, Artificial Sequence
  chemically synthesized
taccttttaacagctatctctt

SEQ ID NO: 1281892 - DNA, 22 bp, Artificial Sequence
  chemically synthesized
tagggctctaccttttaacagc

SEQ ID NO: 1281893 - DNA, 22 bp, Artificial Sequence
  chemically synthesized
tgccacaacctatagggctcta

SEQ ID NO: 1281894 - DNA, 22 bp, Artificial Sequence
  chemically synthesized
atgccacaacctatagggctct

SEQ ID NO: 1281895 - DNA, 22 bp, Artificial Sequence
  chemically synthesized
ttaaaaggtagagccctatagg

SEQ ID NO: 1281896 - DNA, 22 bp, Artificial Sequence
  chemically synthesized
aaaggtagagccctataggttg

SEQ ID NO: 1281897 - DNA, 22 bp, Artificial Sequence
  chemically synthesized
taaagtttatgccacaacctat

SEQ ID NO: 1281898 - DNA, 22 bp, Artificial Sequence
  chemically synthesized
ctgtaaagtttatgccacaacc

SEQ ID NO: 1281899 - DNA, 22 bp, Artificial Sequence
  chemically synthesized
tccattactgtaaagtttatgc

SEQ ID NO: 1281900 - DNA, 22 bp, Artificial Sequence
  chemically synthesized
taggttgtggcataaactttac

SEQ ID NO: 1281901 - DNA, 22 bp, Artificial Sequence
  chemically synthesized
aatagctgtccattactgtaaa

SEQ ID NO: 1281902 - DNA, 22 bp, Artificial Sequence
  chemically synthesized
caatagctgtccattactgtaa

SEQ ID NO: 1281903 - DNA, 22 bp, Artificial Sequence
  chemically synthesized
tggcataaactttacagtaatg

SEQ ID NO: 1281904 - DNA, 22 bp, Artificial Sequence
  chemically synthesized
ttcaatagctgtccattactgt

SEQ ID NO: 1281905 - DNA, 22 bp, Artificial Sequence
  chemically synthesized
taactcttcaatagctgtccat

SEQ ID NO: 1281906 - DNA, 22 bp, Artificial Sequence
  chemically synthesized
ataactcttcaatagctgtcca

SEQ ID NO: 1281907 - DNA, 22 bp, Artificial Sequence
  chemically synthesized
tttataactcttcaatagctgt

SEQ ID NO: 1281908 - DNA, 22 bp, Artificial Sequence
  chemically synthesized
tacagtaatggacagctattga

SEQ ID NO: 1281909 - DNA, 22 bp, Artificial Sequence
  chemically synthesized
acagtaatggacagctattgaa

SEQ ID NO: 1281910 - DNA, 22 bp, Artificial Sequence
  chemically synthesized
cagtaatggacagctattgaag

SEQ ID NO: 1281911 - DNA, 22 bp, Artificial Sequence
  chemically synthesized
ttgtttataactcttcaatagc

SEQ ID NO: 1281912 - DNA, 22 bp, Artificial Sequence
  chemically synthesized
actgttgtttataactcttcaa

SEQ ID NO: 1281913 - DNA, 22 bp, Artificial Sequence
  chemically synthesized
gactgttgtttataactcttca

SEQ ID NO: 1281914 - DNA, 22 bp, Artificial Sequence
  chemically synthesized
tttgactgttgtttataactct

SEQ ID NO: 1281915 - DNA, 22 bp, Artificial Sequence
  chemically synthesized
atttgactgttgtttataactc

SEQ ID NO: 1281916 - DNA, 22 bp, Artificial Sequence
  chemically synthesized
ttgaagagttataaacaacagt

SEQ ID NO: 1281917 - DNA, 22 bp, Artificial Sequence
  chemically synthesized
caacatttatttgactgttgtt

SEQ ID NO: 1281918 - DNA, 22 bp, Artificial Sequence
  chemically synthesized
acaacatttatttgactgttgt

SEQ ID NO: 1281919 - DNA, 22 bp, Artificial Sequence
  chemically synthesized
aagagttataaacaacagtcaa

SEQ ID NO: 1281920 - DNA, 22 bp, Artificial Sequence
  chemically synthesized
tacaacatttatttgactgttg

SEQ ID NO: 1281921 - DNA, 22 bp, Artificial Sequence
  chemically synthesized
ttacaacatttatttgactgtt

SEQ ID NO: 1281922 - DNA, 22 bp, Artificial Sequence
  chemically synthesized
taaacaacagtcaaataaatgt

SEQ ID NO: 1281923 - DNA, 22 bp, Artificial Sequence
  chemically synthesized
aatatggcaaatggaataaatg

SEQ ID NO: 1281924 - DNA, 22 bp, Artificial Sequence
  chemically synthesized
caatatggcaaatggaataaat

SEQ ID NO: 1281925 - DNA, 22 bp, Artificial Sequence
  chemically synthesized
tcaatatggcaaatggaataaa

SEQ ID NO: 1281926 - DNA, 22 bp, Artificial Sequence
  chemically synthesized
taaaaacatttattccatttgc

SEQ ID NO: 1281927 - DNA, 22 bp, Artificial Sequence
  chemically synthesized
taccccattttcaatatggcaa

SEQ ID NO: 1281928 - DNA, 22 bp, Artificial Sequence
  chemically synthesized
attccatttgccatattgaaaa

SEQ ID NO: 1281929 - DNA, 22 bp, Artificial Sequence
  chemically synthesized
ttccatttgccatattgaaaat

SEQ ID NO: 1281930 - DNA, 22 bp, Artificial Sequence
  chemically synthesized
gcccctgtaccccattttcaat

SEQ ID NO: 1281931 - DNA, 22 bp, Artificial Sequence
  chemically synthesized
catttgccatattgaaaatggg

SEQ ID NO: 1281932 - DNA, 22 bp, Artificial Sequence
  chemically synthesized
gcctggcccctgtaccccattt

SEQ ID NO: 1281933 - DNA, 22 bp, Artificial Sequence
  chemically synthesized
gccatattgaaaatggggtaca

SEQ ID NO: 1281934 - DNA, 22 bp, Artificial Sequence
  chemically synthesized
ccatattgaaaatggggtacag

SEQ ID NO: 1281935 - DNA, 22 bp, Artificial Sequence
  chemically synthesized
aaaatggggtacaggggccagg

SEQ ID NO: 1281936 - DNA, 22 bp, Artificial Sequence
  chemically synthesized
caggcgtgaaccacctcgcctg

SEQ ID NO: 1281937 - DNA, 22 bp, Artificial Sequence
  chemically synthesized
ggattacaggcgtgaaccacct

SEQ ID NO: 1281938 - DNA, 22 bp, Artificial Sequence
  chemically synthesized
ccaaagtgctgggattacaggc

SEQ ID NO: 1281939 - DNA, 22 bp, Artificial Sequence
  chemically synthesized
ggcctcccaaagtgctgggatt

SEQ ID NO: 1281940 - DNA, 22 bp, Artificial Sequence
  chemically synthesized
acgcctgtaatcccagcacttt

SEQ ID NO: 1281941 - DNA, 22 bp, Artificial Sequence
  chemically synthesized
cccgcctcggcctcccaaagtg

SEQ ID NO: 1281942 - DNA, 22 bp, Artificial Sequence
  chemically synthesized
taatcccagcactttgggaggc

SEQ ID NO: 1281943 - DNA, 22 bp, Artificial Sequence
  chemically synthesized
aagtgatctgcccgcctcggcc

SEQ ID NO: 1281944 - DNA, 22 bp, Artificial Sequence
  chemically synthesized
acctcaagtgatctgcccgcct

SEQ ID NO: 1281945 - DNA, 22 bp, Artificial Sequence
  chemically synthesized
tgggaggccgaggcgggcagat

SEQ ID NO: 1281946 - DNA, 22 bp, Artificial Sequence
  chemically synthesized
gggaggccgaggcgggcagatc

SEQ ID NO: 1281947 - DNA, 22 bp, Artificial Sequence
  chemically synthesized
ctgacctcaagtgatctgcccg

SEQ ID NO: 1281948 - DNA, 22 bp, Artificial Sequence
  chemically synthesized
ggaggccgaggcgggcagatca

SEQ ID NO: 1281949 - DNA, 22 bp, Artificial Sequence
  chemically synthesized
aaactcctgacctcaagtgatc

SEQ ID NO: 1281950 - DNA, 22 bp, Artificial Sequence
  chemically synthesized
gtctcaaactcctgacctcaag

SEQ ID NO: 1281951 - DNA, 22 bp, Artificial Sequence
  chemically synthesized
gccaggctggtctcaaactcct

SEQ ID NO: 1281952 - DNA, 22 bp, Artificial Sequence
  chemically synthesized
gaggtcaggagtttgagaccag

SEQ ID NO: 1281953 - DNA, 22 bp, Artificial Sequence
  chemically synthesized
aggtcaggagtttgagaccagc

SEQ ID NO: 1281954 - DNA, 22 bp, Artificial Sequence
  chemically synthesized
accacgttggccaggctggtct

SEQ ID NO: 1281955 - DNA, 22 bp, Artificial Sequence
  chemically synthesized
caccacgttggccaggctggtc

SEQ ID NO: 1281956 - DNA, 22 bp, Artificial Sequence
  chemically synthesized
gagaccagcctggccaacgtgg

SEQ ID NO: 1281957 - DNA, 22 bp, Artificial Sequence
  chemically synthesized
agaccagcctggccaacgtggt

SEQ ID NO: 1281958 - DNA, 22 bp, Artificial Sequence
  chemically synthesized
gtagagacggagtttcaccacg

SEQ ID NO: 1281959 - DNA, 22 bp, Artificial Sequence
  chemically synthesized
agtagagacggagtttcaccac

SEQ ID NO: 1281960 - DNA, 22 bp, Artificial Sequence
  chemically synthesized
tagtagagacggagtttcacca

SEQ ID NO: 1281961 - DNA, 22 bp, Artificial Sequence
  chemically synthesized
ttagtagagacggagtttcacc

SEQ ID NO: 1281962 - DNA, 22 bp, Artificial Sequence
  chemically synthesized
tttttagtagagacggagtttc

SEQ ID NO: 1281963 - DNA, 22 bp, Artificial Sequence
  chemically synthesized
gccaacgtggtgaaactccgtc

SEQ ID NO: 1281964 - DNA, 22 bp, Artificial Sequence
  chemically synthesized
tgtttttagtagagacggagtt

SEQ ID NO: 1281965 - DNA, 22 bp, Artificial Sequence
  chemically synthesized
ctgtttttagtagagacggagt

SEQ ID NO: 1281966 - DNA, 22 bp, Artificial Sequence
  chemically synthesized
tctgtttttagtagagacggag

SEQ ID NO: 1281967 - DNA, 22 bp, Artificial Sequence
  chemically synthesized
ttctgtttttagtagagacgga

SEQ ID NO: 1281968 - DNA, 22 bp, Artificial Sequence
  chemically synthesized
atttttctgtttttagtagaga

SEQ ID NO: 1281969 - DNA, 22 bp, Artificial Sequence
  chemically synthesized
cgtctctactaaaaacagaaaa

SEQ ID NO: 1281970 - DNA, 22 bp, Artificial Sequence
  chemically synthesized
caccagcctaatttttctgttt

SEQ ID NO: 1281971 - DNA, 22 bp, Artificial Sequence
  chemically synthesized
ctacaccagcctaatttttctg

SEQ ID NO: 1281972 - DNA, 22 bp, Artificial Sequence
  chemically synthesized
tactaaaaacagaaaaattagg

SEQ ID NO: 1281973 - DNA, 22 bp, Artificial Sequence
  chemically synthesized
ctactacaccagcctaattttt

SEQ ID NO: 1281974 - DNA, 22 bp, Artificial Sequence
  chemically synthesized
ctaaaaacagaaaaattaggct

SEQ ID NO: 1281975 - DNA, 22 bp, Artificial Sequence
  chemically synthesized
aaaacagaaaaattaggctggt

SEQ ID NO: 1281976 - DNA, 22 bp, Artificial Sequence
  chemically synthesized
caggcgcctgctactacaccag

SEQ ID NO: 1281977 - DNA, 22 bp, Artificial Sequence
  chemically synthesized
ggattacaggcgcctgctacta

SEQ ID NO: 1281978 - DNA, 22 bp, Artificial Sequence
  chemically synthesized
ggctggtgtagtagcaggcgcc

SEQ ID NO: 1281979 - DNA, 22 bp, Artificial Sequence
  chemically synthesized
gtgtagtagcaggcgcctgtaa

SEQ ID NO: 1281980 - DNA, 22 bp, Artificial Sequence
  chemically synthesized
ccgagtagctgggattacaggc

SEQ ID NO: 1281981 - DNA, 22 bp, Artificial Sequence
  chemically synthesized
agcctcccgagtagctgggatt

SEQ ID NO: 1281982 - DNA, 22 bp, Artificial Sequence
  chemically synthesized
gcgcctcagcctcccgagtagc

SEQ ID NO: 1281983 - DNA, 22 bp, Artificial Sequence
  chemically synthesized
ctcgcgcctcagcctcccgagt

SEQ ID NO: 1281984 - DNA, 22 bp, Artificial Sequence
  chemically synthesized
taatcccagctactcgggaggc

SEQ ID NO: 1281985 - DNA, 22 bp, Artificial Sequence
  chemically synthesized
aagcattcctcgcgcctcagcc

SEQ ID NO: 1281986 - DNA, 22 bp, Artificial Sequence
  chemically synthesized
ctcgggaggctgaggcgcgagg

SEQ ID NO: 1281987 - DNA, 22 bp, Artificial Sequence
  chemically synthesized
ggttcaagcattcctcgcgcct

SEQ ID NO: 1281988 - DNA, 22 bp, Artificial Sequence
  chemically synthesized
gggaggctgaggcgcgaggaat

SEQ ID NO: 1281989 - DNA, 22 bp, Artificial Sequence
  chemically synthesized
ctgggttcaagcattcctcgcg

SEQ ID NO: 1281990 - DNA, 22 bp, Artificial Sequence
  chemically synthesized
cgcctcctgggttcaagcattc

SEQ ID NO: 1281991 - DNA, 22 bp, Artificial Sequence
  chemically synthesized
aggcgcgaggaatgcttgaacc

SEQ ID NO: 1281992 - DNA, 22 bp, Artificial Sequence
  chemically synthesized
caacctccgcctcctgggttca

SEQ ID NO: 1281993 - DNA, 22 bp, Artificial Sequence
  chemically synthesized
actgcaacctccgcctcctggg

SEQ ID NO: 1281994 - DNA, 22 bp, Artificial Sequence
  chemically synthesized
ggttcactgcaacctccgcctc

SEQ ID NO: 1281995 - DNA, 22 bp, Artificial Sequence
  chemically synthesized
gaacccaggaggcggaggttgc

SEQ ID NO: 1281996 - DNA, 22 bp, Artificial Sequence
  chemically synthesized
aacccaggaggcggaggttgca

SEQ ID NO: 1281997 - DNA, 22 bp, Artificial Sequence
  chemically synthesized
cagtgaaccgagatcgcgccac

SEQ ID NO: 1281998 - DNA, 22 bp, Artificial Sequence
  chemically synthesized
tcgcccaagcaggagtggtgca

SEQ ID NO: 1281999 - DNA, 22 bp, Artificial Sequence
  chemically synthesized
tgtcgcccaagcaggagtggtg

SEQ ID NO: 1282000 - DNA, 22 bp, Artificial Sequence
  chemically synthesized
gctctgtcgcccaagcaggagt

SEQ ID NO: 1282001 - DNA, 22 bp, Artificial Sequence
  chemically synthesized
caccactcctgcttgggcgaca

SEQ ID NO: 1282002 - DNA, 22 bp, Artificial Sequence
  chemically synthesized
agacagagtctggctctgtcgc

SEQ ID NO: 1282003 - DNA, 22 bp, Artificial Sequence
  chemically synthesized
gagacagagtctggctctgtcg

SEQ ID NO: 1282004 - DNA, 22 bp, Artificial Sequence
  chemically synthesized
tgagacagagtctggctctgtc

SEQ ID NO: 1282005 - DNA, 22 bp, Artificial Sequence
  chemically synthesized
ttgagacagagtctggctctgt

SEQ ID NO: 1282006 - DNA, 22 bp, Artificial Sequence
  chemically synthesized
ctgcttgggcgacagagccaga

SEQ ID NO: 1282007 - DNA, 22 bp, Artificial Sequence
  chemically synthesized
tttgagacagagtctggctctg

SEQ ID NO: 1282008 - DNA, 22 bp, Artificial Sequence
  chemically synthesized
ttttgagacagagtctggctct

SEQ ID NO: 1282009 - DNA, 22 bp, Artificial Sequence
  chemically synthesized
tttttgagacagagtctggctc

SEQ ID NO: 1282010 - DNA, 22 bp, Artificial Sequence
  chemically synthesized
cttgggcgacagagccagactc

SEQ ID NO: 1282011 - DNA, 22 bp, Artificial Sequence
  chemically synthesized
ttttttgagacagagtctggct

SEQ ID NO: 1282012 - DNA, 22 bp, Artificial Sequence
  chemically synthesized
tttttttgagacagagtctggc

SEQ ID NO: 1282013 - DNA, 22 bp, Artificial Sequence
  chemically synthesized
ttttttttgagacagagtctgg

SEQ ID NO: 1282014 - DNA, 22 bp, Artificial Sequence
  chemically synthesized
gggcgacagagccagactctgt

SEQ ID NO: 1282015 - DNA, 22 bp, Artificial Sequence
  chemically synthesized
tttttttttgagacagagtctg

SEQ ID NO: 1282016 - DNA, 22 bp, Artificial Sequence
  chemically synthesized
ggcgacagagccagactctgtc

SEQ ID NO: 1282017 - DNA, 22 bp, Artificial Sequence
  chemically synthesized
ttttttttttgagacagagtct

SEQ ID NO: 1282018 - DNA, 22 bp, Artificial Sequence
  chemically synthesized
tttttttttttgagacagagtc

SEQ ID NO: 1282019 - DNA, 22 bp, Artificial Sequence
  chemically synthesized
ttttttttttttgagacagagt

SEQ ID NO: 1282020 - DNA, 22 bp, Artificial Sequence
  chemically synthesized
tttttttttttttgagacagag

SEQ ID NO: 1282021 - DNA, 22 bp, Artificial Sequence
  chemically synthesized
ttttttttttttttgagacaga

SEQ ID NO: 1282022 - DNA, 22 bp, Artificial Sequence
  chemically synthesized
tttttttttttttttgagacag

SEQ ID NO: 1282023 - DNA, 22 bp, Artificial Sequence
  chemically synthesized
ttttttttttttttttgagaca

SEQ ID NO: 1282024 - DNA, 22 bp, Artificial Sequence
  chemically synthesized
tttttttttttttttttgagac

SEQ ID NO: 1282025 - DNA, 22 bp, Artificial Sequence
  chemically synthesized
ttttttttttttttttttgaga

SEQ ID NO: 1282026 - DNA, 22 bp, Artificial Sequence
  chemically synthesized
tttttttttttttttttttgag

SEQ ID NO: 1282027 - DNA, 22 bp, Artificial Sequence
  chemically synthesized
ttttttttttttttttttttga

SEQ ID NO: 1282028 - DNA, 22 bp, Artificial Sequence
  chemically synthesized
tttttttttttttttttttttg

SEQ ID NO: 1282029 - DNA, 22 bp, Artificial Sequence
  chemically synthesized
tttttttttttttttttttttt

SEQ ID NO: 1282030 - DNA, 22 bp, Artificial Sequence
  chemically synthesized
tttttttttttttttttttttt

SEQ ID NO: 1282031 - DNA, 22 bp, Artificial Sequence
  chemically synthesized
cttttttttttttttttttttt

SEQ ID NO: 1282032 - DNA, 22 bp, Artificial Sequence
  chemically synthesized
tgtctcaaaaaaaaaaaaaaaa

SEQ ID NO: 1282033 - DNA, 22 bp, Artificial Sequence
  chemically synthesized
ctcctttttttttttttttttt

SEQ ID NO: 1282034 - DNA, 22 bp, Artificial Sequence
  chemically synthesized
tctcaaaaaaaaaaaaaaaaaa

SEQ ID NO: 1282035 - DNA, 22 bp, Artificial Sequence
  chemically synthesized
actccttttttttttttttttt

SEQ ID NO: 1282036 - DNA, 22 bp, Artificial Sequence
  chemically synthesized
tactcctttttttttttttttt

SEQ ID NO: 1282037 - DNA, 22 bp, Artificial Sequence
  chemically synthesized
aaaaaaaaaaaaaaaaaaaaaa

SEQ ID NO: 1282038 - DNA, 22 bp, Artificial Sequence
  chemically synthesized
cattttactccttttttttttt

SEQ ID NO: 1282039 - DNA, 22 bp, Artificial Sequence
  chemically synthesized
tactccattttactcctttttt

SEQ ID NO: 1282040 - DNA, 22 bp, Artificial Sequence
  chemically synthesized
ataccctgtactccattttact

SEQ ID NO: 1282041 - DNA, 22 bp, Artificial Sequence
  chemically synthesized
ctaataccctgtactccatttt

SEQ ID NO: 1282042 - DNA, 22 bp, Artificial Sequence
  chemically synthesized
cctaataccctgtactccattt

SEQ ID NO: 1282043 - DNA, 22 bp, Artificial Sequence
  chemically synthesized
ttcctaataccctgtactccat

SEQ ID NO: 1282044 - DNA, 22 bp, Artificial Sequence
  chemically synthesized
tatattcttcctaataccctgt

SEQ ID NO: 1282045 - DNA, 22 bp, Artificial Sequence
  chemically synthesized
atatattcttcctaataccctg

SEQ ID NO: 1282046 - DNA, 22 bp, Artificial Sequence
  chemically synthesized
tatatattcttcctaataccct

SEQ ID NO: 1282047 - DNA, 22 bp, Artificial Sequence
  chemically synthesized
tactttatatattcttcctaat

SEQ ID NO: 1282048 - DNA, 22 bp, Artificial Sequence
  chemically synthesized
ttgtactttatatattcttcct

SEQ ID NO: 1282049 - DNA, 22 bp, Artificial Sequence
  chemically synthesized
attgtactttatatattcttcc

SEQ ID NO: 1282050 - DNA, 22 bp, Artificial Sequence
  chemically synthesized
tcttattgtactttatatattc

SEQ ID NO: 1282051 - DNA, 22 bp, Artificial Sequence
  chemically synthesized
tctatcttattgtactttatat

SEQ ID NO: 1282052 - DNA, 22 bp, Artificial Sequence
  chemically synthesized
gtctatcttattgtactttata

SEQ ID NO: 1282053 - DNA, 22 bp, Artificial Sequence
  chemically synthesized
ggaagaatatataaagtacaat

SEQ ID NO: 1282054 - DNA, 22 bp, Artificial Sequence
  chemically synthesized
catttgtctatcttattgtact

SEQ ID NO: 1282055 - DNA, 22 bp, Artificial Sequence
  chemically synthesized
gcatttgtctatcttattgtac

SEQ ID NO: 1282056 - DNA, 22 bp, Artificial Sequence
  chemically synthesized
tgcataaaacttgcatttgtct

SEQ ID NO: 1282057 - DNA, 22 bp, Artificial Sequence
  chemically synthesized
gtgcataaaacttgcatttgtc

SEQ ID NO: 1282058 - DNA, 22 bp, Artificial Sequence
  chemically synthesized
atttgtgcataaaacttgcatt

SEQ ID NO: 1282059 - DNA, 22 bp, Artificial Sequence
  chemically synthesized
acgatgttcatttgtgcataaa

SEQ ID NO: 1282060 - DNA, 22 bp, Artificial Sequence
  chemically synthesized
taacgatgttcatttgtgcata

SEQ ID NO: 1282061 - DNA, 22 bp, Artificial Sequence
  chemically synthesized
tgtcggagttctaacgatgttc

SEQ ID NO: 1282062 - DNA, 22 bp, Artificial Sequence
  chemically synthesized
tatgcacaaatgaacatcgtta

SEQ ID NO: 1282063 - DNA, 22 bp, Artificial Sequence
  chemically synthesized
atgcacaaatgaacatcgttag

SEQ ID NO: 1282064 - DNA, 22 bp, Artificial Sequence
  chemically synthesized
tgcacaaatgaacatcgttaga

SEQ ID NO: 1282065 - DNA, 22 bp, Artificial Sequence
  chemically synthesized
aagggaagaagacattgtgtcg

SEQ ID NO: 1282066 - DNA, 22 bp, Artificial Sequence
  chemically synthesized
gaagggaagaagacattgtgtc

SEQ ID NO: 1282067 - DNA, 22 bp, Artificial Sequence
  chemically synthesized
gaactccgacacaatgtcttct

SEQ ID NO: 1282068 - DNA, 22 bp, Artificial Sequence
  chemically synthesized
cgacacaatgtcttcttccctt

SEQ ID NO: 1282069 - DNA, 22 bp, Artificial Sequence
  chemically synthesized
cttcccttcaaatgtcttcact

SEQ ID NO: 1282070 - DNA, 22 bp, Artificial Sequence
  chemically synthesized
ttcccttcaaatgtcttcactt

SEQ ID NO: 1282071 - DNA, 22 bp, Artificial Sequence
  chemically synthesized
cccttcaaatgtcttcactttt

SEQ ID NO: 1282072 - DNA, 22 bp, Artificial Sequence
  chemically synthesized
ccttcaaatgtcttcacttttc

SEQ ID NO: 1282073 - DNA, 22 bp, Artificial Sequence
  chemically synthesized
caaatgtcttcacttttccatt

SEQ ID NO: 1282074 - DNA, 22 bp, Artificial Sequence
  chemically synthesized
aaatgtcttcacttttccattc

SEQ ID NO: 1282075 - DNA, 22 bp, Artificial Sequence
  chemically synthesized
aaggatgatagtgggaatggaa

SEQ ID NO: 1282076 - DNA, 22 bp, Artificial Sequence
  chemically synthesized
ggctgaaggatgatagtgggaa

SEQ ID NO: 1282077 - DNA, 22 bp, Artificial Sequence
  chemically synthesized
cacttttccattcccactatca

SEQ ID NO: 1282078 - DNA, 22 bp, Artificial Sequence
  chemically synthesized
acttttccattcccactatcat

SEQ ID NO: 1282079 - DNA, 22 bp, Artificial Sequence
  chemically synthesized
ttccattcccactatcatcctt

SEQ ID NO: 1282080 - DNA, 22 bp, Artificial Sequence
  chemically synthesized
tccattcccactatcatccttc

SEQ ID NO: 1282081 - DNA, 22 bp, Artificial Sequence
  chemically synthesized
ccattcccactatcatccttca

SEQ ID NO: 1282082 - DNA, 22 bp, Artificial Sequence
  chemically synthesized
cattcccactatcatccttcag

SEQ ID NO: 1282083 - DNA, 22 bp, Artificial Sequence
  chemically synthesized
gtggtagagactaggctgaagg

SEQ ID NO: 1282084 - DNA, 22 bp, Artificial Sequence
  chemically synthesized
ccactatcatccttcagcctag

SEQ ID NO: 1282085 - DNA, 22 bp, Artificial Sequence
  chemically synthesized
tcatccttcagcctagtctcta

SEQ ID NO: 1282086 - DNA, 22 bp, Artificial Sequence
  chemically synthesized
cagcctagtctctaccaccagt

SEQ ID NO: 1282087 - DNA, 22 bp, Artificial Sequence
  chemically synthesized
agcctagtctctaccaccagtt

SEQ ID NO: 1282088 - DNA, 22 bp, Artificial Sequence
  chemically synthesized
ggggacgcgtcagtaaaactgg

SEQ ID NO: 1282089 - DNA, 22 bp, Artificial Sequence
  chemically synthesized
gggggacgcgtcagtaaaactg

SEQ ID NO: 1282090 - DNA, 22 bp, Artificial Sequence
  chemically synthesized
gtctctaccaccagttttactg

SEQ ID NO: 1282091 - DNA, 22 bp, Artificial Sequence
  chemically synthesized
taccaccagttttactgacgcg

SEQ ID NO: 1282092 - DNA, 22 bp, Artificial Sequence
  chemically synthesized
ccaccagttttactgacgcgtc

SEQ ID NO: 1282093 - DNA, 22 bp, Artificial Sequence
  chemically synthesized
tactgacgcgtcccccaaacgg

SEQ ID NO: 1282094 - DNA, 22 bp, Artificial Sequence
  chemically synthesized
actgacgcgtcccccaaacggt

SEQ ID NO: 1282095 - DNA, 22 bp, Artificial Sequence
  chemically synthesized
ctgacgcgtcccccaaacggtt

SEQ ID NO: 1282096 - DNA, 22 bp, Artificial Sequence
  chemically synthesized
acgcgtcccccaaacggttcct

SEQ ID NO: 1282097 - DNA, 22 bp, Artificial Sequence
  chemically synthesized
gagaagagggtgaaggaaccgt

SEQ ID NO: 1282098 - DNA, 22 bp, Artificial Sequence
  chemically synthesized
ggagcaggttggagaagagggt

SEQ ID NO: 1282099 - DNA, 22 bp, Artificial Sequence
  chemically synthesized
gggagcaggttggagaagaggg

SEQ ID NO: 1282100 - DNA, 22 bp, Artificial Sequence
  chemically synthesized
cttcaccctcttctccaacctg

SEQ ID NO: 1282101 - DNA, 22 bp, Artificial Sequence
  chemically synthesized
caccctcttctccaacctgctc

SEQ ID NO: 1282102 - DNA, 22 bp, Artificial Sequence
  chemically synthesized
accctcttctccaacctgctcc

SEQ ID NO: 1282103 - DNA, 22 bp, Artificial Sequence
  chemically synthesized
tgaaggatacttgggagcaggt

SEQ ID NO: 1282104 - DNA, 22 bp, Artificial Sequence
  chemically synthesized
ttctccaacctgctcccaagta

SEQ ID NO: 1282105 - DNA, 22 bp, Artificial Sequence
  chemically synthesized
tactatgaaggatacttgggag

SEQ ID NO: 1282106 - DNA, 22 bp, Artificial Sequence
  chemically synthesized
gtactatgaaggatacttggga

SEQ ID NO: 1282107 - DNA, 22 bp, Artificial Sequence
  chemically synthesized
ctccaacctgctcccaagtatc

SEQ ID NO: 1282108 - DNA, 22 bp, Artificial Sequence
  chemically synthesized
tccaacctgctcccaagtatcc

SEQ ID NO: 1282109 - DNA, 22 bp, Artificial Sequence
  chemically synthesized
cttgtactatgaaggatacttg

SEQ ID NO: 1282110 - DNA, 22 bp, Artificial Sequence
  chemically synthesized
caacctgctcccaagtatcctt

SEQ ID NO: 1282111 - DNA, 22 bp, Artificial Sequence
  chemically synthesized
ccttgtactatgaaggatactt

SEQ ID NO: 1282112 - DNA, 22 bp, Artificial Sequence
  chemically synthesized
tttccttgtactatgaaggata

SEQ ID NO: 1282113 - DNA, 22 bp, Artificial Sequence
  chemically synthesized
gtttccttgtactatgaaggat

SEQ ID NO: 1282114 - DNA, 22 bp, Artificial Sequence
  chemically synthesized
ctcccaagtatccttcatagta

SEQ ID NO: 1282115 - DNA, 22 bp, Artificial Sequence
  chemically synthesized
ccaagtatccttcatagtacaa

SEQ ID NO: 1282116 - DNA, 22 bp, Artificial Sequence
  chemically synthesized
ggaaaatttgtttccttgtact

SEQ ID NO: 1282117 - DNA, 22 bp, Artificial Sequence
  chemically synthesized
tgattcggaaaatttgtttcct

SEQ ID NO: 1282118 - DNA, 22 bp, Artificial Sequence
  chemically synthesized
catagtacaaggaaacaaattt

SEQ ID NO: 1282119 - DNA, 22 bp, Artificial Sequence
  chemically synthesized
atagtacaaggaaacaaatttt

SEQ ID NO: 1282120 - DNA, 22 bp, Artificial Sequence
  chemically synthesized
tccgaatcataatatttttcat

SEQ ID NO: 1282121 - DNA, 22 bp, Artificial Sequence
  chemically synthesized
ccgaatcataatatttttcatt

SEQ ID NO: 1282122 - DNA, 22 bp, Artificial Sequence
  chemically synthesized
cgaatcataatatttttcattt

SEQ ID NO: 1282123 - DNA, 22 bp, Artificial Sequence
  chemically synthesized
agcagaaaaatgaaatgaaaaa

SEQ ID NO: 1282124 - DNA, 22 bp, Artificial Sequence
  chemically synthesized
aagcagaaaaatgaaatgaaaa

SEQ ID NO: 1282125 - DNA, 22 bp, Artificial Sequence
  chemically synthesized
taagcagaaaaatgaaatgaaa

SEQ ID NO: 1282126 - DNA, 22 bp, Artificial Sequence
  chemically synthesized
ttaagcagaaaaatgaaatgaa

SEQ ID NO: 1282127 - DNA, 22 bp, Artificial Sequence
  chemically synthesized
ttcatttcatttttctgcttaa

SEQ ID NO: 1282128 - DNA, 22 bp, Artificial Sequence
  chemically synthesized
tcatttcatttttctgcttaaa

SEQ ID NO: 1282129 - DNA, 22 bp, Artificial Sequence
  chemically synthesized
catttcatttttctgcttaaaa

SEQ ID NO: 1282130 - DNA, 22 bp, Artificial Sequence
  chemically synthesized
atttcatttttctgcttaaaaa

SEQ ID NO: 1282131 - DNA, 22 bp, Artificial Sequence
  chemically synthesized
catttttctgcttaaaaattta

SEQ ID NO: 1282132 - DNA, 22 bp, Artificial Sequence
  chemically synthesized
atttttctgcttaaaaatttat

SEQ ID NO: 1282133 - DNA, 22 bp, Artificial Sequence
  chemically synthesized
ttctgcttaaaaatttatcatg

SEQ ID NO: 1282134 - DNA, 22 bp, Artificial Sequence
  chemically synthesized
tctgcttaaaaatttatcatgt

SEQ ID NO: 1282135 - DNA, 22 bp, Artificial Sequence
  chemically synthesized
ctgcttaaaaatttatcatgtc

SEQ ID NO: 1282136 - DNA, 22 bp, Artificial Sequence
  chemically synthesized
tgcttaaaaatttatcatgtct

SEQ ID NO: 1282137 - DNA, 22 bp, Artificial Sequence
  chemically synthesized
taagtaatatgaagacatgata

SEQ ID NO: 1282138 - DNA, 22 bp, Artificial Sequence
  chemically synthesized
cttaaaaatttatcatgtcttc

SEQ ID NO: 1282139 - DNA, 22 bp, Artificial Sequence
  chemically synthesized
aaaaatttatcatgtcttcata

SEQ ID NO: 1282140 - DNA, 22 bp, Artificial Sequence
  chemically synthesized
aaaatttatcatgtcttcatat

SEQ ID NO: 1282141 - DNA, 22 bp, Artificial Sequence
  chemically synthesized
catctataagtaatatgaagac

SEQ ID NO: 1282142 - DNA, 22 bp, Artificial Sequence
  chemically synthesized
aaactccatctataagtaatat

SEQ ID NO: 1282143 - DNA, 22 bp, Artificial Sequence
  chemically synthesized
atcatgtcttcatattacttat

SEQ ID NO: 1282144 - DNA, 22 bp, Artificial Sequence
  chemically synthesized
tcatgtcttcatattacttata

SEQ ID NO: 1282145 - DNA, 22 bp, Artificial Sequence
  chemically synthesized
tcaaactccatctataagtaat

SEQ ID NO: 1282146 - DNA, 22 bp, Artificial Sequence
  chemically synthesized
ctcaaactccatctataagtaa

SEQ ID NO: 1282147 - DNA, 22 bp, Artificial Sequence
  chemically synthesized
tctcaaactccatctataagta

SEQ ID NO: 1282148 - DNA, 22 bp, Artificial Sequence
  chemically synthesized
catattacttatagatggagtt

SEQ ID NO: 1282149 - DNA, 22 bp, Artificial Sequence
  chemically synthesized
ataattttctcaaactccatct

SEQ ID NO: 1282150 - DNA, 22 bp, Artificial Sequence
  chemically synthesized
atattacttatagatggagttt

SEQ ID NO: 1282151 - DNA, 22 bp, Artificial Sequence
  chemically synthesized
aataattttctcaaactccatc

SEQ ID NO: 1282152 - DNA, 22 bp, Artificial Sequence
  chemically synthesized
cttatagatggagtttgagaaa

SEQ ID NO: 1282153 - DNA, 22 bp, Artificial Sequence
  chemically synthesized
atagatggagtttgagaaaatt

SEQ ID NO: 1282154 - DNA, 22 bp, Artificial Sequence
  chemically synthesized
tagatggagtttgagaaaatta

SEQ ID NO: 1282155 - DNA, 22 bp, Artificial Sequence
  chemically synthesized
ggtggggaatagatttaataat

SEQ ID NO: 1282156 - DNA, 22 bp, Artificial Sequence
  chemically synthesized
gagaaaattattaaatctattc

SEQ ID NO: 1282157 - DNA, 22 bp, Artificial Sequence
  chemically synthesized
agaaaattattaaatctattcc

SEQ ID NO: 1282158 - DNA, 22 bp, Artificial Sequence
  chemically synthesized
cgaacctaggtggggaatagat

SEQ ID NO: 1282159 - DNA, 22 bp, Artificial Sequence
  chemically synthesized
attacgaacctaggtggggaat

SEQ ID NO: 1282160 - DNA, 22 bp, Artificial Sequence
  chemically synthesized
ttaaatctattccccacctagg

SEQ ID NO: 1282161 - DNA, 22 bp, Artificial Sequence
  chemically synthesized
attgattacgaacctaggtggg

SEQ ID NO: 1282162 - DNA, 22 bp, Artificial Sequence
  chemically synthesized
aattgattacgaacctaggtgg

SEQ ID NO: 1282163 - DNA, 22 bp, Artificial Sequence
  chemically synthesized
aatctattccccacctaggttc

SEQ ID NO: 1282164 - DNA, 22 bp, Artificial Sequence
  chemically synthesized
ttccccacctaggttcgtaatc

SEQ ID NO: 1282165 - DNA, 22 bp, Artificial Sequence
  chemically synthesized
cccacctaggttcgtaatcaat

SEQ ID NO: 1282166 - DNA, 22 bp, Artificial Sequence
  chemically synthesized
tatgtgcggcttaattgattac

SEQ ID NO: 1282167 - DNA, 22 bp, Artificial Sequence
  chemically synthesized
ctatatgtgcggcttaattgat

SEQ ID NO: 1282168 - DNA, 22 bp, Artificial Sequence
  chemically synthesized
ggttcgtaatcaattaagccgc

SEQ ID NO: 1282169 - DNA, 22 bp, Artificial Sequence
  chemically synthesized
actcctatatgtgcggcttaat

SEQ ID NO: 1282170 - DNA, 22 bp, Artificial Sequence
  chemically synthesized
gtaatcaattaagccgcacata

SEQ ID NO: 1282171 - DNA, 22 bp, Artificial Sequence
  chemically synthesized
gtctgactcctatatgtgcggc

SEQ ID NO: 1282172 - DNA, 22 bp, Artificial Sequence
  chemically synthesized
ttcgtctgactcctatatgtgc

SEQ ID NO: 1282173 - DNA, 22 bp, Artificial Sequence
  chemically synthesized
tattcgtctgactcctatatgt

SEQ ID NO: 1282174 - DNA, 22 bp, Artificial Sequence
  chemically synthesized
atctctattcgtctgactccta

SEQ ID NO: 1282175 - DNA, 22 bp, Artificial Sequence
  chemically synthesized
agccgcacatataggagtcaga

SEQ ID NO: 1282176 - DNA, 22 bp, Artificial Sequence
  chemically synthesized
catctctattcgtctgactcct

SEQ ID NO: 1282177 - DNA, 22 bp, Artificial Sequence
  chemically synthesized
tcatctctattcgtctgactcc

SEQ ID NO: 1282178 - DNA, 22 bp, Artificial Sequence
  chemically synthesized
gtaaaggagatattttcatctc

SEQ ID NO: 1282179 - DNA, 22 bp, Artificial Sequence
  chemically synthesized
tcattagtaaaggagatatttt

SEQ ID NO: 1282180 - DNA, 22 bp, Artificial Sequence
  chemically synthesized
atcattagtaaaggagatattt

SEQ ID NO: 1282181 - DNA, 22 bp, Artificial Sequence
  chemically synthesized
tatcattagtaaaggagatatt

SEQ ID NO: 1282182 - DNA, 22 bp, Artificial Sequence
  chemically synthesized
ataacagctttatcattagtaa

SEQ ID NO: 1282183 - DNA, 22 bp, Artificial Sequence
  chemically synthesized
gctgataacagctttatcatta

SEQ ID NO: 1282184 - DNA, 22 bp, Artificial Sequence
  chemically synthesized
tgttcgctgataacagctttat

SEQ ID NO: 1282185 - DNA, 22 bp, Artificial Sequence
  chemically synthesized
ctttactaatgataaagctgtt

SEQ ID NO: 1282186 - DNA, 22 bp, Artificial Sequence
  chemically synthesized
tactaatgataaagctgttatc

SEQ ID NO: 1282187 - DNA, 22 bp, Artificial Sequence
  chemically synthesized
actaatgataaagctgttatca

SEQ ID NO: 1282188 - DNA, 22 bp, Artificial Sequence
  chemically synthesized
ctaatgataaagctgttatcag

SEQ ID NO: 1282189 - DNA, 22 bp, Artificial Sequence
  chemically synthesized
atgctatgttcgctgataacag

SEQ ID NO: 1282190 - DNA, 22 bp, Artificial Sequence
  chemically synthesized
aatgctatgttcgctgataaca

SEQ ID NO: 1282191 - DNA, 22 bp, Artificial Sequence
  chemically synthesized
atgataaagctgttatcagcga

SEQ ID NO: 1282192 - DNA, 22 bp, Artificial Sequence
  chemically synthesized
ttatcagcgaacatagcattaa

SEQ ID NO: 1282193 - DNA, 22 bp, Artificial Sequence
  chemically synthesized
tcagcgaacatagcattaagtc

SEQ ID NO: 1282194 - DNA, 22 bp, Artificial Sequence
  chemically synthesized
gcaaacatacataataagaaga

SEQ ID NO: 1282195 - DNA, 22 bp, Artificial Sequence
  chemically synthesized
ttagcaaacatacataataaga

SEQ ID NO: 1282196 - DNA, 22 bp, Artificial Sequence
  chemically synthesized
agtcttcttattatgtatgttt

SEQ ID NO: 1282197 - DNA, 22 bp, Artificial Sequence
  chemically synthesized
ggcaaattattagcaaacatac

SEQ ID NO: 1282198 - DNA, 22 bp, Artificial Sequence
  chemically synthesized
cttattatgtatgtttgctaat

SEQ ID NO: 1282199 - DNA, 22 bp, Artificial Sequence
  chemically synthesized
ttattatgtatgtttgctaata

SEQ ID NO: 1282200 - DNA, 22 bp, Artificial Sequence
  chemically synthesized
attatgtatgtttgctaataat

SEQ ID NO: 1282201 - DNA, 22 bp, Artificial Sequence
  chemically synthesized
ttatgtatgtttgctaataatt

SEQ ID NO: 1282202 - DNA, 22 bp, Artificial Sequence
  chemically synthesized
tgtatgtttgctaataatttgc

SEQ ID NO: 1282203 - DNA, 22 bp, Artificial Sequence
  chemically synthesized
atggatgtcactaggcaaatta

SEQ ID NO: 1282204 - DNA, 22 bp, Artificial Sequence
  chemically synthesized
ctaatggatgtcactaggcaaa

SEQ ID NO: 1282205 - DNA, 22 bp, Artificial Sequence
  chemically synthesized
actaatggatgtcactaggcaa

SEQ ID NO: 1282206 - DNA, 22 bp, Artificial Sequence
  chemically synthesized
gctaataatttgcctagtgaca

SEQ ID NO: 1282207 - DNA, 22 bp, Artificial Sequence
  chemically synthesized
ctaataatttgcctagtgacat

SEQ ID NO: 1282208 - DNA, 22 bp, Artificial Sequence
  chemically synthesized
atgcttactaatggatgtcact

SEQ ID NO: 1282209 - DNA, 22 bp, Artificial Sequence
  chemically synthesized
ataatttgcctagtgacatcca

SEQ ID NO: 1282210 - DNA, 22 bp, Artificial Sequence
  chemically synthesized
aatgcttactaatggatgtcac

SEQ ID NO: 1282211 - DNA, 22 bp, Artificial Sequence
  chemically synthesized
catttaatgcttactaatggat

SEQ ID NO: 1282212 - DNA, 22 bp, Artificial Sequence
  chemically synthesized
ccatttaatgcttactaatgga

SEQ ID NO: 1282213 - DNA, 22 bp, Artificial Sequence
  chemically synthesized
gcctagtgacatccattagtaa

SEQ ID NO: 1282214 - DNA, 22 bp, Artificial Sequence
  chemically synthesized
cctagtgacatccattagtaag

SEQ ID NO: 1282215 - DNA, 22 bp, Artificial Sequence
  chemically synthesized
ttccatttaatgcttactaatg

SEQ ID NO: 1282216 - DNA, 22 bp, Artificial Sequence
  chemically synthesized
cttccatttaatgcttactaat

SEQ ID NO: 1282217 - DNA, 22 bp, Artificial Sequence
  chemically synthesized
ttcttccatttaatgcttacta

SEQ ID NO: 1282218 - DNA, 22 bp, Artificial Sequence
  chemically synthesized
gtgacatccattagtaagcatt

SEQ ID NO: 1282219 - DNA, 22 bp, Artificial Sequence
  chemically synthesized
cttcttccatttaatgcttact

SEQ ID NO: 1282220 - DNA, 22 bp, Artificial Sequence
  chemically synthesized
gtaagcattaaatggaagaaga

SEQ ID NO: 1282221 - DNA, 22 bp, Artificial Sequence
  chemically synthesized
tatagggaatgcttcttcttcc

SEQ ID NO: 1282222 - DNA, 22 bp, Artificial Sequence
  chemically synthesized
aatggaagaagaagcattccct

SEQ ID NO: 1282223 - DNA, 22 bp, Artificial Sequence
  chemically synthesized
agcccccatgatataaattata

SEQ ID NO: 1282224 - DNA, 22 bp, Artificial Sequence
  chemically synthesized
gggttaagcccccatgatataa

SEQ ID NO: 1282225 - DNA, 22 bp, Artificial Sequence
  chemically synthesized
cctatataatttatatcatggg

SEQ ID NO: 1282226 - DNA, 22 bp, Artificial Sequence
  chemically synthesized
aattggggttaagcccccatga

SEQ ID NO: 1282227 - DNA, 22 bp, Artificial Sequence
  chemically synthesized
tataatttatatcatgggggct

SEQ ID NO: 1282228 - DNA, 22 bp, Artificial Sequence
  chemically synthesized
aaattggggttaagcccccatg

SEQ ID NO: 1282229 - DNA, 22 bp, Artificial Sequence
  chemically synthesized
taaattggggttaagcccccat

SEQ ID NO: 1282230 - DNA, 22 bp, Artificial Sequence
  chemically synthesized
tttaaattggggttaagccccc

SEQ ID NO: 1282231 - DNA, 22 bp, Artificial Sequence
  chemically synthesized
atatcatgggggcttaacccca

SEQ ID NO: 1282232 - DNA, 22 bp, Artificial Sequence
  chemically synthesized
tatcatgggggcttaaccccaa

SEQ ID NO: 1282233 - DNA, 22 bp, Artificial Sequence
  chemically synthesized
atgctctttaaattggggttaa

SEQ ID NO: 1282234 - DNA, 22 bp, Artificial Sequence
  chemically synthesized
catgctctttaaattggggtta

SEQ ID NO: 1282235 - DNA, 22 bp, Artificial Sequence
  chemically synthesized
aaccccaatttaaagagcatga

SEQ ID NO: 1282236 - DNA, 22 bp, Artificial Sequence
  chemically synthesized
accccaatttaaagagcatgaa

SEQ ID NO: 1282237 - DNA, 22 bp, Artificial Sequence
  chemically synthesized
agtaggtatggcttcatgctct

SEQ ID NO: 1282238 - DNA, 22 bp, Artificial Sequence
  chemically synthesized
aaagagcatgaagccataccta

SEQ ID NO: 1282239 - DNA, 22 bp, Artificial Sequence
  chemically synthesized
aagagcatgaagccatacctac

SEQ ID NO: 1282240 - DNA, 22 bp, Artificial Sequence
  chemically synthesized
gaggaggaattgagtaggtatg

SEQ ID NO: 1282241 - DNA, 22 bp, Artificial Sequence
  chemically synthesized
ggaggaggaattgagtaggtat

SEQ ID NO: 1282242 - DNA, 22 bp, Artificial Sequence
  chemically synthesized
tggaggaggaattgagtaggta

SEQ ID NO: 1282243 - DNA, 22 bp, Artificial Sequence
  chemically synthesized
ttggaggaggaattgagtaggt

SEQ ID NO: 1282244 - DNA, 22 bp, Artificial Sequence
  chemically synthesized
atttttggaggaggaattgagt

SEQ ID NO: 1282245 - DNA, 22 bp, Artificial Sequence
  chemically synthesized
ccctgatttttggaggaggaat

SEQ ID NO: 1282246 - DNA, 22 bp, Artificial Sequence
  chemically synthesized
ctcaattcctcctccaaaaatc

SEQ ID NO: 1282247 - DNA, 22 bp, Artificial Sequence
  chemically synthesized
aattcctcctccaaaaatcagg

SEQ ID NO: 1282248 - DNA, 22 bp, Artificial Sequence
  chemically synthesized
ctcctccaaaaatcagggtaga

SEQ ID NO: 1282249 - DNA, 22 bp, Artificial Sequence
  chemically synthesized
ctccaaaaatcagggtagatgg

SEQ ID NO: 1282250 - DNA, 22 bp, Artificial Sequence
  chemically synthesized
caaaaatcagggtagatggttc

SEQ ID NO: 1282251 - DNA, 22 bp, Artificial Sequence
  chemically synthesized
agaaagcagaaatgaaccatct

SEQ ID NO: 1282252 - DNA, 22 bp, Artificial Sequence
  chemically synthesized
caattaagaaagcagaaatgaa

SEQ ID NO: 1282253 - DNA, 22 bp, Artificial Sequence
  chemically synthesized
catgtactccaattaagaaagc

SEQ ID NO: 1282254 - DNA, 22 bp, Artificial Sequence
  chemically synthesized
atttctgctttcttaattggag

SEQ ID NO: 1282255 - DNA, 22 bp, Artificial Sequence
  chemically synthesized
tccctccatgtactccaattaa

SEQ ID NO: 1282256 - DNA, 22 bp, Artificial Sequence
  chemically synthesized
ctgctttcttaattggagtaca

SEQ ID NO: 1282257 - DNA, 22 bp, Artificial Sequence
  chemically synthesized
cctgtccctccatgtactccaa

SEQ ID NO: 1282258 - DNA, 22 bp, Artificial Sequence
  chemically synthesized
tgctttcttaattggagtacat

SEQ ID NO: 1282259 - DNA, 22 bp, Artificial Sequence
  chemically synthesized
ccctgtccctccatgtactcca

SEQ ID NO: 1282260 - DNA, 22 bp, Artificial Sequence
  chemically synthesized
tccctgtccctccatgtactcc

SEQ ID NO: 1282261 - DNA, 22 bp, Artificial Sequence
  chemically synthesized
ctttcttaattggagtacatgg

SEQ ID NO: 1282262 - DNA, 22 bp, Artificial Sequence
  chemically synthesized
tcttaattggagtacatggagg

SEQ ID NO: 1282263 - DNA, 22 bp, Artificial Sequence
  chemically synthesized
cttaattggagtacatggaggg

SEQ ID NO: 1282264 - DNA, 22 bp, Artificial Sequence
  chemically synthesized
ttaattggagtacatggaggga

SEQ ID NO: 1282265 - DNA, 22 bp, Artificial Sequence
  chemically synthesized
cccgttttccctgtccctccat

SEQ ID NO: 1282266 - DNA, 22 bp, Artificial Sequence
  chemically synthesized
aattggagtacatggagggaca

SEQ ID NO: 1282267 - DNA, 22 bp, Artificial Sequence
  chemically synthesized
attggagtacatggagggacag

SEQ ID NO: 1282268 - DNA, 22 bp, Artificial Sequence
  chemically synthesized
gagtacatggagggacagggaa

SEQ ID NO: 1282269 - DNA, 22 bp, Artificial Sequence
  chemically synthesized
gggtaataatattgcccgtttt

SEQ ID NO: 1282270 - DNA, 22 bp, Artificial Sequence
  chemically synthesized
cgctagggtaataatattgccc

SEQ ID NO: 1282271 - DNA, 22 bp, Artificial Sequence
  chemically synthesized
tggagagaactacgctagggta

SEQ ID NO: 1282272 - DNA, 22 bp, Artificial Sequence
  chemically synthesized
ttaccctagcgtagttctctcc

SEQ ID NO: 1282273 - DNA, 22 bp, Artificial Sequence
  chemically synthesized
aaatatccaattgtggagagaa

SEQ ID NO: 1282274 - DNA, 22 bp, Artificial Sequence
  chemically synthesized
ccctagcgtagttctctccaca

SEQ ID NO: 1282275 - DNA, 22 bp, Artificial Sequence
  chemically synthesized
caaatatccaattgtggagaga

SEQ ID NO: 1282276 - DNA, 22 bp, Artificial Sequence
  chemically synthesized
tttcaaatatccaattgtggag

SEQ ID NO: 1282277 - DNA, 22 bp, Artificial Sequence
  chemically synthesized
gcgtagttctctccacaattgg

SEQ ID NO: 1282278 - DNA, 22 bp, Artificial Sequence
  chemically synthesized
ttgtttcaaatatccaattgtg

SEQ ID NO: 1282279 - DNA, 22 bp, Artificial Sequence
  chemically synthesized
gttgtttcaaatatccaattgt

SEQ ID NO: 1282280 - DNA, 22 bp, Artificial Sequence
  chemically synthesized
cttgttgtttcaaatatccaat

SEQ ID NO: 1282281 - DNA, 22 bp, Artificial Sequence
  chemically synthesized
gcttgttgtttcaaatatccaa

SEQ ID NO: 1282282 - DNA, 22 bp, Artificial Sequence
  chemically synthesized
tctccacaattggatatttgaa

SEQ ID NO: 1282283 - DNA, 22 bp, Artificial Sequence
  chemically synthesized
cttgcttgttgtttcaaatatc

SEQ ID NO: 1282284 - DNA, 22 bp, Artificial Sequence
  chemically synthesized
tccacaattggatatttgaaac

SEQ ID NO: 1282285 - DNA, 22 bp, Artificial Sequence
  chemically synthesized
cacaattggatatttgaaacaa

SEQ ID NO: 1282286 - DNA, 22 bp, Artificial Sequence
  chemically synthesized
gaccctccttgcttgttgtttc

SEQ ID NO: 1282287 - DNA, 22 bp, Artificial Sequence
  chemically synthesized
ggaccctccttgcttgttgttt

SEQ ID NO: 1282288 - DNA, 22 bp, Artificial Sequence
  chemically synthesized
tggaccctccttgcttgttgtt

SEQ ID NO: 1282289 - DNA, 22 bp, Artificial Sequence
  chemically synthesized
gatatttgaaacaacaagcaag

SEQ ID NO: 1282290 - DNA, 22 bp, Artificial Sequence
  chemically synthesized
aatctttggaccctccttgctt

SEQ ID NO: 1282291 - DNA, 22 bp, Artificial Sequence
  chemically synthesized
gaaacaacaagcaaggagggtc

SEQ ID NO: 1282292 - DNA, 22 bp, Artificial Sequence
  chemically synthesized
aaacaacaagcaaggagggtcc

SEQ ID NO: 1282293 - DNA, 22 bp, Artificial Sequence
  chemically synthesized
atgtatatgcaattaaatcttt

SEQ ID NO: 1282294 - DNA, 22 bp, Artificial Sequence
  chemically synthesized
ttaatgtatatgcaattaaatc

SEQ ID NO: 1282295 - DNA, 22 bp, Artificial Sequence
  chemically synthesized
aattgcatatacattaacagtt

SEQ ID NO: 1282296 - DNA, 22 bp, Artificial Sequence
  chemically synthesized
attgcatatacattaacagttt

SEQ ID NO: 1282297 - DNA, 22 bp, Artificial Sequence
  chemically synthesized
aaaatgagacaaaaactgttaa

SEQ ID NO: 1282298 - DNA, 22 bp, Artificial Sequence
  chemically synthesized
catatacattaacagtttttgt

SEQ ID NO: 1282299 - DNA, 22 bp, Artificial Sequence
  chemically synthesized
aagaatattgaaaatgagacaa

SEQ ID NO: 1282300 - DNA, 22 bp, Artificial Sequence
  chemically synthesized
taaagaatattgaaaatgagac

SEQ ID NO: 1282301 - DNA, 22 bp, Artificial Sequence
  chemically synthesized
acagtttttgtctcattttcaa

SEQ ID NO: 1282302 - DNA, 22 bp, Artificial Sequence
  chemically synthesized
ttgtctcattttcaatattctt

SEQ ID NO: 1282303 - DNA, 22 bp, Artificial Sequence
  chemically synthesized
tgtctcattttcaatattcttt

SEQ ID NO: 1282304 - DNA, 22 bp, Artificial Sequence
  chemically synthesized
gtctcattttcaatattcttta

SEQ ID NO: 1282305 - DNA, 22 bp, Artificial Sequence
  chemically synthesized
tctcattttcaatattctttag

SEQ ID NO: 1282306 - DNA, 22 bp, Artificial Sequence
  chemically synthesized
aataagcaaactctaaagaata

SEQ ID NO: 1282307 - DNA, 22 bp, Artificial Sequence
  chemically synthesized
gaataagcaaactctaaagaat

SEQ ID NO: 1282308 - DNA, 22 bp, Artificial Sequence
  chemically synthesized
attttcaatattctttagagtt

SEQ ID NO: 1282309 - DNA, 22 bp, Artificial Sequence
  chemically synthesized
tcaatattctttagagtttgct

SEQ ID NO: 1282310 - DNA, 22 bp, Artificial Sequence
  chemically synthesized
caatattctttagagtttgctt

SEQ ID NO: 1282311 - DNA, 22 bp, Artificial Sequence
  chemically synthesized
aatattctttagagtttgctta

SEQ ID NO: 1282312 - DNA, 22 bp, Artificial Sequence
  chemically synthesized
gcaagaagtttgaataagcaaa

SEQ ID NO: 1282313 - DNA, 22 bp, Artificial Sequence
  chemically synthesized
tttagagtttgcttattcaaac

SEQ ID NO: 1282314 - DNA, 22 bp, Artificial Sequence
  chemically synthesized
tagagtttgcttattcaaactt

SEQ ID NO: 1282315 - DNA, 22 bp, Artificial Sequence
  chemically synthesized
agagtttgcttattcaaacttc

SEQ ID NO: 1282316 - DNA, 22 bp, Artificial Sequence
  chemically synthesized
gagtttgcttattcaaacttct

SEQ ID NO: 1282317 - DNA, 22 bp, Artificial Sequence
  chemically synthesized
tgatgataattagcaagaagtt

SEQ ID NO: 1282318 - DNA, 22 bp, Artificial Sequence
  chemically synthesized
gtgatgataattagcaagaagt

SEQ ID NO: 1282319 - DNA, 22 bp, Artificial Sequence
  chemically synthesized
gcttattcaaacttcttgctaa

SEQ ID NO: 1282320 - DNA, 22 bp, Artificial Sequence
  chemically synthesized
cttattcaaacttcttgctaat

SEQ ID NO: 1282321 - DNA, 22 bp, Artificial Sequence
  chemically synthesized
attcaaacttcttgctaattat

SEQ ID NO: 1282322 - DNA, 22 bp, Artificial Sequence
  chemically synthesized
ttcaaacttcttgctaattatc

SEQ ID NO: 1282323 - DNA, 22 bp, Artificial Sequence
  chemically synthesized
aaacttcttgctaattatcatc

SEQ ID NO: 1282324 - DNA, 22 bp, Artificial Sequence
  chemically synthesized
cttgctaattatcatcacaagc

SEQ ID NO: 1282325 - DNA, 22 bp, Artificial Sequence
  chemically synthesized
ttgctaattatcatcacaagcc

SEQ ID NO: 1282326 - DNA, 22 bp, Artificial Sequence
  chemically synthesized
gctaattatcatcacaagccgc

SEQ ID NO: 1282327 - DNA, 22 bp, Artificial Sequence
  chemically synthesized
ctaattatcatcacaagccgct

SEQ ID NO: 1282328 - DNA, 22 bp, Artificial Sequence
  chemically synthesized
attatcatcacaagccgctatt

SEQ ID NO: 1282329 - DNA, 22 bp, Artificial Sequence
  chemically synthesized
tcatcacaagccgctatttctg

SEQ ID NO: 1282330 - DNA, 22 bp, Artificial Sequence
  chemically synthesized
tttctgtcattttccttgtgct

SEQ ID NO: 1282331 - DNA, 22 bp, Artificial Sequence
  chemically synthesized
ctgtcattttccttgtgctgtc

SEQ ID NO: 1282332 - DNA, 22 bp, Artificial Sequence
  chemically synthesized
tgtcattttccttgtgctgtcc

SEQ ID NO: 1282333 - DNA, 22 bp, Artificial Sequence
  chemically synthesized
tcattttccttgtgctgtccat

SEQ ID NO: 1282334 - DNA, 22 bp, Artificial Sequence
  chemically synthesized
tccttgtgctgtccatattact

SEQ ID NO: 1282335 - DNA, 22 bp, Artificial Sequence
  chemically synthesized
aaagaagaggcaagtaatatgg

SEQ ID NO: 1282336 - DNA, 22 bp, Artificial Sequence
  chemically synthesized
ccttgtgctgtccatattactt

SEQ ID NO: 1282337 - DNA, 22 bp, Artificial Sequence
  chemically synthesized
cttgtgctgtccatattacttg

SEQ ID NO: 1282338 - DNA, 22 bp, Artificial Sequence
  chemically synthesized
gtgctgtccatattacttgcct

SEQ ID NO: 1282339 - DNA, 22 bp, Artificial Sequence
  chemically synthesized
tgctgtccatattacttgcctc

SEQ ID NO: 1282340 - DNA, 22 bp, Artificial Sequence
  chemically synthesized
gagttaaaagaagaggcaagta

SEQ ID NO: 1282341 - DNA, 22 bp, Artificial Sequence
  chemically synthesized
tccatattacttgcctcttctt

SEQ ID NO: 1282342 - DNA, 22 bp, Artificial Sequence
  chemically synthesized
gtactagagttaaaagaagagg

SEQ ID NO: 1282343 - DNA, 22 bp, Artificial Sequence
  chemically synthesized
ggtactagagttaaaagaagag

SEQ ID NO: 1282344 - DNA, 22 bp, Artificial Sequence
  chemically synthesized
cttgcctcttcttttaactcta

SEQ ID NO: 1282345 - DNA, 22 bp, Artificial Sequence
  chemically synthesized
gcctcttcttttaactctagta

SEQ ID NO: 1282346 - DNA, 22 bp, Artificial Sequence
  chemically synthesized
cctcttcttttaactctagtac

SEQ ID NO: 1282347 - DNA, 22 bp, Artificial Sequence
  chemically synthesized
ttcttttaactctagtaccaag

SEQ ID NO: 1282348 - DNA, 22 bp, Artificial Sequence
  chemically synthesized
tcatcagtcaatcttggtacta

SEQ ID NO: 1282349 - DNA, 22 bp, Artificial Sequence
  chemically synthesized
cttttaactctagtaccaagat

SEQ ID NO: 1282350 - DNA, 22 bp, Artificial Sequence
  chemically synthesized
ttttaactctagtaccaagatt

SEQ ID NO: 1282351 - DNA, 22 bp, Artificial Sequence
  chemically synthesized
ttaactctagtaccaagattga

SEQ ID NO: 1282352 - DNA, 22 bp, Artificial Sequence
  chemically synthesized
taactctagtaccaagattgac

SEQ ID NO: 1282353 - DNA, 22 bp, Artificial Sequence
  chemically synthesized
aactctagtaccaagattgact

SEQ ID NO: 1282354 - DNA, 22 bp, Artificial Sequence
  chemically synthesized
actctagtaccaagattgactg

SEQ ID NO: 1282355 - DNA, 22 bp, Artificial Sequence
  chemically synthesized
aatggcctatcatcagtcaatc

SEQ ID NO: 1282356 - DNA, 22 bp, Artificial Sequence
  chemically synthesized
tagtaccaagattgactgatga

SEQ ID NO: 1282357 - DNA, 22 bp, Artificial Sequence
  chemically synthesized
gtaccaagattgactgatgata

SEQ ID NO: 1282358 - DNA, 22 bp, Artificial Sequence
  chemically synthesized
gaaaagattgaatggcctatca

SEQ ID NO: 1282359 - DNA, 22 bp, Artificial Sequence
  chemically synthesized
ggaaaagattgaatggcctatc

SEQ ID NO: 1282360 - DNA, 22 bp, Artificial Sequence
  chemically synthesized
tggaaaagattgaatggcctat

SEQ ID NO: 1282361 - DNA, 22 bp, Artificial Sequence
  chemically synthesized
actgatgataggccattcaatc

SEQ ID NO: 1282362 - DNA, 22 bp, Artificial Sequence
  chemically synthesized
ggctttggaaaagattgaatgg

SEQ ID NO: 1282363 - DNA, 22 bp, Artificial Sequence
  chemically synthesized
atgataggccattcaatctttt

SEQ ID NO: 1282364 - DNA, 22 bp, Artificial Sequence
  chemically synthesized
acctcggctttggaaaagattg

SEQ ID NO: 1282365 - DNA, 22 bp, Artificial Sequence
  chemically synthesized
agcatgctaacctcggctttgg

SEQ ID NO: 1282366 - DNA, 22 bp, Artificial Sequence
  chemically synthesized
aatcttttccaaagccgaggtt

SEQ ID NO: 1282367 - DNA, 22 bp, Artificial Sequence
  chemically synthesized
agctaagcatgctaacctcggc

SEQ ID NO: 1282368 - DNA, 22 bp, Artificial Sequence
  chemically synthesized
attcagctaagcatgctaacct

SEQ ID NO: 1282369 - DNA, 22 bp, Artificial Sequence
  chemically synthesized
ttccaaagccgaggttagcatg

SEQ ID NO: 1282370 - DNA, 22 bp, Artificial Sequence
  chemically synthesized
tccaaagccgaggttagcatgc

SEQ ID NO: 1282371 - DNA, 22 bp, Artificial Sequence
  chemically synthesized
ccaaagccgaggttagcatgct

SEQ ID NO: 1282372 - DNA, 22 bp, Artificial Sequence
  chemically synthesized
caaagccgaggttagcatgctt

SEQ ID NO: 1282373 - DNA, 22 bp, Artificial Sequence
  chemically synthesized
cccgaactcattcagctaagca

SEQ ID NO: 1282374 - DNA, 22 bp, Artificial Sequence
  chemically synthesized
gcccgaactcattcagctaagc

SEQ ID NO: 1282375 - DNA, 22 bp, Artificial Sequence
  chemically synthesized
aaatttgcccgaactcattcag

SEQ ID NO: 1282376 - DNA, 22 bp, Artificial Sequence
  chemically synthesized
gcatgcttagctgaatgagttc

SEQ ID NO: 1282377 - DNA, 22 bp, Artificial Sequence
  chemically synthesized
agctgaatgagttcgggcaaat

SEQ ID NO: 1282378 - DNA, 22 bp, Artificial Sequence
  chemically synthesized
gctgaatgagttcgggcaaatt

SEQ ID NO: 1282379 - DNA, 22 bp, Artificial Sequence
  chemically synthesized
aatgagttcgggcaaatttcaa

SEQ ID NO: 1282380 - DNA, 22 bp, Artificial Sequence
  chemically synthesized
tgaaccgcataaaattgaaatt

SEQ ID NO: 1282381 - DNA, 22 bp, Artificial Sequence
  chemically synthesized
ctatgaaccgcataaaattgaa

SEQ ID NO: 1282382 - DNA, 22 bp, Artificial Sequence
  chemically synthesized
ttgctatgaaccgcataaaatt

SEQ ID NO: 1282383 - DNA, 22 bp, Artificial Sequence
  chemically synthesized
gggcaaatttcaattttatgcg

SEQ ID NO: 1282384 - DNA, 22 bp, Artificial Sequence
  chemically synthesized
atatggctattgctatgaaccg

SEQ ID NO: 1282385 - DNA, 22 bp, Artificial Sequence
  chemically synthesized
caattttatgcggttcatagca

SEQ ID NO: 1282386 - DNA, 22 bp, Artificial Sequence
  chemically synthesized
aattttatgcggttcatagcaa

SEQ ID NO: 1282387 - DNA, 22 bp, Artificial Sequence
  chemically synthesized
gttaatatggctattgctatga

SEQ ID NO: 1282388 - DNA, 22 bp, Artificial Sequence
  chemically synthesized
tatgcggttcatagcaatagcc

SEQ ID NO: 1282389 - DNA, 22 bp, Artificial Sequence
  chemically synthesized
atgcggttcatagcaatagcca

SEQ ID NO: 1282390 - DNA, 22 bp, Artificial Sequence
  chemically synthesized
tgcggttcatagcaatagccat

SEQ ID NO: 1282391 - DNA, 22 bp, Artificial Sequence
  chemically synthesized
atagcaatagccatattaacta

SEQ ID NO: 1282392 - DNA, 22 bp, Artificial Sequence
  chemically synthesized
gagacaaataaacatactagtt

SEQ ID NO: 1282393 - DNA, 22 bp, Artificial Sequence
  chemically synthesized
agagacaaataaacatactagt

SEQ ID NO: 1282394 - DNA, 22 bp, Artificial Sequence
  chemically synthesized
tttagagacaaataaacatact

SEQ ID NO: 1282395 - DNA, 22 bp, Artificial Sequence
  chemically synthesized
atttagagacaaataaacatac

SEQ ID NO: 1282396 - DNA, 22 bp, Artificial Sequence
  chemically synthesized
aaccttatttagagacaaataa

SEQ ID NO: 1282397 - DNA, 22 bp, Artificial Sequence
  chemically synthesized
actagtatgtttatttgtctct

SEQ ID NO: 1282398 - DNA, 22 bp, Artificial Sequence
  chemically synthesized
gtatgtttatttgtctctaaat

SEQ ID NO: 1282399 - DNA, 22 bp, Artificial Sequence
  chemically synthesized
agaatacctaaaccttatttag

SEQ ID NO: 1282400 - DNA, 22 bp, Artificial Sequence
  chemically synthesized
cagaatacctaaaccttattta

SEQ ID NO: 1282401 - DNA, 22 bp, Artificial Sequence
  chemically synthesized
atttgtctctaaataaggttta

SEQ ID NO: 1282402 - DNA, 22 bp, Artificial Sequence
  chemically synthesized
tttgtctctaaataaggtttag

SEQ ID NO: 1282403 - DNA, 22 bp, Artificial Sequence
  chemically synthesized
gtctctaaataaggtttaggta

SEQ ID NO: 1282404 - DNA, 22 bp, Artificial Sequence
  chemically synthesized
tctctaaataaggtttaggtat

SEQ ID NO: 1282405 - DNA, 22 bp, Artificial Sequence
  chemically synthesized
gagagacatttcagaataccta

SEQ ID NO: 1282406 - DNA, 22 bp, Artificial Sequence
  chemically synthesized
taaataaggtttaggtattctg

SEQ ID NO: 1282407 - DNA, 22 bp, Artificial Sequence
  chemically synthesized
aataaggtttaggtattctgaa

SEQ ID NO: 1282408 - DNA, 22 bp, Artificial Sequence
  chemically synthesized
aggtattctgaaatgtctctct

SEQ ID NO: 1282409 - DNA, 22 bp, Artificial Sequence
  chemically synthesized
ggtattctgaaatgtctctcta

SEQ ID NO: 1282410 - DNA, 22 bp, Artificial Sequence
  chemically synthesized
gaaatccagtgctagagagaca

SEQ ID NO: 1282411 - DNA, 22 bp, Artificial Sequence
  chemically synthesized
actggaaatccagtgctagaga

SEQ ID NO: 1282412 - DNA, 22 bp, Artificial Sequence
  chemically synthesized
tgaaatgtctctctagcactgg

SEQ ID NO: 1282413 - DNA, 22 bp, Artificial Sequence
  chemically synthesized
attaactggaaatccagtgcta

SEQ ID NO: 1282414 - DNA, 22 bp, Artificial Sequence
  chemically synthesized
aaatgtctctctagcactggat

SEQ ID NO: 1282415 - DNA, 22 bp, Artificial Sequence
  chemically synthesized
tctagcactggatttccagtta

SEQ ID NO: 1282416 - DNA, 22 bp, Artificial Sequence
  chemically synthesized
gtgagatgctcattaactggaa

SEQ ID NO: 1282417 - DNA, 22 bp, Artificial Sequence
  chemically synthesized
tagcactggatttccagttaat

SEQ ID NO: 1282418 - DNA, 22 bp, Artificial Sequence
  chemically synthesized
tagtgagatgctcattaactgg

SEQ ID NO: 1282419 - DNA, 22 bp, Artificial Sequence
  chemically synthesized
gcactggatttccagttaatga

SEQ ID NO: 1282420 - DNA, 22 bp, Artificial Sequence
  chemically synthesized
ctagtgagatgctcattaactg

SEQ ID NO: 1282421 - DNA, 22 bp, Artificial Sequence
  chemically synthesized
gatttccagttaatgagcatct

SEQ ID NO: 1282422 - DNA, 22 bp, Artificial Sequence
  chemically synthesized
ccagttaatgagcatctcacta

SEQ ID NO: 1282423 - DNA, 22 bp, Artificial Sequence
  chemically synthesized
cagttaatgagcatctcactag

SEQ ID NO: 1282424 - DNA, 22 bp, Artificial Sequence
  chemically synthesized
tcaatataaatttctagtgaga

SEQ ID NO: 1282425 - DNA, 22 bp, Artificial Sequence
  chemically synthesized
ttgtcaatataaatttctagtg

SEQ ID NO: 1282426 - DNA, 22 bp, Artificial Sequence
  chemically synthesized
atgagcatctcactagaaattt

SEQ ID NO: 1282427 - DNA, 22 bp, Artificial Sequence
  chemically synthesized
ataaggttgttgtcaatataaa

SEQ ID NO: 1282428 - DNA, 22 bp, Artificial Sequence
  chemically synthesized
actagaaatttatattgacaac

SEQ ID NO: 1282429 - DNA, 22 bp, Artificial Sequence
  chemically synthesized
atattaataaggttgttgtcaa

SEQ ID NO: 1282430 - DNA, 22 bp, Artificial Sequence
  chemically synthesized
gaaatttatattgacaacaacc

SEQ ID NO: 1282431 - DNA, 22 bp, Artificial Sequence
  chemically synthesized
ggggattaatattaataaggtt

SEQ ID NO: 1282432 - DNA, 22 bp, Artificial Sequence
  chemically synthesized
atattgacaacaaccttattaa

SEQ ID NO: 1282433 - DNA, 22 bp, Artificial Sequence
  chemically synthesized
tattgacaacaaccttattaat

SEQ ID NO: 1282434 - DNA, 22 bp, Artificial Sequence
  chemically synthesized
acaacaaccttattaatattaa

SEQ ID NO: 1282435 - DNA, 22 bp, Artificial Sequence
  chemically synthesized
caaatgctaggggattaatatt

SEQ ID NO: 1282436 - DNA, 22 bp, Artificial Sequence
  chemically synthesized
gcaaatgctaggggattaatat

SEQ ID NO: 1282437 - DNA, 22 bp, Artificial Sequence
  chemically synthesized
gtcttgcaaatgctaggggatt

SEQ ID NO: 1282438 - DNA, 22 bp, Artificial Sequence
  chemically synthesized
attaatattaatcccctagcat

SEQ ID NO: 1282439 - DNA, 22 bp, Artificial Sequence
  chemically synthesized
ttaatattaatcccctagcatt

SEQ ID NO: 1282440 - DNA, 22 bp, Artificial Sequence
  chemically synthesized
tcctagtcttgcaaatgctagg

SEQ ID NO: 1282441 - DNA, 22 bp, Artificial Sequence
  chemically synthesized
gtcctagtcttgcaaatgctag

SEQ ID NO: 1282442 - DNA, 22 bp, Artificial Sequence
  chemically synthesized
atattaatcccctagcatttgc

SEQ ID NO: 1282443 - DNA, 22 bp, Artificial Sequence
  chemically synthesized
tgtcctagtcttgcaaatgcta

SEQ ID NO: 1282444 - DNA, 22 bp, Artificial Sequence
  chemically synthesized
atcccctagcatttgcaagact

SEQ ID NO: 1282445 - DNA, 22 bp, Artificial Sequence
  chemically synthesized
aaattttgtcctagtcttgcaa

SEQ ID NO: 1282446 - DNA, 22 bp, Artificial Sequence
  chemically synthesized
gcatttgcaagactaggacaaa

SEQ ID NO: 1282447 - DNA, 22 bp, Artificial Sequence
  chemically synthesized
gcaagactaggacaaaatttca

SEQ ID NO: 1282448 - DNA, 22 bp, Artificial Sequence
  chemically synthesized
caagactaggacaaaatttcag

SEQ ID NO: 1282449 - DNA, 22 bp, Artificial Sequence
  chemically synthesized
ggacaaaatttcagatatcatt

SEQ ID NO: 1282450 - DNA, 22 bp, Artificial Sequence
  chemically synthesized
aaaaatatcatataaatgatat

SEQ ID NO: 1282451 - DNA, 22 bp, Artificial Sequence
  chemically synthesized
caaaaatatcatataaatgata

SEQ ID NO: 1282452 - DNA, 22 bp, Artificial Sequence
  chemically synthesized
cagatatcatttatatgatatt

SEQ ID NO: 1282453 - DNA, 22 bp, Artificial Sequence
  chemically synthesized
agatatcatttatatgatattt

SEQ ID NO: 1282454 - DNA, 22 bp, Artificial Sequence
  chemically synthesized
taaaatgtcttcaaaaatatca

SEQ ID NO: 1282455 - DNA, 22 bp, Artificial Sequence
  chemically synthesized
ataaaatgtcttcaaaaatatc

SEQ ID NO: 1282456 - DNA, 22 bp, Artificial Sequence
  chemically synthesized
tatttataaaatgtcttcaaaa

SEQ ID NO: 1282457 - DNA, 22 bp, Artificial Sequence
  chemically synthesized
atatgatatttttgaagacatt

SEQ ID NO: 1282458 - DNA, 22 bp, Artificial Sequence
  chemically synthesized
ttgtatttataaaatgtcttca

SEQ ID NO: 1282459 - DNA, 22 bp, Artificial Sequence
  chemically synthesized
tatgatatttttgaagacattt

SEQ ID NO: 1282460 - DNA, 22 bp, Artificial Sequence
  chemically synthesized
gttgtatttataaaatgtcttc

SEQ ID NO: 1282461 - DNA, 22 bp, Artificial Sequence
  chemically synthesized
ttgaagacattttataaataca

SEQ ID NO: 1282462 - DNA, 22 bp, Artificial Sequence
  chemically synthesized
tgaagacattttataaatacaa

SEQ ID NO: 1282463 - DNA, 22 bp, Artificial Sequence
  chemically synthesized
gaagacattttataaatacaac

SEQ ID NO: 1282464 - DNA, 22 bp, Artificial Sequence
  chemically synthesized
aagacattttataaatacaaca

SEQ ID NO: 1282465 - DNA, 22 bp, Artificial Sequence
  chemically synthesized
tataaatacaacaaatatgatg

SEQ ID NO: 1282466 - DNA, 22 bp, Artificial Sequence
  chemically synthesized
ataaatacaacaaatatgatgg

SEQ ID NO: 1282467 - DNA, 22 bp, Artificial Sequence
  chemically synthesized
taaatacaacaaatatgatgga

SEQ ID NO: 1282468 - DNA, 22 bp, Artificial Sequence
  chemically synthesized
tagtaatagaaataatccatca

SEQ ID NO: 1282469 - DNA, 22 bp, Artificial Sequence
  chemically synthesized
gttatagtaatagaaataatcc

SEQ ID NO: 1282470 - DNA, 22 bp, Artificial Sequence
  chemically synthesized
agttatagtaatagaaataatc

SEQ ID NO: 1282471 - DNA, 22 bp, Artificial Sequence
  chemically synthesized
aaaacataatttagttatagta

SEQ ID NO: 1282472 - DNA, 22 bp, Artificial Sequence
  chemically synthesized
caaaacataatttagttatagt

SEQ ID NO: 1282473 - DNA, 22 bp, Artificial Sequence
  chemically synthesized
tttctattactataactaaatt

SEQ ID NO: 1282474 - DNA, 22 bp, Artificial Sequence
  chemically synthesized
ctattactataactaaattatg

SEQ ID NO: 1282475 - DNA, 22 bp, Artificial Sequence
  chemically synthesized
tattactataactaaattatgt

SEQ ID NO: 1282476 - DNA, 22 bp, Artificial Sequence
  chemically synthesized
ttactataactaaattatgttt

SEQ ID NO: 1282477 - DNA, 22 bp, Artificial Sequence
  chemically synthesized
ctataactaaattatgttttga

SEQ ID NO: 1282478 - DNA, 22 bp, Artificial Sequence
  chemically synthesized
taactaaattatgttttgaaat

SEQ ID NO: 1282479 - DNA, 22 bp, Artificial Sequence
  chemically synthesized
gtaaatagtatggtatttcaaa

SEQ ID NO: 1282480 - DNA, 22 bp, Artificial Sequence
  chemically synthesized
agtaaatagtatggtatttcaa

SEQ ID NO: 1282481 - DNA, 22 bp, Artificial Sequence
  chemically synthesized
ttagtaaatagtatggtatttc

SEQ ID NO: 1282482 - DNA, 22 bp, Artificial Sequence
  chemically synthesized
aattatgttttgaaataccata

SEQ ID NO: 1282483 - DNA, 22 bp, Artificial Sequence
  chemically synthesized
tgttttgaaataccatactatt

SEQ ID NO: 1282484 - DNA, 22 bp, Artificial Sequence
  chemically synthesized
tagctcttagtaaatagtatgg

SEQ ID NO: 1282485 - DNA, 22 bp, Artificial Sequence
  chemically synthesized
atagctcttagtaaatagtatg

SEQ ID NO: 1282486 - DNA, 22 bp, Artificial Sequence
  chemically synthesized
tatagctcttagtaaatagtat

SEQ ID NO: 1282487 - DNA, 22 bp, Artificial Sequence
  chemically synthesized
tgaaataccatactatttacta

SEQ ID NO: 1282488 - DNA, 22 bp, Artificial Sequence
  chemically synthesized
gaaataccatactatttactaa

SEQ ID NO: 1282489 - DNA, 22 bp, Artificial Sequence
  chemically synthesized
aaataccatactatttactaag

SEQ ID NO: 1282490 - DNA, 22 bp, Artificial Sequence
  chemically synthesized
tcacattttatagctcttagta

SEQ ID NO: 1282491 - DNA, 22 bp, Artificial Sequence
  chemically synthesized
tttactaagagctataaaatgt

SEQ ID NO: 1282492 - DNA, 22 bp, Artificial Sequence
  chemically synthesized
taggatactatcacattttata

SEQ ID NO: 1282493 - DNA, 22 bp, Artificial Sequence
  chemically synthesized
ataggatactatcacattttat

SEQ ID NO: 1282494 - DNA, 22 bp, Artificial Sequence
  chemically synthesized
tataggatactatcacatttta

SEQ ID NO: 1282495 - DNA, 22 bp, Artificial Sequence
  chemically synthesized
actaagagctataaaatgtgat

SEQ ID NO: 1282496 - DNA, 22 bp, Artificial Sequence
  chemically synthesized
ctaagagctataaaatgtgata

SEQ ID NO: 1282497 - DNA, 22 bp, Artificial Sequence
  chemically synthesized
attttataggatactatcacat

SEQ ID NO: 1282498 - DNA, 22 bp, Artificial Sequence
  chemically synthesized
agagctataaaatgtgatagta

SEQ ID NO: 1282499 - DNA, 22 bp, Artificial Sequence
  chemically synthesized
taaaatgtgatagtatcctata

SEQ ID NO: 1282500 - DNA, 22 bp, Artificial Sequence
  chemically synthesized
agatattaattttataggatac

SEQ ID NO: 1282501 - DNA, 22 bp, Artificial Sequence
  chemically synthesized
ttgagatattaattttatagga

SEQ ID NO: 1282502 - DNA, 22 bp, Artificial Sequence
  chemically synthesized
gagttattgagatattaatttt

SEQ ID NO: 1282503 - DNA, 22 bp, Artificial Sequence
  chemically synthesized
agagttattgagatattaattt

SEQ ID NO: 1282504 - DNA, 22 bp, Artificial Sequence
  chemically synthesized
tagagttattgagatattaatt

SEQ ID NO: 1282505 - DNA, 22 bp, Artificial Sequence
  chemically synthesized
acatgttttagagttattgaga

SEQ ID NO: 1282506 - DNA, 22 bp, Artificial Sequence
  chemically synthesized
taaaattaatatctcaataact

SEQ ID NO: 1282507 - DNA, 22 bp, Artificial Sequence
  chemically synthesized
aactgacatgttttagagttat

SEQ ID NO: 1282508 - DNA, 22 bp, Artificial Sequence
  chemically synthesized
caactgacatgttttagagtta

SEQ ID NO: 1282509 - DNA, 22 bp, Artificial Sequence
  chemically synthesized
tcaactgacatgttttagagtt

SEQ ID NO: 1282510 - DNA, 22 bp, Artificial Sequence
  chemically synthesized
atatctcaataactctaaaaca

SEQ ID NO: 1282511 - DNA, 22 bp, Artificial Sequence
  chemically synthesized
ttttcaactgacatgttttaga

SEQ ID NO: 1282512 - DNA, 22 bp, Artificial Sequence
  chemically synthesized
aataactctaaaacatgtcagt

SEQ ID NO: 1282513 - DNA, 22 bp, Artificial Sequence
  chemically synthesized
taaaacatgtcagttgaaaata

SEQ ID NO: 1282514 - DNA, 22 bp, Artificial Sequence
  chemically synthesized
atatatatgcactattttcaac

SEQ ID NO: 1282515 - DNA, 22 bp, Artificial Sequence
  chemically synthesized
aaacatgtcagttgaaaatagt

SEQ ID NO: 1282516 - DNA, 22 bp, Artificial Sequence
  chemically synthesized
acactaatatatatgcactatt

SEQ ID NO: 1282517 - DNA, 22 bp, Artificial Sequence
  chemically synthesized
aaaatagtgcatatatattagt

SEQ ID NO: 1282518 - DNA, 22 bp, Artificial Sequence
  chemically synthesized
acatacccccacatacattcac

SEQ ID NO: 1282519 - DNA, 22 bp, Artificial Sequence
  chemically synthesized
gacatacccccacatacattca

SEQ ID NO: 1282520 - DNA, 22 bp, Artificial Sequence
  chemically synthesized
tgacatacccccacatacattc

SEQ ID NO: 1282521 - DNA, 22 bp, Artificial Sequence
  chemically synthesized
ttgacatacccccacatacatt

SEQ ID NO: 1282522 - DNA, 22 bp, Artificial Sequence
  chemically synthesized
ttttgacatacccccacataca

SEQ ID NO: 1282523 - DNA, 22 bp, Artificial Sequence
  chemically synthesized
tcttttgacatacccccacata

SEQ ID NO: 1282524 - DNA, 22 bp, Artificial Sequence
  chemically synthesized
gtgtgaatgtatgtgggggtat

SEQ ID NO: 1282525 - DNA, 22 bp, Artificial Sequence
  chemically synthesized
aggagattctcttttgacatac

SEQ ID NO: 1282526 - DNA, 22 bp, Artificial Sequence
  chemically synthesized
tattaaggagattctcttttga

SEQ ID NO: 1282527 - DNA, 22 bp, Artificial Sequence
  chemically synthesized
gtattaaggagattctcttttg

SEQ ID NO: 1282528 - DNA, 22 bp, Artificial Sequence
  chemically synthesized
cagcagaggcttgtattaagga

SEQ ID NO: 1282529 - DNA, 22 bp, Artificial Sequence
  chemically synthesized
ccagcagaggcttgtattaagg

SEQ ID NO: 1282530 - DNA, 22 bp, Artificial Sequence
  chemically synthesized
tttccagcagaggcttgtatta

SEQ ID NO: 1282531 - DNA, 22 bp, Artificial Sequence
  chemically synthesized
atttccagcagaggcttgtatt

SEQ ID NO: 1282532 - DNA, 22 bp, Artificial Sequence
  chemically synthesized
tatttccagcagaggcttgtat

SEQ ID NO: 1282533 - DNA, 22 bp, Artificial Sequence
  chemically synthesized
ttatttccagcagaggcttgta

SEQ ID NO: 1282534 - DNA, 22 bp, Artificial Sequence
  chemically synthesized
tttatttccagcagaggcttgt

SEQ ID NO: 1282535 - DNA, 22 bp, Artificial Sequence
  chemically synthesized
ttttttatttccagcagaggct

SEQ ID NO: 1282536 - DNA, 22 bp, Artificial Sequence
  chemically synthesized
attttttatttccagcagaggc

SEQ ID NO: 1282537 - DNA, 22 bp, Artificial Sequence
  chemically synthesized
tattttttatttccagcagagg

SEQ ID NO: 1282538 - DNA, 22 bp, Artificial Sequence
  chemically synthesized
cttaatacaagcctctgctgga

SEQ ID NO: 1282539 - DNA, 22 bp, Artificial Sequence
  chemically synthesized
tttattttttatttccagcaga

SEQ ID NO: 1282540 - DNA, 22 bp, Artificial Sequence
  chemically synthesized
ctttattttttatttccagcag

SEQ ID NO: 1282541 - DNA, 22 bp, Artificial Sequence
  chemically synthesized
aatacaagcctctgctggaaat

SEQ ID NO: 1282542 - DNA, 22 bp, Artificial Sequence
  chemically synthesized
tctttattttttatttccagca

SEQ ID NO: 1282543 - DNA, 22 bp, Artificial Sequence
  chemically synthesized
atacaagcctctgctggaaata

SEQ ID NO: 1282544 - DNA, 22 bp, Artificial Sequence
  chemically synthesized
ttctttattttttatttccagc

SEQ ID NO: 1282545 - DNA, 22 bp, Artificial Sequence
  chemically synthesized
tttctttattttttatttccag

SEQ ID NO: 1282546 - DNA, 22 bp, Artificial Sequence
  chemically synthesized
ttttctttattttttatttcca

SEQ ID NO: 1282547 - DNA, 22 bp, Artificial Sequence
  chemically synthesized
tttttctttattttttatttcc

SEQ ID NO: 1282548 - DNA, 22 bp, Artificial Sequence
  chemically synthesized
ctttttttctttattttttatt

SEQ ID NO: 1282549 - DNA, 22 bp, Artificial Sequence
  chemically synthesized
tgctttttttctttatttttta

SEQ ID NO: 1282550 - DNA, 22 bp, Artificial Sequence
  chemically synthesized
ctgctttttttctttatttttt

SEQ ID NO: 1282551 - DNA, 22 bp, Artificial Sequence
  chemically synthesized
tctgctttttttctttattttt

SEQ ID NO: 1282552 - DNA, 22 bp, Artificial Sequence
  chemically synthesized
tgctggaaataaaaaataaaga

SEQ ID NO: 1282553 - DNA, 22 bp, Artificial Sequence
  chemically synthesized
ctggaaataaaaaataaagaaa

SEQ ID NO: 1282554 - DNA, 22 bp, Artificial Sequence
  chemically synthesized
attttctgctttttttctttat

SEQ ID NO: 1282555 - DNA, 22 bp, Artificial Sequence
  chemically synthesized
gaaataaaaaataaagaaaaaa

SEQ ID NO: 1282556 - DNA, 22 bp, Artificial Sequence
  chemically synthesized
aataattcattttctgcttttt

SEQ ID NO: 1282557 - DNA, 22 bp, Artificial Sequence
  chemically synthesized
ttaaataattcattttctgctt

SEQ ID NO: 1282558 - DNA, 22 bp, Artificial Sequence
  chemically synthesized
gaaattattaaataattcattt

SEQ ID NO: 1282559 - DNA, 22 bp, Artificial Sequence
  chemically synthesized
agaaattattaaataattcatt

SEQ ID NO: 1282560 - DNA, 22 bp, Artificial Sequence
  chemically synthesized
agaacatcttagaaattattaa

SEQ ID NO: 1282561 - DNA, 22 bp, Artificial Sequence
  chemically synthesized
gcacctgagaacatcttagaaa

SEQ ID NO: 1282562 - DNA, 22 bp, Artificial Sequence
  chemically synthesized
tttaataatttctaagatgttc

SEQ ID NO: 1282563 - DNA, 22 bp, Artificial Sequence
  chemically synthesized
tgttggcacctgagaacatctt

SEQ ID NO: 1282564 - DNA, 22 bp, Artificial Sequence
  chemically synthesized
aataatttctaagatgttctca

SEQ ID NO: 1282565 - DNA, 22 bp, Artificial Sequence
  chemically synthesized
ataatttctaagatgttctcag

SEQ ID NO: 1282566 - DNA, 22 bp, Artificial Sequence
  chemically synthesized
ttgtgttggcacctgagaacat

SEQ ID NO: 1282567 - DNA, 22 bp, Artificial Sequence
  chemically synthesized
gttgtgttggcacctgagaaca

SEQ ID NO: 1282568 - DNA, 22 bp, Artificial Sequence
  chemically synthesized
ctaagatgttctcaggtgccaa

SEQ ID NO: 1282569 - DNA, 22 bp, Artificial Sequence
  chemically synthesized
ggatttgttgtgttggcacctg

SEQ ID NO: 1282570 - DNA, 22 bp, Artificial Sequence
  chemically synthesized
taagatgttctcaggtgccaac

SEQ ID NO: 1282571 - DNA, 22 bp, Artificial Sequence
  chemically synthesized
agatgttctcaggtgccaacac

SEQ ID NO: 1282572 - DNA, 22 bp, Artificial Sequence
  chemically synthesized
attaggatttgttgtgttggca

SEQ ID NO: 1282573 - DNA, 22 bp, Artificial Sequence
  chemically synthesized
ggttcattaggatttgttgtgt

SEQ ID NO: 1282574 - DNA, 22 bp, Artificial Sequence
  chemically synthesized
tcaggtgccaacacaacaaatc

SEQ ID NO: 1282575 - DNA, 22 bp, Artificial Sequence
  chemically synthesized
aggtgccaacacaacaaatcct

SEQ ID NO: 1282576 - DNA, 22 bp, Artificial Sequence
  chemically synthesized
atcaaccctgggttcattagga

SEQ ID NO: 1282577 - DNA, 22 bp, Artificial Sequence
  chemically synthesized
aatcaaccctgggttcattagg

SEQ ID NO: 1282578 - DNA, 22 bp, Artificial Sequence
  chemically synthesized
catttaatcaaccctgggttca

SEQ ID NO: 1282579 - DNA, 22 bp, Artificial Sequence
  chemically synthesized
tctgcatttaatcaaccctggg

SEQ ID NO: 1282580 - DNA, 22 bp, Artificial Sequence
  chemically synthesized
atctgcatttaatcaaccctgg

SEQ ID NO: 1282581 - DNA, 22 bp, Artificial Sequence
  chemically synthesized
tatctgcatttaatcaaccctg

SEQ ID NO: 1282582 - DNA, 22 bp, Artificial Sequence
  chemically synthesized
tttatctgcatttaatcaaccc

SEQ ID NO: 1282583 - DNA, 22 bp, Artificial Sequence
  chemically synthesized
ctttatctgcatttaatcaacc

SEQ ID NO: 1282584 - DNA, 22 bp, Artificial Sequence
  chemically synthesized
atgaacccagggttgattaaat

SEQ ID NO: 1282585 - DNA, 22 bp, Artificial Sequence
  chemically synthesized
aaaaatgcatatcttctttatc

SEQ ID NO: 1282586 - DNA, 22 bp, Artificial Sequence
  chemically synthesized
gaaaaatgcatatcttctttat

SEQ ID NO: 1282587 - DNA, 22 bp, Artificial Sequence
  chemically synthesized
attaaatgcagataaagaagat

SEQ ID NO: 1282588 - DNA, 22 bp, Artificial Sequence
  chemically synthesized
aatgcagataaagaagatatgc

SEQ ID NO: 1282589 - DNA, 22 bp, Artificial Sequence
  chemically synthesized
atgagatttgaaaaatgcatat

SEQ ID NO: 1282590 - DNA, 22 bp, Artificial Sequence
  chemically synthesized
catgagatttgaaaaatgcata

SEQ ID NO: 1282591 - DNA, 22 bp, Artificial Sequence
  chemically synthesized
ttcatgagatttgaaaaatgca

SEQ ID NO: 1282592 - DNA, 22 bp, Artificial Sequence
  chemically synthesized
tcttcatgagatttgaaaaatg

SEQ ID NO: 1282593 - DNA, 22 bp, Artificial Sequence
  chemically synthesized
ctcttcatgagatttgaaaaat

SEQ ID NO: 1282594 - DNA, 22 bp, Artificial Sequence
  chemically synthesized
tctcttcatgagatttgaaaaa

SEQ ID NO: 1282595 - DNA, 22 bp, Artificial Sequence
  chemically synthesized
ttctcttcatgagatttgaaaa

SEQ ID NO: 1282596 - DNA, 22 bp, Artificial Sequence
  chemically synthesized
tttctcttcatgagatttgaaa

SEQ ID NO: 1282597 - DNA, 22 bp, Artificial Sequence
  chemically synthesized
ttttctcttcatgagatttgaa

SEQ ID NO: 1282598 - DNA, 22 bp, Artificial Sequence
  chemically synthesized
ttcaaatctcatgaagagaaaa

SEQ ID NO: 1282599 - DNA, 22 bp, Artificial Sequence
  chemically synthesized
tcaaatctcatgaagagaaaaa

SEQ ID NO: 1282600 - DNA, 22 bp, Artificial Sequence
  chemically synthesized
caaatctcatgaagagaaaaaa

SEQ ID NO: 1282601 - DNA, 22 bp, Artificial Sequence
  chemically synthesized
aaatctcatgaagagaaaaaag

SEQ ID NO: 1282602 - DNA, 22 bp, Artificial Sequence
  chemically synthesized
atgaagagaaaaaagatttttc

SEQ ID NO: 1282603 - DNA, 22 bp, Artificial Sequence
  chemically synthesized
gagaatgatcgacagaaaaatc

SEQ ID NO: 1282604 - DNA, 22 bp, Artificial Sequence
  chemically synthesized
attagagaatgatcgacagaaa

SEQ ID NO: 1282605 - DNA, 22 bp, Artificial Sequence
  chemically synthesized
aattagagaatgatcgacagaa

SEQ ID NO: 1282606 - DNA, 22 bp, Artificial Sequence
  chemically synthesized
taattagagaatgatcgacaga

SEQ ID NO: 1282607 - DNA, 22 bp, Artificial Sequence
  chemically synthesized
atactttaattagagaatgatc

SEQ ID NO: 1282608 - DNA, 22 bp, Artificial Sequence
  chemically synthesized
ttctgtcgatcattctctaatt

SEQ ID NO: 1282609 - DNA, 22 bp, Artificial Sequence
  chemically synthesized
tctgtcgatcattctctaatta

SEQ ID NO: 1282610 - DNA, 22 bp, Artificial Sequence
  chemically synthesized
ccgttaatactttaattagaga

SEQ ID NO: 1282611 - DNA, 22 bp, Artificial Sequence
  chemically synthesized
ctgtcgatcattctctaattaa

SEQ ID NO: 1282612 - DNA, 22 bp, Artificial Sequence
  chemically synthesized
accgttaatactttaattagag

SEQ ID NO: 1282613 - DNA, 22 bp, Artificial Sequence
  chemically synthesized
tgtcgatcattctctaattaaa

SEQ ID NO: 1282614 - DNA, 22 bp, Artificial Sequence
  chemically synthesized
tcgatcattctctaattaaagt

SEQ ID NO: 1282615 - DNA, 22 bp, Artificial Sequence
  chemically synthesized
tcttaccgttaatactttaatt

SEQ ID NO: 1282616 - DNA, 22 bp, Artificial Sequence
  chemically synthesized
tatcttaccgttaatactttaa

SEQ ID NO: 1282617 - DNA, 22 bp, Artificial Sequence
  chemically synthesized
tctaattaaagtattaacggta

SEQ ID NO: 1282618 - DNA, 22 bp, Artificial Sequence
  chemically synthesized
taattaaagtattaacggtaag

SEQ ID NO: 1282619 - DNA, 22 bp, Artificial Sequence
  chemically synthesized
attaaagtattaacggtaagat

SEQ ID NO: 1282620 - DNA, 22 bp, Artificial Sequence
  chemically synthesized
aagtattaacggtaagatagag

SEQ ID NO: 1282621 - DNA, 22 bp, Artificial Sequence
  chemically synthesized
cagtaagagggaatacagtctc

SEQ ID NO: 1282622 - DNA, 22 bp, Artificial Sequence
  chemically synthesized
acggtaagatagagactgtatt

SEQ ID NO: 1282623 - DNA, 22 bp, Artificial Sequence
  chemically synthesized
ccagtaagagggaatacagtct

SEQ ID NO: 1282624 - DNA, 22 bp, Artificial Sequence
  chemically synthesized
tccagtaagagggaatacagtc

SEQ ID NO: 1282625 - DNA, 22 bp, Artificial Sequence
  chemically synthesized
tctttccagtaagagggaatac

SEQ ID NO: 1282626 - DNA, 22 bp, Artificial Sequence
  chemically synthesized
atctttccagtaagagggaata

SEQ ID NO: 1282627 - DNA, 22 bp, Artificial Sequence
  chemically synthesized
tattccctcttactggaaagat

SEQ ID NO: 1282628 - DNA, 22 bp, Artificial Sequence
  chemically synthesized
tagaaacatacagtttatcttt

SEQ ID NO: 1282629 - DNA, 22 bp, Artificial Sequence
  chemically synthesized
cctcttactggaaagataaact

SEQ ID NO: 1282630 - DNA, 22 bp, Artificial Sequence
  chemically synthesized
ttactggaaagataaactgtat

SEQ ID NO: 1282631 - DNA, 22 bp, Artificial Sequence
  chemically synthesized
actggaaagataaactgtatgt

SEQ ID NO: 1282632 - DNA, 22 bp, Artificial Sequence
  chemically synthesized
ctggaaagataaactgtatgtt

SEQ ID NO: 1282633 - DNA, 22 bp, Artificial Sequence
  chemically synthesized
gaaagataaactgtatgtttct

SEQ ID NO: 1282634 - DNA, 22 bp, Artificial Sequence
  chemically synthesized
gggtgacatatattatagaaac

SEQ ID NO: 1282635 - DNA, 22 bp, Artificial Sequence
  chemically synthesized
ctagggtgacatatattataga

SEQ ID NO: 1282636 - DNA, 22 bp, Artificial Sequence
  chemically synthesized
ttgctagggtgacatatattat

SEQ ID NO: 1282637 - DNA, 22 bp, Artificial Sequence
  chemically synthesized
tatgtttctataatatatgtca

SEQ ID NO: 1282638 - DNA, 22 bp, Artificial Sequence
  chemically synthesized
tgtgttgttgctagggtgacat

SEQ ID NO: 1282639 - DNA, 22 bp, Artificial Sequence
  chemically synthesized
gtgtgttgttgctagggtgaca

SEQ ID NO: 1282640 - DNA, 22 bp, Artificial Sequence
  chemically synthesized
tgtgtgttgttgctagggtgac

SEQ ID NO: 1282641 - DNA, 22 bp, Artificial Sequence
  chemically synthesized
ctataatatatgtcaccctagc

SEQ ID NO: 1282642 - DNA, 22 bp, Artificial Sequence
  chemically synthesized
tataatatatgtcaccctagca

SEQ ID NO: 1282643 - DNA, 22 bp, Artificial Sequence
  chemically synthesized
taatatatgtcaccctagcaac

SEQ ID NO: 1282644 - DNA, 22 bp, Artificial Sequence
  chemically synthesized
atgctttgtgtgttgttgctag

SEQ ID NO: 1282645 - DNA, 22 bp, Artificial Sequence
  chemically synthesized
aaggcagttgatgctttgtgtg

SEQ ID NO: 1282646 - DNA, 22 bp, Artificial Sequence
  chemically synthesized
ttaaaggcagttgatgctttgt

SEQ ID NO: 1282647 - DNA, 22 bp, Artificial Sequence
  chemically synthesized
attaaaggcagttgatgctttg

SEQ ID NO: 1282648 - DNA, 22 bp, Artificial Sequence
  chemically synthesized
gcaacaacacacaaagcatcaa

SEQ ID NO: 1282649 - DNA, 22 bp, Artificial Sequence
  chemically synthesized
tattaaaggcagttgatgcttt

SEQ ID NO: 1282650 - DNA, 22 bp, Artificial Sequence
  chemically synthesized
ttattaaaggcagttgatgctt

SEQ ID NO: 1282651 - DNA, 22 bp, Artificial Sequence
  chemically synthesized
taaaatcagtttttattaaagg

SEQ ID NO: 1282652 - DNA, 22 bp, Artificial Sequence
  chemically synthesized
attataaaatcagtttttatta

SEQ ID NO: 1282653 - DNA, 22 bp, Artificial Sequence
  chemically synthesized
aattataaaatcagtttttatt

SEQ ID NO: 1282654 - DNA, 22 bp, Artificial Sequence
  chemically synthesized
taattataaaatcagtttttat

SEQ ID NO: 1282655 - DNA, 22 bp, Artificial Sequence
  chemically synthesized
ctttaattataaaatcagtttt

SEQ ID NO: 1282656 - DNA, 22 bp, Artificial Sequence
  chemically synthesized
cctttaataaaaactgatttta

SEQ ID NO: 1282657 - DNA, 22 bp, Artificial Sequence
  chemically synthesized
gctcctttaattataaaatcag

SEQ ID NO: 1282658 - DNA, 22 bp, Artificial Sequence
  chemically synthesized
taataaaaactgattttataat

SEQ ID NO: 1282659 - DNA, 22 bp, Artificial Sequence
  chemically synthesized
aataaaaactgattttataatt

SEQ ID NO: 1282660 - DNA, 22 bp, Artificial Sequence
  chemically synthesized
ataaaaactgattttataatta

SEQ ID NO: 1282661 - DNA, 22 bp, Artificial Sequence
  chemically synthesized
aacagttagctcctttaattat

SEQ ID NO: 1282662 - DNA, 22 bp, Artificial Sequence
  chemically synthesized
caacagttagctcctttaatta

SEQ ID NO: 1282663 - DNA, 22 bp, Artificial Sequence
  chemically synthesized
tcaacagttagctcctttaatt

SEQ ID NO: 1282664 - DNA, 22 bp, Artificial Sequence
  chemically synthesized
ttcaacagttagctcctttaat

SEQ ID NO: 1282665 - DNA, 22 bp, Artificial Sequence
  chemically synthesized
tttttcaacagttagctccttt

SEQ ID NO: 1282666 - DNA, 22 bp, Artificial Sequence
  chemically synthesized
attttataattaaaggagctaa

SEQ ID NO: 1282667 - DNA, 22 bp, Artificial Sequence
  chemically synthesized
tataattaaaggagctaactgt

SEQ ID NO: 1282668 - DNA, 22 bp, Artificial Sequence
  chemically synthesized
ataattaaaggagctaactgtt

SEQ ID NO: 1282669 - DNA, 22 bp, Artificial Sequence
  chemically synthesized
taattaaaggagctaactgttg

SEQ ID NO: 1282670 - DNA, 22 bp, Artificial Sequence
  chemically synthesized
aaggagctaactgttgaaaaat

SEQ ID NO: 1282671 - DNA, 22 bp, Artificial Sequence
  chemically synthesized
taaaaagtgactatttttcaac

SEQ ID NO: 1282672 - DNA, 22 bp, Artificial Sequence
  chemically synthesized
actgttgaaaaatagtcacttt

SEQ ID NO: 1282673 - DNA, 22 bp, Artificial Sequence
  chemically synthesized
aagtgtctataaaaagtgacta

SEQ ID NO: 1282674 - DNA, 22 bp, Artificial Sequence
  chemically synthesized
ttgaaaaatagtcactttttat

SEQ ID NO: 1282675 - DNA, 22 bp, Artificial Sequence
  chemically synthesized
atattcaagtgtctataaaaag

SEQ ID NO: 1282676 - DNA, 22 bp, Artificial Sequence
  chemically synthesized
aaaaatagtcactttttataga

SEQ ID NO: 1282677 - DNA, 22 bp, Artificial Sequence
  chemically synthesized
catattcaagtgtctataaaaa

SEQ ID NO: 1282678 - DNA, 22 bp, Artificial Sequence
  chemically synthesized
tcatattcaagtgtctataaaa

SEQ ID NO: 1282679 - DNA, 22 bp, Artificial Sequence
  chemically synthesized
tttatagacacttgaatatgaa

SEQ ID NO: 1282680 - DNA, 22 bp, Artificial Sequence
  chemically synthesized
ttatagacacttgaatatgaaa

SEQ ID NO: 1282681 - DNA, 22 bp, Artificial Sequence
  chemically synthesized
tatagacacttgaatatgaaaa

SEQ ID NO: 1282682 - DNA, 22 bp, Artificial Sequence
  chemically synthesized
atagacacttgaatatgaaaat

SEQ ID NO: 1282683 - DNA, 22 bp, Artificial Sequence
  chemically synthesized
tagacacttgaatatgaaaatt

SEQ ID NO: 1282684 - DNA, 22 bp, Artificial Sequence
  chemically synthesized
taatgaggtgtgagaaaccaat

SEQ ID NO: 1282685 - DNA, 22 bp, Artificial Sequence
  chemically synthesized
gaatatgaaaattggtttctca

SEQ ID NO: 1282686 - DNA, 22 bp, Artificial Sequence
  chemically synthesized
aatatgaaaattggtttctcac

SEQ ID NO: 1282687 - DNA, 22 bp, Artificial Sequence
  chemically synthesized
gtattataatgaggtgtgagaa

SEQ ID NO: 1282688 - DNA, 22 bp, Artificial Sequence
  chemically synthesized
agtattataatgaggtgtgaga

SEQ ID NO: 1282689 - DNA, 22 bp, Artificial Sequence
  chemically synthesized
cacttagtattataatgaggtg

SEQ ID NO: 1282690 - DNA, 22 bp, Artificial Sequence
  chemically synthesized
gcacttagtattataatgaggt

SEQ ID NO: 1282691 - DNA, 22 bp, Artificial Sequence
  chemically synthesized
gtttctcacacctcattataat

SEQ ID NO: 1282692 - DNA, 22 bp, Artificial Sequence
  chemically synthesized
atttgcacttagtattataatg

SEQ ID NO: 1282693 - DNA, 22 bp, Artificial Sequence
  chemically synthesized
ctcacacctcattataatacta

SEQ ID NO: 1282694 - DNA, 22 bp, Artificial Sequence
  chemically synthesized
tcacacctcattataatactaa

SEQ ID NO: 1282695 - DNA, 22 bp, Artificial Sequence
  chemically synthesized
tactaatttgcacttagtatta

SEQ ID NO: 1282696 - DNA, 22 bp, Artificial Sequence
  chemically synthesized
acacctcattataatactaagt

SEQ ID NO: 1282697 - DNA, 22 bp, Artificial Sequence
  chemically synthesized
atactaatttgcacttagtatt

SEQ ID NO: 1282698 - DNA, 22 bp, Artificial Sequence
  chemically synthesized
attataatactaagtgcaaatt

SEQ ID NO: 1282699 - DNA, 22 bp, Artificial Sequence
  chemically synthesized
taatactaagtgcaaattagta

SEQ ID NO: 1282700 - DNA, 22 bp, Artificial Sequence
  chemically synthesized
agtgcaaattagtataagcctt

SEQ ID NO: 1282701 - DNA, 22 bp, Artificial Sequence
  chemically synthesized
gaatggatgagcaaaggcttat

SEQ ID NO: 1282702 - DNA, 22 bp, Artificial Sequence
  chemically synthesized
ggaatggatgagcaaaggctta

SEQ ID NO: 1282703 - DNA, 22 bp, Artificial Sequence
  chemically synthesized
cttggaatggatgagcaaaggc

SEQ ID NO: 1282704 - DNA, 22 bp, Artificial Sequence
  chemically synthesized
acttggaatggatgagcaaagg

SEQ ID NO: 1282705 - DNA, 22 bp, Artificial Sequence
  chemically synthesized
tacttggaatggatgagcaaag

SEQ ID NO: 1282706 - DNA, 22 bp, Artificial Sequence
  chemically synthesized
ctttacttggaatggatgagca

SEQ ID NO: 1282707 - DNA, 22 bp, Artificial Sequence
  chemically synthesized
gtataagcctttgctcatccat

SEQ ID NO: 1282708 - DNA, 22 bp, Artificial Sequence
  chemically synthesized
tgctttacttggaatggatgag

SEQ ID NO: 1282709 - DNA, 22 bp, Artificial Sequence
  chemically synthesized
ctgctttacttggaatggatga

SEQ ID NO: 1282710 - DNA, 22 bp, Artificial Sequence
  chemically synthesized
tgcttctgctttacttggaatg

SEQ ID NO: 1282711 - DNA, 22 bp, Artificial Sequence
  chemically synthesized
tgctcatccattccaagtaaag

SEQ ID NO: 1282712 - DNA, 22 bp, Artificial Sequence
  chemically synthesized
tctgtgcttctgctttacttgg

SEQ ID NO: 1282713 - DNA, 22 bp, Artificial Sequence
  chemically synthesized
gctcatccattccaagtaaagc

SEQ ID NO: 1282714 - DNA, 22 bp, Artificial Sequence
  chemically synthesized
ctcatccattccaagtaaagca

SEQ ID NO: 1282715 - DNA, 22 bp, Artificial Sequence
  chemically synthesized
atccattccaagtaaagcagaa

SEQ ID NO: 1282716 - DNA, 22 bp, Artificial Sequence
  chemically synthesized
atctgtctgtgcttctgcttta

SEQ ID NO: 1282717 - DNA, 22 bp, Artificial Sequence
  chemically synthesized
gttgatctgtctgtgcttctgc

SEQ ID NO: 1282718 - DNA, 22 bp, Artificial Sequence
  chemically synthesized
caagtaaagcagaagcacagac

SEQ ID NO: 1282719 - DNA, 22 bp, Artificial Sequence
  chemically synthesized
ggttggttgatctgtctgtgct

SEQ ID NO: 1282720 - DNA, 22 bp, Artificial Sequence
  chemically synthesized
caacgtgtcatgtacagtgcta

SEQ ID NO: 1282721 - DNA, 22 bp, Artificial Sequence
  chemically synthesized
ctacaacgtgtcatgtacagtg

SEQ ID NO: 1282722 - DNA, 22 bp, Artificial Sequence
  chemically synthesized
aattcctacaacgtgtcatgta

SEQ ID NO: 1282723 - DNA, 22 bp, Artificial Sequence
  chemically synthesized
gttgaattcctacaacgtgtca

SEQ ID NO: 1282724 - DNA, 22 bp, Artificial Sequence
  chemically synthesized
gcactgtacatgacacgttgta

SEQ ID NO: 1282725 - DNA, 22 bp, Artificial Sequence
  chemically synthesized
tacatgacacgttgtaggaatt

SEQ ID NO: 1282726 - DNA, 22 bp, Artificial Sequence
  chemically synthesized
acagaactagttgaattcctac

SEQ ID NO: 1282727 - DNA, 22 bp, Artificial Sequence
  chemically synthesized
aattaacagaactagttgaatt

SEQ ID NO: 1282728 - DNA, 22 bp, Artificial Sequence
  chemically synthesized
aaattaacagaactagttgaat

SEQ ID NO: 1282729 - DNA, 22 bp, Artificial Sequence
  chemically synthesized
taggaattcaactagttctgtt

SEQ ID NO: 1282730 - DNA, 22 bp, Artificial Sequence
  chemically synthesized
caggtatttaaattaacagaac

SEQ ID NO: 1282731 - DNA, 22 bp, Artificial Sequence
  chemically synthesized
ttgcaggtatttaaattaacag

SEQ ID NO: 1282732 - DNA, 22 bp, Artificial Sequence
  chemically synthesized
aactagttctgttaatttaaat

SEQ ID NO: 1282733 - DNA, 22 bp, Artificial Sequence
  chemically synthesized
gttctgttaatttaaatacctg

SEQ ID NO: 1282734 - DNA, 22 bp, Artificial Sequence
  chemically synthesized
tgttaatttaaatacctgcaat

SEQ ID NO: 1282735 - DNA, 22 bp, Artificial Sequence
  chemically synthesized
ttaatttaaatacctgcaatag

SEQ ID NO: 1282736 - DNA, 22 bp, Artificial Sequence
  chemically synthesized
atttaaatacctgcaatagttt

SEQ ID NO: 1282737 - DNA, 22 bp, Artificial Sequence
  chemically synthesized
aaatacctgcaatagtttttat

SEQ ID NO: 1282738 - DNA, 22 bp, Artificial Sequence
  chemically synthesized
aatacctgcaatagtttttatt

SEQ ID NO: 1282739 - DNA, 22 bp, Artificial Sequence
  chemically synthesized
caatagtttttattatatctgc

SEQ ID NO: 1282740 - DNA, 22 bp, Artificial Sequence
  chemically synthesized
aaaatccatagtgcagatataa

SEQ ID NO: 1282741 - DNA, 22 bp, Artificial Sequence
  chemically synthesized
aaaaatccatagtgcagatata

SEQ ID NO: 1282742 - DNA, 22 bp, Artificial Sequence
  chemically synthesized
taaaaatccatagtgcagatat

SEQ ID NO: 1282743 - DNA, 22 bp, Artificial Sequence
  chemically synthesized
ttaaaaatccatagtgcagata

SEQ ID NO: 1282744 - DNA, 22 bp, Artificial Sequence
  chemically synthesized
tttaaaaatccatagtgcagat

SEQ ID NO: 1282745 - DNA, 22 bp, Artificial Sequence
  chemically synthesized
ttattatatctgcactatggat

SEQ ID NO: 1282746 - DNA, 22 bp, Artificial Sequence
  chemically synthesized
tattatatctgcactatggatt

SEQ ID NO: 1282747 - DNA, 22 bp, Artificial Sequence
  chemically synthesized
attatatctgcactatggattt

SEQ ID NO: 1282748 - DNA, 22 bp, Artificial Sequence
  chemically synthesized
catattttttaaaaatccatag

SEQ ID NO: 1282749 - DNA, 22 bp, Artificial Sequence
  chemically synthesized
ttatatctgcactatggatttt

SEQ ID NO: 1282750 - DNA, 22 bp, Artificial Sequence
  chemically synthesized
ttacatattttttaaaaatcca

SEQ ID NO: 1282751 - DNA, 22 bp, Artificial Sequence
  chemically synthesized
tatctgcactatggatttttaa

SEQ ID NO: 1282752 - DNA, 22 bp, Artificial Sequence
  chemically synthesized
ctgttacatattttttaaaaat

SEQ ID NO: 1282753 - DNA, 22 bp, Artificial Sequence
  chemically synthesized
gctgttacatattttttaaaaa

SEQ ID NO: 1282754 - DNA, 22 bp, Artificial Sequence
  chemically synthesized
tgctgttacatattttttaaaa

SEQ ID NO: 1282755 - DNA, 22 bp, Artificial Sequence
  chemically synthesized
ttgctgttacatattttttaaa

SEQ ID NO: 1282756 - DNA, 22 bp, Artificial Sequence
  chemically synthesized
cactatggatttttaaaaaata

SEQ ID NO: 1282757 - DNA, 22 bp, Artificial Sequence
  chemically synthesized
tttgctgttacatattttttaa

SEQ ID NO: 1282758 - DNA, 22 bp, Artificial Sequence
  chemically synthesized
ttttgctgttacatatttttta

SEQ ID NO: 1282759 - DNA, 22 bp, Artificial Sequence
  chemically synthesized
tggatttttaaaaaatatgtaa

SEQ ID NO: 1282760 - DNA, 22 bp, Artificial Sequence
  chemically synthesized
gtagtttttttgctgttacata

SEQ ID NO: 1282761 - DNA, 22 bp, Artificial Sequence
  chemically synthesized
ggtagtttttttgctgttacat

SEQ ID NO: 1282762 - DNA, 22 bp, Artificial Sequence
  chemically synthesized
ttggtagtttttttgctgttac

SEQ ID NO: 1282763 - DNA, 22 bp, Artificial Sequence
  chemically synthesized
ttaaaaaatatgtaacagcaaa

SEQ ID NO: 1282764 - DNA, 22 bp, Artificial Sequence
  chemically synthesized
taaaaaatatgtaacagcaaaa

SEQ ID NO: 1282765 - DNA, 22 bp, Artificial Sequence
  chemically synthesized
aaaaaatatgtaacagcaaaaa

SEQ ID NO: 1282766 - DNA, 22 bp, Artificial Sequence
  chemically synthesized
aaaaatatgtaacagcaaaaaa

SEQ ID NO: 1282767 - DNA, 22 bp, Artificial Sequence
  chemically synthesized
taaatattcttggtagtttttt

SEQ ID NO: 1282768 - DNA, 22 bp, Artificial Sequence
  chemically synthesized
tattataaatattcttggtagt

SEQ ID NO: 1282769 - DNA, 22 bp, Artificial Sequence
  chemically synthesized
atattataaatattcttggtag

SEQ ID NO: 1282770 - DNA, 22 bp, Artificial Sequence
  chemically synthesized
tttatattataaatattcttgg

SEQ ID NO: 1282771 - DNA, 22 bp, Artificial Sequence
  chemically synthesized
aaaaactgtttatattataaat

SEQ ID NO: 1282772 - DNA, 22 bp, Artificial Sequence
  chemically synthesized
aaaaaactgtttatattataaa

SEQ ID NO: 1282773 - DNA, 22 bp, Artificial Sequence
  chemically synthesized
taaaaaactgtttatattataa

SEQ ID NO: 1282774 - DNA, 22 bp, Artificial Sequence
  chemically synthesized
ttaaaaaactgtttatattata

SEQ ID NO: 1282775 - DNA, 22 bp, Artificial Sequence
  chemically synthesized
ccaagaatatttataatataaa

SEQ ID NO: 1282776 - DNA, 22 bp, Artificial Sequence
  chemically synthesized
ataatataaacagttttttaaa

SEQ ID NO: 1282777 - DNA, 22 bp, Artificial Sequence
  chemically synthesized
taatataaacagttttttaaaa

SEQ ID NO: 1282778 - DNA, 22 bp, Artificial Sequence
  chemically synthesized
atgagaaagaatatttttaaaa

SEQ ID NO: 1282779 - DNA, 22 bp, Artificial Sequence
  chemically synthesized
catgagaaagaatatttttaaa

SEQ ID NO: 1282780 - DNA, 22 bp, Artificial Sequence
  chemically synthesized
tcatgagaaagaatatttttaa

SEQ ID NO: 1282781 - DNA, 22 bp, Artificial Sequence
  chemically synthesized
ttcatgagaaagaatattttta

SEQ ID NO: 1282782 - DNA, 22 bp, Artificial Sequence
  chemically synthesized
tttcatgagaaagaatattttt

SEQ ID NO: 1282783 - DNA, 22 bp, Artificial Sequence
  chemically synthesized
tttaaaaatattctttctcatg

SEQ ID NO: 1282784 - DNA, 22 bp, Artificial Sequence
  chemically synthesized
aatagactttttcatgagaaag

SEQ ID NO: 1282785 - DNA, 22 bp, Artificial Sequence
  chemically synthesized
ttaaaaatattctttctcatga

SEQ ID NO: 1282786 - DNA, 22 bp, Artificial Sequence
  chemically synthesized
taaaaatattctttctcatgaa

SEQ ID NO: 1282787 - DNA, 22 bp, Artificial Sequence
  chemically synthesized
aaaaatattctttctcatgaaa

SEQ ID NO: 1282788 - DNA, 22 bp, Artificial Sequence
  chemically synthesized
ctaaatagactttttcatgaga

SEQ ID NO: 1282789 - DNA, 22 bp, Artificial Sequence
  chemically synthesized
aaaatattctttctcatgaaaa

SEQ ID NO: 1282790 - DNA, 22 bp, Artificial Sequence
  chemically synthesized
tttctcatgaaaaagtctattt

SEQ ID NO: 1282791 - DNA, 22 bp, Artificial Sequence
  chemically synthesized
ccagaagttcctaaatagactt

SEQ ID NO: 1282792 - DNA, 22 bp, Artificial Sequence
  chemically synthesized
accagaagttcctaaatagact

SEQ ID NO: 1282793 - DNA, 22 bp, Artificial Sequence
  chemically synthesized
tctcatgaaaaagtctatttag

SEQ ID NO: 1282794 - DNA, 22 bp, Artificial Sequence
  chemically synthesized
ctcatgaaaaagtctatttagg

SEQ ID NO: 1282795 - DNA, 22 bp, Artificial Sequence
  chemically synthesized
tcatgaaaaagtctatttagga

SEQ ID NO: 1282796 - DNA, 22 bp, Artificial Sequence
  chemically synthesized
atgaaaaagtctatttaggaac

SEQ ID NO: 1282797 - DNA, 22 bp, Artificial Sequence
  chemically synthesized
cccttaccagaagttcctaaat

SEQ ID NO: 1282798 - DNA, 22 bp, Artificial Sequence
  chemically synthesized
acccttaccagaagttcctaaa

SEQ ID NO: 1282799 - DNA, 22 bp, Artificial Sequence
  chemically synthesized
tcttacccttaccagaagttcc

SEQ ID NO: 1282800 - DNA, 22 bp, Artificial Sequence
  chemically synthesized
tttaggaacttctggtaagggt

SEQ ID NO: 1282801 - DNA, 22 bp, Artificial Sequence
  chemically synthesized
aggaacttctggtaagggtaag

SEQ ID NO: 1282802 - DNA, 22 bp, Artificial Sequence
  chemically synthesized
ggaacttctggtaagggtaaga

SEQ ID NO: 1282803 - DNA, 22 bp, Artificial Sequence
  chemically synthesized
ctggtaagggtaagataacttc

SEQ ID NO: 1282804 - DNA, 22 bp, Artificial Sequence
  chemically synthesized
tggtaagggtaagataacttcg

SEQ ID NO: 1282805 - DNA, 22 bp, Artificial Sequence
  chemically synthesized
gtaagggtaagataacttcgac

SEQ ID NO: 1282806 - DNA, 22 bp, Artificial Sequence
  chemically synthesized
gtgggaagaggaagggaaaaat

SEQ ID NO: 1282807 - DNA, 22 bp, Artificial Sequence
  chemically synthesized
agtgggaagaggaagggaaaaa

SEQ ID NO: 1282808 - DNA, 22 bp, Artificial Sequence
  chemically synthesized
tagtgggaagaggaagggaaaa

SEQ ID NO: 1282809 - DNA, 22 bp, Artificial Sequence
  chemically synthesized
ttttagtgggaagaggaaggga

SEQ ID NO: 1282810 - DNA, 22 bp, Artificial Sequence
  chemically synthesized
cgacccatttttcccttcctct

SEQ ID NO: 1282811 - DNA, 22 bp, Artificial Sequence
  chemically synthesized
gacccatttttcccttcctctt

SEQ ID NO: 1282812 - DNA, 22 bp, Artificial Sequence
  chemically synthesized
ctgttttagtgggaagaggaag

SEQ ID NO: 1282813 - DNA, 22 bp, Artificial Sequence
  chemically synthesized
ttgctgttttagtgggaagagg

SEQ ID NO: 1282814 - DNA, 22 bp, Artificial Sequence
  chemically synthesized
gttgctgttttagtgggaagag

SEQ ID NO: 1282815 - DNA, 22 bp, Artificial Sequence
  chemically synthesized
ttcccttcctcttcccactaaa

SEQ ID NO: 1282816 - DNA, 22 bp, Artificial Sequence
  chemically synthesized
tcccttcctcttcccactaaaa

SEQ ID NO: 1282817 - DNA, 22 bp, Artificial Sequence
  chemically synthesized
cccttcctcttcccactaaaac

SEQ ID NO: 1282818 - DNA, 22 bp, Artificial Sequence
  chemically synthesized
ccttcctcttcccactaaaaca

SEQ ID NO: 1282819 - DNA, 22 bp, Artificial Sequence
  chemically synthesized
ccagcatttgttgctgttttag

SEQ ID NO: 1282820 - DNA, 22 bp, Artificial Sequence
  chemically synthesized
cctcttcccactaaaacagcaa

SEQ ID NO: 1282821 - DNA, 22 bp, Artificial Sequence
  chemically synthesized
ctcttcccactaaaacagcaac

SEQ ID NO: 1282822 - DNA, 22 bp, Artificial Sequence
  chemically synthesized
ttaccagcatttgttgctgttt

SEQ ID NO: 1282823 - DNA, 22 bp, Artificial Sequence
  chemically synthesized
ttcccactaaaacagcaacaaa

SEQ ID NO: 1282824 - DNA, 22 bp, Artificial Sequence
  chemically synthesized
cccactaaaacagcaacaaatg

SEQ ID NO: 1282825 - DNA, 22 bp, Artificial Sequence
  chemically synthesized
cattattaccagcatttgttgc

SEQ ID NO: 1282826 - DNA, 22 bp, Artificial Sequence
  chemically synthesized
ccactaaaacagcaacaaatgc

SEQ ID NO: 1282827 - DNA, 22 bp, Artificial Sequence
  chemically synthesized
ctgcattattaccagcatttgt

SEQ ID NO: 1282828 - DNA, 22 bp, Artificial Sequence
  chemically synthesized
ttcctgcattattaccagcatt

SEQ ID NO: 1282829 - DNA, 22 bp, Artificial Sequence
  chemically synthesized
aaacagcaacaaatgctggtaa

SEQ ID NO: 1282830 - DNA, 22 bp, Artificial Sequence
  chemically synthesized
attcctgcattattaccagcat

SEQ ID NO: 1282831 - DNA, 22 bp, Artificial Sequence
  chemically synthesized
ggtttattcctgcattattacc

SEQ ID NO: 1282832 - DNA, 22 bp, Artificial Sequence
  chemically synthesized
gggtttattcctgcattattac

SEQ ID NO: 1282833 - DNA, 22 bp, Artificial Sequence
  chemically synthesized
tcttgggtttattcctgcatta

SEQ ID NO: 1282834 - DNA, 22 bp, Artificial Sequence
  chemically synthesized
agagttatcttgggtttattcc

SEQ ID NO: 1282835 - DNA, 22 bp, Artificial Sequence
  chemically synthesized
gtaataatgcaggaataaaccc

SEQ ID NO: 1282836 - DNA, 22 bp, Artificial Sequence
  chemically synthesized
cagagttatcttgggtttattc

SEQ ID NO: 1282837 - DNA, 22 bp, Artificial Sequence
  chemically synthesized
ccttcagagttatcttgggttt

SEQ ID NO: 1282838 - DNA, 22 bp, Artificial Sequence
  chemically synthesized
actaccttcagagttatcttgg

SEQ ID NO: 1282839 - DNA, 22 bp, Artificial Sequence
  chemically synthesized
tgactaccttcagagttatctt

SEQ ID NO: 1282840 - DNA, 22 bp, Artificial Sequence
  chemically synthesized
ctgactaccttcagagttatct

SEQ ID NO: 1282841 - DNA, 22 bp, Artificial Sequence
  chemically synthesized
ttctgactaccttcagagttat

SEQ ID NO: 1282842 - DNA, 22 bp, Artificial Sequence
  chemically synthesized
cttctgactaccttcagagtta

SEQ ID NO: 1282843 - DNA, 22 bp, Artificial Sequence
  chemically synthesized
cgtcgtcttcttctgactacct

SEQ ID NO: 1282844 - DNA, 22 bp, Artificial Sequence
  chemically synthesized
tgaaggtagtcagaagaagacg

SEQ ID NO: 1282845 - DNA, 22 bp, Artificial Sequence
  chemically synthesized
aaggtagtcagaagaagacgac

SEQ ID NO: 1282846 - DNA, 22 bp, Artificial Sequence
  chemically synthesized
cagacccagtaaaccaaaactc

SEQ ID NO: 1282847 - DNA, 22 bp, Artificial Sequence
  chemically synthesized
ctccagacccagtaaaccaaaa

SEQ ID NO: 1282848 - DNA, 22 bp, Artificial Sequence
  chemically synthesized
tgctccagacccagtaaaccaa

SEQ ID NO: 1282849 - DNA, 22 bp, Artificial Sequence
  chemically synthesized
ctgctccagacccagtaaacca

SEQ ID NO: 1282850 - DNA, 22 bp, Artificial Sequence
  chemically synthesized
aacttctgctccagacccagta

SEQ ID NO: 1282851 - DNA, 22 bp, Artificial Sequence
  chemically synthesized
tggtttactgggtctggagcag

SEQ ID NO: 1282852 - DNA, 22 bp, Artificial Sequence
  chemically synthesized
ggtttactgggtctggagcaga

SEQ ID NO: 1282853 - DNA, 22 bp, Artificial Sequence
  chemically synthesized
gtttactgggtctggagcagaa

SEQ ID NO: 1282854 - DNA, 22 bp, Artificial Sequence
  chemically synthesized
actgggtctggagcagaagttg

SEQ ID NO: 1282855 - DNA, 22 bp, Artificial Sequence
  chemically synthesized
ctgggtctggagcagaagttga

SEQ ID NO: 1282856 - DNA, 22 bp, Artificial Sequence
  chemically synthesized
ggtctggagcagaagttgagtg

SEQ ID NO: 1282857 - DNA, 22 bp, Artificial Sequence
  chemically synthesized
agtgaaaagatgtaagtcactc

SEQ ID NO: 1282858 - DNA, 22 bp, Artificial Sequence
  chemically synthesized
gagcagaagttgagtgacttac

SEQ ID NO: 1282859 - DNA, 22 bp, Artificial Sequence
  chemically synthesized
ttaagtgaaaagatgtaagtca

SEQ ID NO: 1282860 - DNA, 22 bp, Artificial Sequence
  chemically synthesized
tattaagtgaaaagatgtaagt

SEQ ID NO: 1282861 - DNA, 22 bp, Artificial Sequence
  chemically synthesized
ctattaagtgaaaagatgtaag

SEQ ID NO: 1282862 - DNA, 22 bp, Artificial Sequence
  chemically synthesized
cttctattaagtgaaaagatgt

SEQ ID NO: 1282863 - DNA, 22 bp, Artificial Sequence
  chemically synthesized
gcttctattaagtgaaaagatg

SEQ ID NO: 1282864 - DNA, 22 bp, Artificial Sequence
  chemically synthesized
agtgacttacatcttttcactt

SEQ ID NO: 1282865 - DNA, 22 bp, Artificial Sequence
  chemically synthesized
ggtcacttgcttctattaagtg

SEQ ID NO: 1282866 - DNA, 22 bp, Artificial Sequence
  chemically synthesized
acatcttttcacttaatagaag

SEQ ID NO: 1282867 - DNA, 22 bp, Artificial Sequence
  chemically synthesized
catcttttcacttaatagaagc

SEQ ID NO: 1282868 - DNA, 22 bp, Artificial Sequence
  chemically synthesized
ttcacttaatagaagcaagtga

SEQ ID NO: 1282869 - DNA, 22 bp, Artificial Sequence
  chemically synthesized
tcacttaatagaagcaagtgac

SEQ ID NO: 1282870 - DNA, 22 bp, Artificial Sequence
  chemically synthesized
cacttaatagaagcaagtgacc

SEQ ID NO: 1282871 - DNA, 22 bp, Artificial Sequence
  chemically synthesized
acttaatagaagcaagtgaccc

SEQ ID NO: 1282872 - DNA, 22 bp, Artificial Sequence
  chemically synthesized
gaaatggtgagtctgggtcact

SEQ ID NO: 1282873 - DNA, 22 bp, Artificial Sequence
  chemically synthesized
aatagaagcaagtgacccagac

SEQ ID NO: 1282874 - DNA, 22 bp, Artificial Sequence
  chemically synthesized
atagaagcaagtgacccagact

SEQ ID NO: 1282875 - DNA, 22 bp, Artificial Sequence
  chemically synthesized
tgggtctcgaaatggtgagtct

SEQ ID NO: 1282876 - DNA, 22 bp, Artificial Sequence
  chemically synthesized
gttgtgggtctcgaaatggtga

SEQ ID NO: 1282877 - DNA, 22 bp, Artificial Sequence
  chemically synthesized
ctggttgtgggtctcgaaatgg

SEQ ID NO: 1282878 - DNA, 22 bp, Artificial Sequence
  chemically synthesized
gactgctggttgtgggtctcga

SEQ ID NO: 1282879 - DNA, 22 bp, Artificial Sequence
  chemically synthesized
cgactgctggttgtgggtctcg

SEQ ID NO: 1282880 - DNA, 22 bp, Artificial Sequence
  chemically synthesized
tcgactgctggttgtgggtctc

SEQ ID NO: 1282881 - DNA, 22 bp, Artificial Sequence
  chemically synthesized
ctttcgactgctggttgtgggt

SEQ ID NO: 1282882 - DNA, 22 bp, Artificial Sequence
  chemically synthesized
accatttcgagacccacaacca

SEQ ID NO: 1282883 - DNA, 22 bp, Artificial Sequence
  chemically synthesized
ggctgctttcgactgctggttg

SEQ ID NO: 1282884 - DNA, 22 bp, Artificial Sequence
  chemically synthesized
taggctgctttcgactgctggt

SEQ ID NO: 1282885 - DNA, 22 bp, Artificial Sequence
  chemically synthesized
cgagacccacaaccagcagtcg

SEQ ID NO: 1282886 - DNA, 22 bp, Artificial Sequence
  chemically synthesized
ctaggctgctttcgactgctgg

SEQ ID NO: 1282887 - DNA, 22 bp, Artificial Sequence
  chemically synthesized
gagacccacaaccagcagtcga

SEQ ID NO: 1282888 - DNA, 22 bp, Artificial Sequence
  chemically synthesized
tctaggctgctttcgactgctg

SEQ ID NO: 1282889 - DNA, 22 bp, Artificial Sequence
  chemically synthesized
gatgtggagagataagcctttc

SEQ ID NO: 1282890 - DNA, 22 bp, Artificial Sequence
  chemically synthesized
agatgtggagagataagccttt

SEQ ID NO: 1282891 - DNA, 22 bp, Artificial Sequence
  chemically synthesized
ttagatgtggagagataagcct

SEQ ID NO: 1282892 - DNA, 22 bp, Artificial Sequence
  chemically synthesized
gaaaggcttatctctccacatc

SEQ ID NO: 1282893 - DNA, 22 bp, Artificial Sequence
  chemically synthesized
agggaatcctcttagatgtgga

SEQ ID NO: 1282894 - DNA, 22 bp, Artificial Sequence
  chemically synthesized
tctcagggaatcctcttagatg

SEQ ID NO: 1282895 - DNA, 22 bp, Artificial Sequence
  chemically synthesized
atctctccacatctaagaggat

SEQ ID NO: 1282896 - DNA, 22 bp, Artificial Sequence
  chemically synthesized
tctctccacatctaagaggatt

SEQ ID NO: 1282897 - DNA, 22 bp, Artificial Sequence
  chemically synthesized
atgttgtctcagggaatcctct

SEQ ID NO: 1282898 - DNA, 22 bp, Artificial Sequence
  chemically synthesized
tccacatctaagaggattccct

SEQ ID NO: 1282899 - DNA, 22 bp, Artificial Sequence
  chemically synthesized
cacatctaagaggattccctga

SEQ ID NO: 1282900 - DNA, 22 bp, Artificial Sequence
  chemically synthesized
agaggattccctgagacaacat

SEQ ID NO: 1282901 - DNA, 22 bp, Artificial Sequence
  chemically synthesized
gaaagtgtcaggagaacctgat

SEQ ID NO: 1282902 - DNA, 22 bp, Artificial Sequence
  chemically synthesized
cctgagacaacatcaggttctc

SEQ ID NO: 1282903 - DNA, 22 bp, Artificial Sequence
  chemically synthesized
agacaacatcaggttctcctga

SEQ ID NO: 1282904 - DNA, 22 bp, Artificial Sequence
  chemically synthesized
tcctagaaagtgtcaggagaac

SEQ ID NO: 1282905 - DNA, 22 bp, Artificial Sequence
  chemically synthesized
cccatcctgtcctagaaagtgt

SEQ ID NO: 1282906 - DNA, 22 bp, Artificial Sequence
  chemically synthesized
catctacccatcctgtcctaga

SEQ ID NO: 1282907 - DNA, 22 bp, Artificial Sequence
  chemically synthesized
tcctgacactttctaggacagg

SEQ ID NO: 1282908 - DNA, 22 bp, Artificial Sequence
  chemically synthesized
ctgacactttctaggacaggat

SEQ ID NO: 1282909 - DNA, 22 bp, Artificial Sequence
  chemically synthesized
gattgcatctacccatcctgtc

SEQ ID NO: 1282910 - DNA, 22 bp, Artificial Sequence
  chemically synthesized
acactttctaggacaggatggg

SEQ ID NO: 1282911 - DNA, 22 bp, Artificial Sequence
  chemically synthesized
tggattgcatctacccatcctg

SEQ ID NO: 1282912 - DNA, 22 bp, Artificial Sequence
  chemically synthesized
tctggattgcatctacccatcc

SEQ ID NO: 1282913 - DNA, 22 bp, Artificial Sequence
  chemically synthesized
tctaggacaggatgggtagatg

SEQ ID NO: 1282914 - DNA, 22 bp, Artificial Sequence
  chemically synthesized
ctaggacaggatgggtagatgc

SEQ ID NO: 1282915 - DNA, 22 bp, Artificial Sequence
  chemically synthesized
taggacaggatgggtagatgca

SEQ ID NO: 1282916 - DNA, 22 bp, Artificial Sequence
  chemically synthesized
ggacaggatgggtagatgcaat

SEQ ID NO: 1282917 - DNA, 22 bp, Artificial Sequence
  chemically synthesized
gcaattctctggattgcatcta

SEQ ID NO: 1282918 - DNA, 22 bp, Artificial Sequence
  chemically synthesized
ttggcaattctctggattgcat

SEQ ID NO: 1282919 - DNA, 22 bp, Artificial Sequence
  chemically synthesized
ctgttggcaattctctggattg

SEQ ID NO: 1282920 - DNA, 22 bp, Artificial Sequence
  chemically synthesized
actgttggcaattctctggatt

SEQ ID NO: 1282921 - DNA, 22 bp, Artificial Sequence
  chemically synthesized
cccttactgttggcaattctct

SEQ ID NO: 1282922 - DNA, 22 bp, Artificial Sequence
  chemically synthesized
ccccttactgttggcaattctc

SEQ ID NO: 1282923 - DNA, 22 bp, Artificial Sequence
  chemically synthesized
ccaacagtaaggggaaacactc

SEQ ID NO: 1282924 - DNA, 22 bp, Artificial Sequence
  chemically synthesized
aagcaggcccaccaggaacaga

SEQ ID NO: 1282925 - DNA, 22 bp, Artificial Sequence
  chemically synthesized
tctgttcctggtgggcctgctt

SEQ ID NO: 1282926 - DNA, 22 bp, Artificial Sequence
  chemically synthesized
tggatgagagctgaagcaggcc

SEQ ID NO: 1282927 - DNA, 22 bp, Artificial Sequence
  chemically synthesized
tgttcctggtgggcctgcttca

SEQ ID NO: 1282928 - DNA, 22 bp, Artificial Sequence
  chemically synthesized
ttcctggtgggcctgcttcagc

SEQ ID NO: 1282929 - DNA, 22 bp, Artificial Sequence
  chemically synthesized
ctggtgggcctgcttcagctct

SEQ ID NO: 1282930 - DNA, 22 bp, Artificial Sequence
  chemically synthesized
gtgggcctgcttcagctctcat

SEQ ID NO: 1282931 - DNA, 22 bp, Artificial Sequence
  chemically synthesized
acaggtatctgtggatgagagc

SEQ ID NO: 1282932 - DNA, 22 bp, Artificial Sequence
  chemically synthesized
cacaggtatctgtggatgagag

SEQ ID NO: 1282933 - DNA, 22 bp, Artificial Sequence
  chemically synthesized
cttcacaggtatctgtggatga

SEQ ID NO: 1282934 - DNA, 22 bp, Artificial Sequence
  chemically synthesized
cttcagctctcatccacagata

SEQ ID NO: 1282935 - DNA, 22 bp, Artificial Sequence
  chemically synthesized
ctccttcacaggtatctgtgga

SEQ ID NO: 1282936 - DNA, 22 bp, Artificial Sequence
  chemically synthesized
actccttcacaggtatctgtgg

SEQ ID NO: 1282937 - DNA, 22 bp, Artificial Sequence
  chemically synthesized
tactccttcacaggtatctgtg

SEQ ID NO: 1282938 - DNA, 22 bp, Artificial Sequence
  chemically synthesized
cagctctcatccacagatacct

SEQ ID NO: 1282939 - DNA, 22 bp, Artificial Sequence
  chemically synthesized
agctctcatccacagatacctg

SEQ ID NO: 1282940 - DNA, 22 bp, Artificial Sequence
  chemically synthesized
tcatccacagatacctgtgaag

SEQ ID NO: 1282941 - DNA, 22 bp, Artificial Sequence
  chemically synthesized
atccacagatacctgtgaagga

SEQ ID NO: 1282942 - DNA, 22 bp, Artificial Sequence
  chemically synthesized
gggatggaacatcctttactcc

SEQ ID NO: 1282943 - DNA, 22 bp, Artificial Sequence
  chemically synthesized
ggggatggaacatcctttactc

SEQ ID NO: 1282944 - DNA, 22 bp, Artificial Sequence
  chemically synthesized
tgaaggagtaaaggatgttcca

SEQ ID NO: 1282945 - DNA, 22 bp, Artificial Sequence
  chemically synthesized
gcatatttggggatggaacatc

SEQ ID NO: 1282946 - DNA, 22 bp, Artificial Sequence
  chemically synthesized
catccccaaatatgccagattg

SEQ ID NO: 1282947 - DNA, 22 bp, Artificial Sequence
  chemically synthesized
aaaatagccaacataccaatct

SEQ ID NO: 1282948 - DNA, 22 bp, Artificial Sequence
  chemically synthesized
caactgaaaatagccaacatac

SEQ ID NO: 1282949 - DNA, 22 bp, Artificial Sequence
  chemically synthesized
ccaactgaaaatagccaacata

SEQ ID NO: 1282950 - DNA, 22 bp, Artificial Sequence
  chemically synthesized
caaagtttccaactgaaaatag

SEQ ID NO: 1282951 - DNA, 22 bp, Artificial Sequence
  chemically synthesized
tccaaagtttccaactgaaaat

SEQ ID NO: 1282952 - DNA, 22 bp, Artificial Sequence
  chemically synthesized
gtatgttggctattttcagttg

SEQ ID NO: 1282953 - DNA, 22 bp, Artificial Sequence
  chemically synthesized
ctccaaagtttccaactgaaaa

SEQ ID NO: 1282954 - DNA, 22 bp, Artificial Sequence
  chemically synthesized
caatttctccaaagtttccaac

SEQ ID NO: 1282955 - DNA, 22 bp, Artificial Sequence
  chemically synthesized
gctattttcagttggaaacttt

SEQ ID NO: 1282956 - DNA, 22 bp, Artificial Sequence
  chemically synthesized
ttttcagttggaaactttggag

SEQ ID NO: 1282957 - DNA, 22 bp, Artificial Sequence
  chemically synthesized
aaactacaatttctccaaagtt

SEQ ID NO: 1282958 - DNA, 22 bp, Artificial Sequence
  chemically synthesized
tgaaactacaatttctccaaag

SEQ ID NO: 1282959 - DNA, 22 bp, Artificial Sequence
  chemically synthesized
tcagttggaaactttggagaaa

SEQ ID NO: 1282960 - DNA, 22 bp, Artificial Sequence
  chemically synthesized
ctgaaactacaatttctccaaa

SEQ ID NO: 1282961 - DNA, 22 bp, Artificial Sequence
  chemically synthesized
cagttggaaactttggagaaat

SEQ ID NO: 1282962 - DNA, 22 bp, Artificial Sequence
  chemically synthesized
tctgaaactacaatttctccaa

SEQ ID NO: 1282963 - DNA, 22 bp, Artificial Sequence
  chemically synthesized
agttggaaactttggagaaatt

SEQ ID NO: 1282964 - DNA, 22 bp, Artificial Sequence
  chemically synthesized
tttctgaaactacaatttctcc

SEQ ID NO: 1282965 - DNA, 22 bp, Artificial Sequence
  chemically synthesized
gaaactttggagaaattgtagt

SEQ ID NO: 1282966 - DNA, 22 bp, Artificial Sequence
  chemically synthesized
actctttctgaaactacaattt

SEQ ID NO: 1282967 - DNA, 22 bp, Artificial Sequence
  chemically synthesized
tggagaaattgtagtttcagaa

SEQ ID NO: 1282968 - DNA, 22 bp, Artificial Sequence
  chemically synthesized
ggagaaattgtagtttcagaaa

SEQ ID NO: 1282969 - DNA, 22 bp, Artificial Sequence
  chemically synthesized
gagaaattgtagtttcagaaag

SEQ ID NO: 1282970 - DNA, 22 bp, Artificial Sequence
  chemically synthesized
tagtttcagaaagagttagctc

SEQ ID NO: 1282971 - DNA, 22 bp, Artificial Sequence
  chemically synthesized
cagaaagagttagctcacctgt

SEQ ID NO: 1282972 - DNA, 22 bp, Artificial Sequence
  chemically synthesized
agaaagagttagctcacctgtc

SEQ ID NO: 1282973 - DNA, 22 bp, Artificial Sequence
  chemically synthesized
catgtaggaagagacaggtgag

SEQ ID NO: 1282974 - DNA, 22 bp, Artificial Sequence
  chemically synthesized
ctgcatgtaggaagagacaggt

SEQ ID NO: 1282975 - DNA, 22 bp, Artificial Sequence
  chemically synthesized
gctgcatgtaggaagagacagg

SEQ ID NO: 1282976 - DNA, 22 bp, Artificial Sequence
  chemically synthesized
tggtttgctgcatgtaggaaga

SEQ ID NO: 1282977 - DNA, 22 bp, Artificial Sequence
  chemically synthesized
gctcacctgtctcttcctacat

SEQ ID NO: 1282978 - DNA, 22 bp, Artificial Sequence
  chemically synthesized
atggtttgctgcatgtaggaag

SEQ ID NO: 1282979 - DNA, 22 bp, Artificial Sequence
  chemically synthesized
tatggtttgctgcatgtaggaa

SEQ ID NO: 1282980 - DNA, 22 bp, Artificial Sequence
  chemically synthesized
acctgtctcttcctacatgcag

SEQ ID NO: 1282981 - DNA, 22 bp, Artificial Sequence
  chemically synthesized
tctcttcctacatgcagcaaac

SEQ ID NO: 1282982 - DNA, 22 bp, Artificial Sequence
  chemically synthesized
ttcctacatgcagcaaaccata

SEQ ID NO: 1282983 - DNA, 22 bp, Artificial Sequence
  chemically synthesized
ccagaggaatctttatggtttg

SEQ ID NO: 1282984 - DNA, 22 bp, Artificial Sequence
  chemically synthesized
cctacatgcagcaaaccataaa

SEQ ID NO: 1282985 - DNA, 22 bp, Artificial Sequence
  chemically synthesized
ctacatgcagcaaaccataaag

SEQ ID NO: 1282986 - DNA, 22 bp, Artificial Sequence
  chemically synthesized
catgcagcaaaccataaagatt

SEQ ID NO: 1282987 - DNA, 22 bp, Artificial Sequence
  chemically synthesized
tgagggtgcccctcccagagga

SEQ ID NO: 1282988 - DNA, 22 bp, Artificial Sequence
  chemically synthesized
gtcctgtgagggtgcccctccc

SEQ ID NO: 1282989 - DNA, 22 bp, Artificial Sequence
  chemically synthesized
tggtcctgtgagggtgcccctc

SEQ ID NO: 1282990 - DNA, 22 bp, Artificial Sequence
  chemically synthesized
actctggtcctgtgagggtgcc

SEQ ID NO: 1282991 - DNA, 22 bp, Artificial Sequence
  chemically synthesized
ctctgggaggggcaccctcaca

SEQ ID NO: 1282992 - DNA, 22 bp, Artificial Sequence
  chemically synthesized
tcactctggtcctgtgagggtg

SEQ ID NO: 1282993 - DNA, 22 bp, Artificial Sequence
  chemically synthesized
ctcactctggtcctgtgagggt

SEQ ID NO: 1282994 - DNA, 22 bp, Artificial Sequence
  chemically synthesized
tctcactctggtcctgtgaggg

SEQ ID NO: 1282995 - DNA, 22 bp, Artificial Sequence
  chemically synthesized
tgggaggggcaccctcacagga

SEQ ID NO: 1282996 - DNA, 22 bp, Artificial Sequence
  chemically synthesized
ggaggggcaccctcacaggacc

SEQ ID NO: 1282997 - DNA, 22 bp, Artificial Sequence
  chemically synthesized
ttttctcactctggtcctgtga

SEQ ID NO: 1282998 - DNA, 22 bp, Artificial Sequence
  chemically synthesized
gtaataagggctattttctcac

SEQ ID NO: 1282999 - DNA, 22 bp, Artificial Sequence
  chemically synthesized
acaggaccagagtgagaaaata

SEQ ID NO: 1283000 - DNA, 22 bp, Artificial Sequence
  chemically synthesized
tggtaataagggctattttctc

SEQ ID NO: 1283001 - DNA, 22 bp, Artificial Sequence
  chemically synthesized
agtctctggtaataagggctat

SEQ ID NO: 1283002 - DNA, 22 bp, Artificial Sequence
  chemically synthesized
taagtctctggtaataagggct

SEQ ID NO: 1283003 - DNA, 22 bp, Artificial Sequence
  chemically synthesized
caattctaagtctctggtaata

SEQ ID NO: 1283004 - DNA, 22 bp, Artificial Sequence
  chemically synthesized
aagcctccaattctaagtctct

SEQ ID NO: 1283005 - DNA, 22 bp, Artificial Sequence
  chemically synthesized
attaccagagacttagaattgg

SEQ ID NO: 1283006 - DNA, 22 bp, Artificial Sequence
  chemically synthesized
ttaccagagacttagaattgga

SEQ ID NO: 1283007 - DNA, 22 bp, Artificial Sequence
  chemically synthesized
ccagagacttagaattggaggc

SEQ ID NO: 1283008 - DNA, 22 bp, Artificial Sequence
  chemically synthesized
aggtccattgaagcctccaatt

SEQ ID NO: 1283009 - DNA, 22 bp, Artificial Sequence
  chemically synthesized
ttcaggtccattgaagcctcca

SEQ ID NO: 1283010 - DNA, 22 bp, Artificial Sequence
  chemically synthesized
attcaggtccattgaagcctcc

SEQ ID NO: 1283011 - DNA, 22 bp, Artificial Sequence
  chemically synthesized
agaattggaggcttcaatggac

SEQ ID NO: 1283012 - DNA, 22 bp, Artificial Sequence
  chemically synthesized
gaattggaggcttcaatggacc

SEQ ID NO: 1283013 - DNA, 22 bp, Artificial Sequence
  chemically synthesized
gaggcttcaatggacctgaata

SEQ ID NO: 1283014 - DNA, 22 bp, Artificial Sequence
  chemically synthesized
agtaaatatatttattcaggtc

SEQ ID NO: 1283015 - DNA, 22 bp, Artificial Sequence
  chemically synthesized
cagtaaatatatttattcaggt

SEQ ID NO: 1283016 - DNA, 22 bp, Artificial Sequence
  chemically synthesized
cttcagtaaatatatttattca

SEQ ID NO: 1283017 - DNA, 22 bp, Artificial Sequence
  chemically synthesized
caatggacctgaataaatatat

SEQ ID NO: 1283018 - DNA, 22 bp, Artificial Sequence
  chemically synthesized
aatggacctgaataaatatatt

SEQ ID NO: 1283019 - DNA, 22 bp, Artificial Sequence
  chemically synthesized
aataaatatatttactgaagta

SEQ ID NO: 1283020 - DNA, 22 bp, Artificial Sequence
  chemically synthesized
gtgaaagataagggttacttca

SEQ ID NO: 1283021 - DNA, 22 bp, Artificial Sequence
  chemically synthesized
actgaagtaacccttatctttc

SEQ ID NO: 1283022 - DNA, 22 bp, Artificial Sequence
  chemically synthesized
ctgaagtaacccttatctttca

SEQ ID NO: 1283023 - DNA, 22 bp, Artificial Sequence
  chemically synthesized
aagtaacccttatctttcacta

SEQ ID NO: 1283024 - DNA, 22 bp, Artificial Sequence
  chemically synthesized
atctttcactagttttataccc

SEQ ID NO: 1283025 - DNA, 22 bp, Artificial Sequence
  chemically synthesized
tctttcactagttttataccca

SEQ ID NO: 1283026 - DNA, 22 bp, Artificial Sequence
  chemically synthesized
ggagatagatagtgggtataaa

SEQ ID NO: 1283027 - DNA, 22 bp, Artificial Sequence
  chemically synthesized
tcactagttttatacccactat

SEQ ID NO: 1283028 - DNA, 22 bp, Artificial Sequence
  chemically synthesized
cactagttttatacccactatc

SEQ ID NO: 1283029 - DNA, 22 bp, Artificial Sequence
  chemically synthesized
actagttttatacccactatct

SEQ ID NO: 1283030 - DNA, 22 bp, Artificial Sequence
  chemically synthesized
gttttatacccactatctatct

SEQ ID NO: 1283031 - DNA, 22 bp, Artificial Sequence
  chemically synthesized
ggggagtcactaggagatagat

SEQ ID NO: 1283032 - DNA, 22 bp, Artificial Sequence
  chemically synthesized
tatacccactatctatctccta

SEQ ID NO: 1283033 - DNA, 22 bp, Artificial Sequence
  chemically synthesized
taggggagtcactaggagatag

SEQ ID NO: 1283034 - DNA, 22 bp, Artificial Sequence
  chemically synthesized
atacccactatctatctcctag

SEQ ID NO: 1283035 - DNA, 22 bp, Artificial Sequence
  chemically synthesized
tacccactatctatctcctagt

SEQ ID NO: 1283036 - DNA, 22 bp, Artificial Sequence
  chemically synthesized
tctaggggagtcactaggagat

SEQ ID NO: 1283037 - DNA, 22 bp, Artificial Sequence
  chemically synthesized
ctctaggggagtcactaggaga

SEQ ID NO: 1283038 - DNA, 22 bp, Artificial Sequence
  chemically synthesized
tctctaggggagtcactaggag

SEQ ID NO: 1283039 - DNA, 22 bp, Artificial Sequence
  chemically synthesized
tctatctcctagtgactcccct

SEQ ID NO: 1283040 - DNA, 22 bp, Artificial Sequence
  chemically synthesized
tctcctagtgactcccctagag

SEQ ID NO: 1283041 - DNA, 22 bp, Artificial Sequence
  chemically synthesized
gggacagtaaattttctctagg

SEQ ID NO: 1283042 - DNA, 22 bp, Artificial Sequence
  chemically synthesized
ctagtgactcccctagagaaaa

SEQ ID NO: 1283043 - DNA, 22 bp, Artificial Sequence
  chemically synthesized
gtgactcccctagagaaaattt

SEQ ID NO: 1283044 - DNA, 22 bp, Artificial Sequence
  chemically synthesized
gctagggacagtaaattttctc

SEQ ID NO: 1283045 - DNA, 22 bp, Artificial Sequence
  chemically synthesized
ccctagagaaaatttactgtcc

SEQ ID NO: 1283046 - DNA, 22 bp, Artificial Sequence
  chemically synthesized
gagaaaatttactgtccctagc

SEQ ID NO: 1283047 - DNA, 22 bp, Artificial Sequence
  chemically synthesized
actgtccctagccagattctct

SEQ ID NO: 1283048 - DNA, 22 bp, Artificial Sequence
  chemically synthesized
ctgtccctagccagattctctt

SEQ ID NO: 1283049 - DNA, 22 bp, Artificial Sequence
  chemically synthesized
tccctagccagattctctttat

SEQ ID NO: 1283050 - DNA, 22 bp, Artificial Sequence
  chemically synthesized
gaaagcaatgacaggataaaga

SEQ ID NO: 1283051 - DNA, 22 bp, Artificial Sequence
  chemically synthesized
ggaaagcaatgacaggataaag

SEQ ID NO: 1283052 - DNA, 22 bp, Artificial Sequence
  chemically synthesized
gccagattctctttatcctgtc

SEQ ID NO: 1283053 - DNA, 22 bp, Artificial Sequence
  chemically synthesized
atgaatttggaaagcaatgaca

SEQ ID NO: 1283054 - DNA, 22 bp, Artificial Sequence
  chemically synthesized
gatgaatttggaaagcaatgac

SEQ ID NO: 1283055 - DNA, 22 bp, Artificial Sequence
  chemically synthesized
tctttatcctgtcattgctttc

SEQ ID NO: 1283056 - DNA, 22 bp, Artificial Sequence
  chemically synthesized
tttatcctgtcattgctttcca

SEQ ID NO: 1283057 - DNA, 22 bp, Artificial Sequence
  chemically synthesized
tatcctgtcattgctttccaaa

SEQ ID NO: 1283058 - DNA, 22 bp, Artificial Sequence
  chemically synthesized
atcctgtcattgctttccaaat

SEQ ID NO: 1283059 - DNA, 22 bp, Artificial Sequence
  chemically synthesized
tcctgtcattgctttccaaatt

SEQ ID NO: 1283060 - DNA, 22 bp, Artificial Sequence
  chemically synthesized
tcattgctttccaaattcatca

SEQ ID NO: 1283061 - DNA, 22 bp, Artificial Sequence
  chemically synthesized
atgatgaatgatgaatttgatg

SEQ ID NO: 1283062 - DNA, 22 bp, Artificial Sequence
  chemically synthesized
ctttccaaattcatcaaattca

SEQ ID NO: 1283063 - DNA, 22 bp, Artificial Sequence
  chemically synthesized
aatgatgaatgatgaatttgat

SEQ ID NO: 1283064 - DNA, 22 bp, Artificial Sequence
  chemically synthesized
taatgatgaatgatgaatttga

SEQ ID NO: 1283065 - DNA, 22 bp, Artificial Sequence
  chemically synthesized
ttaatgatgaatgatgaatttg

SEQ ID NO: 1283066 - DNA, 22 bp, Artificial Sequence
  chemically synthesized
tccaaattcatcaaattcatca

SEQ ID NO: 1283067 - DNA, 22 bp, Artificial Sequence
  chemically synthesized
ccaaattcatcaaattcatcat

SEQ ID NO: 1283068 - DNA, 22 bp, Artificial Sequence
  chemically synthesized
caaattcatcaaattcatcatt

SEQ ID NO: 1283069 - DNA, 22 bp, Artificial Sequence
  chemically synthesized
atcaaattcatcattcatcatt

SEQ ID NO: 1283070 - DNA, 22 bp, Artificial Sequence
  chemically synthesized
atcattcatcattaaaagcatc

SEQ ID NO: 1283071 - DNA, 22 bp, Artificial Sequence
  chemically synthesized
aagaagtagtcaaagcaagatg

SEQ ID NO: 1283072 - DNA, 22 bp, Artificial Sequence
  chemically synthesized
atcattaaaagcatcttgcttt

SEQ ID NO: 1283073 - DNA, 22 bp, Artificial Sequence
  chemically synthesized
aaagcatcttgctttgactact

SEQ ID NO: 1283074 - DNA, 22 bp, Artificial Sequence
  chemically synthesized
gctttgactacttcttcaggct

SEQ ID NO: 1283075 - DNA, 22 bp, Artificial Sequence
  chemically synthesized
ctttgactacttcttcaggctt

SEQ ID NO: 1283076 - DNA, 22 bp, Artificial Sequence
  chemically synthesized
tgactacttcttcaggcttcac

SEQ ID NO: 1283077 - DNA, 22 bp, Artificial Sequence
  chemically synthesized
gactacttcttcaggcttcact

SEQ ID NO: 1283078 - DNA, 22 bp, Artificial Sequence
  chemically synthesized
actacttcttcaggcttcactt

SEQ ID NO: 1283079 - DNA, 22 bp, Artificial Sequence
  chemically synthesized
cttcttcaggcttcactttctt

SEQ ID NO: 1283080 - DNA, 22 bp, Artificial Sequence
  chemically synthesized
cttcaggcttcactttcttgtg

SEQ ID NO: 1283081 - DNA, 22 bp, Artificial Sequence
  chemically synthesized
ttcaggcttcactttcttgtga

SEQ ID NO: 1283082 - DNA, 22 bp, Artificial Sequence
  chemically synthesized
caggcttcactttcttgtgatg

SEQ ID NO: 1283083 - DNA, 22 bp, Artificial Sequence
  chemically synthesized
aggcttcactttcttgtgatga

SEQ ID NO: 1283084 - DNA, 22 bp, Artificial Sequence
  chemically synthesized
tacatgtacgtggagatcatca

SEQ ID NO: 1283085 - DNA, 22 bp, Artificial Sequence
  chemically synthesized
atacatgtacgtggagatcatc

SEQ ID NO: 1283086 - DNA, 22 bp, Artificial Sequence
  chemically synthesized
cactttcttgtgatgatctcca

SEQ ID NO: 1283087 - DNA, 22 bp, Artificial Sequence
  chemically synthesized
actttcttgtgatgatctccac

SEQ ID NO: 1283088 - DNA, 22 bp, Artificial Sequence
  chemically synthesized
cttatacatgtacgtggagatc

SEQ ID NO: 1283089 - DNA, 22 bp, Artificial Sequence
  chemically synthesized
tcttgtgatgatctccacgtac

SEQ ID NO: 1283090 - DNA, 22 bp, Artificial Sequence
  chemically synthesized
cttgtgatgatctccacgtaca

SEQ ID NO: 1283091 - DNA, 22 bp, Artificial Sequence
  chemically synthesized
ttgtgatgatctccacgtacat

SEQ ID NO: 1283092 - DNA, 22 bp, Artificial Sequence
  chemically synthesized
tattacttatacatgtacgtgg

SEQ ID NO: 1283093 - DNA, 22 bp, Artificial Sequence
  chemically synthesized
gtgatgatctccacgtacatgt

SEQ ID NO: 1283094 - DNA, 22 bp, Artificial Sequence
  chemically synthesized
tgatgatctccacgtacatgta

SEQ ID NO: 1283095 - DNA, 22 bp, Artificial Sequence
  chemically synthesized
cacgtacatgtataagtaatac

SEQ ID NO: 1283096 - DNA, 22 bp, Artificial Sequence
  chemically synthesized
gtattcttttcttttgttttct

SEQ ID NO: 1283097 - DNA, 22 bp, Artificial Sequence
  chemically synthesized
tattcttttcttttgttttctg

SEQ ID NO: 1283098 - DNA, 22 bp, Artificial Sequence
  chemically synthesized
ttttcttttgttttctgcctga

SEQ ID NO: 1283099 - DNA, 22 bp, Artificial Sequence
  chemically synthesized
ttcttttgttttctgcctgatg

SEQ ID NO: 1283100 - DNA, 22 bp, Artificial Sequence
  chemically synthesized
tcttttgttttctgcctgatgt

SEQ ID NO: 1283101 - DNA, 22 bp, Artificial Sequence
  chemically synthesized
gaaaccaaatcgacatcaggca

SEQ ID NO: 1283102 - DNA, 22 bp, Artificial Sequence
  chemically synthesized
cttttgttttctgcctgatgtc

SEQ ID NO: 1283103 - DNA, 22 bp, Artificial Sequence
  chemically synthesized
ttttgttttctgcctgatgtcg

SEQ ID NO: 1283104 - DNA, 22 bp, Artificial Sequence
  chemically synthesized
ttgttttctgcctgatgtcgat

SEQ ID NO: 1283105 - DNA, 22 bp, Artificial Sequence
  chemically synthesized
tgttttctgcctgatgtcgatt

SEQ ID NO: 1283106 - DNA, 22 bp, Artificial Sequence
  chemically synthesized
gttttctgcctgatgtcgattt

SEQ ID NO: 1283107 - DNA, 22 bp, Artificial Sequence
  chemically synthesized
gatctagaaaccaaatcgacat

SEQ ID NO: 1283108 - DNA, 22 bp, Artificial Sequence
  chemically synthesized
ttttctgcctgatgtcgatttg

SEQ ID NO: 1283109 - DNA, 22 bp, Artificial Sequence
  chemically synthesized
tctgcctgatgtcgatttggtt

SEQ ID NO: 1283110 - DNA, 22 bp, Artificial Sequence
  chemically synthesized
ctgcctgatgtcgatttggttt

SEQ ID NO: 1283111 - DNA, 22 bp, Artificial Sequence
  chemically synthesized
agttggatctagaaaccaaatc

SEQ ID NO: 1283112 - DNA, 22 bp, Artificial Sequence
  chemically synthesized
tgcctgatgtcgatttggtttc

SEQ ID NO: 1283113 - DNA, 22 bp, Artificial Sequence
  chemically synthesized
cagttggatctagaaaccaaat

SEQ ID NO: 1283114 - DNA, 22 bp, Artificial Sequence
  chemically synthesized
cctgatgtcgatttggtttcta

SEQ ID NO: 1283115 - DNA, 22 bp, Artificial Sequence
  chemically synthesized
ttcagttggatctagaaaccaa

SEQ ID NO: 1283116 - DNA, 22 bp, Artificial Sequence
  chemically synthesized
atgtcgatttggtttctagatc

SEQ ID NO: 1283117 - DNA, 22 bp, Artificial Sequence
  chemically synthesized
gtaggctcttcagttggatcta

SEQ ID NO: 1283118 - DNA, 22 bp, Artificial Sequence
  chemically synthesized
agtaggctcttcagttggatct

SEQ ID NO: 1283119 - DNA, 22 bp, Artificial Sequence
  chemically synthesized
ttagtaggctcttcagttggat

SEQ ID NO: 1283120 - DNA, 22 bp, Artificial Sequence
  chemically synthesized
ggtttctagatccaactgaaga

SEQ ID NO: 1283121 - DNA, 22 bp, Artificial Sequence
  chemically synthesized
gtttctagatccaactgaagag

SEQ ID NO: 1283122 - DNA, 22 bp, Artificial Sequence
  chemically synthesized
gttcttagtaggctcttcagtt

SEQ ID NO: 1283123 - DNA, 22 bp, Artificial Sequence
  chemically synthesized
agttcttagtaggctcttcagt

SEQ ID NO: 1283124 - DNA, 22 bp, Artificial Sequence
  chemically synthesized
tagttcttagtaggctcttcag

SEQ ID NO: 1283125 - DNA, 22 bp, Artificial Sequence
  chemically synthesized
ttagttcttagtaggctcttca

SEQ ID NO: 1283126 - DNA, 22 bp, Artificial Sequence
  chemically synthesized
ctagatccaactgaagagccta

SEQ ID NO: 1283127 - DNA, 22 bp, Artificial Sequence
  chemically synthesized
tagatccaactgaagagcctac

SEQ ID NO: 1283128 - DNA, 22 bp, Artificial Sequence
  chemically synthesized
gatccaactgaagagcctacta

SEQ ID NO: 1283129 - DNA, 22 bp, Artificial Sequence
  chemically synthesized
caatcccccttttagttcttag

SEQ ID NO: 1283130 - DNA, 22 bp, Artificial Sequence
  chemically synthesized
aagagcctactaagaactaaaa

SEQ ID NO: 1283131 - DNA, 22 bp, Artificial Sequence
  chemically synthesized
gatatcacctccaatccccctt

SEQ ID NO: 1283132 - DNA, 22 bp, Artificial Sequence
  chemically synthesized
ctaagaactaaaagggggattg

SEQ ID NO: 1283133 - DNA, 22 bp, Artificial Sequence
  chemically synthesized
agaactaaaagggggattggag

SEQ ID NO: 1283134 - DNA, 22 bp, Artificial Sequence
  chemically synthesized
aaagggggattggaggtgatat

SEQ ID NO: 1283135 - DNA, 22 bp, Artificial Sequence
  chemically synthesized
gaggtgatatccaattccccta

SEQ ID NO: 1283136 - DNA, 22 bp, Artificial Sequence
  chemically synthesized
atcacatgtgcaggtgtagggg

SEQ ID NO: 1283137 - DNA, 22 bp, Artificial Sequence
  chemically synthesized
catcacatgtgcaggtgtaggg

SEQ ID NO: 1283138 - DNA, 22 bp, Artificial Sequence
  chemically synthesized
tacagtttcatcacatgtgcag

SEQ ID NO: 1283139 - DNA, 22 bp, Artificial Sequence
  chemically synthesized
tgtacagtttcatcacatgtgc

SEQ ID NO: 1283140 - DNA, 22 bp, Artificial Sequence
  chemically synthesized
ccctacacctgcacatgtgatg

SEQ ID NO: 1283141 - DNA, 22 bp, Artificial Sequence
  chemically synthesized
gttctgtacagtttcatcacat

SEQ ID NO: 1283142 - DNA, 22 bp, Artificial Sequence
  chemically synthesized
agttctgtacagtttcatcaca

SEQ ID NO: 1283143 - DNA, 22 bp, Artificial Sequence
  chemically synthesized
cacctgcacatgtgatgaaact

SEQ ID NO: 1283144 - DNA, 22 bp, Artificial Sequence
  chemically synthesized
cacatgtgatgaaactgtacag

SEQ ID NO: 1283145 - DNA, 22 bp, Artificial Sequence
  chemically synthesized
tacagaactaaatacacacaca

SEQ ID NO: 1283146 - DNA, 22 bp, Artificial Sequence
  chemically synthesized
aatacacacacacacacacaca

SEQ ID NO: 1283147 - DNA, 22 bp, Artificial Sequence
  chemically synthesized
tatgtgtgtgtgtgtgtgtgtg

SEQ ID NO: 1283148 - DNA, 22 bp, Artificial Sequence
  chemically synthesized
ctatatgtgtgtgtgtgtgtgt

SEQ ID NO: 1283149 - DNA, 22 bp, Artificial Sequence
  chemically synthesized
ggtgttcctatatgtgtgtgtg

SEQ ID NO: 1283150 - DNA, 22 bp, Artificial Sequence
  chemically synthesized
tcggtgttcctatatgtgtgtg

SEQ ID NO: 1283151 - DNA, 22 bp, Artificial Sequence
  chemically synthesized
tctcggtgttcctatatgtgtg

SEQ ID NO: 1283152 - DNA, 22 bp, Artificial Sequence
  chemically synthesized
ctctcggtgttcctatatgtgt

SEQ ID NO: 1283153 - DNA, 22 bp, Artificial Sequence
  chemically synthesized
agtttctctcggtgttcctata

SEQ ID NO: 1283154 - DNA, 22 bp, Artificial Sequence
  chemically synthesized
ttcagtttctctcggtgttcct

SEQ ID NO: 1283155 - DNA, 22 bp, Artificial Sequence
  chemically synthesized
attcagtttctctcggtgttcc

SEQ ID NO: 1283156 - DNA, 22 bp, Artificial Sequence
  chemically synthesized
tattcagtttctctcggtgttc

SEQ ID NO: 1283157 - DNA, 22 bp, Artificial Sequence
  chemically synthesized
agcaattttattcagtttctct

SEQ ID NO: 1283158 - DNA, 22 bp, Artificial Sequence
  chemically synthesized
caattcagcaattttattcagt

SEQ ID NO: 1283159 - DNA, 22 bp, Artificial Sequence
  chemically synthesized
ctacaattcagcaattttattc

SEQ ID NO: 1283160 - DNA, 22 bp, Artificial Sequence
  chemically synthesized
acattactacaattcagcaatt

SEQ ID NO: 1283161 - DNA, 22 bp, Artificial Sequence
  chemically synthesized
aataaaattgctgaattgtagt

SEQ ID NO: 1283162 - DNA, 22 bp, Artificial Sequence
  chemically synthesized
ctgaattgtagtaatgtcaata

SEQ ID NO: 1283163 - DNA, 22 bp, Artificial Sequence
  chemically synthesized
aattgtagtaatgtcaatattc

SEQ ID NO: 1283164 - DNA, 22 bp, Artificial Sequence
  chemically synthesized
tagtaatgtcaatattctggct

SEQ ID NO: 1283165 - DNA, 22 bp, Artificial Sequence
  chemically synthesized
taatataatatcacagccagaa

SEQ ID NO: 1283166 - DNA, 22 bp, Artificial Sequence
  chemically synthesized
caaaactataatataatatcac

SEQ ID NO: 1283167 - DNA, 22 bp, Artificial Sequence
  chemically synthesized
gcaaaactataatataatatca

SEQ ID NO: 1283168 - DNA, 22 bp, Artificial Sequence
  chemically synthesized
tgcaaaactataatataatatc

SEQ ID NO: 1283169 - DNA, 22 bp, Artificial Sequence
  chemically synthesized
tggctgtgatattatattatag

SEQ ID NO: 1283170 - DNA, 22 bp, Artificial Sequence
  chemically synthesized
atattttgcaaaactataatat

SEQ ID NO: 1283171 - DNA, 22 bp, Artificial Sequence
  chemically synthesized
gctgtgatattatattatagtt

SEQ ID NO: 1283172 - DNA, 22 bp, Artificial Sequence
  chemically synthesized
tgatattatattatagttttgc

SEQ ID NO: 1283173 - DNA, 22 bp, Artificial Sequence
  chemically synthesized
aagttaatattttgcaaaacta

SEQ ID NO: 1283174 - DNA, 22 bp, Artificial Sequence
  chemically synthesized
cctaaagttaatattttgcaaa

SEQ ID NO: 1283175 - DNA, 22 bp, Artificial Sequence
  chemically synthesized
ccctaaagttaatattttgcaa

SEQ ID NO: 1283176 - DNA, 22 bp, Artificial Sequence
  chemically synthesized
tccctaaagttaatattttgca

SEQ ID NO: 1283177 - DNA, 22 bp, Artificial Sequence
  chemically synthesized
tattatagttttgcaaaatatt

SEQ ID NO: 1283178 - DNA, 22 bp, Artificial Sequence
  chemically synthesized
ttccctaaagttaatattttgc

SEQ ID NO: 1283179 - DNA, 22 bp, Artificial Sequence
  chemically synthesized
tttccctaaagttaatattttg

SEQ ID NO: 1283180 - DNA, 22 bp, Artificial Sequence
  chemically synthesized
tagttttgcaaaatattaactt

SEQ ID NO: 1283181 - DNA, 22 bp, Artificial Sequence
  chemically synthesized
ccattttttccctaaagttaat

SEQ ID NO: 1283182 - DNA, 22 bp, Artificial Sequence
  chemically synthesized
accattttttccctaaagttaa

SEQ ID NO: 1283183 - DNA, 22 bp, Artificial Sequence
  chemically synthesized
taccattttttccctaaagtta

SEQ ID NO: 1283184 - DNA, 22 bp, Artificial Sequence
  chemically synthesized
tgcaaaatattaactttaggga

SEQ ID NO: 1283185 - DNA, 22 bp, Artificial Sequence
  chemically synthesized
gcaaaatattaactttagggaa

SEQ ID NO: 1283186 - DNA, 22 bp, Artificial Sequence
  chemically synthesized
caaaatattaactttagggaaa

SEQ ID NO: 1283187 - DNA, 22 bp, Artificial Sequence
  chemically synthesized
tgtacactttaccattttttcc

SEQ ID NO: 1283188 - DNA, 22 bp, Artificial Sequence
  chemically synthesized
actttagggaaaaaatggtaaa

SEQ ID NO: 1283189 - DNA, 22 bp, Artificial Sequence
  chemically synthesized
tagggaaaaaatggtaaagtgt

SEQ ID NO: 1283190 - DNA, 22 bp, Artificial Sequence
  chemically synthesized
agggaaaaaatggtaaagtgta

SEQ ID NO: 1283191 - DNA, 22 bp, Artificial Sequence
  chemically synthesized
gggaaaaaatggtaaagtgtac

SEQ ID NO: 1283192 - DNA, 22 bp, Artificial Sequence
  chemically synthesized
ataagaaataatacggatatcc

SEQ ID NO: 1283193 - DNA, 22 bp, Artificial Sequence
  chemically synthesized
tagatacatatacagttaataa

SEQ ID NO: 1283194 - DNA, 22 bp, Artificial Sequence
  chemically synthesized
tttcttattaactgtatatgta

SEQ ID NO: 1283195 - DNA, 22 bp, Artificial Sequence
  chemically synthesized
cttattaactgtatatgtatct

SEQ ID NO: 1283196 - DNA, 22 bp, Artificial Sequence
  chemically synthesized
ttattaactgtatatgtatcta

SEQ ID NO: 1283197 - DNA, 22 bp, Artificial Sequence
  chemically synthesized
tggagataattgtagatacata

SEQ ID NO: 1283198 - DNA, 22 bp, Artificial Sequence
  chemically synthesized
atggagataattgtagatacat

SEQ ID NO: 1283199 - DNA, 22 bp, Artificial Sequence
  chemically synthesized
attaactgtatatgtatctaca

SEQ ID NO: 1283200 - DNA, 22 bp, Artificial Sequence
  chemically synthesized
tatggagataattgtagataca

SEQ ID NO: 1283201 - DNA, 22 bp, Artificial Sequence
  chemically synthesized
ttaactgtatatgtatctacaa

SEQ ID NO: 1283202 - DNA, 22 bp, Artificial Sequence
  chemically synthesized
actgtatatgtatctacaatta

SEQ ID NO: 1283203 - DNA, 22 bp, Artificial Sequence
  chemically synthesized
acattttatggagataattgta

SEQ ID NO: 1283204 - DNA, 22 bp, Artificial Sequence
  chemically synthesized
tatatgtatctacaattatctc

SEQ ID NO: 1283205 - DNA, 22 bp, Artificial Sequence
  chemically synthesized
aaaaaattgacattttatggag

SEQ ID NO: 1283206 - DNA, 22 bp, Artificial Sequence
  chemically synthesized
aaaaaaattgacattttatgga

SEQ ID NO: 1283207 - DNA, 22 bp, Artificial Sequence
  chemically synthesized
taaaaaaattgacattttatgg

SEQ ID NO: 1283208 - DNA, 22 bp, Artificial Sequence
  chemically synthesized
ttaaaaaaattgacattttatg

SEQ ID NO: 1283209 - DNA, 22 bp, Artificial Sequence
  chemically synthesized
caattatctccataaaatgtca

SEQ ID NO: 1283210 - DNA, 22 bp, Artificial Sequence
  chemically synthesized
acttttaaaaaaattgacattt

SEQ ID NO: 1283211 - DNA, 22 bp, Artificial Sequence
  chemically synthesized
tctccataaaatgtcaattttt

SEQ ID NO: 1283212 - DNA, 22 bp, Artificial Sequence
  chemically synthesized
cataaaatgtcaatttttttaa

SEQ ID NO: 1283213 - DNA, 22 bp, Artificial Sequence
  chemically synthesized
ttttaaaagtcaattttgattt

SEQ ID NO: 1283214 - DNA, 22 bp, Artificial Sequence
  chemically synthesized
tttaaaagtcaattttgatttt

SEQ ID NO: 1283215 - DNA, 22 bp, Artificial Sequence
  chemically synthesized
ttaaaagtcaattttgattttt

SEQ ID NO: 1283216 - DNA, 22 bp, Artificial Sequence
  chemically synthesized
taaaagtcaattttgatttttt

SEQ ID NO: 1283217 - DNA, 22 bp, Artificial Sequence
  chemically synthesized
aaaagtcaattttgattttttt

SEQ ID NO: 1283218 - DNA, 22 bp, Artificial Sequence
  chemically synthesized
aaagtcaattttgattttttta

SEQ ID NO: 1283219 - DNA, 22 bp, Artificial Sequence
  chemically synthesized
gtgaaatccaaacagaaaataa

SEQ ID NO: 1283220 - DNA, 22 bp, Artificial Sequence
  chemically synthesized
tgatttttttattttctgtttg

SEQ ID NO: 1283221 - DNA, 22 bp, Artificial Sequence
  chemically synthesized
gatttttttattttctgtttgg

SEQ ID NO: 1283222 - DNA, 22 bp, Artificial Sequence
  chemically synthesized
atttttttattttctgtttgga

SEQ ID NO: 1283223 - DNA, 22 bp, Artificial Sequence
  chemically synthesized
ttttattttctgtttggatttc

SEQ ID NO: 1283224 - DNA, 22 bp, Artificial Sequence
  chemically synthesized
tttattttctgtttggatttca

SEQ ID NO: 1283225 - DNA, 22 bp, Artificial Sequence
  chemically synthesized
ttattttctgtttggatttcac

SEQ ID NO: 1283226 - DNA, 22 bp, Artificial Sequence
  chemically synthesized
tattttctgtttggatttcact

SEQ ID NO: 1283227 - DNA, 22 bp, Artificial Sequence
  chemically synthesized
attttctgtttggatttcacta

SEQ ID NO: 1283228 - DNA, 22 bp, Artificial Sequence
  chemically synthesized
ttttctgtttggatttcactag

SEQ ID NO: 1283229 - DNA, 22 bp, Artificial Sequence
  chemically synthesized
tctgtttggatttcactagatg

SEQ ID NO: 1283230 - DNA, 22 bp, Artificial Sequence
  chemically synthesized
ctgtttggatttcactagatgt

SEQ ID NO: 1283231 - DNA, 22 bp, Artificial Sequence
  chemically synthesized
tgtttggatttcactagatgtt

SEQ ID NO: 1283232 - DNA, 22 bp, Artificial Sequence
  chemically synthesized
tttggatttcactagatgttct

SEQ ID NO: 1283233 - DNA, 22 bp, Artificial Sequence
  chemically synthesized
ggatttcactagatgttcttat

SEQ ID NO: 1283234 - DNA, 22 bp, Artificial Sequence
  chemically synthesized
gatttcactagatgttcttatt

SEQ ID NO: 1283235 - DNA, 22 bp, Artificial Sequence
  chemically synthesized
tatagtgaataaaatcaataag

SEQ ID NO: 1283236 - DNA, 22 bp, Artificial Sequence
  chemically synthesized
cactagatgttcttattgattt

SEQ ID NO: 1283237 - DNA, 22 bp, Artificial Sequence
  chemically synthesized
actagatgttcttattgatttt

SEQ ID NO: 1283238 - DNA, 22 bp, Artificial Sequence
  chemically synthesized
aattatatagtgaataaaatca

SEQ ID NO: 1283239 - DNA, 22 bp, Artificial Sequence
  chemically synthesized
gatgttcttattgattttattc

SEQ ID NO: 1283240 - DNA, 22 bp, Artificial Sequence
  chemically synthesized
tcaattatatagtgaataaaat

SEQ ID NO: 1283241 - DNA, 22 bp, Artificial Sequence
  chemically synthesized
ttattgattttattcactatat

SEQ ID NO: 1283242 - DNA, 22 bp, Artificial Sequence
  chemically synthesized
attgattttattcactatataa

SEQ ID NO: 1283243 - DNA, 22 bp, Artificial Sequence
  chemically synthesized
ttgattttattcactatataat

SEQ ID NO: 1283244 - DNA, 22 bp, Artificial Sequence
  chemically synthesized
attttattcactatataattga

SEQ ID NO: 1283245 - DNA, 22 bp, Artificial Sequence
  chemically synthesized
tattcactatataattgagaat

SEQ ID NO: 1283246 - DNA, 22 bp, Artificial Sequence
  chemically synthesized
attcactatataattgagaatc

SEQ ID NO: 1283247 - DNA, 22 bp, Artificial Sequence
  chemically synthesized
ttcactatataattgagaatca

SEQ ID NO: 1283248 - DNA, 22 bp, Artificial Sequence
  chemically synthesized
actatataattgagaatcatct

SEQ ID NO: 1283249 - DNA, 22 bp, Artificial Sequence
  chemically synthesized
agtaaacacagagcaagatgat

SEQ ID NO: 1283250 - DNA, 22 bp, Artificial Sequence
  chemically synthesized
tataattgagaatcatcttgct

SEQ ID NO: 1283251 - DNA, 22 bp, Artificial Sequence
  chemically synthesized
tgagtaaacacagagcaagatg

SEQ ID NO: 1283252 - DNA, 22 bp, Artificial Sequence
  chemically synthesized
ctctgagtaaacacagagcaag

SEQ ID NO: 1283253 - DNA, 22 bp, Artificial Sequence
  chemically synthesized
gctctgagtaaacacagagcaa

SEQ ID NO: 1283254 - DNA, 22 bp, Artificial Sequence
  chemically synthesized
agaatcatcttgctctgtgttt

SEQ ID NO: 1283255 - DNA, 22 bp, Artificial Sequence
  chemically synthesized
agcttgctctgagtaaacacag

SEQ ID NO: 1283256 - DNA, 22 bp, Artificial Sequence
  chemically synthesized
aaagttcagcttgctctgagta

SEQ ID NO: 1283257 - DNA, 22 bp, Artificial Sequence
  chemically synthesized
gctctgtgtttactcagagcaa

SEQ ID NO: 1283258 - DNA, 22 bp, Artificial Sequence
  chemically synthesized
ctctgtgtttactcagagcaag

SEQ ID NO: 1283259 - DNA, 22 bp, Artificial Sequence
  chemically synthesized
ctgaaagttcagcttgctctga

SEQ ID NO: 1283260 - DNA, 22 bp, Artificial Sequence
  chemically synthesized
tgtgtttactcagagcaagctg

SEQ ID NO: 1283261 - DNA, 22 bp, Artificial Sequence
  chemically synthesized
tgtttactcagagcaagctgaa

SEQ ID NO: 1283262 - DNA, 22 bp, Artificial Sequence
  chemically synthesized
actcagagcaagctgaactttc

SEQ ID NO: 1283263 - DNA, 22 bp, Artificial Sequence
  chemically synthesized
ctcagagcaagctgaactttca

SEQ ID NO: 1283264 - DNA, 22 bp, Artificial Sequence
  chemically synthesized
aaaataagattgctgaaagttc

SEQ ID NO: 1283265 - DNA, 22 bp, Artificial Sequence
  chemically synthesized
aaaaataagattgctgaaagtt

SEQ ID NO: 1283266 - DNA, 22 bp, Artificial Sequence
  chemically synthesized
agagcaagctgaactttcagca

SEQ ID NO: 1283267 - DNA, 22 bp, Artificial Sequence
  chemically synthesized
taaaaataagattgctgaaagt

SEQ ID NO: 1283268 - DNA, 22 bp, Artificial Sequence
  chemically synthesized
ttaaaaataagattgctgaaag

SEQ ID NO: 1283269 - DNA, 22 bp, Artificial Sequence
  chemically synthesized
tttaaaaataagattgctgaaa

SEQ ID NO: 1283270 - DNA, 22 bp, Artificial Sequence
  chemically synthesized
aactttcagcaatcttattttt

SEQ ID NO: 1283271 - DNA, 22 bp, Artificial Sequence
  chemically synthesized
tcagcaatcttatttttaaaaa

SEQ ID NO: 1283272 - DNA, 22 bp, Artificial Sequence
  chemically synthesized
cagcaatcttatttttaaaaaa

SEQ ID NO: 1283273 - DNA, 22 bp, Artificial Sequence
  chemically synthesized
agcaatcttatttttaaaaaat

SEQ ID NO: 1283274 - DNA, 22 bp, Artificial Sequence
  chemically synthesized
ataaggtcatatcatgtagcat

SEQ ID NO: 1283275 - DNA, 22 bp, Artificial Sequence
  chemically synthesized
atttttaaaaaatgctacatga

SEQ ID NO: 1283276 - DNA, 22 bp, Artificial Sequence
  chemically synthesized
tttttaaaaaatgctacatgat

SEQ ID NO: 1283277 - DNA, 22 bp, Artificial Sequence
  chemically synthesized
ctgataaggtcatatcatgtag

SEQ ID NO: 1283278 - DNA, 22 bp, Artificial Sequence
  chemically synthesized
ttaaaaaatgctacatgatatg

SEQ ID NO: 1283279 - DNA, 22 bp, Artificial Sequence
  chemically synthesized
taaaaaatgctacatgatatga

SEQ ID NO: 1283280 - DNA, 22 bp, Artificial Sequence
  chemically synthesized
aaaaaatgctacatgatatgac

SEQ ID NO: 1283281 - DNA, 22 bp, Artificial Sequence
  chemically synthesized
aaaaatgctacatgatatgacc

SEQ ID NO: 1283282 - DNA, 22 bp, Artificial Sequence
  chemically synthesized
gtaaattgctgataaggtcata

SEQ ID NO: 1283283 - DNA, 22 bp, Artificial Sequence
  chemically synthesized
agtaaattgctgataaggtcat

SEQ ID NO: 1283284 - DNA, 22 bp, Artificial Sequence
  chemically synthesized
catgatatgaccttatcagcaa

SEQ ID NO: 1283285 - DNA, 22 bp, Artificial Sequence
  chemically synthesized
aaataacttagtaaattgctga

SEQ ID NO: 1283286 - DNA, 22 bp, Artificial Sequence
  chemically synthesized
atcagcaatttactaagttatt

SEQ ID NO: 1283287 - DNA, 22 bp, Artificial Sequence
  chemically synthesized
tcagcaatttactaagttattt

SEQ ID NO: 1283288 - DNA, 22 bp, Artificial Sequence
  chemically synthesized
atgtccataaagtccattcaaa

SEQ ID NO: 1283289 - DNA, 22 bp, Artificial Sequence
  chemically synthesized
actaagttatttgaatggactt

SEQ ID NO: 1283290 - DNA, 22 bp, Artificial Sequence
  chemically synthesized
ctaagttatttgaatggacttt

SEQ ID NO: 1283291 - DNA, 22 bp, Artificial Sequence
  chemically synthesized
agttatttgaatggactttatg

SEQ ID NO: 1283292 - DNA, 22 bp, Artificial Sequence
  chemically synthesized
aagataagttcatgtccataaa

SEQ ID NO: 1283293 - DNA, 22 bp, Artificial Sequence
  chemically synthesized
tttgaatggactttatggacat

SEQ ID NO: 1283294 - DNA, 22 bp, Artificial Sequence
  chemically synthesized
gaagataagttcatgtccataa

SEQ ID NO: 1283295 - DNA, 22 bp, Artificial Sequence
  chemically synthesized
tgaagataagttcatgtccata

SEQ ID NO: 1283296 - DNA, 22 bp, Artificial Sequence
  chemically synthesized
gaatggactttatggacatgaa

SEQ ID NO: 1283297 - DNA, 22 bp, Artificial Sequence
  chemically synthesized
aatggactttatggacatgaac

SEQ ID NO: 1283298 - DNA, 22 bp, Artificial Sequence
  chemically synthesized
tatggacatgaacttatcttca

SEQ ID NO: 1283299 - DNA, 22 bp, Artificial Sequence
  chemically synthesized
atggacatgaacttatcttcaa

SEQ ID NO: 1283300 - DNA, 22 bp, Artificial Sequence
  chemically synthesized
tggacatgaacttatcttcaaa

SEQ ID NO: 1283301 - DNA, 22 bp, Artificial Sequence
  chemically synthesized
aacagaaaagacgctttgaaga

SEQ ID NO: 1283302 - DNA, 22 bp, Artificial Sequence
  chemically synthesized
aaacagaaaagacgctttgaag

SEQ ID NO: 1283303 - DNA, 22 bp, Artificial Sequence
  chemically synthesized
taaacagaaaagacgctttgaa

SEQ ID NO: 1283304 - DNA, 22 bp, Artificial Sequence
  chemically synthesized
atcttcaaagcgtcttttctgt

SEQ ID NO: 1283305 - DNA, 22 bp, Artificial Sequence
  chemically synthesized
tcttcaaagcgtcttttctgtt

SEQ ID NO: 1283306 - DNA, 22 bp, Artificial Sequence
  chemically synthesized
caaagcgtcttttctgtttaaa

SEQ ID NO: 1283307 - DNA, 22 bp, Artificial Sequence
  chemically synthesized
aaagcgtcttttctgtttaaag

SEQ ID NO: 1283308 - DNA, 22 bp, Artificial Sequence
  chemically synthesized
ttctgtttaaagctatgtcctt

SEQ ID NO: 1283309 - DNA, 22 bp, Artificial Sequence
  chemically synthesized
aaaaaaacggtaaaggacatag

SEQ ID NO: 1283310 - DNA, 22 bp, Artificial Sequence
  chemically synthesized
tctgtttaaagctatgtccttt

SEQ ID NO: 1283311 - DNA, 22 bp, Artificial Sequence
  chemically synthesized
aaaaaaaacggtaaaggacata

SEQ ID NO: 1283312 - DNA, 22 bp, Artificial Sequence
  chemically synthesized
ctgtttaaagctatgtccttta

SEQ ID NO: 1283313 - DNA, 22 bp, Artificial Sequence
  chemically synthesized
tgtttaaagctatgtcctttac

SEQ ID NO: 1283314 - DNA, 22 bp, Artificial Sequence
  chemically synthesized
tttaaagctatgtcctttaccg

SEQ ID NO: 1283315 - DNA, 22 bp, Artificial Sequence
  chemically synthesized
cagtttaaaaaaaacggtaaag

SEQ ID NO: 1283316 - DNA, 22 bp, Artificial Sequence
  chemically synthesized
aaagctatgtcctttaccgttt

SEQ ID NO: 1283317 - DNA, 22 bp, Artificial Sequence
  chemically synthesized
ccagtttaaaaaaaacggtaaa

SEQ ID NO: 1283318 - DNA, 22 bp, Artificial Sequence
  chemically synthesized
aagctatgtcctttaccgtttt

SEQ ID NO: 1283319 - DNA, 22 bp, Artificial Sequence
  chemically synthesized
tgtcctttaccgttttttttaa

SEQ ID NO: 1283320 - DNA, 22 bp, Artificial Sequence
  chemically synthesized
taccgttttttttaaactggaa

SEQ ID NO: 1283321 - DNA, 22 bp, Artificial Sequence
  chemically synthesized
accgttttttttaaactggaag

SEQ ID NO: 1283322 - DNA, 22 bp, Artificial Sequence
  chemically synthesized
ccgttttttttaaactggaagc

SEQ ID NO: 1283323 - DNA, 22 bp, Artificial Sequence
  chemically synthesized
gcagggaaggaatgcttccagt

SEQ ID NO: 1283324 - DNA, 22 bp, Artificial Sequence
  chemically synthesized
gctggcagggaaggaatgcttc

SEQ ID NO: 1283325 - DNA, 22 bp, Artificial Sequence
  chemically synthesized
tttttaaactggaagcattcct

SEQ ID NO: 1283326 - DNA, 22 bp, Artificial Sequence
  chemically synthesized
agctggcagggaaggaatgctt

SEQ ID NO: 1283327 - DNA, 22 bp, Artificial Sequence
  chemically synthesized
ttttaaactggaagcattcctt

SEQ ID NO: 1283328 - DNA, 22 bp, Artificial Sequence
  chemically synthesized
tagctggcagggaaggaatgct

SEQ ID NO: 1283329 - DNA, 22 bp, Artificial Sequence
  chemically synthesized
tttaaactggaagcattccttc

SEQ ID NO: 1283330 - DNA, 22 bp, Artificial Sequence
  chemically synthesized
ttaaactggaagcattccttcc

SEQ ID NO: 1283331 - DNA, 22 bp, Artificial Sequence
  chemically synthesized
tttagctggcagggaaggaatg

SEQ ID NO: 1283332 - DNA, 22 bp, Artificial Sequence
  chemically synthesized
taaactggaagcattccttccc

SEQ ID NO: 1283333 - DNA, 22 bp, Artificial Sequence
  chemically synthesized
ctttagctggcagggaaggaat

SEQ ID NO: 1283334 - DNA, 22 bp, Artificial Sequence
  chemically synthesized
aaactggaagcattccttccct

SEQ ID NO: 1283335 - DNA, 22 bp, Artificial Sequence
  chemically synthesized
tctttagctggcagggaaggaa

SEQ ID NO: 1283336 - DNA, 22 bp, Artificial Sequence
  chemically synthesized
aactggaagcattccttccctg

SEQ ID NO: 1283337 - DNA, 22 bp, Artificial Sequence
  chemically synthesized
gaagcattccttccctgccagc

SEQ ID NO: 1283338 - DNA, 22 bp, Artificial Sequence
  chemically synthesized
ataacatggaattttctttagc

SEQ ID NO: 1283339 - DNA, 22 bp, Artificial Sequence
  chemically synthesized
cttccctgccagctaaagaaaa

SEQ ID NO: 1283340 - DNA, 22 bp, Artificial Sequence
  chemically synthesized
aataacatggaattttctttag

SEQ ID NO: 1283341 - DNA, 22 bp, Artificial Sequence
  chemically synthesized
taataacatggaattttcttta

SEQ ID NO: 1283342 - DNA, 22 bp, Artificial Sequence
  chemically synthesized
ttaataacatggaattttcttt

SEQ ID NO: 1283343 - DNA, 22 bp, Artificial Sequence
  chemically synthesized
ccctgccagctaaagaaaattc

SEQ ID NO: 1283344 - DNA, 22 bp, Artificial Sequence
  chemically synthesized
cctgccagctaaagaaaattcc

SEQ ID NO: 1283345 - DNA, 22 bp, Artificial Sequence
  chemically synthesized
ccagctaaagaaaattccatgt

SEQ ID NO: 1283346 - DNA, 22 bp, Artificial Sequence
  chemically synthesized
aagaaaattccatgttattaaa

SEQ ID NO: 1283347 - DNA, 22 bp, Artificial Sequence
  chemically synthesized
agaaccaccatttttaataaca

SEQ ID NO: 1283348 - DNA, 22 bp, Artificial Sequence
  chemically synthesized
tggctgagaaccaccattttta

SEQ ID NO: 1283349 - DNA, 22 bp, Artificial Sequence
  chemically synthesized
catgttattaaaaatggtggtt

SEQ ID NO: 1283350 - DNA, 22 bp, Artificial Sequence
  chemically synthesized
attatggctgagaaccaccatt

SEQ ID NO: 1283351 - DNA, 22 bp, Artificial Sequence
  chemically synthesized
ttaaaaatggtggttctcagcc

SEQ ID NO: 1283352 - DNA, 22 bp, Artificial Sequence
  chemically synthesized
tgtgtattaattatggctgaga

SEQ ID NO: 1283353 - DNA, 22 bp, Artificial Sequence
  chemically synthesized
aaaatggtggttctcagccata

SEQ ID NO: 1283354 - DNA, 22 bp, Artificial Sequence
  chemically synthesized
tgaactatgtgtattaattatg

SEQ ID NO: 1283355 - DNA, 22 bp, Artificial Sequence
  chemically synthesized
tcagccataattaatacacata

SEQ ID NO: 1283356 - DNA, 22 bp, Artificial Sequence
  chemically synthesized
agccataattaatacacatagt

SEQ ID NO: 1283357 - DNA, 22 bp, Artificial Sequence
  chemically synthesized
aatgggtgttatgaactatgtg

SEQ ID NO: 1283358 - DNA, 22 bp, Artificial Sequence
  chemically synthesized
aaatgggtgttatgaactatgt

SEQ ID NO: 1283359 - DNA, 22 bp, Artificial Sequence
  chemically synthesized
taaatgggtgttatgaactatg

SEQ ID NO: 1283360 - DNA, 22 bp, Artificial Sequence
  chemically synthesized
atacacatagttcataacaccc

SEQ ID NO: 1283361 - DNA, 22 bp, Artificial Sequence
  chemically synthesized
ccaattttaaatgggtgttatg

SEQ ID NO: 1283362 - DNA, 22 bp, Artificial Sequence
  chemically synthesized
taaacacattaccaattttaaa

SEQ ID NO: 1283363 - DNA, 22 bp, Artificial Sequence
  chemically synthesized
ataaacacattaccaattttaa

SEQ ID NO: 1283364 - DNA, 22 bp, Artificial Sequence
  chemically synthesized
ataacacccatttaaaattggt

SEQ ID NO: 1283365 - DNA, 22 bp, Artificial Sequence
  chemically synthesized
ttataaacacattaccaatttt

SEQ ID NO: 1283366 - DNA, 22 bp, Artificial Sequence
  chemically synthesized
tcttataaacacattaccaatt

SEQ ID NO: 1283367 - DNA, 22 bp, Artificial Sequence
  chemically synthesized
acctctcttataaacacattac

SEQ ID NO: 1283368 - DNA, 22 bp, Artificial Sequence
  chemically synthesized
aaaattggtaatgtgtttataa

SEQ ID NO: 1283369 - DNA, 22 bp, Artificial Sequence
  chemically synthesized
aaattggtaatgtgtttataag

SEQ ID NO: 1283370 - DNA, 22 bp, Artificial Sequence
  chemically synthesized
catgtctcacctctcttataaa

SEQ ID NO: 1283371 - DNA, 22 bp, Artificial Sequence
  chemically synthesized
gcatgtctcacctctcttataa

SEQ ID NO: 1283372 - DNA, 22 bp, Artificial Sequence
  chemically synthesized
ttgcatgtctcacctctcttat

SEQ ID NO: 1283373 - DNA, 22 bp, Artificial Sequence
  chemically synthesized
gtaatgtgtttataagagaggt

SEQ ID NO: 1283374 - DNA, 22 bp, Artificial Sequence
  chemically synthesized
cttgcatgtctcacctctctta

SEQ ID NO: 1283375 - DNA, 22 bp, Artificial Sequence
  chemically synthesized
tcttgcatgtctcacctctctt

SEQ ID NO: 1283376 - DNA, 22 bp, Artificial Sequence
  chemically synthesized
ttcttgcatgtctcacctctct

SEQ ID NO: 1283377 - DNA, 22 bp, Artificial Sequence
  chemically synthesized
ttttcttgcatgtctcacctct

SEQ ID NO: 1283378 - DNA, 22 bp, Artificial Sequence
  chemically synthesized
cttttcttgcatgtctcacctc

SEQ ID NO: 1283379 - DNA, 22 bp, Artificial Sequence
  chemically synthesized
ataagagaggtgagacatgcaa

SEQ ID NO: 1283380 - DNA, 22 bp, Artificial Sequence
  chemically synthesized
taagagaggtgagacatgcaag

SEQ ID NO: 1283381 - DNA, 22 bp, Artificial Sequence
  chemically synthesized
gtaccacttcttttcttgcatg

SEQ ID NO: 1283382 - DNA, 22 bp, Artificial Sequence
  chemically synthesized
ggtaccacttcttttcttgcat

SEQ ID NO: 1283383 - DNA, 22 bp, Artificial Sequence
  chemically synthesized
gtgatcacttggtaccacttct

SEQ ID NO: 1283384 - DNA, 22 bp, Artificial Sequence
  chemically synthesized
tggtgatcacttggtaccactt

SEQ ID NO: 1283385 - DNA, 22 bp, Artificial Sequence
  chemically synthesized
catgtgtctctggtgatcactt

SEQ ID NO: 1283386 - DNA, 22 bp, Artificial Sequence
  chemically synthesized
acacactccatgtgtctctggt

SEQ ID NO: 1283387 - DNA, 22 bp, Artificial Sequence
  chemically synthesized
cactcacacactccatgtgtct

SEQ ID NO: 1283388 - DNA, 22 bp, Artificial Sequence
  chemically synthesized
ctacactcacacactccatgtg

SEQ ID NO: 1283389 - DNA, 22 bp, Artificial Sequence
  chemically synthesized
tcctacactcacacactccatg

SEQ ID NO: 1283390 - DNA, 22 bp, Artificial Sequence
  chemically synthesized
aataactctcctacactcacac

SEQ ID NO: 1283391 - DNA, 22 bp, Artificial Sequence
  chemically synthesized
tttaacctctgtgctatttatt

SEQ ID NO: 1283392 - DNA, 22 bp, Artificial Sequence
  chemically synthesized
aaataagtaaataaataaatag

SEQ ID NO: 1283393 - DNA, 22 bp, Artificial Sequence
  chemically synthesized
aacctctgtgctatttatttat

SEQ ID NO: 1283394 - DNA, 22 bp, Artificial Sequence
  chemically synthesized
acctctgtgctatttatttatt

SEQ ID NO: 1283395 - DNA, 22 bp, Artificial Sequence
  chemically synthesized
catctcaaataagtaaataaat

SEQ ID NO: 1283396 - DNA, 22 bp, Artificial Sequence
  chemically synthesized
tgtgctatttatttatttactt

SEQ ID NO: 1283397 - DNA, 22 bp, Artificial Sequence
  chemically synthesized
tgctatttatttatttacttat

SEQ ID NO: 1283398 - DNA, 22 bp, Artificial Sequence
  chemically synthesized
tttatttatttacttatttgag

SEQ ID NO: 1283399 - DNA, 22 bp, Artificial Sequence
  chemically synthesized
atttatttacttatttgagatg

SEQ ID NO: 1283400 - DNA, 22 bp, Artificial Sequence
  chemically synthesized
tttatttacttatttgagatgg

SEQ ID NO: 1283401 - DNA, 22 bp, Artificial Sequence
  chemically synthesized
atttacttatttgagatggagt

SEQ ID NO: 1283402 - DNA, 22 bp, Artificial Sequence
  chemically synthesized
tttacttatttgagatggagtt

SEQ ID NO: 1283403 - DNA, 22 bp, Artificial Sequence
  chemically synthesized
gggaacaggaaggaaactccat

SEQ ID NO: 1283404 - DNA, 22 bp, Artificial Sequence
  chemically synthesized
acttatttgagatggagtttcc

SEQ ID NO: 1283405 - DNA, 22 bp, Artificial Sequence
  chemically synthesized
cttatttgagatggagtttcct

SEQ ID NO: 1283406 - DNA, 22 bp, Artificial Sequence
  chemically synthesized
atttgagatggagtttccttcc

SEQ ID NO: 1283407 - DNA, 22 bp, Artificial Sequence
  chemically synthesized
tttgagatggagtttccttcct

SEQ ID NO: 1283408 - DNA, 22 bp, Artificial Sequence
  chemically synthesized
cagcctggggaacaggaaggaa

SEQ ID NO: 1283409 - DNA, 22 bp, Artificial Sequence
  chemically synthesized
gagatggagtttccttcctgtt

SEQ ID NO: 1283410 - DNA, 22 bp, Artificial Sequence
  chemically synthesized
agatggagtttccttcctgttc

SEQ ID NO: 1283411 - DNA, 22 bp, Artificial Sequence
  chemically synthesized
cgctccagcctggggaacagga

SEQ ID NO: 1283412 - DNA, 22 bp, Artificial Sequence
  chemically synthesized
ccttcctgttccccaggctgga

SEQ ID NO: 1283413 - DNA, 22 bp, Artificial Sequence
  chemically synthesized
cttcctgttccccaggctggag

SEQ ID NO: 1283414 - DNA, 22 bp, Artificial Sequence
  chemically synthesized
cctgttccccaggctggagcgc

SEQ ID NO: 1283415 - DNA, 22 bp, Artificial Sequence
  chemically synthesized
ctgttccccaggctggagcgca

SEQ ID NO: 1283416 - DNA, 22 bp, Artificial Sequence
  chemically synthesized
ttccccaggctggagcgcaatg

SEQ ID NO: 1283417 - DNA, 22 bp, Artificial Sequence
  chemically synthesized
cccaggctggagcgcaatggcg

SEQ ID NO: 1283418 - DNA, 22 bp, Artificial Sequence
  chemically synthesized
cagtgagccgagatggcgccat

SEQ ID NO: 1283419 - DNA, 22 bp, Artificial Sequence
  chemically synthesized
gagcgcaatggcgccatctcgg

SEQ ID NO: 1283420 - DNA, 22 bp, Artificial Sequence
  chemically synthesized
ggaggcggaagttgcagtgagc

SEQ ID NO: 1283421 - DNA, 22 bp, Artificial Sequence
  chemically synthesized
aacctgggaggcggaagttgca

SEQ ID NO: 1283422 - DNA, 22 bp, Artificial Sequence
  chemically synthesized
gaacctgggaggcggaagttgc

SEQ ID NO: 1283423 - DNA, 22 bp, Artificial Sequence
  chemically synthesized
ggctcactgcaacttccgcctc

SEQ ID NO: 1283424 - DNA, 22 bp, Artificial Sequence
  chemically synthesized
actgcaacttccgcctcccagg

SEQ ID NO: 1283425 - DNA, 22 bp, Artificial Sequence
  chemically synthesized
caacttccgcctcccaggttca

SEQ ID NO: 1283426 - DNA, 22 bp, Artificial Sequence
  chemically synthesized
aggcaggagaatcgcttgaacc

SEQ ID NO: 1283427 - DNA, 22 bp, Artificial Sequence
  chemically synthesized
ccgcctcccaggttcaagcgat

SEQ ID NO: 1283428 - DNA, 22 bp, Artificial Sequence
  chemically synthesized
cgcctcccaggttcaagcgatt

SEQ ID NO: 1283429 - DNA, 22 bp, Artificial Sequence
  chemically synthesized
ggaggctgaggcaggagaatcg

SEQ ID NO: 1283430 - DNA, 22 bp, Artificial Sequence
  chemically synthesized
ccaggttcaagcgattctcctg

SEQ ID NO: 1283431 - DNA, 22 bp, Artificial Sequence
  chemically synthesized
gggaggctgaggcaggagaatc

SEQ ID NO: 1283432 - DNA, 22 bp, Artificial Sequence
  chemically synthesized
cttgggaggctgaggcaggaga

SEQ ID NO: 1283433 - DNA, 22 bp, Artificial Sequence
  chemically synthesized
aagcgattctcctgcctcagcc

SEQ ID NO: 1283434 - DNA, 22 bp, Artificial Sequence
  chemically synthesized
taatcccagctacttgggaggc

SEQ ID NO: 1283435 - DNA, 22 bp, Artificial Sequence
  chemically synthesized
tcctgcctcagcctcccaagta

SEQ ID NO: 1283436 - DNA, 22 bp, Artificial Sequence
  chemically synthesized
ctgcctcagcctcccaagtagc

SEQ ID NO: 1283437 - DNA, 22 bp, Artificial Sequence
  chemically synthesized
cctcagcctcccaagtagctgg

SEQ ID NO: 1283438 - DNA, 22 bp, Artificial Sequence
  chemically synthesized
agcctcccaagtagctgggatt

SEQ ID NO: 1283439 - DNA, 22 bp, Artificial Sequence
  chemically synthesized
ccaagtagctgggattacaggc

SEQ ID NO: 1283440 - DNA, 22 bp, Artificial Sequence
  chemically synthesized
gccgggtgtggtggtgggtgcc

SEQ ID NO: 1283441 - DNA, 22 bp, Artificial Sequence
  chemically synthesized
ggattacaggcacccaccacca

SEQ ID NO: 1283442 - DNA, 22 bp, Artificial Sequence
  chemically synthesized
caggcacccaccaccacacccg

SEQ ID NO: 1283443 - DNA, 22 bp, Artificial Sequence
  chemically synthesized
aaaatacaaaaattagccgggt

SEQ ID NO: 1283444 - DNA, 22 bp, Artificial Sequence
  chemically synthesized
ctaaaaatacaaaaattagccg

SEQ ID NO: 1283445 - DNA, 22 bp, Artificial Sequence
  chemically synthesized
tactaaaaatacaaaaattagc

SEQ ID NO: 1283446 - DNA, 22 bp, Artificial Sequence
  chemically synthesized
tctctactaaaaatacaaaaat

SEQ ID NO: 1283447 - DNA, 22 bp, Artificial Sequence
  chemically synthesized
atttttgtatttttagtagaga

SEQ ID NO: 1283448 - DNA, 22 bp, Artificial Sequence
  chemically synthesized
ttgtatttttagtagagacagg

SEQ ID NO: 1283449 - DNA, 22 bp, Artificial Sequence
  chemically synthesized
tgtatttttagtagagacaggg

SEQ ID NO: 1283450 - DNA, 22 bp, Artificial Sequence
  chemically synthesized
gtatttttagtagagacagggt

SEQ ID NO: 1283451 - DNA, 22 bp, Artificial Sequence
  chemically synthesized
tatttttagtagagacagggtt

SEQ ID NO: 1283452 - DNA, 22 bp, Artificial Sequence
  chemically synthesized
gccaacatgacaaaaccctgtc

SEQ ID NO: 1283453 - DNA, 22 bp, Artificial Sequence
  chemically synthesized
ttagtagagacagggttttgtc

SEQ ID NO: 1283454 - DNA, 22 bp, Artificial Sequence
  chemically synthesized
tagtagagacagggttttgtca

SEQ ID NO: 1283455 - DNA, 22 bp, Artificial Sequence
  chemically synthesized
agtagagacagggttttgtcat

SEQ ID NO: 1283456 - DNA, 22 bp, Artificial Sequence
  chemically synthesized
gtagagacagggttttgtcatg

SEQ ID NO: 1283457 - DNA, 22 bp, Artificial Sequence
  chemically synthesized
agaccagcctggccaacatgac

SEQ ID NO: 1283458 - DNA, 22 bp, Artificial Sequence
  chemically synthesized
gagaccagcctggccaacatga

SEQ ID NO: 1283459 - DNA, 22 bp, Artificial Sequence
  chemically synthesized
tgtcatgttggccaggctggtc

SEQ ID NO: 1283460 - DNA, 22 bp, Artificial Sequence
  chemically synthesized
gtcatgttggccaggctggtct

SEQ ID NO: 1283461 - DNA, 22 bp, Artificial Sequence
  chemically synthesized
tcatgttggccaggctggtctc

SEQ ID NO: 1283462 - DNA, 22 bp, Artificial Sequence
  chemically synthesized
aggtcaagagtttgagaccagc

SEQ ID NO: 1283463 - DNA, 22 bp, Artificial Sequence
  chemically synthesized
gccaggctggtctcaaactctt

SEQ ID NO: 1283464 - DNA, 22 bp, Artificial Sequence
  chemically synthesized
gtctcaaactcttgacctcagg

SEQ ID NO: 1283465 - DNA, 22 bp, Artificial Sequence
  chemically synthesized
aaactcttgacctcaggtgatc

SEQ ID NO: 1283466 - DNA, 22 bp, Artificial Sequence
  chemically synthesized
ggcggccaaagcgggtggatca

SEQ ID NO: 1283467 - DNA, 22 bp, Artificial Sequence
  chemically synthesized
ttgacctcaggtgatccacccg

SEQ ID NO: 1283468 - DNA, 22 bp, Artificial Sequence
  chemically synthesized
gggcggccaaagcgggtggatc

SEQ ID NO: 1283469 - DNA, 22 bp, Artificial Sequence
  chemically synthesized
tgggcggccaaagcgggtggat

SEQ ID NO: 1283470 - DNA, 22 bp, Artificial Sequence
  chemically synthesized
gacctcaggtgatccacccgct

SEQ ID NO: 1283471 - DNA, 22 bp, Artificial Sequence
  chemically synthesized
acctcaggtgatccacccgctt

SEQ ID NO: 1283472 - DNA, 22 bp, Artificial Sequence
  chemically synthesized
aggtgatccacccgctttggcc

SEQ ID NO: 1283473 - DNA, 22 bp, Artificial Sequence
  chemically synthesized
caatcccagcactttgggcggc

SEQ ID NO: 1283474 - DNA, 22 bp, Artificial Sequence
  chemically synthesized
ctacaatcccagcactttgggc

SEQ ID NO: 1283475 - DNA, 22 bp, Artificial Sequence
  chemically synthesized
actcctacaatcccagcacttt

SEQ ID NO: 1283476 - DNA, 22 bp, Artificial Sequence
  chemically synthesized
tggccgcccaaagtgctgggat

SEQ ID NO: 1283477 - DNA, 22 bp, Artificial Sequence
  chemically synthesized
ggccgcccaaagtgctgggatt

SEQ ID NO: 1283478 - DNA, 22 bp, Artificial Sequence
  chemically synthesized
gccgcccaaagtgctgggattg

SEQ ID NO: 1283479 - DNA, 22 bp, Artificial Sequence
  chemically synthesized
ggattgtaggagtgagccaccg

SEQ ID NO: 1283480 - DNA, 22 bp, Artificial Sequence
  chemically synthesized
taggagtgagccaccgtgcccg

SEQ ID NO: 1283481 - DNA, 22 bp, Artificial Sequence
  chemically synthesized
tagatagggaaagtaaaacaca

SEQ ID NO: 1283482 - DNA, 22 bp, Artificial Sequence
  chemically synthesized
atagatagggaaagtaaaacac

SEQ ID NO: 1283483 - DNA, 22 bp, Artificial Sequence
  chemically synthesized
tatagatagggaaagtaaaaca

SEQ ID NO: 1283484 - DNA, 22 bp, Artificial Sequence
  chemically synthesized
ttatagatagggaaagtaaaac

SEQ ID NO: 1283485 - DNA, 22 bp, Artificial Sequence
  chemically synthesized
tttatagatagggaaagtaaaa

SEQ ID NO: 1283486 - DNA, 22 bp, Artificial Sequence
  chemically synthesized
cctttttatagatagggaaagt

SEQ ID NO: 1283487 - DNA, 22 bp, Artificial Sequence
  chemically synthesized
ccctttttatagatagggaaag

SEQ ID NO: 1283488 - DNA, 22 bp, Artificial Sequence
  chemically synthesized
tgtgttttactttccctatcta

SEQ ID NO: 1283489 - DNA, 22 bp, Artificial Sequence
  chemically synthesized
cttccctttttatagataggga

SEQ ID NO: 1283490 - DNA, 22 bp, Artificial Sequence
  chemically synthesized
acttccctttttatagataggg

SEQ ID NO: 1283491 - DNA, 22 bp, Artificial Sequence
  chemically synthesized
tgttttactttccctatctata

SEQ ID NO: 1283492 - DNA, 22 bp, Artificial Sequence
  chemically synthesized
tacttccctttttatagatagg

SEQ ID NO: 1283493 - DNA, 22 bp, Artificial Sequence
  chemically synthesized
ttacttccctttttatagatag

SEQ ID NO: 1283494 - DNA, 22 bp, Artificial Sequence
  chemically synthesized
tttttacttccctttttataga

SEQ ID NO: 1283495 - DNA, 22 bp, Artificial Sequence
  chemically synthesized
tactttccctatctataaaaag

SEQ ID NO: 1283496 - DNA, 22 bp, Artificial Sequence
  chemically synthesized
actttccctatctataaaaagg

SEQ ID NO: 1283497 - DNA, 22 bp, Artificial Sequence
  chemically synthesized
ctttccctatctataaaaaggg

SEQ ID NO: 1283498 - DNA, 22 bp, Artificial Sequence
  chemically synthesized
tccctatctataaaaagggaag

SEQ ID NO: 1283499 - DNA, 22 bp, Artificial Sequence
  chemically synthesized
ccctatctataaaaagggaagt

SEQ ID NO: 1283500 - DNA, 22 bp, Artificial Sequence
  chemically synthesized
cctatctataaaaagggaagta

SEQ ID NO: 1283501 - DNA, 22 bp, Artificial Sequence
  chemically synthesized
tctataaaaagggaagtaaaaa

SEQ ID NO: 1283502 - DNA, 22 bp, Artificial Sequence
  chemically synthesized
agtagaagatactatttttact

SEQ ID NO: 1283503 - DNA, 22 bp, Artificial Sequence
  chemically synthesized
taaaaagggaagtaaaaatagt

SEQ ID NO: 1283504 - DNA, 22 bp, Artificial Sequence
  chemically synthesized
tcctaagtagaagatactattt

SEQ ID NO: 1283505 - DNA, 22 bp, Artificial Sequence
  chemically synthesized
tagcacataactatcctaagta

SEQ ID NO: 1283506 - DNA, 22 bp, Artificial Sequence
  chemically synthesized
acatattatagcacataactat

SEQ ID NO: 1283507 - DNA, 22 bp, Artificial Sequence
  chemically synthesized
cacatattatagcacataacta

SEQ ID NO: 1283508 - DNA, 22 bp, Artificial Sequence
  chemically synthesized
ctacttaggatagttatgtgct

SEQ ID NO: 1283509 - DNA, 22 bp, Artificial Sequence
  chemically synthesized
tacttaggatagttatgtgcta

SEQ ID NO: 1283510 - DNA, 22 bp, Artificial Sequence
  chemically synthesized
cttaggatagttatgtgctata

SEQ ID NO: 1283511 - DNA, 22 bp, Artificial Sequence
  chemically synthesized
aggatagttatgtgctataata

SEQ ID NO: 1283512 - DNA, 22 bp, Artificial Sequence
  chemically synthesized
ggatagttatgtgctataatat

SEQ ID NO: 1283513 - DNA, 22 bp, Artificial Sequence
  chemically synthesized
aaataagggcttcacatattat

SEQ ID NO: 1283514 - DNA, 22 bp, Artificial Sequence
  chemically synthesized
tgaaataagggcttcacatatt

SEQ ID NO: 1283515 - DNA, 22 bp, Artificial Sequence
  chemically synthesized
tgtgctataatatgtgaagccc

SEQ ID NO: 1283516 - DNA, 22 bp, Artificial Sequence
  chemically synthesized
gctctgaaataagggcttcaca

SEQ ID NO: 1283517 - DNA, 22 bp, Artificial Sequence
  chemically synthesized
ggctctgaaataagggcttcac

SEQ ID NO: 1283518 - DNA, 22 bp, Artificial Sequence
  chemically synthesized
taatatgtgaagcccttatttc

SEQ ID NO: 1283519 - DNA, 22 bp, Artificial Sequence
  chemically synthesized
tatgcttggctctgaaataagg

SEQ ID NO: 1283520 - DNA, 22 bp, Artificial Sequence
  chemically synthesized
ctatatgcttggctctgaaata

SEQ ID NO: 1283521 - DNA, 22 bp, Artificial Sequence
  chemically synthesized
actatatgcttggctctgaaat

SEQ ID NO: 1283522 - DNA, 22 bp, Artificial Sequence
  chemically synthesized
tggaagtgcttactatatgctt

SEQ ID NO: 1283523 - DNA, 22 bp, Artificial Sequence
  chemically synthesized
atttcagagccaagcatatagt

SEQ ID NO: 1283524 - DNA, 22 bp, Artificial Sequence
  chemically synthesized
atggaagtgcttactatatgct

SEQ ID NO: 1283525 - DNA, 22 bp, Artificial Sequence
  chemically synthesized
tttcagagccaagcatatagta

SEQ ID NO: 1283526 - DNA, 22 bp, Artificial Sequence
  chemically synthesized
cagagccaagcatatagtaagc

SEQ ID NO: 1283527 - DNA, 22 bp, Artificial Sequence
  chemically synthesized
agagccaagcatatagtaagca

SEQ ID NO: 1283528 - DNA, 22 bp, Artificial Sequence
  chemically synthesized
atatttatggaagtgcttacta

SEQ ID NO: 1283529 - DNA, 22 bp, Artificial Sequence
  chemically synthesized
catgagtaataataataattaa

SEQ ID NO: 1283530 - DNA, 22 bp, Artificial Sequence
  chemically synthesized
ccataaatattaattattatta

SEQ ID NO: 1283531 - DNA, 22 bp, Artificial Sequence
  chemically synthesized
cataaatattaattattattat

SEQ ID NO: 1283532 - DNA, 22 bp, Artificial Sequence
  chemically synthesized
tgttccatgagtaataataata

SEQ ID NO: 1283533 - DNA, 22 bp, Artificial Sequence
  chemically synthesized
attattattattactcatggaa

SEQ ID NO: 1283534 - DNA, 22 bp, Artificial Sequence
  chemically synthesized
ttattattactcatggaacata

SEQ ID NO: 1283535 - DNA, 22 bp, Artificial Sequence
  chemically synthesized
atgggaatcaattatgttccat

SEQ ID NO: 1283536 - DNA, 22 bp, Artificial Sequence
  chemically synthesized
taatgggaatcaattatgttcc

SEQ ID NO: 1283537 - DNA, 22 bp, Artificial Sequence
  chemically synthesized
ttattactcatggaacataatt

SEQ ID NO: 1283538 - DNA, 22 bp, Artificial Sequence
  chemically synthesized
ttactcatggaacataattgat

SEQ ID NO: 1283539 - DNA, 22 bp, Artificial Sequence
  chemically synthesized
ctcatggaacataattgattcc

SEQ ID NO: 1283540 - DNA, 22 bp, Artificial Sequence
  chemically synthesized
caaattctaatgggaatcaatt

SEQ ID NO: 1283541 - DNA, 22 bp, Artificial Sequence
  chemically synthesized
atggaacataattgattcccat

SEQ ID NO: 1283542 - DNA, 22 bp, Artificial Sequence
  chemically synthesized
ctacaaattctaatgggaatca

SEQ ID NO: 1283543 - DNA, 22 bp, Artificial Sequence
  chemically synthesized
ctcctacaaattctaatgggaa

SEQ ID NO: 1283544 - DNA, 22 bp, Artificial Sequence
  chemically synthesized
actcctacaaattctaatggga

SEQ ID NO: 1283545 - DNA, 22 bp, Artificial Sequence
  chemically synthesized
cttactcctacaaattctaatg

SEQ ID NO: 1283546 - DNA, 22 bp, Artificial Sequence
  chemically synthesized
cctccttactcctacaaattct

SEQ ID NO: 1283547 - DNA, 22 bp, Artificial Sequence
  chemically synthesized
attcccattagaatttgtagga

SEQ ID NO: 1283548 - DNA, 22 bp, Artificial Sequence
  chemically synthesized
ccattagaatttgtaggagtaa

SEQ ID NO: 1283549 - DNA, 22 bp, Artificial Sequence
  chemically synthesized
aagtgttacctccttactccta

SEQ ID NO: 1283550 - DNA, 22 bp, Artificial Sequence
  chemically synthesized
aaagtgttacctccttactcct

SEQ ID NO: 1283551 - DNA, 22 bp, Artificial Sequence
  chemically synthesized
gaatttgtaggagtaaggaggt

SEQ ID NO: 1283552 - DNA, 22 bp, Artificial Sequence
  chemically synthesized
gtaggagtaaggaggtaacact

SEQ ID NO: 1283553 - DNA, 22 bp, Artificial Sequence
  chemically synthesized
taggagtaaggaggtaacactt

SEQ ID NO: 1283554 - DNA, 22 bp, Artificial Sequence
  chemically synthesized
aacaaagtagatttaaagtgtt

SEQ ID NO: 1283555 - DNA, 22 bp, Artificial Sequence
  chemically synthesized
tgaacaaagtagatttaaagtg

SEQ ID NO: 1283556 - DNA, 22 bp, Artificial Sequence
  chemically synthesized
cagcgagaagcagctctgaaca

SEQ ID NO: 1283557 - DNA, 22 bp, Artificial Sequence
  chemically synthesized
taaatctactttgttcagagct

SEQ ID NO: 1283558 - DNA, 22 bp, Artificial Sequence
  chemically synthesized
ccagcgagaagcagctctgaac

SEQ ID NO: 1283559 - DNA, 22 bp, Artificial Sequence
  chemically synthesized
aaatctactttgttcagagctg

SEQ ID NO: 1283560 - DNA, 22 bp, Artificial Sequence
  chemically synthesized
aatctactttgttcagagctgc

SEQ ID NO: 1283561 - DNA, 22 bp, Artificial Sequence
  chemically synthesized
ctttgttcagagctgcttctcg

SEQ ID NO: 1283562 - DNA, 22 bp, Artificial Sequence
  chemically synthesized
aaaggtttccagcgagaagcag

SEQ ID NO: 1283563 - DNA, 22 bp, Artificial Sequence
  chemically synthesized
aaaaggtttccagcgagaagca

SEQ ID NO: 1283564 - DNA, 22 bp, Artificial Sequence
  chemically synthesized
tgttcagagctgcttctcgctg

SEQ ID NO: 1283565 - DNA, 22 bp, Artificial Sequence
  chemically synthesized
gttcagagctgcttctcgctgg

SEQ ID NO: 1283566 - DNA, 22 bp, Artificial Sequence
  chemically synthesized
cttaaaaggtttccagcgagaa

SEQ ID NO: 1283567 - DNA, 22 bp, Artificial Sequence
  chemically synthesized
ttcagagctgcttctcgctgga

SEQ ID NO: 1283568 - DNA, 22 bp, Artificial Sequence
  chemically synthesized
agagctgcttctcgctggaaac

SEQ ID NO: 1283569 - DNA, 22 bp, Artificial Sequence
  chemically synthesized
cttctcgctggaaaccttttaa

SEQ ID NO: 1283570 - DNA, 22 bp, Artificial Sequence
  chemically synthesized
ctcgctggaaaccttttaagta

SEQ ID NO: 1283571 - DNA, 22 bp, Artificial Sequence
  chemically synthesized
tcgctggaaaccttttaagtag

SEQ ID NO: 1283572 - DNA, 22 bp, Artificial Sequence
  chemically synthesized
gctggaaaccttttaagtagtg

SEQ ID NO: 1283573 - DNA, 22 bp, Artificial Sequence
  chemically synthesized
gaaaccttttaagtagtgtttg

SEQ ID NO: 1283574 - DNA, 22 bp, Artificial Sequence
  chemically synthesized
ggagaaaaggtgatacaaacac

SEQ ID NO: 1283575 - DNA, 22 bp, Artificial Sequence
  chemically synthesized
ttaagtagtgtttgtatcacct

SEQ ID NO: 1283576 - DNA, 22 bp, Artificial Sequence
  chemically synthesized
taagtagtgtttgtatcacctt

SEQ ID NO: 1283577 - DNA, 22 bp, Artificial Sequence
  chemically synthesized
aagtagtgtttgtatcaccttt

SEQ ID NO: 1283578 - DNA, 22 bp, Artificial Sequence
  chemically synthesized
agtagtgtttgtatcacctttt

SEQ ID NO: 1283579 - DNA, 22 bp, Artificial Sequence
  chemically synthesized
tgtaagtgctaggagaaaaggt

SEQ ID NO: 1283580 - DNA, 22 bp, Artificial Sequence
  chemically synthesized
gtatcaccttttctcctagcac

SEQ ID NO: 1283581 - DNA, 22 bp, Artificial Sequence
  chemically synthesized
tatcaccttttctcctagcact

SEQ ID NO: 1283582 - DNA, 22 bp, Artificial Sequence
  chemically synthesized
cacaagcagtacactatgtaag

SEQ ID NO: 1283583 - DNA, 22 bp, Artificial Sequence
  chemically synthesized
ttctcctagcacttacatagtg

SEQ ID NO: 1283584 - DNA, 22 bp, Artificial Sequence
  chemically synthesized
tctcctagcacttacatagtgt

SEQ ID NO: 1283585 - DNA, 22 bp, Artificial Sequence
  chemically synthesized
ctcctagcacttacatagtgta

SEQ ID NO: 1283586 - DNA, 22 bp, Artificial Sequence
  chemically synthesized
tcctagcacttacatagtgtac

SEQ ID NO: 1283587 - DNA, 22 bp, Artificial Sequence
  chemically synthesized
attacacaagcagtacactatg

SEQ ID NO: 1283588 - DNA, 22 bp, Artificial Sequence
  chemically synthesized
ctagcacttacatagtgtactg

SEQ ID NO: 1283589 - DNA, 22 bp, Artificial Sequence
  chemically synthesized
gcacttacatagtgtactgctt

SEQ ID NO: 1283590 - DNA, 22 bp, Artificial Sequence
  chemically synthesized
acatagtgtactgcttgtgtaa

SEQ ID NO: 1283591 - DNA, 22 bp, Artificial Sequence
  chemically synthesized
catagtgtactgcttgtgtaat

SEQ ID NO: 1283592 - DNA, 22 bp, Artificial Sequence
  chemically synthesized
tccatggagttaattacacaag

SEQ ID NO: 1283593 - DNA, 22 bp, Artificial Sequence
  chemically synthesized
atccatggagttaattacacaa

SEQ ID NO: 1283594 - DNA, 22 bp, Artificial Sequence
  chemically synthesized
tatccatggagttaattacaca

SEQ ID NO: 1283595 - DNA, 22 bp, Artificial Sequence
  chemically synthesized
tttatccatggagttaattaca

SEQ ID NO: 1283596 - DNA, 22 bp, Artificial Sequence
  chemically synthesized
ctttatccatggagttaattac

SEQ ID NO: 1283597 - DNA, 22 bp, Artificial Sequence
  chemically synthesized
cttgtgtaattaactccatgga

SEQ ID NO: 1283598 - DNA, 22 bp, Artificial Sequence
  chemically synthesized
gtgtaattaactccatggataa

SEQ ID NO: 1283599 - DNA, 22 bp, Artificial Sequence
  chemically synthesized
tgtaattaactccatggataaa

SEQ ID NO: 1283600 - DNA, 22 bp, Artificial Sequence
  chemically synthesized
actccatggataaagaaatatc

SEQ ID NO: 1283601 - DNA, 22 bp, Artificial Sequence
  chemically synthesized
catggataaagaaatatccttc

SEQ ID NO: 1283602 - DNA, 22 bp, Artificial Sequence
  chemically synthesized
gtaaatggaaggggaaggatat

SEQ ID NO: 1283603 - DNA, 22 bp, Artificial Sequence
  chemically synthesized
aaaagctagtaaatggaagggg

SEQ ID NO: 1283604 - DNA, 22 bp, Artificial Sequence
  chemically synthesized
ttaaaaagctagtaaatggaag

SEQ ID NO: 1283605 - DNA, 22 bp, Artificial Sequence
  chemically synthesized
cactattaaaaagctagtaaat

SEQ ID NO: 1283606 - DNA, 22 bp, Artificial Sequence
  chemically synthesized
ccccttccatttactagctttt

SEQ ID NO: 1283607 - DNA, 22 bp, Artificial Sequence
  chemically synthesized
cccttccatttactagcttttt

SEQ ID NO: 1283608 - DNA, 22 bp, Artificial Sequence
  chemically synthesized
aagctgcactattaaaaagcta

SEQ ID NO: 1283609 - DNA, 22 bp, Artificial Sequence
  chemically synthesized
ccatttactagctttttaatag

SEQ ID NO: 1283610 - DNA, 22 bp, Artificial Sequence
  chemically synthesized
catttactagctttttaatagt

SEQ ID NO: 1283611 - DNA, 22 bp, Artificial Sequence
  chemically synthesized
actagctttttaatagtgcagc

SEQ ID NO: 1283612 - DNA, 22 bp, Artificial Sequence
  chemically synthesized
ctagctttttaatagtgcagct

SEQ ID NO: 1283613 - DNA, 22 bp, Artificial Sequence
  chemically synthesized
gtggaagacctgaagctgcact

SEQ ID NO: 1283614 - DNA, 22 bp, Artificial Sequence
  chemically synthesized
gctttttaatagtgcagcttca

SEQ ID NO: 1283615 - DNA, 22 bp, Artificial Sequence
  chemically synthesized
tagtggaagacctgaagctgca

SEQ ID NO: 1283616 - DNA, 22 bp, Artificial Sequence
  chemically synthesized
ctagtggaagacctgaagctgc

SEQ ID NO: 1283617 - DNA, 22 bp, Artificial Sequence
  chemically synthesized
tttaatagtgcagcttcaggtc

SEQ ID NO: 1283618 - DNA, 22 bp, Artificial Sequence
  chemically synthesized
ttaatagtgcagcttcaggtct

SEQ ID NO: 1283619 - DNA, 22 bp, Artificial Sequence
  chemically synthesized
taatagtgcagcttcaggtctt

SEQ ID NO: 1283620 - DNA, 22 bp, Artificial Sequence
  chemically synthesized
aatagtgcagcttcaggtcttc

SEQ ID NO: 1283621 - DNA, 22 bp, Artificial Sequence
  chemically synthesized
atatttctagtggaagacctga

SEQ ID NO: 1283622 - DNA, 22 bp, Artificial Sequence
  chemically synthesized
atagtgcagcttcaggtcttcc

SEQ ID NO: 1283623 - DNA, 22 bp, Artificial Sequence
  chemically synthesized
taatatttctagtggaagacct

SEQ ID NO: 1283624 - DNA, 22 bp, Artificial Sequence
  chemically synthesized
caggtcttccactagaaatatt

SEQ ID NO: 1283625 - DNA, 22 bp, Artificial Sequence
  chemically synthesized
agtgacaattctaatatttcta

SEQ ID NO: 1283626 - DNA, 22 bp, Artificial Sequence
  chemically synthesized
aggtcttccactagaaatatta

SEQ ID NO: 1283627 - DNA, 22 bp, Artificial Sequence
  chemically synthesized
aaaattaagtgacaattctaat

SEQ ID NO: 1283628 - DNA, 22 bp, Artificial Sequence
  chemically synthesized
ccactagaaatattagaattgt

SEQ ID NO: 1283629 - DNA, 22 bp, Artificial Sequence
  chemically synthesized
cactagaaatattagaattgtc

SEQ ID NO: 1283630 - DNA, 22 bp, Artificial Sequence
  chemically synthesized
gaaatattagaattgtcactta

SEQ ID NO: 1283631 - DNA, 22 bp, Artificial Sequence
  chemically synthesized
aatatcgggaggttgaaaatta

SEQ ID NO: 1283632 - DNA, 22 bp, Artificial Sequence
  chemically synthesized
gaattgtcacttaattttcaac

SEQ ID NO: 1283633 - DNA, 22 bp, Artificial Sequence
  chemically synthesized
aattaaatatcgggaggttgaa

SEQ ID NO: 1283634 - DNA, 22 bp, Artificial Sequence
  chemically synthesized
caattaaatatcgggaggttga

SEQ ID NO: 1283635 - DNA, 22 bp, Artificial Sequence
  chemically synthesized
tcacttaattttcaacctcccg

SEQ ID NO: 1283636 - DNA, 22 bp, Artificial Sequence
  chemically synthesized
tcaattaaatatcgggaggttg

SEQ ID NO: 1283637 - DNA, 22 bp, Artificial Sequence
  chemically synthesized
aattttcaacctcccgatattt

SEQ ID NO: 1283638 - DNA, 22 bp, Artificial Sequence
  chemically synthesized
attttcaacctcccgatattta

SEQ ID NO: 1283639 - DNA, 22 bp, Artificial Sequence
  chemically synthesized
tacatctttcaattaaatatcg

SEQ ID NO: 1283640 - DNA, 22 bp, Artificial Sequence
  chemically synthesized
tcaacctcccgatatttaattg

SEQ ID NO: 1283641 - DNA, 22 bp, Artificial Sequence
  chemically synthesized
caacctcccgatatttaattga

SEQ ID NO: 1283642 - DNA, 22 bp, Artificial Sequence
  chemically synthesized
aacctcccgatatttaattgaa

SEQ ID NO: 1283643 - DNA, 22 bp, Artificial Sequence
  chemically synthesized
tattgtacatctttcaattaaa

SEQ ID NO: 1283644 - DNA, 22 bp, Artificial Sequence
  chemically synthesized
aattatattgtacatctttcaa

SEQ ID NO: 1283645 - DNA, 22 bp, Artificial Sequence
  chemically synthesized
ccgatatttaattgaaagatgt

SEQ ID NO: 1283646 - DNA, 22 bp, Artificial Sequence
  chemically synthesized
aaattatattgtacatctttca

SEQ ID NO: 1283647 - DNA, 22 bp, Artificial Sequence
  chemically synthesized
taaattatattgtacatctttc

SEQ ID NO: 1283648 - DNA, 22 bp, Artificial Sequence
  chemically synthesized
ttaaattatattgtacatcttt

SEQ ID NO: 1283649 - DNA, 22 bp, Artificial Sequence
  chemically synthesized
aattgaaagatgtacaatataa

SEQ ID NO: 1283650 - DNA, 22 bp, Artificial Sequence
  chemically synthesized
attgaaagatgtacaatataat

SEQ ID NO: 1283651 - DNA, 22 bp, Artificial Sequence
  chemically synthesized
aaagatgtacaatataatttaa

SEQ ID NO: 1283652 - DNA, 22 bp, Artificial Sequence
  chemically synthesized
tgggtaggtaccttttaaatta

SEQ ID NO: 1283653 - DNA, 22 bp, Artificial Sequence
  chemically synthesized
ccctatgggtaggtacctttta

SEQ ID NO: 1283654 - DNA, 22 bp, Artificial Sequence
  chemically synthesized
gttgccctatgggtaggtacct

SEQ ID NO: 1283655 - DNA, 22 bp, Artificial Sequence
  chemically synthesized
agaattagttgccctatgggta

SEQ ID NO: 1283656 - DNA, 22 bp, Artificial Sequence
  chemically synthesized
cagaattagttgccctatgggt

SEQ ID NO: 1283657 - DNA, 22 bp, Artificial Sequence
  chemically synthesized
aaaaggtacctacccatagggc

SEQ ID NO: 1283658 - DNA, 22 bp, Artificial Sequence
  chemically synthesized
tcagaattagttgccctatggg

SEQ ID NO: 1283659 - DNA, 22 bp, Artificial Sequence
  chemically synthesized
aaaggtacctacccatagggca

SEQ ID NO: 1283660 - DNA, 22 bp, Artificial Sequence
  chemically synthesized
tcacccgttttcagaattagtt

SEQ ID NO: 1283661 - DNA, 22 bp, Artificial Sequence
  chemically synthesized
atcacccgttttcagaattagt

SEQ ID NO: 1283662 - DNA, 22 bp, Artificial Sequence
  chemically synthesized
cccatagggcaactaattctga

SEQ ID NO: 1283663 - DNA, 22 bp, Artificial Sequence
  chemically synthesized
acttatcacccgttttcagaat

SEQ ID NO: 1283664 - DNA, 22 bp, Artificial Sequence
  chemically synthesized
ttcacttatcacccgttttcag

SEQ ID NO: 1283665 - DNA, 22 bp, Artificial Sequence
  chemically synthesized
attcacttatcacccgttttca

SEQ ID NO: 1283666 - DNA, 22 bp, Artificial Sequence
  chemically synthesized
tattcacttatcacccgttttc

SEQ ID NO: 1283667 - DNA, 22 bp, Artificial Sequence
  chemically synthesized
ctttattcacttatcacccgtt

SEQ ID NO: 1283668 - DNA, 22 bp, Artificial Sequence
  chemically synthesized
cctttattcacttatcacccgt

SEQ ID NO: 1283669 - DNA, 22 bp, Artificial Sequence
  chemically synthesized
attctgaaaacgggtgataagt

SEQ ID NO: 1283670 - DNA, 22 bp, Artificial Sequence
  chemically synthesized
tgaaaacgggtgataagtgaat

SEQ ID NO: 1283671 - DNA, 22 bp, Artificial Sequence
  chemically synthesized
aaaacgggtgataagtgaataa

SEQ ID NO: 1283672 - DNA, 22 bp, Artificial Sequence
  chemically synthesized
agcatacttcctttattcactt

SEQ ID NO: 1283673 - DNA, 22 bp, Artificial Sequence
  chemically synthesized
cgaaagcatgaaaatgaaatta

SEQ ID NO: 1283674 - DNA, 22 bp, Artificial Sequence
  chemically synthesized
aatttcattttcatgctttcgc

SEQ ID NO: 1283675 - DNA, 22 bp, Artificial Sequence
  chemically synthesized
atttcattttcatgctttcgca

SEQ ID NO: 1283676 - DNA, 22 bp, Artificial Sequence
  chemically synthesized
cattttcatgctttcgcagttt

SEQ ID NO: 1283677 - DNA, 22 bp, Artificial Sequence
  chemically synthesized
attttcatgctttcgcagtttc

SEQ ID NO: 1283678 - DNA, 22 bp, Artificial Sequence
  chemically synthesized
tcaatataagatagaaactgcg

SEQ ID NO: 1283679 - DNA, 22 bp, Artificial Sequence
  chemically synthesized
atcaatataagatagaaactgc

SEQ ID NO: 1283680 - DNA, 22 bp, Artificial Sequence
  chemically synthesized
tatcaatataagatagaaactg

SEQ ID NO: 1283681 - DNA, 22 bp, Artificial Sequence
  chemically synthesized
tcatgctttcgcagtttctatc

SEQ ID NO: 1283682 - DNA, 22 bp, Artificial Sequence
  chemically synthesized
catgctttcgcagtttctatct

SEQ ID NO: 1283683 - DNA, 22 bp, Artificial Sequence
  chemically synthesized
tttatcaatataagatagaaac

SEQ ID NO: 1283684 - DNA, 22 bp, Artificial Sequence
  chemically synthesized
atgctttcgcagtttctatctt

SEQ ID NO: 1283685 - DNA, 22 bp, Artificial Sequence
  chemically synthesized
ctttatcaatataagatagaaa

SEQ ID NO: 1283686 - DNA, 22 bp, Artificial Sequence
  chemically synthesized
tcgcagtttctatcttatattg

SEQ ID NO: 1283687 - DNA, 22 bp, Artificial Sequence
  chemically synthesized
ggatttctttatcaatataaga

SEQ ID NO: 1283688 - DNA, 22 bp, Artificial Sequence
  chemically synthesized
cgcagtttctatcttatattga

SEQ ID NO: 1283689 - DNA, 22 bp, Artificial Sequence
  chemically synthesized
aggatttctttatcaatataag

SEQ ID NO: 1283690 - DNA, 22 bp, Artificial Sequence
  chemically synthesized
gcagtttctatcttatattgat

SEQ ID NO: 1283691 - DNA, 22 bp, Artificial Sequence
  chemically synthesized
ctatcttatattgataaagaaa

SEQ ID NO: 1283692 - DNA, 22 bp, Artificial Sequence
  chemically synthesized
tatcttatattgataaagaaat

SEQ ID NO: 1283693 - DNA, 22 bp, Artificial Sequence
  chemically synthesized
tcttatattgataaagaaatcc

SEQ ID NO: 1283694 - DNA, 22 bp, Artificial Sequence
  chemically synthesized
atattgataaagaaatcctaag

SEQ ID NO: 1283695 - DNA, 22 bp, Artificial Sequence
  chemically synthesized
tattgataaagaaatcctaagc

SEQ ID NO: 1283696 - DNA, 22 bp, Artificial Sequence
  chemically synthesized
tacagatgtagagcttaggatt

SEQ ID NO: 1283697 - DNA, 22 bp, Artificial Sequence
  chemically synthesized
atacagatgtagagcttaggat

SEQ ID NO: 1283698 - DNA, 22 bp, Artificial Sequence
  chemically synthesized
ttatacagatgtagagcttagg

SEQ ID NO: 1283699 - DNA, 22 bp, Artificial Sequence
  chemically synthesized
ataaagaaatcctaagctctac

SEQ ID NO: 1283700 - DNA, 22 bp, Artificial Sequence
  chemically synthesized
agctctacatctgtataagaat

SEQ ID NO: 1283701 - DNA, 22 bp, Artificial Sequence
  chemically synthesized
aaaggatgatacattcttatac

SEQ ID NO: 1283702 - DNA, 22 bp, Artificial Sequence
  chemically synthesized
tacatctgtataagaatgtatc

SEQ ID NO: 1283703 - DNA, 22 bp, Artificial Sequence
  chemically synthesized
catctgtataagaatgtatcat

SEQ ID NO: 1283704 - DNA, 22 bp, Artificial Sequence
  chemically synthesized
tataagaatgtatcatcctttc

SEQ ID NO: 1283705 - DNA, 22 bp, Artificial Sequence
  chemically synthesized
tatagatacaagtatattgaaa

SEQ ID NO: 1283706 - DNA, 22 bp, Artificial Sequence
  chemically synthesized
atatagatacaagtatattgaa

SEQ ID NO: 1283707 - DNA, 22 bp, Artificial Sequence
  chemically synthesized
tatatagatacaagtatattga

SEQ ID NO: 1283708 - DNA, 22 bp, Artificial Sequence
  chemically synthesized
cattttatatagatacaagtat

SEQ ID NO: 1283709 - DNA, 22 bp, Artificial Sequence
  chemically synthesized
tcaatatacttgtatctatata

SEQ ID NO: 1283710 - DNA, 22 bp, Artificial Sequence
  chemically synthesized
caatatacttgtatctatataa

SEQ ID NO: 1283711 - DNA, 22 bp, Artificial Sequence
  chemically synthesized
aatatacttgtatctatataaa

SEQ ID NO: 1283712 - DNA, 22 bp, Artificial Sequence
  chemically synthesized
gtatctatataaaatgcagatg

SEQ ID NO: 1283713 - DNA, 22 bp, Artificial Sequence
  chemically synthesized
tatctatataaaatgcagatgt

SEQ ID NO: 1283714 - DNA, 22 bp, Artificial Sequence
  chemically synthesized
tataaaatgcagatgtgtatat

SEQ ID NO: 1283715 - DNA, 22 bp, Artificial Sequence
  chemically synthesized
tgcatgtgtgtatgcacacaca

SEQ ID NO: 1283716 - DNA, 22 bp, Artificial Sequence
  chemically synthesized
tagctgtgcatgtgtgtatgca

SEQ ID NO: 1283717 - DNA, 22 bp, Artificial Sequence
  chemically synthesized
tatagctgtgcatgtgtgtatg

SEQ ID NO: 1283718 - DNA, 22 bp, Artificial Sequence
  chemically synthesized
ttgtgtgtgcatacacacatgc

SEQ ID NO: 1283719 - DNA, 22 bp, Artificial Sequence
  chemically synthesized
gtgtgtgcatacacacatgcac

SEQ ID NO: 1283720 - DNA, 22 bp, Artificial Sequence
  chemically synthesized
tattctatagctgtgcatgtgt

SEQ ID NO: 1283721 - DNA, 22 bp, Artificial Sequence
  chemically synthesized
tgtgtgcatacacacatgcaca

SEQ ID NO: 1283722 - DNA, 22 bp, Artificial Sequence
  chemically synthesized
aaatatctatattctatagctg

SEQ ID NO: 1283723 - DNA, 22 bp, Artificial Sequence
  chemically synthesized
aattaaaatatctatattctat

SEQ ID NO: 1283724 - DNA, 22 bp, Artificial Sequence
  chemically synthesized
tctaaattaaaatatctatatt

SEQ ID NO: 1283725 - DNA, 22 bp, Artificial Sequence
  chemically synthesized
aaattatctaaattaaaatatc

SEQ ID NO: 1283726 - DNA, 22 bp, Artificial Sequence
  chemically synthesized
tagaatatagatattttaattt

SEQ ID NO: 1283727 - DNA, 22 bp, Artificial Sequence
  chemically synthesized
tgtaaagtcctaaaattatcta

SEQ ID NO: 1283728 - DNA, 22 bp, Artificial Sequence
  chemically synthesized
atgtaaagtcctaaaattatct

SEQ ID NO: 1283729 - DNA, 22 bp, Artificial Sequence
  chemically synthesized
tatgtaaagtcctaaaattatc

SEQ ID NO: 1283730 - DNA, 22 bp, Artificial Sequence
  chemically synthesized
attttatgtaaagtcctaaaat

SEQ ID NO: 1283731 - DNA, 22 bp, Artificial Sequence
  chemically synthesized
taatttagataattttaggact

SEQ ID NO: 1283732 - DNA, 22 bp, Artificial Sequence
  chemically synthesized
aatttagataattttaggactt

SEQ ID NO: 1283733 - DNA, 22 bp, Artificial Sequence
  chemically synthesized
atttagataattttaggacttt

SEQ ID NO: 1283734 - DNA, 22 bp, Artificial Sequence
  chemically synthesized
agataattttaggactttacat

SEQ ID NO: 1283735 - DNA, 22 bp, Artificial Sequence
  chemically synthesized
gataattttaggactttacata

SEQ ID NO: 1283736 - DNA, 22 bp, Artificial Sequence
  chemically synthesized
taggactttacataaaatgaat

SEQ ID NO: 1283737 - DNA, 22 bp, Artificial Sequence
  chemically synthesized
aggactttacataaaatgaatc

SEQ ID NO: 1283738 - DNA, 22 bp, Artificial Sequence
  chemically synthesized
ggactttacataaaatgaatca

SEQ ID NO: 1283739 - DNA, 22 bp, Artificial Sequence
  chemically synthesized
tacataaaatgaatcacatatg

SEQ ID NO: 1283740 - DNA, 22 bp, Artificial Sequence
  chemically synthesized
acataaaatgaatcacatatgc

SEQ ID NO: 1283741 - DNA, 22 bp, Artificial Sequence
  chemically synthesized
cataaaatgaatcacatatgca

SEQ ID NO: 1283742 - DNA, 22 bp, Artificial Sequence
  chemically synthesized
gggaaaacatcataatagtgca

SEQ ID NO: 1283743 - DNA, 22 bp, Artificial Sequence
  chemically synthesized
cattggggaaaacatcataata

SEQ ID NO: 1283744 - DNA, 22 bp, Artificial Sequence
  chemically synthesized
gcattggggaaaacatcataat

SEQ ID NO: 1283745 - DNA, 22 bp, Artificial Sequence
  chemically synthesized
tcttgcattggggaaaacatca

SEQ ID NO: 1283746 - DNA, 22 bp, Artificial Sequence
  chemically synthesized
ttatgatgttttccccaatgca

SEQ ID NO: 1283747 - DNA, 22 bp, Artificial Sequence
  chemically synthesized
gaaaatattatcttgcattggg

SEQ ID NO: 1283748 - DNA, 22 bp, Artificial Sequence
  chemically synthesized
agaaaatattatcttgcattgg

SEQ ID NO: 1283749 - DNA, 22 bp, Artificial Sequence
  chemically synthesized
tgatgttttccccaatgcaaga

SEQ ID NO: 1283750 - DNA, 22 bp, Artificial Sequence
  chemically synthesized
aaatcttagaaaatattatctt

SEQ ID NO: 1283751 - DNA, 22 bp, Artificial Sequence
  chemically synthesized
tccccaatgcaagataatattt

SEQ ID NO: 1283752 - DNA, 22 bp, Artificial Sequence
  chemically synthesized
ccccaatgcaagataatatttt

SEQ ID NO: 1283753 - DNA, 22 bp, Artificial Sequence
  chemically synthesized
cccaatgcaagataatattttc

SEQ ID NO: 1283754 - DNA, 22 bp, Artificial Sequence
  chemically synthesized
tgtctaaaatcttagaaaatat

SEQ ID NO: 1283755 - DNA, 22 bp, Artificial Sequence
  chemically synthesized
atgtctaaaatcttagaaaata

SEQ ID NO: 1283756 - DNA, 22 bp, Artificial Sequence
  chemically synthesized
tctaagattttagacataagat

SEQ ID NO: 1283757 - DNA, 22 bp, Artificial Sequence
  chemically synthesized
ctaagattttagacataagatg

SEQ ID NO: 1283758 - DNA, 22 bp, Artificial Sequence
  chemically synthesized
taagattttagacataagatgt

SEQ ID NO: 1283759 - DNA, 22 bp, Artificial Sequence
  chemically synthesized
tacatgataaaatacatcttat

SEQ ID NO: 1283760 - DNA, 22 bp, Artificial Sequence
  chemically synthesized
agattttagacataagatgtat

SEQ ID NO: 1283761 - DNA, 22 bp, Artificial Sequence
  chemically synthesized
tagacataagatgtattttatc

SEQ ID NO: 1283762 - DNA, 22 bp, Artificial Sequence
  chemically synthesized
agacataagatgtattttatca

SEQ ID NO: 1283763 - DNA, 22 bp, Artificial Sequence
  chemically synthesized
gacataagatgtattttatcat

SEQ ID NO: 1283764 - DNA, 22 bp, Artificial Sequence
  chemically synthesized
gagtgcattgtacatgataaaa

SEQ ID NO: 1283765 - DNA, 22 bp, Artificial Sequence
  chemically synthesized
agagtgcattgtacatgataaa

SEQ ID NO: 1283766 - DNA, 22 bp, Artificial Sequence
  chemically synthesized
tagagtgcattgtacatgataa

SEQ ID NO: 1283767 - DNA, 22 bp, Artificial Sequence
  chemically synthesized
gtaagttttagagtgcattgta

SEQ ID NO: 1283768 - DNA, 22 bp, Artificial Sequence
  chemically synthesized
ggtaagttttagagtgcattgt

SEQ ID NO: 1283769 - DNA, 22 bp, Artificial Sequence
  chemically synthesized
tatcatgtacaatgcactctaa

SEQ ID NO: 1283770 - DNA, 22 bp, Artificial Sequence
  chemically synthesized
atcatgtacaatgcactctaaa

SEQ ID NO: 1283771 - DNA, 22 bp, Artificial Sequence
  chemically synthesized
tcatgtacaatgcactctaaaa

SEQ ID NO: 1283772 - DNA, 22 bp, Artificial Sequence
  chemically synthesized
taaatggaaacttggtaagttt

SEQ ID NO: 1283773 - DNA, 22 bp, Artificial Sequence
  chemically synthesized
gtaaatggaaacttggtaagtt

SEQ ID NO: 1283774 - DNA, 22 bp, Artificial Sequence
  chemically synthesized
ccttgtaaatggaaacttggta

SEQ ID NO: 1283775 - DNA, 22 bp, Artificial Sequence
  chemically synthesized
cccttgtaaatggaaacttggt

SEQ ID NO: 1283776 - DNA, 22 bp, Artificial Sequence
  chemically synthesized
tcccttgtaaatggaaacttgg

SEQ ID NO: 1283777 - DNA, 22 bp, Artificial Sequence
  chemically synthesized
taaaacttaccaagtttccatt

SEQ ID NO: 1283778 - DNA, 22 bp, Artificial Sequence
  chemically synthesized
aaacttaccaagtttccattta

SEQ ID NO: 1283779 - DNA, 22 bp, Artificial Sequence
  chemically synthesized
atcgttttcccttgtaaatgga

SEQ ID NO: 1283780 - DNA, 22 bp, Artificial Sequence
  chemically synthesized
aatcgttttcccttgtaaatgg

SEQ ID NO: 1283781 - DNA, 22 bp, Artificial Sequence
  chemically synthesized
taatcgttttcccttgtaaatg

SEQ ID NO: 1283782 - DNA, 22 bp, Artificial Sequence
  chemically synthesized
accaagtttccatttacaaggg

SEQ ID NO: 1283783 - DNA, 22 bp, Artificial Sequence
  chemically synthesized
ccaagtttccatttacaaggga

SEQ ID NO: 1283784 - DNA, 22 bp, Artificial Sequence
  chemically synthesized
tggttttaatcgttttcccttg

SEQ ID NO: 1283785 - DNA, 22 bp, Artificial Sequence
  chemically synthesized
gtggttttaatcgttttccctt

SEQ ID NO: 1283786 - DNA, 22 bp, Artificial Sequence
  chemically synthesized
ccatttacaagggaaaacgatt

SEQ ID NO: 1283787 - DNA, 22 bp, Artificial Sequence
  chemically synthesized
catttacaagggaaaacgatta

SEQ ID NO: 1283788 - DNA, 22 bp, Artificial Sequence
  chemically synthesized
tagcaatttgtggttttaatcg

SEQ ID NO: 1283789 - DNA, 22 bp, Artificial Sequence
  chemically synthesized
acaagggaaaacgattaaaacc

SEQ ID NO: 1283790 - DNA, 22 bp, Artificial Sequence
  chemically synthesized
caagggaaaacgattaaaacca

SEQ ID NO: 1283791 - DNA, 22 bp, Artificial Sequence
  chemically synthesized
actatagcaatttgtggtttta

SEQ ID NO: 1283792 - DNA, 22 bp, Artificial Sequence
  chemically synthesized
aactatagcaatttgtggtttt

SEQ ID NO: 1283793 - DNA, 22 bp, Artificial Sequence
  chemically synthesized
ttaactatagcaatttgtggtt

SEQ ID NO: 1283794 - DNA, 22 bp, Artificial Sequence
  chemically synthesized
aaaccacaaattgctatagtta

SEQ ID NO: 1283795 - DNA, 22 bp, Artificial Sequence
  chemically synthesized
ctatagttaagagtttgggatt

SEQ ID NO: 1283796 - DNA, 22 bp, Artificial Sequence
  chemically synthesized
tagttaagagtttgggattatt

SEQ ID NO: 1283797 - DNA, 22 bp, Artificial Sequence
  chemically synthesized
taaaataaaataaaataatccc

SEQ ID NO: 1283798 - DNA, 22 bp, Artificial Sequence
  chemically synthesized
gtaaaataaaataaaataatcc

SEQ ID NO: 1283799 - DNA, 22 bp, Artificial Sequence
  chemically synthesized
agagtttgggattattttattt

SEQ ID NO: 1283800 - DNA, 22 bp, Artificial Sequence
  chemically synthesized
atttgtaaaataaaataaaata

SEQ ID NO: 1283801 - DNA, 22 bp, Artificial Sequence
  chemically synthesized
tcatttgtaaaataaaataaaa

SEQ ID NO: 1283802 - DNA, 22 bp, Artificial Sequence
  chemically synthesized
gggattattttattttatttta

SEQ ID NO: 1283803 - DNA, 22 bp, Artificial Sequence
  chemically synthesized
ggattattttattttattttac

SEQ ID NO: 1283804 - DNA, 22 bp, Artificial Sequence
  chemically synthesized
ttttattttattttacaaatga

SEQ ID NO: 1283805 - DNA, 22 bp, Artificial Sequence
  chemically synthesized
agaaatgaatgctctcatttgt

SEQ ID NO: 1283806 - DNA, 22 bp, Artificial Sequence
  chemically synthesized
tattttattttacaaatgagag

SEQ ID NO: 1283807 - DNA, 22 bp, Artificial Sequence
  chemically synthesized
attttattttacaaatgagagc

SEQ ID NO: 1283808 - DNA, 22 bp, Artificial Sequence
  chemically synthesized
ttttattttacaaatgagagca

SEQ ID NO: 1283809 - DNA, 22 bp, Artificial Sequence
  chemically synthesized
tattttacaaatgagagcattc

SEQ ID NO: 1283810 - DNA, 22 bp, Artificial Sequence
  chemically synthesized
attttacaaatgagagcattca

SEQ ID NO: 1283811 - DNA, 22 bp, Artificial Sequence
  chemically synthesized
ttttacaaatgagagcattcat

SEQ ID NO: 1283812 - DNA, 22 bp, Artificial Sequence
  chemically synthesized
tacaaatgagagcattcatttc

SEQ ID NO: 1283813 - DNA, 22 bp, Artificial Sequence
  chemically synthesized
acaaatgagagcattcatttct

SEQ ID NO: 1283814 - DNA, 22 bp, Artificial Sequence
  chemically synthesized
tggtaggtattcagaaatgaat

SEQ ID NO: 1283815 - DNA, 22 bp, Artificial Sequence
  chemically synthesized
caaatgagagcattcatttctg

SEQ ID NO: 1283816 - DNA, 22 bp, Artificial Sequence
  chemically synthesized
atttctgaatacctaccataac

SEQ ID NO: 1283817 - DNA, 22 bp, Artificial Sequence
  chemically synthesized
ctgaatacctaccataacacat

SEQ ID NO: 1283818 - DNA, 22 bp, Artificial Sequence
  chemically synthesized
acagatgtatgcatgtgttatg

SEQ ID NO: 1283819 - DNA, 22 bp, Artificial Sequence
  chemically synthesized
tgaatacctaccataacacatg

SEQ ID NO: 1283820 - DNA, 22 bp, Artificial Sequence
  chemically synthesized
tgacagatgtatgcatgtgtta

SEQ ID NO: 1283821 - DNA, 22 bp, Artificial Sequence
  chemically synthesized
aatacctaccataacacatgca

SEQ ID NO: 1283822 - DNA, 22 bp, Artificial Sequence
  chemically synthesized
ctgacagatgtatgcatgtgtt

SEQ ID NO: 1283823 - DNA, 22 bp, Artificial Sequence
  chemically synthesized
tctgacagatgtatgcatgtgt

SEQ ID NO: 1283824 - DNA, 22 bp, Artificial Sequence
  chemically synthesized
ttctgacagatgtatgcatgtg

SEQ ID NO: 1283825 - DNA, 22 bp, Artificial Sequence
  chemically synthesized
tttctgacagatgtatgcatgt

SEQ ID NO: 1283826 - DNA, 22 bp, Artificial Sequence
  chemically synthesized
ttttctgacagatgtatgcatg

SEQ ID NO: 1283827 - DNA, 22 bp, Artificial Sequence
  chemically synthesized
tttttctgacagatgtatgcat

SEQ ID NO: 1283828 - DNA, 22 bp, Artificial Sequence
  chemically synthesized
ttttttctgacagatgtatgca

SEQ ID NO: 1283829 - DNA, 22 bp, Artificial Sequence
  chemically synthesized
tttttttctgacagatgtatgc

SEQ ID NO: 1283830 - DNA, 22 bp, Artificial Sequence
  chemically synthesized
ccataacacatgcatacatctg

SEQ ID NO: 1283831 - DNA, 22 bp, Artificial Sequence
  chemically synthesized
aatatgattttttttttctgac

SEQ ID NO: 1283832 - DNA, 22 bp, Artificial Sequence
  chemically synthesized
taaatatgattttttttttctg

SEQ ID NO: 1283833 - DNA, 22 bp, Artificial Sequence
  chemically synthesized
gattctaaatatgatttttttt

SEQ ID NO: 1283834 - DNA, 22 bp, Artificial Sequence
  chemically synthesized
ggattctaaatatgattttttt

SEQ ID NO: 1283835 - DNA, 22 bp, Artificial Sequence
  chemically synthesized
tcagaaaaaaaaaatcatattt

SEQ ID NO: 1283836 - DNA, 22 bp, Artificial Sequence
  chemically synthesized
cgggagtaaacttggattctaa

SEQ ID NO: 1283837 - DNA, 22 bp, Artificial Sequence
  chemically synthesized
tccgggagtaaacttggattct

SEQ ID NO: 1283838 - DNA, 22 bp, Artificial Sequence
  chemically synthesized
aggttctccgggagtaaacttg

SEQ ID NO: 1283839 - DNA, 22 bp, Artificial Sequence
  chemically synthesized
agaatccaagtttactcccgga

SEQ ID NO: 1283840 - DNA, 22 bp, Artificial Sequence
  chemically synthesized
gaatccaagtttactcccggag

SEQ ID NO: 1283841 - DNA, 22 bp, Artificial Sequence
  chemically synthesized
aaataggttaaggttctccggg

SEQ ID NO: 1283842 - DNA, 22 bp, Artificial Sequence
  chemically synthesized
gaaataggttaaggttctccgg

SEQ ID NO: 1283843 - DNA, 22 bp, Artificial Sequence
  chemically synthesized
tgaaataggttaaggttctccg

SEQ ID NO: 1283844 - DNA, 22 bp, Artificial Sequence
  chemically synthesized
ttgaaataggttaaggttctcc

SEQ ID NO: 1283845 - DNA, 22 bp, Artificial Sequence
  chemically synthesized
actcccggagaaccttaaccta

SEQ ID NO: 1283846 - DNA, 22 bp, Artificial Sequence
  chemically synthesized
ctcccggagaaccttaacctat

SEQ ID NO: 1283847 - DNA, 22 bp, Artificial Sequence
  chemically synthesized
ccggagaaccttaacctatttc

SEQ ID NO: 1283848 - DNA, 22 bp, Artificial Sequence
  chemically synthesized
ccaaagatgtttttgaaatagg

SEQ ID NO: 1283849 - DNA, 22 bp, Artificial Sequence
  chemically synthesized
cccaaagatgtttttgaaatag

SEQ ID NO: 1283850 - DNA, 22 bp, Artificial Sequence
  chemically synthesized
acatcttcccaaagatgttttt

SEQ ID NO: 1283851 - DNA, 22 bp, Artificial Sequence
  chemically synthesized
aacctatttcaaaaacatcttt

SEQ ID NO: 1283852 - DNA, 22 bp, Artificial Sequence
  chemically synthesized
acctatttcaaaaacatctttg

SEQ ID NO: 1283853 - DNA, 22 bp, Artificial Sequence
  chemically synthesized
ctgacatcttcccaaagatgtt

SEQ ID NO: 1283854 - DNA, 22 bp, Artificial Sequence
  chemically synthesized
tttcaaaaacatctttgggaag

SEQ ID NO: 1283855 - DNA, 22 bp, Artificial Sequence
  chemically synthesized
caaaaacatctttgggaagatg

SEQ ID NO: 1283856 - DNA, 22 bp, Artificial Sequence
  chemically synthesized
aaaaacatctttgggaagatgt

SEQ ID NO: 1283857 - DNA, 22 bp, Artificial Sequence
  chemically synthesized
tgaaaattcctgacatcttccc

SEQ ID NO: 1283858 - DNA, 22 bp, Artificial Sequence
  chemically synthesized
tgggaagatgtcaggaattttc

SEQ ID NO: 1283859 - DNA, 22 bp, Artificial Sequence
  chemically synthesized
gggaagatgtcaggaattttca

SEQ ID NO: 1283860 - DNA, 22 bp, Artificial Sequence
  chemically synthesized
ggaagatgtcaggaattttcac

SEQ ID NO: 1283861 - DNA, 22 bp, Artificial Sequence
  chemically synthesized
aaatcagaagagtgtaatagaa

SEQ ID NO: 1283862 - DNA, 22 bp, Artificial Sequence
  chemically synthesized
actcaaatcagaagagtgtaat

SEQ ID NO: 1283863 - DNA, 22 bp, Artificial Sequence
  chemically synthesized
tcacaatttctattacactctt

SEQ ID NO: 1283864 - DNA, 22 bp, Artificial Sequence
  chemically synthesized
gactcaaatcagaagagtgtaa

SEQ ID NO: 1283865 - DNA, 22 bp, Artificial Sequence
  chemically synthesized
cacaatttctattacactcttc

SEQ ID NO: 1283866 - DNA, 22 bp, Artificial Sequence
  chemically synthesized
tgactcaaatcagaagagtgta

SEQ ID NO: 1283867 - DNA, 22 bp, Artificial Sequence
  chemically synthesized
acaatttctattacactcttct

SEQ ID NO: 1283868 - DNA, 22 bp, Artificial Sequence
  chemically synthesized
tttgactcaaatcagaagagtg

SEQ ID NO: 1283869 - DNA, 22 bp, Artificial Sequence
  chemically synthesized
ctttgactcaaatcagaagagt

SEQ ID NO: 1283870 - DNA, 22 bp, Artificial Sequence
  chemically synthesized
tctttgactcaaatcagaagag

SEQ ID NO: 1283871 - DNA, 22 bp, Artificial Sequence
  chemically synthesized
ttttctttgactcaaatcagaa

SEQ ID NO: 1283872 - DNA, 22 bp, Artificial Sequence
  chemically synthesized
ctattacactcttctgatttga

SEQ ID NO: 1283873 - DNA, 22 bp, Artificial Sequence
  chemically synthesized
tattacactcttctgatttgag

SEQ ID NO: 1283874 - DNA, 22 bp, Artificial Sequence
  chemically synthesized
ttacactcttctgatttgagtc

SEQ ID NO: 1283875 - DNA, 22 bp, Artificial Sequence
  chemically synthesized
cactcttctgatttgagtcaaa

SEQ ID NO: 1283876 - DNA, 22 bp, Artificial Sequence
  chemically synthesized
aaaattattttctttgactcaa

SEQ ID NO: 1283877 - DNA, 22 bp, Artificial Sequence
  chemically synthesized
ttctgatttgagtcaaagaaaa

SEQ ID NO: 1283878 - DNA, 22 bp, Artificial Sequence
  chemically synthesized
tgttgaaaattattttctttga

SEQ ID NO: 1283879 - DNA, 22 bp, Artificial Sequence
  chemically synthesized
ctgatttgagtcaaagaaaata

SEQ ID NO: 1283880 - DNA, 22 bp, Artificial Sequence
  chemically synthesized
tgatttgagtcaaagaaaataa

SEQ ID NO: 1283881 - DNA, 22 bp, Artificial Sequence
  chemically synthesized
ttatgttgaaaattattttctt

SEQ ID NO: 1283882 - DNA, 22 bp, Artificial Sequence
  chemically synthesized
atttgagtcaaagaaaataatt

SEQ ID NO: 1283883 - DNA, 22 bp, Artificial Sequence
  chemically synthesized
tcctattatgttgaaaattatt

SEQ ID NO: 1283884 - DNA, 22 bp, Artificial Sequence
  chemically synthesized
gagtcaaagaaaataattttca

SEQ ID NO: 1283885 - DNA, 22 bp, Artificial Sequence
  chemically synthesized
agtcaaagaaaataattttcaa

SEQ ID NO: 1283886 - DNA, 22 bp, Artificial Sequence
  chemically synthesized
ggctgtcctattatgttgaaaa

SEQ ID NO: 1283887 - DNA, 22 bp, Artificial Sequence
  chemically synthesized
cctgggctgtcctattatgttg

SEQ ID NO: 1283888 - DNA, 22 bp, Artificial Sequence
  chemically synthesized
gcctccctgggctgtcctatta

SEQ ID NO: 1283889 - DNA, 22 bp, Artificial Sequence
  chemically synthesized
tcaacataataggacagcccag

SEQ ID NO: 1283890 - DNA, 22 bp, Artificial Sequence
  chemically synthesized
aaactcgcctccctgggctgtc

SEQ ID NO: 1283891 - DNA, 22 bp, Artificial Sequence
  chemically synthesized
caacataataggacagcccagg

SEQ ID NO: 1283892 - DNA, 22 bp, Artificial Sequence
  chemically synthesized
aacataataggacagcccaggg

SEQ ID NO: 1283893 - DNA, 22 bp, Artificial Sequence
  chemically synthesized
gctgaaactcgcctccctgggc

SEQ ID NO: 1283894 - DNA, 22 bp, Artificial Sequence
  chemically synthesized
cacagcaactggctgaaactcg

SEQ ID NO: 1283895 - DNA, 22 bp, Artificial Sequence
  chemically synthesized
ccacagcaactggctgaaactc

SEQ ID NO: 1283896 - DNA, 22 bp, Artificial Sequence
  chemically synthesized
tccacagcaactggctgaaact

SEQ ID NO: 1283897 - DNA, 22 bp, Artificial Sequence
  chemically synthesized
ttccacagcaactggctgaaac

SEQ ID NO: 1283898 - DNA, 22 bp, Artificial Sequence
  chemically synthesized
gtttttccacagcaactggctg

SEQ ID NO: 1283899 - DNA, 22 bp, Artificial Sequence
  chemically synthesized
tggtttttccacagcaactggc

SEQ ID NO: 1283900 - DNA, 22 bp, Artificial Sequence
  chemically synthesized
cctctggtttttccacagcaac

SEQ ID NO: 1283901 - DNA, 22 bp, Artificial Sequence
  chemically synthesized
cagccagttgctgtggaaaaac

SEQ ID NO: 1283902 - DNA, 22 bp, Artificial Sequence
  chemically synthesized
agccagttgctgtggaaaaacc

SEQ ID NO: 1283903 - DNA, 22 bp, Artificial Sequence
  chemically synthesized
catgacagcgactgcctctggt

SEQ ID NO: 1283904 - DNA, 22 bp, Artificial Sequence
  chemically synthesized
ctgtggaaaaaccagaggcagt

SEQ ID NO: 1283905 - DNA, 22 bp, Artificial Sequence
  chemically synthesized
tggaaaaaccagaggcagtcgc

SEQ ID NO: 1283906 - DNA, 22 bp, Artificial Sequence
  chemically synthesized
gcagctgcatgacagcgactgc

SEQ ID NO: 1283907 - DNA, 22 bp, Artificial Sequence
  chemically synthesized
tggtgttggcagctgcatgaca

SEQ ID NO: 1283908 - DNA, 22 bp, Artificial Sequence
  chemically synthesized
tcatgcagctgccaacaccaca

SEQ ID NO: 1283909 - DNA, 22 bp, Artificial Sequence
  chemically synthesized
gcaaggcccccaactgtggtgt

SEQ ID NO: 1283910 - DNA, 22 bp, Artificial Sequence
  chemically synthesized
ggcaaggcccccaactgtggtg

SEQ ID NO: 1283911 - DNA, 22 bp, Artificial Sequence
  chemically synthesized
cttggcaaggcccccaactgtg

SEQ ID NO: 1283912 - DNA, 22 bp, Artificial Sequence
  chemically synthesized
tctacttggcaaggcccccaac

SEQ ID NO: 1283913 - DNA, 22 bp, Artificial Sequence
  chemically synthesized
ccaacaccacagttgggggcct

SEQ ID NO: 1283914 - DNA, 22 bp, Artificial Sequence
  chemically synthesized
gcatctgtctacttggcaaggc

SEQ ID NO: 1283915 - DNA, 22 bp, Artificial Sequence
  chemically synthesized
ggcatctgtctacttggcaagg

SEQ ID NO: 1283916 - DNA, 22 bp, Artificial Sequence
  chemically synthesized
tggcatctgtctacttggcaag

SEQ ID NO: 1283917 - DNA, 22 bp, Artificial Sequence
  chemically synthesized
ttttggcatctgtctacttggc

SEQ ID NO: 1283918 - DNA, 22 bp, Artificial Sequence
  chemically synthesized
tgttttggcatctgtctacttg

SEQ ID NO: 1283919 - DNA, 22 bp, Artificial Sequence
  chemically synthesized
ctgttttggcatctgtctactt

SEQ ID NO: 1283920 - DNA, 22 bp, Artificial Sequence
  chemically synthesized
ggggccttgccaagtagacaga

SEQ ID NO: 1283921 - DNA, 22 bp, Artificial Sequence
  chemically synthesized
tctgttttggcatctgtctact

SEQ ID NO: 1283922 - DNA, 22 bp, Artificial Sequence
  chemically synthesized
ttctgttttggcatctgtctac

SEQ ID NO: 1283923 - DNA, 22 bp, Artificial Sequence
  chemically synthesized
tttctgttttggcatctgtcta

SEQ ID NO: 1283924 - DNA, 22 bp, Artificial Sequence
  chemically synthesized
ttttttctgttttggcatctgt

SEQ ID NO: 1283925 - DNA, 22 bp, Artificial Sequence
  chemically synthesized
gccaagtagacagatgccaaaa

SEQ ID NO: 1283926 - DNA, 22 bp, Artificial Sequence
  chemically synthesized
ccaagtagacagatgccaaaac

SEQ ID NO: 1283927 - DNA, 22 bp, Artificial Sequence
  chemically synthesized
gaataagctattttttctgttt

SEQ ID NO: 1283928 - DNA, 22 bp, Artificial Sequence
  chemically synthesized
attggaataagctattttttct

SEQ ID NO: 1283929 - DNA, 22 bp, Artificial Sequence
  chemically synthesized
aacaattaattggaataagcta

SEQ ID NO: 1283930 - DNA, 22 bp, Artificial Sequence
  chemically synthesized
caacaattaattggaataagct

SEQ ID NO: 1283931 - DNA, 22 bp, Artificial Sequence
  chemically synthesized
taggtttcaacaattaattgga

SEQ ID NO: 1283932 - DNA, 22 bp, Artificial Sequence
  chemically synthesized
ataggtttcaacaattaattgg

SEQ ID NO: 1283933 - DNA, 22 bp, Artificial Sequence
  chemically synthesized
tataggtttcaacaattaattg

SEQ ID NO: 1283934 - DNA, 22 bp, Artificial Sequence
  chemically synthesized
cctttataggtttcaacaatta

SEQ ID NO: 1283935 - DNA, 22 bp, Artificial Sequence
  chemically synthesized
acctttataggtttcaacaatt

SEQ ID NO: 1283936 - DNA, 22 bp, Artificial Sequence
  chemically synthesized
tacctttataggtttcaacaat

SEQ ID NO: 1283937 - DNA, 22 bp, Artificial Sequence
  chemically synthesized
attccaattaattgttgaaacc

SEQ ID NO: 1283938 - DNA, 22 bp, Artificial Sequence
  chemically synthesized
ttccaattaattgttgaaacct

SEQ ID NO: 1283939 - DNA, 22 bp, Artificial Sequence
  chemically synthesized
caattaattgttgaaacctata

SEQ ID NO: 1283940 - DNA, 22 bp, Artificial Sequence
  chemically synthesized
attgttgaaacctataaaggta

SEQ ID NO: 1283941 - DNA, 22 bp, Artificial Sequence
  chemically synthesized
ttgaaacctataaaggtaaaac

SEQ ID NO: 1283942 - DNA, 22 bp, Artificial Sequence
  chemically synthesized
aaacctataaaggtaaaacact

SEQ ID NO: 1283943 - DNA, 22 bp, Artificial Sequence
  chemically synthesized
taaaggtaaaacacttcatgtg

SEQ ID NO: 1283944 - DNA, 22 bp, Artificial Sequence
  chemically synthesized
tagtcaggcccacacatgaagt

SEQ ID NO: 1283945 - DNA, 22 bp, Artificial Sequence
  chemically synthesized
tgtagtcaggcccacacatgaa

SEQ ID NO: 1283946 - DNA, 22 bp, Artificial Sequence
  chemically synthesized
catgtgtgggcctgactacaga

SEQ ID NO: 1283947 - DNA, 22 bp, Artificial Sequence
  chemically synthesized
atgtgtgggcctgactacagaa

SEQ ID NO: 1283948 - DNA, 22 bp, Artificial Sequence
  chemically synthesized
ggggacaaagcagttctgtagt

SEQ ID NO: 1283949 - DNA, 22 bp, Artificial Sequence
  chemically synthesized
gggggacaaagcagttctgtag

SEQ ID NO: 1283950 - DNA, 22 bp, Artificial Sequence
  chemically synthesized
tgggggacaaagcagttctgta

SEQ ID NO: 1283951 - DNA, 22 bp, Artificial Sequence
  chemically synthesized
actacagaactgctttgtcccc

SEQ ID NO: 1283952 - DNA, 22 bp, Artificial Sequence
  chemically synthesized
cagaactgctttgtcccccaaa

SEQ ID NO: 1283953 - DNA, 22 bp, Artificial Sequence
  chemically synthesized
ctttgtcccccaaaggcatcgt

SEQ ID NO: 1283954 - DNA, 22 bp, Artificial Sequence
  chemically synthesized
tgtcccccaaaggcatcgtgta

SEQ ID NO: 1283955 - DNA, 22 bp, Artificial Sequence
  chemically synthesized
gtcccccaaaggcatcgtgtat

SEQ ID NO: 1283956 - DNA, 22 bp, Artificial Sequence
  chemically synthesized
tcccccaaaggcatcgtgtatt

SEQ ID NO: 1283957 - DNA, 22 bp, Artificial Sequence
  chemically synthesized
gcaacccccacaatgaaaagca

SEQ ID NO: 1283958 - DNA, 22 bp, Artificial Sequence
  chemically synthesized
tagcaacccccacaatgaaaag

SEQ ID NO: 1283959 - DNA, 22 bp, Artificial Sequence
  chemically synthesized
ctagcaacccccacaatgaaaa

SEQ ID NO: 1283960 - DNA, 22 bp, Artificial Sequence
  chemically synthesized
tgtttctagcaacccccacaat

SEQ ID NO: 1283961 - DNA, 22 bp, Artificial Sequence
  chemically synthesized
tatgtttctagcaacccccaca

SEQ ID NO: 1283962 - DNA, 22 bp, Artificial Sequence
  chemically synthesized
ctatgtttctagcaacccccac

SEQ ID NO: 1283963 - DNA, 22 bp, Artificial Sequence
  chemically synthesized
gcttttcattgtgggggttgct

SEQ ID NO: 1283964 - DNA, 22 bp, Artificial Sequence
  chemically synthesized
cttttcattgtgggggttgcta

SEQ ID NO: 1283965 - DNA, 22 bp, Artificial Sequence
  chemically synthesized
tttctatgtttctagcaacccc

SEQ ID NO: 1283966 - DNA, 22 bp, Artificial Sequence
  chemically synthesized
ttcattgtgggggttgctagaa

SEQ ID NO: 1283967 - DNA, 22 bp, Artificial Sequence
  chemically synthesized
tcattgtgggggttgctagaaa

SEQ ID NO: 1283968 - DNA, 22 bp, Artificial Sequence
  chemically synthesized
cattgtgggggttgctagaaac

SEQ ID NO: 1283969 - DNA, 22 bp, Artificial Sequence
  chemically synthesized
attgtgggggttgctagaaaca

SEQ ID NO: 1283970 - DNA, 22 bp, Artificial Sequence
  chemically synthesized
ataatattatttctatgtttct

SEQ ID NO: 1283971 - DNA, 22 bp, Artificial Sequence
  chemically synthesized
tgggggttgctagaaacataga

SEQ ID NO: 1283972 - DNA, 22 bp, Artificial Sequence
  chemically synthesized
aataatattatttctatgtttc

SEQ ID NO: 1283973 - DNA, 22 bp, Artificial Sequence
  chemically synthesized
taataatattatttctatgttt

SEQ ID NO: 1283974 - DNA, 22 bp, Artificial Sequence
  chemically synthesized
tactttaataatattatttcta

SEQ ID NO: 1283975 - DNA, 22 bp, Artificial Sequence
  chemically synthesized
tatactttaataatattatttc

SEQ ID NO: 1283976 - DNA, 22 bp, Artificial Sequence
  chemically synthesized
ctagaaacatagaaataatatt

SEQ ID NO: 1283977 - DNA, 22 bp, Artificial Sequence
  chemically synthesized
ctatactttaataatattattt

SEQ ID NO: 1283978 - DNA, 22 bp, Artificial Sequence
  chemically synthesized
gaaacatagaaataatattatt

SEQ ID NO: 1283979 - DNA, 22 bp, Artificial Sequence
  chemically synthesized
gacatcttctatactttaataa

SEQ ID NO: 1283980 - DNA, 22 bp, Artificial Sequence
  chemically synthesized
ggacatcttctatactttaata

SEQ ID NO: 1283981 - DNA, 22 bp, Artificial Sequence
  chemically synthesized
cttggacatcttctatacttta

SEQ ID NO: 1283982 - DNA, 22 bp, Artificial Sequence
  chemically synthesized
ttaaagtatagaagatgtccaa

SEQ ID NO: 1283983 - DNA, 22 bp, Artificial Sequence
  chemically synthesized
aagtatagaagatgtccaagga

SEQ ID NO: 1283984 - DNA, 22 bp, Artificial Sequence
  chemically synthesized
gaggaaagatgcatgttccttg

SEQ ID NO: 1283985 - DNA, 22 bp, Artificial Sequence
  chemically synthesized
ctagaggaaagatgcatgttcc

SEQ ID NO: 1283986 - DNA, 22 bp, Artificial Sequence
  chemically synthesized
gctagaggaaagatgcatgttc

SEQ ID NO: 1283987 - DNA, 22 bp, Artificial Sequence
  chemically synthesized
tgctagaggaaagatgcatgtt

SEQ ID NO: 1283988 - DNA, 22 bp, Artificial Sequence
  chemically synthesized
tttgctagaggaaagatgcatg

SEQ ID NO: 1283989 - DNA, 22 bp, Artificial Sequence
  chemically synthesized
ttctttgctagaggaaagatgc

SEQ ID NO: 1283990 - DNA, 22 bp, Artificial Sequence
  chemically synthesized
aattattctttgctagaggaaa

SEQ ID NO: 1283991 - DNA, 22 bp, Artificial Sequence
  chemically synthesized
aaattattctttgctagaggaa

SEQ ID NO: 1283992 - DNA, 22 bp, Artificial Sequence
  chemically synthesized
taaattattctttgctagagga

SEQ ID NO: 1283993 - DNA, 22 bp, Artificial Sequence
  chemically synthesized
attttaaattattctttgctag

SEQ ID NO: 1283994 - DNA, 22 bp, Artificial Sequence
  chemically synthesized
aattttaaattattctttgcta

SEQ ID NO: 1283995 - DNA, 22 bp, Artificial Sequence
  chemically synthesized
taattttaaattattctttgct

SEQ ID NO: 1283996 - DNA, 22 bp, Artificial Sequence
  chemically synthesized
ttttaattttaaattattcttt

SEQ ID NO: 1283997 - DNA, 22 bp, Artificial Sequence
  chemically synthesized
attttaattttaaattattctt

SEQ ID NO: 1283998 - DNA, 22 bp, Artificial Sequence
  chemically synthesized
tcctctagcaaagaataattta

SEQ ID NO: 1283999 - DNA, 22 bp, Artificial Sequence
  chemically synthesized
cctctagcaaagaataatttaa

SEQ ID NO: 1284000 - DNA, 22 bp, Artificial Sequence
  chemically synthesized
ctctagcaaagaataatttaaa

SEQ ID NO: 1284001 - DNA, 22 bp, Artificial Sequence
  chemically synthesized
tagcaaagaataatttaaaatt

SEQ ID NO: 1284002 - DNA, 22 bp, Artificial Sequence
  chemically synthesized
gcaaagaataatttaaaattaa

SEQ ID NO: 1284003 - DNA, 22 bp, Artificial Sequence
  chemically synthesized
aaaattaaaataagtattatac

SEQ ID NO: 1284004 - DNA, 22 bp, Artificial Sequence
  chemically synthesized
gaaaagtaataagtataatact

SEQ ID NO: 1284005 - DNA, 22 bp, Artificial Sequence
  chemically synthesized
aaattaaaataagtattatact

SEQ ID NO: 1284006 - DNA, 22 bp, Artificial Sequence
  chemically synthesized
agaaaagtaataagtataatac

SEQ ID NO: 1284007 - DNA, 22 bp, Artificial Sequence
  chemically synthesized
aaataagtattatacttattac

SEQ ID NO: 1284008 - DNA, 22 bp, Artificial Sequence
  chemically synthesized
tacttattacttttctaaattg

SEQ ID NO: 1284009 - DNA, 22 bp, Artificial Sequence
  chemically synthesized
attacttttctaaattgcgact

SEQ ID NO: 1284010 - DNA, 22 bp, Artificial Sequence
  chemically synthesized
ttacttttctaaattgcgactt

SEQ ID NO: 1284011 - DNA, 22 bp, Artificial Sequence
  chemically synthesized
cttttctaaattgcgacttctc

SEQ ID NO: 1284012 - DNA, 22 bp, Artificial Sequence
  chemically synthesized
ttctaaattgcgacttctctcc

SEQ ID NO: 1284013 - DNA, 22 bp, Artificial Sequence
  chemically synthesized
tctaaattgcgacttctctcca

SEQ ID NO: 1284014 - DNA, 22 bp, Artificial Sequence
  chemically synthesized
ctaaattgcgacttctctccat

SEQ ID NO: 1284015 - DNA, 22 bp, Artificial Sequence
  chemically synthesized
taaattgcgacttctctccatg

SEQ ID NO: 1284016 - DNA, 22 bp, Artificial Sequence
  chemically synthesized
aattgcgacttctctccatgcc

SEQ ID NO: 1284017 - DNA, 22 bp, Artificial Sequence
  chemically synthesized
cagagagggaaagtgaggcatg

SEQ ID NO: 1284018 - DNA, 22 bp, Artificial Sequence
  chemically synthesized
cgacttctctccatgcctcact

SEQ ID NO: 1284019 - DNA, 22 bp, Artificial Sequence
  chemically synthesized
acagagagggaaagtgaggcat

SEQ ID NO: 1284020 - DNA, 22 bp, Artificial Sequence
  chemically synthesized
tacagagagggaaagtgaggca

SEQ ID NO: 1284021 - DNA, 22 bp, Artificial Sequence
  chemically synthesized
ctctccatgcctcactttccct

SEQ ID NO: 1284022 - DNA, 22 bp, Artificial Sequence
  chemically synthesized
cattttacagagagggaaagtg

SEQ ID NO: 1284023 - DNA, 22 bp, Artificial Sequence
  chemically synthesized
tctccatgcctcactttccctc

SEQ ID NO: 1284024 - DNA, 22 bp, Artificial Sequence
  chemically synthesized
tccatgcctcactttccctctc

SEQ ID NO: 1284025 - DNA, 22 bp, Artificial Sequence
  chemically synthesized
tctccattttacagagagggaa

SEQ ID NO: 1284026 - DNA, 22 bp, Artificial Sequence
  chemically synthesized
catgcctcactttccctctctg

SEQ ID NO: 1284027 - DNA, 22 bp, Artificial Sequence
  chemically synthesized
ttatctccattttacagagagg

SEQ ID NO: 1284028 - DNA, 22 bp, Artificial Sequence
  chemically synthesized
actttccctctctgtaaaatgg

SEQ ID NO: 1284029 - DNA, 22 bp, Artificial Sequence
  chemically synthesized
tccctctctgtaaaatggagat

SEQ ID NO: 1284030 - DNA, 22 bp, Artificial Sequence
  chemically synthesized
ccctctctgtaaaatggagata

SEQ ID NO: 1284031 - DNA, 22 bp, Artificial Sequence
  chemically synthesized
cctctctgtaaaatggagataa

SEQ ID NO: 1284032 - DNA, 22 bp, Artificial Sequence
  chemically synthesized
tctgtaaaatggagataatagc

SEQ ID NO: 1284033 - DNA, 22 bp, Artificial Sequence
  chemically synthesized
tgtaaaatggagataatagcat

SEQ ID NO: 1284034 - DNA, 22 bp, Artificial Sequence
  chemically synthesized
aaatagcagtgtgatgctatta

SEQ ID NO: 1284035 - DNA, 22 bp, Artificial Sequence
  chemically synthesized
taaaatggagataatagcatca

SEQ ID NO: 1284036 - DNA, 22 bp, Artificial Sequence
  chemically synthesized
attaaaatagcagtgtgatgct

SEQ ID NO: 1284037 - DNA, 22 bp, Artificial Sequence
  chemically synthesized
tcattaaaatagcagtgtgatg

SEQ ID NO: 1284038 - DNA, 22 bp, Artificial Sequence
  chemically synthesized
ctcattaaaatagcagtgtgat

SEQ ID NO: 1284039 - DNA, 22 bp, Artificial Sequence
  chemically synthesized
tctcattaaaatagcagtgtga

SEQ ID NO: 1284040 - DNA, 22 bp, Artificial Sequence
  chemically synthesized
ttctcattaaaatagcagtgtg

SEQ ID NO: 1284041 - DNA, 22 bp, Artificial Sequence
  chemically synthesized
acttttctcattaaaatagcag

SEQ ID NO: 1284042 - DNA, 22 bp, Artificial Sequence
  chemically synthesized
cacttttctcattaaaatagca

SEQ ID NO: 1284043 - DNA, 22 bp, Artificial Sequence
  chemically synthesized
tttcacttttctcattaaaata

SEQ ID NO: 1284044 - DNA, 22 bp, Artificial Sequence
  chemically synthesized
ctattttaatgagaaaagtgaa

SEQ ID NO: 1284045 - DNA, 22 bp, Artificial Sequence
  chemically synthesized
ttttaatgagaaaagtgaaata

SEQ ID NO: 1284046 - DNA, 22 bp, Artificial Sequence
  chemically synthesized
taatgagaaaagtgaaataata

SEQ ID NO: 1284047 - DNA, 22 bp, Artificial Sequence
  chemically synthesized
aatgagaaaagtgaaataatac

SEQ ID NO: 1284048 - DNA, 22 bp, Artificial Sequence
  chemically synthesized
agtacatcacatgtattatttc

SEQ ID NO: 1284049 - DNA, 22 bp, Artificial Sequence
  chemically synthesized
atgagaaaagtgaaataataca

SEQ ID NO: 1284050 - DNA, 22 bp, Artificial Sequence
  chemically synthesized
gcaccattaagtacatcacatg

SEQ ID NO: 1284051 - DNA, 22 bp, Artificial Sequence
  chemically synthesized
ggcaccattaagtacatcacat

SEQ ID NO: 1284052 - DNA, 22 bp, Artificial Sequence
  chemically synthesized
cttggcaccattaagtacatca

SEQ ID NO: 1284053 - DNA, 22 bp, Artificial Sequence
  chemically synthesized
actacttggcaccattaagtac

SEQ ID NO: 1284054 - DNA, 22 bp, Artificial Sequence
  chemically synthesized
atgtatgctaactacttggcac

SEQ ID NO: 1284055 - DNA, 22 bp, Artificial Sequence
  chemically synthesized
gatgtatgctaactacttggca

SEQ ID NO: 1284056 - DNA, 22 bp, Artificial Sequence
  chemically synthesized
atgtttgatgtatgctaactac

SEQ ID NO: 1284057 - DNA, 22 bp, Artificial Sequence
  chemically synthesized
aatggtgccaagtagttagcat

SEQ ID NO: 1284058 - DNA, 22 bp, Artificial Sequence
  chemically synthesized
atggtgccaagtagttagcata

SEQ ID NO: 1284059 - DNA, 22 bp, Artificial Sequence
  chemically synthesized
ctcatgtttgatgtatgctaac

SEQ ID NO: 1284060 - DNA, 22 bp, Artificial Sequence
  chemically synthesized
gcatacatcaaacatgagcaat

SEQ ID NO: 1284061 - DNA, 22 bp, Artificial Sequence
  chemically synthesized
gtataataataggaataatata

SEQ ID NO: 1284062 - DNA, 22 bp, Artificial Sequence
  chemically synthesized
ggtataataataggaataatat

SEQ ID NO: 1284063 - DNA, 22 bp, Artificial Sequence
  chemically synthesized
acttggtataataataggaata

SEQ ID NO: 1284064 - DNA, 22 bp, Artificial Sequence
  chemically synthesized
actaacttggtataataatagg

SEQ ID NO: 1284065 - DNA, 22 bp, Artificial Sequence
  chemically synthesized
aactaacttggtataataatag

SEQ ID NO: 1284066 - DNA, 22 bp, Artificial Sequence
  chemically synthesized
tattattcctattattatacca

SEQ ID NO: 1284067 - DNA, 22 bp, Artificial Sequence
  chemically synthesized
ttcctattattataccaagtta

SEQ ID NO: 1284068 - DNA, 22 bp, Artificial Sequence
  chemically synthesized
ctattattataccaagttagtt

SEQ ID NO: 1284069 - DNA, 22 bp, Artificial Sequence
  chemically synthesized
ttattataccaagttagttaaa

SEQ ID NO: 1284070 - DNA, 22 bp, Artificial Sequence
  chemically synthesized
ttataccaagttagttaaactt

SEQ ID NO: 1284071 - DNA, 22 bp, Artificial Sequence
  chemically synthesized
taccaagttagttaaacttgta

SEQ ID NO: 1284072 - DNA, 22 bp, Artificial Sequence
  chemically synthesized
gtagtaaaataatacaagttta

SEQ ID NO: 1284073 - DNA, 22 bp, Artificial Sequence
  chemically synthesized
gttaaacttgtattattttact

SEQ ID NO: 1284074 - DNA, 22 bp, Artificial Sequence
  chemically synthesized
aacttgtattattttactacta

SEQ ID NO: 1284075 - DNA, 22 bp, Artificial Sequence
  chemically synthesized
gtattattttactactaatatt

SEQ ID NO: 1284076 - DNA, 22 bp, Artificial Sequence
  chemically synthesized
tattattttactactaatattt

SEQ ID NO: 1284077 - DNA, 22 bp, Artificial Sequence
  chemically synthesized
gtgcagtaatacaaatattagt

SEQ ID NO: 1284078 - DNA, 22 bp, Artificial Sequence
  chemically synthesized
agtgcagtaatacaaatattag

SEQ ID NO: 1284079 - DNA, 22 bp, Artificial Sequence
  chemically synthesized
ttttactactaatatttgtatt

SEQ ID NO: 1284080 - DNA, 22 bp, Artificial Sequence
  chemically synthesized
acttagtgcagtaatacaaata

SEQ ID NO: 1284081 - DNA, 22 bp, Artificial Sequence
  chemically synthesized
tactactaatatttgtattact

SEQ ID NO: 1284082 - DNA, 22 bp, Artificial Sequence
  chemically synthesized
actactaatatttgtattactg

SEQ ID NO: 1284083 - DNA, 22 bp, Artificial Sequence
  chemically synthesized
tctaacttagtgcagtaataca

SEQ ID NO: 1284084 - DNA, 22 bp, Artificial Sequence
  chemically synthesized
ctactaatatttgtattactgc

SEQ ID NO: 1284085 - DNA, 22 bp, Artificial Sequence
  chemically synthesized
atctaacttagtgcagtaatac

SEQ ID NO: 1284086 - DNA, 22 bp, Artificial Sequence
  chemically synthesized
ctaatatttgtattactgcact

SEQ ID NO: 1284087 - DNA, 22 bp, Artificial Sequence
  chemically synthesized
atttatctaacttagtgcagta

SEQ ID NO: 1284088 - DNA, 22 bp, Artificial Sequence
  chemically synthesized
gatttatctaacttagtgcagt

SEQ ID NO: 1284089 - DNA, 22 bp, Artificial Sequence
  chemically synthesized
atatttgtattactgcactaag

SEQ ID NO: 1284090 - DNA, 22 bp, Artificial Sequence
  chemically synthesized
tgatttatctaacttagtgcag

SEQ ID NO: 1284091 - DNA, 22 bp, Artificial Sequence
  chemically synthesized
gtattactgcactaagttagat

SEQ ID NO: 1284092 - DNA, 22 bp, Artificial Sequence
  chemically synthesized
tattactgcactaagttagata

SEQ ID NO: 1284093 - DNA, 22 bp, Artificial Sequence
  chemically synthesized
acaatggttttgatttatctaa

SEQ ID NO: 1284094 - DNA, 22 bp, Artificial Sequence
  chemically synthesized
aacaatggttttgatttatcta

SEQ ID NO: 1284095 - DNA, 22 bp, Artificial Sequence
  chemically synthesized
ctgcactaagttagataaatca

SEQ ID NO: 1284096 - DNA, 22 bp, Artificial Sequence
  chemically synthesized
taacaatggttttgatttatct

SEQ ID NO: 1284097 - DNA, 22 bp, Artificial Sequence
  chemically synthesized
cactaagttagataaatcaaaa

SEQ ID NO: 1284098 - DNA, 22 bp, Artificial Sequence
  chemically synthesized
agttagataaatcaaaaccatt

SEQ ID NO: 1284099 - DNA, 22 bp, Artificial Sequence
  chemically synthesized
gatcagctttaacaatggtttt

SEQ ID NO: 1284100 - DNA, 22 bp, Artificial Sequence
  chemically synthesized
tagatcagctttaacaatggtt

SEQ ID NO: 1284101 - DNA, 22 bp, Artificial Sequence
  chemically synthesized
ctagatcagctttaacaatggt

SEQ ID NO: 1284102 - DNA, 22 bp, Artificial Sequence
  chemically synthesized
gataaatcaaaaccattgttaa

SEQ ID NO: 1284103 - DNA, 22 bp, Artificial Sequence
  chemically synthesized
cttctagatcagctttaacaat

SEQ ID NO: 1284104 - DNA, 22 bp, Artificial Sequence
  chemically synthesized
acttctagatcagctttaacaa

SEQ ID NO: 1284105 - DNA, 22 bp, Artificial Sequence
  chemically synthesized
ataacttacttctagatcagct

SEQ ID NO: 1284106 - DNA, 22 bp, Artificial Sequence
  chemically synthesized
ttaaagctgatctagaagtaag

SEQ ID NO: 1284107 - DNA, 22 bp, Artificial Sequence
  chemically synthesized
aagctgatctagaagtaagtta

SEQ ID NO: 1284108 - DNA, 22 bp, Artificial Sequence
  chemically synthesized
aacagaaatgtctaataactta

SEQ ID NO: 1284109 - DNA, 22 bp, Artificial Sequence
  chemically synthesized
atctagaagtaagttattagac

SEQ ID NO: 1284110 - DNA, 22 bp, Artificial Sequence
  chemically synthesized
ctaaacagaaatgtctaataac

SEQ ID NO: 1284111 - DNA, 22 bp, Artificial Sequence
  chemically synthesized
gaagtaagttattagacatttc

SEQ ID NO: 1284112 - DNA, 22 bp, Artificial Sequence
  chemically synthesized
atatctcctaaacagaaatgtc

SEQ ID NO: 1284113 - DNA, 22 bp, Artificial Sequence
  chemically synthesized
agtaactgatatctcctaaaca

SEQ ID NO: 1284114 - DNA, 22 bp, Artificial Sequence
  chemically synthesized
ttagacatttctgtttaggaga

SEQ ID NO: 1284115 - DNA, 22 bp, Artificial Sequence
  chemically synthesized
taagtaactgatatctcctaaa

SEQ ID NO: 1284116 - DNA, 22 bp, Artificial Sequence
  chemically synthesized
ctaagtaactgatatctcctaa

SEQ ID NO: 1284117 - DNA, 22 bp, Artificial Sequence
  chemically synthesized
gacatttctgtttaggagatat

SEQ ID NO: 1284118 - DNA, 22 bp, Artificial Sequence
  chemically synthesized
aatttctaagtaactgatatct

SEQ ID NO: 1284119 - DNA, 22 bp, Artificial Sequence
  chemically synthesized
ctgtttaggagatatcagttac

SEQ ID NO: 1284120 - DNA, 22 bp, Artificial Sequence
  chemically synthesized
tgtttaggagatatcagttact

SEQ ID NO: 1284121 - DNA, 22 bp, Artificial Sequence
  chemically synthesized
tttaggagatatcagttactta

SEQ ID NO: 1284122 - DNA, 22 bp, Artificial Sequence
  chemically synthesized
aggagatatcagttacttagaa

SEQ ID NO: 1284123 - DNA, 22 bp, Artificial Sequence
  chemically synthesized
tagtaactaaatttctaagtaa

SEQ ID NO: 1284124 - DNA, 22 bp, Artificial Sequence
  chemically synthesized
ggagatatcagttacttagaaa

SEQ ID NO: 1284125 - DNA, 22 bp, Artificial Sequence
  chemically synthesized
atagtaactaaatttctaagta

SEQ ID NO: 1284126 - DNA, 22 bp, Artificial Sequence
  chemically synthesized
tttatagtaactaaatttctaa

SEQ ID NO: 1284127 - DNA, 22 bp, Artificial Sequence
  chemically synthesized
atttatagtaactaaatttcta

SEQ ID NO: 1284128 - DNA, 22 bp, Artificial Sequence
  chemically synthesized
cttagaaatttagttactataa

SEQ ID NO: 1284129 - DNA, 22 bp, Artificial Sequence
  chemically synthesized
tatgtaagacttatttatagta

SEQ ID NO: 1284130 - DNA, 22 bp, Artificial Sequence
  chemically synthesized
agaaatttagttactataaata

SEQ ID NO: 1284131 - DNA, 22 bp, Artificial Sequence
  chemically synthesized
gaaatttagttactataaataa

SEQ ID NO: 1284132 - DNA, 22 bp, Artificial Sequence
  chemically synthesized
tatatgtaagacttatttatag

SEQ ID NO: 1284133 - DNA, 22 bp, Artificial Sequence
  chemically synthesized
ctatatgtaagacttatttata

SEQ ID NO: 1284134 - DNA, 22 bp, Artificial Sequence
  chemically synthesized
tctatatgtaagacttatttat

SEQ ID NO: 1284135 - DNA, 22 bp, Artificial Sequence
  chemically synthesized
agttactataaataagtcttac

SEQ ID NO: 1284136 - DNA, 22 bp, Artificial Sequence
  chemically synthesized
gttactataaataagtcttaca

SEQ ID NO: 1284137 - DNA, 22 bp, Artificial Sequence
  chemically synthesized
ctataaataagtcttacatata

SEQ ID NO: 1284138 - DNA, 22 bp, Artificial Sequence
  chemically synthesized
taaataagtcttacatatagaa

SEQ ID NO: 1284139 - DNA, 22 bp, Artificial Sequence
  chemically synthesized
aagtcaccaaaaaaaggtaatt

SEQ ID NO: 1284140 - DNA, 22 bp, Artificial Sequence
  chemically synthesized
acatatagaaaattaccttttt

SEQ ID NO: 1284141 - DNA, 22 bp, Artificial Sequence
  chemically synthesized
taaagtcaccaaaaaaaggtaa

SEQ ID NO: 1284142 - DNA, 22 bp, Artificial Sequence
  chemically synthesized
catatagaaaattacctttttt

SEQ ID NO: 1284143 - DNA, 22 bp, Artificial Sequence
  chemically synthesized
ctaaagtcaccaaaaaaaggta

SEQ ID NO: 1284144 - DNA, 22 bp, Artificial Sequence
  chemically synthesized
aatttctaaagtcaccaaaaaa

SEQ ID NO: 1284145 - DNA, 22 bp, Artificial Sequence
  chemically synthesized
cgccctaaatttctaaagtcac

SEQ ID NO: 1284146 - DNA, 22 bp, Artificial Sequence
  chemically synthesized
acgccctaaatttctaaagtca

SEQ ID NO: 1284147 - DNA, 22 bp, Artificial Sequence
  chemically synthesized
cctttttttggtgactttagaa

SEQ ID NO: 1284148 - DNA, 22 bp, Artificial Sequence
  chemically synthesized
ttacgccctaaatttctaaagt

SEQ ID NO: 1284149 - DNA, 22 bp, Artificial Sequence
  chemically synthesized
cttacgccctaaatttctaaag

SEQ ID NO: 1284150 - DNA, 22 bp, Artificial Sequence
  chemically synthesized
tttttggtgactttagaaattt

SEQ ID NO: 1284151 - DNA, 22 bp, Artificial Sequence
  chemically synthesized
ttttggtgactttagaaattta

SEQ ID NO: 1284152 - DNA, 22 bp, Artificial Sequence
  chemically synthesized
tttcttacgccctaaatttcta

SEQ ID NO: 1284153 - DNA, 22 bp, Artificial Sequence
  chemically synthesized
tttggtgactttagaaatttag

SEQ ID NO: 1284154 - DNA, 22 bp, Artificial Sequence
  chemically synthesized
ttggtgactttagaaatttagg

SEQ ID NO: 1284155 - DNA, 22 bp, Artificial Sequence
  chemically synthesized
tggtgactttagaaatttaggg

SEQ ID NO: 1284156 - DNA, 22 bp, Artificial Sequence
  chemically synthesized
ggtgactttagaaatttagggc

SEQ ID NO: 1284157 - DNA, 22 bp, Artificial Sequence
  chemically synthesized
gtgactttagaaatttagggcg

SEQ ID NO: 1284158 - DNA, 22 bp, Artificial Sequence
  chemically synthesized
aaaagttatttcttacgcccta

SEQ ID NO: 1284159 - DNA, 22 bp, Artificial Sequence
  chemically synthesized
gaaaagttatttcttacgccct

SEQ ID NO: 1284160 - DNA, 22 bp, Artificial Sequence
  chemically synthesized
tgaaaagttatttcttacgccc

SEQ ID NO: 1284161 - DNA, 22 bp, Artificial Sequence
  chemically synthesized
tagaaatttagggcgtaagaaa

SEQ ID NO: 1284162 - DNA, 22 bp, Artificial Sequence
  chemically synthesized
tttgaaaagttatttcttacgc

SEQ ID NO: 1284163 - DNA, 22 bp, Artificial Sequence
  chemically synthesized
agaaatttagggcgtaagaaat

SEQ ID NO: 1284164 - DNA, 22 bp, Artificial Sequence
  chemically synthesized
ctttgaaaagttatttcttacg

SEQ ID NO: 1284165 - DNA, 22 bp, Artificial Sequence
  chemically synthesized
gaaatttagggcgtaagaaata

SEQ ID NO: 1284166 - DNA, 22 bp, Artificial Sequence
  chemically synthesized
tctttgaaaagttatttcttac

SEQ ID NO: 1284167 - DNA, 22 bp, Artificial Sequence
  chemically synthesized
ttctttgaaaagttatttctta

SEQ ID NO: 1284168 - DNA, 22 bp, Artificial Sequence
  chemically synthesized
tttctttgaaaagttatttctt

SEQ ID NO: 1284169 - DNA, 22 bp, Artificial Sequence
  chemically synthesized
ttttctttgaaaagttatttct

SEQ ID NO: 1284170 - DNA, 22 bp, Artificial Sequence
  chemically synthesized
agggcgtaagaaataacttttc

SEQ ID NO: 1284171 - DNA, 22 bp, Artificial Sequence
  chemically synthesized
gggcgtaagaaataacttttca

SEQ ID NO: 1284172 - DNA, 22 bp, Artificial Sequence
  chemically synthesized
aaatgatgacataatttttttc

SEQ ID NO: 1284173 - DNA, 22 bp, Artificial Sequence
  chemically synthesized
aaaatgatgacataattttttt

SEQ ID NO: 1284174 - DNA, 22 bp, Artificial Sequence
  chemically synthesized
taaaatgatgacataatttttt

SEQ ID NO: 1284175 - DNA, 22 bp, Artificial Sequence
  chemically synthesized
tttaaaatgatgacataatttt

SEQ ID NO: 1284176 - DNA, 22 bp, Artificial Sequence
  chemically synthesized
ttcaaagaaaaaaattatgtca

SEQ ID NO: 1284177 - DNA, 22 bp, Artificial Sequence
  chemically synthesized
tcaaagaaaaaaattatgtcat

SEQ ID NO: 1284178 - DNA, 22 bp, Artificial Sequence
  chemically synthesized
caaagaaaaaaattatgtcatc

SEQ ID NO: 1284179 - DNA, 22 bp, Artificial Sequence
  chemically synthesized
aaagaaaaaaattatgtcatca

SEQ ID NO: 1284180 - DNA, 22 bp, Artificial Sequence
  chemically synthesized
agagagctctttaaaatgatga

SEQ ID NO: 1284181 - DNA, 22 bp, Artificial Sequence
  chemically synthesized
actgagagagctctttaaaatg

SEQ ID NO: 1284182 - DNA, 22 bp, Artificial Sequence
  chemically synthesized
tgtcatcattttaaagagctct

SEQ ID NO: 1284183 - DNA, 22 bp, Artificial Sequence
  chemically synthesized
atactcactgagagagctcttt

SEQ ID NO: 1284184 - DNA, 22 bp, Artificial Sequence
  chemically synthesized
taaagagctctctcagtgagta

SEQ ID NO: 1284185 - DNA, 22 bp, Artificial Sequence
  chemically synthesized
aaagagctctctcagtgagtat

SEQ ID NO: 1284186 - DNA, 22 bp, Artificial Sequence
  chemically synthesized
tgaacacaattaatactcactg

SEQ ID NO: 1284187 - DNA, 22 bp, Artificial Sequence
  chemically synthesized
aagagctctctcagtgagtatt

SEQ ID NO: 1284188 - DNA, 22 bp, Artificial Sequence
  chemically synthesized
gctatgaacacaattaatactc

SEQ ID NO: 1284189 - DNA, 22 bp, Artificial Sequence
  chemically synthesized
tctagctatgaacacaattaat

SEQ ID NO: 1284190 - DNA, 22 bp, Artificial Sequence
  chemically synthesized
tctcagtgagtattaattgtgt

SEQ ID NO: 1284191 - DNA, 22 bp, Artificial Sequence
  chemically synthesized
atctagctatgaacacaattaa

SEQ ID NO: 1284192 - DNA, 22 bp, Artificial Sequence
  chemically synthesized
tcagtgagtattaattgtgttc

SEQ ID NO: 1284193 - DNA, 22 bp, Artificial Sequence
  chemically synthesized
agtgagtattaattgtgttcat

SEQ ID NO: 1284194 - DNA, 22 bp, Artificial Sequence
  chemically synthesized
attgtgttcatagctagataaa

SEQ ID NO: 1284195 - DNA, 22 bp, Artificial Sequence
  chemically synthesized
tgtgtgcacacatttatctagc

SEQ ID NO: 1284196 - DNA, 22 bp, Artificial Sequence
  chemically synthesized
tgttcatagctagataaatgtg

SEQ ID NO: 1284197 - DNA, 22 bp, Artificial Sequence
  chemically synthesized
atagctagataaatgtgtgcac

SEQ ID NO: 1284198 - DNA, 22 bp, Artificial Sequence
  chemically synthesized
gccgtaatgtgttgtgtgtgca

SEQ ID NO: 1284199 - DNA, 22 bp, Artificial Sequence
  chemically synthesized
gataaatgtgtgcacacacaac

SEQ ID NO: 1284200 - DNA, 22 bp, Artificial Sequence
  chemically synthesized
aattggccgtaatgtgttgtgt

SEQ ID NO: 1284201 - DNA, 22 bp, Artificial Sequence
  chemically synthesized
gaattggccgtaatgtgttgtg

SEQ ID NO: 1284202 - DNA, 22 bp, Artificial Sequence
  chemically synthesized
aaatttgaattggccgtaatgt

SEQ ID NO: 1284203 - DNA, 22 bp, Artificial Sequence
  chemically synthesized
aaaatttgaattggccgtaatg

SEQ ID NO: 1284204 - DNA, 22 bp, Artificial Sequence
  chemically synthesized
taaaatttgaattggccgtaat

SEQ ID NO: 1284205 - DNA, 22 bp, Artificial Sequence
  chemically synthesized
ttttaaaatttgaattggccgt

SEQ ID NO: 1284206 - DNA, 22 bp, Artificial Sequence
  chemically synthesized
taatggcattgttttaaaattt

SEQ ID NO: 1284207 - DNA, 22 bp, Artificial Sequence
  chemically synthesized
cggccaattcaaattttaaaac

SEQ ID NO: 1284208 - DNA, 22 bp, Artificial Sequence
  chemically synthesized
cactataatggcattgttttaa

SEQ ID NO: 1284209 - DNA, 22 bp, Artificial Sequence
  chemically synthesized
aaattttaaaacaatgccatta

SEQ ID NO: 1284210 - DNA, 22 bp, Artificial Sequence
  chemically synthesized
taaaacaatgccattatagtgg

SEQ ID NO: 1284211 - DNA, 22 bp, Artificial Sequence
  chemically synthesized
aaaacaatgccattatagtgga

SEQ ID NO: 1284212 - DNA, 22 bp, Artificial Sequence
  chemically synthesized
aaacaatgccattatagtggaa

SEQ ID NO: 1284213 - DNA, 22 bp, Artificial Sequence
  chemically synthesized
atcccatacagaataggatgaa

SEQ ID NO: 1284214 - DNA, 22 bp, Artificial Sequence
  chemically synthesized
gatcccatacagaataggatga

SEQ ID NO: 1284215 - DNA, 22 bp, Artificial Sequence
  chemically synthesized
tgatcccatacagaataggatg

SEQ ID NO: 1284216 - DNA, 22 bp, Artificial Sequence
  chemically synthesized
tagtggaatttcatcctattct

SEQ ID NO: 1284217 - DNA, 22 bp, Artificial Sequence
  chemically synthesized
gatgctttgatcccatacagaa

SEQ ID NO: 1284218 - DNA, 22 bp, Artificial Sequence
  chemically synthesized
tggatgctttgatcccatacag

SEQ ID NO: 1284219 - DNA, 22 bp, Artificial Sequence
  chemically synthesized
catcctattctgtatgggatca

SEQ ID NO: 1284220 - DNA, 22 bp, Artificial Sequence
  chemically synthesized
atcctattctgtatgggatcaa

SEQ ID NO: 1284221 - DNA, 22 bp, Artificial Sequence
  chemically synthesized
gacctctggatgctttgatccc

SEQ ID NO: 1284222 - DNA, 22 bp, Artificial Sequence
  chemically synthesized
agacctctggatgctttgatcc

SEQ ID NO: 1284223 - DNA, 22 bp, Artificial Sequence
  chemically synthesized
tagacctctggatgctttgatc

SEQ ID NO: 1284224 - DNA, 22 bp, Artificial Sequence
  chemically synthesized
ttagacctctggatgctttgat

SEQ ID NO: 1284225 - DNA, 22 bp, Artificial Sequence
  chemically synthesized
ttctgtatgggatcaaagcatc

SEQ ID NO: 1284226 - DNA, 22 bp, Artificial Sequence
  chemically synthesized
tttagacctctggatgctttga

SEQ ID NO: 1284227 - DNA, 22 bp, Artificial Sequence
  chemically synthesized
tgtatgggatcaaagcatccag

SEQ ID NO: 1284228 - DNA, 22 bp, Artificial Sequence
  chemically synthesized
tatgggatcaaagcatccagag

SEQ ID NO: 1284229 - DNA, 22 bp, Artificial Sequence
  chemically synthesized
atgttttttagacctctggatg

SEQ ID NO: 1284230 - DNA, 22 bp, Artificial Sequence
  chemically synthesized
aatgttttttagacctctggat

SEQ ID NO: 1284231 - DNA, 22 bp, Artificial Sequence
  chemically synthesized
taatgttttttagacctctgga

SEQ ID NO: 1284232 - DNA, 22 bp, Artificial Sequence
  chemically synthesized
ttttaatgttttttagacctct

SEQ ID NO: 1284233 - DNA, 22 bp, Artificial Sequence
  chemically synthesized
gttattttaatgttttttagac

SEQ ID NO: 1284234 - DNA, 22 bp, Artificial Sequence
  chemically synthesized
gaggattggttattttaatgtt

SEQ ID NO: 1284235 - DNA, 22 bp, Artificial Sequence
  chemically synthesized
aaaaacattaaaataaccaatc

SEQ ID NO: 1284236 - DNA, 22 bp, Artificial Sequence
  chemically synthesized
aaaagcacctagaggattggtt

SEQ ID NO: 1284237 - DNA, 22 bp, Artificial Sequence
  chemically synthesized
aaaaagcacctagaggattggt

SEQ ID NO: 1284238 - DNA, 22 bp, Artificial Sequence
  chemically synthesized
aaataaccaatcctctaggtgc

SEQ ID NO: 1284239 - DNA, 22 bp, Artificial Sequence
  chemically synthesized
aaaacttaaaaagcacctagag

SEQ ID NO: 1284240 - DNA, 22 bp, Artificial Sequence
  chemically synthesized
actgaaaacttaaaaagcacct

SEQ ID NO: 1284241 - DNA, 22 bp, Artificial Sequence
  chemically synthesized
taggtgctttttaagttttcag

SEQ ID NO: 1284242 - DNA, 22 bp, Artificial Sequence
  chemically synthesized
ggtgctttttaagttttcagtt

SEQ ID NO: 1284243 - DNA, 22 bp, Artificial Sequence
  chemically synthesized
tttaagttttcagttaatttgt

SEQ ID NO: 1284244 - DNA, 22 bp, Artificial Sequence
  chemically synthesized
aatgtagataagacaaattaac

SEQ ID NO: 1284245 - DNA, 22 bp, Artificial Sequence
  chemically synthesized
ttaagttttcagttaatttgtc

SEQ ID NO: 1284246 - DNA, 22 bp, Artificial Sequence
  chemically synthesized
caatgtagataagacaaattaa

SEQ ID NO: 1284247 - DNA, 22 bp, Artificial Sequence
  chemically synthesized
taagttttcagttaatttgtct

SEQ ID NO: 1284248 - DNA, 22 bp, Artificial Sequence
  chemically synthesized
aagttttcagttaatttgtctt

SEQ ID NO: 1284249 - DNA, 22 bp, Artificial Sequence
  chemically synthesized
agttttcagttaatttgtctta

SEQ ID NO: 1284250 - DNA, 22 bp, Artificial Sequence
  chemically synthesized
cttcaatgtagataagacaaat

SEQ ID NO: 1284251 - DNA, 22 bp, Artificial Sequence
  chemically synthesized
gcttcaatgtagataagacaaa

SEQ ID NO: 1284252 - DNA, 22 bp, Artificial Sequence
  chemically synthesized
tttgcttcaatgtagataagac

SEQ ID NO: 1284253 - DNA, 22 bp, Artificial Sequence
  chemically synthesized
tcagttaatttgtcttatctac

SEQ ID NO: 1284254 - DNA, 22 bp, Artificial Sequence
  chemically synthesized
cagttaatttgtcttatctaca

SEQ ID NO: 1284255 - DNA, 22 bp, Artificial Sequence
  chemically synthesized
agttaatttgtcttatctacat

SEQ ID NO: 1284256 - DNA, 22 bp, Artificial Sequence
  chemically synthesized
gattgtttgcttcaatgtagat

SEQ ID NO: 1284257 - DNA, 22 bp, Artificial Sequence
  chemically synthesized
agattgtttgcttcaatgtaga

SEQ ID NO: 1284258 - DNA, 22 bp, Artificial Sequence
  chemically synthesized
tagattgtttgcttcaatgtag

SEQ ID NO: 1284259 - DNA, 22 bp, Artificial Sequence
  chemically synthesized
atttgtcttatctacattgaag

SEQ ID NO: 1284260 - DNA, 22 bp, Artificial Sequence
  chemically synthesized
gtcttatctacattgaagcaaa

SEQ ID NO: 1284261 - DNA, 22 bp, Artificial Sequence
  chemically synthesized
tcttatctacattgaagcaaac

SEQ ID NO: 1284262 - DNA, 22 bp, Artificial Sequence
  chemically synthesized
caagttttagattgtttgcttc

SEQ ID NO: 1284263 - DNA, 22 bp, Artificial Sequence
  chemically synthesized
atctacattgaagcaaacaatc

SEQ ID NO: 1284264 - DNA, 22 bp, Artificial Sequence
  chemically synthesized
tctacattgaagcaaacaatct

SEQ ID NO: 1284265 - DNA, 22 bp, Artificial Sequence
  chemically synthesized
cattgaagcaaacaatctaaaa

SEQ ID NO: 1284266 - DNA, 22 bp, Artificial Sequence
  chemically synthesized
aagcaaacaatctaaaacttgc

SEQ ID NO: 1284267 - DNA, 22 bp, Artificial Sequence
  chemically synthesized
acagatatccattgcaagtttt

SEQ ID NO: 1284268 - DNA, 22 bp, Artificial Sequence
  chemically synthesized
cacagatatccattgcaagttt

SEQ ID NO: 1284269 - DNA, 22 bp, Artificial Sequence
  chemically synthesized
atgtatgcttcacagatatcca

SEQ ID NO: 1284270 - DNA, 22 bp, Artificial Sequence
  chemically synthesized
gatgtatgcttcacagatatcc

SEQ ID NO: 1284271 - DNA, 22 bp, Artificial Sequence
  chemically synthesized
aaacttgcaatggatatctgtg

SEQ ID NO: 1284272 - DNA, 22 bp, Artificial Sequence
  chemically synthesized
tgatgtatgcttcacagatatc

SEQ ID NO: 1284273 - DNA, 22 bp, Artificial Sequence
  chemically synthesized
ttgatgtatgcttcacagatat

SEQ ID NO: 1284274 - DNA, 22 bp, Artificial Sequence
  chemically synthesized
ttttgatgtatgcttcacagat

SEQ ID NO: 1284275 - DNA, 22 bp, Artificial Sequence
  chemically synthesized
cttttgatgtatgcttcacaga

SEQ ID NO: 1284276 - DNA, 22 bp, Artificial Sequence
  chemically synthesized
tcttttgatgtatgcttcacag

SEQ ID NO: 1284277 - DNA, 22 bp, Artificial Sequence
  chemically synthesized
gcaatggatatctgtgaagcat

SEQ ID NO: 1284278 - DNA, 22 bp, Artificial Sequence
  chemically synthesized
ttcttttgatgtatgcttcaca

SEQ ID NO: 1284279 - DNA, 22 bp, Artificial Sequence
  chemically synthesized
caatggatatctgtgaagcata

SEQ ID NO: 1284280 - DNA, 22 bp, Artificial Sequence
  chemically synthesized
tacttttcttttgatgtatgct

SEQ ID NO: 1284281 - DNA, 22 bp, Artificial Sequence
  chemically synthesized
ctatacttttcttttgatgtat

SEQ ID NO: 1284282 - DNA, 22 bp, Artificial Sequence
  chemically synthesized
tgaagcatacatcaaaagaaaa

SEQ ID NO: 1284283 - DNA, 22 bp, Artificial Sequence
  chemically synthesized
acagctactatacttttctttt

SEQ ID NO: 1284284 - DNA, 22 bp, Artificial Sequence
  chemically synthesized
aactaacagctactatactttt

SEQ ID NO: 1284285 - DNA, 22 bp, Artificial Sequence
  chemically synthesized
gaactaacagctactatacttt

SEQ ID NO: 1284286 - DNA, 22 bp, Artificial Sequence
  chemically synthesized
cttgaactaacagctactatac

SEQ ID NO: 1284287 - DNA, 22 bp, Artificial Sequence
  chemically synthesized
agttccttgaactaacagctac

SEQ ID NO: 1284288 - DNA, 22 bp, Artificial Sequence
  chemically synthesized
tcattcagttccttgaactaac

SEQ ID NO: 1284289 - DNA, 22 bp, Artificial Sequence
  chemically synthesized
tatcattcagttccttgaacta

SEQ ID NO: 1284290 - DNA, 22 bp, Artificial Sequence
  chemically synthesized
gaagctctatcattcagttcct

SEQ ID NO: 1284291 - DNA, 22 bp, Artificial Sequence
  chemically synthesized
ttagttcaaggaactgaatgat

SEQ ID NO: 1284292 - DNA, 22 bp, Artificial Sequence
  chemically synthesized
attggaagctctatcattcagt

SEQ ID NO: 1284293 - DNA, 22 bp, Artificial Sequence
  chemically synthesized
aattggaagctctatcattcag

SEQ ID NO: 1284294 - DNA, 22 bp, Artificial Sequence
  chemically synthesized
taattggaagctctatcattca

SEQ ID NO: 1284295 - DNA, 22 bp, Artificial Sequence
  chemically synthesized
gttcaaggaactgaatgataga

SEQ ID NO: 1284296 - DNA, 22 bp, Artificial Sequence
  chemically synthesized
ttaattggaagctctatcattc

SEQ ID NO: 1284297 - DNA, 22 bp, Artificial Sequence
  chemically synthesized
aaggaactgaatgatagagctt

SEQ ID NO: 1284298 - DNA, 22 bp, Artificial Sequence
  chemically synthesized
aatgatagagcttccaattaaa

SEQ ID NO: 1284299 - DNA, 22 bp, Artificial Sequence
  chemically synthesized
ccaattaaaaatacacacatgt

SEQ ID NO: 1284300 - DNA, 22 bp, Artificial Sequence
  chemically synthesized
caattaaaaatacacacatgtg

SEQ ID NO: 1284301 - DNA, 22 bp, Artificial Sequence
  chemically synthesized
aaataagataaacaacacatgt

SEQ ID NO: 1284302 - DNA, 22 bp, Artificial Sequence
  chemically synthesized
aaaatacacacatgtgttgttt

SEQ ID NO: 1284303 - DNA, 22 bp, Artificial Sequence
  chemically synthesized
actgaaataagataaacaacac

SEQ ID NO: 1284304 - DNA, 22 bp, Artificial Sequence
  chemically synthesized
gttcactgaaataagataaaca

SEQ ID NO: 1284305 - DNA, 22 bp, Artificial Sequence
  chemically synthesized
agttcactgaaataagataaac

SEQ ID NO: 1284306 - DNA, 22 bp, Artificial Sequence
  chemically synthesized
tagttcactgaaataagataaa

SEQ ID NO: 1284307 - DNA, 22 bp, Artificial Sequence
  chemically synthesized
ttagttcactgaaataagataa

SEQ ID NO: 1284308 - DNA, 22 bp, Artificial Sequence
  chemically synthesized
tttatcttatttcagtgaacta

SEQ ID NO: 1284309 - DNA, 22 bp, Artificial Sequence
  chemically synthesized
atcttatttcagtgaactaaaa

SEQ ID NO: 1284310 - DNA, 22 bp, Artificial Sequence
  chemically synthesized
tcttatttcagtgaactaaaag

SEQ ID NO: 1284311 - DNA, 22 bp, Artificial Sequence
  chemically synthesized
atttcagtgaactaaaaggtta

SEQ ID NO: 1284312 - DNA, 22 bp, Artificial Sequence
  chemically synthesized
tttcagtgaactaaaaggttat

SEQ ID NO: 1284313 - DNA, 22 bp, Artificial Sequence
  chemically synthesized
caagaaatgcaaataacctttt

SEQ ID NO: 1284314 - DNA, 22 bp, Artificial Sequence
  chemically synthesized
acaagaaatgcaaataaccttt

SEQ ID NO: 1284315 - DNA, 22 bp, Artificial Sequence
  chemically synthesized
tacaagaaatgcaaataacctt

SEQ ID NO: 1284316 - DNA, 22 bp, Artificial Sequence
  chemically synthesized
cagtgaactaaaaggttatttg

SEQ ID NO: 1284317 - DNA, 22 bp, Artificial Sequence
  chemically synthesized
agtgaactaaaaggttatttgc

SEQ ID NO: 1284318 - DNA, 22 bp, Artificial Sequence
  chemically synthesized
aaaggttatttgcatttcttgt

SEQ ID NO: 1284319 - DNA, 22 bp, Artificial Sequence
  chemically synthesized
aagggatgagcacactttacaa

SEQ ID NO: 1284320 - DNA, 22 bp, Artificial Sequence
  chemically synthesized
aaagggatgagcacactttaca

SEQ ID NO: 1284321 - DNA, 22 bp, Artificial Sequence
  chemically synthesized
tttgcatttcttgtaaagtgtg

SEQ ID NO: 1284322 - DNA, 22 bp, Artificial Sequence
  chemically synthesized
gcatttcttgtaaagtgtgctc

SEQ ID NO: 1284323 - DNA, 22 bp, Artificial Sequence
  chemically synthesized
catttcttgtaaagtgtgctca

SEQ ID NO: 1284324 - DNA, 22 bp, Artificial Sequence
  chemically synthesized
aaacttaaagggatgagcacac

SEQ ID NO: 1284325 - DNA, 22 bp, Artificial Sequence
  chemically synthesized
cttgtaaagtgtgctcatccct

SEQ ID NO: 1284326 - DNA, 22 bp, Artificial Sequence
  chemically synthesized
actgaaacttaaagggatgagc

SEQ ID NO: 1284327 - DNA, 22 bp, Artificial Sequence
  chemically synthesized
ttgtaaagtgtgctcatccctt

SEQ ID NO: 1284328 - DNA, 22 bp, Artificial Sequence
  chemically synthesized
gtaaagtgtgctcatcccttta

SEQ ID NO: 1284329 - DNA, 22 bp, Artificial Sequence
  chemically synthesized
taaagtgtgctcatccctttaa

SEQ ID NO: 1284330 - DNA, 22 bp, Artificial Sequence
  chemically synthesized
aaacagttcactgaaacttaaa

SEQ ID NO: 1284331 - DNA, 22 bp, Artificial Sequence
  chemically synthesized
tcaaacagttcactgaaactta

SEQ ID NO: 1284332 - DNA, 22 bp, Artificial Sequence
  chemically synthesized
ctcaaacagttcactgaaactt

SEQ ID NO: 1284333 - DNA, 22 bp, Artificial Sequence
  chemically synthesized
atccctttaagtttcagtgaac

SEQ ID NO: 1284334 - DNA, 22 bp, Artificial Sequence
  chemically synthesized
tgtcttctcaaacagttcactg

SEQ ID NO: 1284335 - DNA, 22 bp, Artificial Sequence
  chemically synthesized
cctatgtcttctcaaacagttc

SEQ ID NO: 1284336 - DNA, 22 bp, Artificial Sequence
  chemically synthesized
taagtttcagtgaactgtttga

SEQ ID NO: 1284337 - DNA, 22 bp, Artificial Sequence
  chemically synthesized
aagtttcagtgaactgtttgag

SEQ ID NO: 1284338 - DNA, 22 bp, Artificial Sequence
  chemically synthesized
agtttcagtgaactgtttgaga

SEQ ID NO: 1284339 - DNA, 22 bp, Artificial Sequence
  chemically synthesized
ccattccctatgtcttctcaaa

SEQ ID NO: 1284340 - DNA, 22 bp, Artificial Sequence
  chemically synthesized
cagtgaactgtttgagaagaca

SEQ ID NO: 1284341 - DNA, 22 bp, Artificial Sequence
  chemically synthesized
agtgaactgtttgagaagacat

SEQ ID NO: 1284342 - DNA, 22 bp, Artificial Sequence
  chemically synthesized
tttgagaagacatagggaatgg

SEQ ID NO: 1284343 - DNA, 22 bp, Artificial Sequence
  chemically synthesized
gagaagacatagggaatgggaa

SEQ ID NO: 1284344 - DNA, 22 bp, Artificial Sequence
  chemically synthesized
taataaaatgcattcccattcc

SEQ ID NO: 1284345 - DNA, 22 bp, Artificial Sequence
  chemically synthesized
agaagacatagggaatgggaat

SEQ ID NO: 1284346 - DNA, 22 bp, Artificial Sequence
  chemically synthesized
caaataaagggaaaggttgtaa

SEQ ID NO: 1284347 - DNA, 22 bp, Artificial Sequence
  chemically synthesized
ccaaataaagggaaaggttgta

SEQ ID NO: 1284348 - DNA, 22 bp, Artificial Sequence
  chemically synthesized
tccaaataaagggaaaggttgt

SEQ ID NO: 1284349 - DNA, 22 bp, Artificial Sequence
  chemically synthesized
tattacaacctttccctttatt

SEQ ID NO: 1284350 - DNA, 22 bp, Artificial Sequence
  chemically synthesized
attacaacctttccctttattt

SEQ ID NO: 1284351 - DNA, 22 bp, Artificial Sequence
  chemically synthesized
ttacaacctttccctttatttg

SEQ ID NO: 1284352 - DNA, 22 bp, Artificial Sequence
  chemically synthesized
ccgaataatctttccaaataaa

SEQ ID NO: 1284353 - DNA, 22 bp, Artificial Sequence
  chemically synthesized
caacctttccctttatttggaa

SEQ ID NO: 1284354 - DNA, 22 bp, Artificial Sequence
  chemically synthesized
tccctttatttggaaagattat

SEQ ID NO: 1284355 - DNA, 22 bp, Artificial Sequence
  chemically synthesized
ccctttatttggaaagattatt

SEQ ID NO: 1284356 - DNA, 22 bp, Artificial Sequence
  chemically synthesized
cctttatttggaaagattattc

SEQ ID NO: 1284357 - DNA, 22 bp, Artificial Sequence
  chemically synthesized
agaaacagctaccgaataatct

SEQ ID NO: 1284358 - DNA, 22 bp, Artificial Sequence
  chemically synthesized
cagaaacagctaccgaataatc

SEQ ID NO: 1284359 - DNA, 22 bp, Artificial Sequence
  chemically synthesized
tatttggaaagattattcggta

SEQ ID NO: 1284360 - DNA, 22 bp, Artificial Sequence
  chemically synthesized
atttggaaagattattcggtag

SEQ ID NO: 1284361 - DNA, 22 bp, Artificial Sequence
  chemically synthesized
tttggaaagattattcggtagc

SEQ ID NO: 1284362 - DNA, 22 bp, Artificial Sequence
  chemically synthesized
ggaaagattattcggtagctgt

SEQ ID NO: 1284363 - DNA, 22 bp, Artificial Sequence
  chemically synthesized
gacatttcagaaacagctaccg

SEQ ID NO: 1284364 - DNA, 22 bp, Artificial Sequence
  chemically synthesized
gaaagattattcggtagctgtt

SEQ ID NO: 1284365 - DNA, 22 bp, Artificial Sequence
  chemically synthesized
ttcggtagctgtttctgaaatg

SEQ ID NO: 1284366 - DNA, 22 bp, Artificial Sequence
  chemically synthesized
acagtagtactagacatttcag

SEQ ID NO: 1284367 - DNA, 22 bp, Artificial Sequence
  chemically synthesized
ggtagctgtttctgaaatgtct

SEQ ID NO: 1284368 - DNA, 22 bp, Artificial Sequence
  chemically synthesized
cacagtagtactagacatttca

SEQ ID NO: 1284369 - DNA, 22 bp, Artificial Sequence
  chemically synthesized
tcacagtagtactagacatttc

SEQ ID NO: 1284370 - DNA, 22 bp, Artificial Sequence
  chemically synthesized
ttcacagtagtactagacattt

SEQ ID NO: 1284371 - DNA, 22 bp, Artificial Sequence
  chemically synthesized
gtttttcacagtagtactagac

SEQ ID NO: 1284372 - DNA, 22 bp, Artificial Sequence
  chemically synthesized
tttctgaaatgtctagtactac

SEQ ID NO: 1284373 - DNA, 22 bp, Artificial Sequence
  chemically synthesized
ctgaaatgtctagtactactgt

SEQ ID NO: 1284374 - DNA, 22 bp, Artificial Sequence
  chemically synthesized
tgaaatgtctagtactactgtg

SEQ ID NO: 1284375 - DNA, 22 bp, Artificial Sequence
  chemically synthesized
aaatgtctagtactactgtgaa

SEQ ID NO: 1284376 - DNA, 22 bp, Artificial Sequence
  chemically synthesized
tgggtactagtttttcacagta

SEQ ID NO: 1284377 - DNA, 22 bp, Artificial Sequence
  chemically synthesized
tattgtgggtactagtttttca

SEQ ID NO: 1284378 - DNA, 22 bp, Artificial Sequence
  chemically synthesized
gtactactgtgaaaaactagta

SEQ ID NO: 1284379 - DNA, 22 bp, Artificial Sequence
  chemically synthesized
gaactatattgtgggtactagt

SEQ ID NO: 1284380 - DNA, 22 bp, Artificial Sequence
  chemically synthesized
tagaactatattgtgggtacta

SEQ ID NO: 1284381 - DNA, 22 bp, Artificial Sequence
  chemically synthesized
ctgtgaaaaactagtacccaca

SEQ ID NO: 1284382 - DNA, 22 bp, Artificial Sequence
  chemically synthesized
ctagaactatattgtgggtact

SEQ ID NO: 1284383 - DNA, 22 bp, Artificial Sequence
  chemically synthesized
tgaaaaactagtacccacaata

SEQ ID NO: 1284384 - DNA, 22 bp, Artificial Sequence
  chemically synthesized
tttctagaactatattgtgggt

SEQ ID NO: 1284385 - DNA, 22 bp, Artificial Sequence
  chemically synthesized
tgtttctagaactatattgtgg

SEQ ID NO: 1284386 - DNA, 22 bp, Artificial Sequence
  chemically synthesized
ttctgtttctagaactatattg

SEQ ID NO: 1284387 - DNA, 22 bp, Artificial Sequence
  chemically synthesized
tctattctgtttctagaactat

SEQ ID NO: 1284388 - DNA, 22 bp, Artificial Sequence
  chemically synthesized
gtacccacaatatagttctaga

SEQ ID NO: 1284389 - DNA, 22 bp, Artificial Sequence
  chemically synthesized
gtctattctgtttctagaacta

SEQ ID NO: 1284390 - DNA, 22 bp, Artificial Sequence
  chemically synthesized
tgtctattctgtttctagaact

SEQ ID NO: 1284391 - DNA, 22 bp, Artificial Sequence
  chemically synthesized
tagaaacagaatagacaaagtt

SEQ ID NO: 1284392 - DNA, 22 bp, Artificial Sequence
  chemically synthesized
gaaacagaatagacaaagttgc

SEQ ID NO: 1284393 - DNA, 22 bp, Artificial Sequence
  chemically synthesized
gtagacagaaagatatcagaag

SEQ ID NO: 1284394 - DNA, 22 bp, Artificial Sequence
  chemically synthesized
actagtagacagaaagatatca

SEQ ID NO: 1284395 - DNA, 22 bp, Artificial Sequence
  chemically synthesized
ctgactagtagacagaaagata

SEQ ID NO: 1284396 - DNA, 22 bp, Artificial Sequence
  chemically synthesized
cttctgatatctttctgtctac

SEQ ID NO: 1284397 - DNA, 22 bp, Artificial Sequence
  chemically synthesized
cattcctgactagtagacagaa

SEQ ID NO: 1284398 - DNA, 22 bp, Artificial Sequence
  chemically synthesized
gcattcctgactagtagacaga

SEQ ID NO: 1284399 - DNA, 22 bp, Artificial Sequence
  chemically synthesized
ctgatatctttctgtctactag

SEQ ID NO: 1284400 - DNA, 22 bp, Artificial Sequence
  chemically synthesized
tgatatctttctgtctactagt

SEQ ID NO: 1284401 - DNA, 22 bp, Artificial Sequence
  chemically synthesized
tcttgcattcctgactagtaga

SEQ ID NO: 1284402 - DNA, 22 bp, Artificial Sequence
  chemically synthesized
atatctttctgtctactagtca

SEQ ID NO: 1284403 - DNA, 22 bp, Artificial Sequence
  chemically synthesized
aaattgtcttgcattcctgact

SEQ ID NO: 1284404 - DNA, 22 bp, Artificial Sequence
  chemically synthesized
tctgtctactagtcaggaatgc

SEQ ID NO: 1284405 - DNA, 22 bp, Artificial Sequence
  chemically synthesized
ctgtctactagtcaggaatgca

SEQ ID NO: 1284406 - DNA, 22 bp, Artificial Sequence
  chemically synthesized
tgtctactagtcaggaatgcaa

SEQ ID NO: 1284407 - DNA, 22 bp, Artificial Sequence
  chemically synthesized
atctgaaattgtcttgcattcc

SEQ ID NO: 1284408 - DNA, 22 bp, Artificial Sequence
  chemically synthesized
tctactagtcaggaatgcaaga

SEQ ID NO: 1284409 - DNA, 22 bp, Artificial Sequence
  chemically synthesized
ctagtcaggaatgcaagacaat

SEQ ID NO: 1284410 - DNA, 22 bp, Artificial Sequence
  chemically synthesized
gtcaggaatgcaagacaatttc

SEQ ID NO: 1284411 - DNA, 22 bp, Artificial Sequence
  chemically synthesized
atagtagaaggatcattgatct

SEQ ID NO: 1284412 - DNA, 22 bp, Artificial Sequence
  chemically synthesized
gatagtagaaggatcattgatc

SEQ ID NO: 1284413 - DNA, 22 bp, Artificial Sequence
  chemically synthesized
tgatagtagaaggatcattgat

SEQ ID NO: 1284414 - DNA, 22 bp, Artificial Sequence
  chemically synthesized
ttgatagtagaaggatcattga

SEQ ID NO: 1284415 - DNA, 22 bp, Artificial Sequence
  chemically synthesized
cagatcaatgatccttctacta

SEQ ID NO: 1284416 - DNA, 22 bp, Artificial Sequence
  chemically synthesized
agatcaatgatccttctactat

SEQ ID NO: 1284417 - DNA, 22 bp, Artificial Sequence
  chemically synthesized
ggtcccatgacttttgatagta

SEQ ID NO: 1284418 - DNA, 22 bp, Artificial Sequence
  chemically synthesized
aggtcccatgacttttgatagt

SEQ ID NO: 1284419 - DNA, 22 bp, Artificial Sequence
  chemically synthesized
atccttaggtcccatgactttt

SEQ ID NO: 1284420 - DNA, 22 bp, Artificial Sequence
  chemically synthesized
gatccttaggtcccatgacttt

SEQ ID NO: 1284421 - DNA, 22 bp, Artificial Sequence
  chemically synthesized
ctactatcaaaagtcatgggac

SEQ ID NO: 1284422 - DNA, 22 bp, Artificial Sequence
  chemically synthesized
tactatcaaaagtcatgggacc

SEQ ID NO: 1284423 - DNA, 22 bp, Artificial Sequence
  chemically synthesized
ctatcaaaagtcatgggaccta

SEQ ID NO: 1284424 - DNA, 22 bp, Artificial Sequence
  chemically synthesized
tcaaaagtcatgggacctaagg

SEQ ID NO: 1284425 - DNA, 22 bp, Artificial Sequence
  chemically synthesized
aaatggagcaaaaataaaagtg

SEQ ID NO: 1284426 - DNA, 22 bp, Artificial Sequence
  chemically synthesized
aggatcaagatcacttttattt

SEQ ID NO: 1284427 - DNA, 22 bp, Artificial Sequence
  chemically synthesized
gataattcaaatggagcaaaaa

SEQ ID NO: 1284428 - DNA, 22 bp, Artificial Sequence
  chemically synthesized
cctggataattcaaatggagca

SEQ ID NO: 1284429 - DNA, 22 bp, Artificial Sequence
  chemically synthesized
gcctggataattcaaatggagc

SEQ ID NO: 1284430 - DNA, 22 bp, Artificial Sequence
  chemically synthesized
tgcctggataattcaaatggag

SEQ ID NO: 1284431 - DNA, 22 bp, Artificial Sequence
  chemically synthesized
ttatttttgctccatttgaatt

SEQ ID NO: 1284432 - DNA, 22 bp, Artificial Sequence
  chemically synthesized
tatttttgctccatttgaatta

SEQ ID NO: 1284433 - DNA, 22 bp, Artificial Sequence
  chemically synthesized
gttttgcctggataattcaaat

SEQ ID NO: 1284434 - DNA, 22 bp, Artificial Sequence
  chemically synthesized
atttttgctccatttgaattat

SEQ ID NO: 1284435 - DNA, 22 bp, Artificial Sequence
  chemically synthesized
tttttgctccatttgaattatc

SEQ ID NO: 1284436 - DNA, 22 bp, Artificial Sequence
  chemically synthesized
ttgctccatttgaattatccag

SEQ ID NO: 1284437 - DNA, 22 bp, Artificial Sequence
  chemically synthesized
tgctccatttgaattatccagg

SEQ ID NO: 1284438 - DNA, 22 bp, Artificial Sequence
  chemically synthesized
gctccatttgaattatccaggc

SEQ ID NO: 1284439 - DNA, 22 bp, Artificial Sequence
  chemically synthesized
ctccatttgaattatccaggca

SEQ ID NO: 1284440 - DNA, 22 bp, Artificial Sequence
  chemically synthesized
tgtcattggttttgcctggata

SEQ ID NO: 1284441 - DNA, 22 bp, Artificial Sequence
  chemically synthesized
atgtcattggttttgcctggat

SEQ ID NO: 1284442 - DNA, 22 bp, Artificial Sequence
  chemically synthesized
catttgaattatccaggcaaaa

SEQ ID NO: 1284443 - DNA, 22 bp, Artificial Sequence
  chemically synthesized
atttatgtcattggttttgcct

SEQ ID NO: 1284444 - DNA, 22 bp, Artificial Sequence
  chemically synthesized
gaattatccaggcaaaaccaat

SEQ ID NO: 1284445 - DNA, 22 bp, Artificial Sequence
  chemically synthesized
aattatccaggcaaaaccaatg

SEQ ID NO: 1284446 - DNA, 22 bp, Artificial Sequence
  chemically synthesized
tccaggcaaaaccaatgacata

SEQ ID NO: 1284447 - DNA, 22 bp, Artificial Sequence
  chemically synthesized
gatcaggcatagggatgtcagg

SEQ ID NO: 1284448 - DNA, 22 bp, Artificial Sequence
  chemically synthesized
ctagatcaggcatagggatgtc

SEQ ID NO: 1284449 - DNA, 22 bp, Artificial Sequence
  chemically synthesized
acgtgacctgacatccctatgc

SEQ ID NO: 1284450 - DNA, 22 bp, Artificial Sequence
  chemically synthesized
cgtgacctgacatccctatgcc

SEQ ID NO: 1284451 - DNA, 22 bp, Artificial Sequence
  chemically synthesized
acatccctatgcctgatctagc

SEQ ID NO: 1284452 - DNA, 22 bp, Artificial Sequence
  chemically synthesized
atgtcacagtcctgctagatca

SEQ ID NO: 1284453 - DNA, 22 bp, Artificial Sequence
  chemically synthesized
ttgatgtcacagtcctgctaga

SEQ ID NO: 1284454 - DNA, 22 bp, Artificial Sequence
  chemically synthesized
ctgttgatgtcacagtcctgct

SEQ ID NO: 1284455 - DNA, 22 bp, Artificial Sequence
  chemically synthesized
actgttgatgtcacagtcctgc

SEQ ID NO: 1284456 - DNA, 22 bp, Artificial Sequence
  chemically synthesized
tgcctgatctagcaggactgtg

SEQ ID NO: 1284457 - DNA, 22 bp, Artificial Sequence
  chemically synthesized
tactgttgatgtcacagtcctg

SEQ ID NO: 1284458 - DNA, 22 bp, Artificial Sequence
  chemically synthesized
gctttactgttgatgtcacagt

SEQ ID NO: 1284459 - DNA, 22 bp, Artificial Sequence
  chemically synthesized
atctagcaggactgtgacatca

SEQ ID NO: 1284460 - DNA, 22 bp, Artificial Sequence
  chemically synthesized
gcaggactgtgacatcaacagt

SEQ ID NO: 1284461 - DNA, 22 bp, Artificial Sequence
  chemically synthesized
atccgtctagctttactgttga

SEQ ID NO: 1284462 - DNA, 22 bp, Artificial Sequence
  chemically synthesized
gatccgtctagctttactgttg

SEQ ID NO: 1284463 - DNA, 22 bp, Artificial Sequence
  chemically synthesized
tgatccgtctagctttactgtt

SEQ ID NO: 1284464 - DNA, 22 bp, Artificial Sequence
  chemically synthesized
ttgatccgtctagctttactgt

SEQ ID NO: 1284465 - DNA, 22 bp, Artificial Sequence
  chemically synthesized
tgacatcaacagtaaagctaga

SEQ ID NO: 1284466 - DNA, 22 bp, Artificial Sequence
  chemically synthesized
gaggcaccttttgatccgtcta

SEQ ID NO: 1284467 - DNA, 22 bp, Artificial Sequence
  chemically synthesized
acacgggcattggaggcacctt

SEQ ID NO: 1284468 - DNA, 22 bp, Artificial Sequence
  chemically synthesized
gacggatcaaaaggtgcctcca

SEQ ID NO: 1284469 - DNA, 22 bp, Artificial Sequence
  chemically synthesized
acgctgacacgggcattggagg

SEQ ID NO: 1284470 - DNA, 22 bp, Artificial Sequence
  chemically synthesized
aagctgacgctgacacgggcat

SEQ ID NO: 1284471 - DNA, 22 bp, Artificial Sequence
  chemically synthesized
ctgaagctgacgctgacacggg

SEQ ID NO: 1284472 - DNA, 22 bp, Artificial Sequence
  chemically synthesized
tgctgaagctgacgctgacacg

SEQ ID NO: 1284473 - DNA, 22 bp, Artificial Sequence
  chemically synthesized
ctgctgaagctgacgctgacac

SEQ ID NO: 1284474 - DNA, 22 bp, Artificial Sequence
  chemically synthesized
caatgcccgtgtcagcgtcagc

SEQ ID NO: 1284475 - DNA, 22 bp, Artificial Sequence
  chemically synthesized
aagcaggaatgccaagtgggga

SEQ ID NO: 1284476 - DNA, 22 bp, Artificial Sequence
  chemically synthesized
cagcagaagctccccacttggc

SEQ ID NO: 1284477 - DNA, 22 bp, Artificial Sequence
  chemically synthesized
agcagaagctccccacttggca

SEQ ID NO: 1284478 - DNA, 22 bp, Artificial Sequence
  chemically synthesized
caaagcactcaagcaggaatgc

SEQ ID NO: 1284479 - DNA, 22 bp, Artificial Sequence
  chemically synthesized
cccacttggcattcctgcttga

SEQ ID NO: 1284480 - DNA, 22 bp, Artificial Sequence
  chemically synthesized
ggcattcctgcttgagtgcttt

SEQ ID NO: 1284481 - DNA, 22 bp, Artificial Sequence
  chemically synthesized
gcattcctgcttgagtgctttg

SEQ ID NO: 1284482 - DNA, 22 bp, Artificial Sequence
  chemically synthesized
ctgcttgagtgctttgcagtcc

SEQ ID NO: 1284483 - DNA, 22 bp, Artificial Sequence
  chemically synthesized
ggtgacatgccaggactgcaaa

SEQ ID NO: 1284484 - DNA, 22 bp, Artificial Sequence
  chemically synthesized
cttgagtgctttgcagtcctgg

SEQ ID NO: 1284485 - DNA, 22 bp, Artificial Sequence
  chemically synthesized
gagtgctttgcagtcctggcat

SEQ ID NO: 1284486 - DNA, 22 bp, Artificial Sequence
  chemically synthesized
agtgctttgcagtcctggcatg

SEQ ID NO: 1284487 - DNA, 22 bp, Artificial Sequence
  chemically synthesized
tgcagtcctggcatgtcaccta

SEQ ID NO: 1284488 - DNA, 22 bp, Artificial Sequence
  chemically synthesized
gcagtcctggcatgtcacctaa

SEQ ID NO: 1284489 - DNA, 22 bp, Artificial Sequence
  chemically synthesized
cagtcctggcatgtcacctaac

SEQ ID NO: 1284490 - DNA, 22 bp, Artificial Sequence
  chemically synthesized
ggaagcaccagccagttaggtg

SEQ ID NO: 1284491 - DNA, 22 bp, Artificial Sequence
  chemically synthesized
ttaggaagcaccagccagttag

SEQ ID NO: 1284492 - DNA, 22 bp, Artificial Sequence
  chemically synthesized
gcatgtcacctaactggctggt

SEQ ID NO: 1284493 - DNA, 22 bp, Artificial Sequence
  chemically synthesized
actggctggtgcttcctaatag

SEQ ID NO: 1284494 - DNA, 22 bp, Artificial Sequence
  chemically synthesized
gctggtgcttcctaataggccc

SEQ ID NO: 1284495 - DNA, 22 bp, Artificial Sequence
  chemically synthesized
gtgcttcctaataggccctaca

SEQ ID NO: 1284496 - DNA, 22 bp, Artificial Sequence
  chemically synthesized
cctaataggccctacaccactt

SEQ ID NO: 1284497 - DNA, 22 bp, Artificial Sequence
  chemically synthesized
ctaataggccctacaccacttc

SEQ ID NO: 1284498 - DNA, 22 bp, Artificial Sequence
  chemically synthesized
acacatcaatcagaagtggtgt

SEQ ID NO: 1284499 - DNA, 22 bp, Artificial Sequence
  chemically synthesized
ataggccctacaccacttctga

SEQ ID NO: 1284500 - DNA, 22 bp, Artificial Sequence
  chemically synthesized
catattcacacatcaatcagaa

SEQ ID NO: 1284501 - DNA, 22 bp, Artificial Sequence
  chemically synthesized
gcatattcacacatcaatcaga

SEQ ID NO: 1284502 - DNA, 22 bp, Artificial Sequence
  chemically synthesized
caccacttctgattgatgtgtg

SEQ ID NO: 1284503 - DNA, 22 bp, Artificial Sequence
  chemically synthesized
cagtaaggtttgcatattcaca

SEQ ID NO: 1284504 - DNA, 22 bp, Artificial Sequence
  chemically synthesized
ctgattgatgtgtgaatatgca

SEQ ID NO: 1284505 - DNA, 22 bp, Artificial Sequence
  chemically synthesized
tgattgatgtgtgaatatgcaa

SEQ ID NO: 1284506 - DNA, 22 bp, Artificial Sequence
  chemically synthesized
attgatgtgtgaatatgcaaac

SEQ ID NO: 1284507 - DNA, 22 bp, Artificial Sequence
  chemically synthesized
gattccagtaaggtttgcatat

SEQ ID NO: 1284508 - DNA, 22 bp, Artificial Sequence
  chemically synthesized
ctggattccagtaaggtttgca

SEQ ID NO: 1284509 - DNA, 22 bp, Artificial Sequence
  chemically synthesized
atgtgtgaatatgcaaacctta

SEQ ID NO: 1284510 - DNA, 22 bp, Artificial Sequence
  chemically synthesized
gctcctggattccagtaaggtt

SEQ ID NO: 1284511 - DNA, 22 bp, Artificial Sequence
  chemically synthesized
gtatgtgggccatctggctcct

SEQ ID NO: 1284512 - DNA, 22 bp, Artificial Sequence
  chemically synthesized
ggtatgtgggccatctggctcc

SEQ ID NO: 1284513 - DNA, 22 bp, Artificial Sequence
  chemically synthesized
actggaatccaggagccagatg

SEQ ID NO: 1284514 - DNA, 22 bp, Artificial Sequence
  chemically synthesized
ctggaatccaggagccagatgg

SEQ ID NO: 1284515 - DNA, 22 bp, Artificial Sequence
  chemically synthesized
gaatccaggagccagatggccc

SEQ ID NO: 1284516 - DNA, 22 bp, Artificial Sequence
  chemically synthesized
tacttggtatgtgggccatctg

SEQ ID NO: 1284517 - DNA, 22 bp, Artificial Sequence
  chemically synthesized
ctatacttggtatgtgggccat

SEQ ID NO: 1284518 - DNA, 22 bp, Artificial Sequence
  chemically synthesized
gctgctatacttggtatgtggg

SEQ ID NO: 1284519 - DNA, 22 bp, Artificial Sequence
  chemically synthesized
tctggctgctatacttggtatg

SEQ ID NO: 1284520 - DNA, 22 bp, Artificial Sequence
  chemically synthesized
gtctggctgctatacttggtat

SEQ ID NO: 1284521 - DNA, 22 bp, Artificial Sequence
  chemically synthesized
tgtctggctgctatacttggta

SEQ ID NO: 1284522 - DNA, 22 bp, Artificial Sequence
  chemically synthesized
ttttgtctggctgctatacttg

SEQ ID NO: 1284523 - DNA, 22 bp, Artificial Sequence
  chemically synthesized
tgttttgtctggctgctatact

SEQ ID NO: 1284524 - DNA, 22 bp, Artificial Sequence
  chemically synthesized
cctctgttttgtctggctgcta

SEQ ID NO: 1284525 - DNA, 22 bp, Artificial Sequence
  chemically synthesized
aatctgcctctgttttgtctgg

SEQ ID NO: 1284526 - DNA, 22 bp, Artificial Sequence
  chemically synthesized
ctgaatctgcctctgttttgtc

SEQ ID NO: 1284527 - DNA, 22 bp, Artificial Sequence
  chemically synthesized
gctgaatctgcctctgttttgt

SEQ ID NO: 1284528 - DNA, 22 bp, Artificial Sequence
  chemically synthesized
caacagtttgctgaatctgcct

SEQ ID NO: 1284529 - DNA, 22 bp, Artificial Sequence
  chemically synthesized
tccaacagtttgctgaatctgc

SEQ ID NO: 1284530 - DNA, 22 bp, Artificial Sequence
  chemically synthesized
agcaaactgttggagagttaca

SEQ ID NO: 1284531 - DNA, 22 bp, Artificial Sequence
  chemically synthesized
taggaatcaccaaaaatgtaac

SEQ ID NO: 1284532 - DNA, 22 bp, Artificial Sequence
  chemically synthesized
ttggagagttacatttttggtg

SEQ ID NO: 1284533 - DNA, 22 bp, Artificial Sequence
  chemically synthesized
gagagttacatttttggtgatt

SEQ ID NO: 1284534 - DNA, 22 bp, Artificial Sequence
  chemically synthesized
ggtgtctgtaggaatcaccaaa

SEQ ID NO: 1284535 - DNA, 22 bp, Artificial Sequence
  chemically synthesized
aggtgtctgtaggaatcaccaa

SEQ ID NO: 1284536 - DNA, 22 bp, Artificial Sequence
  chemically synthesized
catttttggtgattcctacaga

SEQ ID NO: 1284537 - DNA, 22 bp, Artificial Sequence
  chemically synthesized
tgtatacttaggtgtctgtagg

SEQ ID NO: 1284538 - DNA, 22 bp, Artificial Sequence
  chemically synthesized
ttggtgattcctacagacacct

SEQ ID NO: 1284539 - DNA, 22 bp, Artificial Sequence
  chemically synthesized
tggtgattcctacagacaccta

SEQ ID NO: 1284540 - DNA, 22 bp, Artificial Sequence
  chemically synthesized
ggtgattcctacagacacctaa

SEQ ID NO: 1284541 - DNA, 22 bp, Artificial Sequence
  chemically synthesized
gtgattcctacagacacctaag

SEQ ID NO: 1284542 - DNA, 22 bp, Artificial Sequence
  chemically synthesized
aataggactatgtatacttagg

SEQ ID NO: 1284543 - DNA, 22 bp, Artificial Sequence
  chemically synthesized
ctacagacacctaagtatacat

SEQ ID NO: 1284544 - DNA, 22 bp, Artificial Sequence
  chemically synthesized
cagacacctaagtatacatagt

SEQ ID NO: 1284545 - DNA, 22 bp, Artificial Sequence
  chemically synthesized
agtatacatagtcctatttaat

SEQ ID NO: 1284546 - DNA, 22 bp, Artificial Sequence
  chemically synthesized
acatggaatgaaatcaattaaa

SEQ ID NO: 1284547 - DNA, 22 bp, Artificial Sequence
  chemically synthesized
tgggttaacatggaatgaaatc

SEQ ID NO: 1284548 - DNA, 22 bp, Artificial Sequence
  chemically synthesized
ttgtgggttaacatggaatgaa

SEQ ID NO: 1284549 - DNA, 22 bp, Artificial Sequence
  chemically synthesized
tttaattgatttcattccatgt

SEQ ID NO: 1284550 - DNA, 22 bp, Artificial Sequence
  chemically synthesized
ttgttgtgggttaacatggaat

SEQ ID NO: 1284551 - DNA, 22 bp, Artificial Sequence
  chemically synthesized
aattgatttcattccatgttaa

SEQ ID NO: 1284552 - DNA, 22 bp, Artificial Sequence
  chemically synthesized
attgatttcattccatgttaac

SEQ ID NO: 1284553 - DNA, 22 bp, Artificial Sequence
  chemically synthesized
atttcattccatgttaacccac

SEQ ID NO: 1284554 - DNA, 22 bp, Artificial Sequence
  chemically synthesized
cattccatgttaacccacaaca

SEQ ID NO: 1284555 - DNA, 22 bp, Artificial Sequence
  chemically synthesized
attccatgttaacccacaacaa

SEQ ID NO: 1284556 - DNA, 22 bp, Artificial Sequence
  chemically synthesized
atgacagaggcactattgttgt

SEQ ID NO: 1284557 - DNA, 22 bp, Artificial Sequence
  chemically synthesized
catgttaacccacaacaatagt

SEQ ID NO: 1284558 - DNA, 22 bp, Artificial Sequence
  chemically synthesized
aatgacagaggcactattgttg

SEQ ID NO: 1284559 - DNA, 22 bp, Artificial Sequence
  chemically synthesized
acccacaacaatagtgcctctg

SEQ ID NO: 1284560 - DNA, 22 bp, Artificial Sequence
  chemically synthesized
gaatgtggcagtttaatgacag

SEQ ID NO: 1284561 - DNA, 22 bp, Artificial Sequence
  chemically synthesized
attagaatgtggcagtttaatg

SEQ ID NO: 1284562 - DNA, 22 bp, Artificial Sequence
  chemically synthesized
aattagaatgtggcagtttaat

SEQ ID NO: 1284563 - DNA, 22 bp, Artificial Sequence
  chemically synthesized
taattagaatgtggcagtttaa

SEQ ID NO: 1284564 - DNA, 22 bp, Artificial Sequence
  chemically synthesized
ctttaattagaatgtggcagtt

SEQ ID NO: 1284565 - DNA, 22 bp, Artificial Sequence
  chemically synthesized
tcctttaattagaatgtggcag

SEQ ID NO: 1284566 - DNA, 22 bp, Artificial Sequence
  chemically synthesized
ctcctttaattagaatgtggca

SEQ ID NO: 1284567 - DNA, 22 bp, Artificial Sequence
  chemically synthesized
tgtcattaaactgccacattct

SEQ ID NO: 1284568 - DNA, 22 bp, Artificial Sequence
  chemically synthesized
tctcctttaattagaatgtggc

SEQ ID NO: 1284569 - DNA, 22 bp, Artificial Sequence
  chemically synthesized
tcattaaactgccacattctaa

SEQ ID NO: 1284570 - DNA, 22 bp, Artificial Sequence
  chemically synthesized
aactgccacattctaattaaag

SEQ ID NO: 1284571 - DNA, 22 bp, Artificial Sequence
  chemically synthesized
ccacattctaattaaaggagaa

SEQ ID NO: 1284572 - DNA, 22 bp, Artificial Sequence
  chemically synthesized
taattaaaggagaaaattcttt

SEQ ID NO: 1284573 - DNA, 22 bp, Artificial Sequence
  chemically synthesized
attaaaggagaaaattctttct

SEQ ID NO: 1284574 - DNA, 22 bp, Artificial Sequence
  chemically synthesized
aatggaaaggagaaaagaaaga

SEQ ID NO: 1284575 - DNA, 22 bp, Artificial Sequence
  chemically synthesized
aaggagaaaattctttcttttc

SEQ ID NO: 1284576 - DNA, 22 bp, Artificial Sequence
  chemically synthesized
atgctaaatggaaaggagaaaa

SEQ ID NO: 1284577 - DNA, 22 bp, Artificial Sequence
  chemically synthesized
catgctaaatggaaaggagaaa

SEQ ID NO: 1284578 - DNA, 22 bp, Artificial Sequence
  chemically synthesized
atttcatgctaaatggaaagga

SEQ ID NO: 1284579 - DNA, 22 bp, Artificial Sequence
  chemically synthesized
catttcatgctaaatggaaagg

SEQ ID NO: 1284580 - DNA, 22 bp, Artificial Sequence
  chemically synthesized
tttcttttctcctttccattta

SEQ ID NO: 1284581 - DNA, 22 bp, Artificial Sequence
  chemically synthesized
tcttttctcctttccatttagc

SEQ ID NO: 1284582 - DNA, 22 bp, Artificial Sequence
  chemically synthesized
cttttctcctttccatttagca

SEQ ID NO: 1284583 - DNA, 22 bp, Artificial Sequence
  chemically synthesized
ttttctcctttccatttagcat

SEQ ID NO: 1284584 - DNA, 22 bp, Artificial Sequence
  chemically synthesized
ttctcctttccatttagcatga

SEQ ID NO: 1284585 - DNA, 22 bp, Artificial Sequence
  chemically synthesized
tctcctttccatttagcatgaa

SEQ ID NO: 1284586 - DNA, 22 bp, Artificial Sequence
  chemically synthesized
ctcctttccatttagcatgaaa

SEQ ID NO: 1284587 - DNA, 22 bp, Artificial Sequence
  chemically synthesized
taaaagccttcatttcatgcta

SEQ ID NO: 1284588 - DNA, 22 bp, Artificial Sequence
  chemically synthesized
tcctttccatttagcatgaaat

SEQ ID NO: 1284589 - DNA, 22 bp, Artificial Sequence
  chemically synthesized
ctttccatttagcatgaaatga

SEQ ID NO: 1284590 - DNA, 22 bp, Artificial Sequence
  chemically synthesized
attataaaagccttcatttcat

SEQ ID NO: 1284591 - DNA, 22 bp, Artificial Sequence
  chemically synthesized
tccatttagcatgaaatgaagg

SEQ ID NO: 1284592 - DNA, 22 bp, Artificial Sequence
  chemically synthesized
ccatttagcatgaaatgaaggc

SEQ ID NO: 1284593 - DNA, 22 bp, Artificial Sequence
  chemically synthesized
catttagcatgaaatgaaggct

SEQ ID NO: 1284594 - DNA, 22 bp, Artificial Sequence
  chemically synthesized
agcatgaaatgaaggcttttat

SEQ ID NO: 1284595 - DNA, 22 bp, Artificial Sequence
  chemically synthesized
gcatgaaatgaaggcttttata

SEQ ID NO: 1284596 - DNA, 22 bp, Artificial Sequence
  chemically synthesized
caagtagcagggtagaatcagg

SEQ ID NO: 1284597 - DNA, 22 bp, Artificial Sequence
  chemically synthesized
ttataatcaacctgattctacc

SEQ ID NO: 1284598 - DNA, 22 bp, Artificial Sequence
  chemically synthesized
tacaagtagcagggtagaatca

SEQ ID NO: 1284599 - DNA, 22 bp, Artificial Sequence
  chemically synthesized
tataatcaacctgattctaccc

SEQ ID NO: 1284600 - DNA, 22 bp, Artificial Sequence
  chemically synthesized
ataatcaacctgattctaccct

SEQ ID NO: 1284601 - DNA, 22 bp, Artificial Sequence
  chemically synthesized
taatcaacctgattctaccctg

SEQ ID NO: 1284602 - DNA, 22 bp, Artificial Sequence
  chemically synthesized
catgacagcctctacaagtagc

SEQ ID NO: 1284603 - DNA, 22 bp, Artificial Sequence
  chemically synthesized
attctaccctgctacttgtaga

SEQ ID NO: 1284604 - DNA, 22 bp, Artificial Sequence
  chemically synthesized
taccctgctacttgtagaggct

SEQ ID NO: 1284605 - DNA, 22 bp, Artificial Sequence
  chemically synthesized
gagactacatgacagcctctac

SEQ ID NO: 1284606 - DNA, 22 bp, Artificial Sequence
  chemically synthesized
ccctgctacttgtagaggctgt

SEQ ID NO: 1284607 - DNA, 22 bp, Artificial Sequence
  chemically synthesized
agagactacatgacagcctcta

SEQ ID NO: 1284608 - DNA, 22 bp, Artificial Sequence
  chemically synthesized
tagagactacatgacagcctct

SEQ ID NO: 1284609 - DNA, 22 bp, Artificial Sequence
  chemically synthesized
ctacttgtagaggctgtcatgt

SEQ ID NO: 1284610 - DNA, 22 bp, Artificial Sequence
  chemically synthesized
tgcctttagagactacatgaca

SEQ ID NO: 1284611 - DNA, 22 bp, Artificial Sequence
  chemically synthesized
cttgtagaggctgtcatgtagt

SEQ ID NO: 1284612 - DNA, 22 bp, Artificial Sequence
  chemically synthesized
gtagaggctgtcatgtagtctc

SEQ ID NO: 1284613 - DNA, 22 bp, Artificial Sequence
  chemically synthesized
tagaggctgtcatgtagtctct

SEQ ID NO: 1284614 - DNA, 22 bp, Artificial Sequence
  chemically synthesized
acctgtgcctttagagactaca

SEQ ID NO: 1284615 - DNA, 22 bp, Artificial Sequence
  chemically synthesized
ttcacctgtgcctttagagact

SEQ ID NO: 1284616 - DNA, 22 bp, Artificial Sequence
  chemically synthesized
gttcacctgtgcctttagagac

SEQ ID NO: 1284617 - DNA, 22 bp, Artificial Sequence
  chemically synthesized
tgttcacctgtgcctttagaga

SEQ ID NO: 1284618 - DNA, 22 bp, Artificial Sequence
  chemically synthesized
tcatgtagtctctaaaggcaca

SEQ ID NO: 1284619 - DNA, 22 bp, Artificial Sequence
  chemically synthesized
taaaggcacaggtgaacaaaat

SEQ ID NO: 1284620 - DNA, 22 bp, Artificial Sequence
  chemically synthesized
aaggcacaggtgaacaaaatct

SEQ ID NO: 1284621 - DNA, 22 bp, Artificial Sequence
  chemically synthesized
gagaagcagcaaagagattttg

SEQ ID NO: 1284622 - DNA, 22 bp, Artificial Sequence
  chemically synthesized
tcctagagaagcagcaaagaga

SEQ ID NO: 1284623 - DNA, 22 bp, Artificial Sequence
  chemically synthesized
atcctagagaagcagcaaagag

SEQ ID NO: 1284624 - DNA, 22 bp, Artificial Sequence
  chemically synthesized
tatcctagagaagcagcaaaga

SEQ ID NO: 1284625 - DNA, 22 bp, Artificial Sequence
  chemically synthesized
ctttatcctagagaagcagcaa

SEQ ID NO: 1284626 - DNA, 22 bp, Artificial Sequence
  chemically synthesized
tttgctgcttctctaggataaa

SEQ ID NO: 1284627 - DNA, 22 bp, Artificial Sequence
  chemically synthesized
tgctgcttctctaggataaagc

SEQ ID NO: 1284628 - DNA, 22 bp, Artificial Sequence
  chemically synthesized
gctgcttctctaggataaagca

SEQ ID NO: 1284629 - DNA, 22 bp, Artificial Sequence
  chemically synthesized
ctgcttctctaggataaagcag

SEQ ID NO: 1284630 - DNA, 22 bp, Artificial Sequence
  chemically synthesized
cttctctaggataaagcagtca

SEQ ID NO: 1284631 - DNA, 22 bp, Artificial Sequence
  chemically synthesized
atgaaagaaataagtgactgct

SEQ ID NO: 1284632 - DNA, 22 bp, Artificial Sequence
  chemically synthesized
ctctaggataaagcagtcactt

SEQ ID NO: 1284633 - DNA, 22 bp, Artificial Sequence
  chemically synthesized
aatgaaagaaataagtgactgc

SEQ ID NO: 1284634 - DNA, 22 bp, Artificial Sequence
  chemically synthesized
tctaggataaagcagtcactta

SEQ ID NO: 1284635 - DNA, 22 bp, Artificial Sequence
  chemically synthesized
taggataaagcagtcacttatt

SEQ ID NO: 1284636 - DNA, 22 bp, Artificial Sequence
  chemically synthesized
ggataaagcagtcacttatttc

SEQ ID NO: 1284637 - DNA, 22 bp, Artificial Sequence
  chemically synthesized
agtttaatgaaagaaataagtg

SEQ ID NO: 1284638 - DNA, 22 bp, Artificial Sequence
  chemically synthesized
atctaagtttaatgaaagaaat

SEQ ID NO: 1284639 - DNA, 22 bp, Artificial Sequence
  chemically synthesized
aataattcatctaagtttaatg

SEQ ID NO: 1284640 - DNA, 22 bp, Artificial Sequence
  chemically synthesized
aaataattcatctaagtttaat

SEQ ID NO: 1284641 - DNA, 22 bp, Artificial Sequence
  chemically synthesized
taaataattcatctaagtttaa

SEQ ID NO: 1284642 - DNA, 22 bp, Artificial Sequence
  chemically synthesized
atttctttcattaaacttagat

SEQ ID NO: 1284643 - DNA, 22 bp, Artificial Sequence
  chemically synthesized
tttctttcattaaacttagatg

SEQ ID NO: 1284644 - DNA, 22 bp, Artificial Sequence
  chemically synthesized
ttttaaataattcatctaagtt

SEQ ID NO: 1284645 - DNA, 22 bp, Artificial Sequence
  chemically synthesized
gttttaaataattcatctaagt

SEQ ID NO: 1284646 - DNA, 22 bp, Artificial Sequence
  chemically synthesized
tgttttaaataattcatctaag

SEQ ID NO: 1284647 - DNA, 22 bp, Artificial Sequence
  chemically synthesized
ctttcattaaacttagatgaat

SEQ ID NO: 1284648 - DNA, 22 bp, Artificial Sequence
  chemically synthesized
ttgttttaaataattcatctaa

SEQ ID NO: 1284649 - DNA, 22 bp, Artificial Sequence
  chemically synthesized
tttcattaaacttagatgaatt

SEQ ID NO: 1284650 - DNA, 22 bp, Artificial Sequence
  chemically synthesized
tcattaaacttagatgaattat

SEQ ID NO: 1284651 - DNA, 22 bp, Artificial Sequence
  chemically synthesized
cattaaacttagatgaattatt

SEQ ID NO: 1284652 - DNA, 22 bp, Artificial Sequence
  chemically synthesized
attaaacttagatgaattattt

SEQ ID NO: 1284653 - DNA, 22 bp, Artificial Sequence
  chemically synthesized
tggcttttgttttaaataattc

SEQ ID NO: 1284654 - DNA, 22 bp, Artificial Sequence
  chemically synthesized
aacttagatgaattatttaaaa

SEQ ID NO: 1284655 - DNA, 22 bp, Artificial Sequence
  chemically synthesized
agatgaattatttaaaacaaaa

SEQ ID NO: 1284656 - DNA, 22 bp, Artificial Sequence
  chemically synthesized
gatgaattatttaaaacaaaag

SEQ ID NO: 1284657 - DNA, 22 bp, Artificial Sequence
  chemically synthesized
tacaagttatggcttttgtttt

SEQ ID NO: 1284658 - DNA, 22 bp, Artificial Sequence
  chemically synthesized
atacaagttatggcttttgttt

SEQ ID NO: 1284659 - DNA, 22 bp, Artificial Sequence
  chemically synthesized
tatacaagttatggcttttgtt

SEQ ID NO: 1284660 - DNA, 22 bp, Artificial Sequence
  chemically synthesized
ttatacaagttatggcttttgt

SEQ ID NO: 1284661 - DNA, 22 bp, Artificial Sequence
  chemically synthesized
ttttatacaagttatggctttt

SEQ ID NO: 1284662 - DNA, 22 bp, Artificial Sequence
  chemically synthesized
tttaaaacaaaagccataactt

SEQ ID NO: 1284663 - DNA, 22 bp, Artificial Sequence
  chemically synthesized
aaaacaaaagccataacttgta

SEQ ID NO: 1284664 - DNA, 22 bp, Artificial Sequence
  chemically synthesized
ggcactcttttatacaagttat

SEQ ID NO: 1284665 - DNA, 22 bp, Artificial Sequence
  chemically synthesized
aaacaaaagccataacttgtat

SEQ ID NO: 1284666 - DNA, 22 bp, Artificial Sequence
  chemically synthesized
atctgggcactcttttatacaa

SEQ ID NO: 1284667 - DNA, 22 bp, Artificial Sequence
  chemically synthesized
gtataaaagagtgcccagatga

SEQ ID NO: 1284668 - DNA, 22 bp, Artificial Sequence
  chemically synthesized
tataaaagagtgcccagatgag

SEQ ID NO: 1284669 - DNA, 22 bp, Artificial Sequence
  chemically synthesized
agggaggatacaccctcatctg

SEQ ID NO: 1284670 - DNA, 22 bp, Artificial Sequence
  chemically synthesized
actcagggaggatacaccctca

SEQ ID NO: 1284671 - DNA, 22 bp, Artificial Sequence
  chemically synthesized
ctcactcagggaggatacaccc

SEQ ID NO: 1284672 - DNA, 22 bp, Artificial Sequence
  chemically synthesized
gatattactcactcagggagga

SEQ ID NO: 1284673 - DNA, 22 bp, Artificial Sequence
  chemically synthesized
atatatactagatattactcac

SEQ ID NO: 1284674 - DNA, 22 bp, Artificial Sequence
  chemically synthesized
cctgagtgagtaatatctagta

SEQ ID NO: 1284675 - DNA, 22 bp, Artificial Sequence
  chemically synthesized
tgtggctgatatatactagata

SEQ ID NO: 1284676 - DNA, 22 bp, Artificial Sequence
  chemically synthesized
agtgagtaatatctagtatata

SEQ ID NO: 1284677 - DNA, 22 bp, Artificial Sequence
  chemically synthesized
ttgtgtggctgatatatactag

SEQ ID NO: 1284678 - DNA, 22 bp, Artificial Sequence
  chemically synthesized
attgtgtggctgatatatacta

SEQ ID NO: 1284679 - DNA, 22 bp, Artificial Sequence
  chemically synthesized
tattgtgtggctgatatatact

SEQ ID NO: 1284680 - DNA, 22 bp, Artificial Sequence
  chemically synthesized
ttattgtgtggctgatatatac

SEQ ID NO: 1284681 - DNA, 22 bp, Artificial Sequence
  chemically synthesized
tttattgtgtggctgatatata

SEQ ID NO: 1284682 - DNA, 22 bp, Artificial Sequence
  chemically synthesized
atcattttttattgtgtggctg

SEQ ID NO: 1284683 - DNA, 22 bp, Artificial Sequence
  chemically synthesized
catcattttttattgtgtggct

SEQ ID NO: 1284684 - DNA, 22 bp, Artificial Sequence
  chemically synthesized
tcatcattttttattgtgtggc

SEQ ID NO: 1284685 - DNA, 22 bp, Artificial Sequence
  chemically synthesized
gtatatatcagccacacaataa

SEQ ID NO: 1284686 - DNA, 22 bp, Artificial Sequence
  chemically synthesized
ccattttcatcattttttattg

SEQ ID NO: 1284687 - DNA, 22 bp, Artificial Sequence
  chemically synthesized
accattttcatcattttttatt

SEQ ID NO: 1284688 - DNA, 22 bp, Artificial Sequence
  chemically synthesized
taccattttcatcattttttat

SEQ ID NO: 1284689 - DNA, 22 bp, Artificial Sequence
  chemically synthesized
ttaccattttcatcatttttta

SEQ ID NO: 1284690 - DNA, 22 bp, Artificial Sequence
  chemically synthesized
taatttttaccattttcatcat

SEQ ID NO: 1284691 - DNA, 22 bp, Artificial Sequence
  chemically synthesized
ataatttttaccattttcatca

SEQ ID NO: 1284692 - DNA, 22 bp, Artificial Sequence
  chemically synthesized
tataatttttaccattttcatc

SEQ ID NO: 1284693 - DNA, 22 bp, Artificial Sequence
  chemically synthesized
tcattttataatttttaccatt

SEQ ID NO: 1284694 - DNA, 22 bp, Artificial Sequence
  chemically synthesized
atcattttataatttttaccat

SEQ ID NO: 1284695 - DNA, 22 bp, Artificial Sequence
  chemically synthesized
tatcattttataatttttacca

SEQ ID NO: 1284696 - DNA, 22 bp, Artificial Sequence
  chemically synthesized
ttatcattttataatttttacc

SEQ ID NO: 1284697 - DNA, 22 bp, Artificial Sequence
  chemically synthesized
tttatcattttataatttttac

SEQ ID NO: 1284698 - DNA, 22 bp, Artificial Sequence
  chemically synthesized
atcattttttatcattttataa

SEQ ID NO: 1284699 - DNA, 22 bp, Artificial Sequence
  chemically synthesized
ttaatcattttttatcatttta

SEQ ID NO: 1284700 - DNA, 22 bp, Artificial Sequence
  chemically synthesized
gttaatcattttttatcatttt

SEQ ID NO: 1284701 - DNA, 22 bp, Artificial Sequence
  chemically synthesized
tgttaatcattttttatcattt

SEQ ID NO: 1284702 - DNA, 22 bp, Artificial Sequence
  chemically synthesized
tgttttgttaatcattttttat

SEQ ID NO: 1284703 - DNA, 22 bp, Artificial Sequence
  chemically synthesized
ctgtgttttgttaatcattttt

SEQ ID NO: 1284704 - DNA, 22 bp, Artificial Sequence
  chemically synthesized
cctgtgttttgttaatcatttt

SEQ ID NO: 1284705 - DNA, 22 bp, Artificial Sequence
  chemically synthesized
taaaatgataaaaaatgattaa

SEQ ID NO: 1284706 - DNA, 22 bp, Artificial Sequence
  chemically synthesized
tcctgtgttttgttaatcattt

SEQ ID NO: 1284707 - DNA, 22 bp, Artificial Sequence
  chemically synthesized
acaaaacacaggaaaatcatat

SEQ ID NO: 1284708 - DNA, 22 bp, Artificial Sequence
  chemically synthesized
tatatatatatacacatatata

SEQ ID NO: 1284709 - DNA, 22 bp, Artificial Sequence
  chemically synthesized
atatatatatatacacatatat

SEQ ID NO: 1284710 - DNA, 22 bp, Artificial Sequence
  chemically synthesized
tatatatatatatacacatata

SEQ ID NO: 1284711 - DNA, 22 bp, Artificial Sequence
  chemically synthesized
tgtgtgattttatatatatata

SEQ ID NO: 1284712 - DNA, 22 bp, Artificial Sequence
  chemically synthesized
tgagacatgctgtgtgtgattt

SEQ ID NO: 1284713 - DNA, 22 bp, Artificial Sequence
  chemically synthesized
attatgagacatgctgtgtgtg

SEQ ID NO: 1284714 - DNA, 22 bp, Artificial Sequence
  chemically synthesized
cattatgagacatgctgtgtgt

SEQ ID NO: 1284715 - DNA, 22 bp, Artificial Sequence
  chemically synthesized
tcattatgagacatgctgtgtg

SEQ ID NO: 1284716 - DNA, 22 bp, Artificial Sequence
  chemically synthesized
ttcattatgagacatgctgtgt

SEQ ID NO: 1284717 - DNA, 22 bp, Artificial Sequence
  chemically synthesized
cttttcattatgagacatgctg

SEQ ID NO: 1284718 - DNA, 22 bp, Artificial Sequence
  chemically synthesized
tacttttcattatgagacatgc

SEQ ID NO: 1284719 - DNA, 22 bp, Artificial Sequence
  chemically synthesized
ctacttttcattatgagacatg

SEQ ID NO: 1284720 - DNA, 22 bp, Artificial Sequence
  chemically synthesized
agtaacttctacttttcattat

SEQ ID NO: 1284721 - DNA, 22 bp, Artificial Sequence
  chemically synthesized
ataatgaaaagtagaagttact

SEQ ID NO: 1284722 - DNA, 22 bp, Artificial Sequence
  chemically synthesized
catatgtaaaaaaagaaaaccg

SEQ ID NO: 1284723 - DNA, 22 bp, Artificial Sequence
  chemically synthesized
acatatgtaaaaaaagaaaacc

SEQ ID NO: 1284724 - DNA, 22 bp, Artificial Sequence
  chemically synthesized
tacatatgtaaaaaaagaaaac

SEQ ID NO: 1284725 - DNA, 22 bp, Artificial Sequence
  chemically synthesized
cttaatatcggttttctttttt

SEQ ID NO: 1284726 - DNA, 22 bp, Artificial Sequence
  chemically synthesized
aatatcggttttctttttttac

SEQ ID NO: 1284727 - DNA, 22 bp, Artificial Sequence
  chemically synthesized
atatcggttttctttttttaca

SEQ ID NO: 1284728 - DNA, 22 bp, Artificial Sequence
  chemically synthesized
tctttttttacatatgtaaaat

SEQ ID NO: 1284729 - DNA, 22 bp, Artificial Sequence
  chemically synthesized
ctttttttacatatgtaaaata

SEQ ID NO: 1284730 - DNA, 22 bp, Artificial Sequence
  chemically synthesized
tttttttacatatgtaaaatat

SEQ ID NO: 1284731 - DNA, 22 bp, Artificial Sequence
  chemically synthesized
tttttacatatgtaaaatatca

SEQ ID NO: 1284732 - DNA, 22 bp, Artificial Sequence
  chemically synthesized
ttttacatatgtaaaatatcat

SEQ ID NO: 1284733 - DNA, 22 bp, Artificial Sequence
  chemically synthesized
tttacatatgtaaaatatcatt

SEQ ID NO: 1284734 - DNA, 22 bp, Artificial Sequence
  chemically synthesized
ttacatatgtaaaatatcattc

SEQ ID NO: 1284735 - DNA, 22 bp, Artificial Sequence
  chemically synthesized
tacatatgtaaaatatcattca

SEQ ID NO: 1284736 - DNA, 22 bp, Artificial Sequence
  chemically synthesized
acatatgtaaaatatcattcat

SEQ ID NO: 1284737 - DNA, 22 bp, Artificial Sequence
  chemically synthesized
catatgtaaaatatcattcatg

SEQ ID NO: 1284738 - DNA, 22 bp, Artificial Sequence
  chemically synthesized
tgcacacacacaagtacaccca

SEQ ID NO: 1284739 - DNA, 22 bp, Artificial Sequence
  chemically synthesized
aatgtggttgtgcacacacaca

SEQ ID NO: 1284740 - DNA, 22 bp, Artificial Sequence
  chemically synthesized
atgggtgtacttgtgtgtgtgc

SEQ ID NO: 1284741 - DNA, 22 bp, Artificial Sequence
  chemically synthesized
cattcaatgtggttgtgcacac

SEQ ID NO: 1284742 - DNA, 22 bp, Artificial Sequence
  chemically synthesized
gtgtgtgtgcacaaccacattg

SEQ ID NO: 1284743 - DNA, 22 bp, Artificial Sequence
  chemically synthesized
tgtgtgtgcacaaccacattga

SEQ ID NO: 1284744 - DNA, 22 bp, Artificial Sequence
  chemically synthesized
aaatgtctccattcaatgtggt

SEQ ID NO: 1284745 - DNA, 22 bp, Artificial Sequence
  chemically synthesized
attgaaatgtctccattcaatg

SEQ ID NO: 1284746 - DNA, 22 bp, Artificial Sequence
  chemically synthesized
taattgaaatgtctccattcaa

SEQ ID NO: 1284747 - DNA, 22 bp, Artificial Sequence
  chemically synthesized
tcggagaagttctaattgaaat

SEQ ID NO: 1284748 - DNA, 22 bp, Artificial Sequence
  chemically synthesized
tatcggagaagttctaattgaa

SEQ ID NO: 1284749 - DNA, 22 bp, Artificial Sequence
  chemically synthesized
aatggagacatttcaattagaa

SEQ ID NO: 1284750 - DNA, 22 bp, Artificial Sequence
  chemically synthesized
ctatcggagaagttctaattga

SEQ ID NO: 1284751 - DNA, 22 bp, Artificial Sequence
  chemically synthesized
ttctatcggagaagttctaatt

SEQ ID NO: 1284752 - DNA, 22 bp, Artificial Sequence
  chemically synthesized
cttctatcggagaagttctaat

SEQ ID NO: 1284753 - DNA, 22 bp, Artificial Sequence
  chemically synthesized
aatttcttctatcggagaagtt

SEQ ID NO: 1284754 - DNA, 22 bp, Artificial Sequence
  chemically synthesized
caattagaacttctccgataga

SEQ ID NO: 1284755 - DNA, 22 bp, Artificial Sequence
  chemically synthesized
aattagaacttctccgatagaa

SEQ ID NO: 1284756 - DNA, 22 bp, Artificial Sequence
  chemically synthesized
tggattaaatttcttctatcgg

SEQ ID NO: 1284757 - DNA, 22 bp, Artificial Sequence
  chemically synthesized
gtggattaaatttcttctatcg

SEQ ID NO: 1284758 - DNA, 22 bp, Artificial Sequence
  chemically synthesized
gaacttctccgatagaagaaat

SEQ ID NO: 1284759 - DNA, 22 bp, Artificial Sequence
  chemically synthesized
tttgtggattaaatttcttcta

SEQ ID NO: 1284760 - DNA, 22 bp, Artificial Sequence
  chemically synthesized
ctatttgtggattaaatttctt

SEQ ID NO: 1284761 - DNA, 22 bp, Artificial Sequence
  chemically synthesized
cctatttgtggattaaatttct

SEQ ID NO: 1284762 - DNA, 22 bp, Artificial Sequence
  chemically synthesized
tcctatttgtggattaaatttc

SEQ ID NO: 1284763 - DNA, 22 bp, Artificial Sequence
  chemically synthesized
ctccgatagaagaaatttaatc

SEQ ID NO: 1284764 - DNA, 22 bp, Artificial Sequence
  chemically synthesized
ttcctatttgtggattaaattt

SEQ ID NO: 1284765 - DNA, 22 bp, Artificial Sequence
  chemically synthesized
tccgatagaagaaatttaatcc

SEQ ID NO: 1284766 - DNA, 22 bp, Artificial Sequence
  chemically synthesized
cgatagaagaaatttaatccac

SEQ ID NO: 1284767 - DNA, 22 bp, Artificial Sequence
  chemically synthesized
cttttcctatttgtggattaaa

SEQ ID NO: 1284768 - DNA, 22 bp, Artificial Sequence
  chemically synthesized
agatatactgcttttcctattt

SEQ ID NO: 1284769 - DNA, 22 bp, Artificial Sequence
  chemically synthesized
aatccacaaataggaaaagcag

SEQ ID NO: 1284770 - DNA, 22 bp, Artificial Sequence
  chemically synthesized
atccacaaataggaaaagcagt

SEQ ID NO: 1284771 - DNA, 22 bp, Artificial Sequence
  chemically synthesized
acgctgagatatactgcttttc

SEQ ID NO: 1284772 - DNA, 22 bp, Artificial Sequence
  chemically synthesized
aggcataagtgattaacgctga

SEQ ID NO: 1284773 - DNA, 22 bp, Artificial Sequence
  chemically synthesized
aaggcataagtgattaacgctg

SEQ ID NO: 1284774 - DNA, 22 bp, Artificial Sequence
  chemically synthesized
taaggcataagtgattaacgct

SEQ ID NO: 1284775 - DNA, 22 bp, Artificial Sequence
  chemically synthesized
ttaaggcataagtgattaacgc

SEQ ID NO: 1284776 - DNA, 22 bp, Artificial Sequence
  chemically synthesized
tttttaaggcataagtgattaa

SEQ ID NO: 1284777 - DNA, 22 bp, Artificial Sequence
  chemically synthesized
agcgttaatcacttatgcctta

SEQ ID NO: 1284778 - DNA, 22 bp, Artificial Sequence
  chemically synthesized
tcatgattatttttaaggcata

SEQ ID NO: 1284779 - DNA, 22 bp, Artificial Sequence
  chemically synthesized
ctatcatgattatttttaaggc

SEQ ID NO: 1284780 - DNA, 22 bp, Artificial Sequence
  chemically synthesized
atcacttatgccttaaaaataa

SEQ ID NO: 1284781 - DNA, 22 bp, Artificial Sequence
  chemically synthesized
gttgctatcatgattattttta

SEQ ID NO: 1284782 - DNA, 22 bp, Artificial Sequence
  chemically synthesized
ggttgctatcatgattattttt

SEQ ID NO: 1284783 - DNA, 22 bp, Artificial Sequence
  chemically synthesized
tggttgctatcatgattatttt

SEQ ID NO: 1284784 - DNA, 22 bp, Artificial Sequence
  chemically synthesized
atgccttaaaaataatcatgat

SEQ ID NO: 1284785 - DNA, 22 bp, Artificial Sequence
  chemically synthesized
tgccttaaaaataatcatgata

SEQ ID NO: 1284786 - DNA, 22 bp, Artificial Sequence
  chemically synthesized
aaaaataatcatgatagcaacc

SEQ ID NO: 1284787 - DNA, 22 bp, Artificial Sequence
  chemically synthesized
aaaataatcatgatagcaacca

SEQ ID NO: 1284788 - DNA, 22 bp, Artificial Sequence
  chemically synthesized
cagaaagaattttggttgctat

SEQ ID NO: 1284789 - DNA, 22 bp, Artificial Sequence
  chemically synthesized
agattccagaaagaattttggt

SEQ ID NO: 1284790 - DNA, 22 bp, Artificial Sequence
  chemically synthesized
attcagattccagaaagaattt

SEQ ID NO: 1284791 - DNA, 22 bp, Artificial Sequence
  chemically synthesized
tttctggaatctgaatcagcca

SEQ ID NO: 1284792 - DNA, 22 bp, Artificial Sequence
  chemically synthesized
tctggaatctgaatcagccaca

SEQ ID NO: 1284793 - DNA, 22 bp, Artificial Sequence
  chemically synthesized
ctggaatctgaatcagccacac

SEQ ID NO: 1284794 - DNA, 22 bp, Artificial Sequence
  chemically synthesized
tggaatctgaatcagccacaca

SEQ ID NO: 1284795 - DNA, 22 bp, Artificial Sequence
  chemically synthesized
gaatctgaatcagccacacaca

SEQ ID NO: 1284796 - DNA, 22 bp, Artificial Sequence
  chemically synthesized
aatcagccacacacatgtgttt

SEQ ID NO: 1284797 - DNA, 22 bp, Artificial Sequence
  chemically synthesized
atgaataaagtcagaaacacat

SEQ ID NO: 1284798 - DNA, 22 bp, Artificial Sequence
  chemically synthesized
aatgaataaagtcagaaacaca

SEQ ID NO: 1284799 - DNA, 22 bp, Artificial Sequence
  chemically synthesized
atcttaatgaataaagtcagaa

SEQ ID NO: 1284800 - DNA, 22 bp, Artificial Sequence
  chemically synthesized
ctaatcttaatgaataaagtca

SEQ ID NO: 1284801 - DNA, 22 bp, Artificial Sequence
  chemically synthesized
gaaggctgctaatcttaatgaa

SEQ ID NO: 1284802 - DNA, 22 bp, Artificial Sequence
  chemically synthesized
tggaaggctgctaatcttaatg

SEQ ID NO: 1284803 - DNA, 22 bp, Artificial Sequence
  chemically synthesized
ctgactttattcattaagatta

SEQ ID NO: 1284804 - DNA, 22 bp, Artificial Sequence
  chemically synthesized
ctggaaggctgctaatcttaat

SEQ ID NO: 1284805 - DNA, 22 bp, Artificial Sequence
  chemically synthesized
tgactttattcattaagattag

SEQ ID NO: 1284806 - DNA, 22 bp, Artificial Sequence
  chemically synthesized
actttattcattaagattagca

SEQ ID NO: 1284807 - DNA, 22 bp, Artificial Sequence
  chemically synthesized
tattcattaagattagcagcct

SEQ ID NO: 1284808 - DNA, 22 bp, Artificial Sequence
  chemically synthesized
gtgatttctggaaggctgctaa

SEQ ID NO: 1284809 - DNA, 22 bp, Artificial Sequence
  chemically synthesized
attcattaagattagcagcctt

SEQ ID NO: 1284810 - DNA, 22 bp, Artificial Sequence
  chemically synthesized
agtgatttctggaaggctgcta

SEQ ID NO: 1284811 - DNA, 22 bp, Artificial Sequence
  chemically synthesized
ttcattaagattagcagccttc

SEQ ID NO: 1284812 - DNA, 22 bp, Artificial Sequence
  chemically synthesized
tagtgatttctggaaggctgct

SEQ ID NO: 1284813 - DNA, 22 bp, Artificial Sequence
  chemically synthesized
attaagattagcagccttccag

SEQ ID NO: 1284814 - DNA, 22 bp, Artificial Sequence
  chemically synthesized
cattttagtgatttctggaagg

SEQ ID NO: 1284815 - DNA, 22 bp, Artificial Sequence
  chemically synthesized
agattagcagccttccagaaat

SEQ ID NO: 1284816 - DNA, 22 bp, Artificial Sequence
  chemically synthesized
aagattccattttagtgatttc

SEQ ID NO: 1284817 - DNA, 22 bp, Artificial Sequence
  chemically synthesized
gcagccttccagaaatcactaa

SEQ ID NO: 1284818 - DNA, 22 bp, Artificial Sequence
  chemically synthesized
gaagattccattttagtgattt

SEQ ID NO: 1284819 - DNA, 22 bp, Artificial Sequence
  chemically synthesized
tgaagattccattttagtgatt

SEQ ID NO: 1284820 - DNA, 22 bp, Artificial Sequence
  chemically synthesized
ttgaagattccattttagtgat

SEQ ID NO: 1284821 - DNA, 22 bp, Artificial Sequence
  chemically synthesized
ccagaaatcactaaaatggaat

SEQ ID NO: 1284822 - DNA, 22 bp, Artificial Sequence
  chemically synthesized
gagcttttgaagattccatttt

SEQ ID NO: 1284823 - DNA, 22 bp, Artificial Sequence
  chemically synthesized
cagaaatcactaaaatggaatc

SEQ ID NO: 1284824 - DNA, 22 bp, Artificial Sequence
  chemically synthesized
aactggagcttttgaagattcc

SEQ ID NO: 1284825 - DNA, 22 bp, Artificial Sequence
  chemically synthesized
gaactggagcttttgaagattc

SEQ ID NO: 1284826 - DNA, 22 bp, Artificial Sequence
  chemically synthesized
aaatggaatcttcaaaagctcc

SEQ ID NO: 1284827 - DNA, 22 bp, Artificial Sequence
  chemically synthesized
cagatcttgaactggagctttt

SEQ ID NO: 1284828 - DNA, 22 bp, Artificial Sequence
  chemically synthesized
tctccagatcttgaactggagc

SEQ ID NO: 1284829 - DNA, 22 bp, Artificial Sequence
  chemically synthesized
atctccagatcttgaactggag

SEQ ID NO: 1284830 - DNA, 22 bp, Artificial Sequence
  chemically synthesized
tatctccagatcttgaactgga

SEQ ID NO: 1284831 - DNA, 22 bp, Artificial Sequence
  chemically synthesized
attttatctccagatcttgaac

SEQ ID NO: 1284832 - DNA, 22 bp, Artificial Sequence
  chemically synthesized
caaaagctccagttcaagatct

SEQ ID NO: 1284833 - DNA, 22 bp, Artificial Sequence
  chemically synthesized
cattttatctccagatcttgaa

SEQ ID NO: 1284834 - DNA, 22 bp, Artificial Sequence
  chemically synthesized
aaaagctccagttcaagatctg

SEQ ID NO: 1284835 - DNA, 22 bp, Artificial Sequence
  chemically synthesized
tcattttatctccagatcttga

SEQ ID NO: 1284836 - DNA, 22 bp, Artificial Sequence
  chemically synthesized
cagttcaagatctggagataaa

SEQ ID NO: 1284837 - DNA, 22 bp, Artificial Sequence
  chemically synthesized
aagatctggagataaaatgaaa

SEQ ID NO: 1284838 - DNA, 22 bp, Artificial Sequence
  chemically synthesized
tggaaaggatcaccagactttc

SEQ ID NO: 1284839 - DNA, 22 bp, Artificial Sequence
  chemically synthesized
gagataaaatgaaagtctggtg

SEQ ID NO: 1284840 - DNA, 22 bp, Artificial Sequence
  chemically synthesized
agagtctatggaaaggatcacc

SEQ ID NO: 1284841 - DNA, 22 bp, Artificial Sequence
  chemically synthesized
gtgatcctttccatagactctg

SEQ ID NO: 1284842 - DNA, 22 bp, Artificial Sequence
  chemically synthesized
agacggtaaagaaagtcctcag

SEQ ID NO: 1284843 - DNA, 22 bp, Artificial Sequence
  chemically synthesized
tccatagactctgaggactttc

SEQ ID NO: 1284844 - DNA, 22 bp, Artificial Sequence
  chemically synthesized
ccatagactctgaggactttct

SEQ ID NO: 1284845 - DNA, 22 bp, Artificial Sequence
  chemically synthesized
catagactctgaggactttctt

SEQ ID NO: 1284846 - DNA, 22 bp, Artificial Sequence
  chemically synthesized
aagacattaagacggtaaagaa

SEQ ID NO: 1284847 - DNA, 22 bp, Artificial Sequence
  chemically synthesized
tgaggactttctttaccgtctt

SEQ ID NO: 1284848 - DNA, 22 bp, Artificial Sequence
  chemically synthesized
cattgaagacattaagacggta

SEQ ID NO: 1284849 - DNA, 22 bp, Artificial Sequence
  chemically synthesized
aggactttctttaccgtcttaa

SEQ ID NO: 1284850 - DNA, 22 bp, Artificial Sequence
  chemically synthesized
ccattgaagacattaagacggt

SEQ ID NO: 1284851 - DNA, 22 bp, Artificial Sequence
  chemically synthesized
tccattgaagacattaagacgg

SEQ ID NO: 1284852 - DNA, 22 bp, Artificial Sequence
  chemically synthesized
ttccattgaagacattaagacg

SEQ ID NO: 1284853 - DNA, 22 bp, Artificial Sequence
  chemically synthesized
tctttaccgtcttaatgtcttc

SEQ ID NO: 1284854 - DNA, 22 bp, Artificial Sequence
  chemically synthesized
ctttaccgtcttaatgtcttca

SEQ ID NO: 1284855 - DNA, 22 bp, Artificial Sequence
  chemically synthesized
tttaccgtcttaatgtcttcaa

SEQ ID NO: 1284856 - DNA, 22 bp, Artificial Sequence
  chemically synthesized
taccgtcttaatgtcttcaatg

SEQ ID NO: 1284857 - DNA, 22 bp, Artificial Sequence
  chemically synthesized
accgtcttaatgtcttcaatgg

SEQ ID NO: 1284858 - DNA, 22 bp, Artificial Sequence
  chemically synthesized
ccgtcttaatgtcttcaatgga

SEQ ID NO: 1284859 - DNA, 22 bp, Artificial Sequence
  chemically synthesized
tcatacacggtcgtttttccat

SEQ ID NO: 1284860 - DNA, 22 bp, Artificial Sequence
  chemically synthesized
gtcatacacggtcgtttttcca

SEQ ID NO: 1284861 - DNA, 22 bp, Artificial Sequence
  chemically synthesized
aatgtcttcaatggaaaaacga

SEQ ID NO: 1284862 - DNA, 22 bp, Artificial Sequence
  chemically synthesized
tgtcatacacggtcgtttttcc

SEQ ID NO: 1284863 - DNA, 22 bp, Artificial Sequence
  chemically synthesized
atgtcttcaatggaaaaacgac

SEQ ID NO: 1284864 - DNA, 22 bp, Artificial Sequence
  chemically synthesized
ttttgtcatacacggtcgtttt

SEQ ID NO: 1284865 - DNA, 22 bp, Artificial Sequence
  chemically synthesized
ttattttgtcatacacggtcgt

SEQ ID NO: 1284866 - DNA, 22 bp, Artificial Sequence
  chemically synthesized
attattttgtcatacacggtcg

SEQ ID NO: 1284867 - DNA, 22 bp, Artificial Sequence
  chemically synthesized
caatggaaaaacgaccgtgtat

SEQ ID NO: 1284868 - DNA, 22 bp, Artificial Sequence
  chemically synthesized
aatggaaaaacgaccgtgtatg

SEQ ID NO: 1284869 - DNA, 22 bp, Artificial Sequence
  chemically synthesized
aggaagcaaacttattattttg

SEQ ID NO: 1284870 - DNA, 22 bp, Artificial Sequence
  chemically synthesized
aagctcaggaagcaaacttatt

SEQ ID NO: 1284871 - DNA, 22 bp, Artificial Sequence
  chemically synthesized
caagctcaggaagcaaacttat

SEQ ID NO: 1284872 - DNA, 22 bp, Artificial Sequence
  chemically synthesized
atttcaagctcaggaagcaaac

SEQ ID NO: 1284873 - DNA, 22 bp, Artificial Sequence
  chemically synthesized
ataggcagccattcatttcaag

SEQ ID NO: 1284874 - DNA, 22 bp, Artificial Sequence
  chemically synthesized
gcttcctgagcttgaaatgaat

SEQ ID NO: 1284875 - DNA, 22 bp, Artificial Sequence
  chemically synthesized
cttcctgagcttgaaatgaatg

SEQ ID NO: 1284876 - DNA, 22 bp, Artificial Sequence
  chemically synthesized
cctgagcttgaaatgaatggct

SEQ ID NO: 1284877 - DNA, 22 bp, Artificial Sequence
  chemically synthesized
ctgagcttgaaatgaatggctg

SEQ ID NO: 1284878 - DNA, 22 bp, Artificial Sequence
  chemically synthesized
agcttgaaatgaatggctgcct

SEQ ID NO: 1284879 - DNA, 22 bp, Artificial Sequence
  chemically synthesized
agagtggatctgataggcagcc

SEQ ID NO: 1284880 - DNA, 22 bp, Artificial Sequence
  chemically synthesized
gaaatgaatggctgcctatcag

SEQ ID NO: 1284881 - DNA, 22 bp, Artificial Sequence
  chemically synthesized
aaatgaatggctgcctatcaga

SEQ ID NO: 1284882 - DNA, 22 bp, Artificial Sequence
  chemically synthesized
aagtgatatgctcagagtggat

SEQ ID NO: 1284883 - DNA, 22 bp, Artificial Sequence
  chemically synthesized
cctatcagatccactctgagca

SEQ ID NO: 1284884 - DNA, 22 bp, Artificial Sequence
  chemically synthesized
tcagatccactctgagcatatc

SEQ ID NO: 1284885 - DNA, 22 bp, Artificial Sequence
  chemically synthesized
acagcctgaagtgatatgctca

SEQ ID NO: 1284886 - DNA, 22 bp, Artificial Sequence
  chemically synthesized
gcctgacagcctgaagtgatat

SEQ ID NO: 1284887 - DNA, 22 bp, Artificial Sequence
  chemically synthesized
tgagcatatcacttcaggctgt

SEQ ID NO: 1284888 - DNA, 22 bp, Artificial Sequence
  chemically synthesized
agcatatcacttcaggctgtca

SEQ ID NO: 1284889 - DNA, 22 bp, Artificial Sequence
  chemically synthesized
tgagcaatgtggctggcctgac

SEQ ID NO: 1284890 - DNA, 22 bp, Artificial Sequence
  chemically synthesized
caggctgtcaggccagccacat

SEQ ID NO: 1284891 - DNA, 22 bp, Artificial Sequence
  chemically synthesized
aggctgtcaggccagccacatt

SEQ ID NO: 1284892 - DNA, 22 bp, Artificial Sequence
  chemically synthesized
tcaggccagccacattgctcac

SEQ ID NO: 1284893 - DNA, 22 bp, Artificial Sequence
  chemically synthesized
tcccaaagggaaattgtgagca

SEQ ID NO: 1284894 - DNA, 22 bp, Artificial Sequence
  chemically synthesized
atcccaaagggaaattgtgagc

SEQ ID NO: 1284895 - DNA, 22 bp, Artificial Sequence
  chemically synthesized
gcttatcccaaagggaaattgt

SEQ ID NO: 1284896 - DNA, 22 bp, Artificial Sequence
  chemically synthesized
ggattagcttatcccaaaggga

SEQ ID NO: 1284897 - DNA, 22 bp, Artificial Sequence
  chemically synthesized
aggattagcttatcccaaaggg

SEQ ID NO: 1284898 - DNA, 22 bp, Artificial Sequence
  chemically synthesized
taggattagcttatcccaaagg

SEQ ID NO: 1284899 - DNA, 22 bp, Artificial Sequence
  chemically synthesized
ctcacaatttccctttgggata

SEQ ID NO: 1284900 - DNA, 22 bp, Artificial Sequence
  chemically synthesized
acaatttccctttgggataagc

SEQ ID NO: 1284901 - DNA, 22 bp, Artificial Sequence
  chemically synthesized
ccctttgggataagctaatcct

SEQ ID NO: 1284902 - DNA, 22 bp, Artificial Sequence
  chemically synthesized
taaaatgattttaggattagct

SEQ ID NO: 1284903 - DNA, 22 bp, Artificial Sequence
  chemically synthesized
cctttgggataagctaatccta

SEQ ID NO: 1284904 - DNA, 22 bp, Artificial Sequence
  chemically synthesized
tgggataagctaatcctaaaat

SEQ ID NO: 1284905 - DNA, 22 bp, Artificial Sequence
  chemically synthesized
gggataagctaatcctaaaatc

SEQ ID NO: 1284906 - DNA, 22 bp, Artificial Sequence
  chemically synthesized
ggataagctaatcctaaaatca

SEQ ID NO: 1284907 - DNA, 22 bp, Artificial Sequence
  chemically synthesized
tccaaactataaaatgatttta

SEQ ID NO: 1284908 - DNA, 22 bp, Artificial Sequence
  chemically synthesized
aaactatccaaactataaaatg

SEQ ID NO: 1284909 - DNA, 22 bp, Artificial Sequence
  chemically synthesized
atcctaaaatcattttatagtt

SEQ ID NO: 1284910 - DNA, 22 bp, Artificial Sequence
  chemically synthesized
atgctgaaactatccaaactat

SEQ ID NO: 1284911 - DNA, 22 bp, Artificial Sequence
  chemically synthesized
aaatcattttatagtttggata

SEQ ID NO: 1284912 - DNA, 22 bp, Artificial Sequence
  chemically synthesized
tatagtttggatagtttcagca

SEQ ID NO: 1284913 - DNA, 22 bp, Artificial Sequence
  chemically synthesized
atagtttggatagtttcagcat

SEQ ID NO: 1284914 - DNA, 22 bp, Artificial Sequence
  chemically synthesized
tagtttggatagtttcagcatg

SEQ ID NO: 1284915 - DNA, 22 bp, Artificial Sequence
  chemically synthesized
caaagacatcaatatctcatgc

SEQ ID NO: 1284916 - DNA, 22 bp, Artificial Sequence
  chemically synthesized
ggatagtttcagcatgagatat

SEQ ID NO: 1284917 - DNA, 22 bp, Artificial Sequence
  chemically synthesized
gatagtttcagcatgagatatt

SEQ ID NO: 1284918 - DNA, 22 bp, Artificial Sequence
  chemically synthesized
tacaaagacatcaatatctcat

SEQ ID NO: 1284919 - DNA, 22 bp, Artificial Sequence
  chemically synthesized
ctacaaagacatcaatatctca

SEQ ID NO: 1284920 - DNA, 22 bp, Artificial Sequence
  chemically synthesized
cagcatgagatattgatgtctt

SEQ ID NO: 1284921 - DNA, 22 bp, Artificial Sequence
  chemically synthesized
agcatgagatattgatgtcttt

SEQ ID NO: 1284922 - DNA, 22 bp, Artificial Sequence
  chemically synthesized
tgcaatagaacttctacaaaga

SEQ ID NO: 1284923 - DNA, 22 bp, Artificial Sequence
  chemically synthesized
atgtctttgtagaagttctatt

SEQ ID NO: 1284924 - DNA, 22 bp, Artificial Sequence
  chemically synthesized
catgtatatgttatgcaataga

SEQ ID NO: 1284925 - DNA, 22 bp, Artificial Sequence
  chemically synthesized
ccatgtatatgttatgcaatag

SEQ ID NO: 1284926 - DNA, 22 bp, Artificial Sequence
  chemically synthesized
tgtagaagttctattgcataac

SEQ ID NO: 1284927 - DNA, 22 bp, Artificial Sequence
  chemically synthesized
gtagaagttctattgcataaca

SEQ ID NO: 1284928 - DNA, 22 bp, Artificial Sequence
  chemically synthesized
tagaagttctattgcataacat

SEQ ID NO: 1284929 - DNA, 22 bp, Artificial Sequence
  chemically synthesized
agtcttccatgtatatgttatg

SEQ ID NO: 1284930 - DNA, 22 bp, Artificial Sequence
  chemically synthesized
gagtcttccatgtatatgttat

SEQ ID NO: 1284931 - DNA, 22 bp, Artificial Sequence
  chemically synthesized
tattgcataacatatacatgga

SEQ ID NO: 1284932 - DNA, 22 bp, Artificial Sequence
  chemically synthesized
ttgcataacatatacatggaag

SEQ ID NO: 1284933 - DNA, 22 bp, Artificial Sequence
  chemically synthesized
cataacatatacatggaagact

SEQ ID NO: 1284934 - DNA, 22 bp, Artificial Sequence
  chemically synthesized
gtgtagtacatacatatccgta

SEQ ID NO: 1284935 - DNA, 22 bp, Artificial Sequence
  chemically synthesized
aagttatacggatatgtatgta

SEQ ID NO: 1284936 - DNA, 22 bp, Artificial Sequence
  chemically synthesized
cacaattagtgtagtacataca

SEQ ID NO: 1284937 - DNA, 22 bp, Artificial Sequence
  chemically synthesized
tacggatatgtatgtactacac

SEQ ID NO: 1284938 - DNA, 22 bp, Artificial Sequence
  chemically synthesized
atgcatacatagtcacactaca

SEQ ID NO: 1284939 - DNA, 22 bp, Artificial Sequence
  chemically synthesized
aatgcatacatagtcacactac

SEQ ID NO: 1284940 - DNA, 22 bp, Artificial Sequence
  chemically synthesized
cactaattgtgtagtgtgacta

SEQ ID NO: 1284941 - DNA, 22 bp, Artificial Sequence
  chemically synthesized
ttaatgcatacatagtcacact

SEQ ID NO: 1284942 - DNA, 22 bp, Artificial Sequence
  chemically synthesized
attgtgtagtgtgactatgtat

SEQ ID NO: 1284943 - DNA, 22 bp, Artificial Sequence
  chemically synthesized
aaattcttaatgcatacatagt

SEQ ID NO: 1284944 - DNA, 22 bp, Artificial Sequence
  chemically synthesized
tgtagtgtgactatgtatgcat

SEQ ID NO: 1284945 - DNA, 22 bp, Artificial Sequence
  chemically synthesized
attaaaattcttaatgcataca

SEQ ID NO: 1284946 - DNA, 22 bp, Artificial Sequence
  chemically synthesized
cacaattgattaaaattcttaa

SEQ ID NO: 1284947 - DNA, 22 bp, Artificial Sequence
  chemically synthesized
acacaattgattaaaattctta

SEQ ID NO: 1284948 - DNA, 22 bp, Artificial Sequence
  chemically synthesized
tacacaattgattaaaattctt

SEQ ID NO: 1284949 - DNA, 22 bp, Artificial Sequence
  chemically synthesized
tgtatgcattaagaattttaat

SEQ ID NO: 1284950 - DNA, 22 bp, Artificial Sequence
  chemically synthesized
cctttacacaattgattaaaat

SEQ ID NO: 1284951 - DNA, 22 bp, Artificial Sequence
  chemically synthesized
ccctttacacaattgattaaaa

SEQ ID NO: 1284952 - DNA, 22 bp, Artificial Sequence
  chemically synthesized
cttccctttacacaattgatta

SEQ ID NO: 1284953 - DNA, 22 bp, Artificial Sequence
  chemically synthesized
gcttccctttacacaattgatt

SEQ ID NO: 1284954 - DNA, 22 bp, Artificial Sequence
  chemically synthesized
agaattttaatcaattgtgtaa

SEQ ID NO: 1284955 - DNA, 22 bp, Artificial Sequence
  chemically synthesized
taatcaattgtgtaaagggaag

SEQ ID NO: 1284956 - DNA, 22 bp, Artificial Sequence
  chemically synthesized
aatcaattgtgtaaagggaagc

SEQ ID NO: 1284957 - DNA, 22 bp, Artificial Sequence
  chemically synthesized
atcaattgtgtaaagggaagca

SEQ ID NO: 1284958 - DNA, 22 bp, Artificial Sequence
  chemically synthesized
tgtaaagggaagcaaatgttca

SEQ ID NO: 1284959 - DNA, 22 bp, Artificial Sequence
  chemically synthesized
agatatgaaagatgaacatttg

SEQ ID NO: 1284960 - DNA, 22 bp, Artificial Sequence
  chemically synthesized
gttgagatatgaaagatgaaca

SEQ ID NO: 1284961 - DNA, 22 bp, Artificial Sequence
  chemically synthesized
ttggttgagatatgaaagatga

SEQ ID NO: 1284962 - DNA, 22 bp, Artificial Sequence
  chemically synthesized
atctttcatatctcaaccaata

SEQ ID NO: 1284963 - DNA, 22 bp, Artificial Sequence
  chemically synthesized
catgagaaccaaaactattggt

SEQ ID NO: 1284964 - DNA, 22 bp, Artificial Sequence
  chemically synthesized
ccatgagaaccaaaactattgg

SEQ ID NO: 1284965 - DNA, 22 bp, Artificial Sequence
  chemically synthesized
tcatatctcaaccaatagtttt

SEQ ID NO: 1284966 - DNA, 22 bp, Artificial Sequence
  chemically synthesized
catatctcaaccaatagttttg

SEQ ID NO: 1284967 - DNA, 22 bp, Artificial Sequence
  chemically synthesized
atatctcaaccaatagttttgg

SEQ ID NO: 1284968 - DNA, 22 bp, Artificial Sequence
  chemically synthesized
atttccatgagaaccaaaacta

SEQ ID NO: 1284969 - DNA, 22 bp, Artificial Sequence
  chemically synthesized
gatttccatgagaaccaaaact

SEQ ID NO: 1284970 - DNA, 22 bp, Artificial Sequence
  chemically synthesized
aaccaatagttttggttctcat

SEQ ID NO: 1284971 - DNA, 22 bp, Artificial Sequence
  chemically synthesized
caaaaaggtaatgtttgatttc

SEQ ID NO: 1284972 - DNA, 22 bp, Artificial Sequence
  chemically synthesized
tggttctcatggaaatcaaaca

SEQ ID NO: 1284973 - DNA, 22 bp, Artificial Sequence
  chemically synthesized
ggttctcatggaaatcaaacat

SEQ ID NO: 1284974 - DNA, 22 bp, Artificial Sequence
  chemically synthesized
gttctcatggaaatcaaacatt

SEQ ID NO: 1284975 - DNA, 22 bp, Artificial Sequence
  chemically synthesized
ttacaaaaaggtaatgtttgat

SEQ ID NO: 1284976 - DNA, 22 bp, Artificial Sequence
  chemically synthesized
attacaaaaaggtaatgtttga

SEQ ID NO: 1284977 - DNA, 22 bp, Artificial Sequence
  chemically synthesized
tattacaaaaaggtaatgtttg

SEQ ID NO: 1284978 - DNA, 22 bp, Artificial Sequence
  chemically synthesized
tcatggaaatcaaacattacct

SEQ ID NO: 1284979 - DNA, 22 bp, Artificial Sequence
  chemically synthesized
atggaaatcaaacattaccttt

SEQ ID NO: 1284980 - DNA, 22 bp, Artificial Sequence
  chemically synthesized
attttattacaaaaaggtaatg

SEQ ID NO: 1284981 - DNA, 22 bp, Artificial Sequence
  chemically synthesized
aaacactgattttattacaaaa

SEQ ID NO: 1284982 - DNA, 22 bp, Artificial Sequence
  chemically synthesized
ttgaaacactgattttattaca

SEQ ID NO: 1284983 - DNA, 22 bp, Artificial Sequence
  chemically synthesized
tgttgaaacactgattttatta

SEQ ID NO: 1284984 - DNA, 22 bp, Artificial Sequence
  chemically synthesized
ctgttgaaacactgattttatt

SEQ ID NO: 1284985 - DNA, 22 bp, Artificial Sequence
  chemically synthesized
cctttttgtaataaaatcagtg

SEQ ID NO: 1284986 - DNA, 22 bp, Artificial Sequence
  chemically synthesized
tttgtaataaaatcagtgtttc

SEQ ID NO: 1284987 - DNA, 22 bp, Artificial Sequence
  chemically synthesized
ttgtaataaaatcagtgtttca

SEQ ID NO: 1284988 - DNA, 22 bp, Artificial Sequence
  chemically synthesized
tgtaataaaatcagtgtttcaa

SEQ ID NO: 1284989 - DNA, 22 bp, Artificial Sequence
  chemically synthesized
gtaataaaatcagtgtttcaac

SEQ ID NO: 1284990 - DNA, 22 bp, Artificial Sequence
  chemically synthesized
taataaaatcagtgtttcaaca

SEQ ID NO: 1284991 - DNA, 22 bp, Artificial Sequence
  chemically synthesized
tgaaatatatttctgttgaaac

SEQ ID NO: 1284992 - DNA, 22 bp, Artificial Sequence
  chemically synthesized
attgtgaaatatatttctgttg

SEQ ID NO: 1284993 - DNA, 22 bp, Artificial Sequence
  chemically synthesized
caacagaaatatatttcacaat

SEQ ID NO: 1284994 - DNA, 22 bp, Artificial Sequence
  chemically synthesized
taaacaaggttcattgtgaaat

SEQ ID NO: 1284995 - DNA, 22 bp, Artificial Sequence
  chemically synthesized
aacagaaatatatttcacaatg

SEQ ID NO: 1284996 - DNA, 22 bp, Artificial Sequence
  chemically synthesized
gatggtcattataaacaaggtt

SEQ ID NO: 1284997 - DNA, 22 bp, Artificial Sequence
  chemically synthesized
agatggtcattataaacaaggt

SEQ ID NO: 1284998 - DNA, 22 bp, Artificial Sequence
  chemically synthesized
tagatggtcattataaacaagg

SEQ ID NO: 1284999 - DNA, 22 bp, Artificial Sequence
  chemically synthesized
cacaatgaaccttgtttataat

SEQ ID NO: 1285000 - DNA, 22 bp, Artificial Sequence
  chemically synthesized
acaatgaaccttgtttataatg

SEQ ID NO: 1285001 - DNA, 22 bp, Artificial Sequence
  chemically synthesized
aagaaattttagatggtcatta

SEQ ID NO: 1285002 - DNA, 22 bp, Artificial Sequence
  chemically synthesized
aaagaaattttagatggtcatt

SEQ ID NO: 1285003 - DNA, 22 bp, Artificial Sequence
  chemically synthesized
ttaaagaaattttagatggtca

SEQ ID NO: 1285004 - DNA, 22 bp, Artificial Sequence
  chemically synthesized
gtttataatgaccatctaaaat

SEQ ID NO: 1285005 - DNA, 22 bp, Artificial Sequence
  chemically synthesized
tttataatgaccatctaaaatt

SEQ ID NO: 1285006 - DNA, 22 bp, Artificial Sequence
  chemically synthesized
ataatgaccatctaaaatttct

SEQ ID NO: 1285007 - DNA, 22 bp, Artificial Sequence
  chemically synthesized
taatgaccatctaaaatttctt

SEQ ID NO: 1285008 - DNA, 22 bp, Artificial Sequence
  chemically synthesized
taatgcccatctcttaaagaaa

SEQ ID NO: 1285009 - DNA, 22 bp, Artificial Sequence
  chemically synthesized
acctgtaatgcccatctcttaa

SEQ ID NO: 1285010 - DNA, 22 bp, Artificial Sequence
  chemically synthesized
gacctgtaatgcccatctctta

SEQ ID NO: 1285011 - DNA, 22 bp, Artificial Sequence
  chemically synthesized
tgacctgtaatgcccatctctt

SEQ ID NO: 1285012 - DNA, 22 bp, Artificial Sequence
  chemically synthesized
aaatttctttaagagatgggca

SEQ ID NO: 1285013 - DNA, 22 bp, Artificial Sequence
  chemically synthesized
tctttgacctgtaatgcccatc

SEQ ID NO: 1285014 - DNA, 22 bp, Artificial Sequence
  chemically synthesized
ctttaagagatgggcattacag

SEQ ID NO: 1285015 - DNA, 22 bp, Artificial Sequence
  chemically synthesized
tttaagagatgggcattacagg

SEQ ID NO: 1285016 - DNA, 22 bp, Artificial Sequence
  chemically synthesized
taagagatgggcattacaggtc

SEQ ID NO: 1285017 - DNA, 22 bp, Artificial Sequence
  chemically synthesized
aagagatgggcattacaggtca

SEQ ID NO: 1285018 - DNA, 22 bp, Artificial Sequence
  chemically synthesized
agagatgggcattacaggtcaa

SEQ ID NO: 1285019 - DNA, 22 bp, Artificial Sequence
  chemically synthesized
atacagattatctttgacctgt

SEQ ID NO: 1285020 - DNA, 22 bp, Artificial Sequence
  chemically synthesized
catacagattatctttgacctg

SEQ ID NO: 1285021 - DNA, 22 bp, Artificial Sequence
  chemically synthesized
tcatacagattatctttgacct

SEQ ID NO: 1285022 - DNA, 22 bp, Artificial Sequence
  chemically synthesized
ttcatacagattatctttgacc

SEQ ID NO: 1285023 - DNA, 22 bp, Artificial Sequence
  chemically synthesized
tttcatacagattatctttgac

SEQ ID NO: 1285024 - DNA, 22 bp, Artificial Sequence
  chemically synthesized
ttttcatacagattatctttga

SEQ ID NO: 1285025 - DNA, 22 bp, Artificial Sequence
  chemically synthesized
tgtatttttttcatacagatta

SEQ ID NO: 1285026 - DNA, 22 bp, Artificial Sequence
  chemically synthesized
caggtcaaagataatctgtatg

SEQ ID NO: 1285027 - DNA, 22 bp, Artificial Sequence
  chemically synthesized
atgtatttttttcatacagatt

SEQ ID NO: 1285028 - DNA, 22 bp, Artificial Sequence
  chemically synthesized
taatatcttatgtatttttttc

SEQ ID NO: 1285029 - DNA, 22 bp, Artificial Sequence
  chemically synthesized
ataatatcttatgtattttttt

SEQ ID NO: 1285030 - DNA, 22 bp, Artificial Sequence
  chemically synthesized
tataatatcttatgtatttttt

SEQ ID NO: 1285031 - DNA, 22 bp, Artificial Sequence
  chemically synthesized
cattttataatatcttatgtat

SEQ ID NO: 1285032 - DNA, 22 bp, Artificial Sequence
  chemically synthesized
tatgaaaaaaatacataagata

SEQ ID NO: 1285033 - DNA, 22 bp, Artificial Sequence
  chemically synthesized
agctacattttataatatctta

SEQ ID NO: 1285034 - DNA, 22 bp, Artificial Sequence
  chemically synthesized
aagctacattttataatatctt

SEQ ID NO: 1285035 - DNA, 22 bp, Artificial Sequence
  chemically synthesized
atacacaacagtttaagctaca

SEQ ID NO: 1285036 - DNA, 22 bp, Artificial Sequence
  chemically synthesized
ctaatacacaacagtttaagct

SEQ ID NO: 1285037 - DNA, 22 bp, Artificial Sequence
  chemically synthesized
cctaatacacaacagtttaagc

SEQ ID NO: 1285038 - DNA, 22 bp, Artificial Sequence
  chemically synthesized
tcctaatacacaacagtttaag

SEQ ID NO: 1285039 - DNA, 22 bp, Artificial Sequence
  chemically synthesized
ttcctaatacacaacagtttaa

SEQ ID NO: 1285040 - DNA, 22 bp, Artificial Sequence
  chemically synthesized
taaaatgtagcttaaactgttg

SEQ ID NO: 1285041 - DNA, 22 bp, Artificial Sequence
  chemically synthesized
aatttttcctaatacacaacag

SEQ ID NO: 1285042 - DNA, 22 bp, Artificial Sequence
  chemically synthesized
tattaaatttttcctaatacac

SEQ ID NO: 1285043 - DNA, 22 bp, Artificial Sequence
  chemically synthesized
gtattaaatttttcctaataca

SEQ ID NO: 1285044 - DNA, 22 bp, Artificial Sequence
  chemically synthesized
aaactgttgtgtattaggaaaa

SEQ ID NO: 1285045 - DNA, 22 bp, Artificial Sequence
  chemically synthesized
aactgttgtgtattaggaaaaa

SEQ ID NO: 1285046 - DNA, 22 bp, Artificial Sequence
  chemically synthesized
ttgtgtattaggaaaaatttaa

SEQ ID NO: 1285047 - DNA, 22 bp, Artificial Sequence
  chemically synthesized
tagcagaatttgtattaaattt

SEQ ID NO: 1285048 - DNA, 22 bp, Artificial Sequence
  chemically synthesized
tgtattaggaaaaatttaatac

SEQ ID NO: 1285049 - DNA, 22 bp, Artificial Sequence
  chemically synthesized
aattatagcagaatttgtatta

SEQ ID NO: 1285050 - DNA, 22 bp, Artificial Sequence
  chemically synthesized
gaattatagcagaatttgtatt

SEQ ID NO: 1285051 - DNA, 22 bp, Artificial Sequence
  chemically synthesized
tgaattatagcagaatttgtat

SEQ ID NO: 1285052 - DNA, 22 bp, Artificial Sequence
  chemically synthesized
ggaaaaatttaatacaaattct

SEQ ID NO: 1285053 - DNA, 22 bp, Artificial Sequence
  chemically synthesized
ttgaattatagcagaatttgta

SEQ ID NO: 1285054 - DNA, 22 bp, Artificial Sequence
  chemically synthesized
tttgaattatagcagaatttgt

SEQ ID NO: 1285055 - DNA, 22 bp, Artificial Sequence
  chemically synthesized
tttttgaattatagcagaattt

SEQ ID NO: 1285056 - DNA, 22 bp, Artificial Sequence
  chemically synthesized
ctttttgaattatagcagaatt

SEQ ID NO: 1285057 - DNA, 22 bp, Artificial Sequence
  chemically synthesized
tctttttgaattatagcagaat

SEQ ID NO: 1285058 - DNA, 22 bp, Artificial Sequence
  chemically synthesized
ttttctttttgaattatagcag

SEQ ID NO: 1285059 - DNA, 22 bp, Artificial Sequence
  chemically synthesized
aatacaaattctgctataattc

SEQ ID NO: 1285060 - DNA, 22 bp, Artificial Sequence
  chemically synthesized
atacaaattctgctataattca

SEQ ID NO: 1285061 - DNA, 22 bp, Artificial Sequence
  chemically synthesized
attattttctttttgaattata

SEQ ID NO: 1285062 - DNA, 22 bp, Artificial Sequence
  chemically synthesized
cattattttctttttgaattat

SEQ ID NO: 1285063 - DNA, 22 bp, Artificial Sequence
  chemically synthesized
ccttcattattttctttttgaa

SEQ ID NO: 1285064 - DNA, 22 bp, Artificial Sequence
  chemically synthesized
cccttcattattttctttttga

SEQ ID NO: 1285065 - DNA, 22 bp, Artificial Sequence
  chemically synthesized
tgctataattcaaaaagaaaat

SEQ ID NO: 1285066 - DNA, 22 bp, Artificial Sequence
  chemically synthesized
tttcccttcattattttctttt

SEQ ID NO: 1285067 - DNA, 22 bp, Artificial Sequence
  chemically synthesized
atttcccttcattattttcttt

SEQ ID NO: 1285068 - DNA, 22 bp, Artificial Sequence
  chemically synthesized
ctataattcaaaaagaaaataa

SEQ ID NO: 1285069 - DNA, 22 bp, Artificial Sequence
  chemically synthesized
tatttcccttcattattttctt

SEQ ID NO: 1285070 - DNA, 22 bp, Artificial Sequence
  chemically synthesized
ttatttcccttcattattttct

SEQ ID NO: 1285071 - DNA, 22 bp, Artificial Sequence
  chemically synthesized
taattcaaaaagaaaataatga

SEQ ID NO: 1285072 - DNA, 22 bp, Artificial Sequence
  chemically synthesized
ttttatttcccttcattatttt

SEQ ID NO: 1285073 - DNA, 22 bp, Artificial Sequence
  chemically synthesized
cttttatttcccttcattattt

SEQ ID NO: 1285074 - DNA, 22 bp, Artificial Sequence
  chemically synthesized
tcttttatttcccttcattatt

SEQ ID NO: 1285075 - DNA, 22 bp, Artificial Sequence
  chemically synthesized
ttcttttatttcccttcattat

SEQ ID NO: 1285076 - DNA, 22 bp, Artificial Sequence
  chemically synthesized
ttttcttttatttcccttcatt

SEQ ID NO: 1285077 - DNA, 22 bp, Artificial Sequence
  chemically synthesized
aaaaagaaaataatgaagggaa

SEQ ID NO: 1285078 - DNA, 22 bp, Artificial Sequence
  chemically synthesized
ttcttttcttttatttcccttc

SEQ ID NO: 1285079 - DNA, 22 bp, Artificial Sequence
  chemically synthesized
attcttttcttttatttccctt

SEQ ID NO: 1285080 - DNA, 22 bp, Artificial Sequence
  chemically synthesized
tattcttttcttttatttccct

SEQ ID NO: 1285081 - DNA, 22 bp, Artificial Sequence
  chemically synthesized
cactttattcttttcttttatt

SEQ ID NO: 1285082 - DNA, 22 bp, Artificial Sequence
  chemically synthesized
ttccactttattcttttctttt

SEQ ID NO: 1285083 - DNA, 22 bp, Artificial Sequence
  chemically synthesized
gttccactttattcttttcttt

SEQ ID NO: 1285084 - DNA, 22 bp, Artificial Sequence
  chemically synthesized
tgttccactttattcttttctt

SEQ ID NO: 1285085 - DNA, 22 bp, Artificial Sequence
  chemically synthesized
tgtgacacattttgttccactt

SEQ ID NO: 1285086 - DNA, 22 bp, Artificial Sequence
  chemically synthesized
atgtgacacattttgttccact

SEQ ID NO: 1285087 - DNA, 22 bp, Artificial Sequence
  chemically synthesized
tatgtgacacattttgttccac

SEQ ID NO: 1285088 - DNA, 22 bp, Artificial Sequence
  chemically synthesized
ttttatgtgacacattttgttc

SEQ ID NO: 1285089 - DNA, 22 bp, Artificial Sequence
  chemically synthesized
gtatatgttgttttatgtgaca

SEQ ID NO: 1285090 - DNA, 22 bp, Artificial Sequence
  chemically synthesized
ccctggtatatgttgttttatg

SEQ ID NO: 1285091 - DNA, 22 bp, Artificial Sequence
  chemically synthesized
tagtaccctaccctggtatatg

SEQ ID NO: 1285092 - DNA, 22 bp, Artificial Sequence
  chemically synthesized
atagtaccctaccctggtatat

SEQ ID NO: 1285093 - DNA, 22 bp, Artificial Sequence
  chemically synthesized
tatagtaccctaccctggtata

SEQ ID NO: 1285094 - DNA, 22 bp, Artificial Sequence
  chemically synthesized
tagaaataaaactttatagtac

SEQ ID NO: 1285095 - DNA, 22 bp, Artificial Sequence
  chemically synthesized
aaagctgtagaaataaaacttt

SEQ ID NO: 1285096 - DNA, 22 bp, Artificial Sequence
  chemically synthesized
caaagctgtagaaataaaactt

SEQ ID NO: 1285097 - DNA, 22 bp, Artificial Sequence
  chemically synthesized
tcaaagctgtagaaataaaact

SEQ ID NO: 1285098 - DNA, 22 bp, Artificial Sequence
  chemically synthesized
tttcaaagctgtagaaataaaa

SEQ ID NO: 1285099 - DNA, 22 bp, Artificial Sequence
  chemically synthesized
ctttcaaagctgtagaaataaa

SEQ ID NO: 1285100 - DNA, 22 bp, Artificial Sequence
  chemically synthesized
gcttctttcaaagctgtagaaa

SEQ ID NO: 1285101 - DNA, 22 bp, Artificial Sequence
  chemically synthesized
agcttctttcaaagctgtagaa

SEQ ID NO: 1285102 - DNA, 22 bp, Artificial Sequence
  chemically synthesized
taaagttttatttctacagctt

SEQ ID NO: 1285103 - DNA, 22 bp, Artificial Sequence
  chemically synthesized
tagcttctttcaaagctgtaga

SEQ ID NO: 1285104 - DNA, 22 bp, Artificial Sequence
  chemically synthesized
ttagcttctttcaaagctgtag

SEQ ID NO: 1285105 - DNA, 22 bp, Artificial Sequence
  chemically synthesized
tatttctacagctttgaaagaa

SEQ ID NO: 1285106 - DNA, 22 bp, Artificial Sequence
  chemically synthesized
atttctacagctttgaaagaag

SEQ ID NO: 1285107 - DNA, 22 bp, Artificial Sequence
  chemically synthesized
tttctacagctttgaaagaagc

SEQ ID NO: 1285108 - DNA, 22 bp, Artificial Sequence
  chemically synthesized
ctacagctttgaaagaagctaa

SEQ ID NO: 1285109 - DNA, 22 bp, Artificial Sequence
  chemically synthesized
tacagctttgaaagaagctaaa

SEQ ID NO: 1285110 - DNA, 22 bp, Artificial Sequence
  chemically synthesized
cagctttgaaagaagctaaaaa

SEQ ID NO: 1285111 - DNA, 22 bp, Artificial Sequence
  chemically synthesized
cagagtcacaagtgagttttta

SEQ ID NO: 1285112 - DNA, 22 bp, Artificial Sequence
  chemically synthesized
tgaaagaagctaaaaactcact

SEQ ID NO: 1285113 - DNA, 22 bp, Artificial Sequence
  chemically synthesized
gaaagaagctaaaaactcactt

SEQ ID NO: 1285114 - DNA, 22 bp, Artificial Sequence
  chemically synthesized
aaagaagctaaaaactcacttg

SEQ ID NO: 1285115 - DNA, 22 bp, Artificial Sequence
  chemically synthesized
atgagctacagagtcacaagtg

SEQ ID NO: 1285116 - DNA, 22 bp, Artificial Sequence
  chemically synthesized
ctcatgagctacagagtcacaa

SEQ ID NO: 1285117 - DNA, 22 bp, Artificial Sequence
  chemically synthesized
aaaactcacttgtgactctgta

SEQ ID NO: 1285118 - DNA, 22 bp, Artificial Sequence
  chemically synthesized
acttgtgactctgtagctcatg

SEQ ID NO: 1285119 - DNA, 22 bp, Artificial Sequence
  chemically synthesized
gtgactctgtagctcatgagta

SEQ ID NO: 1285120 - DNA, 22 bp, Artificial Sequence
  chemically synthesized
aaatgaccacattactcatgag

SEQ ID NO: 1285121 - DNA, 22 bp, Artificial Sequence
  chemically synthesized
tgactctgtagctcatgagtaa

SEQ ID NO: 1285122 - DNA, 22 bp, Artificial Sequence
  chemically synthesized
gaaatgaccacattactcatga

SEQ ID NO: 1285123 - DNA, 22 bp, Artificial Sequence
  chemically synthesized
tgtagctcatgagtaatgtggt

SEQ ID NO: 1285124 - DNA, 22 bp, Artificial Sequence
  chemically synthesized
tagctcatgagtaatgtggtca

SEQ ID NO: 1285125 - DNA, 22 bp, Artificial Sequence
  chemically synthesized
tcaccataagtttgaaatgacc

SEQ ID NO: 1285126 - DNA, 22 bp, Artificial Sequence
  chemically synthesized
atgagtaatgtggtcatttcaa

SEQ ID NO: 1285127 - DNA, 22 bp, Artificial Sequence
  chemically synthesized
atcaccataagtttgaaatgac

SEQ ID NO: 1285128 - DNA, 22 bp, Artificial Sequence
  chemically synthesized
tatcaccataagtttgaaatga

SEQ ID NO: 1285129 - DNA, 22 bp, Artificial Sequence
  chemically synthesized
gagtgccataaagttttatcac

SEQ ID NO: 1285130 - DNA, 22 bp, Artificial Sequence
  chemically synthesized
caaacttatggtgataaaactt

SEQ ID NO: 1285131 - DNA, 22 bp, Artificial Sequence
  chemically synthesized
aaacttatggtgataaaacttt

SEQ ID NO: 1285132 - DNA, 22 bp, Artificial Sequence
  chemically synthesized
aactagagtgccataaagtttt

SEQ ID NO: 1285133 - DNA, 22 bp, Artificial Sequence
  chemically synthesized
tgaactagagtgccataaagtt

SEQ ID NO: 1285134 - DNA, 22 bp, Artificial Sequence
  chemically synthesized
atggtgataaaactttatggca

SEQ ID NO: 1285135 - DNA, 22 bp, Artificial Sequence
  chemically synthesized
tggtgataaaactttatggcac

SEQ ID NO: 1285136 - DNA, 22 bp, Artificial Sequence
  chemically synthesized
acatatgttctgaactagagtg

SEQ ID NO: 1285137 - DNA, 22 bp, Artificial Sequence
  chemically synthesized
gacatatgttctgaactagagt

SEQ ID NO: 1285138 - DNA, 22 bp, Artificial Sequence
  chemically synthesized
tttgacatatgttctgaactag

SEQ ID NO: 1285139 - DNA, 22 bp, Artificial Sequence
  chemically synthesized
tgtttgacatatgttctgaact

SEQ ID NO: 1285140 - DNA, 22 bp, Artificial Sequence
  chemically synthesized
tatggcactctagttcagaaca

SEQ ID NO: 1285141 - DNA, 22 bp, Artificial Sequence
  chemically synthesized
atggcactctagttcagaacat

SEQ ID NO: 1285142 - DNA, 22 bp, Artificial Sequence
  chemically synthesized
tctgtttgacatatgttctgaa

SEQ ID NO: 1285143 - DNA, 22 bp, Artificial Sequence
  chemically synthesized
tggcactctagttcagaacata

SEQ ID NO: 1285144 - DNA, 22 bp, Artificial Sequence
  chemically synthesized
ctctgtttgacatatgttctga

SEQ ID NO: 1285145 - DNA, 22 bp, Artificial Sequence
  chemically synthesized
tctctgtttgacatatgttctg

SEQ ID NO: 1285146 - DNA, 22 bp, Artificial Sequence
  chemically synthesized
ttctctgtttgacatatgttct

SEQ ID NO: 1285147 - DNA, 22 bp, Artificial Sequence
  chemically synthesized
tttctctgtttgacatatgttc

SEQ ID NO: 1285148 - DNA, 22 bp, Artificial Sequence
  chemically synthesized
ttttctctgtttgacatatgtt

SEQ ID NO: 1285149 - DNA, 22 bp, Artificial Sequence
  chemically synthesized
cttttttctctgtttgacatat

SEQ ID NO: 1285150 - DNA, 22 bp, Artificial Sequence
  chemically synthesized
tagttcagaacatatgtcaaac

SEQ ID NO: 1285151 - DNA, 22 bp, Artificial Sequence
  chemically synthesized
acttttttctctgtttgacata

SEQ ID NO: 1285152 - DNA, 22 bp, Artificial Sequence
  chemically synthesized
tacttttttctctgtttgacat

SEQ ID NO: 1285153 - DNA, 22 bp, Artificial Sequence
  chemically synthesized
gttcagaacatatgtcaaacag

SEQ ID NO: 1285154 - DNA, 22 bp, Artificial Sequence
  chemically synthesized
ttacttttttctctgtttgaca

SEQ ID NO: 1285155 - DNA, 22 bp, Artificial Sequence
  chemically synthesized
agaacatatgtcaaacagagaa

SEQ ID NO: 1285156 - DNA, 22 bp, Artificial Sequence
  chemically synthesized
atttttacttttttctctgttt

SEQ ID NO: 1285157 - DNA, 22 bp, Artificial Sequence
  chemically synthesized
gatttttacttttttctctgtt

SEQ ID NO: 1285158 - DNA, 22 bp, Artificial Sequence
  chemically synthesized
tgatttttacttttttctctgt

SEQ ID NO: 1285159 - DNA, 22 bp, Artificial Sequence
  chemically synthesized
attttgatttttacttttttct

SEQ ID NO: 1285160 - DNA, 22 bp, Artificial Sequence
  chemically synthesized
cattttgatttttacttttttc

SEQ ID NO: 1285161 - DNA, 22 bp, Artificial Sequence
  chemically synthesized
tcacatttcattttgattttta

SEQ ID NO: 1285162 - DNA, 22 bp, Artificial Sequence
  chemically synthesized
gtcacatttcattttgattttt

SEQ ID NO: 1285163 - DNA, 22 bp, Artificial Sequence
  chemically synthesized
tgtcacatttcattttgatttt

SEQ ID NO: 1285164 - DNA, 22 bp, Artificial Sequence
  chemically synthesized
cagtgttttgtcacatttcatt

SEQ ID NO: 1285165 - DNA, 22 bp, Artificial Sequence
  chemically synthesized
gcagtgttttgtcacatttcat

SEQ ID NO: 1285166 - DNA, 22 bp, Artificial Sequence
  chemically synthesized
tgcagtgttttgtcacatttca

SEQ ID NO: 1285167 - DNA, 22 bp, Artificial Sequence
  chemically synthesized
caaaacccttctcatctgacac

SEQ ID NO: 1285168 - DNA, 22 bp, Artificial Sequence
  chemically synthesized
ccagacaaaaccagaatagtgg

SEQ ID NO: 1285169 - DNA, 22 bp, Artificial Sequence
  chemically synthesized
ctcatctgacaccactattctg

SEQ ID NO: 1285170 - DNA, 22 bp, Artificial Sequence
  chemically synthesized
tcatctgacaccactattctgg

SEQ ID NO: 1285171 - DNA, 22 bp, Artificial Sequence
  chemically synthesized
atctgacaccactattctggtt

SEQ ID NO: 1285172 - DNA, 22 bp, Artificial Sequence
  chemically synthesized
acaccactattctggttttgtc

SEQ ID NO: 1285173 - DNA, 22 bp, Artificial Sequence
  chemically synthesized
accaccgattcccagacaaaac

SEQ ID NO: 1285174 - DNA, 22 bp, Artificial Sequence
  chemically synthesized
ttctggttttgtctgggaatcg

SEQ ID NO: 1285175 - DNA, 22 bp, Artificial Sequence
  chemically synthesized
tggttttgtctgggaatcggtg

SEQ ID NO: 1285176 - DNA, 22 bp, Artificial Sequence
  chemically synthesized
gttttgtctgggaatcggtggt

SEQ ID NO: 1285177 - DNA, 22 bp, Artificial Sequence
  chemically synthesized
aaaatgaaattgaccaccgatt

SEQ ID NO: 1285178 - DNA, 22 bp, Artificial Sequence
  chemically synthesized
caaaatgaaattgaccaccgat

SEQ ID NO: 1285179 - DNA, 22 bp, Artificial Sequence
  chemically synthesized
tgtctgggaatcggtggtcaat

SEQ ID NO: 1285180 - DNA, 22 bp, Artificial Sequence
  chemically synthesized
gtctgggaatcggtggtcaatt

SEQ ID NO: 1285181 - DNA, 22 bp, Artificial Sequence
  chemically synthesized
tctgggaatcggtggtcaattt

SEQ ID NO: 1285182 - DNA, 22 bp, Artificial Sequence
  chemically synthesized
ggaatcggtggtcaatttcatt

SEQ ID NO: 1285183 - DNA, 22 bp, Artificial Sequence
  chemically synthesized
agacagaaatttcaaaatgaaa

SEQ ID NO: 1285184 - DNA, 22 bp, Artificial Sequence
  chemically synthesized
tgagacagaaatttcaaaatga

SEQ ID NO: 1285185 - DNA, 22 bp, Artificial Sequence
  chemically synthesized
catgactctgagacagaaattt

SEQ ID NO: 1285186 - DNA, 22 bp, Artificial Sequence
  chemically synthesized
ctacatgactctgagacagaaa

SEQ ID NO: 1285187 - DNA, 22 bp, Artificial Sequence
  chemically synthesized
cattttgaaatttctgtctcag

SEQ ID NO: 1285188 - DNA, 22 bp, Artificial Sequence
  chemically synthesized
attttgaaatttctgtctcaga

SEQ ID NO: 1285189 - DNA, 22 bp, Artificial Sequence
  chemically synthesized
agttgctacatgactctgagac

SEQ ID NO: 1285190 - DNA, 22 bp, Artificial Sequence
  chemically synthesized
aagttgctacatgactctgaga

SEQ ID NO: 1285191 - DNA, 22 bp, Artificial Sequence
  chemically synthesized
tgaaatttctgtctcagagtca

SEQ ID NO: 1285192 - DNA, 22 bp, Artificial Sequence
  chemically synthesized
gaaatttctgtctcagagtcat

SEQ ID NO: 1285193 - DNA, 22 bp, Artificial Sequence
  chemically synthesized
aaatttctgtctcagagtcatg

SEQ ID NO: 1285194 - DNA, 22 bp, Artificial Sequence
  chemically synthesized
ctgtctcagagtcatgtagcaa

SEQ ID NO: 1285195 - DNA, 22 bp, Artificial Sequence
  chemically synthesized
tgtctcagagtcatgtagcaac

SEQ ID NO: 1285196 - DNA, 22 bp, Artificial Sequence
  chemically synthesized
tctcagagtcatgtagcaactt

SEQ ID NO: 1285197 - DNA, 22 bp, Artificial Sequence
  chemically synthesized
agagtcatgtagcaacttaaat

SEQ ID NO: 1285198 - DNA, 22 bp, Artificial Sequence
  chemically synthesized
atcagagcagtcatttaagttg

SEQ ID NO: 1285199 - DNA, 22 bp, Artificial Sequence
  chemically synthesized
atgctaatcagagcagtcattt

SEQ ID NO: 1285200 - DNA, 22 bp, Artificial Sequence
  chemically synthesized
gatgctaatcagagcagtcatt

SEQ ID NO: 1285201 - DNA, 22 bp, Artificial Sequence
  chemically synthesized
tgatgctaatcagagcagtcat

SEQ ID NO: 1285202 - DNA, 22 bp, Artificial Sequence
  chemically synthesized
ctttgatgctaatcagagcagt

SEQ ID NO: 1285203 - DNA, 22 bp, Artificial Sequence
  chemically synthesized
actttgatgctaatcagagcag

SEQ ID NO: 1285204 - DNA, 22 bp, Artificial Sequence
  chemically synthesized
cacttactttgatgctaatcag

SEQ ID NO: 1285205 - DNA, 22 bp, Artificial Sequence
  chemically synthesized
aaatgactgctctgattagcat

SEQ ID NO: 1285206 - DNA, 22 bp, Artificial Sequence
  chemically synthesized
aatgactgctctgattagcatc

SEQ ID NO: 1285207 - DNA, 22 bp, Artificial Sequence
  chemically synthesized
tacacttactttgatgctaatc

SEQ ID NO: 1285208 - DNA, 22 bp, Artificial Sequence
  chemically synthesized
ctacacttactttgatgctaat

SEQ ID NO: 1285209 - DNA, 22 bp, Artificial Sequence
  chemically synthesized
tctacacttactttgatgctaa

SEQ ID NO: 1285210 - DNA, 22 bp, Artificial Sequence
  chemically synthesized
ttctacacttactttgatgcta

SEQ ID NO: 1285211 - DNA, 22 bp, Artificial Sequence
  chemically synthesized
ctctgattagcatcaaagtaag

SEQ ID NO: 1285212 - DNA, 22 bp, Artificial Sequence
  chemically synthesized
tgattagcatcaaagtaagtgt

SEQ ID NO: 1285213 - DNA, 22 bp, Artificial Sequence
  chemically synthesized
attagcatcaaagtaagtgtag

SEQ ID NO: 1285214 - DNA, 22 bp, Artificial Sequence
  chemically synthesized
gcatcaaagtaagtgtagaaaa

SEQ ID NO: 1285215 - DNA, 22 bp, Artificial Sequence
  chemically synthesized
acaccatcatgatgaaagcaaa

SEQ ID NO: 1285216 - DNA, 22 bp, Artificial Sequence
  chemically synthesized
ttaacaccatcatgatgaaagc

SEQ ID NO: 1285217 - DNA, 22 bp, Artificial Sequence
  chemically synthesized
gctttcatcatgatggtgttaa

SEQ ID NO: 1285218 - DNA, 22 bp, Artificial Sequence
  chemically synthesized
aagtacatattgttaacaccat

SEQ ID NO: 1285219 - DNA, 22 bp, Artificial Sequence
  chemically synthesized
ctttcatcatgatggtgttaac

SEQ ID NO: 1285220 - DNA, 22 bp, Artificial Sequence
  chemically synthesized
tgaagtacatattgttaacacc

SEQ ID NO: 1285221 - DNA, 22 bp, Artificial Sequence
  chemically synthesized
ctgaagtacatattgttaacac

SEQ ID NO: 1285222 - DNA, 22 bp, Artificial Sequence
  chemically synthesized
tcatcatgatggtgttaacaat

SEQ ID NO: 1285223 - DNA, 22 bp, Artificial Sequence
  chemically synthesized
tctgaagtacatattgttaaca

SEQ ID NO: 1285224 - DNA, 22 bp, Artificial Sequence
  chemically synthesized
catcatgatggtgttaacaata

SEQ ID NO: 1285225 - DNA, 22 bp, Artificial Sequence
  chemically synthesized
atcatgatggtgttaacaatat

SEQ ID NO: 1285226 - DNA, 22 bp, Artificial Sequence
  chemically synthesized
acgatgacattttctgaagtac

SEQ ID NO: 1285227 - DNA, 22 bp, Artificial Sequence
  chemically synthesized
acaatatgtacttcagaaaatg

SEQ ID NO: 1285228 - DNA, 22 bp, Artificial Sequence
  chemically synthesized
gcaacactaacgatgacatttt

SEQ ID NO: 1285229 - DNA, 22 bp, Artificial Sequence
  chemically synthesized
agcaacactaacgatgacattt

SEQ ID NO: 1285230 - DNA, 22 bp, Artificial Sequence
  chemically synthesized
tagcaacactaacgatgacatt

SEQ ID NO: 1285231 - DNA, 22 bp, Artificial Sequence
  chemically synthesized
ctttagcaacactaacgatgac

SEQ ID NO: 1285232 - DNA, 22 bp, Artificial Sequence
  chemically synthesized
actttagcaacactaacgatga

SEQ ID NO: 1285233 - DNA, 22 bp, Artificial Sequence
  chemically synthesized
ttactttagcaacactaacgat

SEQ ID NO: 1285234 - DNA, 22 bp, Artificial Sequence
  chemically synthesized
cagaaaatgtcatcgttagtgt

SEQ ID NO: 1285235 - DNA, 22 bp, Artificial Sequence
  chemically synthesized
agaaaatgtcatcgttagtgtt

SEQ ID NO: 1285236 - DNA, 22 bp, Artificial Sequence
  chemically synthesized
ttcttactttagcaacactaac

SEQ ID NO: 1285237 - DNA, 22 bp, Artificial Sequence
  chemically synthesized
tgttcttactttagcaacacta

SEQ ID NO: 1285238 - DNA, 22 bp, Artificial Sequence
  chemically synthesized
ctgttcttactttagcaacact

SEQ ID NO: 1285239 - DNA, 22 bp, Artificial Sequence
  chemically synthesized
tgcttctgttcttactttagca

SEQ ID NO: 1285240 - DNA, 22 bp, Artificial Sequence
  chemically synthesized
gtgttgctaaagtaagaacaga

SEQ ID NO: 1285241 - DNA, 22 bp, Artificial Sequence
  chemically synthesized
caggaattatgcttctgttctt

SEQ ID NO: 1285242 - DNA, 22 bp, Artificial Sequence
  chemically synthesized
actgcaggaattatgcttctgt

SEQ ID NO: 1285243 - DNA, 22 bp, Artificial Sequence
  chemically synthesized
ctaaagtaagaacagaagcata

SEQ ID NO: 1285244 - DNA, 22 bp, Artificial Sequence
  chemically synthesized
aactgcaggaattatgcttctg

SEQ ID NO: 1285245 - DNA, 22 bp, Artificial Sequence
  chemically synthesized
aagtaagaacagaagcataatt

SEQ ID NO: 1285246 - DNA, 22 bp, Artificial Sequence
  chemically synthesized
gaatttaactgcaggaattatg

SEQ ID NO: 1285247 - DNA, 22 bp, Artificial Sequence
  chemically synthesized
gattggaatttaactgcaggaa

SEQ ID NO: 1285248 - DNA, 22 bp, Artificial Sequence
  chemically synthesized
agattggaatttaactgcagga

SEQ ID NO: 1285249 - DNA, 22 bp, Artificial Sequence
  chemically synthesized
ctgcagttaaattccaatctaa

SEQ ID NO: 1285250 - DNA, 22 bp, Artificial Sequence
  chemically synthesized
cagttaaattccaatctaagat

SEQ ID NO: 1285251 - DNA, 22 bp, Artificial Sequence
  chemically synthesized
gtgtgaaggtcaaatatcttag

SEQ ID NO: 1285252 - DNA, 22 bp, Artificial Sequence
  chemically synthesized
cgtgtgaaggtcaaatatctta

SEQ ID NO: 1285253 - DNA, 22 bp, Artificial Sequence
  chemically synthesized
tcgtgtgaaggtcaaatatctt

SEQ ID NO: 1285254 - DNA, 22 bp, Artificial Sequence
  chemically synthesized
aattccaatctaagatatttga

SEQ ID NO: 1285255 - DNA, 22 bp, Artificial Sequence
  chemically synthesized
ttcgtgtgaaggtcaaatatct

SEQ ID NO: 1285256 - DNA, 22 bp, Artificial Sequence
  chemically synthesized
ttttcgtgtgaaggtcaaatat

SEQ ID NO: 1285257 - DNA, 22 bp, Artificial Sequence
  chemically synthesized
caatctaagatatttgaccttc

SEQ ID NO: 1285258 - DNA, 22 bp, Artificial Sequence
  chemically synthesized
attcttttcgtgtgaaggtcaa

SEQ ID NO: 1285259 - DNA, 22 bp, Artificial Sequence
  chemically synthesized
cattcttttcgtgtgaaggtca

SEQ ID NO: 1285260 - DNA, 22 bp, Artificial Sequence
  chemically synthesized
tcttcattcttttcgtgtgaag

SEQ ID NO: 1285261 - DNA, 22 bp, Artificial Sequence
  chemically synthesized
agatatttgaccttcacacgaa

SEQ ID NO: 1285262 - DNA, 22 bp, Artificial Sequence
  chemically synthesized
gtcttcattcttttcgtgtgaa

SEQ ID NO: 1285263 - DNA, 22 bp, Artificial Sequence
  chemically synthesized
tgtcttcattcttttcgtgtga

SEQ ID NO: 1285264 - DNA, 22 bp, Artificial Sequence
  chemically synthesized
gaccttcacacgaaaagaatga

SEQ ID NO: 1285265 - DNA, 22 bp, Artificial Sequence
  chemically synthesized
accttcacacgaaaagaatgaa

SEQ ID NO: 1285266 - DNA, 22 bp, Artificial Sequence
  chemically synthesized
cacacgaaaagaatgaagacaa

SEQ ID NO: 1285267 - DNA, 22 bp, Artificial Sequence
  chemically synthesized
acacgaaaagaatgaagacaaa

SEQ ID NO: 1285268 - DNA, 22 bp, Artificial Sequence
  chemically synthesized
aaagagaaaggctttgtcttca

SEQ ID NO: 1285269 - DNA, 22 bp, Artificial Sequence
  chemically synthesized
aaaagagaaaggctttgtcttc

SEQ ID NO: 1285270 - DNA, 22 bp, Artificial Sequence
  chemically synthesized
taaaagagaaaggctttgtctt

SEQ ID NO: 1285271 - DNA, 22 bp, Artificial Sequence
  chemically synthesized
ttaaaagagaaaggctttgtct

SEQ ID NO: 1285272 - DNA, 22 bp, Artificial Sequence
  chemically synthesized
cataaaaatagtttttaaaaga

SEQ ID NO: 1285273 - DNA, 22 bp, Artificial Sequence
  chemically synthesized
atatattccataaaaatagttt

SEQ ID NO: 1285274 - DNA, 22 bp, Artificial Sequence
  chemically synthesized
tctcttttaaaaactattttta

SEQ ID NO: 1285275 - DNA, 22 bp, Artificial Sequence
  chemically synthesized
ctcttttaaaaactatttttat

SEQ ID NO: 1285276 - DNA, 22 bp, Artificial Sequence
  chemically synthesized
tcttttaaaaactatttttatg

SEQ ID NO: 1285277 - DNA, 22 bp, Artificial Sequence
  chemically synthesized
ttttaaaaactatttttatgga

SEQ ID NO: 1285278 - DNA, 22 bp, Artificial Sequence
  chemically synthesized
aaattaatatattccataaaaa

SEQ ID NO: 1285279 - DNA, 22 bp, Artificial Sequence
  chemically synthesized
ttaaaaactatttttatggaat

SEQ ID NO: 1285280 - DNA, 22 bp, Artificial Sequence
  chemically synthesized
taaaattaatatattccataaa

SEQ ID NO: 1285281 - DNA, 22 bp, Artificial Sequence
  chemically synthesized
taaaaactatttttatggaata

SEQ ID NO: 1285282 - DNA, 22 bp, Artificial Sequence
  chemically synthesized
aaaaactatttttatggaatat

SEQ ID NO: 1285283 - DNA, 22 bp, Artificial Sequence
  chemically synthesized
tctaaaattaatatattccata

SEQ ID NO: 1285284 - DNA, 22 bp, Artificial Sequence
  chemically synthesized
aaaactatttttatggaatata

SEQ ID NO: 1285285 - DNA, 22 bp, Artificial Sequence
  chemically synthesized
ctctaaaattaatatattccat

SEQ ID NO: 1285286 - DNA, 22 bp, Artificial Sequence
  chemically synthesized
tctctaaaattaatatattcca

SEQ ID NO: 1285287 - DNA, 22 bp, Artificial Sequence
  chemically synthesized
tttttatggaatatattaattt

SEQ ID NO: 1285288 - DNA, 22 bp, Artificial Sequence
  chemically synthesized
ttatggaatatattaattttag

SEQ ID NO: 1285289 - DNA, 22 bp, Artificial Sequence
  chemically synthesized
tatggaatatattaattttaga

SEQ ID NO: 1285290 - DNA, 22 bp, Artificial Sequence
  chemically synthesized
atggaatatattaattttagag

SEQ ID NO: 1285291 - DNA, 22 bp, Artificial Sequence
  chemically synthesized
tggaatatattaattttagaga

SEQ ID NO: 1285292 - DNA, 22 bp, Artificial Sequence
  chemically synthesized
taaagacatgacattttctcta

SEQ ID NO: 1285293 - DNA, 22 bp, Artificial Sequence
  chemically synthesized
attgtaaagacatgacattttc

SEQ ID NO: 1285294 - DNA, 22 bp, Artificial Sequence
  chemically synthesized
tcattgtaaagacatgacattt

SEQ ID NO: 1285295 - DNA, 22 bp, Artificial Sequence
  chemically synthesized
attttagagaaaatgtcatgtc

SEQ ID NO: 1285296 - DNA, 22 bp, Artificial Sequence
  chemically synthesized
agctctcattgtaaagacatga

SEQ ID NO: 1285297 - DNA, 22 bp, Artificial Sequence
  chemically synthesized
tagagaaaatgtcatgtcttta

SEQ ID NO: 1285298 - DNA, 22 bp, Artificial Sequence
  chemically synthesized
agagaaaatgtcatgtctttac

SEQ ID NO: 1285299 - DNA, 22 bp, Artificial Sequence
  chemically synthesized
gagaaaatgtcatgtctttaca

SEQ ID NO: 1285300 - DNA, 22 bp, Artificial Sequence
  chemically synthesized
aaaatattgagctctcattgta

SEQ ID NO: 1285301 - DNA, 22 bp, Artificial Sequence
  chemically synthesized
gaaaatattgagctctcattgt

SEQ ID NO: 1285302 - DNA, 22 bp, Artificial Sequence
  chemically synthesized
tacaatgagagctcaatatttt

SEQ ID NO: 1285303 - DNA, 22 bp, Artificial Sequence
  chemically synthesized
acaatgagagctcaatattttc

SEQ ID NO: 1285304 - DNA, 22 bp, Artificial Sequence
  chemically synthesized
caatgagagctcaatattttca

SEQ ID NO: 1285305 - DNA, 22 bp, Artificial Sequence
  chemically synthesized
atatataaccacatcatttgaa

SEQ ID NO: 1285306 - DNA, 22 bp, Artificial Sequence
  chemically synthesized
aatatataaccacatcatttga

SEQ ID NO: 1285307 - DNA, 22 bp, Artificial Sequence
  chemically synthesized
atttaatatataaccacatcat

SEQ ID NO: 1285308 - DNA, 22 bp, Artificial Sequence
  chemically synthesized
aatattttcaaatgatgtggtt

SEQ ID NO: 1285309 - DNA, 22 bp, Artificial Sequence
  chemically synthesized
tcaaatgatgtggttatatatt

SEQ ID NO: 1285310 - DNA, 22 bp, Artificial Sequence
  chemically synthesized
caaatgatgtggttatatatta

SEQ ID NO: 1285311 - DNA, 22 bp, Artificial Sequence
  chemically synthesized
aaatgatgtggttatatattaa

SEQ ID NO: 1285312 - DNA, 22 bp, Artificial Sequence
  chemically synthesized
atggtaagaaaatgaacgtatt

SEQ ID NO: 1285313 - DNA, 22 bp, Artificial Sequence
  chemically synthesized
tatattaaatgaatacgttcat

SEQ ID NO: 1285314 - DNA, 22 bp, Artificial Sequence
  chemically synthesized
aatggtaagaaaatgaacgtat

SEQ ID NO: 1285315 - DNA, 22 bp, Artificial Sequence
  chemically synthesized
aatgaatacgttcattttctta

SEQ ID NO: 1285316 - DNA, 22 bp, Artificial Sequence
  chemically synthesized
ataccaaaaatttaatggtaag

SEQ ID NO: 1285317 - DNA, 22 bp, Artificial Sequence
  chemically synthesized
attttcttaccattaaattttt

SEQ ID NO: 1285318 - DNA, 22 bp, Artificial Sequence
  chemically synthesized
ccagaactaataccaaaaattt

SEQ ID NO: 1285319 - DNA, 22 bp, Artificial Sequence
  chemically synthesized
tcttaccattaaatttttggta

SEQ ID NO: 1285320 - DNA, 22 bp, Artificial Sequence
  chemically synthesized
cttaccattaaatttttggtat

SEQ ID NO: 1285321 - DNA, 22 bp, Artificial Sequence
  chemically synthesized
ttaccattaaatttttggtatt

SEQ ID NO: 1285322 - DNA, 22 bp, Artificial Sequence
  chemically synthesized
accattaaatttttggtattag

SEQ ID NO: 1285323 - DNA, 22 bp, Artificial Sequence
  chemically synthesized
ccattaaatttttggtattagt

SEQ ID NO: 1285324 - DNA, 22 bp, Artificial Sequence
  chemically synthesized
tggcctcccagaactaatacca

SEQ ID NO: 1285325 - DNA, 22 bp, Artificial Sequence
  chemically synthesized
aatttttggtattagttctggg

SEQ ID NO: 1285326 - DNA, 22 bp, Artificial Sequence
  chemically synthesized
ttggtattagttctgggaggcc

SEQ ID NO: 1285327 - DNA, 22 bp, Artificial Sequence
  chemically synthesized
tggtattagttctgggaggcca

SEQ ID NO: 1285328 - DNA, 22 bp, Artificial Sequence
  chemically synthesized
ggtattagttctgggaggccat

SEQ ID NO: 1285329 - DNA, 22 bp, Artificial Sequence
  chemically synthesized
agtagaaaaattatggcctccc

SEQ ID NO: 1285330 - DNA, 22 bp, Artificial Sequence
  chemically synthesized
gtattagttctgggaggccata

SEQ ID NO: 1285331 - DNA, 22 bp, Artificial Sequence
  chemically synthesized
aagtagaaaaattatggcctcc

SEQ ID NO: 1285332 - DNA, 22 bp, Artificial Sequence
  chemically synthesized
gttctgggaggccataattttt

SEQ ID NO: 1285333 - DNA, 22 bp, Artificial Sequence
  chemically synthesized
tgggaggccataatttttctac

SEQ ID NO: 1285334 - DNA, 22 bp, Artificial Sequence
  chemically synthesized
ggaggccataatttttctactt

SEQ ID NO: 1285335 - DNA, 22 bp, Artificial Sequence
  chemically synthesized
tatacaggcaaaaatttaagta

SEQ ID NO: 1285336 - DNA, 22 bp, Artificial Sequence
  chemically synthesized
atatacaggcaaaaatttaagt

SEQ ID NO: 1285337 - DNA, 22 bp, Artificial Sequence
  chemically synthesized
tatatacaggcaaaaatttaag

SEQ ID NO: 1285338 - DNA, 22 bp, Artificial Sequence
  chemically synthesized
ttatatacaggcaaaaatttaa

SEQ ID NO: 1285339 - DNA, 22 bp, Artificial Sequence
  chemically synthesized
tttatatacaggcaaaaattta

SEQ ID NO: 1285340 - DNA, 22 bp, Artificial Sequence
  chemically synthesized
ttctacttaaatttttgcctgt

SEQ ID NO: 1285341 - DNA, 22 bp, Artificial Sequence
  chemically synthesized
tctacttaaatttttgcctgta

SEQ ID NO: 1285342 - DNA, 22 bp, Artificial Sequence
  chemically synthesized
ctacttaaatttttgcctgtat

SEQ ID NO: 1285343 - DNA, 22 bp, Artificial Sequence
  chemically synthesized
tacttaaatttttgcctgtata

SEQ ID NO: 1285344 - DNA, 22 bp, Artificial Sequence
  chemically synthesized
cttaaatttttgcctgtatata

SEQ ID NO: 1285345 - DNA, 22 bp, Artificial Sequence
  chemically synthesized
cacaaagtactttttatataca

SEQ ID NO: 1285346 - DNA, 22 bp, Artificial Sequence
  chemically synthesized
aaatttttgcctgtatataaaa

SEQ ID NO: 1285347 - DNA, 22 bp, Artificial Sequence
  chemically synthesized
acacaaagtactttttatatac

SEQ ID NO: 1285348 - DNA, 22 bp, Artificial Sequence
  chemically synthesized
aatttttgcctgtatataaaaa

SEQ ID NO: 1285349 - DNA, 22 bp, Artificial Sequence
  chemically synthesized
tttacacaaagtactttttata

SEQ ID NO: 1285350 - DNA, 22 bp, Artificial Sequence
  chemically synthesized
tatttacacaaagtacttttta

SEQ ID NO: 1285351 - DNA, 22 bp, Artificial Sequence
  chemically synthesized
ttgcctgtatataaaaagtact

SEQ ID NO: 1285352 - DNA, 22 bp, Artificial Sequence
  chemically synthesized
tgcctgtatataaaaagtactt

SEQ ID NO: 1285353 - DNA, 22 bp, Artificial Sequence
  chemically synthesized
gcctgtatataaaaagtacttt

SEQ ID NO: 1285354 - DNA, 22 bp, Artificial Sequence
  chemically synthesized
cctgtatataaaaagtactttg

SEQ ID NO: 1285355 - DNA, 22 bp, Artificial Sequence
  chemically synthesized
gactctatttacacaaagtact

SEQ ID NO: 1285356 - DNA, 22 bp, Artificial Sequence
  chemically synthesized
tatataaaaagtactttgtgta

SEQ ID NO: 1285357 - DNA, 22 bp, Artificial Sequence
  chemically synthesized
aagtcaaattggactctattta

SEQ ID NO: 1285358 - DNA, 22 bp, Artificial Sequence
  chemically synthesized
tgtgtaaatagagtccaatttg

SEQ ID NO: 1285359 - DNA, 22 bp, Artificial Sequence
  chemically synthesized
ataaactaaagtcaaattggac

SEQ ID NO: 1285360 - DNA, 22 bp, Artificial Sequence
  chemically synthesized
gtgtaaatagagtccaatttga

SEQ ID NO: 1285361 - DNA, 22 bp, Artificial Sequence
  chemically synthesized
tgtaaatagagtccaatttgac

SEQ ID NO: 1285362 - DNA, 22 bp, Artificial Sequence
  chemically synthesized
atactaataaactaaagtcaaa

SEQ ID NO: 1285363 - DNA, 22 bp, Artificial Sequence
  chemically synthesized
attaatactaataaactaaagt

SEQ ID NO: 1285364 - DNA, 22 bp, Artificial Sequence
  chemically synthesized
gactttagtttattagtattaa

SEQ ID NO: 1285365 - DNA, 22 bp, Artificial Sequence
  chemically synthesized
actttagtttattagtattaat

SEQ ID NO: 1285366 - DNA, 22 bp, Artificial Sequence
  chemically synthesized
tagtttattagtattaattagt

SEQ ID NO: 1285367 - DNA, 22 bp, Artificial Sequence
  chemically synthesized
agtttattagtattaattagtt

SEQ ID NO: 1285368 - DNA, 22 bp, Artificial Sequence
  chemically synthesized
gtttattagtattaattagttg

SEQ ID NO: 1285369 - DNA, 22 bp, Artificial Sequence
  chemically synthesized
attagtattaattagttgtatt

SEQ ID NO: 1285370 - DNA, 22 bp, Artificial Sequence
  chemically synthesized
tccaagtgacaaaatacaacta

SEQ ID NO: 1285371 - DNA, 22 bp, Artificial Sequence
  chemically synthesized
ttagtattaattagttgtattt

SEQ ID NO: 1285372 - DNA, 22 bp, Artificial Sequence
  chemically synthesized
gtattaattagttgtattttgt

SEQ ID NO: 1285373 - DNA, 22 bp, Artificial Sequence
  chemically synthesized
caagttgtccaagtgacaaaat

SEQ ID NO: 1285374 - DNA, 22 bp, Artificial Sequence
  chemically synthesized
gcaagttgtccaagtgacaaaa

SEQ ID NO: 1285375 - DNA, 22 bp, Artificial Sequence
  chemically synthesized
tgcaagttgtccaagtgacaaa

SEQ ID NO: 1285376 - DNA, 22 bp, Artificial Sequence
  chemically synthesized
attagttgtattttgtcacttg

SEQ ID NO: 1285377 - DNA, 22 bp, Artificial Sequence
  chemically synthesized
gttgtattttgtcacttggaca

SEQ ID NO: 1285378 - DNA, 22 bp, Artificial Sequence
  chemically synthesized
tattttgtcacttggacaactt

SEQ ID NO: 1285379 - DNA, 22 bp, Artificial Sequence
  chemically synthesized
tgtcacttggacaacttgcaaa

SEQ ID NO: 1285380 - DNA, 22 bp, Artificial Sequence
  chemically synthesized
gtcacttggacaacttgcaaaa

SEQ ID NO: 1285381 - DNA, 22 bp, Artificial Sequence
  chemically synthesized
tcacttggacaacttgcaaaac

SEQ ID NO: 1285382 - DNA, 22 bp, Artificial Sequence
  chemically synthesized
ggacaacttgcaaaactttggt

SEQ ID NO: 1285383 - DNA, 22 bp, Artificial Sequence
  chemically synthesized
gacaacttgcaaaactttggtg

SEQ ID NO: 1285384 - DNA, 22 bp, Artificial Sequence
  chemically synthesized
gcaaaactttggtgttattctg

SEQ ID NO: 1285385 - DNA, 22 bp, Artificial Sequence
  chemically synthesized
caaaactttggtgttattctga

SEQ ID NO: 1285386 - DNA, 22 bp, Artificial Sequence
  chemically synthesized
agaaaatggagtgacaatcaga

SEQ ID NO: 1285387 - DNA, 22 bp, Artificial Sequence
  chemically synthesized
tggtgttattctgattgtcact

SEQ ID NO: 1285388 - DNA, 22 bp, Artificial Sequence
  chemically synthesized
ggtgttattctgattgtcactc

SEQ ID NO: 1285389 - DNA, 22 bp, Artificial Sequence
  chemically synthesized
gtgttattctgattgtcactcc

SEQ ID NO: 1285390 - DNA, 22 bp, Artificial Sequence
  chemically synthesized
cagctaagaaaatggagtgaca

SEQ ID NO: 1285391 - DNA, 22 bp, Artificial Sequence
  chemically synthesized
ttctgattgtcactccattttc

SEQ ID NO: 1285392 - DNA, 22 bp, Artificial Sequence
  chemically synthesized
gccctacagctaagaaaatgga

SEQ ID NO: 1285393 - DNA, 22 bp, Artificial Sequence
  chemically synthesized
tgattgtcactccattttctta

SEQ ID NO: 1285394 - DNA, 22 bp, Artificial Sequence
  chemically synthesized
tggccctacagctaagaaaatg

SEQ ID NO: 1285395 - DNA, 22 bp, Artificial Sequence
  chemically synthesized
attgtcactccattttcttagc

SEQ ID NO: 1285396 - DNA, 22 bp, Artificial Sequence
  chemically synthesized
gattctggccctacagctaaga

SEQ ID NO: 1285397 - DNA, 22 bp, Artificial Sequence
  chemically synthesized
tcactccattttcttagctgta

SEQ ID NO: 1285398 - DNA, 22 bp, Artificial Sequence
  chemically synthesized
attagattctggccctacagct

SEQ ID NO: 1285399 - DNA, 22 bp, Artificial Sequence
  chemically synthesized
cattttcttagctgtagggcca

SEQ ID NO: 1285400 - DNA, 22 bp, Artificial Sequence
  chemically synthesized
tcttagctgtagggccagaatc

SEQ ID NO: 1285401 - DNA, 22 bp, Artificial Sequence
  chemically synthesized
cttagctgtagggccagaatct

SEQ ID NO: 1285402 - DNA, 22 bp, Artificial Sequence
  chemically synthesized
ttagctgtagggccagaatcta

SEQ ID NO: 1285403 - DNA, 22 bp, Artificial Sequence
  chemically synthesized
agctgtagggccagaatctaat

SEQ ID NO: 1285404 - DNA, 22 bp, Artificial Sequence
  chemically synthesized
ataataggattaattagattct

SEQ ID NO: 1285405 - DNA, 22 bp, Artificial Sequence
  chemically synthesized
gctgtagggccagaatctaatt

SEQ ID NO: 1285406 - DNA, 22 bp, Artificial Sequence
  chemically synthesized
ttaataataggattaattagat

SEQ ID NO: 1285407 - DNA, 22 bp, Artificial Sequence
  chemically synthesized
tagggccagaatctaattaatc

SEQ ID NO: 1285408 - DNA, 22 bp, Artificial Sequence
  chemically synthesized
gacaactattaataataggatt

SEQ ID NO: 1285409 - DNA, 22 bp, Artificial Sequence
  chemically synthesized
attaatcctattattaatagtt

SEQ ID NO: 1285410 - DNA, 22 bp, Artificial Sequence
  chemically synthesized
atcctattattaatagttgtct

SEQ ID NO: 1285411 - DNA, 22 bp, Artificial Sequence
  chemically synthesized
ttattaatagttgtctaatttc

SEQ ID NO: 1285412 - DNA, 22 bp, Artificial Sequence
  chemically synthesized
ttaatagttgtctaatttctca

SEQ ID NO: 1285413 - DNA, 22 bp, Artificial Sequence
  chemically synthesized
aggaacagaatagtgagaaatt

SEQ ID NO: 1285414 - DNA, 22 bp, Artificial Sequence
  chemically synthesized
atagttgtctaatttctcacta

SEQ ID NO: 1285415 - DNA, 22 bp, Artificial Sequence
  chemically synthesized
ggctaaggaacagaatagtgag

SEQ ID NO: 1285416 - DNA, 22 bp, Artificial Sequence
  chemically synthesized
aggctaaggaacagaatagtga

SEQ ID NO: 1285417 - DNA, 22 bp, Artificial Sequence
  chemically synthesized
taggctaaggaacagaatagtg

SEQ ID NO: 1285418 - DNA, 22 bp, Artificial Sequence
  chemically synthesized
tctaatttctcactattctgtt

SEQ ID NO: 1285419 - DNA, 22 bp, Artificial Sequence
  chemically synthesized
atttctcactattctgttcctt

SEQ ID NO: 1285420 - DNA, 22 bp, Artificial Sequence
  chemically synthesized
tgaaacctttaggctaaggaac

SEQ ID NO: 1285421 - DNA, 22 bp, Artificial Sequence
  chemically synthesized
ctcactattctgttccttagcc

SEQ ID NO: 1285422 - DNA, 22 bp, Artificial Sequence
  chemically synthesized
tcactattctgttccttagcct

SEQ ID NO: 1285423 - DNA, 22 bp, Artificial Sequence
  chemically synthesized
actattctgttccttagcctaa

SEQ ID NO: 1285424 - DNA, 22 bp, Artificial Sequence
  chemically synthesized
ttctgttccttagcctaaaggt

SEQ ID NO: 1285425 - DNA, 22 bp, Artificial Sequence
  chemically synthesized
tgttccttagcctaaaggtttc

SEQ ID NO: 1285426 - DNA, 22 bp, Artificial Sequence
  chemically synthesized
atacagagttatgaaaccttta

SEQ ID NO: 1285427 - DNA, 22 bp, Artificial Sequence
  chemically synthesized
catacagagttatgaaaccttt

SEQ ID NO: 1285428 - DNA, 22 bp, Artificial Sequence
  chemically synthesized
ttccttagcctaaaggtttcat

SEQ ID NO: 1285429 - DNA, 22 bp, Artificial Sequence
  chemically synthesized
tcatacagagttatgaaacctt

SEQ ID NO: 1285430 - DNA, 22 bp, Artificial Sequence
  chemically synthesized
cttagcctaaaggtttcataac

SEQ ID NO: 1285431 - DNA, 22 bp, Artificial Sequence
  chemically synthesized
attttcatacagagttatgaaa

SEQ ID NO: 1285432 - DNA, 22 bp, Artificial Sequence
  chemically synthesized
agcctaaaggtttcataactct

SEQ ID NO: 1285433 - DNA, 22 bp, Artificial Sequence
  chemically synthesized
tcattttcatacagagttatga

SEQ ID NO: 1285434 - DNA, 22 bp, Artificial Sequence
  chemically synthesized
gcctaaaggtttcataactctg

SEQ ID NO: 1285435 - DNA, 22 bp, Artificial Sequence
  chemically synthesized
ctcattttcatacagagttatg

SEQ ID NO: 1285436 - DNA, 22 bp, Artificial Sequence
  chemically synthesized
tctcattttcatacagagttat

SEQ ID NO: 1285437 - DNA, 22 bp, Artificial Sequence
  chemically synthesized
aaggtttcataactctgtatga

SEQ ID NO: 1285438 - DNA, 22 bp, Artificial Sequence
  chemically synthesized
cataactctgtatgaaaatgag

SEQ ID NO: 1285439 - DNA, 22 bp, Artificial Sequence
  chemically synthesized
ataactctgtatgaaaatgaga

SEQ ID NO: 1285440 - DNA, 22 bp, Artificial Sequence
  chemically synthesized
atcaatgacaggttttctcatt

SEQ ID NO: 1285441 - DNA, 22 bp, Artificial Sequence
  chemically synthesized
tgtatgaaaatgagaaaacctg

SEQ ID NO: 1285442 - DNA, 22 bp, Artificial Sequence
  chemically synthesized
tatgaaaatgagaaaacctgtc

SEQ ID NO: 1285443 - DNA, 22 bp, Artificial Sequence
  chemically synthesized
atacaaaaacaaacatatatta

SEQ ID NO: 1285444 - DNA, 22 bp, Artificial Sequence
  chemically synthesized
tcattgattaatatatgtttgt

SEQ ID NO: 1285445 - DNA, 22 bp, Artificial Sequence
  chemically synthesized
cacaattaatacaaaaacaaac

SEQ ID NO: 1285446 - DNA, 22 bp, Artificial Sequence
  chemically synthesized
attaatatatgtttgtttttgt

SEQ ID NO: 1285447 - DNA, 22 bp, Artificial Sequence
  chemically synthesized
atatatgtttgtttttgtatta

SEQ ID NO: 1285448 - DNA, 22 bp, Artificial Sequence
  chemically synthesized
cagttgcacaattaatacaaaa

SEQ ID NO: 1285449 - DNA, 22 bp, Artificial Sequence
  chemically synthesized
gtttttgtattaattgtgcaac

SEQ ID NO: 1285450 - DNA, 22 bp, Artificial Sequence
  chemically synthesized
tttttgtattaattgtgcaact

SEQ ID NO: 1285451 - DNA, 22 bp, Artificial Sequence
  chemically synthesized
ttgtattaattgtgcaactgca

SEQ ID NO: 1285452 - DNA, 22 bp, Artificial Sequence
  chemically synthesized
tgtattaattgtgcaactgcaa

SEQ ID NO: 1285453 - DNA, 22 bp, Artificial Sequence
  chemically synthesized
tgtgcagtaacattgcagttgc

SEQ ID NO: 1285454 - DNA, 22 bp, Artificial Sequence
  chemically synthesized
gtattaattgtgcaactgcaat

SEQ ID NO: 1285455 - DNA, 22 bp, Artificial Sequence
  chemically synthesized
tattaattgtgcaactgcaatg

SEQ ID NO: 1285456 - DNA, 22 bp, Artificial Sequence
  chemically synthesized
tatgtgcagtaacattgcagtt

SEQ ID NO: 1285457 - DNA, 22 bp, Artificial Sequence
  chemically synthesized
ctatgtgcagtaacattgcagt

SEQ ID NO: 1285458 - DNA, 22 bp, Artificial Sequence
  chemically synthesized
attgtgcaactgcaatgttact

SEQ ID NO: 1285459 - DNA, 22 bp, Artificial Sequence
  chemically synthesized
catttctatgtgcagtaacatt

SEQ ID NO: 1285460 - DNA, 22 bp, Artificial Sequence
  chemically synthesized
tgcaactgcaatgttactgcac

SEQ ID NO: 1285461 - DNA, 22 bp, Artificial Sequence
  chemically synthesized
caatgttactgcacatagaaat

SEQ ID NO: 1285462 - DNA, 22 bp, Artificial Sequence
  chemically synthesized
aatcaaggagttacatttctat

SEQ ID NO: 1285463 - DNA, 22 bp, Artificial Sequence
  chemically synthesized
ctcaatcaaggagttacatttc

SEQ ID NO: 1285464 - DNA, 22 bp, Artificial Sequence
  chemically synthesized
ctgcacatagaaatgtaactcc

SEQ ID NO: 1285465 - DNA, 22 bp, Artificial Sequence
  chemically synthesized
cacatagaaatgtaactccttg

SEQ ID NO: 1285466 - DNA, 22 bp, Artificial Sequence
  chemically synthesized
catgtgtggcaatgtgctcctc

SEQ ID NO: 1285467 - DNA, 22 bp, Artificial Sequence
  chemically synthesized
cttgattgaggagcacattgcc

SEQ ID NO: 1285468 - DNA, 22 bp, Artificial Sequence
  chemically synthesized
gagattccatgtgtggcaatgt

SEQ ID NO: 1285469 - DNA, 22 bp, Artificial Sequence
  chemically synthesized
gattgaggagcacattgccaca

SEQ ID NO: 1285470 - DNA, 22 bp, Artificial Sequence
  chemically synthesized
ggagattccatgtgtggcaatg

SEQ ID NO: 1285471 - DNA, 22 bp, Artificial Sequence
  chemically synthesized
attgaggagcacattgccacac

SEQ ID NO: 1285472 - DNA, 22 bp, Artificial Sequence
  chemically synthesized
tggagattccatgtgtggcaat

SEQ ID NO: 1285473 - DNA, 22 bp, Artificial Sequence
  chemically synthesized
aggagcacattgccacacatgg

SEQ ID NO: 1285474 - DNA, 22 bp, Artificial Sequence
  chemically synthesized
gcattttggagattccatgtgt

SEQ ID NO: 1285475 - DNA, 22 bp, Artificial Sequence
  chemically synthesized
ggcattttggagattccatgtg

SEQ ID NO: 1285476 - DNA, 22 bp, Artificial Sequence
  chemically synthesized
acttggcattttggagattcca

SEQ ID NO: 1285477 - DNA, 22 bp, Artificial Sequence
  chemically synthesized
cacttggcattttggagattcc

SEQ ID NO: 1285478 - DNA, 22 bp, Artificial Sequence
  chemically synthesized
tcacttggcattttggagattc

SEQ ID NO: 1285479 - DNA, 22 bp, Artificial Sequence
  chemically synthesized
ccacacatggaatctccaaaat

SEQ ID NO: 1285480 - DNA, 22 bp, Artificial Sequence
  chemically synthesized
agagtggtgattttcacttggc

SEQ ID NO: 1285481 - DNA, 22 bp, Artificial Sequence
  chemically synthesized
aagagtggtgattttcacttgg

SEQ ID NO: 1285482 - DNA, 22 bp, Artificial Sequence
  chemically synthesized
ttaagagtggtgattttcactt

SEQ ID NO: 1285483 - DNA, 22 bp, Artificial Sequence
  chemically synthesized
caaaatgccaagtgaaaatcac

SEQ ID NO: 1285484 - DNA, 22 bp, Artificial Sequence
  chemically synthesized
aaataaactcttaagagtggtg

SEQ ID NO: 1285485 - DNA, 22 bp, Artificial Sequence
  chemically synthesized
tgaaataaactcttaagagtgg

SEQ ID NO: 1285486 - DNA, 22 bp, Artificial Sequence
  chemically synthesized
gtcaacactctgaaataaactc

SEQ ID NO: 1285487 - DNA, 22 bp, Artificial Sequence
  chemically synthesized
agtcaacactctgaaataaact

SEQ ID NO: 1285488 - DNA, 22 bp, Artificial Sequence
  chemically synthesized
ttaagagtttatttcagagtgt

SEQ ID NO: 1285489 - DNA, 22 bp, Artificial Sequence
  chemically synthesized
aagagtttatttcagagtgttg

SEQ ID NO: 1285490 - DNA, 22 bp, Artificial Sequence
  chemically synthesized
agagtttatttcagagtgttga

SEQ ID NO: 1285491 - DNA, 22 bp, Artificial Sequence
  chemically synthesized
atttcagagtgttgactaaatt

SEQ ID NO: 1285492 - DNA, 22 bp, Artificial Sequence
  chemically synthesized
tttcagagtgttgactaaattg

SEQ ID NO: 1285493 - DNA, 22 bp, Artificial Sequence
  chemically synthesized
cagagtgttgactaaattgttt

SEQ ID NO: 1285494 - DNA, 22 bp, Artificial Sequence
  chemically synthesized
agagtgttgactaaattgtttg

SEQ ID NO: 1285495 - DNA, 22 bp, Artificial Sequence
  chemically synthesized
taggcaaagaagtccccaaaca

SEQ ID NO: 1285496 - DNA, 22 bp, Artificial Sequence
  chemically synthesized
actaaattgtttggggacttct

SEQ ID NO: 1285497 - DNA, 22 bp, Artificial Sequence
  chemically synthesized
tgttataggcaaagaagtcccc

SEQ ID NO: 1285498 - DNA, 22 bp, Artificial Sequence
  chemically synthesized
atgttataggcaaagaagtccc

SEQ ID NO: 1285499 - DNA, 22 bp, Artificial Sequence
  chemically synthesized
aattgtttggggacttctttgc

SEQ ID NO: 1285500 - DNA, 22 bp, Artificial Sequence
  chemically synthesized
agtttatgttataggcaaagaa

SEQ ID NO: 1285501 - DNA, 22 bp, Artificial Sequence
  chemically synthesized
aagtttatgttataggcaaaga

SEQ ID NO: 1285502 - DNA, 22 bp, Artificial Sequence
  chemically synthesized
tttggggacttctttgcctata

SEQ ID NO: 1285503 - DNA, 22 bp, Artificial Sequence
  chemically synthesized
ttaagtttatgttataggcaaa

SEQ ID NO: 1285504 - DNA, 22 bp, Artificial Sequence
  chemically synthesized
ggggacttctttgcctataaca

SEQ ID NO: 1285505 - DNA, 22 bp, Artificial Sequence
  chemically synthesized
gggacttctttgcctataacat

SEQ ID NO: 1285506 - DNA, 22 bp, Artificial Sequence
  chemically synthesized
aaaaactcttaagtttatgtta

SEQ ID NO: 1285507 - DNA, 22 bp, Artificial Sequence
  chemically synthesized
ctttgcctataacataaactta

SEQ ID NO: 1285508 - DNA, 22 bp, Artificial Sequence
  chemically synthesized
tttgcctataacataaacttaa

SEQ ID NO: 1285509 - DNA, 22 bp, Artificial Sequence
  chemically synthesized
tgcctataacataaacttaaga

SEQ ID NO: 1285510 - DNA, 22 bp, Artificial Sequence
  chemically synthesized
gcctataacataaacttaagag

SEQ ID NO: 1285511 - DNA, 22 bp, Artificial Sequence
  chemically synthesized
cctataacataaacttaagagt

SEQ ID NO: 1285512 - DNA, 22 bp, Artificial Sequence
  chemically synthesized
taacataaacttaagagttttt

SEQ ID NO: 1285513 - DNA, 22 bp, Artificial Sequence
  chemically synthesized
aaaggaaaacaagtacctcaaa

SEQ ID NO: 1285514 - DNA, 22 bp, Artificial Sequence
  chemically synthesized
attaaaaggaaaacaagtacct

SEQ ID NO: 1285515 - DNA, 22 bp, Artificial Sequence
  chemically synthesized
aagagtttttgaggtacttgtt

SEQ ID NO: 1285516 - DNA, 22 bp, Artificial Sequence
  chemically synthesized
gattaaaaggaaaacaagtacc

SEQ ID NO: 1285517 - DNA, 22 bp, Artificial Sequence
  chemically synthesized
agagtttttgaggtacttgttt

SEQ ID NO: 1285518 - DNA, 22 bp, Artificial Sequence
  chemically synthesized
agtatttgattaaaaggaaaac

SEQ ID NO: 1285519 - DNA, 22 bp, Artificial Sequence
  chemically synthesized
ttgaggtacttgttttcctttt

SEQ ID NO: 1285520 - DNA, 22 bp, Artificial Sequence
  chemically synthesized
tgaggtacttgttttcctttta

SEQ ID NO: 1285521 - DNA, 22 bp, Artificial Sequence
  chemically synthesized
gaggtacttgttttccttttaa

SEQ ID NO: 1285522 - DNA, 22 bp, Artificial Sequence
  chemically synthesized
aggtacttgttttccttttaat

SEQ ID NO: 1285523 - DNA, 22 bp, Artificial Sequence
  chemically synthesized
cctaagtatttgattaaaagga

SEQ ID NO: 1285524 - DNA, 22 bp, Artificial Sequence
  chemically synthesized
taattccctaagtatttgatta

SEQ ID NO: 1285525 - DNA, 22 bp, Artificial Sequence
  chemically synthesized
ataattccctaagtatttgatt

SEQ ID NO: 1285526 - DNA, 22 bp, Artificial Sequence
  chemically synthesized
gttttccttttaatcaaatact

SEQ ID NO: 1285527 - DNA, 22 bp, Artificial Sequence
  chemically synthesized
ttttccttttaatcaaatactt

SEQ ID NO: 1285528 - DNA, 22 bp, Artificial Sequence
  chemically synthesized
tccttttaatcaaatacttagg

SEQ ID NO: 1285529 - DNA, 22 bp, Artificial Sequence
  chemically synthesized
ccttttaatcaaatacttaggg

SEQ ID NO: 1285530 - DNA, 22 bp, Artificial Sequence
  chemically synthesized
cttttaatcaaatacttaggga

SEQ ID NO: 1285531 - DNA, 22 bp, Artificial Sequence
  chemically synthesized
ttaatcaaatacttagggaatt

SEQ ID NO: 1285532 - DNA, 22 bp, Artificial Sequence
  chemically synthesized
taatcaaatacttagggaatta

SEQ ID NO: 1285533 - DNA, 22 bp, Artificial Sequence
  chemically synthesized
agaagacacttataattcccta

SEQ ID NO: 1285534 - DNA, 22 bp, Artificial Sequence
  chemically synthesized
aatcaaatacttagggaattat

SEQ ID NO: 1285535 - DNA, 22 bp, Artificial Sequence
  chemically synthesized
atcaaatacttagggaattata

SEQ ID NO: 1285536 - DNA, 22 bp, Artificial Sequence
  chemically synthesized
taagaagacacttataattccc

SEQ ID NO: 1285537 - DNA, 22 bp, Artificial Sequence
  chemically synthesized
agggaattataagtgtcttctt

SEQ ID NO: 1285538 - DNA, 22 bp, Artificial Sequence
  chemically synthesized
gggaattataagtgtcttctta

SEQ ID NO: 1285539 - DNA, 22 bp, Artificial Sequence
  chemically synthesized
ggcatgaaagcatggtctctaa

SEQ ID NO: 1285540 - DNA, 22 bp, Artificial Sequence
  chemically synthesized
taagtgtcttcttagagaccat

SEQ ID NO: 1285541 - DNA, 22 bp, Artificial Sequence
  chemically synthesized
tagctaggcatgaaagcatggt

SEQ ID NO: 1285542 - DNA, 22 bp, Artificial Sequence
  chemically synthesized
cttagagaccatgctttcatgc

SEQ ID NO: 1285543 - DNA, 22 bp, Artificial Sequence
  chemically synthesized
ttagagaccatgctttcatgcc

SEQ ID NO: 1285544 - DNA, 22 bp, Artificial Sequence
  chemically synthesized
agagaccatgctttcatgccta

SEQ ID NO: 1285545 - DNA, 22 bp, Artificial Sequence
  chemically synthesized
gtcaactgtagctaggcatgaa

SEQ ID NO: 1285546 - DNA, 22 bp, Artificial Sequence
  chemically synthesized
gagaccatgctttcatgcctag

SEQ ID NO: 1285547 - DNA, 22 bp, Artificial Sequence
  chemically synthesized
aaagagttggtcaactgtagct

SEQ ID NO: 1285548 - DNA, 22 bp, Artificial Sequence
  chemically synthesized
aaaagagttggtcaactgtagc

SEQ ID NO: 1285549 - DNA, 22 bp, Artificial Sequence
  chemically synthesized
taaaagagttggtcaactgtag

SEQ ID NO: 1285550 - DNA, 22 bp, Artificial Sequence
  chemically synthesized
ttaaaagagttggtcaactgta

SEQ ID NO: 1285551 - DNA, 22 bp, Artificial Sequence
  chemically synthesized
tcatgcctagctacagttgacc

SEQ ID NO: 1285552 - DNA, 22 bp, Artificial Sequence
  chemically synthesized
tttaaaagagttggtcaactgt

SEQ ID NO: 1285553 - DNA, 22 bp, Artificial Sequence
  chemically synthesized
catgcctagctacagttgacca

SEQ ID NO: 1285554 - DNA, 22 bp, Artificial Sequence
  chemically synthesized
atgcctagctacagttgaccaa

SEQ ID NO: 1285555 - DNA, 22 bp, Artificial Sequence
  chemically synthesized
gctacagttgaccaactctttt

SEQ ID NO: 1285556 - DNA, 22 bp, Artificial Sequence
  chemically synthesized
cagttgaccaactcttttaaaa

SEQ ID NO: 1285557 - DNA, 22 bp, Artificial Sequence
  chemically synthesized
aggagacaaagctttttaaaag

SEQ ID NO: 1285558 - DNA, 22 bp, Artificial Sequence
  chemically synthesized
caggagacaaagctttttaaaa

SEQ ID NO: 1285559 - DNA, 22 bp, Artificial Sequence
  chemically synthesized
tttcaggagacaaagcttttta

SEQ ID NO: 1285560 - DNA, 22 bp, Artificial Sequence
  chemically synthesized
accaactcttttaaaaagcttt

SEQ ID NO: 1285561 - DNA, 22 bp, Artificial Sequence
  chemically synthesized
ttatttcaggagacaaagcttt

SEQ ID NO: 1285562 - DNA, 22 bp, Artificial Sequence
  chemically synthesized
ttattatttcaggagacaaagc

SEQ ID NO: 1285563 - DNA, 22 bp, Artificial Sequence
  chemically synthesized
ttttaaaaagctttgtctcctg

SEQ ID NO: 1285564 - DNA, 22 bp, Artificial Sequence
  chemically synthesized
ctattattatttcaggagacaa

SEQ ID NO: 1285565 - DNA, 22 bp, Artificial Sequence
  chemically synthesized
ttaaaaagctttgtctcctgaa

SEQ ID NO: 1285566 - DNA, 22 bp, Artificial Sequence
  chemically synthesized
taaaaagctttgtctcctgaaa

SEQ ID NO: 1285567 - DNA, 22 bp, Artificial Sequence
  chemically synthesized
ttcctattattatttcaggaga

SEQ ID NO: 1285568 - DNA, 22 bp, Artificial Sequence
  chemically synthesized
aaaaagctttgtctcctgaaat

SEQ ID NO: 1285569 - DNA, 22 bp, Artificial Sequence
  chemically synthesized
gttcctattattatttcaggag

SEQ ID NO: 1285570 - DNA, 22 bp, Artificial Sequence
  chemically synthesized
aaaagctttgtctcctgaaata

SEQ ID NO: 1285571 - DNA, 22 bp, Artificial Sequence
  chemically synthesized
agtttgttcctattattatttc

SEQ ID NO: 1285572 - DNA, 22 bp, Artificial Sequence
  chemically synthesized
tgtctcctgaaataataatagg

SEQ ID NO: 1285573 - DNA, 22 bp, Artificial Sequence
  chemically synthesized
gtctcctgaaataataatagga

SEQ ID NO: 1285574 - DNA, 22 bp, Artificial Sequence
  chemically synthesized
tctcctgaaataataataggaa

SEQ ID NO: 1285575 - DNA, 22 bp, Artificial Sequence
  chemically synthesized
gaaatgttgagtttgttcctat

SEQ ID NO: 1285576 - DNA, 22 bp, Artificial Sequence
  chemically synthesized
ctgaaataataataggaacaaa

SEQ ID NO: 1285577 - DNA, 22 bp, Artificial Sequence
  chemically synthesized
agaaatgttgagtttgttccta

SEQ ID NO: 1285578 - DNA, 22 bp, Artificial Sequence
  chemically synthesized
ttagaaatgttgagtttgttcc

SEQ ID NO: 1285579 - DNA, 22 bp, Artificial Sequence
  chemically synthesized
aaataataataggaacaaactc

SEQ ID NO: 1285580 - DNA, 22 bp, Artificial Sequence
  chemically synthesized
tcttagaaatgttgagtttgtt

SEQ ID NO: 1285581 - DNA, 22 bp, Artificial Sequence
  chemically synthesized
ctcttagaaatgttgagtttgt

SEQ ID NO: 1285582 - DNA, 22 bp, Artificial Sequence
  chemically synthesized
ttctcttagaaatgttgagttt

SEQ ID NO: 1285583 - DNA, 22 bp, Artificial Sequence
  chemically synthesized
cttctcttagaaatgttgagtt

SEQ ID NO: 1285584 - DNA, 22 bp, Artificial Sequence
  chemically synthesized
ataacggtgtcttcttctctta

SEQ ID NO: 1285585 - DNA, 22 bp, Artificial Sequence
  chemically synthesized
aacatttctaagagaagaagac

SEQ ID NO: 1285586 - DNA, 22 bp, Artificial Sequence
  chemically synthesized
agttgataacggtgtcttcttc

SEQ ID NO: 1285587 - DNA, 22 bp, Artificial Sequence
  chemically synthesized
cactcagttgataacggtgtct

SEQ ID NO: 1285588 - DNA, 22 bp, Artificial Sequence
  chemically synthesized
ctaagagaagaagacaccgtta

SEQ ID NO: 1285589 - DNA, 22 bp, Artificial Sequence
  chemically synthesized
taagagaagaagacaccgttat

SEQ ID NO: 1285590 - DNA, 22 bp, Artificial Sequence
  chemically synthesized
agagaagaagacaccgttatca

SEQ ID NO: 1285591 - DNA, 22 bp, Artificial Sequence
  chemically synthesized
cactgcactcagttgataacgg

SEQ ID NO: 1285592 - DNA, 22 bp, Artificial Sequence
  chemically synthesized
atgaattacactgcactcagtt

SEQ ID NO: 1285593 - DNA, 22 bp, Artificial Sequence
  chemically synthesized
tcaactgagtgcagtgtaattc

SEQ ID NO: 1285594 - DNA, 22 bp, Artificial Sequence
  chemically synthesized
tcaatgactgatgaattacact

SEQ ID NO: 1285595 - DNA, 22 bp, Artificial Sequence
  chemically synthesized
atcaatgactgatgaattacac

SEQ ID NO: 1285596 - DNA, 22 bp, Artificial Sequence
  chemically synthesized
tatcaatgactgatgaattaca

SEQ ID NO: 1285597 - DNA, 22 bp, Artificial Sequence
  chemically synthesized
agtgcagtgtaattcatcagtc

SEQ ID NO: 1285598 - DNA, 22 bp, Artificial Sequence
  chemically synthesized
gaatatgattttatcaatgact

SEQ ID NO: 1285599 - DNA, 22 bp, Artificial Sequence
  chemically synthesized
atctagaatatgattttatcaa

SEQ ID NO: 1285600 - DNA, 22 bp, Artificial Sequence
  chemically synthesized
atcagtcattgataaaatcata

SEQ ID NO: 1285601 - DNA, 22 bp, Artificial Sequence
  chemically synthesized
gattaatctagaatatgatttt

SEQ ID NO: 1285602 - DNA, 22 bp, Artificial Sequence
  chemically synthesized
ataaaatcatattctagattaa

SEQ ID NO: 1285603 - DNA, 22 bp, Artificial Sequence
  chemically synthesized
aatgaatcctggattaatctag

SEQ ID NO: 1285604 - DNA, 22 bp, Artificial Sequence
  chemically synthesized
tagattaatccaggattcattc

SEQ ID NO: 1285605 - DNA, 22 bp, Artificial Sequence
  chemically synthesized
gtagaaataattgaatgaatcc

SEQ ID NO: 1285606 - DNA, 22 bp, Artificial Sequence
  chemically synthesized
ggtagaaataattgaatgaatc

SEQ ID NO: 1285607 - DNA, 22 bp, Artificial Sequence
  chemically synthesized
gattaatccaggattcattcaa

SEQ ID NO: 1285608 - DNA, 22 bp, Artificial Sequence
  chemically synthesized
atccaggattcattcaattatt

SEQ ID NO: 1285609 - DNA, 22 bp, Artificial Sequence
  chemically synthesized
aagggaaagagatttggtagaa

SEQ ID NO: 1285610 - DNA, 22 bp, Artificial Sequence
  chemically synthesized
gaagggaaagagatttggtaga

SEQ ID NO: 1285611 - DNA, 22 bp, Artificial Sequence
  chemically synthesized
attcaattatttctaccaaatc

SEQ ID NO: 1285612 - DNA, 22 bp, Artificial Sequence
  chemically synthesized
ttgaagggaaagagatttggta

SEQ ID NO: 1285613 - DNA, 22 bp, Artificial Sequence
  chemically synthesized
tcttgaagggaaagagatttgg

SEQ ID NO: 1285614 - DNA, 22 bp, Artificial Sequence
  chemically synthesized
aattatttctaccaaatctctt

SEQ ID NO: 1285615 - DNA, 22 bp, Artificial Sequence
  chemically synthesized
cctctcttgaagggaaagagat

SEQ ID NO: 1285616 - DNA, 22 bp, Artificial Sequence
  chemically synthesized
tttctaccaaatctctttccct

SEQ ID NO: 1285617 - DNA, 22 bp, Artificial Sequence
  chemically synthesized
ctaccaaatctctttcccttca

SEQ ID NO: 1285618 - DNA, 22 bp, Artificial Sequence
  chemically synthesized
cactccctctcttgaagggaaa

SEQ ID NO: 1285619 - DNA, 22 bp, Artificial Sequence
  chemically synthesized
taccaaatctctttcccttcaa

SEQ ID NO: 1285620 - DNA, 22 bp, Artificial Sequence
  chemically synthesized
ccaaatctctttcccttcaaga

SEQ ID NO: 1285621 - DNA, 22 bp, Artificial Sequence
  chemically synthesized
actccactccctctcttgaagg

SEQ ID NO: 1285622 - DNA, 22 bp, Artificial Sequence
  chemically synthesized
tttcccttcaagagagggagtg

SEQ ID NO: 1285623 - DNA, 22 bp, Artificial Sequence
  chemically synthesized
tcccttcaagagagggagtgga

SEQ ID NO: 1285624 - DNA, 22 bp, Artificial Sequence
  chemically synthesized
cccttcaagagagggagtggag

SEQ ID NO: 1285625 - DNA, 22 bp, Artificial Sequence
  chemically synthesized
gatgacaactaactccactccc

SEQ ID NO: 1285626 - DNA, 22 bp, Artificial Sequence
  chemically synthesized
ccttcaagagagggagtggagt

SEQ ID NO: 1285627 - DNA, 22 bp, Artificial Sequence
  chemically synthesized
ggatgacaactaactccactcc

SEQ ID NO: 1285628 - DNA, 22 bp, Artificial Sequence
  chemically synthesized
tggatgacaactaactccactc

SEQ ID NO: 1285629 - DNA, 22 bp, Artificial Sequence
  chemically synthesized
caagagagggagtggagttagt

SEQ ID NO: 1285630 - DNA, 22 bp, Artificial Sequence
  chemically synthesized
aagagagggagtggagttagtt

SEQ ID NO: 1285631 - DNA, 22 bp, Artificial Sequence
  chemically synthesized
gcattttggatgacaactaact

SEQ ID NO: 1285632 - DNA, 22 bp, Artificial Sequence
  chemically synthesized
gattagcattttggatgacaac

SEQ ID NO: 1285633 - DNA, 22 bp, Artificial Sequence
  chemically synthesized
ggattagcattttggatgacaa

SEQ ID NO: 1285634 - DNA, 22 bp, Artificial Sequence
  chemically synthesized
tggattagcattttggatgaca

SEQ ID NO: 1285635 - DNA, 22 bp, Artificial Sequence
  chemically synthesized
ttttggattagcattttggatg

SEQ ID NO: 1285636 - DNA, 22 bp, Artificial Sequence
  chemically synthesized
ttattttggattagcattttgg

SEQ ID NO: 1285637 - DNA, 22 bp, Artificial Sequence
  chemically synthesized
attattttggattagcattttg

SEQ ID NO: 1285638 - DNA, 22 bp, Artificial Sequence
  chemically synthesized
gttgtcatccaaaatgctaatc

SEQ ID NO: 1285639 - DNA, 22 bp, Artificial Sequence
  chemically synthesized
tcatccaaaatgctaatccaaa

SEQ ID NO: 1285640 - DNA, 22 bp, Artificial Sequence
  chemically synthesized
aatggcccttattattttggat

SEQ ID NO: 1285641 - DNA, 22 bp, Artificial Sequence
  chemically synthesized
aaatggcccttattattttgga

SEQ ID NO: 1285642 - DNA, 22 bp, Artificial Sequence
  chemically synthesized
ttaaatggcccttattattttg

SEQ ID NO: 1285643 - DNA, 22 bp, Artificial Sequence
  chemically synthesized
tcttaaatggcccttattattt

SEQ ID NO: 1285644 - DNA, 22 bp, Artificial Sequence
  chemically synthesized
ctcttaaatggcccttattatt

SEQ ID NO: 1285645 - DNA, 22 bp, Artificial Sequence
  chemically synthesized
atccaaaataataagggccatt

SEQ ID NO: 1285646 - DNA, 22 bp, Artificial Sequence
  chemically synthesized
aataacttctcttaaatggccc

SEQ ID NO: 1285647 - DNA, 22 bp, Artificial Sequence
  chemically synthesized
aagcaactcaataacttctctt

SEQ ID NO: 1285648 - DNA, 22 bp, Artificial Sequence
  chemically synthesized
taaagcaactcaataacttctc

SEQ ID NO: 1285649 - DNA, 22 bp, Artificial Sequence
  chemically synthesized
caagttctaaagcaactcaata

SEQ ID NO: 1285650 - DNA, 22 bp, Artificial Sequence
  chemically synthesized
aagagaagttattgagttgctt

SEQ ID NO: 1285651 - DNA, 22 bp, Artificial Sequence
  chemically synthesized
agagaagttattgagttgcttt

SEQ ID NO: 1285652 - DNA, 22 bp, Artificial Sequence
  chemically synthesized
ttgagttgctttagaacttgta

SEQ ID NO: 1285653 - DNA, 22 bp, Artificial Sequence
  chemically synthesized
agttgctttagaacttgtagat

SEQ ID NO: 1285654 - DNA, 22 bp, Artificial Sequence
  chemically synthesized
ctttagaacttgtagattctat

SEQ ID NO: 1285655 - DNA, 22 bp, Artificial Sequence
  chemically synthesized
tagaacttgtagattctatgct

SEQ ID NO: 1285656 - DNA, 22 bp, Artificial Sequence
  chemically synthesized
cagtgacagcatagcatagaat

SEQ ID NO: 1285657 - DNA, 22 bp, Artificial Sequence
  chemically synthesized
agaacttgtagattctatgcta

SEQ ID NO: 1285658 - DNA, 22 bp, Artificial Sequence
  chemically synthesized
acagtgacagcatagcatagaa

SEQ ID NO: 1285659 - DNA, 22 bp, Artificial Sequence
  chemically synthesized
gaacttgtagattctatgctat

SEQ ID NO: 1285660 - DNA, 22 bp, Artificial Sequence
  chemically synthesized
cttacagtgacagcatagcata

SEQ ID NO: 1285661 - DNA, 22 bp, Artificial Sequence
  chemically synthesized
gtagattctatgctatgctgtc

SEQ ID NO: 1285662 - DNA, 22 bp, Artificial Sequence
  chemically synthesized
tagattctatgctatgctgtca

SEQ ID NO: 1285663 - DNA, 22 bp, Artificial Sequence
  chemically synthesized
aaataatgctacttacagtgac

SEQ ID NO: 1285664 - DNA, 22 bp, Artificial Sequence
  chemically synthesized
tatgctatgctgtcactgtaag

SEQ ID NO: 1285665 - DNA, 22 bp, Artificial Sequence
  chemically synthesized
taaaataatgctacttacagtg

SEQ ID NO: 1285666 - DNA, 22 bp, Artificial Sequence
  chemically synthesized
tgctatgctgtcactgtaagta

SEQ ID NO: 1285667 - DNA, 22 bp, Artificial Sequence
  chemically synthesized
ctaaaataatgctacttacagt

SEQ ID NO: 1285668 - DNA, 22 bp, Artificial Sequence
  chemically synthesized
tctaaaataatgctacttacag

SEQ ID NO: 1285669 - DNA, 22 bp, Artificial Sequence
  chemically synthesized
ttttctaaaataatgctactta

SEQ ID NO: 1285670 - DNA, 22 bp, Artificial Sequence
  chemically synthesized
tgctgtcactgtaagtagcatt

SEQ ID NO: 1285671 - DNA, 22 bp, Artificial Sequence
  chemically synthesized
attttctaaaataatgctactt

SEQ ID NO: 1285672 - DNA, 22 bp, Artificial Sequence
  chemically synthesized
tcactgtaagtagcattatttt

SEQ ID NO: 1285673 - DNA, 22 bp, Artificial Sequence
  chemically synthesized
ggggtttattttctaaaataat

SEQ ID NO: 1285674 - DNA, 22 bp, Artificial Sequence
  chemically synthesized
aggggtttattttctaaaataa

SEQ ID NO: 1285675 - DNA, 22 bp, Artificial Sequence
  chemically synthesized
taagtagcattattttagaaaa

SEQ ID NO: 1285676 - DNA, 22 bp, Artificial Sequence
  chemically synthesized
aggtttaggggtttattttcta

SEQ ID NO: 1285677 - DNA, 22 bp, Artificial Sequence
  chemically synthesized
aattaaggtttaggggtttatt

SEQ ID NO: 1285678 - DNA, 22 bp, Artificial Sequence
  chemically synthesized
ttttagaaaataaacccctaaa

SEQ ID NO: 1285679 - DNA, 22 bp, Artificial Sequence
  chemically synthesized
atgttaaattaaggtttagggg

SEQ ID NO: 1285680 - DNA, 22 bp, Artificial Sequence
  chemically synthesized
tagaaaataaacccctaaacct

SEQ ID NO: 1285681 - DNA, 22 bp, Artificial Sequence
  chemically synthesized
catgttaaattaaggtttaggg

SEQ ID NO: 1285682 - DNA, 22 bp, Artificial Sequence
  chemically synthesized
agaaaataaacccctaaacctt

SEQ ID NO: 1285683 - DNA, 22 bp, Artificial Sequence
  chemically synthesized
gaaaataaacccctaaacctta

SEQ ID NO: 1285684 - DNA, 22 bp, Artificial Sequence
  chemically synthesized
tgaaccatttcatgttaaatta

SEQ ID NO: 1285685 - DNA, 22 bp, Artificial Sequence
  chemically synthesized
tagttatgaaccatttcatgtt

SEQ ID NO: 1285686 - DNA, 22 bp, Artificial Sequence
  chemically synthesized
aaccttaatttaacatgaaatg

SEQ ID NO: 1285687 - DNA, 22 bp, Artificial Sequence
  chemically synthesized
aatttaacatgaaatggttcat

SEQ ID NO: 1285688 - DNA, 22 bp, Artificial Sequence
  chemically synthesized
atttaacatgaaatggttcata

SEQ ID NO: 1285689 - DNA, 22 bp, Artificial Sequence
  chemically synthesized
aggtggttgtagttatgaacca

SEQ ID NO: 1285690 - DNA, 22 bp, Artificial Sequence
  chemically synthesized
aacatgaaatggttcataacta

SEQ ID NO: 1285691 - DNA, 22 bp, Artificial Sequence
  chemically synthesized
acatgaaatggttcataactac

SEQ ID NO: 1285692 - DNA, 22 bp, Artificial Sequence
  chemically synthesized
atcacagttcaggtggttgtag

SEQ ID NO: 1285693 - DNA, 22 bp, Artificial Sequence
  chemically synthesized
gatcacagttcaggtggttgta

SEQ ID NO: 1285694 - DNA, 22 bp, Artificial Sequence
  chemically synthesized
ataactacaaccacctgaactg

SEQ ID NO: 1285695 - DNA, 22 bp, Artificial Sequence
  chemically synthesized
agtgacatgatttgatcacagt

SEQ ID NO: 1285696 - DNA, 22 bp, Artificial Sequence
  chemically synthesized
caaccacctgaactgtgatcaa

SEQ ID NO: 1285697 - DNA, 22 bp, Artificial Sequence
  chemically synthesized
catggatctaagtgacatgatt

SEQ ID NO: 1285698 - DNA, 22 bp, Artificial Sequence
  chemically synthesized
aactgtgatcaaatcatgtcac

SEQ ID NO: 1285699 - DNA, 22 bp, Artificial Sequence
  chemically synthesized
acatggatctaagtgacatgat

SEQ ID NO: 1285700 - DNA, 22 bp, Artificial Sequence
  chemically synthesized
tacatggatctaagtgacatga

SEQ ID NO: 1285701 - DNA, 22 bp, Artificial Sequence
  chemically synthesized
ctttacatggatctaagtgaca

SEQ ID NO: 1285702 - DNA, 22 bp, Artificial Sequence
  chemically synthesized
tgatcaaatcatgtcacttaga

SEQ ID NO: 1285703 - DNA, 22 bp, Artificial Sequence
  chemically synthesized
agatccatgtaaagcagtactt

SEQ ID NO: 1285704 - DNA, 22 bp, Artificial Sequence
  chemically synthesized
gatccatgtaaagcagtactta

SEQ ID NO: 1285705 - DNA, 22 bp, Artificial Sequence
  chemically synthesized
caggtgagaggggtgtagtaag

SEQ ID NO: 1285706 - DNA, 22 bp, Artificial Sequence
  chemically synthesized
tccaggtgagaggggtgtagta

SEQ ID NO: 1285707 - DNA, 22 bp, Artificial Sequence
  chemically synthesized
agtaaactctccaggtgagagg

SEQ ID NO: 1285708 - DNA, 22 bp, Artificial Sequence
  chemically synthesized
cagtaaactctccaggtgagag

SEQ ID NO: 1285709 - DNA, 22 bp, Artificial Sequence
  chemically synthesized
tcagtaaactctccaggtgaga

SEQ ID NO: 1285710 - DNA, 22 bp, Artificial Sequence
  chemically synthesized
actacacccctctcacctggag

SEQ ID NO: 1285711 - DNA, 22 bp, Artificial Sequence
  chemically synthesized
ctacacccctctcacctggaga

SEQ ID NO: 1285712 - DNA, 22 bp, Artificial Sequence
  chemically synthesized
cacccctctcacctggagagtt

SEQ ID NO: 1285713 - DNA, 22 bp, Artificial Sequence
  chemically synthesized
ggtatgcctttcagtaaactct

SEQ ID NO: 1285714 - DNA, 22 bp, Artificial Sequence
  chemically synthesized
tcacctggagagtttactgaaa

SEQ ID NO: 1285715 - DNA, 22 bp, Artificial Sequence
  chemically synthesized
cctaggtatgcctttcagtaaa

SEQ ID NO: 1285716 - DNA, 22 bp, Artificial Sequence
  chemically synthesized
ccctaggtatgcctttcagtaa

SEQ ID NO: 1285717 - DNA, 22 bp, Artificial Sequence
  chemically synthesized
acctggagagtttactgaaagg

SEQ ID NO: 1285718 - DNA, 22 bp, Artificial Sequence
  chemically synthesized
tccctaggtatgcctttcagta

SEQ ID NO: 1285719 - DNA, 22 bp, Artificial Sequence
  chemically synthesized
ttccctaggtatgcctttcagt

SEQ ID NO: 1285720 - DNA, 22 bp, Artificial Sequence
  chemically synthesized
gagagtttactgaaaggcatac

SEQ ID NO: 1285721 - DNA, 22 bp, Artificial Sequence
  chemically synthesized
actgaaaggcatacctagggaa

SEQ ID NO: 1285722 - DNA, 22 bp, Artificial Sequence
  chemically synthesized
gatgaatgccttttccctaggt

SEQ ID NO: 1285723 - DNA, 22 bp, Artificial Sequence
  chemically synthesized
ctgaaaggcatacctagggaaa

SEQ ID NO: 1285724 - DNA, 22 bp, Artificial Sequence
  chemically synthesized
aaaggcatacctagggaaaagg

SEQ ID NO: 1285725 - DNA, 22 bp, Artificial Sequence
  chemically synthesized
gggcagcactagatgaatgcct

SEQ ID NO: 1285726 - DNA, 22 bp, Artificial Sequence
  chemically synthesized
gggaaaaggcattcatctagtg

SEQ ID NO: 1285727 - DNA, 22 bp, Artificial Sequence
  chemically synthesized
aaactggggcagcactagatga

SEQ ID NO: 1285728 - DNA, 22 bp, Artificial Sequence
  chemically synthesized
caaactggggcagcactagatg

SEQ ID NO: 1285729 - DNA, 22 bp, Artificial Sequence
  chemically synthesized
tcaaactggggcagcactagat

SEQ ID NO: 1285730 - DNA, 22 bp, Artificial Sequence
  chemically synthesized
gtacgctttcaaactggggcag

SEQ ID NO: 1285731 - DNA, 22 bp, Artificial Sequence
  chemically synthesized
ggtacgctttcaaactggggca

SEQ ID NO: 1285732 - DNA, 22 bp, Artificial Sequence
  chemically synthesized
tggtacgctttcaaactggggc

SEQ ID NO: 1285733 - DNA, 22 bp, Artificial Sequence
  chemically synthesized
ttggtacgctttcaaactgggg

SEQ ID NO: 1285734 - DNA, 22 bp, Artificial Sequence
  chemically synthesized
atctagtgctgccccagtttga

SEQ ID NO: 1285735 - DNA, 22 bp, Artificial Sequence
  chemically synthesized
tttggtacgctttcaaactggg

SEQ ID NO: 1285736 - DNA, 22 bp, Artificial Sequence
  chemically synthesized
gtgctgccccagtttgaaagcg

SEQ ID NO: 1285737 - DNA, 22 bp, Artificial Sequence
  chemically synthesized
ccccagtttgaaagcgtaccaa

SEQ ID NO: 1285738 - DNA, 22 bp, Artificial Sequence
  chemically synthesized
tgtgaatactttttggtacgct

SEQ ID NO: 1285739 - DNA, 22 bp, Artificial Sequence
  chemically synthesized
gtgtgaatactttttggtacgc

SEQ ID NO: 1285740 - DNA, 22 bp, Artificial Sequence
  chemically synthesized
gaaagcgtaccaaaaagtattc

SEQ ID NO: 1285741 - DNA, 22 bp, Artificial Sequence
  chemically synthesized
aaagcgtaccaaaaagtattca

SEQ ID NO: 1285742 - DNA, 22 bp, Artificial Sequence
  chemically synthesized
tgtgacacaaaccttgtgtgaa

SEQ ID NO: 1285743 - DNA, 22 bp, Artificial Sequence
  chemically synthesized
gtgtgacacaaaccttgtgtga

SEQ ID NO: 1285744 - DNA, 22 bp, Artificial Sequence
  chemically synthesized
cttgtgtgacacaaaccttgtg

SEQ ID NO: 1285745 - DNA, 22 bp, Artificial Sequence
  chemically synthesized
tccttgtgtgacacaaaccttg

SEQ ID NO: 1285746 - DNA, 22 bp, Artificial Sequence
  chemically synthesized
ctccttgtgtgacacaaacctt

SEQ ID NO: 1285747 - DNA, 22 bp, Artificial Sequence
  chemically synthesized
acacaaggtttgtgtcacacaa

SEQ ID NO: 1285748 - DNA, 22 bp, Artificial Sequence
  chemically synthesized
gtgtcacacaaggagaaactgt

SEQ ID NO: 1285749 - DNA, 22 bp, Artificial Sequence
  chemically synthesized
tgtcacacaaggagaaactgta

SEQ ID NO: 1285750 - DNA, 22 bp, Artificial Sequence
  chemically synthesized
aagaacaggcacatacagtttc

SEQ ID NO: 1285751 - DNA, 22 bp, Artificial Sequence
  chemically synthesized
caagaacaggcacatacagttt

SEQ ID NO: 1285752 - DNA, 22 bp, Artificial Sequence
  chemically synthesized
tgggtttcaagaacaggcacat

SEQ ID NO: 1285753 - DNA, 22 bp, Artificial Sequence
  chemically synthesized
ctgtgggtttcaagaacaggca

SEQ ID NO: 1285754 - DNA, 22 bp, Artificial Sequence
  chemically synthesized
ctgctgtgggtttcaagaacag

SEQ ID NO: 1285755 - DNA, 22 bp, Artificial Sequence
  chemically synthesized
tatgtgcctgttcttgaaaccc

SEQ ID NO: 1285756 - DNA, 22 bp, Artificial Sequence
  chemically synthesized
ccattactgctgtgggtttcaa

SEQ ID NO: 1285757 - DNA, 22 bp, Artificial Sequence
  chemically synthesized
ttaccattactgctgtgggttt

SEQ ID NO: 1285758 - DNA, 22 bp, Artificial Sequence
  chemically synthesized
tgttaccattactgctgtgggt

SEQ ID NO: 1285759 - DNA, 22 bp, Artificial Sequence
  chemically synthesized
ctgttaccattactgctgtggg

SEQ ID NO: 1285760 - DNA, 22 bp, Artificial Sequence
  chemically synthesized
ttctgttaccattactgctgtg

SEQ ID NO: 1285761 - DNA, 22 bp, Artificial Sequence
  chemically synthesized
ttcttgaaacccacagcagtaa

SEQ ID NO: 1285762 - DNA, 22 bp, Artificial Sequence
  chemically synthesized
ttcttctgttaccattactgct

SEQ ID NO: 1285763 - DNA, 22 bp, Artificial Sequence
  chemically synthesized
ttgaaacccacagcagtaatgg

SEQ ID NO: 1285764 - DNA, 22 bp, Artificial Sequence
  chemically synthesized
gaaacccacagcagtaatggta

SEQ ID NO: 1285765 - DNA, 22 bp, Artificial Sequence
  chemically synthesized
ttattcttctgttaccattact

SEQ ID NO: 1285766 - DNA, 22 bp, Artificial Sequence
  chemically synthesized
aaacccacagcagtaatggtaa

SEQ ID NO: 1285767 - DNA, 22 bp, Artificial Sequence
  chemically synthesized
gttattcttctgttaccattac

SEQ ID NO: 1285768 - DNA, 22 bp, Artificial Sequence
  chemically synthesized
ttgttattcttctgttaccatt

SEQ ID NO: 1285769 - DNA, 22 bp, Artificial Sequence
  chemically synthesized
gtatatggaatcaagatatgta

SEQ ID NO: 1285770 - DNA, 22 bp, Artificial Sequence
  chemically synthesized
ggtatatggaatcaagatatgt

SEQ ID NO: 1285771 - DNA, 22 bp, Artificial Sequence
  chemically synthesized
ggataaagcttggtatatggaa

SEQ ID NO: 1285772 - DNA, 22 bp, Artificial Sequence
  chemically synthesized
taggataaagcttggtatatgg

SEQ ID NO: 1285773 - DNA, 22 bp, Artificial Sequence
  chemically synthesized
ctaggataaagcttggtatatg

SEQ ID NO: 1285774 - DNA, 22 bp, Artificial Sequence
  chemically synthesized
tctaggataaagcttggtatat

SEQ ID NO: 1285775 - DNA, 22 bp, Artificial Sequence
  chemically synthesized
ttctaggataaagcttggtata

SEQ ID NO: 1285776 - DNA, 22 bp, Artificial Sequence
  chemically synthesized
gattccatataccaagctttat

SEQ ID NO: 1285777 - DNA, 22 bp, Artificial Sequence
  chemically synthesized
attccatataccaagctttatc

SEQ ID NO: 1285778 - DNA, 22 bp, Artificial Sequence
  chemically synthesized
catataccaagctttatcctag

SEQ ID NO: 1285779 - DNA, 22 bp, Artificial Sequence
  chemically synthesized
agtccagtaatcccaacctttt

SEQ ID NO: 1285780 - DNA, 22 bp, Artificial Sequence
  chemically synthesized
aagtccagtaatcccaaccttt

SEQ ID NO: 1285781 - DNA, 22 bp, Artificial Sequence
  chemically synthesized
taagtccagtaatcccaacctt

SEQ ID NO: 1285782 - DNA, 22 bp, Artificial Sequence
  chemically synthesized
ttaagtccagtaatcccaacct

SEQ ID NO: 1285783 - DNA, 22 bp, Artificial Sequence
  chemically synthesized
tatcctagaaaaggttgggatt

SEQ ID NO: 1285784 - DNA, 22 bp, Artificial Sequence
  chemically synthesized
atcctagaaaaggttgggatta

SEQ ID NO: 1285785 - DNA, 22 bp, Artificial Sequence
  chemically synthesized
ttttaagtccagtaatcccaac

SEQ ID NO: 1285786 - DNA, 22 bp, Artificial Sequence
  chemically synthesized
tcctagaaaaggttgggattac

SEQ ID NO: 1285787 - DNA, 22 bp, Artificial Sequence
  chemically synthesized
gaaaaggttgggattactggac

SEQ ID NO: 1285788 - DNA, 22 bp, Artificial Sequence
  chemically synthesized
cggaataccatgttcttttaag

SEQ ID NO: 1285789 - DNA, 22 bp, Artificial Sequence
  chemically synthesized
ggattactggacttaaaagaac

SEQ ID NO: 1285790 - DNA, 22 bp, Artificial Sequence
  chemically synthesized
attacggaataccatgttcttt

SEQ ID NO: 1285791 - DNA, 22 bp, Artificial Sequence
  chemically synthesized
ctggacttaaaagaacatggta

SEQ ID NO: 1285792 - DNA, 22 bp, Artificial Sequence
  chemically synthesized
tctgattacggaataccatgtt

SEQ ID NO: 1285793 - DNA, 22 bp, Artificial Sequence
  chemically synthesized
gacttaaaagaacatggtattc

SEQ ID NO: 1285794 - DNA, 22 bp, Artificial Sequence
  chemically synthesized
aggttgtctgattacggaatac

SEQ ID NO: 1285795 - DNA, 22 bp, Artificial Sequence
  chemically synthesized
aaaagaacatggtattccgtaa

SEQ ID NO: 1285796 - DNA, 22 bp, Artificial Sequence
  chemically synthesized
aaagaacatggtattccgtaat

SEQ ID NO: 1285797 - DNA, 22 bp, Artificial Sequence
  chemically synthesized
cgtaatcagacaaccttaattt

SEQ ID NO: 1285798 - DNA, 22 bp, Artificial Sequence
  chemically synthesized
cagaatggtcccaaattaaggt

SEQ ID NO: 1285799 - DNA, 22 bp, Artificial Sequence
  chemically synthesized
tggtaagcagtctccagaatgg

SEQ ID NO: 1285800 - DNA, 22 bp, Artificial Sequence
  chemically synthesized
aatttgggaccattctggagac

SEQ ID NO: 1285801 - DNA, 22 bp, Artificial Sequence
  chemically synthesized
atttgggaccattctggagact

SEQ ID NO: 1285802 - DNA, 22 bp, Artificial Sequence
  chemically synthesized
tcactgtggtaagcagtctcca

SEQ ID NO: 1285803 - DNA, 22 bp, Artificial Sequence
  chemically synthesized
gggaccattctggagactgctt

SEQ ID NO: 1285804 - DNA, 22 bp, Artificial Sequence
  chemically synthesized
ggaccattctggagactgctta

SEQ ID NO: 1285805 - DNA, 22 bp, Artificial Sequence
  chemically synthesized
ggtataattatcactgtggtaa

SEQ ID NO: 1285806 - DNA, 22 bp, Artificial Sequence
  chemically synthesized
tggagactgcttaccacagtga

SEQ ID NO: 1285807 - DNA, 22 bp, Artificial Sequence
  chemically synthesized
gagactgcttaccacagtgata

SEQ ID NO: 1285808 - DNA, 22 bp, Artificial Sequence
  chemically synthesized
acaaattaggtataattatcac

SEQ ID NO: 1285809 - DNA, 22 bp, Artificial Sequence
  chemically synthesized
aacaaattaggtataattatca

SEQ ID NO: 1285810 - DNA, 22 bp, Artificial Sequence
  chemically synthesized
taacaaattaggtataattatc

SEQ ID NO: 1285811 - DNA, 22 bp, Artificial Sequence
  chemically synthesized
cttaccacagtgataattatac

SEQ ID NO: 1285812 - DNA, 22 bp, Artificial Sequence
  chemically synthesized
accacagtgataattataccta

SEQ ID NO: 1285813 - DNA, 22 bp, Artificial Sequence
  chemically synthesized
ccacagtgataattatacctaa

SEQ ID NO: 1285814 - DNA, 22 bp, Artificial Sequence
  chemically synthesized
gaaaaaatgaattttaacaaat

SEQ ID NO: 1285815 - DNA, 22 bp, Artificial Sequence
  chemically synthesized
tacctaatttgttaaaattcat

SEQ ID NO: 1285816 - DNA, 22 bp, Artificial Sequence
  chemically synthesized
taattggaaaaaatgaatttta

SEQ ID NO: 1285817 - DNA, 22 bp, Artificial Sequence
  chemically synthesized
ttataattggaaaaaatgaatt

SEQ ID NO: 1285818 - DNA, 22 bp, Artificial Sequence
  chemically synthesized
atttgttaaaattcattttttc

SEQ ID NO: 1285819 - DNA, 22 bp, Artificial Sequence
  chemically synthesized
ttattataattggaaaaaatga

SEQ ID NO: 1285820 - DNA, 22 bp, Artificial Sequence
  chemically synthesized
gttaaaattcattttttccaat

SEQ ID NO: 1285821 - DNA, 22 bp, Artificial Sequence
  chemically synthesized
attattattataattggaaaaa

SEQ ID NO: 1285822 - DNA, 22 bp, Artificial Sequence
  chemically synthesized
ttaaaattcattttttccaatt

SEQ ID NO: 1285823 - DNA, 22 bp, Artificial Sequence
  chemically synthesized
taattattattataattggaaa

SEQ ID NO: 1285824 - DNA, 22 bp, Artificial Sequence
  chemically synthesized
ctaattattattataattggaa

SEQ ID NO: 1285825 - DNA, 22 bp, Artificial Sequence
  chemically synthesized
aaattcattttttccaattata

SEQ ID NO: 1285826 - DNA, 22 bp, Artificial Sequence
  chemically synthesized
tctaattattattataattgga

SEQ ID NO: 1285827 - DNA, 22 bp, Artificial Sequence
  chemically synthesized
attttttccaattataataata

SEQ ID NO: 1285828 - DNA, 22 bp, Artificial Sequence
  chemically synthesized
tagttttctaattattattata

SEQ ID NO: 1285829 - DNA, 22 bp, Artificial Sequence
  chemically synthesized
atagttttctaattattattat

SEQ ID NO: 1285830 - DNA, 22 bp, Artificial Sequence
  chemically synthesized
tatagttttctaattattatta

SEQ ID NO: 1285831 - DNA, 22 bp, Artificial Sequence
  chemically synthesized
ttatagttttctaattattatt

SEQ ID NO: 1285832 - DNA, 22 bp, Artificial Sequence
  chemically synthesized
tttccaattataataataatta

SEQ ID NO: 1285833 - DNA, 22 bp, Artificial Sequence
  chemically synthesized
ttccaattataataataattag

SEQ ID NO: 1285834 - DNA, 22 bp, Artificial Sequence
  chemically synthesized
tccaattataataataattaga

SEQ ID NO: 1285835 - DNA, 22 bp, Artificial Sequence
  chemically synthesized
ccaattataataataattagaa

SEQ ID NO: 1285836 - DNA, 22 bp, Artificial Sequence
  chemically synthesized
caattataataataattagaaa

SEQ ID NO: 1285837 - DNA, 22 bp, Artificial Sequence
  chemically synthesized
tatacttttatagttttctaat

SEQ ID NO: 1285838 - DNA, 22 bp, Artificial Sequence
  chemically synthesized
gtatacttttatagttttctaa

SEQ ID NO: 1285839 - DNA, 22 bp, Artificial Sequence
  chemically synthesized
taataataattagaaaactata

SEQ ID NO: 1285840 - DNA, 22 bp, Artificial Sequence
  chemically synthesized
catttgtatacttttatagttt

SEQ ID NO: 1285841 - DNA, 22 bp, Artificial Sequence
  chemically synthesized
gaaaactataaaagtatacaaa

SEQ ID NO: 1285842 - DNA, 22 bp, Artificial Sequence
  chemically synthesized
agataaaacgtactgcatttgt

SEQ ID NO: 1285843 - DNA, 22 bp, Artificial Sequence
  chemically synthesized
taaaagtatacaaatgcagtac

SEQ ID NO: 1285844 - DNA, 22 bp, Artificial Sequence
  chemically synthesized
aagtagaagaaaactaagataa

SEQ ID NO: 1285845 - DNA, 22 bp, Artificial Sequence
  chemically synthesized
gaagtagaagaaaactaagata

SEQ ID NO: 1285846 - DNA, 22 bp, Artificial Sequence
  chemically synthesized
tgaagtagaagaaaactaagat

SEQ ID NO: 1285847 - DNA, 22 bp, Artificial Sequence
  chemically synthesized
tatcttagttttcttctacttc

SEQ ID NO: 1285848 - DNA, 22 bp, Artificial Sequence
  chemically synthesized
atcttagttttcttctacttca

SEQ ID NO: 1285849 - DNA, 22 bp, Artificial Sequence
  chemically synthesized
tcttagttttcttctacttcaa

SEQ ID NO: 1285850 - DNA, 22 bp, Artificial Sequence
  chemically synthesized
agttttcttctacttcaaaatt

SEQ ID NO: 1285851 - DNA, 22 bp, Artificial Sequence
  chemically synthesized
gataatatatataattttgaag

SEQ ID NO: 1285852 - DNA, 22 bp, Artificial Sequence
  chemically synthesized
gttttcttctacttcaaaatta

SEQ ID NO: 1285853 - DNA, 22 bp, Artificial Sequence
  chemically synthesized
agataatatatataattttgaa

SEQ ID NO: 1285854 - DNA, 22 bp, Artificial Sequence
  chemically synthesized
tagataatatatataattttga

SEQ ID NO: 1285855 - DNA, 22 bp, Artificial Sequence
  chemically synthesized
tcttctacttcaaaattatata

SEQ ID NO: 1285856 - DNA, 22 bp, Artificial Sequence
  chemically synthesized
cttctacttcaaaattatatat

SEQ ID NO: 1285857 - DNA, 22 bp, Artificial Sequence
  chemically synthesized
ttctacttcaaaattatatata

SEQ ID NO: 1285858 - DNA, 22 bp, Artificial Sequence
  chemically synthesized
ctacttcaaaattatatatatt

SEQ ID NO: 1285859 - DNA, 22 bp, Artificial Sequence
  chemically synthesized
tacttcaaaattatatatatta

SEQ ID NO: 1285860 - DNA, 22 bp, Artificial Sequence
  chemically synthesized
cttcaaaattatatatattatc

SEQ ID NO: 1285861 - DNA, 22 bp, Artificial Sequence
  chemically synthesized
caaaattatatatattatctaa

SEQ ID NO: 1285862 - DNA, 22 bp, Artificial Sequence
  chemically synthesized
aaaattatatatattatctaaa

SEQ ID NO: 1285863 - DNA, 22 bp, Artificial Sequence
  chemically synthesized
aaaagaaaaacaaattttagat

SEQ ID NO: 1285864 - DNA, 22 bp, Artificial Sequence
  chemically synthesized
tatatattatctaaaatttgtt

SEQ ID NO: 1285865 - DNA, 22 bp, Artificial Sequence
  chemically synthesized
gaaataacctgaaaagaaaaac

SEQ ID NO: 1285866 - DNA, 22 bp, Artificial Sequence
  chemically synthesized
agaaataacctgaaaagaaaaa

SEQ ID NO: 1285867 - DNA, 22 bp, Artificial Sequence
  chemically synthesized
tctaaaatttgtttttcttttc

SEQ ID NO: 1285868 - DNA, 22 bp, Artificial Sequence
  chemically synthesized
aaatttgtttttcttttcaggt

SEQ ID NO: 1285869 - DNA, 22 bp, Artificial Sequence
  chemically synthesized
gtttttcttttcaggttatttc

SEQ ID NO: 1285870 - DNA, 22 bp, Artificial Sequence
  chemically synthesized
tttttcttttcaggttatttct

SEQ ID NO: 1285871 - DNA, 22 bp, Artificial Sequence
  chemically synthesized
ttcttttcaggttatttctaag

SEQ ID NO: 1285872 - DNA, 22 bp, Artificial Sequence
  chemically synthesized
tcttttcaggttatttctaagg

SEQ ID NO: 1285873 - DNA, 22 bp, Artificial Sequence
  chemically synthesized
cttttcaggttatttctaaggt

SEQ ID NO: 1285874 - DNA, 22 bp, Artificial Sequence
  chemically synthesized
ttttcaggttatttctaaggta

SEQ ID NO: 1285875 - DNA, 22 bp, Artificial Sequence
  chemically synthesized
acaaaaatcaaagtaccttaga

SEQ ID NO: 1285876 - DNA, 22 bp, Artificial Sequence
  chemically synthesized
ttcaggttatttctaaggtact

SEQ ID NO: 1285877 - DNA, 22 bp, Artificial Sequence
  chemically synthesized
aacaaaaatcaaagtaccttag

SEQ ID NO: 1285878 - DNA, 22 bp, Artificial Sequence
  chemically synthesized
tcaggttatttctaaggtactt

SEQ ID NO: 1285879 - DNA, 22 bp, Artificial Sequence
  chemically synthesized
caggttatttctaaggtacttt

SEQ ID NO: 1285880 - DNA, 22 bp, Artificial Sequence
  chemically synthesized
aggttatttctaaggtactttg

SEQ ID NO: 1285881 - DNA, 22 bp, Artificial Sequence
  chemically synthesized
tttaacaaaaatcaaagtacct

SEQ ID NO: 1285882 - DNA, 22 bp, Artificial Sequence
  chemically synthesized
aattatttaacaaaaatcaaag

SEQ ID NO: 1285883 - DNA, 22 bp, Artificial Sequence
  chemically synthesized
tttctaaggtactttgattttt

SEQ ID NO: 1285884 - DNA, 22 bp, Artificial Sequence
  chemically synthesized
ctaaggtactttgatttttgtt

SEQ ID NO: 1285885 - DNA, 22 bp, Artificial Sequence
  chemically synthesized
taaggtactttgatttttgtta

SEQ ID NO: 1285886 - DNA, 22 bp, Artificial Sequence
  chemically synthesized
aactgaattatttaacaaaaat

SEQ ID NO: 1285887 - DNA, 22 bp, Artificial Sequence
  chemically synthesized
aaactgaattatttaacaaaaa

SEQ ID NO: 1285888 - DNA, 22 bp, Artificial Sequence
  chemically synthesized
aggtactttgatttttgttaaa

SEQ ID NO: 1285889 - DNA, 22 bp, Artificial Sequence
  chemically synthesized
tgatttttgttaaataattcag

SEQ ID NO: 1285890 - DNA, 22 bp, Artificial Sequence
  chemically synthesized
gatttttgttaaataattcagt

SEQ ID NO: 1285891 - DNA, 22 bp, Artificial Sequence
  chemically synthesized
atttttgttaaataattcagtt

SEQ ID NO: 1285892 - DNA, 22 bp, Artificial Sequence
  chemically synthesized
ttgttaaataattcagtttaaa

SEQ ID NO: 1285893 - DNA, 22 bp, Artificial Sequence
  chemically synthesized
tgttaaataattcagtttaaat

SEQ ID NO: 1285894 - DNA, 22 bp, Artificial Sequence
  chemically synthesized
gttaaataattcagtttaaatt

SEQ ID NO: 1285895 - DNA, 22 bp, Artificial Sequence
  chemically synthesized
ttaaataattcagtttaaattc

SEQ ID NO: 1285896 - DNA, 22 bp, Artificial Sequence
  chemically synthesized
cataaaaacgtggaatttaaac

SEQ ID NO: 1285897 - DNA, 22 bp, Artificial Sequence
  chemically synthesized
tacataaaaacgtggaatttaa

SEQ ID NO: 1285898 - DNA, 22 bp, Artificial Sequence
  chemically synthesized
aataattcagtttaaattccac

SEQ ID NO: 1285899 - DNA, 22 bp, Artificial Sequence
  chemically synthesized
ctacataaaaacgtggaattta

SEQ ID NO: 1285900 - DNA, 22 bp, Artificial Sequence
  chemically synthesized
tctacataaaaacgtggaattt

SEQ ID NO: 1285901 - DNA, 22 bp, Artificial Sequence
  chemically synthesized
ttctacataaaaacgtggaatt

SEQ ID NO: 1285902 - DNA, 22 bp, Artificial Sequence
  chemically synthesized
tttctacataaaaacgtggaat

SEQ ID NO: 1285903 - DNA, 22 bp, Artificial Sequence
  chemically synthesized
ttttctacataaaaacgtggaa

SEQ ID NO: 1285904 - DNA, 22 bp, Artificial Sequence
  chemically synthesized
agtttaaattccacgtttttat

SEQ ID NO: 1285905 - DNA, 22 bp, Artificial Sequence
  chemically synthesized
atttttttctacataaaaacgt

SEQ ID NO: 1285906 - DNA, 22 bp, Artificial Sequence
  chemically synthesized
gatttttttctacataaaaacg

SEQ ID NO: 1285907 - DNA, 22 bp, Artificial Sequence
  chemically synthesized
aaattccacgtttttatgtaga

SEQ ID NO: 1285908 - DNA, 22 bp, Artificial Sequence
  chemically synthesized
aattccacgtttttatgtagaa

SEQ ID NO: 1285909 - DNA, 22 bp, Artificial Sequence
  chemically synthesized
cacgtttttatgtagaaaaaaa

SEQ ID NO: 1285910 - DNA, 22 bp, Artificial Sequence
  chemically synthesized
ttatgtagaaaaaaatcaagga

SEQ ID NO: 1285911 - DNA, 22 bp, Artificial Sequence
  chemically synthesized
tatgtagaaaaaaatcaaggat

SEQ ID NO: 1285912 - DNA, 22 bp, Artificial Sequence
  chemically synthesized
atgtagaaaaaaatcaaggatt

SEQ ID NO: 1285913 - DNA, 22 bp, Artificial Sequence
  chemically synthesized
tgtagaaaaaaatcaaggattt

SEQ ID NO: 1285914 - DNA, 22 bp, Artificial Sequence
  chemically synthesized
aatataagagaaatcaaatcct

SEQ ID NO: 1285915 - DNA, 22 bp, Artificial Sequence
  chemically synthesized
gaatataagagaaatcaaatcc

SEQ ID NO: 1285916 - DNA, 22 bp, Artificial Sequence
  chemically synthesized
tgaatataagagaaatcaaatc

SEQ ID NO: 1285917 - DNA, 22 bp, Artificial Sequence
  chemically synthesized
ttgaatataagagaaatcaaat

SEQ ID NO: 1285918 - DNA, 22 bp, Artificial Sequence
  chemically synthesized
cacttttgaatataagagaaat

SEQ ID NO: 1285919 - DNA, 22 bp, Artificial Sequence
  chemically synthesized
gatttctcttatattcaaaagt

SEQ ID NO: 1285920 - DNA, 22 bp, Artificial Sequence
  chemically synthesized
atttctcttatattcaaaagtg

SEQ ID NO: 1285921 - DNA, 22 bp, Artificial Sequence
  chemically synthesized
ctcttatattcaaaagtgcaat

SEQ ID NO: 1285922 - DNA, 22 bp, Artificial Sequence
  chemically synthesized
tcttatattcaaaagtgcaatc

SEQ ID NO: 1285923 - DNA, 22 bp, Artificial Sequence
  chemically synthesized
ttatattcaaaagtgcaatcgt

SEQ ID NO: 1285924 - DNA, 22 bp, Artificial Sequence
  chemically synthesized
atattcaaaagtgcaatcgttt

SEQ ID NO: 1285925 - DNA, 22 bp, Artificial Sequence
  chemically synthesized
aatgtagaaagaaaacgattgc

SEQ ID NO: 1285926 - DNA, 22 bp, Artificial Sequence
  chemically synthesized
tattcaaaagtgcaatcgtttt

SEQ ID NO: 1285927 - DNA, 22 bp, Artificial Sequence
  chemically synthesized
atctcaatgtagaaagaaaacg

SEQ ID NO: 1285928 - DNA, 22 bp, Artificial Sequence
  chemically synthesized
aaaagtgcaatcgttttctttc

SEQ ID NO: 1285929 - DNA, 22 bp, Artificial Sequence
  chemically synthesized
catctcaatgtagaaagaaaac

SEQ ID NO: 1285930 - DNA, 22 bp, Artificial Sequence
  chemically synthesized
tcatctcaatgtagaaagaaaa

SEQ ID NO: 1285931 - DNA, 22 bp, Artificial Sequence
  chemically synthesized
caaaatactttcatctcaatgt

SEQ ID NO: 1285932 - DNA, 22 bp, Artificial Sequence
  chemically synthesized
tctttctacattgagatgaaag

SEQ ID NO: 1285933 - DNA, 22 bp, Artificial Sequence
  chemically synthesized
tgctccaaaatactttcatctc

SEQ ID NO: 1285934 - DNA, 22 bp, Artificial Sequence
  chemically synthesized
ctttctacattgagatgaaagt

SEQ ID NO: 1285935 - DNA, 22 bp, Artificial Sequence
  chemically synthesized
atgctccaaaatactttcatct

SEQ ID NO: 1285936 - DNA, 22 bp, Artificial Sequence
  chemically synthesized
tttctacattgagatgaaagta

SEQ ID NO: 1285937 - DNA, 22 bp, Artificial Sequence
  chemically synthesized
tctacattgagatgaaagtatt

SEQ ID NO: 1285938 - DNA, 22 bp, Artificial Sequence
  chemically synthesized
tttatgctccaaaatactttca

SEQ ID NO: 1285939 - DNA, 22 bp, Artificial Sequence
  chemically synthesized
ctacattgagatgaaagtattt

SEQ ID NO: 1285940 - DNA, 22 bp, Artificial Sequence
  chemically synthesized
tacattgagatgaaagtatttt

SEQ ID NO: 1285941 - DNA, 22 bp, Artificial Sequence
  chemically synthesized
cattgagatgaaagtattttgg

SEQ ID NO: 1285942 - DNA, 22 bp, Artificial Sequence
  chemically synthesized
agatgaaagtattttggagcat

SEQ ID NO: 1285943 - DNA, 22 bp, Artificial Sequence
  chemically synthesized
gcgtgtattgtttatgctccaa

SEQ ID NO: 1285944 - DNA, 22 bp, Artificial Sequence
  chemically synthesized
agcgtgtattgtttatgctcca

SEQ ID NO: 1285945 - DNA, 22 bp, Artificial Sequence
  chemically synthesized
tttagcgtgtattgtttatgct

SEQ ID NO: 1285946 - DNA, 22 bp, Artificial Sequence
  chemically synthesized
caattatttagcgtgtattgtt

SEQ ID NO: 1285947 - DNA, 22 bp, Artificial Sequence
  chemically synthesized
gcaattatttagcgtgtattgt

SEQ ID NO: 1285948 - DNA, 22 bp, Artificial Sequence
  chemically synthesized
tggagcataaacaatacacgct

SEQ ID NO: 1285949 - DNA, 22 bp, Artificial Sequence
  chemically synthesized
ggagcataaacaatacacgcta

SEQ ID NO: 1285950 - DNA, 22 bp, Artificial Sequence
  chemically synthesized
tttgcaattatttagcgtgtat

SEQ ID NO: 1285951 - DNA, 22 bp, Artificial Sequence
  chemically synthesized
gagcataaacaatacacgctaa

SEQ ID NO: 1285952 - DNA, 22 bp, Artificial Sequence
  chemically synthesized
aaagctatttgcaattatttag

SEQ ID NO: 1285953 - DNA, 22 bp, Artificial Sequence
  chemically synthesized
aaaagctatttgcaattattta

SEQ ID NO: 1285954 - DNA, 22 bp, Artificial Sequence
  chemically synthesized
taaaagctatttgcaattattt

SEQ ID NO: 1285955 - DNA, 22 bp, Artificial Sequence
  chemically synthesized
gcctttaaaagctatttgcaat

SEQ ID NO: 1285956 - DNA, 22 bp, Artificial Sequence
  chemically synthesized
agcctttaaaagctatttgcaa

SEQ ID NO: 1285957 - DNA, 22 bp, Artificial Sequence
  chemically synthesized
tagcctttaaaagctatttgca

SEQ ID NO: 1285958 - DNA, 22 bp, Artificial Sequence
  chemically synthesized
aataattgcaaatagcttttaa

SEQ ID NO: 1285959 - DNA, 22 bp, Artificial Sequence
  chemically synthesized
caaactttagcctttaaaagct

SEQ ID NO: 1285960 - DNA, 22 bp, Artificial Sequence
  chemically synthesized
caaatagcttttaaaggctaaa

SEQ ID NO: 1285961 - DNA, 22 bp, Artificial Sequence
  chemically synthesized
agtattgcaaactttagccttt

SEQ ID NO: 1285962 - DNA, 22 bp, Artificial Sequence
  chemically synthesized
cagtattgcaaactttagcctt

SEQ ID NO: 1285963 - DNA, 22 bp, Artificial Sequence
  chemically synthesized
ttcagtattgcaaactttagcc

SEQ ID NO: 1285964 - DNA, 22 bp, Artificial Sequence
  chemically synthesized
gctcttcagtattgcaaacttt

SEQ ID NO: 1285965 - DNA, 22 bp, Artificial Sequence
  chemically synthesized
agctcttcagtattgcaaactt

SEQ ID NO: 1285966 - DNA, 22 bp, Artificial Sequence
  chemically synthesized
ttaaaggctaaagtttgcaata

SEQ ID NO: 1285967 - DNA, 22 bp, Artificial Sequence
  chemically synthesized
taaaggctaaagtttgcaatac

SEQ ID NO: 1285968 - DNA, 22 bp, Artificial Sequence
  chemically synthesized
aaaggctaaagtttgcaatact

SEQ ID NO: 1285969 - DNA, 22 bp, Artificial Sequence
  chemically synthesized
gtttagctcttcagtattgcaa

SEQ ID NO: 1285970 - DNA, 22 bp, Artificial Sequence
  chemically synthesized
aaggctaaagtttgcaatactg

SEQ ID NO: 1285971 - DNA, 22 bp, Artificial Sequence
  chemically synthesized
aagtttgcaatactgaagagct

SEQ ID NO: 1285972 - DNA, 22 bp, Artificial Sequence
  chemically synthesized
atggacaatgctggtttagctc

SEQ ID NO: 1285973 - DNA, 22 bp, Artificial Sequence
  chemically synthesized
gcaatactgaagagctaaacca

SEQ ID NO: 1285974 - DNA, 22 bp, Artificial Sequence
  chemically synthesized
caatactgaagagctaaaccag

SEQ ID NO: 1285975 - DNA, 22 bp, Artificial Sequence
  chemically synthesized
taatggacaatgctggtttagc

SEQ ID NO: 1285976 - DNA, 22 bp, Artificial Sequence
  chemically synthesized
aagagctaaaccagcattgtcc

SEQ ID NO: 1285977 - DNA, 22 bp, Artificial Sequence
  chemically synthesized
aaccagcattgtccattagaat

SEQ ID NO: 1285978 - DNA, 22 bp, Artificial Sequence
  chemically synthesized
tcaccaccaaaaattctaatgg

SEQ ID NO: 1285979 - DNA, 22 bp, Artificial Sequence
  chemically synthesized
atcaccaccaaaaattctaatg

SEQ ID NO: 1285980 - DNA, 22 bp, Artificial Sequence
  chemically synthesized
tatcaccaccaaaaattctaat

SEQ ID NO: 1285981 - DNA, 22 bp, Artificial Sequence
  chemically synthesized
ttatcaccaccaaaaattctaa

SEQ ID NO: 1285982 - DNA, 22 bp, Artificial Sequence
  chemically synthesized
tttatcaccaccaaaaattcta

SEQ ID NO: 1285983 - DNA, 22 bp, Artificial Sequence
  chemically synthesized
ttttttatcaccaccaaaaatt

SEQ ID NO: 1285984 - DNA, 22 bp, Artificial Sequence
  chemically synthesized
gttttttatcaccaccaaaaat

SEQ ID NO: 1285985 - DNA, 22 bp, Artificial Sequence
  chemically synthesized
tgttttttatcaccaccaaaaa

SEQ ID NO: 1285986 - DNA, 22 bp, Artificial Sequence
  chemically synthesized
ttgttttttatcaccaccaaaa

SEQ ID NO: 1285987 - DNA, 22 bp, Artificial Sequence
  chemically synthesized
tccattagaatttttggtggtg

SEQ ID NO: 1285988 - DNA, 22 bp, Artificial Sequence
  chemically synthesized
tttgttttttatcaccaccaaa

SEQ ID NO: 1285989 - DNA, 22 bp, Artificial Sequence
  chemically synthesized
gaatttttggtggtgataaaaa

SEQ ID NO: 1285990 - DNA, 22 bp, Artificial Sequence
  chemically synthesized
ttggtggtgataaaaaacaaaa

SEQ ID NO: 1285991 - DNA, 22 bp, Artificial Sequence
  chemically synthesized
tggtggtgataaaaaacaaaaa

SEQ ID NO: 1285992 - DNA, 22 bp, Artificial Sequence
  chemically synthesized
ggtggtgataaaaaacaaaaaa

SEQ ID NO: 1285993 - DNA, 22 bp, Artificial Sequence
  chemically synthesized
gtggtgataaaaaacaaaaaat

SEQ ID NO: 1285994 - DNA, 22 bp, Artificial Sequence
  chemically synthesized
tgtagtgcatgtatagaacatt

SEQ ID NO: 1285995 - DNA, 22 bp, Artificial Sequence
  chemically synthesized
gtggccatcgtgttatgtagtg

SEQ ID NO: 1285996 - DNA, 22 bp, Artificial Sequence
  chemically synthesized
agtggccatcgtgttatgtagt

SEQ ID NO: 1285997 - DNA, 22 bp, Artificial Sequence
  chemically synthesized
tagtggccatcgtgttatgtag

SEQ ID NO: 1285998 - DNA, 22 bp, Artificial Sequence
  chemically synthesized
tatacatgcactacataacacg

SEQ ID NO: 1285999 - DNA, 22 bp, Artificial Sequence
  chemically synthesized
tacatgcactacataacacgat

SEQ ID NO: 1286000 - DNA, 22 bp, Artificial Sequence
  chemically synthesized
cataacacgatggccactaaaa

SEQ ID NO: 1286001 - DNA, 22 bp, Artificial Sequence
  chemically synthesized
agtagtcacatggttttagtgg

SEQ ID NO: 1286002 - DNA, 22 bp, Artificial Sequence
  chemically synthesized
aagtgctcagtagtcacatggt

SEQ ID NO: 1286003 - DNA, 22 bp, Artificial Sequence
  chemically synthesized
gaagtgctcagtagtcacatgg

SEQ ID NO: 1286004 - DNA, 22 bp, Artificial Sequence
  chemically synthesized
catttgaagtgctcagtagtca

SEQ ID NO: 1286005 - DNA, 22 bp, Artificial Sequence
  chemically synthesized
aaaccatgtgactactgagcac

SEQ ID NO: 1286006 - DNA, 22 bp, Artificial Sequence
  chemically synthesized
gctacatttgaagtgctcagta

SEQ ID NO: 1286007 - DNA, 22 bp, Artificial Sequence
  chemically synthesized
ctagctacatttgaagtgctca

SEQ ID NO: 1286008 - DNA, 22 bp, Artificial Sequence
  chemically synthesized
gctagctacatttgaagtgctc

SEQ ID NO: 1286009 - DNA, 22 bp, Artificial Sequence
  chemically synthesized
tgctagctacatttgaagtgct

SEQ ID NO: 1286010 - DNA, 22 bp, Artificial Sequence
  chemically synthesized
cattttgctagctacatttgaa

SEQ ID NO: 1286011 - DNA, 22 bp, Artificial Sequence
  chemically synthesized
ctccattttgctagctacattt

SEQ ID NO: 1286012 - DNA, 22 bp, Artificial Sequence
  chemically synthesized
ctgagcacttcaaatgtagcta

SEQ ID NO: 1286013 - DNA, 22 bp, Artificial Sequence
  chemically synthesized
ttcctccattttgctagctaca

SEQ ID NO: 1286014 - DNA, 22 bp, Artificial Sequence
  chemically synthesized
agcacttcaaatgtagctagca

SEQ ID NO: 1286015 - DNA, 22 bp, Artificial Sequence
  chemically synthesized
tgttgttcctccattttgctag

SEQ ID NO: 1286016 - DNA, 22 bp, Artificial Sequence
  chemically synthesized
caaatgtagctagcaaaatgga

SEQ ID NO: 1286017 - DNA, 22 bp, Artificial Sequence
  chemically synthesized
aaatgtagctagcaaaatggag

SEQ ID NO: 1286018 - DNA, 22 bp, Artificial Sequence
  chemically synthesized
gcaaaatggaggaacaacatag

SEQ ID NO: 1286019 - DNA, 22 bp, Artificial Sequence
  chemically synthesized
gtgaaagtaaaagaaactatgt

SEQ ID NO: 1286020 - DNA, 22 bp, Artificial Sequence
  chemically synthesized
aattagtgaaagtaaaagaaac

SEQ ID NO: 1286021 - DNA, 22 bp, Artificial Sequence
  chemically synthesized
aaattagtgaaagtaaaagaaa

SEQ ID NO: 1286022 - DNA, 22 bp, Artificial Sequence
  chemically synthesized
aatttaaattagtgaaagtaaa

SEQ ID NO: 1286023 - DNA, 22 bp, Artificial Sequence
  chemically synthesized
gaatttaaattagtgaaagtaa

SEQ ID NO: 1286024 - DNA, 22 bp, Artificial Sequence
  chemically synthesized
tgaatttaaattagtgaaagta

SEQ ID NO: 1286025 - DNA, 22 bp, Artificial Sequence
  chemically synthesized
ttttgaatttaaattagtgaaa

SEQ ID NO: 1286026 - DNA, 22 bp, Artificial Sequence
  chemically synthesized
cttttactttcactaatttaaa

SEQ ID NO: 1286027 - DNA, 22 bp, Artificial Sequence
  chemically synthesized
ttttactttcactaatttaaat

SEQ ID NO: 1286028 - DNA, 22 bp, Artificial Sequence
  chemically synthesized
ttactttcactaatttaaattc

SEQ ID NO: 1286029 - DNA, 22 bp, Artificial Sequence
  chemically synthesized
tactttcactaatttaaattca

SEQ ID NO: 1286030 - DNA, 22 bp, Artificial Sequence
  chemically synthesized
actttcactaatttaaattcaa

SEQ ID NO: 1286031 - DNA, 22 bp, Artificial Sequence
  chemically synthesized
ctttcactaatttaaattcaaa

SEQ ID NO: 1286032 - DNA, 22 bp, Artificial Sequence
  chemically synthesized
tcactaatttaaattcaaaata

SEQ ID NO: 1286033 - DNA, 22 bp, Artificial Sequence
  chemically synthesized
cactaatttaaattcaaaataa

SEQ ID NO: 1286034 - DNA, 22 bp, Artificial Sequence
  chemically synthesized
actaatttaaattcaaaataat

SEQ ID NO: 1286035 - DNA, 22 bp, Artificial Sequence
  chemically synthesized
gacaatggcaaaaaattatttt

SEQ ID NO: 1286036 - DNA, 22 bp, Artificial Sequence
  chemically synthesized
atttaaattcaaaataattttt

SEQ ID NO: 1286037 - DNA, 22 bp, Artificial Sequence
  chemically synthesized
aaattcaaaataattttttgcc

SEQ ID NO: 1286038 - DNA, 22 bp, Artificial Sequence
  chemically synthesized
aattcaaaataattttttgcca

SEQ ID NO: 1286039 - DNA, 22 bp, Artificial Sequence
  chemically synthesized
gtagccattagacaatggcaaa

SEQ ID NO: 1286040 - DNA, 22 bp, Artificial Sequence
  chemically synthesized
ggtagccattagacaatggcaa

SEQ ID NO: 1286041 - DNA, 22 bp, Artificial Sequence
  chemically synthesized
aaaataattttttgccattgtc

SEQ ID NO: 1286042 - DNA, 22 bp, Artificial Sequence
  chemically synthesized
tccaatttggtagccattagac

SEQ ID NO: 1286043 - DNA, 22 bp, Artificial Sequence
  chemically synthesized
tttgccattgtctaatggctac

SEQ ID NO: 1286044 - DNA, 22 bp, Artificial Sequence
  chemically synthesized
ttgccattgtctaatggctacc

SEQ ID NO: 1286045 - DNA, 22 bp, Artificial Sequence
  chemically synthesized
tgccattgtctaatggctacca

SEQ ID NO: 1286046 - DNA, 22 bp, Artificial Sequence
  chemically synthesized
tgctgtccaatttggtagccat

SEQ ID NO: 1286047 - DNA, 22 bp, Artificial Sequence
  chemically synthesized
gccattgtctaatggctaccaa

SEQ ID NO: 1286048 - DNA, 22 bp, Artificial Sequence
  chemically synthesized
gtgctgtccaatttggtagcca

SEQ ID NO: 1286049 - DNA, 22 bp, Artificial Sequence
  chemically synthesized
ccattgtctaatggctaccaaa

SEQ ID NO: 1286050 - DNA, 22 bp, Artificial Sequence
  chemically synthesized
gacttgtgctgtccaatttggt

SEQ ID NO: 1286051 - DNA, 22 bp, Artificial Sequence
  chemically synthesized
tctaatggctaccaaattggac

SEQ ID NO: 1286052 - DNA, 22 bp, Artificial Sequence
  chemically synthesized
tagacttgtgctgtccaatttg

SEQ ID NO: 1286053 - DNA, 22 bp, Artificial Sequence
  chemically synthesized
atggctaccaaattggacagca

SEQ ID NO: 1286054 - DNA, 22 bp, Artificial Sequence
  chemically synthesized
aattctagacttgtgctgtcca

SEQ ID NO: 1286055 - DNA, 22 bp, Artificial Sequence
  chemically synthesized
ccaaattggacagcacaagtct

SEQ ID NO: 1286056 - DNA, 22 bp, Artificial Sequence
  chemically synthesized
gtaattaaattctagacttgtg

SEQ ID NO: 1286057 - DNA, 22 bp, Artificial Sequence
  chemically synthesized
gacagcacaagtctagaattta

SEQ ID NO: 1286058 - DNA, 22 bp, Artificial Sequence
  chemically synthesized
gaatttaattactaatacatgt

SEQ ID NO: 1286059 - DNA, 22 bp, Artificial Sequence
  chemically synthesized
aattactaatacatgtatactt

SEQ ID NO: 1286060 - DNA, 22 bp, Artificial Sequence
  chemically synthesized
attactaatacatgtatacttt

SEQ ID NO: 1286061 - DNA, 22 bp, Artificial Sequence
  chemically synthesized
ctaatacatgtatacttttttt

SEQ ID NO: 1286062 - DNA, 22 bp, Artificial Sequence
  chemically synthesized
atacatgtatactttttttatt

SEQ ID NO: 1286063 - DNA, 22 bp, Artificial Sequence
  chemically synthesized
tatgacatatgtaccaataaaa

SEQ ID NO: 1286064 - DNA, 22 bp, Artificial Sequence
  chemically synthesized
atatgacatatgtaccaataaa

SEQ ID NO: 1286065 - DNA, 22 bp, Artificial Sequence
  chemically synthesized
tttttattggtacatatgtcat

SEQ ID NO: 1286066 - DNA, 22 bp, Artificial Sequence
  chemically synthesized
ttttattggtacatatgtcata

SEQ ID NO: 1286067 - DNA, 22 bp, Artificial Sequence
  chemically synthesized
tttattggtacatatgtcatat

SEQ ID NO: 1286068 - DNA, 22 bp, Artificial Sequence
  chemically synthesized
ttattggtacatatgtcatata

SEQ ID NO: 1286069 - DNA, 22 bp, Artificial Sequence
  chemically synthesized
cgcatacaaccttatatgacat

SEQ ID NO: 1286070 - DNA, 22 bp, Artificial Sequence
  chemically synthesized
tattggtacatatgtcatataa

SEQ ID NO: 1286071 - DNA, 22 bp, Artificial Sequence
  chemically synthesized
attggtacatatgtcatataag

SEQ ID NO: 1286072 - DNA, 22 bp, Artificial Sequence
  chemically synthesized
tgcgcatacaaccttatatgac

SEQ ID NO: 1286073 - DNA, 22 bp, Artificial Sequence
  chemically synthesized
ttggtacatatgtcatataagg

SEQ ID NO: 1286074 - DNA, 22 bp, Artificial Sequence
  chemically synthesized
ctgcgcatacaaccttatatga

SEQ ID NO: 1286075 - DNA, 22 bp, Artificial Sequence
  chemically synthesized
gtacatatgtcatataaggttg

SEQ ID NO: 1286076 - DNA, 22 bp, Artificial Sequence
  chemically synthesized
tatgcttctgcgcatacaacct

SEQ ID NO: 1286077 - DNA, 22 bp, Artificial Sequence
  chemically synthesized
tctgtatgcttctgcgcataca

SEQ ID NO: 1286078 - DNA, 22 bp, Artificial Sequence
  chemically synthesized
atctgtatgcttctgcgcatac

SEQ ID NO: 1286079 - DNA, 22 bp, Artificial Sequence
  chemically synthesized
tatgcgcagaagcatacagata

SEQ ID NO: 1286080 - DNA, 22 bp, Artificial Sequence
  chemically synthesized
gatagtaacaagatggcatcca

SEQ ID NO: 1286081 - DNA, 22 bp, Artificial Sequence
  chemically synthesized
agatagtaacaagatggcatcc

SEQ ID NO: 1286082 - DNA, 22 bp, Artificial Sequence
  chemically synthesized
tagatagtaacaagatggcatc

SEQ ID NO: 1286083 - DNA, 22 bp, Artificial Sequence
  chemically synthesized
ttagatagtaacaagatggcat

SEQ ID NO: 1286084 - DNA, 22 bp, Artificial Sequence
  chemically synthesized
gcttttagatagtaacaagatg

SEQ ID NO: 1286085 - DNA, 22 bp, Artificial Sequence
  chemically synthesized
tatgttggcttttagatagtaa

SEQ ID NO: 1286086 - DNA, 22 bp, Artificial Sequence
  chemically synthesized
gtatgttggcttttagatagta

SEQ ID NO: 1286087 - DNA, 22 bp, Artificial Sequence
  chemically synthesized
gttactatctaaaagccaacat

SEQ ID NO: 1286088 - DNA, 22 bp, Artificial Sequence
  chemically synthesized
ttactatctaaaagccaacata

SEQ ID NO: 1286089 - DNA, 22 bp, Artificial Sequence
  chemically synthesized
ctatctaaaagccaacatacaa

SEQ ID NO: 1286090 - DNA, 22 bp, Artificial Sequence
  chemically synthesized
agtcataaaacatttgtatgtt

SEQ ID NO: 1286091 - DNA, 22 bp, Artificial Sequence
  chemically synthesized
aagtcataaaacatttgtatgt

SEQ ID NO: 1286092 - DNA, 22 bp, Artificial Sequence
  chemically synthesized
tctaaaagccaacatacaaatg

SEQ ID NO: 1286093 - DNA, 22 bp, Artificial Sequence
  chemically synthesized
taagtcataaaacatttgtatg

SEQ ID NO: 1286094 - DNA, 22 bp, Artificial Sequence
  chemically synthesized
ttaagtcataaaacatttgtat

SEQ ID NO: 1286095 - DNA, 22 bp, Artificial Sequence
  chemically synthesized
tttaagtcataaaacatttgta

SEQ ID NO: 1286096 - DNA, 22 bp, Artificial Sequence
  chemically synthesized
ttttaagtcataaaacatttgt

SEQ ID NO: 1286097 - DNA, 22 bp, Artificial Sequence
  chemically synthesized
aaagccaacatacaaatgtttt

SEQ ID NO: 1286098 - DNA, 22 bp, Artificial Sequence
  chemically synthesized
tggcatttttttaagtcataaa

SEQ ID NO: 1286099 - DNA, 22 bp, Artificial Sequence
  chemically synthesized
tatgacttaaaaaaatgccaca

SEQ ID NO: 1286100 - DNA, 22 bp, Artificial Sequence
  chemically synthesized
atgacttaaaaaaatgccacag

SEQ ID NO: 1286101 - DNA, 22 bp, Artificial Sequence
  chemically synthesized
tgacttaaaaaaatgccacaga

SEQ ID NO: 1286102 - DNA, 22 bp, Artificial Sequence
  chemically synthesized
aagtgaagcaagaatctgtggc

SEQ ID NO: 1286103 - DNA, 22 bp, Artificial Sequence
  chemically synthesized
aaaaaaatgccacagattcttg

SEQ ID NO: 1286104 - DNA, 22 bp, Artificial Sequence
  chemically synthesized
aaaaaatgccacagattcttgc

SEQ ID NO: 1286105 - DNA, 22 bp, Artificial Sequence
  chemically synthesized
acattaaagtgaagcaagaatc

SEQ ID NO: 1286106 - DNA, 22 bp, Artificial Sequence
  chemically synthesized
ctcacattaaagtgaagcaaga

SEQ ID NO: 1286107 - DNA, 22 bp, Artificial Sequence
  chemically synthesized
agttcctcacattaaagtgaag

SEQ ID NO: 1286108 - DNA, 22 bp, Artificial Sequence
  chemically synthesized
ttgcttcactttaatgtgagga

SEQ ID NO: 1286109 - DNA, 22 bp, Artificial Sequence
  chemically synthesized
gcttcactttaatgtgaggaac

SEQ ID NO: 1286110 - DNA, 22 bp, Artificial Sequence
  chemically synthesized
ataaatatctgagttcctcaca

SEQ ID NO: 1286111 - DNA, 22 bp, Artificial Sequence
  chemically synthesized
cttcactttaatgtgaggaact

SEQ ID NO: 1286112 - DNA, 22 bp, Artificial Sequence
  chemically synthesized
cactttaatgtgaggaactcag

SEQ ID NO: 1286113 - DNA, 22 bp, Artificial Sequence
  chemically synthesized
actttaatgtgaggaactcaga

SEQ ID NO: 1286114 - DNA, 22 bp, Artificial Sequence
  chemically synthesized
tgttaataaatatctgagttcc

SEQ ID NO: 1286115 - DNA, 22 bp, Artificial Sequence
  chemically synthesized
taatgtgaggaactcagatatt

SEQ ID NO: 1286116 - DNA, 22 bp, Artificial Sequence
  chemically synthesized
aatgtgaggaactcagatattt

SEQ ID NO: 1286117 - DNA, 22 bp, Artificial Sequence
  chemically synthesized
atgtgaggaactcagatattta

SEQ ID NO: 1286118 - DNA, 22 bp, Artificial Sequence
  chemically synthesized
gtcaaaattatgttaataaata

SEQ ID NO: 1286119 - DNA, 22 bp, Artificial Sequence
  chemically synthesized
ggtcaaaattatgttaataaat

SEQ ID NO: 1286120 - DNA, 22 bp, Artificial Sequence
  chemically synthesized
tggtcaaaattatgttaataaa

SEQ ID NO: 1286121 - DNA, 22 bp, Artificial Sequence
  chemically synthesized
ttggtcaaaattatgttaataa

SEQ ID NO: 1286122 - DNA, 22 bp, Artificial Sequence
  chemically synthesized
cttttggtcaaaattatgttaa

SEQ ID NO: 1286123 - DNA, 22 bp, Artificial Sequence
  chemically synthesized
agatatttattaacataatttt

SEQ ID NO: 1286124 - DNA, 22 bp, Artificial Sequence
  chemically synthesized
attaacataattttgaccaaaa

SEQ ID NO: 1286125 - DNA, 22 bp, Artificial Sequence
  chemically synthesized
ttaacataattttgaccaaaag

SEQ ID NO: 1286126 - DNA, 22 bp, Artificial Sequence
  chemically synthesized
gtatggaggctacttttggtca

SEQ ID NO: 1286127 - DNA, 22 bp, Artificial Sequence
  chemically synthesized
ggtatggaggctacttttggtc

SEQ ID NO: 1286128 - DNA, 22 bp, Artificial Sequence
  chemically synthesized
acataattttgaccaaaagtag

SEQ ID NO: 1286129 - DNA, 22 bp, Artificial Sequence
  chemically synthesized
catttggtatggaggctacttt

SEQ ID NO: 1286130 - DNA, 22 bp, Artificial Sequence
  chemically synthesized
tgaccaaaagtagcctccatac

SEQ ID NO: 1286131 - DNA, 22 bp, Artificial Sequence
  chemically synthesized
gaccaaaagtagcctccatacc

SEQ ID NO: 1286132 - DNA, 22 bp, Artificial Sequence
  chemically synthesized
accaaaagtagcctccatacca

SEQ ID NO: 1286133 - DNA, 22 bp, Artificial Sequence
  chemically synthesized
aataattgcatttggtatggag

SEQ ID NO: 1286134 - DNA, 22 bp, Artificial Sequence
  chemically synthesized
cagaaatggctaaataattgca

SEQ ID NO: 1286135 - DNA, 22 bp, Artificial Sequence
  chemically synthesized
gcagaaatggctaaataattgc

SEQ ID NO: 1286136 - DNA, 22 bp, Artificial Sequence
  chemically synthesized
cataccaaatgcaattatttag

SEQ ID NO: 1286137 - DNA, 22 bp, Artificial Sequence
  chemically synthesized
cagtcttgcagaaatggctaaa

SEQ ID NO: 1286138 - DNA, 22 bp, Artificial Sequence
  chemically synthesized
tttagccatttctgcaagactg

SEQ ID NO: 1286139 - DNA, 22 bp, Artificial Sequence
  chemically synthesized
gggaaaaaatctccagtcttgc

SEQ ID NO: 1286140 - DNA, 22 bp, Artificial Sequence
  chemically synthesized
ggggaaaaaatctccagtcttg

SEQ ID NO: 1286141 - DNA, 22 bp, Artificial Sequence
  chemically synthesized
agccatttctgcaagactggag

SEQ ID NO: 1286142 - DNA, 22 bp, Artificial Sequence
  chemically synthesized
tggggaaaaaatctccagtctt

SEQ ID NO: 1286143 - DNA, 22 bp, Artificial Sequence
  chemically synthesized
gccatttctgcaagactggaga

SEQ ID NO: 1286144 - DNA, 22 bp, Artificial Sequence
  chemically synthesized
ttggggaaaaaatctccagtct

SEQ ID NO: 1286145 - DNA, 22 bp, Artificial Sequence
  chemically synthesized
gtttttggggaaaaaatctcca

SEQ ID NO: 1286146 - DNA, 22 bp, Artificial Sequence
  chemically synthesized
ctgcaagactggagattttttc

SEQ ID NO: 1286147 - DNA, 22 bp, Artificial Sequence
  chemically synthesized
tgcaagactggagattttttcc

SEQ ID NO: 1286148 - DNA, 22 bp, Artificial Sequence
  chemically synthesized
gttagtttttggggaaaaaatc

SEQ ID NO: 1286149 - DNA, 22 bp, Artificial Sequence
  chemically synthesized
caagactggagattttttcccc

SEQ ID NO: 1286150 - DNA, 22 bp, Artificial Sequence
  chemically synthesized
tagttagtttttggggaaaaaa

SEQ ID NO: 1286151 - DNA, 22 bp, Artificial Sequence
  chemically synthesized
ctagttagtttttggggaaaaa

SEQ ID NO: 1286152 - DNA, 22 bp, Artificial Sequence
  chemically synthesized
tctagttagtttttggggaaaa

SEQ ID NO: 1286153 - DNA, 22 bp, Artificial Sequence
  chemically synthesized
ttctagttagtttttggggaaa

SEQ ID NO: 1286154 - DNA, 22 bp, Artificial Sequence
  chemically synthesized
tttttctagttagtttttgggg

SEQ ID NO: 1286155 - DNA, 22 bp, Artificial Sequence
  chemically synthesized
gagattttttccccaaaaacta

SEQ ID NO: 1286156 - DNA, 22 bp, Artificial Sequence
  chemically synthesized
agttatttttctagttagtttt

SEQ ID NO: 1286157 - DNA, 22 bp, Artificial Sequence
  chemically synthesized
tttccccaaaaactaactagaa

SEQ ID NO: 1286158 - DNA, 22 bp, Artificial Sequence
  chemically synthesized
ttccccaaaaactaactagaaa

SEQ ID NO: 1286159 - DNA, 22 bp, Artificial Sequence
  chemically synthesized
tccccaaaaactaactagaaaa

SEQ ID NO: 1286160 - DNA, 22 bp, Artificial Sequence
  chemically synthesized
ccccaaaaactaactagaaaaa

SEQ ID NO: 1286161 - DNA, 22 bp, Artificial Sequence
  chemically synthesized
cccaaaaactaactagaaaaat

SEQ ID NO: 1286162 - DNA, 22 bp, Artificial Sequence
  chemically synthesized
aaacagaggattaagttatttt

SEQ ID NO: 1286163 - DNA, 22 bp, Artificial Sequence
  chemically synthesized
actagaaaaataacttaatcct

SEQ ID NO: 1286164 - DNA, 22 bp, Artificial Sequence
  chemically synthesized
gaaaaataacttaatcctctgt

SEQ ID NO: 1286165 - DNA, 22 bp, Artificial Sequence
  chemically synthesized
tgaaatggcatattaaaacaga

SEQ ID NO: 1286166 - DNA, 22 bp, Artificial Sequence
  chemically synthesized
aatcctctgttttaatatgcca

SEQ ID NO: 1286167 - DNA, 22 bp, Artificial Sequence
  chemically synthesized
caagctgtgaaatggcatatta

SEQ ID NO: 1286168 - DNA, 22 bp, Artificial Sequence
  chemically synthesized
atcctctgttttaatatgccat

SEQ ID NO: 1286169 - DNA, 22 bp, Artificial Sequence
  chemically synthesized
tgttttaatatgccatttcaca

SEQ ID NO: 1286170 - DNA, 22 bp, Artificial Sequence
  chemically synthesized
ttttaatatgccatttcacagc

SEQ ID NO: 1286171 - DNA, 22 bp, Artificial Sequence
  chemically synthesized
taatatgccatttcacagcttg

SEQ ID NO: 1286172 - DNA, 22 bp, Artificial Sequence
  chemically synthesized
aatatgccatttcacagcttgc

SEQ ID NO: 1286173 - DNA, 22 bp, Artificial Sequence
  chemically synthesized
atatgccatttcacagcttgca

SEQ ID NO: 1286174 - DNA, 22 bp, Artificial Sequence
  chemically synthesized
acaataagcaattgcaagctgt

SEQ ID NO: 1286175 - DNA, 22 bp, Artificial Sequence
  chemically synthesized
cacagcttgcaattgcttattg

SEQ ID NO: 1286176 - DNA, 22 bp, Artificial Sequence
  chemically synthesized
acagcttgcaattgcttattgt

SEQ ID NO: 1286177 - DNA, 22 bp, Artificial Sequence
  chemically synthesized
gcaattgcttattgtgaatgct

SEQ ID NO: 1286178 - DNA, 22 bp, Artificial Sequence
  chemically synthesized
caattgcttattgtgaatgctc

SEQ ID NO: 1286179 - DNA, 22 bp, Artificial Sequence
  chemically synthesized
aagaaaagaaataggagcattc

SEQ ID NO: 1286180 - DNA, 22 bp, Artificial Sequence
  chemically synthesized
caagaaaagaaataggagcatt

SEQ ID NO: 1286181 - DNA, 22 bp, Artificial Sequence
  chemically synthesized
cttattgtgaatgctcctattt

SEQ ID NO: 1286182 - DNA, 22 bp, Artificial Sequence
  chemically synthesized
attgtgaatgctcctatttctt

SEQ ID NO: 1286183 - DNA, 22 bp, Artificial Sequence
  chemically synthesized
ttgtgaatgctcctatttcttt

SEQ ID NO: 1286184 - DNA, 22 bp, Artificial Sequence
  chemically synthesized
ccaaagtttcaagaaaagaaat

SEQ ID NO: 1286185 - DNA, 22 bp, Artificial Sequence
  chemically synthesized
tgaatgctcctatttcttttct

SEQ ID NO: 1286186 - DNA, 22 bp, Artificial Sequence
  chemically synthesized
gccaaagtttcaagaaaagaaa

SEQ ID NO: 1286187 - DNA, 22 bp, Artificial Sequence
  chemically synthesized
tgccaaagtttcaagaaaagaa

SEQ ID NO: 1286188 - DNA, 22 bp, Artificial Sequence
  chemically synthesized
ctatttcttttcttgaaacttt

SEQ ID NO: 1286189 - DNA, 22 bp, Artificial Sequence
  chemically synthesized
tttcttttcttgaaactttggc

SEQ ID NO: 1286190 - DNA, 22 bp, Artificial Sequence
  chemically synthesized
gcataatagttttgccaaagtt

SEQ ID NO: 1286191 - DNA, 22 bp, Artificial Sequence
  chemically synthesized
cttttcttgaaactttggcaaa

SEQ ID NO: 1286192 - DNA, 22 bp, Artificial Sequence
  chemically synthesized
tggcataatagttttgccaaag

SEQ ID NO: 1286193 - DNA, 22 bp, Artificial Sequence
  chemically synthesized
ttttcttgaaactttggcaaaa

SEQ ID NO: 1286194 - DNA, 22 bp, Artificial Sequence
  chemically synthesized
ttcttgaaactttggcaaaact

SEQ ID NO: 1286195 - DNA, 22 bp, Artificial Sequence
  chemically synthesized
tcttgaaactttggcaaaacta

SEQ ID NO: 1286196 - DNA, 22 bp, Artificial Sequence
  chemically synthesized
cttgaaactttggcaaaactat

SEQ ID NO: 1286197 - DNA, 22 bp, Artificial Sequence
  chemically synthesized
ttgaaactttggcaaaactatt

SEQ ID NO: 1286198 - DNA, 22 bp, Artificial Sequence
  chemically synthesized
gaaactttggcaaaactattat

SEQ ID NO: 1286199 - DNA, 22 bp, Artificial Sequence
  chemically synthesized
aaactttggcaaaactattatg

SEQ ID NO: 1286200 - DNA, 22 bp, Artificial Sequence
  chemically synthesized
tggcaaaactattatgccagaa

SEQ ID NO: 1286201 - DNA, 22 bp, Artificial Sequence
  chemically synthesized
ggcaaaactattatgccagaac

SEQ ID NO: 1286202 - DNA, 22 bp, Artificial Sequence
  chemically synthesized
gcaaaactattatgccagaaca

SEQ ID NO: 1286203 - DNA, 22 bp, Artificial Sequence
  chemically synthesized
ttatgccagaacatgatttaca

SEQ ID NO: 1286204 - DNA, 22 bp, Artificial Sequence
  chemically synthesized
aatgaatgacaaaatgtaaatc

SEQ ID NO: 1286205 - DNA, 22 bp, Artificial Sequence
  chemically synthesized
tgccagaacatgatttacattt

SEQ ID NO: 1286206 - DNA, 22 bp, Artificial Sequence
  chemically synthesized
aaatgaatgacaaaatgtaaat

SEQ ID NO: 1286207 - DNA, 22 bp, Artificial Sequence
  chemically synthesized
taaatgaatgacaaaatgtaaa

SEQ ID NO: 1286208 - DNA, 22 bp, Artificial Sequence
  chemically synthesized
aattttaaatgaatgacaaaat

SEQ ID NO: 1286209 - DNA, 22 bp, Artificial Sequence
  chemically synthesized
tgaattttaaatgaatgacaaa

SEQ ID NO: 1286210 - DNA, 22 bp, Artificial Sequence
  chemically synthesized
acattttgtcattcatttaaaa

SEQ ID NO: 1286211 - DNA, 22 bp, Artificial Sequence
  chemically synthesized
cattttgtcattcatttaaaat

SEQ ID NO: 1286212 - DNA, 22 bp, Artificial Sequence
  chemically synthesized
tgtcattcatttaaaattcaga

SEQ ID NO: 1286213 - DNA, 22 bp, Artificial Sequence
  chemically synthesized
gtcattcatttaaaattcagaa

SEQ ID NO: 1286214 - DNA, 22 bp, Artificial Sequence
  chemically synthesized
tcattcatttaaaattcagaat

SEQ ID NO: 1286215 - DNA, 22 bp, Artificial Sequence
  chemically synthesized
atggcataaaaagccattctga

SEQ ID NO: 1286216 - DNA, 22 bp, Artificial Sequence
  chemically synthesized
aatggcataaaaagccattctg

SEQ ID NO: 1286217 - DNA, 22 bp, Artificial Sequence
  chemically synthesized
atttaaaattcagaatggcttt

SEQ ID NO: 1286218 - DNA, 22 bp, Artificial Sequence
  chemically synthesized
aaaattcagaatggctttttat

SEQ ID NO: 1286219 - DNA, 22 bp, Artificial Sequence
  chemically synthesized
aaattcagaatggctttttatg

SEQ ID NO: 1286220 - DNA, 22 bp, Artificial Sequence
  chemically synthesized
agaatggctttttatgccatta

SEQ ID NO: 1286221 - DNA, 22 bp, Artificial Sequence
  chemically synthesized
atgtaaataaatagacttaatg

SEQ ID NO: 1286222 - DNA, 22 bp, Artificial Sequence
  chemically synthesized
aatgtaaataaatagacttaat

SEQ ID NO: 1286223 - DNA, 22 bp, Artificial Sequence
  chemically synthesized
taatgtaaataaatagacttaa

SEQ ID NO: 1286224 - DNA, 22 bp, Artificial Sequence
  chemically synthesized
tttatgccattaagtctattta

SEQ ID NO: 1286225 - DNA, 22 bp, Artificial Sequence
  chemically synthesized
ttatgccattaagtctatttat

SEQ ID NO: 1286226 - DNA, 22 bp, Artificial Sequence
  chemically synthesized
tctttaatgtaaataaatagac

SEQ ID NO: 1286227 - DNA, 22 bp, Artificial Sequence
  chemically synthesized
tatgccattaagtctatttatt

SEQ ID NO: 1286228 - DNA, 22 bp, Artificial Sequence
  chemically synthesized
gtctttaatgtaaataaataga

SEQ ID NO: 1286229 - DNA, 22 bp, Artificial Sequence
  chemically synthesized
atgccattaagtctatttattt

SEQ ID NO: 1286230 - DNA, 22 bp, Artificial Sequence
  chemically synthesized
tgccattaagtctatttattta

SEQ ID NO: 1286231 - DNA, 22 bp, Artificial Sequence
  chemically synthesized
agtctatttatttacattaaag

SEQ ID NO: 1286232 - DNA, 22 bp, Artificial Sequence
  chemically synthesized
agtatgcatttgtctttaatgt

SEQ ID NO: 1286233 - DNA, 22 bp, Artificial Sequence
  chemically synthesized
ttaagtatgcatttgtctttaa

SEQ ID NO: 1286234 - DNA, 22 bp, Artificial Sequence
  chemically synthesized
tttatttacattaaagacaaat

SEQ ID NO: 1286235 - DNA, 22 bp, Artificial Sequence
  chemically synthesized
atttacattaaagacaaatgca

SEQ ID NO: 1286236 - DNA, 22 bp, Artificial Sequence
  chemically synthesized
tttacattaaagacaaatgcat

SEQ ID NO: 1286237 - DNA, 22 bp, Artificial Sequence
  chemically synthesized
caaattgttaagtatgcatttg

SEQ ID NO: 1286238 - DNA, 22 bp, Artificial Sequence
  chemically synthesized
acattaaagacaaatgcatact

SEQ ID NO: 1286239 - DNA, 22 bp, Artificial Sequence
  chemically synthesized
tccaaattgttaagtatgcatt

SEQ ID NO: 1286240 - DNA, 22 bp, Artificial Sequence
  chemically synthesized
cattaaagacaaatgcatactt

SEQ ID NO: 1286241 - DNA, 22 bp, Artificial Sequence
  chemically synthesized
ctccaaattgttaagtatgcat

SEQ ID NO: 1286242 - DNA, 22 bp, Artificial Sequence
  chemically synthesized
tctccaaattgttaagtatgca

SEQ ID NO: 1286243 - DNA, 22 bp, Artificial Sequence
  chemically synthesized
ttttctccaaattgttaagtat

SEQ ID NO: 1286244 - DNA, 22 bp, Artificial Sequence
  chemically synthesized
aagacaaatgcatacttaacaa

SEQ ID NO: 1286245 - DNA, 22 bp, Artificial Sequence
  chemically synthesized
attgttttctccaaattgttaa

SEQ ID NO: 1286246 - DNA, 22 bp, Artificial Sequence
  chemically synthesized
gattgttttctccaaattgtta

SEQ ID NO: 1286247 - DNA, 22 bp, Artificial Sequence
  chemically synthesized
tgattgttttctccaaattgtt

SEQ ID NO: 1286248 - DNA, 22 bp, Artificial Sequence
  chemically synthesized
ttgattgttttctccaaattgt

SEQ ID NO: 1286249 - DNA, 22 bp, Artificial Sequence
  chemically synthesized
aaaagcttttgattgttttctc

SEQ ID NO: 1286250 - DNA, 22 bp, Artificial Sequence
  chemically synthesized
aacaatttggagaaaacaatca

SEQ ID NO: 1286251 - DNA, 22 bp, Artificial Sequence
  chemically synthesized
acaatttggagaaaacaatcaa

SEQ ID NO: 1286252 - DNA, 22 bp, Artificial Sequence
  chemically synthesized
gaatgattcaaaagcttttgat

SEQ ID NO: 1286253 - DNA, 22 bp, Artificial Sequence
  chemically synthesized
ggagaaaacaatcaaaagcttt

SEQ ID NO: 1286254 - DNA, 22 bp, Artificial Sequence
  chemically synthesized
gagaaaacaatcaaaagctttt

SEQ ID NO: 1286255 - DNA, 22 bp, Artificial Sequence
  chemically synthesized
accaattagaatgattcaaaag

SEQ ID NO: 1286256 - DNA, 22 bp, Artificial Sequence
  chemically synthesized
aagaataagccctcaccaatta

SEQ ID NO: 1286257 - DNA, 22 bp, Artificial Sequence
  chemically synthesized
ttgaatcattctaattggtgag

SEQ ID NO: 1286258 - DNA, 22 bp, Artificial Sequence
  chemically synthesized
aaagaataagccctcaccaatt

SEQ ID NO: 1286259 - DNA, 22 bp, Artificial Sequence
  chemically synthesized
tgaatcattctaattggtgagg

SEQ ID NO: 1286260 - DNA, 22 bp, Artificial Sequence
  chemically synthesized
taaagaataagccctcaccaat

SEQ ID NO: 1286261 - DNA, 22 bp, Artificial Sequence
  chemically synthesized
gaatcattctaattggtgaggg

SEQ ID NO: 1286262 - DNA, 22 bp, Artificial Sequence
  chemically synthesized
ttaaagaataagccctcaccaa

SEQ ID NO: 1286263 - DNA, 22 bp, Artificial Sequence
  chemically synthesized
aatcattctaattggtgagggc

SEQ ID NO: 1286264 - DNA, 22 bp, Artificial Sequence
  chemically synthesized
tttaaagaataagccctcacca

SEQ ID NO: 1286265 - DNA, 22 bp, Artificial Sequence
  chemically synthesized
ctttttaaagaataagccctca

SEQ ID NO: 1286266 - DNA, 22 bp, Artificial Sequence
  chemically synthesized
taattggtgagggcttattctt

SEQ ID NO: 1286267 - DNA, 22 bp, Artificial Sequence
  chemically synthesized
attggtgagggcttattcttta

SEQ ID NO: 1286268 - DNA, 22 bp, Artificial Sequence
  chemically synthesized
gtgagggcttattctttaaaaa

SEQ ID NO: 1286269 - DNA, 22 bp, Artificial Sequence
  chemically synthesized
catcaaatagatgttacttttt

SEQ ID NO: 1286270 - DNA, 22 bp, Artificial Sequence
  chemically synthesized
attctttaaaaagtaacatcta

SEQ ID NO: 1286271 - DNA, 22 bp, Artificial Sequence
  chemically synthesized
ttctttaaaaagtaacatctat

SEQ ID NO: 1286272 - DNA, 22 bp, Artificial Sequence
  chemically synthesized
tttaaaaagtaacatctatttg

SEQ ID NO: 1286273 - DNA, 22 bp, Artificial Sequence
  chemically synthesized
taaaaagtaacatctatttgat

SEQ ID NO: 1286274 - DNA, 22 bp, Artificial Sequence
  chemically synthesized
aaaaagtaacatctatttgatg

SEQ ID NO: 1286275 - DNA, 22 bp, Artificial Sequence
  chemically synthesized
aaaagtaacatctatttgatgt

SEQ ID NO: 1286276 - DNA, 22 bp, Artificial Sequence
  chemically synthesized
tcagatcacagatctacatcaa

SEQ ID NO: 1286277 - DNA, 22 bp, Artificial Sequence
  chemically synthesized
tgtcagatcacagatctacatc

SEQ ID NO: 1286278 - DNA, 22 bp, Artificial Sequence
  chemically synthesized
ctgtcagatcacagatctacat

SEQ ID NO: 1286279 - DNA, 22 bp, Artificial Sequence
  chemically synthesized
tctgtcagatcacagatctaca

SEQ ID NO: 1286280 - DNA, 22 bp, Artificial Sequence
  chemically synthesized
gttttctgtcagatcacagatc

SEQ ID NO: 1286281 - DNA, 22 bp, Artificial Sequence
  chemically synthesized
tttgatgtagatctgtgatctg

SEQ ID NO: 1286282 - DNA, 22 bp, Artificial Sequence
  chemically synthesized
gatgtagatctgtgatctgaca

SEQ ID NO: 1286283 - DNA, 22 bp, Artificial Sequence
  chemically synthesized
atgtagatctgtgatctgacag

SEQ ID NO: 1286284 - DNA, 22 bp, Artificial Sequence
  chemically synthesized
aaacaattagttttctgtcaga

SEQ ID NO: 1286285 - DNA, 22 bp, Artificial Sequence
  chemically synthesized
aaaacaattagttttctgtcag

SEQ ID NO: 1286286 - DNA, 22 bp, Artificial Sequence
  chemically synthesized
tgatctgacagaaaactaattg

SEQ ID NO: 1286287 - DNA, 22 bp, Artificial Sequence
  chemically synthesized
caaatacttaaaacaattagtt

SEQ ID NO: 1286288 - DNA, 22 bp, Artificial Sequence
  chemically synthesized
gattacaaatacttaaaacaat

SEQ ID NO: 1286289 - DNA, 22 bp, Artificial Sequence
  chemically synthesized
acagaaaactaattgttttaag

SEQ ID NO: 1286290 - DNA, 22 bp, Artificial Sequence
  chemically synthesized
ggattacaaatacttaaaacaa

SEQ ID NO: 1286291 - DNA, 22 bp, Artificial Sequence
  chemically synthesized
cttggattacaaatacttaaaa

SEQ ID NO: 1286292 - DNA, 22 bp, Artificial Sequence
  chemically synthesized
ctgcttggattacaaatactta

SEQ ID NO: 1286293 - DNA, 22 bp, Artificial Sequence
  chemically synthesized
attgttttaagtatttgtaatc

SEQ ID NO: 1286294 - DNA, 22 bp, Artificial Sequence
  chemically synthesized
catcactgctgcttggattaca

SEQ ID NO: 1286295 - DNA, 22 bp, Artificial Sequence
  chemically synthesized
ttttaagtatttgtaatccaag

SEQ ID NO: 1286296 - DNA, 22 bp, Artificial Sequence
  chemically synthesized
gcatcactgctgcttggattac

SEQ ID NO: 1286297 - DNA, 22 bp, Artificial Sequence
  chemically synthesized
taagtatttgtaatccaagcag

SEQ ID NO: 1286298 - DNA, 22 bp, Artificial Sequence
  chemically synthesized
aagtatttgtaatccaagcagc

SEQ ID NO: 1286299 - DNA, 22 bp, Artificial Sequence
  chemically synthesized
atttgcatcactgctgcttgga

SEQ ID NO: 1286300 - DNA, 22 bp, Artificial Sequence
  chemically synthesized
agtatttgtaatccaagcagca

SEQ ID NO: 1286301 - DNA, 22 bp, Artificial Sequence
  chemically synthesized
aattcatttgcatcactgctgc

SEQ ID NO: 1286302 - DNA, 22 bp, Artificial Sequence
  chemically synthesized
gtaatccaagcagcagtgatgc

SEQ ID NO: 1286303 - DNA, 22 bp, Artificial Sequence
  chemically synthesized
taatccaagcagcagtgatgca

SEQ ID NO: 1286304 - DNA, 22 bp, Artificial Sequence
  chemically synthesized
ataattaaattcatttgcatca

SEQ ID NO: 1286305 - DNA, 22 bp, Artificial Sequence
  chemically synthesized
aactgataattaaattcatttg

SEQ ID NO: 1286306 - DNA, 22 bp, Artificial Sequence
  chemically synthesized
aaactgataattaaattcattt

SEQ ID NO: 1286307 - DNA, 22 bp, Artificial Sequence
  chemically synthesized
taaactgataattaaattcatt

SEQ ID NO: 1286308 - DNA, 22 bp, Artificial Sequence
  chemically synthesized
ttaaactgataattaaattcat

SEQ ID NO: 1286309 - DNA, 22 bp, Artificial Sequence
  chemically synthesized
gatttttaaactgataattaaa

SEQ ID NO: 1286310 - DNA, 22 bp, Artificial Sequence
  chemically synthesized
ggatttttaaactgataattaa

SEQ ID NO: 1286311 - DNA, 22 bp, Artificial Sequence
  chemically synthesized
tttggatttttaaactgataat

SEQ ID NO: 1286312 - DNA, 22 bp, Artificial Sequence
  chemically synthesized
ccattgtttggatttttaaact

SEQ ID NO: 1286313 - DNA, 22 bp, Artificial Sequence
  chemically synthesized
cccattgtttggatttttaaac

SEQ ID NO: 1286314 - DNA, 22 bp, Artificial Sequence
  chemically synthesized
cttcccattgtttggattttta

SEQ ID NO: 1286315 - DNA, 22 bp, Artificial Sequence
  chemically synthesized
aattatcagtttaaaaatccaa

SEQ ID NO: 1286316 - DNA, 22 bp, Artificial Sequence
  chemically synthesized
acttcccattgtttggattttt

SEQ ID NO: 1286317 - DNA, 22 bp, Artificial Sequence
  chemically synthesized
attatcagtttaaaaatccaaa

SEQ ID NO: 1286318 - DNA, 22 bp, Artificial Sequence
  chemically synthesized
tcttacttcccattgtttggat

SEQ ID NO: 1286319 - DNA, 22 bp, Artificial Sequence
  chemically synthesized
tcagtttaaaaatccaaacaat

SEQ ID NO: 1286320 - DNA, 22 bp, Artificial Sequence
  chemically synthesized
aaaaatccaaacaatgggaagt

SEQ ID NO: 1286321 - DNA, 22 bp, Artificial Sequence
  chemically synthesized
aaaatccaaacaatgggaagta

SEQ ID NO: 1286322 - DNA, 22 bp, Artificial Sequence
  chemically synthesized
aaggcagcgtgttgtcttactt

SEQ ID NO: 1286323 - DNA, 22 bp, Artificial Sequence
  chemically synthesized
gaaggcagcgtgttgtcttact

SEQ ID NO: 1286324 - DNA, 22 bp, Artificial Sequence
  chemically synthesized
tgaaggcagcgtgttgtcttac

SEQ ID NO: 1286325 - DNA, 22 bp, Artificial Sequence
  chemically synthesized
tagctttgaaggcagcgtgttg

SEQ ID NO: 1286326 - DNA, 22 bp, Artificial Sequence
  chemically synthesized
ctatagctttgaaggcagcgtg

SEQ ID NO: 1286327 - DNA, 22 bp, Artificial Sequence
  chemically synthesized
ttactatagctttgaaggcagc

SEQ ID NO: 1286328 - DNA, 22 bp, Artificial Sequence
  chemically synthesized
attactatagctttgaaggcag

SEQ ID NO: 1286329 - DNA, 22 bp, Artificial Sequence
  chemically synthesized
tattactatagctttgaaggca

SEQ ID NO: 1286330 - DNA, 22 bp, Artificial Sequence
  chemically synthesized
ttattactatagctttgaaggc

SEQ ID NO: 1286331 - DNA, 22 bp, Artificial Sequence
  chemically synthesized
ttttattactatagctttgaag

SEQ ID NO: 1286332 - DNA, 22 bp, Artificial Sequence
  chemically synthesized
cttttattactatagctttgaa

SEQ ID NO: 1286333 - DNA, 22 bp, Artificial Sequence
  chemically synthesized
gcacttcttttattactatagc

SEQ ID NO: 1286334 - DNA, 22 bp, Artificial Sequence
  chemically synthesized
ccttcaaagctatagtaataaa

SEQ ID NO: 1286335 - DNA, 22 bp, Artificial Sequence
  chemically synthesized
caaagctatagtaataaaagaa

SEQ ID NO: 1286336 - DNA, 22 bp, Artificial Sequence
  chemically synthesized
aaagctatagtaataaaagaag

SEQ ID NO: 1286337 - DNA, 22 bp, Artificial Sequence
  chemically synthesized
tagtaataaaagaagtgctagt

SEQ ID NO: 1286338 - DNA, 22 bp, Artificial Sequence
  chemically synthesized
caggtacatgaggaaatgtact

SEQ ID NO: 1286339 - DNA, 22 bp, Artificial Sequence
  chemically synthesized
ccaggtacatgaggaaatgtac

SEQ ID NO: 1286340 - DNA, 22 bp, Artificial Sequence
  chemically synthesized
atttccaggtacatgaggaaat

SEQ ID NO: 1286341 - DNA, 22 bp, Artificial Sequence
  chemically synthesized
gtacatttcctcatgtacctgg

SEQ ID NO: 1286342 - DNA, 22 bp, Artificial Sequence
  chemically synthesized
ggccactcatttccaggtacat

SEQ ID NO: 1286343 - DNA, 22 bp, Artificial Sequence
  chemically synthesized
cctcatgtacctggaaatgagt

SEQ ID NO: 1286344 - DNA, 22 bp, Artificial Sequence
  chemically synthesized
ctcatgtacctggaaatgagtg

SEQ ID NO: 1286345 - DNA, 22 bp, Artificial Sequence
  chemically synthesized
atgtacctggaaatgagtggcc

SEQ ID NO: 1286346 - DNA, 22 bp, Artificial Sequence
  chemically synthesized
gtgcaagcaaatctgggccact

SEQ ID NO: 1286347 - DNA, 22 bp, Artificial Sequence
  chemically synthesized
agtgcaagcaaatctgggccac

SEQ ID NO: 1286348 - DNA, 22 bp, Artificial Sequence
  chemically synthesized
tagtgcaagcaaatctgggcca

SEQ ID NO: 1286349 - DNA, 22 bp, Artificial Sequence
  chemically synthesized
gaaatgagtggcccagatttgc

SEQ ID NO: 1286350 - DNA, 22 bp, Artificial Sequence
  chemically synthesized
ggcatgtagactttagtgcaag

SEQ ID NO: 1286351 - DNA, 22 bp, Artificial Sequence
  chemically synthesized
aaattaggcatgtagactttag

SEQ ID NO: 1286352 - DNA, 22 bp, Artificial Sequence
  chemically synthesized
gcttgcactaaagtctacatgc

SEQ ID NO: 1286353 - DNA, 22 bp, Artificial Sequence
  chemically synthesized
cttgcactaaagtctacatgcc

SEQ ID NO: 1286354 - DNA, 22 bp, Artificial Sequence
  chemically synthesized
gcactaaagtctacatgcctaa

SEQ ID NO: 1286355 - DNA, 22 bp, Artificial Sequence
  chemically synthesized
cactaaagtctacatgcctaat

SEQ ID NO: 1286356 - DNA, 22 bp, Artificial Sequence
  chemically synthesized
aagtctacatgcctaattttaa

SEQ ID NO: 1286357 - DNA, 22 bp, Artificial Sequence
  chemically synthesized
tacaatcaaaatgattaaaatt

SEQ ID NO: 1286358 - DNA, 22 bp, Artificial Sequence
  chemically synthesized
attatacaatcaaaatgattaa

SEQ ID NO: 1286359 - DNA, 22 bp, Artificial Sequence
  chemically synthesized
catgcctaattttaatcatttt

SEQ ID NO: 1286360 - DNA, 22 bp, Artificial Sequence
  chemically synthesized
attttaatcattttgattgtat

SEQ ID NO: 1286361 - DNA, 22 bp, Artificial Sequence
  chemically synthesized
ggggaagttgattatacaatca

SEQ ID NO: 1286362 - DNA, 22 bp, Artificial Sequence
  chemically synthesized
taatcattttgattgtataatc

SEQ ID NO: 1286363 - DNA, 22 bp, Artificial Sequence
  chemically synthesized
aatcattttgattgtataatca

SEQ ID NO: 1286364 - DNA, 22 bp, Artificial Sequence
  chemically synthesized
atcattttgattgtataatcaa

SEQ ID NO: 1286365 - DNA, 22 bp, Artificial Sequence
  chemically synthesized
gaaatgactgggggaagttgat

SEQ ID NO: 1286366 - DNA, 22 bp, Artificial Sequence
  chemically synthesized
agaaatgactgggggaagttga

SEQ ID NO: 1286367 - DNA, 22 bp, Artificial Sequence
  chemically synthesized
tgattgtataatcaacttcccc

SEQ ID NO: 1286368 - DNA, 22 bp, Artificial Sequence
  chemically synthesized
tagaaatgactgggggaagttg

SEQ ID NO: 1286369 - DNA, 22 bp, Artificial Sequence
  chemically synthesized
gattgtataatcaacttccccc

SEQ ID NO: 1286370 - DNA, 22 bp, Artificial Sequence
  chemically synthesized
attgtataatcaacttccccca

SEQ ID NO: 1286371 - DNA, 22 bp, Artificial Sequence
  chemically synthesized
tctttagaaatgactgggggaa

SEQ ID NO: 1286372 - DNA, 22 bp, Artificial Sequence
  chemically synthesized
atctttagaaatgactggggga

SEQ ID NO: 1286373 - DNA, 22 bp, Artificial Sequence
  chemically synthesized
tataatcaacttcccccagtca

SEQ ID NO: 1286374 - DNA, 22 bp, Artificial Sequence
  chemically synthesized
atttatctttagaaatgactgg

SEQ ID NO: 1286375 - DNA, 22 bp, Artificial Sequence
  chemically synthesized
aatttatctttagaaatgactg

SEQ ID NO: 1286376 - DNA, 22 bp, Artificial Sequence
  chemically synthesized
cccccagtcatttctaaagata

SEQ ID NO: 1286377 - DNA, 22 bp, Artificial Sequence
  chemically synthesized
ccccagtcatttctaaagataa

SEQ ID NO: 1286378 - DNA, 22 bp, Artificial Sequence
  chemically synthesized
atgaaagcatgcatcttaattt

SEQ ID NO: 1286379 - DNA, 22 bp, Artificial Sequence
  chemically synthesized
aatgaaagcatgcatcttaatt

SEQ ID NO: 1286380 - DNA, 22 bp, Artificial Sequence
  chemically synthesized
ttaatgaaagcatgcatcttaa

SEQ ID NO: 1286381 - DNA, 22 bp, Artificial Sequence
  chemically synthesized
ctaaagataaattaagatgcat

SEQ ID NO: 1286382 - DNA, 22 bp, Artificial Sequence
  chemically synthesized
taaagataaattaagatgcatg

SEQ ID NO: 1286383 - DNA, 22 bp, Artificial Sequence
  chemically synthesized
ttcttaatgaaagcatgcatct

SEQ ID NO: 1286384 - DNA, 22 bp, Artificial Sequence
  chemically synthesized
aagataaattaagatgcatgct

SEQ ID NO: 1286385 - DNA, 22 bp, Artificial Sequence
  chemically synthesized
attcttaatgaaagcatgcatc

SEQ ID NO: 1286386 - DNA, 22 bp, Artificial Sequence
  chemically synthesized
tattcttaatgaaagcatgcat

SEQ ID NO: 1286387 - DNA, 22 bp, Artificial Sequence
  chemically synthesized
agatgcatgctttcattaagaa

SEQ ID NO: 1286388 - DNA, 22 bp, Artificial Sequence
  chemically synthesized
tcattaagaataaaacaccctg

SEQ ID NO: 1286389 - DNA, 22 bp, Artificial Sequence
  chemically synthesized
cattaagaataaaacaccctga

SEQ ID NO: 1286390 - DNA, 22 bp, Artificial Sequence
  chemically synthesized
attaagaataaaacaccctgat

SEQ ID NO: 1286391 - DNA, 22 bp, Artificial Sequence
  chemically synthesized
gaaatatgaagaaatcagggtg

SEQ ID NO: 1286392 - DNA, 22 bp, Artificial Sequence
  chemically synthesized
agaaatatgaagaaatcagggt

SEQ ID NO: 1286393 - DNA, 22 bp, Artificial Sequence
  chemically synthesized
agaataaaacaccctgatttct

SEQ ID NO: 1286394 - DNA, 22 bp, Artificial Sequence
  chemically synthesized
tttagaaatatgaagaaatcag

SEQ ID NO: 1286395 - DNA, 22 bp, Artificial Sequence
  chemically synthesized
gaaaaggcaagttatttagaaa

SEQ ID NO: 1286396 - DNA, 22 bp, Artificial Sequence
  chemically synthesized
atttcttcatatttctaaataa

SEQ ID NO: 1286397 - DNA, 22 bp, Artificial Sequence
  chemically synthesized
cttcatatttctaaataacttg

SEQ ID NO: 1286398 - DNA, 22 bp, Artificial Sequence
  chemically synthesized
ttcatatttctaaataacttgc

SEQ ID NO: 1286399 - DNA, 22 bp, Artificial Sequence
  chemically synthesized
catatttctaaataacttgcct

SEQ ID NO: 1286400 - DNA, 22 bp, Artificial Sequence
  chemically synthesized
atatttctaaataacttgcctt

SEQ ID NO: 1286401 - DNA, 22 bp, Artificial Sequence
  chemically synthesized
agaaaacctggaaaaggcaagt

SEQ ID NO: 1286402 - DNA, 22 bp, Artificial Sequence
  chemically synthesized
cctcagaaaacctggaaaaggc

SEQ ID NO: 1286403 - DNA, 22 bp, Artificial Sequence
  chemically synthesized
ctaaataacttgccttttccag

SEQ ID NO: 1286404 - DNA, 22 bp, Artificial Sequence
  chemically synthesized
acctcagaaaacctggaaaagg

SEQ ID NO: 1286405 - DNA, 22 bp, Artificial Sequence
  chemically synthesized
taaataacttgccttttccagg

SEQ ID NO: 1286406 - DNA, 22 bp, Artificial Sequence
  chemically synthesized
ttacctcagaaaacctggaaaa

SEQ ID NO: 1286407 - DNA, 22 bp, Artificial Sequence
  chemically synthesized
aataacttgccttttccaggtt

SEQ ID NO: 1286408 - DNA, 22 bp, Artificial Sequence
  chemically synthesized
aggaattcttacctcagaaaac

SEQ ID NO: 1286409 - DNA, 22 bp, Artificial Sequence
  chemically synthesized
gccttttccaggttttctgagg

SEQ ID NO: 1286410 - DNA, 22 bp, Artificial Sequence
  chemically synthesized
ccttttccaggttttctgaggt

SEQ ID NO: 1286411 - DNA, 22 bp, Artificial Sequence
  chemically synthesized
ttccaggttttctgaggtaaga

SEQ ID NO: 1286412 - DNA, 22 bp, Artificial Sequence
  chemically synthesized
tccaggttttctgaggtaagaa

SEQ ID NO: 1286413 - DNA, 22 bp, Artificial Sequence
  chemically synthesized
ccaggttttctgaggtaagaat

SEQ ID NO: 1286414 - DNA, 22 bp, Artificial Sequence
  chemically synthesized
caggttttctgaggtaagaatt

SEQ ID NO: 1286415 - DNA, 22 bp, Artificial Sequence
  chemically synthesized
tgagtatcattcaggaattctt

SEQ ID NO: 1286416 - DNA, 22 bp, Artificial Sequence
  chemically synthesized
gtgagtatcattcaggaattct

SEQ ID NO: 1286417 - DNA, 22 bp, Artificial Sequence
  chemically synthesized
tgtgagtatcattcaggaattc

SEQ ID NO: 1286418 - DNA, 22 bp, Artificial Sequence
  chemically synthesized
ttgtgagtatcattcaggaatt

SEQ ID NO: 1286419 - DNA, 22 bp, Artificial Sequence
  chemically synthesized
tctgaggtaagaattcctgaat

SEQ ID NO: 1286420 - DNA, 22 bp, Artificial Sequence
  chemically synthesized
ctgaggtaagaattcctgaatg

SEQ ID NO: 1286421 - DNA, 22 bp, Artificial Sequence
  chemically synthesized
tgaggtaagaattcctgaatga

SEQ ID NO: 1286422 - DNA, 22 bp, Artificial Sequence
  chemically synthesized
cttttgtgagtatcattcagga

SEQ ID NO: 1286423 - DNA, 22 bp, Artificial Sequence
  chemically synthesized
acttttgtgagtatcattcagg

SEQ ID NO: 1286424 - DNA, 22 bp, Artificial Sequence
  chemically synthesized
aggtaagaattcctgaatgata

SEQ ID NO: 1286425 - DNA, 22 bp, Artificial Sequence
  chemically synthesized
tacttttgtgagtatcattcag

SEQ ID NO: 1286426 - DNA, 22 bp, Artificial Sequence
  chemically synthesized
agtgtacattttacttttgtga

SEQ ID NO: 1286427 - DNA, 22 bp, Artificial Sequence
  chemically synthesized
ctgaatgatactcacaaaagta

SEQ ID NO: 1286428 - DNA, 22 bp, Artificial Sequence
  chemically synthesized
aatgatactcacaaaagtaaaa

SEQ ID NO: 1286429 - DNA, 22 bp, Artificial Sequence
  chemically synthesized
gattcagtgtacattttacttt

SEQ ID NO: 1286430 - DNA, 22 bp, Artificial Sequence
  chemically synthesized
ctagattcagtgtacattttac

SEQ ID NO: 1286431 - DNA, 22 bp, Artificial Sequence
  chemically synthesized
acaaaagtaaaatgtacactga

SEQ ID NO: 1286432 - DNA, 22 bp, Artificial Sequence
  chemically synthesized
aaataaatataattactagatt

SEQ ID NO: 1286433 - DNA, 22 bp, Artificial Sequence
  chemically synthesized
aatctagtaattatatttattt

SEQ ID NO: 1286434 - DNA, 22 bp, Artificial Sequence
  chemically synthesized
aagaaagaaaattaaaataaat

SEQ ID NO: 1286435 - DNA, 22 bp, Artificial Sequence
  chemically synthesized
aaagaaagaaaattaaaataaa

SEQ ID NO: 1286436 - DNA, 22 bp, Artificial Sequence
  chemically synthesized
ttaaagaaagaaaattaaaata

SEQ ID NO: 1286437 - DNA, 22 bp, Artificial Sequence
  chemically synthesized
gtaattatatttattttaattt

SEQ ID NO: 1286438 - DNA, 22 bp, Artificial Sequence
  chemically synthesized
ttcttaaagaaagaaaattaaa

SEQ ID NO: 1286439 - DNA, 22 bp, Artificial Sequence
  chemically synthesized
tatttattttaattttctttct

SEQ ID NO: 1286440 - DNA, 22 bp, Artificial Sequence
  chemically synthesized
attttaattttctttctttaag

SEQ ID NO: 1286441 - DNA, 22 bp, Artificial Sequence
  chemically synthesized
ttttaattttctttctttaaga

SEQ ID NO: 1286442 - DNA, 22 bp, Artificial Sequence
  chemically synthesized
gccaacagtctgttcttaaaga

SEQ ID NO: 1286443 - DNA, 22 bp, Artificial Sequence
  chemically synthesized
taattttctttctttaagaaca

SEQ ID NO: 1286444 - DNA, 22 bp, Artificial Sequence
  chemically synthesized
aattttctttctttaagaacag

SEQ ID NO: 1286445 - DNA, 22 bp, Artificial Sequence
  chemically synthesized
attttctttctttaagaacaga

SEQ ID NO: 1286446 - DNA, 22 bp, Artificial Sequence
  chemically synthesized
tctttctttaagaacagactgt

SEQ ID NO: 1286447 - DNA, 22 bp, Artificial Sequence
  chemically synthesized
ctttctttaagaacagactgtt

SEQ ID NO: 1286448 - DNA, 22 bp, Artificial Sequence
  chemically synthesized
ccccacctggccaacagtctgt

SEQ ID NO: 1286449 - DNA, 22 bp, Artificial Sequence
  chemically synthesized
tttctttaagaacagactgttg

SEQ ID NO: 1286450 - DNA, 22 bp, Artificial Sequence
  chemically synthesized
tctttaagaacagactgttggc

SEQ ID NO: 1286451 - DNA, 22 bp, Artificial Sequence
  chemically synthesized
ctttaagaacagactgttggcc

SEQ ID NO: 1286452 - DNA, 22 bp, Artificial Sequence
  chemically synthesized
tttaagaacagactgttggcca

SEQ ID NO: 1286453 - DNA, 22 bp, Artificial Sequence
  chemically synthesized
agattaccccacctggccaaca

SEQ ID NO: 1286454 - DNA, 22 bp, Artificial Sequence
  chemically synthesized
taagaacagactgttggccagg

SEQ ID NO: 1286455 - DNA, 22 bp, Artificial Sequence
  chemically synthesized
aagaacagactgttggccaggt

SEQ ID NO: 1286456 - DNA, 22 bp, Artificial Sequence
  chemically synthesized
agaacagactgttggccaggtg

SEQ ID NO: 1286457 - DNA, 22 bp, Artificial Sequence
  chemically synthesized
ccaaaatactgagattacccca

SEQ ID NO: 1286458 - DNA, 22 bp, Artificial Sequence
  chemically synthesized
ttggccaggtggggtaatctca

SEQ ID NO: 1286459 - DNA, 22 bp, Artificial Sequence
  chemically synthesized
gccaggtggggtaatctcagta

SEQ ID NO: 1286460 - DNA, 22 bp, Artificial Sequence
  chemically synthesized
agtattttgggaggccgatggg

SEQ ID NO: 1286461 - DNA, 22 bp, Artificial Sequence
  chemically synthesized
aggtgatccgcccccatcggcc

SEQ ID NO: 1286462 - DNA, 22 bp, Artificial Sequence
  chemically synthesized
tgggaggccgatgggggcggat

SEQ ID NO: 1286463 - DNA, 22 bp, Artificial Sequence
  chemically synthesized
gggaggccgatgggggcggatc

SEQ ID NO: 1286464 - DNA, 22 bp, Artificial Sequence
  chemically synthesized
atgacctcaggtgatccgcccc

SEQ ID NO: 1286465 - DNA, 22 bp, Artificial Sequence
  chemically synthesized
ggaggccgatgggggcggatca

SEQ ID NO: 1286466 - DNA, 22 bp, Artificial Sequence
  chemically synthesized
aactcatgacctcaggtgatcc

SEQ ID NO: 1286467 - DNA, 22 bp, Artificial Sequence
  chemically synthesized
gaactcatgacctcaggtgatc

SEQ ID NO: 1286468 - DNA, 22 bp, Artificial Sequence
  chemically synthesized
gtcttgaactcatgacctcagg

SEQ ID NO: 1286469 - DNA, 22 bp, Artificial Sequence
  chemically synthesized
accaggctggtcttgaactcat

SEQ ID NO: 1286470 - DNA, 22 bp, Artificial Sequence
  chemically synthesized
aggtcatgagttcaagaccagc

SEQ ID NO: 1286471 - DNA, 22 bp, Artificial Sequence
  chemically synthesized
accatgttgaccaggctggtct

SEQ ID NO: 1286472 - DNA, 22 bp, Artificial Sequence
  chemically synthesized
caccatgttgaccaggctggtc

SEQ ID NO: 1286473 - DNA, 22 bp, Artificial Sequence
  chemically synthesized
aagaccagcctggtcaacatgg

SEQ ID NO: 1286474 - DNA, 22 bp, Artificial Sequence
  chemically synthesized
gtagagacggggtttcaccatg

SEQ ID NO: 1286475 - DNA, 22 bp, Artificial Sequence
  chemically synthesized
agtagagacggggtttcaccat

SEQ ID NO: 1286476 - DNA, 22 bp, Artificial Sequence
  chemically synthesized
tagtagagacggggtttcacca

SEQ ID NO: 1286477 - DNA, 22 bp, Artificial Sequence
  chemically synthesized
gtcaacatggtgaaaccccgtc

SEQ ID NO: 1286478 - DNA, 22 bp, Artificial Sequence
  chemically synthesized
tattttagtagagacggggttt

SEQ ID NO: 1286479 - DNA, 22 bp, Artificial Sequence
  chemically synthesized
gtattttagtagagacggggtt

SEQ ID NO: 1286480 - DNA, 22 bp, Artificial Sequence
  chemically synthesized
tgtattttagtagagacggggt

SEQ ID NO: 1286481 - DNA, 22 bp, Artificial Sequence
  chemically synthesized
ttgtattttagtagagacgggg

SEQ ID NO: 1286482 - DNA, 22 bp, Artificial Sequence
  chemically synthesized
atttttgtattttagtagagac

SEQ ID NO: 1286483 - DNA, 22 bp, Artificial Sequence
  chemically synthesized
ccaccatgcccagctaattttt

SEQ ID NO: 1286484 - DNA, 22 bp, Artificial Sequence
  chemically synthesized
tactaaaatacaaaaattagct

SEQ ID NO: 1286485 - DNA, 22 bp, Artificial Sequence
  chemically synthesized
ctaaaatacaaaaattagctgg

SEQ ID NO: 1286486 - DNA, 22 bp, Artificial Sequence
  chemically synthesized
aaatacaaaaattagctgggca

SEQ ID NO: 1286487 - DNA, 22 bp, Artificial Sequence
  chemically synthesized
caggcacctgccaccatgccca

SEQ ID NO: 1286488 - DNA, 22 bp, Artificial Sequence
  chemically synthesized
ggattacaggcacctgccacca

SEQ ID NO: 1286489 - DNA, 22 bp, Artificial Sequence
  chemically synthesized
gctgggcatggtggcaggtgcc

SEQ ID NO: 1286490 - DNA, 22 bp, Artificial Sequence
  chemically synthesized
ggcatggtggcaggtgcctgta

SEQ ID NO: 1286491 - DNA, 22 bp, Artificial Sequence
  chemically synthesized
ccaagtagttgggattacaggc

SEQ ID NO: 1286492 - DNA, 22 bp, Artificial Sequence
  chemically synthesized
agcctcccaagtagttgggatt

SEQ ID NO: 1286493 - DNA, 22 bp, Artificial Sequence
  chemically synthesized
ctcagcctcccaagtagttggg

SEQ ID NO: 1286494 - DNA, 22 bp, Artificial Sequence
  chemically synthesized
cctcagcctcccaagtagttgg

SEQ ID NO: 1286495 - DNA, 22 bp, Artificial Sequence
  chemically synthesized
tccttcctcagcctcccaagta

SEQ ID NO: 1286496 - DNA, 22 bp, Artificial Sequence
  chemically synthesized
taatcccaactacttgggaggc

SEQ ID NO: 1286497 - DNA, 22 bp, Artificial Sequence
  chemically synthesized
aagcgattgtccttcctcagcc

SEQ ID NO: 1286498 - DNA, 22 bp, Artificial Sequence
  chemically synthesized
cttgggaggctgaggaaggaca

SEQ ID NO: 1286499 - DNA, 22 bp, Artificial Sequence
  chemically synthesized
ggttcaagcgattgtccttcct

SEQ ID NO: 1286500 - DNA, 22 bp, Artificial Sequence
  chemically synthesized
gggaggctgaggaaggacaatc

SEQ ID NO: 1286501 - DNA, 22 bp, Artificial Sequence
  chemically synthesized
ctgggttcaagcgattgtcctt

SEQ ID NO: 1286502 - DNA, 22 bp, Artificial Sequence
  chemically synthesized
ggaggctgaggaaggacaatcg

SEQ ID NO: 1286503 - DNA, 22 bp, Artificial Sequence
  chemically synthesized
cctcctgggttcaagcgattgt

SEQ ID NO: 1286504 - DNA, 22 bp, Artificial Sequence
  chemically synthesized
tgcctcctgggttcaagcgatt

SEQ ID NO: 1286505 - DNA, 22 bp, Artificial Sequence
  chemically synthesized
aggaaggacaatcgcttgaacc

SEQ ID NO: 1286506 - DNA, 22 bp, Artificial Sequence
  chemically synthesized
caacctctgcctcctgggttca

SEQ ID NO: 1286507 - DNA, 22 bp, Artificial Sequence
  chemically synthesized
actgcaacctctgcctcctggg

SEQ ID NO: 1286508 - DNA, 22 bp, Artificial Sequence
  chemically synthesized
gctcactgcaacctctgcctcc

SEQ ID NO: 1286509 - DNA, 22 bp, Artificial Sequence
  chemically synthesized
ggctcactgcaacctctgcctc

SEQ ID NO: 1286510 - DNA, 22 bp, Artificial Sequence
  chemically synthesized
gaacccaggaggcagaggttgc

SEQ ID NO: 1286511 - DNA, 22 bp, Artificial Sequence
  chemically synthesized
aacccaggaggcagaggttgca

SEQ ID NO: 1286512 - DNA, 22 bp, Artificial Sequence
  chemically synthesized
gagtgcaatggcgtggtcttgg

SEQ ID NO: 1286513 - DNA, 22 bp, Artificial Sequence
  chemically synthesized
cagtgagccaagaccacgccat

SEQ ID NO: 1286514 - DNA, 22 bp, Artificial Sequence
  chemically synthesized
cccaggctggagtgcaatggcg

SEQ ID NO: 1286515 - DNA, 22 bp, Artificial Sequence
  chemically synthesized
ttgcccaggctggagtgcaatg

SEQ ID NO: 1286516 - DNA, 22 bp, Artificial Sequence
  chemically synthesized
gttgcccaggctggagtgcaat

SEQ ID NO: 1286517 - DNA, 22 bp, Artificial Sequence
  chemically synthesized
tgttgcccaggctggagtgcaa

SEQ ID NO: 1286518 - DNA, 22 bp, Artificial Sequence
  chemically synthesized
ttgttgcccaggctggagtgca

SEQ ID NO: 1286519 - DNA, 22 bp, Artificial Sequence
  chemically synthesized
gcttttgttgcccaggctggag

SEQ ID NO: 1286520 - DNA, 22 bp, Artificial Sequence
  chemically synthesized
ggcttttgttgcccaggctgga

SEQ ID NO: 1286521 - DNA, 22 bp, Artificial Sequence
  chemically synthesized
cactccagcctgggcaacaaaa

SEQ ID NO: 1286522 - DNA, 22 bp, Artificial Sequence
  chemically synthesized
agacagagcttggcttttgttg

SEQ ID NO: 1286523 - DNA, 22 bp, Artificial Sequence
  chemically synthesized
gagacagagcttggcttttgtt

SEQ ID NO: 1286524 - DNA, 22 bp, Artificial Sequence
  chemically synthesized
tgagacagagcttggcttttgt

SEQ ID NO: 1286525 - DNA, 22 bp, Artificial Sequence
  chemically synthesized
cagcctgggcaacaaaagccaa

SEQ ID NO: 1286526 - DNA, 22 bp, Artificial Sequence
  chemically synthesized
ttgagacagagcttggcttttg

SEQ ID NO: 1286527 - DNA, 22 bp, Artificial Sequence
  chemically synthesized
tttgagacagagcttggctttt

SEQ ID NO: 1286528 - DNA, 22 bp, Artificial Sequence
  chemically synthesized
ttttgagacagagcttggcttt

SEQ ID NO: 1286529 - DNA, 22 bp, Artificial Sequence
  chemically synthesized
tttttgagacagagcttggctt

SEQ ID NO: 1286530 - DNA, 22 bp, Artificial Sequence
  chemically synthesized
ttttttgagacagagcttggct

SEQ ID NO: 1286531 - DNA, 22 bp, Artificial Sequence
  chemically synthesized
tttttttgagacagagcttggc

SEQ ID NO: 1286532 - DNA, 22 bp, Artificial Sequence
  chemically synthesized
ttttttttgagacagagcttgg

SEQ ID NO: 1286533 - DNA, 22 bp, Artificial Sequence
  chemically synthesized
ggcaacaaaagccaagctctgt

SEQ ID NO: 1286534 - DNA, 22 bp, Artificial Sequence
  chemically synthesized
tttttttttgagacagagcttg

SEQ ID NO: 1286535 - DNA, 22 bp, Artificial Sequence
  chemically synthesized
ttttttttttgagacagagctt

SEQ ID NO: 1286536 - DNA, 22 bp, Artificial Sequence
  chemically synthesized
tttttttttttgagacagagct

SEQ ID NO: 1286537 - DNA, 22 bp, Artificial Sequence
  chemically synthesized
ttttttttttttgagacagagc

SEQ ID NO: 1286538 - DNA, 22 bp, Artificial Sequence
  chemically synthesized
tttttttttttttgagacagag

SEQ ID NO: 1286539 - DNA, 22 bp, Artificial Sequence
  chemically synthesized
ttttttttttttttgagacaga

SEQ ID NO: 1286540 - DNA, 22 bp, Artificial Sequence
  chemically synthesized
tttttttttttttttgagacag

SEQ ID NO: 1286541 - DNA, 22 bp, Artificial Sequence
  chemically synthesized
ttttttttttttttttgagaca

SEQ ID NO: 1286542 - DNA, 22 bp, Artificial Sequence
  chemically synthesized
tttttttttttttttttgagac

SEQ ID NO: 1286543 - DNA, 22 bp, Artificial Sequence
  chemically synthesized
ttttttttttttttttttgaga

SEQ ID NO: 1286544 - DNA, 22 bp, Artificial Sequence
  chemically synthesized
tgtctcaaaaaaaaaaaaaaaa

SEQ ID NO: 1286545 - DNA, 22 bp, Artificial Sequence
  chemically synthesized
tctcaaaaaaaaaaaaaaaaaa

SEQ ID NO: 1286546 - DNA, 22 bp, Artificial Sequence
  chemically synthesized
aaaaaaaaaaaaaaaaaaaaac

SEQ ID NO: 1286547 - DNA, 22 bp, Artificial Sequence
  chemically synthesized
aatataaaatagacagtttttt

SEQ ID NO: 1286548 - DNA, 22 bp, Artificial Sequence
  chemically synthesized
aaattcaatataaaatagacag

SEQ ID NO: 1286549 - DNA, 22 bp, Artificial Sequence
  chemically synthesized
ctcaaattcaatataaaataga

SEQ ID NO: 1286550 - DNA, 22 bp, Artificial Sequence
  chemically synthesized
actcaaattcaatataaaatag

SEQ ID NO: 1286551 - DNA, 22 bp, Artificial Sequence
  chemically synthesized
tactcaaattcaatataaaata

SEQ ID NO: 1286552 - DNA, 22 bp, Artificial Sequence
  chemically synthesized
cattttactcaaattcaatata

SEQ ID NO: 1286553 - DNA, 22 bp, Artificial Sequence
  chemically synthesized
gcattttactcaaattcaatat

SEQ ID NO: 1286554 - DNA, 22 bp, Artificial Sequence
  chemically synthesized
tgcattttactcaaattcaata

SEQ ID NO: 1286555 - DNA, 22 bp, Artificial Sequence
  chemically synthesized
tctattttatattgaatttgag

SEQ ID NO: 1286556 - DNA, 22 bp, Artificial Sequence
  chemically synthesized
ttttatattgaatttgagtaaa

SEQ ID NO: 1286557 - DNA, 22 bp, Artificial Sequence
  chemically synthesized
catattttgcattttactcaaa

SEQ ID NO: 1286558 - DNA, 22 bp, Artificial Sequence
  chemically synthesized
tatattgaatttgagtaaaatg

SEQ ID NO: 1286559 - DNA, 22 bp, Artificial Sequence
  chemically synthesized
atattgaatttgagtaaaatgc

SEQ ID NO: 1286560 - DNA, 22 bp, Artificial Sequence
  chemically synthesized
actgcatattttgcattttact

SEQ ID NO: 1286561 - DNA, 22 bp, Artificial Sequence
  chemically synthesized
tattgaatttgagtaaaatgca

SEQ ID NO: 1286562 - DNA, 22 bp, Artificial Sequence
  chemically synthesized
aatttgagtaaaatgcaaaata

SEQ ID NO: 1286563 - DNA, 22 bp, Artificial Sequence
  chemically synthesized
gtaaaattcactgcatattttg

SEQ ID NO: 1286564 - DNA, 22 bp, Artificial Sequence
  chemically synthesized
agtaaaattcactgcatatttt

SEQ ID NO: 1286565 - DNA, 22 bp, Artificial Sequence
  chemically synthesized
gagtaaaatgcaaaatatgcag

SEQ ID NO: 1286566 - DNA, 22 bp, Artificial Sequence
  chemically synthesized
tagtaaaattcactgcatattt

SEQ ID NO: 1286567 - DNA, 22 bp, Artificial Sequence
  chemically synthesized
agtaaaatgcaaaatatgcagt

SEQ ID NO: 1286568 - DNA, 22 bp, Artificial Sequence
  chemically synthesized
attttagtaaaattcactgcat

SEQ ID NO: 1286569 - DNA, 22 bp, Artificial Sequence
  chemically synthesized
agtaaaatacattgattttagt

SEQ ID NO: 1286570 - DNA, 22 bp, Artificial Sequence
  chemically synthesized
atattcagtaaaatacattgat

SEQ ID NO: 1286571 - DNA, 22 bp, Artificial Sequence
  chemically synthesized
tactaaaatcaatgtattttac

SEQ ID NO: 1286572 - DNA, 22 bp, Artificial Sequence
  chemically synthesized
gtctaatattcagtaaaataca

SEQ ID NO: 1286573 - DNA, 22 bp, Artificial Sequence
  chemically synthesized
actaaaatcaatgtattttact

SEQ ID NO: 1286574 - DNA, 22 bp, Artificial Sequence
  chemically synthesized
ctaaaatcaatgtattttactg

SEQ ID NO: 1286575 - DNA, 22 bp, Artificial Sequence
  chemically synthesized
aaatcaatgtattttactgaat

SEQ ID NO: 1286576 - DNA, 22 bp, Artificial Sequence
  chemically synthesized
caatgcgttggtctaatattca

SEQ ID NO: 1286577 - DNA, 22 bp, Artificial Sequence
  chemically synthesized
tactgaatattagaccaacgca

SEQ ID NO: 1286578 - DNA, 22 bp, Artificial Sequence
  chemically synthesized
actgaatattagaccaacgcat

SEQ ID NO: 1286579 - DNA, 22 bp, Artificial Sequence
  chemically synthesized
ctgaatattagaccaacgcatt

SEQ ID NO: 1286580 - DNA, 22 bp, Artificial Sequence
  chemically synthesized
aatattagaccaacgcattgta

SEQ ID NO: 1286581 - DNA, 22 bp, Artificial Sequence
  chemically synthesized
gaccaacgcattgtagttgggg

SEQ ID NO: 1286582 - DNA, 22 bp, Artificial Sequence
  chemically synthesized
ccaaaggggcaatccccaacta

SEQ ID NO: 1286583 - DNA, 22 bp, Artificial Sequence
  chemically synthesized
gccaaaggggcaatccccaact

SEQ ID NO: 1286584 - DNA, 22 bp, Artificial Sequence
  chemically synthesized
tgccaaaggggcaatccccaac

SEQ ID NO: 1286585 - DNA, 22 bp, Artificial Sequence
  chemically synthesized
tagttggggattgcccctttgg

SEQ ID NO: 1286586 - DNA, 22 bp, Artificial Sequence
  chemically synthesized
aatgggagctttgccaaagggg

SEQ ID NO: 1286587 - DNA, 22 bp, Artificial Sequence
  chemically synthesized
gggattgcccctttggcaaagc

SEQ ID NO: 1286588 - DNA, 22 bp, Artificial Sequence
  chemically synthesized
ggaactaaatgggagctttgcc

SEQ ID NO: 1286589 - DNA, 22 bp, Artificial Sequence
  chemically synthesized
cccctttggcaaagctcccatt

SEQ ID NO: 1286590 - DNA, 22 bp, Artificial Sequence
  chemically synthesized
tggcaaagctcccatttagttc

SEQ ID NO: 1286591 - DNA, 22 bp, Artificial Sequence
  chemically synthesized
ggcaaagctcccatttagttcc

SEQ ID NO: 1286592 - DNA, 22 bp, Artificial Sequence
  chemically synthesized
gcaaagctcccatttagttccc

SEQ ID NO: 1286593 - DNA, 22 bp, Artificial Sequence
  chemically synthesized
taaatcagaatagttgggaact

SEQ ID NO: 1286594 - DNA, 22 bp, Artificial Sequence
  chemically synthesized
gctataaatcagaatagttggg

SEQ ID NO: 1286595 - DNA, 22 bp, Artificial Sequence
  chemically synthesized
ccatttagttcccaactattct

SEQ ID NO: 1286596 - DNA, 22 bp, Artificial Sequence
  chemically synthesized
catattagctataaatcagaat

SEQ ID NO: 1286597 - DNA, 22 bp, Artificial Sequence
  chemically synthesized
agttcccaactattctgattta

SEQ ID NO: 1286598 - DNA, 22 bp, Artificial Sequence
  chemically synthesized
gttcccaactattctgatttat

SEQ ID NO: 1286599 - DNA, 22 bp, Artificial Sequence
  chemically synthesized
tccatattagctataaatcaga

SEQ ID NO: 1286600 - DNA, 22 bp, Artificial Sequence
  chemically synthesized
ctccatattagctataaatcag

SEQ ID NO: 1286601 - DNA, 22 bp, Artificial Sequence
  chemically synthesized
tctccatattagctataaatca

SEQ ID NO: 1286602 - DNA, 22 bp, Artificial Sequence
  chemically synthesized
ttctccatattagctataaatc

SEQ ID NO: 1286603 - DNA, 22 bp, Artificial Sequence
  chemically synthesized
ccaactattctgatttatagct

SEQ ID NO: 1286604 - DNA, 22 bp, Artificial Sequence
  chemically synthesized
acttttctccatattagctata

SEQ ID NO: 1286605 - DNA, 22 bp, Artificial Sequence
  chemically synthesized
ctaacttttctccatattagct

SEQ ID NO: 1286606 - DNA, 22 bp, Artificial Sequence
  chemically synthesized
ttctgatttatagctaatatgg

SEQ ID NO: 1286607 - DNA, 22 bp, Artificial Sequence
  chemically synthesized
cctaacttttctccatattagc

SEQ ID NO: 1286608 - DNA, 22 bp, Artificial Sequence
  chemically synthesized
tgatttatagctaatatggaga

SEQ ID NO: 1286609 - DNA, 22 bp, Artificial Sequence
  chemically synthesized
atttcctaacttttctccatat

SEQ ID NO: 1286610 - DNA, 22 bp, Artificial Sequence
  chemically synthesized
atttatagctaatatggagaaa

SEQ ID NO: 1286611 - DNA, 22 bp, Artificial Sequence
  chemically synthesized
catttcctaacttttctccata

SEQ ID NO: 1286612 - DNA, 22 bp, Artificial Sequence
  chemically synthesized
ttcatttcctaacttttctcca

SEQ ID NO: 1286613 - DNA, 22 bp, Artificial Sequence
  chemically synthesized
atagctaatatggagaaaagtt

SEQ ID NO: 1286614 - DNA, 22 bp, Artificial Sequence
  chemically synthesized
tagctaatatggagaaaagtta

SEQ ID NO: 1286615 - DNA, 22 bp, Artificial Sequence
  chemically synthesized
atatggagaaaagttaggaaat

SEQ ID NO: 1286616 - DNA, 22 bp, Artificial Sequence
  chemically synthesized
tgtcagtccaaaaattcttcat

SEQ ID NO: 1286617 - DNA, 22 bp, Artificial Sequence
  chemically synthesized
taattgtgtcagtccaaaaatt

SEQ ID NO: 1286618 - DNA, 22 bp, Artificial Sequence
  chemically synthesized
ataattgtgtcagtccaaaaat

SEQ ID NO: 1286619 - DNA, 22 bp, Artificial Sequence
  chemically synthesized
ggaaatgaagaatttttggact

SEQ ID NO: 1286620 - DNA, 22 bp, Artificial Sequence
  chemically synthesized
tataattgtgtcagtccaaaaa

SEQ ID NO: 1286621 - DNA, 22 bp, Artificial Sequence
  chemically synthesized
gttttataattgtgtcagtcca

SEQ ID NO: 1286622 - DNA, 22 bp, Artificial Sequence
  chemically synthesized
ggttttataattgtgtcagtcc

SEQ ID NO: 1286623 - DNA, 22 bp, Artificial Sequence
  chemically synthesized
ttggttttataattgtgtcagt

SEQ ID NO: 1286624 - DNA, 22 bp, Artificial Sequence
  chemically synthesized
ctcttggttttataattgtgtc

SEQ ID NO: 1286625 - DNA, 22 bp, Artificial Sequence
  chemically synthesized
cctcttggttttataattgtgt

SEQ ID NO: 1286626 - DNA, 22 bp, Artificial Sequence
  chemically synthesized
tcctcttggttttataattgtg

SEQ ID NO: 1286627 - DNA, 22 bp, Artificial Sequence
  chemically synthesized
ttcctcttggttttataattgt

SEQ ID NO: 1286628 - DNA, 22 bp, Artificial Sequence
  chemically synthesized
tttcctcttggttttataattg

SEQ ID NO: 1286629 - DNA, 22 bp, Artificial Sequence
  chemically synthesized
ttggactgacacaattataaaa

SEQ ID NO: 1286630 - DNA, 22 bp, Artificial Sequence
  chemically synthesized
tggactgacacaattataaaac

SEQ ID NO: 1286631 - DNA, 22 bp, Artificial Sequence
  chemically synthesized
ggactgacacaattataaaacc

SEQ ID NO: 1286632 - DNA, 22 bp, Artificial Sequence
  chemically synthesized
gactgacacaattataaaacca

SEQ ID NO: 1286633 - DNA, 22 bp, Artificial Sequence
  chemically synthesized
taggctttttcctcttggtttt

SEQ ID NO: 1286634 - DNA, 22 bp, Artificial Sequence
  chemically synthesized
acacaattataaaaccaagagg

SEQ ID NO: 1286635 - DNA, 22 bp, Artificial Sequence
  chemically synthesized
aaaactgtaggctttttcctct

SEQ ID NO: 1286636 - DNA, 22 bp, Artificial Sequence
  chemically synthesized
aaaaactgtaggctttttcctc

SEQ ID NO: 1286637 - DNA, 22 bp, Artificial Sequence
  chemically synthesized
taaaaccaagaggaaaaagcct

SEQ ID NO: 1286638 - DNA, 22 bp, Artificial Sequence
  chemically synthesized
gtttaaaaactgtaggcttttt

SEQ ID NO: 1286639 - DNA, 22 bp, Artificial Sequence
  chemically synthesized
ggtttaaaaactgtaggctttt

SEQ ID NO: 1286640 - DNA, 22 bp, Artificial Sequence
  chemically synthesized
tggtttaaaaactgtaggcttt

SEQ ID NO: 1286641 - DNA, 22 bp, Artificial Sequence
  chemically synthesized
ttggtttaaaaactgtaggctt

SEQ ID NO: 1286642 - DNA, 22 bp, Artificial Sequence
  chemically synthesized
tttggtttaaaaactgtaggct

SEQ ID NO: 1286643 - DNA, 22 bp, Artificial Sequence
  chemically synthesized
ggttttttggtttaaaaactgt

SEQ ID NO: 1286644 - DNA, 22 bp, Artificial Sequence
  chemically synthesized
aagttaggttttttggtttaaa

SEQ ID NO: 1286645 - DNA, 22 bp, Artificial Sequence
  chemically synthesized
taaagttaggttttttggttta

SEQ ID NO: 1286646 - DNA, 22 bp, Artificial Sequence
  chemically synthesized
cagtttttaaaccaaaaaacct

SEQ ID NO: 1286647 - DNA, 22 bp, Artificial Sequence
  chemically synthesized
ttaaaccaaaaaacctaacttt

SEQ ID NO: 1286648 - DNA, 22 bp, Artificial Sequence
  chemically synthesized
taaaccaaaaaacctaacttta

SEQ ID NO: 1286649 - DNA, 22 bp, Artificial Sequence
  chemically synthesized
aaaccaaaaaacctaactttag

SEQ ID NO: 1286650 - DNA, 22 bp, Artificial Sequence
  chemically synthesized
aaccaaaaaacctaactttaga

SEQ ID NO: 1286651 - DNA, 22 bp, Artificial Sequence
  chemically synthesized
acaaatccgggttctaaagtta

SEQ ID NO: 1286652 - DNA, 22 bp, Artificial Sequence
  chemically synthesized
ctcacaaatccgggttctaaag

SEQ ID NO: 1286653 - DNA, 22 bp, Artificial Sequence
  chemically synthesized
actcacaaatccgggttctaaa

SEQ ID NO: 1286654 - DNA, 22 bp, Artificial Sequence
  chemically synthesized
cttactcacaaatccgggttct

SEQ ID NO: 1286655 - DNA, 22 bp, Artificial Sequence
  chemically synthesized
aaactacttactcacaaatccg

SEQ ID NO: 1286656 - DNA, 22 bp, Artificial Sequence
  chemically synthesized
actttagaacccggatttgtga

SEQ ID NO: 1286657 - DNA, 22 bp, Artificial Sequence
  chemically synthesized
ctcaaactacttactcacaaat

SEQ ID NO: 1286658 - DNA, 22 bp, Artificial Sequence
  chemically synthesized
gctcaaactacttactcacaaa

SEQ ID NO: 1286659 - DNA, 22 bp, Artificial Sequence
  chemically synthesized
tagaacccggatttgtgagtaa

SEQ ID NO: 1286660 - DNA, 22 bp, Artificial Sequence
  chemically synthesized
agaacccggatttgtgagtaag

SEQ ID NO: 1286661 - DNA, 22 bp, Artificial Sequence
  chemically synthesized
gaacccggatttgtgagtaagt

SEQ ID NO: 1286662 - DNA, 22 bp, Artificial Sequence
  chemically synthesized
aatgacttgctcaaactactta

SEQ ID NO: 1286663 - DNA, 22 bp, Artificial Sequence
  chemically synthesized
tctaaatgacttgctcaaacta

SEQ ID NO: 1286664 - DNA, 22 bp, Artificial Sequence
  chemically synthesized
gtctaaatgacttgctcaaact

SEQ ID NO: 1286665 - DNA, 22 bp, Artificial Sequence
  chemically synthesized
gtgagtaagtagtttgagcaag

SEQ ID NO: 1286666 - DNA, 22 bp, Artificial Sequence
  chemically synthesized
tgagtaagtagtttgagcaagt

SEQ ID NO: 1286667 - DNA, 22 bp, Artificial Sequence
  chemically synthesized
aagagcatttgtctaaatgact

SEQ ID NO: 1286668 - DNA, 22 bp, Artificial Sequence
  chemically synthesized
gaagagcatttgtctaaatgac

SEQ ID NO: 1286669 - DNA, 22 bp, Artificial Sequence
  chemically synthesized
gagcaagtcatttagacaaatg

SEQ ID NO: 1286670 - DNA, 22 bp, Artificial Sequence
  chemically synthesized
tagcttgaagagcatttgtcta

SEQ ID NO: 1286671 - DNA, 22 bp, Artificial Sequence
  chemically synthesized
agcaagtcatttagacaaatgc

SEQ ID NO: 1286672 - DNA, 22 bp, Artificial Sequence
  chemically synthesized
acctatagcttgaagagcattt

SEQ ID NO: 1286673 - DNA, 22 bp, Artificial Sequence
  chemically synthesized
gacctatagcttgaagagcatt

SEQ ID NO: 1286674 - DNA, 22 bp, Artificial Sequence
  chemically synthesized
agacaaatgctcttcaagctat

SEQ ID NO: 1286675 - DNA, 22 bp, Artificial Sequence
  chemically synthesized
gacaaatgctcttcaagctata

SEQ ID NO: 1286676 - DNA, 22 bp, Artificial Sequence
  chemically synthesized
acaaatgtcttgacctatagct

SEQ ID NO: 1286677 - DNA, 22 bp, Artificial Sequence
  chemically synthesized
ttcaagctataggtcaagacat

SEQ ID NO: 1286678 - DNA, 22 bp, Artificial Sequence
  chemically synthesized
tacagctcacaaatgtcttgac

SEQ ID NO: 1286679 - DNA, 22 bp, Artificial Sequence
  chemically synthesized
caagctataggtcaagacattt

SEQ ID NO: 1286680 - DNA, 22 bp, Artificial Sequence
  chemically synthesized
aagctataggtcaagacatttg

SEQ ID NO: 1286681 - DNA, 22 bp, Artificial Sequence
  chemically synthesized
taggtcaagacatttgtgagct

SEQ ID NO: 1286682 - DNA, 22 bp, Artificial Sequence
  chemically synthesized
tgacacataaacgggttgtaca

SEQ ID NO: 1286683 - DNA, 22 bp, Artificial Sequence
  chemically synthesized
gtgagctgtacaacccgtttat

SEQ ID NO: 1286684 - DNA, 22 bp, Artificial Sequence
  chemically synthesized
tgagctgtacaacccgtttatg

SEQ ID NO: 1286685 - DNA, 22 bp, Artificial Sequence
  chemically synthesized
atggcagttatgacacataaac

SEQ ID NO: 1286686 - DNA, 22 bp, Artificial Sequence
  chemically synthesized
tacaacccgtttatgtgtcata

SEQ ID NO: 1286687 - DNA, 22 bp, Artificial Sequence
  chemically synthesized
cattaatggcagttatgacaca

SEQ ID NO: 1286688 - DNA, 22 bp, Artificial Sequence
  chemically synthesized
acattaatggcagttatgacac

SEQ ID NO: 1286689 - DNA, 22 bp, Artificial Sequence
  chemically synthesized
tacattaatggcagttatgaca

SEQ ID NO: 1286690 - DNA, 22 bp, Artificial Sequence
  chemically synthesized
ttacattaatggcagttatgac

SEQ ID NO: 1286691 - DNA, 22 bp, Artificial Sequence
  chemically synthesized
tttacattaatggcagttatga

SEQ ID NO: 1286692 - DNA, 22 bp, Artificial Sequence
  chemically synthesized
attttttacattaatggcagtt

SEQ ID NO: 1286693 - DNA, 22 bp, Artificial Sequence
  chemically synthesized
gattttttacattaatggcagt

SEQ ID NO: 1286694 - DNA, 22 bp, Artificial Sequence
  chemically synthesized
atgtgtcataactgccattaat

SEQ ID NO: 1286695 - DNA, 22 bp, Artificial Sequence
  chemically synthesized
tgtgtcataactgccattaatg

SEQ ID NO: 1286696 - DNA, 22 bp, Artificial Sequence
  chemically synthesized
tttgattttttacattaatggc

SEQ ID NO: 1286697 - DNA, 22 bp, Artificial Sequence
  chemically synthesized
tatttgattttttacattaatg

SEQ ID NO: 1286698 - DNA, 22 bp, Artificial Sequence
  chemically synthesized
ctatttgattttttacattaat

SEQ ID NO: 1286699 - DNA, 22 bp, Artificial Sequence
  chemically synthesized
ccattaatgtaaaaaatcaaat

SEQ ID NO: 1286700 - DNA, 22 bp, Artificial Sequence
  chemically synthesized
atgtaaaaaatcaaatagaagg

SEQ ID NO: 1286701 - DNA, 22 bp, Artificial Sequence
  chemically synthesized
caggcatgagcgaccgcaccag

SEQ ID NO: 1286702 - DNA, 22 bp, Artificial Sequence
  chemically synthesized
ggattacaggcatgagcgaccg

SEQ ID NO: 1286703 - DNA, 22 bp, Artificial Sequence
  chemically synthesized
gtgcggtcgctcatgcctgtaa

SEQ ID NO: 1286704 - DNA, 22 bp, Artificial Sequence
  chemically synthesized
ccaaagtgctaggattacaggc

SEQ ID NO: 1286705 - DNA, 22 bp, Artificial Sequence
  chemically synthesized
agcctcccaaagtgctaggatt

SEQ ID NO: 1286706 - DNA, 22 bp, Artificial Sequence
  chemically synthesized
atgcctgtaatcctagcacttt

SEQ ID NO: 1286707 - DNA, 22 bp, Artificial Sequence
  chemically synthesized
taatcctagcactttgggaggc

SEQ ID NO: 1286708 - DNA, 22 bp, Artificial Sequence
  chemically synthesized
gcactttgggaggctgaggcgg

SEQ ID NO: 1286709 - DNA, 22 bp, Artificial Sequence
  chemically synthesized
aggtcaggcagtccgcccgcct

SEQ ID NO: 1286710 - DNA, 22 bp, Artificial Sequence
  chemically synthesized
tgggaggctgaggcgggcggac

SEQ ID NO: 1286711 - DNA, 22 bp, Artificial Sequence
  chemically synthesized
gggaggctgaggcgggcggact

SEQ ID NO: 1286712 - DNA, 22 bp, Artificial Sequence
  chemically synthesized
ctgaggtcaggcagtccgcccg

SEQ ID NO: 1286713 - DNA, 22 bp, Artificial Sequence
  chemically synthesized
ggaggctgaggcgggcggactg

SEQ ID NO: 1286714 - DNA, 22 bp, Artificial Sequence
  chemically synthesized
aactcctgaggtcaggcagtcc

SEQ ID NO: 1286715 - DNA, 22 bp, Artificial Sequence
  chemically synthesized
gaactcctgaggtcaggcagtc

SEQ ID NO: 1286716 - DNA, 22 bp, Artificial Sequence
  chemically synthesized
aggcgggcggactgcctgacct

SEQ ID NO: 1286717 - DNA, 22 bp, Artificial Sequence
  chemically synthesized
gtcttgaactcctgaggtcagg

SEQ ID NO: 1286718 - DNA, 22 bp, Artificial Sequence
  chemically synthesized
cccaggctggtcttgaactcct

SEQ ID NO: 1286719 - DNA, 22 bp, Artificial Sequence
  chemically synthesized
cctgacctcaggagttcaagac

SEQ ID NO: 1286720 - DNA, 22 bp, Artificial Sequence
  chemically synthesized
acctcaggagttcaagaccagc

SEQ ID NO: 1286721 - DNA, 22 bp, Artificial Sequence
  chemically synthesized
accgtgttgcccaggctggtct

SEQ ID NO: 1286722 - DNA, 22 bp, Artificial Sequence
  chemically synthesized
caccgtgttgcccaggctggtc

SEQ ID NO: 1286723 - DNA, 22 bp, Artificial Sequence
  chemically synthesized
aggagttcaagaccagcctggg

SEQ ID NO: 1286724 - DNA, 22 bp, Artificial Sequence
  chemically synthesized
aagaccagcctgggcaacacgg

SEQ ID NO: 1286725 - DNA, 22 bp, Artificial Sequence
  chemically synthesized
gtagagacggggtttcaccgtg

SEQ ID NO: 1286726 - DNA, 22 bp, Artificial Sequence
  chemically synthesized
agtagagacggggtttcaccgt

SEQ ID NO: 1286727 - DNA, 22 bp, Artificial Sequence
  chemically synthesized
tagtagagacggggtttcaccg

SEQ ID NO: 1286728 - DNA, 22 bp, Artificial Sequence
  chemically synthesized
ggcaacacggtgaaaccccgtc

SEQ ID NO: 1286729 - DNA, 22 bp, Artificial Sequence
  chemically synthesized
tattttagtagagacggggttt

SEQ ID NO: 1286730 - DNA, 22 bp, Artificial Sequence
  chemically synthesized
ttgtattttagtagagacgggg

SEQ ID NO: 1286731 - DNA, 22 bp, Artificial Sequence
  chemically synthesized
attattgtattttagtagagac

SEQ ID NO: 1286732 - DNA, 22 bp, Artificial Sequence
  chemically synthesized
gctaattattgtattttagtag

SEQ ID NO: 1286733 - DNA, 22 bp, Artificial Sequence
  chemically synthesized
tactaaaatacaataattagcc

SEQ ID NO: 1286734 - DNA, 22 bp, Artificial Sequence
  chemically synthesized
ctaaaatacaataattagccag

SEQ ID NO: 1286735 - DNA, 22 bp, Artificial Sequence
  chemically synthesized
aaatacaataattagccaggca

SEQ ID NO: 1286736 - DNA, 22 bp, Artificial Sequence
  chemically synthesized
caggcacacaccaccatgcctg

SEQ ID NO: 1286737 - DNA, 22 bp, Artificial Sequence
  chemically synthesized
ggactacaggcacacaccacca

SEQ ID NO: 1286738 - DNA, 22 bp, Artificial Sequence
  chemically synthesized
gccaggcatggtggtgtgtgcc

SEQ ID NO: 1286739 - DNA, 22 bp, Artificial Sequence
  chemically synthesized
ccaagtagctgggactacaggc

SEQ ID NO: 1286740 - DNA, 22 bp, Artificial Sequence
  chemically synthesized
ccacagcctcccaagtagctgg

SEQ ID NO: 1286741 - DNA, 22 bp, Artificial Sequence
  chemically synthesized
ctgccacagcctcccaagtagc

SEQ ID NO: 1286742 - DNA, 22 bp, Artificial Sequence
  chemically synthesized
tcctgccacagcctcccaagta

SEQ ID NO: 1286743 - DNA, 22 bp, Artificial Sequence
  chemically synthesized
tagtcccagctacttgggaggc

SEQ ID NO: 1286744 - DNA, 22 bp, Artificial Sequence
  chemically synthesized
aagcaattctcctgccacagcc

SEQ ID NO: 1286745 - DNA, 22 bp, Artificial Sequence
  chemically synthesized
cttgggaggctgtggcaggaga

SEQ ID NO: 1286746 - DNA, 22 bp, Artificial Sequence
  chemically synthesized
ggttcaagcaattctcctgcca

SEQ ID NO: 1286747 - DNA, 22 bp, Artificial Sequence
  chemically synthesized
gggaggctgtggcaggagaatt

SEQ ID NO: 1286748 - DNA, 22 bp, Artificial Sequence
  chemically synthesized
ctgggttcaagcaattctcctg

SEQ ID NO: 1286749 - DNA, 22 bp, Artificial Sequence
  chemically synthesized
ggaggctgtggcaggagaattg

SEQ ID NO: 1286750 - DNA, 22 bp, Artificial Sequence
  chemically synthesized
cctcctgggttcaagcaattct

SEQ ID NO: 1286751 - DNA, 22 bp, Artificial Sequence
  chemically synthesized
tgcctcctgggttcaagcaatt

SEQ ID NO: 1286752 - DNA, 22 bp, Artificial Sequence
  chemically synthesized
tggcaggagaattgcttgaacc

SEQ ID NO: 1286753 - DNA, 22 bp, Artificial Sequence
  chemically synthesized
caacctctgcctcctgggttca

SEQ ID NO: 1286754 - DNA, 22 bp, Artificial Sequence
  chemically synthesized
actgcaacctctgcctcctggg

SEQ ID NO: 1286755 - DNA, 22 bp, Artificial Sequence
  chemically synthesized
cttgaacccaggaggcagaggt

SEQ ID NO: 1286756 - DNA, 22 bp, Artificial Sequence
  chemically synthesized
gaacccaggaggcagaggttgc

SEQ ID NO: 1286757 - DNA, 22 bp, Artificial Sequence
  chemically synthesized
aacccaggaggcagaggttgca

SEQ ID NO: 1286758 - DNA, 22 bp, Artificial Sequence
  chemically synthesized
gagtgcagtggcatgatatcag

SEQ ID NO: 1286759 - DNA, 22 bp, Artificial Sequence
  chemically synthesized
cagtgagctgatatcatgccac

SEQ ID NO: 1286760 - DNA, 22 bp, Artificial Sequence
  chemically synthesized
aggctggagtgcagtggcatga

SEQ ID NO: 1286761 - DNA, 22 bp, Artificial Sequence
  chemically synthesized
ctcaggctggagtgcagtggca

SEQ ID NO: 1286762 - DNA, 22 bp, Artificial Sequence
  chemically synthesized
ttgctcaggctggagtgcagtg

SEQ ID NO: 1286763 - DNA, 22 bp, Artificial Sequence
  chemically synthesized
tgttgctcaggctggagtgcag

SEQ ID NO: 1286764 - DNA, 22 bp, Artificial Sequence
  chemically synthesized
atatcatgccactgcactccag

SEQ ID NO: 1286765 - DNA, 22 bp, Artificial Sequence
  chemically synthesized
agatggagtctctgttgctcag

SEQ ID NO: 1286766 - DNA, 22 bp, Artificial Sequence
  chemically synthesized
gagatggagtctctgttgctca

SEQ ID NO: 1286767 - DNA, 22 bp, Artificial Sequence
  chemically synthesized
tgagatggagtctctgttgctc

SEQ ID NO: 1286768 - DNA, 22 bp, Artificial Sequence
  chemically synthesized
cactccagcctgagcaacagag

SEQ ID NO: 1286769 - DNA, 22 bp, Artificial Sequence
  chemically synthesized
ttgagatggagtctctgttgct

SEQ ID NO: 1286770 - DNA, 22 bp, Artificial Sequence
  chemically synthesized
tttgagatggagtctctgttgc

SEQ ID NO: 1286771 - DNA, 22 bp, Artificial Sequence
  chemically synthesized
ttttgagatggagtctctgttg

SEQ ID NO: 1286772 - DNA, 22 bp, Artificial Sequence
  chemically synthesized
tttttgagatggagtctctgtt

SEQ ID NO: 1286773 - DNA, 22 bp, Artificial Sequence
  chemically synthesized
cagcctgagcaacagagactcc

SEQ ID NO: 1286774 - DNA, 22 bp, Artificial Sequence
  chemically synthesized
ctttttttgagatggagtctct

SEQ ID NO: 1286775 - DNA, 22 bp, Artificial Sequence
  chemically synthesized
cctttttttgagatggagtctc

SEQ ID NO: 1286776 - DNA, 22 bp, Artificial Sequence
  chemically synthesized
tcctttttttgagatggagtct

SEQ ID NO: 1286777 - DNA, 22 bp, Artificial Sequence
  chemically synthesized
ttcctttttttgagatggagtc

SEQ ID NO: 1286778 - DNA, 22 bp, Artificial Sequence
  chemically synthesized
tttcctttttttgagatggagt

SEQ ID NO: 1286779 - DNA, 22 bp, Artificial Sequence
  chemically synthesized
ttttcctttttttgagatggag

SEQ ID NO: 1286780 - DNA, 22 bp, Artificial Sequence
  chemically synthesized
agcaacagagactccatctcaa

SEQ ID NO: 1286781 - DNA, 22 bp, Artificial Sequence
  chemically synthesized
tttttcctttttttgagatgga

SEQ ID NO: 1286782 - DNA, 22 bp, Artificial Sequence
  chemically synthesized
ttttttcctttttttgagatgg

SEQ ID NO: 1286783 - DNA, 22 bp, Artificial Sequence
  chemically synthesized
tttttttcctttttttgagatg

SEQ ID NO: 1286784 - DNA, 22 bp, Artificial Sequence
  chemically synthesized
ttttttttcctttttttgagat

SEQ ID NO: 1286785 - DNA, 22 bp, Artificial Sequence
  chemically synthesized
tttttttttttcctttttttga

SEQ ID NO: 1286786 - DNA, 22 bp, Artificial Sequence
  chemically synthesized
gtttttttttttcctttttttg

SEQ ID NO: 1286787 - DNA, 22 bp, Artificial Sequence
  chemically synthesized
tttgtttttttttttccttttt

SEQ ID NO: 1286788 - DNA, 22 bp, Artificial Sequence
  chemically synthesized
tatttgtttttttttttccttt

SEQ ID NO: 1286789 - DNA, 22 bp, Artificial Sequence
  chemically synthesized
ctatttgtttttttttttcctt

SEQ ID NO: 1286790 - DNA, 22 bp, Artificial Sequence
  chemically synthesized
catctcaaaaaaaggaaaaaaa

SEQ ID NO: 1286791 - DNA, 22 bp, Artificial Sequence
  chemically synthesized
tctatttgtttttttttttcct

SEQ ID NO: 1286792 - DNA, 22 bp, Artificial Sequence
  chemically synthesized
ttctatttgtttttttttttcc

SEQ ID NO: 1286793 - DNA, 22 bp, Artificial Sequence
  chemically synthesized
ttttctatttgttttttttttt

SEQ ID NO: 1286794 - DNA, 22 bp, Artificial Sequence
  chemically synthesized
aaaaaaaggaaaaaaaaaaaca

SEQ ID NO: 1286795 - DNA, 22 bp, Artificial Sequence
  chemically synthesized
attcttttctatttgttttttt

SEQ ID NO: 1286796 - DNA, 22 bp, Artificial Sequence
  chemically synthesized
cattcttttctatttgtttttt

SEQ ID NO: 1286797 - DNA, 22 bp, Artificial Sequence
  chemically synthesized
tttcattcttttctatttgttt

SEQ ID NO: 1286798 - DNA, 22 bp, Artificial Sequence
  chemically synthesized
atttcattcttttctatttgtt

SEQ ID NO: 1286799 - DNA, 22 bp, Artificial Sequence
  chemically synthesized
tatttcattcttttctatttgt

SEQ ID NO: 1286800 - DNA, 22 bp, Artificial Sequence
  chemically synthesized
ataattttatttcattcttttc

SEQ ID NO: 1286801 - DNA, 22 bp, Artificial Sequence
  chemically synthesized
aataattttatttcattctttt

SEQ ID NO: 1286802 - DNA, 22 bp, Artificial Sequence
  chemically synthesized
taataattttatttcattcttt

SEQ ID NO: 1286803 - DNA, 22 bp, Artificial Sequence
  chemically synthesized
gtatatgtagccacactttaat

SEQ ID NO: 1286804 - DNA, 22 bp, Artificial Sequence
  chemically synthesized
agtatatgtagccacactttaa

SEQ ID NO: 1286805 - DNA, 22 bp, Artificial Sequence
  chemically synthesized
tagtatatgtagccacacttta

SEQ ID NO: 1286806 - DNA, 22 bp, Artificial Sequence
  chemically synthesized
ttagtatatgtagccacacttt

SEQ ID NO: 1286807 - DNA, 22 bp, Artificial Sequence
  chemically synthesized
ttaaagtgtggctacatatact

SEQ ID NO: 1286808 - DNA, 22 bp, Artificial Sequence
  chemically synthesized
aagtgtggctacatatactaaa

SEQ ID NO: 1286809 - DNA, 22 bp, Artificial Sequence
  chemically synthesized
taaaaggtggcatttttagtat

SEQ ID NO: 1286810 - DNA, 22 bp, Artificial Sequence
  chemically synthesized
ataaaaggtggcatttttagta

SEQ ID NO: 1286811 - DNA, 22 bp, Artificial Sequence
  chemically synthesized
tataaaaggtggcatttttagt

SEQ ID NO: 1286812 - DNA, 22 bp, Artificial Sequence
  chemically synthesized
catatactaaaaatgccacctt

SEQ ID NO: 1286813 - DNA, 22 bp, Artificial Sequence
  chemically synthesized
aaaatgccaccttttataaaac

SEQ ID NO: 1286814 - DNA, 22 bp, Artificial Sequence
  chemically synthesized
ttataaaacttttgttttattt

SEQ ID NO: 1286815 - DNA, 22 bp, Artificial Sequence
  chemically synthesized
tataaaacttttgttttatttc

SEQ ID NO: 1286816 - DNA, 22 bp, Artificial Sequence
  chemically synthesized
ataaaacttttgttttatttct

SEQ ID NO: 1286817 - DNA, 22 bp, Artificial Sequence
  chemically synthesized
taaaacttttgttttatttctg

SEQ ID NO: 1286818 - DNA, 22 bp, Artificial Sequence
  chemically synthesized
ttgttttatttctgcatgtgtc

SEQ ID NO: 1286819 - DNA, 22 bp, Artificial Sequence
  chemically synthesized
tgttttatttctgcatgtgtct

SEQ ID NO: 1286820 - DNA, 22 bp, Artificial Sequence
  chemically synthesized
gttttatttctgcatgtgtctg

SEQ ID NO: 1286821 - DNA, 22 bp, Artificial Sequence
  chemically synthesized
ttttatttctgcatgtgtctgt

SEQ ID NO: 1286822 - DNA, 22 bp, Artificial Sequence
  chemically synthesized
tatttctgcatgtgtctgtgtg

SEQ ID NO: 1286823 - DNA, 22 bp, Artificial Sequence
  chemically synthesized
atttctgcatgtgtctgtgtgt

SEQ ID NO: 1286824 - DNA, 22 bp, Artificial Sequence
  chemically synthesized
tttctgcatgtgtctgtgtgtt

SEQ ID NO: 1286825 - DNA, 22 bp, Artificial Sequence
  chemically synthesized
ctgcatgtgtctgtgtgttttg

SEQ ID NO: 1286826 - DNA, 22 bp, Artificial Sequence
  chemically synthesized
tgcatgtgtctgtgtgttttgg

SEQ ID NO: 1286827 - DNA, 22 bp, Artificial Sequence
  chemically synthesized
catgtgtctgtgtgttttgggg

SEQ ID NO: 1286828 - DNA, 22 bp, Artificial Sequence
  chemically synthesized
atgatccagtaccccccaaaac

SEQ ID NO: 1286829 - DNA, 22 bp, Artificial Sequence
  chemically synthesized
gatgatccagtaccccccaaaa

SEQ ID NO: 1286830 - DNA, 22 bp, Artificial Sequence
  chemically synthesized
ttgatgatccagtaccccccaa

SEQ ID NO: 1286831 - DNA, 22 bp, Artificial Sequence
  chemically synthesized
tgtgttttggggggtactggat

SEQ ID NO: 1286832 - DNA, 22 bp, Artificial Sequence
  chemically synthesized
tggggggtactggatcatcaag

SEQ ID NO: 1286833 - DNA, 22 bp, Artificial Sequence
  chemically synthesized
ggggggtactggatcatcaaga

SEQ ID NO: 1286834 - DNA, 22 bp, Artificial Sequence
  chemically synthesized
gggggtactggatcatcaagag

SEQ ID NO: 1286835 - DNA, 22 bp, Artificial Sequence
  chemically synthesized
agagaaaaagtgagcactcttg

SEQ ID NO: 1286836 - DNA, 22 bp, Artificial Sequence
  chemically synthesized
aagagaaaaagtgagcactctt

SEQ ID NO: 1286837 - DNA, 22 bp, Artificial Sequence
  chemically synthesized
gatcatcaagagtgctcacttt

SEQ ID NO: 1286838 - DNA, 22 bp, Artificial Sequence
  chemically synthesized
acaatccaatttaagagaaaaa

SEQ ID NO: 1286839 - DNA, 22 bp, Artificial Sequence
  chemically synthesized
ttcacaatccaatttaagagaa

SEQ ID NO: 1286840 - DNA, 22 bp, Artificial Sequence
  chemically synthesized
cattgttcacaatccaatttaa

SEQ ID NO: 1286841 - DNA, 22 bp, Artificial Sequence
  chemically synthesized
actttttctcttaaattggatt

SEQ ID NO: 1286842 - DNA, 22 bp, Artificial Sequence
  chemically synthesized
ccctacattgttcacaatccaa

SEQ ID NO: 1286843 - DNA, 22 bp, Artificial Sequence
  chemically synthesized
tttctcttaaattggattgtga

SEQ ID NO: 1286844 - DNA, 22 bp, Artificial Sequence
  chemically synthesized
ttctcttaaattggattgtgaa

SEQ ID NO: 1286845 - DNA, 22 bp, Artificial Sequence
  chemically synthesized
tcccctacattgttcacaatcc

SEQ ID NO: 1286846 - DNA, 22 bp, Artificial Sequence
  chemically synthesized
tctcttaaattggattgtgaac

SEQ ID NO: 1286847 - DNA, 22 bp, Artificial Sequence
  chemically synthesized
ctcccctacattgttcacaatc

SEQ ID NO: 1286848 - DNA, 22 bp, Artificial Sequence
  chemically synthesized
ctcttaaattggattgtgaaca

SEQ ID NO: 1286849 - DNA, 22 bp, Artificial Sequence
  chemically synthesized
tctcccctacattgttcacaat

SEQ ID NO: 1286850 - DNA, 22 bp, Artificial Sequence
  chemically synthesized
tcttaaattggattgtgaacaa

SEQ ID NO: 1286851 - DNA, 22 bp, Artificial Sequence
  chemically synthesized
ttctcccctacattgttcacaa

SEQ ID NO: 1286852 - DNA, 22 bp, Artificial Sequence
  chemically synthesized
tttctcccctacattgttcaca

SEQ ID NO: 1286853 - DNA, 22 bp, Artificial Sequence
  chemically synthesized
ttaaattggattgtgaacaatg

SEQ ID NO: 1286854 - DNA, 22 bp, Artificial Sequence
  chemically synthesized
aaattggattgtgaacaatgta

SEQ ID NO: 1286855 - DNA, 22 bp, Artificial Sequence
  chemically synthesized
aattggattgtgaacaatgtag

SEQ ID NO: 1286856 - DNA, 22 bp, Artificial Sequence
  chemically synthesized
gattgtgaacaatgtaggggag

SEQ ID NO: 1286857 - DNA, 22 bp, Artificial Sequence
  chemically synthesized
tgaacaatgtaggggagaaaaa

SEQ ID NO: 1286858 - DNA, 22 bp, Artificial Sequence
  chemically synthesized
tgataggcgaggaaatcaattt

SEQ ID NO: 1286859 - DNA, 22 bp, Artificial Sequence
  chemically synthesized
gtgataggcgaggaaatcaatt

SEQ ID NO: 1286860 - DNA, 22 bp, Artificial Sequence
  chemically synthesized
tgaaccttgtgataggcgagga

SEQ ID NO: 1286861 - DNA, 22 bp, Artificial Sequence
  chemically synthesized
agctatgaaccttgtgataggc

SEQ ID NO: 1286862 - DNA, 22 bp, Artificial Sequence
  chemically synthesized
atttcctcgcctatcacaaggt

SEQ ID NO: 1286863 - DNA, 22 bp, Artificial Sequence
  chemically synthesized
cctcgcctatcacaaggttcat

SEQ ID NO: 1286864 - DNA, 22 bp, Artificial Sequence
  chemically synthesized
ctcgcctatcacaaggttcata

SEQ ID NO: 1286865 - DNA, 22 bp, Artificial Sequence
  chemically synthesized
taggggtctcagctatgaacct

SEQ ID NO: 1286866 - DNA, 22 bp, Artificial Sequence
  chemically synthesized
gcctatcacaaggttcatagct

SEQ ID NO: 1286867 - DNA, 22 bp, Artificial Sequence
  chemically synthesized
ctataggggtctcagctatgaa

SEQ ID NO: 1286868 - DNA, 22 bp, Artificial Sequence
  chemically synthesized
gctataggggtctcagctatga

SEQ ID NO: 1286869 - DNA, 22 bp, Artificial Sequence
  chemically synthesized
tgctataggggtctcagctatg

SEQ ID NO: 1286870 - DNA, 22 bp, Artificial Sequence
  chemically synthesized
ttgctataggggtctcagctat

SEQ ID NO: 1286871 - DNA, 22 bp, Artificial Sequence
  chemically synthesized
tcacaaggttcatagctgagac

SEQ ID NO: 1286872 - DNA, 22 bp, Artificial Sequence
  chemically synthesized
ttttgctataggggtctcagct

SEQ ID NO: 1286873 - DNA, 22 bp, Artificial Sequence
  chemically synthesized
cttttgctataggggtctcagc

SEQ ID NO: 1286874 - DNA, 22 bp, Artificial Sequence
  chemically synthesized
tcttttgctataggggtctcag

SEQ ID NO: 1286875 - DNA, 22 bp, Artificial Sequence
  chemically synthesized
acctttcttttgctataggggt

SEQ ID NO: 1286876 - DNA, 22 bp, Artificial Sequence
  chemically synthesized
atagctgagacccctatagcaa

SEQ ID NO: 1286877 - DNA, 22 bp, Artificial Sequence
  chemically synthesized
ttaacctttcttttgctatagg

SEQ ID NO: 1286878 - DNA, 22 bp, Artificial Sequence
  chemically synthesized
gttaacctttcttttgctatag

SEQ ID NO: 1286879 - DNA, 22 bp, Artificial Sequence
  chemically synthesized
ttgttaacctttcttttgctat

SEQ ID NO: 1286880 - DNA, 22 bp, Artificial Sequence
  chemically synthesized
tcttgttaacctttcttttgct

SEQ ID NO: 1286881 - DNA, 22 bp, Artificial Sequence
  chemically synthesized
ctcttgttaacctttcttttgc

SEQ ID NO: 1286882 - DNA, 22 bp, Artificial Sequence
  chemically synthesized
agacccctatagcaaaagaaag

SEQ ID NO: 1286883 - DNA, 22 bp, Artificial Sequence
  chemically synthesized
tctcttgttaacctttcttttg

SEQ ID NO: 1286884 - DNA, 22 bp, Artificial Sequence
  chemically synthesized
ttctcttgttaacctttctttt

SEQ ID NO: 1286885 - DNA, 22 bp, Artificial Sequence
  chemically synthesized
tatgcttttctcttgttaacct

SEQ ID NO: 1286886 - DNA, 22 bp, Artificial Sequence
  chemically synthesized
tagcaaaagaaaggttaacaag

SEQ ID NO: 1286887 - DNA, 22 bp, Artificial Sequence
  chemically synthesized
gtatgcttttctcttgttaacc

SEQ ID NO: 1286888 - DNA, 22 bp, Artificial Sequence
  chemically synthesized
aatacatttgtatgcttttctc

SEQ ID NO: 1286889 - DNA, 22 bp, Artificial Sequence
  chemically synthesized
tattaaatacatttgtatgctt

SEQ ID NO: 1286890 - DNA, 22 bp, Artificial Sequence
  chemically synthesized
atattaaatacatttgtatgct

SEQ ID NO: 1286891 - DNA, 22 bp, Artificial Sequence
  chemically synthesized
acaagagaaaagcatacaaatg

SEQ ID NO: 1286892 - DNA, 22 bp, Artificial Sequence
  chemically synthesized
taaaatttatattaaatacatt

SEQ ID NO: 1286893 - DNA, 22 bp, Artificial Sequence
  chemically synthesized
gtaaaatttatattaaatacat

SEQ ID NO: 1286894 - DNA, 22 bp, Artificial Sequence
  chemically synthesized
gtatcatttgtaaaatttatat

SEQ ID NO: 1286895 - DNA, 22 bp, Artificial Sequence
  chemically synthesized
tgtcctggtatcatttgtaaaa

SEQ ID NO: 1286896 - DNA, 22 bp, Artificial Sequence
  chemically synthesized
ctgtgtcctggtatcatttgta

SEQ ID NO: 1286897 - DNA, 22 bp, Artificial Sequence
  chemically synthesized
aatataaattttacaaatgata

SEQ ID NO: 1286898 - DNA, 22 bp, Artificial Sequence
  chemically synthesized
atataaattttacaaatgatac

SEQ ID NO: 1286899 - DNA, 22 bp, Artificial Sequence
  chemically synthesized
aatgctcctgtgtcctggtatc

SEQ ID NO: 1286900 - DNA, 22 bp, Artificial Sequence
  chemically synthesized
tgaatgctcctgtgtcctggta

SEQ ID NO: 1286901 - DNA, 22 bp, Artificial Sequence
  chemically synthesized
ctgaatgctcctgtgtcctggt

SEQ ID NO: 1286902 - DNA, 22 bp, Artificial Sequence
  chemically synthesized
tacaaatgataccaggacacag

SEQ ID NO: 1286903 - DNA, 22 bp, Artificial Sequence
  chemically synthesized
acaaatgataccaggacacagg

SEQ ID NO: 1286904 - DNA, 22 bp, Artificial Sequence
  chemically synthesized
caaatgataccaggacacagga

SEQ ID NO: 1286905 - DNA, 22 bp, Artificial Sequence
  chemically synthesized
atttctgaatgctcctgtgtcc

SEQ ID NO: 1286906 - DNA, 22 bp, Artificial Sequence
  chemically synthesized
ggtattcatttctgaatgctcc

SEQ ID NO: 1286907 - DNA, 22 bp, Artificial Sequence
  chemically synthesized
aggtattcatttctgaatgctc

SEQ ID NO: 1286908 - DNA, 22 bp, Artificial Sequence
  chemically synthesized
taggtattcatttctgaatgct

SEQ ID NO: 1286909 - DNA, 22 bp, Artificial Sequence
  chemically synthesized
tttaggtattcatttctgaatg

SEQ ID NO: 1286910 - DNA, 22 bp, Artificial Sequence
  chemically synthesized
ctttaggtattcatttctgaat

SEQ ID NO: 1286911 - DNA, 22 bp, Artificial Sequence
  chemically synthesized
tctttaggtattcatttctgaa

SEQ ID NO: 1286912 - DNA, 22 bp, Artificial Sequence
  chemically synthesized
ttctttaggtattcatttctga

SEQ ID NO: 1286913 - DNA, 22 bp, Artificial Sequence
  chemically synthesized
tttctttaggtattcatttctg

SEQ ID NO: 1286914 - DNA, 22 bp, Artificial Sequence
  chemically synthesized
ccctttttctttaggtattcat

SEQ ID NO: 1286915 - DNA, 22 bp, Artificial Sequence
  chemically synthesized
agaaatgaatacctaaagaaaa

SEQ ID NO: 1286916 - DNA, 22 bp, Artificial Sequence
  chemically synthesized
gcataaaaatacacaggtctcc

SEQ ID NO: 1286917 - DNA, 22 bp, Artificial Sequence
  chemically synthesized
agcataaaaatacacaggtctc

SEQ ID NO: 1286918 - DNA, 22 bp, Artificial Sequence
  chemically synthesized
aagaaaaaggggagacctgtgt

SEQ ID NO: 1286919 - DNA, 22 bp, Artificial Sequence
  chemically synthesized
atcaaatttagcataaaaatac

SEQ ID NO: 1286920 - DNA, 22 bp, Artificial Sequence
  chemically synthesized
catcaaatttagcataaaaata

SEQ ID NO: 1286921 - DNA, 22 bp, Artificial Sequence
  chemically synthesized
ttcatcaaatttagcataaaaa

SEQ ID NO: 1286922 - DNA, 22 bp, Artificial Sequence
  chemically synthesized
tccactcttcatcaaatttagc

SEQ ID NO: 1286923 - DNA, 22 bp, Artificial Sequence
  chemically synthesized
tgtatttttatgctaaatttga

SEQ ID NO: 1286924 - DNA, 22 bp, Artificial Sequence
  chemically synthesized
ttatgctaaatttgatgaagag

SEQ ID NO: 1286925 - DNA, 22 bp, Artificial Sequence
  chemically synthesized
ccaggttgtccactcttcatca

SEQ ID NO: 1286926 - DNA, 22 bp, Artificial Sequence
  chemically synthesized
tatgctaaatttgatgaagagt

SEQ ID NO: 1286927 - DNA, 22 bp, Artificial Sequence
  chemically synthesized
atgctaaatttgatgaagagtg

SEQ ID NO: 1286928 - DNA, 22 bp, Artificial Sequence
  chemically synthesized
tgccaggttgtccactcttcat

SEQ ID NO: 1286929 - DNA, 22 bp, Artificial Sequence
  chemically synthesized
tgctaaatttgatgaagagtgg

SEQ ID NO: 1286930 - DNA, 22 bp, Artificial Sequence
  chemically synthesized
ctgccaggttgtccactcttca

SEQ ID NO: 1286931 - DNA, 22 bp, Artificial Sequence
  chemically synthesized
aatttgatgaagagtggacaac

SEQ ID NO: 1286932 - DNA, 22 bp, Artificial Sequence
  chemically synthesized
gatgaagagtggacaacctggc

SEQ ID NO: 1286933 - DNA, 22 bp, Artificial Sequence
  chemically synthesized
atgaagagtggacaacctggca

SEQ ID NO: 1286934 - DNA, 22 bp, Artificial Sequence
  chemically synthesized
caatcatacttctgccaggttg

SEQ ID NO: 1286935 - DNA, 22 bp, Artificial Sequence
  chemically synthesized
tccaatcatacttctgccaggt

SEQ ID NO: 1286936 - DNA, 22 bp, Artificial Sequence
  chemically synthesized
ttctccaatcatacttctgcca

SEQ ID NO: 1286937 - DNA, 22 bp, Artificial Sequence
  chemically synthesized
gttctccaatcatacttctgcc

SEQ ID NO: 1286938 - DNA, 22 bp, Artificial Sequence
  chemically synthesized
tgttctccaatcatacttctgc

SEQ ID NO: 1286939 - DNA, 22 bp, Artificial Sequence
  chemically synthesized
ttgttctccaatcatacttctg

SEQ ID NO: 1286940 - DNA, 22 bp, Artificial Sequence
  chemically synthesized
cacccttttgttctccaatcat

SEQ ID NO: 1286941 - DNA, 22 bp, Artificial Sequence
  chemically synthesized
gcagaagtatgattggagaaca

SEQ ID NO: 1286942 - DNA, 22 bp, Artificial Sequence
  chemically synthesized
gattacacccttttgttctcca

SEQ ID NO: 1286943 - DNA, 22 bp, Artificial Sequence
  chemically synthesized
ccattagattacacccttttgt

SEQ ID NO: 1286944 - DNA, 22 bp, Artificial Sequence
  chemically synthesized
ttaccattagattacacccttt

SEQ ID NO: 1286945 - DNA, 22 bp, Artificial Sequence
  chemically synthesized
attaccattagattacaccctt

SEQ ID NO: 1286946 - DNA, 22 bp, Artificial Sequence
  chemically synthesized
tattaccattagattacaccct

SEQ ID NO: 1286947 - DNA, 22 bp, Artificial Sequence
  chemically synthesized
gagaacaaaagggtgtaatcta

SEQ ID NO: 1286948 - DNA, 22 bp, Artificial Sequence
  chemically synthesized
ccccccaccccaactttattac

SEQ ID NO: 1286949 - DNA, 22 bp, Artificial Sequence
  chemically synthesized
cattcccccccaccccaacttt

SEQ ID NO: 1286950 - DNA, 22 bp, Artificial Sequence
  chemically synthesized
ctacattcccccccaccccaac

SEQ ID NO: 1286951 - DNA, 22 bp, Artificial Sequence
  chemically synthesized
atggtaataaagttggggtggg

SEQ ID NO: 1286952 - DNA, 22 bp, Artificial Sequence
  chemically synthesized
gctacattcccccccaccccaa

SEQ ID NO: 1286953 - DNA, 22 bp, Artificial Sequence
  chemically synthesized
tgctacattcccccccacccca

SEQ ID NO: 1286954 - DNA, 22 bp, Artificial Sequence
  chemically synthesized
aacaaacaggctttgctacatt

SEQ ID NO: 1286955 - DNA, 22 bp, Artificial Sequence
  chemically synthesized
gggtgggggggaatgtagcaaa

SEQ ID NO: 1286956 - DNA, 22 bp, Artificial Sequence
  chemically synthesized
ggacacagagaagactgaacaa

SEQ ID NO: 1286957 - DNA, 22 bp, Artificial Sequence
  chemically synthesized
tttgttcagtcttctctgtgtc

SEQ ID NO: 1286958 - DNA, 22 bp, Artificial Sequence
  chemically synthesized
gttcagtcttctctgtgtccca

SEQ ID NO: 1286959 - DNA, 22 bp, Artificial Sequence
  chemically synthesized
ttcagtcttctctgtgtcccag

SEQ ID NO: 1286960 - DNA, 22 bp, Artificial Sequence
  chemically synthesized
agtcttctctgtgtcccagtgt

SEQ ID NO: 1286961 - DNA, 22 bp, Artificial Sequence
  chemically synthesized
aaggaaaggaatgtcacactgg

SEQ ID NO: 1286962 - DNA, 22 bp, Artificial Sequence
  chemically synthesized
ctctgtgtcccagtgtgacatt

SEQ ID NO: 1286963 - DNA, 22 bp, Artificial Sequence
  chemically synthesized
tctgtgtcccagtgtgacattc

SEQ ID NO: 1286964 - DNA, 22 bp, Artificial Sequence
  chemically synthesized
tgtgtcccagtgtgacattcct

SEQ ID NO: 1286965 - DNA, 22 bp, Artificial Sequence
  chemically synthesized
tgtcccagtgtgacattccttt

SEQ ID NO: 1286966 - DNA, 22 bp, Artificial Sequence
  chemically synthesized
atgtgtcccatacctaaaggaa

SEQ ID NO: 1286967 - DNA, 22 bp, Artificial Sequence
  chemically synthesized
ctttcctttaggtatgggacac

SEQ ID NO: 1286968 - DNA, 22 bp, Artificial Sequence
  chemically synthesized
tcctttaggtatgggacacatg

SEQ ID NO: 1286969 - DNA, 22 bp, Artificial Sequence
  chemically synthesized
cctttaggtatgggacacatga

SEQ ID NO: 1286970 - DNA, 22 bp, Artificial Sequence
  chemically synthesized
ctttaggtatgggacacatgag

SEQ ID NO: 1286971 - DNA, 22 bp, Artificial Sequence
  chemically synthesized
taggtatgggacacatgagggg

SEQ ID NO: 1286972 - DNA, 22 bp, Artificial Sequence
  chemically synthesized
aggtatgggacacatgaggggt

SEQ ID NO: 1286973 - DNA, 22 bp, Artificial Sequence
  chemically synthesized
ggtatgggacacatgaggggtc

SEQ ID NO: 1286974 - DNA, 22 bp, Artificial Sequence
  chemically synthesized
aagtaggccataagacccctca

SEQ ID NO: 1286975 - DNA, 22 bp, Artificial Sequence
  chemically synthesized
tgaagtaggccataagacccct

SEQ ID NO: 1286976 - DNA, 22 bp, Artificial Sequence
  chemically synthesized
ctctgaagtaggccataagacc

SEQ ID NO: 1286977 - DNA, 22 bp, Artificial Sequence
  chemically synthesized
gctctgaagtaggccataagac

SEQ ID NO: 1286978 - DNA, 22 bp, Artificial Sequence
  chemically synthesized
gccttgctctgaagtaggccat

SEQ ID NO: 1286979 - DNA, 22 bp, Artificial Sequence
  chemically synthesized
tctggccttgctctgaagtagg

SEQ ID NO: 1286980 - DNA, 22 bp, Artificial Sequence
  chemically synthesized
atggcctacttcagagcaaggc

SEQ ID NO: 1286981 - DNA, 22 bp, Artificial Sequence
  chemically synthesized
tggcctacttcagagcaaggcc

SEQ ID NO: 1286982 - DNA, 22 bp, Artificial Sequence
  chemically synthesized
cttcagagcaaggccagataat

SEQ ID NO: 1286983 - DNA, 22 bp, Artificial Sequence
  chemically synthesized
cagagcaaggccagataattct

SEQ ID NO: 1286984 - DNA, 22 bp, Artificial Sequence
  chemically synthesized
agagcaaggccagataattctt

SEQ ID NO: 1286985 - DNA, 22 bp, Artificial Sequence
  chemically synthesized
aagcagatcagaaaagaattat

SEQ ID NO: 1286986 - DNA, 22 bp, Artificial Sequence
  chemically synthesized
tgaagcagatcagaaaagaatt

SEQ ID NO: 1286987 - DNA, 22 bp, Artificial Sequence
  chemically synthesized
ctctgaagcagatcagaaaaga

SEQ ID NO: 1286988 - DNA, 22 bp, Artificial Sequence
  chemically synthesized
cctctgaagcagatcagaaaag

SEQ ID NO: 1286989 - DNA, 22 bp, Artificial Sequence
  chemically synthesized
tcctctgaagcagatcagaaaa

SEQ ID NO: 1286990 - DNA, 22 bp, Artificial Sequence
  chemically synthesized
ccaccattttcctctgaagcag

SEQ ID NO: 1286991 - DNA, 22 bp, Artificial Sequence
  chemically synthesized
tgccaccattttcctctgaagc

SEQ ID NO: 1286992 - DNA, 22 bp, Artificial Sequence
  chemically synthesized
ttttctgatctgcttcagagga

SEQ ID NO: 1286993 - DNA, 22 bp, Artificial Sequence
  chemically synthesized
ctgccaccattttcctctgaag

SEQ ID NO: 1286994 - DNA, 22 bp, Artificial Sequence
  chemically synthesized
ttctgatctgcttcagaggaaa

SEQ ID NO: 1286995 - DNA, 22 bp, Artificial Sequence
  chemically synthesized
tctgatctgcttcagaggaaaa

SEQ ID NO: 1286996 - DNA, 22 bp, Artificial Sequence
  chemically synthesized
ctgatctgcttcagaggaaaat

SEQ ID NO: 1286997 - DNA, 22 bp, Artificial Sequence
  chemically synthesized
tgatctgcttcagaggaaaatg

SEQ ID NO: 1286998 - DNA, 22 bp, Artificial Sequence
  chemically synthesized
accttctgccaccattttcctc

SEQ ID NO: 1286999 - DNA, 22 bp, Artificial Sequence
  chemically synthesized
atctgcttcagaggaaaatggt

SEQ ID NO: 1287000 - DNA, 22 bp, Artificial Sequence
  chemically synthesized
tgaccttctgccaccattttcc

SEQ ID NO: 1287001 - DNA, 22 bp, Artificial Sequence
  chemically synthesized
cttcagaggaaaatggtggcag

SEQ ID NO: 1287002 - DNA, 22 bp, Artificial Sequence
  chemically synthesized
cagaggaaaatggtggcagaag

SEQ ID NO: 1287003 - DNA, 22 bp, Artificial Sequence
  chemically synthesized
agaggaaaatggtggcagaagg

SEQ ID NO: 1287004 - DNA, 22 bp, Artificial Sequence
  chemically synthesized
gggaaacagcggaagtgagaaa

SEQ ID NO: 1287005 - DNA, 22 bp, Artificial Sequence
  chemically synthesized
cgggaaacagcggaagtgagaa

SEQ ID NO: 1287006 - DNA, 22 bp, Artificial Sequence
  chemically synthesized
gcatttcgggaaacagcggaag

SEQ ID NO: 1287007 - DNA, 22 bp, Artificial Sequence
  chemically synthesized
ggcatttcgggaaacagcggaa

SEQ ID NO: 1287008 - DNA, 22 bp, Artificial Sequence
  chemically synthesized
tctcacttccgctgtttcccga

SEQ ID NO: 1287009 - DNA, 22 bp, Artificial Sequence
  chemically synthesized
ctcacttccgctgtttcccgaa

SEQ ID NO: 1287010 - DNA, 22 bp, Artificial Sequence
  chemically synthesized
tcacttccgctgtttcccgaaa

SEQ ID NO: 1287011 - DNA, 22 bp, Artificial Sequence
  chemically synthesized
acttccgctgtttcccgaaatg

SEQ ID NO: 1287012 - DNA, 22 bp, Artificial Sequence
  chemically synthesized
ccgctgtttcccgaaatgccaa

SEQ ID NO: 1287013 - DNA, 22 bp, Artificial Sequence
  chemically synthesized
cgctgtttcccgaaatgccaag

SEQ ID NO: 1287014 - DNA, 22 bp, Artificial Sequence
  chemically synthesized
tttcccgaaatgccaaggtgcc

SEQ ID NO: 1287015 - DNA, 22 bp, Artificial Sequence
  chemically synthesized
cccgaaatgccaaggtgccata

SEQ ID NO: 1287016 - DNA, 22 bp, Artificial Sequence
  chemically synthesized
ccgaaatgccaaggtgccatat

SEQ ID NO: 1287017 - DNA, 22 bp, Artificial Sequence
  chemically synthesized
ggacatatcatccccaaatatg

SEQ ID NO: 1287018 - DNA, 22 bp, Artificial Sequence
  chemically synthesized
aggacatatcatccccaaatat

SEQ ID NO: 1287019 - DNA, 22 bp, Artificial Sequence
  chemically synthesized
gtgggatttaggacatatcatc

SEQ ID NO: 1287020 - DNA, 22 bp, Artificial Sequence
  chemically synthesized
ttagtgggatttaggacatatc

SEQ ID NO: 1287021 - DNA, 22 bp, Artificial Sequence
  chemically synthesized
ttgttagtgggatttaggacat

SEQ ID NO: 1287022 - DNA, 22 bp, Artificial Sequence
  chemically synthesized
gttgttagtgggatttaggaca

SEQ ID NO: 1287023 - DNA, 22 bp, Artificial Sequence
  chemically synthesized
ggggatgatatgtcctaaatcc

SEQ ID NO: 1287024 - DNA, 22 bp, Artificial Sequence
  chemically synthesized
gggatgatatgtcctaaatccc

SEQ ID NO: 1287025 - DNA, 22 bp, Artificial Sequence
  chemically synthesized
tatttgttgttagtgggattta

SEQ ID NO: 1287026 - DNA, 22 bp, Artificial Sequence
  chemically synthesized
atatttgttgttagtgggattt

SEQ ID NO: 1287027 - DNA, 22 bp, Artificial Sequence
  chemically synthesized
tatatttgttgttagtgggatt

SEQ ID NO: 1287028 - DNA, 22 bp, Artificial Sequence
  chemically synthesized
ttatatttgttgttagtgggat

SEQ ID NO: 1287029 - DNA, 22 bp, Artificial Sequence
  chemically synthesized
tttatatttgttgttagtggga

SEQ ID NO: 1287030 - DNA, 22 bp, Artificial Sequence
  chemically synthesized
ttttatatttgttgttagtggg

SEQ ID NO: 1287031 - DNA, 22 bp, Artificial Sequence
  chemically synthesized
caccttttttatatttgttgtt

SEQ ID NO: 1287032 - DNA, 22 bp, Artificial Sequence
  chemically synthesized
ccaccttttttatatttgttgt

SEQ ID NO: 1287033 - DNA, 22 bp, Artificial Sequence
  chemically synthesized
aatcccactaacaacaaatata

SEQ ID NO: 1287034 - DNA, 22 bp, Artificial Sequence
  chemically synthesized
ggggcttccaccttttttatat

SEQ ID NO: 1287035 - DNA, 22 bp, Artificial Sequence
  chemically synthesized
acaacaaatataaaaaaggtgg

SEQ ID NO: 1287036 - DNA, 22 bp, Artificial Sequence
  chemically synthesized
aattgggggcttccaccttttt

SEQ ID NO: 1287037 - DNA, 22 bp, Artificial Sequence
  chemically synthesized
aaattgggggcttccacctttt

SEQ ID NO: 1287038 - DNA, 22 bp, Artificial Sequence
  chemically synthesized
taaattgggggcttccaccttt

SEQ ID NO: 1287039 - DNA, 22 bp, Artificial Sequence
  chemically synthesized
ttaaattgggggcttccacctt

SEQ ID NO: 1287040 - DNA, 22 bp, Artificial Sequence
  chemically synthesized
tttaaattgggggcttccacct

SEQ ID NO: 1287041 - DNA, 22 bp, Artificial Sequence
  chemically synthesized
ttttaaattgggggcttccacc

SEQ ID NO: 1287042 - DNA, 22 bp, Artificial Sequence
  chemically synthesized
tttttaaattgggggcttccac

SEQ ID NO: 1287043 - DNA, 22 bp, Artificial Sequence
  chemically synthesized
ttttttaaattgggggcttcca

SEQ ID NO: 1287044 - DNA, 22 bp, Artificial Sequence
  chemically synthesized
tttttttaaattgggggcttcc

SEQ ID NO: 1287045 - DNA, 22 bp, Artificial Sequence
  chemically synthesized
ttttttttaaattgggggcttc

SEQ ID NO: 1287046 - DNA, 22 bp, Artificial Sequence
  chemically synthesized
tttttttttaaattgggggctt

SEQ ID NO: 1287047 - DNA, 22 bp, Artificial Sequence
  chemically synthesized
ttttttttttaaattgggggct

SEQ ID NO: 1287048 - DNA, 22 bp, Artificial Sequence
  chemically synthesized
tttttttttttaaattgggggc

SEQ ID NO: 1287049 - DNA, 22 bp, Artificial Sequence
  chemically synthesized
ttttttttttttaaattggggg

SEQ ID NO: 1287050 - DNA, 22 bp, Artificial Sequence
  chemically synthesized
tttttttttttttaaattgggg

SEQ ID NO: 1287051 - DNA, 22 bp, Artificial Sequence
  chemically synthesized
ttttttttttttttttaaattg

SEQ ID NO: 1287052 - DNA, 22 bp, Artificial Sequence
  chemically synthesized
aacaatctattttttttttttt

SEQ ID NO: 1287053 - DNA, 22 bp, Artificial Sequence
  chemically synthesized
aaaaaaaaaaaaaaaatagatt

SEQ ID NO: 1287054 - DNA, 22 bp, Artificial Sequence
  chemically synthesized
aaatgattaaacaatctatttt

SEQ ID NO: 1287055 - DNA, 22 bp, Artificial Sequence
  chemically synthesized
aaaaaaaaaaaaaaatagattg

SEQ ID NO: 1287056 - DNA, 22 bp, Artificial Sequence
  chemically synthesized
ccaagttcaaatgattaaacaa

SEQ ID NO: 1287057 - DNA, 22 bp, Artificial Sequence
  chemically synthesized
aagattcccaagttcaaatgat

SEQ ID NO: 1287058 - DNA, 22 bp, Artificial Sequence
  chemically synthesized
caagattcccaagttcaaatga

SEQ ID NO: 1287059 - DNA, 22 bp, Artificial Sequence
  chemically synthesized
tcaagattcccaagttcaaatg

SEQ ID NO: 1287060 - DNA, 22 bp, Artificial Sequence
  chemically synthesized
tttaatcatttgaacttgggaa

SEQ ID NO: 1287061 - DNA, 22 bp, Artificial Sequence
  chemically synthesized
atattttcaagattcccaagtt

SEQ ID NO: 1287062 - DNA, 22 bp, Artificial Sequence
  chemically synthesized
aatattttcaagattcccaagt

SEQ ID NO: 1287063 - DNA, 22 bp, Artificial Sequence
  chemically synthesized
taatattttcaagattcccaag

SEQ ID NO: 1287064 - DNA, 22 bp, Artificial Sequence
  chemically synthesized
aatcatttgaacttgggaatct

SEQ ID NO: 1287065 - DNA, 22 bp, Artificial Sequence
  chemically synthesized
ttaatattttcaagattcccaa

SEQ ID NO: 1287066 - DNA, 22 bp, Artificial Sequence
  chemically synthesized
atcatttgaacttgggaatctt

SEQ ID NO: 1287067 - DNA, 22 bp, Artificial Sequence
  chemically synthesized
tttaatattttcaagattccca

SEQ ID NO: 1287068 - DNA, 22 bp, Artificial Sequence
  chemically synthesized
tttttaatattttcaagattcc

SEQ ID NO: 1287069 - DNA, 22 bp, Artificial Sequence
  chemically synthesized
gaacttgggaatcttgaaaata

SEQ ID NO: 1287070 - DNA, 22 bp, Artificial Sequence
  chemically synthesized
aacttgggaatcttgaaaatat

SEQ ID NO: 1287071 - DNA, 22 bp, Artificial Sequence
  chemically synthesized
gggaatcttgaaaatattaaaa

SEQ ID NO: 1287072 - DNA, 22 bp, Artificial Sequence
  chemically synthesized
ggaatcttgaaaatattaaaaa

SEQ ID NO: 1287073 - DNA, 22 bp, Artificial Sequence
  chemically synthesized
gaaaatattaaaaagaatcctg

SEQ ID NO: 1287074 - DNA, 22 bp, Artificial Sequence
  chemically synthesized
aaaatattaaaaagaatcctga

SEQ ID NO: 1287075 - DNA, 22 bp, Artificial Sequence
  chemically synthesized
aacggagaaagaatcaggattc

SEQ ID NO: 1287076 - DNA, 22 bp, Artificial Sequence
  chemically synthesized
aaggctaaacggagaaagaatc

SEQ ID NO: 1287077 - DNA, 22 bp, Artificial Sequence
  chemically synthesized
aaaagaatcctgattctttctc

SEQ ID NO: 1287078 - DNA, 22 bp, Artificial Sequence
  chemically synthesized
ttcaaggctaaacggagaaaga

SEQ ID NO: 1287079 - DNA, 22 bp, Artificial Sequence
  chemically synthesized
gttcaaggctaaacggagaaag

SEQ ID NO: 1287080 - DNA, 22 bp, Artificial Sequence
  chemically synthesized
aataacttgttcaaggctaaac

SEQ ID NO: 1287081 - DNA, 22 bp, Artificial Sequence
  chemically synthesized
attctttctccgtttagccttg

SEQ ID NO: 1287082 - DNA, 22 bp, Artificial Sequence
  chemically synthesized
tttctccgtttagccttgaaca

SEQ ID NO: 1287083 - DNA, 22 bp, Artificial Sequence
  chemically synthesized
tctccgtttagccttgaacaag

SEQ ID NO: 1287084 - DNA, 22 bp, Artificial Sequence
  chemically synthesized
ctccgtttagccttgaacaagt

SEQ ID NO: 1287085 - DNA, 22 bp, Artificial Sequence
  chemically synthesized
tccgtttagccttgaacaagtt

SEQ ID NO: 1287086 - DNA, 22 bp, Artificial Sequence
  chemically synthesized
cgtttagccttgaacaagttat

SEQ ID NO: 1287087 - DNA, 22 bp, Artificial Sequence
  chemically synthesized
agccttgaacaagttatttaac

SEQ ID NO: 1287088 - DNA, 22 bp, Artificial Sequence
  chemically synthesized
gccttgaacaagttatttaact

SEQ ID NO: 1287089 - DNA, 22 bp, Artificial Sequence
  chemically synthesized
gaacaagttatttaactattct

SEQ ID NO: 1287090 - DNA, 22 bp, Artificial Sequence
  chemically synthesized
aacaagttatttaactattctc

SEQ ID NO: 1287091 - DNA, 22 bp, Artificial Sequence
  chemically synthesized
catatgacagaaccaaagcaga

SEQ ID NO: 1287092 - DNA, 22 bp, Artificial Sequence
  chemically synthesized
tttaactattctctgctttggt

SEQ ID NO: 1287093 - DNA, 22 bp, Artificial Sequence
  chemically synthesized
acatatgacagaaccaaagcag

SEQ ID NO: 1287094 - DNA, 22 bp, Artificial Sequence
  chemically synthesized
tacatatgacagaaccaaagca

SEQ ID NO: 1287095 - DNA, 22 bp, Artificial Sequence
  chemically synthesized
aactattctctgctttggttct

SEQ ID NO: 1287096 - DNA, 22 bp, Artificial Sequence
  chemically synthesized
actattctctgctttggttctg

SEQ ID NO: 1287097 - DNA, 22 bp, Artificial Sequence
  chemically synthesized
attttacatatgacagaaccaa

SEQ ID NO: 1287098 - DNA, 22 bp, Artificial Sequence
  chemically synthesized
ttctctgctttggttctgtcat

SEQ ID NO: 1287099 - DNA, 22 bp, Artificial Sequence
  chemically synthesized
tctgctttggttctgtcatatg

SEQ ID NO: 1287100 - DNA, 22 bp, Artificial Sequence
  chemically synthesized
tgctttggttctgtcatatgta

SEQ ID NO: 1287101 - DNA, 22 bp, Artificial Sequence
  chemically synthesized
gtatcctcattttacatatgac

SEQ ID NO: 1287102 - DNA, 22 bp, Artificial Sequence
  chemically synthesized
ctttggttctgtcatatgtaaa

SEQ ID NO: 1287103 - DNA, 22 bp, Artificial Sequence
  chemically synthesized
ttagtatcctcattttacatat

SEQ ID NO: 1287104 - DNA, 22 bp, Artificial Sequence
  chemically synthesized
tggttctgtcatatgtaaaatg

SEQ ID NO: 1287105 - DNA, 22 bp, Artificial Sequence
  chemically synthesized
ggttctgtcatatgtaaaatga

SEQ ID NO: 1287106 - DNA, 22 bp, Artificial Sequence
  chemically synthesized
gttctgtcatatgtaaaatgag

SEQ ID NO: 1287107 - DNA, 22 bp, Artificial Sequence
  chemically synthesized
tgtcatatgtaaaatgaggata

SEQ ID NO: 1287108 - DNA, 22 bp, Artificial Sequence
  chemically synthesized
tcatatgtaaaatgaggatact

SEQ ID NO: 1287109 - DNA, 22 bp, Artificial Sequence
  chemically synthesized
agatagacattattagtatcct

SEQ ID NO: 1287110 - DNA, 22 bp, Artificial Sequence
  chemically synthesized
aagcaacgtactgagatagaca

SEQ ID NO: 1287111 - DNA, 22 bp, Artificial Sequence
  chemically synthesized
aaagcaacgtactgagatagac

SEQ ID NO: 1287112 - DNA, 22 bp, Artificial Sequence
  chemically synthesized
ttaaagcaacgtactgagatag

SEQ ID NO: 1287113 - DNA, 22 bp, Artificial Sequence
  chemically synthesized
attcttaaagcaacgtactgag

SEQ ID NO: 1287114 - DNA, 22 bp, Artificial Sequence
  chemically synthesized
ataatgtctatctcagtacgtt

SEQ ID NO: 1287115 - DNA, 22 bp, Artificial Sequence
  chemically synthesized
agttaattcttaaagcaacgta

SEQ ID NO: 1287116 - DNA, 22 bp, Artificial Sequence
  chemically synthesized
tcagttaattcttaaagcaacg

SEQ ID NO: 1287117 - DNA, 22 bp, Artificial Sequence
  chemically synthesized
tctcagtacgttgctttaagaa

SEQ ID NO: 1287118 - DNA, 22 bp, Artificial Sequence
  chemically synthesized
agtacgttgctttaagaattaa

SEQ ID NO: 1287119 - DNA, 22 bp, Artificial Sequence
  chemically synthesized
ctttaagaattaactgagagtg

SEQ ID NO: 1287120 - DNA, 22 bp, Artificial Sequence
  chemically synthesized
taagaattaactgagagtgcac

SEQ ID NO: 1287121 - DNA, 22 bp, Artificial Sequence
  chemically synthesized
tcaaagatatatgtgcactctc

SEQ ID NO: 1287122 - DNA, 22 bp, Artificial Sequence
  chemically synthesized
aagaattaactgagagtgcaca

SEQ ID NO: 1287123 - DNA, 22 bp, Artificial Sequence
  chemically synthesized
gtcaaagatatatgtgcactct

SEQ ID NO: 1287124 - DNA, 22 bp, Artificial Sequence
  chemically synthesized
agaattaactgagagtgcacat

SEQ ID NO: 1287125 - DNA, 22 bp, Artificial Sequence
  chemically synthesized
atttgtcaaagatatatgtgca

SEQ ID NO: 1287126 - DNA, 22 bp, Artificial Sequence
  chemically synthesized
actgagagtgcacatatatctt

SEQ ID NO: 1287127 - DNA, 22 bp, Artificial Sequence
  chemically synthesized
attgatttgtcaaagatatatg

SEQ ID NO: 1287128 - DNA, 22 bp, Artificial Sequence
  chemically synthesized
aattgatttgtcaaagatatat

SEQ ID NO: 1287129 - DNA, 22 bp, Artificial Sequence
  chemically synthesized
taattgatttgtcaaagatata

SEQ ID NO: 1287130 - DNA, 22 bp, Artificial Sequence
  chemically synthesized
agagtgcacatatatctttgac

SEQ ID NO: 1287131 - DNA, 22 bp, Artificial Sequence
  chemically synthesized
tgacaaatcaattaaaatacct

SEQ ID NO: 1287132 - DNA, 22 bp, Artificial Sequence
  chemically synthesized
gacaaatcaattaaaatacctt

SEQ ID NO: 1287133 - DNA, 22 bp, Artificial Sequence
  chemically synthesized
gatatatatccaaaggtatttt

SEQ ID NO: 1287134 - DNA, 22 bp, Artificial Sequence
  chemically synthesized
acaaatcaattaaaataccttt

SEQ ID NO: 1287135 - DNA, 22 bp, Artificial Sequence
  chemically synthesized
tggatatatatccaaaggtatt

SEQ ID NO: 1287136 - DNA, 22 bp, Artificial Sequence
  chemically synthesized
ctggatatatatccaaaggtat

SEQ ID NO: 1287137 - DNA, 22 bp, Artificial Sequence
  chemically synthesized
cttctggatatatatccaaagg

SEQ ID NO: 1287138 - DNA, 22 bp, Artificial Sequence
  chemically synthesized
ctacttctggatatatatccaa

SEQ ID NO: 1287139 - DNA, 22 bp, Artificial Sequence
  chemically synthesized
cctacttctggatatatatcca

SEQ ID NO: 1287140 - DNA, 22 bp, Artificial Sequence
  chemically synthesized
tcctacttctggatatatatcc

SEQ ID NO: 1287141 - DNA, 22 bp, Artificial Sequence
  chemically synthesized
aaatacctttggatatatatcc

SEQ ID NO: 1287142 - DNA, 22 bp, Artificial Sequence
  chemically synthesized
tggatatatatccagaagtagg

SEQ ID NO: 1287143 - DNA, 22 bp, Artificial Sequence
  chemically synthesized
ggatatatatccagaagtagga

SEQ ID NO: 1287144 - DNA, 22 bp, Artificial Sequence
  chemically synthesized
gatatatatccagaagtaggaa

SEQ ID NO: 1287145 - DNA, 22 bp, Artificial Sequence
  chemically synthesized
ccatatgatccaactttcctac

SEQ ID NO: 1287146 - DNA, 22 bp, Artificial Sequence
  chemically synthesized
aaaatggaattaccatatgatc

SEQ ID NO: 1287147 - DNA, 22 bp, Artificial Sequence
  chemically synthesized
aaaaacctaaaaatggaattac

SEQ ID NO: 1287148 - DNA, 22 bp, Artificial Sequence
  chemically synthesized
gatcatatggtaattccatttt

SEQ ID NO: 1287149 - DNA, 22 bp, Artificial Sequence
  chemically synthesized
ctcaaaaacctaaaaatggaat

SEQ ID NO: 1287150 - DNA, 22 bp, Artificial Sequence
  chemically synthesized
catttttaggtttttgaggaat

SEQ ID NO: 1287151 - DNA, 22 bp, Artificial Sequence
  chemically synthesized
gaaaataatatggagattcctc

SEQ ID NO: 1287152 - DNA, 22 bp, Artificial Sequence
  chemically synthesized
ggaaaataatatggagattcct

SEQ ID NO: 1287153 - DNA, 22 bp, Artificial Sequence
  chemically synthesized
ttaggtttttgaggaatctcca

SEQ ID NO: 1287154 - DNA, 22 bp, Artificial Sequence
  chemically synthesized
tggaaaataatatggagattcc

SEQ ID NO: 1287155 - DNA, 22 bp, Artificial Sequence
  chemically synthesized
taggtttttgaggaatctccat

SEQ ID NO: 1287156 - DNA, 22 bp, Artificial Sequence
  chemically synthesized
aggtttttgaggaatctccata

SEQ ID NO: 1287157 - DNA, 22 bp, Artificial Sequence
  chemically synthesized
ggtttttgaggaatctccatat

SEQ ID NO: 1287158 - DNA, 22 bp, Artificial Sequence
  chemically synthesized
ttgaggaatctccatattattt

SEQ ID NO: 1287159 - DNA, 22 bp, Artificial Sequence
  chemically synthesized
tgaggaatctccatattatttt

SEQ ID NO: 1287160 - DNA, 22 bp, Artificial Sequence
  chemically synthesized
gaggaatctccatattattttc

SEQ ID NO: 1287161 - DNA, 22 bp, Artificial Sequence
  chemically synthesized
aggaatctccatattattttcc

SEQ ID NO: 1287162 - DNA, 22 bp, Artificial Sequence
  chemically synthesized
gtatggtcattttggaaaataa

SEQ ID NO: 1287163 - DNA, 22 bp, Artificial Sequence
  chemically synthesized
catattattttccaaaatgacc

SEQ ID NO: 1287164 - DNA, 22 bp, Artificial Sequence
  chemically synthesized
ttttccaaaatgaccatactaa

SEQ ID NO: 1287165 - DNA, 22 bp, Artificial Sequence
  chemically synthesized
gtgggaatgtaaattagtatgg

SEQ ID NO: 1287166 - DNA, 22 bp, Artificial Sequence
  chemically synthesized
ggtgggaatgtaaattagtatg

SEQ ID NO: 1287167 - DNA, 22 bp, Artificial Sequence
  chemically synthesized
tccaaaatgaccatactaattt

SEQ ID NO: 1287168 - DNA, 22 bp, Artificial Sequence
  chemically synthesized
ccaaaatgaccatactaattta

SEQ ID NO: 1287169 - DNA, 22 bp, Artificial Sequence
  chemically synthesized
ttggtgggaatgtaaattagta

SEQ ID NO: 1287170 - DNA, 22 bp, Artificial Sequence
  chemically synthesized
caaaatgaccatactaatttac

SEQ ID NO: 1287171 - DNA, 22 bp, Artificial Sequence
  chemically synthesized
ctcttggtgggaatgtaaatta

SEQ ID NO: 1287172 - DNA, 22 bp, Artificial Sequence
  chemically synthesized
tctactcttggtgggaatgtaa

SEQ ID NO: 1287173 - DNA, 22 bp, Artificial Sequence
  chemically synthesized
atttacattcccaccaagagta

SEQ ID NO: 1287174 - DNA, 22 bp, Artificial Sequence
  chemically synthesized
acattcccaccaagagtagaca

SEQ ID NO: 1287175 - DNA, 22 bp, Artificial Sequence
  chemically synthesized
tggtcagaatgttgtctactct

SEQ ID NO: 1287176 - DNA, 22 bp, Artificial Sequence
  chemically synthesized
cattcccaccaagagtagacaa

SEQ ID NO: 1287177 - DNA, 22 bp, Artificial Sequence
  chemically synthesized
gtggtcagaatgttgtctactc

SEQ ID NO: 1287178 - DNA, 22 bp, Artificial Sequence
  chemically synthesized
tgtggtcagaatgttgtctact

SEQ ID NO: 1287179 - DNA, 22 bp, Artificial Sequence
  chemically synthesized
ccaccaagagtagacaacattc

SEQ ID NO: 1287180 - DNA, 22 bp, Artificial Sequence
  chemically synthesized
tgttttgtggtcagaatgttgt

SEQ ID NO: 1287181 - DNA, 22 bp, Artificial Sequence
  chemically synthesized
atgttttgtggtcagaatgttg

SEQ ID NO: 1287182 - DNA, 22 bp, Artificial Sequence
  chemically synthesized
acttatgttttgtggtcagaat

SEQ ID NO: 1287183 - DNA, 22 bp, Artificial Sequence
  chemically synthesized
actaacttatgttttgtggtca

SEQ ID NO: 1287184 - DNA, 22 bp, Artificial Sequence
  chemically synthesized
tcacctcactaacttatgtttt

SEQ ID NO: 1287185 - DNA, 22 bp, Artificial Sequence
  chemically synthesized
tgaccacaaaacataagttagt

SEQ ID NO: 1287186 - DNA, 22 bp, Artificial Sequence
  chemically synthesized
accacaaaacataagttagtga

SEQ ID NO: 1287187 - DNA, 22 bp, Artificial Sequence
  chemically synthesized
acatatctatcacctcactaac

SEQ ID NO: 1287188 - DNA, 22 bp, Artificial Sequence
  chemically synthesized
attaacatatctatcacctcac

SEQ ID NO: 1287189 - DNA, 22 bp, Artificial Sequence
  chemically synthesized
aatcaagctaattaacatatct

SEQ ID NO: 1287190 - DNA, 22 bp, Artificial Sequence
  chemically synthesized
gtgaggtgatagatatgttaat

SEQ ID NO: 1287191 - DNA, 22 bp, Artificial Sequence
  chemically synthesized
cagaaacattcaatcaagctaa

SEQ ID NO: 1287192 - DNA, 22 bp, Artificial Sequence
  chemically synthesized
attagcttgattgaatgtttct

SEQ ID NO: 1287193 - DNA, 22 bp, Artificial Sequence
  chemically synthesized
tgaatatattacagaaacattc

SEQ ID NO: 1287194 - DNA, 22 bp, Artificial Sequence
  chemically synthesized
gcttgattgaatgtttctgtaa

SEQ ID NO: 1287195 - DNA, 22 bp, Artificial Sequence
  chemically synthesized
atctatgaatatattacagaaa

SEQ ID NO: 1287196 - DNA, 22 bp, Artificial Sequence
  chemically synthesized
aatctatgaatatattacagaa

SEQ ID NO: 1287197 - DNA, 22 bp, Artificial Sequence
  chemically synthesized
taatctatgaatatattacaga

SEQ ID NO: 1287198 - DNA, 22 bp, Artificial Sequence
  chemically synthesized
gattgaatgtttctgtaatata

SEQ ID NO: 1287199 - DNA, 22 bp, Artificial Sequence
  chemically synthesized
attgaatgtttctgtaatatat

SEQ ID NO: 1287200 - DNA, 22 bp, Artificial Sequence
  chemically synthesized
aatgtttctgtaatatattcat

SEQ ID NO: 1287201 - DNA, 22 bp, Artificial Sequence
  chemically synthesized
ctgtaatatattcatagattaa

SEQ ID NO: 1287202 - DNA, 22 bp, Artificial Sequence
  chemically synthesized
tgtaatatattcatagattaaa

SEQ ID NO: 1287203 - DNA, 22 bp, Artificial Sequence
  chemically synthesized
taatatattcatagattaaaat

SEQ ID NO: 1287204 - DNA, 22 bp, Artificial Sequence
  chemically synthesized
tggtgtacaatgtgatatttta

SEQ ID NO: 1287205 - DNA, 22 bp, Artificial Sequence
  chemically synthesized
atggtgtacaatgtgatatttt

SEQ ID NO: 1287206 - DNA, 22 bp, Artificial Sequence
  chemically synthesized
atagattaaaatatcacattgt

SEQ ID NO: 1287207 - DNA, 22 bp, Artificial Sequence
  chemically synthesized
agtaatttatggtgtacaatgt

SEQ ID NO: 1287208 - DNA, 22 bp, Artificial Sequence
  chemically synthesized
aaatatcacattgtacaccata

SEQ ID NO: 1287209 - DNA, 22 bp, Artificial Sequence
  chemically synthesized
tacaccataaattactcaactg

SEQ ID NO: 1287210 - DNA, 22 bp, Artificial Sequence
  chemically synthesized
atgaacaagtaacagttgagta

SEQ ID NO: 1287211 - DNA, 22 bp, Artificial Sequence
  chemically synthesized
aatgaacaagtaacagttgagt

SEQ ID NO: 1287212 - DNA, 22 bp, Artificial Sequence
  chemically synthesized
taatgaacaagtaacagttgag

SEQ ID NO: 1287213 - DNA, 22 bp, Artificial Sequence
  chemically synthesized
ttaatgaacaagtaacagttga

SEQ ID NO: 1287214 - DNA, 22 bp, Artificial Sequence
  chemically synthesized
tttttaatgaacaagtaacagt

SEQ ID NO: 1287215 - DNA, 22 bp, Artificial Sequence
  chemically synthesized
atttttaatgaacaagtaacag

SEQ ID NO: 1287216 - DNA, 22 bp, Artificial Sequence
  chemically synthesized
tttatttttaatgaacaagtaa

SEQ ID NO: 1287217 - DNA, 22 bp, Artificial Sequence
  chemically synthesized
atttatttttaatgaacaagta

SEQ ID NO: 1287218 - DNA, 22 bp, Artificial Sequence
  chemically synthesized
ctcaactgttacttgttcatta

SEQ ID NO: 1287219 - DNA, 22 bp, Artificial Sequence
  chemically synthesized
tttatttatttttaatgaacaa

SEQ ID NO: 1287220 - DNA, 22 bp, Artificial Sequence
  chemically synthesized
atttatttatttttaatgaaca

SEQ ID NO: 1287221 - DNA, 22 bp, Artificial Sequence
  chemically synthesized
aactgttacttgttcattaaaa

SEQ ID NO: 1287222 - DNA, 22 bp, Artificial Sequence
  chemically synthesized
accttatttatttatttttaat

SEQ ID NO: 1287223 - DNA, 22 bp, Artificial Sequence
  chemically synthesized
ttacttgttcattaaaaataaa

SEQ ID NO: 1287224 - DNA, 22 bp, Artificial Sequence
  chemically synthesized
cttgttcattaaaaataaataa

SEQ ID NO: 1287225 - DNA, 22 bp, Artificial Sequence
  chemically synthesized
gttcattaaaaataaataaata

SEQ ID NO: 1287226 - DNA, 22 bp, Artificial Sequence
  chemically synthesized
ttcattaaaaataaataaataa

SEQ ID NO: 1287227 - DNA, 22 bp, Artificial Sequence
  chemically synthesized
attaaaaataaataaataaggt

SEQ ID NO: 1287228 - DNA, 22 bp, Artificial Sequence
  chemically synthesized
aaaataaataaataaggtcagt

SEQ ID NO: 1287229 - DNA, 22 bp, Artificial Sequence
  chemically synthesized
gcgtgagccacggtgactgacc

SEQ ID NO: 1287230 - DNA, 22 bp, Artificial Sequence
  chemically synthesized
aaagtgctggcgtgagccacgg

SEQ ID NO: 1287231 - DNA, 22 bp, Artificial Sequence
  chemically synthesized
tcaaagtgctggcgtgagccac

SEQ ID NO: 1287232 - DNA, 22 bp, Artificial Sequence
  chemically synthesized
gcctctcaaagtgctggcgtga

SEQ ID NO: 1287233 - DNA, 22 bp, Artificial Sequence
  chemically synthesized
agcctctcaaagtgctggcgtg

SEQ ID NO: 1287234 - DNA, 22 bp, Artificial Sequence
  chemically synthesized
tagcctctcaaagtgctggcgt

SEQ ID NO: 1287235 - DNA, 22 bp, Artificial Sequence
  chemically synthesized
ctttagcctctcaaagtgctgg

SEQ ID NO: 1287236 - DNA, 22 bp, Artificial Sequence
  chemically synthesized
cctgctttagcctctcaaagtg

SEQ ID NO: 1287237 - DNA, 22 bp, Artificial Sequence
  chemically synthesized
acgccagcactttgagaggcta

SEQ ID NO: 1287238 - DNA, 22 bp, Artificial Sequence
  chemically synthesized
aggtgatctacctgctttagcc

SEQ ID NO: 1287239 - DNA, 22 bp, Artificial Sequence
  chemically synthesized
tgagaggctaaagcaggtagat

SEQ ID NO: 1287240 - DNA, 22 bp, Artificial Sequence
  chemically synthesized
gagaggctaaagcaggtagatc

SEQ ID NO: 1287241 - DNA, 22 bp, Artificial Sequence
  chemically synthesized
catagctcaggtgatctacctg

SEQ ID NO: 1287242 - DNA, 22 bp, Artificial Sequence
  chemically synthesized
agaggctaaagcaggtagatca

SEQ ID NO: 1287243 - DNA, 22 bp, Artificial Sequence
  chemically synthesized
agactccatagctcaggtgatc

SEQ ID NO: 1287244 - DNA, 22 bp, Artificial Sequence
  chemically synthesized
aagcaggtagatcacctgagct

SEQ ID NO: 1287245 - DNA, 22 bp, Artificial Sequence
  chemically synthesized
gtctcagactccatagctcagg

SEQ ID NO: 1287246 - DNA, 22 bp, Artificial Sequence
  chemically synthesized
cccaggctggtctcagactcca

SEQ ID NO: 1287247 - DNA, 22 bp, Artificial Sequence
  chemically synthesized
tgttgcccaggctggtctcaga

SEQ ID NO: 1287248 - DNA, 22 bp, Artificial Sequence
  chemically synthesized
agctatggagtctgagaccagc

SEQ ID NO: 1287249 - DNA, 22 bp, Artificial Sequence
  chemically synthesized
tggagtctgagaccagcctggg

SEQ ID NO: 1287250 - DNA, 22 bp, Artificial Sequence
  chemically synthesized
agaccagcctgggcaacatagg

SEQ ID NO: 1287251 - DNA, 22 bp, Artificial Sequence
  chemically synthesized
tagagatgggggtcccctatgt

SEQ ID NO: 1287252 - DNA, 22 bp, Artificial Sequence
  chemically synthesized
gtagagatgggggtcccctatg

SEQ ID NO: 1287253 - DNA, 22 bp, Artificial Sequence
  chemically synthesized
tgtagagatgggggtcccctat

SEQ ID NO: 1287254 - DNA, 22 bp, Artificial Sequence
  chemically synthesized
ttgtagagatgggggtccccta

SEQ ID NO: 1287255 - DNA, 22 bp, Artificial Sequence
  chemically synthesized
tttgtagagatgggggtcccct

SEQ ID NO: 1287256 - DNA, 22 bp, Artificial Sequence
  chemically synthesized
ttttttgtagagatgggggtcc

SEQ ID NO: 1287257 - DNA, 22 bp, Artificial Sequence
  chemically synthesized
ggcaacataggggacccccatc

SEQ ID NO: 1287258 - DNA, 22 bp, Artificial Sequence
  chemically synthesized
ctattttttgtagagatggggg

SEQ ID NO: 1287259 - DNA, 22 bp, Artificial Sequence
  chemically synthesized
atgttcctattttttgtagaga

SEQ ID NO: 1287260 - DNA, 22 bp, Artificial Sequence
  chemically synthesized
agctaatgttcctattttttgt

SEQ ID NO: 1287261 - DNA, 22 bp, Artificial Sequence
  chemically synthesized
tacaaaaaataggaacattagc

SEQ ID NO: 1287262 - DNA, 22 bp, Artificial Sequence
  chemically synthesized
caaaaaataggaacattagctg

SEQ ID NO: 1287263 - DNA, 22 bp, Artificial Sequence
  chemically synthesized
caggtgtcccccaccatgctca

SEQ ID NO: 1287264 - DNA, 22 bp, Artificial Sequence
  chemically synthesized
ggactacaggtgtcccccacca

SEQ ID NO: 1287265 - DNA, 22 bp, Artificial Sequence
  chemically synthesized
gctgagcatggtgggggacacc

SEQ ID NO: 1287266 - DNA, 22 bp, Artificial Sequence
  chemically synthesized
agcatggtgggggacacctgta

SEQ ID NO: 1287267 - DNA, 22 bp, Artificial Sequence
  chemically synthesized
aacccccaagtagctgggacta

SEQ ID NO: 1287268 - DNA, 22 bp, Artificial Sequence
  chemically synthesized
cctgaacccccaagtagctggg

SEQ ID NO: 1287269 - DNA, 22 bp, Artificial Sequence
  chemically synthesized
ctacctgaacccccaagtagct

SEQ ID NO: 1287270 - DNA, 22 bp, Artificial Sequence
  chemically synthesized
tagtcccagctacttgggggtt

SEQ ID NO: 1287271 - DNA, 22 bp, Artificial Sequence
  chemically synthesized
caagccatcctcctacctgaac

SEQ ID NO: 1287272 - DNA, 22 bp, Artificial Sequence
  chemically synthesized
cttgggggttcaggtaggagga

SEQ ID NO: 1287273 - DNA, 22 bp, Artificial Sequence
  chemically synthesized
acctccaagccatcctcctacc

SEQ ID NO: 1287274 - DNA, 22 bp, Artificial Sequence
  chemically synthesized
gacctccaagccatcctcctac

SEQ ID NO: 1287275 - DNA, 22 bp, Artificial Sequence
  chemically synthesized
gggggttcaggtaggaggatgg

SEQ ID NO: 1287276 - DNA, 22 bp, Artificial Sequence
  chemically synthesized
ggggttcaggtaggaggatggc

SEQ ID NO: 1287277 - DNA, 22 bp, Artificial Sequence
  chemically synthesized
cagccttgacctccaagccatc

SEQ ID NO: 1287278 - DNA, 22 bp, Artificial Sequence
  chemically synthesized
aggtaggaggatggcttggagg

SEQ ID NO: 1287279 - DNA, 22 bp, Artificial Sequence
  chemically synthesized
attgcagccttgacctccaagc

SEQ ID NO: 1287280 - DNA, 22 bp, Artificial Sequence
  chemically synthesized
cggctcattgcagccttgacct

SEQ ID NO: 1287281 - DNA, 22 bp, Artificial Sequence
  chemically synthesized
ggaggtcaaggctgcaatgagc

SEQ ID NO: 1287282 - DNA, 22 bp, Artificial Sequence
  chemically synthesized
gaggtcaaggctgcaatgagcc

SEQ ID NO: 1287283 - DNA, 22 bp, Artificial Sequence
  chemically synthesized
gagtgcagtggagtcattgcgg

SEQ ID NO: 1287284 - DNA, 22 bp, Artificial Sequence
  chemically synthesized
caatgagccgcaatgactccac

SEQ ID NO: 1287285 - DNA, 22 bp, Artificial Sequence
  chemically synthesized
aggttggagtgcagtggagtca

SEQ ID NO: 1287286 - DNA, 22 bp, Artificial Sequence
  chemically synthesized
gtcactcaggttggagtgcagt

SEQ ID NO: 1287287 - DNA, 22 bp, Artificial Sequence
  chemically synthesized
cgtcactcaggttggagtgcag

SEQ ID NO: 1287288 - DNA, 22 bp, Artificial Sequence
  chemically synthesized
acttcgtcactcaggttggagt

SEQ ID NO: 1287289 - DNA, 22 bp, Artificial Sequence
  chemically synthesized
cactgcactccaacctgagtga

SEQ ID NO: 1287290 - DNA, 22 bp, Artificial Sequence
  chemically synthesized
cactccaacctgagtgacgaag

SEQ ID NO: 1287291 - DNA, 22 bp, Artificial Sequence
  chemically synthesized
agacaagatctcacttcgtcac

SEQ ID NO: 1287292 - DNA, 22 bp, Artificial Sequence
  chemically synthesized
gagacaagatctcacttcgtca

SEQ ID NO: 1287293 - DNA, 22 bp, Artificial Sequence
  chemically synthesized
tgagacaagatctcacttcgtc

SEQ ID NO: 1287294 - DNA, 22 bp, Artificial Sequence
  chemically synthesized
ttgagacaagatctcacttcgt

SEQ ID NO: 1287295 - DNA, 22 bp, Artificial Sequence
  chemically synthesized
caacctgagtgacgaagtgaga

SEQ ID NO: 1287296 - DNA, 22 bp, Artificial Sequence
  chemically synthesized
gtttttgagacaagatctcact

SEQ ID NO: 1287297 - DNA, 22 bp, Artificial Sequence
  chemically synthesized
ggtttttgagacaagatctcac

SEQ ID NO: 1287298 - DNA, 22 bp, Artificial Sequence
  chemically synthesized
agtgacgaagtgagatcttgtc

SEQ ID NO: 1287299 - DNA, 22 bp, Artificial Sequence
  chemically synthesized
gtttggtttttgagacaagatc

SEQ ID NO: 1287300 - DNA, 22 bp, Artificial Sequence
  chemically synthesized
ggtttggtttttgagacaagat

SEQ ID NO: 1287301 - DNA, 22 bp, Artificial Sequence
  chemically synthesized
tggtttggtttttgagacaaga

SEQ ID NO: 1287302 - DNA, 22 bp, Artificial Sequence
  chemically synthesized
ttttggtttggtttttgagaca

SEQ ID NO: 1287303 - DNA, 22 bp, Artificial Sequence
  chemically synthesized
gttttggtttggtttttgagac

SEQ ID NO: 1287304 - DNA, 22 bp, Artificial Sequence
  chemically synthesized
tcttgttttggtttggtttttg

SEQ ID NO: 1287305 - DNA, 22 bp, Artificial Sequence
  chemically synthesized
atcttgttttggtttggttttt

SEQ ID NO: 1287306 - DNA, 22 bp, Artificial Sequence
  chemically synthesized
tttatcttgttttggtttggtt

SEQ ID NO: 1287307 - DNA, 22 bp, Artificial Sequence
  chemically synthesized
atttatcttgttttggtttggt

SEQ ID NO: 1287308 - DNA, 22 bp, Artificial Sequence
  chemically synthesized
gtctcaaaaaccaaaccaaaac

SEQ ID NO: 1287309 - DNA, 22 bp, Artificial Sequence
  chemically synthesized
tctcaaaaaccaaaccaaaaca

SEQ ID NO: 1287310 - DNA, 22 bp, Artificial Sequence
  chemically synthesized
catttatttatcttgttttggt

SEQ ID NO: 1287311 - DNA, 22 bp, Artificial Sequence
  chemically synthesized
aaaaaccaaaccaaaacaagat

SEQ ID NO: 1287312 - DNA, 22 bp, Artificial Sequence
  chemically synthesized
attgcatttatttatcttgttt

SEQ ID NO: 1287313 - DNA, 22 bp, Artificial Sequence
  chemically synthesized
aattgcatttatttatcttgtt

SEQ ID NO: 1287314 - DNA, 22 bp, Artificial Sequence
  chemically synthesized
taattgcatttatttatcttgt

SEQ ID NO: 1287315 - DNA, 22 bp, Artificial Sequence
  chemically synthesized
tttaattgcatttatttatctt

SEQ ID NO: 1287316 - DNA, 22 bp, Artificial Sequence
  chemically synthesized
catgagttctttaattgcattt

SEQ ID NO: 1287317 - DNA, 22 bp, Artificial Sequence
  chemically synthesized
gcatgagttctttaattgcatt

SEQ ID NO: 1287318 - DNA, 22 bp, Artificial Sequence
  chemically synthesized
taatggatttgcatgagttctt

SEQ ID NO: 1287319 - DNA, 22 bp, Artificial Sequence
  chemically synthesized
ttataatggatttgcatgagtt

SEQ ID NO: 1287320 - DNA, 22 bp, Artificial Sequence
  chemically synthesized
aagaactcatgcaaatccatta

SEQ ID NO: 1287321 - DNA, 22 bp, Artificial Sequence
  chemically synthesized
agtgtcaagcattgttataatg

SEQ ID NO: 1287322 - DNA, 22 bp, Artificial Sequence
  chemically synthesized
atgcaaatccattataacaatg

SEQ ID NO: 1287323 - DNA, 22 bp, Artificial Sequence
  chemically synthesized
ttaagtgtcaagcattgttata

SEQ ID NO: 1287324 - DNA, 22 bp, Artificial Sequence
  chemically synthesized
attaagtgtcaagcattgttat

SEQ ID NO: 1287325 - DNA, 22 bp, Artificial Sequence
  chemically synthesized
tattaagtgtcaagcattgtta

SEQ ID NO: 1287326 - DNA, 22 bp, Artificial Sequence
  chemically synthesized
gcctttattaagtgtcaagcat

SEQ ID NO: 1287327 - DNA, 22 bp, Artificial Sequence
  chemically synthesized
taacaatgcttgacacttaata

SEQ ID NO: 1287328 - DNA, 22 bp, Artificial Sequence
  chemically synthesized
gacacttaataaaggctagcca

SEQ ID NO: 1287329 - DNA, 22 bp, Artificial Sequence
  chemically synthesized
acacttaataaaggctagccat

SEQ ID NO: 1287330 - DNA, 22 bp, Artificial Sequence
  chemically synthesized
aataaaggctagccatctgtat

SEQ ID NO: 1287331 - DNA, 22 bp, Artificial Sequence
  chemically synthesized
ataaaggctagccatctgtatg

SEQ ID NO: 1287332 - DNA, 22 bp, Artificial Sequence
  chemically synthesized
gccatctgtatgacatctctgt

SEQ ID NO: 1287333 - DNA, 22 bp, Artificial Sequence
  chemically synthesized
aaaagtcatagaacagagatgt

SEQ ID NO: 1287334 - DNA, 22 bp, Artificial Sequence
  chemically synthesized
tatgacatctctgttctatgac

SEQ ID NO: 1287335 - DNA, 22 bp, Artificial Sequence
  chemically synthesized
aaagtaactaaaaagtcataga

SEQ ID NO: 1287336 - DNA, 22 bp, Artificial Sequence
  chemically synthesized
aacctaaaagtaactaaaaagt

SEQ ID NO: 1287337 - DNA, 22 bp, Artificial Sequence
  chemically synthesized
tgttctatgactttttagttac

SEQ ID NO: 1287338 - DNA, 22 bp, Artificial Sequence
  chemically synthesized
ttctatgactttttagttactt

SEQ ID NO: 1287339 - DNA, 22 bp, Artificial Sequence
  chemically synthesized
acattaaacctaaaagtaacta

SEQ ID NO: 1287340 - DNA, 22 bp, Artificial Sequence
  chemically synthesized
tatgactttttagttactttta

SEQ ID NO: 1287341 - DNA, 22 bp, Artificial Sequence
  chemically synthesized
tgactttttagttacttttagg

SEQ ID NO: 1287342 - DNA, 22 bp, Artificial Sequence
  chemically synthesized
tttagttacttttaggtttaat

SEQ ID NO: 1287343 - DNA, 22 bp, Artificial Sequence
  chemically synthesized
ttagttacttttaggtttaatg

SEQ ID NO: 1287344 - DNA, 22 bp, Artificial Sequence
  chemically synthesized
tagttacttttaggtttaatgt

SEQ ID NO: 1287345 - DNA, 22 bp, Artificial Sequence
  chemically synthesized
agttacttttaggtttaatgtg

SEQ ID NO: 1287346 - DNA, 22 bp, Artificial Sequence
  chemically synthesized
gttacttttaggtttaatgtga

SEQ ID NO: 1287347 - DNA, 22 bp, Artificial Sequence
  chemically synthesized
cttttaggtttaatgtgaatgt

SEQ ID NO: 1287348 - DNA, 22 bp, Artificial Sequence
  chemically synthesized
aaaagaaagaaaaaacattcac

SEQ ID NO: 1287349 - DNA, 22 bp, Artificial Sequence
  chemically synthesized
ttaggtttaatgtgaatgtttt

SEQ ID NO: 1287350 - DNA, 22 bp, Artificial Sequence
  chemically synthesized
taggtttaatgtgaatgttttt

SEQ ID NO: 1287351 - DNA, 22 bp, Artificial Sequence
  chemically synthesized
aggtttaatgtgaatgtttttt

SEQ ID NO: 1287352 - DNA, 22 bp, Artificial Sequence
  chemically synthesized
ggtttaatgtgaatgttttttc

SEQ ID NO: 1287353 - DNA, 22 bp, Artificial Sequence
  chemically synthesized
agttaaaaagaaagaaaaaaca

SEQ ID NO: 1287354 - DNA, 22 bp, Artificial Sequence
  chemically synthesized
aagttaaaaagaaagaaaaaac

SEQ ID NO: 1287355 - DNA, 22 bp, Artificial Sequence
  chemically synthesized
aatgtgaatgttttttctttct

SEQ ID NO: 1287356 - DNA, 22 bp, Artificial Sequence
  chemically synthesized
atgtgaatgttttttctttctt

SEQ ID NO: 1287357 - DNA, 22 bp, Artificial Sequence
  chemically synthesized
tacggcatttaagttaaaaaga

SEQ ID NO: 1287358 - DNA, 22 bp, Artificial Sequence
  chemically synthesized
atacggcatttaagttaaaaag

SEQ ID NO: 1287359 - DNA, 22 bp, Artificial Sequence
  chemically synthesized
tatacggcatttaagttaaaaa

SEQ ID NO: 1287360 - DNA, 22 bp, Artificial Sequence
  chemically synthesized
tttctttctttttaacttaaat

SEQ ID NO: 1287361 - DNA, 22 bp, Artificial Sequence
  chemically synthesized
ttctttctttttaacttaaatg

SEQ ID NO: 1287362 - DNA, 22 bp, Artificial Sequence
  chemically synthesized
tctttctttttaacttaaatgc

SEQ ID NO: 1287363 - DNA, 22 bp, Artificial Sequence
  chemically synthesized
ctttctttttaacttaaatgcc

SEQ ID NO: 1287364 - DNA, 22 bp, Artificial Sequence
  chemically synthesized
tttctttttaacttaaatgccg

SEQ ID NO: 1287365 - DNA, 22 bp, Artificial Sequence
  chemically synthesized
tctttttaacttaaatgccgta

SEQ ID NO: 1287366 - DNA, 22 bp, Artificial Sequence
  chemically synthesized
ctttttaacttaaatgccgtat

SEQ ID NO: 1287367 - DNA, 22 bp, Artificial Sequence
  chemically synthesized
aaagagtgctttatacggcatt

SEQ ID NO: 1287368 - DNA, 22 bp, Artificial Sequence
  chemically synthesized
tttttaacttaaatgccgtata

SEQ ID NO: 1287369 - DNA, 22 bp, Artificial Sequence
  chemically synthesized
aaaagagtgctttatacggcat

SEQ ID NO: 1287370 - DNA, 22 bp, Artificial Sequence
  chemically synthesized
tttaacttaaatgccgtataaa

SEQ ID NO: 1287371 - DNA, 22 bp, Artificial Sequence
  chemically synthesized
ttaacttaaatgccgtataaag

SEQ ID NO: 1287372 - DNA, 22 bp, Artificial Sequence
  chemically synthesized
tttaaaagagtgctttatacgg

SEQ ID NO: 1287373 - DNA, 22 bp, Artificial Sequence
  chemically synthesized
taacttaaatgccgtataaagc

SEQ ID NO: 1287374 - DNA, 22 bp, Artificial Sequence
  chemically synthesized
aacttaaatgccgtataaagca

SEQ ID NO: 1287375 - DNA, 22 bp, Artificial Sequence
  chemically synthesized
acttaaatgccgtataaagcac

SEQ ID NO: 1287376 - DNA, 22 bp, Artificial Sequence
  chemically synthesized
aaatgccgtataaagcactctt

SEQ ID NO: 1287377 - DNA, 22 bp, Artificial Sequence
  chemically synthesized
aatgccgtataaagcactcttt

SEQ ID NO: 1287378 - DNA, 22 bp, Artificial Sequence
  chemically synthesized
tgtacattatttaaaagagtgc

SEQ ID NO: 1287379 - DNA, 22 bp, Artificial Sequence
  chemically synthesized
tatgtacattatttaaaagagt

SEQ ID NO: 1287380 - DNA, 22 bp, Artificial Sequence
  chemically synthesized
ctatgtacattatttaaaagag

SEQ ID NO: 1287381 - DNA, 22 bp, Artificial Sequence
  chemically synthesized
gataaagtttctatgtacatta

SEQ ID NO: 1287382 - DNA, 22 bp, Artificial Sequence
  chemically synthesized
agataaagtttctatgtacatt

SEQ ID NO: 1287383 - DNA, 22 bp, Artificial Sequence
  chemically synthesized
tagataaagtttctatgtacat

SEQ ID NO: 1287384 - DNA, 22 bp, Artificial Sequence
  chemically synthesized
ttttaaataatgtacatagaaa

SEQ ID NO: 1287385 - DNA, 22 bp, Artificial Sequence
  chemically synthesized
ttaaataatgtacatagaaact

SEQ ID NO: 1287386 - DNA, 22 bp, Artificial Sequence
  chemically synthesized
taaataatgtacatagaaactt

SEQ ID NO: 1287387 - DNA, 22 bp, Artificial Sequence
  chemically synthesized
aaataatgtacatagaaacttt

SEQ ID NO: 1287388 - DNA, 22 bp, Artificial Sequence
  chemically synthesized
ggaattttagataaagtttcta

SEQ ID NO: 1287389 - DNA, 22 bp, Artificial Sequence
  chemically synthesized
aataatgtacatagaaacttta

SEQ ID NO: 1287390 - DNA, 22 bp, Artificial Sequence
  chemically synthesized
gcaaaatcacataactaggaat

SEQ ID NO: 1287391 - DNA, 22 bp, Artificial Sequence
  chemically synthesized
ttagcaaaatcacataactagg

SEQ ID NO: 1287392 - DNA, 22 bp, Artificial Sequence
  chemically synthesized
tatctaaaattcctagttatgt

SEQ ID NO: 1287393 - DNA, 22 bp, Artificial Sequence
  chemically synthesized
atctaaaattcctagttatgtg

SEQ ID NO: 1287394 - DNA, 22 bp, Artificial Sequence
  chemically synthesized
tctaaaattcctagttatgtga

SEQ ID NO: 1287395 - DNA, 22 bp, Artificial Sequence
  chemically synthesized
aaattcctagttatgtgatttt

SEQ ID NO: 1287396 - DNA, 22 bp, Artificial Sequence
  chemically synthesized
ctagttatgtgattttgctaac

SEQ ID NO: 1287397 - DNA, 22 bp, Artificial Sequence
  chemically synthesized
gttatgtgattttgctaacagg

SEQ ID NO: 1287398 - DNA, 22 bp, Artificial Sequence
  chemically synthesized
catgaaaaatatgcctgttagc

SEQ ID NO: 1287399 - DNA, 22 bp, Artificial Sequence
  chemically synthesized
tgtgattttgctaacaggcata

SEQ ID NO: 1287400 - DNA, 22 bp, Artificial Sequence
  chemically synthesized
ttccatgaaaaatatgcctgtt

SEQ ID NO: 1287401 - DNA, 22 bp, Artificial Sequence
  chemically synthesized
gttccatgaaaaatatgcctgt

SEQ ID NO: 1287402 - DNA, 22 bp, Artificial Sequence
  chemically synthesized
tgttccatgaaaaatatgcctg

SEQ ID NO: 1287403 - DNA, 22 bp, Artificial Sequence
  chemically synthesized
ttgttccatgaaaaatatgcct

SEQ ID NO: 1287404 - DNA, 22 bp, Artificial Sequence
  chemically synthesized
tttgttccatgaaaaatatgcc

SEQ ID NO: 1287405 - DNA, 22 bp, Artificial Sequence
  chemically synthesized
tgctaacaggcatatttttcat

SEQ ID NO: 1287406 - DNA, 22 bp, Artificial Sequence
  chemically synthesized
gctaacaggcatatttttcatg

SEQ ID NO: 1287407 - DNA, 22 bp, Artificial Sequence
  chemically synthesized
ctaacaggcatatttttcatgg

SEQ ID NO: 1287408 - DNA, 22 bp, Artificial Sequence
  chemically synthesized
acaggcatatttttcatggaac

SEQ ID NO: 1287409 - DNA, 22 bp, Artificial Sequence
  chemically synthesized
tccgtgactttttgttccatga

SEQ ID NO: 1287410 - DNA, 22 bp, Artificial Sequence
  chemically synthesized
ttgtccgtgactttttgttcca

SEQ ID NO: 1287411 - DNA, 22 bp, Artificial Sequence
  chemically synthesized
gttgtccgtgactttttgttcc

SEQ ID NO: 1287412 - DNA, 22 bp, Artificial Sequence
  chemically synthesized
ttcatggaacaaaaagtcacgg

SEQ ID NO: 1287413 - DNA, 22 bp, Artificial Sequence
  chemically synthesized
tcatggaacaaaaagtcacgga

SEQ ID NO: 1287414 - DNA, 22 bp, Artificial Sequence
  chemically synthesized
catggaacaaaaagtcacggac

SEQ ID NO: 1287415 - DNA, 22 bp, Artificial Sequence
  chemically synthesized
atggaacaaaaagtcacggaca

SEQ ID NO: 1287416 - DNA, 22 bp, Artificial Sequence
  chemically synthesized
atatgagaaaaatggacaatga

SEQ ID NO: 1287417 - DNA, 22 bp, Artificial Sequence
  chemically synthesized
attgtccatttttctcatatga

SEQ ID NO: 1287418 - DNA, 22 bp, Artificial Sequence
  chemically synthesized
aagtacagagaaattcatatga

SEQ ID NO: 1287419 - DNA, 22 bp, Artificial Sequence
  chemically synthesized
caagtacagagaaattcatatg

SEQ ID NO: 1287420 - DNA, 22 bp, Artificial Sequence
  chemically synthesized
tccatttttctcatatgaattt

SEQ ID NO: 1287421 - DNA, 22 bp, Artificial Sequence
  chemically synthesized
ttctcatatgaatttctctgta

SEQ ID NO: 1287422 - DNA, 22 bp, Artificial Sequence
  chemically synthesized
tctcatatgaatttctctgtac

SEQ ID NO: 1287423 - DNA, 22 bp, Artificial Sequence
  chemically synthesized
ctcatatgaatttctctgtact

SEQ ID NO: 1287424 - DNA, 22 bp, Artificial Sequence
  chemically synthesized
tcatatgaatttctctgtactt

SEQ ID NO: 1287425 - DNA, 22 bp, Artificial Sequence
  chemically synthesized
acagtaacatttcaagtacaga

SEQ ID NO: 1287426 - DNA, 22 bp, Artificial Sequence
  chemically synthesized
atatgaatttctctgtacttga

SEQ ID NO: 1287427 - DNA, 22 bp, Artificial Sequence
  chemically synthesized
ctctgtacttgaaatgttactg

SEQ ID NO: 1287428 - DNA, 22 bp, Artificial Sequence
  chemically synthesized
tctgtacttgaaatgttactgt

SEQ ID NO: 1287429 - DNA, 22 bp, Artificial Sequence
  chemically synthesized
tgtacttgaaatgttactgtca

SEQ ID NO: 1287430 - DNA, 22 bp, Artificial Sequence
  chemically synthesized
tacttgaaatgttactgtcagg

SEQ ID NO: 1287431 - DNA, 22 bp, Artificial Sequence
  chemically synthesized
gaaatgttactgtcaggacttg

SEQ ID NO: 1287432 - DNA, 22 bp, Artificial Sequence
  chemically synthesized
aaatgttactgtcaggacttgg

SEQ ID NO: 1287433 - DNA, 22 bp, Artificial Sequence
  chemically synthesized
ctgtcaggacttggctctgccc

SEQ ID NO: 1287434 - DNA, 22 bp, Artificial Sequence
  chemically synthesized
tcaggacttggctctgccctgc

SEQ ID NO: 1287435 - DNA, 22 bp, Artificial Sequence
  chemically synthesized
ggctctgccctgcttctatcat

SEQ ID NO: 1287436 - DNA, 22 bp, Artificial Sequence
  chemically synthesized
gctctgccctgcttctatcatg

SEQ ID NO: 1287437 - DNA, 22 bp, Artificial Sequence
  chemically synthesized
aataaggtgacaggcatgatag

SEQ ID NO: 1287438 - DNA, 22 bp, Artificial Sequence
  chemically synthesized
tgccctgcttctatcatgcctg

SEQ ID NO: 1287439 - DNA, 22 bp, Artificial Sequence
  chemically synthesized
ttgaataaggtgacaggcatga

SEQ ID NO: 1287440 - DNA, 22 bp, Artificial Sequence
  chemically synthesized
ccctgcttctatcatgcctgtc

SEQ ID NO: 1287441 - DNA, 22 bp, Artificial Sequence
  chemically synthesized
tattgaataaggtgacaggcat

SEQ ID NO: 1287442 - DNA, 22 bp, Artificial Sequence
  chemically synthesized
ctattgaataaggtgacaggca

SEQ ID NO: 1287443 - DNA, 22 bp, Artificial Sequence
  chemically synthesized
cttctatcatgcctgtcacctt

SEQ ID NO: 1287444 - DNA, 22 bp, Artificial Sequence
  chemically synthesized
tttctattgaataaggtgacag

SEQ ID NO: 1287445 - DNA, 22 bp, Artificial Sequence
  chemically synthesized
gtttctattgaataaggtgaca

SEQ ID NO: 1287446 - DNA, 22 bp, Artificial Sequence
  chemically synthesized
ctatcatgcctgtcaccttatt

SEQ ID NO: 1287447 - DNA, 22 bp, Artificial Sequence
  chemically synthesized
tatcatgcctgtcaccttattc

SEQ ID NO: 1287448 - DNA, 22 bp, Artificial Sequence
  chemically synthesized
tcatgcctgtcaccttattcaa

SEQ ID NO: 1287449 - DNA, 22 bp, Artificial Sequence
  chemically synthesized
atcttgtttctattgaataagg

SEQ ID NO: 1287450 - DNA, 22 bp, Artificial Sequence
  chemically synthesized
tcaccttattcaatagaaacaa

SEQ ID NO: 1287451 - DNA, 22 bp, Artificial Sequence
  chemically synthesized
attcaatagaaacaagatgagt

SEQ ID NO: 1287452 - DNA, 22 bp, Artificial Sequence
  chemically synthesized
ttcaatagaaacaagatgagtg

SEQ ID NO: 1287453 - DNA, 22 bp, Artificial Sequence
  chemically synthesized
ccaatgccaagaacactcatct

SEQ ID NO: 1287454 - DNA, 22 bp, Artificial Sequence
  chemically synthesized
cccaatgccaagaacactcatc

SEQ ID NO: 1287455 - DNA, 22 bp, Artificial Sequence
  chemically synthesized
aatagaaacaagatgagtgttc

SEQ ID NO: 1287456 - DNA, 22 bp, Artificial Sequence
  chemically synthesized
cttcccaatgccaagaacactc

SEQ ID NO: 1287457 - DNA, 22 bp, Artificial Sequence
  chemically synthesized
gcttcccaatgccaagaacact

SEQ ID NO: 1287458 - DNA, 22 bp, Artificial Sequence
  chemically synthesized
ttgcttcccaatgccaagaaca

SEQ ID NO: 1287459 - DNA, 22 bp, Artificial Sequence
  chemically synthesized
cttgcttcccaatgccaagaac

SEQ ID NO: 1287460 - DNA, 22 bp, Artificial Sequence
  chemically synthesized
acttcttgcttcccaatgccaa

SEQ ID NO: 1287461 - DNA, 22 bp, Artificial Sequence
  chemically synthesized
caatactaacttcttgcttccc

SEQ ID NO: 1287462 - DNA, 22 bp, Artificial Sequence
  chemically synthesized
acaatactaacttcttgcttcc

SEQ ID NO: 1287463 - DNA, 22 bp, Artificial Sequence
  chemically synthesized
ttggcattgggaagcaagaagt

SEQ ID NO: 1287464 - DNA, 22 bp, Artificial Sequence
  chemically synthesized
ggcattgggaagcaagaagtta

SEQ ID NO: 1287465 - DNA, 22 bp, Artificial Sequence
  chemically synthesized
gcattgggaagcaagaagttag

SEQ ID NO: 1287466 - DNA, 22 bp, Artificial Sequence
  chemically synthesized
ggaagcaagaagttagtattgt

SEQ ID NO: 1287467 - DNA, 22 bp, Artificial Sequence
  chemically synthesized
tgtgaaataatcatacttacaa

SEQ ID NO: 1287468 - DNA, 22 bp, Artificial Sequence
  chemically synthesized
gtattgtgtgaaataatcatac

SEQ ID NO: 1287469 - DNA, 22 bp, Artificial Sequence
  chemically synthesized
tagtattgtgtgaaataatcat

SEQ ID NO: 1287470 - DNA, 22 bp, Artificial Sequence
  chemically synthesized
gtattgtaagtatgattatttc

SEQ ID NO: 1287471 - DNA, 22 bp, Artificial Sequence
  chemically synthesized
ctagtattgtgtgaaataatca

SEQ ID NO: 1287472 - DNA, 22 bp, Artificial Sequence
  chemically synthesized
taagtatgattatttcacacaa

SEQ ID NO: 1287473 - DNA, 22 bp, Artificial Sequence
  chemically synthesized
agcaacgatttctagtattgtg

SEQ ID NO: 1287474 - DNA, 22 bp, Artificial Sequence
  chemically synthesized
ctcagcaacgatttctagtatt

SEQ ID NO: 1287475 - DNA, 22 bp, Artificial Sequence
  chemically synthesized
ttcctcagcaacgatttctagt

SEQ ID NO: 1287476 - DNA, 22 bp, Artificial Sequence
  chemically synthesized
tttcacacaatactagaaatcg

SEQ ID NO: 1287477 - DNA, 22 bp, Artificial Sequence
  chemically synthesized
cacacaatactagaaatcgttg

SEQ ID NO: 1287478 - DNA, 22 bp, Artificial Sequence
  chemically synthesized
acacaatactagaaatcgttgc

SEQ ID NO: 1287479 - DNA, 22 bp, Artificial Sequence
  chemically synthesized
gaaatcgttgctgaggaacagc

SEQ ID NO: 1287480 - DNA, 22 bp, Artificial Sequence
  chemically synthesized
cgtggcaatatgcaggctgttc

SEQ ID NO: 1287481 - DNA, 22 bp, Artificial Sequence
  chemically synthesized
ccgtggcaatatgcaggctgtt

SEQ ID NO: 1287482 - DNA, 22 bp, Artificial Sequence
  chemically synthesized
ttccgtggcaatatgcaggctg

SEQ ID NO: 1287483 - DNA, 22 bp, Artificial Sequence
  chemically synthesized
cttccgtggcaatatgcaggct

SEQ ID NO: 1287484 - DNA, 22 bp, Artificial Sequence
  chemically synthesized
ctgaggaacagcctgcatattg

SEQ ID NO: 1287485 - DNA, 22 bp, Artificial Sequence
  chemically synthesized
aggaacagcctgcatattgcca

SEQ ID NO: 1287486 - DNA, 22 bp, Artificial Sequence
  chemically synthesized
catattgccacggaagaaggct

SEQ ID NO: 1287487 - DNA, 22 bp, Artificial Sequence
  chemically synthesized
agggtacaggatcccagccttc

SEQ ID NO: 1287488 - DNA, 22 bp, Artificial Sequence
  chemically synthesized
ccacggaagaaggctgggatcc

SEQ ID NO: 1287489 - DNA, 22 bp, Artificial Sequence
  chemically synthesized
tctcagggtacaggatcccagc

SEQ ID NO: 1287490 - DNA, 22 bp, Artificial Sequence
  chemically synthesized
gcctatctcagggtacaggatc

SEQ ID NO: 1287491 - DNA, 22 bp, Artificial Sequence
  chemically synthesized
ggcctatctcagggtacaggat

SEQ ID NO: 1287492 - DNA, 22 bp, Artificial Sequence
  chemically synthesized
acttggcctatctcagggtaca

SEQ ID NO: 1287493 - DNA, 22 bp, Artificial Sequence
  chemically synthesized
cacttggcctatctcagggtac

SEQ ID NO: 1287494 - DNA, 22 bp, Artificial Sequence
  chemically synthesized
tttcacttggcctatctcaggg

SEQ ID NO: 1287495 - DNA, 22 bp, Artificial Sequence
  chemically synthesized
atttcacttggcctatctcagg

SEQ ID NO: 1287496 - DNA, 22 bp, Artificial Sequence
  chemically synthesized
ggatcctgtaccctgagatagg

SEQ ID NO: 1287497 - DNA, 22 bp, Artificial Sequence
  chemically synthesized
taccctgagataggccaagtga

SEQ ID NO: 1287498 - DNA, 22 bp, Artificial Sequence
  chemically synthesized
tgaatagaccttatttcacttg

SEQ ID NO: 1287499 - DNA, 22 bp, Artificial Sequence
  chemically synthesized
agataggccaagtgaaataagg

SEQ ID NO: 1287500 - DNA, 22 bp, Artificial Sequence
  chemically synthesized
ccatacaagtctatgaatagac

SEQ ID NO: 1287501 - DNA, 22 bp, Artificial Sequence
  chemically synthesized
taactaccatacaagtctatga

SEQ ID NO: 1287502 - DNA, 22 bp, Artificial Sequence
  chemically synthesized
ttcatagacttgtatggtagtt

SEQ ID NO: 1287503 - DNA, 22 bp, Artificial Sequence
  chemically synthesized
atagacttgtatggtagttaca

SEQ ID NO: 1287504 - DNA, 22 bp, Artificial Sequence
  chemically synthesized
aaacaaccaatgttgtaactac

SEQ ID NO: 1287505 - DNA, 22 bp, Artificial Sequence
  chemically synthesized
tctaaaacaaccaatgttgtaa

SEQ ID NO: 1287506 - DNA, 22 bp, Artificial Sequence
  chemically synthesized
gtatggtagttacaacattggt

SEQ ID NO: 1287507 - DNA, 22 bp, Artificial Sequence
  chemically synthesized
ttatctaaaacaaccaatgttg

SEQ ID NO: 1287508 - DNA, 22 bp, Artificial Sequence
  chemically synthesized
tatggtagttacaacattggtt

SEQ ID NO: 1287509 - DNA, 22 bp, Artificial Sequence
  chemically synthesized
cattattatctaaaacaaccaa

SEQ ID NO: 1287510 - DNA, 22 bp, Artificial Sequence
  chemically synthesized
caacattggttgttttagataa

SEQ ID NO: 1287511 - DNA, 22 bp, Artificial Sequence
  chemically synthesized
tgaagtctacattattatctaa

SEQ ID NO: 1287512 - DNA, 22 bp, Artificial Sequence
  chemically synthesized
atgaagtctacattattatcta

SEQ ID NO: 1287513 - DNA, 22 bp, Artificial Sequence
  chemically synthesized
gttgttttagataataatgtag

SEQ ID NO: 1287514 - DNA, 22 bp, Artificial Sequence
  chemically synthesized
gatgatttatgaagtctacatt

SEQ ID NO: 1287515 - DNA, 22 bp, Artificial Sequence
  chemically synthesized
ttttagataataatgtagactt

SEQ ID NO: 1287516 - DNA, 22 bp, Artificial Sequence
  chemically synthesized
tagataataatgtagacttcat

SEQ ID NO: 1287517 - DNA, 22 bp, Artificial Sequence
  chemically synthesized
agataataatgtagacttcata

SEQ ID NO: 1287518 - DNA, 22 bp, Artificial Sequence
  chemically synthesized
gataataatgtagacttcataa

SEQ ID NO: 1287519 - DNA, 22 bp, Artificial Sequence
  chemically synthesized
caagtgttagatgatttatgaa

SEQ ID NO: 1287520 - DNA, 22 bp, Artificial Sequence
  chemically synthesized
ccaagtgttagatgatttatga

SEQ ID NO: 1287521 - DNA, 22 bp, Artificial Sequence
  chemically synthesized
tccaagtgttagatgatttatg

SEQ ID NO: 1287522 - DNA, 22 bp, Artificial Sequence
  chemically synthesized
cataaatcatctaacacttgga

SEQ ID NO: 1287523 - DNA, 22 bp, Artificial Sequence
  chemically synthesized
ataaatcatctaacacttggaa

SEQ ID NO: 1287524 - DNA, 22 bp, Artificial Sequence
  chemically synthesized
tatggtacgtaatattttccaa

SEQ ID NO: 1287525 - DNA, 22 bp, Artificial Sequence
  chemically synthesized
ctatatggtacgtaatattttc

SEQ ID NO: 1287526 - DNA, 22 bp, Artificial Sequence
  chemically synthesized
actatatggtacgtaatatttt

SEQ ID NO: 1287527 - DNA, 22 bp, Artificial Sequence
  chemically synthesized
acacttggaaaatattacgtac

SEQ ID NO: 1287528 - DNA, 22 bp, Artificial Sequence
  chemically synthesized
aagagtttactatatggtacgt

SEQ ID NO: 1287529 - DNA, 22 bp, Artificial Sequence
  chemically synthesized
caagagtttactatatggtacg

SEQ ID NO: 1287530 - DNA, 22 bp, Artificial Sequence
  chemically synthesized
ggaaaatattacgtaccatata

SEQ ID NO: 1287531 - DNA, 22 bp, Artificial Sequence
  chemically synthesized
tcaagagtttactatatggtac

SEQ ID NO: 1287532 - DNA, 22 bp, Artificial Sequence
  chemically synthesized
gaaaatattacgtaccatatag

SEQ ID NO: 1287533 - DNA, 22 bp, Artificial Sequence
  chemically synthesized
tttcaagagtttactatatggt

SEQ ID NO: 1287534 - DNA, 22 bp, Artificial Sequence
  chemically synthesized
aaatgctctttcaagagtttac

SEQ ID NO: 1287535 - DNA, 22 bp, Artificial Sequence
  chemically synthesized
cgtaccatatagtaaactcttg

SEQ ID NO: 1287536 - DNA, 22 bp, Artificial Sequence
  chemically synthesized
ggggtactaaaatgctctttca

SEQ ID NO: 1287537 - DNA, 22 bp, Artificial Sequence
  chemically synthesized
tgggggtactaaaatgctcttt

SEQ ID NO: 1287538 - DNA, 22 bp, Artificial Sequence
  chemically synthesized
ttctgggggtactaaaatgctc

SEQ ID NO: 1287539 - DNA, 22 bp, Artificial Sequence
  chemically synthesized
ttgaaagagcattttagtaccc

SEQ ID NO: 1287540 - DNA, 22 bp, Artificial Sequence
  chemically synthesized
gaaagagcattttagtaccccc

SEQ ID NO: 1287541 - DNA, 22 bp, Artificial Sequence
  chemically synthesized
aagcattgttctgggggtacta

SEQ ID NO: 1287542 - DNA, 22 bp, Artificial Sequence
  chemically synthesized
aaagagcattttagtaccccca

SEQ ID NO: 1287543 - DNA, 22 bp, Artificial Sequence
  chemically synthesized
caagcattgttctgggggtact

SEQ ID NO: 1287544 - DNA, 22 bp, Artificial Sequence
  chemically synthesized
tcaagcattgttctgggggtac

SEQ ID NO: 1287545 - DNA, 22 bp, Artificial Sequence
  chemically synthesized
aattttcaagcattgttctggg

SEQ ID NO: 1287546 - DNA, 22 bp, Artificial Sequence
  chemically synthesized
aaattttcaagcattgttctgg

SEQ ID NO: 1287547 - DNA, 22 bp, Artificial Sequence
  chemically synthesized
tagtacccccagaacaatgctt

SEQ ID NO: 1287548 - DNA, 22 bp, Artificial Sequence
  chemically synthesized
ccttaaattttcaagcattgtt

SEQ ID NO: 1287549 - DNA, 22 bp, Artificial Sequence
  chemically synthesized
agtacccccagaacaatgcttg

SEQ ID NO: 1287550 - DNA, 22 bp, Artificial Sequence
  chemically synthesized
gccttaaattttcaagcattgt

SEQ ID NO: 1287551 - DNA, 22 bp, Artificial Sequence
  chemically synthesized
gtacccccagaacaatgcttga

SEQ ID NO: 1287552 - DNA, 22 bp, Artificial Sequence
  chemically synthesized
gaagtaatttgccttaaatttt

SEQ ID NO: 1287553 - DNA, 22 bp, Artificial Sequence
  chemically synthesized
ggaagtaatttgccttaaattt

SEQ ID NO: 1287554 - DNA, 22 bp, Artificial Sequence
  chemically synthesized
atttggaagtaatttgccttaa

SEQ ID NO: 1287555 - DNA, 22 bp, Artificial Sequence
  chemically synthesized
tgttgatttggaagtaatttgc

SEQ ID NO: 1287556 - DNA, 22 bp, Artificial Sequence
  chemically synthesized
gaaaatttaaggcaaattactt

SEQ ID NO: 1287557 - DNA, 22 bp, Artificial Sequence
  chemically synthesized
aaaatttaaggcaaattacttc

SEQ ID NO: 1287558 - DNA, 22 bp, Artificial Sequence
  chemically synthesized
aaaattgtgttgatttggaagt

SEQ ID NO: 1287559 - DNA, 22 bp, Artificial Sequence
  chemically synthesized
aaggcaaattacttccaaatca

SEQ ID NO: 1287560 - DNA, 22 bp, Artificial Sequence
  chemically synthesized
aggcaaattacttccaaatcaa

SEQ ID NO: 1287561 - DNA, 22 bp, Artificial Sequence
  chemically synthesized
cactcaaaattgtgttgatttg

SEQ ID NO: 1287562 - DNA, 22 bp, Artificial Sequence
  chemically synthesized
agttacactcaaaattgtgttg

SEQ ID NO: 1287563 - DNA, 22 bp, Artificial Sequence
  chemically synthesized
cttccaaatcaacacaattttg

SEQ ID NO: 1287564 - DNA, 22 bp, Artificial Sequence
  chemically synthesized
ccaaatcaacacaattttgagt

SEQ ID NO: 1287565 - DNA, 22 bp, Artificial Sequence
  chemically synthesized
caaatcaacacaattttgagtg

SEQ ID NO: 1287566 - DNA, 22 bp, Artificial Sequence
  chemically synthesized
ccatatcaaaggccagagttaa

SEQ ID NO: 1287567 - DNA, 22 bp, Artificial Sequence
  chemically synthesized
accatatcaaaggccagagtta

SEQ ID NO: 1287568 - DNA, 22 bp, Artificial Sequence
  chemically synthesized
tgagtgtaacttaactctggcc

SEQ ID NO: 1287569 - DNA, 22 bp, Artificial Sequence
  chemically synthesized
gagtgtaacttaactctggcct

SEQ ID NO: 1287570 - DNA, 22 bp, Artificial Sequence
  chemically synthesized
agtgtaacttaactctggcctt

SEQ ID NO: 1287571 - DNA, 22 bp, Artificial Sequence
  chemically synthesized
gcagtttaccatatcaaaggcc

SEQ ID NO: 1287572 - DNA, 22 bp, Artificial Sequence
  chemically synthesized
aactctggcctttgatatggta

SEQ ID NO: 1287573 - DNA, 22 bp, Artificial Sequence
  chemically synthesized
taattggcagtttaccatatca

SEQ ID NO: 1287574 - DNA, 22 bp, Artificial Sequence
  chemically synthesized
actctggcctttgatatggtaa

SEQ ID NO: 1287575 - DNA, 22 bp, Artificial Sequence
  chemically synthesized
tggcctttgatatggtaaactg

SEQ ID NO: 1287576 - DNA, 22 bp, Artificial Sequence
  chemically synthesized
gcctttgatatggtaaactgcc

SEQ ID NO: 1287577 - DNA, 22 bp, Artificial Sequence
  chemically synthesized
gatagctataattggcagttta

SEQ ID NO: 1287578 - DNA, 22 bp, Artificial Sequence
  chemically synthesized
tgatatggtaaactgccaatta

SEQ ID NO: 1287579 - DNA, 22 bp, Artificial Sequence
  chemically synthesized
gatatggtaaactgccaattat

SEQ ID NO: 1287580 - DNA, 22 bp, Artificial Sequence
  chemically synthesized
atatggtaaactgccaattata

SEQ ID NO: 1287581 - DNA, 22 bp, Artificial Sequence
  chemically synthesized
aatccgagctagatagctataa

SEQ ID NO: 1287582 - DNA, 22 bp, Artificial Sequence
  chemically synthesized
aaatccgagctagatagctata

SEQ ID NO: 1287583 - DNA, 22 bp, Artificial Sequence
  chemically synthesized
aatttaaatccgagctagatag

SEQ ID NO: 1287584 - DNA, 22 bp, Artificial Sequence
  chemically synthesized
ccaattatagctatctagctcg

SEQ ID NO: 1287585 - DNA, 22 bp, Artificial Sequence
  chemically synthesized
attcaatttaaatccgagctag

SEQ ID NO: 1287586 - DNA, 22 bp, Artificial Sequence
  chemically synthesized
tagctatctagctcggatttaa

SEQ ID NO: 1287587 - DNA, 22 bp, Artificial Sequence
  chemically synthesized
atctaattcaatttaaatccga

SEQ ID NO: 1287588 - DNA, 22 bp, Artificial Sequence
  chemically synthesized
aatctaattcaatttaaatccg

SEQ ID NO: 1287589 - DNA, 22 bp, Artificial Sequence
  chemically synthesized
tctagctcggatttaaattgaa

SEQ ID NO: 1287590 - DNA, 22 bp, Artificial Sequence
  chemically synthesized
gctcggatttaaattgaattag

SEQ ID NO: 1287591 - DNA, 22 bp, Artificial Sequence
  chemically synthesized
ggtcacagtttaatctaattca

SEQ ID NO: 1287592 - DNA, 22 bp, Artificial Sequence
  chemically synthesized
ggatttaaattgaattagatta

SEQ ID NO: 1287593 - DNA, 22 bp, Artificial Sequence
  chemically synthesized
aaattgaattagattaaactgt

SEQ ID NO: 1287594 - DNA, 22 bp, Artificial Sequence
  chemically synthesized
aattgaattagattaaactgtg

SEQ ID NO: 1287595 - DNA, 22 bp, Artificial Sequence
  chemically synthesized
aattagattaaactgtgaccca

SEQ ID NO: 1287596 - DNA, 22 bp, Artificial Sequence
  chemically synthesized
gattaaactgtgacccagtgat

SEQ ID NO: 1287597 - DNA, 22 bp, Artificial Sequence
  chemically synthesized
aactgtgacccagtgatttttc

SEQ ID NO: 1287598 - DNA, 22 bp, Artificial Sequence
  chemically synthesized
accacataagaaaccagaaaaa

SEQ ID NO: 1287599 - DNA, 22 bp, Artificial Sequence
  chemically synthesized
tgacccagtgatttttctggtt

SEQ ID NO: 1287600 - DNA, 22 bp, Artificial Sequence
  chemically synthesized
cactgaccacataagaaaccag

SEQ ID NO: 1287601 - DNA, 22 bp, Artificial Sequence
  chemically synthesized
gcactgaccacataagaaacca

SEQ ID NO: 1287602 - DNA, 22 bp, Artificial Sequence
  chemically synthesized
tttgcactgaccacataagaaa

SEQ ID NO: 1287603 - DNA, 22 bp, Artificial Sequence
  chemically synthesized
ttctggtttcttatgtggtcag

SEQ ID NO: 1287604 - DNA, 22 bp, Artificial Sequence
  chemically synthesized
tctggtttcttatgtggtcagt

SEQ ID NO: 1287605 - DNA, 22 bp, Artificial Sequence
  chemically synthesized
ctggtttcttatgtggtcagtg

SEQ ID NO: 1287606 - DNA, 22 bp, Artificial Sequence
  chemically synthesized
tggtttcttatgtggtcagtgc

SEQ ID NO: 1287607 - DNA, 22 bp, Artificial Sequence
  chemically synthesized
aatataactgtttgcactgacc

SEQ ID NO: 1287608 - DNA, 22 bp, Artificial Sequence
  chemically synthesized
gtttcttatgtggtcagtgcaa

SEQ ID NO: 1287609 - DNA, 22 bp, Artificial Sequence
  chemically synthesized
cttatgtggtcagtgcaaacag

SEQ ID NO: 1287610 - DNA, 22 bp, Artificial Sequence
  chemically synthesized
ttatgtggtcagtgcaaacagt

SEQ ID NO: 1287611 - DNA, 22 bp, Artificial Sequence
  chemically synthesized
atgtggtcagtgcaaacagtta

SEQ ID NO: 1287612 - DNA, 22 bp, Artificial Sequence
  chemically synthesized
tgtggtcagtgcaaacagttat

SEQ ID NO: 1287613 - DNA, 22 bp, Artificial Sequence
  chemically synthesized
ccaccattaaatataactgttt

SEQ ID NO: 1287614 - DNA, 22 bp, Artificial Sequence
  chemically synthesized
accaccattaaatataactgtt

SEQ ID NO: 1287615 - DNA, 22 bp, Artificial Sequence
  chemically synthesized
taccaccattaaatataactgt

SEQ ID NO: 1287616 - DNA, 22 bp, Artificial Sequence
  chemically synthesized
agctttaccaccattaaatata

SEQ ID NO: 1287617 - DNA, 22 bp, Artificial Sequence
  chemically synthesized
tctcagctttaccaccattaaa

SEQ ID NO: 1287618 - DNA, 22 bp, Artificial Sequence
  chemically synthesized
atctcagctttaccaccattaa

SEQ ID NO: 1287619 - DNA, 22 bp, Artificial Sequence
  chemically synthesized
tatctcagctttaccaccatta

SEQ ID NO: 1287620 - DNA, 22 bp, Artificial Sequence
  chemically synthesized
ttatctcagctttaccaccatt

SEQ ID NO: 1287621 - DNA, 22 bp, Artificial Sequence
  chemically synthesized
acgtttttatctcagctttacc

SEQ ID NO: 1287622 - DNA, 22 bp, Artificial Sequence
  chemically synthesized
tatttaatggtggtaaagctga

SEQ ID NO: 1287623 - DNA, 22 bp, Artificial Sequence
  chemically synthesized
aacgtttttatctcagctttac

SEQ ID NO: 1287624 - DNA, 22 bp, Artificial Sequence
  chemically synthesized
aatggtggtaaagctgagataa

SEQ ID NO: 1287625 - DNA, 22 bp, Artificial Sequence
  chemically synthesized
catttaacgtttttatctcagc

SEQ ID NO: 1287626 - DNA, 22 bp, Artificial Sequence
  chemically synthesized
atggtggtaaagctgagataaa

SEQ ID NO: 1287627 - DNA, 22 bp, Artificial Sequence
  chemically synthesized
acatttaacgtttttatctcag

SEQ ID NO: 1287628 - DNA, 22 bp, Artificial Sequence
  chemically synthesized
ttacatttaacgtttttatctc

SEQ ID NO: 1287629 - DNA, 22 bp, Artificial Sequence
  chemically synthesized
actcttacatttaacgttttta

SEQ ID NO: 1287630 - DNA, 22 bp, Artificial Sequence
  chemically synthesized
caattgactcttacatttaacg

SEQ ID NO: 1287631 - DNA, 22 bp, Artificial Sequence
  chemically synthesized
gcaattgactcttacatttaac

SEQ ID NO: 1287632 - DNA, 22 bp, Artificial Sequence
  chemically synthesized
agataaaaacgttaaatgtaag

SEQ ID NO: 1287633 - DNA, 22 bp, Artificial Sequence
  chemically synthesized
aatgtaagagtcaattgcaagg

SEQ ID NO: 1287634 - DNA, 22 bp, Artificial Sequence
  chemically synthesized
gaaagaaaatgaccttgcaatt

SEQ ID NO: 1287635 - DNA, 22 bp, Artificial Sequence
  chemically synthesized
ggaaagaaaatgaccttgcaat

SEQ ID NO: 1287636 - DNA, 22 bp, Artificial Sequence
  chemically synthesized
cttggaaagaaaatgaccttgc

SEQ ID NO: 1287637 - DNA, 22 bp, Artificial Sequence
  chemically synthesized
attacttggaaagaaaatgacc

SEQ ID NO: 1287638 - DNA, 22 bp, Artificial Sequence
  chemically synthesized
cattacttggaaagaaaatgac

SEQ ID NO: 1287639 - DNA, 22 bp, Artificial Sequence
  chemically synthesized
tcattacttggaaagaaaatga

SEQ ID NO: 1287640 - DNA, 22 bp, Artificial Sequence
  chemically synthesized
cgttttcattacttggaaagaa

SEQ ID NO: 1287641 - DNA, 22 bp, Artificial Sequence
  chemically synthesized
caaggtcattttctttccaagt

SEQ ID NO: 1287642 - DNA, 22 bp, Artificial Sequence
  chemically synthesized
tctttccaagtaatgaaaacgt

SEQ ID NO: 1287643 - DNA, 22 bp, Artificial Sequence
  chemically synthesized
ctttccaagtaatgaaaacgta

SEQ ID NO: 1287644 - DNA, 22 bp, Artificial Sequence
  chemically synthesized
tttccaagtaatgaaaacgtag

SEQ ID NO: 1287645 - DNA, 22 bp, Artificial Sequence
  chemically synthesized
tccaagtaatgaaaacgtagta

SEQ ID NO: 1287646 - DNA, 22 bp, Artificial Sequence
  chemically synthesized
cagcggatcaagtactacgttt

SEQ ID NO: 1287647 - DNA, 22 bp, Artificial Sequence
  chemically synthesized
ccaagtaatgaaaacgtagtac

SEQ ID NO: 1287648 - DNA, 22 bp, Artificial Sequence
  chemically synthesized
acagcggatcaagtactacgtt

SEQ ID NO: 1287649 - DNA, 22 bp, Artificial Sequence
  chemically synthesized
caagtaatgaaaacgtagtact

SEQ ID NO: 1287650 - DNA, 22 bp, Artificial Sequence
  chemically synthesized
tacagcggatcaagtactacgt

SEQ ID NO: 1287651 - DNA, 22 bp, Artificial Sequence
  chemically synthesized
taattttacagcggatcaagta

SEQ ID NO: 1287652 - DNA, 22 bp, Artificial Sequence
  chemically synthesized
gcctgtaattttacagcggatc

SEQ ID NO: 1287653 - DNA, 22 bp, Artificial Sequence
  chemically synthesized
agtcattagcctgtaattttac

SEQ ID NO: 1287654 - DNA, 22 bp, Artificial Sequence
  chemically synthesized
gatccgctgtaaaattacaggc

SEQ ID NO: 1287655 - DNA, 22 bp, Artificial Sequence
  chemically synthesized
atccgctgtaaaattacaggct

SEQ ID NO: 1287656 - DNA, 22 bp, Artificial Sequence
  chemically synthesized
taggactgagtcattagcctgt

SEQ ID NO: 1287657 - DNA, 22 bp, Artificial Sequence
  chemically synthesized
tgtaggactgagtcattagcct

SEQ ID NO: 1287658 - DNA, 22 bp, Artificial Sequence
  chemically synthesized
taaaattacaggctaatgactc

SEQ ID NO: 1287659 - DNA, 22 bp, Artificial Sequence
  chemically synthesized
ctctgtaggactgagtcattag

SEQ ID NO: 1287660 - DNA, 22 bp, Artificial Sequence
  chemically synthesized
agagctactctgtaggactgag

SEQ ID NO: 1287661 - DNA, 22 bp, Artificial Sequence
  chemically synthesized
caggctaatgactcagtcctac

SEQ ID NO: 1287662 - DNA, 22 bp, Artificial Sequence
  chemically synthesized
gagagctactctgtaggactga

SEQ ID NO: 1287663 - DNA, 22 bp, Artificial Sequence
  chemically synthesized
atgactcagtcctacagagtag

SEQ ID NO: 1287664 - DNA, 22 bp, Artificial Sequence
  chemically synthesized
agtcctacagagtagctctcaa

SEQ ID NO: 1287665 - DNA, 22 bp, Artificial Sequence
  chemically synthesized
cagagtagctctcaaaccttgt

SEQ ID NO: 1287666 - DNA, 22 bp, Artificial Sequence
  chemically synthesized
aatcagtgtgggtacatcgaac

SEQ ID NO: 1287667 - DNA, 22 bp, Artificial Sequence
  chemically synthesized
aaatcagtgtgggtacatcgaa

SEQ ID NO: 1287668 - DNA, 22 bp, Artificial Sequence
  chemically synthesized
tcaaaccttgttcgatgtaccc

SEQ ID NO: 1287669 - DNA, 22 bp, Artificial Sequence
  chemically synthesized
cttaaatcagtgtgggtacatc

SEQ ID NO: 1287670 - DNA, 22 bp, Artificial Sequence
  chemically synthesized
aaaccttgttcgatgtacccac

SEQ ID NO: 1287671 - DNA, 22 bp, Artificial Sequence
  chemically synthesized
gcttaaatcagtgtgggtacat

SEQ ID NO: 1287672 - DNA, 22 bp, Artificial Sequence
  chemically synthesized
tgcttaaatcagtgtgggtaca

SEQ ID NO: 1287673 - DNA, 22 bp, Artificial Sequence
  chemically synthesized
tctttgcttaaatcagtgtggg

SEQ ID NO: 1287674 - DNA, 22 bp, Artificial Sequence
  chemically synthesized
gtctttgcttaaatcagtgtgg

SEQ ID NO: 1287675 - DNA, 22 bp, Artificial Sequence
  chemically synthesized
gttcgatgtacccacactgatt

SEQ ID NO: 1287676 - DNA, 22 bp, Artificial Sequence
  chemically synthesized
tgtctttgcttaaatcagtgtg

SEQ ID NO: 1287677 - DNA, 22 bp, Artificial Sequence
  chemically synthesized
ttcgatgtacccacactgattt

SEQ ID NO: 1287678 - DNA, 22 bp, Artificial Sequence
  chemically synthesized
gatgtacccacactgatttaag

SEQ ID NO: 1287679 - DNA, 22 bp, Artificial Sequence
  chemically synthesized
atcgtcaaaatgatactttgtc

SEQ ID NO: 1287680 - DNA, 22 bp, Artificial Sequence
  chemically synthesized
atttaagcaaagacaaagtatc

SEQ ID NO: 1287681 - DNA, 22 bp, Artificial Sequence
  chemically synthesized
aatcgtcaaaatgatactttgt

SEQ ID NO: 1287682 - DNA, 22 bp, Artificial Sequence
  chemically synthesized
tttaatcgtcaaaatgatactt

SEQ ID NO: 1287683 - DNA, 22 bp, Artificial Sequence
  chemically synthesized
aagcaaagacaaagtatcattt

SEQ ID NO: 1287684 - DNA, 22 bp, Artificial Sequence
  chemically synthesized
agcaaagacaaagtatcatttt

SEQ ID NO: 1287685 - DNA, 22 bp, Artificial Sequence
  chemically synthesized
tcattatttaatcgtcaaaatg

SEQ ID NO: 1287686 - DNA, 22 bp, Artificial Sequence
  chemically synthesized
gtcattatttaatcgtcaaaat

SEQ ID NO: 1287687 - DNA, 22 bp, Artificial Sequence
  chemically synthesized
cttgtcattatttaatcgtcaa

SEQ ID NO: 1287688 - DNA, 22 bp, Artificial Sequence
  chemically synthesized
tgctccttgtcattatttaatc

SEQ ID NO: 1287689 - DNA, 22 bp, Artificial Sequence
  chemically synthesized
atgctccttgtcattatttaat

SEQ ID NO: 1287690 - DNA, 22 bp, Artificial Sequence
  chemically synthesized
tgacgattaaataatgacaagg

SEQ ID NO: 1287691 - DNA, 22 bp, Artificial Sequence
  chemically synthesized
gacgattaaataatgacaagga

SEQ ID NO: 1287692 - DNA, 22 bp, Artificial Sequence
  chemically synthesized
acgattaaataatgacaaggag

SEQ ID NO: 1287693 - DNA, 22 bp, Artificial Sequence
  chemically synthesized
agacgtgatttatgctccttgt

SEQ ID NO: 1287694 - DNA, 22 bp, Artificial Sequence
  chemically synthesized
aataatgacaaggagcataaat

SEQ ID NO: 1287695 - DNA, 22 bp, Artificial Sequence
  chemically synthesized
tggcaccatctaagacgtgatt

SEQ ID NO: 1287696 - DNA, 22 bp, Artificial Sequence
  chemically synthesized
gtggcaccatctaagacgtgat

SEQ ID NO: 1287697 - DNA, 22 bp, Artificial Sequence
  chemically synthesized
tgtggcaccatctaagacgtga

SEQ ID NO: 1287698 - DNA, 22 bp, Artificial Sequence
  chemically synthesized
tattttgtggcaccatctaaga

SEQ ID NO: 1287699 - DNA, 22 bp, Artificial Sequence
  chemically synthesized
gtattttgtggcaccatctaag

SEQ ID NO: 1287700 - DNA, 22 bp, Artificial Sequence
  chemically synthesized
aaatttgtattttgtggcacca

SEQ ID NO: 1287701 - DNA, 22 bp, Artificial Sequence
  chemically synthesized
aaaatttgtattttgtggcacc

SEQ ID NO: 1287702 - DNA, 22 bp, Artificial Sequence
  chemically synthesized
taaaatttgtattttgtggcac

SEQ ID NO: 1287703 - DNA, 22 bp, Artificial Sequence
  chemically synthesized
agatggtgccacaaaatacaaa

SEQ ID NO: 1287704 - DNA, 22 bp, Artificial Sequence
  chemically synthesized
agacctttaaaatttgtatttt

SEQ ID NO: 1287705 - DNA, 22 bp, Artificial Sequence
  chemically synthesized
gatggtgccacaaaatacaaat

SEQ ID NO: 1287706 - DNA, 22 bp, Artificial Sequence
  chemically synthesized
ttgagacctttaaaatttgtat

SEQ ID NO: 1287707 - DNA, 22 bp, Artificial Sequence
  chemically synthesized
tccaaaaatgtctattgagacc

SEQ ID NO: 1287708 - DNA, 22 bp, Artificial Sequence
  chemically synthesized
atccaaaaatgtctattgagac

SEQ ID NO: 1287709 - DNA, 22 bp, Artificial Sequence
  chemically synthesized
tatccaaaaatgtctattgaga

SEQ ID NO: 1287710 - DNA, 22 bp, Artificial Sequence
  chemically synthesized
ttttatccaaaaatgtctattg

SEQ ID NO: 1287711 - DNA, 22 bp, Artificial Sequence
  chemically synthesized
taaaggtctcaatagacatttt

SEQ ID NO: 1287712 - DNA, 22 bp, Artificial Sequence
  chemically synthesized
aaaggtctcaatagacattttt

SEQ ID NO: 1287713 - DNA, 22 bp, Artificial Sequence
  chemically synthesized
attattttatccaaaaatgtct

SEQ ID NO: 1287714 - DNA, 22 bp, Artificial Sequence
  chemically synthesized
aaggtctcaatagacatttttg

SEQ ID NO: 1287715 - DNA, 22 bp, Artificial Sequence
  chemically synthesized
tcattattttatccaaaaatgt

SEQ ID NO: 1287716 - DNA, 22 bp, Artificial Sequence
  chemically synthesized
ctcattattttatccaaaaatg

SEQ ID NO: 1287717 - DNA, 22 bp, Artificial Sequence
  chemically synthesized
tctcattattttatccaaaaat

SEQ ID NO: 1287718 - DNA, 22 bp, Artificial Sequence
  chemically synthesized
ttctcattattttatccaaaaa

SEQ ID NO: 1287719 - DNA, 22 bp, Artificial Sequence
  chemically synthesized
tttctcattattttatccaaaa

SEQ ID NO: 1287720 - DNA, 22 bp, Artificial Sequence
  chemically synthesized
ttttctcattattttatccaaa

SEQ ID NO: 1287721 - DNA, 22 bp, Artificial Sequence
  chemically synthesized
aatagacatttttggataaaat

SEQ ID NO: 1287722 - DNA, 22 bp, Artificial Sequence
  chemically synthesized
aacatttttttctcattatttt

SEQ ID NO: 1287723 - DNA, 22 bp, Artificial Sequence
  chemically synthesized
attgaacatttttttctcatta

SEQ ID NO: 1287724 - DNA, 22 bp, Artificial Sequence
  chemically synthesized
gattgaacatttttttctcatt

SEQ ID NO: 1287725 - DNA, 22 bp, Artificial Sequence
  chemically synthesized
ttggataaaataatgagaaaaa

SEQ ID NO: 1287726 - DNA, 22 bp, Artificial Sequence
  chemically synthesized
tgattgaacatttttttctcat

SEQ ID NO: 1287727 - DNA, 22 bp, Artificial Sequence
  chemically synthesized
tggataaaataatgagaaaaaa

SEQ ID NO: 1287728 - DNA, 22 bp, Artificial Sequence
  chemically synthesized
ggataaaataatgagaaaaaaa

SEQ ID NO: 1287729 - DNA, 22 bp, Artificial Sequence
  chemically synthesized
gataaaataatgagaaaaaaat

SEQ ID NO: 1287730 - DNA, 22 bp, Artificial Sequence
  chemically synthesized
ccatccacctttgattgaacat

SEQ ID NO: 1287731 - DNA, 22 bp, Artificial Sequence
  chemically synthesized
accatccacctttgattgaaca

SEQ ID NO: 1287732 - DNA, 22 bp, Artificial Sequence
  chemically synthesized
taaatatttaccatccaccttt

SEQ ID NO: 1287733 - DNA, 22 bp, Artificial Sequence
  chemically synthesized
gtaaatatttaccatccacctt

SEQ ID NO: 1287734 - DNA, 22 bp, Artificial Sequence
  chemically synthesized
aaatttgtaaatatttaccatc

SEQ ID NO: 1287735 - DNA, 22 bp, Artificial Sequence
  chemically synthesized
aatcaaaggtggatggtaaata

SEQ ID NO: 1287736 - DNA, 22 bp, Artificial Sequence
  chemically synthesized
aaaatttgtaaatatttaccat

SEQ ID NO: 1287737 - DNA, 22 bp, Artificial Sequence
  chemically synthesized
taaaatttgtaaatatttacca

SEQ ID NO: 1287738 - DNA, 22 bp, Artificial Sequence
  chemically synthesized
ttaaaatttgtaaatatttacc

SEQ ID NO: 1287739 - DNA, 22 bp, Artificial Sequence
  chemically synthesized
tttttaaaatttgtaaatattt

SEQ ID NO: 1287740 - DNA, 22 bp, Artificial Sequence
  chemically synthesized
atttttaaaatttgtaaatatt

SEQ ID NO: 1287741 - DNA, 22 bp, Artificial Sequence
  chemically synthesized
taaatatttatttttaaaattt

SEQ ID NO: 1287742 - DNA, 22 bp, Artificial Sequence
  chemically synthesized
ataaatatttatttttaaaatt

SEQ ID NO: 1287743 - DNA, 22 bp, Artificial Sequence
  chemically synthesized
acaaattttaaaaataaatatt

SEQ ID NO: 1287744 - DNA, 22 bp, Artificial Sequence
  chemically synthesized
caaattttaaaaataaatattt

SEQ ID NO: 1287745 - DNA, 22 bp, Artificial Sequence
  chemically synthesized
agtaataggacttataaatatt

SEQ ID NO: 1287746 - DNA, 22 bp, Artificial Sequence
  chemically synthesized
aagtaataggacttataaatat

SEQ ID NO: 1287747 - DNA, 22 bp, Artificial Sequence
  chemically synthesized
taagtaataggacttataaata

SEQ ID NO: 1287748 - DNA, 22 bp, Artificial Sequence
  chemically synthesized
ttaagtaataggacttataaat

SEQ ID NO: 1287749 - DNA, 22 bp, Artificial Sequence
  chemically synthesized
taaaaataaatatttataagtc

SEQ ID NO: 1287750 - DNA, 22 bp, Artificial Sequence
  chemically synthesized
tttaagtaataggacttataaa

SEQ ID NO: 1287751 - DNA, 22 bp, Artificial Sequence
  chemically synthesized
aaaaataaatatttataagtcc

SEQ ID NO: 1287752 - DNA, 22 bp, Artificial Sequence
  chemically synthesized
ttttaagtaataggacttataa

SEQ ID NO: 1287753 - DNA, 22 bp, Artificial Sequence
  chemically synthesized
aaaataaatatttataagtcct

SEQ ID NO: 1287754 - DNA, 22 bp, Artificial Sequence
  chemically synthesized
cttttttaagtaataggactta

SEQ ID NO: 1287755 - DNA, 22 bp, Artificial Sequence
  chemically synthesized
tattacttttttaagtaatagg

SEQ ID NO: 1287756 - DNA, 22 bp, Artificial Sequence
  chemically synthesized
ataagtcctattacttaaaaaa

SEQ ID NO: 1287757 - DNA, 22 bp, Artificial Sequence
  chemically synthesized
taagtcctattacttaaaaaag

SEQ ID NO: 1287758 - DNA, 22 bp, Artificial Sequence
  chemically synthesized
caatgtgtactatattactttt

SEQ ID NO: 1287759 - DNA, 22 bp, Artificial Sequence
  chemically synthesized
ttacttaaaaaagtaatatagt

SEQ ID NO: 1287760 - DNA, 22 bp, Artificial Sequence
  chemically synthesized
cttaaaaaagtaatatagtaca

SEQ ID NO: 1287761 - DNA, 22 bp, Artificial Sequence
  chemically synthesized
aaatattacaatgtgtactata

SEQ ID NO: 1287762 - DNA, 22 bp, Artificial Sequence
  chemically synthesized
aaaatattacaatgtgtactat

SEQ ID NO: 1287763 - DNA, 22 bp, Artificial Sequence
  chemically synthesized
aaaaaagtaatatagtacacat

SEQ ID NO: 1287764 - DNA, 22 bp, Artificial Sequence
  chemically synthesized
aaaaagtaatatagtacacatt

SEQ ID NO: 1287765 - DNA, 22 bp, Artificial Sequence
  chemically synthesized
ttaaaatattacaatgtgtact

SEQ ID NO: 1287766 - DNA, 22 bp, Artificial Sequence
  chemically synthesized
cttaaaatattacaatgtgtac

SEQ ID NO: 1287767 - DNA, 22 bp, Artificial Sequence
  chemically synthesized
tcttaaaatattacaatgtgta

SEQ ID NO: 1287768 - DNA, 22 bp, Artificial Sequence
  chemically synthesized
aaactttcttaaaatattacaa

SEQ ID NO: 1287769 - DNA, 22 bp, Artificial Sequence
  chemically synthesized
agaaaacaatactaaaactttc

SEQ ID NO: 1287770 - DNA, 22 bp, Artificial Sequence
  chemically synthesized
taatattttaagaaagttttag

SEQ ID NO: 1287771 - DNA, 22 bp, Artificial Sequence
  chemically synthesized
atgcctcagaaaacaatactaa

SEQ ID NO: 1287772 - DNA, 22 bp, Artificial Sequence
  chemically synthesized
gatgcctcagaaaacaatacta

SEQ ID NO: 1287773 - DNA, 22 bp, Artificial Sequence
  chemically synthesized
taagaaagttttagtattgttt

SEQ ID NO: 1287774 - DNA, 22 bp, Artificial Sequence
  chemically synthesized
aagaaagttttagtattgtttt

SEQ ID NO: 1287775 - DNA, 22 bp, Artificial Sequence
  chemically synthesized
agaaagttttagtattgttttc

SEQ ID NO: 1287776 - DNA, 22 bp, Artificial Sequence
  chemically synthesized
tagtattgttttctgaggcatc

SEQ ID NO: 1287777 - DNA, 22 bp, Artificial Sequence
  chemically synthesized
agtattgttttctgaggcatca

SEQ ID NO: 1287778 - DNA, 22 bp, Artificial Sequence
  chemically synthesized
gtattgttttctgaggcatcaa

SEQ ID NO: 1287779 - DNA, 22 bp, Artificial Sequence
  chemically synthesized
aaaaaatggaatttgatgcctc

SEQ ID NO: 1287780 - DNA, 22 bp, Artificial Sequence
  chemically synthesized
caaaaaatggaatttgatgcct

SEQ ID NO: 1287781 - DNA, 22 bp, Artificial Sequence
  chemically synthesized
tcaaaaaatggaatttgatgcc

SEQ ID NO: 1287782 - DNA, 22 bp, Artificial Sequence
  chemically synthesized
ttttctgaggcatcaaattcca

SEQ ID NO: 1287783 - DNA, 22 bp, Artificial Sequence
  chemically synthesized
tctgaggcatcaaattccattt

SEQ ID NO: 1287784 - DNA, 22 bp, Artificial Sequence
  chemically synthesized
ctgaggcatcaaattccatttt

SEQ ID NO: 1287785 - DNA, 22 bp, Artificial Sequence
  chemically synthesized
tgaggcatcaaattccattttt

SEQ ID NO: 1287786 - DNA, 22 bp, Artificial Sequence
  chemically synthesized
atgatactttcaaaaaatggaa

SEQ ID NO: 1287787 - DNA, 22 bp, Artificial Sequence
  chemically synthesized
catgatactttcaaaaaatgga

SEQ ID NO: 1287788 - DNA, 22 bp, Artificial Sequence
  chemically synthesized
aggcatcaaattccattttttg

SEQ ID NO: 1287789 - DNA, 22 bp, Artificial Sequence
  chemically synthesized
ttcatgatactttcaaaaaatg

SEQ ID NO: 1287790 - DNA, 22 bp, Artificial Sequence
  chemically synthesized
cttcatgatactttcaaaaaat

SEQ ID NO: 1287791 - DNA, 22 bp, Artificial Sequence
  chemically synthesized
atatccttcttcatgatacttt

SEQ ID NO: 1287792 - DNA, 22 bp, Artificial Sequence
  chemically synthesized
aatatccttcttcatgatactt

SEQ ID NO: 1287793 - DNA, 22 bp, Artificial Sequence
  chemically synthesized
taatatccttcttcatgatact

SEQ ID NO: 1287794 - DNA, 22 bp, Artificial Sequence
  chemically synthesized
cattttttgaaagtatcatgaa

SEQ ID NO: 1287795 - DNA, 22 bp, Artificial Sequence
  chemically synthesized
tttgaaagtatcatgaagaagg

SEQ ID NO: 1287796 - DNA, 22 bp, Artificial Sequence
  chemically synthesized
ttgaaagtatcatgaagaagga

SEQ ID NO: 1287797 - DNA, 22 bp, Artificial Sequence
  chemically synthesized
tgaaagtatcatgaagaaggat

SEQ ID NO: 1287798 - DNA, 22 bp, Artificial Sequence
  chemically synthesized
aagtactttaatatccttcttc

SEQ ID NO: 1287799 - DNA, 22 bp, Artificial Sequence
  chemically synthesized
gaaagtatcatgaagaaggata

SEQ ID NO: 1287800 - DNA, 22 bp, Artificial Sequence
  chemically synthesized
aaagtatcatgaagaaggatat

SEQ ID NO: 1287801 - DNA, 22 bp, Artificial Sequence
  chemically synthesized
gcagggcaatctaaagtacttt

SEQ ID NO: 1287802 - DNA, 22 bp, Artificial Sequence
  chemically synthesized
cagttggcagggcaatctaaag

SEQ ID NO: 1287803 - DNA, 22 bp, Artificial Sequence
  chemically synthesized
ctacagttggcagggcaatcta

SEQ ID NO: 1287804 - DNA, 22 bp, Artificial Sequence
  chemically synthesized
aagtactttagattgccctgcc

SEQ ID NO: 1287805 - DNA, 22 bp, Artificial Sequence
  chemically synthesized
ggtctcctacagttggcagggc

SEQ ID NO: 1287806 - DNA, 22 bp, Artificial Sequence
  chemically synthesized
cggtctcctacagttggcaggg

SEQ ID NO: 1287807 - DNA, 22 bp, Artificial Sequence
  chemically synthesized
tagattgccctgccaactgtag

SEQ ID NO: 1287808 - DNA, 22 bp, Artificial Sequence
  chemically synthesized
agattgccctgccaactgtagg

SEQ ID NO: 1287809 - DNA, 22 bp, Artificial Sequence
  chemically synthesized
gattgccctgccaactgtagga

SEQ ID NO: 1287810 - DNA, 22 bp, Artificial Sequence
  chemically synthesized
ccctgccaactgtaggagaccg

SEQ ID NO: 1287811 - DNA, 22 bp, Artificial Sequence
  chemically synthesized
ggatggcatatttcggtctcct

SEQ ID NO: 1287812 - DNA, 22 bp, Artificial Sequence
  chemically synthesized
gggatggcatatttcggtctcc

SEQ ID NO: 1287813 - DNA, 22 bp, Artificial Sequence
  chemically synthesized
tgggatggcatatttcggtctc

SEQ ID NO: 1287814 - DNA, 22 bp, Artificial Sequence
  chemically synthesized
ccaactgtaggagaccgaaata

SEQ ID NO: 1287815 - DNA, 22 bp, Artificial Sequence
  chemically synthesized
taggagaccgaaatatgccatc

SEQ ID NO: 1287816 - DNA, 22 bp, Artificial Sequence
  chemically synthesized
tgacatattttgggatggcata

SEQ ID NO: 1287817 - DNA, 22 bp, Artificial Sequence
  chemically synthesized
gtgacatattttgggatggcat

SEQ ID NO: 1287818 - DNA, 22 bp, Artificial Sequence
  chemically synthesized
tgtgacatattttgggatggca

SEQ ID NO: 1287819 - DNA, 22 bp, Artificial Sequence
  chemically synthesized
acatattttgtgacatattttg

SEQ ID NO: 1287820 - DNA, 22 bp, Artificial Sequence
  chemically synthesized
gacatattttgtgacatatttt

SEQ ID NO: 1287821 - DNA, 22 bp, Artificial Sequence
  chemically synthesized
ttgacatattttgtgacatatt

SEQ ID NO: 1287822 - DNA, 22 bp, Artificial Sequence
  chemically synthesized
cttgacatattttgtgacatat

SEQ ID NO: 1287823 - DNA, 22 bp, Artificial Sequence
  chemically synthesized
tcttgacatattttgtgacata

SEQ ID NO: 1287824 - DNA, 22 bp, Artificial Sequence
  chemically synthesized
ctttcttgacatattttgtgac

SEQ ID NO: 1287825 - DNA, 22 bp, Artificial Sequence
  chemically synthesized
caggcatgagccaccgcggcca

SEQ ID NO: 1287826 - DNA, 22 bp, Artificial Sequence
  chemically synthesized
ggattacaggcatgagccaccg

SEQ ID NO: 1287827 - DNA, 22 bp, Artificial Sequence
  chemically synthesized
gatggccgcggtggctcatgcc

SEQ ID NO: 1287828 - DNA, 22 bp, Artificial Sequence
  chemically synthesized
atggccgcggtggctcatgcct

SEQ ID NO: 1287829 - DNA, 22 bp, Artificial Sequence
  chemically synthesized
ccaaagtgctgggattacaggc

SEQ ID NO: 1287830 - DNA, 22 bp, Artificial Sequence
  chemically synthesized
cctcccaaagtgctgggattac

SEQ ID NO: 1287831 - DNA, 22 bp, Artificial Sequence
  chemically synthesized
tgcctcccaaagtgctgggatt

SEQ ID NO: 1287832 - DNA, 22 bp, Artificial Sequence
  chemically synthesized
atgcctgtaatcccagcacttt

SEQ ID NO: 1287833 - DNA, 22 bp, Artificial Sequence
  chemically synthesized
taatcccagcactttgggaggc

SEQ ID NO: 1287834 - DNA, 22 bp, Artificial Sequence
  chemically synthesized
aggtgacccgcccgcctctgcc

SEQ ID NO: 1287835 - DNA, 22 bp, Artificial Sequence
  chemically synthesized
acctcaggtgacccgcccgcct

SEQ ID NO: 1287836 - DNA, 22 bp, Artificial Sequence
  chemically synthesized
tgggaggcagaggcgggcgggt

SEQ ID NO: 1287837 - DNA, 22 bp, Artificial Sequence
  chemically synthesized
gggaggcagaggcgggcgggtc

SEQ ID NO: 1287838 - DNA, 22 bp, Artificial Sequence
  chemically synthesized
ctgacctcaggtgacccgcccg

SEQ ID NO: 1287839 - DNA, 22 bp, Artificial Sequence
  chemically synthesized
ggaggcagaggcgggcgggtca

SEQ ID NO: 1287840 - DNA, 22 bp, Artificial Sequence
  chemically synthesized
gaactcctgacctcaggtgacc

SEQ ID NO: 1287841 - DNA, 22 bp, Artificial Sequence
  chemically synthesized
gtctcgaactcctgacctcagg

SEQ ID NO: 1287842 - DNA, 22 bp, Artificial Sequence
  chemically synthesized
gcccggctggtctcgaactcct

SEQ ID NO: 1287843 - DNA, 22 bp, Artificial Sequence
  chemically synthesized
aggtcaggagttcgagaccagc

SEQ ID NO: 1287844 - DNA, 22 bp, Artificial Sequence
  chemically synthesized
ccatgttggcccggctggtctc

SEQ ID NO: 1287845 - DNA, 22 bp, Artificial Sequence
  chemically synthesized
gccatgttggcccggctggtct

SEQ ID NO: 1287846 - DNA, 22 bp, Artificial Sequence
  chemically synthesized
tgccatgttggcccggctggtc

SEQ ID NO: 1287847 - DNA, 22 bp, Artificial Sequence
  chemically synthesized
gagaccagccgggccaacatgg

SEQ ID NO: 1287848 - DNA, 22 bp, Artificial Sequence
  chemically synthesized
gtagaggttttgccatgttggc

SEQ ID NO: 1287849 - DNA, 22 bp, Artificial Sequence
  chemically synthesized
ggtagaggttttgccatgttgg

SEQ ID NO: 1287850 - DNA, 22 bp, Artificial Sequence
  chemically synthesized
tggtagaggttttgccatgttg

SEQ ID NO: 1287851 - DNA, 22 bp, Artificial Sequence
  chemically synthesized
ttggtagaggttttgccatgtt

SEQ ID NO: 1287852 - DNA, 22 bp, Artificial Sequence
  chemically synthesized
tttttggtagaggttttgccat

SEQ ID NO: 1287853 - DNA, 22 bp, Artificial Sequence
  chemically synthesized
atttttggtagaggttttgcca

SEQ ID NO: 1287854 - DNA, 22 bp, Artificial Sequence
  chemically synthesized
tatttttggtagaggttttgcc

SEQ ID NO: 1287855 - DNA, 22 bp, Artificial Sequence
  chemically synthesized
ttatttttggtagaggttttgc

SEQ ID NO: 1287856 - DNA, 22 bp, Artificial Sequence
  chemically synthesized
tttatttttggtagaggttttg

SEQ ID NO: 1287857 - DNA, 22 bp, Artificial Sequence
  chemically synthesized
attttttatttttggtagaggt

SEQ ID NO: 1287858 - DNA, 22 bp, Artificial Sequence
  chemically synthesized
gctaattttttatttttggtag

SEQ ID NO: 1287859 - DNA, 22 bp, Artificial Sequence
  chemically synthesized
taccaaaaataaaaaattagcc

SEQ ID NO: 1287860 - DNA, 22 bp, Artificial Sequence
  chemically synthesized
ccaaaaataaaaaattagccag

SEQ ID NO: 1287861 - DNA, 22 bp, Artificial Sequence
  chemically synthesized
caggtgtgtgccaccatgcctg

SEQ ID NO: 1287862 - DNA, 22 bp, Artificial Sequence
  chemically synthesized
ggactacaggtgtgtgccacca

SEQ ID NO: 1287863 - DNA, 22 bp, Artificial Sequence
  chemically synthesized
gccaggcatggtggcacacacc

SEQ ID NO: 1287864 - DNA, 22 bp, Artificial Sequence
  chemically synthesized
ccaggtagctgggactacaggt

SEQ ID NO: 1287865 - DNA, 22 bp, Artificial Sequence
  chemically synthesized
ggcctcccaggtagctgggact

SEQ ID NO: 1287866 - DNA, 22 bp, Artificial Sequence
  chemically synthesized
cctcggcctcccaggtagctgg

SEQ ID NO: 1287867 - DNA, 22 bp, Artificial Sequence
  chemically synthesized
ctgcctcggcctcccaggtagc

SEQ ID NO: 1287868 - DNA, 22 bp, Artificial Sequence
  chemically synthesized
tcctgcctcggcctcccaggta

SEQ ID NO: 1287869 - DNA, 22 bp, Artificial Sequence
  chemically synthesized
tagtcccagctacctgggaggc

SEQ ID NO: 1287870 - DNA, 22 bp, Artificial Sequence
  chemically synthesized
aagcgattctcctgcctcggcc

SEQ ID NO: 1287871 - DNA, 22 bp, Artificial Sequence
  chemically synthesized
cctgggaggccgaggcaggaga

SEQ ID NO: 1287872 - DNA, 22 bp, Artificial Sequence
  chemically synthesized
cagggttcaagcgattctcctg

SEQ ID NO: 1287873 - DNA, 22 bp, Artificial Sequence
  chemically synthesized
ggaggccgaggcaggagaatcg

SEQ ID NO: 1287874 - DNA, 22 bp, Artificial Sequence
  chemically synthesized
acctccagggttcaagcgattc

SEQ ID NO: 1287875 - DNA, 22 bp, Artificial Sequence
  chemically synthesized
cacctccagggttcaagcgatt

SEQ ID NO: 1287876 - DNA, 22 bp, Artificial Sequence
  chemically synthesized
caaccttcacctccagggttca

SEQ ID NO: 1287877 - DNA, 22 bp, Artificial Sequence
  chemically synthesized
actgcaaccttcacctccaggg

SEQ ID NO: 1287878 - DNA, 22 bp, Artificial Sequence
  chemically synthesized
ggctcactgcaaccttcacctc

SEQ ID NO: 1287879 - DNA, 22 bp, Artificial Sequence
  chemically synthesized
gaaccctggaggtgaaggttgc

SEQ ID NO: 1287880 - DNA, 22 bp, Artificial Sequence
  chemically synthesized
tctcggctcactgcaaccttca

SEQ ID NO: 1287881 - DNA, 22 bp, Artificial Sequence
  chemically synthesized
aaccctggaggtgaaggttgca

SEQ ID NO: 1287882 - DNA, 22 bp, Artificial Sequence
  chemically synthesized
gaggtgaaggttgcagtgagcc

SEQ ID NO: 1287883 - DNA, 22 bp, Artificial Sequence
  chemically synthesized
cagtgagccgagatagtgccat

SEQ ID NO: 1287884 - DNA, 22 bp, Artificial Sequence
  chemically synthesized
tcgcccaaggtggagtgcaatg

SEQ ID NO: 1287885 - DNA, 22 bp, Artificial Sequence
  chemically synthesized
tgtcgcccaaggtggagtgcaa

SEQ ID NO: 1287886 - DNA, 22 bp, Artificial Sequence
  chemically synthesized
ctctgtcgcccaaggtggagtg

SEQ ID NO: 1287887 - DNA, 22 bp, Artificial Sequence
  chemically synthesized
gctctgtcgcccaaggtggagt

SEQ ID NO: 1287888 - DNA, 22 bp, Artificial Sequence
  chemically synthesized
aaacagtcttgctctgtcgccc

SEQ ID NO: 1287889 - DNA, 22 bp, Artificial Sequence
  chemically synthesized
cactccaccttgggcgacagag

SEQ ID NO: 1287890 - DNA, 22 bp, Artificial Sequence
  chemically synthesized
gaaacagtcttgctctgtcgcc

SEQ ID NO: 1287891 - DNA, 22 bp, Artificial Sequence
  chemically synthesized
tgaaacagtcttgctctgtcgc

SEQ ID NO: 1287892 - DNA, 22 bp, Artificial Sequence
  chemically synthesized
ttgaaacagtcttgctctgtcg

SEQ ID NO: 1287893 - DNA, 22 bp, Artificial Sequence
  chemically synthesized
tttgaaacagtcttgctctgtc

SEQ ID NO: 1287894 - DNA, 22 bp, Artificial Sequence
  chemically synthesized
ttttgaaacagtcttgctctgt

SEQ ID NO: 1287895 - DNA, 22 bp, Artificial Sequence
  chemically synthesized
caccttgggcgacagagcaaga

SEQ ID NO: 1287896 - DNA, 22 bp, Artificial Sequence
  chemically synthesized
tttttgaaacagtcttgctctg

SEQ ID NO: 1287897 - DNA, 22 bp, Artificial Sequence
  chemically synthesized
ttttttgaaacagtcttgctct

SEQ ID NO: 1287898 - DNA, 22 bp, Artificial Sequence
  chemically synthesized
tttttttgaaacagtcttgctc

SEQ ID NO: 1287899 - DNA, 22 bp, Artificial Sequence
  chemically synthesized
ttttttttgaaacagtcttgct

SEQ ID NO: 1287900 - DNA, 22 bp, Artificial Sequence
  chemically synthesized
tttttttttgaaacagtcttgc

SEQ ID NO: 1287901 - DNA, 22 bp, Artificial Sequence
  chemically synthesized
ttttttttttgaaacagtcttg

SEQ ID NO: 1287902 - DNA, 22 bp, Artificial Sequence
  chemically synthesized
gggcgacagagcaagactgttt

SEQ ID NO: 1287903 - DNA, 22 bp, Artificial Sequence
  chemically synthesized
tttttttttttgaaacagtctt

SEQ ID NO: 1287904 - DNA, 22 bp, Artificial Sequence
  chemically synthesized
ggcgacagagcaagactgtttc

SEQ ID NO: 1287905 - DNA, 22 bp, Artificial Sequence
  chemically synthesized
ttttttttttttgaaacagtct

SEQ ID NO: 1287906 - DNA, 22 bp, Artificial Sequence
  chemically synthesized
gtttttttttttttttgaaaca

SEQ ID NO: 1287907 - DNA, 22 bp, Artificial Sequence
  chemically synthesized
tttcaaaaaaaaaaaaaaacta

SEQ ID NO: 1287908 - DNA, 22 bp, Artificial Sequence
  chemically synthesized
caaaaaaaaaaaaaaactagct

SEQ ID NO: 1287909 - DNA, 22 bp, Artificial Sequence
  chemically synthesized
aaaaaaaaaaaaaaactagctt

SEQ ID NO: 1287910 - DNA, 22 bp, Artificial Sequence
  chemically synthesized
agaaatccagcaataaaatgca

SEQ ID NO: 1287911 - DNA, 22 bp, Artificial Sequence
  chemically synthesized
gagaaatccagcaataaaatgc

SEQ ID NO: 1287912 - DNA, 22 bp, Artificial Sequence
  chemically synthesized
gcttgcattttattgctggatt

SEQ ID NO: 1287913 - DNA, 22 bp, Artificial Sequence
  chemically synthesized
gcattttattgctggatttctc

SEQ ID NO: 1287914 - DNA, 22 bp, Artificial Sequence
  chemically synthesized
tgagcacaacttgagaaatcca

SEQ ID NO: 1287915 - DNA, 22 bp, Artificial Sequence
  chemically synthesized
cattttattgctggatttctca

SEQ ID NO: 1287916 - DNA, 22 bp, Artificial Sequence
  chemically synthesized
tattgctggatttctcaagttg

SEQ ID NO: 1287917 - DNA, 22 bp, Artificial Sequence
  chemically synthesized
attgctggatttctcaagttgt

SEQ ID NO: 1287918 - DNA, 22 bp, Artificial Sequence
  chemically synthesized
tgccctatgagcacaacttgag

SEQ ID NO: 1287919 - DNA, 22 bp, Artificial Sequence
  chemically synthesized
ttgctggatttctcaagttgtg

SEQ ID NO: 1287920 - DNA, 22 bp, Artificial Sequence
  chemically synthesized
ctggatttctcaagttgtgctc

SEQ ID NO: 1287921 - DNA, 22 bp, Artificial Sequence
  chemically synthesized
cattgtgccctatgagcacaac

SEQ ID NO: 1287922 - DNA, 22 bp, Artificial Sequence
  chemically synthesized
gatttctcaagttgtgctcata

SEQ ID NO: 1287923 - DNA, 22 bp, Artificial Sequence
  chemically synthesized
tccattgtgccctatgagcaca

SEQ ID NO: 1287924 - DNA, 22 bp, Artificial Sequence
  chemically synthesized
ctccattgtgccctatgagcac

SEQ ID NO: 1287925 - DNA, 22 bp, Artificial Sequence
  chemically synthesized
tctccattgtgccctatgagca

SEQ ID NO: 1287926 - DNA, 22 bp, Artificial Sequence
  chemically synthesized
tttctccattgtgccctatgag

SEQ ID NO: 1287927 - DNA, 22 bp, Artificial Sequence
  chemically synthesized
ctcaagttgtgctcatagggca

SEQ ID NO: 1287928 - DNA, 22 bp, Artificial Sequence
  chemically synthesized
ctttctccattgtgccctatga

SEQ ID NO: 1287929 - DNA, 22 bp, Artificial Sequence
  chemically synthesized
tcaagttgtgctcatagggcac

SEQ ID NO: 1287930 - DNA, 22 bp, Artificial Sequence
  chemically synthesized
tctttctccattgtgccctatg

SEQ ID NO: 1287931 - DNA, 22 bp, Artificial Sequence
  chemically synthesized
ttctttctccattgtgccctat

SEQ ID NO: 1287932 - DNA, 22 bp, Artificial Sequence
  chemically synthesized
aagttgtgctcatagggcacaa

SEQ ID NO: 1287933 - DNA, 22 bp, Artificial Sequence
  chemically synthesized
tgctcatagggcacaatggaga

SEQ ID NO: 1287934 - DNA, 22 bp, Artificial Sequence
  chemically synthesized
gaacatgtttttctttctccat

SEQ ID NO: 1287935 - DNA, 22 bp, Artificial Sequence
  chemically synthesized
atagggcacaatggagaaagaa

SEQ ID NO: 1287936 - DNA, 22 bp, Artificial Sequence
  chemically synthesized
ttagaacatgtttttctttctc

SEQ ID NO: 1287937 - DNA, 22 bp, Artificial Sequence
  chemically synthesized
aaaatatgttattagaacatgt

SEQ ID NO: 1287938 - DNA, 22 bp, Artificial Sequence
  chemically synthesized
gaaaatatgttattagaacatg

SEQ ID NO: 1287939 - DNA, 22 bp, Artificial Sequence
  chemically synthesized
accttgaaaatatgttattaga

SEQ ID NO: 1287940 - DNA, 22 bp, Artificial Sequence
  chemically synthesized
acaatggctaaccttgaaaata

SEQ ID NO: 1287941 - DNA, 22 bp, Artificial Sequence
  chemically synthesized
gacaatggctaaccttgaaaat

SEQ ID NO: 1287942 - DNA, 22 bp, Artificial Sequence
  chemically synthesized
tgacaatggctaaccttgaaaa

SEQ ID NO: 1287943 - DNA, 22 bp, Artificial Sequence
  chemically synthesized
ttgacaatggctaaccttgaaa

SEQ ID NO: 1287944 - DNA, 22 bp, Artificial Sequence
  chemically synthesized
taataacatattttcaaggtta

SEQ ID NO: 1287945 - DNA, 22 bp, Artificial Sequence
  chemically synthesized
ataacatattttcaaggttagc

SEQ ID NO: 1287946 - DNA, 22 bp, Artificial Sequence
  chemically synthesized
tcaaggttagccattgtcaaaa

SEQ ID NO: 1287947 - DNA, 22 bp, Artificial Sequence
  chemically synthesized
caaggttagccattgtcaaaag

SEQ ID NO: 1287948 - DNA, 22 bp, Artificial Sequence
  chemically synthesized
agtgaatgaaaacttttgacaa

SEQ ID NO: 1287949 - DNA, 22 bp, Artificial Sequence
  chemically synthesized
aaggttagccattgtcaaaagt

SEQ ID NO: 1287950 - DNA, 22 bp, Artificial Sequence
  chemically synthesized
cagtgaatgaaaacttttgaca

SEQ ID NO: 1287951 - DNA, 22 bp, Artificial Sequence
  chemically synthesized
tttcagtgaatgaaaacttttg

SEQ ID NO: 1287952 - DNA, 22 bp, Artificial Sequence
  chemically synthesized
atttcagtgaatgaaaactttt

SEQ ID NO: 1287953 - DNA, 22 bp, Artificial Sequence
  chemically synthesized
tatttcagtgaatgaaaacttt

SEQ ID NO: 1287954 - DNA, 22 bp, Artificial Sequence
  chemically synthesized
gccattgtcaaaagttttcatt

SEQ ID NO: 1287955 - DNA, 22 bp, Artificial Sequence
  chemically synthesized
ttttatttcagtgaatgaaaac

SEQ ID NO: 1287956 - DNA, 22 bp, Artificial Sequence
  chemically synthesized
atctgttttatttcagtgaatg

SEQ ID NO: 1287957 - DNA, 22 bp, Artificial Sequence
  chemically synthesized
tcaaaagttttcattcactgaa

SEQ ID NO: 1287958 - DNA, 22 bp, Artificial Sequence
  chemically synthesized
attaatctgttttatttcagtg

SEQ ID NO: 1287959 - DNA, 22 bp, Artificial Sequence
  chemically synthesized
tcattcactgaaataaaacaga

SEQ ID NO: 1287960 - DNA, 22 bp, Artificial Sequence
  chemically synthesized
tagattcattaatctgttttat

SEQ ID NO: 1287961 - DNA, 22 bp, Artificial Sequence
  chemically synthesized
cattcactgaaataaaacagat

SEQ ID NO: 1287962 - DNA, 22 bp, Artificial Sequence
  chemically synthesized
atagattcattaatctgtttta

SEQ ID NO: 1287963 - DNA, 22 bp, Artificial Sequence
  chemically synthesized
attcactgaaataaaacagatt

SEQ ID NO: 1287964 - DNA, 22 bp, Artificial Sequence
  chemically synthesized
ttatagattcattaatctgttt

SEQ ID NO: 1287965 - DNA, 22 bp, Artificial Sequence
  chemically synthesized
cttatagattcattaatctgtt

SEQ ID NO: 1287966 - DNA, 22 bp, Artificial Sequence
  chemically synthesized
tcttatagattcattaatctgt

SEQ ID NO: 1287967 - DNA, 22 bp, Artificial Sequence
  chemically synthesized
actgaaataaaacagattaatg

SEQ ID NO: 1287968 - DNA, 22 bp, Artificial Sequence
  chemically synthesized
aaataaaacagattaatgaatc

SEQ ID NO: 1287969 - DNA, 22 bp, Artificial Sequence
  chemically synthesized
atgaatctataagaaagcatat

SEQ ID NO: 1287970 - DNA, 22 bp, Artificial Sequence
  chemically synthesized
taagaaagcatatgtatatttg

SEQ ID NO: 1287971 - DNA, 22 bp, Artificial Sequence
  chemically synthesized
taaaaataacaacagaaaaagg

SEQ ID NO: 1287972 - DNA, 22 bp, Artificial Sequence
  chemically synthesized
aatctataaaaataacaacaga

SEQ ID NO: 1287973 - DNA, 22 bp, Artificial Sequence
  chemically synthesized
ctaaatctataaaaataacaac

SEQ ID NO: 1287974 - DNA, 22 bp, Artificial Sequence
  chemically synthesized
gcctttttctgttgttattttt

SEQ ID NO: 1287975 - DNA, 22 bp, Artificial Sequence
  chemically synthesized
cctttttctgttgttattttta

SEQ ID NO: 1287976 - DNA, 22 bp, Artificial Sequence
  chemically synthesized
tacctcctaaatctataaaaat

SEQ ID NO: 1287977 - DNA, 22 bp, Artificial Sequence
  chemically synthesized
tttctgttgttatttttataga

SEQ ID NO: 1287978 - DNA, 22 bp, Artificial Sequence
  chemically synthesized
ttctgttgttatttttatagat

SEQ ID NO: 1287979 - DNA, 22 bp, Artificial Sequence
  chemically synthesized
tctgttgttatttttatagatt

SEQ ID NO: 1287980 - DNA, 22 bp, Artificial Sequence
  chemically synthesized
ctgttgttatttttatagattt

SEQ ID NO: 1287981 - DNA, 22 bp, Artificial Sequence
  chemically synthesized
tgttgttatttttatagattta

SEQ ID NO: 1287982 - DNA, 22 bp, Artificial Sequence
  chemically synthesized
cactgtacctcctaaatctata

SEQ ID NO: 1287983 - DNA, 22 bp, Artificial Sequence
  chemically synthesized
ttgttatttttatagatttagg

SEQ ID NO: 1287984 - DNA, 22 bp, Artificial Sequence
  chemically synthesized
ttatttttatagatttaggagg

SEQ ID NO: 1287985 - DNA, 22 bp, Artificial Sequence
  chemically synthesized
tttttatagatttaggaggtac

SEQ ID NO: 1287986 - DNA, 22 bp, Artificial Sequence
  chemically synthesized
ttatagatttaggaggtacagt

SEQ ID NO: 1287987 - DNA, 22 bp, Artificial Sequence
  chemically synthesized
tatagatttaggaggtacagtg

SEQ ID NO: 1287988 - DNA, 22 bp, Artificial Sequence
  chemically synthesized
atagatttaggaggtacagtgt

SEQ ID NO: 1287989 - DNA, 22 bp, Artificial Sequence
  chemically synthesized
tagatttaggaggtacagtgta

SEQ ID NO: 1287990 - DNA, 22 bp, Artificial Sequence
  chemically synthesized
aggaggtacagtgtagttttgt

SEQ ID NO: 1287991 - DNA, 22 bp, Artificial Sequence
  chemically synthesized
ggaggtacagtgtagttttgtt

SEQ ID NO: 1287992 - DNA, 22 bp, Artificial Sequence
  chemically synthesized
tccaacatatgcatgtaacaaa

SEQ ID NO: 1287993 - DNA, 22 bp, Artificial Sequence
  chemically synthesized
ctatccaacatatgcatgtaac

SEQ ID NO: 1287994 - DNA, 22 bp, Artificial Sequence
  chemically synthesized
tgttacatgcatatgttggata

SEQ ID NO: 1287995 - DNA, 22 bp, Artificial Sequence
  chemically synthesized
gttacatgcatatgttggatag

SEQ ID NO: 1287996 - DNA, 22 bp, Artificial Sequence
  chemically synthesized
ttacatgcatatgttggatagt

SEQ ID NO: 1287997 - DNA, 22 bp, Artificial Sequence
  chemically synthesized
catgcatatgttggatagtagt

SEQ ID NO: 1287998 - DNA, 22 bp, Artificial Sequence
  chemically synthesized
gaagaccagacatcactactat

SEQ ID NO: 1287999 - DNA, 22 bp, Artificial Sequence
  chemically synthesized
actagaagaccagacatcacta

SEQ ID NO: 1288000 - DNA, 22 bp, Artificial Sequence
  chemically synthesized
cactagaagaccagacatcact

SEQ ID NO: 1288001 - DNA, 22 bp, Artificial Sequence
  chemically synthesized
gatagtagtgatgtctggtctt

SEQ ID NO: 1288002 - DNA, 22 bp, Artificial Sequence
  chemically synthesized
gagtgatggtttcactagaaga

SEQ ID NO: 1288003 - DNA, 22 bp, Artificial Sequence
  chemically synthesized
ttggagtgatggtttcactaga

SEQ ID NO: 1288004 - DNA, 22 bp, Artificial Sequence
  chemically synthesized
gtcttctagtgaaaccatcact

SEQ ID NO: 1288005 - DNA, 22 bp, Artificial Sequence
  chemically synthesized
ctagtgaaaccatcactccaat

SEQ ID NO: 1288006 - DNA, 22 bp, Artificial Sequence
  chemically synthesized
tagtgaaaccatcactccaata

SEQ ID NO: 1288007 - DNA, 22 bp, Artificial Sequence
  chemically synthesized
gtgaaaccatcactccaatagt

SEQ ID NO: 1288008 - DNA, 22 bp, Artificial Sequence
  chemically synthesized
ggtacaatgtacactattggag

SEQ ID NO: 1288009 - DNA, 22 bp, Artificial Sequence
  chemically synthesized
ttaggtacaatgtacactattg

SEQ ID NO: 1288010 - DNA, 22 bp, Artificial Sequence
  chemically synthesized
cctattaggtacaatgtacact

SEQ ID NO: 1288011 - DNA, 22 bp, Artificial Sequence
  chemically synthesized
caatagtgtacattgtacctaa

SEQ ID NO: 1288012 - DNA, 22 bp, Artificial Sequence
  chemically synthesized
tacctaataggtaatttctcac

SEQ ID NO: 1288013 - DNA, 22 bp, Artificial Sequence
  chemically synthesized
tggcaggggagtgaggagtgag

SEQ ID NO: 1288014 - DNA, 22 bp, Artificial Sequence
  chemically synthesized
ataggtaatttctcactcctca

SEQ ID NO: 1288015 - DNA, 22 bp, Artificial Sequence
  chemically synthesized
ctcactcctcactcccctgcca

SEQ ID NO: 1288016 - DNA, 22 bp, Artificial Sequence
  chemically synthesized
tcactcctcactcccctgccac

SEQ ID NO: 1288017 - DNA, 22 bp, Artificial Sequence
  chemically synthesized
aaaggtgagattgtggcagggg

SEQ ID NO: 1288018 - DNA, 22 bp, Artificial Sequence
  chemically synthesized
aaaaggtgagattgtggcaggg

SEQ ID NO: 1288019 - DNA, 22 bp, Artificial Sequence
  chemically synthesized
actcctcactcccctgccacaa

SEQ ID NO: 1288020 - DNA, 22 bp, Artificial Sequence
  chemically synthesized
taaaaggtgagattgtggcagg

SEQ ID NO: 1288021 - DNA, 22 bp, Artificial Sequence
  chemically synthesized
ttaaaaggtgagattgtggcag

SEQ ID NO: 1288022 - DNA, 22 bp, Artificial Sequence
  chemically synthesized
tttaaaaggtgagattgtggca

SEQ ID NO: 1288023 - DNA, 22 bp, Artificial Sequence
  chemically synthesized
ctcactcccctgccacaatctc

SEQ ID NO: 1288024 - DNA, 22 bp, Artificial Sequence
  chemically synthesized
actcccctgccacaatctcacc

SEQ ID NO: 1288025 - DNA, 22 bp, Artificial Sequence
  chemically synthesized
ccctgccacaatctcacctttt

SEQ ID NO: 1288026 - DNA, 22 bp, Artificial Sequence
  chemically synthesized
ccacaatctcaccttttaaaaa

SEQ ID NO: 1288027 - DNA, 22 bp, Artificial Sequence
  chemically synthesized
aaaatacaaaattttttaaaag

SEQ ID NO: 1288028 - DNA, 22 bp, Artificial Sequence
  chemically synthesized
accttttaaaaaattttgtatt

SEQ ID NO: 1288029 - DNA, 22 bp, Artificial Sequence
  chemically synthesized
ttaaaaaattttgtatttttaa

SEQ ID NO: 1288030 - DNA, 22 bp, Artificial Sequence
  chemically synthesized
taaaaaattttgtatttttaat

SEQ ID NO: 1288031 - DNA, 22 bp, Artificial Sequence
  chemically synthesized
aaaaaattttgtatttttaatt

SEQ ID NO: 1288032 - DNA, 22 bp, Artificial Sequence
  chemically synthesized
aaaaattttgtatttttaattt

SEQ ID NO: 1288033 - DNA, 22 bp, Artificial Sequence
  chemically synthesized
cagtgtacccacaaaaattaaa

SEQ ID NO: 1288034 - DNA, 22 bp, Artificial Sequence
  chemically synthesized
tgtatttttaatttttgtgggt

SEQ ID NO: 1288035 - DNA, 22 bp, Artificial Sequence
  chemically synthesized
gtatttttaatttttgtgggta

SEQ ID NO: 1288036 - DNA, 22 bp, Artificial Sequence
  chemically synthesized
tatttttaatttttgtgggtac

SEQ ID NO: 1288037 - DNA, 22 bp, Artificial Sequence
  chemically synthesized
tacacctacagtgtacccacaa

SEQ ID NO: 1288038 - DNA, 22 bp, Artificial Sequence
  chemically synthesized
atacacctacagtgtacccaca

SEQ ID NO: 1288039 - DNA, 22 bp, Artificial Sequence
  chemically synthesized
ttaatttttgtgggtacactgt

SEQ ID NO: 1288040 - DNA, 22 bp, Artificial Sequence
  chemically synthesized
taatttttgtgggtacactgta

SEQ ID NO: 1288041 - DNA, 22 bp, Artificial Sequence
  chemically synthesized
aatttttgtgggtacactgtag

SEQ ID NO: 1288042 - DNA, 22 bp, Artificial Sequence
  chemically synthesized
atttttgtgggtacactgtagg

SEQ ID NO: 1288043 - DNA, 22 bp, Artificial Sequence
  chemically synthesized
ttgtgggtacactgtaggtgta

SEQ ID NO: 1288044 - DNA, 22 bp, Artificial Sequence
  chemically synthesized
tgtgggtacactgtaggtgtat

SEQ ID NO: 1288045 - DNA, 22 bp, Artificial Sequence
  chemically synthesized
gtgggtacactgtaggtgtata

SEQ ID NO: 1288046 - DNA, 22 bp, Artificial Sequence
  chemically synthesized
tgggtacactgtaggtgtataa

SEQ ID NO: 1288047 - DNA, 22 bp, Artificial Sequence
  chemically synthesized
atgtaccccagaaatttataca

SEQ ID NO: 1288048 - DNA, 22 bp, Artificial Sequence
  chemically synthesized
tcatgtaccccagaaatttata

SEQ ID NO: 1288049 - DNA, 22 bp, Artificial Sequence
  chemically synthesized
taggtgtataaatttctggggt

SEQ ID NO: 1288050 - DNA, 22 bp, Artificial Sequence
  chemically synthesized
ctggggtacatgagagcctccc

SEQ ID NO: 1288051 - DNA, 22 bp, Artificial Sequence
  chemically synthesized
tggggtacatgagagcctcccg

SEQ ID NO: 1288052 - DNA, 22 bp, Artificial Sequence
  chemically synthesized
gggtacatgagagcctcccgcc

SEQ ID NO: 1288053 - DNA, 22 bp, Artificial Sequence
  chemically synthesized
aaaaaaaaaaaaaatggcggga

SEQ ID NO: 1288054 - DNA, 22 bp, Artificial Sequence
  chemically synthesized
catctcaaaaaaaaaaaaaatg

SEQ ID NO: 1288055 - DNA, 22 bp, Artificial Sequence
  chemically synthesized
ccgccattttttttttttttga

SEQ ID NO: 1288056 - DNA, 22 bp, Artificial Sequence
  chemically synthesized
tttttttttttgagatggagtc

SEQ ID NO: 1288057 - DNA, 22 bp, Artificial Sequence
  chemically synthesized
ttttttttttgagatggagtct

SEQ ID NO: 1288058 - DNA, 22 bp, Artificial Sequence
  chemically synthesized
tttttttttgagatggagtctc

SEQ ID NO: 1288059 - DNA, 22 bp, Artificial Sequence
  chemically synthesized
ggtgcacagggcgagactccat

SEQ ID NO: 1288060 - DNA, 22 bp, Artificial Sequence
  chemically synthesized
ttttttttgagatggagtctcg

SEQ ID NO: 1288061 - DNA, 22 bp, Artificial Sequence
  chemically synthesized
tttttttgagatggagtctcgc

SEQ ID NO: 1288062 - DNA, 22 bp, Artificial Sequence
  chemically synthesized
ttttttgagatggagtctcgcc

SEQ ID NO: 1288063 - DNA, 22 bp, Artificial Sequence
  chemically synthesized
tttttgagatggagtctcgccc

SEQ ID NO: 1288064 - DNA, 22 bp, Artificial Sequence
  chemically synthesized
ttttgagatggagtctcgccct

SEQ ID NO: 1288065 - DNA, 22 bp, Artificial Sequence
  chemically synthesized
tttgagatggagtctcgccctg

SEQ ID NO: 1288066 - DNA, 22 bp, Artificial Sequence
  chemically synthesized
ttgagatggagtctcgccctgt

SEQ ID NO: 1288067 - DNA, 22 bp, Artificial Sequence
  chemically synthesized
cagcctgggtgcacagggcgag

SEQ ID NO: 1288068 - DNA, 22 bp, Artificial Sequence
  chemically synthesized
tgagatggagtctcgccctgtg

SEQ ID NO: 1288069 - DNA, 22 bp, Artificial Sequence
  chemically synthesized
gagatggagtctcgccctgtgc

SEQ ID NO: 1288070 - DNA, 22 bp, Artificial Sequence
  chemically synthesized
agatggagtctcgccctgtgca

SEQ ID NO: 1288071 - DNA, 22 bp, Artificial Sequence
  chemically synthesized
cactccagcctgggtgcacagg

SEQ ID NO: 1288072 - DNA, 22 bp, Artificial Sequence
  chemically synthesized
gccctgtgcacccaggctggag

SEQ ID NO: 1288073 - DNA, 22 bp, Artificial Sequence
  chemically synthesized
tgcacccaggctggagtgcagt

SEQ ID NO: 1288074 - DNA, 22 bp, Artificial Sequence
  chemically synthesized
cagtgagccgagatcgcgccac

SEQ ID NO: 1288075 - DNA, 22 bp, Artificial Sequence
  chemically synthesized
gagtgcagtggcgcgatctcgg

SEQ ID NO: 1288076 - DNA, 22 bp, Artificial Sequence
  chemically synthesized
aacccaggaggcggaggttgca

SEQ ID NO: 1288077 - DNA, 22 bp, Artificial Sequence
  chemically synthesized
attgaacccaggaggcggaggt

SEQ ID NO: 1288078 - DNA, 22 bp, Artificial Sequence
  chemically synthesized
ggctcactgcaacctccgcctc

SEQ ID NO: 1288079 - DNA, 22 bp, Artificial Sequence
  chemically synthesized
actgcaacctccgcctcctggg

SEQ ID NO: 1288080 - DNA, 22 bp, Artificial Sequence
  chemically synthesized
caacctccgcctcctgggttca

SEQ ID NO: 1288081 - DNA, 22 bp, Artificial Sequence
  chemically synthesized
cgcctcctgggttcaatcaatt

SEQ ID NO: 1288082 - DNA, 22 bp, Artificial Sequence
  chemically synthesized
ctgggttcaatcaattctcctg

SEQ ID NO: 1288083 - DNA, 22 bp, Artificial Sequence
  chemically synthesized
aggagaccgaggcaggagaatt

SEQ ID NO: 1288084 - DNA, 22 bp, Artificial Sequence
  chemically synthesized
ggttcaatcaattctcctgcct

SEQ ID NO: 1288085 - DNA, 22 bp, Artificial Sequence
  chemically synthesized
ttcaggagaccgaggcaggaga

SEQ ID NO: 1288086 - DNA, 22 bp, Artificial Sequence
  chemically synthesized
aatcaattctcctgcctcggtc

SEQ ID NO: 1288087 - DNA, 22 bp, Artificial Sequence
  chemically synthesized
taatcccagctattcaggagac

SEQ ID NO: 1288088 - DNA, 22 bp, Artificial Sequence
  chemically synthesized
tcctgcctcggtctcctgaata

SEQ ID NO: 1288089 - DNA, 22 bp, Artificial Sequence
  chemically synthesized
ctgcctcggtctcctgaatagc

SEQ ID NO: 1288090 - DNA, 22 bp, Artificial Sequence
  chemically synthesized
cctcggtctcctgaatagctgg

SEQ ID NO: 1288091 - DNA, 22 bp, Artificial Sequence
  chemically synthesized
ggtctcctgaatagctgggatt

SEQ ID NO: 1288092 - DNA, 22 bp, Artificial Sequence
  chemically synthesized
ctgaatagctgggattacaggc

SEQ ID NO: 1288093 - DNA, 22 bp, Artificial Sequence
  chemically synthesized
aatagctgggattacaggcacg

SEQ ID NO: 1288094 - DNA, 22 bp, Artificial Sequence
  chemically synthesized
ggattacaggcacgcgccacca

SEQ ID NO: 1288095 - DNA, 22 bp, Artificial Sequence
  chemically synthesized
caggcacgcgccaccatgcccg

SEQ ID NO: 1288096 - DNA, 22 bp, Artificial Sequence
  chemically synthesized
aaaatacaaaaatcagtcgggc

SEQ ID NO: 1288097 - DNA, 22 bp, Artificial Sequence
  chemically synthesized
ctaaaaatacaaaaatcagtcg

SEQ ID NO: 1288098 - DNA, 22 bp, Artificial Sequence
  chemically synthesized
tactaaaaatacaaaaatcagt

SEQ ID NO: 1288099 - DNA, 22 bp, Artificial Sequence
  chemically synthesized
tctctactaaaaatacaaaaat

SEQ ID NO: 1288100 - DNA, 22 bp, Artificial Sequence
  chemically synthesized
aaccctgtctctactaaaaata

SEQ ID NO: 1288101 - DNA, 22 bp, Artificial Sequence
  chemically synthesized
atttttgtatttttagtagaga

SEQ ID NO: 1288102 - DNA, 22 bp, Artificial Sequence
  chemically synthesized
ttgtatttttagtagagacagg

SEQ ID NO: 1288103 - DNA, 22 bp, Artificial Sequence
  chemically synthesized
tgtatttttagtagagacaggg

SEQ ID NO: 1288104 - DNA, 22 bp, Artificial Sequence
  chemically synthesized
gtatttttagtagagacagggt

SEQ ID NO: 1288105 - DNA, 22 bp, Artificial Sequence
  chemically synthesized
tatttttagtagagacagggtt

SEQ ID NO: 1288106 - DNA, 22 bp, Artificial Sequence
  chemically synthesized
accaacatggttaaaccctgtc

SEQ ID NO: 1288107 - DNA, 22 bp, Artificial Sequence
  chemically synthesized
ttagtagagacagggtttaacc

SEQ ID NO: 1288108 - DNA, 22 bp, Artificial Sequence
  chemically synthesized
tagtagagacagggtttaacca

SEQ ID NO: 1288109 - DNA, 22 bp, Artificial Sequence
  chemically synthesized
agtagagacagggtttaaccat

SEQ ID NO: 1288110 - DNA, 22 bp, Artificial Sequence
  chemically synthesized
gtagagacagggtttaaccatg

SEQ ID NO: 1288111 - DNA, 22 bp, Artificial Sequence
  chemically synthesized
gagaccagcctgaccaacatgg

SEQ ID NO: 1288112 - DNA, 22 bp, Artificial Sequence
  chemically synthesized
aaccatgttggtcaggctggtc

SEQ ID NO: 1288113 - DNA, 22 bp, Artificial Sequence
  chemically synthesized
accatgttggtcaggctggtct

SEQ ID NO: 1288114 - DNA, 22 bp, Artificial Sequence
  chemically synthesized
gtcaggctggtctcgaactcct

SEQ ID NO: 1288115 - DNA, 22 bp, Artificial Sequence
  chemically synthesized
gtctcgaactcctgacctcgtg

SEQ ID NO: 1288116 - DNA, 22 bp, Artificial Sequence
  chemically synthesized
aggcaggcagatcacgaggtca

SEQ ID NO: 1288117 - DNA, 22 bp, Artificial Sequence
  chemically synthesized
gaactcctgacctcgtgatctg

SEQ ID NO: 1288118 - DNA, 22 bp, Artificial Sequence
  chemically synthesized
ggaggctgaggcaggcagatca

SEQ ID NO: 1288119 - DNA, 22 bp, Artificial Sequence
  chemically synthesized
gggaggctgaggcaggcagatc

SEQ ID NO: 1288120 - DNA, 22 bp, Artificial Sequence
  chemically synthesized
tgggaggctgaggcaggcagat

SEQ ID NO: 1288121 - DNA, 22 bp, Artificial Sequence
  chemically synthesized
ctgacctcgtgatctgcctgcc

SEQ ID NO: 1288122 - DNA, 22 bp, Artificial Sequence
  chemically synthesized
acctcgtgatctgcctgcctca

SEQ ID NO: 1288123 - DNA, 22 bp, Artificial Sequence
  chemically synthesized
gtgatctgcctgcctcagcctc

SEQ ID NO: 1288124 - DNA, 22 bp, Artificial Sequence
  chemically synthesized
taaccccagaactttgggaggc

SEQ ID NO: 1288125 - DNA, 22 bp, Artificial Sequence
  chemically synthesized
cctgcctcagcctcccaaagtt

SEQ ID NO: 1288126 - DNA, 22 bp, Artificial Sequence
  chemically synthesized
cctcagcctcccaaagttctgg

SEQ ID NO: 1288127 - DNA, 22 bp, Artificial Sequence
  chemically synthesized
acgcctataaccccagaacttt

SEQ ID NO: 1288128 - DNA, 22 bp, Artificial Sequence
  chemically synthesized
agcctcccaaagttctggggtt

SEQ ID NO: 1288129 - DNA, 22 bp, Artificial Sequence
  chemically synthesized
ccaaagttctggggttataggc

SEQ ID NO: 1288130 - DNA, 22 bp, Artificial Sequence
  chemically synthesized
tggggttataggcgtgagccac

SEQ ID NO: 1288131 - DNA, 22 bp, Artificial Sequence
  chemically synthesized
gggttataggcgtgagccaccg

SEQ ID NO: 1288132 - DNA, 22 bp, Artificial Sequence
  chemically synthesized
taggcgtgagccaccgcacccg

SEQ ID NO: 1288133 - DNA, 22 bp, Artificial Sequence
  chemically synthesized
aaaaggtgagaggggccgggtg

SEQ ID NO: 1288134 - DNA, 22 bp, Artificial Sequence
  chemically synthesized
caaaaggtgagaggggccgggt

SEQ ID NO: 1288135 - DNA, 22 bp, Artificial Sequence
  chemically synthesized
gagacttcaaaaggtgagaggg

SEQ ID NO: 1288136 - DNA, 22 bp, Artificial Sequence
  chemically synthesized
tcaccttttgaagtctccaatg

SEQ ID NO: 1288137 - DNA, 22 bp, Artificial Sequence
  chemically synthesized
accttttgaagtctccaatgtc

SEQ ID NO: 1288138 - DNA, 22 bp, Artificial Sequence
  chemically synthesized
ttgaagtctccaatgtctatta

SEQ ID NO: 1288139 - DNA, 22 bp, Artificial Sequence
  chemically synthesized
tgaagtctccaatgtctattat

SEQ ID NO: 1288140 - DNA, 22 bp, Artificial Sequence
  chemically synthesized
gaagtctccaatgtctattatt

SEQ ID NO: 1288141 - DNA, 22 bp, Artificial Sequence
  chemically synthesized
aagtctccaatgtctattattc

SEQ ID NO: 1288142 - DNA, 22 bp, Artificial Sequence
  chemically synthesized
atgaacatagagaatggaataa

SEQ ID NO: 1288143 - DNA, 22 bp, Artificial Sequence
  chemically synthesized
catgaacatagagaatggaata

SEQ ID NO: 1288144 - DNA, 22 bp, Artificial Sequence
  chemically synthesized
tcatgaacatagagaatggaat

SEQ ID NO: 1288145 - DNA, 22 bp, Artificial Sequence
  chemically synthesized
caatgtctattattccattctc

SEQ ID NO: 1288146 - DNA, 22 bp, Artificial Sequence
  chemically synthesized
ttattccattctctatgttcat

SEQ ID NO: 1288147 - DNA, 22 bp, Artificial Sequence
  chemically synthesized
ttccattctctatgttcatgaa

SEQ ID NO: 1288148 - DNA, 22 bp, Artificial Sequence
  chemically synthesized
cattctctatgttcatgaaaat

SEQ ID NO: 1288149 - DNA, 22 bp, Artificial Sequence
  chemically synthesized
tgtcaaagtggcatattttcat

SEQ ID NO: 1288150 - DNA, 22 bp, Artificial Sequence
  chemically synthesized
tctatgttcatgaaaatatgcc

SEQ ID NO: 1288151 - DNA, 22 bp, Artificial Sequence
  chemically synthesized
tatgttcatgaaaatatgccac

SEQ ID NO: 1288152 - DNA, 22 bp, Artificial Sequence
  chemically synthesized
tgttcatgaaaatatgccactt

SEQ ID NO: 1288153 - DNA, 22 bp, Artificial Sequence
  chemically synthesized
atgaaaatatgccactttgaca

SEQ ID NO: 1288154 - DNA, 22 bp, Artificial Sequence
  chemically synthesized
aaaatagtcctgtgtcaaagtg

SEQ ID NO: 1288155 - DNA, 22 bp, Artificial Sequence
  chemically synthesized
gctcaaaatagtcctgtgtcaa

SEQ ID NO: 1288156 - DNA, 22 bp, Artificial Sequence
  chemically synthesized
agctcaaaatagtcctgtgtca

SEQ ID NO: 1288157 - DNA, 22 bp, Artificial Sequence
  chemically synthesized
tagctcaaaatagtcctgtgtc

SEQ ID NO: 1288158 - DNA, 22 bp, Artificial Sequence
  chemically synthesized
cctttagctcaaaatagtcctg

SEQ ID NO: 1288159 - DNA, 22 bp, Artificial Sequence
  chemically synthesized
aattgcctttagctcaaaatag

SEQ ID NO: 1288160 - DNA, 22 bp, Artificial Sequence
  chemically synthesized
tgacacaggactattttgagct

SEQ ID NO: 1288161 - DNA, 22 bp, Artificial Sequence
  chemically synthesized
tgaattgcctttagctcaaaat

SEQ ID NO: 1288162 - DNA, 22 bp, Artificial Sequence
  chemically synthesized
gacacaggactattttgagcta

SEQ ID NO: 1288163 - DNA, 22 bp, Artificial Sequence
  chemically synthesized
ctgaattgcctttagctcaaaa

SEQ ID NO: 1288164 - DNA, 22 bp, Artificial Sequence
  chemically synthesized
acacaggactattttgagctaa

SEQ ID NO: 1288165 - DNA, 22 bp, Artificial Sequence
  chemically synthesized
ttctgaattgcctttagctcaa

SEQ ID NO: 1288166 - DNA, 22 bp, Artificial Sequence
  chemically synthesized
cttctgaattgcctttagctca

SEQ ID NO: 1288167 - DNA, 22 bp, Artificial Sequence
  chemically synthesized
cttcttctgaattgcctttagc

SEQ ID NO: 1288168 - DNA, 22 bp, Artificial Sequence
  chemically synthesized
ttttgagctaaaggcaattcag

SEQ ID NO: 1288169 - DNA, 22 bp, Artificial Sequence
  chemically synthesized
tatctgcttcttctgaattgcc

SEQ ID NO: 1288170 - DNA, 22 bp, Artificial Sequence
  chemically synthesized
atatctgcttcttctgaattgc

SEQ ID NO: 1288171 - DNA, 22 bp, Artificial Sequence
  chemically synthesized
tgagctaaaggcaattcagaag

SEQ ID NO: 1288172 - DNA, 22 bp, Artificial Sequence
  chemically synthesized
gagctaaaggcaattcagaaga

SEQ ID NO: 1288173 - DNA, 22 bp, Artificial Sequence
  chemically synthesized
agctaaaggcaattcagaagaa

SEQ ID NO: 1288174 - DNA, 22 bp, Artificial Sequence
  chemically synthesized
aaggcaattcagaagaagcaga

SEQ ID NO: 1288175 - DNA, 22 bp, Artificial Sequence
  chemically synthesized
agaagaagcagatataagttct

SEQ ID NO: 1288176 - DNA, 22 bp, Artificial Sequence
  chemically synthesized
aggcaaatagtgggagggcaga

SEQ ID NO: 1288177 - DNA, 22 bp, Artificial Sequence
  chemically synthesized
caggcaaatagtgggagggcag

SEQ ID NO: 1288178 - DNA, 22 bp, Artificial Sequence
  chemically synthesized
tcaggcaaatagtgggagggca

SEQ ID NO: 1288179 - DNA, 22 bp, Artificial Sequence
  chemically synthesized
ttttcaggcaaatagtgggagg

SEQ ID NO: 1288180 - DNA, 22 bp, Artificial Sequence
  chemically synthesized
tctgccctcccactatttgcct

SEQ ID NO: 1288181 - DNA, 22 bp, Artificial Sequence
  chemically synthesized
tgccctcccactatttgcctga

SEQ ID NO: 1288182 - DNA, 22 bp, Artificial Sequence
  chemically synthesized
ccctcccactatttgcctgaaa

SEQ ID NO: 1288183 - DNA, 22 bp, Artificial Sequence
  chemically synthesized
caaatgtatgtactgttttcag

SEQ ID NO: 1288184 - DNA, 22 bp, Artificial Sequence
  chemically synthesized
ccactatttgcctgaaaacagt

SEQ ID NO: 1288185 - DNA, 22 bp, Artificial Sequence
  chemically synthesized
gcaaatgtatgtactgttttca

SEQ ID NO: 1288186 - DNA, 22 bp, Artificial Sequence
  chemically synthesized
tgcaaatgtatgtactgttttc

SEQ ID NO: 1288187 - DNA, 22 bp, Artificial Sequence
  chemically synthesized
tttgcctgaaaacagtacatac

SEQ ID NO: 1288188 - DNA, 22 bp, Artificial Sequence
  chemically synthesized
gcctgaaaacagtacatacatt

SEQ ID NO: 1288189 - DNA, 22 bp, Artificial Sequence
  chemically synthesized
cctgaaaacagtacatacattt

SEQ ID NO: 1288190 - DNA, 22 bp, Artificial Sequence
  chemically synthesized
aaaacagtacatacatttgcaa

SEQ ID NO: 1288191 - DNA, 22 bp, Artificial Sequence
  chemically synthesized
atagagaggagaggatggacac

SEQ ID NO: 1288192 - DNA, 22 bp, Artificial Sequence
  chemically synthesized
tgatagagaggagaggatggac

SEQ ID NO: 1288193 - DNA, 22 bp, Artificial Sequence
  chemically synthesized
ctgatagagaggagaggatgga

SEQ ID NO: 1288194 - DNA, 22 bp, Artificial Sequence
  chemically synthesized
tctgatagagaggagaggatgg

SEQ ID NO: 1288195 - DNA, 22 bp, Artificial Sequence
  chemically synthesized
gcaaaggtgtccatcctctcct

SEQ ID NO: 1288196 - DNA, 22 bp, Artificial Sequence
  chemically synthesized
caaaggtgtccatcctctcctc

SEQ ID NO: 1288197 - DNA, 22 bp, Artificial Sequence
  chemically synthesized
tcctttctgatagagaggagag

SEQ ID NO: 1288198 - DNA, 22 bp, Artificial Sequence
  chemically synthesized
gtcctttctgatagagaggaga

SEQ ID NO: 1288199 - DNA, 22 bp, Artificial Sequence
  chemically synthesized
tgtcctttctgatagagaggag

SEQ ID NO: 1288200 - DNA, 22 bp, Artificial Sequence
  chemically synthesized
gtgatcaaactttgtcctttct

SEQ ID NO: 1288201 - DNA, 22 bp, Artificial Sequence
  chemically synthesized
tcctctctatcagaaaggacaa

SEQ ID NO: 1288202 - DNA, 22 bp, Artificial Sequence
  chemically synthesized
ctctctatcagaaaggacaaag

SEQ ID NO: 1288203 - DNA, 22 bp, Artificial Sequence
  chemically synthesized
tctatcagaaaggacaaagttt

SEQ ID NO: 1288204 - DNA, 22 bp, Artificial Sequence
  chemically synthesized
tcattggtgatcaaactttgtc

SEQ ID NO: 1288205 - DNA, 22 bp, Artificial Sequence
  chemically synthesized
tatcagaaaggacaaagtttga

SEQ ID NO: 1288206 - DNA, 22 bp, Artificial Sequence
  chemically synthesized
tcagaaaggacaaagtttgatc

SEQ ID NO: 1288207 - DNA, 22 bp, Artificial Sequence
  chemically synthesized
aagttgtcattggtgatcaaac

SEQ ID NO: 1288208 - DNA, 22 bp, Artificial Sequence
  chemically synthesized
ataaagatctaaagttgtcatt

SEQ ID NO: 1288209 - DNA, 22 bp, Artificial Sequence
  chemically synthesized
gatcaccaatgacaactttaga

SEQ ID NO: 1288210 - DNA, 22 bp, Artificial Sequence
  chemically synthesized
atcaccaatgacaactttagat

SEQ ID NO: 1288211 - DNA, 22 bp, Artificial Sequence
  chemically synthesized
cgggctgataaagatctaaagt

SEQ ID NO: 1288212 - DNA, 22 bp, Artificial Sequence
  chemically synthesized
atgcagtctccgggctgataaa

SEQ ID NO: 1288213 - DNA, 22 bp, Artificial Sequence
  chemically synthesized
tgatgcagtctccgggctgata

SEQ ID NO: 1288214 - DNA, 22 bp, Artificial Sequence
  chemically synthesized
ctctgatgcagtctccgggctg

SEQ ID NO: 1288215 - DNA, 22 bp, Artificial Sequence
  chemically synthesized
tagatctttatcagcccggaga

SEQ ID NO: 1288216 - DNA, 22 bp, Artificial Sequence
  chemically synthesized
agatctttatcagcccggagac

SEQ ID NO: 1288217 - DNA, 22 bp, Artificial Sequence
  chemically synthesized
gatctttatcagcccggagact

SEQ ID NO: 1288218 - DNA, 22 bp, Artificial Sequence
  chemically synthesized
tatcagcccggagactgcatca

SEQ ID NO: 1288219 - DNA, 22 bp, Artificial Sequence
  chemically synthesized
tgtagattcctctgatgcagtc

SEQ ID NO: 1288220 - DNA, 22 bp, Artificial Sequence
  chemically synthesized
atcagcccggagactgcatcag

SEQ ID NO: 1288221 - DNA, 22 bp, Artificial Sequence
  chemically synthesized
tcagcccggagactgcatcaga

SEQ ID NO: 1288222 - DNA, 22 bp, Artificial Sequence
  chemically synthesized
ttatgtagattcctctgatgca

SEQ ID NO: 1288223 - DNA, 22 bp, Artificial Sequence
  chemically synthesized
attatgtagattcctctgatgc

SEQ ID NO: 1288224 - DNA, 22 bp, Artificial Sequence
  chemically synthesized
agaaaatttattatgtagattc

SEQ ID NO: 1288225 - DNA, 22 bp, Artificial Sequence
  chemically synthesized
catcagaggaatctacataata

SEQ ID NO: 1288226 - DNA, 22 bp, Artificial Sequence
  chemically synthesized
gttaagaaaatttattatgtag

SEQ ID NO: 1288227 - DNA, 22 bp, Artificial Sequence
  chemically synthesized
cataataaattttcttaactag

SEQ ID NO: 1288228 - DNA, 22 bp, Artificial Sequence
  chemically synthesized
atggtagataaaggctagttaa

SEQ ID NO: 1288229 - DNA, 22 bp, Artificial Sequence
  chemically synthesized
tcttaactagcctttatctacc

SEQ ID NO: 1288230 - DNA, 22 bp, Artificial Sequence
  chemically synthesized
cttaactagcctttatctacca

SEQ ID NO: 1288231 - DNA, 22 bp, Artificial Sequence
  chemically synthesized
ttaactagcctttatctaccat

SEQ ID NO: 1288232 - DNA, 22 bp, Artificial Sequence
  chemically synthesized
aactagcctttatctaccatca

SEQ ID NO: 1288233 - DNA, 22 bp, Artificial Sequence
  chemically synthesized
actagcctttatctaccatcag

SEQ ID NO: 1288234 - DNA, 22 bp, Artificial Sequence
  chemically synthesized
gcctttatctaccatcagtttc

SEQ ID NO: 1288235 - DNA, 22 bp, Artificial Sequence
  chemically synthesized
tatctaccatcagtttcccata

SEQ ID NO: 1288236 - DNA, 22 bp, Artificial Sequence
  chemically synthesized
atctaccatcagtttcccatat

SEQ ID NO: 1288237 - DNA, 22 bp, Artificial Sequence
  chemically synthesized
aggaaggcaaatatatgggaaa

SEQ ID NO: 1288238 - DNA, 22 bp, Artificial Sequence
  chemically synthesized
tctaccatcagtttcccatata

SEQ ID NO: 1288239 - DNA, 22 bp, Artificial Sequence
  chemically synthesized
caggaaggcaaatatatgggaa

SEQ ID NO: 1288240 - DNA, 22 bp, Artificial Sequence
  chemically synthesized
ccatcagtttcccatatatttg

SEQ ID NO: 1288241 - DNA, 22 bp, Artificial Sequence
  chemically synthesized
cccatatatttgccttcctgaa

SEQ ID NO: 1288242 - DNA, 22 bp, Artificial Sequence
  chemically synthesized
tgagtggccaatttcaggaagg

SEQ ID NO: 1288243 - DNA, 22 bp, Artificial Sequence
  chemically synthesized
ccatatatttgccttcctgaaa

SEQ ID NO: 1288244 - DNA, 22 bp, Artificial Sequence
  chemically synthesized
tatgagtggccaatttcaggaa

SEQ ID NO: 1288245 - DNA, 22 bp, Artificial Sequence
  chemically synthesized
agtctctatgagtggccaattt

SEQ ID NO: 1288246 - DNA, 22 bp, Artificial Sequence
  chemically synthesized
gccttcctgaaattggccactc

SEQ ID NO: 1288247 - DNA, 22 bp, Artificial Sequence
  chemically synthesized
ccttcctgaaattggccactca

SEQ ID NO: 1288248 - DNA, 22 bp, Artificial Sequence
  chemically synthesized
cctgaaattggccactcataga

SEQ ID NO: 1288249 - DNA, 22 bp, Artificial Sequence
  chemically synthesized
ctgaaattggccactcatagag

SEQ ID NO: 1288250 - DNA, 22 bp, Artificial Sequence
  chemically synthesized
aaattggccactcatagagact

SEQ ID NO: 1288251 - DNA, 22 bp, Artificial Sequence
  chemically synthesized
gccactcatagagactcagggt

SEQ ID NO: 1288252 - DNA, 22 bp, Artificial Sequence
  chemically synthesized
atagagactcagggtccttttc

SEQ ID NO: 1288253 - DNA, 22 bp, Artificial Sequence
  chemically synthesized
agaagtaacaagacaagggaaa

SEQ ID NO: 1288254 - DNA, 22 bp, Artificial Sequence
  chemically synthesized
gagaagtaacaagacaagggaa

SEQ ID NO: 1288255 - DNA, 22 bp, Artificial Sequence
  chemically synthesized
tgagaagtaacaagacaaggga

SEQ ID NO: 1288256 - DNA, 22 bp, Artificial Sequence
  chemically synthesized
ttgagaagtaacaagacaaggg

SEQ ID NO: 1288257 - DNA, 22 bp, Artificial Sequence
  chemically synthesized
agggtccttttcccttgtcttg

SEQ ID NO: 1288258 - DNA, 22 bp, Artificial Sequence
  chemically synthesized
tttgagaagtaacaagacaagg

SEQ ID NO: 1288259 - DNA, 22 bp, Artificial Sequence
  chemically synthesized
ttcccttgtcttgttacttctc

SEQ ID NO: 1288260 - DNA, 22 bp, Artificial Sequence
  chemically synthesized
tcccttgtcttgttacttctca

SEQ ID NO: 1288261 - DNA, 22 bp, Artificial Sequence
  chemically synthesized
cccttgtcttgttacttctcaa

SEQ ID NO: 1288262 - DNA, 22 bp, Artificial Sequence
  chemically synthesized
ccttgtcttgttacttctcaaa

SEQ ID NO: 1288263 - DNA, 22 bp, Artificial Sequence
  chemically synthesized
gtcttgttacttctcaaaaaac

SEQ ID NO: 1288264 - DNA, 22 bp, Artificial Sequence
  chemically synthesized
tcttgttacttctcaaaaaacg

SEQ ID NO: 1288265 - DNA, 22 bp, Artificial Sequence
  chemically synthesized
acaaagaacaatacgttttttg

SEQ ID NO: 1288266 - DNA, 22 bp, Artificial Sequence
  chemically synthesized
tgacaaagaacaatacgttttt

SEQ ID NO: 1288267 - DNA, 22 bp, Artificial Sequence
  chemically synthesized
gttacttctcaaaaaacgtatt

SEQ ID NO: 1288268 - DNA, 22 bp, Artificial Sequence
  chemically synthesized
ttacttctcaaaaaacgtattg

SEQ ID NO: 1288269 - DNA, 22 bp, Artificial Sequence
  chemically synthesized
tctgacaaagaacaatacgttt

SEQ ID NO: 1288270 - DNA, 22 bp, Artificial Sequence
  chemically synthesized
ctctgacaaagaacaatacgtt

SEQ ID NO: 1288271 - DNA, 22 bp, Artificial Sequence
  chemically synthesized
cttctcaaaaaacgtattgttc

SEQ ID NO: 1288272 - DNA, 22 bp, Artificial Sequence
  chemically synthesized
ctcaaaaaacgtattgttcttt

SEQ ID NO: 1288273 - DNA, 22 bp, Artificial Sequence
  chemically synthesized
tcaaaaaacgtattgttctttg

SEQ ID NO: 1288274 - DNA, 22 bp, Artificial Sequence
  chemically synthesized
aaaaaacgtattgttctttgtc

SEQ ID NO: 1288275 - DNA, 22 bp, Artificial Sequence
  chemically synthesized
ttctttgtcagagaaatttatt

SEQ ID NO: 1288276 - DNA, 22 bp, Artificial Sequence
  chemically synthesized
tttgtcagagaaatttattcat

SEQ ID NO: 1288277 - DNA, 22 bp, Artificial Sequence
  chemically synthesized
tgtcagagaaatttattcattt

SEQ ID NO: 1288278 - DNA, 22 bp, Artificial Sequence
  chemically synthesized
gtcagagaaatttattcatttt

SEQ ID NO: 1288279 - DNA, 22 bp, Artificial Sequence
  chemically synthesized
tcagagaaatttattcattttt

SEQ ID NO: 1288280 - DNA, 22 bp, Artificial Sequence
  chemically synthesized
attcatttttccttatatatct

SEQ ID NO: 1288281 - DNA, 22 bp, Artificial Sequence
  chemically synthesized
ttcatttttccttatatatctt

SEQ ID NO: 1288282 - DNA, 22 bp, Artificial Sequence
  chemically synthesized
atgtatacatgaaagatatata

SEQ ID NO: 1288283 - DNA, 22 bp, Artificial Sequence
  chemically synthesized
atttttccttatatatctttca

SEQ ID NO: 1288284 - DNA, 22 bp, Artificial Sequence
  chemically synthesized
ttccttatatatctttcatgta

SEQ ID NO: 1288285 - DNA, 22 bp, Artificial Sequence
  chemically synthesized
tccttatatatctttcatgtat

SEQ ID NO: 1288286 - DNA, 22 bp, Artificial Sequence
  chemically synthesized
ccttatatatctttcatgtata

SEQ ID NO: 1288287 - DNA, 22 bp, Artificial Sequence
  chemically synthesized
cttatatatctttcatgtatac

SEQ ID NO: 1288288 - DNA, 22 bp, Artificial Sequence
  chemically synthesized
atatatctttcatgtatacatg

SEQ ID NO: 1288289 - DNA, 22 bp, Artificial Sequence
  chemically synthesized
acatacacacctcatgtataca

SEQ ID NO: 1288290 - DNA, 22 bp, Artificial Sequence
  chemically synthesized
tatatctttcatgtatacatga

SEQ ID NO: 1288291 - DNA, 22 bp, Artificial Sequence
  chemically synthesized
ctaacatacacacctcatgtat

SEQ ID NO: 1288292 - DNA, 22 bp, Artificial Sequence
  chemically synthesized
actaacatacacacctcatgta

SEQ ID NO: 1288293 - DNA, 22 bp, Artificial Sequence
  chemically synthesized
tcatgtatacatgaggtgtgta

SEQ ID NO: 1288294 - DNA, 22 bp, Artificial Sequence
  chemically synthesized
catgtatacatgaggtgtgtat

SEQ ID NO: 1288295 - DNA, 22 bp, Artificial Sequence
  chemically synthesized
atgtatacatgaggtgtgtatg

SEQ ID NO: 1288296 - DNA, 22 bp, Artificial Sequence
  chemically synthesized
gtaaactttattgtttttttct

SEQ ID NO: 1288297 - DNA, 22 bp, Artificial Sequence
  chemically synthesized
tattgtttttttcttgttgata

SEQ ID NO: 1288298 - DNA, 22 bp, Artificial Sequence
  chemically synthesized
taacaaaagagatatcaacaag

SEQ ID NO: 1288299 - DNA, 22 bp, Artificial Sequence
  chemically synthesized
attgtttttttcttgttgatat

SEQ ID NO: 1288300 - DNA, 22 bp, Artificial Sequence
  chemically synthesized
ttgtttttttcttgttgatatc

SEQ ID NO: 1288301 - DNA, 22 bp, Artificial Sequence
  chemically synthesized
ctataacaaaagagatatcaac

SEQ ID NO: 1288302 - DNA, 22 bp, Artificial Sequence
  chemically synthesized
tttttttcttgttgatatctct

SEQ ID NO: 1288303 - DNA, 22 bp, Artificial Sequence
  chemically synthesized
ttttcttgttgatatctctttt

SEQ ID NO: 1288304 - DNA, 22 bp, Artificial Sequence
  chemically synthesized
tttcttgttgatatctcttttg

SEQ ID NO: 1288305 - DNA, 22 bp, Artificial Sequence
  chemically synthesized
ggactcctataacaaaagagat

SEQ ID NO: 1288306 - DNA, 22 bp, Artificial Sequence
  chemically synthesized
ttcttgttgatatctcttttgt

SEQ ID NO: 1288307 - DNA, 22 bp, Artificial Sequence
  chemically synthesized
tcttgttgatatctcttttgtt

SEQ ID NO: 1288308 - DNA, 22 bp, Artificial Sequence
  chemically synthesized
cttgttgatatctcttttgtta

SEQ ID NO: 1288309 - DNA, 22 bp, Artificial Sequence
  chemically synthesized
ttgttgatatctcttttgttat

SEQ ID NO: 1288310 - DNA, 22 bp, Artificial Sequence
  chemically synthesized
actgggactcctataacaaaag

SEQ ID NO: 1288311 - DNA, 22 bp, Artificial Sequence
  chemically synthesized
aactgggactcctataacaaaa

SEQ ID NO: 1288312 - DNA, 22 bp, Artificial Sequence
  chemically synthesized
gttgatatctcttttgttatag

SEQ ID NO: 1288313 - DNA, 22 bp, Artificial Sequence
  chemically synthesized
ttgatatctcttttgttatagg

SEQ ID NO: 1288314 - DNA, 22 bp, Artificial Sequence
  chemically synthesized
ttaactgggactcctataacaa

SEQ ID NO: 1288315 - DNA, 22 bp, Artificial Sequence
  chemically synthesized
cttaactgggactcctataaca

SEQ ID NO: 1288316 - DNA, 22 bp, Artificial Sequence
  chemically synthesized
atatctcttttgttataggagt

SEQ ID NO: 1288317 - DNA, 22 bp, Artificial Sequence
  chemically synthesized
tttcttaactgggactcctata

SEQ ID NO: 1288318 - DNA, 22 bp, Artificial Sequence
  chemically synthesized
atttcttaactgggactcctat

SEQ ID NO: 1288319 - DNA, 22 bp, Artificial Sequence
  chemically synthesized
tatttcttaactgggactccta

SEQ ID NO: 1288320 - DNA, 22 bp, Artificial Sequence
  chemically synthesized
ttttgttataggagtcccagtt

SEQ ID NO: 1288321 - DNA, 22 bp, Artificial Sequence
  chemically synthesized
cctttatttcttaactgggact

SEQ ID NO: 1288322 - DNA, 22 bp, Artificial Sequence
  chemically synthesized
ttgttataggagtcccagttaa

SEQ ID NO: 1288323 - DNA, 22 bp, Artificial Sequence
  chemically synthesized
tacctttatttcttaactggga

SEQ ID NO: 1288324 - DNA, 22 bp, Artificial Sequence
  chemically synthesized
tgttataggagtcccagttaag

SEQ ID NO: 1288325 - DNA, 22 bp, Artificial Sequence
  chemically synthesized
gttataggagtcccagttaaga

SEQ ID NO: 1288326 - DNA, 22 bp, Artificial Sequence
  chemically synthesized
ttataggagtcccagttaagaa

SEQ ID NO: 1288327 - DNA, 22 bp, Artificial Sequence
  chemically synthesized
gcctctacctttatttcttaac

SEQ ID NO: 1288328 - DNA, 22 bp, Artificial Sequence
  chemically synthesized
taggagtcccagttaagaaata

SEQ ID NO: 1288329 - DNA, 22 bp, Artificial Sequence
  chemically synthesized
agaaataaaggtagaggctaga

SEQ ID NO: 1288330 - DNA, 22 bp, Artificial Sequence
  chemically synthesized
caggtgtgagccaccgcatcta

SEQ ID NO: 1288331 - DNA, 22 bp, Artificial Sequence
  chemically synthesized
ggattacaggtgtgagccaccg

SEQ ID NO: 1288332 - DNA, 22 bp, Artificial Sequence
  chemically synthesized
gatgcggtggctcacacctgta

SEQ ID NO: 1288333 - DNA, 22 bp, Artificial Sequence
  chemically synthesized
ccaaagagctgggattacaggt

SEQ ID NO: 1288334 - DNA, 22 bp, Artificial Sequence
  chemically synthesized
agcctcccaaagagctgggatt

SEQ ID NO: 1288335 - DNA, 22 bp, Artificial Sequence
  chemically synthesized
acacctgtaatcccagctcttt

SEQ ID NO: 1288336 - DNA, 22 bp, Artificial Sequence
  chemically synthesized
agtctcagcctcccaaagagct

SEQ ID NO: 1288337 - DNA, 22 bp, Artificial Sequence
  chemically synthesized
cagtctcagcctcccaaagagc

SEQ ID NO: 1288338 - DNA, 22 bp, Artificial Sequence
  chemically synthesized
taatcccagctctttgggaggc

SEQ ID NO: 1288339 - DNA, 22 bp, Artificial Sequence
  chemically synthesized
aagtgatccttcagtctcagcc

SEQ ID NO: 1288340 - DNA, 22 bp, Artificial Sequence
  chemically synthesized
tttgggaggctgagactgaagg

SEQ ID NO: 1288341 - DNA, 22 bp, Artificial Sequence
  chemically synthesized
agctcaagtgatccttcagtct

SEQ ID NO: 1288342 - DNA, 22 bp, Artificial Sequence
  chemically synthesized
gagctcaagtgatccttcagtc

SEQ ID NO: 1288343 - DNA, 22 bp, Artificial Sequence
  chemically synthesized
tgggaggctgagactgaaggat

SEQ ID NO: 1288344 - DNA, 22 bp, Artificial Sequence
  chemically synthesized
gggaggctgagactgaaggatc

SEQ ID NO: 1288345 - DNA, 22 bp, Artificial Sequence
  chemically synthesized
ggaggctgagactgaaggatca

SEQ ID NO: 1288346 - DNA, 22 bp, Artificial Sequence
  chemically synthesized
aatgcttgagctcaagtgatcc

SEQ ID NO: 1288347 - DNA, 22 bp, Artificial Sequence
  chemically synthesized
gaatgcttgagctcaagtgatc

SEQ ID NO: 1288348 - DNA, 22 bp, Artificial Sequence
  chemically synthesized
agactgaaggatcacttgagct

SEQ ID NO: 1288349 - DNA, 22 bp, Artificial Sequence
  chemically synthesized
gtcttgaatgcttgagctcaag

SEQ ID NO: 1288350 - DNA, 22 bp, Artificial Sequence
  chemically synthesized
aaggatcacttgagctcaagca

SEQ ID NO: 1288351 - DNA, 22 bp, Artificial Sequence
  chemically synthesized
ccaaggctggtcttgaatgctt

SEQ ID NO: 1288352 - DNA, 22 bp, Artificial Sequence
  chemically synthesized
tgttgccaaggctggtcttgaa

SEQ ID NO: 1288353 - DNA, 22 bp, Artificial Sequence
  chemically synthesized
gagctcaagcattcaagaccag

SEQ ID NO: 1288354 - DNA, 22 bp, Artificial Sequence
  chemically synthesized
agctcaagcattcaagaccagc

SEQ ID NO: 1288355 - DNA, 22 bp, Artificial Sequence
  chemically synthesized
ctatgttgccaaggctggtctt

SEQ ID NO: 1288356 - DNA, 22 bp, Artificial Sequence
  chemically synthesized
gctatgttgccaaggctggtct

SEQ ID NO: 1288357 - DNA, 22 bp, Artificial Sequence
  chemically synthesized
aagcattcaagaccagccttgg

SEQ ID NO: 1288358 - DNA, 22 bp, Artificial Sequence
  chemically synthesized
aagaccagccttggcaacatag

SEQ ID NO: 1288359 - DNA, 22 bp, Artificial Sequence
  chemically synthesized
gagaaatgagggtcttgctatg

SEQ ID NO: 1288360 - DNA, 22 bp, Artificial Sequence
  chemically synthesized
ggagaaatgagggtcttgctat

SEQ ID NO: 1288361 - DNA, 22 bp, Artificial Sequence
  chemically synthesized
tggagaaatgagggtcttgcta

SEQ ID NO: 1288362 - DNA, 22 bp, Artificial Sequence
  chemically synthesized
ttggagaaatgagggtcttgct

SEQ ID NO: 1288363 - DNA, 22 bp, Artificial Sequence
  chemically synthesized
tttggagaaatgagggtcttgc

SEQ ID NO: 1288364 - DNA, 22 bp, Artificial Sequence
  chemically synthesized
ggcaacatagcaagaccctcat

SEQ ID NO: 1288365 - DNA, 22 bp, Artificial Sequence
  chemically synthesized
ctttttggagaaatgagggtct

SEQ ID NO: 1288366 - DNA, 22 bp, Artificial Sequence
  chemically synthesized
gcaacatagcaagaccctcatt

SEQ ID NO: 1288367 - DNA, 22 bp, Artificial Sequence
  chemically synthesized
actttttggagaaatgagggtc

SEQ ID NO: 1288368 - DNA, 22 bp, Artificial Sequence
  chemically synthesized
tactttttggagaaatgagggt

SEQ ID NO: 1288369 - DNA, 22 bp, Artificial Sequence
  chemically synthesized
ttactttttggagaaatgaggg

SEQ ID NO: 1288370 - DNA, 22 bp, Artificial Sequence
  chemically synthesized
tttactttttggagaaatgagg

SEQ ID NO: 1288371 - DNA, 22 bp, Artificial Sequence
  chemically synthesized
ttttactttttggagaaatgag

SEQ ID NO: 1288372 - DNA, 22 bp, Artificial Sequence
  chemically synthesized
tttttactttttggagaaatga

SEQ ID NO: 1288373 - DNA, 22 bp, Artificial Sequence
  chemically synthesized
ttttttttactttttggagaaa

SEQ ID NO: 1288374 - DNA, 22 bp, Artificial Sequence
  chemically synthesized
ttattttttttactttttggag

SEQ ID NO: 1288375 - DNA, 22 bp, Artificial Sequence
  chemically synthesized
attattttttttactttttgga

SEQ ID NO: 1288376 - DNA, 22 bp, Artificial Sequence
  chemically synthesized
atttattattttttttactttt

SEQ ID NO: 1288377 - DNA, 22 bp, Artificial Sequence
  chemically synthesized
atttctccaaaaagtaaaaaaa

SEQ ID NO: 1288378 - DNA, 22 bp, Artificial Sequence
  chemically synthesized
ctccaaaaagtaaaaaaaataa

SEQ ID NO: 1288379 - DNA, 22 bp, Artificial Sequence
  chemically synthesized
tccaaaaagtaaaaaaaataat

SEQ ID NO: 1288380 - DNA, 22 bp, Artificial Sequence
  chemically synthesized
caaaaagtaaaaaaaataataa

SEQ ID NO: 1288381 - DNA, 22 bp, Artificial Sequence
  chemically synthesized
caggcatgcaccaccatgccgg

SEQ ID NO: 1288382 - DNA, 22 bp, Artificial Sequence
  chemically synthesized
gctacaggcatgcaccaccatg

SEQ ID NO: 1288383 - DNA, 22 bp, Artificial Sequence
  chemically synthesized
agctacaggcatgcaccaccat

SEQ ID NO: 1288384 - DNA, 22 bp, Artificial Sequence
  chemically synthesized
gcccggcatggtggtgcatgcc

SEQ ID NO: 1288385 - DNA, 22 bp, Artificial Sequence
  chemically synthesized
cccggtagcttagctacaggca

SEQ ID NO: 1288386 - DNA, 22 bp, Artificial Sequence
  chemically synthesized
agcctccccggtagcttagcta

SEQ ID NO: 1288387 - DNA, 22 bp, Artificial Sequence
  chemically synthesized
cacctcagcctccccggtagct

SEQ ID NO: 1288388 - DNA, 22 bp, Artificial Sequence
  chemically synthesized
ccacctcagcctccccggtagc

SEQ ID NO: 1288389 - DNA, 22 bp, Artificial Sequence
  chemically synthesized
tagctaagctaccggggaggct

SEQ ID NO: 1288390 - DNA, 22 bp, Artificial Sequence
  chemically synthesized
agccatccttccacctcagcct

SEQ ID NO: 1288391 - DNA, 22 bp, Artificial Sequence
  chemically synthesized
agctaccggggaggctgaggtg

SEQ ID NO: 1288392 - DNA, 22 bp, Artificial Sequence
  chemically synthesized
gagccatccttccacctcagcc

SEQ ID NO: 1288393 - DNA, 22 bp, Artificial Sequence
  chemically synthesized
ccggggaggctgaggtggaagg

SEQ ID NO: 1288394 - DNA, 22 bp, Artificial Sequence
  chemically synthesized
ccgggtttgagccatccttcca

SEQ ID NO: 1288395 - DNA, 22 bp, Artificial Sequence
  chemically synthesized
aacctcccgggtttgagccatc

SEQ ID NO: 1288396 - DNA, 22 bp, Artificial Sequence
  chemically synthesized
caacctcccgggtttgagccat

SEQ ID NO: 1288397 - DNA, 22 bp, Artificial Sequence
  chemically synthesized
aggtggaaggatggctcaaacc

SEQ ID NO: 1288398 - DNA, 22 bp, Artificial Sequence
  chemically synthesized
tagcttcaacctcccgggtttg

SEQ ID NO: 1288399 - DNA, 22 bp, Artificial Sequence
  chemically synthesized
actatagcttcaacctcccggg

SEQ ID NO: 1288400 - DNA, 22 bp, Artificial Sequence
  chemically synthesized
tctcactatagcttcaacctcc

SEQ ID NO: 1288401 - DNA, 22 bp, Artificial Sequence
  chemically synthesized
gtctcactatagcttcaacctc

SEQ ID NO: 1288402 - DNA, 22 bp, Artificial Sequence
  chemically synthesized
aaacccgggaggttgaagctat

SEQ ID NO: 1288403 - DNA, 22 bp, Artificial Sequence
  chemically synthesized
aagctatagtgagacaagattg

SEQ ID NO: 1288404 - DNA, 22 bp, Artificial Sequence
  chemically synthesized
gagtgtggtaatgcaatcttgt

SEQ ID NO: 1288405 - DNA, 22 bp, Artificial Sequence
  chemically synthesized
tagtgagacaagattgcattac

SEQ ID NO: 1288406 - DNA, 22 bp, Artificial Sequence
  chemically synthesized
tggcccaggctggagtgtggta

SEQ ID NO: 1288407 - DNA, 22 bp, Artificial Sequence
  chemically synthesized
gtggcccaggctggagtgtggt

SEQ ID NO: 1288408 - DNA, 22 bp, Artificial Sequence
  chemically synthesized
tgtggcccaggctggagtgtgg

SEQ ID NO: 1288409 - DNA, 22 bp, Artificial Sequence
  chemically synthesized
actttgtggcccaggctggagt

SEQ ID NO: 1288410 - DNA, 22 bp, Artificial Sequence
  chemically synthesized
cattaccacactccagcctggg

SEQ ID NO: 1288411 - DNA, 22 bp, Artificial Sequence
  chemically synthesized
ggtctcactttgtggcccaggc

SEQ ID NO: 1288412 - DNA, 22 bp, Artificial Sequence
  chemically synthesized
ccacactccagcctgggccaca

SEQ ID NO: 1288413 - DNA, 22 bp, Artificial Sequence
  chemically synthesized
acactgggtctcactttgtggc

SEQ ID NO: 1288414 - DNA, 22 bp, Artificial Sequence
  chemically synthesized
gacactgggtctcactttgtgg

SEQ ID NO: 1288415 - DNA, 22 bp, Artificial Sequence
  chemically synthesized
tgacactgggtctcactttgtg

SEQ ID NO: 1288416 - DNA, 22 bp, Artificial Sequence
  chemically synthesized
ttgacactgggtctcactttgt

SEQ ID NO: 1288417 - DNA, 22 bp, Artificial Sequence
  chemically synthesized
cagcctgggccacaaagtgaga

SEQ ID NO: 1288418 - DNA, 22 bp, Artificial Sequence
  chemically synthesized
tttgacactgggtctcactttg

SEQ ID NO: 1288419 - DNA, 22 bp, Artificial Sequence
  chemically synthesized
ttttgacactgggtctcacttt

SEQ ID NO: 1288420 - DNA, 22 bp, Artificial Sequence
  chemically synthesized
tttttgacactgggtctcactt

SEQ ID NO: 1288421 - DNA, 22 bp, Artificial Sequence
  chemically synthesized
ttttttgacactgggtctcact

SEQ ID NO: 1288422 - DNA, 22 bp, Artificial Sequence
  chemically synthesized
tttttttgacactgggtctcac

SEQ ID NO: 1288423 - DNA, 22 bp, Artificial Sequence
  chemically synthesized
ttttttttgacactgggtctca

SEQ ID NO: 1288424 - DNA, 22 bp, Artificial Sequence
  chemically synthesized
tttttttttgacactgggtctc

SEQ ID NO: 1288425 - DNA, 22 bp, Artificial Sequence
  chemically synthesized
ggccacaaagtgagacccagtg

SEQ ID NO: 1288426 - DNA, 22 bp, Artificial Sequence
  chemically synthesized
ttttttttttgacactgggtct

SEQ ID NO: 1288427 - DNA, 22 bp, Artificial Sequence
  chemically synthesized
tttttttttttgacactgggtc

SEQ ID NO: 1288428 - DNA, 22 bp, Artificial Sequence
  chemically synthesized
ttttttttttttgacactgggt

SEQ ID NO: 1288429 - DNA, 22 bp, Artificial Sequence
  chemically synthesized
tttttttttttttgacactggg

SEQ ID NO: 1288430 - DNA, 22 bp, Artificial Sequence
  chemically synthesized
ttttttttttttttgacactgg

SEQ ID NO: 1288431 - DNA, 22 bp, Artificial Sequence
  chemically synthesized
tttttttttttttttgacactg

SEQ ID NO: 1288432 - DNA, 22 bp, Artificial Sequence
  chemically synthesized
ttttttttttttttttgacact

SEQ ID NO: 1288433 - DNA, 22 bp, Artificial Sequence
  chemically synthesized
tttttttttttttttttgacac

SEQ ID NO: 1288434 - DNA, 22 bp, Artificial Sequence
  chemically synthesized
ttttttttttttttttttgaca

SEQ ID NO: 1288435 - DNA, 22 bp, Artificial Sequence
  chemically synthesized
tttttttttttttttttttgac

SEQ ID NO: 1288436 - DNA, 22 bp, Artificial Sequence
  chemically synthesized
ttttttttttttttttttttga

SEQ ID NO: 1288437 - DNA, 22 bp, Artificial Sequence
  chemically synthesized
tttttttttttttttttttttg

SEQ ID NO: 1288438 - DNA, 22 bp, Artificial Sequence
  chemically synthesized
tttttttttttttttttttttt

SEQ ID NO: 1288439 - DNA, 22 bp, Artificial Sequence
  chemically synthesized
tttttttttttttttttttttt

SEQ ID NO: 1288440 - DNA, 22 bp, Artificial Sequence
  chemically synthesized
attttttttttttttttttttt

SEQ ID NO: 1288441 - DNA, 22 bp, Artificial Sequence
  chemically synthesized
gatttttttttttttttttttt

SEQ ID NO: 1288442 - DNA, 22 bp, Artificial Sequence
  chemically synthesized
ccttgatttttttttttttttt

SEQ ID NO: 1288443 - DNA, 22 bp, Artificial Sequence
  chemically synthesized
taccttgatttttttttttttt

SEQ ID NO: 1288444 - DNA, 22 bp, Artificial Sequence
  chemically synthesized
cctctaccttgatttttttttt

SEQ ID NO: 1288445 - DNA, 22 bp, Artificial Sequence
  chemically synthesized
acctctaccttgattttttttt

SEQ ID NO: 1288446 - DNA, 22 bp, Artificial Sequence
  chemically synthesized
tacctctaccttgatttttttt

SEQ ID NO: 1288447 - DNA, 22 bp, Artificial Sequence
  chemically synthesized
cataggggaagaaaacataatt

SEQ ID NO: 1288448 - DNA, 22 bp, Artificial Sequence
  chemically synthesized
tgttttcttcccctatgcaatg

SEQ ID NO: 1288449 - DNA, 22 bp, Artificial Sequence
  chemically synthesized
aataaaagaaacacattgcata

SEQ ID NO: 1288450 - DNA, 22 bp, Artificial Sequence
  chemically synthesized
aaataaaagaaacacattgcat

SEQ ID NO: 1288451 - DNA, 22 bp, Artificial Sequence
  chemically synthesized
tcttcccctatgcaatgtgttt

SEQ ID NO: 1288452 - DNA, 22 bp, Artificial Sequence
  chemically synthesized
cttcccctatgcaatgtgtttc

SEQ ID NO: 1288453 - DNA, 22 bp, Artificial Sequence
  chemically synthesized
ttcccctatgcaatgtgtttct

SEQ ID NO: 1288454 - DNA, 22 bp, Artificial Sequence
  chemically synthesized
cccctatgcaatgtgtttcttt

SEQ ID NO: 1288455 - DNA, 22 bp, Artificial Sequence
  chemically synthesized
ccctatgcaatgtgtttctttt

SEQ ID NO: 1288456 - DNA, 22 bp, Artificial Sequence
  chemically synthesized
aataaacatttaaataaaagaa

SEQ ID NO: 1288457 - DNA, 22 bp, Artificial Sequence
  chemically synthesized
tgcaatgtgtttcttttattta

SEQ ID NO: 1288458 - DNA, 22 bp, Artificial Sequence
  chemically synthesized
ctaaataaacatttaaataaaa

SEQ ID NO: 1288459 - DNA, 22 bp, Artificial Sequence
  chemically synthesized
gctaaataaacatttaaataaa

SEQ ID NO: 1288460 - DNA, 22 bp, Artificial Sequence
  chemically synthesized
cttttatttaaatgtttattta

SEQ ID NO: 1288461 - DNA, 22 bp, Artificial Sequence
  chemically synthesized
ttttatttaaatgtttatttag

SEQ ID NO: 1288462 - DNA, 22 bp, Artificial Sequence
  chemically synthesized
ttatttaaatgtttatttagca

SEQ ID NO: 1288463 - DNA, 22 bp, Artificial Sequence
  chemically synthesized
tatttaaatgtttatttagcaa

SEQ ID NO: 1288464 - DNA, 22 bp, Artificial Sequence
  chemically synthesized
atttaaatgtttatttagcaaa

SEQ ID NO: 1288465 - DNA, 22 bp, Artificial Sequence
  chemically synthesized
tttaaatgtttatttagcaaat

SEQ ID NO: 1288466 - DNA, 22 bp, Artificial Sequence
  chemically synthesized
atcaggtaaacaatttgctaaa

SEQ ID NO: 1288467 - DNA, 22 bp, Artificial Sequence
  chemically synthesized
aaatgtttatttagcaaattgt

SEQ ID NO: 1288468 - DNA, 22 bp, Artificial Sequence
  chemically synthesized
ttcatcaggtaaacaatttgct

SEQ ID NO: 1288469 - DNA, 22 bp, Artificial Sequence
  chemically synthesized
aatgtttatttagcaaattgtt

SEQ ID NO: 1288470 - DNA, 22 bp, Artificial Sequence
  chemically synthesized
gttgttcatcaggtaaacaatt

SEQ ID NO: 1288471 - DNA, 22 bp, Artificial Sequence
  chemically synthesized
atttagcaaattgtttacctga

SEQ ID NO: 1288472 - DNA, 22 bp, Artificial Sequence
  chemically synthesized
tttagcaaattgtttacctgat

SEQ ID NO: 1288473 - DNA, 22 bp, Artificial Sequence
  chemically synthesized
agattagttgttcatcaggtaa

SEQ ID NO: 1288474 - DNA, 22 bp, Artificial Sequence
  chemically synthesized
agcaaattgtttacctgatgaa

SEQ ID NO: 1288475 - DNA, 22 bp, Artificial Sequence
  chemically synthesized
tcagattagttgttcatcaggt

SEQ ID NO: 1288476 - DNA, 22 bp, Artificial Sequence
  chemically synthesized
gcaaattgtttacctgatgaac

SEQ ID NO: 1288477 - DNA, 22 bp, Artificial Sequence
  chemically synthesized
actctcagattagttgttcatc

SEQ ID NO: 1288478 - DNA, 22 bp, Artificial Sequence
  chemically synthesized
ctcactctcagattagttgttc

SEQ ID NO: 1288479 - DNA, 22 bp, Artificial Sequence
  chemically synthesized
tttacctgatgaacaactaatc

SEQ ID NO: 1288480 - DNA, 22 bp, Artificial Sequence
  chemically synthesized
acctgatgaacaactaatctga

SEQ ID NO: 1288481 - DNA, 22 bp, Artificial Sequence
  chemically synthesized
cctgatgaacaactaatctgag

SEQ ID NO: 1288482 - DNA, 22 bp, Artificial Sequence
  chemically synthesized
atactactcactctcagattag

SEQ ID NO: 1288483 - DNA, 22 bp, Artificial Sequence
  chemically synthesized
ctcatactactcactctcagat

SEQ ID NO: 1288484 - DNA, 22 bp, Artificial Sequence
  chemically synthesized
atgaacaactaatctgagagtg

SEQ ID NO: 1288485 - DNA, 22 bp, Artificial Sequence
  chemically synthesized
gctcatactactcactctcaga

SEQ ID NO: 1288486 - DNA, 22 bp, Artificial Sequence
  chemically synthesized
atctgagagtgagtagtatgag

SEQ ID NO: 1288487 - DNA, 22 bp, Artificial Sequence
  chemically synthesized
caaaagccatttgctcatacta

SEQ ID NO: 1288488 - DNA, 22 bp, Artificial Sequence
  chemically synthesized
acaaaagccatttgctcatact

SEQ ID NO: 1288489 - DNA, 22 bp, Artificial Sequence
  chemically synthesized
tacaaaagccatttgctcatac

SEQ ID NO: 1288490 - DNA, 22 bp, Artificial Sequence
  chemically synthesized
agagtgagtagtatgagcaaat

SEQ ID NO: 1288491 - DNA, 22 bp, Artificial Sequence
  chemically synthesized
agaaaatctttacaaaagccat

SEQ ID NO: 1288492 - DNA, 22 bp, Artificial Sequence
  chemically synthesized
gagaaaatctttacaaaagcca

SEQ ID NO: 1288493 - DNA, 22 bp, Artificial Sequence
  chemically synthesized
aagtcaggtaaatttgagaaaa

SEQ ID NO: 1288494 - DNA, 22 bp, Artificial Sequence
  chemically synthesized
ttgtaaagattttctcaaattt

SEQ ID NO: 1288495 - DNA, 22 bp, Artificial Sequence
  chemically synthesized
tgtaaagattttctcaaattta

SEQ ID NO: 1288496 - DNA, 22 bp, Artificial Sequence
  chemically synthesized
gctcaagtcaggtaaatttgag

SEQ ID NO: 1288497 - DNA, 22 bp, Artificial Sequence
  chemically synthesized
gtaaagattttctcaaatttac

SEQ ID NO: 1288498 - DNA, 22 bp, Artificial Sequence
  chemically synthesized
taaagattttctcaaatttacc

SEQ ID NO: 1288499 - DNA, 22 bp, Artificial Sequence
  chemically synthesized
aatgtggttagctcaagtcagg

SEQ ID NO: 1288500 - DNA, 22 bp, Artificial Sequence
  chemically synthesized
tctcaaatttacctgacttgag

SEQ ID NO: 1288501 - DNA, 22 bp, Artificial Sequence
  chemically synthesized
ctcaaatttacctgacttgagc

SEQ ID NO: 1288502 - DNA, 22 bp, Artificial Sequence
  chemically synthesized
tcaaatttacctgacttgagct

SEQ ID NO: 1288503 - DNA, 22 bp, Artificial Sequence
  chemically synthesized
aaatttacctgacttgagctaa

SEQ ID NO: 1288504 - DNA, 22 bp, Artificial Sequence
  chemically synthesized
aaatctgaatgtggttagctca

SEQ ID NO: 1288505 - DNA, 22 bp, Artificial Sequence
  chemically synthesized
acctgacttgagctaaccacat

SEQ ID NO: 1288506 - DNA, 22 bp, Artificial Sequence
  chemically synthesized
cctgacttgagctaaccacatt

SEQ ID NO: 1288507 - DNA, 22 bp, Artificial Sequence
  chemically synthesized
acttgagctaaccacattcaga

SEQ ID NO: 1288508 - DNA, 22 bp, Artificial Sequence
  chemically synthesized
aagtaattaaaatctgaatgtg

SEQ ID NO: 1288509 - DNA, 22 bp, Artificial Sequence
  chemically synthesized
aaagtaattaaaatctgaatgt

SEQ ID NO: 1288510 - DNA, 22 bp, Artificial Sequence
  chemically synthesized
taaagtaattaaaatctgaatg

SEQ ID NO: 1288511 - DNA, 22 bp, Artificial Sequence
  chemically synthesized
gagctaaccacattcagatttt

SEQ ID NO: 1288512 - DNA, 22 bp, Artificial Sequence
  chemically synthesized
agctaaccacattcagatttta

SEQ ID NO: 1288513 - DNA, 22 bp, Artificial Sequence
  chemically synthesized
accacattcagattttaattac

SEQ ID NO: 1288514 - DNA, 22 bp, Artificial Sequence
  chemically synthesized
agattttaattactttaaagtt

SEQ ID NO: 1288515 - DNA, 22 bp, Artificial Sequence
  chemically synthesized
taattactttaaagttctctac

SEQ ID NO: 1288516 - DNA, 22 bp, Artificial Sequence
  chemically synthesized
aattactttaaagttctctacc

SEQ ID NO: 1288517 - DNA, 22 bp, Artificial Sequence
  chemically synthesized
attactttaaagttctctacct

SEQ ID NO: 1288518 - DNA, 22 bp, Artificial Sequence
  chemically synthesized
ctttaaagttctctacctattt

SEQ ID NO: 1288519 - DNA, 22 bp, Artificial Sequence
  chemically synthesized
taaagttctctacctatttata

SEQ ID NO: 1288520 - DNA, 22 bp, Artificial Sequence
  chemically synthesized
aaagttctctacctatttatat

SEQ ID NO: 1288521 - DNA, 22 bp, Artificial Sequence
  chemically synthesized
aagttctctacctatttatata

SEQ ID NO: 1288522 - DNA, 22 bp, Artificial Sequence
  chemically synthesized
tctacctatttatatatatata

SEQ ID NO: 1288523 - DNA, 22 bp, Artificial Sequence
  chemically synthesized
tacctatttatatatatatata

SEQ ID NO: 1288524 - DNA, 22 bp, Artificial Sequence
  chemically synthesized
cctatttatatatatatataca

SEQ ID NO: 1288525 - DNA, 22 bp, Artificial Sequence
  chemically synthesized
tttatatatatatatacacaca

SEQ ID NO: 1288526 - DNA, 22 bp, Artificial Sequence
  chemically synthesized
atatatatatatacacacacac

SEQ ID NO: 1288527 - DNA, 22 bp, Artificial Sequence
  chemically synthesized
tatatatatatacacacacaca

SEQ ID NO: 1288528 - DNA, 22 bp, Artificial Sequence
  chemically synthesized
tgtgtgtgtgtgtatataaaca

SEQ ID NO: 1288529 - DNA, 22 bp, Artificial Sequence
  chemically synthesized
gtgtgtgtgtgtgtatataaac

SEQ ID NO: 1288530 - DNA, 22 bp, Artificial Sequence
  chemically synthesized
gcatatatatgtttatatacac

SEQ ID NO: 1288531 - DNA, 22 bp, Artificial Sequence
  chemically synthesized
catatatatgtttatatacaca

SEQ ID NO: 1288532 - DNA, 22 bp, Artificial Sequence
  chemically synthesized
atatacacacacacacacaaat

SEQ ID NO: 1288533 - DNA, 22 bp, Artificial Sequence
  chemically synthesized
tatacacacacacacacaaatg

SEQ ID NO: 1288534 - DNA, 22 bp, Artificial Sequence
  chemically synthesized
gaatatatatgtagcatttgtg

SEQ ID NO: 1288535 - DNA, 22 bp, Artificial Sequence
  chemically synthesized
catatatattctaattgtttta

SEQ ID NO: 1288536 - DNA, 22 bp, Artificial Sequence
  chemically synthesized
aaatacacagaaaatgaataaa

SEQ ID NO: 1288537 - DNA, 22 bp, Artificial Sequence
  chemically synthesized
gttaaaatacacagaaaatgaa

SEQ ID NO: 1288538 - DNA, 22 bp, Artificial Sequence
  chemically synthesized
taattgttttattcattttctg

SEQ ID NO: 1288539 - DNA, 22 bp, Artificial Sequence
  chemically synthesized
attgttttattcattttctgtg

SEQ ID NO: 1288540 - DNA, 22 bp, Artificial Sequence
  chemically synthesized
ttttattcattttctgtgtatt

SEQ ID NO: 1288541 - DNA, 22 bp, Artificial Sequence
  chemically synthesized
aataagttagttaaaatacaca

SEQ ID NO: 1288542 - DNA, 22 bp, Artificial Sequence
  chemically synthesized
tattcattttctgtgtatttta

SEQ ID NO: 1288543 - DNA, 22 bp, Artificial Sequence
  chemically synthesized
attcattttctgtgtattttaa

SEQ ID NO: 1288544 - DNA, 22 bp, Artificial Sequence
  chemically synthesized
ttcattttctgtgtattttaac

SEQ ID NO: 1288545 - DNA, 22 bp, Artificial Sequence
  chemically synthesized
attttctgtgtattttaactaa

SEQ ID NO: 1288546 - DNA, 22 bp, Artificial Sequence
  chemically synthesized
aagcatctcaataagttagtta

SEQ ID NO: 1288547 - DNA, 22 bp, Artificial Sequence
  chemically synthesized
tctgtgtattttaactaactta

SEQ ID NO: 1288548 - DNA, 22 bp, Artificial Sequence
  chemically synthesized
ctgtgtattttaactaacttat

SEQ ID NO: 1288549 - DNA, 22 bp, Artificial Sequence
  chemically synthesized
tgtgtattttaactaacttatt

SEQ ID NO: 1288550 - DNA, 22 bp, Artificial Sequence
  chemically synthesized
ttcaagcatctcaataagttag

SEQ ID NO: 1288551 - DNA, 22 bp, Artificial Sequence
  chemically synthesized
gttcaagcatctcaataagtta

SEQ ID NO: 1288552 - DNA, 22 bp, Artificial Sequence
  chemically synthesized
tgtattttaactaacttattga

SEQ ID NO: 1288553 - DNA, 22 bp, Artificial Sequence
  chemically synthesized
aatttgttcaagcatctcaata

SEQ ID NO: 1288554 - DNA, 22 bp, Artificial Sequence
  chemically synthesized
caatttgttcaagcatctcaat

SEQ ID NO: 1288555 - DNA, 22 bp, Artificial Sequence
  chemically synthesized
taactaacttattgagatgctt

SEQ ID NO: 1288556 - DNA, 22 bp, Artificial Sequence
  chemically synthesized
aactaacttattgagatgcttg

SEQ ID NO: 1288557 - DNA, 22 bp, Artificial Sequence
  chemically synthesized
actaacttattgagatgcttga

SEQ ID NO: 1288558 - DNA, 22 bp, Artificial Sequence
  chemically synthesized
acttattgagatgcttgaacaa

SEQ ID NO: 1288559 - DNA, 22 bp, Artificial Sequence
  chemically synthesized
attgagatgcttgaacaaattg

SEQ ID NO: 1288560 - DNA, 22 bp, Artificial Sequence
  chemically synthesized
taaaaagcatttcaatttgttc

SEQ ID NO: 1288561 - DNA, 22 bp, Artificial Sequence
  chemically synthesized
ttgagatgcttgaacaaattga

SEQ ID NO: 1288562 - DNA, 22 bp, Artificial Sequence
  chemically synthesized
agatgcttgaacaaattgaaat

SEQ ID NO: 1288563 - DNA, 22 bp, Artificial Sequence
  chemically synthesized
aaagcattataaaaagcatttc

SEQ ID NO: 1288564 - DNA, 22 bp, Artificial Sequence
  chemically synthesized
aaaagcattataaaaagcattt

SEQ ID NO: 1288565 - DNA, 22 bp, Artificial Sequence
  chemically synthesized
taaaagcattataaaaagcatt

SEQ ID NO: 1288566 - DNA, 22 bp, Artificial Sequence
  chemically synthesized
gaacaaattgaaatgcttttta

SEQ ID NO: 1288567 - DNA, 22 bp, Artificial Sequence
  chemically synthesized
ttaaaagcattataaaaagcat

SEQ ID NO: 1288568 - DNA, 22 bp, Artificial Sequence
  chemically synthesized
aacaaattgaaatgctttttat

SEQ ID NO: 1288569 - DNA, 22 bp, Artificial Sequence
  chemically synthesized
tttttaaaagcattataaaaag

SEQ ID NO: 1288570 - DNA, 22 bp, Artificial Sequence
  chemically synthesized
aaatgctttttataatgctttt

SEQ ID NO: 1288571 - DNA, 22 bp, Artificial Sequence
  chemically synthesized
tatgtagtgattatttttaaaa

SEQ ID NO: 1288572 - DNA, 22 bp, Artificial Sequence
  chemically synthesized
tttataatgcttttaaaaataa

SEQ ID NO: 1288573 - DNA, 22 bp, Artificial Sequence
  chemically synthesized
ttataatgcttttaaaaataat

SEQ ID NO: 1288574 - DNA, 22 bp, Artificial Sequence
  chemically synthesized
tataatgcttttaaaaataatc

SEQ ID NO: 1288575 - DNA, 22 bp, Artificial Sequence
  chemically synthesized
ataatgcttttaaaaataatca

SEQ ID NO: 1288576 - DNA, 22 bp, Artificial Sequence
  chemically synthesized
taatgcttttaaaaataatcac

SEQ ID NO: 1288577 - DNA, 22 bp, Artificial Sequence
  chemically synthesized
gagaatatgttatatgtagtga

SEQ ID NO: 1288578 - DNA, 22 bp, Artificial Sequence
  chemically synthesized
ttaaaaataatcactacatata

SEQ ID NO: 1288579 - DNA, 22 bp, Artificial Sequence
  chemically synthesized
taaaaataatcactacatataa

SEQ ID NO: 1288580 - DNA, 22 bp, Artificial Sequence
  chemically synthesized
ctggagaatatgttatatgtag

SEQ ID NO: 1288581 - DNA, 22 bp, Artificial Sequence
  chemically synthesized
aaaaataatcactacatataac

SEQ ID NO: 1288582 - DNA, 22 bp, Artificial Sequence
  chemically synthesized
aaaataatcactacatataaca

SEQ ID NO: 1288583 - DNA, 22 bp, Artificial Sequence
  chemically synthesized
aactactggagaatatgttata

SEQ ID NO: 1288584 - DNA, 22 bp, Artificial Sequence
  chemically synthesized
ttcaactactggagaatatgtt

SEQ ID NO: 1288585 - DNA, 22 bp, Artificial Sequence
  chemically synthesized
cattgttcaactactggagaat

SEQ ID NO: 1288586 - DNA, 22 bp, Artificial Sequence
  chemically synthesized
acattgttcaactactggagaa

SEQ ID NO: 1288587 - DNA, 22 bp, Artificial Sequence
  chemically synthesized
catataacatattctccagtag

SEQ ID NO: 1288588 - DNA, 22 bp, Artificial Sequence
  chemically synthesized
tacattgttcaactactggaga

SEQ ID NO: 1288589 - DNA, 22 bp, Artificial Sequence
  chemically synthesized
tttacattgttcaactactgga

SEQ ID NO: 1288590 - DNA, 22 bp, Artificial Sequence
  chemically synthesized
tccagtagttgaacaatgtaaa

SEQ ID NO: 1288591 - DNA, 22 bp, Artificial Sequence
  chemically synthesized
cagtagttgaacaatgtaaaga

SEQ ID NO: 1288592 - DNA, 22 bp, Artificial Sequence
  chemically synthesized
aacaatgtaaagaatttcttat

SEQ ID NO: 1288593 - DNA, 22 bp, Artificial Sequence
  chemically synthesized
gaataaagtcatacatataaga

SEQ ID NO: 1288594 - DNA, 22 bp, Artificial Sequence
  chemically synthesized
cttatatgtatgactttattct

SEQ ID NO: 1288595 - DNA, 22 bp, Artificial Sequence
  chemically synthesized
ttatatgtatgactttattcta

SEQ ID NO: 1288596 - DNA, 22 bp, Artificial Sequence
  chemically synthesized
atatgtatgactttattctaac

SEQ ID NO: 1288597 - DNA, 22 bp, Artificial Sequence
  chemically synthesized
tatgtatgactttattctaaca

SEQ ID NO: 1288598 - DNA, 22 bp, Artificial Sequence
  chemically synthesized
gtaagtacccaagaaatatgaa

SEQ ID NO: 1288599 - DNA, 22 bp, Artificial Sequence
  chemically synthesized
agtaagtacccaagaaatatga

SEQ ID NO: 1288600 - DNA, 22 bp, Artificial Sequence
  chemically synthesized
tattctaacattcatatttctt

SEQ ID NO: 1288601 - DNA, 22 bp, Artificial Sequence
  chemically synthesized
attctaacattcatatttcttg

SEQ ID NO: 1288602 - DNA, 22 bp, Artificial Sequence
  chemically synthesized
ttctaacattcatatttcttgg

SEQ ID NO: 1288603 - DNA, 22 bp, Artificial Sequence
  chemically synthesized
taacattcatatttcttgggta

SEQ ID NO: 1288604 - DNA, 22 bp, Artificial Sequence
  chemically synthesized
acatttagtaagtacccaagaa

SEQ ID NO: 1288605 - DNA, 22 bp, Artificial Sequence
  chemically synthesized
acattcatatttcttgggtact

SEQ ID NO: 1288606 - DNA, 22 bp, Artificial Sequence
  chemically synthesized
atatttcttgggtacttactaa

SEQ ID NO: 1288607 - DNA, 22 bp, Artificial Sequence
  chemically synthesized
tgagtgcctaacatttagtaag

SEQ ID NO: 1288608 - DNA, 22 bp, Artificial Sequence
  chemically synthesized
cttgggtacttactaaatgtta

SEQ ID NO: 1288609 - DNA, 22 bp, Artificial Sequence
  chemically synthesized
gctgtgagtgcctaacatttag

SEQ ID NO: 1288610 - DNA, 22 bp, Artificial Sequence
  chemically synthesized
ttgggtacttactaaatgttag

SEQ ID NO: 1288611 - DNA, 22 bp, Artificial Sequence
  chemically synthesized
gggtacttactaaatgttaggc

SEQ ID NO: 1288612 - DNA, 22 bp, Artificial Sequence
  chemically synthesized
ctagctgtgagtgcctaacatt

SEQ ID NO: 1288613 - DNA, 22 bp, Artificial Sequence
  chemically synthesized
ggtacttactaaatgttaggca

SEQ ID NO: 1288614 - DNA, 22 bp, Artificial Sequence
  chemically synthesized
cattactagctgtgagtgccta

SEQ ID NO: 1288615 - DNA, 22 bp, Artificial Sequence
  chemically synthesized
acattactagctgtgagtgcct

SEQ ID NO: 1288616 - DNA, 22 bp, Artificial Sequence
  chemically synthesized
tacattactagctgtgagtgcc

SEQ ID NO: 1288617 - DNA, 22 bp, Artificial Sequence
  chemically synthesized
actaaatgttaggcactcacag

SEQ ID NO: 1288618 - DNA, 22 bp, Artificial Sequence
  chemically synthesized
ctaaatgttaggcactcacagc

SEQ ID NO: 1288619 - DNA, 22 bp, Artificial Sequence
  chemically synthesized
aatgttaggcactcacagctag

SEQ ID NO: 1288620 - DNA, 22 bp, Artificial Sequence
  chemically synthesized
cccaccattttacattactagc

SEQ ID NO: 1288621 - DNA, 22 bp, Artificial Sequence
  chemically synthesized
gcccaccattttacattactag

SEQ ID NO: 1288622 - DNA, 22 bp, Artificial Sequence
  chemically synthesized
ggcactcacagctagtaatgta

SEQ ID NO: 1288623 - DNA, 22 bp, Artificial Sequence
  chemically synthesized
tgcccaccattttacattacta

SEQ ID NO: 1288624 - DNA, 22 bp, Artificial Sequence
  chemically synthesized
acagctagtaatgtaaaatggt

SEQ ID NO: 1288625 - DNA, 22 bp, Artificial Sequence
  chemically synthesized
gaagagactttgcccaccattt

SEQ ID NO: 1288626 - DNA, 22 bp, Artificial Sequence
  chemically synthesized
ggaagagactttgcccaccatt

SEQ ID NO: 1288627 - DNA, 22 bp, Artificial Sequence
  chemically synthesized
tggaagagactttgcccaccat

SEQ ID NO: 1288628 - DNA, 22 bp, Artificial Sequence
  chemically synthesized
gtaatgtaaaatggtgggcaaa

SEQ ID NO: 1288629 - DNA, 22 bp, Artificial Sequence
  chemically synthesized
tagttttggaagagactttgcc

SEQ ID NO: 1288630 - DNA, 22 bp, Artificial Sequence
  chemically synthesized
taaactatagttttggaagaga

SEQ ID NO: 1288631 - DNA, 22 bp, Artificial Sequence
  chemically synthesized
gcctataaactatagttttgga

SEQ ID NO: 1288632 - DNA, 22 bp, Artificial Sequence
  chemically synthesized
ttagcctataaactatagtttt

SEQ ID NO: 1288633 - DNA, 22 bp, Artificial Sequence
  chemically synthesized
cattattagcctataaactata

SEQ ID NO: 1288634 - DNA, 22 bp, Artificial Sequence
  chemically synthesized
ccattattagcctataaactat

SEQ ID NO: 1288635 - DNA, 22 bp, Artificial Sequence
  chemically synthesized
ttccaaaactatagtttatagg

SEQ ID NO: 1288636 - DNA, 22 bp, Artificial Sequence
  chemically synthesized
ccaaaactatagtttataggct

SEQ ID NO: 1288637 - DNA, 22 bp, Artificial Sequence
  chemically synthesized
caaaactatagtttataggcta

SEQ ID NO: 1288638 - DNA, 22 bp, Artificial Sequence
  chemically synthesized
aagcttccattattagcctata

SEQ ID NO: 1288639 - DNA, 22 bp, Artificial Sequence
  chemically synthesized
tagtttataggctaataatgga

SEQ ID NO: 1288640 - DNA, 22 bp, Artificial Sequence
  chemically synthesized
ataggctaataatggaagcttt

SEQ ID NO: 1288641 - DNA, 22 bp, Artificial Sequence
  chemically synthesized
gaaaagtgtcctaaagcttcca

SEQ ID NO: 1288642 - DNA, 22 bp, Artificial Sequence
  chemically synthesized
taggctaataatggaagcttta

SEQ ID NO: 1288643 - DNA, 22 bp, Artificial Sequence
  chemically synthesized
ttggaaaagtgtcctaaagctt

SEQ ID NO: 1288644 - DNA, 22 bp, Artificial Sequence
  chemically synthesized
ataatggaagctttaggacact

SEQ ID NO: 1288645 - DNA, 22 bp, Artificial Sequence
  chemically synthesized
tgtaattattggaaaagtgtcc

SEQ ID NO: 1288646 - DNA, 22 bp, Artificial Sequence
  chemically synthesized
taggacacttttccaataatta

SEQ ID NO: 1288647 - DNA, 22 bp, Artificial Sequence
  chemically synthesized
taacatgttgtgtaattattgg

SEQ ID NO: 1288648 - DNA, 22 bp, Artificial Sequence
  chemically synthesized
aggacacttttccaataattac

SEQ ID NO: 1288649 - DNA, 22 bp, Artificial Sequence
  chemically synthesized
ggacacttttccaataattaca

SEQ ID NO: 1288650 - DNA, 22 bp, Artificial Sequence
  chemically synthesized
aaactataacatgttgtgtaat

SEQ ID NO: 1288651 - DNA, 22 bp, Artificial Sequence
  chemically synthesized
caaactataacatgttgtgtaa

SEQ ID NO: 1288652 - DNA, 22 bp, Artificial Sequence
  chemically synthesized
ttccaataattacacaacatgt

SEQ ID NO: 1288653 - DNA, 22 bp, Artificial Sequence
  chemically synthesized
tccaataattacacaacatgtt

SEQ ID NO: 1288654 - DNA, 22 bp, Artificial Sequence
  chemically synthesized
ccaataattacacaacatgtta

SEQ ID NO: 1288655 - DNA, 22 bp, Artificial Sequence
  chemically synthesized
caataattacacaacatgttat

SEQ ID NO: 1288656 - DNA, 22 bp, Artificial Sequence
  chemically synthesized
acacttcaaactataacatgtt

SEQ ID NO: 1288657 - DNA, 22 bp, Artificial Sequence
  chemically synthesized
gaaggttcacacttcaaactat

SEQ ID NO: 1288658 - DNA, 22 bp, Artificial Sequence
  chemically synthesized
cacaacatgttatagtttgaag

SEQ ID NO: 1288659 - DNA, 22 bp, Artificial Sequence
  chemically synthesized
cgaaggttcacacttcaaacta

SEQ ID NO: 1288660 - DNA, 22 bp, Artificial Sequence
  chemically synthesized
tttcgaaggttcacacttcaaa

SEQ ID NO: 1288661 - DNA, 22 bp, Artificial Sequence
  chemically synthesized
tgtttcgaaggttcacacttca

SEQ ID NO: 1288662 - DNA, 22 bp, Artificial Sequence
  chemically synthesized
ctgtttcgaaggttcacacttc

SEQ ID NO: 1288663 - DNA, 22 bp, Artificial Sequence
  chemically synthesized
tagtttgaagtgtgaaccttcg

SEQ ID NO: 1288664 - DNA, 22 bp, Artificial Sequence
  chemically synthesized
cagcaacttctgtttcgaaggt

SEQ ID NO: 1288665 - DNA, 22 bp, Artificial Sequence
  chemically synthesized
ccagcaacttctgtttcgaagg

SEQ ID NO: 1288666 - DNA, 22 bp, Artificial Sequence
  chemically synthesized
gaagtgtgaaccttcgaaacag

SEQ ID NO: 1288667 - DNA, 22 bp, Artificial Sequence
  chemically synthesized
aagtgtgaaccttcgaaacaga

SEQ ID NO: 1288668 - DNA, 22 bp, Artificial Sequence
  chemically synthesized
aatttccagcaacttctgtttc

SEQ ID NO: 1288669 - DNA, 22 bp, Artificial Sequence
  chemically synthesized
cgaaacagaagttgctggaaat

SEQ ID NO: 1288670 - DNA, 22 bp, Artificial Sequence
  chemically synthesized
gaaacagaagttgctggaaatt

SEQ ID NO: 1288671 - DNA, 22 bp, Artificial Sequence
  chemically synthesized
gaatagtgtaaggacactgaat

SEQ ID NO: 1288672 - DNA, 22 bp, Artificial Sequence
  chemically synthesized
cgaatagtgtaaggacactgaa

SEQ ID NO: 1288673 - DNA, 22 bp, Artificial Sequence
  chemically synthesized
ctggaaattcagtgtccttaca

SEQ ID NO: 1288674 - DNA, 22 bp, Artificial Sequence
  chemically synthesized
gaaattcagtgtccttacacta

SEQ ID NO: 1288675 - DNA, 22 bp, Artificial Sequence
  chemically synthesized
agtgtccttacactattcgaag

SEQ ID NO: 1288676 - DNA, 22 bp, Artificial Sequence
  chemically synthesized
catgtataaatccttcgaatag

SEQ ID NO: 1288677 - DNA, 22 bp, Artificial Sequence
  chemically synthesized
tgcatgtataaatccttcgaat

SEQ ID NO: 1288678 - DNA, 22 bp, Artificial Sequence
  chemically synthesized
gttctgcatgtataaatccttc

SEQ ID NO: 1288679 - DNA, 22 bp, Artificial Sequence
  chemically synthesized
tggttctgcatgtataaatcct

SEQ ID NO: 1288680 - DNA, 22 bp, Artificial Sequence
  chemically synthesized
acactattcgaaggatttatac

SEQ ID NO: 1288681 - DNA, 22 bp, Artificial Sequence
  chemically synthesized
ctggttctgcatgtataaatcc

SEQ ID NO: 1288682 - DNA, 22 bp, Artificial Sequence
  chemically synthesized
cactattcgaaggatttataca

SEQ ID NO: 1288683 - DNA, 22 bp, Artificial Sequence
  chemically synthesized
tctggttctgcatgtataaatc

SEQ ID NO: 1288684 - DNA, 22 bp, Artificial Sequence
  chemically synthesized
ttttctggttctgcatgtataa

SEQ ID NO: 1288685 - DNA, 22 bp, Artificial Sequence
  chemically synthesized
gttttctggttctgcatgtata

SEQ ID NO: 1288686 - DNA, 22 bp, Artificial Sequence
  chemically synthesized
ttcgaaggatttatacatgcag

SEQ ID NO: 1288687 - DNA, 22 bp, Artificial Sequence
  chemically synthesized
tttgttttctggttctgcatgt

SEQ ID NO: 1288688 - DNA, 22 bp, Artificial Sequence
  chemically synthesized
gaaggatttatacatgcagaac

SEQ ID NO: 1288689 - DNA, 22 bp, Artificial Sequence
  chemically synthesized
gtttgttttctggttctgcatg

SEQ ID NO: 1288690 - DNA, 22 bp, Artificial Sequence
  chemically synthesized
tttgtttgttttctggttctgc

SEQ ID NO: 1288691 - DNA, 22 bp, Artificial Sequence
  chemically synthesized
gtttgtttgttttctggttctg

SEQ ID NO: 1288692 - DNA, 22 bp, Artificial Sequence
  chemically synthesized
tgtttgtttgttttctggttct

SEQ ID NO: 1288693 - DNA, 22 bp, Artificial Sequence
  chemically synthesized
ttgtttgtttgttttctggttc

SEQ ID NO: 1288694 - DNA, 22 bp, Artificial Sequence
  chemically synthesized
atacatgcagaaccagaaaaca

SEQ ID NO: 1288695 - DNA, 22 bp, Artificial Sequence
  chemically synthesized
tacatgcagaaccagaaaacaa

SEQ ID NO: 1288696 - DNA, 22 bp, Artificial Sequence
  chemically synthesized
agatatttttgtttgtttgttt

SEQ ID NO: 1288697 - DNA, 22 bp, Artificial Sequence
  chemically synthesized
actgagatatttttgtttgttt

SEQ ID NO: 1288698 - DNA, 22 bp, Artificial Sequence
  chemically synthesized
aactgagatatttttgtttgtt

SEQ ID NO: 1288699 - DNA, 22 bp, Artificial Sequence
  chemically synthesized
taactgagatatttttgtttgt

SEQ ID NO: 1288700 - DNA, 22 bp, Artificial Sequence
  chemically synthesized
attttaactgagatatttttgt

SEQ ID NO: 1288701 - DNA, 22 bp, Artificial Sequence
  chemically synthesized
aagtgactgattttaactgaga

SEQ ID NO: 1288702 - DNA, 22 bp, Artificial Sequence
  chemically synthesized
tgaagtgactgattttaactga

SEQ ID NO: 1288703 - DNA, 22 bp, Artificial Sequence
  chemically synthesized
ctctgaagtgactgattttaac

SEQ ID NO: 1288704 - DNA, 22 bp, Artificial Sequence
  chemically synthesized
cctctgaagtgactgattttaa

SEQ ID NO: 1288705 - DNA, 22 bp, Artificial Sequence
  chemically synthesized
tttcctctgaagtgactgattt

SEQ ID NO: 1288706 - DNA, 22 bp, Artificial Sequence
  chemically synthesized
gtttcctctgaagtgactgatt

SEQ ID NO: 1288707 - DNA, 22 bp, Artificial Sequence
  chemically synthesized
agttaaaatcagtcacttcaga

SEQ ID NO: 1288708 - DNA, 22 bp, Artificial Sequence
  chemically synthesized
aaatcagtcacttcagaggaaa

SEQ ID NO: 1288709 - DNA, 22 bp, Artificial Sequence
  chemically synthesized
tcgcgatcaatttgtttcctct

SEQ ID NO: 1288710 - DNA, 22 bp, Artificial Sequence
  chemically synthesized
ctatcgcgatcaatttgtttcc

SEQ ID NO: 1288711 - DNA, 22 bp, Artificial Sequence
  chemically synthesized
ctgctatcgcgatcaatttgtt

SEQ ID NO: 1288712 - DNA, 22 bp, Artificial Sequence
  chemically synthesized
cctactgctatcgcgatcaatt

SEQ ID NO: 1288713 - DNA, 22 bp, Artificial Sequence
  chemically synthesized
cagaggaaacaaattgatcgcg

SEQ ID NO: 1288714 - DNA, 22 bp, Artificial Sequence
  chemically synthesized
ccctactgctatcgcgatcaat

SEQ ID NO: 1288715 - DNA, 22 bp, Artificial Sequence
  chemically synthesized
agaggaaacaaattgatcgcga

SEQ ID NO: 1288716 - DNA, 22 bp, Artificial Sequence
  chemically synthesized
tccctactgctatcgcgatcaa

SEQ ID NO: 1288717 - DNA, 22 bp, Artificial Sequence
  chemically synthesized
caaaattttccctactgctatc

SEQ ID NO: 1288718 - DNA, 22 bp, Artificial Sequence
  chemically synthesized
tccaaaattttccctactgcta

SEQ ID NO: 1288719 - DNA, 22 bp, Artificial Sequence
  chemically synthesized
ctccaaaattttccctactgct

SEQ ID NO: 1288720 - DNA, 22 bp, Artificial Sequence
  chemically synthesized
tctccaaaattttccctactgc

SEQ ID NO: 1288721 - DNA, 22 bp, Artificial Sequence
  chemically synthesized
ttctccaaaattttccctactg

SEQ ID NO: 1288722 - DNA, 22 bp, Artificial Sequence
  chemically synthesized
tttctccaaaattttccctact

SEQ ID NO: 1288723 - DNA, 22 bp, Artificial Sequence
  chemically synthesized
atcgcgatagcagtagggaaaa

SEQ ID NO: 1288724 - DNA, 22 bp, Artificial Sequence
  chemically synthesized
acattttttctccaaaattttc

SEQ ID NO: 1288725 - DNA, 22 bp, Artificial Sequence
  chemically synthesized
aaagctaacattttttctccaa

SEQ ID NO: 1288726 - DNA, 22 bp, Artificial Sequence
  chemically synthesized
caaagctaacattttttctcca

SEQ ID NO: 1288727 - DNA, 22 bp, Artificial Sequence
  chemically synthesized
cttcaaagctaacattttttct

SEQ ID NO: 1288728 - DNA, 22 bp, Artificial Sequence
  chemically synthesized
gcttcaaagctaacattttttc

SEQ ID NO: 1288729 - DNA, 22 bp, Artificial Sequence
  chemically synthesized
tggagaaaaaatgttagctttg

SEQ ID NO: 1288730 - DNA, 22 bp, Artificial Sequence
  chemically synthesized
ggagaaaaaatgttagctttga

SEQ ID NO: 1288731 - DNA, 22 bp, Artificial Sequence
  chemically synthesized
gacaagcttgcttcaaagctaa

SEQ ID NO: 1288732 - DNA, 22 bp, Artificial Sequence
  chemically synthesized
gagaaaaaatgttagctttgaa

SEQ ID NO: 1288733 - DNA, 22 bp, Artificial Sequence
  chemically synthesized
cgggttggacaagcttgcttca

SEQ ID NO: 1288734 - DNA, 22 bp, Artificial Sequence
  chemically synthesized
taggctgcgggttggacaagct

SEQ ID NO: 1288735 - DNA, 22 bp, Artificial Sequence
  chemically synthesized
gctttgaagcaagcttgtccaa

SEQ ID NO: 1288736 - DNA, 22 bp, Artificial Sequence
  chemically synthesized
tgaagcaagcttgtccaacccg

SEQ ID NO: 1288737 - DNA, 22 bp, Artificial Sequence
  chemically synthesized
gaagcaagcttgtccaacccgc

SEQ ID NO: 1288738 - DNA, 22 bp, Artificial Sequence
  chemically synthesized
aagcaagcttgtccaacccgca

SEQ ID NO: 1288739 - DNA, 22 bp, Artificial Sequence
  chemically synthesized
atgcagcctgtaggctgcgggt

SEQ ID NO: 1288740 - DNA, 22 bp, Artificial Sequence
  chemically synthesized
ggcctcatgcagcctgtaggct

SEQ ID NO: 1288741 - DNA, 22 bp, Artificial Sequence
  chemically synthesized
gtccaacccgcagcctacaggc

SEQ ID NO: 1288742 - DNA, 22 bp, Artificial Sequence
  chemically synthesized
tccaacccgcagcctacaggct

SEQ ID NO: 1288743 - DNA, 22 bp, Artificial Sequence
  chemically synthesized
tcctgggcctcatgcagcctgt

SEQ ID NO: 1288744 - DNA, 22 bp, Artificial Sequence
  chemically synthesized
aaagctgtcctgggcctcatgc

SEQ ID NO: 1288745 - DNA, 22 bp, Artificial Sequence
  chemically synthesized
cattcaaagctgtcctgggcct

SEQ ID NO: 1288746 - DNA, 22 bp, Artificial Sequence
  chemically synthesized
caggctgcatgaggcccaggac

SEQ ID NO: 1288747 - DNA, 22 bp, Artificial Sequence
  chemically synthesized
ggctgcattcaaagctgtcctg

SEQ ID NO: 1288748 - DNA, 22 bp, Artificial Sequence
  chemically synthesized
catgaggcccaggacagctttg

SEQ ID NO: 1288749 - DNA, 22 bp, Artificial Sequence
  chemically synthesized
tgttgggctgcattcaaagctg

SEQ ID NO: 1288750 - DNA, 22 bp, Artificial Sequence
  chemically synthesized
gtgttgggctgcattcaaagct

SEQ ID NO: 1288751 - DNA, 22 bp, Artificial Sequence
  chemically synthesized
caaatttgtgttgggctgcatt

SEQ ID NO: 1288752 - DNA, 22 bp, Artificial Sequence
  chemically synthesized
acaaatttgtgttgggctgcat

SEQ ID NO: 1288753 - DNA, 22 bp, Artificial Sequence
  chemically synthesized
tgaatgcagcccaacacaaatt

SEQ ID NO: 1288754 - DNA, 22 bp, Artificial Sequence
  chemically synthesized
gaatgcagcccaacacaaattt

SEQ ID NO: 1288755 - DNA, 22 bp, Artificial Sequence
  chemically synthesized
aagaaagtttacaaatttgtgt

SEQ ID NO: 1288756 - DNA, 22 bp, Artificial Sequence
  chemically synthesized
aatgcagcccaacacaaatttg

SEQ ID NO: 1288757 - DNA, 22 bp, Artificial Sequence
  chemically synthesized
caagaaagtttacaaatttgtg

SEQ ID NO: 1288758 - DNA, 22 bp, Artificial Sequence
  chemically synthesized
atgatgtttcaagaaagtttac

SEQ ID NO: 1288759 - DNA, 22 bp, Artificial Sequence
  chemically synthesized
aaaaatatctcatgatgtttca

SEQ ID NO: 1288760 - DNA, 22 bp, Artificial Sequence
  chemically synthesized
gtaaactttcttgaaacatcat

SEQ ID NO: 1288761 - DNA, 22 bp, Artificial Sequence
  chemically synthesized
taaactttcttgaaacatcatg

SEQ ID NO: 1288762 - DNA, 22 bp, Artificial Sequence
  chemically synthesized
tcttgaaacatcatgagatatt

SEQ ID NO: 1288763 - DNA, 22 bp, Artificial Sequence
  chemically synthesized
cttgaaacatcatgagatattt

SEQ ID NO: 1288764 - DNA, 22 bp, Artificial Sequence
  chemically synthesized
ttgaaacatcatgagatatttt

SEQ ID NO: 1288765 - DNA, 22 bp, Artificial Sequence
  chemically synthesized
gaaacatcatgagatatttttt

SEQ ID NO: 1288766 - DNA, 22 bp, Artificial Sequence
  chemically synthesized
aaacatcatgagatatttttta

SEQ ID NO: 1288767 - DNA, 22 bp, Artificial Sequence
  chemically synthesized
aaaaaaataaatctaaaaaata

SEQ ID NO: 1288768 - DNA, 22 bp, Artificial Sequence
  chemically synthesized
tttagatttattttttttagct

SEQ ID NO: 1288769 - DNA, 22 bp, Artificial Sequence
  chemically synthesized
ttagatttattttttttagctc

SEQ ID NO: 1288770 - DNA, 22 bp, Artificial Sequence
  chemically synthesized
atgatagatgatgagctaaaaa

SEQ ID NO: 1288771 - DNA, 22 bp, Artificial Sequence
  chemically synthesized
tagatttattttttttagctca

SEQ ID NO: 1288772 - DNA, 22 bp, Artificial Sequence
  chemically synthesized
agatttattttttttagctcat

SEQ ID NO: 1288773 - DNA, 22 bp, Artificial Sequence
  chemically synthesized
gatttattttttttagctcatc

SEQ ID NO: 1288774 - DNA, 22 bp, Artificial Sequence
  chemically synthesized
attttttttagctcatcatcta

SEQ ID NO: 1288775 - DNA, 22 bp, Artificial Sequence
  chemically synthesized
ttttttttagctcatcatctat

SEQ ID NO: 1288776 - DNA, 22 bp, Artificial Sequence
  chemically synthesized
tttttagctcatcatctatcat

SEQ ID NO: 1288777 - DNA, 22 bp, Artificial Sequence
  chemically synthesized
ttttagctcatcatctatcatt

SEQ ID NO: 1288778 - DNA, 22 bp, Artificial Sequence
  chemically synthesized
tttagctcatcatctatcatta

SEQ ID NO: 1288779 - DNA, 22 bp, Artificial Sequence
  chemically synthesized
ttagctcatcatctatcattag

SEQ ID NO: 1288780 - DNA, 22 bp, Artificial Sequence
  chemically synthesized
aatacagtaacactaatgatag

SEQ ID NO: 1288781 - DNA, 22 bp, Artificial Sequence
  chemically synthesized
tagctcatcatctatcattagt

SEQ ID NO: 1288782 - DNA, 22 bp, Artificial Sequence
  chemically synthesized
agctcatcatctatcattagtg

SEQ ID NO: 1288783 - DNA, 22 bp, Artificial Sequence
  chemically synthesized
gctcatcatctatcattagtgt

SEQ ID NO: 1288784 - DNA, 22 bp, Artificial Sequence
  chemically synthesized
atcatctatcattagtgttact

SEQ ID NO: 1288785 - DNA, 22 bp, Artificial Sequence
  chemically synthesized
ggccacacattaaatacagtaa

SEQ ID NO: 1288786 - DNA, 22 bp, Artificial Sequence
  chemically synthesized
gggccacacattaaatacagta

SEQ ID NO: 1288787 - DNA, 22 bp, Artificial Sequence
  chemically synthesized
tcattagtgttactgtatttaa

SEQ ID NO: 1288788 - DNA, 22 bp, Artificial Sequence
  chemically synthesized
tcttgggccacacattaaatac

SEQ ID NO: 1288789 - DNA, 22 bp, Artificial Sequence
  chemically synthesized
gtgttactgtatttaatgtgtg

SEQ ID NO: 1288790 - DNA, 22 bp, Artificial Sequence
  chemically synthesized
ggagaattgtcttgggccacac

SEQ ID NO: 1288791 - DNA, 22 bp, Artificial Sequence
  chemically synthesized
ctgtatttaatgtgtggcccaa

SEQ ID NO: 1288792 - DNA, 22 bp, Artificial Sequence
  chemically synthesized
tatttaatgtgtggcccaagac

SEQ ID NO: 1288793 - DNA, 22 bp, Artificial Sequence
  chemically synthesized
aatgtgtggcccaagacaattc

SEQ ID NO: 1288794 - DNA, 22 bp, Artificial Sequence
  chemically synthesized
atgtgtggcccaagacaattct

SEQ ID NO: 1288795 - DNA, 22 bp, Artificial Sequence
  chemically synthesized
ggccacactgggagaattgtct

SEQ ID NO: 1288796 - DNA, 22 bp, Artificial Sequence
  chemically synthesized
cctgggccacactgggagaatt

SEQ ID NO: 1288797 - DNA, 22 bp, Artificial Sequence
  chemically synthesized
ccctgggccacactgggagaat

SEQ ID NO: 1288798 - DNA, 22 bp, Artificial Sequence
  chemically synthesized
gcttccctgggccacactggga

SEQ ID NO: 1288799 - DNA, 22 bp, Artificial Sequence
  chemically synthesized
agcttccctgggccacactggg

SEQ ID NO: 1288800 - DNA, 22 bp, Artificial Sequence
  chemically synthesized
tagcttccctgggccacactgg

SEQ ID NO: 1288801 - DNA, 22 bp, Artificial Sequence
  chemically synthesized
ttagcttccctgggccacactg

SEQ ID NO: 1288802 - DNA, 22 bp, Artificial Sequence
  chemically synthesized
tcccagtgtggcccagggaagc

SEQ ID NO: 1288803 - DNA, 22 bp, Artificial Sequence
  chemically synthesized
tcagaacttttagcttccctgg

SEQ ID NO: 1288804 - DNA, 22 bp, Artificial Sequence
  chemically synthesized
ccagtgtggcccagggaagcta

SEQ ID NO: 1288805 - DNA, 22 bp, Artificial Sequence
  chemically synthesized
aaagcagaattgtcagaacttt

SEQ ID NO: 1288806 - DNA, 22 bp, Artificial Sequence
  chemically synthesized
caaagcagaattgtcagaactt

SEQ ID NO: 1288807 - DNA, 22 bp, Artificial Sequence
  chemically synthesized
aaagttctgacaattctgcttt

SEQ ID NO: 1288808 - DNA, 22 bp, Artificial Sequence
  chemically synthesized
aaagggagtcttcaaagcagaa

SEQ ID NO: 1288809 - DNA, 22 bp, Artificial Sequence
  chemically synthesized
aaaagggagtcttcaaagcaga

SEQ ID NO: 1288810 - DNA, 22 bp, Artificial Sequence
  chemically synthesized
tgacaattctgctttgaagact

SEQ ID NO: 1288811 - DNA, 22 bp, Artificial Sequence
  chemically synthesized
acaattctgctttgaagactcc

SEQ ID NO: 1288812 - DNA, 22 bp, Artificial Sequence
  chemically synthesized
ccaacttaaaagggagtcttca

SEQ ID NO: 1288813 - DNA, 22 bp, Artificial Sequence
  chemically synthesized
attgccaacttaaaagggagtc

SEQ ID NO: 1288814 - DNA, 22 bp, Artificial Sequence
  chemically synthesized
tgctttgaagactcccttttaa

SEQ ID NO: 1288815 - DNA, 22 bp, Artificial Sequence
  chemically synthesized
ctttgaagactcccttttaagt

SEQ ID NO: 1288816 - DNA, 22 bp, Artificial Sequence
  chemically synthesized
tgaagactcccttttaagttgg

SEQ ID NO: 1288817 - DNA, 22 bp, Artificial Sequence
  chemically synthesized
gaagactcccttttaagttggc

SEQ ID NO: 1288818 - DNA, 22 bp, Artificial Sequence
  chemically synthesized
aagactcccttttaagttggca

SEQ ID NO: 1288819 - DNA, 22 bp, Artificial Sequence
  chemically synthesized
ccttttaagttggcaatgaatg

SEQ ID NO: 1288820 - DNA, 22 bp, Artificial Sequence
  chemically synthesized
ttaagttggcaatgaatgtact

SEQ ID NO: 1288821 - DNA, 22 bp, Artificial Sequence
  chemically synthesized
cataatcatgtaagtacattca

SEQ ID NO: 1288822 - DNA, 22 bp, Artificial Sequence
  chemically synthesized
taagttggcaatgaatgtactt

SEQ ID NO: 1288823 - DNA, 22 bp, Artificial Sequence
  chemically synthesized
aagttggcaatgaatgtactta

SEQ ID NO: 1288824 - DNA, 22 bp, Artificial Sequence
  chemically synthesized
agttggcaatgaatgtacttac

SEQ ID NO: 1288825 - DNA, 22 bp, Artificial Sequence
  chemically synthesized
gcaatgaatgtacttacatgat

SEQ ID NO: 1288826 - DNA, 22 bp, Artificial Sequence
  chemically synthesized
agtaacaatacctacataatca

SEQ ID NO: 1288827 - DNA, 22 bp, Artificial Sequence
  chemically synthesized
aagtaacaatacctacataatc

SEQ ID NO: 1288828 - DNA, 22 bp, Artificial Sequence
  chemically synthesized
catttaagtaacaatacctaca

SEQ ID NO: 1288829 - DNA, 22 bp, Artificial Sequence
  chemically synthesized
acatgattatgtaggtattgtt

SEQ ID NO: 1288830 - DNA, 22 bp, Artificial Sequence
  chemically synthesized
catgattatgtaggtattgtta

SEQ ID NO: 1288831 - DNA, 22 bp, Artificial Sequence
  chemically synthesized
tgtaggtattgttacttaaatg

SEQ ID NO: 1288832 - DNA, 22 bp, Artificial Sequence
  chemically synthesized
aacgtaacatgttacatttaag

SEQ ID NO: 1288833 - DNA, 22 bp, Artificial Sequence
  chemically synthesized
ttacttaaatgtaacatgttac

SEQ ID NO: 1288834 - DNA, 22 bp, Artificial Sequence
  chemically synthesized
aacatgttaaacgtaacatgtt

SEQ ID NO: 1288835 - DNA, 22 bp, Artificial Sequence
  chemically synthesized
aaacatgttaaacgtaacatgt

SEQ ID NO: 1288836 - DNA, 22 bp, Artificial Sequence
  chemically synthesized
cttaaatgtaacatgttacgtt

SEQ ID NO: 1288837 - DNA, 22 bp, Artificial Sequence
  chemically synthesized
aaatgtaacatgttacgtttaa

SEQ ID NO: 1288838 - DNA, 22 bp, Artificial Sequence
  chemically synthesized
aatgtaacatgttacgtttaac

SEQ ID NO: 1288839 - DNA, 22 bp, Artificial Sequence
  chemically synthesized
gtcatcaatgtttaaacatgtt

SEQ ID NO: 1288840 - DNA, 22 bp, Artificial Sequence
  chemically synthesized
cgttggtcatcaatgtttaaac

SEQ ID NO: 1288841 - DNA, 22 bp, Artificial Sequence
  chemically synthesized
cgtttaacatgtttaaacattg

SEQ ID NO: 1288842 - DNA, 22 bp, Artificial Sequence
  chemically synthesized
tgcgttggtcatcaatgtttaa

SEQ ID NO: 1288843 - DNA, 22 bp, Artificial Sequence
  chemically synthesized
aacatgtttaaacattgatgac

SEQ ID NO: 1288844 - DNA, 22 bp, Artificial Sequence
  chemically synthesized
acatgtttaaacattgatgacc

SEQ ID NO: 1288845 - DNA, 22 bp, Artificial Sequence
  chemically synthesized
agattctgcgttggtcatcaat

SEQ ID NO: 1288846 - DNA, 22 bp, Artificial Sequence
  chemically synthesized
aaacattgatgaccaacgcaga

SEQ ID NO: 1288847 - DNA, 22 bp, Artificial Sequence
  chemically synthesized
aacattgatgaccaacgcagaa

SEQ ID NO: 1288848 - DNA, 22 bp, Artificial Sequence
  chemically synthesized
ccaaagtgctgagattctgcgt

SEQ ID NO: 1288849 - DNA, 22 bp, Artificial Sequence
  chemically synthesized
atgaccaacgcagaatctcagc

SEQ ID NO: 1288850 - DNA, 22 bp, Artificial Sequence
  chemically synthesized
agcctcccaaagtgctgagatt

SEQ ID NO: 1288851 - DNA, 22 bp, Artificial Sequence
  chemically synthesized
cccgcctcagcctcccaaagtg

SEQ ID NO: 1288852 - DNA, 22 bp, Artificial Sequence
  chemically synthesized
gtgatctgcccgcctcagcctc

SEQ ID NO: 1288853 - DNA, 22 bp, Artificial Sequence
  chemically synthesized
agcactttgggaggctgaggcg

SEQ ID NO: 1288854 - DNA, 22 bp, Artificial Sequence
  chemically synthesized
acctcgtgatctgcccgcctca

SEQ ID NO: 1288855 - DNA, 22 bp, Artificial Sequence
  chemically synthesized
ctgacctcgtgatctgcccgcc

SEQ ID NO: 1288856 - DNA, 22 bp, Artificial Sequence
  chemically synthesized
tgggaggctgaggcgggcagat

SEQ ID NO: 1288857 - DNA, 22 bp, Artificial Sequence
  chemically synthesized
gggaggctgaggcgggcagatc

SEQ ID NO: 1288858 - DNA, 22 bp, Artificial Sequence
  chemically synthesized
ggaggctgaggcgggcagatca

SEQ ID NO: 1288859 - DNA, 22 bp, Artificial Sequence
  chemically synthesized
aatctcctgacctcgtgatctg

SEQ ID NO: 1288860 - DNA, 22 bp, Artificial Sequence
  chemically synthesized
aggcgggcagatcacgaggtca

SEQ ID NO: 1288861 - DNA, 22 bp, Artificial Sequence
  chemically synthesized
gccaggatggctcaatctcctg

SEQ ID NO: 1288862 - DNA, 22 bp, Artificial Sequence
  chemically synthesized
accatgttagccaggatggctc

SEQ ID NO: 1288863 - DNA, 22 bp, Artificial Sequence
  chemically synthesized
caccatgttagccaggatggct

SEQ ID NO: 1288864 - DNA, 22 bp, Artificial Sequence
  chemically synthesized
agccatcctggctaacatggtg

SEQ ID NO: 1288865 - DNA, 22 bp, Artificial Sequence
  chemically synthesized
gtagaggcggggtttcaccatg

SEQ ID NO: 1288866 - DNA, 22 bp, Artificial Sequence
  chemically synthesized
agtagaggcggggtttcaccat

SEQ ID NO: 1288867 - DNA, 22 bp, Artificial Sequence
  chemically synthesized
tagtagaggcggggtttcacca

SEQ ID NO: 1288868 - DNA, 22 bp, Artificial Sequence
  chemically synthesized
ttagtagaggcggggtttcacc

SEQ ID NO: 1288869 - DNA, 22 bp, Artificial Sequence
  chemically synthesized
gctaacatggtgaaaccccgcc

SEQ ID NO: 1288870 - DNA, 22 bp, Artificial Sequence
  chemically synthesized
tatttttagtagaggcggggtt

SEQ ID NO: 1288871 - DNA, 22 bp, Artificial Sequence
  chemically synthesized
gtatttttagtagaggcggggt

SEQ ID NO: 1288872 - DNA, 22 bp, Artificial Sequence
  chemically synthesized
tgtatttttagtagaggcgggg

SEQ ID NO: 1288873 - DNA, 22 bp, Artificial Sequence
  chemically synthesized
acatggtgaaaccccgcctcta

SEQ ID NO: 1288874 - DNA, 22 bp, Artificial Sequence
  chemically synthesized
ttgtatttttagtagaggcggg

SEQ ID NO: 1288875 - DNA, 22 bp, Artificial Sequence
  chemically synthesized
atttttgtatttttagtagagg

SEQ ID NO: 1288876 - DNA, 22 bp, Artificial Sequence
  chemically synthesized
tactaaaaatacaaaaattagc

SEQ ID NO: 1288877 - DNA, 22 bp, Artificial Sequence
  chemically synthesized
ctaaaaatacaaaaattagccg

SEQ ID NO: 1288878 - DNA, 22 bp, Artificial Sequence
  chemically synthesized
aaaatacaaaaattagccgggt

SEQ ID NO: 1288879 - DNA, 22 bp, Artificial Sequence
  chemically synthesized
caggcacgtgccaccacacccg

SEQ ID NO: 1288880 - DNA, 22 bp, Artificial Sequence
  chemically synthesized
ggactacaggcacgtgccacca

SEQ ID NO: 1288881 - DNA, 22 bp, Artificial Sequence
  chemically synthesized
gccgggtgtggtggcacgtgcc

SEQ ID NO: 1288882 - DNA, 22 bp, Artificial Sequence
  chemically synthesized
agtagctgggactacaggcacg

SEQ ID NO: 1288883 - DNA, 22 bp, Artificial Sequence
  chemically synthesized
ctgagtagctgggactacaggc

SEQ ID NO: 1288884 - DNA, 22 bp, Artificial Sequence
  chemically synthesized
agcctcctgagtagctgggact

SEQ ID NO: 1288885 - DNA, 22 bp, Artificial Sequence
  chemically synthesized
cctcagcctcctgagtagctgg

SEQ ID NO: 1288886 - DNA, 22 bp, Artificial Sequence
  chemically synthesized
ctgcctcagcctcctgagtagc

SEQ ID NO: 1288887 - DNA, 22 bp, Artificial Sequence
  chemically synthesized
tcctgcctcagcctcctgagta

SEQ ID NO: 1288888 - DNA, 22 bp, Artificial Sequence
  chemically synthesized
tagtcccagctactcaggaggc

SEQ ID NO: 1288889 - DNA, 22 bp, Artificial Sequence
  chemically synthesized
aagcgattctcctgcctcagcc

SEQ ID NO: 1288890 - DNA, 22 bp, Artificial Sequence
  chemically synthesized
gttcaagcgattctcctgcctc

SEQ ID NO: 1288891 - DNA, 22 bp, Artificial Sequence
  chemically synthesized
ctcaggaggctgaggcaggaga

SEQ ID NO: 1288892 - DNA, 22 bp, Artificial Sequence
  chemically synthesized
aggaggctgaggcaggagaatc

SEQ ID NO: 1288893 - DNA, 22 bp, Artificial Sequence
  chemically synthesized
cctagttcaagcgattctcctg

SEQ ID NO: 1288894 - DNA, 22 bp, Artificial Sequence
  chemically synthesized
cgactccctagttcaagcgatt

SEQ ID NO: 1288895 - DNA, 22 bp, Artificial Sequence
  chemically synthesized
aggcaggagaatcgcttgaact

SEQ ID NO: 1288896 - DNA, 22 bp, Artificial Sequence
  chemically synthesized
caacctccgactccctagttca

SEQ ID NO: 1288897 - DNA, 22 bp, Artificial Sequence
  chemically synthesized
actgcaacctccgactccctag

SEQ ID NO: 1288898 - DNA, 22 bp, Artificial Sequence
  chemically synthesized
gctcactgcaacctccgactcc

SEQ ID NO: 1288899 - DNA, 22 bp, Artificial Sequence
  chemically synthesized
ggctcactgcaacctccgactc

SEQ ID NO: 1288900 - DNA, 22 bp, Artificial Sequence
  chemically synthesized
ttggctcactgcaacctccgac

SEQ ID NO: 1288901 - DNA, 22 bp, Artificial Sequence
  chemically synthesized
gaactagggagtcggaggttgc

SEQ ID NO: 1288902 - DNA, 22 bp, Artificial Sequence
  chemically synthesized
aactagggagtcggaggttgca

SEQ ID NO: 1288903 - DNA, 22 bp, Artificial Sequence
  chemically synthesized
gggagtcggaggttgcagtgag

SEQ ID NO: 1288904 - DNA, 22 bp, Artificial Sequence
  chemically synthesized
gagtgcagtggcacactcttgg

SEQ ID NO: 1288905 - DNA, 22 bp, Artificial Sequence
  chemically synthesized
cagtgagccaagagtgtgccac

SEQ ID NO: 1288906 - DNA, 22 bp, Artificial Sequence
  chemically synthesized
tcacccaggctggagtgcagtg

SEQ ID NO: 1288907 - DNA, 22 bp, Artificial Sequence
  chemically synthesized
tgtcacccaggctggagtgcag

SEQ ID NO: 1288908 - DNA, 22 bp, Artificial Sequence
  chemically synthesized
gctctgtcacccaggctggagt

SEQ ID NO: 1288909 - DNA, 22 bp, Artificial Sequence
  chemically synthesized
cactccagcctgggtgacagag

SEQ ID NO: 1288910 - DNA, 22 bp, Artificial Sequence
  chemically synthesized
agatggagtctcgctctgtcac

SEQ ID NO: 1288911 - DNA, 22 bp, Artificial Sequence
  chemically synthesized
gagatggagtctcgctctgtca

SEQ ID NO: 1288912 - DNA, 22 bp, Artificial Sequence
  chemically synthesized
tgagatggagtctcgctctgtc

SEQ ID NO: 1288913 - DNA, 22 bp, Artificial Sequence
  chemically synthesized
ttgagatggagtctcgctctgt

SEQ ID NO: 1288914 - DNA, 22 bp, Artificial Sequence
  chemically synthesized
cagcctgggtgacagagcgaga

SEQ ID NO: 1288915 - DNA, 22 bp, Artificial Sequence
  chemically synthesized
tttttgagatggagtctcgctc

SEQ ID NO: 1288916 - DNA, 22 bp, Artificial Sequence
  chemically synthesized
gtttttgagatggagtctcgct

SEQ ID NO: 1288917 - DNA, 22 bp, Artificial Sequence
  chemically synthesized
tgtttttgagatggagtctcgc

SEQ ID NO: 1288918 - DNA, 22 bp, Artificial Sequence
  chemically synthesized
ttgtttttgagatggagtctcg

SEQ ID NO: 1288919 - DNA, 22 bp, Artificial Sequence
  chemically synthesized
ggtgacagagcgagactccatc

SEQ ID NO: 1288920 - DNA, 22 bp, Artificial Sequence
  chemically synthesized
tttttgtttttgagatggagtc

SEQ ID NO: 1288921 - DNA, 22 bp, Artificial Sequence
  chemically synthesized
gtttttgtttttgagatggagt

SEQ ID NO: 1288922 - DNA, 22 bp, Artificial Sequence
  chemically synthesized
tgtttttgtttttgagatggag

SEQ ID NO: 1288923 - DNA, 22 bp, Artificial Sequence
  chemically synthesized
ttgtttttgtttttgagatgga

SEQ ID NO: 1288924 - DNA, 22 bp, Artificial Sequence
  chemically synthesized
tttttgtttttgtttttgagat

SEQ ID NO: 1288925 - DNA, 22 bp, Artificial Sequence
  chemically synthesized
gtttttgtttttgtttttgaga

SEQ ID NO: 1288926 - DNA, 22 bp, Artificial Sequence
  chemically synthesized
tgtttttgtttttgtttttgag

SEQ ID NO: 1288927 - DNA, 22 bp, Artificial Sequence
  chemically synthesized
ttgtttttgtttttgtttttga

SEQ ID NO: 1288928 - DNA, 22 bp, Artificial Sequence
  chemically synthesized
tttttgtttttgtttttgtttt

SEQ ID NO: 1288929 - DNA, 22 bp, Artificial Sequence
  chemically synthesized
gtttttgtttttgtttttgttt

SEQ ID NO: 1288930 - DNA, 22 bp, Artificial Sequence
  chemically synthesized
tgtttttgtttttgtttttgtt

SEQ ID NO: 1288931 - DNA, 22 bp, Artificial Sequence
  chemically synthesized
ttgtttttgtttttgtttttgt

SEQ ID NO: 1288932 - DNA, 22 bp, Artificial Sequence
  chemically synthesized
tttgtttttgtttttgtttttg

SEQ ID NO: 1288933 - DNA, 22 bp, Artificial Sequence
  chemically synthesized
catctcaaaaacaaaaacaaaa

SEQ ID NO: 1288934 - DNA, 22 bp, Artificial Sequence
  chemically synthesized
ttttttgtttttgtttttgttt

SEQ ID NO: 1288935 - DNA, 22 bp, Artificial Sequence
  chemically synthesized
gttttttgtttttgtttttgtt

SEQ ID NO: 1288936 - DNA, 22 bp, Artificial Sequence
  chemically synthesized
tgttttttgtttttgtttttgt

SEQ ID NO: 1288937 - DNA, 22 bp, Artificial Sequence
  chemically synthesized
ttgttttttgtttttgtttttg

SEQ ID NO: 1288938 - DNA, 22 bp, Artificial Sequence
  chemically synthesized
aaaaacaaaaacaaaaacaaaa

SEQ ID NO: 1288939 - DNA, 22 bp, Artificial Sequence
  chemically synthesized
tttgttttttgtttttgttttt

SEQ ID NO: 1288940 - DNA, 22 bp, Artificial Sequence
  chemically synthesized
ttttgttttttgtttttgtttt

SEQ ID NO: 1288941 - DNA, 22 bp, Artificial Sequence
  chemically synthesized
tttttgttttttgtttttgttt

SEQ ID NO: 1288942 - DNA, 22 bp, Artificial Sequence
  chemically synthesized
ttttttgttttttgtttttgtt

SEQ ID NO: 1288943 - DNA, 22 bp, Artificial Sequence
  chemically synthesized
tttttttgttttttgtttttgt

SEQ ID NO: 1288944 - DNA, 22 bp, Artificial Sequence
  chemically synthesized
ggttttttttttgttttttgtt

SEQ ID NO: 1288945 - DNA, 22 bp, Artificial Sequence
  chemically synthesized
cggttttttttttgttttttgt

SEQ ID NO: 1288946 - DNA, 22 bp, Artificial Sequence
  chemically synthesized
tcggttttttttttgttttttg

SEQ ID NO: 1288947 - DNA, 22 bp, Artificial Sequence
  chemically synthesized
ttcggttttttttttgtttttt

SEQ ID NO: 1288948 - DNA, 22 bp, Artificial Sequence
  chemically synthesized
tttcggttttttttttgttttt

SEQ ID NO: 1288949 - DNA, 22 bp, Artificial Sequence
  chemically synthesized
ttttttcggttttttttttgtt

SEQ ID NO: 1288950 - DNA, 22 bp, Artificial Sequence
  chemically synthesized
gttttttcggttttttttttgt

SEQ ID NO: 1288951 - DNA, 22 bp, Artificial Sequence
  chemically synthesized
ttgttttttcggtttttttttt

SEQ ID NO: 1288952 - DNA, 22 bp, Artificial Sequence
  chemically synthesized
cttgttttttcggttttttttt

SEQ ID NO: 1288953 - DNA, 22 bp, Artificial Sequence
  chemically synthesized
gtcagaagacatttcttgtttt

SEQ ID NO: 1288954 - DNA, 22 bp, Artificial Sequence
  chemically synthesized
ctgaccaatttctgtttctggt

SEQ ID NO: 1288955 - DNA, 22 bp, Artificial Sequence
  chemically synthesized
tgaccaatttctgtttctggtc

SEQ ID NO: 1288956 - DNA, 22 bp, Artificial Sequence
  chemically synthesized
accaatttctgtttctggtctg

SEQ ID NO: 1288957 - DNA, 22 bp, Artificial Sequence
  chemically synthesized
aagtcaaatgcacagaccagaa

SEQ ID NO: 1288958 - DNA, 22 bp, Artificial Sequence
  chemically synthesized
tgctcaagtcaaatgcacagac

SEQ ID NO: 1288959 - DNA, 22 bp, Artificial Sequence
  chemically synthesized
ctgtttctggtctgtgcatttg

SEQ ID NO: 1288960 - DNA, 22 bp, Artificial Sequence
  chemically synthesized
tgtttctggtctgtgcatttga

SEQ ID NO: 1288961 - DNA, 22 bp, Artificial Sequence
  chemically synthesized
tttctggtctgtgcatttgact

SEQ ID NO: 1288962 - DNA, 22 bp, Artificial Sequence
  chemically synthesized
ctggtctgtgcatttgacttga

SEQ ID NO: 1288963 - DNA, 22 bp, Artificial Sequence
  chemically synthesized
tggtctgtgcatttgacttgag

SEQ ID NO: 1288964 - DNA, 22 bp, Artificial Sequence
  chemically synthesized
gtctgtgcatttgacttgagca

SEQ ID NO: 1288965 - DNA, 22 bp, Artificial Sequence
  chemically synthesized
tgcatttgacttgagcacagat

SEQ ID NO: 1288966 - DNA, 22 bp, Artificial Sequence
  chemically synthesized
aagtatgcaacaatggatctgt

SEQ ID NO: 1288967 - DNA, 22 bp, Artificial Sequence
  chemically synthesized
caagtatgcaacaatggatctg

SEQ ID NO: 1288968 - DNA, 22 bp, Artificial Sequence
  chemically synthesized
gacttgagcacagatccattgt

SEQ ID NO: 1288969 - DNA, 22 bp, Artificial Sequence
  chemically synthesized
acttgagcacagatccattgtt

SEQ ID NO: 1288970 - DNA, 22 bp, Artificial Sequence
  chemically synthesized
gagcacagatccattgttgcat

SEQ ID NO: 1288971 - DNA, 22 bp, Artificial Sequence
  chemically synthesized
agcacagatccattgttgcata

SEQ ID NO: 1288972 - DNA, 22 bp, Artificial Sequence
  chemically synthesized
aacacgtgtacgtgacgcttca

SEQ ID NO: 1288973 - DNA, 22 bp, Artificial Sequence
  chemically synthesized
ttgcatacttgaagcgtcacgt

SEQ ID NO: 1288974 - DNA, 22 bp, Artificial Sequence
  chemically synthesized
actcaacacgtgtacgtgacgc

SEQ ID NO: 1288975 - DNA, 22 bp, Artificial Sequence
  chemically synthesized
aactcaacacgtgtacgtgacg

SEQ ID NO: 1288976 - DNA, 22 bp, Artificial Sequence
  chemically synthesized
catacttgaagcgtcacgtaca

SEQ ID NO: 1288977 - DNA, 22 bp, Artificial Sequence
  chemically synthesized
cttaactcaacacgtgtacgtg

SEQ ID NO: 1288978 - DNA, 22 bp, Artificial Sequence
  chemically synthesized
ccttaactcaacacgtgtacgt

SEQ ID NO: 1288979 - DNA, 22 bp, Artificial Sequence
  chemically synthesized
tccttaactcaacacgtgtacg

SEQ ID NO: 1288980 - DNA, 22 bp, Artificial Sequence
  chemically synthesized
ttccttaactcaacacgtgtac

SEQ ID NO: 1288981 - DNA, 22 bp, Artificial Sequence
  chemically synthesized
tttccttaactcaacacgtgta

SEQ ID NO: 1288982 - DNA, 22 bp, Artificial Sequence
  chemically synthesized
gaagcgtcacgtacacgtgttg

SEQ ID NO: 1288983 - DNA, 22 bp, Artificial Sequence
  chemically synthesized
ttttccttaactcaacacgtgt

SEQ ID NO: 1288984 - DNA, 22 bp, Artificial Sequence
  chemically synthesized
aagcgtcacgtacacgtgttga

SEQ ID NO: 1288985 - DNA, 22 bp, Artificial Sequence
  chemically synthesized
tttttccttaactcaacacgtg

SEQ ID NO: 1288986 - DNA, 22 bp, Artificial Sequence
  chemically synthesized
agttaaggaaaaaaagtcacat

SEQ ID NO: 1288987 - DNA, 22 bp, Artificial Sequence
  chemically synthesized
aggaaaaaaagtcacattttct

SEQ ID NO: 1288988 - DNA, 22 bp, Artificial Sequence
  chemically synthesized
catgggagagtgatcaaaagaa

SEQ ID NO: 1288989 - DNA, 22 bp, Artificial Sequence
  chemically synthesized
aacgaagttacatgggagagtg

SEQ ID NO: 1288990 - DNA, 22 bp, Artificial Sequence
  chemically synthesized
caacgaagttacatgggagagt

SEQ ID NO: 1288991 - DNA, 22 bp, Artificial Sequence
  chemically synthesized
tcaacgaagttacatgggagag

SEQ ID NO: 1288992 - DNA, 22 bp, Artificial Sequence
  chemically synthesized
tcttttgatcactctcccatgt

SEQ ID NO: 1288993 - DNA, 22 bp, Artificial Sequence
  chemically synthesized
cttttgatcactctcccatgta

SEQ ID NO: 1288994 - DNA, 22 bp, Artificial Sequence
  chemically synthesized
ttttgatcactctcccatgtaa

SEQ ID NO: 1288995 - DNA, 22 bp, Artificial Sequence
  chemically synthesized
ttgatcactctcccatgtaact

SEQ ID NO: 1288996 - DNA, 22 bp, Artificial Sequence
  chemically synthesized
tgatcactctcccatgtaactt

SEQ ID NO: 1288997 - DNA, 22 bp, Artificial Sequence
  chemically synthesized
gatcactctcccatgtaacttc

SEQ ID NO: 1288998 - DNA, 22 bp, Artificial Sequence
  chemically synthesized
atcactctcccatgtaacttcg

SEQ ID NO: 1288999 - DNA, 22 bp, Artificial Sequence
  chemically synthesized
tcccatgtaacttcgttgaaag

SEQ ID NO: 1289000 - DNA, 22 bp, Artificial Sequence
  chemically synthesized
ccatgtaacttcgttgaaagtt

SEQ ID NO: 1289001 - DNA, 22 bp, Artificial Sequence
  chemically synthesized
cgttgaaagttacctttcattc

SEQ ID NO: 1289002 - DNA, 22 bp, Artificial Sequence
  chemically synthesized
gttgaaagttacctttcattcc

SEQ ID NO: 1289003 - DNA, 22 bp, Artificial Sequence
  chemically synthesized
aaagttacctttcattcctttt

SEQ ID NO: 1289004 - DNA, 22 bp, Artificial Sequence
  chemically synthesized
cctttcattcctttttccatat

SEQ ID NO: 1289005 - DNA, 22 bp, Artificial Sequence
  chemically synthesized
gcccaggaaatgatatggaaaa

SEQ ID NO: 1289006 - DNA, 22 bp, Artificial Sequence
  chemically synthesized
tcattcctttttccatatcatt

SEQ ID NO: 1289007 - DNA, 22 bp, Artificial Sequence
  chemically synthesized
cattcctttttccatatcattt

SEQ ID NO: 1289008 - DNA, 22 bp, Artificial Sequence
  chemically synthesized
attcctttttccatatcatttc

SEQ ID NO: 1289009 - DNA, 22 bp, Artificial Sequence
  chemically synthesized
ctttttccatatcatttcctgg

SEQ ID NO: 1289010 - DNA, 22 bp, Artificial Sequence
  chemically synthesized
tgtaagactagcccaggaaatg

SEQ ID NO: 1289011 - DNA, 22 bp, Artificial Sequence
  chemically synthesized
tttccatatcatttcctgggct

SEQ ID NO: 1289012 - DNA, 22 bp, Artificial Sequence
  chemically synthesized
ttccatatcatttcctgggcta

SEQ ID NO: 1289013 - DNA, 22 bp, Artificial Sequence
  chemically synthesized
tccatatcatttcctgggctag

SEQ ID NO: 1289014 - DNA, 22 bp, Artificial Sequence
  chemically synthesized
ccatatcatttcctgggctagt

SEQ ID NO: 1289015 - DNA, 22 bp, Artificial Sequence
  chemically synthesized
catatcatttcctgggctagtc

SEQ ID NO: 1289016 - DNA, 22 bp, Artificial Sequence
  chemically synthesized
aacattatgtaagactagccca

SEQ ID NO: 1289017 - DNA, 22 bp, Artificial Sequence
  chemically synthesized
gaacattatgtaagactagccc

SEQ ID NO: 1289018 - DNA, 22 bp, Artificial Sequence
  chemically synthesized
tttgaacattatgtaagactag

SEQ ID NO: 1289019 - DNA, 22 bp, Artificial Sequence
  chemically synthesized
cctgggctagtcttacataatg

SEQ ID NO: 1289020 - DNA, 22 bp, Artificial Sequence
  chemically synthesized
ctgggctagtcttacataatgt

SEQ ID NO: 1289021 - DNA, 22 bp, Artificial Sequence
  chemically synthesized
ggctagtcttacataatgttca

SEQ ID NO: 1289022 - DNA, 22 bp, Artificial Sequence
  chemically synthesized
catgatccctgtttgaacatta

SEQ ID NO: 1289023 - DNA, 22 bp, Artificial Sequence
  chemically synthesized
gtcttacataatgttcaaacag

SEQ ID NO: 1289024 - DNA, 22 bp, Artificial Sequence
  chemically synthesized
gttacatgatccctgtttgaac

SEQ ID NO: 1289025 - DNA, 22 bp, Artificial Sequence
  chemically synthesized
acataatgttcaaacagggatc

SEQ ID NO: 1289026 - DNA, 22 bp, Artificial Sequence
  chemically synthesized
cataatgttcaaacagggatca

SEQ ID NO: 1289027 - DNA, 22 bp, Artificial Sequence
  chemically synthesized
atatggaattcgttacatgatc

SEQ ID NO: 1289028 - DNA, 22 bp, Artificial Sequence
  chemically synthesized
aaacagggatcatgtaacgaat

SEQ ID NO: 1289029 - DNA, 22 bp, Artificial Sequence
  chemically synthesized
taaactgatatggaattcgtta

SEQ ID NO: 1289030 - DNA, 22 bp, Artificial Sequence
  chemically synthesized
ataaactgatatggaattcgtt

SEQ ID NO: 1289031 - DNA, 22 bp, Artificial Sequence
  chemically synthesized
gcttataaactgatatggaatt

SEQ ID NO: 1289032 - DNA, 22 bp, Artificial Sequence
  chemically synthesized
atagtctagcttataaactgat

SEQ ID NO: 1289033 - DNA, 22 bp, Artificial Sequence
  chemically synthesized
aatagtctagcttataaactga

SEQ ID NO: 1289034 - DNA, 22 bp, Artificial Sequence
  chemically synthesized
catatcagtttataagctagac

SEQ ID NO: 1289035 - DNA, 22 bp, Artificial Sequence
  chemically synthesized
ccaatcttaatagtctagctta

SEQ ID NO: 1289036 - DNA, 22 bp, Artificial Sequence
  chemically synthesized
accaatcttaatagtctagctt

SEQ ID NO: 1289037 - DNA, 22 bp, Artificial Sequence
  chemically synthesized
ataagctagactattaagattg

SEQ ID NO: 1289038 - DNA, 22 bp, Artificial Sequence
  chemically synthesized
taagctagactattaagattgg

SEQ ID NO: 1289039 - DNA, 22 bp, Artificial Sequence
  chemically synthesized
gactattaagattggtaaatgt

SEQ ID NO: 1289040 - DNA, 22 bp, Artificial Sequence
  chemically synthesized
ttaagattggtaaatgtatatt

SEQ ID NO: 1289041 - DNA, 22 bp, Artificial Sequence
  chemically synthesized
agattggtaaatgtatattttg

SEQ ID NO: 1289042 - DNA, 22 bp, Artificial Sequence
  chemically synthesized
gtaaatgtatattttgtgtttt

SEQ ID NO: 1289043 - DNA, 22 bp, Artificial Sequence
  chemically synthesized
caaagcagtaagaaaaaaaaca

SEQ ID NO: 1289044 - DNA, 22 bp, Artificial Sequence
  chemically synthesized
aatactccaaagcagtaagaaa

SEQ ID NO: 1289045 - DNA, 22 bp, Artificial Sequence
  chemically synthesized
caatactccaaagcagtaagaa

SEQ ID NO: 1289046 - DNA, 22 bp, Artificial Sequence
  chemically synthesized
tcaatactccaaagcagtaaga

SEQ ID NO: 1289047 - DNA, 22 bp, Artificial Sequence
  chemically synthesized
tgtgttttttttcttactgctt

SEQ ID NO: 1289048 - DNA, 22 bp, Artificial Sequence
  chemically synthesized
gtgttttttttcttactgcttt

SEQ ID NO: 1289049 - DNA, 22 bp, Artificial Sequence
  chemically synthesized
tgttttttttcttactgctttg

SEQ ID NO: 1289050 - DNA, 22 bp, Artificial Sequence
  chemically synthesized
ctttcaatactccaaagcagta

SEQ ID NO: 1289051 - DNA, 22 bp, Artificial Sequence
  chemically synthesized
tttttcttactgctttggagta

SEQ ID NO: 1289052 - DNA, 22 bp, Artificial Sequence
  chemically synthesized
ttttcttactgctttggagtat

SEQ ID NO: 1289053 - DNA, 22 bp, Artificial Sequence
  chemically synthesized
aaactcctttcaatactccaaa

SEQ ID NO: 1289054 - DNA, 22 bp, Artificial Sequence
  chemically synthesized
tttcttactgctttggagtatt

SEQ ID NO: 1289055 - DNA, 22 bp, Artificial Sequence
  chemically synthesized
ttcttactgctttggagtattg

SEQ ID NO: 1289056 - DNA, 22 bp, Artificial Sequence
  chemically synthesized
tcttactgctttggagtattga

SEQ ID NO: 1289057 - DNA, 22 bp, Artificial Sequence
  chemically synthesized
cttactgctttggagtattgaa

SEQ ID NO: 1289058 - DNA, 22 bp, Artificial Sequence
  chemically synthesized
ttactgctttggagtattgaaa

SEQ ID NO: 1289059 - DNA, 22 bp, Artificial Sequence
  chemically synthesized
tactaaaactcctttcaatact

SEQ ID NO: 1289060 - DNA, 22 bp, Artificial Sequence
  chemically synthesized
actgctttggagtattgaaagg

SEQ ID NO: 1289061 - DNA, 22 bp, Artificial Sequence
  chemically synthesized
ctgctttggagtattgaaagga

SEQ ID NO: 1289062 - DNA, 22 bp, Artificial Sequence
  chemically synthesized
ctttggagtattgaaaggagtt

SEQ ID NO: 1289063 - DNA, 22 bp, Artificial Sequence
  chemically synthesized
tggagtattgaaaggagtttta

SEQ ID NO: 1289064 - DNA, 22 bp, Artificial Sequence
  chemically synthesized
ggagtattgaaaggagttttag

SEQ ID NO: 1289065 - DNA, 22 bp, Artificial Sequence
  chemically synthesized
gagtattgaaaggagttttagt

SEQ ID NO: 1289066 - DNA, 22 bp, Artificial Sequence
  chemically synthesized
gtataaaaacacccctatacta

SEQ ID NO: 1289067 - DNA, 22 bp, Artificial Sequence
  chemically synthesized
agtataaaaacacccctatact

SEQ ID NO: 1289068 - DNA, 22 bp, Artificial Sequence
  chemically synthesized
aaaggagttttagtataggggt

SEQ ID NO: 1289069 - DNA, 22 bp, Artificial Sequence
  chemically synthesized
aagtatgtttagtataaaaaca

SEQ ID NO: 1289070 - DNA, 22 bp, Artificial Sequence
  chemically synthesized
tagtataggggtgtttttatac

SEQ ID NO: 1289071 - DNA, 22 bp, Artificial Sequence
  chemically synthesized
agtataggggtgtttttatact

SEQ ID NO: 1289072 - DNA, 22 bp, Artificial Sequence
  chemically synthesized
gtataggggtgtttttatacta

SEQ ID NO: 1289073 - DNA, 22 bp, Artificial Sequence
  chemically synthesized
tgtaaactaaagtatgtttagt

SEQ ID NO: 1289074 - DNA, 22 bp, Artificial Sequence
  chemically synthesized
ttatgtaaactaaagtatgttt

SEQ ID NO: 1289075 - DNA, 22 bp, Artificial Sequence
  chemically synthesized
tattatgtaaactaaagtatgt

SEQ ID NO: 1289076 - DNA, 22 bp, Artificial Sequence
  chemically synthesized
ttatactaaacatactttagtt

SEQ ID NO: 1289077 - DNA, 22 bp, Artificial Sequence
  chemically synthesized
tatactaaacatactttagttt

SEQ ID NO: 1289078 - DNA, 22 bp, Artificial Sequence
  chemically synthesized
atactaaacatactttagttta

SEQ ID NO: 1289079 - DNA, 22 bp, Artificial Sequence
  chemically synthesized
tactaaacatactttagtttac

SEQ ID NO: 1289080 - DNA, 22 bp, Artificial Sequence
  chemically synthesized
aacatactttagtttacataat

SEQ ID NO: 1289081 - DNA, 22 bp, Artificial Sequence
  chemically synthesized
tagtttacataatagagtgtac

SEQ ID NO: 1289082 - DNA, 22 bp, Artificial Sequence
  chemically synthesized
agtttacataatagagtgtaca

SEQ ID NO: 1289083 - DNA, 22 bp, Artificial Sequence
  chemically synthesized
gtttacataatagagtgtacat

SEQ ID NO: 1289084 - DNA, 22 bp, Artificial Sequence
  chemically synthesized
acataatagagtgtacatttac

SEQ ID NO: 1289085 - DNA, 22 bp, Artificial Sequence
  chemically synthesized
cataatagagtgtacatttact

SEQ ID NO: 1289086 - DNA, 22 bp, Artificial Sequence
  chemically synthesized
aataaaatatgtatagtaaatg

SEQ ID NO: 1289087 - DNA, 22 bp, Artificial Sequence
  chemically synthesized
tgaattgaataaaatatgtata

SEQ ID NO: 1289088 - DNA, 22 bp, Artificial Sequence
  chemically synthesized
actatacatattttattcaatt

SEQ ID NO: 1289089 - DNA, 22 bp, Artificial Sequence
  chemically synthesized
aaaaaaattgtgaattgaataa

SEQ ID NO: 1289090 - DNA, 22 bp, Artificial Sequence
  chemically synthesized
ctatacatattttattcaattc

SEQ ID NO: 1289091 - DNA, 22 bp, Artificial Sequence
  chemically synthesized
aaaaaaaattgtgaattgaata

SEQ ID NO: 1289092 - DNA, 22 bp, Artificial Sequence
  chemically synthesized
tacatattttattcaattcaca

SEQ ID NO: 1289093 - DNA, 22 bp, Artificial Sequence
  chemically synthesized
tattcaattcacaatttttttt

SEQ ID NO: 1289094 - DNA, 22 bp, Artificial Sequence
  chemically synthesized
attcaattcacaatttttttta

SEQ ID NO: 1289095 - DNA, 22 bp, Artificial Sequence
  chemically synthesized
ttcaattcacaattttttttaa

SEQ ID NO: 1289096 - DNA, 22 bp, Artificial Sequence
  chemically synthesized
aacaaagcaagatttaaaaaaa

SEQ ID NO: 1289097 - DNA, 22 bp, Artificial Sequence
  chemically synthesized
aattcacaattttttttaaatc

SEQ ID NO: 1289098 - DNA, 22 bp, Artificial Sequence
  chemically synthesized
ttgaacaaagcaagatttaaaa

SEQ ID NO: 1289099 - DNA, 22 bp, Artificial Sequence
  chemically synthesized
acaattttttttaaatcttgct

SEQ ID NO: 1289100 - DNA, 22 bp, Artificial Sequence
  chemically synthesized
tttttaaatcttgctttgttca

SEQ ID NO: 1289101 - DNA, 22 bp, Artificial Sequence
  chemically synthesized
ttttaaatcttgctttgttcaa

SEQ ID NO: 1289102 - DNA, 22 bp, Artificial Sequence
  chemically synthesized
tttaaatcttgctttgttcaat

SEQ ID NO: 1289103 - DNA, 22 bp, Artificial Sequence
  chemically synthesized
ttaaatcttgctttgttcaata

SEQ ID NO: 1289104 - DNA, 22 bp, Artificial Sequence
  chemically synthesized
taaatcttgctttgttcaatag

SEQ ID NO: 1289105 - DNA, 22 bp, Artificial Sequence
  chemically synthesized
aaatcttgctttgttcaatagt

SEQ ID NO: 1289106 - DNA, 22 bp, Artificial Sequence
  chemically synthesized
aatcttgctttgttcaatagtg

SEQ ID NO: 1289107 - DNA, 22 bp, Artificial Sequence
  chemically synthesized
aaagtgtatataatgaacacta

SEQ ID NO: 1289108 - DNA, 22 bp, Artificial Sequence
  chemically synthesized
gctttgttcaatagtgttcatt

SEQ ID NO: 1289109 - DNA, 22 bp, Artificial Sequence
  chemically synthesized
ctttgttcaatagtgttcatta

SEQ ID NO: 1289110 - DNA, 22 bp, Artificial Sequence
  chemically synthesized
tgttcaatagtgttcattatat

SEQ ID NO: 1289111 - DNA, 22 bp, Artificial Sequence
  chemically synthesized
gttcaatagtgttcattatata

SEQ ID NO: 1289112 - DNA, 22 bp, Artificial Sequence
  chemically synthesized
ttcaatagtgttcattatatac

SEQ ID NO: 1289113 - DNA, 22 bp, Artificial Sequence
  chemically synthesized
aatagtgttcattatatacact

SEQ ID NO: 1289114 - DNA, 22 bp, Artificial Sequence
  chemically synthesized
aagccaggttcaaagtgtatat

SEQ ID NO: 1289115 - DNA, 22 bp, Artificial Sequence
  chemically synthesized
gaagccaggttcaaagtgtata

SEQ ID NO: 1289116 - DNA, 22 bp, Artificial Sequence
  chemically synthesized
tgaagccaggttcaaagtgtat

SEQ ID NO: 1289117 - DNA, 22 bp, Artificial Sequence
  chemically synthesized
ttgaagccaggttcaaagtgta

SEQ ID NO: 1289118 - DNA, 22 bp, Artificial Sequence
  chemically synthesized
tttttgaagccaggttcaaagt

SEQ ID NO: 1289119 - DNA, 22 bp, Artificial Sequence
  chemically synthesized
attatatacactttgaacctgg

SEQ ID NO: 1289120 - DNA, 22 bp, Artificial Sequence
  chemically synthesized
tatacactttgaacctggcttc

SEQ ID NO: 1289121 - DNA, 22 bp, Artificial Sequence
  chemically synthesized
tgaacctggcttcaaaaatagt

SEQ ID NO: 1289122 - DNA, 22 bp, Artificial Sequence
  chemically synthesized
gaacctggcttcaaaaatagta

SEQ ID NO: 1289123 - DNA, 22 bp, Artificial Sequence
  chemically synthesized
aacctggcttcaaaaatagtac

SEQ ID NO: 1289124 - DNA, 22 bp, Artificial Sequence
  chemically synthesized
gcttcaaaaatagtacatcctt

SEQ ID NO: 1289125 - DNA, 22 bp, Artificial Sequence
  chemically synthesized
caaaaatagtacatccttctct

SEQ ID NO: 1289126 - DNA, 22 bp, Artificial Sequence
  chemically synthesized
aaaaatagtacatccttctcta

SEQ ID NO: 1289127 - DNA, 22 bp, Artificial Sequence
  chemically synthesized
atataaaatgcataaaatagag

SEQ ID NO: 1289128 - DNA, 22 bp, Artificial Sequence
  chemically synthesized
catatagttgatataaaatgca

SEQ ID NO: 1289129 - DNA, 22 bp, Artificial Sequence
  chemically synthesized
ctctattttatgcattttatat

SEQ ID NO: 1289130 - DNA, 22 bp, Artificial Sequence
  chemically synthesized
tctattttatgcattttatatc

SEQ ID NO: 1289131 - DNA, 22 bp, Artificial Sequence
  chemically synthesized
tattttatgcattttatatcaa

SEQ ID NO: 1289132 - DNA, 22 bp, Artificial Sequence
  chemically synthesized
ttttatgcattttatatcaact

SEQ ID NO: 1289133 - DNA, 22 bp, Artificial Sequence
  chemically synthesized
aaacaattacatatagttgata

SEQ ID NO: 1289134 - DNA, 22 bp, Artificial Sequence
  chemically synthesized
tatgcattttatatcaactata

SEQ ID NO: 1289135 - DNA, 22 bp, Artificial Sequence
  chemically synthesized
gaaacaattacatatagttgat

SEQ ID NO: 1289136 - DNA, 22 bp, Artificial Sequence
  chemically synthesized
atgcattttatatcaactatat

SEQ ID NO: 1289137 - DNA, 22 bp, Artificial Sequence
  chemically synthesized
tgcattttatatcaactatatg

SEQ ID NO: 1289138 - DNA, 22 bp, Artificial Sequence
  chemically synthesized
atttgaaacaattacatatagt

SEQ ID NO: 1289139 - DNA, 22 bp, Artificial Sequence
  chemically synthesized
aatttgaaacaattacatatag

SEQ ID NO: 1289140 - DNA, 22 bp, Artificial Sequence
  chemically synthesized
tatatcaactatatgtaattgt

SEQ ID NO: 1289141 - DNA, 22 bp, Artificial Sequence
  chemically synthesized
atatcaactatatgtaattgtt

SEQ ID NO: 1289142 - DNA, 22 bp, Artificial Sequence
  chemically synthesized
tatcaactatatgtaattgttt

SEQ ID NO: 1289143 - DNA, 22 bp, Artificial Sequence
  chemically synthesized
aaatcttaatttgaaacaatta

SEQ ID NO: 1289144 - DNA, 22 bp, Artificial Sequence
  chemically synthesized
tctaaaatcttaatttgaaaca

SEQ ID NO: 1289145 - DNA, 22 bp, Artificial Sequence
  chemically synthesized
tatgtaattgtttcaaattaag

SEQ ID NO: 1289146 - DNA, 22 bp, Artificial Sequence
  chemically synthesized
tttcaaattaagattttagata

SEQ ID NO: 1289147 - DNA, 22 bp, Artificial Sequence
  chemically synthesized
caaattaagattttagataata

SEQ ID NO: 1289148 - DNA, 22 bp, Artificial Sequence
  chemically synthesized
aaattaagattttagataatat

SEQ ID NO: 1289149 - DNA, 22 bp, Artificial Sequence
  chemically synthesized
agtgtaatgtgacaggatatta

SEQ ID NO: 1289150 - DNA, 22 bp, Artificial Sequence
  chemically synthesized
agattttagataatatcctgtc

SEQ ID NO: 1289151 - DNA, 22 bp, Artificial Sequence
  chemically synthesized
tagataatatcctgtcacatta

SEQ ID NO: 1289152 - DNA, 22 bp, Artificial Sequence
  chemically synthesized
agataatatcctgtcacattac

SEQ ID NO: 1289153 - DNA, 22 bp, Artificial Sequence
  chemically synthesized
gataatatcctgtcacattaca

SEQ ID NO: 1289154 - DNA, 22 bp, Artificial Sequence
  chemically synthesized
gtcagacaacctaagtgtaatg

SEQ ID NO: 1289155 - DNA, 22 bp, Artificial Sequence
  chemically synthesized
ttggtcagacaacctaagtgta

SEQ ID NO: 1289156 - DNA, 22 bp, Artificial Sequence
  chemically synthesized
tcacattacacttaggttgtct

SEQ ID NO: 1289157 - DNA, 22 bp, Artificial Sequence
  chemically synthesized
agaaactattggtcagacaacc

SEQ ID NO: 1289158 - DNA, 22 bp, Artificial Sequence
  chemically synthesized
aagaaactattggtcagacaac

SEQ ID NO: 1289159 - DNA, 22 bp, Artificial Sequence
  chemically synthesized
taagaaactattggtcagacaa

SEQ ID NO: 1289160 - DNA, 22 bp, Artificial Sequence
  chemically synthesized
cacttaggttgtctgaccaata

SEQ ID NO: 1289161 - DNA, 22 bp, Artificial Sequence
  chemically synthesized
aggttgtctgaccaatagtttc

SEQ ID NO: 1289162 - DNA, 22 bp, Artificial Sequence
  chemically synthesized
ggttgtctgaccaatagtttct

SEQ ID NO: 1289163 - DNA, 22 bp, Artificial Sequence
  chemically synthesized
tagaggaatctttaagaaacta

SEQ ID NO: 1289164 - DNA, 22 bp, Artificial Sequence
  chemically synthesized
tctgaccaatagtttcttaaag

SEQ ID NO: 1289165 - DNA, 22 bp, Artificial Sequence
  chemically synthesized
accaatagtttcttaaagattc

SEQ ID NO: 1289166 - DNA, 22 bp, Artificial Sequence
  chemically synthesized
gaaaatgtaactatagaggaat

SEQ ID NO: 1289167 - DNA, 22 bp, Artificial Sequence
  chemically synthesized
cttaaagattcctctatagtta

SEQ ID NO: 1289168 - DNA, 22 bp, Artificial Sequence
  chemically synthesized
ttaaagattcctctatagttac

SEQ ID NO: 1289169 - DNA, 22 bp, Artificial Sequence
  chemically synthesized
aaagattcctctatagttacat

SEQ ID NO: 1289170 - DNA, 22 bp, Artificial Sequence
  chemically synthesized
aagattcctctatagttacatt

SEQ ID NO: 1289171 - DNA, 22 bp, Artificial Sequence
  chemically synthesized
caaaggaaactagaaaatgtaa

SEQ ID NO: 1289172 - DNA, 22 bp, Artificial Sequence
  chemically synthesized
ctctatagttacattttctagt

SEQ ID NO: 1289173 - DNA, 22 bp, Artificial Sequence
  chemically synthesized
attgcaaaggaaactagaaaat

SEQ ID NO: 1289174 - DNA, 22 bp, Artificial Sequence
  chemically synthesized
aattgcaaaggaaactagaaaa

SEQ ID NO: 1289175 - DNA, 22 bp, Artificial Sequence
  chemically synthesized
tatagttacattttctagtttc

SEQ ID NO: 1289176 - DNA, 22 bp, Artificial Sequence
  chemically synthesized
tagttacattttctagtttcct

SEQ ID NO: 1289177 - DNA, 22 bp, Artificial Sequence
  chemically synthesized
aacttaattgcaaaggaaacta

SEQ ID NO: 1289178 - DNA, 22 bp, Artificial Sequence
  chemically synthesized
cattttctagtttcctttgcaa

SEQ ID NO: 1289179 - DNA, 22 bp, Artificial Sequence
  chemically synthesized
tatggctaaacttaattgcaaa

SEQ ID NO: 1289180 - DNA, 22 bp, Artificial Sequence
  chemically synthesized
tctagtttcctttgcaattaag

SEQ ID NO: 1289181 - DNA, 22 bp, Artificial Sequence
  chemically synthesized
ctagtttcctttgcaattaagt

SEQ ID NO: 1289182 - DNA, 22 bp, Artificial Sequence
  chemically synthesized
tagtttcctttgcaattaagtt

SEQ ID NO: 1289183 - DNA, 22 bp, Artificial Sequence
  chemically synthesized
gtttcctttgcaattaagttta

SEQ ID NO: 1289184 - DNA, 22 bp, Artificial Sequence
  chemically synthesized
cctttgcaattaagtttagcca

SEQ ID NO: 1289185 - DNA, 22 bp, Artificial Sequence
  chemically synthesized
ctttgcaattaagtttagccat

SEQ ID NO: 1289186 - DNA, 22 bp, Artificial Sequence
  chemically synthesized
tgcaattaagtttagccatata

SEQ ID NO: 1289187 - DNA, 22 bp, Artificial Sequence
  chemically synthesized
gcaattaagtttagccatataa

SEQ ID NO: 1289188 - DNA, 22 bp, Artificial Sequence
  chemically synthesized
caattaagtttagccatataac

SEQ ID NO: 1289189 - DNA, 22 bp, Artificial Sequence
  chemically synthesized
agtttagccatataactgggtt

SEQ ID NO: 1289190 - DNA, 22 bp, Artificial Sequence
  chemically synthesized
agccatataactgggttctgac

SEQ ID NO: 1289191 - DNA, 22 bp, Artificial Sequence
  chemically synthesized
gccatataactgggttctgacc

SEQ ID NO: 1289192 - DNA, 22 bp, Artificial Sequence
  chemically synthesized
caccaacatcccatgggtcaga

SEQ ID NO: 1289193 - DNA, 22 bp, Artificial Sequence
  chemically synthesized
tcacctccaccaacatcccatg

SEQ ID NO: 1289194 - DNA, 22 bp, Artificial Sequence
  chemically synthesized
gtcacctccaccaacatcccat

SEQ ID NO: 1289195 - DNA, 22 bp, Artificial Sequence
  chemically synthesized
ggttctgacccatgggatgttg

SEQ ID NO: 1289196 - DNA, 22 bp, Artificial Sequence
  chemically synthesized
tgtcacctccaccaacatccca

SEQ ID NO: 1289197 - DNA, 22 bp, Artificial Sequence
  chemically synthesized
ttgtcacctccaccaacatccc

SEQ ID NO: 1289198 - DNA, 22 bp, Artificial Sequence
  chemically synthesized
tgacccatgggatgttggtgga

SEQ ID NO: 1289199 - DNA, 22 bp, Artificial Sequence
  chemically synthesized
acccatgggatgttggtggagg

SEQ ID NO: 1289200 - DNA, 22 bp, Artificial Sequence
  chemically synthesized
agtcaggaagggacttttgtca

SEQ ID NO: 1289201 - DNA, 22 bp, Artificial Sequence
  chemically synthesized
actaagtcaggaagggactttt

SEQ ID NO: 1289202 - DNA, 22 bp, Artificial Sequence
  chemically synthesized
gtggaggtgacaaaagtccctt

SEQ ID NO: 1289203 - DNA, 22 bp, Artificial Sequence
  chemically synthesized
tgactaagtcaggaagggactt

SEQ ID NO: 1289204 - DNA, 22 bp, Artificial Sequence
  chemically synthesized
gaatattctgactaagtcagga

SEQ ID NO: 1289205 - DNA, 22 bp, Artificial Sequence
  chemically synthesized
agaatattctgactaagtcagg

SEQ ID NO: 1289206 - DNA, 22 bp, Artificial Sequence
  chemically synthesized
cctgacttagtcagaatattct

SEQ ID NO: 1289207 - DNA, 22 bp, Artificial Sequence
  chemically synthesized
tagaggggtcttagaatattct

SEQ ID NO: 1289208 - DNA, 22 bp, Artificial Sequence
  chemically synthesized
ctgacttagtcagaatattcta

SEQ ID NO: 1289209 - DNA, 22 bp, Artificial Sequence
  chemically synthesized
acttagtcagaatattctaaga

SEQ ID NO: 1289210 - DNA, 22 bp, Artificial Sequence
  chemically synthesized
agtcagaatattctaagacccc

SEQ ID NO: 1289211 - DNA, 22 bp, Artificial Sequence
  chemically synthesized
gtcagaatattctaagacccct

SEQ ID NO: 1289212 - DNA, 22 bp, Artificial Sequence
  chemically synthesized
cacagcatagctatagaggggt

SEQ ID NO: 1289213 - DNA, 22 bp, Artificial Sequence
  chemically synthesized
taagacccctctatagctatgc

SEQ ID NO: 1289214 - DNA, 22 bp, Artificial Sequence
  chemically synthesized
ccacattacacagcatagctat

SEQ ID NO: 1289215 - DNA, 22 bp, Artificial Sequence
  chemically synthesized
agacccctctatagctatgctg

SEQ ID NO: 1289216 - DNA, 22 bp, Artificial Sequence
  chemically synthesized
gtggctaccacattacacagca

SEQ ID NO: 1289217 - DNA, 22 bp, Artificial Sequence
  chemically synthesized
tatagctatgctgtgtaatgtg

SEQ ID NO: 1289218 - DNA, 22 bp, Artificial Sequence
  chemically synthesized
tagctatgctgtgtaatgtggt

SEQ ID NO: 1289219 - DNA, 22 bp, Artificial Sequence
  chemically synthesized
tgctgtgtaatgtggtagccac

SEQ ID NO: 1289220 - DNA, 22 bp, Artificial Sequence
  chemically synthesized
tgtaatgtggtagccactagcc

SEQ ID NO: 1289221 - DNA, 22 bp, Artificial Sequence
  chemically synthesized
caaagccacatgtggctagtgg

SEQ ID NO: 1289222 - DNA, 22 bp, Artificial Sequence
  chemically synthesized
aggtgctccaaagccacatgtg

SEQ ID NO: 1289223 - DNA, 22 bp, Artificial Sequence
  chemically synthesized
ttcaggtgctccaaagccacat

SEQ ID NO: 1289224 - DNA, 22 bp, Artificial Sequence
  chemically synthesized
gccacatgtggctttggagcac

SEQ ID NO: 1289225 - DNA, 22 bp, Artificial Sequence
  chemically synthesized
tggagcacctgaatagtggcta

SEQ ID NO: 1289226 - DNA, 22 bp, Artificial Sequence
  chemically synthesized
agcaacacgggatagccactat

SEQ ID NO: 1289227 - DNA, 22 bp, Artificial Sequence
  chemically synthesized
ggagcacctgaatagtggctat

SEQ ID NO: 1289228 - DNA, 22 bp, Artificial Sequence
  chemically synthesized
gagcacctgaatagtggctatc

SEQ ID NO: 1289229 - DNA, 22 bp, Artificial Sequence
  chemically synthesized
aatagtggctatcccgtgttgc

SEQ ID NO: 1289230 - DNA, 22 bp, Artificial Sequence
  chemically synthesized
cagcaaatctcagcaacacggg

SEQ ID NO: 1289231 - DNA, 22 bp, Artificial Sequence
  chemically synthesized
ccagcaaatctcagcaacacgg

SEQ ID NO: 1289232 - DNA, 22 bp, Artificial Sequence
  chemically synthesized
cacttccagcaaatctcagcaa

SEQ ID NO: 1289233 - DNA, 22 bp, Artificial Sequence
  chemically synthesized
acacttccagcaaatctcagca

SEQ ID NO: 1289234 - DNA, 22 bp, Artificial Sequence
  chemically synthesized
tacacttccagcaaatctcagc

SEQ ID NO: 1289235 - DNA, 22 bp, Artificial Sequence
  chemically synthesized
tcccgtgttgctgagatttgct

SEQ ID NO: 1289236 - DNA, 22 bp, Artificial Sequence
  chemically synthesized
tgaattttacacttccagcaaa

SEQ ID NO: 1289237 - DNA, 22 bp, Artificial Sequence
  chemically synthesized
cgttgtgaattttacacttcca

SEQ ID NO: 1289238 - DNA, 22 bp, Artificial Sequence
  chemically synthesized
ctgagatttgctggaagtgtaa

SEQ ID NO: 1289239 - DNA, 22 bp, Artificial Sequence
  chemically synthesized
agatttgctggaagtgtaaaat

SEQ ID NO: 1289240 - DNA, 22 bp, Artificial Sequence
  chemically synthesized
aattccgttgtgaattttacac

SEQ ID NO: 1289241 - DNA, 22 bp, Artificial Sequence
  chemically synthesized
taaattccgttgtgaattttac

SEQ ID NO: 1289242 - DNA, 22 bp, Artificial Sequence
  chemically synthesized
tctaaattccgttgtgaatttt

SEQ ID NO: 1289243 - DNA, 22 bp, Artificial Sequence
  chemically synthesized
gctggaagtgtaaaattcacaa

SEQ ID NO: 1289244 - DNA, 22 bp, Artificial Sequence
  chemically synthesized
ctggaagtgtaaaattcacaac

SEQ ID NO: 1289245 - DNA, 22 bp, Artificial Sequence
  chemically synthesized
gaagtgtaaaattcacaacgga

SEQ ID NO: 1289246 - DNA, 22 bp, Artificial Sequence
  chemically synthesized
taccacctctctaaattccgtt

SEQ ID NO: 1289247 - DNA, 22 bp, Artificial Sequence
  chemically synthesized
ttgtaccacctctctaaattcc

SEQ ID NO: 1289248 - DNA, 22 bp, Artificial Sequence
  chemically synthesized
attgtaccacctctctaaattc

SEQ ID NO: 1289249 - DNA, 22 bp, Artificial Sequence
  chemically synthesized
tttattgtaccacctctctaaa

SEQ ID NO: 1289250 - DNA, 22 bp, Artificial Sequence
  chemically synthesized
acaacggaatttagagaggtgg

SEQ ID NO: 1289251 - DNA, 22 bp, Artificial Sequence
  chemically synthesized
cattatttattgtaccacctct

SEQ ID NO: 1289252 - DNA, 22 bp, Artificial Sequence
  chemically synthesized
ttgcattatttattgtaccacc

SEQ ID NO: 1289253 - DNA, 22 bp, Artificial Sequence
  chemically synthesized
attgcattatttattgtaccac

SEQ ID NO: 1289254 - DNA, 22 bp, Artificial Sequence
  chemically synthesized
tttattgcattatttattgtac

SEQ ID NO: 1289255 - DNA, 22 bp, Artificial Sequence
  chemically synthesized
agagaggtggtacaataaataa

SEQ ID NO: 1289256 - DNA, 22 bp, Artificial Sequence
  chemically synthesized
gagaggtggtacaataaataat

SEQ ID NO: 1289257 - DNA, 22 bp, Artificial Sequence
  chemically synthesized
gtattatttattgcattattta

SEQ ID NO: 1289258 - DNA, 22 bp, Artificial Sequence
  chemically synthesized
tatcaattagtattatttattg

SEQ ID NO: 1289259 - DNA, 22 bp, Artificial Sequence
  chemically synthesized
aacaggtaatcactatatcaat

SEQ ID NO: 1289260 - DNA, 22 bp, Artificial Sequence
  chemically synthesized
caacaggtaatcactatatcaa

SEQ ID NO: 1289261 - DNA, 22 bp, Artificial Sequence
  chemically synthesized
ttcaacaggtaatcactatatc

SEQ ID NO: 1289262 - DNA, 22 bp, Artificial Sequence
  chemically synthesized
cttcaacaggtaatcactatat

SEQ ID NO: 1289263 - DNA, 22 bp, Artificial Sequence
  chemically synthesized
tttcttcaacaggtaatcacta

SEQ ID NO: 1289264 - DNA, 22 bp, Artificial Sequence
  chemically synthesized
attgatatagtgattacctgtt

SEQ ID NO: 1289265 - DNA, 22 bp, Artificial Sequence
  chemically synthesized
atatagtgattacctgttgaag

SEQ ID NO: 1289266 - DNA, 22 bp, Artificial Sequence
  chemically synthesized
tatgtaaaacaaaaatattatt

SEQ ID NO: 1289267 - DNA, 22 bp, Artificial Sequence
  chemically synthesized
cctgttgaagaaataatatttt

SEQ ID NO: 1289268 - DNA, 22 bp, Artificial Sequence
  chemically synthesized
actatatgtaaaacaaaaatat

SEQ ID NO: 1289269 - DNA, 22 bp, Artificial Sequence
  chemically synthesized
ttgaagaaataatatttttgtt

SEQ ID NO: 1289270 - DNA, 22 bp, Artificial Sequence
  chemically synthesized
aactatatgtaaaacaaaaata

SEQ ID NO: 1289271 - DNA, 22 bp, Artificial Sequence
  chemically synthesized
aagaaataatatttttgtttta

SEQ ID NO: 1289272 - DNA, 22 bp, Artificial Sequence
  chemically synthesized
tttaactatatgtaaaacaaaa

SEQ ID NO: 1289273 - DNA, 22 bp, Artificial Sequence
  chemically synthesized
atttaactatatgtaaaacaaa

SEQ ID NO: 1289274 - DNA, 22 bp, Artificial Sequence
  chemically synthesized
ataatatttatttaactatatg

SEQ ID NO: 1289275 - DNA, 22 bp, Artificial Sequence
  chemically synthesized
aataatatttatttaactatat

SEQ ID NO: 1289276 - DNA, 22 bp, Artificial Sequence
  chemically synthesized
taataatatttatttaactata

SEQ ID NO: 1289277 - DNA, 22 bp, Artificial Sequence
  chemically synthesized
ttgttttacatatagttaaata

SEQ ID NO: 1289278 - DNA, 22 bp, Artificial Sequence
  chemically synthesized
tgttttacatatagttaaataa

SEQ ID NO: 1289279 - DNA, 22 bp, Artificial Sequence
  chemically synthesized
gttttacatatagttaaataaa

SEQ ID NO: 1289280 - DNA, 22 bp, Artificial Sequence
  chemically synthesized
ttttacatatagttaaataaat

SEQ ID NO: 1289281 - DNA, 22 bp, Artificial Sequence
  chemically synthesized
tacatatagttaaataaatatt

SEQ ID NO: 1289282 - DNA, 22 bp, Artificial Sequence
  chemically synthesized
acatatagttaaataaatatta

SEQ ID NO: 1289283 - DNA, 22 bp, Artificial Sequence
  chemically synthesized
catatagttaaataaatattat

SEQ ID NO: 1289284 - DNA, 22 bp, Artificial Sequence
  chemically synthesized
aataaatattattaaaattact

SEQ ID NO: 1289285 - DNA, 22 bp, Artificial Sequence
  chemically synthesized
agaagaaacaggtgaagtaatt

SEQ ID NO: 1289286 - DNA, 22 bp, Artificial Sequence
  chemically synthesized
aaaactgagaagaaacaggtga

SEQ ID NO: 1289287 - DNA, 22 bp, Artificial Sequence
  chemically synthesized
ttaaaattacttcacctgtttc

SEQ ID NO: 1289288 - DNA, 22 bp, Artificial Sequence
  chemically synthesized
aaaaactgagaagaaacaggtg

SEQ ID NO: 1289289 - DNA, 22 bp, Artificial Sequence
  chemically synthesized
aaattacttcacctgtttcttc

SEQ ID NO: 1289290 - DNA, 22 bp, Artificial Sequence
  chemically synthesized
atttaaaaactgagaagaaaca

SEQ ID NO: 1289291 - DNA, 22 bp, Artificial Sequence
  chemically synthesized
cttcacctgtttcttctcagtt

SEQ ID NO: 1289292 - DNA, 22 bp, Artificial Sequence
  chemically synthesized
tagcctcatttaaaaactgaga

SEQ ID NO: 1289293 - DNA, 22 bp, Artificial Sequence
  chemically synthesized
cacctgtttcttctcagttttt

SEQ ID NO: 1289294 - DNA, 22 bp, Artificial Sequence
  chemically synthesized
atagcctcatttaaaaactgag

SEQ ID NO: 1289295 - DNA, 22 bp, Artificial Sequence
  chemically synthesized
acctgtttcttctcagttttta

SEQ ID NO: 1289296 - DNA, 22 bp, Artificial Sequence
  chemically synthesized
ttatagcctcatttaaaaactg

SEQ ID NO: 1289297 - DNA, 22 bp, Artificial Sequence
  chemically synthesized
cttatagcctcatttaaaaact

SEQ ID NO: 1289298 - DNA, 22 bp, Artificial Sequence
  chemically synthesized
tttcttctcagtttttaaatga

SEQ ID NO: 1289299 - DNA, 22 bp, Artificial Sequence
  chemically synthesized
catttcttatagcctcatttaa

SEQ ID NO: 1289300 - DNA, 22 bp, Artificial Sequence
  chemically synthesized
cttctcagtttttaaatgaggc

SEQ ID NO: 1289301 - DNA, 22 bp, Artificial Sequence
  chemically synthesized
acatttcttatagcctcattta

SEQ ID NO: 1289302 - DNA, 22 bp, Artificial Sequence
  chemically synthesized
ttctcagtttttaaatgaggct

SEQ ID NO: 1289303 - DNA, 22 bp, Artificial Sequence
  chemically synthesized
ctcagtttttaaatgaggctat

SEQ ID NO: 1289304 - DNA, 22 bp, Artificial Sequence
  chemically synthesized
tcagtttttaaatgaggctata

SEQ ID NO: 1289305 - DNA, 22 bp, Artificial Sequence
  chemically synthesized
agtttttaaatgaggctataag

SEQ ID NO: 1289306 - DNA, 22 bp, Artificial Sequence
  chemically synthesized
tatagtatttacatttcttata

SEQ ID NO: 1289307 - DNA, 22 bp, Artificial Sequence
  chemically synthesized
ttaaatgaggctataagaaatg

SEQ ID NO: 1289308 - DNA, 22 bp, Artificial Sequence
  chemically synthesized
atatagtatttacatttcttat

SEQ ID NO: 1289309 - DNA, 22 bp, Artificial Sequence
  chemically synthesized
taaatgaggctataagaaatgt

SEQ ID NO: 1289310 - DNA, 22 bp, Artificial Sequence
  chemically synthesized
aaatgaggctataagaaatgta

SEQ ID NO: 1289311 - DNA, 22 bp, Artificial Sequence
  chemically synthesized
aatgaggctataagaaatgtaa

SEQ ID NO: 1289312 - DNA, 22 bp, Artificial Sequence
  chemically synthesized
caaaaagtttatatagtattta

SEQ ID NO: 1289313 - DNA, 22 bp, Artificial Sequence
  chemically synthesized
taagaaatgtaaatactatata

SEQ ID NO: 1289314 - DNA, 22 bp, Artificial Sequence
  chemically synthesized
tataaactttttgcaatacatt

SEQ ID NO: 1289315 - DNA, 22 bp, Artificial Sequence
  chemically synthesized
gcagcacatccaatagaaatgt

SEQ ID NO: 1289316 - DNA, 22 bp, Artificial Sequence
  chemically synthesized
ggcagcacatccaatagaaatg

SEQ ID NO: 1289317 - DNA, 22 bp, Artificial Sequence
  chemically synthesized
tttgcaatacatttctattgga

SEQ ID NO: 1289318 - DNA, 22 bp, Artificial Sequence
  chemically synthesized
ttgcaatacatttctattggat

SEQ ID NO: 1289319 - DNA, 22 bp, Artificial Sequence
  chemically synthesized
tgcaatacatttctattggatg

SEQ ID NO: 1289320 - DNA, 22 bp, Artificial Sequence
  chemically synthesized
gcaatacatttctattggatgt

SEQ ID NO: 1289321 - DNA, 22 bp, Artificial Sequence
  chemically synthesized
caatacatttctattggatgtg

SEQ ID NO: 1289322 - DNA, 22 bp, Artificial Sequence
  chemically synthesized
agaagtttggcagcacatccaa

SEQ ID NO: 1289323 - DNA, 22 bp, Artificial Sequence
  chemically synthesized
ctattggatgtgctgccaaact

SEQ ID NO: 1289324 - DNA, 22 bp, Artificial Sequence
  chemically synthesized
tattggatgtgctgccaaactt

SEQ ID NO: 1289325 - DNA, 22 bp, Artificial Sequence
  chemically synthesized
ttggatgtgctgccaaacttct

SEQ ID NO: 1289326 - DNA, 22 bp, Artificial Sequence
  chemically synthesized
gatgtgctgccaaacttctcag

SEQ ID NO: 1289327 - DNA, 22 bp, Artificial Sequence
  chemically synthesized
ccaaacttctcaggattcctat

SEQ ID NO: 1289328 - DNA, 22 bp, Artificial Sequence
  chemically synthesized
ctcaggattcctatatatcttt

SEQ ID NO: 1289329 - DNA, 22 bp, Artificial Sequence
  chemically synthesized
tcaggattcctatatatctttc

SEQ ID NO: 1289330 - DNA, 22 bp, Artificial Sequence
  chemically synthesized
aggattcctatatatctttcta

SEQ ID NO: 1289331 - DNA, 22 bp, Artificial Sequence
  chemically synthesized
ctatatatctttctattctact

SEQ ID NO: 1289332 - DNA, 22 bp, Artificial Sequence
  chemically synthesized
tatatctttctattctactaca

SEQ ID NO: 1289333 - DNA, 22 bp, Artificial Sequence
  chemically synthesized
tctattctactacatctaccat

SEQ ID NO: 1289334 - DNA, 22 bp, Artificial Sequence
  chemically synthesized
ctattctactacatctaccatt

SEQ ID NO: 1289335 - DNA, 22 bp, Artificial Sequence
  chemically synthesized
tattctactacatctaccattc

SEQ ID NO: 1289336 - DNA, 22 bp, Artificial Sequence
  chemically synthesized
atgatgaagaaatgaatggtag

SEQ ID NO: 1289337 - DNA, 22 bp, Artificial Sequence
  chemically synthesized
ttctactacatctaccattcat

SEQ ID NO: 1289338 - DNA, 22 bp, Artificial Sequence
  chemically synthesized
tactacatctaccattcatttc

SEQ ID NO: 1289339 - DNA, 22 bp, Artificial Sequence
  chemically synthesized
ctacatctaccattcatttctt

SEQ ID NO: 1289340 - DNA, 22 bp, Artificial Sequence
  chemically synthesized
catctaccattcatttcttcat

SEQ ID NO: 1289341 - DNA, 22 bp, Artificial Sequence
  chemically synthesized
ccattcatttcttcatcattaa

SEQ ID NO: 1289342 - DNA, 22 bp, Artificial Sequence
  chemically synthesized
atttcttcatcattaattattc

SEQ ID NO: 1289343 - DNA, 22 bp, Artificial Sequence
  chemically synthesized
taataaaaaatatagaataatt

SEQ ID NO: 1289344 - DNA, 22 bp, Artificial Sequence
  chemically synthesized
ataataaaaaatatagaataat

SEQ ID NO: 1289345 - DNA, 22 bp, Artificial Sequence
  chemically synthesized
cttcatcattaattattctata

SEQ ID NO: 1289346 - DNA, 22 bp, Artificial Sequence
  chemically synthesized
ttcatcattaattattctatat

SEQ ID NO: 1289347 - DNA, 22 bp, Artificial Sequence
  chemically synthesized
catcattaattattctatattt

SEQ ID NO: 1289348 - DNA, 22 bp, Artificial Sequence
  chemically synthesized
atcattaattattctatatttt

SEQ ID NO: 1289349 - DNA, 22 bp, Artificial Sequence
  chemically synthesized
attattctatattttttattat

SEQ ID NO: 1289350 - DNA, 22 bp, Artificial Sequence
  chemically synthesized
gcgcacagtaaatttataataa

SEQ ID NO: 1289351 - DNA, 22 bp, Artificial Sequence
  chemically synthesized
ttctatattttttattataaat

SEQ ID NO: 1289352 - DNA, 22 bp, Artificial Sequence
  chemically synthesized
tatattttttattataaattta

SEQ ID NO: 1289353 - DNA, 22 bp, Artificial Sequence
  chemically synthesized
tattttttattataaatttact

SEQ ID NO: 1289354 - DNA, 22 bp, Artificial Sequence
  chemically synthesized
gagtgcctagcgcacagtaaat

SEQ ID NO: 1289355 - DNA, 22 bp, Artificial Sequence
  chemically synthesized
tttattataaatttactgtgcg

SEQ ID NO: 1289356 - DNA, 22 bp, Artificial Sequence
  chemically synthesized
ttattataaatttactgtgcgc

SEQ ID NO: 1289357 - DNA, 22 bp, Artificial Sequence
  chemically synthesized
tattataaatttactgtgcgct

SEQ ID NO: 1289358 - DNA, 22 bp, Artificial Sequence
  chemically synthesized
attataaatttactgtgcgcta

SEQ ID NO: 1289359 - DNA, 22 bp, Artificial Sequence
  chemically synthesized
ttataaatttactgtgcgctag

SEQ ID NO: 1289360 - DNA, 22 bp, Artificial Sequence
  chemically synthesized
taaatttactgtgcgctaggca

SEQ ID NO: 1289361 - DNA, 22 bp, Artificial Sequence
  chemically synthesized
actgtgcgctaggcactctaat

SEQ ID NO: 1289362 - DNA, 22 bp, Artificial Sequence
  chemically synthesized
ctgtgcgctaggcactctaatt

SEQ ID NO: 1289363 - DNA, 22 bp, Artificial Sequence
  chemically synthesized
tgcgctaggcactctaattatt

SEQ ID NO: 1289364 - DNA, 22 bp, Artificial Sequence
  chemically synthesized
taataaacaatggaataattag

SEQ ID NO: 1289365 - DNA, 22 bp, Artificial Sequence
  chemically synthesized
ataataaacaatggaataatta

SEQ ID NO: 1289366 - DNA, 22 bp, Artificial Sequence
  chemically synthesized
ggcactctaattattccattgt

SEQ ID NO: 1289367 - DNA, 22 bp, Artificial Sequence
  chemically synthesized
taattattccattgtttattat

SEQ ID NO: 1289368 - DNA, 22 bp, Artificial Sequence
  chemically synthesized
attattccattgtttattataa

SEQ ID NO: 1289369 - DNA, 22 bp, Artificial Sequence
  chemically synthesized
gcacacagtagatttataataa

SEQ ID NO: 1289370 - DNA, 22 bp, Artificial Sequence
  chemically synthesized
ttccattgtttattataaatct

SEQ ID NO: 1289371 - DNA, 22 bp, Artificial Sequence
  chemically synthesized
cattgtttattataaatctact

SEQ ID NO: 1289372 - DNA, 22 bp, Artificial Sequence
  chemically synthesized
tttattataaatctactgtgtg

SEQ ID NO: 1289373 - DNA, 22 bp, Artificial Sequence
  chemically synthesized
gaagagtagctggcacacagta

SEQ ID NO: 1289374 - DNA, 22 bp, Artificial Sequence
  chemically synthesized
attataaatctactgtgtgcca

SEQ ID NO: 1289375 - DNA, 22 bp, Artificial Sequence
  chemically synthesized
ttataaatctactgtgtgccag

SEQ ID NO: 1289376 - DNA, 22 bp, Artificial Sequence
  chemically synthesized
ttagaagagtagctggcacaca

SEQ ID NO: 1289377 - DNA, 22 bp, Artificial Sequence
  chemically synthesized
taaatctactgtgtgccagcta

SEQ ID NO: 1289378 - DNA, 22 bp, Artificial Sequence
  chemically synthesized
ctgtgtgccagctactcttcta

SEQ ID NO: 1289379 - DNA, 22 bp, Artificial Sequence
  chemically synthesized
tgtgccagctactcttctaata

SEQ ID NO: 1289380 - DNA, 22 bp, Artificial Sequence
  chemically synthesized
acagtaggtgattattagaaga

SEQ ID NO: 1289381 - DNA, 22 bp, Artificial Sequence
  chemically synthesized
aacagtaggtgattattagaag

SEQ ID NO: 1289382 - DNA, 22 bp, Artificial Sequence
  chemically synthesized
tgtcttaacagtaggtgattat

SEQ ID NO: 1289383 - DNA, 22 bp, Artificial Sequence
  chemically synthesized
ctcttctaataatcacctactg

SEQ ID NO: 1289384 - DNA, 22 bp, Artificial Sequence
  chemically synthesized
ttctaataatcacctactgtta

SEQ ID NO: 1289385 - DNA, 22 bp, Artificial Sequence
  chemically synthesized
ctaataatcacctactgttaag

SEQ ID NO: 1289386 - DNA, 22 bp, Artificial Sequence
  chemically synthesized
taataatcacctactgttaaga

SEQ ID NO: 1289387 - DNA, 22 bp, Artificial Sequence
  chemically synthesized
ataatcacctactgttaagaca

SEQ ID NO: 1289388 - DNA, 22 bp, Artificial Sequence
  chemically synthesized
ctgttaagacacaggatgggac

SEQ ID NO: 1289389 - DNA, 22 bp, Artificial Sequence
  chemically synthesized
tcatgaagtcacatgtcccatc

SEQ ID NO: 1289390 - DNA, 22 bp, Artificial Sequence
  chemically synthesized
ttaagacacaggatgggacatg

SEQ ID NO: 1289391 - DNA, 22 bp, Artificial Sequence
  chemically synthesized
atcatgaagtcacatgtcccat

SEQ ID NO: 1289392 - DNA, 22 bp, Artificial Sequence
  chemically synthesized
tatcatgaagtcacatgtccca

SEQ ID NO: 1289393 - DNA, 22 bp, Artificial Sequence
  chemically synthesized
ttatcatgaagtcacatgtccc

SEQ ID NO: 1289394 - DNA, 22 bp, Artificial Sequence
  chemically synthesized
agacacaggatgggacatgtga

SEQ ID NO: 1289395 - DNA, 22 bp, Artificial Sequence
  chemically synthesized
tttatcatgaagtcacatgtcc

SEQ ID NO: 1289396 - DNA, 22 bp, Artificial Sequence
  chemically synthesized
cccctttttatcatgaagtcac

SEQ ID NO: 1289397 - DNA, 22 bp, Artificial Sequence
  chemically synthesized
ccccctttttatcatgaagtca

SEQ ID NO: 1289398 - DNA, 22 bp, Artificial Sequence
  chemically synthesized
tatcagggtgtttccccctttt

SEQ ID NO: 1289399 - DNA, 22 bp, Artificial Sequence
  chemically synthesized
ctatatcagggtgtttccccct

SEQ ID NO: 1289400 - DNA, 22 bp, Artificial Sequence
  chemically synthesized
catgataaaaagggggaaacac

SEQ ID NO: 1289401 - DNA, 22 bp, Artificial Sequence
  chemically synthesized
atgataaaaagggggaaacacc

SEQ ID NO: 1289402 - DNA, 22 bp, Artificial Sequence
  chemically synthesized
agttcctatatcagggtgtttc

SEQ ID NO: 1289403 - DNA, 22 bp, Artificial Sequence
  chemically synthesized
taaaattcagttcctatatcag

SEQ ID NO: 1289404 - DNA, 22 bp, Artificial Sequence
  chemically synthesized
gtaaaattcagttcctatatca

SEQ ID NO: 1289405 - DNA, 22 bp, Artificial Sequence
  chemically synthesized
atataggaactgaattttacaa

SEQ ID NO: 1289406 - DNA, 22 bp, Artificial Sequence
  chemically synthesized
gagcacaaaaaatcttgtaaaa

SEQ ID NO: 1289407 - DNA, 22 bp, Artificial Sequence
  chemically synthesized
aagttggagcacaaaaaatctt

SEQ ID NO: 1289408 - DNA, 22 bp, Artificial Sequence
  chemically synthesized
aattttacaagattttttgtgc

SEQ ID NO: 1289409 - DNA, 22 bp, Artificial Sequence
  chemically synthesized
tacaagattttttgtgctccaa

SEQ ID NO: 1289410 - DNA, 22 bp, Artificial Sequence
  chemically synthesized
acaagattttttgtgctccaac

SEQ ID NO: 1289411 - DNA, 22 bp, Artificial Sequence
  chemically synthesized
gcagggactgaagttggagcac

SEQ ID NO: 1289412 - DNA, 22 bp, Artificial Sequence
  chemically synthesized
caagattttttgtgctccaact

SEQ ID NO: 1289413 - DNA, 22 bp, Artificial Sequence
  chemically synthesized
tggcagggactgaagttggagc

SEQ ID NO: 1289414 - DNA, 22 bp, Artificial Sequence
  chemically synthesized
ttctggcagggactgaagttgg

SEQ ID NO: 1289415 - DNA, 22 bp, Artificial Sequence
  chemically synthesized
gttctggcagggactgaagttg

SEQ ID NO: 1289416 - DNA, 22 bp, Artificial Sequence
  chemically synthesized
tttgtgctccaacttcagtccc

SEQ ID NO: 1289417 - DNA, 22 bp, Artificial Sequence
  chemically synthesized
cttgttctggcagggactgaag

SEQ ID NO: 1289418 - DNA, 22 bp, Artificial Sequence
  chemically synthesized
ttgtgctccaacttcagtccct

SEQ ID NO: 1289419 - DNA, 22 bp, Artificial Sequence
  chemically synthesized
gcttgttctggcagggactgaa

SEQ ID NO: 1289420 - DNA, 22 bp, Artificial Sequence
  chemically synthesized
tgtgctccaacttcagtccctg

SEQ ID NO: 1289421 - DNA, 22 bp, Artificial Sequence
  chemically synthesized
tgcttgttctggcagggactga

SEQ ID NO: 1289422 - DNA, 22 bp, Artificial Sequence
  chemically synthesized
gtgctccaacttcagtccctgc

SEQ ID NO: 1289423 - DNA, 22 bp, Artificial Sequence
  chemically synthesized
ttgcttgttctggcagggactg

SEQ ID NO: 1289424 - DNA, 22 bp, Artificial Sequence
  chemically synthesized
tgctccaacttcagtccctgcc

SEQ ID NO: 1289425 - DNA, 22 bp, Artificial Sequence
  chemically synthesized
cttttgcttgttctggcaggga

SEQ ID NO: 1289426 - DNA, 22 bp, Artificial Sequence
  chemically synthesized
caacttcagtccctgccagaac

SEQ ID NO: 1289427 - DNA, 22 bp, Artificial Sequence
  chemically synthesized
cagtccctgccagaacaagcaa

SEQ ID NO: 1289428 - DNA, 22 bp, Artificial Sequence
  chemically synthesized
tagtcactccttttgcttgttc

SEQ ID NO: 1289429 - DNA, 22 bp, Artificial Sequence
  chemically synthesized
agtccctgccagaacaagcaaa

SEQ ID NO: 1289430 - DNA, 22 bp, Artificial Sequence
  chemically synthesized
ccagaacaagcaaaaggagtga

SEQ ID NO: 1289431 - DNA, 22 bp, Artificial Sequence
  chemically synthesized
gaaagtcacattgtagtcactc

SEQ ID NO: 1289432 - DNA, 22 bp, Artificial Sequence
  chemically synthesized
agaaagtcacattgtagtcact

SEQ ID NO: 1289433 - DNA, 22 bp, Artificial Sequence
  chemically synthesized
aatacaaccatttagaaagtca

SEQ ID NO: 1289434 - DNA, 22 bp, Artificial Sequence
  chemically synthesized
caatgtgactttctaaatggtt

SEQ ID NO: 1289435 - DNA, 22 bp, Artificial Sequence
  chemically synthesized
tggtcctcaatacaaccattta

SEQ ID NO: 1289436 - DNA, 22 bp, Artificial Sequence
  chemically synthesized
tctaaatggttgtattgaggac

SEQ ID NO: 1289437 - DNA, 22 bp, Artificial Sequence
  chemically synthesized
ctaaatggttgtattgaggacc

SEQ ID NO: 1289438 - DNA, 22 bp, Artificial Sequence
  chemically synthesized
taaatggttgtattgaggacca

SEQ ID NO: 1289439 - DNA, 22 bp, Artificial Sequence
  chemically synthesized
aatggttgtattgaggaccaca

SEQ ID NO: 1289440 - DNA, 22 bp, Artificial Sequence
  chemically synthesized
ataggcaggacccagcatctgt

SEQ ID NO: 1289441 - DNA, 22 bp, Artificial Sequence
  chemically synthesized
tattgaggaccacagatgctgg

SEQ ID NO: 1289442 - DNA, 22 bp, Artificial Sequence
  chemically synthesized
ctaataggcaggacccagcatc

SEQ ID NO: 1289443 - DNA, 22 bp, Artificial Sequence
  chemically synthesized
cctaataggcaggacccagcat

SEQ ID NO: 1289444 - DNA, 22 bp, Artificial Sequence
  chemically synthesized
aggaccacagatgctgggtcct

SEQ ID NO: 1289445 - DNA, 22 bp, Artificial Sequence
  chemically synthesized
ttcctaataggcaggacccagc

SEQ ID NO: 1289446 - DNA, 22 bp, Artificial Sequence
  chemically synthesized
agtgtgcccattcttcctaata

SEQ ID NO: 1289447 - DNA, 22 bp, Artificial Sequence
  chemically synthesized
ggtcctgcctattaggaagaat

SEQ ID NO: 1289448 - DNA, 22 bp, Artificial Sequence
  chemically synthesized
ataactcagtgtgcccattctt

SEQ ID NO: 1289449 - DNA, 22 bp, Artificial Sequence
  chemically synthesized
cataactcagtgtgcccattct

SEQ ID NO: 1289450 - DNA, 22 bp, Artificial Sequence
  chemically synthesized
cctattaggaagaatgggcaca

SEQ ID NO: 1289451 - DNA, 22 bp, Artificial Sequence
  chemically synthesized
ttaggaagaatgggcacactga

SEQ ID NO: 1289452 - DNA, 22 bp, Artificial Sequence
  chemically synthesized
tcatttcataactcagtgtgcc

SEQ ID NO: 1289453 - DNA, 22 bp, Artificial Sequence
  chemically synthesized
atcatttcataactcagtgtgc

SEQ ID NO: 1289454 - DNA, 22 bp, Artificial Sequence
  chemically synthesized
tatcatttcataactcagtgtg

SEQ ID NO: 1289455 - DNA, 22 bp, Artificial Sequence
  chemically synthesized
ggaagaatgggcacactgagtt

SEQ ID NO: 1289456 - DNA, 22 bp, Artificial Sequence
  chemically synthesized
ttatcatttcataactcagtgt

SEQ ID NO: 1289457 - DNA, 22 bp, Artificial Sequence
  chemically synthesized
agttatgaaatgataaaagact

SEQ ID NO: 1289458 - DNA, 22 bp, Artificial Sequence
  chemically synthesized
tgaaatgataaaagactcctgt

SEQ ID NO: 1289459 - DNA, 22 bp, Artificial Sequence
  chemically synthesized
aaggccaaagaatgagacacag

SEQ ID NO: 1289460 - DNA, 22 bp, Artificial Sequence
  chemically synthesized
ctgtgtctcattctttggcctt

SEQ ID NO: 1289461 - DNA, 22 bp, Artificial Sequence
  chemically synthesized
tgtctcattctttggccttcag

SEQ ID NO: 1289462 - DNA, 22 bp, Artificial Sequence
  chemically synthesized
caaaatcaccacagtccctgaa

SEQ ID NO: 1289463 - DNA, 22 bp, Artificial Sequence
  chemically synthesized
attctttggccttcagggactg

SEQ ID NO: 1289464 - DNA, 22 bp, Artificial Sequence
  chemically synthesized
tttggccttcagggactgtggt

SEQ ID NO: 1289465 - DNA, 22 bp, Artificial Sequence
  chemically synthesized
tggccttcagggactgtggtga

SEQ ID NO: 1289466 - DNA, 22 bp, Artificial Sequence
  chemically synthesized
ggccttcagggactgtggtgat

SEQ ID NO: 1289467 - DNA, 22 bp, Artificial Sequence
  chemically synthesized
gccttcagggactgtggtgatt

SEQ ID NO: 1289468 - DNA, 22 bp, Artificial Sequence
  chemically synthesized
acagacattgcaaaatcaccac

SEQ ID NO: 1289469 - DNA, 22 bp, Artificial Sequence
  chemically synthesized
cagggactgtggtgattttgca

SEQ ID NO: 1289470 - DNA, 22 bp, Artificial Sequence
  chemically synthesized
agggactgtggtgattttgcaa

SEQ ID NO: 1289471 - DNA, 22 bp, Artificial Sequence
  chemically synthesized
ggcaattcacagacattgcaaa

SEQ ID NO: 1289472 - DNA, 22 bp, Artificial Sequence
  chemically synthesized
tggtgattttgcaatgtctgtg

SEQ ID NO: 1289473 - DNA, 22 bp, Artificial Sequence
  chemically synthesized
aagccctgggcaattcacagac

SEQ ID NO: 1289474 - DNA, 22 bp, Artificial Sequence
  chemically synthesized
tgcaatgtctgtgaattgccca

SEQ ID NO: 1289475 - DNA, 22 bp, Artificial Sequence
  chemically synthesized
gcaatgtctgtgaattgcccag

SEQ ID NO: 1289476 - DNA, 22 bp, Artificial Sequence
  chemically synthesized
caatgtctgtgaattgcccagg

SEQ ID NO: 1289477 - DNA, 22 bp, Artificial Sequence
  chemically synthesized
tcaccacagtcactgaagccct

SEQ ID NO: 1289478 - DNA, 22 bp, Artificial Sequence
  chemically synthesized
tgaattgcccagggcttcagtg

SEQ ID NO: 1289479 - DNA, 22 bp, Artificial Sequence
  chemically synthesized
gaactatcaccacagtcactga

SEQ ID NO: 1289480 - DNA, 22 bp, Artificial Sequence
  chemically synthesized
agaactatcaccacagtcactg

SEQ ID NO: 1289481 - DNA, 22 bp, Artificial Sequence
  chemically synthesized
tagaactatcaccacagtcact

SEQ ID NO: 1289482 - DNA, 22 bp, Artificial Sequence
  chemically synthesized
cccagggcttcagtgactgtgg

SEQ ID NO: 1289483 - DNA, 22 bp, Artificial Sequence
  chemically synthesized
ttttagaactatcaccacagtc

SEQ ID NO: 1289484 - DNA, 22 bp, Artificial Sequence
  chemically synthesized
cagtgactgtggtgatagttct

SEQ ID NO: 1289485 - DNA, 22 bp, Artificial Sequence
  chemically synthesized
agtgactgtggtgatagttcta

SEQ ID NO: 1289486 - DNA, 22 bp, Artificial Sequence
  chemically synthesized
tgtgtccctgttttagaactat

SEQ ID NO: 1289487 - DNA, 22 bp, Artificial Sequence
  chemically synthesized
aagctgtgtgtccctgttttag

SEQ ID NO: 1289488 - DNA, 22 bp, Artificial Sequence
  chemically synthesized
tggtgatagttctaaaacaggg

SEQ ID NO: 1289489 - DNA, 22 bp, Artificial Sequence
  chemically synthesized
ctaaagctgtgtgtccctgttt

SEQ ID NO: 1289490 - DNA, 22 bp, Artificial Sequence
  chemically synthesized
ttcctaaagctgtgtgtccctg

SEQ ID NO: 1289491 - DNA, 22 bp, Artificial Sequence
  chemically synthesized
aaactgttcctaaagctgtgtg

SEQ ID NO: 1289492 - DNA, 22 bp, Artificial Sequence
  chemically synthesized
taaaacagggacacacagcttt

SEQ ID NO: 1289493 - DNA, 22 bp, Artificial Sequence
  chemically synthesized
aaacagggacacacagctttag

SEQ ID NO: 1289494 - DNA, 22 bp, Artificial Sequence
  chemically synthesized
tagactgaaactgttcctaaag

SEQ ID NO: 1289495 - DNA, 22 bp, Artificial Sequence
  chemically synthesized
atagactgaaactgttcctaaa

SEQ ID NO: 1289496 - DNA, 22 bp, Artificial Sequence
  chemically synthesized
taggaacagtttcagtctataa

SEQ ID NO: 1289497 - DNA, 22 bp, Artificial Sequence
  chemically synthesized
aggaacagtttcagtctataag

SEQ ID NO: 1289498 - DNA, 22 bp, Artificial Sequence
  chemically synthesized
ggaacagtttcagtctataagt

SEQ ID NO: 1289499 - DNA, 22 bp, Artificial Sequence
  chemically synthesized
cagtctataagtctgactatat

SEQ ID NO: 1289500 - DNA, 22 bp, Artificial Sequence
  chemically synthesized
agtctataagtctgactatatg

SEQ ID NO: 1289501 - DNA, 22 bp, Artificial Sequence
  chemically synthesized
tcaacaggaagtacatatagtc

SEQ ID NO: 1289502 - DNA, 22 bp, Artificial Sequence
  chemically synthesized
atcaacaggaagtacatatagt

SEQ ID NO: 1289503 - DNA, 22 bp, Artificial Sequence
  chemically synthesized
taagtctgactatatgtacttc

SEQ ID NO: 1289504 - DNA, 22 bp, Artificial Sequence
  chemically synthesized
actatatgtacttcctgttgat

SEQ ID NO: 1289505 - DNA, 22 bp, Artificial Sequence
  chemically synthesized
tatgtacttcctgttgataaac

SEQ ID NO: 1289506 - DNA, 22 bp, Artificial Sequence
  chemically synthesized
acaaaagcatgagtttatcaac

SEQ ID NO: 1289507 - DNA, 22 bp, Artificial Sequence
  chemically synthesized
cctgttgataaactcatgcttt

SEQ ID NO: 1289508 - DNA, 22 bp, Artificial Sequence
  chemically synthesized
ctgttgataaactcatgctttt

SEQ ID NO: 1289509 - DNA, 22 bp, Artificial Sequence
  chemically synthesized
gcaaaagactgacaaaagcatg

SEQ ID NO: 1289510 - DNA, 22 bp, Artificial Sequence
  chemically synthesized
ttgataaactcatgcttttgtc

SEQ ID NO: 1289511 - DNA, 22 bp, Artificial Sequence
  chemically synthesized
ataaactcatgcttttgtcagt

SEQ ID NO: 1289512 - DNA, 22 bp, Artificial Sequence
  chemically synthesized
agtattagcaaaagactgacaa

SEQ ID NO: 1289513 - DNA, 22 bp, Artificial Sequence
  chemically synthesized
cagtattagcaaaagactgaca

SEQ ID NO: 1289514 - DNA, 22 bp, Artificial Sequence
  chemically synthesized
tcagtattagcaaaagactgac

SEQ ID NO: 1289515 - DNA, 22 bp, Artificial Sequence
  chemically synthesized
ttcagtattagcaaaagactga

SEQ ID NO: 1289516 - DNA, 22 bp, Artificial Sequence
  chemically synthesized
atgcttttgtcagtcttttgct

SEQ ID NO: 1289517 - DNA, 22 bp, Artificial Sequence
  chemically synthesized
ttgtcagtcttttgctaatact

SEQ ID NO: 1289518 - DNA, 22 bp, Artificial Sequence
  chemically synthesized
tgtcagtcttttgctaatactg

SEQ ID NO: 1289519 - DNA, 22 bp, Artificial Sequence
  chemically synthesized
atgagtgtttttcagtattagc

SEQ ID NO: 1289520 - DNA, 22 bp, Artificial Sequence
  chemically synthesized
gtcagtcttttgctaatactga

SEQ ID NO: 1289521 - DNA, 22 bp, Artificial Sequence
  chemically synthesized
tcagtcttttgctaatactgaa

SEQ ID NO: 1289522 - DNA, 22 bp, Artificial Sequence
  chemically synthesized
ttgctaatactgaaaaacactc

SEQ ID NO: 1289523 - DNA, 22 bp, Artificial Sequence
  chemically synthesized
tgctaatactgaaaaacactca

SEQ ID NO: 1289524 - DNA, 22 bp, Artificial Sequence
  chemically synthesized
gctaatactgaaaaacactcat

SEQ ID NO: 1289525 - DNA, 22 bp, Artificial Sequence
  chemically synthesized
ctaatactgaaaaacactcatg

SEQ ID NO: 1289526 - DNA, 22 bp, Artificial Sequence
  chemically synthesized
atactgaaaaacactcatgaac

SEQ ID NO: 1289527 - DNA, 22 bp, Artificial Sequence
  chemically synthesized
aaaaacactcatgaaccatcct

SEQ ID NO: 1289528 - DNA, 22 bp, Artificial Sequence
  chemically synthesized
aataataatgggaaatggagga

SEQ ID NO: 1289529 - DNA, 22 bp, Artificial Sequence
  chemically synthesized
gaataataatgggaaatggagg

SEQ ID NO: 1289530 - DNA, 22 bp, Artificial Sequence
  chemically synthesized
atgaaccatcctccatttccca

SEQ ID NO: 1289531 - DNA, 22 bp, Artificial Sequence
  chemically synthesized
aagtccttgaataataatggga

SEQ ID NO: 1289532 - DNA, 22 bp, Artificial Sequence
  chemically synthesized
catttcccattattattcaagg

SEQ ID NO: 1289533 - DNA, 22 bp, Artificial Sequence
  chemically synthesized
aatgtctaaagtccttgaataa

SEQ ID NO: 1289534 - DNA, 22 bp, Artificial Sequence
  chemically synthesized
tgaatgtctaaagtccttgaat

SEQ ID NO: 1289535 - DNA, 22 bp, Artificial Sequence
  chemically synthesized
cccattattattcaaggacttt

SEQ ID NO: 1289536 - DNA, 22 bp, Artificial Sequence
  chemically synthesized
ccattattattcaaggacttta

SEQ ID NO: 1289537 - DNA, 22 bp, Artificial Sequence
  chemically synthesized
agaactctgaatgtctaaagtc

SEQ ID NO: 1289538 - DNA, 22 bp, Artificial Sequence
  chemically synthesized
ttattcaaggactttagacatt

SEQ ID NO: 1289539 - DNA, 22 bp, Artificial Sequence
  chemically synthesized
tctgagaactctgaatgtctaa

SEQ ID NO: 1289540 - DNA, 22 bp, Artificial Sequence
  chemically synthesized
ttcaaggactttagacattcag

SEQ ID NO: 1289541 - DNA, 22 bp, Artificial Sequence
  chemically synthesized
aaggactttagacattcagagt

SEQ ID NO: 1289542 - DNA, 22 bp, Artificial Sequence
  chemically synthesized
tagacattcagagttctcagac

SEQ ID NO: 1289543 - DNA, 22 bp, Artificial Sequence
  chemically synthesized
agacattcagagttctcagaca

SEQ ID NO: 1289544 - DNA, 22 bp, Artificial Sequence
  chemically synthesized
aaaagaaaaaattgtctgagaa

SEQ ID NO: 1289545 - DNA, 22 bp, Artificial Sequence
  chemically synthesized
gacattcagagttctcagacaa

SEQ ID NO: 1289546 - DNA, 22 bp, Artificial Sequence
  chemically synthesized
caaaagaaaaaattgtctgaga

SEQ ID NO: 1289547 - DNA, 22 bp, Artificial Sequence
  chemically synthesized
ttcaaaagaaaaaattgtctga

SEQ ID NO: 1289548 - DNA, 22 bp, Artificial Sequence
  chemically synthesized
tcttcaaaagaaaaaattgtct

SEQ ID NO: 1289549 - DNA, 22 bp, Artificial Sequence
  chemically synthesized
ctcttcaaaagaaaaaattgtc

SEQ ID NO: 1289550 - DNA, 22 bp, Artificial Sequence
  chemically synthesized
tctcttcaaaagaaaaaattgt

SEQ ID NO: 1289551 - DNA, 22 bp, Artificial Sequence
  chemically synthesized
agagttctcagacaattttttc

SEQ ID NO: 1289552 - DNA, 22 bp, Artificial Sequence
  chemically synthesized
tcagacaattttttcttttgaa

SEQ ID NO: 1289553 - DNA, 22 bp, Artificial Sequence
  chemically synthesized
agacaattttttcttttgaaga

SEQ ID NO: 1289554 - DNA, 22 bp, Artificial Sequence
  chemically synthesized
tttcttttgaagagaaaatgtg

SEQ ID NO: 1289555 - DNA, 22 bp, Artificial Sequence
  chemically synthesized
ttcttttgaagagaaaatgtgg

SEQ ID NO: 1289556 - DNA, 22 bp, Artificial Sequence
  chemically synthesized
taaagaaaccacccacattttc

SEQ ID NO: 1289557 - DNA, 22 bp, Artificial Sequence
  chemically synthesized
tcttttgaagagaaaatgtggg

SEQ ID NO: 1289558 - DNA, 22 bp, Artificial Sequence
  chemically synthesized
cttttgaagagaaaatgtgggt

SEQ ID NO: 1289559 - DNA, 22 bp, Artificial Sequence
  chemically synthesized
ttttgaagagaaaatgtgggtg

SEQ ID NO: 1289560 - DNA, 22 bp, Artificial Sequence
  chemically synthesized
ttgaagagaaaatgtgggtggt

SEQ ID NO: 1289561 - DNA, 22 bp, Artificial Sequence
  chemically synthesized
tgaagagaaaatgtgggtggtt

SEQ ID NO: 1289562 - DNA, 22 bp, Artificial Sequence
  chemically synthesized
gaagagaaaatgtgggtggttt

SEQ ID NO: 1289563 - DNA, 22 bp, Artificial Sequence
  chemically synthesized
aagagaaaatgtgggtggtttc

SEQ ID NO: 1289564 - DNA, 22 bp, Artificial Sequence
  chemically synthesized
ataataatacacaaaacaaaaa

SEQ ID NO: 1289565 - DNA, 22 bp, Artificial Sequence
  chemically synthesized
ctttacaacttttttgttttgt

SEQ ID NO: 1289566 - DNA, 22 bp, Artificial Sequence
  chemically synthesized
tttacaacttttttgttttgtg

SEQ ID NO: 1289567 - DNA, 22 bp, Artificial Sequence
  chemically synthesized
tacaacttttttgttttgtgta

SEQ ID NO: 1289568 - DNA, 22 bp, Artificial Sequence
  chemically synthesized
acaacttttttgttttgtgtat

SEQ ID NO: 1289569 - DNA, 22 bp, Artificial Sequence
  chemically synthesized
caacttttttgttttgtgtatt

SEQ ID NO: 1289570 - DNA, 22 bp, Artificial Sequence
  chemically synthesized
gacagtgtctaataataataca

SEQ ID NO: 1289571 - DNA, 22 bp, Artificial Sequence
  chemically synthesized
ttttgttttgtgtattattatt

SEQ ID NO: 1289572 - DNA, 22 bp, Artificial Sequence
  chemically synthesized
tttgttttgtgtattattatta

SEQ ID NO: 1289573 - DNA, 22 bp, Artificial Sequence
  chemically synthesized
ttgttttgtgtattattattag

SEQ ID NO: 1289574 - DNA, 22 bp, Artificial Sequence
  chemically synthesized
tgttttgtgtattattattaga

SEQ ID NO: 1289575 - DNA, 22 bp, Artificial Sequence
  chemically synthesized
gttttgtgtattattattagac

SEQ ID NO: 1289576 - DNA, 22 bp, Artificial Sequence
  chemically synthesized
ttttgtgtattattattagaca

SEQ ID NO: 1289577 - DNA, 22 bp, Artificial Sequence
  chemically synthesized
tgtgtattattattagacactg

SEQ ID NO: 1289578 - DNA, 22 bp, Artificial Sequence
  chemically synthesized
tgtaacattagacagtgtctaa

SEQ ID NO: 1289579 - DNA, 22 bp, Artificial Sequence
  chemically synthesized
gtgtattattattagacactgt

SEQ ID NO: 1289580 - DNA, 22 bp, Artificial Sequence
  chemically synthesized
tgtattattattagacactgtc

SEQ ID NO: 1289581 - DNA, 22 bp, Artificial Sequence
  chemically synthesized
tatgtaacattagacagtgtct

SEQ ID NO: 1289582 - DNA, 22 bp, Artificial Sequence
  chemically synthesized
ctatgtaacattagacagtgtc

SEQ ID NO: 1289583 - DNA, 22 bp, Artificial Sequence
  chemically synthesized
tctatgtaacattagacagtgt

SEQ ID NO: 1289584 - DNA, 22 bp, Artificial Sequence
  chemically synthesized
ttctatgtaacattagacagtg

SEQ ID NO: 1289585 - DNA, 22 bp, Artificial Sequence
  chemically synthesized
ttttctatgtaacattagacag

SEQ ID NO: 1289586 - DNA, 22 bp, Artificial Sequence
  chemically synthesized
ttattagacactgtctaatgtt

SEQ ID NO: 1289587 - DNA, 22 bp, Artificial Sequence
  chemically synthesized
ttagacactgtctaatgttaca

SEQ ID NO: 1289588 - DNA, 22 bp, Artificial Sequence
  chemically synthesized
gacactgtctaatgttacatag

SEQ ID NO: 1289589 - DNA, 22 bp, Artificial Sequence
  chemically synthesized
aaccaattcttttctatgtaac

SEQ ID NO: 1289590 - DNA, 22 bp, Artificial Sequence
  chemically synthesized
caaccaattcttttctatgtaa

SEQ ID NO: 1289591 - DNA, 22 bp, Artificial Sequence
  chemically synthesized
tcttcaaccaattcttttctat

SEQ ID NO: 1289592 - DNA, 22 bp, Artificial Sequence
  chemically synthesized
tctaatgttacatagaaaagaa

SEQ ID NO: 1289593 - DNA, 22 bp, Artificial Sequence
  chemically synthesized
gtcttcaaccaattcttttcta

SEQ ID NO: 1289594 - DNA, 22 bp, Artificial Sequence
  chemically synthesized
ttgtcttcaaccaattcttttc

SEQ ID NO: 1289595 - DNA, 22 bp, Artificial Sequence
  chemically synthesized
cttgtcttcaaccaattctttt

SEQ ID NO: 1289596 - DNA, 22 bp, Artificial Sequence
  chemically synthesized
atgttacatagaaaagaattgg

SEQ ID NO: 1289597 - DNA, 22 bp, Artificial Sequence
  chemically synthesized
tcttgtcttcaaccaattcttt

SEQ ID NO: 1289598 - DNA, 22 bp, Artificial Sequence
  chemically synthesized
tctttcttgtcttcaaccaatt

SEQ ID NO: 1289599 - DNA, 22 bp, Artificial Sequence
  chemically synthesized
catagaaaagaattggttgaag

SEQ ID NO: 1289600 - DNA, 22 bp, Artificial Sequence
  chemically synthesized
gacgctgtctttcttgtcttca

SEQ ID NO: 1289601 - DNA, 22 bp, Artificial Sequence
  chemically synthesized
ttagacgctgtctttcttgtct

SEQ ID NO: 1289602 - DNA, 22 bp, Artificial Sequence
  chemically synthesized
tgttagacgctgtctttcttgt

SEQ ID NO: 1289603 - DNA, 22 bp, Artificial Sequence
  chemically synthesized
gttgaagacaagaaagacagcg

SEQ ID NO: 1289604 - DNA, 22 bp, Artificial Sequence
  chemically synthesized
tattctgttagacgctgtcttt

SEQ ID NO: 1289605 - DNA, 22 bp, Artificial Sequence
  chemically synthesized
atattctgttagacgctgtctt

SEQ ID NO: 1289606 - DNA, 22 bp, Artificial Sequence
  chemically synthesized
tatattctgttagacgctgtct

SEQ ID NO: 1289607 - DNA, 22 bp, Artificial Sequence
  chemically synthesized
aagacaagaaagacagcgtcta

SEQ ID NO: 1289608 - DNA, 22 bp, Artificial Sequence
  chemically synthesized
ttttatattctgttagacgctg

SEQ ID NO: 1289609 - DNA, 22 bp, Artificial Sequence
  chemically synthesized
attttatattctgttagacgct

SEQ ID NO: 1289610 - DNA, 22 bp, Artificial Sequence
  chemically synthesized
tattttatattctgttagacgc

SEQ ID NO: 1289611 - DNA, 22 bp, Artificial Sequence
  chemically synthesized
tttattttatattctgttagac

SEQ ID NO: 1289612 - DNA, 22 bp, Artificial Sequence
  chemically synthesized
ctttattttatattctgttaga

SEQ ID NO: 1289613 - DNA, 22 bp, Artificial Sequence
  chemically synthesized
tctttattttatattctgttag

SEQ ID NO: 1289614 - DNA, 22 bp, Artificial Sequence
  chemically synthesized
ttctttattttatattctgtta

SEQ ID NO: 1289615 - DNA, 22 bp, Artificial Sequence
  chemically synthesized
tttttctttattttatattctg

SEQ ID NO: 1289616 - DNA, 22 bp, Artificial Sequence
  chemically synthesized
gtttttctttattttatattct

SEQ ID NO: 1289617 - DNA, 22 bp, Artificial Sequence
  chemically synthesized
tgtttttctttattttatattc

SEQ ID NO: 1289618 - DNA, 22 bp, Artificial Sequence
  chemically synthesized
gttttgtttttctttattttat

SEQ ID NO: 1289619 - DNA, 22 bp, Artificial Sequence
  chemically synthesized
ggttttgtttttctttatttta

SEQ ID NO: 1289620 - DNA, 22 bp, Artificial Sequence
  chemically synthesized
tggttttgtttttctttatttt

SEQ ID NO: 1289621 - DNA, 22 bp, Artificial Sequence
  chemically synthesized
acagaatataaaataaagaaaa

SEQ ID NO: 1289622 - DNA, 22 bp, Artificial Sequence
  chemically synthesized
aatgctttggttttgtttttct

SEQ ID NO: 1289623 - DNA, 22 bp, Artificial Sequence
  chemically synthesized
gaatgctttggttttgtttttc

SEQ ID NO: 1289624 - DNA, 22 bp, Artificial Sequence
  chemically synthesized
tttgaatgctttggttttgttt

SEQ ID NO: 1289625 - DNA, 22 bp, Artificial Sequence
  chemically synthesized
attatttgaatgctttggtttt

SEQ ID NO: 1289626 - DNA, 22 bp, Artificial Sequence
  chemically synthesized
atattaattatttgaatgcttt

SEQ ID NO: 1289627 - DNA, 22 bp, Artificial Sequence
  chemically synthesized
attcatattaattatttgaatg

SEQ ID NO: 1289628 - DNA, 22 bp, Artificial Sequence
  chemically synthesized
tcattcatattaattatttgaa

SEQ ID NO: 1289629 - DNA, 22 bp, Artificial Sequence
  chemically synthesized
ctcattcatattaattatttga

SEQ ID NO: 1289630 - DNA, 22 bp, Artificial Sequence
  chemically synthesized
tctcattcatattaattatttg

SEQ ID NO: 1289631 - DNA, 22 bp, Artificial Sequence
  chemically synthesized
aaataattaatatgaatgagaa

SEQ ID NO: 1289632 - DNA, 22 bp, Artificial Sequence
  chemically synthesized
atatgaatgagaaaggtatcat

SEQ ID NO: 1289633 - DNA, 22 bp, Artificial Sequence
  chemically synthesized
gccaaagtagaaacgaaaccaa

SEQ ID NO: 1289634 - DNA, 22 bp, Artificial Sequence
  chemically synthesized
tctagccaaagtagaaacgaaa

SEQ ID NO: 1289635 - DNA, 22 bp, Artificial Sequence
  chemically synthesized
aaactgtctagccaaagtagaa

SEQ ID NO: 1289636 - DNA, 22 bp, Artificial Sequence
  chemically synthesized
ggtttcgtttctactttggcta

SEQ ID NO: 1289637 - DNA, 22 bp, Artificial Sequence
  chemically synthesized
gtttcgtttctactttggctag

SEQ ID NO: 1289638 - DNA, 22 bp, Artificial Sequence
  chemically synthesized
cgtttctactttggctagacag

SEQ ID NO: 1289639 - DNA, 22 bp, Artificial Sequence
  chemically synthesized
gtttctactttggctagacagt

SEQ ID NO: 1289640 - DNA, 22 bp, Artificial Sequence
  chemically synthesized
ctactttggctagacagtttca

SEQ ID NO: 1289641 - DNA, 22 bp, Artificial Sequence
  chemically synthesized
tactttggctagacagtttcag

SEQ ID NO: 1289642 - DNA, 22 bp, Artificial Sequence
  chemically synthesized
ctttggctagacagtttcagta

SEQ ID NO: 1289643 - DNA, 22 bp, Artificial Sequence
  chemically synthesized
tggctagacagtttcagtactt

SEQ ID NO: 1289644 - DNA, 22 bp, Artificial Sequence
  chemically synthesized
ggctagacagtttcagtacttc

SEQ ID NO: 1289645 - DNA, 22 bp, Artificial Sequence
  chemically synthesized
tgagaaaagtcagaagtactga

SEQ ID NO: 1289646 - DNA, 22 bp, Artificial Sequence
  chemically synthesized
gctagacagtttcagtacttct

SEQ ID NO: 1289647 - DNA, 22 bp, Artificial Sequence
  chemically synthesized
atgagaaaagtcagaagtactg

SEQ ID NO: 1289648 - DNA, 22 bp, Artificial Sequence
  chemically synthesized
gacagtttcagtacttctgact

SEQ ID NO: 1289649 - DNA, 22 bp, Artificial Sequence
  chemically synthesized
cagtacttctgacttttctcat

SEQ ID NO: 1289650 - DNA, 22 bp, Artificial Sequence
  chemically synthesized
agtacttctgacttttctcata

SEQ ID NO: 1289651 - DNA, 22 bp, Artificial Sequence
  chemically synthesized
gaaaaaaagacttatgagaaaa

SEQ ID NO: 1289652 - DNA, 22 bp, Artificial Sequence
  chemically synthesized
ctgacttttctcataagtcttt

SEQ ID NO: 1289653 - DNA, 22 bp, Artificial Sequence
  chemically synthesized
tgacttttctcataagtctttt

SEQ ID NO: 1289654 - DNA, 22 bp, Artificial Sequence
  chemically synthesized
aaatattagaaaaaaagactta

SEQ ID NO: 1289655 - DNA, 22 bp, Artificial Sequence
  chemically synthesized
aaaatattagaaaaaaagactt

SEQ ID NO: 1289656 - DNA, 22 bp, Artificial Sequence
  chemically synthesized
acttttctcataagtctttttt

SEQ ID NO: 1289657 - DNA, 22 bp, Artificial Sequence
  chemically synthesized
ttctcataagtctttttttcta

SEQ ID NO: 1289658 - DNA, 22 bp, Artificial Sequence
  chemically synthesized
tctcataagtctttttttctaa

SEQ ID NO: 1289659 - DNA, 22 bp, Artificial Sequence
  chemically synthesized
ctcataagtctttttttctaat

SEQ ID NO: 1289660 - DNA, 22 bp, Artificial Sequence
  chemically synthesized
tcataagtctttttttctaata

SEQ ID NO: 1289661 - DNA, 22 bp, Artificial Sequence
  chemically synthesized
ataagtctttttttctaatatt

SEQ ID NO: 1289662 - DNA, 22 bp, Artificial Sequence
  chemically synthesized
tttttctaatattttaagcatt

SEQ ID NO: 1289663 - DNA, 22 bp, Artificial Sequence
  chemically synthesized
ttttctaatattttaagcattg

SEQ ID NO: 1289664 - DNA, 22 bp, Artificial Sequence
  chemically synthesized
tttctaatattttaagcattgt

SEQ ID NO: 1289665 - DNA, 22 bp, Artificial Sequence
  chemically synthesized
ttctaatattttaagcattgtt

SEQ ID NO: 1289666 - DNA, 22 bp, Artificial Sequence
  chemically synthesized
tctaatattttaagcattgttt

SEQ ID NO: 1289667 - DNA, 22 bp, Artificial Sequence
  chemically synthesized
ctaatattttaagcattgtttc

SEQ ID NO: 1289668 - DNA, 22 bp, Artificial Sequence
  chemically synthesized
taatattttaagcattgtttct

SEQ ID NO: 1289669 - DNA, 22 bp, Artificial Sequence
  chemically synthesized
atattttaagcattgtttctct

SEQ ID NO: 1289670 - DNA, 22 bp, Artificial Sequence
  chemically synthesized
agtaagataatgaagagaaaca

SEQ ID NO: 1289671 - DNA, 22 bp, Artificial Sequence
  chemically synthesized
taagcattgtttctcttcatta

SEQ ID NO: 1289672 - DNA, 22 bp, Artificial Sequence
  chemically synthesized
gattaagtaagataatgaagag

SEQ ID NO: 1289673 - DNA, 22 bp, Artificial Sequence
  chemically synthesized
aagcattgtttctcttcattat

SEQ ID NO: 1289674 - DNA, 22 bp, Artificial Sequence
  chemically synthesized
agattaagtaagataatgaaga

SEQ ID NO: 1289675 - DNA, 22 bp, Artificial Sequence
  chemically synthesized
agcattgtttctcttcattatc

SEQ ID NO: 1289676 - DNA, 22 bp, Artificial Sequence
  chemically synthesized
tagattaagtaagataatgaag

SEQ ID NO: 1289677 - DNA, 22 bp, Artificial Sequence
  chemically synthesized
ttttagattaagtaagataatg

SEQ ID NO: 1289678 - DNA, 22 bp, Artificial Sequence
  chemically synthesized
tttctcttcattatcttactta

SEQ ID NO: 1289679 - DNA, 22 bp, Artificial Sequence
  chemically synthesized
ctcttcattatcttacttaatc

SEQ ID NO: 1289680 - DNA, 22 bp, Artificial Sequence
  chemically synthesized
tcttcattatcttacttaatct

SEQ ID NO: 1289681 - DNA, 22 bp, Artificial Sequence
  chemically synthesized
agggaactgttttagattaagt

SEQ ID NO: 1289682 - DNA, 22 bp, Artificial Sequence
  chemically synthesized
ttcattatcttacttaatctaa

SEQ ID NO: 1289683 - DNA, 22 bp, Artificial Sequence
  chemically synthesized
gagggaactgttttagattaag

SEQ ID NO: 1289684 - DNA, 22 bp, Artificial Sequence
  chemically synthesized
tgagggaactgttttagattaa

SEQ ID NO: 1289685 - DNA, 22 bp, Artificial Sequence
  chemically synthesized
cattatcttacttaatctaaaa

SEQ ID NO: 1289686 - DNA, 22 bp, Artificial Sequence
  chemically synthesized
attatcttacttaatctaaaac

SEQ ID NO: 1289687 - DNA, 22 bp, Artificial Sequence
  chemically synthesized
tcttacttaatctaaaacagtt

SEQ ID NO: 1289688 - DNA, 22 bp, Artificial Sequence
  chemically synthesized
aaaaggttttgagggaactgtt

SEQ ID NO: 1289689 - DNA, 22 bp, Artificial Sequence
  chemically synthesized
acttaatctaaaacagttccct

SEQ ID NO: 1289690 - DNA, 22 bp, Artificial Sequence
  chemically synthesized
cttaatctaaaacagttccctc

SEQ ID NO: 1289691 - DNA, 22 bp, Artificial Sequence
  chemically synthesized
aatctaaaacagttccctcaaa

SEQ ID NO: 1289692 - DNA, 22 bp, Artificial Sequence
  chemically synthesized
atctaaaacagttccctcaaaa

SEQ ID NO: 1289693 - DNA, 22 bp, Artificial Sequence
  chemically synthesized
aaacagttccctcaaaaccttt

SEQ ID NO: 1289694 - DNA, 22 bp, Artificial Sequence
  chemically synthesized
aaagagaattaaaaaggttttg

SEQ ID NO: 1289695 - DNA, 22 bp, Artificial Sequence
  chemically synthesized
aaaagagaattaaaaaggtttt

SEQ ID NO: 1289696 - DNA, 22 bp, Artificial Sequence
  chemically synthesized
taaaagagaattaaaaaggttt

SEQ ID NO: 1289697 - DNA, 22 bp, Artificial Sequence
  chemically synthesized
cctcaaaacctttttaattctc

SEQ ID NO: 1289698 - DNA, 22 bp, Artificial Sequence
  chemically synthesized
aaaacctttttaattctctttt

SEQ ID NO: 1289699 - DNA, 22 bp, Artificial Sequence
  chemically synthesized
tttaattctcttttaaaatctc

SEQ ID NO: 1289700 - DNA, 22 bp, Artificial Sequence
  chemically synthesized
ttaattctcttttaaaatctct

SEQ ID NO: 1289701 - DNA, 22 bp, Artificial Sequence
  chemically synthesized
taattctcttttaaaatctcta

SEQ ID NO: 1289702 - DNA, 22 bp, Artificial Sequence
  chemically synthesized
aattctcttttaaaatctctac

SEQ ID NO: 1289703 - DNA, 22 bp, Artificial Sequence
  chemically synthesized
aaagatataaaagtagagattt

SEQ ID NO: 1289704 - DNA, 22 bp, Artificial Sequence
  chemically synthesized
attctcttttaaaatctctact

SEQ ID NO: 1289705 - DNA, 22 bp, Artificial Sequence
  chemically synthesized
aaaagatataaaagtagagatt

SEQ ID NO: 1289706 - DNA, 22 bp, Artificial Sequence
  chemically synthesized
taaaagatataaaagtagagat

SEQ ID NO: 1289707 - DNA, 22 bp, Artificial Sequence
  chemically synthesized
ttaaaagatataaaagtagaga

SEQ ID NO: 1289708 - DNA, 22 bp, Artificial Sequence
  chemically synthesized
tcttttaaaatctctactttta

SEQ ID NO: 1289709 - DNA, 22 bp, Artificial Sequence
  chemically synthesized
ttttaaaatctctacttttata

SEQ ID NO: 1289710 - DNA, 22 bp, Artificial Sequence
  chemically synthesized
tatttttaaaagatataaaagt

SEQ ID NO: 1289711 - DNA, 22 bp, Artificial Sequence
  chemically synthesized
ttaaaatctctacttttatatc

SEQ ID NO: 1289712 - DNA, 22 bp, Artificial Sequence
  chemically synthesized
taaaatctctacttttatatct

SEQ ID NO: 1289713 - DNA, 22 bp, Artificial Sequence
  chemically synthesized
aaaatctctacttttatatctt

SEQ ID NO: 1289714 - DNA, 22 bp, Artificial Sequence
  chemically synthesized
aaatctctacttttatatcttt

SEQ ID NO: 1289715 - DNA, 22 bp, Artificial Sequence
  chemically synthesized
atgcctatatttttaaaagata

SEQ ID NO: 1289716 - DNA, 22 bp, Artificial Sequence
  chemically synthesized
tacttttatatcttttaaaaat

SEQ ID NO: 1289717 - DNA, 22 bp, Artificial Sequence
  chemically synthesized
cttttatatcttttaaaaatat

SEQ ID NO: 1289718 - DNA, 22 bp, Artificial Sequence
  chemically synthesized
ttatatcttttaaaaatatagg

SEQ ID NO: 1289719 - DNA, 22 bp, Artificial Sequence
  chemically synthesized
tatatcttttaaaaatataggc

SEQ ID NO: 1289720 - DNA, 22 bp, Artificial Sequence
  chemically synthesized
atatcttttaaaaatataggca

SEQ ID NO: 1289721 - DNA, 22 bp, Artificial Sequence
  chemically synthesized
tatcttttaaaaatataggcat

SEQ ID NO: 1289722 - DNA, 22 bp, Artificial Sequence
  chemically synthesized
aagtataatgttgatgcctata

SEQ ID NO: 1289723 - DNA, 22 bp, Artificial Sequence
  chemically synthesized
ttaaaaatataggcatcaacat

SEQ ID NO: 1289724 - DNA, 22 bp, Artificial Sequence
  chemically synthesized
taaaaatataggcatcaacatt

SEQ ID NO: 1289725 - DNA, 22 bp, Artificial Sequence
  chemically synthesized
gtattaaagtataatgttgatg

SEQ ID NO: 1289726 - DNA, 22 bp, Artificial Sequence
  chemically synthesized
aaaaatataggcatcaacatta

SEQ ID NO: 1289727 - DNA, 22 bp, Artificial Sequence
  chemically synthesized
aaaatataggcatcaacattat

SEQ ID NO: 1289728 - DNA, 22 bp, Artificial Sequence
  chemically synthesized
ttagtattaaagtataatgttg

SEQ ID NO: 1289729 - DNA, 22 bp, Artificial Sequence
  chemically synthesized
gttagtattaaagtataatgtt

SEQ ID NO: 1289730 - DNA, 22 bp, Artificial Sequence
  chemically synthesized
tagtaaaatttgttagtattaa

SEQ ID NO: 1289731 - DNA, 22 bp, Artificial Sequence
  chemically synthesized
tatagtaaaatttgttagtatt

SEQ ID NO: 1289732 - DNA, 22 bp, Artificial Sequence
  chemically synthesized
ctatagtaaaatttgttagtat

SEQ ID NO: 1289733 - DNA, 22 bp, Artificial Sequence
  chemically synthesized
tctatagtaaaatttgttagta

SEQ ID NO: 1289734 - DNA, 22 bp, Artificial Sequence
  chemically synthesized
tactttaatactaacaaatttt

SEQ ID NO: 1289735 - DNA, 22 bp, Artificial Sequence
  chemically synthesized
acaattttctatagtaaaattt

SEQ ID NO: 1289736 - DNA, 22 bp, Artificial Sequence
  chemically synthesized
cacaattttctatagtaaaatt

SEQ ID NO: 1289737 - DNA, 22 bp, Artificial Sequence
  chemically synthesized
taatactaacaaattttactat

SEQ ID NO: 1289738 - DNA, 22 bp, Artificial Sequence
  chemically synthesized
tcacaattttctatagtaaaat

SEQ ID NO: 1289739 - DNA, 22 bp, Artificial Sequence
  chemically synthesized
aatactaacaaattttactata

SEQ ID NO: 1289740 - DNA, 22 bp, Artificial Sequence
  chemically synthesized
atactaacaaattttactatag

SEQ ID NO: 1289741 - DNA, 22 bp, Artificial Sequence
  chemically synthesized
tttcacaattttctatagtaaa

SEQ ID NO: 1289742 - DNA, 22 bp, Artificial Sequence
  chemically synthesized
gttctttcacaattttctatag

SEQ ID NO: 1289743 - DNA, 22 bp, Artificial Sequence
  chemically synthesized
ggttctttcacaattttctata

SEQ ID NO: 1289744 - DNA, 22 bp, Artificial Sequence
  chemically synthesized
acaaattttactatagaaaatt

SEQ ID NO: 1289745 - DNA, 22 bp, Artificial Sequence
  chemically synthesized
tggttctttcacaattttctat

SEQ ID NO: 1289746 - DNA, 22 bp, Artificial Sequence
  chemically synthesized
ttttggttctttcacaattttc

SEQ ID NO: 1289747 - DNA, 22 bp, Artificial Sequence
  chemically synthesized
ttgttttggttctttcacaatt

SEQ ID NO: 1289748 - DNA, 22 bp, Artificial Sequence
  chemically synthesized
tactatagaaaattgtgaaaga

SEQ ID NO: 1289749 - DNA, 22 bp, Artificial Sequence
  chemically synthesized
actatagaaaattgtgaaagaa

SEQ ID NO: 1289750 - DNA, 22 bp, Artificial Sequence
  chemically synthesized
ctatagaaaattgtgaaagaac

SEQ ID NO: 1289751 - DNA, 22 bp, Artificial Sequence
  chemically synthesized
tagaaaattgtgaaagaaccaa

SEQ ID NO: 1289752 - DNA, 22 bp, Artificial Sequence
  chemically synthesized
caacaagaggactgttgttttg

SEQ ID NO: 1289753 - DNA, 22 bp, Artificial Sequence
  chemically synthesized
tgaaagaaccaaaacaacagtc

SEQ ID NO: 1289754 - DNA, 22 bp, Artificial Sequence
  chemically synthesized
tggttacaacaagaggactgtt

SEQ ID NO: 1289755 - DNA, 22 bp, Artificial Sequence
  chemically synthesized
gtggttacaacaagaggactgt

SEQ ID NO: 1289756 - DNA, 22 bp, Artificial Sequence
  chemically synthesized
ttgtggttacaacaagaggact

SEQ ID NO: 1289757 - DNA, 22 bp, Artificial Sequence
  chemically synthesized
gtaagctcttgtggttacaaca

SEQ ID NO: 1289758 - DNA, 22 bp, Artificial Sequence
  chemically synthesized
ttgttgtaaccacaagagctta

SEQ ID NO: 1289759 - DNA, 22 bp, Artificial Sequence
  chemically synthesized
aaaatgaattagtaagctcttg

SEQ ID NO: 1289760 - DNA, 22 bp, Artificial Sequence
  chemically synthesized
aaaaatgaattagtaagctctt

SEQ ID NO: 1289761 - DNA, 22 bp, Artificial Sequence
  chemically synthesized
gttgtaaccacaagagcttact

SEQ ID NO: 1289762 - DNA, 22 bp, Artificial Sequence
  chemically synthesized
taaaaatgaattagtaagctct

SEQ ID NO: 1289763 - DNA, 22 bp, Artificial Sequence
  chemically synthesized
ttgtaaccacaagagcttacta

SEQ ID NO: 1289764 - DNA, 22 bp, Artificial Sequence
  chemically synthesized
ttaaaaatgaattagtaagctc

SEQ ID NO: 1289765 - DNA, 22 bp, Artificial Sequence
  chemically synthesized
ttttaaaaatgaattagtaagc

SEQ ID NO: 1289766 - DNA, 22 bp, Artificial Sequence
  chemically synthesized
taaccacaagagcttactaatt

SEQ ID NO: 1289767 - DNA, 22 bp, Artificial Sequence
  chemically synthesized
cttttaaaaatgaattagtaag

SEQ ID NO: 1289768 - DNA, 22 bp, Artificial Sequence
  chemically synthesized
actaattcatttttaaaagaaa

SEQ ID NO: 1289769 - DNA, 22 bp, Artificial Sequence
  chemically synthesized
ctaattcatttttaaaagaaat

SEQ ID NO: 1289770 - DNA, 22 bp, Artificial Sequence
  chemically synthesized
attcatttttaaaagaaattat

SEQ ID NO: 1289771 - DNA, 22 bp, Artificial Sequence
  chemically synthesized
atttttaaaagaaattatattg

SEQ ID NO: 1289772 - DNA, 22 bp, Artificial Sequence
  chemically synthesized
ttaaaagaaattatattgccta

SEQ ID NO: 1289773 - DNA, 22 bp, Artificial Sequence
  chemically synthesized
taaaagaaattatattgcctat

SEQ ID NO: 1289774 - DNA, 22 bp, Artificial Sequence
  chemically synthesized
aaaagaaattatattgcctatt

SEQ ID NO: 1289775 - DNA, 22 bp, Artificial Sequence
  chemically synthesized
aaagaaattatattgcctattc

SEQ ID NO: 1289776 - DNA, 22 bp, Artificial Sequence
  chemically synthesized
tattgcctattcattccccttt

SEQ ID NO: 1289777 - DNA, 22 bp, Artificial Sequence
  chemically synthesized
agcaagaaggtaaccaaaaggg

SEQ ID NO: 1289778 - DNA, 22 bp, Artificial Sequence
  chemically synthesized
cctattcattccccttttggtt

SEQ ID NO: 1289779 - DNA, 22 bp, Artificial Sequence
  chemically synthesized
gagcaagaaggtaaccaaaagg

SEQ ID NO: 1289780 - DNA, 22 bp, Artificial Sequence
  chemically synthesized
ttgagcaagaaggtaaccaaaa

SEQ ID NO: 1289781 - DNA, 22 bp, Artificial Sequence
  chemically synthesized
cttgagcaagaaggtaaccaaa

SEQ ID NO: 1289782 - DNA, 22 bp, Artificial Sequence
  chemically synthesized
ttcattccccttttggttacct

SEQ ID NO: 1289783 - DNA, 22 bp, Artificial Sequence
  chemically synthesized
cttcttgagcaagaaggtaacc

SEQ ID NO: 1289784 - DNA, 22 bp, Artificial Sequence
  chemically synthesized
attccccttttggttaccttct

SEQ ID NO: 1289785 - DNA, 22 bp, Artificial Sequence
  chemically synthesized
acttcttgagcaagaaggtaac

SEQ ID NO: 1289786 - DNA, 22 bp, Artificial Sequence
  chemically synthesized
cccttttggttaccttcttgct

SEQ ID NO: 1289787 - DNA, 22 bp, Artificial Sequence
  chemically synthesized
ttggttaccttcttgctcaaga

SEQ ID NO: 1289788 - DNA, 22 bp, Artificial Sequence
  chemically synthesized
tggttaccttcttgctcaagaa

SEQ ID NO: 1289789 - DNA, 22 bp, Artificial Sequence
  chemically synthesized
ggttaccttcttgctcaagaag

SEQ ID NO: 1289790 - DNA, 22 bp, Artificial Sequence
  chemically synthesized
caaagtaccttacttcttgagc

SEQ ID NO: 1289791 - DNA, 22 bp, Artificial Sequence
  chemically synthesized
gttaccttcttgctcaagaagt

SEQ ID NO: 1289792 - DNA, 22 bp, Artificial Sequence
  chemically synthesized
gcaaagtaccttacttcttgag

SEQ ID NO: 1289793 - DNA, 22 bp, Artificial Sequence
  chemically synthesized
ccttcttgctcaagaagtaagg

SEQ ID NO: 1289794 - DNA, 22 bp, Artificial Sequence
  chemically synthesized
cttgctcaagaagtaaggtact

SEQ ID NO: 1289795 - DNA, 22 bp, Artificial Sequence
  chemically synthesized
tgccatttgcaaagtaccttac

SEQ ID NO: 1289796 - DNA, 22 bp, Artificial Sequence
  chemically synthesized
ttgctcaagaagtaaggtactt

SEQ ID NO: 1289797 - DNA, 22 bp, Artificial Sequence
  chemically synthesized
gctcaagaagtaaggtactttg

SEQ ID NO: 1289798 - DNA, 22 bp, Artificial Sequence
  chemically synthesized
ctcaagaagtaaggtactttgc

SEQ ID NO: 1289799 - DNA, 22 bp, Artificial Sequence
  chemically synthesized
aagaagtaaggtactttgcaaa

SEQ ID NO: 1289800 - DNA, 22 bp, Artificial Sequence
  chemically synthesized
ggatcaactatgccatttgcaa

SEQ ID NO: 1289801 - DNA, 22 bp, Artificial Sequence
  chemically synthesized
ggtgctgggatcaactatgcca

SEQ ID NO: 1289802 - DNA, 22 bp, Artificial Sequence
  chemically synthesized
tgcaaatggcatagttgatccc

SEQ ID NO: 1289803 - DNA, 22 bp, Artificial Sequence
  chemically synthesized
gcaaatggcatagttgatccca

SEQ ID NO: 1289804 - DNA, 22 bp, Artificial Sequence
  chemically synthesized
caaatggcatagttgatcccag

SEQ ID NO: 1289805 - DNA, 22 bp, Artificial Sequence
  chemically synthesized
gagatgtatatatctaggtgct

SEQ ID NO: 1289806 - DNA, 22 bp, Artificial Sequence
  chemically synthesized
attagagatgtatatatctagg

SEQ ID NO: 1289807 - DNA, 22 bp, Artificial Sequence
  chemically synthesized
gattagagatgtatatatctag

SEQ ID NO: 1289808 - DNA, 22 bp, Artificial Sequence
  chemically synthesized
atcccagcacctagatatatac

SEQ ID NO: 1289809 - DNA, 22 bp, Artificial Sequence
  chemically synthesized
gatatatacatctctaatcaag

SEQ ID NO: 1289810 - DNA, 22 bp, Artificial Sequence
  chemically synthesized
aatagaaaaggcacttgattag

SEQ ID NO: 1289811 - DNA, 22 bp, Artificial Sequence
  chemically synthesized
tgaatagaaaaggcacttgatt

SEQ ID NO: 1289812 - DNA, 22 bp, Artificial Sequence
  chemically synthesized
ctgaatagaaaaggcacttgat

SEQ ID NO: 1289813 - DNA, 22 bp, Artificial Sequence
  chemically synthesized
ccttctgaatagaaaaggcact

SEQ ID NO: 1289814 - DNA, 22 bp, Artificial Sequence
  chemically synthesized
accttctgaatagaaaaggcac

SEQ ID NO: 1289815 - DNA, 22 bp, Artificial Sequence
  chemically synthesized
taccttctgaatagaaaaggca

SEQ ID NO: 1289816 - DNA, 22 bp, Artificial Sequence
  chemically synthesized
ttaccttctgaatagaaaaggc

SEQ ID NO: 1289817 - DNA, 22 bp, Artificial Sequence
  chemically synthesized
taatcaagtgccttttctattc

SEQ ID NO: 1289818 - DNA, 22 bp, Artificial Sequence
  chemically synthesized
atcaagtgccttttctattcag

SEQ ID NO: 1289819 - DNA, 22 bp, Artificial Sequence
  chemically synthesized
cacttttaccttctgaatagaa

SEQ ID NO: 1289820 - DNA, 22 bp, Artificial Sequence
  chemically synthesized
acctacacttttaccttctgaa

SEQ ID NO: 1289821 - DNA, 22 bp, Artificial Sequence
  chemically synthesized
ttctattcagaaggtaaaagtg

SEQ ID NO: 1289822 - DNA, 22 bp, Artificial Sequence
  chemically synthesized
ataattcacctacacttttacc

SEQ ID NO: 1289823 - DNA, 22 bp, Artificial Sequence
  chemically synthesized
tctattcagaaggtaaaagtgt

SEQ ID NO: 1289824 - DNA, 22 bp, Artificial Sequence
  chemically synthesized
ctattcagaaggtaaaagtgta

SEQ ID NO: 1289825 - DNA, 22 bp, Artificial Sequence
  chemically synthesized
tattcagaaggtaaaagtgtag

SEQ ID NO: 1289826 - DNA, 22 bp, Artificial Sequence
  chemically synthesized
ttcagaaggtaaaagtgtaggt

SEQ ID NO: 1289827 - DNA, 22 bp, Artificial Sequence
  chemically synthesized
ggctgataattcacctacactt

SEQ ID NO: 1289828 - DNA, 22 bp, Artificial Sequence
  chemically synthesized
agaaggtaaaagtgtaggtgaa

SEQ ID NO: 1289829 - DNA, 22 bp, Artificial Sequence
  chemically synthesized
tattgggctgataattcaccta

SEQ ID NO: 1289830 - DNA, 22 bp, Artificial Sequence
  chemically synthesized
ttatattgggctgataattcac

SEQ ID NO: 1289831 - DNA, 22 bp, Artificial Sequence
  chemically synthesized
attatattgggctgataattca

SEQ ID NO: 1289832 - DNA, 22 bp, Artificial Sequence
  chemically synthesized
ataagatcttattatattgggc

SEQ ID NO: 1289833 - DNA, 22 bp, Artificial Sequence
  chemically synthesized
tcagcccaatataataagatct

SEQ ID NO: 1289834 - DNA, 22 bp, Artificial Sequence
  chemically synthesized
gtgacacactgataagatctta

SEQ ID NO: 1289835 - DNA, 22 bp, Artificial Sequence
  chemically synthesized
cactagtgacacactgataaga

SEQ ID NO: 1289836 - DNA, 22 bp, Artificial Sequence
  chemically synthesized
ggcaccctccactagtgacaca

SEQ ID NO: 1289837 - DNA, 22 bp, Artificial Sequence
  chemically synthesized
atcagtgtgtcactagtggagg

SEQ ID NO: 1289838 - DNA, 22 bp, Artificial Sequence
  chemically synthesized
tcagtgtgtcactagtggaggg

SEQ ID NO: 1289839 - DNA, 22 bp, Artificial Sequence
  chemically synthesized
atcaagacaccaagaacctggg

SEQ ID NO: 1289840 - DNA, 22 bp, Artificial Sequence
  chemically synthesized
gatcaagacaccaagaacctgg

SEQ ID NO: 1289841 - DNA, 22 bp, Artificial Sequence
  chemically synthesized
gtggagggtgcccaggttcttg

SEQ ID NO: 1289842 - DNA, 22 bp, Artificial Sequence
  chemically synthesized
tgatcaagacaccaagaacctg

SEQ ID NO: 1289843 - DNA, 22 bp, Artificial Sequence
  chemically synthesized
tttgatcaagacaccaagaacc

SEQ ID NO: 1289844 - DNA, 22 bp, Artificial Sequence
  chemically synthesized
tccaattctttgatcaagacac

SEQ ID NO: 1289845 - DNA, 22 bp, Artificial Sequence
  chemically synthesized
gtccaattctttgatcaagaca

SEQ ID NO: 1289846 - DNA, 22 bp, Artificial Sequence
  chemically synthesized
tgtccaattctttgatcaagac

SEQ ID NO: 1289847 - DNA, 22 bp, Artificial Sequence
  chemically synthesized
ttggtgtcttgatcaaagaatt

SEQ ID NO: 1289848 - DNA, 22 bp, Artificial Sequence
  chemically synthesized
tgcattttgtccaattctttga

SEQ ID NO: 1289849 - DNA, 22 bp, Artificial Sequence
  chemically synthesized
gtgcattttgtccaattctttg

SEQ ID NO: 1289850 - DNA, 22 bp, Artificial Sequence
  chemically synthesized
ggtgtcttgatcaaagaattgg

SEQ ID NO: 1289851 - DNA, 22 bp, Artificial Sequence
  chemically synthesized
gtgtcttgatcaaagaattgga

SEQ ID NO: 1289852 - DNA, 22 bp, Artificial Sequence
  chemically synthesized
tttgtgcattttgtccaattct

SEQ ID NO: 1289853 - DNA, 22 bp, Artificial Sequence
  chemically synthesized
gtttgtgcattttgtccaattc

SEQ ID NO: 1289854 - DNA, 22 bp, Artificial Sequence
  chemically synthesized
tgtttgtgcattttgtccaatt

SEQ ID NO: 1289855 - DNA, 22 bp, Artificial Sequence
  chemically synthesized
ctttgtttgtgcattttgtcca

SEQ ID NO: 1289856 - DNA, 22 bp, Artificial Sequence
  chemically synthesized
gatcaaagaattggacaaaatg

SEQ ID NO: 1289857 - DNA, 22 bp, Artificial Sequence
  chemically synthesized
gctttgtttgtgcattttgtcc

SEQ ID NO: 1289858 - DNA, 22 bp, Artificial Sequence
  chemically synthesized
atcaaagaattggacaaaatgc

SEQ ID NO: 1289859 - DNA, 22 bp, Artificial Sequence
  chemically synthesized
cttgctttgtttgtgcattttg

SEQ ID NO: 1289860 - DNA, 22 bp, Artificial Sequence
  chemically synthesized
ccttgctttgtttgtgcatttt

SEQ ID NO: 1289861 - DNA, 22 bp, Artificial Sequence
  chemically synthesized
cttccttgctttgtttgtgcat

SEQ ID NO: 1289862 - DNA, 22 bp, Artificial Sequence
  chemically synthesized
attccttccttgctttgtttgt

SEQ ID NO: 1289863 - DNA, 22 bp, Artificial Sequence
  chemically synthesized
cattccttccttgctttgtttg

SEQ ID NO: 1289864 - DNA, 22 bp, Artificial Sequence
  chemically synthesized
gacaaaatgcacaaacaaagca

SEQ ID NO: 1289865 - DNA, 22 bp, Artificial Sequence
  chemically synthesized
aataaatcccttcattccttcc

SEQ ID NO: 1289866 - DNA, 22 bp, Artificial Sequence
  chemically synthesized
aaataaatcccttcattccttc

SEQ ID NO: 1289867 - DNA, 22 bp, Artificial Sequence
  chemically synthesized
taaataaatcccttcattcctt

SEQ ID NO: 1289868 - DNA, 22 bp, Artificial Sequence
  chemically synthesized
attttaaataaatcccttcatt

SEQ ID NO: 1289869 - DNA, 22 bp, Artificial Sequence
  chemically synthesized
cattttaaataaatcccttcat

SEQ ID NO: 1289870 - DNA, 22 bp, Artificial Sequence
  chemically synthesized
tcattttaaataaatcccttca

SEQ ID NO: 1289871 - DNA, 22 bp, Artificial Sequence
  chemically synthesized
ttcattttaaataaatcccttc

SEQ ID NO: 1289872 - DNA, 22 bp, Artificial Sequence
  chemically synthesized
tggcatgtacttttcattttaa

SEQ ID NO: 1289873 - DNA, 22 bp, Artificial Sequence
  chemically synthesized
acactatggcatgtacttttca

SEQ ID NO: 1289874 - DNA, 22 bp, Artificial Sequence
  chemically synthesized
tcacactatggcatgtactttt

SEQ ID NO: 1289875 - DNA, 22 bp, Artificial Sequence
  chemically synthesized
atttaaaatgaaaagtacatgc

SEQ ID NO: 1289876 - DNA, 22 bp, Artificial Sequence
  chemically synthesized
tttaaaatgaaaagtacatgcc

SEQ ID NO: 1289877 - DNA, 22 bp, Artificial Sequence
  chemically synthesized
aaaatgaaaagtacatgccata

SEQ ID NO: 1289878 - DNA, 22 bp, Artificial Sequence
  chemically synthesized
aaatgaaaagtacatgccatag

SEQ ID NO: 1289879 - DNA, 22 bp, Artificial Sequence
  chemically synthesized
agcccgctctcacactatggca

SEQ ID NO: 1289880 - DNA, 22 bp, Artificial Sequence
  chemically synthesized
ctcagcccgctctcacactatg

SEQ ID NO: 1289881 - DNA, 22 bp, Artificial Sequence
  chemically synthesized
agccgctgctcagcccgctctc

SEQ ID NO: 1289882 - DNA, 22 bp, Artificial Sequence
  chemically synthesized
gagccgctgctcagcccgctct

SEQ ID NO: 1289883 - DNA, 22 bp, Artificial Sequence
  chemically synthesized
ggcacttgagccgctgctcagc

SEQ ID NO: 1289884 - DNA, 22 bp, Artificial Sequence
  chemically synthesized
tctgggcacttgagccgctgct

SEQ ID NO: 1289885 - DNA, 22 bp, Artificial Sequence
  chemically synthesized
atctgggcacttgagccgctgc

SEQ ID NO: 1289886 - DNA, 22 bp, Artificial Sequence
  chemically synthesized
tatctgggcacttgagccgctg

SEQ ID NO: 1289887 - DNA, 22 bp, Artificial Sequence
  chemically synthesized
tttatctgggcacttgagccgc

SEQ ID NO: 1289888 - DNA, 22 bp, Artificial Sequence
  chemically synthesized
ctttatctgggcacttgagccg

SEQ ID NO: 1289889 - DNA, 22 bp, Artificial Sequence
  chemically synthesized
tctttatctgggcacttgagcc

SEQ ID NO: 1289890 - DNA, 22 bp, Artificial Sequence
  chemically synthesized
agcagcggctcaagtgcccaga

SEQ ID NO: 1289891 - DNA, 22 bp, Artificial Sequence
  chemically synthesized
gaccccagaagattttctttat

SEQ ID NO: 1289892 - DNA, 22 bp, Artificial Sequence
  chemically synthesized
ggaccccagaagattttcttta

SEQ ID NO: 1289893 - DNA, 22 bp, Artificial Sequence
  chemically synthesized
aagtgcccagataaagaaaatc

SEQ ID NO: 1289894 - DNA, 22 bp, Artificial Sequence
  chemically synthesized
tagagggtatttggaccccaga

SEQ ID NO: 1289895 - DNA, 22 bp, Artificial Sequence
  chemically synthesized
ctggggtccaaataccctctac

SEQ ID NO: 1289896 - DNA, 22 bp, Artificial Sequence
  chemically synthesized
tggggtccaaataccctctaca

SEQ ID NO: 1289897 - DNA, 22 bp, Artificial Sequence
  chemically synthesized
gggtccaaataccctctacagg

SEQ ID NO: 1289898 - DNA, 22 bp, Artificial Sequence
  chemically synthesized
tacaggtttcccattggccact

SEQ ID NO: 1289899 - DNA, 22 bp, Artificial Sequence
  chemically synthesized
caggtttcccattggccacttc

SEQ ID NO: 1289900 - DNA, 22 bp, Artificial Sequence
  chemically synthesized
cgtggggtgagcatgaagtggc

SEQ ID NO: 1289901 - DNA, 22 bp, Artificial Sequence
  chemically synthesized
acgtggggtgagcatgaagtgg

SEQ ID NO: 1289902 - DNA, 22 bp, Artificial Sequence
  chemically synthesized
cccattggccacttcatgctca

SEQ ID NO: 1289903 - DNA, 22 bp, Artificial Sequence
  chemically synthesized
atttacgtggggtgagcatgaa

SEQ ID NO: 1289904 - DNA, 22 bp, Artificial Sequence
  chemically synthesized
ccattggccacttcatgctcac

SEQ ID NO: 1289905 - DNA, 22 bp, Artificial Sequence
  chemically synthesized
catttacgtggggtgagcatga

SEQ ID NO: 1289906 - DNA, 22 bp, Artificial Sequence
  chemically synthesized
gccacttcatgctcaccccacg

SEQ ID NO: 1289907 - DNA, 22 bp, Artificial Sequence
  chemically synthesized
catgctcaccccacgtaaatga

SEQ ID NO: 1289908 - DNA, 22 bp, Artificial Sequence
  chemically synthesized
caggccaccacttcatttacgt

SEQ ID NO: 1289909 - DNA, 22 bp, Artificial Sequence
  chemically synthesized
atgctcaccccacgtaaatgaa

SEQ ID NO: 1289910 - DNA, 22 bp, Artificial Sequence
  chemically synthesized
accccacgtaaatgaagtggtg

SEQ ID NO: 1289911 - DNA, 22 bp, Artificial Sequence
  chemically synthesized
cacaaccaatcagaccaattgc

SEQ ID NO: 1289912 - DNA, 22 bp, Artificial Sequence
  chemically synthesized
ccacaaccaatcagaccaattg

SEQ ID NO: 1289913 - DNA, 22 bp, Artificial Sequence
  chemically synthesized
tccacaaccaatcagaccaatt

SEQ ID NO: 1289914 - DNA, 22 bp, Artificial Sequence
  chemically synthesized
ctttccacaaccaatcagacca

SEQ ID NO: 1289915 - DNA, 22 bp, Artificial Sequence
  chemically synthesized
gttgctttccacaaccaatcag

SEQ ID NO: 1289916 - DNA, 22 bp, Artificial Sequence
  chemically synthesized
caattggtctgattggttgtgg

SEQ ID NO: 1289917 - DNA, 22 bp, Artificial Sequence
  chemically synthesized
attggttgctttccacaaccaa

SEQ ID NO: 1289918 - DNA, 22 bp, Artificial Sequence
  chemically synthesized
tgattggttgctttccacaacc

SEQ ID NO: 1289919 - DNA, 22 bp, Artificial Sequence
  chemically synthesized
gtctgattggttgtggaaagca

SEQ ID NO: 1289920 - DNA, 22 bp, Artificial Sequence
  chemically synthesized
agcctctgattggttgctttcc

SEQ ID NO: 1289921 - DNA, 22 bp, Artificial Sequence
  chemically synthesized
cagcctctgattggttgctttc

SEQ ID NO: 1289922 - DNA, 22 bp, Artificial Sequence
  chemically synthesized
attggttgtggaaagcaaccaa

SEQ ID NO: 1289923 - DNA, 22 bp, Artificial Sequence
  chemically synthesized
cttcagcctctgattggttgct

SEQ ID NO: 1289924 - DNA, 22 bp, Artificial Sequence
  chemically synthesized
tacttcagcctctgattggttg

SEQ ID NO: 1289925 - DNA, 22 bp, Artificial Sequence
  chemically synthesized
gttgtggaaagcaaccaatcag

SEQ ID NO: 1289926 - DNA, 22 bp, Artificial Sequence
  chemically synthesized
tggaaagcaaccaatcagaggc

SEQ ID NO: 1289927 - DNA, 22 bp, Artificial Sequence
  chemically synthesized
tgtaactctacttcagcctctg

SEQ ID NO: 1289928 - DNA, 22 bp, Artificial Sequence
  chemically synthesized
cacaggagagtgtcctatgtaa

SEQ ID NO: 1289929 - DNA, 22 bp, Artificial Sequence
  chemically synthesized
gcacaggagagtgtcctatgta

SEQ ID NO: 1289930 - DNA, 22 bp, Artificial Sequence
  chemically synthesized
aagtagagttacataggacact

SEQ ID NO: 1289931 - DNA, 22 bp, Artificial Sequence
  chemically synthesized
cataggacactctcctgtgcaa

SEQ ID NO: 1289932 - DNA, 22 bp, Artificial Sequence
  chemically synthesized
caaccaatcagatgtttgcaca

SEQ ID NO: 1289933 - DNA, 22 bp, Artificial Sequence
  chemically synthesized
gcaaccaatcagatgtttgcac

SEQ ID NO: 1289934 - DNA, 22 bp, Artificial Sequence
  chemically synthesized
tgcaaccaatcagatgtttgca

SEQ ID NO: 1289935 - DNA, 22 bp, Artificial Sequence
  chemically synthesized
ttgcaaccaatcagatgtttgc

SEQ ID NO: 1289936 - DNA, 22 bp, Artificial Sequence
  chemically synthesized
tttgcaaccaatcagatgtttg

SEQ ID NO: 1289937 - DNA, 22 bp, Artificial Sequence
  chemically synthesized
ctttttgcaaccaatcagatgt

SEQ ID NO: 1289938 - DNA, 22 bp, Artificial Sequence
  chemically synthesized
tcctgtgcaaacatctgattgg

SEQ ID NO: 1289939 - DNA, 22 bp, Artificial Sequence
  chemically synthesized
ctgtgcaaacatctgattggtt

SEQ ID NO: 1289940 - DNA, 22 bp, Artificial Sequence
  chemically synthesized
gttgctttttgcaaccaatcag

SEQ ID NO: 1289941 - DNA, 22 bp, Artificial Sequence
  chemically synthesized
tgcaaacatctgattggttgca

SEQ ID NO: 1289942 - DNA, 22 bp, Artificial Sequence
  chemically synthesized
attggttgctttttgcaaccaa

SEQ ID NO: 1289943 - DNA, 22 bp, Artificial Sequence
  chemically synthesized
tgattggttgctttttgcaacc

SEQ ID NO: 1289944 - DNA, 22 bp, Artificial Sequence
  chemically synthesized
gcctctgattggttgctttttg

SEQ ID NO: 1289945 - DNA, 22 bp, Artificial Sequence
  chemically synthesized
agcctctgattggttgcttttt

SEQ ID NO: 1289946 - DNA, 22 bp, Artificial Sequence
  chemically synthesized
attggttgcaaaaagcaaccaa

SEQ ID NO: 1289947 - DNA, 22 bp, Artificial Sequence
  chemically synthesized
accttagcctctgattggttgc

SEQ ID NO: 1289948 - DNA, 22 bp, Artificial Sequence
  chemically synthesized
caccttagcctctgattggttg

SEQ ID NO: 1289949 - DNA, 22 bp, Artificial Sequence
  chemically synthesized
gttgcaaaaagcaaccaatcag

SEQ ID NO: 1289950 - DNA, 22 bp, Artificial Sequence
  chemically synthesized
caaaaagcaaccaatcagaggc

SEQ ID NO: 1289951 - DNA, 22 bp, Artificial Sequence
  chemically synthesized
taacttcaccttagcctctgat

SEQ ID NO: 1289952 - DNA, 22 bp, Artificial Sequence
  chemically synthesized
gtaacttcaccttagcctctga

SEQ ID NO: 1289953 - DNA, 22 bp, Artificial Sequence
  chemically synthesized
tgtaacttcaccttagcctctg

SEQ ID NO: 1289954 - DNA, 22 bp, Artificial Sequence
  chemically synthesized
cacagaagtgcaactttgtaac

SEQ ID NO: 1289955 - DNA, 22 bp, Artificial Sequence
  chemically synthesized
gcacagaagtgcaactttgtaa

SEQ ID NO: 1289956 - DNA, 22 bp, Artificial Sequence
  chemically synthesized
tgcacagaagtgcaactttgta

SEQ ID NO: 1289957 - DNA, 22 bp, Artificial Sequence
  chemically synthesized
aggtgaagttacaaagttgcac

SEQ ID NO: 1289958 - DNA, 22 bp, Artificial Sequence
  chemically synthesized
cgggcccagtctttgcacagaa

SEQ ID NO: 1289959 - DNA, 22 bp, Artificial Sequence
  chemically synthesized
caaagttgcacttctgtgcaaa

SEQ ID NO: 1289960 - DNA, 22 bp, Artificial Sequence
  chemically synthesized
attgcgggcccagtctttgcac

SEQ ID NO: 1289961 - DNA, 22 bp, Artificial Sequence
  chemically synthesized
cacttctgtgcaaagactgggc

SEQ ID NO: 1289962 - DNA, 22 bp, Artificial Sequence
  chemically synthesized
ctgtgcaaagactgggcccgca

SEQ ID NO: 1289963 - DNA, 22 bp, Artificial Sequence
  chemically synthesized
tgtgcaaagactgggcccgcaa

SEQ ID NO: 1289964 - DNA, 22 bp, Artificial Sequence
  chemically synthesized
tgcaaagactgggcccgcaatc

SEQ ID NO: 1289965 - DNA, 22 bp, Artificial Sequence
  chemically synthesized
ccaaccaatcagactgattgcg

SEQ ID NO: 1289966 - DNA, 22 bp, Artificial Sequence
  chemically synthesized
ttcccaaccaatcagactgatt

SEQ ID NO: 1289967 - DNA, 22 bp, Artificial Sequence
  chemically synthesized
gctgttcccaaccaatcagact

SEQ ID NO: 1289968 - DNA, 22 bp, Artificial Sequence
  chemically synthesized
ggcccgcaatcagtctgattgg

SEQ ID NO: 1289969 - DNA, 22 bp, Artificial Sequence
  chemically synthesized
attggttgggaacagccaattt

SEQ ID NO: 1289970 - DNA, 22 bp, Artificial Sequence
  chemically synthesized
tgtagcagatgggaaattggct

SEQ ID NO: 1289971 - DNA, 22 bp, Artificial Sequence
  chemically synthesized
tgtgtagcagatgggaaattgg

SEQ ID NO: 1289972 - DNA, 22 bp, Artificial Sequence
  chemically synthesized
gttgggaacagccaatttccca

SEQ ID NO: 1289973 - DNA, 22 bp, Artificial Sequence
  chemically synthesized
ctgtgtagcagatgggaaattg

SEQ ID NO: 1289974 - DNA, 22 bp, Artificial Sequence
  chemically synthesized
tctgtgtagcagatgggaaatt

SEQ ID NO: 1289975 - DNA, 22 bp, Artificial Sequence
  chemically synthesized
ttctgtgtagcagatgggaaat

SEQ ID NO: 1289976 - DNA, 22 bp, Artificial Sequence
  chemically synthesized
ggaacagccaatttcccatctg

SEQ ID NO: 1289977 - DNA, 22 bp, Artificial Sequence
  chemically synthesized
ccaccttttctgtgtagcagat

SEQ ID NO: 1289978 - DNA, 22 bp, Artificial Sequence
  chemically synthesized
caaacctcccaccttttctgtg

SEQ ID NO: 1289979 - DNA, 22 bp, Artificial Sequence
  chemically synthesized
cccatctgctacacagaaaagg

SEQ ID NO: 1289980 - DNA, 22 bp, Artificial Sequence
  chemically synthesized
gcaaacctcccaccttttctgt

SEQ ID NO: 1289981 - DNA, 22 bp, Artificial Sequence
  chemically synthesized
ccatctgctacacagaaaaggt

SEQ ID NO: 1289982 - DNA, 22 bp, Artificial Sequence
  chemically synthesized
tgcaaacctcccaccttttctg

SEQ ID NO: 1289983 - DNA, 22 bp, Artificial Sequence
  chemically synthesized
cctttgcaaacctcccaccttt

SEQ ID NO: 1289984 - DNA, 22 bp, Artificial Sequence
  chemically synthesized
ctacacagaaaaggtgggaggt

SEQ ID NO: 1289985 - DNA, 22 bp, Artificial Sequence
  chemically synthesized
ctccctttgcaaacctcccacc

SEQ ID NO: 1289986 - DNA, 22 bp, Artificial Sequence
  chemically synthesized
cacagaaaaggtgggaggtttg

SEQ ID NO: 1289987 - DNA, 22 bp, Artificial Sequence
  chemically synthesized
agtaacataaggaccagaggct

SEQ ID NO: 1289988 - DNA, 22 bp, Artificial Sequence
  chemically synthesized
gcaaagggagtagcctctggtc

SEQ ID NO: 1289989 - DNA, 22 bp, Artificial Sequence
  chemically synthesized
caaagggagtagcctctggtcc

SEQ ID NO: 1289990 - DNA, 22 bp, Artificial Sequence
  chemically synthesized
cacccctaagtaacataaggac

SEQ ID NO: 1289991 - DNA, 22 bp, Artificial Sequence
  chemically synthesized
ccacccctaagtaacataagga

SEQ ID NO: 1289992 - DNA, 22 bp, Artificial Sequence
  chemically synthesized
tccacccctaagtaacataagg

SEQ ID NO: 1289993 - DNA, 22 bp, Artificial Sequence
  chemically synthesized
actttccacccctaagtaacat

SEQ ID NO: 1289994 - DNA, 22 bp, Artificial Sequence
  chemically synthesized
tggtccttatgttacttagggg

SEQ ID NO: 1289995 - DNA, 22 bp, Artificial Sequence
  chemically synthesized
gtccttatgttacttaggggtg

SEQ ID NO: 1289996 - DNA, 22 bp, Artificial Sequence
  chemically synthesized
atgttacttaggggtggaaagt

SEQ ID NO: 1289997 - DNA, 22 bp, Artificial Sequence
  chemically synthesized
tgttacttaggggtggaaagtt

SEQ ID NO: 1289998 - DNA, 22 bp, Artificial Sequence
  chemically synthesized
aaggcaaaaccctaactttcca

SEQ ID NO: 1289999 - DNA, 22 bp, Artificial Sequence
  chemically synthesized
cttaggggtggaaagttagggt

SEQ ID NO: 1290000 - DNA, 22 bp, Artificial Sequence
  chemically synthesized
aactgaaggcaaaaccctaact

SEQ ID NO: 1290001 - DNA, 22 bp, Artificial Sequence
  chemically synthesized
aggggtggaaagttagggtttt

SEQ ID NO: 1290002 - DNA, 22 bp, Artificial Sequence
  chemically synthesized
ggggtggaaagttagggttttg

SEQ ID NO: 1290003 - DNA, 22 bp, Artificial Sequence
  chemically synthesized
ggactaaactgaaggcaaaacc

SEQ ID NO: 1290004 - DNA, 22 bp, Artificial Sequence
  chemically synthesized
cctaggactaaactgaaggcaa

SEQ ID NO: 1290005 - DNA, 22 bp, Artificial Sequence
  chemically synthesized
ccctaggactaaactgaaggca

SEQ ID NO: 1290006 - DNA, 22 bp, Artificial Sequence
  chemically synthesized
acttccctaggactaaactgaa

SEQ ID NO: 1290007 - DNA, 22 bp, Artificial Sequence
  chemically synthesized
gggttttgccttcagtttagtc

SEQ ID NO: 1290008 - DNA, 22 bp, Artificial Sequence
  chemically synthesized
acgctgacttccctaggactaa

SEQ ID NO: 1290009 - DNA, 22 bp, Artificial Sequence
  chemically synthesized
cacgctgacttccctaggacta

SEQ ID NO: 1290010 - DNA, 22 bp, Artificial Sequence
  chemically synthesized
tgccttcagtttagtcctaggg

SEQ ID NO: 1290011 - DNA, 22 bp, Artificial Sequence
  chemically synthesized
gccttcagtttagtcctaggga

SEQ ID NO: 1290012 - DNA, 22 bp, Artificial Sequence
  chemically synthesized
ccttcagtttagtcctagggaa

SEQ ID NO: 1290013 - DNA, 22 bp, Artificial Sequence
  chemically synthesized
cagtttagtcctagggaagtca

SEQ ID NO: 1290014 - DNA, 22 bp, Artificial Sequence
  chemically synthesized
agtttagtcctagggaagtcag

SEQ ID NO: 1290015 - DNA, 22 bp, Artificial Sequence
  chemically synthesized
aggccatttcacgctgacttcc

SEQ ID NO: 1290016 - DNA, 22 bp, Artificial Sequence
  chemically synthesized
agtcctagggaagtcagcgtga

SEQ ID NO: 1290017 - DNA, 22 bp, Artificial Sequence
  chemically synthesized
gtcctagggaagtcagcgtgaa

SEQ ID NO: 1290018 - DNA, 22 bp, Artificial Sequence
  chemically synthesized
gggaagtcagcgtgaaatggcc

SEQ ID NO: 1290019 - DNA, 22 bp, Artificial Sequence
  chemically synthesized
gaggaagggaacctaaggccat

SEQ ID NO: 1290020 - DNA, 22 bp, Artificial Sequence
  chemically synthesized
aggttcccttcctccagaccct

SEQ ID NO: 1290021 - DNA, 22 bp, Artificial Sequence
  chemically synthesized
aggcaggagaatagggtctgga

SEQ ID NO: 1290022 - DNA, 22 bp, Artificial Sequence
  chemically synthesized
ggttcccttcctccagacccta

SEQ ID NO: 1290023 - DNA, 22 bp, Artificial Sequence
  chemically synthesized
gaggcaggagaatagggtctgg

SEQ ID NO: 1290024 - DNA, 22 bp, Artificial Sequence
  chemically synthesized
ccttcctccagaccctattctc

SEQ ID NO: 1290025 - DNA, 22 bp, Artificial Sequence
  chemically synthesized
cctccagaccctattctcctgc

SEQ ID NO: 1290026 - DNA, 22 bp, Artificial Sequence
  chemically synthesized
ctccagaccctattctcctgcc

SEQ ID NO: 1290027 - DNA, 22 bp, Artificial Sequence
  chemically synthesized
cagaccctattctcctgcctca

SEQ ID NO: 1290028 - DNA, 22 bp, Artificial Sequence
  chemically synthesized
ttctcctgcctcaaatgtgtga

SEQ ID NO: 1290029 - DNA, 22 bp, Artificial Sequence
  chemically synthesized
gagaaaaaaatatcacacattt

SEQ ID NO: 1290030 - DNA, 22 bp, Artificial Sequence
  chemically synthesized
cgagaaaaaaatatcacacatt

SEQ ID NO: 1290031 - DNA, 22 bp, Artificial Sequence
  chemically synthesized
tcgagaaaaaaatatcacacat

SEQ ID NO: 1290032 - DNA, 22 bp, Artificial Sequence
  chemically synthesized
tcctgcctcaaatgtgtgatat

SEQ ID NO: 1290033 - DNA, 22 bp, Artificial Sequence
  chemically synthesized
ttcgagaaaaaaatatcacaca

SEQ ID NO: 1290034 - DNA, 22 bp, Artificial Sequence
  chemically synthesized
tttcgagaaaaaaatatcacac

SEQ ID NO: 1290035 - DNA, 22 bp, Artificial Sequence
  chemically synthesized
ctgcctcaaatgtgtgatattt

SEQ ID NO: 1290036 - DNA, 22 bp, Artificial Sequence
  chemically synthesized
ttttcgagaaaaaaatatcaca

SEQ ID NO: 1290037 - DNA, 22 bp, Artificial Sequence
  chemically synthesized
tttttcgagaaaaaaatatcac

SEQ ID NO: 1290038 - DNA, 22 bp, Artificial Sequence
  chemically synthesized
ttttttcgagaaaaaaatatca

SEQ ID NO: 1290039 - DNA, 22 bp, Artificial Sequence
  chemically synthesized
cctcaaatgtgtgatatttttt

SEQ ID NO: 1290040 - DNA, 22 bp, Artificial Sequence
  chemically synthesized
tttttttcgagaaaaaaatatc

SEQ ID NO: 1290041 - DNA, 22 bp, Artificial Sequence
  chemically synthesized
ttttttttcgagaaaaaaatat

SEQ ID NO: 1290042 - DNA, 22 bp, Artificial Sequence
  chemically synthesized
tttttttttcgagaaaaaaata

SEQ ID NO: 1290043 - DNA, 22 bp, Artificial Sequence
  chemically synthesized
ttttttttttcgagaaaaaaat

SEQ ID NO: 1290044 - DNA, 22 bp, Artificial Sequence
  chemically synthesized
aaatgtgtgatatttttttctc

SEQ ID NO: 1290045 - DNA, 22 bp, Artificial Sequence
  chemically synthesized
tttttttttttcgagaaaaaaa

SEQ ID NO: 1290046 - DNA, 22 bp, Artificial Sequence
  chemically synthesized
ttttttttttttcgagaaaaaa

SEQ ID NO: 1290047 - DNA, 22 bp, Artificial Sequence
  chemically synthesized
tttttttttttttcgagaaaaa

SEQ ID NO: 1290048 - DNA, 22 bp, Artificial Sequence
  chemically synthesized
ttttttttttttttcgagaaaa

SEQ ID NO: 1290049 - DNA, 22 bp, Artificial Sequence
  chemically synthesized
tttttttttttttttcgagaaa

SEQ ID NO: 1290050 - DNA, 22 bp, Artificial Sequence
  chemically synthesized
ttttttttttttttttcgagaa

SEQ ID NO: 1290051 - DNA, 22 bp, Artificial Sequence
  chemically synthesized
tttttttttttttttttcgaga

SEQ ID NO: 1290052 - DNA, 22 bp, Artificial Sequence
  chemically synthesized
ttttttttttttttttttcgag

SEQ ID NO: 1290053 - DNA, 22 bp, Artificial Sequence
  chemically synthesized
tttttttttttttttttttcga

SEQ ID NO: 1290054 - DNA, 22 bp, Artificial Sequence
  chemically synthesized
ttttttttttttttttttttcg

SEQ ID NO: 1290055 - DNA, 22 bp, Artificial Sequence
  chemically synthesized
tttttttttttttttttttttc

SEQ ID NO: 1290056 - DNA, 22 bp, Artificial Sequence
  chemically synthesized
tttttttttttttttttttttt

SEQ ID NO: 1290057 - DNA, 22 bp, Artificial Sequence
  chemically synthesized
tttttttttttttttttttttt

SEQ ID NO: 1290058 - DNA, 22 bp, Artificial Sequence
  chemically synthesized
tttttttttttttttttttttt

SEQ ID NO: 1290059 - DNA, 22 bp, Artificial Sequence
  chemically synthesized
ttttctcgaaaaaaaaaaaaaa

SEQ ID NO: 1290060 - DNA, 22 bp, Artificial Sequence
  chemically synthesized
cttttttttttttttttttttt

SEQ ID NO: 1290061 - DNA, 22 bp, Artificial Sequence
  chemically synthesized
tttctcgaaaaaaaaaaaaaaa

SEQ ID NO: 1290062 - DNA, 22 bp, Artificial Sequence
  chemically synthesized
ttctcgaaaaaaaaaaaaaaaa

SEQ ID NO: 1290063 - DNA, 22 bp, Artificial Sequence
  chemically synthesized
ttcttttttttttttttttttt

SEQ ID NO: 1290064 - DNA, 22 bp, Artificial Sequence
  chemically synthesized
tctcgaaaaaaaaaaaaaaaaa

SEQ ID NO: 1290065 - DNA, 22 bp, Artificial Sequence
  chemically synthesized
cttctttttttttttttttttt

SEQ ID NO: 1290066 - DNA, 22 bp, Artificial Sequence
  chemically synthesized
ctcgaaaaaaaaaaaaaaaaaa

SEQ ID NO: 1290067 - DNA, 22 bp, Artificial Sequence
  chemically synthesized
tcgaaaaaaaaaaaaaaaaaaa

SEQ ID NO: 1290068 - DNA, 22 bp, Artificial Sequence
  chemically synthesized
ttcttctttttttttttttttt

SEQ ID NO: 1290069 - DNA, 22 bp, Artificial Sequence
  chemically synthesized
cttcttcttttttttttttttt

SEQ ID NO: 1290070 - DNA, 22 bp, Artificial Sequence
  chemically synthesized
gaaaaaaaaaaaaaaaaaaaaa

SEQ ID NO: 1290071 - DNA, 22 bp, Artificial Sequence
  chemically synthesized
tcttcttctttttttttttttt

SEQ ID NO: 1290072 - DNA, 22 bp, Artificial Sequence
  chemically synthesized
ttcttcttcttttttttttttt

SEQ ID NO: 1290073 - DNA, 22 bp, Artificial Sequence
  chemically synthesized
tttcttcttctttttttttttt

SEQ ID NO: 1290074 - DNA, 22 bp, Artificial Sequence
  chemically synthesized
ttttcttcttcttttttttttt

SEQ ID NO: 1290075 - DNA, 22 bp, Artificial Sequence
  chemically synthesized
ttttttcttcttcttttttttt

SEQ ID NO: 1290076 - DNA, 22 bp, Artificial Sequence
  chemically synthesized
cttttttcttcttctttttttt

SEQ ID NO: 1290077 - DNA, 22 bp, Artificial Sequence
  chemically synthesized
tcttttttcttcttcttttttt

SEQ ID NO: 1290078 - DNA, 22 bp, Artificial Sequence
  chemically synthesized
ttcttttttcttcttctttttt

SEQ ID NO: 1290079 - DNA, 22 bp, Artificial Sequence
  chemically synthesized
tttcttttttcttcttcttttt

SEQ ID NO: 1290080 - DNA, 22 bp, Artificial Sequence
  chemically synthesized
ttttcttttttcttcttctttt

SEQ ID NO: 1290081 - DNA, 22 bp, Artificial Sequence
  chemically synthesized
ttttttcttttttcttcttctt

SEQ ID NO: 1290082 - DNA, 22 bp, Artificial Sequence
  chemically synthesized
cttttttcttttttcttcttct

SEQ ID NO: 1290083 - DNA, 22 bp, Artificial Sequence
  chemically synthesized
tcttttttcttttttcttcttc

SEQ ID NO: 1290084 - DNA, 22 bp, Artificial Sequence
  chemically synthesized
ttcttttttcttttttcttctt

SEQ ID NO: 1290085 - DNA, 22 bp, Artificial Sequence
  chemically synthesized
tttcttttttcttttttcttct

SEQ ID NO: 1290086 - DNA, 22 bp, Artificial Sequence
  chemically synthesized
tttttcttttttcttttttctt

SEQ ID NO: 1290087 - DNA, 22 bp, Artificial Sequence
  chemically synthesized
ctttttcttttttcttttttct

SEQ ID NO: 1290088 - DNA, 22 bp, Artificial Sequence
  chemically synthesized
tctttttcttttttcttttttc

SEQ ID NO: 1290089 - DNA, 22 bp, Artificial Sequence
  chemically synthesized
ttctttttcttttttctttttt

SEQ ID NO: 1290090 - DNA, 22 bp, Artificial Sequence
  chemically synthesized
tttctttttcttttttcttttt

SEQ ID NO: 1290091 - DNA, 22 bp, Artificial Sequence
  chemically synthesized
aggaattttttctttttctttt

SEQ ID NO: 1290092 - DNA, 22 bp, Artificial Sequence
  chemically synthesized
gtgcagaggtccctgaggaatt

SEQ ID NO: 1290093 - DNA, 22 bp, Artificial Sequence
  chemically synthesized
gcacacctggtgcagaggtccc

SEQ ID NO: 1290094 - DNA, 22 bp, Artificial Sequence
  chemically synthesized
agcacacctggtgcagaggtcc

SEQ ID NO: 1290095 - DNA, 22 bp, Artificial Sequence
  chemically synthesized
tagcacacctggtgcagaggtc

SEQ ID NO: 1290096 - DNA, 22 bp, Artificial Sequence
  chemically synthesized
ttttagcacacctggtgcagag

SEQ ID NO: 1290097 - DNA, 22 bp, Artificial Sequence
  chemically synthesized
tgttttagcacacctggtgcag

SEQ ID NO: 1290098 - DNA, 22 bp, Artificial Sequence
  chemically synthesized
ctcagggacctctgcaccaggt

SEQ ID NO: 1290099 - DNA, 22 bp, Artificial Sequence
  chemically synthesized
ctctgttttagcacacctggtg

SEQ ID NO: 1290100 - DNA, 22 bp, Artificial Sequence
  chemically synthesized
agggacctctgcaccaggtgtg

SEQ ID NO: 1290101 - DNA, 22 bp, Artificial Sequence
  chemically synthesized
atgtgttgctctgttttagcac

SEQ ID NO: 1290102 - DNA, 22 bp, Artificial Sequence
  chemically synthesized
catgtgttgctctgttttagca

SEQ ID NO: 1290103 - DNA, 22 bp, Artificial Sequence
  chemically synthesized
tgcaccaggtgtgctaaaacag

SEQ ID NO: 1290104 - DNA, 22 bp, Artificial Sequence
  chemically synthesized
tcatgtgttgctctgttttagc

SEQ ID NO: 1290105 - DNA, 22 bp, Artificial Sequence
  chemically synthesized
caccaggtgtgctaaaacagag

SEQ ID NO: 1290106 - DNA, 22 bp, Artificial Sequence
  chemically synthesized
aaacagagcaacacatgaaaat

SEQ ID NO: 1290107 - DNA, 22 bp, Artificial Sequence
  chemically synthesized
ggaaaaggaagtacattttcat

SEQ ID NO: 1290108 - DNA, 22 bp, Artificial Sequence
  chemically synthesized
aaaaattaggaaaaggaagtac

SEQ ID NO: 1290109 - DNA, 22 bp, Artificial Sequence
  chemically synthesized
gaaaaattaggaaaaggaagta

SEQ ID NO: 1290110 - DNA, 22 bp, Artificial Sequence
  chemically synthesized
tgaaaaattaggaaaaggaagt

SEQ ID NO: 1290111 - DNA, 22 bp, Artificial Sequence
  chemically synthesized
aaattttgaaaaattaggaaaa

SEQ ID NO: 1290112 - DNA, 22 bp, Artificial Sequence
  chemically synthesized
aaaattttgaaaaattaggaaa

SEQ ID NO: 1290113 - DNA, 22 bp, Artificial Sequence
  chemically synthesized
ccttttcctaatttttcaaaat

SEQ ID NO: 1290114 - DNA, 22 bp, Artificial Sequence
  chemically synthesized
cttttcctaatttttcaaaatt

SEQ ID NO: 1290115 - DNA, 22 bp, Artificial Sequence
  chemically synthesized
ttcctaatttttcaaaatttta

SEQ ID NO: 1290116 - DNA, 22 bp, Artificial Sequence
  chemically synthesized
tcctaatttttcaaaattttaa

SEQ ID NO: 1290117 - DNA, 22 bp, Artificial Sequence
  chemically synthesized
aaataaaaaaatttaaaatttt

SEQ ID NO: 1290118 - DNA, 22 bp, Artificial Sequence
  chemically synthesized
cctaatttttcaaaattttaaa

SEQ ID NO: 1290119 - DNA, 22 bp, Artificial Sequence
  chemically synthesized
ctaatttttcaaaattttaaat

SEQ ID NO: 1290120 - DNA, 22 bp, Artificial Sequence
  chemically synthesized
atttttcaaaattttaaatttt

SEQ ID NO: 1290121 - DNA, 22 bp, Artificial Sequence
  chemically synthesized
ttcaaaattttaaattttttta

SEQ ID NO: 1290122 - DNA, 22 bp, Artificial Sequence
  chemically synthesized
tcaaaattttaaatttttttat

SEQ ID NO: 1290123 - DNA, 22 bp, Artificial Sequence
  chemically synthesized
caaaattttaaatttttttatt

SEQ ID NO: 1290124 - DNA, 22 bp, Artificial Sequence
  chemically synthesized
aaaattttaaatttttttattt

SEQ ID NO: 1290125 - DNA, 22 bp, Artificial Sequence
  chemically synthesized
ccccaaaagtattaaaataaaa

SEQ ID NO: 1290126 - DNA, 22 bp, Artificial Sequence
  chemically synthesized
ttcccccaaaagtattaaaata

SEQ ID NO: 1290127 - DNA, 22 bp, Artificial Sequence
  chemically synthesized
taaatttttttattttaatact

SEQ ID NO: 1290128 - DNA, 22 bp, Artificial Sequence
  chemically synthesized
aaatttttttattttaatactt

SEQ ID NO: 1290129 - DNA, 22 bp, Artificial Sequence
  chemically synthesized
aatttttttattttaatacttt

SEQ ID NO: 1290130 - DNA, 22 bp, Artificial Sequence
  chemically synthesized
ttttattttaatacttttgggg

SEQ ID NO: 1290131 - DNA, 22 bp, Artificial Sequence
  chemically synthesized
tttattttaatacttttggggg

SEQ ID NO: 1290132 - DNA, 22 bp, Artificial Sequence
  chemically synthesized
ttattttaatacttttggggga

SEQ ID NO: 1290133 - DNA, 22 bp, Artificial Sequence
  chemically synthesized
tattttaatacttttgggggaa

SEQ ID NO: 1290134 - DNA, 22 bp, Artificial Sequence
  chemically synthesized
attttaatacttttgggggaac

SEQ ID NO: 1290135 - DNA, 22 bp, Artificial Sequence
  chemically synthesized
ttttaatacttttgggggaaca

SEQ ID NO: 1290136 - DNA, 22 bp, Artificial Sequence
  chemically synthesized
taatacttttgggggaacaggt

SEQ ID NO: 1290137 - DNA, 22 bp, Artificial Sequence
  chemically synthesized
aatacttttgggggaacaggtg

SEQ ID NO: 1290138 - DNA, 22 bp, Artificial Sequence
  chemically synthesized
atacttttgggggaacaggtgg

SEQ ID NO: 1290139 - DNA, 22 bp, Artificial Sequence
  chemically synthesized
cccaggtaaccaaaaaccacct

SEQ ID NO: 1290140 - DNA, 22 bp, Artificial Sequence
  chemically synthesized
acccaggtaaccaaaaaccacc

SEQ ID NO: 1290141 - DNA, 22 bp, Artificial Sequence
  chemically synthesized
ttgggggaacaggtggtttttg

SEQ ID NO: 1290142 - DNA, 22 bp, Artificial Sequence
  chemically synthesized
tgggggaacaggtggtttttgg

SEQ ID NO: 1290143 - DNA, 22 bp, Artificial Sequence
  chemically synthesized
gggggaacaggtggtttttggt

SEQ ID NO: 1290144 - DNA, 22 bp, Artificial Sequence
  chemically synthesized
ggggaacaggtggtttttggtt

SEQ ID NO: 1290145 - DNA, 22 bp, Artificial Sequence
  chemically synthesized
aagaacttacccaggtaaccaa

SEQ ID NO: 1290146 - DNA, 22 bp, Artificial Sequence
  chemically synthesized
ttggttacctgggtaagttctt

SEQ ID NO: 1290147 - DNA, 22 bp, Artificial Sequence
  chemically synthesized
tggttacctgggtaagttcttt

SEQ ID NO: 1290148 - DNA, 22 bp, Artificial Sequence
  chemically synthesized
ggttacctgggtaagttcttta

SEQ ID NO: 1290149 - DNA, 22 bp, Artificial Sequence
  chemically synthesized
ggaaatcaccactaaagaactt

SEQ ID NO: 1290150 - DNA, 22 bp, Artificial Sequence
  chemically synthesized
gttacctgggtaagttctttag

SEQ ID NO: 1290151 - DNA, 22 bp, Artificial Sequence
  chemically synthesized
cctgggtaagttctttagtggt

SEQ ID NO: 1290152 - DNA, 22 bp, Artificial Sequence
  chemically synthesized
ggtaagttctttagtggtgatt

SEQ ID NO: 1290153 - DNA, 22 bp, Artificial Sequence
  chemically synthesized
tttagtggtgatttccgagatt

SEQ ID NO: 1290154 - DNA, 22 bp, Artificial Sequence
  chemically synthesized
tagtggtgatttccgagatttt

SEQ ID NO: 1290155 - DNA, 22 bp, Artificial Sequence
  chemically synthesized
agtggtgatttccgagattttg

SEQ ID NO: 1290156 - DNA, 22 bp, Artificial Sequence
  chemically synthesized
gtggtgatttccgagattttgg

SEQ ID NO: 1290157 - DNA, 22 bp, Artificial Sequence
  chemically synthesized
aggtgatgggtgcaccaaaatc

SEQ ID NO: 1290158 - DNA, 22 bp, Artificial Sequence
  chemically synthesized
tcaggtgatgggtgcaccaaaa

SEQ ID NO: 1290159 - DNA, 22 bp, Artificial Sequence
  chemically synthesized
ctcaggtgatgggtgcaccaaa

SEQ ID NO: 1290160 - DNA, 22 bp, Artificial Sequence
  chemically synthesized
ccgagattttggtgcacccatc

SEQ ID NO: 1290161 - DNA, 22 bp, Artificial Sequence
  chemically synthesized
cgagattttggtgcacccatca

SEQ ID NO: 1290162 - DNA, 22 bp, Artificial Sequence
  chemically synthesized
tggtgcacccatcacctgagaa

SEQ ID NO: 1290163 - DNA, 22 bp, Artificial Sequence
  chemically synthesized
ggtgcacccatcacctgagaag

SEQ ID NO: 1290164 - DNA, 22 bp, Artificial Sequence
  chemically synthesized
gtgcacccatcacctgagaagt

SEQ ID NO: 1290165 - DNA, 22 bp, Artificial Sequence
  chemically synthesized
ggtacggtgtatacttctcagg

SEQ ID NO: 1290166 - DNA, 22 bp, Artificial Sequence
  chemically synthesized
catattgggtacggtgtatact

SEQ ID NO: 1290167 - DNA, 22 bp, Artificial Sequence
  chemically synthesized
agaagtatacaccgtacccaat

SEQ ID NO: 1290168 - DNA, 22 bp, Artificial Sequence
  chemically synthesized
ttatctctcacccatctcctac

SEQ ID NO: 1290169 - DNA, 22 bp, Artificial Sequence
  chemically synthesized
tatctctcacccatctcctacc

SEQ ID NO: 1290170 - DNA, 22 bp, Artificial Sequence
  chemically synthesized
atctctcacccatctcctaccc

SEQ ID NO: 1290171 - DNA, 22 bp, Artificial Sequence
  chemically synthesized
tctctcacccatctcctaccct

SEQ ID NO: 1290172 - DNA, 22 bp, Artificial Sequence
  chemically synthesized
agagcagggggaagggtaggag

SEQ ID NO: 1290173 - DNA, 22 bp, Artificial Sequence
  chemically synthesized
tcacccatctcctacccttccc

SEQ ID NO: 1290174 - DNA, 22 bp, Artificial Sequence
  chemically synthesized
acccatctcctacccttccccc

SEQ ID NO: 1290175 - DNA, 22 bp, Artificial Sequence
  chemically synthesized
gggactcagagcagggggaagg

SEQ ID NO: 1290176 - DNA, 22 bp, Artificial Sequence
  chemically synthesized
tagggactcagagcagggggaa

SEQ ID NO: 1290177 - DNA, 22 bp, Artificial Sequence
  chemically synthesized
ctacccttccccctgctctgag

SEQ ID NO: 1290178 - DNA, 22 bp, Artificial Sequence
  chemically synthesized
cccttccccctgctctgagtcc

SEQ ID NO: 1290179 - DNA, 22 bp, Artificial Sequence
  chemically synthesized
ccccctgctctgagtccctaga

SEQ ID NO: 1290180 - DNA, 22 bp, Artificial Sequence
  chemically synthesized
cccctgctctgagtccctagag

SEQ ID NO: 1290181 - DNA, 22 bp, Artificial Sequence
  chemically synthesized
ctctgagtccctagagtccatt

SEQ ID NO: 1290182 - DNA, 22 bp, Artificial Sequence
  chemically synthesized
tgagtccctagagtccattata

SEQ ID NO: 1290183 - DNA, 22 bp, Artificial Sequence
  chemically synthesized
agtccctagagtccattatatc

SEQ ID NO: 1290184 - DNA, 22 bp, Artificial Sequence
  chemically synthesized
gagtccattatatcattcttat

SEQ ID NO: 1290185 - DNA, 22 bp, Artificial Sequence
  chemically synthesized
tgaggatgcaaaggcataagaa

SEQ ID NO: 1290186 - DNA, 22 bp, Artificial Sequence
  chemically synthesized
aactatgaggatgcaaaggcat

SEQ ID NO: 1290187 - DNA, 22 bp, Artificial Sequence
  chemically synthesized
tatcattcttatgcctttgcat

SEQ ID NO: 1290188 - DNA, 22 bp, Artificial Sequence
  chemically synthesized
ttatgcctttgcatcctcatag

SEQ ID NO: 1290189 - DNA, 22 bp, Artificial Sequence
  chemically synthesized
atgcctttgcatcctcatagtt

SEQ ID NO: 1290190 - DNA, 22 bp, Artificial Sequence
  chemically synthesized
tgcctttgcatcctcatagttg

SEQ ID NO: 1290191 - DNA, 22 bp, Artificial Sequence
  chemically synthesized
ataagtgggagctcaactatga

SEQ ID NO: 1290192 - DNA, 22 bp, Artificial Sequence
  chemically synthesized
actcataagtgggagctcaact

SEQ ID NO: 1290193 - DNA, 22 bp, Artificial Sequence
  chemically synthesized
tgcatcctcatagttgagctcc

SEQ ID NO: 1290194 - DNA, 22 bp, Artificial Sequence
  chemically synthesized
gcatcctcatagttgagctccc

SEQ ID NO: 1290195 - DNA, 22 bp, Artificial Sequence
  chemically synthesized
tcactcataagtgggagctcaa

SEQ ID NO: 1290196 - DNA, 22 bp, Artificial Sequence
  chemically synthesized
catcctcatagttgagctccca

SEQ ID NO: 1290197 - DNA, 22 bp, Artificial Sequence
  chemically synthesized
atagttgagctcccacttatga

SEQ ID NO: 1290198 - DNA, 22 bp, Artificial Sequence
  chemically synthesized
agctcccacttatgagtgagaa

SEQ ID NO: 1290199 - DNA, 22 bp, Artificial Sequence
  chemically synthesized
ccacttatgagtgagaacatac

SEQ ID NO: 1290200 - DNA, 22 bp, Artificial Sequence
  chemically synthesized
atgagtgagaacatacggtgtt

SEQ ID NO: 1290201 - DNA, 22 bp, Artificial Sequence
  chemically synthesized
tgagtgagaacatacggtgttt

SEQ ID NO: 1290202 - DNA, 22 bp, Artificial Sequence
  chemically synthesized
aggaatggaaaaccaaacaccg

SEQ ID NO: 1290203 - DNA, 22 bp, Artificial Sequence
  chemically synthesized
agtaaagtaattcaggaatgga

SEQ ID NO: 1290204 - DNA, 22 bp, Artificial Sequence
  chemically synthesized
taagtaaagtaattcaggaatg

SEQ ID NO: 1290205 - DNA, 22 bp, Artificial Sequence
  chemically synthesized
ttctaagtaaagtaattcagga

SEQ ID NO: 1290206 - DNA, 22 bp, Artificial Sequence
  chemically synthesized
ggttttccattcctgaattact

SEQ ID NO: 1290207 - DNA, 22 bp, Artificial Sequence
  chemically synthesized
gttttccattcctgaattactt

SEQ ID NO: 1290208 - DNA, 22 bp, Artificial Sequence
  chemically synthesized
tccattcctgaattactttact

SEQ ID NO: 1290209 - DNA, 22 bp, Artificial Sequence
  chemically synthesized
ccattcctgaattactttactt

SEQ ID NO: 1290210 - DNA, 22 bp, Artificial Sequence
  chemically synthesized
cattcctgaattactttactta

SEQ ID NO: 1290211 - DNA, 22 bp, Artificial Sequence
  chemically synthesized
gaggccattattctaagtaaag

SEQ ID NO: 1290212 - DNA, 22 bp, Artificial Sequence
  chemically synthesized
ctgaattactttacttagaata

SEQ ID NO: 1290213 - DNA, 22 bp, Artificial Sequence
  chemically synthesized
aattactttacttagaataatg

SEQ ID NO: 1290214 - DNA, 22 bp, Artificial Sequence
  chemically synthesized
gatagaactggaggccattatt

SEQ ID NO: 1290215 - DNA, 22 bp, Artificial Sequence
  chemically synthesized
ggatagaactggaggccattat

SEQ ID NO: 1290216 - DNA, 22 bp, Artificial Sequence
  chemically synthesized
ctttacttagaataatggcctc

SEQ ID NO: 1290217 - DNA, 22 bp, Artificial Sequence
  chemically synthesized
tacttagaataatggcctccag

SEQ ID NO: 1290218 - DNA, 22 bp, Artificial Sequence
  chemically synthesized
acttagaataatggcctccagt

SEQ ID NO: 1290219 - DNA, 22 bp, Artificial Sequence
  chemically synthesized
cttagaataatggcctccagtt

SEQ ID NO: 1290220 - DNA, 22 bp, Artificial Sequence
  chemically synthesized
agaataatggcctccagttcta

SEQ ID NO: 1290221 - DNA, 22 bp, Artificial Sequence
  chemically synthesized
caacaacttggatagaactgga

SEQ ID NO: 1290222 - DNA, 22 bp, Artificial Sequence
  chemically synthesized
gaataatggcctccagttctat

SEQ ID NO: 1290223 - DNA, 22 bp, Artificial Sequence
  chemically synthesized
gcaacaacttggatagaactgg

SEQ ID NO: 1290224 - DNA, 22 bp, Artificial Sequence
  chemically synthesized
tgcaacaacttggatagaactg

SEQ ID NO: 1290225 - DNA, 22 bp, Artificial Sequence
  chemically synthesized
cagttctatccaagttgttgca

SEQ ID NO: 1290226 - DNA, 22 bp, Artificial Sequence
  chemically synthesized
tatccaagttgttgcaaaatac

SEQ ID NO: 1290227 - DNA, 22 bp, Artificial Sequence
  chemically synthesized
tccaagttgttgcaaaatacat

SEQ ID NO: 1290228 - DNA, 22 bp, Artificial Sequence
  chemically synthesized
ttgcaaaatacattatttcatt

SEQ ID NO: 1290229 - DNA, 22 bp, Artificial Sequence
  chemically synthesized
caaaatacattatttcattcct

SEQ ID NO: 1290230 - DNA, 22 bp, Artificial Sequence
  chemically synthesized
aaagggaagtacaggaatgaaa

SEQ ID NO: 1290231 - DNA, 22 bp, Artificial Sequence
  chemically synthesized
tggttgaaagggaagtacagga

SEQ ID NO: 1290232 - DNA, 22 bp, Artificial Sequence
  chemically synthesized
tgtggttgaaagggaagtacag

SEQ ID NO: 1290233 - DNA, 22 bp, Artificial Sequence
  chemically synthesized
ctgtggttgaaagggaagtaca

SEQ ID NO: 1290234 - DNA, 22 bp, Artificial Sequence
  chemically synthesized
tctgtggttgaaagggaagtac

SEQ ID NO: 1290235 - DNA, 22 bp, Artificial Sequence
  chemically synthesized
tttcattcctgtacttcccttt

SEQ ID NO: 1290236 - DNA, 22 bp, Artificial Sequence
  chemically synthesized
ttttctgtggttgaaagggaag

SEQ ID NO: 1290237 - DNA, 22 bp, Artificial Sequence
  chemically synthesized
gttttctgtggttgaaagggaa

SEQ ID NO: 1290238 - DNA, 22 bp, Artificial Sequence
  chemically synthesized
cattcctgtacttccctttcaa

SEQ ID NO: 1290239 - DNA, 22 bp, Artificial Sequence
  chemically synthesized
attcctgtacttccctttcaac

SEQ ID NO: 1290240 - DNA, 22 bp, Artificial Sequence
  chemically synthesized
tttgttttctgtggttgaaagg

SEQ ID NO: 1290241 - DNA, 22 bp, Artificial Sequence
  chemically synthesized
ctgtacttccctttcaaccaca

SEQ ID NO: 1290242 - DNA, 22 bp, Artificial Sequence
  chemically synthesized
ttgtttgttttctgtggttgaa

SEQ ID NO: 1290243 - DNA, 22 bp, Artificial Sequence
  chemically synthesized
gttgtttgttttctgtggttga

SEQ ID NO: 1290244 - DNA, 22 bp, Artificial Sequence
  chemically synthesized
tacttccctttcaaccacagaa

SEQ ID NO: 1290245 - DNA, 22 bp, Artificial Sequence
  chemically synthesized
ccctttcaaccacagaaaacaa

SEQ ID NO: 1290246 - DNA, 22 bp, Artificial Sequence
  chemically synthesized
cctttcaaccacagaaaacaaa

SEQ ID NO: 1290247 - DNA, 22 bp, Artificial Sequence
  chemically synthesized
tcaaccacagaaaacaaacaac

SEQ ID NO: 1290248 - DNA, 22 bp, Artificial Sequence
  chemically synthesized
caaccacagaaaacaaacaaca

SEQ ID NO: 1290249 - DNA, 22 bp, Artificial Sequence
  chemically synthesized
aaccacagaaaacaaacaacaa

SEQ ID NO: 1290250 - DNA, 22 bp, Artificial Sequence
  chemically synthesized
ataaatgataacatttgttgtt

SEQ ID NO: 1290251 - DNA, 22 bp, Artificial Sequence
  chemically synthesized
cataaatgataacatttgttgt

SEQ ID NO: 1290252 - DNA, 22 bp, Artificial Sequence
  chemically synthesized
ttcataaatgataacatttgtt

SEQ ID NO: 1290253 - DNA, 22 bp, Artificial Sequence
  chemically synthesized
ttcttcataaatgataacattt

SEQ ID NO: 1290254 - DNA, 22 bp, Artificial Sequence
  chemically synthesized
attcttcataaatgataacatt

SEQ ID NO: 1290255 - DNA, 22 bp, Artificial Sequence
  chemically synthesized
tattcttcataaatgataacat

SEQ ID NO: 1290256 - DNA, 22 bp, Artificial Sequence
  chemically synthesized
tcatttatgaagaataaaatct

SEQ ID NO: 1290257 - DNA, 22 bp, Artificial Sequence
  chemically synthesized
cccaaaatacacaagattttat

SEQ ID NO: 1290258 - DNA, 22 bp, Artificial Sequence
  chemically synthesized
atgaagaataaaatcttgtgta

SEQ ID NO: 1290259 - DNA, 22 bp, Artificial Sequence
  chemically synthesized
cactccccaaaatacacaagat

SEQ ID NO: 1290260 - DNA, 22 bp, Artificial Sequence
  chemically synthesized
tgaagaataaaatcttgtgtat

SEQ ID NO: 1290261 - DNA, 22 bp, Artificial Sequence
  chemically synthesized
ccactccccaaaatacacaaga

SEQ ID NO: 1290262 - DNA, 22 bp, Artificial Sequence
  chemically synthesized
ttccactccccaaaatacacaa

SEQ ID NO: 1290263 - DNA, 22 bp, Artificial Sequence
  chemically synthesized
cttccactccccaaaatacaca

SEQ ID NO: 1290264 - DNA, 22 bp, Artificial Sequence
  chemically synthesized
tcttccactccccaaaatacac

SEQ ID NO: 1290265 - DNA, 22 bp, Artificial Sequence
  chemically synthesized
cctttcttccactccccaaaat

SEQ ID NO: 1290266 - DNA, 22 bp, Artificial Sequence
  chemically synthesized
gtgtattttggggagtggaaga

SEQ ID NO: 1290267 - DNA, 22 bp, Artificial Sequence
  chemically synthesized
tgtattttggggagtggaagaa

SEQ ID NO: 1290268 - DNA, 22 bp, Artificial Sequence
  chemically synthesized
taaaagaagtgctacctttctt

SEQ ID NO: 1290269 - DNA, 22 bp, Artificial Sequence
  chemically synthesized
ataaaagaagtgctacctttct

SEQ ID NO: 1290270 - DNA, 22 bp, Artificial Sequence
  chemically synthesized
tggggagtggaagaaaggtagc

SEQ ID NO: 1290271 - DNA, 22 bp, Artificial Sequence
  chemically synthesized
ggggagtggaagaaaggtagca

SEQ ID NO: 1290272 - DNA, 22 bp, Artificial Sequence
  chemically synthesized
gggagtggaagaaaggtagcac

SEQ ID NO: 1290273 - DNA, 22 bp, Artificial Sequence
  chemically synthesized
acttataaaagaagtgctacct

SEQ ID NO: 1290274 - DNA, 22 bp, Artificial Sequence
  chemically synthesized
taaaataatagcactaacttat

SEQ ID NO: 1290275 - DNA, 22 bp, Artificial Sequence
  chemically synthesized
aagttataaaataatagcacta

SEQ ID NO: 1290276 - DNA, 22 bp, Artificial Sequence
  chemically synthesized
cttttataagttagtgctatta

SEQ ID NO: 1290277 - DNA, 22 bp, Artificial Sequence
  chemically synthesized
ttttataagttagtgctattat

SEQ ID NO: 1290278 - DNA, 22 bp, Artificial Sequence
  chemically synthesized
ttataagttagtgctattattt

SEQ ID NO: 1290279 - DNA, 22 bp, Artificial Sequence
  chemically synthesized
tataagttagtgctattatttt

SEQ ID NO: 1290280 - DNA, 22 bp, Artificial Sequence
  chemically synthesized
ataagttagtgctattatttta

SEQ ID NO: 1290281 - DNA, 22 bp, Artificial Sequence
  chemically synthesized
taagttagtgctattattttat

SEQ ID NO: 1290282 - DNA, 22 bp, Artificial Sequence
  chemically synthesized
atcagatgtctcaagttataaa

SEQ ID NO: 1290283 - DNA, 22 bp, Artificial Sequence
  chemically synthesized
gtgctattattttataacttga

SEQ ID NO: 1290284 - DNA, 22 bp, Artificial Sequence
  chemically synthesized
ttattttataacttgagacatc

SEQ ID NO: 1290285 - DNA, 22 bp, Artificial Sequence
  chemically synthesized
ttttataacttgagacatctga

SEQ ID NO: 1290286 - DNA, 22 bp, Artificial Sequence
  chemically synthesized
taggtaagctaatcagatgtct

SEQ ID NO: 1290287 - DNA, 22 bp, Artificial Sequence
  chemically synthesized
tataacttgagacatctgatta

SEQ ID NO: 1290288 - DNA, 22 bp, Artificial Sequence
  chemically synthesized
ttataggtaagctaatcagatg

SEQ ID NO: 1290289 - DNA, 22 bp, Artificial Sequence
  chemically synthesized
ataacttgagacatctgattag

SEQ ID NO: 1290290 - DNA, 22 bp, Artificial Sequence
  chemically synthesized
gttataggtaagctaatcagat

SEQ ID NO: 1290291 - DNA, 22 bp, Artificial Sequence
  chemically synthesized
taacttgagacatctgattagc

SEQ ID NO: 1290292 - DNA, 22 bp, Artificial Sequence
  chemically synthesized
tgttataggtaagctaatcaga

SEQ ID NO: 1290293 - DNA, 22 bp, Artificial Sequence
  chemically synthesized
cactttgttataggtaagctaa

SEQ ID NO: 1290294 - DNA, 22 bp, Artificial Sequence
  chemically synthesized
gagacatctgattagcttacct

SEQ ID NO: 1290295 - DNA, 22 bp, Artificial Sequence
  chemically synthesized
ccactttgttataggtaagcta

SEQ ID NO: 1290296 - DNA, 22 bp, Artificial Sequence
  chemically synthesized
agacatctgattagcttaccta

SEQ ID NO: 1290297 - DNA, 22 bp, Artificial Sequence
  chemically synthesized
tttccactttgttataggtaag

SEQ ID NO: 1290298 - DNA, 22 bp, Artificial Sequence
  chemically synthesized
tatttccactttgttataggta

SEQ ID NO: 1290299 - DNA, 22 bp, Artificial Sequence
  chemically synthesized
ctatttccactttgttataggt

SEQ ID NO: 1290300 - DNA, 22 bp, Artificial Sequence
  chemically synthesized
tctatttccactttgttatagg

SEQ ID NO: 1290301 - DNA, 22 bp, Artificial Sequence
  chemically synthesized
attagcttacctataacaaagt

SEQ ID NO: 1290302 - DNA, 22 bp, Artificial Sequence
  chemically synthesized
gcttacctataacaaagtggaa

SEQ ID NO: 1290303 - DNA, 22 bp, Artificial Sequence
  chemically synthesized
tatattttctatttccactttg

SEQ ID NO: 1290304 - DNA, 22 bp, Artificial Sequence
  chemically synthesized
acctataacaaagtggaaatag

SEQ ID NO: 1290305 - DNA, 22 bp, Artificial Sequence
  chemically synthesized
cctataacaaagtggaaataga

SEQ ID NO: 1290306 - DNA, 22 bp, Artificial Sequence
  chemically synthesized
tatattatatattttctatttc

SEQ ID NO: 1290307 - DNA, 22 bp, Artificial Sequence
  chemically synthesized
taacaaagtggaaatagaaaat

SEQ ID NO: 1290308 - DNA, 22 bp, Artificial Sequence
  chemically synthesized
ctgtatattatatattttctat

SEQ ID NO: 1290309 - DNA, 22 bp, Artificial Sequence
  chemically synthesized
actgtatattatatattttcta

SEQ ID NO: 1290310 - DNA, 22 bp, Artificial Sequence
  chemically synthesized
tatgaatagtttactgtatatt

SEQ ID NO: 1290311 - DNA, 22 bp, Artificial Sequence
  chemically synthesized
cattatatgaatagtttactgt

SEQ ID NO: 1290312 - DNA, 22 bp, Artificial Sequence
  chemically synthesized
aacagttacattatatgaatag

SEQ ID NO: 1290313 - DNA, 22 bp, Artificial Sequence
  chemically synthesized
taaacagttacattatatgaat

SEQ ID NO: 1290314 - DNA, 22 bp, Artificial Sequence
  chemically synthesized
agattctaaacagttacattat

SEQ ID NO: 1290315 - DNA, 22 bp, Artificial Sequence
  chemically synthesized
ttcatataatgtaactgtttag

SEQ ID NO: 1290316 - DNA, 22 bp, Artificial Sequence
  chemically synthesized
atagttaagattctaaacagtt

SEQ ID NO: 1290317 - DNA, 22 bp, Artificial Sequence
  chemically synthesized
atataatgtaactgtttagaat

SEQ ID NO: 1290318 - DNA, 22 bp, Artificial Sequence
  chemically synthesized
cctgatagttaagattctaaac

SEQ ID NO: 1290319 - DNA, 22 bp, Artificial Sequence
  chemically synthesized
aatacactgcctgatagttaag

SEQ ID NO: 1290320 - DNA, 22 bp, Artificial Sequence
  chemically synthesized
tttagaatcttaactatcaggc

SEQ ID NO: 1290321 - DNA, 22 bp, Artificial Sequence
  chemically synthesized
agaatcttaactatcaggcagt

SEQ ID NO: 1290322 - DNA, 22 bp, Artificial Sequence
  chemically synthesized
gaatcttaactatcaggcagtg

SEQ ID NO: 1290323 - DNA, 22 bp, Artificial Sequence
  chemically synthesized
aaagatcattaaatacactgcc

SEQ ID NO: 1290324 - DNA, 22 bp, Artificial Sequence
  chemically synthesized
gaaagatcattaaatacactgc

SEQ ID NO: 1290325 - DNA, 22 bp, Artificial Sequence
  chemically synthesized
aactatcaggcagtgtatttaa

SEQ ID NO: 1290326 - DNA, 22 bp, Artificial Sequence
  chemically synthesized
actatcaggcagtgtatttaat

SEQ ID NO: 1290327 - DNA, 22 bp, Artificial Sequence
  chemically synthesized
tcaggcagtgtatttaatgatc

SEQ ID NO: 1290328 - DNA, 22 bp, Artificial Sequence
  chemically synthesized
aatgatctttcaagttgcttcg

SEQ ID NO: 1290329 - DNA, 22 bp, Artificial Sequence
  chemically synthesized
atgatctttcaagttgcttcgt

SEQ ID NO: 1290330 - DNA, 22 bp, Artificial Sequence
  chemically synthesized
tcaagttgcttcgtattttctt

SEQ ID NO: 1290331 - DNA, 22 bp, Artificial Sequence
  chemically synthesized
caagttgcttcgtattttcttt

SEQ ID NO: 1290332 - DNA, 22 bp, Artificial Sequence
  chemically synthesized
aagttgcttcgtattttctttt

SEQ ID NO: 1290333 - DNA, 22 bp, Artificial Sequence
  chemically synthesized
aaaaaacggacaaaaagaaaat

SEQ ID NO: 1290334 - DNA, 22 bp, Artificial Sequence
  chemically synthesized
aattaaaaaaacggacaaaaag

SEQ ID NO: 1290335 - DNA, 22 bp, Artificial Sequence
  chemically synthesized
cttcgtattttctttttgtccg

SEQ ID NO: 1290336 - DNA, 22 bp, Artificial Sequence
  chemically synthesized
gaattaaaaaaacggacaaaaa

SEQ ID NO: 1290337 - DNA, 22 bp, Artificial Sequence
  chemically synthesized
cgtattttctttttgtccgttt

SEQ ID NO: 1290338 - DNA, 22 bp, Artificial Sequence
  chemically synthesized
gtattttctttttgtccgtttt

SEQ ID NO: 1290339 - DNA, 22 bp, Artificial Sequence
  chemically synthesized
tctttttgtccgtttttttaat

SEQ ID NO: 1290340 - DNA, 22 bp, Artificial Sequence
  chemically synthesized
ctttttgtccgtttttttaatt

SEQ ID NO: 1290341 - DNA, 22 bp, Artificial Sequence
  chemically synthesized
tttttgtccgtttttttaattc

SEQ ID NO: 1290342 - DNA, 22 bp, Artificial Sequence
  chemically synthesized
tttgtccgtttttttaattcaa

SEQ ID NO: 1290343 - DNA, 22 bp, Artificial Sequence
  chemically synthesized
ttgtccgtttttttaattcaaa

SEQ ID NO: 1290344 - DNA, 22 bp, Artificial Sequence
  chemically synthesized
tgtccgtttttttaattcaaat

SEQ ID NO: 1290345 - DNA, 22 bp, Artificial Sequence
  chemically synthesized
gtccgtttttttaattcaaatt

SEQ ID NO: 1290346 - DNA, 22 bp, Artificial Sequence
  chemically synthesized
tccgtttttttaattcaaatta

SEQ ID NO: 1290347 - DNA, 22 bp, Artificial Sequence
  chemically synthesized
agtcagtaaaccaataatttga

SEQ ID NO: 1290348 - DNA, 22 bp, Artificial Sequence
  chemically synthesized
ttttaattcaaattattggttt

SEQ ID NO: 1290349 - DNA, 22 bp, Artificial Sequence
  chemically synthesized
tttaattcaaattattggttta

SEQ ID NO: 1290350 - DNA, 22 bp, Artificial Sequence
  chemically synthesized
ttaattcaaattattggtttac

SEQ ID NO: 1290351 - DNA, 22 bp, Artificial Sequence
  chemically synthesized
tcatctaagtcagtaaaccaat

SEQ ID NO: 1290352 - DNA, 22 bp, Artificial Sequence
  chemically synthesized
taattcaaattattggtttact

SEQ ID NO: 1290353 - DNA, 22 bp, Artificial Sequence
  chemically synthesized
aattcaaattattggtttactg

SEQ ID NO: 1290354 - DNA, 22 bp, Artificial Sequence
  chemically synthesized
attcaaattattggtttactga

SEQ ID NO: 1290355 - DNA, 22 bp, Artificial Sequence
  chemically synthesized
aaattattggtttactgactta

SEQ ID NO: 1290356 - DNA, 22 bp, Artificial Sequence
  chemically synthesized
ttggtttactgacttagatgat

SEQ ID NO: 1290357 - DNA, 22 bp, Artificial Sequence
  chemically synthesized
aagaacaaacctatcatctaag

SEQ ID NO: 1290358 - DNA, 22 bp, Artificial Sequence
  chemically synthesized
gtttactgacttagatgatagg

SEQ ID NO: 1290359 - DNA, 22 bp, Artificial Sequence
  chemically synthesized
ctaaagaacaaacctatcatct

SEQ ID NO: 1290360 - DNA, 22 bp, Artificial Sequence
  chemically synthesized
actgacttagatgataggtttg

SEQ ID NO: 1290361 - DNA, 22 bp, Artificial Sequence
  chemically synthesized
ctgacttagatgataggtttgt

SEQ ID NO: 1290362 - DNA, 22 bp, Artificial Sequence
  chemically synthesized
acttagatgataggtttgttct

SEQ ID NO: 1290363 - DNA, 22 bp, Artificial Sequence
  chemically synthesized
agcatatctgctaaagaacaaa

SEQ ID NO: 1290364 - DNA, 22 bp, Artificial Sequence
  chemically synthesized
cagcatatctgctaaagaacaa

SEQ ID NO: 1290365 - DNA, 22 bp, Artificial Sequence
  chemically synthesized
agatgataggtttgttctttag

SEQ ID NO: 1290366 - DNA, 22 bp, Artificial Sequence
  chemically synthesized
gatgataggtttgttctttagc

SEQ ID NO: 1290367 - DNA, 22 bp, Artificial Sequence
  chemically synthesized
tataagacatttcagcatatct

SEQ ID NO: 1290368 - DNA, 22 bp, Artificial Sequence
  chemically synthesized
atataagacatttcagcatatc

SEQ ID NO: 1290369 - DNA, 22 bp, Artificial Sequence
  chemically synthesized
gttctttagcagatatgctgaa

SEQ ID NO: 1290370 - DNA, 22 bp, Artificial Sequence
  chemically synthesized
ttctttagcagatatgctgaaa

SEQ ID NO: 1290371 - DNA, 22 bp, Artificial Sequence
  chemically synthesized
tttatataagacatttcagcat

SEQ ID NO: 1290372 - DNA, 22 bp, Artificial Sequence
  chemically synthesized
tttagcagatatgctgaaatgt

SEQ ID NO: 1290373 - DNA, 22 bp, Artificial Sequence
  chemically synthesized
tagcagatatgctgaaatgtct

SEQ ID NO: 1290374 - DNA, 22 bp, Artificial Sequence
  chemically synthesized
agcagatatgctgaaatgtctt

SEQ ID NO: 1290375 - DNA, 22 bp, Artificial Sequence
  chemically synthesized
gcagatatgctgaaatgtctta

SEQ ID NO: 1290376 - DNA, 22 bp, Artificial Sequence
  chemically synthesized
agagactatttatataagacat

SEQ ID NO: 1290377 - DNA, 22 bp, Artificial Sequence
  chemically synthesized
ttcagagactatttatataaga

SEQ ID NO: 1290378 - DNA, 22 bp, Artificial Sequence
  chemically synthesized
attcagagactatttatataag

SEQ ID NO: 1290379 - DNA, 22 bp, Artificial Sequence
  chemically synthesized
tattcagagactatttatataa

SEQ ID NO: 1290380 - DNA, 22 bp, Artificial Sequence
  chemically synthesized
aaatgtcttatataaatagtct

SEQ ID NO: 1290381 - DNA, 22 bp, Artificial Sequence
  chemically synthesized
tgattttattcagagactattt

SEQ ID NO: 1290382 - DNA, 22 bp, Artificial Sequence
  chemically synthesized
atattgtgattttattcagaga

SEQ ID NO: 1290383 - DNA, 22 bp, Artificial Sequence
  chemically synthesized
atataaatagtctctgaataaa

SEQ ID NO: 1290384 - DNA, 22 bp, Artificial Sequence
  chemically synthesized
tataaatagtctctgaataaaa

SEQ ID NO: 1290385 - DNA, 22 bp, Artificial Sequence
  chemically synthesized
tgatagctgatattgtgatttt

SEQ ID NO: 1290386 - DNA, 22 bp, Artificial Sequence
  chemically synthesized
atgatagctgatattgtgattt

SEQ ID NO: 1290387 - DNA, 22 bp, Artificial Sequence
  chemically synthesized
tatgatagctgatattgtgatt

SEQ ID NO: 1290388 - DNA, 22 bp, Artificial Sequence
  chemically synthesized
tgaataaaatcacaatatcagc

SEQ ID NO: 1290389 - DNA, 22 bp, Artificial Sequence
  chemically synthesized
aataaaatcacaatatcagcta

SEQ ID NO: 1290390 - DNA, 22 bp, Artificial Sequence
  chemically synthesized
tgtaagtagagttttatgatag

SEQ ID NO: 1290391 - DNA, 22 bp, Artificial Sequence
  chemically synthesized
aacgagctatgtaagtagagtt

SEQ ID NO: 1290392 - DNA, 22 bp, Artificial Sequence
  chemically synthesized
tcataaaactctacttacatag

SEQ ID NO: 1290393 - DNA, 22 bp, Artificial Sequence
  chemically synthesized
ataatatattaaacgagctatg

SEQ ID NO: 1290394 - DNA, 22 bp, Artificial Sequence
  chemically synthesized
taataatatattaaacgagcta

SEQ ID NO: 1290395 - DNA, 22 bp, Artificial Sequence
  chemically synthesized
ctaataatatattaaacgagct

SEQ ID NO: 1290396 - DNA, 22 bp, Artificial Sequence
  chemically synthesized
tacttacatagctcgtttaata

SEQ ID NO: 1290397 - DNA, 22 bp, Artificial Sequence
  chemically synthesized
tttctaataatatattaaacga

SEQ ID NO: 1290398 - DNA, 22 bp, Artificial Sequence
  chemically synthesized
cttacatagctcgtttaatata

SEQ ID NO: 1290399 - DNA, 22 bp, Artificial Sequence
  chemically synthesized
acatagctcgtttaatatatta

SEQ ID NO: 1290400 - DNA, 22 bp, Artificial Sequence
  chemically synthesized
catagctcgtttaatatattat

SEQ ID NO: 1290401 - DNA, 22 bp, Artificial Sequence
  chemically synthesized
aaatgaagactgtttctaataa

SEQ ID NO: 1290402 - DNA, 22 bp, Artificial Sequence
  chemically synthesized
aaaatgaagactgtttctaata

SEQ ID NO: 1290403 - DNA, 22 bp, Artificial Sequence
  chemically synthesized
gtttaatatattattagaaaca

SEQ ID NO: 1290404 - DNA, 22 bp, Artificial Sequence
  chemically synthesized
aatatattattagaaacagtct

SEQ ID NO: 1290405 - DNA, 22 bp, Artificial Sequence
  chemically synthesized
atatattattagaaacagtctt

SEQ ID NO: 1290406 - DNA, 22 bp, Artificial Sequence
  chemically synthesized
gaagaagcatttaaaatgaaga

SEQ ID NO: 1290407 - DNA, 22 bp, Artificial Sequence
  chemically synthesized
ttagaaacagtcttcattttaa

SEQ ID NO: 1290408 - DNA, 22 bp, Artificial Sequence
  chemically synthesized
tggaagaagcatttaaaatgaa

SEQ ID NO: 1290409 - DNA, 22 bp, Artificial Sequence
  chemically synthesized
gaaacagtcttcattttaaatg

SEQ ID NO: 1290410 - DNA, 22 bp, Artificial Sequence
  chemically synthesized
cattttaaatgcttcttccaga

SEQ ID NO: 1290411 - DNA, 22 bp, Artificial Sequence
  chemically synthesized
attttaaatgcttcttccagaa

SEQ ID NO: 1290412 - DNA, 22 bp, Artificial Sequence
  chemically synthesized
taaatgcttcttccagaatgta

SEQ ID NO: 1290413 - DNA, 22 bp, Artificial Sequence
  chemically synthesized
aaatgcttcttccagaatgtat

SEQ ID NO: 1290414 - DNA, 22 bp, Artificial Sequence
  chemically synthesized
tataatatgtgcatacattctg

SEQ ID NO: 1290415 - DNA, 22 bp, Artificial Sequence
  chemically synthesized
aatgcttcttccagaatgtatg

SEQ ID NO: 1290416 - DNA, 22 bp, Artificial Sequence
  chemically synthesized
actatataatatgtgcatacat

SEQ ID NO: 1290417 - DNA, 22 bp, Artificial Sequence
  chemically synthesized
cttccagaatgtatgcacatat

SEQ ID NO: 1290418 - DNA, 22 bp, Artificial Sequence
  chemically synthesized
ttccagaatgtatgcacatatt

SEQ ID NO: 1290419 - DNA, 22 bp, Artificial Sequence
  chemically synthesized
ccagaatgtatgcacatattat

SEQ ID NO: 1290420 - DNA, 22 bp, Artificial Sequence
  chemically synthesized
cagaatgtatgcacatattata

SEQ ID NO: 1290421 - DNA, 22 bp, Artificial Sequence
  chemically synthesized
agtatgcctcactatataatat

SEQ ID NO: 1290422 - DNA, 22 bp, Artificial Sequence
  chemically synthesized
aagtatgcctcactatataata

SEQ ID NO: 1290423 - DNA, 22 bp, Artificial Sequence
  chemically synthesized
atatttaagtatgcctcactat

SEQ ID NO: 1290424 - DNA, 22 bp, Artificial Sequence
  chemically synthesized
ttaatatttaagtatgcctcac

SEQ ID NO: 1290425 - DNA, 22 bp, Artificial Sequence
  chemically synthesized
tatagtgaggcatacttaaata

SEQ ID NO: 1290426 - DNA, 22 bp, Artificial Sequence
  chemically synthesized
gaaggtcagcaatgtcctgtta

SEQ ID NO: 1290427 - DNA, 22 bp, Artificial Sequence
  chemically synthesized
ggaaggtcagcaatgtcctgtt

SEQ ID NO: 1290428 - DNA, 22 bp, Artificial Sequence
  chemically synthesized
tggaaggtcagcaatgtcctgt

SEQ ID NO: 1290429 - DNA, 22 bp, Artificial Sequence
  chemically synthesized
aaatattaacaggacattgctg

SEQ ID NO: 1290430 - DNA, 22 bp, Artificial Sequence
  chemically synthesized
aatattaacaggacattgctga

SEQ ID NO: 1290431 - DNA, 22 bp, Artificial Sequence
  chemically synthesized
acaggacattgctgaccttcca

SEQ ID NO: 1290432 - DNA, 22 bp, Artificial Sequence
  chemically synthesized
aaacatcgaatacaattttgga

SEQ ID NO: 1290433 - DNA, 22 bp, Artificial Sequence
  chemically synthesized
tgaaacatcgaatacaattttg

SEQ ID NO: 1290434 - DNA, 22 bp, Artificial Sequence
  chemically synthesized
ctgaaacatcgaatacaatttt

SEQ ID NO: 1290435 - DNA, 22 bp, Artificial Sequence
  chemically synthesized
ctgaccttccaaaattgtattc

SEQ ID NO: 1290436 - DNA, 22 bp, Artificial Sequence
  chemically synthesized
cttctgaaacatcgaatacaat

SEQ ID NO: 1290437 - DNA, 22 bp, Artificial Sequence
  chemically synthesized
acttctgaaacatcgaatacaa

SEQ ID NO: 1290438 - DNA, 22 bp, Artificial Sequence
  chemically synthesized
accttccaaaattgtattcgat

SEQ ID NO: 1290439 - DNA, 22 bp, Artificial Sequence
  chemically synthesized
ccaaaattgtattcgatgtttc

SEQ ID NO: 1290440 - DNA, 22 bp, Artificial Sequence
  chemically synthesized
caaaattgtattcgatgtttca

SEQ ID NO: 1290441 - DNA, 22 bp, Artificial Sequence
  chemically synthesized
tagtatcataacttacttctga

SEQ ID NO: 1290442 - DNA, 22 bp, Artificial Sequence
  chemically synthesized
tattcgatgtttcagaagtaag

SEQ ID NO: 1290443 - DNA, 22 bp, Artificial Sequence
  chemically synthesized
attgtagtatcataacttactt

SEQ ID NO: 1290444 - DNA, 22 bp, Artificial Sequence
  chemically synthesized
gatgtttcagaagtaagttatg

SEQ ID NO: 1290445 - DNA, 22 bp, Artificial Sequence
  chemically synthesized
ctgattgtagtatcataactta

SEQ ID NO: 1290446 - DNA, 22 bp, Artificial Sequence
  chemically synthesized
tattactgattgtagtatcata

SEQ ID NO: 1290447 - DNA, 22 bp, Artificial Sequence
  chemically synthesized
cagaagtaagttatgatactac

SEQ ID NO: 1290448 - DNA, 22 bp, Artificial Sequence
  chemically synthesized
atattactgattgtagtatcat

SEQ ID NO: 1290449 - DNA, 22 bp, Artificial Sequence
  chemically synthesized
agaagtaagttatgatactaca

SEQ ID NO: 1290450 - DNA, 22 bp, Artificial Sequence
  chemically synthesized
tatattactgattgtagtatca

SEQ ID NO: 1290451 - DNA, 22 bp, Artificial Sequence
  chemically synthesized
tgatactacaatcagtaatata

SEQ ID NO: 1290452 - DNA, 22 bp, Artificial Sequence
  chemically synthesized
caatcagtaatataaagcattc

SEQ ID NO: 1290453 - DNA, 22 bp, Artificial Sequence
  chemically synthesized
agaataaagtcatagcagaatg

SEQ ID NO: 1290454 - DNA, 22 bp, Artificial Sequence
  chemically synthesized
aagaataaagtcatagcagaat

SEQ ID NO: 1290455 - DNA, 22 bp, Artificial Sequence
  chemically synthesized
taagaataaagtcatagcagaa

SEQ ID NO: 1290456 - DNA, 22 bp, Artificial Sequence
  chemically synthesized
ttaagaataaagtcatagcaga

SEQ ID NO: 1290457 - DNA, 22 bp, Artificial Sequence
  chemically synthesized
ttttaagaataaagtcatagca

SEQ ID NO: 1290458 - DNA, 22 bp, Artificial Sequence
  chemically synthesized
tcttttaagaataaagtcatag

SEQ ID NO: 1290459 - DNA, 22 bp, Artificial Sequence
  chemically synthesized
tctcttttaagaataaagtcat

SEQ ID NO: 1290460 - DNA, 22 bp, Artificial Sequence
  chemically synthesized
ctctcttttaagaataaagtca

SEQ ID NO: 1290461 - DNA, 22 bp, Artificial Sequence
  chemically synthesized
gtttctctcttttaagaataaa

SEQ ID NO: 1290462 - DNA, 22 bp, Artificial Sequence
  chemically synthesized
agtttctctcttttaagaataa

SEQ ID NO: 1290463 - DNA, 22 bp, Artificial Sequence
  chemically synthesized
tgctatgactttattcttaaaa

SEQ ID NO: 1290464 - DNA, 22 bp, Artificial Sequence
  chemically synthesized
ctatgactttattcttaaaaga

SEQ ID NO: 1290465 - DNA, 22 bp, Artificial Sequence
  chemically synthesized
tgactttattcttaaaagagag

SEQ ID NO: 1290466 - DNA, 22 bp, Artificial Sequence
  chemically synthesized
tattcttaaaagagagaaacta

SEQ ID NO: 1290467 - DNA, 22 bp, Artificial Sequence
  chemically synthesized
attcttaaaagagagaaactaa

SEQ ID NO: 1290468 - DNA, 22 bp, Artificial Sequence
  chemically synthesized
ttcttaaaagagagaaactaaa

SEQ ID NO: 1290469 - DNA, 22 bp, Artificial Sequence
  chemically synthesized
aagtaaatgtgatttagtttct

SEQ ID NO: 1290470 - DNA, 22 bp, Artificial Sequence
  chemically synthesized
caagtaaatgtgatttagtttc

SEQ ID NO: 1290471 - DNA, 22 bp, Artificial Sequence
  chemically synthesized
tcaagtaaatgtgatttagttt

SEQ ID NO: 1290472 - DNA, 22 bp, Artificial Sequence
  chemically synthesized
ttaaaagagagaaactaaatca

SEQ ID NO: 1290473 - DNA, 22 bp, Artificial Sequence
  chemically synthesized
aaaagagagaaactaaatcaca

SEQ ID NO: 1290474 - DNA, 22 bp, Artificial Sequence
  chemically synthesized
aaagagagaaactaaatcacat

SEQ ID NO: 1290475 - DNA, 22 bp, Artificial Sequence
  chemically synthesized
aatatgccagttttcaagtaaa

SEQ ID NO: 1290476 - DNA, 22 bp, Artificial Sequence
  chemically synthesized
caatatgccagttttcaagtaa

SEQ ID NO: 1290477 - DNA, 22 bp, Artificial Sequence
  chemically synthesized
aatcacatttacttgaaaactg

SEQ ID NO: 1290478 - DNA, 22 bp, Artificial Sequence
  chemically synthesized
atttcaatatgccagttttcaa

SEQ ID NO: 1290479 - DNA, 22 bp, Artificial Sequence
  chemically synthesized
catttcaatatgccagttttca

SEQ ID NO: 1290480 - DNA, 22 bp, Artificial Sequence
  chemically synthesized
acttgaaaactggcatattgaa

SEQ ID NO: 1290481 - DNA, 22 bp, Artificial Sequence
  chemically synthesized
cttgaaaactggcatattgaaa

SEQ ID NO: 1290482 - DNA, 22 bp, Artificial Sequence
  chemically synthesized
gaaaactggcatattgaaatga

SEQ ID NO: 1290483 - DNA, 22 bp, Artificial Sequence
  chemically synthesized
aaaactggcatattgaaatgaa

SEQ ID NO: 1290484 - DNA, 22 bp, Artificial Sequence
  chemically synthesized
cacaaaggatggaaatgtttca

SEQ ID NO: 1290485 - DNA, 22 bp, Artificial Sequence
  chemically synthesized
gcatattgaaatgaaacatttc

SEQ ID NO: 1290486 - DNA, 22 bp, Artificial Sequence
  chemically synthesized
tctccacaaaggatggaaatgt

SEQ ID NO: 1290487 - DNA, 22 bp, Artificial Sequence
  chemically synthesized
tatctccacaaaggatggaaat

SEQ ID NO: 1290488 - DNA, 22 bp, Artificial Sequence
  chemically synthesized
tctatctccacaaaggatggaa

SEQ ID NO: 1290489 - DNA, 22 bp, Artificial Sequence
  chemically synthesized
aaatgaaacatttccatccttt

SEQ ID NO: 1290490 - DNA, 22 bp, Artificial Sequence
  chemically synthesized
gagcgttctctatctccacaaa

SEQ ID NO: 1290491 - DNA, 22 bp, Artificial Sequence
  chemically synthesized
ccatcctttgtggagatagaga

SEQ ID NO: 1290492 - DNA, 22 bp, Artificial Sequence
  chemically synthesized
catcctttgtggagatagagaa

SEQ ID NO: 1290493 - DNA, 22 bp, Artificial Sequence
  chemically synthesized
aagaatctggagcgttctctat

SEQ ID NO: 1290494 - DNA, 22 bp, Artificial Sequence
  chemically synthesized
caagaatctggagcgttctcta

SEQ ID NO: 1290495 - DNA, 22 bp, Artificial Sequence
  chemically synthesized
ttcaagaatctggagcgttctc

SEQ ID NO: 1290496 - DNA, 22 bp, Artificial Sequence
  chemically synthesized
tgtggagatagagaacgctcca

SEQ ID NO: 1290497 - DNA, 22 bp, Artificial Sequence
  chemically synthesized
gtggagatagagaacgctccag

SEQ ID NO: 1290498 - DNA, 22 bp, Artificial Sequence
  chemically synthesized
tggagatagagaacgctccaga

SEQ ID NO: 1290499 - DNA, 22 bp, Artificial Sequence
  chemically synthesized
atggtctcttcaagaatctgga

SEQ ID NO: 1290500 - DNA, 22 bp, Artificial Sequence
  chemically synthesized
tgatggtctcttcaagaatctg

SEQ ID NO: 1290501 - DNA, 22 bp, Artificial Sequence
  chemically synthesized
tctgatggtctcttcaagaatc

SEQ ID NO: 1290502 - DNA, 22 bp, Artificial Sequence
  chemically synthesized
ctctgatggtctcttcaagaat

SEQ ID NO: 1290503 - DNA, 22 bp, Artificial Sequence
  chemically synthesized
tctctgatggtctcttcaagaa

SEQ ID NO: 1290504 - DNA, 22 bp, Artificial Sequence
  chemically synthesized
gattttctctgatggtctcttc

SEQ ID NO: 1290505 - DNA, 22 bp, Artificial Sequence
  chemically synthesized
cagattcttgaagagaccatca

SEQ ID NO: 1290506 - DNA, 22 bp, Artificial Sequence
  chemically synthesized
gcctagattttctctgatggtc

SEQ ID NO: 1290507 - DNA, 22 bp, Artificial Sequence
  chemically synthesized
ttgaagagaccatcagagaaaa

SEQ ID NO: 1290508 - DNA, 22 bp, Artificial Sequence
  chemically synthesized
gaagagaccatcagagaaaatc

SEQ ID NO: 1290509 - DNA, 22 bp, Artificial Sequence
  chemically synthesized
aagagaccatcagagaaaatct

SEQ ID NO: 1290510 - DNA, 22 bp, Artificial Sequence
  chemically synthesized
gtaacaataaatgttggcctag

SEQ ID NO: 1290511 - DNA, 22 bp, Artificial Sequence
  chemically synthesized
agtaacaataaatgttggccta

SEQ ID NO: 1290512 - DNA, 22 bp, Artificial Sequence
  chemically synthesized
tgcatttagtaacaataaatgt

SEQ ID NO: 1290513 - DNA, 22 bp, Artificial Sequence
  chemically synthesized
atgcatttagtaacaataaatg

SEQ ID NO: 1290514 - DNA, 22 bp, Artificial Sequence
  chemically synthesized
ggccaacatttattgttactaa

SEQ ID NO: 1290515 - DNA, 22 bp, Artificial Sequence
  chemically synthesized
aaagagaaatttatgcatttag

SEQ ID NO: 1290516 - DNA, 22 bp, Artificial Sequence
  chemically synthesized
attgttactaaatgcataaatt

SEQ ID NO: 1290517 - DNA, 22 bp, Artificial Sequence
  chemically synthesized
ttgttactaaatgcataaattt

SEQ ID NO: 1290518 - DNA, 22 bp, Artificial Sequence
  chemically synthesized
atactgaaagagaaatttatgc

SEQ ID NO: 1290519 - DNA, 22 bp, Artificial Sequence
  chemically synthesized
ttactaaatgcataaatttctc

SEQ ID NO: 1290520 - DNA, 22 bp, Artificial Sequence
  chemically synthesized
ctgatactgaaagagaaattta

SEQ ID NO: 1290521 - DNA, 22 bp, Artificial Sequence
  chemically synthesized
cctgatactgaaagagaaattt

SEQ ID NO: 1290522 - DNA, 22 bp, Artificial Sequence
  chemically synthesized
tcctgatactgaaagagaaatt

SEQ ID NO: 1290523 - DNA, 22 bp, Artificial Sequence
  chemically synthesized
ctaaatgcataaatttctcttt

SEQ ID NO: 1290524 - DNA, 22 bp, Artificial Sequence
  chemically synthesized
aatgcataaatttctctttcag

SEQ ID NO: 1290525 - DNA, 22 bp, Artificial Sequence
  chemically synthesized
atatattttcctgatactgaaa

SEQ ID NO: 1290526 - DNA, 22 bp, Artificial Sequence
  chemically synthesized
atactcatatattttcctgata

SEQ ID NO: 1290527 - DNA, 22 bp, Artificial Sequence
  chemically synthesized
ctctttcagtatcaggaaaata

SEQ ID NO: 1290528 - DNA, 22 bp, Artificial Sequence
  chemically synthesized
tctttcagtatcaggaaaatat

SEQ ID NO: 1290529 - DNA, 22 bp, Artificial Sequence
  chemically synthesized
tttcagtatcaggaaaatatat

SEQ ID NO: 1290530 - DNA, 22 bp, Artificial Sequence
  chemically synthesized
tcagtatcaggaaaatatatga

SEQ ID NO: 1290531 - DNA, 22 bp, Artificial Sequence
  chemically synthesized
cagtatcaggaaaatatatgag

SEQ ID NO: 1290532 - DNA, 22 bp, Artificial Sequence
  chemically synthesized
tagatgttcatactcatatatt

SEQ ID NO: 1290533 - DNA, 22 bp, Artificial Sequence
  chemically synthesized
agtatcaggaaaatatatgagt

SEQ ID NO: 1290534 - DNA, 22 bp, Artificial Sequence
  chemically synthesized
atagatgttcatactcatatat

SEQ ID NO: 1290535 - DNA, 22 bp, Artificial Sequence
  chemically synthesized
aaacatatttatagatgttcat

SEQ ID NO: 1290536 - DNA, 22 bp, Artificial Sequence
  chemically synthesized
aaaacatatttatagatgttca

SEQ ID NO: 1290537 - DNA, 22 bp, Artificial Sequence
  chemically synthesized
taaaacatatttatagatgttc

SEQ ID NO: 1290538 - DNA, 22 bp, Artificial Sequence
  chemically synthesized
ttaaaacatatttatagatgtt

SEQ ID NO: 1290539 - DNA, 22 bp, Artificial Sequence
  chemically synthesized
aaataatttttaaaacatattt

SEQ ID NO: 1290540 - DNA, 22 bp, Artificial Sequence
  chemically synthesized
caaataatttttaaaacatatt

SEQ ID NO: 1290541 - DNA, 22 bp, Artificial Sequence
  chemically synthesized
gaaaggcttcaaataattttta

SEQ ID NO: 1290542 - DNA, 22 bp, Artificial Sequence
  chemically synthesized
taaatatgttttaaaaattatt

SEQ ID NO: 1290543 - DNA, 22 bp, Artificial Sequence
  chemically synthesized
ttggaaaggcttcaaataattt

SEQ ID NO: 1290544 - DNA, 22 bp, Artificial Sequence
  chemically synthesized
attggaaaggcttcaaataatt

SEQ ID NO: 1290545 - DNA, 22 bp, Artificial Sequence
  chemically synthesized
tattggaaaggcttcaaataat

SEQ ID NO: 1290546 - DNA, 22 bp, Artificial Sequence
  chemically synthesized
tcattttattggaaaggcttca

SEQ ID NO: 1290547 - DNA, 22 bp, Artificial Sequence
  chemically synthesized
taaaaattatttgaagcctttc

SEQ ID NO: 1290548 - DNA, 22 bp, Artificial Sequence
  chemically synthesized
aaaaattatttgaagcctttcc

SEQ ID NO: 1290549 - DNA, 22 bp, Artificial Sequence
  chemically synthesized
aaaattatttgaagcctttcca

SEQ ID NO: 1290550 - DNA, 22 bp, Artificial Sequence
  chemically synthesized
ctgtcattttattggaaaggct

SEQ ID NO: 1290551 - DNA, 22 bp, Artificial Sequence
  chemically synthesized
cctgtcattttattggaaaggc

SEQ ID NO: 1290552 - DNA, 22 bp, Artificial Sequence
  chemically synthesized
ttcctgtcattttattggaaag

SEQ ID NO: 1290553 - DNA, 22 bp, Artificial Sequence
  chemically synthesized
cttcctgtcattttattggaaa

SEQ ID NO: 1290554 - DNA, 22 bp, Artificial Sequence
  chemically synthesized
tcttcctgtcattttattggaa

SEQ ID NO: 1290555 - DNA, 22 bp, Artificial Sequence
  chemically synthesized
tttgaagcctttccaataaaat

SEQ ID NO: 1290556 - DNA, 22 bp, Artificial Sequence
  chemically synthesized
gaagcctttccaataaaatgac

SEQ ID NO: 1290557 - DNA, 22 bp, Artificial Sequence
  chemically synthesized
aagcctttccaataaaatgaca

SEQ ID NO: 1290558 - DNA, 22 bp, Artificial Sequence
  chemically synthesized
aaaggttttcttcctgtcattt

SEQ ID NO: 1290559 - DNA, 22 bp, Artificial Sequence
  chemically synthesized
aaaaggttttcttcctgtcatt

SEQ ID NO: 1290560 - DNA, 22 bp, Artificial Sequence
  chemically synthesized
taaaaggttttcttcctgtcat

SEQ ID NO: 1290561 - DNA, 22 bp, Artificial Sequence
  chemically synthesized
ttaaaaggttttcttcctgtca

SEQ ID NO: 1290562 - DNA, 22 bp, Artificial Sequence
  chemically synthesized
tttaaaaggttttcttcctgtc

SEQ ID NO: 1290563 - DNA, 22 bp, Artificial Sequence
  chemically synthesized
tccaataaaatgacaggaagaa

SEQ ID NO: 1290564 - DNA, 22 bp, Artificial Sequence
  chemically synthesized
ccaataaaatgacaggaagaaa

SEQ ID NO: 1290565 - DNA, 22 bp, Artificial Sequence
  chemically synthesized
caataaaatgacaggaagaaaa

SEQ ID NO: 1290566 - DNA, 22 bp, Artificial Sequence
  chemically synthesized
cacctttttaaaaggttttctt

SEQ ID NO: 1290567 - DNA, 22 bp, Artificial Sequence
  chemically synthesized
tagagttacacctttttaaaag

SEQ ID NO: 1290568 - DNA, 22 bp, Artificial Sequence
  chemically synthesized
gtagagttacacctttttaaaa

SEQ ID NO: 1290569 - DNA, 22 bp, Artificial Sequence
  chemically synthesized
tgcttgtagagttacacctttt

SEQ ID NO: 1290570 - DNA, 22 bp, Artificial Sequence
  chemically synthesized
atgcttgtagagttacaccttt

SEQ ID NO: 1290571 - DNA, 22 bp, Artificial Sequence
  chemically synthesized
tatgcttgtagagttacacctt

SEQ ID NO: 1290572 - DNA, 22 bp, Artificial Sequence
  chemically synthesized
tttatgcttgtagagttacacc

SEQ ID NO: 1290573 - DNA, 22 bp, Artificial Sequence
  chemically synthesized
ctttatgcttgtagagttacac

SEQ ID NO: 1290574 - DNA, 22 bp, Artificial Sequence
  chemically synthesized
tctttatgcttgtagagttaca

SEQ ID NO: 1290575 - DNA, 22 bp, Artificial Sequence
  chemically synthesized
ttaaaaaggtgtaactctacaa

SEQ ID NO: 1290576 - DNA, 22 bp, Artificial Sequence
  chemically synthesized
ttttctttatgcttgtagagtt

SEQ ID NO: 1290577 - DNA, 22 bp, Artificial Sequence
  chemically synthesized
taaaaaggtgtaactctacaag

SEQ ID NO: 1290578 - DNA, 22 bp, Artificial Sequence
  chemically synthesized
aaaaaggtgtaactctacaagc

SEQ ID NO: 1290579 - DNA, 22 bp, Artificial Sequence
  chemically synthesized
aaaaggtgtaactctacaagca

SEQ ID NO: 1290580 - DNA, 22 bp, Artificial Sequence
  chemically synthesized
ctgttttctttatgcttgtaga

SEQ ID NO: 1290581 - DNA, 22 bp, Artificial Sequence
  chemically synthesized
tcctgttttctttatgcttgta

SEQ ID NO: 1290582 - DNA, 22 bp, Artificial Sequence
  chemically synthesized
ctcctgttttctttatgcttgt

SEQ ID NO: 1290583 - DNA, 22 bp, Artificial Sequence
  chemically synthesized
ttctcctgttttctttatgctt

SEQ ID NO: 1290584 - DNA, 22 bp, Artificial Sequence
  chemically synthesized
cttctcctgttttctttatgct

SEQ ID NO: 1290585 - DNA, 22 bp, Artificial Sequence
  chemically synthesized
tcttctcctgttttctttatgc

SEQ ID NO: 1290586 - DNA, 22 bp, Artificial Sequence
  chemically synthesized
ttcttctcctgttttctttatg

SEQ ID NO: 1290587 - DNA, 22 bp, Artificial Sequence
  chemically synthesized
atttttcttctcctgttttctt

SEQ ID NO: 1290588 - DNA, 22 bp, Artificial Sequence
  chemically synthesized
tacaagcataaagaaaacagga

SEQ ID NO: 1290589 - DNA, 22 bp, Artificial Sequence
  chemically synthesized
ttcatttttcttctcctgtttt

SEQ ID NO: 1290590 - DNA, 22 bp, Artificial Sequence
  chemically synthesized
caagcataaagaaaacaggaga

SEQ ID NO: 1290591 - DNA, 22 bp, Artificial Sequence
  chemically synthesized
agttgttcatttttcttctcct

SEQ ID NO: 1290592 - DNA, 22 bp, Artificial Sequence
  chemically synthesized
gagttgttcatttttcttctcc

SEQ ID NO: 1290593 - DNA, 22 bp, Artificial Sequence
  chemically synthesized
acatcttgagttgttcattttt

SEQ ID NO: 1290594 - DNA, 22 bp, Artificial Sequence
  chemically synthesized
ctaacatcttgagttgttcatt

SEQ ID NO: 1290595 - DNA, 22 bp, Artificial Sequence
  chemically synthesized
gctaacatcttgagttgttcat

SEQ ID NO: 1290596 - DNA, 22 bp, Artificial Sequence
  chemically synthesized
ccaaaatttgctaacatcttga

SEQ ID NO: 1290597 - DNA, 22 bp, Artificial Sequence
  chemically synthesized
cccaaaatttgctaacatcttg

SEQ ID NO: 1290598 - DNA, 22 bp, Artificial Sequence
  chemically synthesized
aagatgttagcaaattttggga

SEQ ID NO: 1290599 - DNA, 22 bp, Artificial Sequence
  chemically synthesized
gcaaattttgggaagtacttcc

SEQ ID NO: 1290600 - DNA, 22 bp, Artificial Sequence
  chemically synthesized
gagccataaggcaaggaagtac

SEQ ID NO: 1290601 - DNA, 22 bp, Artificial Sequence
  chemically synthesized
ttagagccataaggcaaggaag

SEQ ID NO: 1290602 - DNA, 22 bp, Artificial Sequence
  chemically synthesized
gttagagccataaggcaaggaa

SEQ ID NO: 1290603 - DNA, 22 bp, Artificial Sequence
  chemically synthesized
tgttagagccataaggcaagga

SEQ ID NO: 1290604 - DNA, 22 bp, Artificial Sequence
  chemically synthesized
tgggaagtacttccttgcctta

SEQ ID NO: 1290605 - DNA, 22 bp, Artificial Sequence
  chemically synthesized
gggaagtacttccttgccttat

SEQ ID NO: 1290606 - DNA, 22 bp, Artificial Sequence
  chemically synthesized
ggaagtacttccttgccttatg

SEQ ID NO: 1290607 - DNA, 22 bp, Artificial Sequence
  chemically synthesized
cagcctttgttagagccataag

SEQ ID NO: 1290608 - DNA, 22 bp, Artificial Sequence
  chemically synthesized
ccttgccttatggctctaacaa

SEQ ID NO: 1290609 - DNA, 22 bp, Artificial Sequence
  chemically synthesized
cttgccttatggctctaacaaa

SEQ ID NO: 1290610 - DNA, 22 bp, Artificial Sequence
  chemically synthesized
gccttatggctctaacaaaggc

SEQ ID NO: 1290611 - DNA, 22 bp, Artificial Sequence
  chemically synthesized
ccttatggctctaacaaaggct

SEQ ID NO: 1290612 - DNA, 22 bp, Artificial Sequence
  chemically synthesized
atggctctaacaaaggctgcag

SEQ ID NO: 1290613 - DNA, 22 bp, Artificial Sequence
  chemically synthesized
tggctctaacaaaggctgcagg

SEQ ID NO: 1290614 - DNA, 22 bp, Artificial Sequence
  chemically synthesized
taacaaaggctgcaggctcacc

SEQ ID NO: 1290615 - DNA, 22 bp, Artificial Sequence
  chemically synthesized
acaaaggctgcaggctcaccca

SEQ ID NO: 1290616 - DNA, 22 bp, Artificial Sequence
  chemically synthesized
gccaaggaacatagtgggtgag

SEQ ID NO: 1290617 - DNA, 22 bp, Artificial Sequence
  chemically synthesized
atcctggccaaggaacatagtg

SEQ ID NO: 1290618 - DNA, 22 bp, Artificial Sequence
  chemically synthesized
catcctggccaaggaacatagt

SEQ ID NO: 1290619 - DNA, 22 bp, Artificial Sequence
  chemically synthesized
caggctcacccactatgttcct

SEQ ID NO: 1290620 - DNA, 22 bp, Artificial Sequence
  chemically synthesized
acccactatgttccttggccag

SEQ ID NO: 1290621 - DNA, 22 bp, Artificial Sequence
  chemically synthesized
tgttccttggccaggatgaagt

SEQ ID NO: 1290622 - DNA, 22 bp, Artificial Sequence
  chemically synthesized
gaagaatatatgatacttcatc

SEQ ID NO: 1290623 - DNA, 22 bp, Artificial Sequence
  chemically synthesized
cttggccaggatgaagtatcat

SEQ ID NO: 1290624 - DNA, 22 bp, Artificial Sequence
  chemically synthesized
attagaagaatatatgatactt

SEQ ID NO: 1290625 - DNA, 22 bp, Artificial Sequence
  chemically synthesized
ggccaggatgaagtatcatata

SEQ ID NO: 1290626 - DNA, 22 bp, Artificial Sequence
  chemically synthesized
gccaggatgaagtatcatatat

SEQ ID NO: 1290627 - DNA, 22 bp, Artificial Sequence
  chemically synthesized
aaagaagtcacagctcattaga

SEQ ID NO: 1290628 - DNA, 22 bp, Artificial Sequence
  chemically synthesized
cacactgaaagaagtcacagct

SEQ ID NO: 1290629 - DNA, 22 bp, Artificial Sequence
  chemically synthesized
ttctaatgagctgtgacttctt

SEQ ID NO: 1290630 - DNA, 22 bp, Artificial Sequence
  chemically synthesized
attccacactgaaagaagtcac

SEQ ID NO: 1290631 - DNA, 22 bp, Artificial Sequence
  chemically synthesized
ctaatgagctgtgacttctttc

SEQ ID NO: 1290632 - DNA, 22 bp, Artificial Sequence
  chemically synthesized
taatgagctgtgacttctttca

SEQ ID NO: 1290633 - DNA, 22 bp, Artificial Sequence
  chemically synthesized
atgagctgtgacttctttcagt

SEQ ID NO: 1290634 - DNA, 22 bp, Artificial Sequence
  chemically synthesized
gtaagtctcattccacactgaa

SEQ ID NO: 1290635 - DNA, 22 bp, Artificial Sequence
  chemically synthesized
tgacttctttcagtgtggaatg

SEQ ID NO: 1290636 - DNA, 22 bp, Artificial Sequence
  chemically synthesized
attggtaagtctcattccacac

SEQ ID NO: 1290637 - DNA, 22 bp, Artificial Sequence
  chemically synthesized
ctttcagtgtggaatgagactt

SEQ ID NO: 1290638 - DNA, 22 bp, Artificial Sequence
  chemically synthesized
tttcagtgtggaatgagactta

SEQ ID NO: 1290639 - DNA, 22 bp, Artificial Sequence
  chemically synthesized
tcagtgtggaatgagacttacc

SEQ ID NO: 1290640 - DNA, 22 bp, Artificial Sequence
  chemically synthesized
cagtgtggaatgagacttacca

SEQ ID NO: 1290641 - DNA, 22 bp, Artificial Sequence
  chemically synthesized
agtgtggaatgagacttaccaa

SEQ ID NO: 1290642 - DNA, 22 bp, Artificial Sequence
  chemically synthesized
gcatgcagatattcattggtaa

SEQ ID NO: 1290643 - DNA, 22 bp, Artificial Sequence
  chemically synthesized
accaatgaatatctgcatgcta

SEQ ID NO: 1290644 - DNA, 22 bp, Artificial Sequence
  chemically synthesized
ccaatgaatatctgcatgctag

SEQ ID NO: 1290645 - DNA, 22 bp, Artificial Sequence
  chemically synthesized
gtagtaatgagtatacctagca

SEQ ID NO: 1290646 - DNA, 22 bp, Artificial Sequence
  chemically synthesized
catgctaggtatactcattact

SEQ ID NO: 1290647 - DNA, 22 bp, Artificial Sequence
  chemically synthesized
ggaaggtctggtagtaatgagt

SEQ ID NO: 1290648 - DNA, 22 bp, Artificial Sequence
  chemically synthesized
ggtatactcattactaccagac

SEQ ID NO: 1290649 - DNA, 22 bp, Artificial Sequence
  chemically synthesized
tcagctgggaaggtctggtagt

SEQ ID NO: 1290650 - DNA, 22 bp, Artificial Sequence
  chemically synthesized
tatcagctgggaaggtctggta

SEQ ID NO: 1290651 - DNA, 22 bp, Artificial Sequence
  chemically synthesized
ctatcagctgggaaggtctggt

SEQ ID NO: 1290652 - DNA, 22 bp, Artificial Sequence
  chemically synthesized
attactaccagaccttcccagc

SEQ ID NO: 1290653 - DNA, 22 bp, Artificial Sequence
  chemically synthesized
ctaccagaccttcccagctgat

SEQ ID NO: 1290654 - DNA, 22 bp, Artificial Sequence
  chemically synthesized
ccagaccttcccagctgataga

SEQ ID NO: 1290655 - DNA, 22 bp, Artificial Sequence
  chemically synthesized
taaaaatatatttctatcagct

SEQ ID NO: 1290656 - DNA, 22 bp, Artificial Sequence
  chemically synthesized
gtaaaaatatatttctatcagc

SEQ ID NO: 1290657 - DNA, 22 bp, Artificial Sequence
  chemically synthesized
tgtaaaaatatatttctatcag

SEQ ID NO: 1290658 - DNA, 22 bp, Artificial Sequence
  chemically synthesized
cccagctgatagaaatatattt

SEQ ID NO: 1290659 - DNA, 22 bp, Artificial Sequence
  chemically synthesized
ccagctgatagaaatatatttt

SEQ ID NO: 1290660 - DNA, 22 bp, Artificial Sequence
  chemically synthesized
aaatgtgttttgtaaaaatata

SEQ ID NO: 1290661 - DNA, 22 bp, Artificial Sequence
  chemically synthesized
ttaaaatgtgttttgtaaaaat

SEQ ID NO: 1290662 - DNA, 22 bp, Artificial Sequence
  chemically synthesized
gttaaaatgtgttttgtaaaaa

SEQ ID NO: 1290663 - DNA, 22 bp, Artificial Sequence
  chemically synthesized
atagaaatatatttttacaaaa

SEQ ID NO: 1290664 - DNA, 22 bp, Artificial Sequence
  chemically synthesized
acaatttgttaaaatgtgtttt

SEQ ID NO: 1290665 - DNA, 22 bp, Artificial Sequence
  chemically synthesized
ttacaaaacacattttaacaaa

SEQ ID NO: 1290666 - DNA, 22 bp, Artificial Sequence
  chemically synthesized
tacaaaacacattttaacaaat

SEQ ID NO: 1290667 - DNA, 22 bp, Artificial Sequence
  chemically synthesized
acaaaacacattttaacaaatt

SEQ ID NO: 1290668 - DNA, 22 bp, Artificial Sequence
  chemically synthesized
caaaacacattttaacaaattg

SEQ ID NO: 1290669 - DNA, 22 bp, Artificial Sequence
  chemically synthesized
aataaaaactaacaatttgtta

SEQ ID NO: 1290670 - DNA, 22 bp, Artificial Sequence
  chemically synthesized
caataaaaactaacaatttgtt

SEQ ID NO: 1290671 - DNA, 22 bp, Artificial Sequence
  chemically synthesized
tcaataaaaactaacaatttgt

SEQ ID NO: 1290672 - DNA, 22 bp, Artificial Sequence
  chemically synthesized
taacaaattgttagtttttatt

SEQ ID NO: 1290673 - DNA, 22 bp, Artificial Sequence
  chemically synthesized
aacaaattgttagtttttattg

SEQ ID NO: 1290674 - DNA, 22 bp, Artificial Sequence
  chemically synthesized
aatataaattttcaataaaaac

SEQ ID NO: 1290675 - DNA, 22 bp, Artificial Sequence
  chemically synthesized
acaaattgttagtttttattga

SEQ ID NO: 1290676 - DNA, 22 bp, Artificial Sequence
  chemically synthesized
tcatattaaatataaattttca

SEQ ID NO: 1290677 - DNA, 22 bp, Artificial Sequence
  chemically synthesized
ttagtttttattgaaaatttat

SEQ ID NO: 1290678 - DNA, 22 bp, Artificial Sequence
  chemically synthesized
gtttttattgaaaatttatatt

SEQ ID NO: 1290679 - DNA, 22 bp, Artificial Sequence
  chemically synthesized
ttattgaaaatttatatttaat

SEQ ID NO: 1290680 - DNA, 22 bp, Artificial Sequence
  chemically synthesized
tattgaaaatttatatttaata

SEQ ID NO: 1290681 - DNA, 22 bp, Artificial Sequence
  chemically synthesized
attgaaaatttatatttaatat

SEQ ID NO: 1290682 - DNA, 22 bp, Artificial Sequence
  chemically synthesized
gggaaaactatcatattaaata

SEQ ID NO: 1290683 - DNA, 22 bp, Artificial Sequence
  chemically synthesized
ttgaaaatttatatttaatatg

SEQ ID NO: 1290684 - DNA, 22 bp, Artificial Sequence
  chemically synthesized
agggaaaactatcatattaaat

SEQ ID NO: 1290685 - DNA, 22 bp, Artificial Sequence
  chemically synthesized
aaaatttatatttaatatgata

SEQ ID NO: 1290686 - DNA, 22 bp, Artificial Sequence
  chemically synthesized
aaacttagggaaaactatcata

SEQ ID NO: 1290687 - DNA, 22 bp, Artificial Sequence
  chemically synthesized
atatttaatatgatagttttcc

SEQ ID NO: 1290688 - DNA, 22 bp, Artificial Sequence
  chemically synthesized
tatttaatatgatagttttccc

SEQ ID NO: 1290689 - DNA, 22 bp, Artificial Sequence
  chemically synthesized
taaattaaaacttagggaaaac

SEQ ID NO: 1290690 - DNA, 22 bp, Artificial Sequence
  chemically synthesized
aatatgatagttttccctaagt

SEQ ID NO: 1290691 - DNA, 22 bp, Artificial Sequence
  chemically synthesized
atatgatagttttccctaagtt

SEQ ID NO: 1290692 - DNA, 22 bp, Artificial Sequence
  chemically synthesized
tccctaagttttaatttataat

SEQ ID NO: 1290693 - DNA, 22 bp, Artificial Sequence
  chemically synthesized
ccctaagttttaatttataatt

SEQ ID NO: 1290694 - DNA, 22 bp, Artificial Sequence
  chemically synthesized
cctaagttttaatttataattt

SEQ ID NO: 1290695 - DNA, 22 bp, Artificial Sequence
  chemically synthesized
agttttaatttataattttatg

SEQ ID NO: 1290696 - DNA, 22 bp, Artificial Sequence
  chemically synthesized
taatttataattttatgtttcc

SEQ ID NO: 1290697 - DNA, 22 bp, Artificial Sequence
  chemically synthesized
aatttataattttatgtttccc

SEQ ID NO: 1290698 - DNA, 22 bp, Artificial Sequence
  chemically synthesized
atttataattttatgtttccct

SEQ ID NO: 1290699 - DNA, 22 bp, Artificial Sequence
  chemically synthesized
ataattttatgtttccctatcc

SEQ ID NO: 1290700 - DNA, 22 bp, Artificial Sequence
  chemically synthesized
taattttatgtttccctatccc

SEQ ID NO: 1290701 - DNA, 22 bp, Artificial Sequence
  chemically synthesized
tatgtttccctatcccttcatc

SEQ ID NO: 1290702 - DNA, 22 bp, Artificial Sequence
  chemically synthesized
aaaataaatatcgatgaaggga

SEQ ID NO: 1290703 - DNA, 22 bp, Artificial Sequence
  chemically synthesized
atgtttccctatcccttcatcg

SEQ ID NO: 1290704 - DNA, 22 bp, Artificial Sequence
  chemically synthesized
tgtttccctatcccttcatcga

SEQ ID NO: 1290705 - DNA, 22 bp, Artificial Sequence
  chemically synthesized
ccctatcccttcatcgatattt

SEQ ID NO: 1290706 - DNA, 22 bp, Artificial Sequence
  chemically synthesized
cctatcccttcatcgatattta

SEQ ID NO: 1290707 - DNA, 22 bp, Artificial Sequence
  chemically synthesized
tcccttcatcgatatttatttt

SEQ ID NO: 1290708 - DNA, 22 bp, Artificial Sequence
  chemically synthesized
catcgatatttatttttagtgt

SEQ ID NO: 1290709 - DNA, 22 bp, Artificial Sequence
  chemically synthesized
atcgatatttatttttagtgtt

SEQ ID NO: 1290710 - DNA, 22 bp, Artificial Sequence
  chemically synthesized
atttttagtgtttttctggtta

SEQ ID NO: 1290711 - DNA, 22 bp, Artificial Sequence
  chemically synthesized
tttttagtgtttttctggttat

SEQ ID NO: 1290712 - DNA, 22 bp, Artificial Sequence
  chemically synthesized
ttagtgtttttctggttatttt

SEQ ID NO: 1290713 - DNA, 22 bp, Artificial Sequence
  chemically synthesized
tagtgtttttctggttattttt

SEQ ID NO: 1290714 - DNA, 22 bp, Artificial Sequence
  chemically synthesized
agtgtttttctggttattttta

SEQ ID NO: 1290715 - DNA, 22 bp, Artificial Sequence
  chemically synthesized
gtgtttttctggttatttttac

SEQ ID NO: 1290716 - DNA, 22 bp, Artificial Sequence
  chemically synthesized
taaaaaaatacacaagtaaaaa

SEQ ID NO: 1290717 - DNA, 22 bp, Artificial Sequence
  chemically synthesized
ataaaaaaatacacaagtaaaa

SEQ ID NO: 1290718 - DNA, 22 bp, Artificial Sequence
  chemically synthesized
tataaaaaaatacacaagtaaa

SEQ ID NO: 1290719 - DNA, 22 bp, Artificial Sequence
  chemically synthesized
ttctggttatttttacttgtgt

SEQ ID NO: 1290720 - DNA, 22 bp, Artificial Sequence
  chemically synthesized
ttataaaaaaatacacaagtaa

SEQ ID NO: 1290721 - DNA, 22 bp, Artificial Sequence
  chemically synthesized
tctggttatttttacttgtgta

SEQ ID NO: 1290722 - DNA, 22 bp, Artificial Sequence
  chemically synthesized
tttataaaaaaatacacaagta

SEQ ID NO: 1290723 - DNA, 22 bp, Artificial Sequence
  chemically synthesized
ctggttatttttacttgtgtat

SEQ ID NO: 1290724 - DNA, 22 bp, Artificial Sequence
  chemically synthesized
tggttatttttacttgtgtatt

SEQ ID NO: 1290725 - DNA, 22 bp, Artificial Sequence
  chemically synthesized
gttatttttacttgtgtatttt

SEQ ID NO: 1290726 - DNA, 22 bp, Artificial Sequence
  chemically synthesized
taaactttttataaaaaaatac

SEQ ID NO: 1290727 - DNA, 22 bp, Artificial Sequence
  chemically synthesized
tttttacttgtgtattttttta

SEQ ID NO: 1290728 - DNA, 22 bp, Artificial Sequence
  chemically synthesized
ttacttgtgtatttttttataa

SEQ ID NO: 1290729 - DNA, 22 bp, Artificial Sequence
  chemically synthesized
attataaactttttataaaaaa

SEQ ID NO: 1290730 - DNA, 22 bp, Artificial Sequence
  chemically synthesized
tacttgtgtatttttttataaa

SEQ ID NO: 1290731 - DNA, 22 bp, Artificial Sequence
  chemically synthesized
acttgtgtatttttttataaaa

SEQ ID NO: 1290732 - DNA, 22 bp, Artificial Sequence
  chemically synthesized
cttgtgtatttttttataaaaa

SEQ ID NO: 1290733 - DNA, 22 bp, Artificial Sequence
  chemically synthesized
gtgtatttttttataaaaagtt

SEQ ID NO: 1290734 - DNA, 22 bp, Artificial Sequence
  chemically synthesized
tgtatttttttataaaaagttt

SEQ ID NO: 1290735 - DNA, 22 bp, Artificial Sequence
  chemically synthesized
gataaattgattataaactttt

SEQ ID NO: 1290736 - DNA, 22 bp, Artificial Sequence
  chemically synthesized
ttttataaaaagtttataatca

SEQ ID NO: 1290737 - DNA, 22 bp, Artificial Sequence
  chemically synthesized
tttataaaaagtttataatcaa

SEQ ID NO: 1290738 - DNA, 22 bp, Artificial Sequence
  chemically synthesized
gagttggataaattgattataa

SEQ ID NO: 1290739 - DNA, 22 bp, Artificial Sequence
  chemically synthesized
ttataaaaagtttataatcaat

SEQ ID NO: 1290740 - DNA, 22 bp, Artificial Sequence
  chemically synthesized
tataaaaagtttataatcaatt

SEQ ID NO: 1290741 - DNA, 22 bp, Artificial Sequence
  chemically synthesized
tggagttggataaattgattat

SEQ ID NO: 1290742 - DNA, 22 bp, Artificial Sequence
  chemically synthesized
ataaaaagtttataatcaattt

SEQ ID NO: 1290743 - DNA, 22 bp, Artificial Sequence
  chemically synthesized
ctggagttggataaattgatta

SEQ ID NO: 1290744 - DNA, 22 bp, Artificial Sequence
  chemically synthesized
taaaaagtttataatcaattta

SEQ ID NO: 1290745 - DNA, 22 bp, Artificial Sequence
  chemically synthesized
tctggagttggataaattgatt

SEQ ID NO: 1290746 - DNA, 22 bp, Artificial Sequence
  chemically synthesized
ttctggagttggataaattgat

SEQ ID NO: 1290747 - DNA, 22 bp, Artificial Sequence
  chemically synthesized
tttctggagttggataaattga

SEQ ID NO: 1290748 - DNA, 22 bp, Artificial Sequence
  chemically synthesized
ttttctggagttggataaattg

SEQ ID NO: 1290749 - DNA, 22 bp, Artificial Sequence
  chemically synthesized
ataatcaatttatccaactcca

SEQ ID NO: 1290750 - DNA, 22 bp, Artificial Sequence
  chemically synthesized
taatcaatttatccaactccag

SEQ ID NO: 1290751 - DNA, 22 bp, Artificial Sequence
  chemically synthesized
atccaactccagaaaaaaatac

SEQ ID NO: 1290752 - DNA, 22 bp, Artificial Sequence
  chemically synthesized
tccaactccagaaaaaaatact

SEQ ID NO: 1290753 - DNA, 22 bp, Artificial Sequence
  chemically synthesized
caatataataagtagtattttt

SEQ ID NO: 1290754 - DNA, 22 bp, Artificial Sequence
  chemically synthesized
cagaaaaaaatactacttatta

SEQ ID NO: 1290755 - DNA, 22 bp, Artificial Sequence
  chemically synthesized
aaggcattccaatataataagt

SEQ ID NO: 1290756 - DNA, 22 bp, Artificial Sequence
  chemically synthesized
atgtgtaaattaaaggcattcc

SEQ ID NO: 1290757 - DNA, 22 bp, Artificial Sequence
  chemically synthesized
cttattatattggaatgccttt

SEQ ID NO: 1290758 - DNA, 22 bp, Artificial Sequence
  chemically synthesized
attatattggaatgcctttaat

SEQ ID NO: 1290759 - DNA, 22 bp, Artificial Sequence
  chemically synthesized
ttatattggaatgcctttaatt

SEQ ID NO: 1290760 - DNA, 22 bp, Artificial Sequence
  chemically synthesized
agttaatgtgtaaattaaaggc

SEQ ID NO: 1290761 - DNA, 22 bp, Artificial Sequence
  chemically synthesized
aagttaatgtgtaaattaaagg

SEQ ID NO: 1290762 - DNA, 22 bp, Artificial Sequence
  chemically synthesized
taagttaatgtgtaaattaaag

SEQ ID NO: 1290763 - DNA, 22 bp, Artificial Sequence
  chemically synthesized
tattggaatgcctttaatttac

SEQ ID NO: 1290764 - DNA, 22 bp, Artificial Sequence
  chemically synthesized
ttaagttaatgtgtaaattaaa

SEQ ID NO: 1290765 - DNA, 22 bp, Artificial Sequence
  chemically synthesized
tttttaagttaatgtgtaaatt

SEQ ID NO: 1290766 - DNA, 22 bp, Artificial Sequence
  chemically synthesized
gaatgcctttaatttacacatt

SEQ ID NO: 1290767 - DNA, 22 bp, Artificial Sequence
  chemically synthesized
ttgtttttaagttaatgtgtaa

SEQ ID NO: 1290768 - DNA, 22 bp, Artificial Sequence
  chemically synthesized
taatttacacattaacttaaaa

SEQ ID NO: 1290769 - DNA, 22 bp, Artificial Sequence
  chemically synthesized
aatttacacattaacttaaaaa

SEQ ID NO: 1290770 - DNA, 22 bp, Artificial Sequence
  chemically synthesized
atttacacattaacttaaaaac

SEQ ID NO: 1290771 - DNA, 22 bp, Artificial Sequence
  chemically synthesized
taaagtaaactattgtttttaa

SEQ ID NO: 1290772 - DNA, 22 bp, Artificial Sequence
  chemically synthesized
acacattaacttaaaaacaata

SEQ ID NO: 1290773 - DNA, 22 bp, Artificial Sequence
  chemically synthesized
cacattaacttaaaaacaatag

SEQ ID NO: 1290774 - DNA, 22 bp, Artificial Sequence
  chemically synthesized
acattataaagtaaactattgt

SEQ ID NO: 1290775 - DNA, 22 bp, Artificial Sequence
  chemically synthesized
aacattataaagtaaactattg

SEQ ID NO: 1290776 - DNA, 22 bp, Artificial Sequence
  chemically synthesized
acttaaaaacaatagtttactt

SEQ ID NO: 1290777 - DNA, 22 bp, Artificial Sequence
  chemically synthesized
aaaaacaatagtttactttata

SEQ ID NO: 1290778 - DNA, 22 bp, Artificial Sequence
  chemically synthesized
aaaacaatagtttactttataa

SEQ ID NO: 1290779 - DNA, 22 bp, Artificial Sequence
  chemically synthesized
aaaagcatggcttaacattata

SEQ ID NO: 1290780 - DNA, 22 bp, Artificial Sequence
  chemically synthesized
ctgaaaagcatggcttaacatt

SEQ ID NO: 1290781 - DNA, 22 bp, Artificial Sequence
  chemically synthesized
ttcctgaaaagcatggcttaac

SEQ ID NO: 1290782 - DNA, 22 bp, Artificial Sequence
  chemically synthesized
gttcctgaaaagcatggcttaa

SEQ ID NO: 1290783 - DNA, 22 bp, Artificial Sequence
  chemically synthesized
actttataatgttaagccatgc

SEQ ID NO: 1290784 - DNA, 22 bp, Artificial Sequence
  chemically synthesized
ctttataatgttaagccatgct

SEQ ID NO: 1290785 - DNA, 22 bp, Artificial Sequence
  chemically synthesized
cttgttcctgaaaagcatggct

SEQ ID NO: 1290786 - DNA, 22 bp, Artificial Sequence
  chemically synthesized
tataatgttaagccatgctttt

SEQ ID NO: 1290787 - DNA, 22 bp, Artificial Sequence
  chemically synthesized
ataatgttaagccatgcttttc

SEQ ID NO: 1290788 - DNA, 22 bp, Artificial Sequence
  chemically synthesized
taatgttaagccatgcttttca

SEQ ID NO: 1290789 - DNA, 22 bp, Artificial Sequence
  chemically synthesized
agccatgcttttcaggaacaag

SEQ ID NO: 1290790 - DNA, 22 bp, Artificial Sequence
  chemically synthesized
ttcaggaacaaggagcatcttt

SEQ ID NO: 1290791 - DNA, 22 bp, Artificial Sequence
  chemically synthesized
tcaggaacaaggagcatctttc

SEQ ID NO: 1290792 - DNA, 22 bp, Artificial Sequence
  chemically synthesized
caggaacaaggagcatctttct

SEQ ID NO: 1290793 - DNA, 22 bp, Artificial Sequence
  chemically synthesized
aggaacaaggagcatctttctc

SEQ ID NO: 1290794 - DNA, 22 bp, Artificial Sequence
  chemically synthesized
aacaacccaaaaggaaatcaag

SEQ ID NO: 1290795 - DNA, 22 bp, Artificial Sequence
  chemically synthesized
ctgaacaacccaaaaggaaatc

SEQ ID NO: 1290796 - DNA, 22 bp, Artificial Sequence
  chemically synthesized
tcctgaacaacccaaaaggaaa

SEQ ID NO: 1290797 - DNA, 22 bp, Artificial Sequence
  chemically synthesized
tctccttgatttccttttgggt

SEQ ID NO: 1290798 - DNA, 22 bp, Artificial Sequence
  chemically synthesized
ctccttgatttccttttgggtt

SEQ ID NO: 1290799 - DNA, 22 bp, Artificial Sequence
  chemically synthesized
tccttgatttccttttgggttg

SEQ ID NO: 1290800 - DNA, 22 bp, Artificial Sequence
  chemically synthesized
aaactctcctgaacaacccaaa

SEQ ID NO: 1290801 - DNA, 22 bp, Artificial Sequence
  chemically synthesized
cttgatttccttttgggttgtt

SEQ ID NO: 1290802 - DNA, 22 bp, Artificial Sequence
  chemically synthesized
aaaactctcctgaacaacccaa

SEQ ID NO: 1290803 - DNA, 22 bp, Artificial Sequence
  chemically synthesized
gatttccttttgggttgttcag

SEQ ID NO: 1290804 - DNA, 22 bp, Artificial Sequence
  chemically synthesized
atttccttttgggttgttcagg

SEQ ID NO: 1290805 - DNA, 22 bp, Artificial Sequence
  chemically synthesized
tgtttaaaactctcctgaacaa

SEQ ID NO: 1290806 - DNA, 22 bp, Artificial Sequence
  chemically synthesized
ccttttgggttgttcaggagag

SEQ ID NO: 1290807 - DNA, 22 bp, Artificial Sequence
  chemically synthesized
cttttgggttgttcaggagagt

SEQ ID NO: 1290808 - DNA, 22 bp, Artificial Sequence
  chemically synthesized
ttgggttgttcaggagagtttt

SEQ ID NO: 1290809 - DNA, 22 bp, Artificial Sequence
  chemically synthesized
tgggttgttcaggagagtttta

SEQ ID NO: 1290810 - DNA, 22 bp, Artificial Sequence
  chemically synthesized
agtacctatgtttaaaactctc

SEQ ID NO: 1290811 - DNA, 22 bp, Artificial Sequence
  chemically synthesized
gggttgttcaggagagttttaa

SEQ ID NO: 1290812 - DNA, 22 bp, Artificial Sequence
  chemically synthesized
cagtacctatgtttaaaactct

SEQ ID NO: 1290813 - DNA, 22 bp, Artificial Sequence
  chemically synthesized
ggttgttcaggagagttttaaa

SEQ ID NO: 1290814 - DNA, 22 bp, Artificial Sequence
  chemically synthesized
ttcaggagagttttaaacatag

SEQ ID NO: 1290815 - DNA, 22 bp, Artificial Sequence
  chemically synthesized
aggagagttttaaacataggta

SEQ ID NO: 1290816 - DNA, 22 bp, Artificial Sequence
  chemically synthesized
acaagaaatttcagtacctatg

SEQ ID NO: 1290817 - DNA, 22 bp, Artificial Sequence
  chemically synthesized
aacaagaaatttcagtacctat

SEQ ID NO: 1290818 - DNA, 22 bp, Artificial Sequence
  chemically synthesized
taaacataggtactgaaatttc

SEQ ID NO: 1290819 - DNA, 22 bp, Artificial Sequence
  chemically synthesized
aaacataggtactgaaatttct

SEQ ID NO: 1290820 - DNA, 22 bp, Artificial Sequence
  chemically synthesized
aacataggtactgaaatttctt

SEQ ID NO: 1290821 - DNA, 22 bp, Artificial Sequence
  chemically synthesized
aaatttcttgttaaatgtgttt

SEQ ID NO: 1290822 - DNA, 22 bp, Artificial Sequence
  chemically synthesized
cttgttaaatgtgtttcttgtt

SEQ ID NO: 1290823 - DNA, 22 bp, Artificial Sequence
  chemically synthesized
ttgttaaatgtgtttcttgttt

SEQ ID NO: 1290824 - DNA, 22 bp, Artificial Sequence
  chemically synthesized
gttaaatgtgtttcttgttttt

SEQ ID NO: 1290825 - DNA, 22 bp, Artificial Sequence
  chemically synthesized
ttaaatgtgtttcttgtttttg

SEQ ID NO: 1290826 - DNA, 22 bp, Artificial Sequence
  chemically synthesized
aatgtgtttcttgtttttgctg

SEQ ID NO: 1290827 - DNA, 22 bp, Artificial Sequence
  chemically synthesized
caacaatagcaacaacagcaaa

SEQ ID NO: 1290828 - DNA, 22 bp, Artificial Sequence
  chemically synthesized
gcaacaatagcaacaacagcaa

SEQ ID NO: 1290829 - DNA, 22 bp, Artificial Sequence
  chemically synthesized
cttgtttttgctgttgttgcta

SEQ ID NO: 1290830 - DNA, 22 bp, Artificial Sequence
  chemically synthesized
ttgtttttgctgttgttgctat

SEQ ID NO: 1290831 - DNA, 22 bp, Artificial Sequence
  chemically synthesized
gtttttgctgttgttgctattg

SEQ ID NO: 1290832 - DNA, 22 bp, Artificial Sequence
  chemically synthesized
tttttgctgttgttgctattgt

SEQ ID NO: 1290833 - DNA, 22 bp, Artificial Sequence
  chemically synthesized
ttgctgttgttgctattgttgc

SEQ ID NO: 1290834 - DNA, 22 bp, Artificial Sequence
  chemically synthesized
tgctgttgttgctattgttgca

SEQ ID NO: 1290835 - DNA, 22 bp, Artificial Sequence
  chemically synthesized
gctgttgttgctattgttgcaa

SEQ ID NO: 1290836 - DNA, 22 bp, Artificial Sequence
  chemically synthesized
ctgttgttgctattgttgcaaa

SEQ ID NO: 1290837 - DNA, 22 bp, Artificial Sequence
  chemically synthesized
ttgttgctattgttgcaaatgg

SEQ ID NO: 1290838 - DNA, 22 bp, Artificial Sequence
  chemically synthesized
tggatggtgcacacccatttgc

SEQ ID NO: 1290839 - DNA, 22 bp, Artificial Sequence
  chemically synthesized
ttgctattgttgcaaatgggtg

SEQ ID NO: 1290840 - DNA, 22 bp, Artificial Sequence
  chemically synthesized
atggatggtgcacacccatttg

SEQ ID NO: 1290841 - DNA, 22 bp, Artificial Sequence
  chemically synthesized
tatggatggtgcacacccattt

SEQ ID NO: 1290842 - DNA, 22 bp, Artificial Sequence
  chemically synthesized
ttatggatggtgcacacccatt

SEQ ID NO: 1290843 - DNA, 22 bp, Artificial Sequence
  chemically synthesized
ctattgttgcaaatgggtgtgc

SEQ ID NO: 1290844 - DNA, 22 bp, Artificial Sequence
  chemically synthesized
ttgttgcaaatgggtgtgcacc

SEQ ID NO: 1290845 - DNA, 22 bp, Artificial Sequence
  chemically synthesized
ttgcaaatgggtgtgcaccatc

SEQ ID NO: 1290846 - DNA, 22 bp, Artificial Sequence
  chemically synthesized
gaagtttttatggatggtgcac

SEQ ID NO: 1290847 - DNA, 22 bp, Artificial Sequence
  chemically synthesized
caaatgggtgtgcaccatccat

SEQ ID NO: 1290848 - DNA, 22 bp, Artificial Sequence
  chemically synthesized
taggtaatgagctagaagtttt

SEQ ID NO: 1290849 - DNA, 22 bp, Artificial Sequence
  chemically synthesized
ataggtaatgagctagaagttt

SEQ ID NO: 1290850 - DNA, 22 bp, Artificial Sequence
  chemically synthesized
tataggtaatgagctagaagtt

SEQ ID NO: 1290851 - DNA, 22 bp, Artificial Sequence
  chemically synthesized
attttataggtaatgagctaga

SEQ ID NO: 1290852 - DNA, 22 bp, Artificial Sequence
  chemically synthesized
ctagctcattacctataaaatg

SEQ ID NO: 1290853 - DNA, 22 bp, Artificial Sequence
  chemically synthesized
tagctcattacctataaaatga

SEQ ID NO: 1290854 - DNA, 22 bp, Artificial Sequence
  chemically synthesized
gctcattacctataaaatgaat

SEQ ID NO: 1290855 - DNA, 22 bp, Artificial Sequence
  chemically synthesized
attacctataaaatgaatttta

SEQ ID NO: 1290856 - DNA, 22 bp, Artificial Sequence
  chemically synthesized
caggcaaaatcagtaaaattca

SEQ ID NO: 1290857 - DNA, 22 bp, Artificial Sequence
  chemically synthesized
acaggcaaaatcagtaaaattc

SEQ ID NO: 1290858 - DNA, 22 bp, Artificial Sequence
  chemically synthesized
cctataaaatgaattttactga

SEQ ID NO: 1290859 - DNA, 22 bp, Artificial Sequence
  chemically synthesized
taaaatgaattttactgatttt

SEQ ID NO: 1290860 - DNA, 22 bp, Artificial Sequence
  chemically synthesized
taaaatttacaggcaaaatcag

SEQ ID NO: 1290861 - DNA, 22 bp, Artificial Sequence
  chemically synthesized
gcagactataaaatttacaggc

SEQ ID NO: 1290862 - DNA, 22 bp, Artificial Sequence
  chemically synthesized
tactgattttgcctgtaaattt

SEQ ID NO: 1290863 - DNA, 22 bp, Artificial Sequence
  chemically synthesized
actgattttgcctgtaaatttt

SEQ ID NO: 1290864 - DNA, 22 bp, Artificial Sequence
  chemically synthesized
ctgattttgcctgtaaatttta

SEQ ID NO: 1290865 - DNA, 22 bp, Artificial Sequence
  chemically synthesized
attttgcctgtaaattttatag

SEQ ID NO: 1290866 - DNA, 22 bp, Artificial Sequence
  chemically synthesized
gtaagttagcagactataaaat

SEQ ID NO: 1290867 - DNA, 22 bp, Artificial Sequence
  chemically synthesized
agtaagttagcagactataaaa

SEQ ID NO: 1290868 - DNA, 22 bp, Artificial Sequence
  chemically synthesized
tgcctgtaaattttatagtctg

SEQ ID NO: 1290869 - DNA, 22 bp, Artificial Sequence
  chemically synthesized
gcctgtaaattttatagtctgc

SEQ ID NO: 1290870 - DNA, 22 bp, Artificial Sequence
  chemically synthesized
cctgtaaattttatagtctgct

SEQ ID NO: 1290871 - DNA, 22 bp, Artificial Sequence
  chemically synthesized
taaattttatagtctgctaact

SEQ ID NO: 1290872 - DNA, 22 bp, Artificial Sequence
  chemically synthesized
tatagtctgctaacttactaaa

SEQ ID NO: 1290873 - DNA, 22 bp, Artificial Sequence
  chemically synthesized
atagtctgctaacttactaaat

SEQ ID NO: 1290874 - DNA, 22 bp, Artificial Sequence
  chemically synthesized
tagtctgctaacttactaaatt

SEQ ID NO: 1290875 - DNA, 22 bp, Artificial Sequence
  chemically synthesized
ctaacttactaaattattttat

SEQ ID NO: 1290876 - DNA, 22 bp, Artificial Sequence
  chemically synthesized
acttactaaattattttattgg

SEQ ID NO: 1290877 - DNA, 22 bp, Artificial Sequence
  chemically synthesized
actaaattattttattggtatt

SEQ ID NO: 1290878 - DNA, 22 bp, Artificial Sequence
  chemically synthesized
ctaaattattttattggtattt

SEQ ID NO: 1290879 - DNA, 22 bp, Artificial Sequence
  chemically synthesized
aattattttattggtatttgtt

SEQ ID NO: 1290880 - DNA, 22 bp, Artificial Sequence
  chemically synthesized
ttttattggtatttgtttgtgt

SEQ ID NO: 1290881 - DNA, 22 bp, Artificial Sequence
  chemically synthesized
tattggtatttgtttgtgttca

SEQ ID NO: 1290882 - DNA, 22 bp, Artificial Sequence
  chemically synthesized
attggtatttgtttgtgttcat

SEQ ID NO: 1290883 - DNA, 22 bp, Artificial Sequence
  chemically synthesized
acaaacacaaatatgaacacaa

SEQ ID NO: 1290884 - DNA, 22 bp, Artificial Sequence
  chemically synthesized
ttggtatttgtttgtgttcata

SEQ ID NO: 1290885 - DNA, 22 bp, Artificial Sequence
  chemically synthesized
gtatttgtttgtgttcatattt

SEQ ID NO: 1290886 - DNA, 22 bp, Artificial Sequence
  chemically synthesized
gtttgtgttcatatttgtgttt

SEQ ID NO: 1290887 - DNA, 22 bp, Artificial Sequence
  chemically synthesized
tttgtgttcatatttgtgtttg

SEQ ID NO: 1290888 - DNA, 22 bp, Artificial Sequence
  chemically synthesized
gtgttcatatttgtgtttgtta

SEQ ID NO: 1290889 - DNA, 22 bp, Artificial Sequence
  chemically synthesized
tgttcatatttgtgtttgttaa

SEQ ID NO: 1290890 - DNA, 22 bp, Artificial Sequence
  chemically synthesized
atatttgtgtttgttaatatta

SEQ ID NO: 1290891 - DNA, 22 bp, Artificial Sequence
  chemically synthesized
gtgtttgttaatattattgttt

SEQ ID NO: 1290892 - DNA, 22 bp, Artificial Sequence
  chemically synthesized
tgtttgttaatattattgtttt

SEQ ID NO: 1290893 - DNA, 22 bp, Artificial Sequence
  chemically synthesized
aagagatcacacaaaacaataa

SEQ ID NO: 1290894 - DNA, 22 bp, Artificial Sequence
  chemically synthesized
cctcaagagatcacacaaaaca

SEQ ID NO: 1290895 - DNA, 22 bp, Artificial Sequence
  chemically synthesized
gttaatattattgttttgtgtg

SEQ ID NO: 1290896 - DNA, 22 bp, Artificial Sequence
  chemically synthesized
acctcaagagatcacacaaaac

SEQ ID NO: 1290897 - DNA, 22 bp, Artificial Sequence
  chemically synthesized
ttaatattattgttttgtgtga

SEQ ID NO: 1290898 - DNA, 22 bp, Artificial Sequence
  chemically synthesized
tttacctcaagagatcacacaa

SEQ ID NO: 1290899 - DNA, 22 bp, Artificial Sequence
  chemically synthesized
atattattgttttgtgtgatct

SEQ ID NO: 1290900 - DNA, 22 bp, Artificial Sequence
  chemically synthesized
ttgttttgtgtgatctcttgag

SEQ ID NO: 1290901 - DNA, 22 bp, Artificial Sequence
  chemically synthesized
ttttgtgtgatctcttgaggta

SEQ ID NO: 1290902 - DNA, 22 bp, Artificial Sequence
  chemically synthesized
cagatagaattgtttacctcaa

SEQ ID NO: 1290903 - DNA, 22 bp, Artificial Sequence
  chemically synthesized
tgtgtgatctcttgaggtaaac

SEQ ID NO: 1290904 - DNA, 22 bp, Artificial Sequence
  chemically synthesized
acagatagaattgtttacctca

SEQ ID NO: 1290905 - DNA, 22 bp, Artificial Sequence
  chemically synthesized
gtgtgatctcttgaggtaaaca

SEQ ID NO: 1290906 - DNA, 22 bp, Artificial Sequence
  chemically synthesized
tgtgatctcttgaggtaaacaa

SEQ ID NO: 1290907 - DNA, 22 bp, Artificial Sequence
  chemically synthesized
ttgaggtaaacaattctatctg

SEQ ID NO: 1290908 - DNA, 22 bp, Artificial Sequence
  chemically synthesized
gaggtaaacaattctatctgta

SEQ ID NO: 1290909 - DNA, 22 bp, Artificial Sequence
  chemically synthesized
aggtaaacaattctatctgtaa

SEQ ID NO: 1290910 - DNA, 22 bp, Artificial Sequence
  chemically synthesized
tatctgtaaattgggatcccat

SEQ ID NO: 1290911 - DNA, 22 bp, Artificial Sequence
  chemically synthesized
caagcagtggtaatgggatccc

SEQ ID NO: 1290912 - DNA, 22 bp, Artificial Sequence
  chemically synthesized
tctgtaaattgggatcccatta

SEQ ID NO: 1290913 - DNA, 22 bp, Artificial Sequence
  chemically synthesized
taaattgggatcccattaccac

SEQ ID NO: 1290914 - DNA, 22 bp, Artificial Sequence
  chemically synthesized
ggatcccattaccactgcttgc

SEQ ID NO: 1290915 - DNA, 22 bp, Artificial Sequence
  chemically synthesized
gaggcaaaacaattgcaagcag

SEQ ID NO: 1290916 - DNA, 22 bp, Artificial Sequence
  chemically synthesized
ccactgcttgcaattgttttgc

SEQ ID NO: 1290917 - DNA, 22 bp, Artificial Sequence
  chemically synthesized
cttgcaattgttttgcctcgaa

SEQ ID NO: 1290918 - DNA, 22 bp, Artificial Sequence
  chemically synthesized
gcaattgttttgcctcgaattg

SEQ ID NO: 1290919 - DNA, 22 bp, Artificial Sequence
  chemically synthesized
caattgttttgcctcgaattgg

SEQ ID NO: 1290920 - DNA, 22 bp, Artificial Sequence
  chemically synthesized
caaccagacaagataaaccaat

SEQ ID NO: 1290921 - DNA, 22 bp, Artificial Sequence
  chemically synthesized
ttttgcctcgaattggtttatc

SEQ ID NO: 1290922 - DNA, 22 bp, Artificial Sequence
  chemically synthesized
tgcctcgaattggtttatcttg

SEQ ID NO: 1290923 - DNA, 22 bp, Artificial Sequence
  chemically synthesized
gcctcgaattggtttatcttgt

SEQ ID NO: 1290924 - DNA, 22 bp, Artificial Sequence
  chemically synthesized
cctcgaattggtttatcttgtc

SEQ ID NO: 1290925 - DNA, 22 bp, Artificial Sequence
  chemically synthesized
gccattgcaaccagacaagata

SEQ ID NO: 1290926 - DNA, 22 bp, Artificial Sequence
  chemically synthesized
gaattggtttatcttgtctggt

SEQ ID NO: 1290927 - DNA, 22 bp, Artificial Sequence
  chemically synthesized
gtttatcttgtctggttgcaat

SEQ ID NO: 1290928 - DNA, 22 bp, Artificial Sequence
  chemically synthesized
aaaatattagccattgcaacca

SEQ ID NO: 1290929 - DNA, 22 bp, Artificial Sequence
  chemically synthesized
atcttgtctggttgcaatggct

SEQ ID NO: 1290930 - DNA, 22 bp, Artificial Sequence
  chemically synthesized
tcttgtctggttgcaatggcta

SEQ ID NO: 1290931 - DNA, 22 bp, Artificial Sequence
  chemically synthesized
tgttgaaaatattagccattgc

SEQ ID NO: 1290932 - DNA, 22 bp, Artificial Sequence
  chemically synthesized
gtctggttgcaatggctaatat

SEQ ID NO: 1290933 - DNA, 22 bp, Artificial Sequence
  chemically synthesized
tctggttgcaatggctaatatt

SEQ ID NO: 1290934 - DNA, 22 bp, Artificial Sequence
  chemically synthesized
acattgtgttgaaaatattagc

SEQ ID NO: 1290935 - DNA, 22 bp, Artificial Sequence
  chemically synthesized
aacattgtgttgaaaatattag

SEQ ID NO: 1290936 - DNA, 22 bp, Artificial Sequence
  chemically synthesized
gttgcaatggctaatattttca

SEQ ID NO: 1290937 - DNA, 22 bp, Artificial Sequence
  chemically synthesized
caatggctaatattttcaacac

SEQ ID NO: 1290938 - DNA, 22 bp, Artificial Sequence
  chemically synthesized
atacttaacattgtgttgaaaa

SEQ ID NO: 1290939 - DNA, 22 bp, Artificial Sequence
  chemically synthesized
cattaatacttaacattgtgtt

SEQ ID NO: 1290940 - DNA, 22 bp, Artificial Sequence
  chemically synthesized
atattttcaacacaatgttaag

SEQ ID NO: 1290941 - DNA, 22 bp, Artificial Sequence
  chemically synthesized
cctccattaatacttaacattg

SEQ ID NO: 1290942 - DNA, 22 bp, Artificial Sequence
  chemically synthesized
tcaacacaatgttaagtattaa

SEQ ID NO: 1290943 - DNA, 22 bp, Artificial Sequence
  chemically synthesized
cagctacctccattaatactta

SEQ ID NO: 1290944 - DNA, 22 bp, Artificial Sequence
  chemically synthesized
caacacaatgttaagtattaat

SEQ ID NO: 1290945 - DNA, 22 bp, Artificial Sequence
  chemically synthesized
aacacaatgttaagtattaatg

SEQ ID NO: 1290946 - DNA, 22 bp, Artificial Sequence
  chemically synthesized
agtattaatggaggtagctgta

SEQ ID NO: 1290947 - DNA, 22 bp, Artificial Sequence
  chemically synthesized
atggaggtagctgtagtactca

SEQ ID NO: 1290948 - DNA, 22 bp, Artificial Sequence
  chemically synthesized
gataaagacaggaaaaccatat

SEQ ID NO: 1290949 - DNA, 22 bp, Artificial Sequence
  chemically synthesized
tggataaagacaggaaaaccat

SEQ ID NO: 1290950 - DNA, 22 bp, Artificial Sequence
  chemically synthesized
tagtactcatatggttttcctg

SEQ ID NO: 1290951 - DNA, 22 bp, Artificial Sequence
  chemically synthesized
atgcattctggataaagacagg

SEQ ID NO: 1290952 - DNA, 22 bp, Artificial Sequence
  chemically synthesized
atatggttttcctgtctttatc

SEQ ID NO: 1290953 - DNA, 22 bp, Artificial Sequence
  chemically synthesized
tcctgtctttatccagaatgca

SEQ ID NO: 1290954 - DNA, 22 bp, Artificial Sequence
  chemically synthesized
cctgtctttatccagaatgcat

SEQ ID NO: 1290955 - DNA, 22 bp, Artificial Sequence
  chemically synthesized
ctgtctttatccagaatgcatc

SEQ ID NO: 1290956 - DNA, 22 bp, Artificial Sequence
  chemically synthesized
aagaagaaacatctgatgcatt

SEQ ID NO: 1290957 - DNA, 22 bp, Artificial Sequence
  chemically synthesized
tctttatccagaatgcatcaga

SEQ ID NO: 1290958 - DNA, 22 bp, Artificial Sequence
  chemically synthesized
aaagaagaaacatctgatgcat

SEQ ID NO: 1290959 - DNA, 22 bp, Artificial Sequence
  chemically synthesized
cttaaagaagaaacatctgatg

SEQ ID NO: 1290960 - DNA, 22 bp, Artificial Sequence
  chemically synthesized
tatccagaatgcatcagatgtt

SEQ ID NO: 1290961 - DNA, 22 bp, Artificial Sequence
  chemically synthesized
atccagaatgcatcagatgttt

SEQ ID NO: 1290962 - DNA, 22 bp, Artificial Sequence
  chemically synthesized
tccagaatgcatcagatgtttc

SEQ ID NO: 1290963 - DNA, 22 bp, Artificial Sequence
  chemically synthesized
tacattacttaaagaagaaaca

SEQ ID NO: 1290964 - DNA, 22 bp, Artificial Sequence
  chemically synthesized
gtacattacttaaagaagaaac

SEQ ID NO: 1290965 - DNA, 22 bp, Artificial Sequence
  chemically synthesized
cttctttaagtaatgtacaaac

SEQ ID NO: 1290966 - DNA, 22 bp, Artificial Sequence
  chemically synthesized
ttctttaagtaatgtacaaact

SEQ ID NO: 1290967 - DNA, 22 bp, Artificial Sequence
  chemically synthesized
ctttaagtaatgtacaaacttt

SEQ ID NO: 1290968 - DNA, 22 bp, Artificial Sequence
  chemically synthesized
tttaagtaatgtacaaactttt

SEQ ID NO: 1290969 - DNA, 22 bp, Artificial Sequence
  chemically synthesized
taagtaatgtacaaacttttgg

SEQ ID NO: 1290970 - DNA, 22 bp, Artificial Sequence
  chemically synthesized
aagtaatgtacaaacttttgga

SEQ ID NO: 1290971 - DNA, 22 bp, Artificial Sequence
  chemically synthesized
agtaatgtacaaacttttggac

SEQ ID NO: 1290972 - DNA, 22 bp, Artificial Sequence
  chemically synthesized
tgtgtgtgtaaagtccaaaagt

SEQ ID NO: 1290973 - DNA, 22 bp, Artificial Sequence
  chemically synthesized
gtgtgtgtgtaaagtccaaaag

SEQ ID NO: 1290974 - DNA, 22 bp, Artificial Sequence
  chemically synthesized
ttggactttacacacacacaaa

SEQ ID NO: 1290975 - DNA, 22 bp, Artificial Sequence
  chemically synthesized
tggactttacacacacacaaac

SEQ ID NO: 1290976 - DNA, 22 bp, Artificial Sequence
  chemically synthesized
ggactttacacacacacaaaca

SEQ ID NO: 1290977 - DNA, 22 bp, Artificial Sequence
  chemically synthesized
gactttacacacacacaaacac

SEQ ID NO: 1290978 - DNA, 22 bp, Artificial Sequence
  chemically synthesized
tacacacacacaaacacacaca

SEQ ID NO: 1290979 - DNA, 22 bp, Artificial Sequence
  chemically synthesized
acacacacacaaacacacacac

SEQ ID NO: 1290980 - DNA, 22 bp, Artificial Sequence
  chemically synthesized
cacacacacaaacacacacaca

SEQ ID NO: 1290981 - DNA, 22 bp, Artificial Sequence
  chemically synthesized
tatatatatatgcgtgtgtgtg

SEQ ID NO: 1290982 - DNA, 22 bp, Artificial Sequence
  chemically synthesized
acatattatatatatatatgcg

SEQ ID NO: 1290983 - DNA, 22 bp, Artificial Sequence
  chemically synthesized
ttgacatattatatatatatat

SEQ ID NO: 1290984 - DNA, 22 bp, Artificial Sequence
  chemically synthesized
gttgacatattatatatatata

SEQ ID NO: 1290985 - DNA, 22 bp, Artificial Sequence
  chemically synthesized
tgttgacatattatatatatat

SEQ ID NO: 1290986 - DNA, 22 bp, Artificial Sequence
  chemically synthesized
aataattttgttgacatattat

SEQ ID NO: 1290987 - DNA, 22 bp, Artificial Sequence
  chemically synthesized
atataaaacagaattgaataat

SEQ ID NO: 1290988 - DNA, 22 bp, Artificial Sequence
  chemically synthesized
aatataaaacagaattgaataa

SEQ ID NO: 1290989 - DNA, 22 bp, Artificial Sequence
  chemically synthesized
aagtacatttaatataaaacag

SEQ ID NO: 1290990 - DNA, 22 bp, Artificial Sequence
  chemically synthesized
ttcaattctgttttatattaaa

SEQ ID NO: 1290991 - DNA, 22 bp, Artificial Sequence
  chemically synthesized
atgattaaagtacatttaatat

SEQ ID NO: 1290992 - DNA, 22 bp, Artificial Sequence
  chemically synthesized
aattctgttttatattaaatgt

SEQ ID NO: 1290993 - DNA, 22 bp, Artificial Sequence
  chemically synthesized
catgattaaagtacatttaata

SEQ ID NO: 1290994 - DNA, 22 bp, Artificial Sequence
  chemically synthesized
tttcatgattaaagtacattta

SEQ ID NO: 1290995 - DNA, 22 bp, Artificial Sequence
  chemically synthesized
tgttttatattaaatgtacttt

SEQ ID NO: 1290996 - DNA, 22 bp, Artificial Sequence
  chemically synthesized
ttttatattaaatgtactttaa

SEQ ID NO: 1290997 - DNA, 22 bp, Artificial Sequence
  chemically synthesized
tatattaaatgtactttaatca

SEQ ID NO: 1290998 - DNA, 22 bp, Artificial Sequence
  chemically synthesized
aaatctatttcatgattaaagt

SEQ ID NO: 1290999 - DNA, 22 bp, Artificial Sequence
  chemically synthesized
atattaaatgtactttaatcat

SEQ ID NO: 1291000 - DNA, 22 bp, Artificial Sequence
  chemically synthesized
tattaaatgtactttaatcatg
